United States Patent 7,655,785 (BIOINFORMATICALLY DETECTABLE GROUP OF NOVEL REGULATORY OLIGONUCLEOTIDES AND USES THEREOF) - sequence listing, part 7

SEQ ID NO: 241161 - RNA, 22 nt, Homo sapiens
ucacuagggaucacuuuacccg

SEQ ID NO: 241162 - RNA, 22 nt, Homo sapiens
ucacugaaaccuccaccucucg

SEQ ID NO: 241163 - RNA, 20 nt, Homo sapiens
ucacugaguaucuacgauua

SEQ ID NO: 241164 - RNA, 22 nt, Homo sapiens
ucacugcacuccagccuuuaug

SEQ ID NO: 241165 - RNA, 22 nt, Homo sapiens
ucacugcgaccucugccucccg

SEQ ID NO: 241166 - RNA, 22 nt, Homo sapiens
ucacuggagauagcaaucuggu

SEQ ID NO: 241167 - RNA, 22 nt, Homo sapiens
ucacuguguauguauaugcagg

SEQ ID NO: 241168 - RNA, 22 nt, Homo sapiens
ucacuuuggguacuauggaaau

SEQ ID NO: 241169 - RNA, 21 nt, Homo sapiens
ucagaagcucccagggaggac

SEQ ID NO: 241170 - RNA, 22 nt, Homo sapiens
ucagacacugcccuccaccugu

SEQ ID NO: 241171 - RNA, 22 nt, Homo sapiens
ucagaccauuucauuacagacu

SEQ ID NO: 241172 - RNA, 22 nt, Homo sapiens
ucagaguagagcgacuucuccu

SEQ ID NO: 241173 - RNA, 22 nt, Homo sapiens
ucagaguagcugucugaggugc

SEQ ID NO: 241174 - RNA, 22 nt, Homo sapiens
ucagaucacuggcgcuggcgga

SEQ ID NO: 241175 - RNA, 22 nt, Homo sapiens
ucagaucaguuccacaagaacu

SEQ ID NO: 241176 - RNA, 22 nt, Homo sapiens
ucagaugaucugguaagaacuu

SEQ ID NO: 241177 - RNA, 22 nt, Homo sapiens
ucagauuggugcaaaaguaauu

SEQ ID NO: 241178 - RNA, 22 nt, Homo sapiens
ucagcaccauguaacaauugau

SEQ ID NO: 241179 - RNA, 22 nt, Homo sapiens
ucagcagugccccacucuacug

SEQ ID NO: 241180 - RNA, 22 nt, Homo sapiens
ucagcaguggacagaaugguag

SEQ ID NO: 241181 - RNA, 22 nt, Homo sapiens
ucaggcuuuucccagagugaug

SEQ ID NO: 241182 - RNA, 21 nt, Homo sapiens
ucaggcuuuuugagugccaau

SEQ ID NO: 241183 - RNA, 21 nt, Homo sapiens
ucagggaccugcuguacugau

SEQ ID NO: 241184 - RNA, 22 nt, Homo sapiens
ucagguagcauuuuggaaacag

SEQ ID NO: 241185 - RNA, 22 nt, Homo sapiens
ucagguaucuucauagcaaugc

SEQ ID NO: 241186 - RNA, 22 nt, Homo sapiens
ucagguauuuauagcaaugcaa

SEQ ID NO: 241187 - RNA, 22 nt, Homo sapiens
ucaguaaucuuagcugugcaga

SEQ ID NO: 241188 - RNA, 23 nt, Homo sapiens
ucaguacucuauaagugccagcu

SEQ ID NO: 241189 - RNA, 20 nt, Homo sapiens
ucaguauauuguuuccacag

SEQ ID NO: 241190 - RNA, 22 nt, Homo sapiens
ucagucauucacucacucggac

SEQ ID NO: 241191 - RNA, 22 nt, Homo sapiens
ucagucuuuuuuuggcaagcau

SEQ ID NO: 241192 - RNA, 22 nt, Homo sapiens
ucagugccucaguuuuuaaaga

SEQ ID NO: 241193 - RNA, 22 nt, Homo sapiens
ucagugcuguuugcccucguuu

SEQ ID NO: 241194 - RNA, 22 nt, Homo sapiens
ucagugggcuauguaauuaacu

SEQ ID NO: 241195 - RNA, 22 nt, Homo sapiens
ucaguguuuggaaucucaauuu

SEQ ID NO: 241196 - RNA, 22 nt, Homo sapiens
ucaguguuuuauccuccagagc

SEQ ID NO: 241197 - RNA, 22 nt, Homo sapiens
ucauaaaguuguuuuaauggga

SEQ ID NO: 241198 - RNA, 22 nt, Homo sapiens
ucauacaggccaccagggaagu

SEQ ID NO: 241199 - RNA, 22 nt, Homo sapiens
ucauacuguuaaaugguuuagu

SEQ ID NO: 241200 - RNA, 22 nt, Homo sapiens
ucauagaucaaguaauaagaca

SEQ ID NO: 241201 - RNA, 22 nt, Homo sapiens
ucauaguagucacuuaauaaau

SEQ ID NO: 241202 - RNA, 22 nt, Homo sapiens
ucauagucuaagguucuuuugc

SEQ ID NO: 241203 - RNA, 22 nt, Homo sapiens
ucauaucauuagaucuacugua

SEQ ID NO: 241204 - RNA, 22 nt, Homo sapiens
ucaucaguggggaugugguuga

SEQ ID NO: 241205 - RNA, 20 nt, Homo sapiens
ucaucaguuggugcucgcug

SEQ ID NO: 241206 - RNA, 22 nt, Homo sapiens
ucaugacacagcauacugacuu

SEQ ID NO: 241207 - RNA, 20 nt, Homo sapiens
ucaugccacugcgcuccagc

SEQ ID NO: 241208 - RNA, 22 nt, Homo sapiens
ucauuagagacagggugucacu

SEQ ID NO: 241209 - RNA, 22 nt, Homo sapiens
ucauuggaugucugaaaugauu

SEQ ID NO: 241210 - RNA, 21 nt, Homo sapiens
ucauugggugcagcccacccu

SEQ ID NO: 241211 - RNA, 22 nt, Homo sapiens
ucauugguagcuugaaggggau

SEQ ID NO: 241212 - RNA, 18 nt, Homo sapiens
ucauuggugagcaccucc

SEQ ID NO: 241213 - RNA, 22 nt, Homo sapiens
ucauugguugcguaauuugauu

SEQ ID NO: 241214 - RNA, 22 nt, Homo sapiens
ucauuguccaacuucuuucagu

SEQ ID NO: 241215 - RNA, 22 nt, Homo sapiens
ugagaagacaucagcuuucgga

SEQ ID NO: 241216 - RNA, 22 nt, Homo sapiens
ugagaagaugaacuccuugguc

SEQ ID NO: 241217 - RNA, 22 nt, Homo sapiens
ugagaaugaugauugguaaacc

SEQ ID NO: 241218 - RNA, 22 nt, Homo sapiens
ugagaaugcagaaucucgugca

SEQ ID NO: 241219 - RNA, 22 nt, Homo sapiens
ugagaauguagggcucucccag

SEQ ID NO: 241220 - RNA, 22 nt, Homo sapiens
ugagacacuucccagaucccuu

SEQ ID NO: 241221 - RNA, 22 nt, Homo sapiens
ugagacaucucuccugagacag

SEQ ID NO: 241222 - RNA, 22 nt, Homo sapiens
ugagacaucugagauuuuaagc

SEQ ID NO: 241223 - RNA, 22 nt, Homo sapiens
ugagacaugugaauauuuguac

SEQ ID NO: 241224 - RNA, 22 nt, Homo sapiens
ugagacggagucucacucuguu

SEQ ID NO: 241225 - RNA, 22 nt, Homo sapiens
ugagacggagucuugcuaaguu

SEQ ID NO: 241226 - RNA, 22 nt, Homo sapiens
ugagacggaguuucacucuugu

SEQ ID NO: 241227 - RNA, 22 nt, Homo sapiens
ugagacugaguuuugccuuugu

SEQ ID NO: 241228 - RNA, 22 nt, Homo sapiens
ugagacugaguuuugcucuugu

SEQ ID NO: 241229 - RNA, 22 nt, Homo sapiens
ugagacugauaggacauuuucu

SEQ ID NO: 241230 - RNA, 22 nt, Homo sapiens
ugagagacauuuguuguagagu

SEQ ID NO: 241231 - RNA, 22 nt, Homo sapiens
ugagagaugauaaaauguuugu

SEQ ID NO: 241232 - RNA, 19 nt, Homo sapiens
ugagagcacaacugaacaa

SEQ ID NO: 241233 - RNA, 22 nt, Homo sapiens
ugagagcugcauucuugaaagc

SEQ ID NO: 241234 - RNA, 22 nt, Homo sapiens
ugagagcuuuuuugccugguga

SEQ ID NO: 241235 - RNA, 22 nt, Homo sapiens
ugagaucacgccacugcacucc

SEQ ID NO: 241236 - RNA, 22 nt, Homo sapiens
ugagaucauguguggaccccag

SEQ ID NO: 241237 - RNA, 22 nt, Homo sapiens
ugagaucuuggaggcuuuguga

SEQ ID NO: 241238 - RNA, 19 nt, Homo sapiens
ugagaucuuuacuggguuu

SEQ ID NO: 241239 - RNA, 22 nt, Homo sapiens
ugagaucuuugcuguccucacc

SEQ ID NO: 241240 - RNA, 22 nt, Homo sapiens
ugagaugaagucucacucuguc

SEQ ID NO: 241241 - RNA, 22 nt, Homo sapiens
ugagaugagagaaugcuugccu

SEQ ID NO: 241242 - RNA, 22 nt, Homo sapiens
ugagaugaguugcuggcucuga

SEQ ID NO: 241243 - RNA, 22 nt, Homo sapiens
ugagaugauagauauguuaauu

SEQ ID NO: 241244 - RNA, 22 nt, Homo sapiens
ugagaugaugggauaagagggc

SEQ ID NO: 241245 - RNA, 22 nt, Homo sapiens
ugagauggguaauuaaauggug

SEQ ID NO: 241246 - RNA, 22 nt, Homo sapiens
ugagaugguaaauuuuuguugu

SEQ ID NO: 241247 - RNA, 22 nt, Homo sapiens
ugagaugugaagaucacaugaa

SEQ ID NO: 241248 - RNA, 22 nt, Homo sapiens
ugagauguuuguuucagugccu

SEQ ID NO: 241249 - RNA, 23 nt, Homo sapiens
ugagauuacccagaaagaguaua

SEQ ID NO: 241250 - RNA, 22 nt, Homo sapiens
ugagauucucugauuguagguc

SEQ ID NO: 241251 - RNA, 22 nt, Homo sapiens
ugagcaauaaaguuacacaguu

SEQ ID NO: 241252 - RNA, 22 nt, Homo sapiens
ugagcacagagccugggguggc

SEQ ID NO: 241253 - RNA, 22 nt, Homo sapiens
ugagcacagcgugugggagagc

SEQ ID NO: 241254 - RNA, 22 nt, Homo sapiens
ugagcacaggugcgcgguuacu

SEQ ID NO: 241255 - RNA, 22 nt, Homo sapiens
ugagcagagggagaaguaaauu

SEQ ID NO: 241256 - RNA, 22 nt, Homo sapiens
ugagcagaguuguuucuccuga

SEQ ID NO: 241257 - RNA, 22 nt, Homo sapiens
ugagcauuguguuugacuguga

SEQ ID NO: 241258 - RNA, 23 nt, Homo sapiens
ugagccaugggacuccaagggag

SEQ ID NO: 241259 - RNA, 20 nt, Homo sapiens
ugagccccuggacucaagcg

SEQ ID NO: 241260 - RNA, 22 nt, Homo sapiens
ugagcuacuacacccagcuugg

SEQ ID NO: 241261 - RNA, 22 nt, Homo sapiens
ugagcuagggccuggaauaggg

SEQ ID NO: 241262 - RNA, 22 nt, Homo sapiens
ugagcuaggucuugcucuguca

SEQ ID NO: 241263 - RNA, 22 nt, Homo sapiens
ugagcucaguauuucauaaaca

SEQ ID NO: 241264 - RNA, 22 nt, Homo sapiens
ugagcuguuugaagaagcauuu

SEQ ID NO: 241265 - RNA, 18 nt, Homo sapiens
ugaggaaaggguuugcua

SEQ ID NO: 241266 - RNA, 22 nt, Homo sapiens
ugaggaguauguucuguagacc

SEQ ID NO: 241267 - RNA, 22 nt, Homo sapiens
ugaggcuaggauaggcugauuc

SEQ ID NO: 241268 - RNA, 22 nt, Homo sapiens
ugagguaaaacaaggauuggau

SEQ ID NO: 241269 - RNA, 22 nt, Homo sapiens
ugagguaucauugcccaggcug

SEQ ID NO: 241270 - RNA, 22 nt, Homo sapiens
ugagguguauugggggaaauuc

SEQ ID NO: 241271 - RNA, 22 nt, Homo sapiens
ugaguacugauuuaagauacac

SEQ ID NO: 241272 - RNA, 22 nt, Homo sapiens
ugaguagaacuagucuagagcu

SEQ ID NO: 241273 - RNA, 22 nt, Homo sapiens
ugaguagaacuccuggagaugu

SEQ ID NO: 241274 - RNA, 22 nt, Homo sapiens
ugaguagaagugaagauagugg

SEQ ID NO: 241275 - RNA, 23 nt, Homo sapiens
ugaguagguccacguaugugagu

SEQ ID NO: 241276 - RNA, 22 nt, Homo sapiens
ucagugucugugauggagaggu

SEQ ID NO: 241277 - RNA, 22 nt, Homo sapiens
ucaguguugauggcugcugacu

SEQ ID NO: 241278 - RNA, 21 nt, Homo sapiens
ucaguuacugagagagaagug

SEQ ID NO: 241279 - RNA, 22 nt, Homo sapiens
ucauacuguugugaaacaaaac

SEQ ID NO: 241280 - RNA, 22 nt, Homo sapiens
ucauauugcgguucauugacuu

SEQ ID NO: 241281 - RNA, 21 nt, Homo sapiens
ucaucaagcuguagacaugau

SEQ ID NO: 241282 - RNA, 21 nt, Homo sapiens
ucaucagucaaagacaauggu

SEQ ID NO: 241283 - RNA, 22 nt, Homo sapiens
ucaucagugcuugcaaauuauu

SEQ ID NO: 241284 - RNA, 22 nt, Homo sapiens
ucaugcaaugagucaggaggca

SEQ ID NO: 241285 - RNA, 22 nt, Homo sapiens
ucaugcaucuuguggaauuuga

SEQ ID NO: 241286 - RNA, 21 nt, Homo sapiens
ucaugccacugcacuuuagcc

SEQ ID NO: 241287 - RNA, 22 nt, Homo sapiens
uccaaaucucuggcacugggau

SEQ ID NO: 241288 - RNA, 22 nt, Homo sapiens
uccaagaugcuggcagcuacag

SEQ ID NO: 241289 - RNA, 22 nt, Homo sapiens
uccacaguggugaggugcagca

SEQ ID NO: 241290 - RNA, 19 nt, Homo sapiens
uccaccgcgugcaccucua

SEQ ID NO: 241291 - RNA, 22 nt, Homo sapiens
uccacguggucuaucuguccuu

SEQ ID NO: 241292 - RNA, 21 nt, Homo sapiens
uccagcuuugagaguuguggu

SEQ ID NO: 241293 - RNA, 22 nt, Homo sapiens
uccaguuuucuuuccuagggcu

SEQ ID NO: 241294 - RNA, 22 nt, Homo sapiens
uccaguuuuguuaacauauggu

SEQ ID NO: 241295 - RNA, 22 nt, Homo sapiens
uccauagugagcagucaaugua

SEQ ID NO: 241296 - RNA, 22 nt, Homo sapiens
uccaugagaauaguuaggcucu

SEQ ID NO: 241297 - RNA, 22 nt, Homo sapiens
uccaugaguccauuagaaaaaa

SEQ ID NO: 241298 - RNA, 22 nt, Homo sapiens
ucccaguguguagcuugucucu

SEQ ID NO: 241299 - RNA, 17 nt, Homo sapiens
ucccauguuucuucuac

SEQ ID NO: 241300 - RNA, 19 nt, Homo sapiens
uccccaguuuuccguucag

SEQ ID NO: 241301 - RNA, 19 nt, Homo sapiens
uccccgggucuagugcagc

SEQ ID NO: 241302 - RNA, 22 nt, Homo sapiens
uccccugagaccccucagcacu

SEQ ID NO: 241303 - RNA, 18 nt, Homo sapiens
ucccucagaauuauagaa

SEQ ID NO: 241304 - RNA, 22 nt, Homo sapiens
ucccugaaagcugagauuggaa

SEQ ID NO: 241305 - RNA, 22 nt, Homo sapiens
ucccugaagcugcagcaacaca

SEQ ID NO: 241306 - RNA, 22 nt, Homo sapiens
ucccugguguuaguuuguucuu

SEQ ID NO: 241307 - RNA, 22 nt, Homo sapiens
ucccuuucuggaguuucccaag

SEQ ID NO: 241308 - RNA, 22 nt, Homo sapiens
uccucaguggauuggauggugc

SEQ ID NO: 241309 - RNA, 22 nt, Homo sapiens
uccucugaacuccagacccaua

SEQ ID NO: 241310 - RNA, 22 nt, Homo sapiens
uccugagagcagacccucuaua

SEQ ID NO: 241311 - RNA, 22 nt, Homo sapiens
uccugcauucauccugguguug

SEQ ID NO: 241312 - RNA, 22 nt, Homo sapiens
uccuguaaucccagcuaccaga

SEQ ID NO: 241313 - RNA, 22 nt, Homo sapiens
ucgcugggaagacugaaguguc

SEQ ID NO: 241314 - RNA, 23 nt, Homo sapiens
ucgguccccuuggcugcccucgg

SEQ ID NO: 241315 - RNA, 22 nt, Homo sapiens
ucuaagaauucauuuauaagcc

SEQ ID NO: 241316 - RNA, 22 nt, Homo sapiens
ucuaaggcaccuagagucauca

SEQ ID NO: 241317 - RNA, 17 nt, Homo sapiens
ucuaauaauaugcauuu

SEQ ID NO: 241318 - RNA, 22 nt, Homo sapiens
ucuacagccaguucaggaagaa

SEQ ID NO: 241319 - RNA, 21 nt, Homo sapiens
ucuaccuacugcucacaggcu

SEQ ID NO: 241320 - RNA, 22 nt, Homo sapiens
ucucaaccucccaaguagcugg

SEQ ID NO: 241321 - RNA, 22 nt, Homo sapiens
agaaacauucucuugccuccuu

SEQ ID NO: 241322 - RNA, 22 nt, Homo sapiens
agaaccaaucccacauggauac

SEQ ID NO: 241323 - RNA, 21 nt, Homo sapiens
agacacuuggaagguuuuaga

SEQ ID NO: 241324 - RNA, 22 nt, Homo sapiens
agacaguguguguauauauggu

SEQ ID NO: 241325 - RNA, 22 nt, Homo sapiens
agacccuguauguguuuaguuu

SEQ ID NO: 241326 - RNA, 20 nt, Homo sapiens
agacuagggagcagaaagcc

SEQ ID NO: 241327 - RNA, 23 nt, Homo sapiens
agacugaaguaucugagacucag

SEQ ID NO: 241328 - RNA, 22 nt, Homo sapiens
agagagcuugggguguuaaauu

SEQ ID NO: 241329 - RNA, 22 nt, Homo sapiens
agagagguggguggagccccca

SEQ ID NO: 241330 - RNA, 22 nt, Homo sapiens
agagauaauuagguuaaaugag

SEQ ID NO: 241331 - RNA, 22 nt, Homo sapiens
agagauaguuuccaacucauac

SEQ ID NO: 241332 - RNA, 22 nt, Homo sapiens
agagaucaauaugaaggaaaug

SEQ ID NO: 241333 - RNA, 22 nt, Homo sapiens
agagaugauuaacauuuuggua

SEQ ID NO: 241334 - RNA, 22 nt, Homo sapiens
agagauuauccuggcuucucug

SEQ ID NO: 241335 - RNA, 22 nt, Homo sapiens
agagcacuguggguccaaauau

SEQ ID NO: 241336 - RNA, 22 nt, Homo sapiens
agagcauugaguuaaugguuca

SEQ ID NO: 241337 - RNA, 18 nt, Homo sapiens
agagcuaugaacauaugc

SEQ ID NO: 241338 - RNA, 22 nt, Homo sapiens
agaggucuuaucaaacaugcuu

SEQ ID NO: 241339 - RNA, 22 nt, Homo sapiens
agagguuuaauugauucacagu

SEQ ID NO: 241340 - RNA, 22 nt, Homo sapiens
agagguuuuggggcugagagcu

SEQ ID NO: 241341 - RNA, 22 nt, Homo sapiens
agaguauagcaacuuaguaaaa

SEQ ID NO: 241342 - RNA, 20 nt, Homo sapiens
agagugcugucuguccugag

SEQ ID NO: 241343 - RNA, 22 nt, Homo sapiens
agauauguuauugauguuaaug

SEQ ID NO: 241344 - RNA, 22 nt, Homo sapiens
agaucacucagguuucucccug

SEQ ID NO: 241345 - RNA, 22 nt, Homo sapiens
agaugauguuucuggcacauga

SEQ ID NO: 241346 - RNA, 18 nt, Homo sapiens
agaugcaugcucacuaca

SEQ ID NO: 241347 - RNA, 22 nt, Homo sapiens
agaugcauugguggcauauuca

SEQ ID NO: 241348 - RNA, 22 nt, Homo sapiens
agaugcauuuuuauuggaauac

SEQ ID NO: 241349 - RNA, 22 nt, Homo sapiens
agaugcuguuaucaacuguagc

SEQ ID NO: 241350 - RNA, 23 nt, Homo sapiens
agauggcauuucaguucuuuagg

SEQ ID NO: 241351 - RNA, 22 nt, Homo sapiens
agaugguuuuguucacagcucu

SEQ ID NO: 241352 - RNA, 22 nt, Homo sapiens
agcaaaucuaugaauguauauu

SEQ ID NO: 241353 - RNA, 22 nt, Homo sapiens
agcaacauagaaauuugggugg

SEQ ID NO: 241354 - RNA, 22 nt, Homo sapiens
agcaacaucagcagcaggaaaa

SEQ ID NO: 241355 - RNA, 22 nt, Homo sapiens
agcaacauugagacugcaguug

SEQ ID NO: 241356 - RNA, 22 nt, Homo sapiens
agcaccaccguugcucuauccc

SEQ ID NO: 241357 - RNA, 22 nt, Homo sapiens
agcaccauuguacuccagccug

SEQ ID NO: 241358 - RNA, 22 nt, Homo sapiens
agcaccauuuauugaaaagaca

SEQ ID NO: 241359 - RNA, 22 nt, Homo sapiens
agcagcaccaaacagacuaaga

SEQ ID NO: 241360 - RNA, 22 nt, Homo sapiens
agcagcauggguauaaaucucc

SEQ ID NO: 241361 - RNA, 22 nt, Homo sapiens
agcagcauuccaaaaaucugcu

SEQ ID NO: 241362 - RNA, 17 nt, Homo sapiens
agcagcccauaucccca

SEQ ID NO: 241363 - RNA, 22 nt, Homo sapiens
agcagcgacacccuguggugag

SEQ ID NO: 241364 - RNA, 21 nt, Homo sapiens
agcagcuuugguugaagcaga

SEQ ID NO: 241365 - RNA, 22 nt, Homo sapiens
agcaggucuuaacuugugaggu

SEQ ID NO: 241366 - RNA, 22 nt, Homo sapiens
agcagugugagaauggacuaau

SEQ ID NO: 241367 - RNA, 22 nt, Homo sapiens
agcaucacacacuacagggaaa

SEQ ID NO: 241368 - RNA, 20 nt, Homo sapiens
agcaucauugcaauuuguca

SEQ ID NO: 241369 - RNA, 22 nt, Homo sapiens
agccuguguugaauuauagaaa

SEQ ID NO: 241370 - RNA, 22 nt, Homo sapiens
agcgccacugcacuccagccug

SEQ ID NO: 241371 - RNA, 18 nt, Homo sapiens
agcucaguguuugcuuac

SEQ ID NO: 241372 - RNA, 21 nt, Homo sapiens
agcuccacucguucccaaagc

SEQ ID NO: 241373 - RNA, 22 nt, Homo sapiens
agcuccuuucugcaggcagguc

SEQ ID NO: 241374 - RNA, 20 nt, Homo sapiens
agcugcagauauaaauccgc

SEQ ID NO: 241375 - RNA, 22 nt, Homo sapiens
agcuggauuguuuaccuggggc

SEQ ID NO: 241376 - RNA, 22 nt, Homo sapiens
agcuggcuguggagaaaccccu

SEQ ID NO: 241377 - RNA, 23 nt, Homo sapiens
agcugguacuagaggcuugcgcc

SEQ ID NO: 241378 - RNA, 22 nt, Homo sapiens
agcugguauuuguuagggaguu

SEQ ID NO: 241379 - RNA, 22 nt, Homo sapiens
agcugguauuuugucgaggacu

SEQ ID NO: 241380 - RNA, 22 nt, Homo sapiens
agcugugucuucuuaaagauuu

SEQ ID NO: 241381 - RNA, 20 nt, Homo sapiens
agcuguuguuaugagguuua

SEQ ID NO: 241382 - RNA, 22 nt, Homo sapiens
agcuucauucugaauagguuga

SEQ ID NO: 241383 - RNA, 22 nt, Homo sapiens
agcuugugauuuagagugagag

SEQ ID NO: 241384 - RNA, 21 nt, Homo sapiens
agcuuguguguaucacagugu

SEQ ID NO: 241385 - RNA, 22 nt, Homo sapiens
agcuuguuuuauagaaagucaa

SEQ ID NO: 241386 - RNA, 22 nt, Homo sapiens
agcuuuuugggaggccuuagga

SEQ ID NO: 241387 - RNA, 22 nt, Homo sapiens
auuguucuuacaugcugucauc

SEQ ID NO: 241388 - RNA, 22 nt, Homo sapiens
auuuccuguaggggcuugcgaa

SEQ ID NO: 241389 - RNA, 22 nt, Homo sapiens
auuuugcauugcuguaaaggaa

SEQ ID NO: 241390 - RNA, 21 nt, Homo sapiens
auuuuugcagagcugguagug

SEQ ID NO: 241391 - RNA, 18 nt, Homo sapiens
auuuuugcaguccacaug

SEQ ID NO: 241392 - RNA, 22 nt, Homo sapiens
caaaguaauuacgguuuuggcc

SEQ ID NO: 241393 - RNA, 22 nt, Homo sapiens
caaagucuucaguugauucuga

SEQ ID NO: 241394 - RNA, 22 nt, Homo sapiens
caaagugcugaaagaggccagg

SEQ ID NO: 241395 - RNA, 22 nt, Homo sapiens
caaagugcuggccgggcgcagu

SEQ ID NO: 241396 - RNA, 22 nt, Homo sapiens
caaaugaucugcuggccucagc

SEQ ID NO: 241397 - RNA, 22 nt, Homo sapiens
caacaguaaagcauuuuuaagu

SEQ ID NO: 241398 - RNA, 22 nt, Homo sapiens
caaccaguagcugaguucaaaa

SEQ ID NO: 241399 - RNA, 22 nt, Homo sapiens
caacucuguaggauccaggugg

SEQ ID NO: 241400 - RNA, 22 nt, Homo sapiens
caacugguuuuauacaguuuag

SEQ ID NO: 241401 - RNA, 22 nt, Homo sapiens
caagaggcuguguauaaagcca

SEQ ID NO: 241402 - RNA, 22 nt, Homo sapiens
caagggguggaaaugguagugu

SEQ ID NO: 241403 - RNA, 22 nt, Homo sapiens
caaggugcugagacaggagccc

SEQ ID NO: 241404 - RNA, 22 nt, Homo sapiens
caagugcucuaggauccugagu

SEQ ID NO: 241405 - RNA, 22 nt, Homo sapiens
caagugcuugaugaaugaucaa

SEQ ID NO: 241406 - RNA, 22 nt, Homo sapiens
caagugcuuucuuggggauuua

SEQ ID NO: 241407 - RNA, 22 nt, Homo sapiens
caauacuguuaccugaaauagg

SEQ ID NO: 241408 - RNA, 22 nt, Homo sapiens
caaugcagcuuuuggagagaaa

SEQ ID NO: 241409 - RNA, 21 nt, Homo sapiens
caauggcacgaucuuggcuca

SEQ ID NO: 241410 - RNA, 22 nt, Homo sapiens
caauggcacuauuggaaaaggu

SEQ ID NO: 241411 - RNA, 22 nt, Homo sapiens
caaugguuuuuuaguauaagua

SEQ ID NO: 241412 - RNA, 22 nt, Homo sapiens
cacacugucuucaauggguggu

SEQ ID NO: 241413 - RNA, 22 nt, Homo sapiens
cacacugucuucauuacuguag

SEQ ID NO: 241414 - RNA, 22 nt, Homo sapiens
cacagcuaacaacuguuucuuc

SEQ ID NO: 241415 - RNA, 22 nt, Homo sapiens
cacaggccugucucuuucuaac

SEQ ID NO: 241416 - RNA, 22 nt, Homo sapiens
cacagggcuaacauuuuugccc

SEQ ID NO: 241417 - RNA, 22 nt, Homo sapiens
caccacuacaccccaggcuggg

SEQ ID NO: 241418 - RNA, 22 nt, Homo sapiens
caccaggugcccagcacggcca

SEQ ID NO: 241419 - RNA, 22 nt, Homo sapiens
caccugagcgggaugcucgccu

SEQ ID NO: 241420 - RNA, 22 nt, Homo sapiens
caccuguagucccagcugaggc

SEQ ID NO: 241421 - RNA, 22 nt, Homo sapiens
cacuaggcuggagugcaguggc

SEQ ID NO: 241422 - RNA, 22 nt, Homo sapiens
cacugcacuccagccuaagagg

SEQ ID NO: 241423 - RNA, 22 nt, Homo sapiens
cacugcacuccagucuggcgac

SEQ ID NO: 241424 - RNA, 22 nt, Homo sapiens
cacugcacuccaguuuggauga

SEQ ID NO: 241425 - RNA, 22 nt, Homo sapiens
cacugcacucuucuucugggca

SEQ ID NO: 241426 - RNA, 21 nt, Homo sapiens
cacugcacuugccuucugggu

SEQ ID NO: 241427 - RNA, 22 nt, Homo sapiens
cacugcaguaaauugcgucggu

SEQ ID NO: 241428 - RNA, 22 nt, Homo sapiens
cacugcaguguaauuaagguug

SEQ ID NO: 241429 - RNA, 22 nt, Homo sapiens
cacugcauccuccaccuccugg

SEQ ID NO: 241430 - RNA, 22 nt, Homo sapiens
gucaggugcuuacgcggagauc

SEQ ID NO: 241431 - RNA, 22 nt, Homo sapiens
gucagucugucccugccuggcg

SEQ ID NO: 241432 - RNA, 22 nt, Homo sapiens
gucagugauugauuuaaagacg

SEQ ID NO: 241433 - RNA, 22 nt, Homo sapiens
gucaucaucaguccucugugca

SEQ ID NO: 241434 - RNA, 22 nt, Homo sapiens
gucauccaggcuggagugaagc

SEQ ID NO: 241435 - RNA, 22 nt, Homo sapiens
gucaugucuugaaauucaguuu

SEQ ID NO: 241436 - RNA, 21 nt, Homo sapiens
guccaaaacaguguccaaugc

SEQ ID NO: 241437 - RNA, 18 nt, Homo sapiens
guccauuuguugguacac

SEQ ID NO: 241438 - RNA, 22 nt, Homo sapiens
guccugaagaccuuccucugga

SEQ ID NO: 241439 - RNA, 22 nt, Homo sapiens
gucuagaacuucugaccuuagg

SEQ ID NO: 241440 - RNA, 22 nt, Homo sapiens
gucucccaaccccugugcccag

SEQ ID NO: 241441 - RNA, 22 nt, Homo sapiens
gucuggcuuaucucacuuacca

SEQ ID NO: 241442 - RNA, 22 nt, Homo sapiens
gucugguugacagcauguggcc

SEQ ID NO: 241443 - RNA, 22 nt, Homo sapiens
gucugucuuuugucuuugaaau

SEQ ID NO: 241444 - RNA, 22 nt, Homo sapiens
gucuuccagccuccaucuuucu

SEQ ID NO: 241445 - RNA, 22 nt, Homo sapiens
gucuugaaggcugaguaccugu

SEQ ID NO: 241446 - RNA, 22 nt, Homo sapiens
gucuuggagaacucagcuuggc

SEQ ID NO: 241447 - RNA, 22 nt, Homo sapiens
gucuuuaguugaaacauguggu

SEQ ID NO: 241448 - RNA, 22 nt, Homo sapiens
gucuuugcauguauguucauga

SEQ ID NO: 241449 - RNA, 22 nt, Homo sapiens
gucuuugcuuuuaaccagaggu

SEQ ID NO: 241450 - RNA, 22 nt, Homo sapiens
gucuuuggaaagacaaaguuca

SEQ ID NO: 241451 - RNA, 22 nt, Homo sapiens
gucuuuguuuggucuguaucag

SEQ ID NO: 241452 - RNA, 22 nt, Homo sapiens
gucuuuguuuugauuuaccaga

SEQ ID NO: 241453 - RNA, 22 nt, Homo sapiens
gugaacagaaccugggaucgaa

SEQ ID NO: 241454 - RNA, 22 nt, Homo sapiens
gugaacuguuugaggaagagaa

SEQ ID NO: 241455 - RNA, 22 nt, Homo sapiens
gugaaguuuuugugaggccuaa

SEQ ID NO: 241456 - RNA, 22 nt, Homo sapiens
gugaaugcauuaagaaggggga

SEQ ID NO: 241457 - RNA, 22 nt, Homo sapiens
gugacagaguaagacccuguau

SEQ ID NO: 241458 - RNA, 22 nt, Homo sapiens
gugaccaaagauagcucaaguu

SEQ ID NO: 241459 - RNA, 22 nt, Homo sapiens
gugaccagaugggcaggggugu

SEQ ID NO: 241460 - RNA, 22 nt, Homo sapiens
gugaccucuguugcugucacua

SEQ ID NO: 241461 - RNA, 22 nt, Homo sapiens
gugagacugguccugaacccag

SEQ ID NO: 241462 - RNA, 22 nt, Homo sapiens
gugagacugguucugaacccag

SEQ ID NO: 241463 - RNA, 22 nt, Homo sapiens
gugagagaaugacuauguguuu

SEQ ID NO: 241464 - RNA, 22 nt, Homo sapiens
gugagauggaguuggugucuuu

SEQ ID NO: 241465 - RNA, 22 nt, Homo sapiens
gugagauuuucuccagguucag

SEQ ID NO: 241466 - RNA, 19 nt, Homo sapiens
gugagcacagacaauacaa

SEQ ID NO: 241467 - RNA, 22 nt, Homo sapiens
gugagcacugaaagaaggcaag

SEQ ID NO: 241468 - RNA, 22 nt, Homo sapiens
gugagcauaggaggcuucuguu

SEQ ID NO: 241469 - RNA, 22 nt, Homo sapiens
gugagccaugauuuuaccacug

SEQ ID NO: 241470 - RNA, 22 nt, Homo sapiens
gugagcuaagcaaauaugagcc

SEQ ID NO: 241471 - RNA, 22 nt, Homo sapiens
gugagcuccucuucugcugcag

SEQ ID NO: 241472 - RNA, 22 nt, Homo sapiens
gugaggcacugcugcuuuccag

SEQ ID NO: 241473 - RNA, 22 nt, Homo sapiens
gugauaguucuuacuccaaagu

SEQ ID NO: 241474 - RNA, 22 nt, Homo sapiens
gugaucuguccuucauagccug

SEQ ID NO: 241475 - RNA, 22 nt, Homo sapiens
gugaucuuucaggcuugaccau

SEQ ID NO: 241476 - RNA, 20 nt, Homo sapiens
gugauuggucacugguuguu

SEQ ID NO: 241477 - RNA, 22 nt, Homo sapiens
gugauuuaguagaugcuaguua

SEQ ID NO: 241478 - RNA, 22 nt, Homo sapiens
gugcaaauguuauugagguuuu

SEQ ID NO: 241479 - RNA, 22 nt, Homo sapiens
gugcaacaucccuccauaauuu

SEQ ID NO: 241480 - RNA, 22 nt, Homo sapiens
gugcaaugagaaggggcucugg

SEQ ID NO: 241481 - RNA, 22 nt, Homo sapiens
gugcaauucacuguuaugucug

SEQ ID NO: 241482 - RNA, 23 nt, Homo sapiens
gugcaguggcgagauuucggcuc

SEQ ID NO: 241483 - RNA, 23 nt, Homo sapiens
gugccuucugagccuagucucca

SEQ ID NO: 241484 - RNA, 22 nt, Homo sapiens
gugcuauguuauccagcaagau

SEQ ID NO: 241485 - RNA, 16 nt, Homo sapiens
gugcuguguuguuagg

SEQ ID NO: 241486 - RNA, 22 nt, Homo sapiens
guggaaaacauaugcuuguuga

SEQ ID NO: 241487 - RNA, 22 nt, Homo sapiens
guggaagauaguguguuaaugu

SEQ ID NO: 241488 - RNA, 22 nt, Homo sapiens
guggaauacuaugaugguggau

SEQ ID NO: 241489 - RNA, 22 nt, Homo sapiens
guggaauggaaugauuguguau

SEQ ID NO: 241490 - RNA, 22 nt, Homo sapiens
guggaauuauagagacaucuug

SEQ ID NO: 241491 - RNA, 22 nt, Homo sapiens
guggagucaucacucagagugg

SEQ ID NO: 241492 - RNA, 22 nt, Homo sapiens
guggcaaacucagcaugcccca

SEQ ID NO: 241493 - RNA, 22 nt, Homo sapiens
guggcaaagaugccuucuccaa

SEQ ID NO: 241494 - RNA, 22 nt, Homo sapiens
guggcagaaaagagaagcaaug

SEQ ID NO: 241495 - RNA, 22 nt, Homo sapiens
guggcuagaaugaagguagcug

SEQ ID NO: 241496 - RNA, 22 nt, Homo sapiens
gugggaugaucacaguucacug

SEQ ID NO: 241497 - RNA, 22 nt, Homo sapiens
gugggcaagucacuucaguucu

SEQ ID NO: 241498 - RNA, 22 nt, Homo sapiens
gugggguaggaggaguacuucc

SEQ ID NO: 241499 - RNA, 22 nt, Homo sapiens
guggggucaucucauuugugga

SEQ ID NO: 241500 - RNA, 22 nt, Homo sapiens
gugguaaaauggcauagagcua

SEQ ID NO: 241501 - RNA, 22 nt, Homo sapiens
gugguuuucaacuccaccugca

SEQ ID NO: 241502 - RNA, 22 nt, Homo sapiens
gugguuuuuaaaguaccugugg

SEQ ID NO: 241503 - RNA, 22 nt, Homo sapiens
guguaaaacaauuagaggauuu

SEQ ID NO: 241504 - RNA, 22 nt, Homo sapiens
guguaaaucaaucuguugucuu

SEQ ID NO: 241505 - RNA, 22 nt, Homo sapiens
guguagagaaaaguaccauuuu

SEQ ID NO: 241506 - RNA, 22 nt, Homo sapiens
guguagagaaauagccugaagg

SEQ ID NO: 241507 - RNA, 22 nt, Homo sapiens
gugugacugcucuauuagggcg

SEQ ID NO: 241508 - RNA, 22 nt, Homo sapiens
gugugauuguuaauuuuaggug

SEQ ID NO: 241509 - RNA, 23 nt, Homo sapiens
gugugguaggcuauaccaucuag

SEQ ID NO: 241510 - RNA, 22 nt, Homo sapiens
gugugguauuauaacuagguau

SEQ ID NO: 241511 - RNA, 22 nt, Homo sapiens
guuaagaaguguaacuuaaguu

SEQ ID NO: 241512 - RNA, 22 nt, Homo sapiens
guuacagucuuguguaagguua

SEQ ID NO: 241513 - RNA, 22 nt, Homo sapiens
guuauguguuuccuuaauugcu

SEQ ID NO: 241514 - RNA, 22 nt, Homo sapiens
guuauguuaguuacaaggcuag

SEQ ID NO: 241515 - RNA, 22 nt, Homo sapiens
guucaaggaauguuggcuucuc

SEQ ID NO: 241516 - RNA, 22 nt, Homo sapiens
guucacaguucagccuguaaca

SEQ ID NO: 241517 - RNA, 22 nt, Homo sapiens
guucaucagggauacuggcuua

SEQ ID NO: 241518 - RNA, 22 nt, Homo sapiens
guucuggagauaaagccaaggu

SEQ ID NO: 241519 - RNA, 22 nt, Homo sapiens
guugaggcaggagaauuacuug

SEQ ID NO: 241520 - RNA, 22 nt, Homo sapiens
guugccuaggcuggagugcagu

SEQ ID NO: 241521 - RNA, 22 nt, Homo sapiens
guuggaauuaaaaggcaaguau

SEQ ID NO: 241522 - RNA, 22 nt, Homo sapiens
guuuaacugguacuucaagucu

SEQ ID NO: 241523 - RNA, 22 nt, Homo sapiens
guuugccuuuuagauaggaaug

SEQ ID NO: 241524 - RNA, 22 nt, Homo sapiens
guuuggauuuucuaauuucugu

SEQ ID NO: 241525 - RNA, 22 nt, Homo sapiens
guuuguaacucuagugacuaga

SEQ ID NO: 241526 - RNA, 21 nt, Homo sapiens
uaaaacuguaacuuuguccug

SEQ ID NO: 241527 - RNA, 22 nt, Homo sapiens
uaaaagucaucacaacuggagu

SEQ ID NO: 241528 - RNA, 22 nt, Homo sapiens
uaaaccuagcauuuugcauaug

SEQ ID NO: 241529 - RNA, 22 nt, Homo sapiens
uaaagagcuuuugaggugucau

SEQ ID NO: 241530 - RNA, 22 nt, Homo sapiens
uaaagauaaggcucgcuuggau

SEQ ID NO: 241531 - RNA, 22 nt, Homo sapiens
uacccaguaacaaguauuuugg

SEQ ID NO: 241532 - RNA, 22 nt, Homo sapiens
uaccuaguaggugguuuuucag

SEQ ID NO: 241533 - RNA, 22 nt, Homo sapiens
uacuagaaccuuauucagagug

SEQ ID NO: 241534 - RNA, 22 nt, Homo sapiens
uacuccccuuguucugugagcu

SEQ ID NO: 241535 - RNA, 22 nt, Homo sapiens
uacucuuuagcuccuuaaggaa

SEQ ID NO: 241536 - RNA, 22 nt, Homo sapiens
uacugcacuccagccugccaac

SEQ ID NO: 241537 - RNA, 22 nt, Homo sapiens
uacugcacuccagccuugccaa

SEQ ID NO: 241538 - RNA, 18 nt, Homo sapiens
uacugcacucuccagccu

SEQ ID NO: 241539 - RNA, 22 nt, Homo sapiens
uacugcaucgaaaugcuuuuau

SEQ ID NO: 241540 - RNA, 22 nt, Homo sapiens
uacugcauucuccgccuccggg

SEQ ID NO: 241541 - RNA, 22 nt, Homo sapiens
uacugcuuaagggcaugggccc

SEQ ID NO: 241542 - RNA, 21 nt, Homo sapiens
uacuggagauacagucugcaa

SEQ ID NO: 241543 - RNA, 22 nt, Homo sapiens
uacuuuguagagugugagaauu

SEQ ID NO: 241544 - RNA, 22 nt, Homo sapiens
uacuuuguuauagcagcaggaa

SEQ ID NO: 241545 - RNA, 22 nt, Homo sapiens
uagaaagcaugaccuucagaua

SEQ ID NO: 241546 - RNA, 22 nt, Homo sapiens
uagaagcacuaucccuccuagu

SEQ ID NO: 241547 - RNA, 22 nt, Homo sapiens
uagaagcuacucuucuuguggc

SEQ ID NO: 241548 - RNA, 22 nt, Homo sapiens
uagaagcugagaauguccucag

SEQ ID NO: 241549 - RNA, 22 nt, Homo sapiens
uagaaguaggcuacgugucugg

SEQ ID NO: 241550 - RNA, 22 nt, Homo sapiens
uagaauguaaauuccaagggca

SEQ ID NO: 241551 - RNA, 22 nt, Homo sapiens
uagaauguaacaguuaaaagca

SEQ ID NO: 241552 - RNA, 22 nt, Homo sapiens
uagagcacagugauuagaccua

SEQ ID NO: 241553 - RNA, 21 nt, Homo sapiens
uagagcuuggcacagaguaga

SEQ ID NO: 241554 - RNA, 19 nt, Homo sapiens
uagagguuuaagaaaagaa

SEQ ID NO: 241555 - RNA, 22 nt, Homo sapiens
uagaguacucugguaaguucuu

SEQ ID NO: 241556 - RNA, 22 nt, Homo sapiens
uagaguguuuuguuaggcagca

SEQ ID NO: 241557 - RNA, 22 nt, Homo sapiens
uagaucauauucagugcuuacu

SEQ ID NO: 241558 - RNA, 23 nt, Homo sapiens
uagaucaucaaguuuacugugcu

SEQ ID NO: 241559 - RNA, 20 nt, Homo sapiens
uagaugcauuuagauucauu

SEQ ID NO: 241560 - RNA, 22 nt, Homo sapiens
uagauuaucucaccacucgagu

SEQ ID NO: 241561 - RNA, 22 nt, Homo sapiens
uagauuauuggcugauuugauc

SEQ ID NO: 241562 - RNA, 22 nt, Homo sapiens
uagcacagggaauugguucucu

SEQ ID NO: 241563 - RNA, 19 nt, Homo sapiens
uagcacagggucccagacu

SEQ ID NO: 241564 - RNA, 22 nt, Homo sapiens
uagcacaucuucuuggccugca

SEQ ID NO: 241565 - RNA, 22 nt, Homo sapiens
uagcagaauauaccucuuacuu

SEQ ID NO: 241566 - RNA, 22 nt, Homo sapiens
uagcagcaccccacucuacugg

SEQ ID NO: 241567 - RNA, 22 nt, Homo sapiens
uagcagcuuuauugagguaaau

SEQ ID NO: 241568 - RNA, 22 nt, Homo sapiens
uagcaguaaagaaugugauguu

SEQ ID NO: 241569 - RNA, 22 nt, Homo sapiens
uagcaguagacagacuuuggcu

SEQ ID NO: 241570 - RNA, 22 nt, Homo sapiens
uagcaguauaugagagcuauug

SEQ ID NO: 241571 - RNA, 22 nt, Homo sapiens
uagcaguaucccaccaucuggu

SEQ ID NO: 241572 - RNA, 22 nt, Homo sapiens
uagcaguauggagcgaggccca

SEQ ID NO: 241573 - RNA, 22 nt, Homo sapiens
uagcaguauugaaagaugaggg

SEQ ID NO: 241574 - RNA, 22 nt, Homo sapiens
uagcagugugaaaacggacuaa

SEQ ID NO: 241575 - RNA, 22 nt, Homo sapiens
uagcaucaauucauguuaugau

SEQ ID NO: 241576 - RNA, 21 nt, Homo sapiens
uagcuacacugugauucaugg

SEQ ID NO: 241577 - RNA, 20 nt, Homo sapiens
auaugcagacacauacauac

SEQ ID NO: 241578 - RNA, 22 nt, Homo sapiens
auauggcauucagaacuguaua

SEQ ID NO: 241579 - RNA, 22 nt, Homo sapiens
auaugguacuuaugcucaaacu

SEQ ID NO: 241580 - RNA, 22 nt, Homo sapiens
auauguauuuuaacguguaagg

SEQ ID NO: 241581 - RNA, 22 nt, Homo sapiens
auaugugacuucaugcaaggcu

SEQ ID NO: 241582 - RNA, 22 nt, Homo sapiens
auauguucucauucauaugugg

SEQ ID NO: 241583 - RNA, 22 nt, Homo sapiens
auauuacagagaggaccuggga

SEQ ID NO: 241584 - RNA, 22 nt, Homo sapiens
auauucaagugaggauggcuaa

SEQ ID NO: 241585 - RNA, 22 nt, Homo sapiens
auauuggucuucaagaccugug

SEQ ID NO: 241586 - RNA, 22 nt, Homo sapiens
auauugguuaaauauuauguga

SEQ ID NO: 241587 - RNA, 20 nt, Homo sapiens
aucaaagacuuagaggggga

SEQ ID NO: 241588 - RNA, 22 nt, Homo sapiens
aucaaaguaucucaauauggua

SEQ ID NO: 241589 - RNA, 22 nt, Homo sapiens
aucaaagugaaauauuaguuau

SEQ ID NO: 241590 - RNA, 22 nt, Homo sapiens
aucaaagugaauuaaugagaau

SEQ ID NO: 241591 - RNA, 22 nt, Homo sapiens
gcauaaagcuaauaagacgaag

SEQ ID NO: 241592 - RNA, 22 nt, Homo sapiens
gcaucacagcuccugugcuggc

SEQ ID NO: 241593 - RNA, 22 nt, Homo sapiens
gcaucacagggagacaggccuc

SEQ ID NO: 241594 - RNA, 22 nt, Homo sapiens
gcaugacaaugauugcucuuca

SEQ ID NO: 241595 - RNA, 22 nt, Homo sapiens
gcauggaguggaaauucuuggg

SEQ ID NO: 241596 - RNA, 22 nt, Homo sapiens
gcauggauguugauggcugcug

SEQ ID NO: 241597 - RNA, 22 nt, Homo sapiens
gccaaaaugcugggauuacagg

SEQ ID NO: 241598 - RNA, 20 nt, Homo sapiens
gccacaguuaagcuucugcc

SEQ ID NO: 241599 - RNA, 22 nt, Homo sapiens
gccagugugaugugaucauggc

SEQ ID NO: 241600 - RNA, 22 nt, Homo sapiens
gccaguguguguuguucuccgc

SEQ ID NO: 241601 - RNA, 22 nt, Homo sapiens
gccaguguuuuauugagaauuu

SEQ ID NO: 241602 - RNA, 22 nt, Homo sapiens
gccauugcacuccagccuaggc

SEQ ID NO: 241603 - RNA, 22 nt, Homo sapiens
gccauugcacuccagccucggg

SEQ ID NO: 241604 - RNA, 22 nt, Homo sapiens
gcccagcguucagggaggggcu

SEQ ID NO: 241605 - RNA, 22 nt, Homo sapiens
gcccugauacauucuucugccu

SEQ ID NO: 241606 - RNA, 17 nt, Homo sapiens
gcccuuugugccucuuc

SEQ ID NO: 241607 - RNA, 22 nt, Homo sapiens
gcuaggagaucugcugcucucu

SEQ ID NO: 241608 - RNA, 22 nt, Homo sapiens
gcucaguuuccucagcugcaaa

SEQ ID NO: 241609 - RNA, 22 nt, Homo sapiens
gcucuuuugggguaauucugag

SEQ ID NO: 241610 - RNA, 19 nt, Homo sapiens
gcugauguuacauucuugc

SEQ ID NO: 241611 - RNA, 22 nt, Homo sapiens
gcugcacuuuaaggcauccccu

SEQ ID NO: 241612 - RNA, 22 nt, Homo sapiens
gcugcuguuauucaucagaacu

SEQ ID NO: 241613 - RNA, 22 nt, Homo sapiens
gcugcuguuuaguuucuccugg

SEQ ID NO: 241614 - RNA, 22 nt, Homo sapiens
gcuggcaaguggccuacuuugu

SEQ ID NO: 241615 - RNA, 22 nt, Homo sapiens
gcuggguugccagguuacuuaa

SEQ ID NO: 241616 - RNA, 22 nt, Homo sapiens
gcuggucugccguaguaggugc

SEQ ID NO: 241617 - RNA, 22 nt, Homo sapiens
gcuggugacuuuaaguugaagc

SEQ ID NO: 241618 - RNA, 22 nt, Homo sapiens
gcuguauugacuuuguaucaua

SEQ ID NO: 241619 - RNA, 22 nt, Homo sapiens
gcugucaugagcaacacaugaa

SEQ ID NO: 241620 - RNA, 22 nt, Homo sapiens
gcugucuggagucuguucaaug

SEQ ID NO: 241621 - RNA, 20 nt, Homo sapiens
gcugugcuuaauacacuuuc

SEQ ID NO: 241622 - RNA, 22 nt, Homo sapiens
gcuguugguaaaaaggacauga

SEQ ID NO: 241623 - RNA, 19 nt, Homo sapiens
gcuucuugaggacgaugac

SEQ ID NO: 241624 - RNA, 22 nt, Homo sapiens
gcuuguguuugcuccccagaau

SEQ ID NO: 241625 - RNA, 22 nt, Homo sapiens
gcuuuguugauggugagucugu

SEQ ID NO: 241626 - RNA, 22 nt, Homo sapiens
gcuuuugcaggaaaggaagaau

SEQ ID NO: 241627 - RNA, 22 nt, Homo sapiens
ggaaagcuagguguggguguac

SEQ ID NO: 241628 - RNA, 22 nt, Homo sapiens
ggaaaguccuucuguaggcucc

SEQ ID NO: 241629 - RNA, 22 nt, Homo sapiens
ggaaauguuuagcauccacuuu

SEQ ID NO: 241630 - RNA, 20 nt, Homo sapiens
ggaagagugacacaagguau

SEQ ID NO: 241631 - RNA, 22 nt, Homo sapiens
ggaagccuggaaaaaauuguga

SEQ ID NO: 241632 - RNA, 20 nt, Homo sapiens
ggaauagucuacacucugac

SEQ ID NO: 241633 - RNA, 22 nt, Homo sapiens
ggaaucugaaccaugggaaugg

SEQ ID NO: 241634 - RNA, 19 nt, Homo sapiens
ggaaugcuauucaaccuuu

SEQ ID NO: 241635 - RNA, 21 nt, Homo sapiens
ggaauuuagggaaugauuuag

SEQ ID NO: 241636 - RNA, 22 nt, Homo sapiens
ggacagaaaggguucaccaaac

SEQ ID NO: 241637 - RNA, 22 nt, Homo sapiens
ggacuagggacauggggagcug

SEQ ID NO: 241638 - RNA, 22 nt, Homo sapiens
ggacugagaggacuacagugua

SEQ ID NO: 241639 - RNA, 22 nt, Homo sapiens
ggagagugacauauuucuaggc

SEQ ID NO: 241640 - RNA, 22 nt, Homo sapiens
ggagaugauuaugaaucacuua

SEQ ID NO: 241641 - RNA, 22 nt, Homo sapiens
ggagauuauugaaucaugaggg

SEQ ID NO: 241642 - RNA, 22 nt, Homo sapiens
ggagguagucuuucccuuauca

SEQ ID NO: 241643 - RNA, 22 nt, Homo sapiens
ggaguaggcuguccggcaccca

SEQ ID NO: 241644 - RNA, 22 nt, Homo sapiens
ggagucugauuuuuauguugcu

SEQ ID NO: 241645 - RNA, 22 nt, Homo sapiens
ggagugugauucaguauaauau

SEQ ID NO: 241646 - RNA, 22 nt, Homo sapiens
ggagugugauuguucucuguua

SEQ ID NO: 241647 - RNA, 22 nt, Homo sapiens
ggaguguuccauuugucacauu

SEQ ID NO: 241648 - RNA, 22 nt, Homo sapiens
ggaguuuaagucuugugcaucu

SEQ ID NO: 241649 - RNA, 22 nt, Homo sapiens
ggaugcauuuuugguugucaca

SEQ ID NO: 241650 - RNA, 23 nt, Homo sapiens
ggauggaaaguuuugagggccac

SEQ ID NO: 241651 - RNA, 22 nt, Homo sapiens
ggcaaaugaagauggagaggcu

SEQ ID NO: 241652 - RNA, 22 nt, Homo sapiens
ggcaacaugaugaaaugccauc

SEQ ID NO: 241653 - RNA, 22 nt, Homo sapiens
ggcaagaaccacaauuacuuuu

SEQ ID NO: 241654 - RNA, 22 nt, Homo sapiens
ggcaagaacuucacucacuuuu

SEQ ID NO: 241655 - RNA, 22 nt, Homo sapiens
ggcaaggugcuacagacaguga

SEQ ID NO: 241656 - RNA, 22 nt, Homo sapiens
ggcaaugucagcuaaugaugga

SEQ ID NO: 241657 - RNA, 22 nt, Homo sapiens
ggcaccacagacgccaggcgug

SEQ ID NO: 241658 - RNA, 22 nt, Homo sapiens
ggcagagucuugcaucuuuaga

SEQ ID NO: 241659 - RNA, 17 nt, Homo sapiens
ggcaggauccaggaucc

SEQ ID NO: 241660 - RNA, 22 nt, Homo sapiens
ggcaguuuguucuugcuccuuu

SEQ ID NO: 241661 - RNA, 22 nt, Homo sapiens
ggcaugaaguagcccacaggca

SEQ ID NO: 241662 - RNA, 23 nt, Homo sapiens
ggcauuguggcucacaucuguaa

SEQ ID NO: 241663 - RNA, 22 nt, Homo sapiens
ggccuguaggguauugguaggg

SEQ ID NO: 241664 - RNA, 22 nt, Homo sapiens
ggcuagagacaaguugcugaga

SEQ ID NO: 241665 - RNA, 19 nt, Homo sapiens
ggcucagucaacugacugu

SEQ ID NO: 241666 - RNA, 22 nt, Homo sapiens
ggcucagugggguccugguucu

SEQ ID NO: 241667 - RNA, 18 nt, Homo sapiens
ggcugguguuuuaguaua

SEQ ID NO: 241668 - RNA, 22 nt, Homo sapiens
gggaacaugagaaugugaauga

SEQ ID NO: 241669 - RNA, 22 nt, Homo sapiens
gggaagaaggagugguuuacuc

SEQ ID NO: 241670 - RNA, 22 nt, Homo sapiens
gggaggucauuguucaaugcug

SEQ ID NO: 241671 - RNA, 22 nt, Homo sapiens
gggagugugcacacaugguaua

SEQ ID NO: 241672 - RNA, 22 nt, Homo sapiens
gggaucaacuuauacuaaaauu

SEQ ID NO: 241673 - RNA, 22 nt, Homo sapiens
gggaugaagaagaauaguucgu

SEQ ID NO: 241674 - RNA, 18 nt, Homo sapiens
gggcaaguugccuggcuu

SEQ ID NO: 241675 - RNA, 22 nt, Homo sapiens
gggcgagaaucggcugcucagc

SEQ ID NO: 241676 - RNA, 19 nt, Homo sapiens
gggucaguuugaaugauua

SEQ ID NO: 241677 - RNA, 22 nt, Homo sapiens
gggucauggaugugaagcuaga

SEQ ID NO: 241678 - RNA, 15 nt, Homo sapiens
ggguccucucccaaa

SEQ ID NO: 241679 - RNA, 22 nt, Homo sapiens
ggguucaaaucuuggcucuuac

SEQ ID NO: 241680 - RNA, 22 nt, Homo sapiens
gguaggcacuggugggaagaga

SEQ ID NO: 241681 - RNA, 22 nt, Homo sapiens
gguauguagcaaaagaggugcu

SEQ ID NO: 241682 - RNA, 19 nt, Homo sapiens
ggucagcaaagucuagcug

SEQ ID NO: 241683 - RNA, 22 nt, Homo sapiens
ggucaggagaaugguaacugag

SEQ ID NO: 241684 - RNA, 22 nt, Homo sapiens
ggucauggauugucuuuucuug

SEQ ID NO: 241685 - RNA, 19 nt, Homo sapiens
ggucccucucaagucauuc

SEQ ID NO: 241686 - RNA, 22 nt, Homo sapiens
gguccgccugccuuggccuccc

SEQ ID NO: 241687 - RNA, 22 nt, Homo sapiens
ggugagaaagggauuccuguuc

SEQ ID NO: 241688 - RNA, 22 nt, Homo sapiens
ggugaguggugcuuaaguucag

SEQ ID NO: 241689 - RNA, 22 nt, Homo sapiens
ggugaucauugucucuaguaug

SEQ ID NO: 241690 - RNA, 22 nt, Homo sapiens
ggugcuugaggaacggaggcug

SEQ ID NO: 241691 - RNA, 22 nt, Homo sapiens
gguggcaaaucugaguggcgcu

SEQ ID NO: 241692 - RNA, 22 nt, Homo sapiens
gguguguaaauuacuuaucucu

SEQ ID NO: 241693 - RNA, 22 nt, Homo sapiens
ugagaguagggguugggauugg

SEQ ID NO: 241694 - RNA, 22 nt, Homo sapiens
ugagagucauacaaauaaaaau

SEQ ID NO: 241695 - RNA, 22 nt, Homo sapiens
ugagauaaucaugugguuuuug

SEQ ID NO: 241696 - RNA, 22 nt, Homo sapiens
ugagauaauuuacuuguugagg

SEQ ID NO: 241697 - RNA, 22 nt, Homo sapiens
ugagauagggucucacucuguc

SEQ ID NO: 241698 - RNA, 22 nt, Homo sapiens
ugagauauugggaguaauguca

SEQ ID NO: 241699 - RNA, 22 nt, Homo sapiens
ugagaucaagauguuagggacu

SEQ ID NO: 241700 - RNA, 22 nt, Homo sapiens
ugagaucagaaggauuucucug

SEQ ID NO: 241701 - RNA, 22 nt, Homo sapiens
ugagauccugugacuacacuga

SEQ ID NO: 241702 - RNA, 22 nt, Homo sapiens
ugagaugagggaagccuaggca

SEQ ID NO: 241703 - RNA, 22 nt, Homo sapiens
ugagaugagggcugcacucaaa

SEQ ID NO: 241704 - RNA, 22 nt, Homo sapiens
ugagaugaggucucgcucuguc

SEQ ID NO: 241705 - RNA, 22 nt, Homo sapiens
ugagaugagucucgcucuguca

SEQ ID NO: 241706 - RNA, 22 nt, Homo sapiens
ugagaugauuuaauggagccca

SEQ ID NO: 241707 - RNA, 21 nt, Homo sapiens
ugagaugcaaucaccagggag

SEQ ID NO: 241708 - RNA, 22 nt, Homo sapiens
ugagauggaguuucgcuuuugu

SEQ ID NO: 241709 - RNA, 22 nt, Homo sapiens
ugagauggcugaauucagaaua

SEQ ID NO: 241710 - RNA, 22 nt, Homo sapiens
ugagauguuccaaugacuauua

SEQ ID NO: 241711 - RNA, 22 nt, Homo sapiens
ugagauuaucuugaucuugaaa

SEQ ID NO: 241712 - RNA, 22 nt, Homo sapiens
ugagcaagaaauagaaacagau

SEQ ID NO: 241713 - RNA, 22 nt, Homo sapiens
ugagcacauuuacaucaguucc

SEQ ID NO: 241714 - RNA, 22 nt, Homo sapiens
ugagcagaaguuuugauuggcg

SEQ ID NO: 241715 - RNA, 22 nt, Homo sapiens
ugagcagagaucacggcauugu

SEQ ID NO: 241716 - RNA, 22 nt, Homo sapiens
ugagcauuguuuggacuuggau

SEQ ID NO: 241717 - RNA, 22 nt, Homo sapiens
ugagcugagaaaugcagcagcu

SEQ ID NO: 241718 - RNA, 22 nt, Homo sapiens
ugaggagugagaaauugguuuc

SEQ ID NO: 241719 - RNA, 22 nt, Homo sapiens
ugaggcaagauacugauuucau

SEQ ID NO: 241720 - RNA, 22 nt, Homo sapiens
ugaggcaaggcugaaugaaggc

SEQ ID NO: 241721 - RNA, 22 nt, Homo sapiens
ugaggcaggagaacggcuugaa

SEQ ID NO: 241722 - RNA, 17 nt, Homo sapiens
ugagggaugccugguuc

SEQ ID NO: 241723 - RNA, 22 nt, Homo sapiens
ugagguaacaaacuaugaguua

SEQ ID NO: 241724 - RNA, 22 nt, Homo sapiens
ugagguaauagauaauauuuuu

SEQ ID NO: 241725 - RNA, 22 nt, Homo sapiens
ugaggugcagcaauccucaugu

SEQ ID NO: 241726 - RNA, 22 nt, Homo sapiens
ugaguacuacuaguuacugcua

SEQ ID NO: 241727 - RNA, 23 nt, Homo sapiens
ugaguaggugguuuuccccucac

SEQ ID NO: 241728 - RNA, 22 nt, Homo sapiens
ugagucagucucacucugcugc

SEQ ID NO: 241729 - RNA, 22 nt, Homo sapiens
ugagugaaugugaaggcuaggg

SEQ ID NO: 241730 - RNA, 18 nt, Homo sapiens
uggauuggaaaaguuccu

SEQ ID NO: 241731 - RNA, 22 nt, Homo sapiens
uggauuuuaauuauucugucau

SEQ ID NO: 241732 - RNA, 22 nt, Homo sapiens
uggcaaagugugacgugggggu

SEQ ID NO: 241733 - RNA, 22 nt, Homo sapiens
uggcaaauauuuuguuuuguaa

SEQ ID NO: 241734 - RNA, 22 nt, Homo sapiens
uggcaacaucuggggacauguu

SEQ ID NO: 241735 - RNA, 21 nt, Homo sapiens
uggcaacauggauggauucug

SEQ ID NO: 241736 - RNA, 22 nt, Homo sapiens
uggcaacuugcaaccucauucu

SEQ ID NO: 241737 - RNA, 22 nt, Homo sapiens
uggcaagaacugcaauugcuuu

SEQ ID NO: 241738 - RNA, 22 nt, Homo sapiens
uggcaagagcugcauucaucug

SEQ ID NO: 241739 - RNA, 22 nt, Homo sapiens
uggcaagaucacaauuacuuuu

SEQ ID NO: 241740 - RNA, 22 nt, Homo sapiens
uggcaagauuguuccgguuugg

SEQ ID NO: 241741 - RNA, 23 nt, Homo sapiens
uggcaagauuuguauugccugga

SEQ ID NO: 241742 - RNA, 22 nt, Homo sapiens
uggcaauaaggacuccuuaggu

SEQ ID NO: 241743 - RNA, 22 nt, Homo sapiens
uggcaauauccacaauuacuuu

SEQ ID NO: 241744 - RNA, 19 nt, Homo sapiens
uggcaaugucagcagagau

SEQ ID NO: 241745 - RNA, 19 nt, Homo sapiens
uggcacauguauacauaug

SEQ ID NO: 241746 - RNA, 22 nt, Homo sapiens
uggcagauagaaaugugguuaa

SEQ ID NO: 241747 - RNA, 22 nt, Homo sapiens
uggcaguuuacagcuuuaggag

SEQ ID NO: 241748 - RNA, 22 nt, Homo sapiens
uggcauauaauauagaagacua

SEQ ID NO: 241749 - RNA, 22 nt, Homo sapiens
uggcaugaagaccccauccuuu

SEQ ID NO: 241750 - RNA, 22 nt, Homo sapiens
uggcaugauccuagauucaaca

SEQ ID NO: 241751 - RNA, 22 nt, Homo sapiens
uggcauggaaagcuuuucauac

SEQ ID NO: 241752 - RNA, 22 nt, Homo sapiens
uggcauggaacuacuuugaaac

SEQ ID NO: 241753 - RNA, 22 nt, Homo sapiens
uggcauggucugcccaaguuuc

SEQ ID NO: 241754 - RNA, 22 nt, Homo sapiens
uggcaugucguuuuucauagga

SEQ ID NO: 241755 - RNA, 22 nt, Homo sapiens
uggcauuuuguuuuagaauuag

SEQ ID NO: 241756 - RNA, 23 nt, Homo sapiens
uggccaagauaaucucaguuuuc

SEQ ID NO: 241757 - RNA, 22 nt, Homo sapiens
uggcgagaugcucgugugcaga

SEQ ID NO: 241758 - RNA, 22 nt, Homo sapiens
uggcggagacauggacuucaga

SEQ ID NO: 241759 - RNA, 22 nt, Homo sapiens
uggcuacagaaaguacuaguga

SEQ ID NO: 241760 - RNA, 22 nt, Homo sapiens
uggcuagaccugcauaacagcu

SEQ ID NO: 241761 - RNA, 19 nt, Homo sapiens
uggcuagagcagauauccu

SEQ ID NO: 241762 - RNA, 22 nt, Homo sapiens
uggcuagauauccagaguucug

SEQ ID NO: 241763 - RNA, 22 nt, Homo sapiens
uggcuccguuguacaggcugga

SEQ ID NO: 241764 - RNA, 22 nt, Homo sapiens
uggcucuguuuguuaacuagac

SEQ ID NO: 241765 - RNA, 20 nt, Homo sapiens
uggcucuuugcugcuaaagu

SEQ ID NO: 241766 - RNA, 22 nt, Homo sapiens
uggcuguguccucucccaaauc

SEQ ID NO: 241767 - RNA, 22 nt, Homo sapiens
uggcuuuuaucuacucucaacu

SEQ ID NO: 241768 - RNA, 22 nt, Homo sapiens
ugggaaacauccagcacauacu

SEQ ID NO: 241769 - RNA, 22 nt, Homo sapiens
ugggaacaugaagguuaaagag

SEQ ID NO: 241770 - RNA, 18 nt, Homo sapiens
ugggaagaaauucuucuc

SEQ ID NO: 241771 - RNA, 22 nt, Homo sapiens
ugggaagcugcauuuuaacaag

SEQ ID NO: 241772 - RNA, 22 nt, Homo sapiens
ugggaauaugauacaggucuuu

SEQ ID NO: 241773 - RNA, 22 nt, Homo sapiens
ugggaucagcugggcucucugu

SEQ ID NO: 241774 - RNA, 22 nt, Homo sapiens
ugggaucaugagcaccgcuucc

SEQ ID NO: 241775 - RNA, 22 nt, Homo sapiens
ugggaugaugcuugagaauauc

SEQ ID NO: 241776 - RNA, 22 nt, Homo sapiens
ugggauguagccuucuauuuuc

SEQ ID NO: 241777 - RNA, 22 nt, Homo sapiens
ugggcaaaacuaagagcugugg

SEQ ID NO: 241778 - RNA, 22 nt, Homo sapiens
ugggcaagagagcaugacccug

SEQ ID NO: 241779 - RNA, 22 nt, Homo sapiens
ugggcaguauggucauuuucgu

SEQ ID NO: 241780 - RNA, 22 nt, Homo sapiens
uggggucguaggugcccgccag

SEQ ID NO: 241781 - RNA, 22 nt, Homo sapiens
uggguagagaaucaggaucuua

SEQ ID NO: 241782 - RNA, 19 nt, Homo sapiens
uggguagugaugagacaua

SEQ ID NO: 241783 - RNA, 23 nt, Homo sapiens
ugggucaguuuuucugacaucau

SEQ ID NO: 241784 - RNA, 22 nt, Homo sapiens
uggguccccuacucuuuccaca

SEQ ID NO: 241785 - RNA, 22 nt, Homo sapiens
ugguacuucaugcucacagaua

SEQ ID NO: 241786 - RNA, 22 nt, Homo sapiens
ugguauguuuauaaguauagga

SEQ ID NO: 241787 - RNA, 20 nt, Homo sapiens
uggucaccuucaggagguuc

SEQ ID NO: 241788 - RNA, 21 nt, Homo sapiens
uggucccauaagauuauaaug

SEQ ID NO: 241789 - RNA, 21 nt, Homo sapiens
uggucccuucagaucggauuu

SEQ ID NO: 241790 - RNA, 22 nt, Homo sapiens
uggucguggagucccuggcuuc

SEQ ID NO: 241791 - RNA, 22 nt, Homo sapiens
uggucuucuggccuccagaacc

SEQ ID NO: 241792 - RNA, 22 nt, Homo sapiens
uggugcaaugaagugaucucaa

SEQ ID NO: 241793 - RNA, 22 nt, Homo sapiens
aucaaaguaggcauauguuuuu

SEQ ID NO: 241794 - RNA, 22 nt, Homo sapiens
aucaagccaaagaaaguccuug

SEQ ID NO: 241795 - RNA, 22 nt, Homo sapiens
aucacaguuaagaggugaugaa

SEQ ID NO: 241796 - RNA, 22 nt, Homo sapiens
aucacaguuauaacauccuuuu

SEQ ID NO: 241797 - RNA, 22 nt, Homo sapiens
aucacauuuauaguggcacgca

SEQ ID NO: 241798 - RNA, 22 nt, Homo sapiens
aucaccugagcaguauacacug

SEQ ID NO: 241799 - RNA, 22 nt, Homo sapiens
aucaccuuucccuuucugaauc

SEQ ID NO: 241800 - RNA, 22 nt, Homo sapiens
aucacuaugcaggugucucggg

SEQ ID NO: 241801 - RNA, 22 nt, Homo sapiens
aucacuguccacucaucuuucu

SEQ ID NO: 241802 - RNA, 23 nt, Homo sapiens
aucacuguuaacaauuucuuccu

SEQ ID NO: 241803 - RNA, 16 nt, Homo sapiens
aucacuugcuucuuuu

SEQ ID NO: 241804 - RNA, 22 nt, Homo sapiens
aucagaaucucuugagaguguu

SEQ ID NO: 241805 - RNA, 22 nt, Homo sapiens
aucagagugaauaaugacaaaa

SEQ ID NO: 241806 - RNA, 22 nt, Homo sapiens
aucagauaccuguugggaaaug

SEQ ID NO: 241807 - RNA, 22 nt, Homo sapiens
aucagauguuuguauaggagua

SEQ ID NO: 241808 - RNA, 19 nt, Homo sapiens
aucagcacaagugugcuuu

SEQ ID NO: 241809 - RNA, 22 nt, Homo sapiens
aucaggaaccuuuuuggugugu

SEQ ID NO: 241810 - RNA, 22 nt, Homo sapiens
aucaggcacacauuggaguuug

SEQ ID NO: 241811 - RNA, 22 nt, Homo sapiens
aucagugagugguuagugaaug

SEQ ID NO: 241812 - RNA, 22 nt, Homo sapiens
aucagugcauaguauuuaauga

SEQ ID NO: 241813 - RNA, 22 nt, Homo sapiens
aucagugcauguuuguugagcu

SEQ ID NO: 241814 - RNA, 21 nt, Homo sapiens
aucauaugcucacuccuagaa

SEQ ID NO: 241815 - RNA, 22 nt, Homo sapiens
aucaucaugcacuacagccugg

SEQ ID NO: 241816 - RNA, 22 nt, Homo sapiens
aucaugucuucccagugauucu

SEQ ID NO: 241817 - RNA, 22 nt, Homo sapiens
auccaguuuuaggagauuucua

SEQ ID NO: 241818 - RNA, 22 nt, Homo sapiens
aucccuagaaaaaucagcacau

SEQ ID NO: 241819 - RNA, 22 nt, Homo sapiens
auccucugagaucuaggcagag

SEQ ID NO: 241820 - RNA, 22 nt, Homo sapiens
auccugaagcuuuacugaauuc

SEQ ID NO: 241821 - RNA, 22 nt, Homo sapiens
auccugaugacacagugcugca

SEQ ID NO: 241822 - RNA, 22 nt, Homo sapiens
aucuaaaucucauaugggcaca

SEQ ID NO: 241823 - RNA, 22 nt, Homo sapiens
aucucagagaaaauuacuaaga

SEQ ID NO: 241824 - RNA, 22 nt, Homo sapiens
aucucaguucaggcuggccaca

SEQ ID NO: 241825 - RNA, 22 nt, Homo sapiens
aucucauggagguagagaguaa

SEQ ID NO: 241826 - RNA, 22 nt, Homo sapiens
aucugauggagagcguguggcu

SEQ ID NO: 241827 - RNA, 22 nt, Homo sapiens
aucuggcuccuuuugacaaugc

SEQ ID NO: 241828 - RNA, 22 nt, Homo sapiens
aucuggcuucuuuuaguccaca

SEQ ID NO: 241829 - RNA, 22 nt, Homo sapiens
aucugggguuggcaaaguuugg

SEQ ID NO: 241830 - RNA, 22 nt, Homo sapiens
aucugguauuacugcaacugua

SEQ ID NO: 241831 - RNA, 22 nt, Homo sapiens
aucugguguccucgugggaguc

SEQ ID NO: 241832 - RNA, 22 nt, Homo sapiens
ugugaacugagcauuaacuaca

SEQ ID NO: 241833 - RNA, 22 nt, Homo sapiens
ugugaaugaagaaugcuaaccu

SEQ ID NO: 241834 - RNA, 22 nt, Homo sapiens
ugugaauggugcugcaaugaac

SEQ ID NO: 241835 - RNA, 22 nt, Homo sapiens
ugugacaguuaguuugguguua

SEQ ID NO: 241836 - RNA, 20 nt, Homo sapiens
ugugagacugguuuugaacu

SEQ ID NO: 241837 - RNA, 19 nt, Homo sapiens
ugugagcauuagcauuuag

SEQ ID NO: 241838 - RNA, 22 nt, Homo sapiens
ugugaugaaggcauagggaugu

SEQ ID NO: 241839 - RNA, 22 nt, Homo sapiens
ugugaugugaugagaaguuccu

SEQ ID NO: 241840 - RNA, 22 nt, Homo sapiens
ugugauuauuuauagacaguca

SEQ ID NO: 241841 - RNA, 18 nt, Homo sapiens
ugugcaauauuaaccacc

SEQ ID NO: 241842 - RNA, 22 nt, Homo sapiens
ugugcaaucagcuucauuacau

SEQ ID NO: 241843 - RNA, 22 nt, Homo sapiens
ugugcacaacgugcagguuugu

SEQ ID NO: 241844 - RNA, 22 nt, Homo sapiens
ugugcacaauguacagguuagu

SEQ ID NO: 241845 - RNA, 22 nt, Homo sapiens
ugugcacaaugugcagguuuga

SEQ ID NO: 241846 - RNA, 23 nt, Homo sapiens
ugugcacauuuacauauauacac

SEQ ID NO: 241847 - RNA, 22 nt, Homo sapiens
ugugccacugcacucuggccug

SEQ ID NO: 241848 - RNA, 22 nt, Homo sapiens
ugugcuugcuucuucuccuagu

SEQ ID NO: 241849 - RNA, 22 nt, Homo sapiens
uguggccccuagcuacuagaga

SEQ ID NO: 241850 - RNA, 22 nt, Homo sapiens
uguggcucuucuguucuccacu

SEQ ID NO: 241851 - RNA, 22 nt, Homo sapiens
uguggcugguggcaccuuuucc

SEQ ID NO: 241852 - RNA, 22 nt, Homo sapiens
ugugguagugcuuaccugcagu

SEQ ID NO: 241853 - RNA, 19 nt, Homo sapiens
uguggucauccugggacga

SEQ ID NO: 241854 - RNA, 22 nt, Homo sapiens
uguguaauaccuuugacuauau

SEQ ID NO: 241855 - RNA, 22 nt, Homo sapiens
ugugucacugcacuccagcgug

SEQ ID NO: 241856 - RNA, 22 nt, Homo sapiens
ugugucuugcuggugccugcau

SEQ ID NO: 241857 - RNA, 22 nt, Homo sapiens
uguuacagcagaauugauugca

SEQ ID NO: 241858 - RNA, 22 nt, Homo sapiens
uguuacagcagcacaaaaugga

SEQ ID NO: 241859 - RNA, 22 nt, Homo sapiens
uguuauuuuguguuagggcaca

SEQ ID NO: 241860 - RNA, 22 nt, Homo sapiens
uguucaauucccaccuaugagu

SEQ ID NO: 241861 - RNA, 22 nt, Homo sapiens
uguucacaguguuucuuugaga

SEQ ID NO: 241862 - RNA, 22 nt, Homo sapiens
uguucuugaguugggaguacaa

SEQ ID NO: 241863 - RNA, 22 nt, Homo sapiens
uguugcacacacugaaauacac

SEQ ID NO: 241864 - RNA, 19 nt, Homo sapiens
uguugcacauaucaauaug

SEQ ID NO: 241865 - RNA, 22 nt, Homo sapiens
uguugcacuccagccugggcaa

SEQ ID NO: 241866 - RNA, 19 nt, Homo sapiens
uguugcacuccagcuuggg

SEQ ID NO: 241867 - RNA, 22 nt, Homo sapiens
uguugcacuccauccugggcga

SEQ ID NO: 241868 - RNA, 22 nt, Homo sapiens
uguuugguggucucuucacaug

SEQ ID NO: 241869 - RNA, 22 nt, Homo sapiens
uuaaacugcuugaauuggguuu

SEQ ID NO: 241870 - RNA, 22 nt, Homo sapiens
uuaaaguaauugaaauggccuu

SEQ ID NO: 241871 - RNA, 22 nt, Homo sapiens
uuaaagugaucauaaggauagu

SEQ ID NO: 241872 - RNA, 22 nt, Homo sapiens
uuaaagugcacacgggucaggc

SEQ ID NO: 241873 - RNA, 22 nt, Homo sapiens
uuaaaguguuugcagacaggug

SEQ ID NO: 241874 - RNA, 22 nt, Homo sapiens
uuaaaugcauagaauguguagu

SEQ ID NO: 241875 - RNA, 22 nt, Homo sapiens
uuaaaugcucacauaaagguag

SEQ ID NO: 241876 - RNA, 22 nt, Homo sapiens
uuaagaagugauuuuccucauu

SEQ ID NO: 241877 - RNA, 22 nt, Homo sapiens
uuaagcucauuuccauucuaca

SEQ ID NO: 241878 - RNA, 22 nt, Homo sapiens
uuaaggcagugucuaugccagu

SEQ ID NO: 241879 - RNA, 22 nt, Homo sapiens
uuaaggcuuuaaguaaacacag

SEQ ID NO: 241880 - RNA, 22 nt, Homo sapiens
uuaaugugaaucaggaugcauu

SEQ ID NO: 241881 - RNA, 22 nt, Homo sapiens
uuaauuguccaaguucaucucu

SEQ ID NO: 241882 - RNA, 19 nt, Homo sapiens
uuacacaaccuaguggggc

SEQ ID NO: 241883 - RNA, 22 nt, Homo sapiens
uuacacaguugguaggggcaga

SEQ ID NO: 241884 - RNA, 22 nt, Homo sapiens
uuacaccuguaauccagcacuu

SEQ ID NO: 241885 - RNA, 22 nt, Homo sapiens
uuacaggacuaagcagcuuugc

SEQ ID NO: 241886 - RNA, 17 nt, Homo sapiens
uuacaggugcugagagu

SEQ ID NO: 241887 - RNA, 22 nt, Homo sapiens
uuacagucaaguuacauuucuc

SEQ ID NO: 241888 - RNA, 20 nt, Homo sapiens
uuacagugggaccuuccuga

SEQ ID NO: 241889 - RNA, 22 nt, Homo sapiens
uuacaguugugagccaccaugc

SEQ ID NO: 241890 - RNA, 22 nt, Homo sapiens
uuaccaguggugcuguaaacuu

SEQ ID NO: 241891 - RNA, 22 nt, Homo sapiens
uuacguaguuuuggagaucaua

SEQ ID NO: 241892 - RNA, 22 nt, Homo sapiens
uuacuugagaugaguuggacaa

SEQ ID NO: 241893 - RNA, 22 nt, Homo sapiens
uuagaacaguguuugccucgcu

SEQ ID NO: 241894 - RNA, 22 nt, Homo sapiens
auggagugagaauggagguucc

SEQ ID NO: 241895 - RNA, 22 nt, Homo sapiens
auggaguguaauauugagagcu

SEQ ID NO: 241896 - RNA, 22 nt, Homo sapiens
auggcaaugcgaugaugacuga

SEQ ID NO: 241897 - RNA, 22 nt, Homo sapiens
auggcaauguaagucagaaaaa

SEQ ID NO: 241898 - RNA, 22 nt, Homo sapiens
auggcacuaaugggaguuuacu

SEQ ID NO: 241899 - RNA, 22 nt, Homo sapiens
auggcacugaagcguauugaca

SEQ ID NO: 241900 - RNA, 22 nt, Homo sapiens
auggcagagucagaaagucagg

SEQ ID NO: 241901 - RNA, 22 nt, Homo sapiens
auggcagcccucuuuauccaug

SEQ ID NO: 241902 - RNA, 22 nt, Homo sapiens
auggccuuucuggcacauuucc

SEQ ID NO: 241903 - RNA, 22 nt, Homo sapiens
auggcguguggcuuggaggcug

SEQ ID NO: 241904 - RNA, 22 nt, Homo sapiens
auggcucaauucuuucccugaa

SEQ ID NO: 241905 - RNA, 22 nt, Homo sapiens
auggcucaguguguaucuauca

SEQ ID NO: 241906 - RNA, 22 nt, Homo sapiens
auggcucuguuuuuuaugcucu

SEQ ID NO: 241907 - RNA, 22 nt, Homo sapiens
auggcuucuuacucuucugcau

SEQ ID NO: 241908 - RNA, 22 nt, Homo sapiens
augggauaguaucaguggaaua

SEQ ID NO: 241909 - RNA, 22 nt, Homo sapiens
augggcuaguaaagacaaacuu

SEQ ID NO: 241910 - RNA, 21 nt, Homo sapiens
augggguagaagagaaggcuu

SEQ ID NO: 241911 - RNA, 22 nt, Homo sapiens
augggguaggcuugcuguagua

SEQ ID NO: 241912 - RNA, 22 nt, Homo sapiens
augguaagcugaaaauaucgaa

SEQ ID NO: 241913 - RNA, 22 nt, Homo sapiens
augguauuuugugauaccuugu

SEQ ID NO: 241914 - RNA, 22 nt, Homo sapiens
auggugugugaauuaaauguua

SEQ ID NO: 241915 - RNA, 22 nt, Homo sapiens
augguuugugcuccuauaagaa

SEQ ID NO: 241916 - RNA, 22 nt, Homo sapiens
augguuuuacugcaaaauggga

SEQ ID NO: 241917 - RNA, 22 nt, Homo sapiens
augucaaagaggaaaacuggau

SEQ ID NO: 241918 - RNA, 22 nt, Homo sapiens
augucaaggugggugauaguuu

SEQ ID NO: 241919 - RNA, 22 nt, Homo sapiens
augucacugcacuccugccugg

SEQ ID NO: 241920 - RNA, 20 nt, Homo sapiens
augucagaguguggguacgg

SEQ ID NO: 241921 - RNA, 22 nt, Homo sapiens
augucuggcagaagacuucuca

SEQ ID NO: 241922 - RNA, 22 nt, Homo sapiens
augucugguagccaccuggagg

SEQ ID NO: 241923 - RNA, 22 nt, Homo sapiens
augugaacugaauuaauucaca

SEQ ID NO: 241924 - RNA, 22 nt, Homo sapiens
augugacuuuuuccugugccuu

SEQ ID NO: 241925 - RNA, 22 nt, Homo sapiens
augugcaaagcacuguucagca

SEQ ID NO: 241926 - RNA, 22 nt, Homo sapiens
augugcaacugcuggaacaguc

SEQ ID NO: 241927 - RNA, 22 nt, Homo sapiens
augugcaauggugucaccacau

SEQ ID NO: 241928 - RNA, 22 nt, Homo sapiens
augugcacaugcuuacauguga

SEQ ID NO: 241929 - RNA, 22 nt, Homo sapiens
augugcacauucugguaaauau

SEQ ID NO: 241930 - RNA, 21 nt, Homo sapiens
augugcacuaugucauuuaau

SEQ ID NO: 241931 - RNA, 20 nt, Homo sapiens
augugcaguguggcaaccaa

SEQ ID NO: 241932 - RNA, 22 nt, Homo sapiens
augugcauaugaagcacagaca

SEQ ID NO: 241933 - RNA, 22 nt, Homo sapiens
augugccaauuaggauuccaag

SEQ ID NO: 241934 - RNA, 19 nt, Homo sapiens
acugcacuccaaccuccug

SEQ ID NO: 241935 - RNA, 22 nt, Homo sapiens
acugcacuccacccuuggcagc

SEQ ID NO: 241936 - RNA, 18 nt, Homo sapiens
acugcacuccaccuuggg

SEQ ID NO: 241937 - RNA, 22 nt, Homo sapiens
acugcacuccagacucugucuc

SEQ ID NO: 241938 - RNA, 22 nt, Homo sapiens
acugcacuccagcccgggugac

SEQ ID NO: 241939 - RNA, 22 nt, Homo sapiens
acugcacuccagccuaggcgac

SEQ ID NO: 241940 - RNA, 22 nt, Homo sapiens
acugcacuccagccuccugggu

SEQ ID NO: 241941 - RNA, 22 nt, Homo sapiens
acugcacuccagccucgcaaca

SEQ ID NO: 241942 - RNA, 22 nt, Homo sapiens
acugcacuccagccucggugac

SEQ ID NO: 241943 - RNA, 22 nt, Homo sapiens
acugcacuccagccucguggac

SEQ ID NO: 241944 - RNA, 22 nt, Homo sapiens
acugcacuccagccuuugcgau

SEQ ID NO: 241945 - RNA, 22 nt, Homo sapiens
acugcacuccagcuccagggug

SEQ ID NO: 241946 - RNA, 22 nt, Homo sapiens
acugcacuccagcuuuggguga

SEQ ID NO: 241947 - RNA, 22 nt, Homo sapiens
acugcacuccagcuuuggugac

SEQ ID NO: 241948 - RNA, 22 nt, Homo sapiens
acugcacuccggccuggcaaca

SEQ ID NO: 241949 - RNA, 19 nt, Homo sapiens
acugcacuccuccuugggu

SEQ ID NO: 241950 - RNA, 20 nt, Homo sapiens
acugcacuucagccugcugg

SEQ ID NO: 241951 - RNA, 22 nt, Homo sapiens
acugcauuugguaaagucaaga

SEQ ID NO: 241952 - RNA, 18 nt, Homo sapiens
acuggauguaaagggucc

SEQ ID NO: 241953 - RNA, 22 nt, Homo sapiens
acugggauauuauugguaauau

SEQ ID NO: 241954 - RNA, 22 nt, Homo sapiens
acuguacuccagccugggcaac

SEQ ID NO: 241955 - RNA, 22 nt, Homo sapiens
acuguacuccagccugggugac

SEQ ID NO: 241956 - RNA, 21 nt, Homo sapiens
acuuucuguggcaguccauuc

SEQ ID NO: 241957 - RNA, 22 nt, Homo sapiens
acuuugcuuagagggcauuaaa

SEQ ID NO: 241958 - RNA, 22 nt, Homo sapiens
acuuugcuuaucccaggcacug

SEQ ID NO: 241959 - RNA, 21 nt, Homo sapiens
acuuuguugggggcugaggca

SEQ ID NO: 241960 - RNA, 20 nt, Homo sapiens
acuuuuugaugaggucguuu

SEQ ID NO: 241961 - RNA, 22 nt, Homo sapiens
acuuuuugcaaccauuuggacc

SEQ ID NO: 241962 - RNA, 22 nt, Homo sapiens
agaaagcgcuucccuuugcugg

SEQ ID NO: 241963 - RNA, 22 nt, Homo sapiens
agaaagugcuucccuuugguga

SEQ ID NO: 241964 - RNA, 22 nt, Homo sapiens
agaaauguuuacucacccccuu

SEQ ID NO: 241965 - RNA, 22 nt, Homo sapiens
agaagaacauagggugacugaa

SEQ ID NO: 241966 - RNA, 22 nt, Homo sapiens
agaauguaaacagaauagagga

SEQ ID NO: 241967 - RNA, 22 nt, Homo sapiens
agaauguauauucuguaguugu

SEQ ID NO: 241968 - RNA, 22 nt, Homo sapiens
agaaugugaacaucuugaaagu

SEQ ID NO: 241969 - RNA, 22 nt, Homo sapiens
agacaagauggcuugagguuca

SEQ ID NO: 241970 - RNA, 22 nt, Homo sapiens
agacagcuggaguaucauagcu

SEQ ID NO: 241971 - RNA, 22 nt, Homo sapiens
agacagcugggaaauggagugu

SEQ ID NO: 241972 - RNA, 22 nt, Homo sapiens
agacaguauuggcaaagugugu

SEQ ID NO: 241973 - RNA, 19 nt, Homo sapiens
agacuggcccaggcgggug

SEQ ID NO: 241974 - RNA, 22 nt, Homo sapiens
agagaacugauucagggaaaau

SEQ ID NO: 241975 - RNA, 22 nt, Homo sapiens
agagacauugcuccaacucacc

SEQ ID NO: 241976 - RNA, 20 nt, Homo sapiens
agagaucaguaauucaucaa

SEQ ID NO: 241977 - RNA, 20 nt, Homo sapiens
agagcaaagccgcaccccua

SEQ ID NO: 241978 - RNA, 22 nt, Homo sapiens
agagcaaugggugaauauuaaa

SEQ ID NO: 241979 - RNA, 22 nt, Homo sapiens
agagcaccauuuagcaagguga

SEQ ID NO: 241980 - RNA, 22 nt, Homo sapiens
agagcuaguauuuacggagcau

SEQ ID NO: 241981 - RNA, 22 nt, Homo sapiens
agaggaguacuacuccaagucu

SEQ ID NO: 241982 - RNA, 22 nt, Homo sapiens
agaguauacaugugagugagau

SEQ ID NO: 241983 - RNA, 21 nt, Homo sapiens
agagucaucucuaucuguacc

SEQ ID NO: 241984 - RNA, 22 nt, Homo sapiens
agaugguauuauagguuucugu

SEQ ID NO: 241985 - RNA, 22 nt, Homo sapiens
agauggugauaaaugugguacc

SEQ ID NO: 241986 - RNA, 22 nt, Homo sapiens
agaugguguuggcugaguguau

SEQ ID NO: 241987 - RNA, 22 nt, Homo sapiens
agcacagccuuguguuuucuug

SEQ ID NO: 241988 - RNA, 22 nt, Homo sapiens
agcacaguuaaaugaggcuucu

SEQ ID NO: 241989 - RNA, 22 nt, Homo sapiens
agcacuacugcacuccagccug

SEQ ID NO: 241990 - RNA, 21 nt, Homo sapiens
agcagaguggcagcucuuuug

SEQ ID NO: 241991 - RNA, 22 nt, Homo sapiens
agcagcaauuuuguaugguuua

SEQ ID NO: 241992 - RNA, 22 nt, Homo sapiens
agcagcauuaguggaaucuugu

SEQ ID NO: 241993 - RNA, 20 nt, Homo sapiens
agcagccacagauuccucag

SEQ ID NO: 241994 - RNA, 22 nt, Homo sapiens
agcagcucaagacuuaaauuug

SEQ ID NO: 241995 - RNA, 22 nt, Homo sapiens
agcagcuuugcauggccuguga

SEQ ID NO: 241996 - RNA, 22 nt, Homo sapiens
agcaggauuguuacaauaguaa

SEQ ID NO: 241997 - RNA, 22 nt, Homo sapiens
agcagguguccacaauguuugc

SEQ ID NO: 241998 - RNA, 22 nt, Homo sapiens
agcaucacguagacuuuaccau

SEQ ID NO: 241999 - RNA, 19 nt, Homo sapiens
agcaucauuauuguuuugg

SEQ ID NO: 242000 - RNA, 22 nt, Homo sapiens
agcaugauugggguugggcaca

SEQ ID NO: 242001 - RNA, 22 nt, Homo sapiens
agcauuacaugguacagagaag

SEQ ID NO: 242002 - RNA, 20 nt, Homo sapiens
agcauugguuagaacaguag

SEQ ID NO: 242003 - RNA, 22 nt, Homo sapiens
agccaguauuuccacagagugg

SEQ ID NO: 242004 - RNA, 22 nt, Homo sapiens
agccauacaacguaugcaugua

SEQ ID NO: 242005 - RNA, 22 nt, Homo sapiens
agcccugugauuacuuuuauaa

SEQ ID NO: 242006 - RNA, 21 nt, Homo sapiens
agccugugggucauaguugcc

SEQ ID NO: 242007 - RNA, 22 nt, Homo sapiens
agcuaaaucucauguugaauug

SEQ ID NO: 242008 - RNA, 21 nt, Homo sapiens
agcuaaauuggaaauuucugu

SEQ ID NO: 242009 - RNA, 22 nt, Homo sapiens
agcucauugcuguccuggagga

SEQ ID NO: 242010 - RNA, 22 nt, Homo sapiens
agcuccauuguaaucaccuggu

SEQ ID NO: 242011 - RNA, 22 nt, Homo sapiens
agcuccuuucugcagguagguu

SEQ ID NO: 242012 - RNA, 22 nt, Homo sapiens
agcugcauucguaucauauugu

SEQ ID NO: 242013 - RNA, 21 nt, Homo sapiens
agcugcguuuaggcauuuucc

SEQ ID NO: 242014 - RNA, 16 nt, Homo sapiens
agcuggaauuacaggc

SEQ ID NO: 242015 - RNA, 20 nt, Homo sapiens
agcuggguguguuggugcau

SEQ ID NO: 242016 - RNA, 22 nt, Homo sapiens
agcugguccugugacuugcuuc

SEQ ID NO: 242017 - RNA, 22 nt, Homo sapiens
agcugguuuauuucuauauccu

SEQ ID NO: 242018 - RNA, 22 nt, Homo sapiens
agcuguuguuaauuaacucauu

SEQ ID NO: 242019 - RNA, 22 nt, Homo sapiens
agcuguuguuuuaagauacuaa

SEQ ID NO: 242020 - RNA, 22 nt, Homo sapiens
agcuucauuguuaugaauguca

SEQ ID NO: 242021 - RNA, 22 nt, Homo sapiens
agcuuguguuugucugccuggg

SEQ ID NO: 242022 - RNA, 22 nt, Homo sapiens
aggaaauguuggucccauuucu

SEQ ID NO: 242023 - RNA, 22 nt, Homo sapiens
aggaacuguaacuaugucucug

SEQ ID NO: 242024 - RNA, 22 nt, Homo sapiens
aggaaguaauaaguuugguucu

SEQ ID NO: 242025 - RNA, 23 nt, Homo sapiens
aggaauggaaaaccaaguaucau

SEQ ID NO: 242026 - RNA, 22 nt, Homo sapiens
cuaaagucacgauuugugggua

SEQ ID NO: 242027 - RNA, 22 nt, Homo sapiens
cuaaaugucucuacuaaguuua

SEQ ID NO: 242028 - RNA, 22 nt, Homo sapiens
cuaacuaugucucaggaugucc

SEQ ID NO: 242029 - RNA, 17 nt, Homo sapiens
cuaaggcaagagucugc

SEQ ID NO: 242030 - RNA, 22 nt, Homo sapiens
cuaagguaggagaaucacucaa

SEQ ID NO: 242031 - RNA, 22 nt, Homo sapiens
cuaauacaguuguccaagcugg

SEQ ID NO: 242032 - RNA, 22 nt, Homo sapiens
cuaauucuguaccuggcacaua

SEQ ID NO: 242033 - RNA, 22 nt, Homo sapiens
cuacagcagcccaguccccgaa

SEQ ID NO: 242034 - RNA, 22 nt, Homo sapiens
cuacaguaugaaaccuuuacuc

SEQ ID NO: 242035 - RNA, 23 nt, Homo sapiens
cuacagugccugucucuuuggcc

SEQ ID NO: 242036 - RNA, 22 nt, Homo sapiens
cuacaguucucaggaguuggcc

SEQ ID NO: 242037 - RNA, 22 nt, Homo sapiens
cuagaggcacagccuaggcacu

SEQ ID NO: 242038 - RNA, 22 nt, Homo sapiens
cuagcagaacaauacaauucgg

SEQ ID NO: 242039 - RNA, 22 nt, Homo sapiens
cuagcccagugcuccuggauca

SEQ ID NO: 242040 - RNA, 22 nt, Homo sapiens
cuagccuggagugcaguggugc

SEQ ID NO: 242041 - RNA, 22 nt, Homo sapiens
cuauaacagugugguuuggaga

SEQ ID NO: 242042 - RNA, 22 nt, Homo sapiens
cuauggcagccacggccuggag

SEQ ID NO: 242043 - RNA, 22 nt, Homo sapiens
cuaugguaggggcuggaggaag

SEQ ID NO: 242044 - RNA, 22 nt, Homo sapiens
cucaaagucaagggaaagcagg

SEQ ID NO: 242045 - RNA, 22 nt, Homo sapiens
cucaaagugcuaagauuaggcu

SEQ ID NO: 242046 - RNA, 22 nt, Homo sapiens
cucaaagugcugggacuggcug

SEQ ID NO: 242047 - RNA, 19 nt, Homo sapiens
cucaaagugguauuuggag

SEQ ID NO: 242048 - RNA, 22 nt, Homo sapiens
cucaaaugguccagcuaguggu

SEQ ID NO: 242049 - RNA, 22 nt, Homo sapiens
cucacagugacacgaaccccca

SEQ ID NO: 242050 - RNA, 22 nt, Homo sapiens
cucacaguucuaaaggcaagaa

SEQ ID NO: 242051 - RNA, 22 nt, Homo sapiens
cucaccuugugauccacccacc

SEQ ID NO: 242052 - RNA, 17 nt, Homo sapiens
cucacugagaacagcua

SEQ ID NO: 242053 - RNA, 22 nt, Homo sapiens
cucacugggaccacucugaagu

SEQ ID NO: 242054 - RNA, 22 nt, Homo sapiens
cucagagcacaguuuaugacag

SEQ ID NO: 242055 - RNA, 22 nt, Homo sapiens
cucagcuacuugggaagcugag

SEQ ID NO: 242056 - RNA, 22 nt, Homo sapiens
cucaggcacucugauuccagug

SEQ ID NO: 242057 - RNA, 22 nt, Homo sapiens
cucaggguacuucuccuuugcu

SEQ ID NO: 242058 - RNA, 22 nt, Homo sapiens
cucagugaagggcaagaggcaa

SEQ ID NO: 242059 - RNA, 22 nt, Homo sapiens
cucagugucuggcacacagaaa

SEQ ID NO: 242060 - RNA, 22 nt, Homo sapiens
cucaguguuucagcugcucaga

SEQ ID NO: 242061 - RNA, 19 nt, Homo sapiens
cucauggagaaggagaaua

SEQ ID NO: 242062 - RNA, 22 nt, Homo sapiens
cucauuggcuacugaggcuugu

SEQ ID NO: 242063 - RNA, 22 nt, Homo sapiens
cuccacugagcaggugggaggc

SEQ ID NO: 242064 - RNA, 22 nt, Homo sapiens
cuccauuuaguccuuuuagaag

SEQ ID NO: 242065 - RNA, 22 nt, Homo sapiens
cucccagagccaguuauaggcu

SEQ ID NO: 242066 - RNA, 22 nt, Homo sapiens
cuccccuuuaguuucuuaauaa

SEQ ID NO: 242067 - RNA, 23 nt, Homo sapiens
cucccugaacaugacacaccaga

SEQ ID NO: 242068 - RNA, 22 nt, Homo sapiens
cucucaagaugcugggauuaca

SEQ ID NO: 242069 - RNA, 22 nt, Homo sapiens
cucucaguguggaggccagaaa

SEQ ID NO: 242070 - RNA, 22 nt, Homo sapiens
cucugagccugagguuccuacu

SEQ ID NO: 242071 - RNA, 22 nt, Homo sapiens
cucugagguuauucguaauauu

SEQ ID NO: 242072 - RNA, 22 nt, Homo sapiens
cucugcuuaaugucccacuuga

SEQ ID NO: 242073 - RNA, 22 nt, Homo sapiens
cucugguggaagcagggggcaa

SEQ ID NO: 242074 - RNA, 22 nt, Homo sapiens
cucugguuuuucuuccauuaag

SEQ ID NO: 242075 - RNA, 22 nt, Homo sapiens
cugaaagagcauuugaaugggu

SEQ ID NO: 242076 - RNA, 22 nt, Homo sapiens
cugaaaguuauucaggggcaag

SEQ ID NO: 242077 - RNA, 22 nt, Homo sapiens
cugaaggcagguagaauagaga

SEQ ID NO: 242078 - RNA, 22 nt, Homo sapiens
cugaauguccaggcagagguuu

SEQ ID NO: 242079 - RNA, 22 nt, Homo sapiens
cugacaagauucaucacucagu

SEQ ID NO: 242080 - RNA, 22 nt, Homo sapiens
cugacugugcaugcccagcccc

SEQ ID NO: 242081 - RNA, 22 nt, Homo sapiens
cugagacuggugauuuaugaag

SEQ ID NO: 242082 - RNA, 22 nt, Homo sapiens
cugagagaggagcuaaaacugc

SEQ ID NO: 242083 - RNA, 22 nt, Homo sapiens
cugagaucaugggucagguggu

SEQ ID NO: 242084 - RNA, 22 nt, Homo sapiens
cugagaucguggggcugcuguc

SEQ ID NO: 242085 - RNA, 22 nt, Homo sapiens
cugagcaaagaagugauaauga

SEQ ID NO: 242086 - RNA, 22 nt, Homo sapiens
cugagcaauauagugagaucuu

SEQ ID NO: 242087 - RNA, 22 nt, Homo sapiens
cugagcaucauggcagaaucuu

SEQ ID NO: 242088 - RNA, 22 nt, Homo sapiens
cugagcccauucuggggagaag

SEQ ID NO: 242089 - RNA, 22 nt, Homo sapiens
cugaggacaucagggaagcauc

SEQ ID NO: 242090 - RNA, 22 nt, Homo sapiens
cugaggauauucagccucugug

SEQ ID NO: 242091 - RNA, 22 nt, Homo sapiens
cugaggugggagaaucacauaa

SEQ ID NO: 242092 - RNA, 22 nt, Homo sapiens
cugagguuguucuucucagugg

SEQ ID NO: 242093 - RNA, 22 nt, Homo sapiens
cugauacugagaccuuggguua

SEQ ID NO: 242094 - RNA, 22 nt, Homo sapiens
cugauauuuuucuggcuugugu

SEQ ID NO: 242095 - RNA, 22 nt, Homo sapiens
cugaucuguagcagccaccaca

SEQ ID NO: 242096 - RNA, 22 nt, Homo sapiens
cugauuguuugccucuaaaauc

SEQ ID NO: 242097 - RNA, 21 nt, Homo sapiens
cugcaaaugcugcugccugau

SEQ ID NO: 242098 - RNA, 22 nt, Homo sapiens
cugcagaucuuggggcuugcca

SEQ ID NO: 242099 - RNA, 22 nt, Homo sapiens
cugcauuggguuaugcauuuuu

SEQ ID NO: 242100 - RNA, 22 nt, Homo sapiens
cugcauuugaugacguauggug

SEQ ID NO: 242101 - RNA, 22 nt, Homo sapiens
cuggaaaguagacaaucuaaaa

SEQ ID NO: 242102 - RNA, 22 nt, Homo sapiens
cuggaaugugagccccaaaaag

SEQ ID NO: 242103 - RNA, 22 nt, Homo sapiens
cuggacguugaggcugcaguga

SEQ ID NO: 242104 - RNA, 22 nt, Homo sapiens
cuggaggccugaacauaaaugg

SEQ ID NO: 242105 - RNA, 19 nt, Homo sapiens
cuggcaaaugcuuuggcca

SEQ ID NO: 242106 - RNA, 22 nt, Homo sapiens
cuggcacagugucagaaacaca

SEQ ID NO: 242107 - RNA, 22 nt, Homo sapiens
cuggcuaagugcuugagugugc

SEQ ID NO: 242108 - RNA, 22 nt, Homo sapiens
cuggcucuguuagaagaaccag

SEQ ID NO: 242109 - RNA, 22 nt, Homo sapiens
cugguaugcuucauaugcaaac

SEQ ID NO: 242110 - RNA, 22 nt, Homo sapiens
cuguaaaguucucauuguagcc

SEQ ID NO: 242111 - RNA, 22 nt, Homo sapiens
cuguaacagaauaaauuuguuu

SEQ ID NO: 242112 - RNA, 22 nt, Homo sapiens
cugucuaugagccaggaagcca

SEQ ID NO: 242113 - RNA, 22 nt, Homo sapiens
cugugaacaugggagaaauggc

SEQ ID NO: 242114 - RNA, 22 nt, Homo sapiens
cugugaagaaagucauugguag

SEQ ID NO: 242115 - RNA, 22 nt, Homo sapiens
cugugauuauauaguuaaggua

SEQ ID NO: 242116 - RNA, 22 nt, Homo sapiens
cugugccaagcuugcgaugugc

SEQ ID NO: 242117 - RNA, 22 nt, Homo sapiens
cugugcuugauuauaugagugu

SEQ ID NO: 242118 - RNA, 22 nt, Homo sapiens
cugugguuuaaggaauuuugac

SEQ ID NO: 242119 - RNA, 22 nt, Homo sapiens
cuuaaggccagauaauuucuau

SEQ ID NO: 242120 - RNA, 22 nt, Homo sapiens
cuuacagucuaucagccacaac

SEQ ID NO: 242121 - RNA, 19 nt, Homo sapiens
cuuaggugaccaguuccca

SEQ ID NO: 242122 - RNA, 17 nt, Homo sapiens
cuucaaauaauuucccc

SEQ ID NO: 242123 - RNA, 22 nt, Homo sapiens
cuucacuuuguuaaacuccaau

SEQ ID NO: 242124 - RNA, 22 nt, Homo sapiens
cuuccugaguccugggcucaca

SEQ ID NO: 242125 - RNA, 22 nt, Homo sapiens
cuucggugaguagauggguuaa

SEQ ID NO: 242126 - RNA, 22 nt, Homo sapiens
cuugacaaugcuucaggcugaa

SEQ ID NO: 242127 - RNA, 22 nt, Homo sapiens
cuugagacauuguuuuccaagu

SEQ ID NO: 242128 - RNA, 22 nt, Homo sapiens
gaacugggguuggguugcgaua

SEQ ID NO: 242129 - RNA, 22 nt, Homo sapiens
gaacuguuucuggugaaagagu

SEQ ID NO: 242130 - RNA, 18 nt, Homo sapiens
gaagaaguaggcauggca

SEQ ID NO: 242131 - RNA, 22 nt, Homo sapiens
gaagagacagguucccacaaaa

SEQ ID NO: 242132 - RNA, 22 nt, Homo sapiens
gaaggcacugugugccacccug

SEQ ID NO: 242133 - RNA, 22 nt, Homo sapiens
gaaguaauaaauggauucuuaa

SEQ ID NO: 242134 - RNA, 22 nt, Homo sapiens
gaagugcuuuuggacuaacagu

SEQ ID NO: 242135 - RNA, 22 nt, Homo sapiens
gaagugguaggauugcuuuuga

SEQ ID NO: 242136 - RNA, 19 nt, Homo sapiens
gaaguguuuguucuccaug

SEQ ID NO: 242137 - RNA, 22 nt, Homo sapiens
gaauaaacuagagaggacugag

SEQ ID NO: 242138 - RNA, 22 nt, Homo sapiens
gaaucaauugaucuaugugucu

SEQ ID NO: 242139 - RNA, 22 nt, Homo sapiens
gaaucacagauuaugaguaucu

SEQ ID NO: 242140 - RNA, 22 nt, Homo sapiens
gaaugcuaagcaugugggaguu

SEQ ID NO: 242141 - RNA, 22 nt, Homo sapiens
gacacagugaagucucuacuug

SEQ ID NO: 242142 - RNA, 22 nt, Homo sapiens
gacaccauuucaguacuagguu

SEQ ID NO: 242143 - RNA, 18 nt, Homo sapiens
gacagugugaagauuccu

SEQ ID NO: 242144 - RNA, 18 nt, Homo sapiens
gacaguguggcaauuccu

SEQ ID NO: 242145 - RNA, 22 nt, Homo sapiens
gacaguguggcgauuccucaag

SEQ ID NO: 242146 - RNA, 17 nt, Homo sapiens
gacauaggaaaaggaga

SEQ ID NO: 242147 - RNA, 20 nt, Homo sapiens
gacauguugguuugcugcac

SEQ ID NO: 242148 - RNA, 22 nt, Homo sapiens
gacauguuuacaguguugagag

SEQ ID NO: 242149 - RNA, 22 nt, Homo sapiens
gacauguuuuuuaagguuuaug

SEQ ID NO: 242150 - RNA, 22 nt, Homo sapiens
gaccacagacuggaaagagggc

SEQ ID NO: 242151 - RNA, 22 nt, Homo sapiens
gacucuguagacaaucacaucu

SEQ ID NO: 242152 - RNA, 22 nt, Homo sapiens
gacugaggaagcgcucucuccu

SEQ ID NO: 242153 - RNA, 22 nt, Homo sapiens
gacuggagcuguaugugguuac

SEQ ID NO: 242154 - RNA, 22 nt, Homo sapiens
gacuggccauugauacagaggu

SEQ ID NO: 242155 - RNA, 22 nt, Homo sapiens
gacuggccuauaauggcgaauu

SEQ ID NO: 242156 - RNA, 20 nt, Homo sapiens
gacuucagaagcuucagagu

SEQ ID NO: 242157 - RNA, 20 nt, Homo sapiens
gacuugagagugggagagua

SEQ ID NO: 242158 - RNA, 22 nt, Homo sapiens
gagaacauuuaagccacucagg

SEQ ID NO: 242159 - RNA, 22 nt, Homo sapiens
gagaacugagugugcuggcgga

SEQ ID NO: 242160 - RNA, 22 nt, Homo sapiens
gagacauguuugccaauaauuu

SEQ ID NO: 242161 - RNA, 22 nt, Homo sapiens
gagacugagucucgcucugccg

SEQ ID NO: 242162 - RNA, 22 nt, Homo sapiens
gagagugcuuuggguguaggcc

SEQ ID NO: 242163 - RNA, 22 nt, Homo sapiens
gagauacacccagugcagaggc

SEQ ID NO: 242164 - RNA, 22 nt, Homo sapiens
gagaucauucugauccagaguc

SEQ ID NO: 242165 - RNA, 22 nt, Homo sapiens
gagaucuuggccaaguuucuua

SEQ ID NO: 242166 - RNA, 22 nt, Homo sapiens
gagaugaugagauguucacagu

SEQ ID NO: 242167 - RNA, 22 nt, Homo sapiens
gagaugugugugauuauauaau

SEQ ID NO: 242168 - RNA, 20 nt, Homo sapiens
gagauguugaucagggcuau

SEQ ID NO: 242169 - RNA, 22 nt, Homo sapiens
gagauuauuagauguucugcuu

SEQ ID NO: 242170 - RNA, 22 nt, Homo sapiens
gagcaacaguggcagugguggg

SEQ ID NO: 242171 - RNA, 22 nt, Homo sapiens
gagcaguugagagugcuggcca

SEQ ID NO: 242172 - RNA, 20 nt, Homo sapiens
gagcaucacaggccucugcu

SEQ ID NO: 242173 - RNA, 22 nt, Homo sapiens
gagcaucauucaacaaaagucu

SEQ ID NO: 242174 - RNA, 22 nt, Homo sapiens
gagcuagguuuugaauccagac

SEQ ID NO: 242175 - RNA, 22 nt, Homo sapiens
gagcugguccuuuaaggaugca

SEQ ID NO: 242176 - RNA, 22 nt, Homo sapiens
gagcuguuuuucacuagaccaa

SEQ ID NO: 242177 - RNA, 22 nt, Homo sapiens
gagcuuguggucuucguguuau

SEQ ID NO: 242178 - RNA, 22 nt, Homo sapiens
gaggcaaguggccaccgagucu

SEQ ID NO: 242179 - RNA, 22 nt, Homo sapiens
gaggcaaugugcccggcccaca

SEQ ID NO: 242180 - RNA, 22 nt, Homo sapiens
gagguaagaaagucaguccuuc

SEQ ID NO: 242181 - RNA, 22 nt, Homo sapiens
gagguaugauugacauauaaaa

SEQ ID NO: 242182 - RNA, 22 nt, Homo sapiens
gaggugaaggucucaauaaaua

SEQ ID NO: 242183 - RNA, 22 nt, Homo sapiens
gagguugggaugagggauacag

SEQ ID NO: 242184 - RNA, 22 nt, Homo sapiens
gaguaaaugucaaguacuuagg

SEQ ID NO: 242185 - RNA, 22 nt, Homo sapiens
gaguaaauguccuagcuucuug

SEQ ID NO: 242186 - RNA, 22 nt, Homo sapiens
gaguagugcugcaauaaacaua

SEQ ID NO: 242187 - RNA, 22 nt, Homo sapiens
gaguagugcuguaauaaacaua

SEQ ID NO: 242188 - RNA, 22 nt, Homo sapiens
gagucagugucuugcucuguca

SEQ ID NO: 242189 - RNA, 22 nt, Homo sapiens
gagugcaauggcgcgaucucgg

SEQ ID NO: 242190 - RNA, 22 nt, Homo sapiens
gagugcugagcccacuuccuug

SEQ ID NO: 242191 - RNA, 22 nt, Homo sapiens
gagugcuguuagcccuggguuu

SEQ ID NO: 242192 - RNA, 23 nt, Homo sapiens
gaguggagacucauugauuuccu

SEQ ID NO: 242193 - RNA, 22 nt, Homo sapiens
gaguucaaaucucagcucuguu

SEQ ID NO: 242194 - RNA, 22 nt, Homo sapiens
gaguucaauuuccagcuguucu

SEQ ID NO: 242195 - RNA, 22 nt, Homo sapiens
gauaguugugagaacucuuacu

SEQ ID NO: 242196 - RNA, 22 nt, Homo sapiens
gauauguaguaguugaaaaaga

SEQ ID NO: 242197 - RNA, 22 nt, Homo sapiens
gauauguucugagaaaugcauu

SEQ ID NO: 242198 - RNA, 22 nt, Homo sapiens
gaucacuuugaugccaggaacu

SEQ ID NO: 242199 - RNA, 22 nt, Homo sapiens
gaucccauuggcugccaugugg

SEQ ID NO: 242200 - RNA, 22 nt, Homo sapiens
gaucuggagguuuuccucauga

SEQ ID NO: 242201 - RNA, 22 nt, Homo sapiens
gaucugucuuuccuuauagucu

SEQ ID NO: 242202 - RNA, 22 nt, Homo sapiens
gaugaaacaucuuuggaaacug

SEQ ID NO: 242203 - RNA, 22 nt, Homo sapiens
gaugacagugaguaaccccaac

SEQ ID NO: 242204 - RNA, 22 nt, Homo sapiens
gaugagaucauaaguguggagc

SEQ ID NO: 242205 - RNA, 22 nt, Homo sapiens
gaugaggcuagagacaugugua

SEQ ID NO: 242206 - RNA, 22 nt, Homo sapiens
aaaagcauucagagugcugggc

SEQ ID NO: 242207 - RNA, 22 nt, Homo sapiens
aaacauugaccucauccuggca

SEQ ID NO: 242208 - RNA, 22 nt, Homo sapiens
aaaccaccauuacuuuugcacc

SEQ ID NO: 242209 - RNA, 15 nt, Homo sapiens
aaacccugucucaag

SEQ ID NO: 242210 - RNA, 22 nt, Homo sapiens
aaacucuguagcagagacagau

SEQ ID NO: 242211 - RNA, 22 nt, Homo sapiens
aaacuugucuaauuauaagcau

SEQ ID NO: 242212 - RNA, 22 nt, Homo sapiens
aaagaagucagccuguccuuug

SEQ ID NO: 242213 - RNA, 22 nt, Homo sapiens
aaagagaucuaugggcacuaug

SEQ ID NO: 242214 - RNA, 22 nt, Homo sapiens
aaagcagcaggugguuuucaau

SEQ ID NO: 242215 - RNA, 22 nt, Homo sapiens
aaaggcacuagaaguuaccuuu

SEQ ID NO: 242216 - RNA, 22 nt, Homo sapiens
aaaggcuucggaucagaaggua

SEQ ID NO: 242217 - RNA, 22 nt, Homo sapiens
aaagggcacugugcuuuggcaa

SEQ ID NO: 242218 - RNA, 22 nt, Homo sapiens
aaaguaauugcaguuuuugcaa

SEQ ID NO: 242219 - RNA, 22 nt, Homo sapiens
aaagugauguccaggcuuucag

SEQ ID NO: 242220 - RNA, 22 nt, Homo sapiens
aaagugcugagucuaggcgggg

SEQ ID NO: 242221 - RNA, 22 nt, Homo sapiens
aaagugcugggauuggcugggc

SEQ ID NO: 242222 - RNA, 22 nt, Homo sapiens
aaagugcuguagacugggcgca

SEQ ID NO: 242223 - RNA, 22 nt, Homo sapiens
aaagugcuuacuaaguugccaa

SEQ ID NO: 242224 - RNA, 22 nt, Homo sapiens
aaagugcuucucuuuggugggu

SEQ ID NO: 242225 - RNA, 22 nt, Homo sapiens
aaaguguguuuccaaccugugg

SEQ ID NO: 242226 - RNA, 22 nt, Homo sapiens
aaaguucugcguuagggcuaaa

SEQ ID NO: 242227 - RNA, 15 nt, Homo sapiens
aaauaugucaguucu

SEQ ID NO: 242228 - RNA, 22 nt, Homo sapiens
aaaugcacaaagauuuugcacu

SEQ ID NO: 242229 - RNA, 22 nt, Homo sapiens
aaaugcagcacucaagugggaa

SEQ ID NO: 242230 - RNA, 22 nt, Homo sapiens
aaaugcaugaauaagcucgugu

SEQ ID NO: 242231 - RNA, 22 nt, Homo sapiens
aaaugcaugaggugggaagaaa

SEQ ID NO: 242232 - RNA, 22 nt, Homo sapiens
aaaugcuguuccaggaccuauc

SEQ ID NO: 242233 - RNA, 22 nt, Homo sapiens
aaaugcuuucuuggaccauuug

SEQ ID NO: 242234 - RNA, 22 nt, Homo sapiens
aaauggcuuugaggguaggaca

SEQ ID NO: 242235 - RNA, 22 nt, Homo sapiens
aaaugguguuaguagaucuuua

SEQ ID NO: 242236 - RNA, 22 nt, Homo sapiens
aaaugucauggaguguuucccc

SEQ ID NO: 242237 - RNA, 22 nt, Homo sapiens
aaauuguccuauugguuuaagc

SEQ ID NO: 242238 - RNA, 22 nt, Homo sapiens
aacacggcccgcagagcaagcu

SEQ ID NO: 242239 - RNA, 22 nt, Homo sapiens
aacagagcuggugacuccaggu

SEQ ID NO: 242240 - RNA, 22 nt, Homo sapiens
aacagcacacccgcugcuucca

SEQ ID NO: 242241 - RNA, 22 nt, Homo sapiens
aacaggguggugccugguccau

SEQ ID NO: 242242 - RNA, 22 nt, Homo sapiens
aacaggguguuugcaguuucuu

SEQ ID NO: 242243 - RNA, 20 nt, Homo sapiens
aacaguguguaaguuuccuu

SEQ ID NO: 242244 - RNA, 22 nt, Homo sapiens
aacauugaacuuggcacaccca

SEQ ID NO: 242245 - RNA, 22 nt, Homo sapiens
aacccugagucaugagucuaga

SEQ ID NO: 242246 - RNA, 22 nt, Homo sapiens
aacucugucuccuucaaguuca

SEQ ID NO: 242247 - RNA, 22 nt, Homo sapiens
aacugcacauauuuguaugggu

SEQ ID NO: 242248 - RNA, 22 nt, Homo sapiens
aacugcacuaggacagguuuuu

SEQ ID NO: 242249 - RNA, 22 nt, Homo sapiens
aacugcauuuucugauugugug

SEQ ID NO: 242250 - RNA, 22 nt, Homo sapiens
aacuggccuccuugggaaauua

SEQ ID NO: 242251 - RNA, 22 nt, Homo sapiens
aagagaacugacaguaccuggg

SEQ ID NO: 242252 - RNA, 22 nt, Homo sapiens
aagagcauuauuuaguaauuuc

SEQ ID NO: 242253 - RNA, 22 nt, Homo sapiens
aagagccgcaagggugaagggu

SEQ ID NO: 242254 - RNA, 22 nt, Homo sapiens
aagaggcuguaggauaaugccu

SEQ ID NO: 242255 - RNA, 22 nt, Homo sapiens
aagagguagcagucacaaaaga

SEQ ID NO: 242256 - RNA, 23 nt, Homo sapiens
aagagguaugacuaugaagugga

SEQ ID NO: 242257 - RNA, 22 nt, Homo sapiens
aagagguuauagaguguauacu

SEQ ID NO: 242258 - RNA, 22 nt, Homo sapiens
aagaguaguaguggcacucucu

SEQ ID NO: 242259 - RNA, 22 nt, Homo sapiens
aagaugauguucuuuuucuuag

SEQ ID NO: 242260 - RNA, 22 nt, Homo sapiens
aagcaacacaucugccccgguu

SEQ ID NO: 242261 - RNA, 22 nt, Homo sapiens
aagcaucacauaauggaucaug

SEQ ID NO: 242262 - RNA, 22 nt, Homo sapiens
aagcaucacuggaggcagccau

SEQ ID NO: 242263 - RNA, 22 nt, Homo sapiens
aagcaucauuuggaauuugaga

SEQ ID NO: 242264 - RNA, 22 nt, Homo sapiens
aagccagugugacaggaaacuu

SEQ ID NO: 242265 - RNA, 22 nt, Homo sapiens
aagcuacuuuggugguuccuua

SEQ ID NO: 242266 - RNA, 22 nt, Homo sapiens
aagcuaggguuaauuuauuauu

SEQ ID NO: 242267 - RNA, 22 nt, Homo sapiens
aagcuagugagacagugguacu

SEQ ID NO: 242268 - RNA, 22 nt, Homo sapiens
aagcucuuguugaaucuuguca

SEQ ID NO: 242269 - RNA, 22 nt, Homo sapiens
aagcugcauuuucuagaugcuu

SEQ ID NO: 242270 - RNA, 22 nt, Homo sapiens
aagcugccaggcaugguggcug

SEQ ID NO: 242271 - RNA, 22 nt, Homo sapiens
aagcugccuugugaaggcauuc

SEQ ID NO: 242272 - RNA, 22 nt, Homo sapiens
aagcuggcauucaugagauuac

SEQ ID NO: 242273 - RNA, 22 nt, Homo sapiens
aagcuggcauucauucguucuu

SEQ ID NO: 242274 - RNA, 22 nt, Homo sapiens
aagcuggcuuucauugagugcu

SEQ ID NO: 242275 - RNA, 22 nt, Homo sapiens
aagcuguguguaagcucucaca

SEQ ID NO: 242276 - RNA, 22 nt, Homo sapiens
aaggaauucaaauuuucucugg

SEQ ID NO: 242277 - RNA, 22 nt, Homo sapiens
aaggagcagagagcccuguuuc

SEQ ID NO: 242278 - RNA, 22 nt, Homo sapiens
aaggaguagacaacauggcgcc

SEQ ID NO: 242279 - RNA, 22 nt, Homo sapiens
aaggaguagaggaauagcaaug

SEQ ID NO: 242280 - RNA, 22 nt, Homo sapiens
aaggaguauugaaugaccaagu

SEQ ID NO: 242281 - RNA, 22 nt, Homo sapiens
aaggagugugauucuucaguuu

SEQ ID NO: 242282 - RNA, 22 nt, Homo sapiens
aaggauuguaaaguugacaaau

SEQ ID NO: 242283 - RNA, 22 nt, Homo sapiens
aaggcgguguggauccuacagc

SEQ ID NO: 242284 - RNA, 22 nt, Homo sapiens
aaggcuguucauuuagcacagu

SEQ ID NO: 242285 - RNA, 22 nt, Homo sapiens
aaggugcucucuuauguagaaa

SEQ ID NO: 242286 - RNA, 22 nt, Homo sapiens
aagguggugucagagagcuuau

SEQ ID NO: 242287 - RNA, 22 nt, Homo sapiens
aagguucuugcuugcaugacug

SEQ ID NO: 242288 - RNA, 22 nt, Homo sapiens
aaguacuguuuaaauugcagaa

SEQ ID NO: 242289 - RNA, 22 nt, Homo sapiens
aaguagcagaggcaagacuuga

SEQ ID NO: 242290 - RNA, 22 nt, Homo sapiens
aaguagugcuugugcucaucuc

SEQ ID NO: 242291 - RNA, 22 nt, Homo sapiens
uuaaguuaggcuucagcagucu

SEQ ID NO: 242292 - RNA, 22 nt, Homo sapiens
uuaaucaggccguuuccuaaga

SEQ ID NO: 242293 - RNA, 22 nt, Homo sapiens
uuaauguaauugauugauugac

SEQ ID NO: 242294 - RNA, 22 nt, Homo sapiens
uuacagauggcacacucaaggg

SEQ ID NO: 242295 - RNA, 22 nt, Homo sapiens
uuacagcagugccccacuccca

SEQ ID NO: 242296 - RNA, 22 nt, Homo sapiens
uuacagucaccugggggacaua

SEQ ID NO: 242297 - RNA, 22 nt, Homo sapiens
uuacaguggugaccuuguauug

SEQ ID NO: 242298 - RNA, 22 nt, Homo sapiens
uuacagugguugcuauugugaa

SEQ ID NO: 242299 - RNA, 19 nt, Homo sapiens
uuacagugugcccuuuuag

SEQ ID NO: 242300 - RNA, 22 nt, Homo sapiens
uuacaugucuugguaagguuag

SEQ ID NO: 242301 - RNA, 22 nt, Homo sapiens
uuacauugcuucaaauucagug

SEQ ID NO: 242302 - RNA, 22 nt, Homo sapiens
uuaccucagaccugcucugugu

SEQ ID NO: 242303 - RNA, 22 nt, Homo sapiens
uuacuagaacauuuagggaacu

SEQ ID NO: 242304 - RNA, 22 nt, Homo sapiens
uuacugcauaauuccugggaag

SEQ ID NO: 242305 - RNA, 22 nt, Homo sapiens
uuacuguauagaaucaucuuga

SEQ ID NO: 242306 - RNA, 17 nt, Homo sapiens
uuagacagacauccugc

SEQ ID NO: 242307 - RNA, 22 nt, Homo sapiens
uuagacaguggugcacugcacu

SEQ ID NO: 242308 - RNA, 20 nt, Homo sapiens
uuagaguaguaugauuuaua

SEQ ID NO: 242309 - RNA, 22 nt, Homo sapiens
uuagauguuugacugggccuua

SEQ ID NO: 242310 - RNA, 22 nt, Homo sapiens
uuagauuauugguguuuugcaa

SEQ ID NO: 242311 - RNA, 22 nt, Homo sapiens
uuagcacaguucauucauguua

SEQ ID NO: 242312 - RNA, 22 nt, Homo sapiens
uuagcacuugggaguauuuauu

SEQ ID NO: 242313 - RNA, 20 nt, Homo sapiens
uuagcagcaugauuuauaau

SEQ ID NO: 242314 - RNA, 22 nt, Homo sapiens
uuagcagcucuaauaacugcua

SEQ ID NO: 242315 - RNA, 22 nt, Homo sapiens
uuagcagcucuggugacaaggu

SEQ ID NO: 242316 - RNA, 22 nt, Homo sapiens
uuagcagugugaaaaaagacua

SEQ ID NO: 242317 - RNA, 22 nt, Homo sapiens
uuaggacaauguucguuuuuug

SEQ ID NO: 242318 - RNA, 22 nt, Homo sapiens
uuaggaucacagaaaauccucu

SEQ ID NO: 242319 - RNA, 21 nt, Homo sapiens
uuaggcagugucagaggugag

SEQ ID NO: 242320 - RNA, 22 nt, Homo sapiens
uuagggaguaaucuaaaaaugg

SEQ ID NO: 242321 - RNA, 22 nt, Homo sapiens
uuagguaggugcuuuuuucaca

SEQ ID NO: 242322 - RNA, 22 nt, Homo sapiens
uuagguauuuuguuaugucagc

SEQ ID NO: 242323 - RNA, 22 nt, Homo sapiens
uuaggucaucgcuguccuucag

SEQ ID NO: 242324 - RNA, 22 nt, Homo sapiens
uuaguagcacagaguaucagca

SEQ ID NO: 242325 - RNA, 22 nt, Homo sapiens
uuagugaaugcaccacuucuga

SEQ ID NO: 242326 - RNA, 22 nt, Homo sapiens
uuagugaaugggugugauuugu

SEQ ID NO: 242327 - RNA, 21 nt, Homo sapiens
uuagugcucaguuugacaaaa

SEQ ID NO: 242328 - RNA, 22 nt, Homo sapiens
uuauaaacaugaagauuugggg

SEQ ID NO: 242329 - RNA, 22 nt, Homo sapiens
uuauaacagagacuccugugcu

SEQ ID NO: 242330 - RNA, 22 nt, Homo sapiens
uuauaacucugcagccugguau

SEQ ID NO: 242331 - RNA, 22 nt, Homo sapiens
uuauacucgucugaaugauucu

SEQ ID NO: 242332 - RNA, 19 nt, Homo sapiens
uuauacuguauuguuuagg

SEQ ID NO: 242333 - RNA, 22 nt, Homo sapiens
uuauauguuagacauggugggu

SEQ ID NO: 242334 - RNA, 22 nt, Homo sapiens
uuaucaaacccuaggagguggu

SEQ ID NO: 242335 - RNA, 22 nt, Homo sapiens
uuaucagcagcaugaaacugga

SEQ ID NO: 242336 - RNA, 22 nt, Homo sapiens
uuaugcagcaaagugcuugaaa

SEQ ID NO: 242337 - RNA, 22 nt, Homo sapiens
uuaugcuuauugguguacggua

SEQ ID NO: 242338 - RNA, 22 nt, Homo sapiens
uuaugucuuugagcaaugcugu

SEQ ID NO: 242339 - RNA, 22 nt, Homo sapiens
uucaaaaccucugcuuaagccc

SEQ ID NO: 242340 - RNA, 22 nt, Homo sapiens
uucaaaggauuuagauuagcua

SEQ ID NO: 242341 - RNA, 22 nt, Homo sapiens
uucaaaguaaaaauguguucac

SEQ ID NO: 242342 - RNA, 22 nt, Homo sapiens
uucaaaguaaagggauggagac

SEQ ID NO: 242343 - RNA, 22 nt, Homo sapiens
uucaaaguguugguuuugggcu

SEQ ID NO: 242344 - RNA, 23 nt, Homo sapiens
uucaaauguucucugguugucag

SEQ ID NO: 242345 - RNA, 22 nt, Homo sapiens
uucaaauguucuuucaccaccc

SEQ ID NO: 242346 - RNA, 22 nt, Homo sapiens
uucaaguagguaggaccacagg

SEQ ID NO: 242347 - RNA, 22 nt, Homo sapiens
uucaaguaguucucaugccuca

SEQ ID NO: 242348 - RNA, 22 nt, Homo sapiens
uucaagucaauuuuugaaugac

SEQ ID NO: 242349 - RNA, 22 nt, Homo sapiens
uucacagccgcaccccaucacu

SEQ ID NO: 242350 - RNA, 20 nt, Homo sapiens
uucacaggcagcuucuuucu

SEQ ID NO: 242351 - RNA, 22 nt, Homo sapiens
uucacaguacucccuggaauua

SEQ ID NO: 242352 - RNA, 22 nt, Homo sapiens
uucacagugugaucuaugggca

SEQ ID NO: 242353 - RNA, 22 nt, Homo sapiens
uucaccaguuuugucacgaaug

SEQ ID NO: 242354 - RNA, 22 nt, Homo sapiens
uucaccuguagcaugcccuugg

SEQ ID NO: 242355 - RNA, 22 nt, Homo sapiens
uucacugcaugaaaaggacagc

SEQ ID NO: 242356 - RNA, 22 nt, Homo sapiens
ucucaaguggucgcaguuagau

SEQ ID NO: 242357 - RNA, 22 nt, Homo sapiens
ucucacagccauuucucccucu

SEQ ID NO: 242358 - RNA, 22 nt, Homo sapiens
ucucagcacagucagggcgccu

SEQ ID NO: 242359 - RNA, 22 nt, Homo sapiens
ucucagugugguaaaaguuuuu

SEQ ID NO: 242360 - RNA, 20 nt, Homo sapiens
ucucauagagguagagaaua

SEQ ID NO: 242361 - RNA, 21 nt, Homo sapiens
ucucauagaguuucacuuucu

SEQ ID NO: 242362 - RNA, 20 nt, Homo sapiens
ucucauggagguagagaaua

SEQ ID NO: 242363 - RNA, 22 nt, Homo sapiens
ucucauggagguagagaguaaa

SEQ ID NO: 242364 - RNA, 22 nt, Homo sapiens
ucucauggagucaggagcagaa

SEQ ID NO: 242365 - RNA, 23 nt, Homo sapiens
ucucauuccuugaaaauaaugac

SEQ ID NO: 242366 - RNA, 22 nt, Homo sapiens
ucuccaguuuccuucgucuauc

SEQ ID NO: 242367 - RNA, 22 nt, Homo sapiens
ucucugauuauugcauuucauu

SEQ ID NO: 242368 - RNA, 22 nt, Homo sapiens
ucucugguuuguggaaucuuag

SEQ ID NO: 242369 - RNA, 22 nt, Homo sapiens
ucucuguuuauuuuugguguau

SEQ ID NO: 242370 - RNA, 19 nt, Homo sapiens
ucugacagccccagucaac

SEQ ID NO: 242371 - RNA, 23 nt, Homo sapiens
ucugauguuauaaaauucuuugg

SEQ ID NO: 242372 - RNA, 22 nt, Homo sapiens
ucugccuacugagcacacagug

SEQ ID NO: 242373 - RNA, 23 nt, Homo sapiens
ucugcggguguggacccuagugc

SEQ ID NO: 242374 - RNA, 22 nt, Homo sapiens
ucuggccccucccaaaucucau

SEQ ID NO: 242375 - RNA, 20 nt, Homo sapiens
ucuggccccucuaaaucuca

SEQ ID NO: 242376 - RNA, 22 nt, Homo sapiens
ucuggccuacaaguaauuuuau

SEQ ID NO: 242377 - RNA, 22 nt, Homo sapiens
ucuggcuuugugaguugccaga

SEQ ID NO: 242378 - RNA, 22 nt, Homo sapiens
ucugggguuuccacuuuuacuu

SEQ ID NO: 242379 - RNA, 22 nt, Homo sapiens
ucuggguuuuguaccgugcucg

SEQ ID NO: 242380 - RNA, 22 nt, Homo sapiens
ucuggguuuuuccauugccggu

SEQ ID NO: 242381 - RNA, 22 nt, Homo sapiens
ucugguguuacugagccuccca

SEQ ID NO: 242382 - RNA, 22 nt, Homo sapiens
ucugguguuauucauguaguuu

SEQ ID NO: 242383 - RNA, 19 nt, Homo sapiens
ucuguaguuagggcuacag

SEQ ID NO: 242384 - RNA, 22 nt, Homo sapiens
ucugucuuugccuaaguuuguc

SEQ ID NO: 242385 - RNA, 22 nt, Homo sapiens
ucugugaaaucauuuccuguaa

SEQ ID NO: 242386 - RNA, 22 nt, Homo sapiens
ucugugcauuguaggauguuua

SEQ ID NO: 242387 - RNA, 22 nt, Homo sapiens
ucuuaguuuagauuagcaauuc

SEQ ID NO: 242388 - RNA, 22 nt, Homo sapiens
ucuucagucauauuggccugga

SEQ ID NO: 242389 - RNA, 22 nt, Homo sapiens
ucuucuagcggaacccucuugu

SEQ ID NO: 242390 - RNA, 22 nt, Homo sapiens
ucuugaacuucauaggucuaga

SEQ ID NO: 242391 - RNA, 19 nt, Homo sapiens
ucuugcacaugugaacuca

SEQ ID NO: 242392 - RNA, 21 nt, Homo sapiens
ucuuggguugaauucucccag

SEQ ID NO: 242393 - RNA, 20 nt, Homo sapiens
ucuugguuggaggucuuuua

SEQ ID NO: 242394 - RNA, 22 nt, Homo sapiens
ucuuugauuaugcagauggguu

SEQ ID NO: 242395 - RNA, 22 nt, Homo sapiens
ucuuugauuuuguuacuaagac

SEQ ID NO: 242396 - RNA, 19 nt, Homo sapiens
ucuuugcuuuucuaagagg

SEQ ID NO: 242397 - RNA, 22 nt, Homo sapiens
ucuuugguaugugcaugugcuu

SEQ ID NO: 242398 - RNA, 22 nt, Homo sapiens
ucuuuggucuacuuucauaugu

SEQ ID NO: 242399 - RNA, 22 nt, Homo sapiens
ucuuuggugaauggucauccag

SEQ ID NO: 242400 - RNA, 22 nt, Homo sapiens
ucuuugguuagguuuaguugau

SEQ ID NO: 242401 - RNA, 22 nt, Homo sapiens
ucuuuuguaaaaugaggaggug

SEQ ID NO: 242402 - RNA, 20 nt, Homo sapiens
ucuuuuuguggccccagagu

SEQ ID NO: 242403 - RNA, 22 nt, Homo sapiens
ugaaaagucuaagauuaagguu

SEQ ID NO: 242404 - RNA, 22 nt, Homo sapiens
ugaaacacacagagaagggaga

SEQ ID NO: 242405 - RNA, 22 nt, Homo sapiens
ugaaacauacacucugaugggg

SEQ ID NO: 242406 - RNA, 22 nt, Homo sapiens
ugaaauaguuaaguugccuagu

SEQ ID NO: 242407 - RNA, 20 nt, Homo sapiens
ugaaaucuucacuaagucuc

SEQ ID NO: 242408 - RNA, 22 nt, Homo sapiens
ugaaaugauuauaugguguuug

SEQ ID NO: 242409 - RNA, 22 nt, Homo sapiens
ugaaaugccuuuaaugaauuua

SEQ ID NO: 242410 - RNA, 22 nt, Homo sapiens
ugaaauggaaagaguguagacu

SEQ ID NO: 242411 - RNA, 22 nt, Homo sapiens
ugaaauguaaguugucuagucu

SEQ ID NO: 242412 - RNA, 22 nt, Homo sapiens
ugaacagagaaacacuggccau

SEQ ID NO: 242413 - RNA, 20 nt, Homo sapiens
ugaacugguuacuuucuguc

SEQ ID NO: 242414 - RNA, 22 nt, Homo sapiens
ugaagacucauacuugaaucag

SEQ ID NO: 242415 - RNA, 22 nt, Homo sapiens
ugggcaagugacuuggcuucuc

SEQ ID NO: 242416 - RNA, 22 nt, Homo sapiens
ugggcauggaguggccuuaugu

SEQ ID NO: 242417 - RNA, 22 nt, Homo sapiens
uggguaggcccucauuggacag

SEQ ID NO: 242418 - RNA, 23 nt, Homo sapiens
uggguucauucuugaagucagug

SEQ ID NO: 242419 - RNA, 22 nt, Homo sapiens
ugguaauguaauuuggagaagg

SEQ ID NO: 242420 - RNA, 22 nt, Homo sapiens
uggucaaaugccaaucuguagu

SEQ ID NO: 242421 - RNA, 22 nt, Homo sapiens
uggucauggaaauagaaugcac

SEQ ID NO: 242422 - RNA, 22 nt, Homo sapiens
ugguccacuaacccucaguauc

SEQ ID NO: 242423 - RNA, 22 nt, Homo sapiens
uggucuuuucaacaaaugguau

SEQ ID NO: 242424 - RNA, 22 nt, Homo sapiens
uggugagaaaugagaugcuuuu

SEQ ID NO: 242425 - RNA, 22 nt, Homo sapiens
ugguguuugagaagcugauguc

SEQ ID NO: 242426 - RNA, 18 nt, Homo sapiens
uguaaacuaccucaaccu

SEQ ID NO: 242427 - RNA, 22 nt, Homo sapiens
uguaauguuugguagguuaggu

SEQ ID NO: 242428 - RNA, 22 nt, Homo sapiens
uguacaaauuucugugguggug

SEQ ID NO: 242429 - RNA, 22 nt, Homo sapiens
uguacaugggacaggaggagag

SEQ ID NO: 242430 - RNA, 22 nt, Homo sapiens
uguagacaccaaagacagcaua

SEQ ID NO: 242431 - RNA, 21 nt, Homo sapiens
uguagcagcauaauuuauaau

SEQ ID NO: 242432 - RNA, 21 nt, Homo sapiens
uguagcagcaugauucauagu

SEQ ID NO: 242433 - RNA, 22 nt, Homo sapiens
uguagguguacauacaugguua

SEQ ID NO: 242434 - RNA, 22 nt, Homo sapiens
uguauacauauguauguuuugu

SEQ ID NO: 242435 - RNA, 22 nt, Homo sapiens
uguauacugucuaauauguugu

SEQ ID NO: 242436 - RNA, 22 nt, Homo sapiens
uguauaggcaaauuuccucaug

SEQ ID NO: 242437 - RNA, 22 nt, Homo sapiens
uguauguaaagacaggauaaca

SEQ ID NO: 242438 - RNA, 22 nt, Homo sapiens
uguauguaauugaaguuaaguu

SEQ ID NO: 242439 - RNA, 22 nt, Homo sapiens
uguaugucuucuuuagauaagu

SEQ ID NO: 242440 - RNA, 22 nt, Homo sapiens
uguauguuuaaggccaguggaa

SEQ ID NO: 242441 - RNA, 22 nt, Homo sapiens
uguauugcuugaagagugaauu

SEQ ID NO: 242442 - RNA, 22 nt, Homo sapiens
uguauuuguuguuaaauggaga

SEQ ID NO: 242443 - RNA, 22 nt, Homo sapiens
ugucaaaugcagugauauuuga

SEQ ID NO: 242444 - RNA, 22 nt, Homo sapiens
ugucaacauuuaucaaguuauu

SEQ ID NO: 242445 - RNA, 22 nt, Homo sapiens
ugucaaugggaauuuguuuuag

SEQ ID NO: 242446 - RNA, 22 nt, Homo sapiens
ugucagaaucugagacgacaac

SEQ ID NO: 242447 - RNA, 22 nt, Homo sapiens
ugucaggaggguccagagaaaa

SEQ ID NO: 242448 - RNA, 22 nt, Homo sapiens
ugucaggaguuuuagaaucuua

SEQ ID NO: 242449 - RNA, 22 nt, Homo sapiens
ugucagggaggcucggccgcac

SEQ ID NO: 242450 - RNA, 22 nt, Homo sapiens
ugucaguggucuggaugcagcc

SEQ ID NO: 242451 - RNA, 22 nt, Homo sapiens
ugucaguguaugagccccggau

SEQ ID NO: 242452 - RNA, 22 nt, Homo sapiens
ugucaguuucuugagauggaac

SEQ ID NO: 242453 - RNA, 22 nt, Homo sapiens
ugucauagaugauuuuuuucgg

SEQ ID NO: 242454 - RNA, 23 nt, Homo sapiens
ugucaucaagaugaggucacacu

SEQ ID NO: 242455 - RNA, 22 nt, Homo sapiens
ugucaucuagguuuuaagccuu

SEQ ID NO: 242456 - RNA, 22 nt, Homo sapiens
ugucaugucuuuguguaucaau

SEQ ID NO: 242457 - RNA, 22 nt, Homo sapiens
ugucauucaggaaauucuaagu

SEQ ID NO: 242458 - RNA, 22 nt, Homo sapiens
ugucccugagccuggauuccug

SEQ ID NO: 242459 - RNA, 18 nt, Homo sapiens
ugucccuuugcuguucau

SEQ ID NO: 242460 - RNA, 22 nt, Homo sapiens
uguccugaagcuuuguuaugua

SEQ ID NO: 242461 - RNA, 22 nt, Homo sapiens
uguccuggugaugcccaaauuc

SEQ ID NO: 242462 - RNA, 22 nt, Homo sapiens
ugucucaguucccuucucugga

SEQ ID NO: 242463 - RNA, 22 nt, Homo sapiens
ugucucccuucccauuaggaag

SEQ ID NO: 242464 - RNA, 22 nt, Homo sapiens
ugucuggaguccauagaagugu

SEQ ID NO: 242465 - RNA, 22 nt, Homo sapiens
ugugaaauguuaucccgucgug

SEQ ID NO: 242466 - RNA, 20 nt, Homo sapiens
ugugaacuguagauagucuu

SEQ ID NO: 242467 - RNA, 22 nt, Homo sapiens
ugugaagaaagucauugguagc

SEQ ID NO: 242468 - RNA, 19 nt, Homo sapiens
ugugaagaaaugcugcaag

SEQ ID NO: 242469 - RNA, 22 nt, Homo sapiens
ugugaagauguuucuuaauuga

SEQ ID NO: 242470 - RNA, 23 nt, Homo sapiens
ugugacacuuccgucaguucauu

SEQ ID NO: 242471 - RNA, 22 nt, Homo sapiens
ugugacagguauccuguguucu

SEQ ID NO: 242472 - RNA, 18 nt, Homo sapiens
ugugacauugagcauguc

SEQ ID NO: 242473 - RNA, 19 nt, Homo sapiens
ugugacugguugucucgcu

SEQ ID NO: 242474 - RNA, 22 nt, Homo sapiens
ugugagacugacagggcagggu

SEQ ID NO: 242475 - RNA, 22 nt, Homo sapiens
ugugagacugguucugaaccca

SEQ ID NO: 242476 - RNA, 22 nt, Homo sapiens
ugugagaucucagaauugaacu

SEQ ID NO: 242477 - RNA, 22 nt, Homo sapiens
ugugagcuauggaguuguagag

SEQ ID NO: 242478 - RNA, 22 nt, Homo sapiens
ugugaugaagaguccaagaaca

SEQ ID NO: 242479 - RNA, 22 nt, Homo sapiens
cacuagagaauagguaguucug

SEQ ID NO: 242480 - RNA, 22 nt, Homo sapiens
cacugcacuccagucccgucuc

SEQ ID NO: 242481 - RNA, 22 nt, Homo sapiens
cacugcauccuccaccugccag

SEQ ID NO: 242482 - RNA, 22 nt, Homo sapiens
cacugcauggucuagcuggguu

SEQ ID NO: 242483 - RNA, 22 nt, Homo sapiens
cacugcauuacucaugagcaug

SEQ ID NO: 242484 - RNA, 22 nt, Homo sapiens
cacugggugccauauguuugcu

SEQ ID NO: 242485 - RNA, 22 nt, Homo sapiens
cagacaugucuuguggccgugg

SEQ ID NO: 242486 - RNA, 22 nt, Homo sapiens
cagagaacauucagagcuguag

SEQ ID NO: 242487 - RNA, 22 nt, Homo sapiens
cagagguauugcaaaagccuag

SEQ ID NO: 242488 - RNA, 22 nt, Homo sapiens
cagccgggugagguggcuuguu

SEQ ID NO: 242489 - RNA, 22 nt, Homo sapiens
cagcuaaauuguuaaauccaag

SEQ ID NO: 242490 - RNA, 20 nt, Homo sapiens
cagcuagugguaggagucgg

SEQ ID NO: 242491 - RNA, 22 nt, Homo sapiens
cagcucauugcagucucgaccu

SEQ ID NO: 242492 - RNA, 22 nt, Homo sapiens
cagcugcuuuggaaaauauuuu

SEQ ID NO: 242493 - RNA, 22 nt, Homo sapiens
cagcugguggcaagaagacaga

SEQ ID NO: 242494 - RNA, 22 nt, Homo sapiens
cagcuguguuauaaacuaccau

SEQ ID NO: 242495 - RNA, 22 nt, Homo sapiens
cagcuguuguuaugucugcagg

SEQ ID NO: 242496 - RNA, 22 nt, Homo sapiens
cagcuugugguauugcugguug

SEQ ID NO: 242497 - RNA, 22 nt, Homo sapiens
caggcacgcuugggagacacac

SEQ ID NO: 242498 - RNA, 22 nt, Homo sapiens
caggcagucuggcucccaagug

SEQ ID NO: 242499 - RNA, 22 nt, Homo sapiens
caggcagugggagacaaaacug

SEQ ID NO: 242500 - RNA, 22 nt, Homo sapiens
cagggaauguuauuuaauagca

SEQ ID NO: 242501 - RNA, 22 nt, Homo sapiens
cagggcaugugggucuauuggc

SEQ ID NO: 242502 - RNA, 22 nt, Homo sapiens
cagggcauuggcugguaccugg

SEQ ID NO: 242503 - RNA, 22 nt, Homo sapiens
caguaguagccccuuagaugga

SEQ ID NO: 242504 - RNA, 20 nt, Homo sapiens
cagucaugaagaacugugag

SEQ ID NO: 242505 - RNA, 20 nt, Homo sapiens
cagugcacuuucccacuggu

SEQ ID NO: 242506 - RNA, 22 nt, Homo sapiens
cagugcauccauguucagcagu

SEQ ID NO: 242507 - RNA, 22 nt, Homo sapiens
caguuacuuuugcaccaaccua

SEQ ID NO: 242508 - RNA, 22 nt, Homo sapiens
caguucaugguaggcaccauag

SEQ ID NO: 242509 - RNA, 21 nt, Homo sapiens
cauaaugcuacuuauuuuaug

SEQ ID NO: 242510 - RNA, 22 nt, Homo sapiens
cauacaagcuacaaucacaaag

SEQ ID NO: 242511 - RNA, 22 nt, Homo sapiens
cauauucacuuuacagagcugu

SEQ ID NO: 242512 - RNA, 23 nt, Homo sapiens
caucacagagccuuccuugacuc

SEQ ID NO: 242513 - RNA, 22 nt, Homo sapiens
caucacaucugcaugguaagua

SEQ ID NO: 242514 - RNA, 22 nt, Homo sapiens
caucccauucgaggggcacagc

SEQ ID NO: 242515 - RNA, 21 nt, Homo sapiens
cauccccugccauuguggucu

SEQ ID NO: 242516 - RNA, 22 nt, Homo sapiens
caugacacauguuuaccuaugu

SEQ ID NO: 242517 - RNA, 22 nt, Homo sapiens
caugcauuggucuauuauguga

SEQ ID NO: 242518 - RNA, 22 nt, Homo sapiens
caugccacugcacgccauccug

SEQ ID NO: 242519 - RNA, 22 nt, Homo sapiens
caugccauugcucuccugggug

SEQ ID NO: 242520 - RNA, 22 nt, Homo sapiens
cauggcacugagcagguaugca

SEQ ID NO: 242521 - RNA, 22 nt, Homo sapiens
cauggcccuggguccauaggaa

SEQ ID NO: 242522 - RNA, 22 nt, Homo sapiens
caugucuuuuaaacauucaacu

SEQ ID NO: 242523 - RNA, 22 nt, Homo sapiens
caugugcaugagcacauacgug

SEQ ID NO: 242524 - RNA, 22 nt, Homo sapiens
caugugcaugcuuucuuaugug

SEQ ID NO: 242525 - RNA, 22 nt, Homo sapiens
cauugcaaugaggucuugcagu

SEQ ID NO: 242526 - RNA, 22 nt, Homo sapiens
cauugcacuccagccugaguga

SEQ ID NO: 242527 - RNA, 22 nt, Homo sapiens
cauugcacuccagccuuggcaa

SEQ ID NO: 242528 - RNA, 22 nt, Homo sapiens
cauugcacuccagcucugggcg

SEQ ID NO: 242529 - RNA, 22 nt, Homo sapiens
cauugcacuccauccuuggcaa

SEQ ID NO: 242530 - RNA, 22 nt, Homo sapiens
cauugcacugcauucugggcaa

SEQ ID NO: 242531 - RNA, 22 nt, Homo sapiens
cauugcaugccagccugggcaa

SEQ ID NO: 242532 - RNA, 20 nt, Homo sapiens
cauugcccuccagccugggc

SEQ ID NO: 242533 - RNA, 22 nt, Homo sapiens
cauugcuuuuggugguuuagac

SEQ ID NO: 242534 - RNA, 22 nt, Homo sapiens
cauugggugagaacaugcuccu

SEQ ID NO: 242535 - RNA, 22 nt, Homo sapiens
cauugguuccaguuuguccuua

SEQ ID NO: 242536 - RNA, 22 nt, Homo sapiens
cauuuugcaguuucugucucca

SEQ ID NO: 242537 - RNA, 22 nt, Homo sapiens
ccaaaucucauguugaaaugug

SEQ ID NO: 242538 - RNA, 22 nt, Homo sapiens
ccaaggaauacccucccuuuuu

SEQ ID NO: 242539 - RNA, 22 nt, Homo sapiens
ccaagugcuuaaaauuucauuu

SEQ ID NO: 242540 - RNA, 23 nt, Homo sapiens
ccacaaugguugaacuagauuac

SEQ ID NO: 242541 - RNA, 22 nt, Homo sapiens
ccaccgggucccagcucugcuc

SEQ ID NO: 242542 - RNA, 22 nt, Homo sapiens
ccaguauugaacacaaugaaag

SEQ ID NO: 242543 - RNA, 22 nt, Homo sapiens
ccagucuuggugucuguagcac

SEQ ID NO: 242544 - RNA, 22 nt, Homo sapiens
ccagugauggcugccucauuug

SEQ ID NO: 242545 - RNA, 18 nt, Homo sapiens
ccagugcaaggaaagccc

SEQ ID NO: 242546 - RNA, 22 nt, Homo sapiens
ccagugguucccuguggccuga

SEQ ID NO: 242547 - RNA, 20 nt, Homo sapiens
ccaguguuauuuauguucua

SEQ ID NO: 242548 - RNA, 22 nt, Homo sapiens
ccaguuuucaagauaaugguuu

SEQ ID NO: 242549 - RNA, 22 nt, Homo sapiens
ucacagccuaguuuuauacauu

SEQ ID NO: 242550 - RNA, 18 nt, Homo sapiens
ucacagguaaaguugaca

SEQ ID NO: 242551 - RNA, 22 nt, Homo sapiens
ucacaguagccccucccaucau

SEQ ID NO: 242552 - RNA, 22 nt, Homo sapiens
ucacaguauucaugaacaugga

SEQ ID NO: 242553 - RNA, 22 nt, Homo sapiens
ucacagucaaaguaaucauaga

SEQ ID NO: 242554 - RNA, 22 nt, Homo sapiens
ucacagugaguggaguggggug

SEQ ID NO: 242555 - RNA, 22 nt, Homo sapiens
ucacaugaagauuuuaguauac

SEQ ID NO: 242556 - RNA, 22 nt, Homo sapiens
ucacauuguauauguaccuauc

SEQ ID NO: 242557 - RNA, 22 nt, Homo sapiens
ucacauuguuauguaaauguuu

SEQ ID NO: 242558 - RNA, 22 nt, Homo sapiens
ucaccaccuuccaggaccacug

SEQ ID NO: 242559 - RNA, 22 nt, Homo sapiens
ucaccggcagacguggccugau

SEQ ID NO: 242560 - RNA, 22 nt, Homo sapiens
ucaccuggggaucuuguuuaca

SEQ ID NO: 242561 - RNA, 22 nt, Homo sapiens
ucaccuugcacaguuguguggg

SEQ ID NO: 242562 - RNA, 22 nt, Homo sapiens
ucacgugguucauaaggcagaa

SEQ ID NO: 242563 - RNA, 22 nt, Homo sapiens
ucacuaggcuggagugcagugg

SEQ ID NO: 242564 - RNA, 22 nt, Homo sapiens
ucacuauugacaacagugugga

SEQ ID NO: 242565 - RNA, 22 nt, Homo sapiens
ucacugaaaccuccgccuucug

SEQ ID NO: 242566 - RNA, 22 nt, Homo sapiens
ucacugagaaugauguuucuga

SEQ ID NO: 242567 - RNA, 21 nt, Homo sapiens
ucacugagguuaaauaggguu

SEQ ID NO: 242568 - RNA, 20 nt, Homo sapiens
ucacugagugguccacagua

SEQ ID NO: 242569 - RNA, 22 nt, Homo sapiens
ucacugcacucuccgccuugcg

SEQ ID NO: 242570 - RNA, 19 nt, Homo sapiens
ucacuggacagcacacuca

SEQ ID NO: 242571 - RNA, 22 nt, Homo sapiens
ucacuggacucuagccugggug

SEQ ID NO: 242572 - RNA, 22 nt, Homo sapiens
ucacuggaggagaggaagugga

SEQ ID NO: 242573 - RNA, 22 nt, Homo sapiens
ucacuggagguuccugaaguuc

SEQ ID NO: 242574 - RNA, 22 nt, Homo sapiens
ucacugggagaccaaagccauc

SEQ ID NO: 242575 - RNA, 22 nt, Homo sapiens
ucacugugagaguuuauccugu

SEQ ID NO: 242576 - RNA, 22 nt, Homo sapiens
ucacugugcaugaaggaugcug

SEQ ID NO: 242577 - RNA, 22 nt, Homo sapiens
ucacuguggaacucaaaaagcu

SEQ ID NO: 242578 - RNA, 22 nt, Homo sapiens
ucacugugugucucuguaucug

SEQ ID NO: 242579 - RNA, 22 nt, Homo sapiens
ucacuuggccgcagccuucucu

SEQ ID NO: 242580 - RNA, 22 nt, Homo sapiens
ucagaauguaacuuuaguugga

SEQ ID NO: 242581 - RNA, 22 nt, Homo sapiens
ucagaguagaaacacuuccaua

SEQ ID NO: 242582 - RNA, 22 nt, Homo sapiens
ucagaguggagucugcagccuu

SEQ ID NO: 242583 - RNA, 22 nt, Homo sapiens
ucagaguggccucucuugaaga

SEQ ID NO: 242584 - RNA, 22 nt, Homo sapiens
ucagaucauauucuucgcugcu

SEQ ID NO: 242585 - RNA, 22 nt, Homo sapiens
ucagaucauuaagguagguuua

SEQ ID NO: 242586 - RNA, 22 nt, Homo sapiens
ucagaucuucagcaggggcccc

SEQ ID NO: 242587 - RNA, 22 nt, Homo sapiens
ucagaugauuccguugacgaga

SEQ ID NO: 242588 - RNA, 22 nt, Homo sapiens
ucagaugauucuguuguugugu

SEQ ID NO: 242589 - RNA, 22 nt, Homo sapiens
ucagauguuuuguuuaucugcu

SEQ ID NO: 242590 - RNA, 22 nt, Homo sapiens
ucagcagugagagaccucaccc

SEQ ID NO: 242591 - RNA, 22 nt, Homo sapiens
ucagcagugugaaaauggacua

SEQ ID NO: 242592 - RNA, 22 nt, Homo sapiens
ucagcaucacgugggcucccgu

SEQ ID NO: 242593 - RNA, 20 nt, Homo sapiens
ucagguagaucuuugagguc

SEQ ID NO: 242594 - RNA, 23 nt, Homo sapiens
ucagguaggccuagaguauucuu

SEQ ID NO: 242595 - RNA, 22 nt, Homo sapiens
ucagguaucucuauagcaaugu

SEQ ID NO: 242596 - RNA, 22 nt, Homo sapiens
ucagguauuucuuuuagcugug

SEQ ID NO: 242597 - RNA, 22 nt, Homo sapiens
ucaggucauuccaggagggcca

SEQ ID NO: 242598 - RNA, 22 nt, Homo sapiens
ucaggugcagagaagaaauggg

SEQ ID NO: 242599 - RNA, 22 nt, Homo sapiens
ucagguugcuaaguauaauauu

SEQ ID NO: 242600 - RNA, 22 nt, Homo sapiens
ucaguccccucgcugagucuac

SEQ ID NO: 242601 - RNA, 22 nt, Homo sapiens
ucagugaauauauaacagcgau

SEQ ID NO: 242602 - RNA, 20 nt, Homo sapiens
ucagugcagauuguccaagu

SEQ ID NO: 242603 - RNA, 21 nt, Homo sapiens
ucagugcugugggcaaggugc

SEQ ID NO: 242604 - RNA, 22 nt, Homo sapiens
ucaguggagccucacucugugg

SEQ ID NO: 242605 - RNA, 23 nt, Homo sapiens
ucagugucuggauccugcucagu

SEQ ID NO: 242606 - RNA, 22 nt, Homo sapiens
ucaguuuguauuucagguugca

SEQ ID NO: 242607 - RNA, 22 nt, Homo sapiens
ucauacuguccaauucuagugg

SEQ ID NO: 242608 - RNA, 22 nt, Homo sapiens
ucauauugguuaaaauaguggg

SEQ ID NO: 242609 - RNA, 22 nt, Homo sapiens
ucauccauacaguuagcaaagg

SEQ ID NO: 242610 - RNA, 22 nt, Homo sapiens
ucaucuggcgaaugugaagagu

SEQ ID NO: 242611 - RNA, 22 nt, Homo sapiens
ucauggcuuuuauuauguugag

SEQ ID NO: 242612 - RNA, 22 nt, Homo sapiens
ucauggggugagcuacaggcac

SEQ ID NO: 242613 - RNA, 22 nt, Homo sapiens
ucaugucuuguuguauuuauuu

SEQ ID NO: 242614 - RNA, 22 nt, Homo sapiens
ucaugugagcaaguugggcuca

SEQ ID NO: 242615 - RNA, 22 nt, Homo sapiens
ucaugugaggauaacaauagug

SEQ ID NO: 242616 - RNA, 22 nt, Homo sapiens
ucauucauucauccagcuugag

SEQ ID NO: 242617 - RNA, 22 nt, Homo sapiens
ucauugcauuccagcccaagca

SEQ ID NO: 242618 - RNA, 22 nt, Homo sapiens
uccacaauggcugaacuagauu

SEQ ID NO: 242619 - RNA, 22 nt, Homo sapiens
uccaguguuccucagucacccc

SEQ ID NO: 242620 - RNA, 22 nt, Homo sapiens
uccaguuuggaggcuugaugug

SEQ ID NO: 242621 - RNA, 20 nt, Homo sapiens
uccaguuuuggagacauucu

SEQ ID NO: 242622 - RNA, 22 nt, Homo sapiens
uccauuuguucagcuucaggaa

SEQ ID NO: 242623 - RNA, 22 nt, Homo sapiens
ucccagucuagagccggauugg

SEQ ID NO: 242624 - RNA, 22 nt, Homo sapiens
ucccagugcuaugcaaaagccu

SEQ ID NO: 242625 - RNA, 22 nt, Homo sapiens
ucccaguuuuucugaauaguca

SEQ ID NO: 242626 - RNA, 22 nt, Homo sapiens
ucccauguagcuaggauuacag

SEQ ID NO: 242627 - RNA, 22 nt, Homo sapiens
ucccauugucucugaccuugcc

SEQ ID NO: 242628 - RNA, 23 nt, Homo sapiens
uccccgggagcaccagcuuguug

SEQ ID NO: 242629 - RNA, 22 nt, Homo sapiens
uccccugagucaccugcuucuc

SEQ ID NO: 242630 - RNA, 22 nt, Homo sapiens
uccccuuuguaagauggaaacg

SEQ ID NO: 242631 - RNA, 22 nt, Homo sapiens
ucccuagagaagugauuuuuga

SEQ ID NO: 242632 - RNA, 22 nt, Homo sapiens
ucccugaaaaauuggcuuaaca

SEQ ID NO: 242633 - RNA, 22 nt, Homo sapiens
ucccugaacacauguugagaag

SEQ ID NO: 242634 - RNA, 22 nt, Homo sapiens
ucccugacagggucugagcuuu

SEQ ID NO: 242635 - RNA, 22 nt, Homo sapiens
ucccugacagucacagagcuac

SEQ ID NO: 242636 - RNA, 22 nt, Homo sapiens
ucccugagguccuggauuauug

SEQ ID NO: 242637 - RNA, 22 nt, Homo sapiens
ucccuggagcaagagaagaagg

SEQ ID NO: 242638 - RNA, 22 nt, Homo sapiens
ucccuguagugccuagaucaga

SEQ ID NO: 242639 - RNA, 22 nt, Homo sapiens
ucccuugagccuggcuucucac

SEQ ID NO: 242640 - RNA, 19 nt, Homo sapiens
ucccuuuguagguaaccug

SEQ ID NO: 242641 - RNA, 19 nt, Homo sapiens
ucccuuuguauggacauac

SEQ ID NO: 242642 - RNA, 22 nt, Homo sapiens
uccucauggagaaccucugcua

SEQ ID NO: 242643 - RNA, 22 nt, Homo sapiens
uccugagaauagaguugcaugu

SEQ ID NO: 242644 - RNA, 22 nt, Homo sapiens
uccugagacugaggagcuuugg

SEQ ID NO: 242645 - RNA, 22 nt, Homo sapiens
uccuucaguccaguggguuuug

SEQ ID NO: 242646 - RNA, 22 nt, Homo sapiens
uccuucauuugucaacucuagu

SEQ ID NO: 242647 - RNA, 22 nt, Homo sapiens
uccuugcacuaacuuaaggagg

SEQ ID NO: 242648 - RNA, 22 nt, Homo sapiens
uccuuggucaaaaagaaagugu

SEQ ID NO: 242649 - RNA, 22 nt, Homo sapiens
uccuuggucauggaagagacag

SEQ ID NO: 242650 - RNA, 22 nt, Homo sapiens
uccuuuggucaguauucuuuug

SEQ ID NO: 242651 - RNA, 22 nt, Homo sapiens
cugauaaguuuuucuuuauaag

SEQ ID NO: 242652 - RNA, 20 nt, Homo sapiens
cugcaaaugcugcugcugau

SEQ ID NO: 242653 - RNA, 22 nt, Homo sapiens
cugcagguaggggcagcuuugg

SEQ ID NO: 242654 - RNA, 22 nt, Homo sapiens
cugcaguaaccacuguaggugu

SEQ ID NO: 242655 - RNA, 22 nt, Homo sapiens
cugcagucaucugaagauuuug

SEQ ID NO: 242656 - RNA, 18 nt, Homo sapiens
cugccagugugcucuccg

SEQ ID NO: 242657 - RNA, 22 nt, Homo sapiens
cugccaguuugauucgggccac

SEQ ID NO: 242658 - RNA, 22 nt, Homo sapiens
cugcccuuucuauaugauguaa

SEQ ID NO: 242659 - RNA, 22 nt, Homo sapiens
cugcuguuguuaacuuuuggag

SEQ ID NO: 242660 - RNA, 22 nt, Homo sapiens
cuggaaagaaacccuuaauucu

SEQ ID NO: 242661 - RNA, 22 nt, Homo sapiens
cuggaagaaaaucacgccaucu

SEQ ID NO: 242662 - RNA, 22 nt, Homo sapiens
cuggaguaugauguuagcguug

SEQ ID NO: 242663 - RNA, 22 nt, Homo sapiens
cuggauguaaaugaaacuacag

SEQ ID NO: 242664 - RNA, 22 nt, Homo sapiens
cuggcaaauguuuucuguaaag

SEQ ID NO: 242665 - RNA, 22 nt, Homo sapiens
cuggcaccauacacuguuguug

SEQ ID NO: 242666 - RNA, 22 nt, Homo sapiens
cuggcccaguucugcguuuugc

SEQ ID NO: 242667 - RNA, 22 nt, Homo sapiens
cuggcucugggcuaaagaaaua

SEQ ID NO: 242668 - RNA, 22 nt, Homo sapiens
cugggaucaguucuagucagaa

SEQ ID NO: 242669 - RNA, 22 nt, Homo sapiens
cugggcaaugcggcuggauaga

SEQ ID NO: 242670 - RNA, 22 nt, Homo sapiens
cugggucaguuucugauuauug

SEQ ID NO: 242671 - RNA, 22 nt, Homo sapiens
cuggugugugacuuuucauuau

SEQ ID NO: 242672 - RNA, 22 nt, Homo sapiens
cugguuuguaaaguuccugaga

SEQ ID NO: 242673 - RNA, 23 nt, Homo sapiens
cuguacacauauacaucuaagua

SEQ ID NO: 242674 - RNA, 22 nt, Homo sapiens
cuguagcuuuuauaugcuuagc

SEQ ID NO: 242675 - RNA, 22 nt, Homo sapiens
cuguaugugagaaauaauaagu

SEQ ID NO: 242676 - RNA, 22 nt, Homo sapiens
cugucacaguuuuggaggccag

SEQ ID NO: 242677 - RNA, 22 nt, Homo sapiens
cugucucagccucuccaguagc

SEQ ID NO: 242678 - RNA, 22 nt, Homo sapiens
cugucuggaggccugcaaauaa

SEQ ID NO: 242679 - RNA, 22 nt, Homo sapiens
cugucuggaguccuucgugugc

SEQ ID NO: 242680 - RNA, 22 nt, Homo sapiens
cugugacugcagggcauauuug

SEQ ID NO: 242681 - RNA, 22 nt, Homo sapiens
cugugauagguuagucaugaau

SEQ ID NO: 242682 - RNA, 22 nt, Homo sapiens
cugugaucuuuuuucauguggu

SEQ ID NO: 242683 - RNA, 22 nt, Homo sapiens
ucggcucagugcaagcucugcc

SEQ ID NO: 242684 - RNA, 22 nt, Homo sapiens
ucuaaaguacuacuacuguugg

SEQ ID NO: 242685 - RNA, 22 nt, Homo sapiens
ucuaaguaguagcuggucagaa

SEQ ID NO: 242686 - RNA, 22 nt, Homo sapiens
ucuagaugaaguauaaaguagu

SEQ ID NO: 242687 - RNA, 22 nt, Homo sapiens
ucuauugguaggggcugaggca

SEQ ID NO: 242688 - RNA, 22 nt, Homo sapiens
ucucaagaugguagaugggaau

SEQ ID NO: 242689 - RNA, 22 nt, Homo sapiens
ucucacacugaauguguguggg

SEQ ID NO: 242690 - RNA, 18 nt, Homo sapiens
ucucacagcaaucuguca

SEQ ID NO: 242691 - RNA, 22 nt, Homo sapiens
ucucagcacaaacaaaauugcu

SEQ ID NO: 242692 - RNA, 22 nt, Homo sapiens
ucucaguggugcuggcagggga

SEQ ID NO: 242693 - RNA, 22 nt, Homo sapiens
ucucccuaccugagccgagcca

SEQ ID NO: 242694 - RNA, 22 nt, Homo sapiens
ucucugauuaaacaagauagug

SEQ ID NO: 242695 - RNA, 22 nt, Homo sapiens
ucugagaucaugucugugcugu

SEQ ID NO: 242696 - RNA, 22 nt, Homo sapiens
ucugagguuaaauuuuauaguu

SEQ ID NO: 242697 - RNA, 22 nt, Homo sapiens
ucugaguggcagaaugagcuga

SEQ ID NO: 242698 - RNA, 22 nt, Homo sapiens
ucugccuuuucaugugggaugg

SEQ ID NO: 242699 - RNA, 22 nt, Homo sapiens
ucuggauuuuugaggcaauaua

SEQ ID NO: 242700 - RNA, 22 nt, Homo sapiens
ucuggccccucucaaaucucau

SEQ ID NO: 242701 - RNA, 22 nt, Homo sapiens
ucuggccuacaucauuuuuccg

SEQ ID NO: 242702 - RNA, 22 nt, Homo sapiens
ucuggccuagaacaauuaauua

SEQ ID NO: 242703 - RNA, 22 nt, Homo sapiens
ucuggccuccuaugagaaucga

SEQ ID NO: 242704 - RNA, 22 nt, Homo sapiens
ucuggcuccaaagucuauuuuu

SEQ ID NO: 242705 - RNA, 17 nt, Homo sapiens
ucuggcuuucacaccug

SEQ ID NO: 242706 - RNA, 20 nt, Homo sapiens
ucuggguuuuggccacgccc

SEQ ID NO: 242707 - RNA, 22 nt, Homo sapiens
ucuggucccugcacauauuuuc

SEQ ID NO: 242708 - RNA, 22 nt, Homo sapiens
ucuguacuuccguaccuaaagu

SEQ ID NO: 242709 - RNA, 22 nt, Homo sapiens
ucugucacugaaucccugucac

SEQ ID NO: 242710 - RNA, 19 nt, Homo sapiens
ucugucacuggggguauuc

SEQ ID NO: 242711 - RNA, 22 nt, Homo sapiens
ucugucuugugguuugagugcc

SEQ ID NO: 242712 - RNA, 22 nt, Homo sapiens
ucugugaaugaacacuugaaaa

SEQ ID NO: 242713 - RNA, 22 nt, Homo sapiens
ucugugaaugugaccuuauuug

SEQ ID NO: 242714 - RNA, 22 nt, Homo sapiens
ucugugcauggcagaggaauga

SEQ ID NO: 242715 - RNA, 22 nt, Homo sapiens
ucugugcauuguaacaacuaaa

SEQ ID NO: 242716 - RNA, 22 nt, Homo sapiens
ucugugcugagaguugaaaguu

SEQ ID NO: 242717 - RNA, 22 nt, Homo sapiens
ucugugcuugucauaugcuuug

SEQ ID NO: 242718 - RNA, 22 nt, Homo sapiens
ucugugguucaaaccagcaacu

SEQ ID NO: 242719 - RNA, 22 nt, Homo sapiens
ucugugguuguugcauggaaug

SEQ ID NO: 242720 - RNA, 21 nt, Homo sapiens
ucuguguugaucucacuggga

SEQ ID NO: 242721 - RNA, 22 nt, Homo sapiens
ucuguguuugaucaagauugua

SEQ ID NO: 242722 - RNA, 22 nt, Homo sapiens
ucuguuguuaucauaauauuga

SEQ ID NO: 242723 - RNA, 22 nt, Homo sapiens
ucuuaggugggccaucacccca

SEQ ID NO: 242724 - RNA, 22 nt, Homo sapiens
ucuucaugcuugaaauaauagc

SEQ ID NO: 242725 - RNA, 17 nt, Homo sapiens
ucuucuguuacuguggc

SEQ ID NO: 242726 - RNA, 20 nt, Homo sapiens
ucuugaacuuagucaacagg

SEQ ID NO: 242727 - RNA, 22 nt, Homo sapiens
ucuugaacuucugcacacucag

SEQ ID NO: 242728 - RNA, 22 nt, Homo sapiens
ucuugcacacaguaaguguuuu

SEQ ID NO: 242729 - RNA, 22 nt, Homo sapiens
ucuugcaccuacaugcuuuguc

SEQ ID NO: 242730 - RNA, 22 nt, Homo sapiens
ucuugcaguucccaaauucaca

SEQ ID NO: 242731 - RNA, 22 nt, Homo sapiens
ucuugcuuuugcagagcuucuc

SEQ ID NO: 242732 - RNA, 22 nt, Homo sapiens
ucuuggguggauucauucuuuc

SEQ ID NO: 242733 - RNA, 22 nt, Homo sapiens
ucuuggguuugccuugcugcug

SEQ ID NO: 242734 - RNA, 22 nt, Homo sapiens
ucuuggguuuguccuucuccua

SEQ ID NO: 242735 - RNA, 22 nt, Homo sapiens
ucuugguugaaaauucauaaua

SEQ ID NO: 242736 - RNA, 22 nt, Homo sapiens
ucuugguuuauugauggagagg

SEQ ID NO: 242737 - RNA, 22 nt, Homo sapiens
ucuugucacugcauccccagcu

SEQ ID NO: 242738 - RNA, 22 nt, Homo sapiens
ucuuuaguaauuucuguaaggc

SEQ ID NO: 242739 - RNA, 22 nt, Homo sapiens
ucuuugaguguauacuuagauu

SEQ ID NO: 242740 - RNA, 22 nt, Homo sapiens
ucuuugaguuauugugcagacu

SEQ ID NO: 242741 - RNA, 22 nt, Homo sapiens
ucuuuggaggcgaucuguuuga

SEQ ID NO: 242742 - RNA, 22 nt, Homo sapiens
ucuuuggauggaaauuggaguc

SEQ ID NO: 242743 - RNA, 22 nt, Homo sapiens
ucuuuggucaucaugggaagca

SEQ ID NO: 242744 - RNA, 22 nt, Homo sapiens
ucuuugguuguuuagggugcau

SEQ ID NO: 242745 - RNA, 22 nt, Homo sapiens
ucuuugucuacauccuguuaaa

SEQ ID NO: 242746 - RNA, 22 nt, Homo sapiens
ucuuuguugcauaggcuuguuc

SEQ ID NO: 242747 - RNA, 22 nt, Homo sapiens
ucuuuguuuucugauccugaag

SEQ ID NO: 242748 - RNA, 22 nt, Homo sapiens
ucuuuugggccucuugucagac

SEQ ID NO: 242749 - RNA, 22 nt, Homo sapiens
ucuuuuggguauggagccauca

SEQ ID NO: 242750 - RNA, 22 nt, Homo sapiens
ugaaagacugaaagcuuuucuu

SEQ ID NO: 242751 - RNA, 22 nt, Homo sapiens
ugaaagguauagguucuggagg

SEQ ID NO: 242752 - RNA, 22 nt, Homo sapiens
ugaaagguuuaauucugugaga

SEQ ID NO: 242753 - RNA, 22 nt, Homo sapiens
ugaaauacuuaauuucuccaug

SEQ ID NO: 242754 - RNA, 22 nt, Homo sapiens
ugaaaucuaaaauguuccaaga

SEQ ID NO: 242755 - RNA, 22 nt, Homo sapiens
ugaaaugcagaacuuuaggucu

SEQ ID NO: 242756 - RNA, 22 nt, Homo sapiens
ugaaaugccuugagauuuugac

SEQ ID NO: 242757 - RNA, 22 nt, Homo sapiens
ugaaaugcuaauucguagcuaa

SEQ ID NO: 242758 - RNA, 22 nt, Homo sapiens
ugaaauguuaaacaaguggcuc

SEQ ID NO: 242759 - RNA, 22 nt, Homo sapiens
ugaaauguugggugauggaauc

SEQ ID NO: 242760 - RNA, 22 nt, Homo sapiens
ugaaauuauucuuaccaaggug

SEQ ID NO: 242761 - RNA, 22 nt, Homo sapiens
ugaacugagacuagacuuguuc

SEQ ID NO: 242762 - RNA, 22 nt, Homo sapiens
ugaagacucaauuauuaugaac

SEQ ID NO: 242763 - RNA, 22 nt, Homo sapiens
ugaagagucuaaaucugucuuc

SEQ ID NO: 242764 - RNA, 22 nt, Homo sapiens
ugaagaucauacugguggaggg

SEQ ID NO: 242765 - RNA, 22 nt, Homo sapiens
ugaagaucuuaggagcugaggg

SEQ ID NO: 242766 - RNA, 22 nt, Homo sapiens
ugaaggacauaaggcagaguga

SEQ ID NO: 242767 - RNA, 22 nt, Homo sapiens
ugaagggcauuguuuugccaaa

SEQ ID NO: 242768 - RNA, 22 nt, Homo sapiens
ugaagugaaugguaaguaugcc

SEQ ID NO: 242769 - RNA, 21 nt, Homo sapiens
ugaauacugcugcucccuuug

SEQ ID NO: 242770 - RNA, 22 nt, Homo sapiens
ugaauagaaguggcaggaguag

SEQ ID NO: 242771 - RNA, 22 nt, Homo sapiens
ugaauauagacagggguagaga

SEQ ID NO: 242772 - RNA, 22 nt, Homo sapiens
ugaauauguuucuaaaagugca

SEQ ID NO: 242773 - RNA, 22 nt, Homo sapiens
ugaauguacacgcguacuuguu

SEQ ID NO: 242774 - RNA, 22 nt, Homo sapiens
ugaauguccugacgcugcaguu

SEQ ID NO: 242775 - RNA, 21 nt, Homo sapiens
ugaaugucuaggcagaaguuu

SEQ ID NO: 242776 - RNA, 22 nt, Homo sapiens
ugaauguuugcagcuuauacca

SEQ ID NO: 242777 - RNA, 22 nt, Homo sapiens
ugaauucuguccaaaauaacug

SEQ ID NO: 242778 - RNA, 22 nt, Homo sapiens
ugacaagagaccccuccgcagg

SEQ ID NO: 242779 - RNA, 17 nt, Homo sapiens
ugacagaaacuuguugu

SEQ ID NO: 242780 - RNA, 18 nt, Homo sapiens
ugacagcacaugugggga

SEQ ID NO: 242781 - RNA, 22 nt, Homo sapiens
ugacaggucuaauuuacugaca

SEQ ID NO: 242782 - RNA, 22 nt, Homo sapiens
ugacagguugauaggugcagca

SEQ ID NO: 242783 - RNA, 22 nt, Homo sapiens
ugacaguguccucauucccaac

SEQ ID NO: 242784 - RNA, 22 nt, Homo sapiens
ugacaguguccuccuccugaga

SEQ ID NO: 242785 - RNA, 22 nt, Homo sapiens
uuuuuugguaauugaacaauga

SEQ ID NO: 242786 - RNA, 22 nt, Homo sapiens
cacugcauccucugccuggcgg

SEQ ID NO: 242787 - RNA, 22 nt, Homo sapiens
cacugcauccuugaccuucugg

SEQ ID NO: 242788 - RNA, 22 nt, Homo sapiens
cacugcauucuccaccucccag

SEQ ID NO: 242789 - RNA, 22 nt, Homo sapiens
cacugggugagauccauguuua

SEQ ID NO: 242790 - RNA, 21 nt, Homo sapiens
cacuggguucaggcuugugga

SEQ ID NO: 242791 - RNA, 21 nt, Homo sapiens
cacugguguugcuauaucaaa

SEQ ID NO: 242792 - RNA, 22 nt, Homo sapiens
cacuuugguucaccugaguuuc

SEQ ID NO: 242793 - RNA, 22 nt, Homo sapiens
cagacagugucccgagucccug

SEQ ID NO: 242794 - RNA, 22 nt, Homo sapiens
cagagagcuugcccuuguauau

SEQ ID NO: 242795 - RNA, 22 nt, Homo sapiens
cagagguaagcaagucagcauu

SEQ ID NO: 242796 - RNA, 22 nt, Homo sapiens
cagaucaucuugagcuuaggaa

SEQ ID NO: 242797 - RNA, 22 nt, Homo sapiens
cagauggucuuaaggcagccuu

SEQ ID NO: 242798 - RNA, 22 nt, Homo sapiens
cagcaucauucaucugggguaa

SEQ ID NO: 242799 - RNA, 22 nt, Homo sapiens
cagcccuacacagacugacuca

SEQ ID NO: 242800 - RNA, 20 nt, Homo sapiens
cagcuaccugggaaauuugg

SEQ ID NO: 242801 - RNA, 22 nt, Homo sapiens
caggcauuguccaugcugaagg

SEQ ID NO: 242802 - RNA, 22 nt, Homo sapiens
caggcuuuuccacacauggguu

SEQ ID NO: 242803 - RNA, 22 nt, Homo sapiens
cagggcauugucuucuuaguac

SEQ ID NO: 242804 - RNA, 22 nt, Homo sapiens
cagguacaugcaugugugugca

SEQ ID NO: 242805 - RNA, 22 nt, Homo sapiens
cugaggugggaggauuacuuga

SEQ ID NO: 242806 - RNA, 22 nt, Homo sapiens
cugaggugggaggauuggcuug

SEQ ID NO: 242807 - RNA, 22 nt, Homo sapiens
cugaucuggaggugucugggga

SEQ ID NO: 242808 - RNA, 22 nt, Homo sapiens
cugauuguagagccccagggcu

SEQ ID NO: 242809 - RNA, 22 nt, Homo sapiens
cugauugucaucaauauuauua

SEQ ID NO: 242810 - RNA, 22 nt, Homo sapiens
cugauugugcagagguguaauu

SEQ ID NO: 242811 - RNA, 22 nt, Homo sapiens
cugcaauggagaaagugagacu

SEQ ID NO: 242812 - RNA, 22 nt, Homo sapiens
cugcaauguuugaaauggcaaa

SEQ ID NO: 242813 - RNA, 19 nt, Homo sapiens
cugcacugagaaaaggagg

SEQ ID NO: 242814 - RNA, 21 nt, Homo sapiens
cugcauccauuucugagugau

SEQ ID NO: 242815 - RNA, 22 nt, Homo sapiens
cugcauuagucuguuuaguguu

SEQ ID NO: 242816 - RNA, 22 nt, Homo sapiens
cugcuggucuuuaaggucuagg

SEQ ID NO: 242817 - RNA, 22 nt, Homo sapiens
cuggaagcacaacgcauuuauu

SEQ ID NO: 242818 - RNA, 22 nt, Homo sapiens
cuggaauauuagcuggucuuaa

SEQ ID NO: 242819 - RNA, 22 nt, Homo sapiens
cuggaauuacaggguugagcua

SEQ ID NO: 242820 - RNA, 22 nt, Homo sapiens
cuggagauuaaccaauugccau

SEQ ID NO: 242821 - RNA, 22 nt, Homo sapiens
cuggagcaaaggugacucuugu

SEQ ID NO: 242822 - RNA, 22 nt, Homo sapiens
cuggaguaugaaccauguauca

SEQ ID NO: 242823 - RNA, 22 nt, Homo sapiens
cuggcaaaaagagggcaauaau

SEQ ID NO: 242824 - RNA, 22 nt, Homo sapiens
cuggcaccauuuugaucaaagg

SEQ ID NO: 242825 - RNA, 22 nt, Homo sapiens
cuggcagucugccucuucacug

SEQ ID NO: 242826 - RNA, 22 nt, Homo sapiens
cuggcaucuaaauacuugaugu

SEQ ID NO: 242827 - RNA, 22 nt, Homo sapiens
cuggccagagacauucauuaaa

SEQ ID NO: 242828 - RNA, 22 nt, Homo sapiens
cuggcucugagguguuuagggc

SEQ ID NO: 242829 - RNA, 22 nt, Homo sapiens
cuggcugagugguaaguagagg

SEQ ID NO: 242830 - RNA, 21 nt, Homo sapiens
cugguccccuuuauguaugug

SEQ ID NO: 242831 - RNA, 22 nt, Homo sapiens
cuggugagaugucuuuccucuu

SEQ ID NO: 242832 - RNA, 21 nt, Homo sapiens
cugguguuagcacuucuuccc

SEQ ID NO: 242833 - RNA, 22 nt, Homo sapiens
cugucacugggaggggcagcag

SEQ ID NO: 242834 - RNA, 22 nt, Homo sapiens
cugucacuggggcacauguccc

SEQ ID NO: 242835 - RNA, 22 nt, Homo sapiens
cugucagugggaguucaggcuu

SEQ ID NO: 242836 - RNA, 22 nt, Homo sapiens
cugucaucauuucuaugugcca

SEQ ID NO: 242837 - RNA, 22 nt, Homo sapiens
cuguccugcagagucagaauga

SEQ ID NO: 242838 - RNA, 22 nt, Homo sapiens
cugugcaaacaagugaaccccu

SEQ ID NO: 242839 - RNA, 22 nt, Homo sapiens
cugugcauaucuuggacugugu

SEQ ID NO: 242840 - RNA, 22 nt, Homo sapiens
cugugcauuggaugucucccug

SEQ ID NO: 242841 - RNA, 22 nt, Homo sapiens
cuguggauguauugcacagucu

SEQ ID NO: 242842 - RNA, 22 nt, Homo sapiens
cugugguuacguucuuugugcu

SEQ ID NO: 242843 - RNA, 22 nt, Homo sapiens
cuucaagucuuuggauaauuag

SEQ ID NO: 242844 - RNA, 20 nt, Homo sapiens
cuucacagaaguggaaucau

SEQ ID NO: 242845 - RNA, 22 nt, Homo sapiens
cuucacuggagucccuggauuc

SEQ ID NO: 242846 - RNA, 18 nt, Homo sapiens
cuucauugcuguuuugcu

SEQ ID NO: 242847 - RNA, 22 nt, Homo sapiens
cuuccagcuggguucagucagu

SEQ ID NO: 242848 - RNA, 22 nt, Homo sapiens
cuuccauaguuacacccaggga

SEQ ID NO: 242849 - RNA, 22 nt, Homo sapiens
cuucccguuauugcccuugggu

SEQ ID NO: 242850 - RNA, 22 nt, Homo sapiens
cuucugauugaaaauggaguag

SEQ ID NO: 242851 - RNA, 21 nt, Homo sapiens
cuucuuggggcagggcagggu

SEQ ID NO: 242852 - RNA, 20 nt, Homo sapiens
cuugaagacuaugcugcuga

SEQ ID NO: 242853 - RNA, 22 nt, Homo sapiens
uuucccagugguacaguuuaua

SEQ ID NO: 242854 - RNA, 22 nt, Homo sapiens
uuucccuuuagcuuagugauuu

SEQ ID NO: 242855 - RNA, 22 nt, Homo sapiens
uuucucaguguuucaggguagg

SEQ ID NO: 242856 - RNA, 20 nt, Homo sapiens
uuucuccccuauaaaucuca

SEQ ID NO: 242857 - RNA, 22 nt, Homo sapiens
uuucugugguccucuugaaggu

SEQ ID NO: 242858 - RNA, 22 nt, Homo sapiens
uuugaaaguaauuugguuggug

SEQ ID NO: 242859 - RNA, 22 nt, Homo sapiens
uuugaaguguggcacugaguuu

SEQ ID NO: 242860 - RNA, 22 nt, Homo sapiens
uuugacuaccaggaauguucuu

SEQ ID NO: 242861 - RNA, 22 nt, Homo sapiens
uuugagcaagaggugacauuau

SEQ ID NO: 242862 - RNA, 22 nt, Homo sapiens
uuugaguaggcuuauauuuugg

SEQ ID NO: 242863 - RNA, 23 nt, Homo sapiens
uuugagugugauaaacacuguca

SEQ ID NO: 242864 - RNA, 21 nt, Homo sapiens
uuugaucauuaaaagugaauc

SEQ ID NO: 242865 - RNA, 22 nt, Homo sapiens
uuugcacuggagauucaauggg

SEQ ID NO: 242866 - RNA, 21 nt, Homo sapiens
uuugcacuuugcaaaucccua

SEQ ID NO: 242867 - RNA, 22 nt, Homo sapiens
uuugcacuuuuguaauaugguu

SEQ ID NO: 242868 - RNA, 22 nt, Homo sapiens
uuugcauauguugaaccagccu

SEQ ID NO: 242869 - RNA, 22 nt, Homo sapiens
uuugcaugcuccuuaugagaau

SEQ ID NO: 242870 - RNA, 22 nt, Homo sapiens
uuugccacugcaggcuguuuaa

SEQ ID NO: 242871 - RNA, 22 nt, Homo sapiens
uuugcuuaaaguccuuguggga

SEQ ID NO: 242872 - RNA, 22 nt, Homo sapiens
uuugcuucacuguuuggcaaaa

SEQ ID NO: 242873 - RNA, 22 nt, Homo sapiens
uuugcuuguguaaaaaucugga

SEQ ID NO: 242874 - RNA, 22 nt, Homo sapiens
uuuggaagaugccacuguauca

SEQ ID NO: 242875 - RNA, 22 nt, Homo sapiens
uuuggcagaugacccucaaguu

SEQ ID NO: 242876 - RNA, 22 nt, Homo sapiens
uuuggcauuuaaauaugcaugg

SEQ ID NO: 242877 - RNA, 22 nt, Homo sapiens
uuuggccauguuggucaggcug

SEQ ID NO: 242878 - RNA, 22 nt, Homo sapiens
uuuggcuauguuguaucuuucc

SEQ ID NO: 242879 - RNA, 22 nt, Homo sapiens
uuugguuauauauauacacucu

SEQ ID NO: 242880 - RNA, 22 nt, Homo sapiens
uuugguugucacaacuggggga

SEQ ID NO: 242881 - RNA, 22 nt, Homo sapiens
uuuguacacuguuggugguuau

SEQ ID NO: 242882 - RNA, 22 nt, Homo sapiens
uuuguacuaugguuuuucacua

SEQ ID NO: 242883 - RNA, 22 nt, Homo sapiens
uuuguacuugaaacccagggcc

SEQ ID NO: 242884 - RNA, 23 nt, Homo sapiens
uuuguaguagcaugauuuauaau

SEQ ID NO: 242885 - RNA, 22 nt, Homo sapiens
uuuguauguuggagauuggaga

SEQ ID NO: 242886 - RNA, 21 nt, Homo sapiens
uuuguccaccuguguucacca

SEQ ID NO: 242887 - RNA, 22 nt, Homo sapiens
uuugucccccguaguucauaua

SEQ ID NO: 242888 - RNA, 22 nt, Homo sapiens
uuugugcuccuaugagaaucua

SEQ ID NO: 242889 - RNA, 22 nt, Homo sapiens
uuugugcuccugugagaaucua

SEQ ID NO: 242890 - RNA, 22 nt, Homo sapiens
uuuguucuucguuccugagcca

SEQ ID NO: 242891 - RNA, 22 nt, Homo sapiens
uuuuaacagccaggggacggcc

SEQ ID NO: 242892 - RNA, 22 nt, Homo sapiens
uuuuagcagccaugacaaagau

SEQ ID NO: 242893 - RNA, 22 nt, Homo sapiens
uuuuagcuuuucccaggacucc

SEQ ID NO: 242894 - RNA, 22 nt, Homo sapiens
uuuuaugggcuauuugcauuag

SEQ ID NO: 242895 - RNA, 22 nt, Homo sapiens
uuuugcaauauguuccugaaua

SEQ ID NO: 242896 - RNA, 21 nt, Homo sapiens
uuuugcacacuaugcagcuuu

SEQ ID NO: 242897 - RNA, 22 nt, Homo sapiens
uuuugcucuugguaaugaaaga

SEQ ID NO: 242898 - RNA, 18 nt, Homo sapiens
uuuugcuuaacugcgcca

SEQ ID NO: 242899 - RNA, 22 nt, Homo sapiens
uuuuggacuugcuccccugucc

SEQ ID NO: 242900 - RNA, 22 nt, Homo sapiens
uuuuggcuagaaauauaccucc

SEQ ID NO: 242901 - RNA, 22 nt, Homo sapiens
uuuugguauacacaaggguccu

SEQ ID NO: 242902 - RNA, 22 nt, Homo sapiens
uuuugguauaugcaggggucuu

SEQ ID NO: 242903 - RNA, 21 nt, Homo sapiens
uuuuggucauucaggaagaaa

SEQ ID NO: 242904 - RNA, 21 nt, Homo sapiens
uuuugugcaugugcagccugc

SEQ ID NO: 242905 - RNA, 22 nt, Homo sapiens
uuuuugagaauuggugaaacac

SEQ ID NO: 242906 - RNA, 22 nt, Homo sapiens
uuuuugaguagcuggagagcag

SEQ ID NO: 242907 - RNA, 22 nt, Homo sapiens
gagacggagucucgcucuguca

SEQ ID NO: 242908 - RNA, 22 nt, Homo sapiens
gagacugagucuugcucugucg

SEQ ID NO: 242909 - RNA, 22 nt, Homo sapiens
gagacugaguuuugcucuuguu

SEQ ID NO: 242910 - RNA, 22 nt, Homo sapiens
gagagcaugugcuggcaucagu

SEQ ID NO: 242911 - RNA, 22 nt, Homo sapiens
gagagcuaggccacuggggcuu

SEQ ID NO: 242912 - RNA, 22 nt, Homo sapiens
gagagugaaguuugcuaccugu

SEQ ID NO: 242913 - RNA, 22 nt, Homo sapiens
gagauauucugguuuacuaaau

SEQ ID NO: 242914 - RNA, 22 nt, Homo sapiens
gagaugaagugucaauaaggau

SEQ ID NO: 242915 - RNA, 22 nt, Homo sapiens
gagaugaaguuaaggaucuuua

SEQ ID NO: 242916 - RNA, 22 nt, Homo sapiens
gagauucaucuagguccagaga

SEQ ID NO: 242917 - RNA, 22 nt, Homo sapiens
gagcaaugauugagccacugua

SEQ ID NO: 242918 - RNA, 22 nt, Homo sapiens
gagcacauguggagagucuggg

SEQ ID NO: 242919 - RNA, 21 nt, Homo sapiens
gagcacauuguccucuaacgc

SEQ ID NO: 242920 - RNA, 22 nt, Homo sapiens
gagcaccagucccugucagugc

SEQ ID NO: 242921 - RNA, 22 nt, Homo sapiens
gagcacugaauacugugguggu

SEQ ID NO: 242922 - RNA, 22 nt, Homo sapiens
gagcaucauggggccaaagcgc

SEQ ID NO: 242923 - RNA, 22 nt, Homo sapiens
gagcgcauugauguuggaugcu

SEQ ID NO: 242924 - RNA, 22 nt, Homo sapiens
gagcuagggucaugcuacugca

SEQ ID NO: 242925 - RNA, 22 nt, Homo sapiens
gagcucaccuuaccucuggagc

SEQ ID NO: 242926 - RNA, 22 nt, Homo sapiens
gagcugaauugcugccauuugc

SEQ ID NO: 242927 - RNA, 22 nt, Homo sapiens
gagcugaucuuuucugauucca

SEQ ID NO: 242928 - RNA, 22 nt, Homo sapiens
gagcuggacuucuuaccuuuuc

SEQ ID NO: 242929 - RNA, 22 nt, Homo sapiens
gagcuuggguuaaaguugccuu

SEQ ID NO: 242930 - RNA, 22 nt, Homo sapiens
gagcuuguagugugaaugguau

SEQ ID NO: 242931 - RNA, 22 nt, Homo sapiens
gaggaaguaauuuuaggccugu

SEQ ID NO: 242932 - RNA, 22 nt, Homo sapiens
gaggaguagggcacaaagccuu

SEQ ID NO: 242933 - RNA, 22 nt, Homo sapiens
gaggaucucuugagcccagaag

SEQ ID NO: 242934 - RNA, 22 nt, Homo sapiens
gaggcaagaguaguuaaguuag

SEQ ID NO: 242935 - RNA, 22 nt, Homo sapiens
gaggcagucugucccuuagcag

SEQ ID NO: 242936 - RNA, 22 nt, Homo sapiens
gaggcauuauucccaucuuaca

SEQ ID NO: 242937 - RNA, 22 nt, Homo sapiens
gagguaggaggauugcuuaagg

SEQ ID NO: 242938 - RNA, 21 nt, Homo sapiens
gagguagggauuaaagaccuc

SEQ ID NO: 242939 - RNA, 22 nt, Homo sapiens
gagguaggggccuuaaagaugc

SEQ ID NO: 242940 - RNA, 22 nt, Homo sapiens
gagguagggucccacuauguug

SEQ ID NO: 242941 - RNA, 22 nt, Homo sapiens
gagguagguacaauugccacca

SEQ ID NO: 242942 - RNA, 22 nt, Homo sapiens
gagguaucauuauguugcccag

SEQ ID NO: 242943 - RNA, 22 nt, Homo sapiens
gaggucuuacauuuuaauauuu

SEQ ID NO: 242944 - RNA, 22 nt, Homo sapiens
gaguaacagcauaaauuuguga

SEQ ID NO: 242945 - RNA, 23 nt, Homo sapiens
gaguacauuaaaagcccagacug

SEQ ID NO: 242946 - RNA, 22 nt, Homo sapiens
gagugcaauggcaccgucucgg

SEQ ID NO: 242947 - RNA, 22 nt, Homo sapiens
gagugcaauggcaugaucuggg

SEQ ID NO: 242948 - RNA, 22 nt, Homo sapiens
gagugcaauggugcuaucucgg

SEQ ID NO: 242949 - RNA, 22 nt, Homo sapiens
gagugcauaugggccuguguca

SEQ ID NO: 242950 - RNA, 22 nt, Homo sapiens
gagugguucuauauguaauugg

SEQ ID NO: 242951 - RNA, 22 nt, Homo sapiens
gagugguuuugauuuauagcug

SEQ ID NO: 242952 - RNA, 22 nt, Homo sapiens
gaguucauaucuaugagugugc

SEQ ID NO: 242953 - RNA, 22 nt, Homo sapiens
gaguucauuuugaaaccuugau

SEQ ID NO: 242954 - RNA, 19 nt, Homo sapiens
gaguugggguuuacuguaa

SEQ ID NO: 242955 - RNA, 22 nt, Homo sapiens
aaaagcuuagaugggcuuguau

SEQ ID NO: 242956 - RNA, 22 nt, Homo sapiens
aaaagucuguagugaaagguga

SEQ ID NO: 242957 - RNA, 22 nt, Homo sapiens
aaaaguucuuugagccuugaca

SEQ ID NO: 242958 - RNA, 22 nt, Homo sapiens
aaaaugcugauauugggcccca

SEQ ID NO: 242959 - RNA, 22 nt, Homo sapiens
aaacaccacgcggucccucgga

SEQ ID NO: 242960 - RNA, 18 nt, Homo sapiens
aaacagugucucuuucug

SEQ ID NO: 242961 - RNA, 22 nt, Homo sapiens
aaaccacagugugcugcugggg

SEQ ID NO: 242962 - RNA, 22 nt, Homo sapiens
aaacgugcagagaucaauagca

SEQ ID NO: 242963 - RNA, 22 nt, Homo sapiens
aaacugccuuccuuguaggugc

SEQ ID NO: 242964 - RNA, 23 nt, Homo sapiens
aaagacuagucaggugcaguggu

SEQ ID NO: 242965 - RNA, 22 nt, Homo sapiens
aaagcaucacuuuuccuacuuu

SEQ ID NO: 242966 - RNA, 22 nt, Homo sapiens
aaagcuacaggaccugcucauu

SEQ ID NO: 242967 - RNA, 22 nt, Homo sapiens
aaagcuaccagauucuguugga

SEQ ID NO: 242968 - RNA, 22 nt, Homo sapiens
aaagcugucaaggcaggaggcu

SEQ ID NO: 242969 - RNA, 22 nt, Homo sapiens
uugauuuguagaaugccccaac

SEQ ID NO: 242970 - RNA, 22 nt, Homo sapiens
uugcaaacaucuuguuucacau

SEQ ID NO: 242971 - RNA, 20 nt, Homo sapiens
uugcacagagaaggaggcag

SEQ ID NO: 242972 - RNA, 22 nt, Homo sapiens
uugcacagucuagcuccaccuu

SEQ ID NO: 242973 - RNA, 22 nt, Homo sapiens
uugcacauggcaggugcucaau

SEQ ID NO: 242974 - RNA, 22 nt, Homo sapiens
uugcaccuugaagccaauagca

SEQ ID NO: 242975 - RNA, 22 nt, Homo sapiens
uugcacuccagccuggaugaca

SEQ ID NO: 242976 - RNA, 22 nt, Homo sapiens
uugcacuccauccuggguugac

SEQ ID NO: 242977 - RNA, 18 nt, Homo sapiens
uugcacuccugccugggu

SEQ ID NO: 242978 - RNA, 22 nt, Homo sapiens
uugcacuugcugaggagugauu

SEQ ID NO: 242979 - RNA, 22 nt, Homo sapiens
uugcagagucaguuauuuugcc

SEQ ID NO: 242980 - RNA, 22 nt, Homo sapiens
uugcagugguuucacuggcaaa

SEQ ID NO: 242981 - RNA, 22 nt, Homo sapiens
uugcauagacaauauuaaucuu

SEQ ID NO: 242982 - RNA, 22 nt, Homo sapiens
uugcaugucauaacugauggaa

SEQ ID NO: 242983 - RNA, 22 nt, Homo sapiens
uugcaugucugcuucuccuccu

SEQ ID NO: 242984 - RNA, 22 nt, Homo sapiens
uugcauuagugugguacauuug

SEQ ID NO: 242985 - RNA, 22 nt, Homo sapiens
uugccuuuguuggaaacaagug

SEQ ID NO: 242986 - RNA, 22 nt, Homo sapiens
uugcuaagucaagagaaaugau

SEQ ID NO: 242987 - RNA, 22 nt, Homo sapiens
uugcuacauugauugccucuuu

SEQ ID NO: 242988 - RNA, 22 nt, Homo sapiens
uugcuacuuggauguacaugug

SEQ ID NO: 242989 - RNA, 20 nt, Homo sapiens
uugcugguguuagaggaggc

SEQ ID NO: 242990 - RNA, 22 nt, Homo sapiens
uuggaaacaccuggugagguua

SEQ ID NO: 242991 - RNA, 22 nt, Homo sapiens
uuggaaagagguguuuaugacu

SEQ ID NO: 242992 - RNA, 22 nt, Homo sapiens
uuggaagacaaugcugauucuc

SEQ ID NO: 242993 - RNA, 22 nt, Homo sapiens
uuggaagguaaucaaaaguucu

SEQ ID NO: 242994 - RNA, 22 nt, Homo sapiens
uuggaaguguguauguauagcu

SEQ ID NO: 242995 - RNA, 22 nt, Homo sapiens
uuggaauuuuaaaauaggcaac

SEQ ID NO: 242996 - RNA, 22 nt, Homo sapiens
uuggauugugaaaguauucucu

SEQ ID NO: 242997 - RNA, 22 nt, Homo sapiens
uuggcaaagugucuggcauuua

SEQ ID NO: 242998 - RNA, 22 nt, Homo sapiens
uuggcaaauagguuuuauugca

SEQ ID NO: 242999 - RNA, 22 nt, Homo sapiens
uuggcaaaugucacaaaucagg

SEQ ID NO: 243000 - RNA, 22 nt, Homo sapiens
uuggcaagcuguuaauuauaaa

SEQ ID NO: 243001 - RNA, 22 nt, Homo sapiens
uuggcaaguccccaccucucuc

SEQ ID NO: 243002 - RNA, 22 nt, Homo sapiens
uuggcaauucagauucuuuuau

SEQ ID NO: 243003 - RNA, 22 nt, Homo sapiens
uuggcauugaguuucaaaucau

SEQ ID NO: 243004 - RNA, 22 nt, Homo sapiens
uuggcuauagauacauggauua

SEQ ID NO: 243005 - RNA, 22 nt, Homo sapiens
uuggcucugcgucucgcggacg

SEQ ID NO: 243006 - RNA, 22 nt, Homo sapiens
uuggcuguguuucccuacaaau

SEQ ID NO: 243007 - RNA, 22 nt, Homo sapiens
uuggcuuggagaguugaaaugu

SEQ ID NO: 243008 - RNA, 22 nt, Homo sapiens
uuggcuuuuaugcagcuuaggu

SEQ ID NO: 243009 - RNA, 22 nt, Homo sapiens
uugggauaaucacaaaguaaaa

SEQ ID NO: 243010 - RNA, 22 nt, Homo sapiens
uugggcaauaggaagcaggugg

SEQ ID NO: 243011 - RNA, 21 nt, Homo sapiens
uuggggaauggagagguuuuc

SEQ ID NO: 243012 - RNA, 22 nt, Homo sapiens
uugguacuacacuucuaaucuu

SEQ ID NO: 243013 - RNA, 22 nt, Homo sapiens
uuggucaggcuaaucucgaacg

SEQ ID NO: 243014 - RNA, 22 nt, Homo sapiens
uuggucaucucccuccuuuuag

SEQ ID NO: 243015 - RNA, 22 nt, Homo sapiens
uugguccauuacauugaugaca

SEQ ID NO: 243016 - RNA, 22 nt, Homo sapiens
uugguucaguuuaacgaguaau

SEQ ID NO: 243017 - RNA, 22 nt, Homo sapiens
uugguuccauuuuaccagcucu

SEQ ID NO: 243018 - RNA, 22 nt, Homo sapiens
uuguaaaguucuuaggaagcuc

SEQ ID NO: 243019 - RNA, 22 nt, Homo sapiens
uuguaugucuucauuugaaaaa

SEQ ID NO: 243020 - RNA, 22 nt, Homo sapiens
uugucaaacucauucuccaucc

SEQ ID NO: 243021 - RNA, 22 nt, Homo sapiens
uugucaguguucacucaaagcu

SEQ ID NO: 243022 - RNA, 22 nt, Homo sapiens
uugucauuuucagaguguuacg

SEQ ID NO: 243023 - RNA, 22 nt, Homo sapiens
uugucccauggggucuuccuuu

SEQ ID NO: 243024 - RNA, 22 nt, Homo sapiens
ccacugugguaucugauacugg

SEQ ID NO: 243025 - RNA, 22 nt, Homo sapiens
ccagauguuuucauucagcaag

SEQ ID NO: 243026 - RNA, 22 nt, Homo sapiens
ccagcaccauuuauuaaauagg

SEQ ID NO: 243027 - RNA, 22 nt, Homo sapiens
ccaggguugagacccacugacu

SEQ ID NO: 243028 - RNA, 22 nt, Homo sapiens
ccaggguugcuuuagauucuga

SEQ ID NO: 243029 - RNA, 22 nt, Homo sapiens
ccaguauuuuauugaggguuuu

SEQ ID NO: 243030 - RNA, 22 nt, Homo sapiens
ccagugcugugcaguguaugag

SEQ ID NO: 243031 - RNA, 21 nt, Homo sapiens
ccagugguuggaaacuauggg

SEQ ID NO: 243032 - RNA, 22 nt, Homo sapiens
ccagugguugggccggagacgg

SEQ ID NO: 243033 - RNA, 22 nt, Homo sapiens
ccaguguucuggaaggcugagu

SEQ ID NO: 243034 - RNA, 22 nt, Homo sapiens
ccaguguuuuugaauuccagga

SEQ ID NO: 243035 - RNA, 22 nt, Homo sapiens
ccaguucaaugauauggaaacu

SEQ ID NO: 243036 - RNA, 22 nt, Homo sapiens
ccaugaacuagaauagaacaug

SEQ ID NO: 243037 - RNA, 22 nt, Homo sapiens
ccauggcuauucuguaaggguu

SEQ ID NO: 243038 - RNA, 18 nt, Homo sapiens
ccauucaacagauuuguc

SEQ ID NO: 243039 - RNA, 21 nt, Homo sapiens
cccagguucucugaggguaga

SEQ ID NO: 243040 - RNA, 19 nt, Homo sapiens
cccagugucagagaagggu

SEQ ID NO: 243041 - RNA, 22 nt, Homo sapiens
cccagugugaacuuggcauuuu

SEQ ID NO: 243042 - RNA, 22 nt, Homo sapiens
ccccaguguguaaaggccuugc

SEQ ID NO: 243043 - RNA, 22 nt, Homo sapiens
ccccauguucucucugcagcuc

SEQ ID NO: 243044 - RNA, 22 nt, Homo sapiens
ccccggguucugucugcccuug

SEQ ID NO: 243045 - RNA, 17 nt, Homo sapiens
ccccugagcgaugcagu

SEQ ID NO: 243046 - RNA, 22 nt, Homo sapiens
ccccuguaaacuggcuucccug

SEQ ID NO: 243047 - RNA, 22 nt, Homo sapiens
ccccuguaucucagcgucuuca

SEQ ID NO: 243048 - RNA, 18 nt, Homo sapiens
cccgggugggcuguuccc

SEQ ID NO: 243049 - RNA, 22 nt, Homo sapiens
cccucgagaaaccaucugcuga

SEQ ID NO: 243050 - RNA, 22 nt, Homo sapiens
cccugagaaaacuuuguccuua

SEQ ID NO: 243051 - RNA, 22 nt, Homo sapiens
cccuguagcagcauucuuaaau

SEQ ID NO: 243052 - RNA, 22 nt, Homo sapiens
cccuugcacuucagagcugcau

SEQ ID NO: 243053 - RNA, 22 nt, Homo sapiens
ccucauggagaaccucugcuag

SEQ ID NO: 243054 - RNA, 21 nt, Homo sapiens
ccuccauuuguauucuugccc

SEQ ID NO: 243055 - RNA, 22 nt, Homo sapiens
ccucuuuguugagacuucacca

SEQ ID NO: 243056 - RNA, 22 nt, Homo sapiens
ccugaugacacgggagauguac

SEQ ID NO: 243057 - RNA, 22 nt, Homo sapiens
ccugaugacuaaugguuuugag

SEQ ID NO: 243058 - RNA, 22 nt, Homo sapiens
ccugucuugauuaaauuacuua

SEQ ID NO: 243059 - RNA, 22 nt, Homo sapiens
ccugugguuaaccagcuagaug

SEQ ID NO: 243060 - RNA, 18 nt, Homo sapiens
ccuuaguuauagagaguc

SEQ ID NO: 243061 - RNA, 22 nt, Homo sapiens
ccuucauccuccagcaggcuag

SEQ ID NO: 243062 - RNA, 22 nt, Homo sapiens
ccuuggcaauggcuggggcuga

SEQ ID NO: 243063 - RNA, 22 nt, Homo sapiens
cgcuggugucuaagcgacagcu

SEQ ID NO: 243064 - RNA, 22 nt, Homo sapiens
cuaaagauagugacaugauuug

SEQ ID NO: 243065 - RNA, 22 nt, Homo sapiens
cuaaaguagccaggacugcagg

SEQ ID NO: 243066 - RNA, 19 nt, Homo sapiens
cuaaaugggucccuagugg

SEQ ID NO: 243067 - RNA, 18 nt, Homo sapiens
cuaagacacuuggcagag

SEQ ID NO: 243068 - RNA, 22 nt, Homo sapiens
cuaagauugucuuaguguguug

SEQ ID NO: 243069 - RNA, 21 nt, Homo sapiens
cuaaggaaagcuaugaacccu

SEQ ID NO: 243070 - RNA, 22 nt, Homo sapiens
cuaauucuggccaaagggauaa

SEQ ID NO: 243071 - RNA, 22 nt, Homo sapiens
auggaaagcuguuccuacacaa

SEQ ID NO: 243072 - RNA, 22 nt, Homo sapiens
auggaacauaacuauuugggga

SEQ ID NO: 243073 - RNA, 22 nt, Homo sapiens
auggaacuggagaucauuaugu

SEQ ID NO: 243074 - RNA, 22 nt, Homo sapiens
auggacuuuuuguucagugucu

SEQ ID NO: 243075 - RNA, 22 nt, Homo sapiens
auggagguguggggagugaguu

SEQ ID NO: 243076 - RNA, 22 nt, Homo sapiens
auggcaaaaaaugcaauuacuu

SEQ ID NO: 243077 - RNA, 22 nt, Homo sapiens
auggcaaaauguuccuaguggu

SEQ ID NO: 243078 - RNA, 22 nt, Homo sapiens
auggcacagacucuuggucaag

SEQ ID NO: 243079 - RNA, 18 nt, Homo sapiens
auggcagaacaauuuaca

SEQ ID NO: 243080 - RNA, 22 nt, Homo sapiens
auggcagcaccccacucuacug

SEQ ID NO: 243081 - RNA, 22 nt, Homo sapiens
auggcagcugguuuuacccuag

SEQ ID NO: 243082 - RNA, 22 nt, Homo sapiens
auggcagugagucucuaguauu

SEQ ID NO: 243083 - RNA, 22 nt, Homo sapiens
auggcaucgucaccuuuucagu

SEQ ID NO: 243084 - RNA, 22 nt, Homo sapiens
auggcauugaagaguugucccu

SEQ ID NO: 243085 - RNA, 22 nt, Homo sapiens
auggcccuguguggagcugcug

SEQ ID NO: 243086 - RNA, 22 nt, Homo sapiens
auggccugaugcaccuguccca

SEQ ID NO: 243087 - RNA, 22 nt, Homo sapiens
uaucacuuugauaguuuaaaug

SEQ ID NO: 243088 - RNA, 22 nt, Homo sapiens
uaucagcagcaggggcugcaga

SEQ ID NO: 243089 - RNA, 22 nt, Homo sapiens
uaucauagacaaucaguuauug

SEQ ID NO: 243090 - RNA, 22 nt, Homo sapiens
uaucauaguuuggacuuucauu

SEQ ID NO: 243091 - RNA, 22 nt, Homo sapiens
uaucauggaaagauguugaaau

SEQ ID NO: 243092 - RNA, 22 nt, Homo sapiens
uaucauuguguuauuucuucca

SEQ ID NO: 243093 - RNA, 22 nt, Homo sapiens
uaucccaguggauguaccccau

SEQ ID NO: 243094 - RNA, 22 nt, Homo sapiens
uaucccuuagagcggggugguu

SEQ ID NO: 243095 - RNA, 22 nt, Homo sapiens
uaucucagaugagacuuguaac

SEQ ID NO: 243096 - RNA, 22 nt, Homo sapiens
uaucucuguggguagugcugaa

SEQ ID NO: 243097 - RNA, 20 nt, Homo sapiens
uaugacacugucauaaaaau

SEQ ID NO: 243098 - RNA, 22 nt, Homo sapiens
uaugacauaguccuuaacccuc

SEQ ID NO: 243099 - RNA, 22 nt, Homo sapiens
uaugacuguuugcucauucagg

SEQ ID NO: 243100 - RNA, 22 nt, Homo sapiens
uaugacuuuugaauacagaugg

SEQ ID NO: 243101 - RNA, 19 nt, Homo sapiens
uaugagcuaugacaugcau

SEQ ID NO: 243102 - RNA, 22 nt, Homo sapiens
uaugccucuucauaaaguauga

SEQ ID NO: 243103 - RNA, 22 nt, Homo sapiens
uaugccuuucucacuaagcuua

SEQ ID NO: 243104 - RNA, 22 nt, Homo sapiens
uaugcuuauaaacauuugucag

SEQ ID NO: 243105 - RNA, 22 nt, Homo sapiens
uauggauuuucagauucuuauc

SEQ ID NO: 243106 - RNA, 22 nt, Homo sapiens
uauggccccuacaugugcaaaa

SEQ ID NO: 243107 - RNA, 22 nt, Homo sapiens
uauggcuuuguuaacauuuucu

SEQ ID NO: 243108 - RNA, 22 nt, Homo sapiens
uauggcuuuuauuauguuguag

SEQ ID NO: 243109 - RNA, 22 nt, Homo sapiens
uaugguuuuaagguuaaggacu

SEQ ID NO: 243110 - RNA, 20 nt, Homo sapiens
uaugguuuuagguauagcau

SEQ ID NO: 243111 - RNA, 22 nt, Homo sapiens
uaugugcaaauuaauugcuaga

SEQ ID NO: 243112 - RNA, 22 nt, Homo sapiens
uauuaagcuaguugucagugcu

SEQ ID NO: 243113 - RNA, 22 nt, Homo sapiens
uauuacugucaauaucacagaa

SEQ ID NO: 243114 - RNA, 22 nt, Homo sapiens
uauuacuguuauuccuaucaaa

SEQ ID NO: 243115 - RNA, 22 nt, Homo sapiens
uauuacuugucugugucucaau

SEQ ID NO: 243116 - RNA, 22 nt, Homo sapiens
uauucacaggugugggacaaag

SEQ ID NO: 243117 - RNA, 22 nt, Homo sapiens
uauuccauuugggucaggauga

SEQ ID NO: 243118 - RNA, 22 nt, Homo sapiens
uauuccauuugugaaaggaagu

SEQ ID NO: 243119 - RNA, 22 nt, Homo sapiens
uauugcacuccucaugcauuug

SEQ ID NO: 243120 - RNA, 22 nt, Homo sapiens
uauuggcucuguuucucugaag

SEQ ID NO: 243121 - RNA, 22 nt, Homo sapiens
uauuugguuacuugaauagcua

SEQ ID NO: 243122 - RNA, 22 nt, Homo sapiens
ucaaaaccucagagaguagagc

SEQ ID NO: 243123 - RNA, 22 nt, Homo sapiens
ucaaagacacacaaggagaagg

SEQ ID NO: 243124 - RNA, 22 nt, Homo sapiens
ucaaaguauucuucugagaacc

SEQ ID NO: 243125 - RNA, 22 nt, Homo sapiens
ucaaagucuucucaaguaacau

SEQ ID NO: 243126 - RNA, 22 nt, Homo sapiens
ucaaagugagcuccuucucacu

SEQ ID NO: 243127 - RNA, 17 nt, Homo sapiens
ucaaaugcucccaguga

SEQ ID NO: 243128 - RNA, 22 nt, Homo sapiens
ucaaaugcucuuugcagagagg

SEQ ID NO: 243129 - RNA, 22 nt, Homo sapiens
ucaaauuccaagucuagguagg

SEQ ID NO: 243130 - RNA, 22 nt, Homo sapiens
ucaacagugggcacuguaaaug

SEQ ID NO: 243131 - RNA, 22 nt, Homo sapiens
ucaacauugcugucaggcaucu

SEQ ID NO: 243132 - RNA, 21 nt, Homo sapiens
ucaacccuugcgucaccaagc

SEQ ID NO: 243133 - RNA, 22 nt, Homo sapiens
ucaagcaauucuccucucagcc

SEQ ID NO: 243134 - RNA, 22 nt, Homo sapiens
ucaagcaauucuccugccucag

SEQ ID NO: 243135 - RNA, 22 nt, Homo sapiens
ucaagcaauucugcugccucag

SEQ ID NO: 243136 - RNA, 18 nt, Homo sapiens
ucaagcaauugucaugcc

SEQ ID NO: 243137 - RNA, 22 nt, Homo sapiens
ucaaggacucagagagggauua

SEQ ID NO: 243138 - RNA, 22 nt, Homo sapiens
ucaaggcacauuugacauuuuc

SEQ ID NO: 243139 - RNA, 20 nt, Homo sapiens
ucaaggcacgaauaaaaguu

SEQ ID NO: 243140 - RNA, 22 nt, Homo sapiens
ucaaggcacuagcugagcugca

SEQ ID NO: 243141 - RNA, 22 nt, Homo sapiens
ucaaggcaguggccuuccuucu

SEQ ID NO: 243142 - RNA, 22 nt, Homo sapiens
ucaaguaguaacuaacugugac

SEQ ID NO: 243143 - RNA, 22 nt, Homo sapiens
ucaagugauucuugugccuuag

SEQ ID NO: 243144 - RNA, 22 nt, Homo sapiens
ucaagugcauaugcuaacgguu

SEQ ID NO: 243145 - RNA, 22 nt, Homo sapiens
ucaaugggcuacacauugagug

SEQ ID NO: 243146 - RNA, 22 nt, Homo sapiens
ucaauguaucuccaagaauuga

SEQ ID NO: 243147 - RNA, 22 nt, Homo sapiens
ucacaaggcaggaaugaaaggg

SEQ ID NO: 243148 - RNA, 22 nt, Homo sapiens
ucacaaguguauagacaugucc

SEQ ID NO: 243149 - RNA, 22 nt, Homo sapiens
ucacaauggcugaacuaauuua

SEQ ID NO: 243150 - RNA, 22 nt, Homo sapiens
ucacacugaauuugaagcaaug

SEQ ID NO: 243151 - RNA, 22 nt, Homo sapiens
ucacagaugaggcgagaggcag

SEQ ID NO: 243152 - RNA, 19 nt, Homo sapiens
ucacaggguugacuugagg

SEQ ID NO: 243153 - RNA, 22 nt, Homo sapiens
ucacaguagggaacugacaaag

SEQ ID NO: 243154 - RNA, 22 nt, Homo sapiens
ucacagucuccucuagggaggg

SEQ ID NO: 243155 - RNA, 23 nt, Homo sapiens
ucacaguggcugcuuaauuguga

SEQ ID NO: 243156 - RNA, 17 nt, Homo sapiens
ucacaguguuaggauga

SEQ ID NO: 243157 - RNA, 22 nt, Homo sapiens
ucacaugaauugucuuguucca

SEQ ID NO: 243158 - RNA, 22 nt, Homo sapiens
ucacauguguaaauugguguaa

SEQ ID NO: 243159 - RNA, 22 nt, Homo sapiens
ucacauguguaugagcuuugau

SEQ ID NO: 243160 - RNA, 22 nt, Homo sapiens
ucacauucaauuguaauccccg

SEQ ID NO: 243161 - RNA, 22 nt, Homo sapiens
ucaccaccugcugaucauagag

SEQ ID NO: 243162 - RNA, 22 nt, Homo sapiens
ucacccacacaggagacaggga

SEQ ID NO: 243163 - RNA, 20 nt, Homo sapiens
ucacccugacaucugcccag

SEQ ID NO: 243164 - RNA, 22 nt, Homo sapiens
ucacccugacaugcggccgaac

SEQ ID NO: 243165 - RNA, 22 nt, Homo sapiens
ucaccuggagagcuugcuaaua

SEQ ID NO: 243166 - RNA, 22 nt, Homo sapiens
ucaccuguagcuaagaccuaau

SEQ ID NO: 243167 - RNA, 21 nt, Homo sapiens
ucaccuguagcugcauguucu

SEQ ID NO: 243168 - RNA, 21 nt, Homo sapiens
ucaccuguugcgaugaagcug

SEQ ID NO: 243169 - RNA, 22 nt, Homo sapiens
ucaccuuacuugcuucugaacu

SEQ ID NO: 243170 - RNA, 22 nt, Homo sapiens
ucacgugcucuuguguguucug

SEQ ID NO: 243171 - RNA, 22 nt, Homo sapiens
ucacugaaaccacugccuccug

SEQ ID NO: 243172 - RNA, 22 nt, Homo sapiens
ucacugaaaccgccuccaccuc

SEQ ID NO: 243173 - RNA, 22 nt, Homo sapiens
ucacugagcacaggagaugugc

SEQ ID NO: 243174 - RNA, 21 nt, Homo sapiens
ucacugagcaucaugguuuca

SEQ ID NO: 243175 - RNA, 22 nt, Homo sapiens
ucacugagcuagaucacuugac

SEQ ID NO: 243176 - RNA, 20 nt, Homo sapiens
ucacuggagcucauuugauu

SEQ ID NO: 243177 - RNA, 20 nt, Homo sapiens
ucacuggguucuugaagucu

SEQ ID NO: 243178 - RNA, 22 nt, Homo sapiens
ucacuggucuaaguggaggggg

SEQ ID NO: 243179 - RNA, 20 nt, Homo sapiens
ucacugugaacuucuugagg

SEQ ID NO: 243180 - RNA, 22 nt, Homo sapiens
ucacugugcacauaugauaggu

SEQ ID NO: 243181 - RNA, 22 nt, Homo sapiens
ucacuuugacggccaacuucua

SEQ ID NO: 243182 - RNA, 22 nt, Homo sapiens
ucacuuuguauagcgacuggcu

SEQ ID NO: 243183 - RNA, 22 nt, Homo sapiens
ucagaaccuccuagcaguguuc

SEQ ID NO: 243184 - RNA, 22 nt, Homo sapiens
ucagaacugauacuagaacuuu

SEQ ID NO: 243185 - RNA, 22 nt, Homo sapiens
ucagacacuguggccuuuggac

SEQ ID NO: 243186 - RNA, 22 nt, Homo sapiens
ucagagcaaagacacuuuauca

SEQ ID NO: 243187 - RNA, 22 nt, Homo sapiens
ucagagucuagaucacucacug

SEQ ID NO: 243188 - RNA, 22 nt, Homo sapiens
ucagagugcagggaguagcagc

SEQ ID NO: 243189 - RNA, 22 nt, Homo sapiens
uaauuggaucucaaaaaagugu

SEQ ID NO: 243190 - RNA, 22 nt, Homo sapiens
uacaaagugggaaacgaagguu

SEQ ID NO: 243191 - RNA, 22 nt, Homo sapiens
uacaagcacaggcagcaggcug

SEQ ID NO: 243192 - RNA, 22 nt, Homo sapiens
uacaagcaggaaaugguauaug

SEQ ID NO: 243193 - RNA, 16 nt, Homo sapiens
uacaauguagaaaaca

SEQ ID NO: 243194 - RNA, 22 nt, Homo sapiens
uacacacguguguauauauaca

SEQ ID NO: 243195 - RNA, 22 nt, Homo sapiens
uacaccaauuuaaucaaaagca

SEQ ID NO: 243196 - RNA, 20 nt, Homo sapiens
uacacguaugagcacaugug

SEQ ID NO: 243197 - RNA, 22 nt, Homo sapiens
uacagaguagaagauuugcaga

SEQ ID NO: 243198 - RNA, 22 nt, Homo sapiens
uacagcacugugcauagugguu

SEQ ID NO: 243199 - RNA, 22 nt, Homo sapiens
uacagcuaugugcaugcaugcu

SEQ ID NO: 243200 - RNA, 22 nt, Homo sapiens
uacaggcagguguucccugguu

SEQ ID NO: 243201 - RNA, 22 nt, Homo sapiens
uacagguaugugucuauauaca

SEQ ID NO: 243202 - RNA, 22 nt, Homo sapiens
uacaguagagaucagcaaacua

SEQ ID NO: 243203 - RNA, 22 nt, Homo sapiens
uacaguaguaucuucauuuguu

SEQ ID NO: 243204 - RNA, 22 nt, Homo sapiens
uacagucacauuccugaccaua

SEQ ID NO: 243205 - RNA, 22 nt, Homo sapiens
uacaguccaugcauuauccucc

SEQ ID NO: 243206 - RNA, 22 nt, Homo sapiens
uacauacuucacagacuuuaaa

SEQ ID NO: 243207 - RNA, 19 nt, Homo sapiens
uacauaguauuuaguggca

SEQ ID NO: 243208 - RNA, 22 nt, Homo sapiens
uacauguauacaggguuuacuu

SEQ ID NO: 243209 - RNA, 22 nt, Homo sapiens
uacauguauguguuuauggcug

SEQ ID NO: 243210 - RNA, 22 nt, Homo sapiens
uacaugugcacaacgugcaggu

SEQ ID NO: 243211 - RNA, 22 nt, Homo sapiens
uaccacagucauuacacuugua

SEQ ID NO: 243212 - RNA, 22 nt, Homo sapiens
uaccacccuuuuuccagaagcc

SEQ ID NO: 243213 - RNA, 22 nt, Homo sapiens
uaccaucauuauacguagaaau

SEQ ID NO: 243214 - RNA, 19 nt, Homo sapiens
uacccagaagcagcauugu

SEQ ID NO: 243215 - RNA, 22 nt, Homo sapiens
uacguguauuguuuucacaaga

SEQ ID NO: 243216 - RNA, 22 nt, Homo sapiens
uacuacagccugagcgacugag

SEQ ID NO: 243217 - RNA, 22 nt, Homo sapiens
uacuagaggaaaacuugaagac

SEQ ID NO: 243218 - RNA, 22 nt, Homo sapiens
uacuagaggaauugcuauaacu

SEQ ID NO: 243219 - RNA, 22 nt, Homo sapiens
uacuagaggcgggguuucgcca

SEQ ID NO: 243220 - RNA, 22 nt, Homo sapiens
uacucaguagacacucauaugu

SEQ ID NO: 243221 - RNA, 22 nt, Homo sapiens
uacugagagaggaauauugaaa

SEQ ID NO: 243222 - RNA, 22 nt, Homo sapiens
uacugcacuccacccuggguga

SEQ ID NO: 243223 - RNA, 22 nt, Homo sapiens
uacugcauuucacuguuaaaga

SEQ ID NO: 243224 - RNA, 22 nt, Homo sapiens
uacuggccuugaacucuggugu

SEQ ID NO: 243225 - RNA, 22 nt, Homo sapiens
uacugguuuuggugggcaggug

SEQ ID NO: 243226 - RNA, 22 nt, Homo sapiens
uacuucauucuugaccuugcau

SEQ ID NO: 243227 - RNA, 22 nt, Homo sapiens
uagaacauuccaggugauguug

SEQ ID NO: 243228 - RNA, 18 nt, Homo sapiens
uagaauauaggucauucu

SEQ ID NO: 243229 - RNA, 22 nt, Homo sapiens
uagaauguaacuuccaugucau

SEQ ID NO: 243230 - RNA, 20 nt, Homo sapiens
uagacagcuagauuagauag

SEQ ID NO: 243231 - RNA, 22 nt, Homo sapiens
uagacccauuacguaguuucca

SEQ ID NO: 243232 - RNA, 22 nt, Homo sapiens
uagacugguuuagcacugaaua

SEQ ID NO: 243233 - RNA, 22 nt, Homo sapiens
uagagaucuuauauuuuaugac

SEQ ID NO: 243234 - RNA, 22 nt, Homo sapiens
uagagcaugugccauacguaca

SEQ ID NO: 243235 - RNA, 22 nt, Homo sapiens
uagagcuaguuuuuaaucuaac

SEQ ID NO: 243236 - RNA, 22 nt, Homo sapiens
uagagguagagugacuucccca

SEQ ID NO: 243237 - RNA, 22 nt, Homo sapiens
uagagguaggucuucgagucuc

SEQ ID NO: 243238 - RNA, 22 nt, Homo sapiens
uagagguauaccaaaaaggcau

SEQ ID NO: 243239 - RNA, 22 nt, Homo sapiens
uagagguauguauaguauucuu

SEQ ID NO: 243240 - RNA, 22 nt, Homo sapiens
uagagguauuaacaguagaaga

SEQ ID NO: 243241 - RNA, 22 nt, Homo sapiens
uagaucaacuuugguaagagaa

SEQ ID NO: 243242 - RNA, 19 nt, Homo sapiens
uagaugucuuugcauagau

SEQ ID NO: 243243 - RNA, 22 nt, Homo sapiens
uagauuauccggcugggacaau

SEQ ID NO: 243244 - RNA, 22 nt, Homo sapiens
uagauuguaauaugcagaaugg

SEQ ID NO: 243245 - RNA, 22 nt, Homo sapiens
uagcaacauucagcucagguac

SEQ ID NO: 243246 - RNA, 22 nt, Homo sapiens
uagcaccacaaucaagauacag

SEQ ID NO: 243247 - RNA, 22 nt, Homo sapiens
uagcaccuuagcauuucuagug

SEQ ID NO: 243248 - RNA, 22 nt, Homo sapiens
uagcagcagugguguauuuaga

SEQ ID NO: 243249 - RNA, 19 nt, Homo sapiens
uagcagcaugauuuauaau

SEQ ID NO: 243250 - RNA, 22 nt, Homo sapiens
uagcagccaggaagggcuggcu

SEQ ID NO: 243251 - RNA, 22 nt, Homo sapiens
uagcaggaaaggggucagaucu

SEQ ID NO: 243252 - RNA, 22 nt, Homo sapiens
uagcaguaccccaguauccugg

SEQ ID NO: 243253 - RNA, 22 nt, Homo sapiens
uagcaguauacguacugggucc

SEQ ID NO: 243254 - RNA, 20 nt, Homo sapiens
uagccggguguugugucaug

SEQ ID NO: 243255 - RNA, 22 nt, Homo sapiens
uagccuguggugaauguuucug

SEQ ID NO: 243256 - RNA, 17 nt, Homo sapiens
uagcucuauuucuagcc

SEQ ID NO: 243257 - RNA, 22 nt, Homo sapiens
uagcugcauccugugcacucaa

SEQ ID NO: 243258 - RNA, 17 nt, Homo sapiens
uagcuucacauuaggaa

SEQ ID NO: 243259 - RNA, 22 nt, Homo sapiens
uaggacacagauggagaaaagc

SEQ ID NO: 243260 - RNA, 22 nt, Homo sapiens
uaggagugugaacccuaugaac

SEQ ID NO: 243261 - RNA, 22 nt, Homo sapiens
uaggccuuuuuaugucaauauc

SEQ ID NO: 243262 - RNA, 22 nt, Homo sapiens
uaggguaguaauaguuguuuca

SEQ ID NO: 243263 - RNA, 22 nt, Homo sapiens
uagguugucucuucacucugau

SEQ ID NO: 243264 - RNA, 18 nt, Homo sapiens
uaguacuguucucaugau

SEQ ID NO: 243265 - RNA, 22 nt, Homo sapiens
uaguagcaccucucaugagcuu

SEQ ID NO: 243266 - RNA, 22 nt, Homo sapiens
uagugcugagauugagaagccc

SEQ ID NO: 243267 - RNA, 22 nt, Homo sapiens
uagugcuguaauucuaaugaaa

SEQ ID NO: 243268 - RNA, 22 nt, Homo sapiens
uagugcugugauaaacauauau

SEQ ID NO: 243269 - RNA, 22 nt, Homo sapiens
uaguucauuuuucuugcuuaga

SEQ ID NO: 243270 - RNA, 22 nt, Homo sapiens
uaguugcauuggcugcuaugcu

SEQ ID NO: 243271 - RNA, 22 nt, Homo sapiens
uauaacaaugcaagaauggccu

SEQ ID NO: 243272 - RNA, 22 nt, Homo sapiens
uauacagcaaguuacugugcug

SEQ ID NO: 243273 - RNA, 22 nt, Homo sapiens
uauacaugugccauguuggugu

SEQ ID NO: 243274 - RNA, 22 nt, Homo sapiens
uauacaugugggcaucaggaga

SEQ ID NO: 243275 - RNA, 22 nt, Homo sapiens
uauaccacugauuuuauucuga

SEQ ID NO: 243276 - RNA, 21 nt, Homo sapiens
uauagcagcacgauuuauaau

SEQ ID NO: 243277 - RNA, 21 nt, Homo sapiens
uauagcagcacgauuuauagu

SEQ ID NO: 243278 - RNA, 22 nt, Homo sapiens
uauagcuauuguuaauggaacu

SEQ ID NO: 243279 - RNA, 22 nt, Homo sapiens
uauaugcaacauaguguaugug

SEQ ID NO: 243280 - RNA, 22 nt, Homo sapiens
uauaugcucugggauccugaaa

SEQ ID NO: 243281 - RNA, 22 nt, Homo sapiens
uauaugucugagacugggggau

SEQ ID NO: 243282 - RNA, 22 nt, Homo sapiens
uauaugucuucuuguaauuggc

SEQ ID NO: 243283 - RNA, 22 nt, Homo sapiens
uaucaaacccaaggaggggguu

SEQ ID NO: 243284 - RNA, 22 nt, Homo sapiens
uaucacagauauuaugggccaa

SEQ ID NO: 243285 - RNA, 22 nt, Homo sapiens
uaucacagcauugucuauaaua

SEQ ID NO: 243286 - RNA, 20 nt, Homo sapiens
uaucacaggucagaaacccu

SEQ ID NO: 243287 - RNA, 22 nt, Homo sapiens
uaucacaggucaggaaccuugu

SEQ ID NO: 243288 - RNA, 22 nt, Homo sapiens
uaucacaggucaggaaucuugc

SEQ ID NO: 243289 - RNA, 22 nt, Homo sapiens
uaucaccauguccguuuuaaaa

SEQ ID NO: 243290 - RNA, 19 nt, Homo sapiens
uaucacuucccuggaaaca

SEQ ID NO: 243291 - RNA, 22 nt, Homo sapiens
acaaaguguuuucugaaggccu

SEQ ID NO: 243292 - RNA, 22 nt, Homo sapiens
acaauggaauggaguggaaagu

SEQ ID NO: 243293 - RNA, 22 nt, Homo sapiens
acaauguauauuuuacuguagg

SEQ ID NO: 243294 - RNA, 22 nt, Homo sapiens
acacagugucuguguauuuaaa

SEQ ID NO: 243295 - RNA, 22 nt, Homo sapiens
acaccaugucuguuucugguuu

SEQ ID NO: 243296 - RNA, 22 nt, Homo sapiens
acacucuaguguucuuaaucag

SEQ ID NO: 243297 - RNA, 22 nt, Homo sapiens
acacuguuuuaguuauuauagc

SEQ ID NO: 243298 - RNA, 22 nt, Homo sapiens
acacuugcuugcaauagccucc

SEQ ID NO: 243299 - RNA, 22 nt, Homo sapiens
acagaauucucagaacugggag

SEQ ID NO: 243300 - RNA, 22 nt, Homo sapiens
acaggagugggauuugaguccu

SEQ ID NO: 243301 - RNA, 22 nt, Homo sapiens
acagguacacagaauauccaga

SEQ ID NO: 243302 - RNA, 22 nt, Homo sapiens
acaguacuguuguuugcugcca

SEQ ID NO: 243303 - RNA, 22 nt, Homo sapiens
acaguagcgcaaucucggcuca

SEQ ID NO: 243304 - RNA, 19 nt, Homo sapiens
acaguauugugcacagguu

SEQ ID NO: 243305 - RNA, 23 nt, Homo sapiens
acagucuaguuugaagucaggua

SEQ ID NO: 243306 - RNA, 22 nt, Homo sapiens
acagucuggagaaugggugcuc

SEQ ID NO: 243307 - RNA, 18 nt, Homo sapiens
acagugcuggcaugagau

SEQ ID NO: 243308 - RNA, 22 nt, Homo sapiens
acagugcugucugcuuuggcua

SEQ ID NO: 243309 - RNA, 23 nt, Homo sapiens
acaguggugugaucuuggcucag

SEQ ID NO: 243310 - RNA, 22 nt, Homo sapiens
acagugucaugucguguucccc

SEQ ID NO: 243311 - RNA, 22 nt, Homo sapiens
acaguguguguguucaccuaga

SEQ ID NO: 243312 - RNA, 22 nt, Homo sapiens
acaucacuguuugauugauuga

SEQ ID NO: 243313 - RNA, 22 nt, Homo sapiens
acauccauuugcuuuauuugcu

SEQ ID NO: 243314 - RNA, 22 nt, Homo sapiens
acaucccaugccuggguacucc

SEQ ID NO: 243315 - RNA, 22 nt, Homo sapiens
acaugcauauguuggaagaaag

SEQ ID NO: 243316 - RNA, 21 nt, Homo sapiens
acauguacacauguaugcaca

SEQ ID NO: 243317 - RNA, 22 nt, Homo sapiens
acauugcauauggcacccucuu

SEQ ID NO: 243318 - RNA, 22 nt, Homo sapiens
accaucuagauuuguguaggua

SEQ ID NO: 243319 - RNA, 17 nt, Homo sapiens
acccagucuuuuugcac

SEQ ID NO: 243320 - RNA, 22 nt, Homo sapiens
acccaguguugggcagaacugu

SEQ ID NO: 243321 - RNA, 22 nt, Homo sapiens
acccguuacuuagcagaccagg

SEQ ID NO: 243322 - RNA, 22 nt, Homo sapiens
acccucagaccaguuucccugg

SEQ ID NO: 243323 - RNA, 21 nt, Homo sapiens
acccucuaguuuucaacaggc

SEQ ID NO: 243324 - RNA, 22 nt, Homo sapiens
acccuggagagugcuguaguaa

SEQ ID NO: 243325 - RNA, 22 nt, Homo sapiens
acccugucaaaacggaccaauc

SEQ ID NO: 243326 - RNA, 22 nt, Homo sapiens
acccugucaaaauggaccaauc

SEQ ID NO: 243327 - RNA, 22 nt, Homo sapiens
acccugucacucccaucaauuu

SEQ ID NO: 243328 - RNA, 22 nt, Homo sapiens
acccugugagagaguuaauauu

SEQ ID NO: 243329 - RNA, 18 nt, Homo sapiens
acccuucagcacugggcc

SEQ ID NO: 243330 - RNA, 23 nt, Homo sapiens
accugauguuucuguggggagcc

SEQ ID NO: 243331 - RNA, 19 nt, Homo sapiens
accuguagaaaguacaaca

SEQ ID NO: 243332 - RNA, 22 nt, Homo sapiens
acuacauaugacaucuucuuua

SEQ ID NO: 243333 - RNA, 22 nt, Homo sapiens
acuacugucagacugccacuga

SEQ ID NO: 243334 - RNA, 22 nt, Homo sapiens
acucagagugggccccuagaua

SEQ ID NO: 243335 - RNA, 22 nt, Homo sapiens
acugagucauugaggcccucuc

SEQ ID NO: 243336 - RNA, 22 nt, Homo sapiens
acugcacuccaccuugggcaac

SEQ ID NO: 243337 - RNA, 22 nt, Homo sapiens
acugcacuccagccuccugaca

SEQ ID NO: 243338 - RNA, 22 nt, Homo sapiens
acugcacuccagccucggcaau

SEQ ID NO: 243339 - RNA, 22 nt, Homo sapiens
acugcacuccagccugaugaaa

SEQ ID NO: 243340 - RNA, 22 nt, Homo sapiens
acugcacuccagccugcuggau

SEQ ID NO: 243341 - RNA, 22 nt, Homo sapiens
acugcacuccagccuggacgaa

SEQ ID NO: 243342 - RNA, 22 nt, Homo sapiens
acugcacuccagccuggcggac

SEQ ID NO: 243343 - RNA, 22 nt, Homo sapiens
acugcacuccagccuucgugac

SEQ ID NO: 243344 - RNA, 20 nt, Homo sapiens
acugcacuccagucucuggg

SEQ ID NO: 243345 - RNA, 22 nt, Homo sapiens
acugcacuccaguuccgggcaa

SEQ ID NO: 243346 - RNA, 22 nt, Homo sapiens
acugcacuccaguuugggcagc

SEQ ID NO: 243347 - RNA, 22 nt, Homo sapiens
acugcacuccggccucgugaca

SEQ ID NO: 243348 - RNA, 22 nt, Homo sapiens
acugcacuccuccuugggugac

SEQ ID NO: 243349 - RNA, 22 nt, Homo sapiens
acugcacucuagcauggguaau

SEQ ID NO: 243350 - RNA, 22 nt, Homo sapiens
acugcacuguccuagaguccuc

SEQ ID NO: 243351 - RNA, 22 nt, Homo sapiens
acugcacuucagccuuggggac

SEQ ID NO: 243352 - RNA, 22 nt, Homo sapiens
acugcauuugucccuuuugaac

SEQ ID NO: 243353 - RNA, 22 nt, Homo sapiens
acugcauuugucugucucaauu

SEQ ID NO: 243354 - RNA, 18 nt, Homo sapiens
acuggaauuaaacuuuuu

SEQ ID NO: 243355 - RNA, 22 nt, Homo sapiens
acuggcuguuaggaauuaccuc

SEQ ID NO: 243356 - RNA, 22 nt, Homo sapiens
acuggcuuuugagaaaaacacu

SEQ ID NO: 243357 - RNA, 22 nt, Homo sapiens
acugggucaaaguagaaaacua

SEQ ID NO: 243358 - RNA, 22 nt, Homo sapiens
acugugcuguuuuaauuauuga

SEQ ID NO: 243359 - RNA, 22 nt, Homo sapiens
acuucauucucuggaucagaau

SEQ ID NO: 243360 - RNA, 22 nt, Homo sapiens
acuuugguuaucauacuuucag

SEQ ID NO: 243361 - RNA, 22 nt, Homo sapiens
acuuuguguuacccagcaagga

SEQ ID NO: 243362 - RNA, 22 nt, Homo sapiens
acuuuuugaugaggucguuugu

SEQ ID NO: 243363 - RNA, 20 nt, Homo sapiens
agaaccuguaguguagaggg

SEQ ID NO: 243364 - RNA, 22 nt, Homo sapiens
agaacuguccauucagcaugaa

SEQ ID NO: 243365 - RNA, 22 nt, Homo sapiens
agaagacuauucuggguugggc

SEQ ID NO: 243366 - RNA, 22 nt, Homo sapiens
agaagugcuggguucaggcugg

SEQ ID NO: 243367 - RNA, 19 nt, Homo sapiens
agaaucuaaauuauuucug

SEQ ID NO: 243368 - RNA, 22 nt, Homo sapiens
agaaugauccuucucagaggca

SEQ ID NO: 243369 - RNA, 22 nt, Homo sapiens
agaauguaacucuaugaaggca

SEQ ID NO: 243370 - RNA, 22 nt, Homo sapiens
agaauucugucauguuuauauu

SEQ ID NO: 243371 - RNA, 22 nt, Homo sapiens
agacagcugguagcacuuccug

SEQ ID NO: 243372 - RNA, 22 nt, Homo sapiens
agagagcuuuugguugcccuaa

SEQ ID NO: 243373 - RNA, 22 nt, Homo sapiens
agagaucauuuuguuucaaauc

SEQ ID NO: 243374 - RNA, 22 nt, Homo sapiens
agagauccucauuuuauagaca

SEQ ID NO: 243375 - RNA, 22 nt, Homo sapiens
agagcaauguuaucagucucug

SEQ ID NO: 243376 - RNA, 18 nt, Homo sapiens
agagcacugaguuuuaga

SEQ ID NO: 243377 - RNA, 22 nt, Homo sapiens
agagccacacucuccuaacuca

SEQ ID NO: 243378 - RNA, 22 nt, Homo sapiens
agagguaagcaguggcaagugc

SEQ ID NO: 243379 - RNA, 22 nt, Homo sapiens
agaguacaggcaaguuagucau

SEQ ID NO: 243380 - RNA, 22 nt, Homo sapiens
agaguacugacguuugcaaauu

SEQ ID NO: 243381 - RNA, 22 nt, Homo sapiens
agagugaagcuuuuuauauucu

SEQ ID NO: 243382 - RNA, 23 nt, Homo sapiens
agagugcaauggugccaucucgg

SEQ ID NO: 243383 - RNA, 20 nt, Homo sapiens
agagugcuggacugaggagc

SEQ ID NO: 243384 - RNA, 22 nt, Homo sapiens
agauauguuuaguuucaaaaug

SEQ ID NO: 243385 - RNA, 22 nt, Homo sapiens
agaucacaguaccguaaggcug

SEQ ID NO: 243386 - RNA, 22 nt, Homo sapiens
agaugauguuuacugagcauca

SEQ ID NO: 243387 - RNA, 22 nt, Homo sapiens
agaugccuaugaagagaaauua

SEQ ID NO: 243388 - RNA, 22 nt, Homo sapiens
agauggguuuucacauguuggc

SEQ ID NO: 243389 - RNA, 22 nt, Homo sapiens
agauucauccaaguuguugcau

SEQ ID NO: 243390 - RNA, 22 nt, Homo sapiens
agcaacauggaguuugugcgca

SEQ ID NO: 243391 - RNA, 22 nt, Homo sapiens
agcaacauuguucauaauagcu

SEQ ID NO: 243392 - RNA, 22 nt, Homo sapiens
agcaagacauggcuuccaaaug

SEQ ID NO: 243393 - RNA, 22 nt, Homo sapiens
augagacauuaaaguguguuug

SEQ ID NO: 243394 - RNA, 22 nt, Homo sapiens
augagagcugacuuuaaggcaa

SEQ ID NO: 243395 - RNA, 22 nt, Homo sapiens
augagauacuacaaaugaguuu

SEQ ID NO: 243396 - RNA, 22 nt, Homo sapiens
augagauauuuuauaagaucau

SEQ ID NO: 243397 - RNA, 22 nt, Homo sapiens
augagaucugugaacaccuguc

SEQ ID NO: 243398 - RNA, 22 nt, Homo sapiens
augagcagaagagauacacugu

SEQ ID NO: 243399 - RNA, 22 nt, Homo sapiens
augagcuauggagcucccaccu

SEQ ID NO: 243400 - RNA, 22 nt, Homo sapiens
augagcucauaaagagugauuu

SEQ ID NO: 243401 - RNA, 22 nt, Homo sapiens
augagcuccucaaggucagaga

SEQ ID NO: 243402 - RNA, 22 nt, Homo sapiens
augagcugauuuccuuaccaua

SEQ ID NO: 243403 - RNA, 22 nt, Homo sapiens
augagcuguuuggaagacacuu

SEQ ID NO: 243404 - RNA, 22 nt, Homo sapiens
augaggcacugcgcccuacuga

SEQ ID NO: 243405 - RNA, 22 nt, Homo sapiens
augaggcuauaauuuuuaugua

SEQ ID NO: 243406 - RNA, 22 nt, Homo sapiens
augagggcggacgcccuggaga

SEQ ID NO: 243407 - RNA, 22 nt, Homo sapiens
augagguaauaaguccuuggaa

SEQ ID NO: 243408 - RNA, 22 nt, Homo sapiens
augaguaguugcuaaauauuga

SEQ ID NO: 243409 - RNA, 22 nt, Homo sapiens
augauauuauucuagcccagag

SEQ ID NO: 243410 - RNA, 22 nt, Homo sapiens
augaucacaccacugcacucca

SEQ ID NO: 243411 - RNA, 22 nt, Homo sapiens
augauuguucucacucaagaga

SEQ ID NO: 243412 - RNA, 22 nt, Homo sapiens
augcaauucuagauugauagua

SEQ ID NO: 243413 - RNA, 22 nt, Homo sapiens
augcacuguuguuauuggauaa

SEQ ID NO: 243414 - RNA, 22 nt, Homo sapiens
augcauaugucuuuauaguggc

SEQ ID NO: 243415 - RNA, 22 nt, Homo sapiens
augcauauuuuaccuagaagag

SEQ ID NO: 243416 - RNA, 22 nt, Homo sapiens
augcauggucugaagucaaccu

SEQ ID NO: 243417 - RNA, 19 nt, Homo sapiens
augccacagugaggucaga

SEQ ID NO: 243418 - RNA, 22 nt, Homo sapiens
augccucugacaauuggauucu

SEQ ID NO: 243419 - RNA, 19 nt, Homo sapiens
augccuggagaugguuaua

SEQ ID NO: 243420 - RNA, 21 nt, Homo sapiens
auggaaagacugccucuucaa

SEQ ID NO: 243421 - RNA, 22 nt, Homo sapiens
auggaaaugaagggcuggcccu

SEQ ID NO: 243422 - RNA, 22 nt, Homo sapiens
auggaagaaacgauuuucugga

SEQ ID NO: 243423 - RNA, 22 nt, Homo sapiens
auggagagaauuauucucucag

SEQ ID NO: 243424 - RNA, 22 nt, Homo sapiens
auggagaugaacuuggguaaag

SEQ ID NO: 243425 - RNA, 22 nt, Homo sapiens
auggaguguggaacugggaauc

SEQ ID NO: 243426 - RNA, 22 nt, Homo sapiens
auggaucuuucugcuuuugaau

SEQ ID NO: 243427 - RNA, 22 nt, Homo sapiens
auggauuuuaggauacaguuga

SEQ ID NO: 243428 - RNA, 22 nt, Homo sapiens
auggcacagaguagaugcucaa

SEQ ID NO: 243429 - RNA, 22 nt, Homo sapiens
auggcacuguguauuuuucugu

SEQ ID NO: 243430 - RNA, 22 nt, Homo sapiens
auggcagaaucaagccgacagc

SEQ ID NO: 243431 - RNA, 22 nt, Homo sapiens
auggcaguguaugauuauauua

SEQ ID NO: 243432 - RNA, 22 nt, Homo sapiens
auggccauuacuaagaauguuu

SEQ ID NO: 243433 - RNA, 22 nt, Homo sapiens
auggcccaguuugcuaucccua

SEQ ID NO: 243434 - RNA, 20 nt, Homo sapiens
auggcccugcugggaguguc

SEQ ID NO: 243435 - RNA, 22 nt, Homo sapiens
auggcccugggaaaggaggcau

SEQ ID NO: 243436 - RNA, 22 nt, Homo sapiens
auggcucuuauuauuugaggua

SEQ ID NO: 243437 - RNA, 22 nt, Homo sapiens
auggcucuuauuauuuugaggu

SEQ ID NO: 243438 - RNA, 22 nt, Homo sapiens
auggcugugagaucgacuuauu

SEQ ID NO: 243439 - RNA, 22 nt, Homo sapiens
auggcuguuuaagaguuucauu

SEQ ID NO: 243440 - RNA, 22 nt, Homo sapiens
auggcuguuucugcaaugucua

SEQ ID NO: 243441 - RNA, 22 nt, Homo sapiens
auggcuguuuuuuauguuacag

SEQ ID NO: 243442 - RNA, 22 nt, Homo sapiens
auggcuugugacccaugcuuca

SEQ ID NO: 243443 - RNA, 22 nt, Homo sapiens
auggcuuucaggacguggcgag

SEQ ID NO: 243444 - RNA, 22 nt, Homo sapiens
auggcuuuuccugucuugcaug

SEQ ID NO: 243445 - RNA, 22 nt, Homo sapiens
auggcuuuugcccuaaauggau

SEQ ID NO: 243446 - RNA, 22 nt, Homo sapiens
auggcuuuuuucuugggcacuc

SEQ ID NO: 243447 - RNA, 22 nt, Homo sapiens
augggaaaaucagaaggccugg

SEQ ID NO: 243448 - RNA, 22 nt, Homo sapiens
augggagugugguuagagaccu

SEQ ID NO: 243449 - RNA, 22 nt, Homo sapiens
augggguaggcuuugcugcagu

SEQ ID NO: 243450 - RNA, 22 nt, Homo sapiens
augggguagguagcucggggaa

SEQ ID NO: 243451 - RNA, 22 nt, Homo sapiens
augggugaguaugaguugacuu

SEQ ID NO: 243452 - RNA, 21 nt, Homo sapiens
augguacugucucuggagaua

SEQ ID NO: 243453 - RNA, 22 nt, Homo sapiens
auggucuuuucccuggauuaua

SEQ ID NO: 243454 - RNA, 21 nt, Homo sapiens
auguaacugggaaugugagag

SEQ ID NO: 243455 - RNA, 22 nt, Homo sapiens
auguaauugagguuuuugccau

SEQ ID NO: 243456 - RNA, 20 nt, Homo sapiens
augucaggaagggagucagg

SEQ ID NO: 243457 - RNA, 22 nt, Homo sapiens
augucauagaagccugugaacc

SEQ ID NO: 243458 - RNA, 22 nt, Homo sapiens
augucauagauaaggaagugga

SEQ ID NO: 243459 - RNA, 22 nt, Homo sapiens
augucuagagcaagagaugcug

SEQ ID NO: 243460 - RNA, 22 nt, Homo sapiens
augucuuucauagagacccaga

SEQ ID NO: 243461 - RNA, 22 nt, Homo sapiens
augugaaugugaucggauaguc

SEQ ID NO: 243462 - RNA, 22 nt, Homo sapiens
augugcaaauuuccaaacucuu

SEQ ID NO: 243463 - RNA, 22 nt, Homo sapiens
augugccauucucauggcgcuu

SEQ ID NO: 243464 - RNA, 20 nt, Homo sapiens
augugcuaauauuaauaugu

SEQ ID NO: 243465 - RNA, 22 nt, Homo sapiens
augugcuuuuggugagagauuu

SEQ ID NO: 243466 - RNA, 22 nt, Homo sapiens
augugcuuuuuaaacagaugcu

SEQ ID NO: 243467 - RNA, 22 nt, Homo sapiens
auguggcuuuucaacuguguga

SEQ ID NO: 243468 - RNA, 22 nt, Homo sapiens
augugucaaaucuaggccaaag

SEQ ID NO: 243469 - RNA, 22 nt, Homo sapiens
augugugaaucccagaaccugu

SEQ ID NO: 243470 - RNA, 23 nt, Homo sapiens
augugugcuuggagagcaggaug

SEQ ID NO: 243471 - RNA, 22 nt, Homo sapiens
auguuaagauggaacaugggaa

SEQ ID NO: 243472 - RNA, 22 nt, Homo sapiens
auguuauguucuucucuguaua

SEQ ID NO: 243473 - RNA, 22 nt, Homo sapiens
auguugcuugaaggcauuuugu

SEQ ID NO: 243474 - RNA, 22 nt, Homo sapiens
auguuuagagagggugucaaau

SEQ ID NO: 243475 - RNA, 22 nt, Homo sapiens
auuaaggaguggguucauggug

SEQ ID NO: 243476 - RNA, 22 nt, Homo sapiens
auuaaguuaggauuuugagaua

SEQ ID NO: 243477 - RNA, 22 nt, Homo sapiens
auuaaguugugccugaaaacuu

SEQ ID NO: 243478 - RNA, 22 nt, Homo sapiens
auuacauagucaaggugucuca

SEQ ID NO: 243479 - RNA, 22 nt, Homo sapiens
auuacaugucuauccaugaaca

SEQ ID NO: 243480 - RNA, 22 nt, Homo sapiens
auuaucacaguuuugcauaugg

SEQ ID NO: 243481 - RNA, 22 nt, Homo sapiens
auuauuagucggccagcuguua

SEQ ID NO: 243482 - RNA, 22 nt, Homo sapiens
auuauuaguuguugaaugaagu

SEQ ID NO: 243483 - RNA, 20 nt, Homo sapiens
auucaaguaugccuugagaa

SEQ ID NO: 243484 - RNA, 22 nt, Homo sapiens
auucacuuuuauagacaggucu

SEQ ID NO: 243485 - RNA, 22 nt, Homo sapiens
auucagaggggcagcugucuug

SEQ ID NO: 243486 - RNA, 22 nt, Homo sapiens
auuccacuuccacuaguuucuc

SEQ ID NO: 243487 - RNA, 22 nt, Homo sapiens
auuccuuaggcccuuugguuag

SEQ ID NO: 243488 - RNA, 22 nt, Homo sapiens
auugaacaugccauauguacca

SEQ ID NO: 243489 - RNA, 21 nt, Homo sapiens
auugcacaauauacccaugua

SEQ ID NO: 243490 - RNA, 22 nt, Homo sapiens
auugcacaccagucugggcaaa

SEQ ID NO: 243491 - RNA, 22 nt, Homo sapiens
auugcacuccagcccugcugac

SEQ ID NO: 243492 - RNA, 22 nt, Homo sapiens
auugcacuccagccuagguaac

SEQ ID NO: 243493 - RNA, 22 nt, Homo sapiens
auugcacuccagccucggugac

SEQ ID NO: 243494 - RNA, 22 nt, Homo sapiens
auugcacuccagccuggccaac

SEQ ID NO: 243495 - RNA, 22 nt, Homo sapiens
cuccgggugcgucggcgcccug

SEQ ID NO: 243496 - RNA, 22 nt, Homo sapiens
cuccuggugauuggagugugaa

SEQ ID NO: 243497 - RNA, 22 nt, Homo sapiens
cucucugagccauggcugcccu

SEQ ID NO: 243498 - RNA, 22 nt, Homo sapiens
cucuuggguagauuuugcagag

SEQ ID NO: 243499 - RNA, 22 nt, Homo sapiens
cucuuugaguuccuccuggugu

SEQ ID NO: 243500 - RNA, 22 nt, Homo sapiens
cugaaaagcaucugcauagcug

SEQ ID NO: 243501 - RNA, 22 nt, Homo sapiens
cugaaaugaauuauuuucuuuc

SEQ ID NO: 243502 - RNA, 22 nt, Homo sapiens
cugaaauguccaucgacugaug

SEQ ID NO: 243503 - RNA, 22 nt, Homo sapiens
cugaagugcuugccacauaaaa

SEQ ID NO: 243504 - RNA, 22 nt, Homo sapiens
cugaaucauugcauuaucaagg

SEQ ID NO: 243505 - RNA, 22 nt, Homo sapiens
cugaauguucuggauggaagag

SEQ ID NO: 243506 - RNA, 22 nt, Homo sapiens
cugaauguuucacucugaaaug

SEQ ID NO: 243507 - RNA, 22 nt, Homo sapiens
cugaauguuuucuucuauucug

SEQ ID NO: 243508 - RNA, 22 nt, Homo sapiens
cugagauacacuaauagucucu

SEQ ID NO: 243509 - RNA, 22 nt, Homo sapiens
cugagauaggacucugcuggcu

SEQ ID NO: 243510 - RNA, 22 nt, Homo sapiens
cugagcaaaguucuauuuaugg

SEQ ID NO: 243511 - RNA, 22 nt, Homo sapiens
cugaggaaguucuuuaacaguu

SEQ ID NO: 243512 - RNA, 22 nt, Homo sapiens
cugagguaauuuguugccagua

SEQ ID NO: 243513 - RNA, 22 nt, Homo sapiens
cugaggugauauauacauauuu

SEQ ID NO: 243514 - RNA, 18 nt, Homo sapiens
cugagucauuccuggguc

SEQ ID NO: 243515 - RNA, 22 nt, Homo sapiens
cugauauuuuaaaauuggcugg

SEQ ID NO: 243516 - RNA, 22 nt, Homo sapiens
cugaucuguuauacuuuucuau

SEQ ID NO: 243517 - RNA, 22 nt, Homo sapiens
cugaugaaguauuuguucugga

SEQ ID NO: 243518 - RNA, 22 nt, Homo sapiens
cugauuuguccccagccucaug

SEQ ID NO: 243519 - RNA, 22 nt, Homo sapiens
cugcaagaugcauaggaauuuu

SEQ ID NO: 243520 - RNA, 19 nt, Homo sapiens
cugcaagguaauaggucag

SEQ ID NO: 243521 - RNA, 22 nt, Homo sapiens
cugcacugagacccucuuugcu

SEQ ID NO: 243522 - RNA, 22 nt, Homo sapiens
cugcauaaucaucucucugcau

SEQ ID NO: 243523 - RNA, 22 nt, Homo sapiens
cugccuagaucugaaccuggcu

SEQ ID NO: 243524 - RNA, 22 nt, Homo sapiens
cuggaaacaucuuaggaaugca

SEQ ID NO: 243525 - RNA, 22 nt, Homo sapiens
cuggaaagcaaagggugcauug

SEQ ID NO: 243526 - RNA, 22 nt, Homo sapiens
cuggaaagcaaguccauugcuc

SEQ ID NO: 243527 - RNA, 22 nt, Homo sapiens
cuggaaggaaaaacaaccacag

SEQ ID NO: 243528 - RNA, 22 nt, Homo sapiens
cuggaaugcagcuuuaggggcu

SEQ ID NO: 243529 - RNA, 22 nt, Homo sapiens
cuggaauguuccuaaagauuca

SEQ ID NO: 243530 - RNA, 22 nt, Homo sapiens
cuggaauucaaaaucugaauuu

SEQ ID NO: 243531 - RNA, 22 nt, Homo sapiens
cuggagcauugguggauuuguu

SEQ ID NO: 243532 - RNA, 22 nt, Homo sapiens
cuggagucugacugacacaagg

SEQ ID NO: 243533 - RNA, 22 nt, Homo sapiens
cuggauauuaacauugaugaaa

SEQ ID NO: 243534 - RNA, 20 nt, Homo sapiens
cuggaugucgaggcagaggu

SEQ ID NO: 243535 - RNA, 18 nt, Homo sapiens
cuggaugucgaguguguu

SEQ ID NO: 243536 - RNA, 22 nt, Homo sapiens
cuggcaaauaguagagccagga

SEQ ID NO: 243537 - RNA, 22 nt, Homo sapiens
cuggcaauaaauuuuuguguug

SEQ ID NO: 243538 - RNA, 22 nt, Homo sapiens
cuggcgagacagcuccaucacu

SEQ ID NO: 243539 - RNA, 22 nt, Homo sapiens
cuggcucauuucauuuagcaua

SEQ ID NO: 243540 - RNA, 22 nt, Homo sapiens
cugggaugauguaaauaggcua

SEQ ID NO: 243541 - RNA, 22 nt, Homo sapiens
cugggaugugacuguugccccc

SEQ ID NO: 243542 - RNA, 22 nt, Homo sapiens
cugggguaggacuggcuuuuga

SEQ ID NO: 243543 - RNA, 22 nt, Homo sapiens
cugguaguguuuauaaggguau

SEQ ID NO: 243544 - RNA, 22 nt, Homo sapiens
cuguaaagaucacagagcuggu

SEQ ID NO: 243545 - RNA, 22 nt, Homo sapiens
cuguaguuagcagaugaugaau

SEQ ID NO: 243546 - RNA, 22 nt, Homo sapiens
cuguauguuucuaugaauguga

SEQ ID NO: 243547 - RNA, 19 nt, Homo sapiens
cugucacugaggaagacug

SEQ ID NO: 243548 - RNA, 22 nt, Homo sapiens
cugucuagagggcacaugaugc

SEQ ID NO: 243549 - RNA, 22 nt, Homo sapiens
cugucuguuucaaaagugguua

SEQ ID NO: 243550 - RNA, 22 nt, Homo sapiens
cugugcaaagcgcucucggggu

SEQ ID NO: 243551 - RNA, 22 nt, Homo sapiens
cugugcuugagagaugacacag

SEQ ID NO: 243552 - RNA, 23 nt, Homo sapiens
cuguggauaugaguuguaaaugg

SEQ ID NO: 243553 - RNA, 23 nt, Homo sapiens
cuguggugaggcccuagaaucug

SEQ ID NO: 243554 - RNA, 22 nt, Homo sapiens
cugugguguaacucuuggggcg

SEQ ID NO: 243555 - RNA, 22 nt, Homo sapiens
cuguuaacauguuguggauaau

SEQ ID NO: 243556 - RNA, 22 nt, Homo sapiens
cuguugcaguuauggcugcagg

SEQ ID NO: 243557 - RNA, 22 nt, Homo sapiens
cuguugguuaaauuccaugcag

SEQ ID NO: 243558 - RNA, 22 nt, Homo sapiens
cuguuugguaaggaugccucag

SEQ ID NO: 243559 - RNA, 22 nt, Homo sapiens
cuguuugguuaucuuuuccugu

SEQ ID NO: 243560 - RNA, 22 nt, Homo sapiens
cuuagguuaugauaaauuuagu

SEQ ID NO: 243561 - RNA, 22 nt, Homo sapiens
cuucaaaguuggcuaggagaca

SEQ ID NO: 243562 - RNA, 22 nt, Homo sapiens
cuucaaguguggccaccugacc

SEQ ID NO: 243563 - RNA, 20 nt, Homo sapiens
cuuccaguggccccaucuuu

SEQ ID NO: 243564 - RNA, 22 nt, Homo sapiens
cuucuguuaguucugauaacuu

SEQ ID NO: 243565 - RNA, 22 nt, Homo sapiens
cuucuugcuguguccucacaug

SEQ ID NO: 243566 - RNA, 22 nt, Homo sapiens
cuugacaucugucaguuccuca

SEQ ID NO: 243567 - RNA, 22 nt, Homo sapiens
cuugaccaauauggugaaaccc

SEQ ID NO: 243568 - RNA, 22 nt, Homo sapiens
cuugaccuauggaucuguuuuu

SEQ ID NO: 243569 - RNA, 22 nt, Homo sapiens
cuugcagagucauucuaauuuc

SEQ ID NO: 243570 - RNA, 22 nt, Homo sapiens
cuuggcacgugauagguguuga

SEQ ID NO: 243571 - RNA, 22 nt, Homo sapiens
cuuggcacugcucacccuccuu

SEQ ID NO: 243572 - RNA, 22 nt, Homo sapiens
cuuggcuccgacuccccuccaa

SEQ ID NO: 243573 - RNA, 22 nt, Homo sapiens
cuuggcuucuuuauguggcuau

SEQ ID NO: 243574 - RNA, 20 nt, Homo sapiens
cuuggcuuucuugguguuaa

SEQ ID NO: 243575 - RNA, 22 nt, Homo sapiens
cuuggguugauugauaaugcca

SEQ ID NO: 243576 - RNA, 18 nt, Homo sapiens
cuugucaaaucuuuccuc

SEQ ID NO: 243577 - RNA, 22 nt, Homo sapiens
cuugucuugcacacgguugcca

SEQ ID NO: 243578 - RNA, 21 nt, Homo sapiens
cuugucuugcuuagaauagac

SEQ ID NO: 243579 - RNA, 22 nt, Homo sapiens
cuugugcaugaccccagguggg

SEQ ID NO: 243580 - RNA, 22 nt, Homo sapiens
cuuuggcacuuccuaagugcca

SEQ ID NO: 243581 - RNA, 22 nt, Homo sapiens
cuuugguguauuuucagagacc

SEQ ID NO: 243582 - RNA, 23 nt, Homo sapiens
cuuuguccccacccaaaucucau

SEQ ID NO: 243583 - RNA, 22 nt, Homo sapiens
cuuuguccuucaagguguguca

SEQ ID NO: 243584 - RNA, 22 nt, Homo sapiens
cuuugugcccuucugcccauca

SEQ ID NO: 243585 - RNA, 22 nt, Homo sapiens
cuuugugugggccaagggcugg

SEQ ID NO: 243586 - RNA, 22 nt, Homo sapiens
cuuuuggucuaucagagaagca

SEQ ID NO: 243587 - RNA, 22 nt, Homo sapiens
cuuuuggugguucugaugcagg

SEQ ID NO: 243588 - RNA, 22 nt, Homo sapiens
cuuuuugcaaauacaacucuga

SEQ ID NO: 243589 - RNA, 22 nt, Homo sapiens
cuuuuugcuagagucuaggguc

SEQ ID NO: 243590 - RNA, 22 nt, Homo sapiens
gaaacugcauuucuaacaagcu

SEQ ID NO: 243591 - RNA, 22 nt, Homo sapiens
gaaagugcugcaaggccaugca

SEQ ID NO: 243592 - RNA, 22 nt, Homo sapiens
gaaagugcugcuugacugggau

SEQ ID NO: 243593 - RNA, 22 nt, Homo sapiens
gaaaugcucauuuuggauccuu

SEQ ID NO: 243594 - RNA, 22 nt, Homo sapiens
gaacuggcuuagugaaacuucc

SEQ ID NO: 243595 - RNA, 20 nt, Homo sapiens
gaacugguguauguuuaacu

SEQ ID NO: 243596 - RNA, 22 nt, Homo sapiens
gaagauguugcuuaccuuggag

SEQ ID NO: 243597 - RNA, 22 nt, Homo sapiens
guaaucucaccuacuugggagg

SEQ ID NO: 243598 - RNA, 22 nt, Homo sapiens
guaaucucagcuacuugggagc

SEQ ID NO: 243599 - RNA, 22 nt, Homo sapiens
guacaguacugaaugaauguau

SEQ ID NO: 243600 - RNA, 22 nt, Homo sapiens
guacaguauaguaauaggauuu

SEQ ID NO: 243601 - RNA, 22 nt, Homo sapiens
guacaugcauacaugcacaucu

SEQ ID NO: 243602 - RNA, 22 nt, Homo sapiens
guagagguagauucuguuuuga

SEQ ID NO: 243603 - RNA, 22 nt, Homo sapiens
guagaugcauggauuuacuucu

SEQ ID NO: 243604 - RNA, 22 nt, Homo sapiens
guagcagcuacuaaguugcugu

SEQ ID NO: 243605 - RNA, 22 nt, Homo sapiens
guaggcacuggcucagcuuauc

SEQ ID NO: 243606 - RNA, 22 nt, Homo sapiens
guaguuuaucagaaagaauagg

SEQ ID NO: 243607 - RNA, 22 nt, Homo sapiens
guauacaguugacccuugaacc

SEQ ID NO: 243608 - RNA, 22 nt, Homo sapiens
guauaguaguacaaaaguuuuu

SEQ ID NO: 243609 - RNA, 22 nt, Homo sapiens
guaucccuugcuaucugaaucu

SEQ ID NO: 243610 - RNA, 22 nt, Homo sapiens
guauggaagucaguuuguuggc

SEQ ID NO: 243611 - RNA, 22 nt, Homo sapiens
guaugguuuauagggaaauugu

SEQ ID NO: 243612 - RNA, 22 nt, Homo sapiens
guaugugcauuguaaauuuuga

SEQ ID NO: 243613 - RNA, 22 nt, Homo sapiens
guauuguacuacaagcucuuua

SEQ ID NO: 243614 - RNA, 22 nt, Homo sapiens
guauuugauuauagcaugcuua

SEQ ID NO: 243615 - RNA, 22 nt, Homo sapiens
guauuuguugcagcagcacuau

SEQ ID NO: 243616 - RNA, 22 nt, Homo sapiens
guauuuuguuagggugugguau

SEQ ID NO: 243617 - RNA, 22 nt, Homo sapiens
gucaagagaacuuucuaucacu

SEQ ID NO: 243618 - RNA, 22 nt, Homo sapiens
gucaaguaaauguuaugguuau

SEQ ID NO: 243619 - RNA, 22 nt, Homo sapiens
gucacugagauugguauuaaug

SEQ ID NO: 243620 - RNA, 22 nt, Homo sapiens
gucacugccugaggcugaugca

SEQ ID NO: 243621 - RNA, 22 nt, Homo sapiens
gucagcaaagaggaauaguuug

SEQ ID NO: 243622 - RNA, 22 nt, Homo sapiens
gucaggcaccgauacaguuuuu

SEQ ID NO: 243623 - RNA, 22 nt, Homo sapiens
gucagugccugucccaggcuuu

SEQ ID NO: 243624 - RNA, 22 nt, Homo sapiens
gucaguggauacugucucuguc

SEQ ID NO: 243625 - RNA, 22 nt, Homo sapiens
gucagugucuuugcagcucaga

SEQ ID NO: 243626 - RNA, 22 nt, Homo sapiens
gucagugugauaucugcagggg

SEQ ID NO: 243627 - RNA, 22 nt, Homo sapiens
gucaugggguacuacacauggg

SEQ ID NO: 243628 - RNA, 22 nt, Homo sapiens
guccaaagugggagaggugggg

SEQ ID NO: 243629 - RNA, 22 nt, Homo sapiens
guccaaauccaugggauguaca

SEQ ID NO: 243630 - RNA, 22 nt, Homo sapiens
guccauuuguuuccagagcacu

SEQ ID NO: 243631 - RNA, 22 nt, Homo sapiens
gucccagagauauugugucuuu

SEQ ID NO: 243632 - RNA, 22 nt, Homo sapiens
gucccaguggaaccuccaagcu

SEQ ID NO: 243633 - RNA, 22 nt, Homo sapiens
gucucacagcuagcugcuuuau

SEQ ID NO: 243634 - RNA, 22 nt, Homo sapiens
gucucauugcaguuagaccugu

SEQ ID NO: 243635 - RNA, 22 nt, Homo sapiens
gucucccagccuacaucuuucu

SEQ ID NO: 243636 - RNA, 22 nt, Homo sapiens
gucucugguugcuuuuguacca

SEQ ID NO: 243637 - RNA, 22 nt, Homo sapiens
gucugagcauggggccggcagg

SEQ ID NO: 243638 - RNA, 22 nt, Homo sapiens
gucugcaugucauaugauagua

SEQ ID NO: 243639 - RNA, 22 nt, Homo sapiens
gucuggcuccugucuaaucacu

SEQ ID NO: 243640 - RNA, 22 nt, Homo sapiens
gucuggcuccuucuacuacaug

SEQ ID NO: 243641 - RNA, 20 nt, Homo sapiens
gucugucuccgaguagaauu

SEQ ID NO: 243642 - RNA, 22 nt, Homo sapiens
gucugugcauuaauacgugcug

SEQ ID NO: 243643 - RNA, 22 nt, Homo sapiens
gucuguuugauccagaucaaaa

SEQ ID NO: 243644 - RNA, 22 nt, Homo sapiens
gucuuugagauaggguuauuuu

SEQ ID NO: 243645 - RNA, 22 nt, Homo sapiens
gucuuugaugucuaugugcuuc

SEQ ID NO: 243646 - RNA, 22 nt, Homo sapiens
gugaaaagaugagcaccauaca

SEQ ID NO: 243647 - RNA, 22 nt, Homo sapiens
gugaauugagagaacuguguua

SEQ ID NO: 243648 - RNA, 22 nt, Homo sapiens
gugagaauugacacccuugucu

SEQ ID NO: 243649 - RNA, 22 nt, Homo sapiens
gugagaggaggcagcuuuuaca

SEQ ID NO: 243650 - RNA, 22 nt, Homo sapiens
gugagauacuagagauauagug

SEQ ID NO: 243651 - RNA, 22 nt, Homo sapiens
gugagauccucucuuauauggg

SEQ ID NO: 243652 - RNA, 22 nt, Homo sapiens
gugagaugauggguauguuaau

SEQ ID NO: 243653 - RNA, 22 nt, Homo sapiens
gugagaugguaucucauugugg

SEQ ID NO: 243654 - RNA, 22 nt, Homo sapiens
gugagauuaccauuuaaaucag

SEQ ID NO: 243655 - RNA, 22 nt, Homo sapiens
gugagauuagcugagauccuug

SEQ ID NO: 243656 - RNA, 22 nt, Homo sapiens
gugagcaaacuuaccuaagguu

SEQ ID NO: 243657 - RNA, 22 nt, Homo sapiens
gugagcaauugauacuugaagu

SEQ ID NO: 243658 - RNA, 22 nt, Homo sapiens
gugagcagagaucgcgugauug

SEQ ID NO: 243659 - RNA, 22 nt, Homo sapiens
gugagcauaacaacagaguuua

SEQ ID NO: 243660 - RNA, 22 nt, Homo sapiens
gugagcauauuaguauugcacu

SEQ ID NO: 243661 - RNA, 22 nt, Homo sapiens
gugaggaaggaaaccugcuagc

SEQ ID NO: 243662 - RNA, 22 nt, Homo sapiens
gugaggcuuuuccuguuagacu

SEQ ID NO: 243663 - RNA, 22 nt, Homo sapiens
gugagguacgugucaagaacca

SEQ ID NO: 243664 - RNA, 20 nt, Homo sapiens
gugagguagaggguuaccug

SEQ ID NO: 243665 - RNA, 22 nt, Homo sapiens
gugagguauacugggaucacua

SEQ ID NO: 243666 - RNA, 17 nt, Homo sapiens
gugagguggguaguauc

SEQ ID NO: 243667 - RNA, 22 nt, Homo sapiens
gugaggugguacaauauuaacu

SEQ ID NO: 243668 - RNA, 22 nt, Homo sapiens
gugagguguuaaccaaccugug

SEQ ID NO: 243669 - RNA, 22 nt, Homo sapiens
gugaguuauuauuuauguaaac

SEQ ID NO: 243670 - RNA, 22 nt, Homo sapiens
gugauacugcuuauuaauuuaa

SEQ ID NO: 243671 - RNA, 22 nt, Homo sapiens
gugaucaugauccugaagcauu

SEQ ID NO: 243672 - RNA, 21 nt, Homo sapiens
gugaucaugucacugcacucc

SEQ ID NO: 243673 - RNA, 22 nt, Homo sapiens
gugauguguuucaacagcuccu

SEQ ID NO: 243674 - RNA, 22 nt, Homo sapiens
gugauugugaaaacauuaagaa

SEQ ID NO: 243675 - RNA, 22 nt, Homo sapiens
gugcaaaucucugaguaucuuu

SEQ ID NO: 243676 - RNA, 22 nt, Homo sapiens
gugcaaauuccagcucaacucc

SEQ ID NO: 243677 - RNA, 18 nt, Homo sapiens
gugcaaugaauagcagag

SEQ ID NO: 243678 - RNA, 22 nt, Homo sapiens
gugcagugugauccuuccguau

SEQ ID NO: 243679 - RNA, 18 nt, Homo sapiens
gugcauagccauggcagc

SEQ ID NO: 243680 - RNA, 22 nt, Homo sapiens
guggaaaauuauugcuguuuuu

SEQ ID NO: 243681 - RNA, 21 nt, Homo sapiens
guggaaauggaauuuacuaau

SEQ ID NO: 243682 - RNA, 22 nt, Homo sapiens
guggaagcacaggccuccugga

SEQ ID NO: 243683 - RNA, 22 nt, Homo sapiens
guggaaggucaugaauguucuu

SEQ ID NO: 243684 - RNA, 22 nt, Homo sapiens
guggaagugucuggggccaggg

SEQ ID NO: 243685 - RNA, 22 nt, Homo sapiens
guggagcuguguggccuugggc

SEQ ID NO: 243686 - RNA, 22 nt, Homo sapiens
guggcacaauuaaguagcuauu

SEQ ID NO: 243687 - RNA, 22 nt, Homo sapiens
guggcagcacauauagguuguu

SEQ ID NO: 243688 - RNA, 22 nt, Homo sapiens
guggcagugugaggauccugcu

SEQ ID NO: 243689 - RNA, 22 nt, Homo sapiens
guggcaugaaagcaucugugau

SEQ ID NO: 243690 - RNA, 22 nt, Homo sapiens
guggcauuucccaaaguauucu

SEQ ID NO: 243691 - RNA, 23 nt, Homo sapiens
guggccuuuggccaguccgaguc

SEQ ID NO: 243692 - RNA, 22 nt, Homo sapiens
guggcuauucaccuuuaugaaa

SEQ ID NO: 243693 - RNA, 22 nt, Homo sapiens
gugggaagcuggaacucccucc

SEQ ID NO: 243694 - RNA, 22 nt, Homo sapiens
gugggauauaaucaguccugua

SEQ ID NO: 243695 - RNA, 22 nt, Homo sapiens
gugggaugcaaguaaaauuguc

SEQ ID NO: 243696 - RNA, 22 nt, Homo sapiens
gugggcucguucguguuagaca

SEQ ID NO: 243697 - RNA, 22 nt, Homo sapiens
guggguaaaucucuguucgagg

SEQ ID NO: 243698 - RNA, 22 nt, Homo sapiens
gugguagaaaguaccaaacuag

SEQ ID NO: 243699 - RNA, 22 nt, Homo sapiens
uacugaccugaaggccauggaa

SEQ ID NO: 243700 - RNA, 22 nt, Homo sapiens
uacugaccugucauucagaguu

SEQ ID NO: 243701 - RNA, 22 nt, Homo sapiens
uacugcacuccagccuggguga

SEQ ID NO: 243702 - RNA, 22 nt, Homo sapiens
uacugcacucuagccuggguga

SEQ ID NO: 243703 - RNA, 22 nt, Homo sapiens
uacugcauuccaaucugggcga

SEQ ID NO: 243704 - RNA, 22 nt, Homo sapiens
uacugguuuuauauauuucucc

SEQ ID NO: 243705 - RNA, 22 nt, Homo sapiens
uagaaaguagggaagguaggau

SEQ ID NO: 243706 - RNA, 22 nt, Homo sapiens
uagaaugaaacaagcugugccu

SEQ ID NO: 243707 - RNA, 22 nt, Homo sapiens
uagaaugucagcuucuugaggg

SEQ ID NO: 243708 - RNA, 22 nt, Homo sapiens
uagaccaauuggcauauaguaa

SEQ ID NO: 243709 - RNA, 22 nt, Homo sapiens
uagacccauuguucagagagug

SEQ ID NO: 243710 - RNA, 20 nt, Homo sapiens
uagagagauauggggguucc

SEQ ID NO: 243711 - RNA, 22 nt, Homo sapiens
uagagagcuguuugaaagcagg

SEQ ID NO: 243712 - RNA, 22 nt, Homo sapiens
uagagccauugcagauguuuga

SEQ ID NO: 243713 - RNA, 22 nt, Homo sapiens
uagagcuugacacuuuccaugg

SEQ ID NO: 243714 - RNA, 22 nt, Homo sapiens
uagagguagccuacuacacacc

SEQ ID NO: 243715 - RNA, 22 nt, Homo sapiens
uagagguagguguaugaacuag

SEQ ID NO: 243716 - RNA, 22 nt, Homo sapiens
uagauuaucuguaugugcucuu

SEQ ID NO: 243717 - RNA, 21 nt, Homo sapiens
uagcaaauugcuauuaaggca

SEQ ID NO: 243718 - RNA, 23 nt, Homo sapiens
uagcaacaguuggaggugaggua

SEQ ID NO: 243719 - RNA, 22 nt, Homo sapiens
uagcacaucccuaaaaugcugu

SEQ ID NO: 243720 - RNA, 22 nt, Homo sapiens
uagcacaugucagguaauuugc

SEQ ID NO: 243721 - RNA, 22 nt, Homo sapiens
uagcaccucuuuggccuuucgu

SEQ ID NO: 243722 - RNA, 22 nt, Homo sapiens
uagcagcaaagcaggaucugcu

SEQ ID NO: 243723 - RNA, 20 nt, Homo sapiens
uagcagcagacagagggagg

SEQ ID NO: 243724 - RNA, 22 nt, Homo sapiens
uagcagcauuuuuguagaguau

SEQ ID NO: 243725 - RNA, 22 nt, Homo sapiens
uagcagguggugaccacauuuu

SEQ ID NO: 243726 - RNA, 22 nt, Homo sapiens
uagcagugugaaaacagacuaa

SEQ ID NO: 243727 - RNA, 22 nt, Homo sapiens
uagcccagugagguugauuugg

SEQ ID NO: 243728 - RNA, 22 nt, Homo sapiens
uagccgggugugguggaacucc

SEQ ID NO: 243729 - RNA, 22 nt, Homo sapiens
uagcucagcccagcuaagcuca

SEQ ID NO: 243730 - RNA, 22 nt, Homo sapiens
uagcugagacuacaguaggugc

SEQ ID NO: 243731 - RNA, 22 nt, Homo sapiens
uagcugcuguauguacacggau

SEQ ID NO: 243732 - RNA, 22 nt, Homo sapiens
uagcuggaauuacuugcaccug

SEQ ID NO: 243733 - RNA, 22 nt, Homo sapiens
uagcugguucuccaggagcuag

SEQ ID NO: 243734 - RNA, 22 nt, Homo sapiens
uagcuucuccauagcuccaugu

SEQ ID NO: 243735 - RNA, 22 nt, Homo sapiens
uaggacacaggacauauguaga

SEQ ID NO: 243736 - RNA, 22 nt, Homo sapiens
uaggacacucucuccaccagua

SEQ ID NO: 243737 - RNA, 22 nt, Homo sapiens
uaggacauugcccuuguggaga

SEQ ID NO: 243738 - RNA, 22 nt, Homo sapiens
uaggagcacaaacccuacugug

SEQ ID NO: 243739 - RNA, 22 nt, Homo sapiens
uaggagcacagcagcauguggg

SEQ ID NO: 243740 - RNA, 22 nt, Homo sapiens
uaggagcauaggauuguuugag

SEQ ID NO: 243741 - RNA, 22 nt, Homo sapiens
uaggcaauguggcgaaacucug

SEQ ID NO: 243742 - RNA, 22 nt, Homo sapiens
uaggcaguguucucacuuguaa

SEQ ID NO: 243743 - RNA, 19 nt, Homo sapiens
uagggcacgaggcagaguc

SEQ ID NO: 243744 - RNA, 22 nt, Homo sapiens
uagguaagauguuaacagcuga

SEQ ID NO: 243745 - RNA, 22 nt, Homo sapiens
uagguagaacccagaaaucuga

SEQ ID NO: 243746 - RNA, 22 nt, Homo sapiens
uaggugaaugcuggaagaaaug

SEQ ID NO: 243747 - RNA, 23 nt, Homo sapiens
uagguuauuugguaaauauaugu

SEQ ID NO: 243748 - RNA, 22 nt, Homo sapiens
uaguauguuuauagcauugagu

SEQ ID NO: 243749 - RNA, 22 nt, Homo sapiens
uagucaaaucugaaggaaauuu

SEQ ID NO: 243750 - RNA, 22 nt, Homo sapiens
uagucagcaauguucauguucu

SEQ ID NO: 243751 - RNA, 22 nt, Homo sapiens
uagucccauaugauuuagugaa

SEQ ID NO: 243752 - RNA, 22 nt, Homo sapiens
uagucccuuucuauuaaugaga

SEQ ID NO: 243753 - RNA, 20 nt, Homo sapiens
uaguggaaaucagguccucu

SEQ ID NO: 243754 - RNA, 22 nt, Homo sapiens
uaguuaguagacucugauuauu

SEQ ID NO: 243755 - RNA, 22 nt, Homo sapiens
uaguuauggaguaauuuuaagc

SEQ ID NO: 243756 - RNA, 22 nt, Homo sapiens
uaguucauuauguguugcucag

SEQ ID NO: 243757 - RNA, 22 nt, Homo sapiens
uaguucguguuugaacuagauc

SEQ ID NO: 243758 - RNA, 22 nt, Homo sapiens
uaguugcaucuuaggucuguga

SEQ ID NO: 243759 - RNA, 22 nt, Homo sapiens
uaguugcauucaggauaugacg

SEQ ID NO: 243760 - RNA, 22 nt, Homo sapiens
uauaaccauuucuucucucuuc

SEQ ID NO: 243761 - RNA, 22 nt, Homo sapiens
uauacaguaggcacucaguggc

SEQ ID NO: 243762 - RNA, 22 nt, Homo sapiens
uauagcacugagaauguaauuc

SEQ ID NO: 243763 - RNA, 22 nt, Homo sapiens
uauagcuuaaaguuuagauccu

SEQ ID NO: 243764 - RNA, 22 nt, Homo sapiens
uauagcuuuuuagggaauuugg

SEQ ID NO: 243765 - RNA, 22 nt, Homo sapiens
uauaugucuuuguuauguugag

SEQ ID NO: 243766 - RNA, 22 nt, Homo sapiens
uaucaagaugacaaacuuugcu

SEQ ID NO: 243767 - RNA, 22 nt, Homo sapiens
uaucaaggccacucauuuuaug

SEQ ID NO: 243768 - RNA, 23 nt, Homo sapiens
uaucacacuuucucugugccaca

SEQ ID NO: 243769 - RNA, 22 nt, Homo sapiens
uaucacagcgggguguacaccc

SEQ ID NO: 243770 - RNA, 22 nt, Homo sapiens
uaucacaguaucuagcacagug

SEQ ID NO: 243771 - RNA, 22 nt, Homo sapiens
uaucacuguuguuuguuuaagg

SEQ ID NO: 243772 - RNA, 21 nt, Homo sapiens
uaucagagacauugagaggca

SEQ ID NO: 243773 - RNA, 22 nt, Homo sapiens
uaucagaguuacacugaagacu

SEQ ID NO: 243774 - RNA, 22 nt, Homo sapiens
uaucagauugcugccaucugcu

SEQ ID NO: 243775 - RNA, 22 nt, Homo sapiens
uaucagcacaguggguucaugg

SEQ ID NO: 243776 - RNA, 22 nt, Homo sapiens
uaucaucauguuuuugcugugu

SEQ ID NO: 243777 - RNA, 22 nt, Homo sapiens
uaucccaauguaauaucacaaa

SEQ ID NO: 243778 - RNA, 22 nt, Homo sapiens
uaucccuguggacuucccaaca

SEQ ID NO: 243779 - RNA, 23 nt, Homo sapiens
uaucccuugccuuaugaugugag

SEQ ID NO: 243780 - RNA, 22 nt, Homo sapiens
uauccugaagcuuuauuuaagu

SEQ ID NO: 243781 - RNA, 22 nt, Homo sapiens
uaucuacauguagguauguaug

SEQ ID NO: 243782 - RNA, 22 nt, Homo sapiens
uaucucuuuucauguguaaaug

SEQ ID NO: 243783 - RNA, 22 nt, Homo sapiens
uaugaauuuuauccaggauaua

SEQ ID NO: 243784 - RNA, 23 nt, Homo sapiens
uaugacagaggaagggggagcug

SEQ ID NO: 243785 - RNA, 22 nt, Homo sapiens
uaugacugagacuuaaauugug

SEQ ID NO: 243786 - RNA, 22 nt, Homo sapiens
uaugagacugguuaauuuuugu

SEQ ID NO: 243787 - RNA, 22 nt, Homo sapiens
uaugagagcugguagguagaga

SEQ ID NO: 243788 - RNA, 19 nt, Homo sapiens
uaugcaacuuauagugcug

SEQ ID NO: 243789 - RNA, 22 nt, Homo sapiens
uaugcacacacguguuuaugug

SEQ ID NO: 243790 - RNA, 22 nt, Homo sapiens
uaugcacuaggcacuguguuug

SEQ ID NO: 243791 - RNA, 22 nt, Homo sapiens
uaugcacuauagcauauguggu

SEQ ID NO: 243792 - RNA, 22 nt, Homo sapiens
uaugccuuuuggcucaagaaac

SEQ ID NO: 243793 - RNA, 19 nt, Homo sapiens
uaugcuauuuauuagaagu

SEQ ID NO: 243794 - RNA, 22 nt, Homo sapiens
uauggauguuaagguucacagc

SEQ ID NO: 243795 - RNA, 22 nt, Homo sapiens
uauggauuucauuagacuugag

SEQ ID NO: 243796 - RNA, 22 nt, Homo sapiens
uauggcugcuuucacacuacaa

SEQ ID NO: 243797 - RNA, 22 nt, Homo sapiens
uaugggcuuuguuuuguacuag

SEQ ID NO: 243798 - RNA, 22 nt, Homo sapiens
uauggguguuauugcaugggag

SEQ ID NO: 243799 - RNA, 22 nt, Homo sapiens
uaugucacagguuuuggugaaa

SEQ ID NO: 243800 - RNA, 22 nt, Homo sapiens
uaugucacuggacauaaguucu

SEQ ID NO: 243801 - RNA, 22 nt, Homo sapiens
uccacuuuugugcugaauugga

SEQ ID NO: 243802 - RNA, 22 nt, Homo sapiens
uccagaguggugaugcuggggc

SEQ ID NO: 243803 - RNA, 22 nt, Homo sapiens
uccagguacucagggggcugag

SEQ ID NO: 243804 - RNA, 22 nt, Homo sapiens
uccagugugcaggcaaguuuga

SEQ ID NO: 243805 - RNA, 18 nt, Homo sapiens
uccaguuuucccagcauc

SEQ ID NO: 243806 - RNA, 19 nt, Homo sapiens
uccaugagcccacagugau

SEQ ID NO: 243807 - RNA, 22 nt, Homo sapiens
uccauugucuagauguaacaca

SEQ ID NO: 243808 - RNA, 23 nt, Homo sapiens
ucccaagauggaccagaccaagg

SEQ ID NO: 243809 - RNA, 22 nt, Homo sapiens
ucccagaaacgcauauguucau

SEQ ID NO: 243810 - RNA, 22 nt, Homo sapiens
ucccaguggucuugaaacaggg

SEQ ID NO: 243811 - RNA, 22 nt, Homo sapiens
uccccugagaacuugcuagaaa

SEQ ID NO: 243812 - RNA, 19 nt, Homo sapiens
ucccugagucuuagcuuga

SEQ ID NO: 243813 - RNA, 22 nt, Homo sapiens
ucccuguuaggcacagauuuau

SEQ ID NO: 243814 - RNA, 22 nt, Homo sapiens
ucccuguuguuucauaauuuua

SEQ ID NO: 243815 - RNA, 17 nt, Homo sapiens
ucccuguuuuuucaguc

SEQ ID NO: 243816 - RNA, 22 nt, Homo sapiens
ucccuugguaauucuguuccuu

SEQ ID NO: 243817 - RNA, 18 nt, Homo sapiens
ucccuuuguagaugaccc

SEQ ID NO: 243818 - RNA, 22 nt, Homo sapiens
ucccuuuguccaacggauccac

SEQ ID NO: 243819 - RNA, 22 nt, Homo sapiens
uccuacugucuucggggcacug

SEQ ID NO: 243820 - RNA, 22 nt, Homo sapiens
uccugagacucacaggcucccc

SEQ ID NO: 243821 - RNA, 20 nt, Homo sapiens
uccugagauucccaguucuc

SEQ ID NO: 243822 - RNA, 22 nt, Homo sapiens
uccugagucagcauccguuugu

SEQ ID NO: 243823 - RNA, 22 nt, Homo sapiens
uccugcauucugaaauacaagu

SEQ ID NO: 243824 - RNA, 22 nt, Homo sapiens
uccuggcuccacuguuuauucc

SEQ ID NO: 243825 - RNA, 22 nt, Homo sapiens
uccuugagccuuaaauuauaaa

SEQ ID NO: 243826 - RNA, 22 nt, Homo sapiens
uccuuggugacauuucuugucu

SEQ ID NO: 243827 - RNA, 22 nt, Homo sapiens
uccuugguugauccugugcaga

SEQ ID NO: 243828 - RNA, 23 nt, Homo sapiens
uccuugguuggcgcccuaugugu

SEQ ID NO: 243829 - RNA, 22 nt, Homo sapiens
uccuuuggguagcuguucagau

SEQ ID NO: 243830 - RNA, 20 nt, Homo sapiens
ucgcaccacuauacuccagc

SEQ ID NO: 243831 - RNA, 22 nt, Homo sapiens
ucgcagcacgagcaugcaaggu

SEQ ID NO: 243832 - RNA, 22 nt, Homo sapiens
ucgugcugugucaucuuguggc

SEQ ID NO: 243833 - RNA, 22 nt, Homo sapiens
ucuaaaacuagauugugaugau

SEQ ID NO: 243834 - RNA, 22 nt, Homo sapiens
ucuaauguaaccugcaaauauu

SEQ ID NO: 243835 - RNA, 22 nt, Homo sapiens
ucucaauuugauuacauucaua

SEQ ID NO: 243836 - RNA, 22 nt, Homo sapiens
ucucacaccccucucauauacc

SEQ ID NO: 243837 - RNA, 22 nt, Homo sapiens
ucucacagaguugaauguuucu

SEQ ID NO: 243838 - RNA, 22 nt, Homo sapiens
ucucagugaauguggaaaaagc

SEQ ID NO: 243839 - RNA, 22 nt, Homo sapiens
ucucagugaauugguuuugucu

SEQ ID NO: 243840 - RNA, 22 nt, Homo sapiens
ucucaguggcacccccaacacc

SEQ ID NO: 243841 - RNA, 22 nt, Homo sapiens
ucucaguggcuuccucacuuuu

SEQ ID NO: 243842 - RNA, 20 nt, Homo sapiens
ucucauggagggaaagagca

SEQ ID NO: 243843 - RNA, 22 nt, Homo sapiens
ucucauggcucacccugcauag

SEQ ID NO: 243844 - RNA, 22 nt, Homo sapiens
ucucccauccaugaacuucugu

SEQ ID NO: 243845 - RNA, 22 nt, Homo sapiens
ucucccauccguacacggauug

SEQ ID NO: 243846 - RNA, 22 nt, Homo sapiens
ucucuagagagccugguguuca

SEQ ID NO: 243847 - RNA, 19 nt, Homo sapiens
ucucugguguuggagggga

SEQ ID NO: 243848 - RNA, 22 nt, Homo sapiens
ucucuguuugucuguuacuggu

SEQ ID NO: 243849 - RNA, 22 nt, Homo sapiens
ucugacaaugaacaaucuauag

SEQ ID NO: 243850 - RNA, 22 nt, Homo sapiens
ucugacucuggagucucagguu

SEQ ID NO: 243851 - RNA, 22 nt, Homo sapiens
ucugagacuguuucuaacaagc

SEQ ID NO: 243852 - RNA, 22 nt, Homo sapiens
ucugagcaauagauguggauau

SEQ ID NO: 243853 - RNA, 22 nt, Homo sapiens
ucugagguaggugcauggauac

SEQ ID NO: 243854 - RNA, 21 nt, Homo sapiens
ucugagucauucaguggccug

SEQ ID NO: 243855 - RNA, 22 nt, Homo sapiens
ucugcaagucuaaacuagccau

SEQ ID NO: 243856 - RNA, 22 nt, Homo sapiens
ucugcauauucuagggcaccaa

SEQ ID NO: 243857 - RNA, 21 nt, Homo sapiens
ucuggcccccucaaaucucau

SEQ ID NO: 243858 - RNA, 20 nt, Homo sapiens
ucuggccccuccaaaucuca

SEQ ID NO: 243859 - RNA, 22 nt, Homo sapiens
ucuggcuuuagcaugugggaag

SEQ ID NO: 243860 - RNA, 21 nt, Homo sapiens
ucuggcuuucauuccccuucu

SEQ ID NO: 243861 - RNA, 22 nt, Homo sapiens
ucugggguuagucaaagguaug

SEQ ID NO: 243862 - RNA, 22 nt, Homo sapiens
ucuggguuuuuacaauguuuac

SEQ ID NO: 243863 - RNA, 22 nt, Homo sapiens
ucugguggugaugagagacagu

SEQ ID NO: 243864 - RNA, 22 nt, Homo sapiens
ucuguacugccaaguuucuuua

SEQ ID NO: 243865 - RNA, 22 nt, Homo sapiens
ucugugguucuagcuacuuugg

SEQ ID NO: 243866 - RNA, 22 nt, Homo sapiens
ucuguguuuagacccaggguag

SEQ ID NO: 243867 - RNA, 22 nt, Homo sapiens
ucuguguuugguuggcaauuuc

SEQ ID NO: 243868 - RNA, 22 nt, Homo sapiens
ucuuaguuugggguggggauag

SEQ ID NO: 243869 - RNA, 22 nt, Homo sapiens
ucuuggcauggcugaagauucc

SEQ ID NO: 243870 - RNA, 22 nt, Homo sapiens
ucuuggguuguuggcuucuccu

SEQ ID NO: 243871 - RNA, 22 nt, Homo sapiens
ucuugguuaggggaaauaggca

SEQ ID NO: 243872 - RNA, 19 nt, Homo sapiens
ucuuuagucacauuuuuau

SEQ ID NO: 243873 - RNA, 22 nt, Homo sapiens
ucuuugauaagauccagaagaa

SEQ ID NO: 243874 - RNA, 22 nt, Homo sapiens
ucuuugauguucugaaagaugg

SEQ ID NO: 243875 - RNA, 22 nt, Homo sapiens
ucuuuggagacaaccccagucu

SEQ ID NO: 243876 - RNA, 22 nt, Homo sapiens
ucuuuggguguauuucacagcc

SEQ ID NO: 243877 - RNA, 22 nt, Homo sapiens
ucuuugguaggaguaggaggcc

SEQ ID NO: 243878 - RNA, 22 nt, Homo sapiens
ucuuugguauuuguggggaauu

SEQ ID NO: 243879 - RNA, 22 nt, Homo sapiens
ucuuuguguaggucaaucuggc

SEQ ID NO: 243880 - RNA, 22 nt, Homo sapiens
ucuuuguguucaggagccacgu

SEQ ID NO: 243881 - RNA, 22 nt, Homo sapiens
ucuuuguucaggagccaacucc

SEQ ID NO: 243882 - RNA, 22 nt, Homo sapiens
ucuuuugguuucuagaggccgc

SEQ ID NO: 243883 - RNA, 22 nt, Homo sapiens
ucuuuuguucuauucaggccuu

SEQ ID NO: 243884 - RNA, 22 nt, Homo sapiens
ugaaacacacauugcccuuuau

SEQ ID NO: 243885 - RNA, 18 nt, Homo sapiens
ugaaacacauuuuuuccu

SEQ ID NO: 243886 - RNA, 22 nt, Homo sapiens
ugaaacugcagugggcuuggca

SEQ ID NO: 243887 - RNA, 22 nt, Homo sapiens
ugaaagcuacaggaaaguauuu

SEQ ID NO: 243888 - RNA, 22 nt, Homo sapiens
ugaaaguaauugcaguuuuuac

SEQ ID NO: 243889 - RNA, 22 nt, Homo sapiens
ugaaaguuauauugugaaauuc

SEQ ID NO: 243890 - RNA, 22 nt, Homo sapiens
ugaaaugcugucuaggggaaau

SEQ ID NO: 243891 - RNA, 21 nt, Homo sapiens
ugaaccccugcucucaagaaa

SEQ ID NO: 243892 - RNA, 22 nt, Homo sapiens
ugaacucagcauccagggccaa

SEQ ID NO: 243893 - RNA, 22 nt, Homo sapiens
ugaacuguaagguauaggugau

SEQ ID NO: 243894 - RNA, 22 nt, Homo sapiens
ugaagcuaacuugauugugaug

SEQ ID NO: 243895 - RNA, 22 nt, Homo sapiens
ugaaguaauguuuuauucuauu

SEQ ID NO: 243896 - RNA, 22 nt, Homo sapiens
ugaagugcugugggccaggcgu

SEQ ID NO: 243897 - RNA, 22 nt, Homo sapiens
ugaaguguuuuuucaggcaugu

SEQ ID NO: 243898 - RNA, 22 nt, Homo sapiens
ugaauacagcacacccaugggu

SEQ ID NO: 243899 - RNA, 22 nt, Homo sapiens
ugaauacugugcaaaggauuug

SEQ ID NO: 243900 - RNA, 22 nt, Homo sapiens
ugaauacuucaaaaaaauagcu

SEQ ID NO: 243901 - RNA, 22 nt, Homo sapiens
ugaauagagcugcaguggacau

SEQ ID NO: 243902 - RNA, 22 nt, Homo sapiens
ugaauauuugcuacucacucuu

SEQ ID NO: 243903 - RNA, 21 nt, Homo sapiens
ugcauauuggaacuuucucuc

SEQ ID NO: 243904 - RNA, 22 nt, Homo sapiens
ugcaucaggcugcuuauuacaa

SEQ ID NO: 243905 - RNA, 22 nt, Homo sapiens
ugcauggagauauacaguuuuu

SEQ ID NO: 243906 - RNA, 22 nt, Homo sapiens
ugcauuguuccgaauguguccu

SEQ ID NO: 243907 - RNA, 21 nt, Homo sapiens
ugcauuguugcugagagcagg

SEQ ID NO: 243908 - RNA, 22 nt, Homo sapiens
ugccaagaacauuuucuguuuu

SEQ ID NO: 243909 - RNA, 20 nt, Homo sapiens
ugccaagaugacuauagcuc

SEQ ID NO: 243910 - RNA, 22 nt, Homo sapiens
ugccaguauuuuauugagcauu

SEQ ID NO: 243911 - RNA, 22 nt, Homo sapiens
ugccaugaagaucccugaaaug

SEQ ID NO: 243912 - RNA, 22 nt, Homo sapiens
ugccauugcacuccagccuggg

SEQ ID NO: 243913 - RNA, 23 nt, Homo sapiens
ugccuagaugcugcccugggaca

SEQ ID NO: 243914 - RNA, 22 nt, Homo sapiens
ugccuaggcccaguccucagaa

SEQ ID NO: 243915 - RNA, 22 nt, Homo sapiens
ugccuaguggaaggagagcaaa

SEQ ID NO: 243916 - RNA, 22 nt, Homo sapiens
ugccugauacccucugucucuc

SEQ ID NO: 243917 - RNA, 22 nt, Homo sapiens
ugccuuuguucuggaaugggaa

SEQ ID NO: 243918 - RNA, 21 nt, Homo sapiens
ugcgauccucaauccucuguu

SEQ ID NO: 243919 - RNA, 22 nt, Homo sapiens
ugcgccauugcacuccagccug

SEQ ID NO: 243920 - RNA, 22 nt, Homo sapiens
ugcuaucauugauuagugaugu

SEQ ID NO: 243921 - RNA, 23 nt, Homo sapiens
ugcuauguaagcauuuauuaaau

SEQ ID NO: 243922 - RNA, 22 nt, Homo sapiens
ugcucaguuuaaaacuuuugag

SEQ ID NO: 243923 - RNA, 21 nt, Homo sapiens
ugcugcacuucuuuugcugug

SEQ ID NO: 243924 - RNA, 19 nt, Homo sapiens
ugcugcauugugaccuugc

SEQ ID NO: 243925 - RNA, 22 nt, Homo sapiens
ugcugguauuauguuauccaga

SEQ ID NO: 243926 - RNA, 22 nt, Homo sapiens
ugcuguuguuugaugaaguaau

SEQ ID NO: 243927 - RNA, 22 nt, Homo sapiens
ugcuugagacacauaugaauuu

SEQ ID NO: 243928 - RNA, 20 nt, Homo sapiens
uggaaauuaaccuuucaggu

SEQ ID NO: 243929 - RNA, 22 nt, Homo sapiens
uggaagacaggcuguauuuuaa

SEQ ID NO: 243930 - RNA, 20 nt, Homo sapiens
uggaagccuggugcuaucuu

SEQ ID NO: 243931 - RNA, 22 nt, Homo sapiens
uggaaguauagauaauugaaag

SEQ ID NO: 243932 - RNA, 22 nt, Homo sapiens
uggaagugaacaaccaaggcag

SEQ ID NO: 243933 - RNA, 22 nt, Homo sapiens
uggaauaugagacgggguuguc

SEQ ID NO: 243934 - RNA, 21 nt, Homo sapiens
uggaaucuauagaggcaguag

SEQ ID NO: 243935 - RNA, 22 nt, Homo sapiens
uggaaugucuauguuuuugauu

SEQ ID NO: 243936 - RNA, 21 nt, Homo sapiens
uggaauuaauggagagguguu

SEQ ID NO: 243937 - RNA, 22 nt, Homo sapiens
uggacaagauagguucuauauu

SEQ ID NO: 243938 - RNA, 22 nt, Homo sapiens
uggacagacaagguuauagauc

SEQ ID NO: 243939 - RNA, 22 nt, Homo sapiens
uggacaugaagggcacaggagg

SEQ ID NO: 243940 - RNA, 20 nt, Homo sapiens
uggaccagagagguggggac

SEQ ID NO: 243941 - RNA, 22 nt, Homo sapiens
uggacuguaagugccuugagua

SEQ ID NO: 243942 - RNA, 22 nt, Homo sapiens
uggagacugaucccucuuuccu

SEQ ID NO: 243943 - RNA, 18 nt, Homo sapiens
uggagauaagaagaacuu

SEQ ID NO: 243944 - RNA, 22 nt, Homo sapiens
uggagcaaaguugaggccaagc

SEQ ID NO: 243945 - RNA, 22 nt, Homo sapiens
uggaggacugcagaacugaggc

SEQ ID NO: 243946 - RNA, 22 nt, Homo sapiens
uggagguagagaugggaucucc

SEQ ID NO: 243947 - RNA, 22 nt, Homo sapiens
uggaguaggccuaagaaugaca

SEQ ID NO: 243948 - RNA, 21 nt, Homo sapiens
uggagugcaacacuagguaua

SEQ ID NO: 243949 - RNA, 22 nt, Homo sapiens
uggagugcaauggcaccaucuu

SEQ ID NO: 243950 - RNA, 22 nt, Homo sapiens
uggaguguaauuagccaucagu

SEQ ID NO: 243951 - RNA, 22 nt, Homo sapiens
uggaguguagaagccagccucc

SEQ ID NO: 243952 - RNA, 22 nt, Homo sapiens
uggauagaaauguacuguuuuc

SEQ ID NO: 243953 - RNA, 22 nt, Homo sapiens
uggauauguuuauauguugucu

SEQ ID NO: 243954 - RNA, 22 nt, Homo sapiens
uggaucuguucuauuuaucuga

SEQ ID NO: 243955 - RNA, 22 nt, Homo sapiens
uggaugacauccuuguaugcag

SEQ ID NO: 243956 - RNA, 22 nt, Homo sapiens
uggauggagaggcuugugaugc

SEQ ID NO: 243957 - RNA, 22 nt, Homo sapiens
uggauguacagucaguauuugu

SEQ ID NO: 243958 - RNA, 22 nt, Homo sapiens
uggauuguaacauagaguaaau

SEQ ID NO: 243959 - RNA, 22 nt, Homo sapiens
uggcaaaaaaacgcaauuacgu

SEQ ID NO: 243960 - RNA, 22 nt, Homo sapiens
uggcaaauagcaauaggagggu

SEQ ID NO: 243961 - RNA, 22 nt, Homo sapiens
uggcaagaacaacaauuacuuu

SEQ ID NO: 243962 - RNA, 22 nt, Homo sapiens
uggcaagaaccacaguuacuuu

SEQ ID NO: 243963 - RNA, 22 nt, Homo sapiens
uggcaagaacgaaauguagggu

SEQ ID NO: 243964 - RNA, 22 nt, Homo sapiens
uggcaagaaggauuuauuccuu

SEQ ID NO: 243965 - RNA, 22 nt, Homo sapiens
uggcaagaccccaucucuacaa

SEQ ID NO: 243966 - RNA, 22 nt, Homo sapiens
uggcaagagauaugugucuaua

SEQ ID NO: 243967 - RNA, 22 nt, Homo sapiens
uggcaagagcaaaauguacagu

SEQ ID NO: 243968 - RNA, 22 nt, Homo sapiens
uggcaccauccaggugucucua

SEQ ID NO: 243969 - RNA, 22 nt, Homo sapiens
uggcagauaggauacaggacua

SEQ ID NO: 243970 - RNA, 22 nt, Homo sapiens
uggcagcgugaaagacuuuuuc

SEQ ID NO: 243971 - RNA, 22 nt, Homo sapiens
uggcagcgugaauguggcugaa

SEQ ID NO: 243972 - RNA, 22 nt, Homo sapiens
uggcaggugcacuggcuuugaa

SEQ ID NO: 243973 - RNA, 22 nt, Homo sapiens
uggcagugggagauauuuuauu

SEQ ID NO: 243974 - RNA, 22 nt, Homo sapiens
uggcaguuucacauggcucaac

SEQ ID NO: 243975 - RNA, 22 nt, Homo sapiens
uggcaguuuuugccuucaauac

SEQ ID NO: 243976 - RNA, 22 nt, Homo sapiens
uggcauggaguggauggcccca

SEQ ID NO: 243977 - RNA, 22 nt, Homo sapiens
uggcauggggcagaacauuaca

SEQ ID NO: 243978 - RNA, 22 nt, Homo sapiens
uggcauguagucugggaccugg

SEQ ID NO: 243979 - RNA, 22 nt, Homo sapiens
uggcaugugugaagugcccagc

SEQ ID NO: 243980 - RNA, 22 nt, Homo sapiens
uggcauguuggguguugacucc

SEQ ID NO: 243981 - RNA, 22 nt, Homo sapiens
uggcauuuucucuguucuuaga

SEQ ID NO: 243982 - RNA, 22 nt, Homo sapiens
uggcauuuugugugaauuagaa

SEQ ID NO: 243983 - RNA, 23 nt, Homo sapiens
uggcauuuuuggcaaugccuucu

SEQ ID NO: 243984 - RNA, 22 nt, Homo sapiens
uggccagagggcaauuagcugu

SEQ ID NO: 243985 - RNA, 22 nt, Homo sapiens
uggccuguaacccucucauagg

SEQ ID NO: 243986 - RNA, 22 nt, Homo sapiens
uggccuguaacgcugucucagc

SEQ ID NO: 243987 - RNA, 20 nt, Homo sapiens
uggcuaaaugaaugauagca

SEQ ID NO: 243988 - RNA, 22 nt, Homo sapiens
uggcuaaguuaaucaaggagau

SEQ ID NO: 243989 - RNA, 22 nt, Homo sapiens
uggcuacugaccugcuaggggg

SEQ ID NO: 243990 - RNA, 22 nt, Homo sapiens
uggcuacuguacuugagcuauu

SEQ ID NO: 243991 - RNA, 22 nt, Homo sapiens
uggcucuuucuagacuuaauua

SEQ ID NO: 243992 - RNA, 22 nt, Homo sapiens
uggcuguuguuacuaacaguuc

SEQ ID NO: 243993 - RNA, 22 nt, Homo sapiens
uggcuguuuauuucaccuggau

SEQ ID NO: 243994 - RNA, 22 nt, Homo sapiens
uggcuguuuauuucaccugggu

SEQ ID NO: 243995 - RNA, 20 nt, Homo sapiens
uggcuucuuaauugcaggca

SEQ ID NO: 243996 - RNA, 22 nt, Homo sapiens
uggcuuuucauccugggacauu

SEQ ID NO: 243997 - RNA, 22 nt, Homo sapiens
uggcuuuuccuugaaucugccu

SEQ ID NO: 243998 - RNA, 22 nt, Homo sapiens
uggcuuuuguuauuuggaagcu

SEQ ID NO: 243999 - RNA, 20 nt, Homo sapiens
ugggaacaugugguauaugg

SEQ ID NO: 244000 - RNA, 22 nt, Homo sapiens
ugggaagcugcugaacuacagu

SEQ ID NO: 244001 - RNA, 22 nt, Homo sapiens
ugggagugugcacaauuucagc

SEQ ID NO: 244002 - RNA, 22 nt, Homo sapiens
ugggaucuuuccuauuagcgag

SEQ ID NO: 244003 - RNA, 22 nt, Homo sapiens
ugggaugaauacaaugggauca

SEQ ID NO: 244004 - RNA, 22 nt, Homo sapiens
ugggaugauguuaaacguacuc

SEQ ID NO: 244005 - RNA, 16 nt, Homo sapiens
cuaaaaugucuacuug

SEQ ID NO: 244006 - RNA, 22 nt, Homo sapiens
cuaaaguauugagugguaaaga

SEQ ID NO: 244007 - RNA, 22 nt, Homo sapiens
cuaaagugcuuaaaaucucauu

SEQ ID NO: 244008 - RNA, 22 nt, Homo sapiens
cuaaaugcacugucaaaggaag

SEQ ID NO: 244009 - RNA, 22 nt, Homo sapiens
cuaagcaccuuaguggggaauc

SEQ ID NO: 244010 - RNA, 22 nt, Homo sapiens
cuaaggaaggacugaaaggaca

SEQ ID NO: 244011 - RNA, 22 nt, Homo sapiens
cuaagugaacugucacugagaa

SEQ ID NO: 244012 - RNA, 22 nt, Homo sapiens
cuaagugaguauaauuuuaaga

SEQ ID NO: 244013 - RNA, 18 nt, Homo sapiens
cuaauacuauucaacaag

SEQ ID NO: 244014 - RNA, 22 nt, Homo sapiens
cuaauccugugguagcacucaa

SEQ ID NO: 244015 - RNA, 22 nt, Homo sapiens
cuaaugcagucaggagaaggaa

SEQ ID NO: 244016 - RNA, 22 nt, Homo sapiens
cuacacaugcaggcucccugcc

SEQ ID NO: 244017 - RNA, 22 nt, Homo sapiens
cuacagguaugaaagggaguau

SEQ ID NO: 244018 - RNA, 21 nt, Homo sapiens
cuacccuguauuagagaaaga

SEQ ID NO: 244019 - RNA, 22 nt, Homo sapiens
cuaccuggguggcucaugacuu

SEQ ID NO: 244020 - RNA, 22 nt, Homo sapiens
cuagagagaagcugugugaccu

SEQ ID NO: 244021 - RNA, 22 nt, Homo sapiens
cuagcuccauauaaagcaggau

SEQ ID NO: 244022 - RNA, 22 nt, Homo sapiens
cuaggaaguauguguuauugcu

SEQ ID NO: 244023 - RNA, 22 nt, Homo sapiens
cuaggcacugauaguuguauuu

SEQ ID NO: 244024 - RNA, 22 nt, Homo sapiens
cuauauacugccugcugauuag

SEQ ID NO: 244025 - RNA, 22 nt, Homo sapiens
cuauaugucuguuuugguacca

SEQ ID NO: 244026 - RNA, 21 nt, Homo sapiens
cuaucucaguguuuacauuug

SEQ ID NO: 244027 - RNA, 22 nt, Homo sapiens
cuaugcauuuuggaggagggaa

SEQ ID NO: 244028 - RNA, 22 nt, Homo sapiens
cuauuugcauucagaggcaugu

SEQ ID NO: 244029 - RNA, 21 nt, Homo sapiens
cucaaaguacugauauuacag

SEQ ID NO: 244030 - RNA, 22 nt, Homo sapiens
cucaaaguacuuugguuauugu

SEQ ID NO: 244031 - RNA, 22 nt, Homo sapiens
cucaaaguguggucuguggguu

SEQ ID NO: 244032 - RNA, 22 nt, Homo sapiens
cucaaguaauccucccgccuug

SEQ ID NO: 244033 - RNA, 20 nt, Homo sapiens
cucacagacagcuucuuucu

SEQ ID NO: 244034 - RNA, 22 nt, Homo sapiens
cucacagucucucccuaauuuu

SEQ ID NO: 244035 - RNA, 22 nt, Homo sapiens
cucacaugcucaccugguguuc

SEQ ID NO: 244036 - RNA, 22 nt, Homo sapiens
cucagcuacuugagaggcuuag

SEQ ID NO: 244037 - RNA, 22 nt, Homo sapiens
cucaguuuugccuuguuuaagg

SEQ ID NO: 244038 - RNA, 22 nt, Homo sapiens
cucauggagaacaucugcuagg

SEQ ID NO: 244039 - RNA, 22 nt, Homo sapiens
cucauggagaaccucugcuagg

SEQ ID NO: 244040 - RNA, 22 nt, Homo sapiens
cucauugcaaucucugccuccc

SEQ ID NO: 244041 - RNA, 22 nt, Homo sapiens
cuccaggugagguuaagggacu

SEQ ID NO: 244042 - RNA, 22 nt, Homo sapiens
cuccaggugucauccaccuccu

SEQ ID NO: 244043 - RNA, 22 nt, Homo sapiens
cuccaguacagagagguuccuc

SEQ ID NO: 244044 - RNA, 22 nt, Homo sapiens
cuccagugcaaagucaugauca

SEQ ID NO: 244045 - RNA, 22 nt, Homo sapiens
cuccauuuaucugaaauuuuau

SEQ ID NO: 244046 - RNA, 22 nt, Homo sapiens
cucccauugcaaacaacagaag

SEQ ID NO: 244047 - RNA, 20 nt, Homo sapiens
cucccugacaaauguggaaa

SEQ ID NO: 244048 - RNA, 22 nt, Homo sapiens
cucccuuugcugaauguuuuuc

SEQ ID NO: 244049 - RNA, 22 nt, Homo sapiens
cuccuguagccccaucaucuuu

SEQ ID NO: 244050 - RNA, 22 nt, Homo sapiens
cuccuugauuagaguauagagu

SEQ ID NO: 244051 - RNA, 17 nt, Homo sapiens
cucucugguuuaaagca

SEQ ID NO: 244052 - RNA, 22 nt, Homo sapiens
cucugguuaaggcugaacuaua

SEQ ID NO: 244053 - RNA, 22 nt, Homo sapiens
cucuuacaguguguggugaaag

SEQ ID NO: 244054 - RNA, 22 nt, Homo sapiens
cucuuuuguuccuaguuugauc

SEQ ID NO: 244055 - RNA, 19 nt, Homo sapiens
cugaaacacagagagggcu

SEQ ID NO: 244056 - RNA, 22 nt, Homo sapiens
cugaaauggaaugugugcacag

SEQ ID NO: 244057 - RNA, 22 nt, Homo sapiens
cugacaagugaucacagcagca

SEQ ID NO: 244058 - RNA, 22 nt, Homo sapiens
cugacagaugacugccacugua

SEQ ID NO: 244059 - RNA, 22 nt, Homo sapiens
cugaccauagacuacucugggc

SEQ ID NO: 244060 - RNA, 22 nt, Homo sapiens
cugacuaguuuuaaugcagauu

SEQ ID NO: 244061 - RNA, 22 nt, Homo sapiens
cugacuuuagaacccaaaaagu

SEQ ID NO: 244062 - RNA, 22 nt, Homo sapiens
cugagaauguaaaugaagcuuu

SEQ ID NO: 244063 - RNA, 22 nt, Homo sapiens
cugagagugguauguuuaagug

SEQ ID NO: 244064 - RNA, 22 nt, Homo sapiens
cugagaguugaugaaauauggu

SEQ ID NO: 244065 - RNA, 22 nt, Homo sapiens
cugagaucaagucuugcucugu

SEQ ID NO: 244066 - RNA, 22 nt, Homo sapiens
cugagaucugaaccaggagugu

SEQ ID NO: 244067 - RNA, 22 nt, Homo sapiens
cugagauggagucucgcauugu

SEQ ID NO: 244068 - RNA, 22 nt, Homo sapiens
cugagauuaagauauugggagu

SEQ ID NO: 244069 - RNA, 22 nt, Homo sapiens
cugagcaugacaucaugugacu

SEQ ID NO: 244070 - RNA, 22 nt, Homo sapiens
cugaggcacggcgaccuuaagu

SEQ ID NO: 244071 - RNA, 20 nt, Homo sapiens
cugaggugggagaaucgcuu

SEQ ID NO: 244072 - RNA, 22 nt, Homo sapiens
cugaggugggaguuuuucucau

SEQ ID NO: 244073 - RNA, 22 nt, Homo sapiens
cugagguuaggaguuugagacc

SEQ ID NO: 244074 - RNA, 22 nt, Homo sapiens
cugagugcaagugauccuccca

SEQ ID NO: 244075 - RNA, 22 nt, Homo sapiens
aaaacgcauccucacaggucug

SEQ ID NO: 244076 - RNA, 22 nt, Homo sapiens
aaacccauauaccagcugugcu

SEQ ID NO: 244077 - RNA, 20 nt, Homo sapiens
aaacucugucuucuuuauca

SEQ ID NO: 244078 - RNA, 18 nt, Homo sapiens
aaacugcuuccuuggccu

SEQ ID NO: 244079 - RNA, 22 nt, Homo sapiens
aaagaguucagguagauuucaa

SEQ ID NO: 244080 - RNA, 22 nt, Homo sapiens
aaagcacuggagucaucaucua

SEQ ID NO: 244081 - RNA, 22 nt, Homo sapiens
aaagcuaagguagcauuggaga

SEQ ID NO: 244082 - RNA, 22 nt, Homo sapiens
aaagguaguacuucuagaaggg

SEQ ID NO: 244083 - RNA, 17 nt, Homo sapiens
aaaguccuuugcuaucu

SEQ ID NO: 244084 - RNA, 22 nt, Homo sapiens
aaagugauuguaguuuuugcca

SEQ ID NO: 244085 - RNA, 22 nt, Homo sapiens
aaagugcugggauuggccgggc

SEQ ID NO: 244086 - RNA, 22 nt, Homo sapiens
aaaguggugggauuccaggcau

SEQ ID NO: 244087 - RNA, 22 nt, Homo sapiens
aaagugguuuuucagacuuuga

SEQ ID NO: 244088 - RNA, 19 nt, Homo sapiens
aaaguguuuuaaagaggau

SEQ ID NO: 244089 - RNA, 22 nt, Homo sapiens
aaaguucuguugauagugcuga

SEQ ID NO: 244090 - RNA, 22 nt, Homo sapiens
aaaguucuugcugaaggauuau

SEQ ID NO: 244091 - RNA, 22 nt, Homo sapiens
aaauaacugucagguucuggaa

SEQ ID NO: 244092 - RNA, 22 nt, Homo sapiens
aaauccauuuguucagcuaugc

SEQ ID NO: 244093 - RNA, 22 nt, Homo sapiens
aaaugacuuuuuaugcagagua

SEQ ID NO: 244094 - RNA, 22 nt, Homo sapiens
aaaugcaccacucuggugcagg

SEQ ID NO: 244095 - RNA, 22 nt, Homo sapiens
aaaugcagauucugcuuagguu

SEQ ID NO: 244096 - RNA, 22 nt, Homo sapiens
aaaugcauaucaagauugcccu

SEQ ID NO: 244097 - RNA, 22 nt, Homo sapiens
aaaugcauugagggaaaaggca

SEQ ID NO: 244098 - RNA, 23 nt, Homo sapiens
aaaugcucucaggugccaguaga

SEQ ID NO: 244099 - RNA, 22 nt, Homo sapiens
aaaugcucucuacacguuucug

SEQ ID NO: 244100 - RNA, 18 nt, Homo sapiens
aaaugcucuucuggaaua

SEQ ID NO: 244101 - RNA, 22 nt, Homo sapiens
aaaugcugcuuuggccucuucu

SEQ ID NO: 244102 - RNA, 22 nt, Homo sapiens
aaauggcuuuuugggcaaggug

SEQ ID NO: 244103 - RNA, 19 nt, Homo sapiens
aaaugugcacuguuuucca

SEQ ID NO: 244104 - RNA, 22 nt, Homo sapiens
aaauucaugucaccucuaggua

SEQ ID NO: 244105 - RNA, 22 nt, Homo sapiens
aaauugcaguuaggaugauggu

SEQ ID NO: 244106 - RNA, 22 nt, Homo sapiens
aaauugcauugagcugcuuauu

SEQ ID NO: 244107 - RNA, 23 nt, Homo sapiens
aaauuugccuauuauuccuaugg

SEQ ID NO: 244108 - RNA, 22 nt, Homo sapiens
aacacuaucugccuuacaggga

SEQ ID NO: 244109 - RNA, 22 nt, Homo sapiens
aacaucaaccaugaggguugga

SEQ ID NO: 244110 - RNA, 22 nt, Homo sapiens
aacauguuuagcagauaccugu

SEQ ID NO: 244111 - RNA, 22 nt, Homo sapiens
aaccuucauuccuuucccugcc

SEQ ID NO: 244112 - RNA, 17 nt, Homo sapiens
ccaguuuucccucagug

SEQ ID NO: 244113 - RNA, 22 nt, Homo sapiens
ccaguuuuucauuuauacuagu

SEQ ID NO: 244114 - RNA, 19 nt, Homo sapiens
ccauggcaaugaucugaug

SEQ ID NO: 244115 - RNA, 23 nt, Homo sapiens
ccauugcacuccagccucaguga

SEQ ID NO: 244116 - RNA, 22 nt, Homo sapiens
ccauugcacuccauccugggca

SEQ ID NO: 244117 - RNA, 22 nt, Homo sapiens
cccagaguucuuaaauacugag

SEQ ID NO: 244118 - RNA, 22 nt, Homo sapiens
cccagcguucggcauggcugag

SEQ ID NO: 244119 - RNA, 22 nt, Homo sapiens
cccagugugcugggugacagcu

SEQ ID NO: 244120 - RNA, 22 nt, Homo sapiens
cccaguguuuauuuugagccaa

SEQ ID NO: 244121 - RNA, 22 nt, Homo sapiens
ccccagguuucaauaaagccca

SEQ ID NO: 244122 - RNA, 19 nt, Homo sapiens
ccccuguggauaccgaggg

SEQ ID NO: 244123 - RNA, 23 nt, Homo sapiens
cccucagaagugcagggagagaa

SEQ ID NO: 244124 - RNA, 22 nt, Homo sapiens
cccugaagacuccaccgucaug

SEQ ID NO: 244125 - RNA, 22 nt, Homo sapiens
cccugagagcagggucuuucuc

SEQ ID NO: 244126 - RNA, 22 nt, Homo sapiens
cccugagcagccugaguuuccc

SEQ ID NO: 244127 - RNA, 22 nt, Homo sapiens
cccuucauucaaggguugugag

SEQ ID NO: 244128 - RNA, 22 nt, Homo sapiens
ccuaggcacugggguccagccc

SEQ ID NO: 244129 - RNA, 22 nt, Homo sapiens
ccucaguguuuaucauuauuuu

SEQ ID NO: 244130 - RNA, 22 nt, Homo sapiens
ccucauggagaacaucugcuag

SEQ ID NO: 244131 - RNA, 22 nt, Homo sapiens
ccucauggagaacuucugcuag

SEQ ID NO: 244132 - RNA, 22 nt, Homo sapiens
ccuccauuugugucaggaaguc

SEQ ID NO: 244133 - RNA, 22 nt, Homo sapiens
ccucuguaguccugcaagagga

SEQ ID NO: 244134 - RNA, 21 nt, Homo sapiens
ccucuuugagggaagaaaggg

SEQ ID NO: 244135 - RNA, 21 nt, Homo sapiens
ccugaagaagugaccucugag

SEQ ID NO: 244136 - RNA, 22 nt, Homo sapiens
ccugagacugauugacucacaa

SEQ ID NO: 244137 - RNA, 22 nt, Homo sapiens
ccugagacuugagggggcuucu

SEQ ID NO: 244138 - RNA, 21 nt, Homo sapiens
ccugaugaccucugagaguua

SEQ ID NO: 244139 - RNA, 22 nt, Homo sapiens
ccuuuguggggcgguggguaau

SEQ ID NO: 244140 - RNA, 22 nt, Homo sapiens
cgcccuguagcuagcuagaggu

SEQ ID NO: 244141 - RNA, 22 nt, Homo sapiens
cggaaugaaaauguccuucagu

SEQ ID NO: 244142 - RNA, 22 nt, Homo sapiens
cggcaguggguaagccaagcuu

SEQ ID NO: 244143 - RNA, 22 nt, Homo sapiens
cuaaaacuuucugagugcagca

SEQ ID NO: 244144 - RNA, 22 nt, Homo sapiens
ugaguaguauucuaugguaugu

SEQ ID NO: 244145 - RNA, 22 nt, Homo sapiens
ugaguauagaucaguucaagug

SEQ ID NO: 244146 - RNA, 22 nt, Homo sapiens
ugagucuguucucacauugcua

SEQ ID NO: 244147 - RNA, 22 nt, Homo sapiens
ugagugaggcugggcagucccu

SEQ ID NO: 244148 - RNA, 22 nt, Homo sapiens
ugagugagguucuacucuguga

SEQ ID NO: 244149 - RNA, 22 nt, Homo sapiens
ugagugccuggagggcagggac

SEQ ID NO: 244150 - RNA, 22 nt, Homo sapiens
ugagugugacuuagcagaagga

SEQ ID NO: 244151 - RNA, 22 nt, Homo sapiens
ugaguuaauuuuuguaucaugu

SEQ ID NO: 244152 - RNA, 22 nt, Homo sapiens
ugauaguguccugugccacauu

SEQ ID NO: 244153 - RNA, 22 nt, Homo sapiens
ugauauauugaaugaugaaaca

SEQ ID NO: 244154 - RNA, 22 nt, Homo sapiens
ugauauguaacuacuccuuaua

SEQ ID NO: 244155 - RNA, 22 nt, Homo sapiens
ugauaugugaguauaugguuau

SEQ ID NO: 244156 - RNA, 17 nt, Homo sapiens
ugauauuuucccagaua

SEQ ID NO: 244157 - RNA, 22 nt, Homo sapiens
ugaucacagcuugacuaaagga

SEQ ID NO: 244158 - RNA, 22 nt, Homo sapiens
ugaucuguguaacauaggaguc

SEQ ID NO: 244159 - RNA, 22 nt, Homo sapiens
ugaugacauugucacagucuga

SEQ ID NO: 244160 - RNA, 22 nt, Homo sapiens
ugauggccuguucuccauaugu

SEQ ID NO: 244161 - RNA, 23 nt, Homo sapiens
ugauguccacuuagggucuaggu

SEQ ID NO: 244162 - RNA, 22 nt, Homo sapiens
ugauucccucaagugccuuaug

SEQ ID NO: 244163 - RNA, 19 nt, Homo sapiens
ugcaaagucuuuuccuauu

SEQ ID NO: 244164 - RNA, 22 nt, Homo sapiens
ugcaaaucuuguguaguuguga

SEQ ID NO: 244165 - RNA, 22 nt, Homo sapiens
ugcaaauguuauuuugguuucu

SEQ ID NO: 244166 - RNA, 22 nt, Homo sapiens
ugcaagacacuguccugggcau

SEQ ID NO: 244167 - RNA, 22 nt, Homo sapiens
ugcaagaggagacuguacucag

SEQ ID NO: 244168 - RNA, 22 nt, Homo sapiens
ugcaagcacacccagggauugu

SEQ ID NO: 244169 - RNA, 22 nt, Homo sapiens
ugcaaguaauuccagcuacuga

SEQ ID NO: 244170 - RNA, 22 nt, Homo sapiens
ugcaagucaucuguccuucaga

SEQ ID NO: 244171 - RNA, 22 nt, Homo sapiens
ugcaaguggauuuuuccccaga

SEQ ID NO: 244172 - RNA, 22 nt, Homo sapiens
ugcaaucaucgcuguuggccac

SEQ ID NO: 244173 - RNA, 22 nt, Homo sapiens
ugcaauuuaaugugucccaauu

SEQ ID NO: 244174 - RNA, 22 nt, Homo sapiens
ugcaccacugcuagccugggua

SEQ ID NO: 244175 - RNA, 18 nt, Homo sapiens
ugcaccaguuuacacuuc

SEQ ID NO: 244176 - RNA, 22 nt, Homo sapiens
ugcaccaucuugcuucuguggu

SEQ ID NO: 244177 - RNA, 22 nt, Homo sapiens
ugcacuguggucugagagacag

SEQ ID NO: 244178 - RNA, 18 nt, Homo sapiens
ugcagcaucaguacccag

SEQ ID NO: 244179 - RNA, 22 nt, Homo sapiens
ugcagcucaaauuccuaacaag

SEQ ID NO: 244180 - RNA, 22 nt, Homo sapiens
ugcaggauguucaguaauuucc

SEQ ID NO: 244181 - RNA, 23 nt, Homo sapiens
ugcaguagugagaucuaggcuca

SEQ ID NO: 244182 - RNA, 22 nt, Homo sapiens
ugcaguuuaggaacugguaaca

SEQ ID NO: 244183 - RNA, 22 nt, Homo sapiens
ugcauaugcagcauuuaugauu

SEQ ID NO: 244184 - RNA, 22 nt, Homo sapiens
ugcauauguauacaugugccau

SEQ ID NO: 244185 - RNA, 22 nt, Homo sapiens
ugugauggaguuucauggacug

SEQ ID NO: 244186 - RNA, 22 nt, Homo sapiens
ugugcaauucgauggagcucau

SEQ ID NO: 244187 - RNA, 22 nt, Homo sapiens
ugugcaccucuucacacaggga

SEQ ID NO: 244188 - RNA, 22 nt, Homo sapiens
ugugccacuccaaccuggguga

SEQ ID NO: 244189 - RNA, 22 nt, Homo sapiens
ugugccacugcacucugggcaa

SEQ ID NO: 244190 - RNA, 22 nt, Homo sapiens
ugugccugagguuaacauuguu

SEQ ID NO: 244191 - RNA, 22 nt, Homo sapiens
ugugcuauguuauucacauggg

SEQ ID NO: 244192 - RNA, 22 nt, Homo sapiens
ugugcuugaauuuaguagcuua

SEQ ID NO: 244193 - RNA, 22 nt, Homo sapiens
ugugcuuguaaaggccagagca

SEQ ID NO: 244194 - RNA, 22 nt, Homo sapiens
uguggcaaauggucaggaagaa

SEQ ID NO: 244195 - RNA, 22 nt, Homo sapiens
uguggcagugcuuuaugaaacc

SEQ ID NO: 244196 - RNA, 22 nt, Homo sapiens
uguggcauugaauaaccuugga

SEQ ID NO: 244197 - RNA, 17 nt, Homo sapiens
uguggcucuuaugcuga

SEQ ID NO: 244198 - RNA, 22 nt, Homo sapiens
uguggcuuuacagcaugguuca

SEQ ID NO: 244199 - RNA, 22 nt, Homo sapiens
uguguaaauacaagugcuugaa

SEQ ID NO: 244200 - RNA, 22 nt, Homo sapiens
uguguaaauaugauagaggaau

SEQ ID NO: 244201 - RNA, 22 nt, Homo sapiens
uguguagagaaauauuacuuau

SEQ ID NO: 244202 - RNA, 22 nt, Homo sapiens
ugugucuuguuuauagcuuucu

SEQ ID NO: 244203 - RNA, 21 nt, Homo sapiens
uguuaacaugcagauuacugg

SEQ ID NO: 244204 - RNA, 22 nt, Homo sapiens
uguuacaguguaggccuugggu

SEQ ID NO: 244205 - RNA, 22 nt, Homo sapiens
uguucuggagaguuuagucugg

SEQ ID NO: 244206 - RNA, 22 nt, Homo sapiens
uguucuggagccgguucaaaug

SEQ ID NO: 244207 - RNA, 22 nt, Homo sapiens
uguugcaccugccuugcuuuag

SEQ ID NO: 244208 - RNA, 22 nt, Homo sapiens
uguugcacuccagccuggguga

SEQ ID NO: 244209 - RNA, 22 nt, Homo sapiens
uguuuuggaguggacuuugcau

SEQ ID NO: 244210 - RNA, 22 nt, Homo sapiens
uguuuuguuagcacucugggaa

SEQ ID NO: 244211 - RNA, 21 nt, Homo sapiens
uguuuuugcuguguaucucuc

SEQ ID NO: 244212 - RNA, 22 nt, Homo sapiens
uuaaaguguuuucaaaauguca

SEQ ID NO: 244213 - RNA, 22 nt, Homo sapiens
uuaacacugccauugauacugu

SEQ ID NO: 244214 - RNA, 22 nt, Homo sapiens
uuaacagucacuuagcucauuu

SEQ ID NO: 244215 - RNA, 22 nt, Homo sapiens
uuaagacaccaaucauuggauu

SEQ ID NO: 244216 - RNA, 22 nt, Homo sapiens
uuaagaugcauuuugaaguuaa

SEQ ID NO: 244217 - RNA, 22 nt, Homo sapiens
uuaagcaguaguuaaggagagg

SEQ ID NO: 244218 - RNA, 22 nt, Homo sapiens
uuaagcuaguuuauucaggaaa

SEQ ID NO: 244219 - RNA, 22 nt, Homo sapiens
uuaagggaggagcuucaagaug

SEQ ID NO: 244220 - RNA, 22 nt, Homo sapiens
uuaagguaugugggcauuuugu

SEQ ID NO: 244221 - RNA, 22 nt, Homo sapiens
uuaagucacacuagacaacuga

SEQ ID NO: 244222 - RNA, 22 nt, Homo sapiens
uuaagugaauuaucuaacaugu

SEQ ID NO: 244223 - RNA, 22 nt, Homo sapiens
ugacauagcuauuaagugaugc

SEQ ID NO: 244224 - RNA, 20 nt, Homo sapiens
ugacaucagcaauguaauaa

SEQ ID NO: 244225 - RNA, 18 nt, Homo sapiens
ugacaucauuuagaaagg

SEQ ID NO: 244226 - RNA, 19 nt, Homo sapiens
ugacaugaaacccaagauc

SEQ ID NO: 244227 - RNA, 21 nt, Homo sapiens
ugacauuauuucaugucagua

SEQ ID NO: 244228 - RNA, 22 nt, Homo sapiens
ugaccagaaaacaaauuaguuu

SEQ ID NO: 244229 - RNA, 22 nt, Homo sapiens
ugacccauagaaauguggauaa

SEQ ID NO: 244230 - RNA, 22 nt, Homo sapiens
ugacuauaguaaucacuucaca

SEQ ID NO: 244231 - RNA, 22 nt, Homo sapiens
ugacuauaucucuguauaaacu

SEQ ID NO: 244232 - RNA, 22 nt, Homo sapiens
ugacucuagagcugccuguggc

SEQ ID NO: 244233 - RNA, 22 nt, Homo sapiens
ugacugaguaguauuccacuau

SEQ ID NO: 244234 - RNA, 23 nt, Homo sapiens
ugacugaguauauguuuggugcu

SEQ ID NO: 244235 - RNA, 22 nt, Homo sapiens
ugacuggaaacaguguuauuug

SEQ ID NO: 244236 - RNA, 22 nt, Homo sapiens
ugacuggaacuuuagugagucu

SEQ ID NO: 244237 - RNA, 23 nt, Homo sapiens
ugacuggagacuguugauccuuu

SEQ ID NO: 244238 - RNA, 22 nt, Homo sapiens
ugacugugcagcuccaucaggg

SEQ ID NO: 244239 - RNA, 23 nt, Homo sapiens
ugacuuaggccucaacuaugacu

SEQ ID NO: 244240 - RNA, 22 nt, Homo sapiens
ugacuucauuuuuggccaugag

SEQ ID NO: 244241 - RNA, 22 nt, Homo sapiens
ugacuugaguaacuggcucagg

SEQ ID NO: 244242 - RNA, 22 nt, Homo sapiens
ugagaacaugcacuugagguug

SEQ ID NO: 244243 - RNA, 20 nt, Homo sapiens
ugagaacauguggcauuugg

SEQ ID NO: 244244 - RNA, 22 nt, Homo sapiens
ugagaagcauaccagugucugu

SEQ ID NO: 244245 - RNA, 19 nt, Homo sapiens
ugagaauguuaccaggucc

SEQ ID NO: 244246 - RNA, 22 nt, Homo sapiens
ugagacauacuuacaggggaug

SEQ ID NO: 244247 - RNA, 23 nt, Homo sapiens
ugagacauuggaaaguuaggcag

SEQ ID NO: 244248 - RNA, 22 nt, Homo sapiens
ugagacugagucuugcucuugu

SEQ ID NO: 244249 - RNA, 22 nt, Homo sapiens
ugagagacaguuucgucggagg

SEQ ID NO: 244250 - RNA, 22 nt, Homo sapiens
ugagagaugaacucugauaugu

SEQ ID NO: 244251 - RNA, 22 nt, Homo sapiens
ugagaggugaauggcaggcuca

SEQ ID NO: 244252 - RNA, 22 nt, Homo sapiens
ugagauaaagcauguacugugu

SEQ ID NO: 244253 - RNA, 22 nt, Homo sapiens
ugagauaacuaaaaacauuuug

SEQ ID NO: 244254 - RNA, 22 nt, Homo sapiens
ugagauaaucaugugauuucau

SEQ ID NO: 244255 - RNA, 22 nt, Homo sapiens
ugagauaggaucuugcucuguu

SEQ ID NO: 244256 - RNA, 22 nt, Homo sapiens
ugagaucaaggugggcccuggg

SEQ ID NO: 244257 - RNA, 22 nt, Homo sapiens
ugagaucagugaagaaguguuu

SEQ ID NO: 244258 - RNA, 20 nt, Homo sapiens
ugagauccacgugaaguaug

SEQ ID NO: 244259 - RNA, 22 nt, Homo sapiens
ugagauccaugcuauuugggcu

SEQ ID NO: 244260 - RNA, 19 nt, Homo sapiens
ugagaugaagacagggguu

SEQ ID NO: 244261 - RNA, 22 nt, Homo sapiens
ugagaugaagcuagaagaaugg

SEQ ID NO: 244262 - RNA, 22 nt, Homo sapiens
ugagaugacgacacaccucagu

SEQ ID NO: 244263 - RNA, 22 nt, Homo sapiens
ugagaugaguugcgcucugucg

SEQ ID NO: 244264 - RNA, 22 nt, Homo sapiens
ugagaugcauauucuggcuccu

SEQ ID NO: 244265 - RNA, 20 nt, Homo sapiens
ugagaugcauugggauguuu

SEQ ID NO: 244266 - RNA, 22 nt, Homo sapiens
ugagauggagucuugucgccua

SEQ ID NO: 244267 - RNA, 22 nt, Homo sapiens
ugagauggguucugguccccug

SEQ ID NO: 244268 - RNA, 22 nt, Homo sapiens
ugagauguugcucugaaacaag

SEQ ID NO: 244269 - RNA, 22 nt, Homo sapiens
ugagcaagaucuuuauaauuag

SEQ ID NO: 244270 - RNA, 21 nt, Homo sapiens
ugagcauuaguacaguaggga

SEQ ID NO: 244271 - RNA, 22 nt, Homo sapiens
ugagcuaagugccaauauuaau

SEQ ID NO: 244272 - RNA, 22 nt, Homo sapiens
ugagcucaugcauucuugagga

SEQ ID NO: 244273 - RNA, 22 nt, Homo sapiens
ugaggaauguguguuaaagaua

SEQ ID NO: 244274 - RNA, 22 nt, Homo sapiens
ugaggacugagaggcacugugg

SEQ ID NO: 244275 - RNA, 22 nt, Homo sapiens
ugagggaugccugguuuguuuu

SEQ ID NO: 244276 - RNA, 22 nt, Homo sapiens
ugagggaugcguacccuaugcc

SEQ ID NO: 244277 - RNA, 22 nt, Homo sapiens
ugagggcguauccuucauuaag

SEQ ID NO: 244278 - RNA, 22 nt, Homo sapiens
ugagguaggugaagaaugcacg

SEQ ID NO: 244279 - RNA, 21 nt, Homo sapiens
ugaggucaugaugcugcuucc

SEQ ID NO: 244280 - RNA, 22 nt, Homo sapiens
ugaggucauucaugugggcgca

SEQ ID NO: 244281 - RNA, 22 nt, Homo sapiens
ugaggugaaguaauauucuaag

SEQ ID NO: 244282 - RNA, 22 nt, Homo sapiens
ugaggugaggguaucaaaugcu

SEQ ID NO: 244283 - RNA, 22 nt, Homo sapiens
ugagguguuauccagaguucuu

SEQ ID NO: 244284 - RNA, 22 nt, Homo sapiens
ugagguuggguaauuuaugaag

SEQ ID NO: 244285 - RNA, 19 nt, Homo sapiens
ugaguauauuguauucauu

SEQ ID NO: 244286 - RNA, 22 nt, Homo sapiens
ugagucaugcuggagucauggc

SEQ ID NO: 244287 - RNA, 22 nt, Homo sapiens
ugagucauguaauaaugcugcu

SEQ ID NO: 244288 - RNA, 22 nt, Homo sapiens
ugagugaaggggcucuguugug

SEQ ID NO: 244289 - RNA, 22 nt, Homo sapiens
ugagugugaggaagaauuagaa

SEQ ID NO: 244290 - RNA, 22 nt, Homo sapiens
ugaguguguaugugcauacaca

SEQ ID NO: 244291 - RNA, 17 nt, Homo sapiens
ugaguuaaucuuugugc

SEQ ID NO: 244292 - RNA, 22 nt, Homo sapiens
ugaguuagguaauaauaaauau

SEQ ID NO: 244293 - RNA, 22 nt, Homo sapiens
ugaguucaauguuaaugaagca

SEQ ID NO: 244294 - RNA, 22 nt, Homo sapiens
ugauaagaaauuguucauguag

SEQ ID NO: 244295 - RNA, 22 nt, Homo sapiens
ugauauguguaaacaauguaua

SEQ ID NO: 244296 - RNA, 22 nt, Homo sapiens
ugauccagugcucaguuggagu

SEQ ID NO: 244297 - RNA, 22 nt, Homo sapiens
cugugcaaguuauaggccaggu

SEQ ID NO: 244298 - RNA, 22 nt, Homo sapiens
cugugcacaucuggcggcccga

SEQ ID NO: 244299 - RNA, 22 nt, Homo sapiens
cugugcauaugacuuuauugga

SEQ ID NO: 244300 - RNA, 22 nt, Homo sapiens
cugugcaugcgcggagcugaaa

SEQ ID NO: 244301 - RNA, 22 nt, Homo sapiens
cugugcauggauuuuaagauug

SEQ ID NO: 244302 - RNA, 22 nt, Homo sapiens
cugugcauguaugcgugaguuc

SEQ ID NO: 244303 - RNA, 22 nt, Homo sapiens
cugugcauguuguccaauucuu

SEQ ID NO: 244304 - RNA, 22 nt, Homo sapiens
cuguguaguacuagauugagca

SEQ ID NO: 244305 - RNA, 22 nt, Homo sapiens
cuguucaaauuguuugugaagu

SEQ ID NO: 244306 - RNA, 22 nt, Homo sapiens
cuguuugaggguuugcuuucag

SEQ ID NO: 244307 - RNA, 22 nt, Homo sapiens
cuguuuguuuaggguacucaga

SEQ ID NO: 244308 - RNA, 18 nt, Homo sapiens
cuuaacauugggaugaua

SEQ ID NO: 244309 - RNA, 22 nt, Homo sapiens
cuuaagcauugacuuuggacag

SEQ ID NO: 244310 - RNA, 22 nt, Homo sapiens
cuucaguucuguaaggacagca

SEQ ID NO: 244311 - RNA, 22 nt, Homo sapiens
cuucaucugguuugugaacuuu

SEQ ID NO: 244312 - RNA, 22 nt, Homo sapiens
cuucaugagacuuuuggaaggc

SEQ ID NO: 244313 - RNA, 22 nt, Homo sapiens
cuuccaaguggggcacgugcca

SEQ ID NO: 244314 - RNA, 22 nt, Homo sapiens
cuuccauaguauuuuuacaaaa

SEQ ID NO: 244315 - RNA, 18 nt, Homo sapiens
cuuccuuagucugguuaa

SEQ ID NO: 244316 - RNA, 22 nt, Homo sapiens
cuugaacaaagagauuccauua

SEQ ID NO: 244317 - RNA, 22 nt, Homo sapiens
cuugagcuugagauccuuucug

SEQ ID NO: 244318 - RNA, 22 nt, Homo sapiens
cuugcacuagugcagaggcgcu

SEQ ID NO: 244319 - RNA, 22 nt, Homo sapiens
cuugcacuguuguaagggacuu

SEQ ID NO: 244320 - RNA, 22 nt, Homo sapiens
cuugcagaggcccuggggagag

SEQ ID NO: 244321 - RNA, 22 nt, Homo sapiens
cuugccuaaucugcaugauuuu

SEQ ID NO: 244322 - RNA, 22 nt, Homo sapiens
cuugccuuugucuucaaaggcu

SEQ ID NO: 244323 - RNA, 20 nt, Homo sapiens
cuugcuccccuuguucuaga

SEQ ID NO: 244324 - RNA, 22 nt, Homo sapiens
cuuguggugcuuuuacgugggc

SEQ ID NO: 244325 - RNA, 22 nt, Homo sapiens
cuuguucuccuaagaugaaugc

SEQ ID NO: 244326 - RNA, 22 nt, Homo sapiens
cuuucacacuguuggugggaau

SEQ ID NO: 244327 - RNA, 18 nt, Homo sapiens
cuuugcagcuuccagagg

SEQ ID NO: 244328 - RNA, 22 nt, Homo sapiens
cuuuggagaaaaguucuugggc

SEQ ID NO: 244329 - RNA, 22 nt, Homo sapiens
cuuugggaccgcgguuuauacu

SEQ ID NO: 244330 - RNA, 22 nt, Homo sapiens
cuuuggucaauugcugcgggga

SEQ ID NO: 244331 - RNA, 22 nt, Homo sapiens
cuuugguuuacuuggugcuagu

SEQ ID NO: 244332 - RNA, 22 nt, Homo sapiens
cuuuguaugucaugacaacugu

SEQ ID NO: 244333 - RNA, 20 nt, Homo sapiens
cuuuguccuccugcugugcu

SEQ ID NO: 244334 - RNA, 22 nt, Homo sapiens
cuuuguggggucuuuccucaaa

SEQ ID NO: 244335 - RNA, 22 nt, Homo sapiens
cuuuuacacugguggugggaau

SEQ ID NO: 244336 - RNA, 22 nt, Homo sapiens
cuuuuacacuguuggugggaau

SEQ ID NO: 244337 - RNA, 21 nt, Homo sapiens
cuuuugcacuccagccugggu

SEQ ID NO: 244338 - RNA, 22 nt, Homo sapiens
cuuuuggcuuagaauugucuug

SEQ ID NO: 244339 - RNA, 22 nt, Homo sapiens
cuuuugugauucuucaguugcu

SEQ ID NO: 244340 - RNA, 22 nt, Homo sapiens
cuuuuguggaucuucuguugcu

SEQ ID NO: 244341 - RNA, 22 nt, Homo sapiens
cuuuuugcugcagcaauacugg

SEQ ID NO: 244342 - RNA, 20 nt, Homo sapiens
cuuuuugcugugcugggagc

SEQ ID NO: 244343 - RNA, 22 nt, Homo sapiens
cuuuuugguagagcaggugugc

SEQ ID NO: 244344 - RNA, 22 nt, Homo sapiens
gaaaauccauccccagggagua

SEQ ID NO: 244345 - RNA, 22 nt, Homo sapiens
gaaagacuuucugcuguggaua

SEQ ID NO: 244346 - RNA, 22 nt, Homo sapiens
gaaagauuuuaacugggagacu

SEQ ID NO: 244347 - RNA, 22 nt, Homo sapiens
gaaagcugguauagauacauua

SEQ ID NO: 244348 - RNA, 22 nt, Homo sapiens
gaaaugcucagggguuuuccag

SEQ ID NO: 244349 - RNA, 22 nt, Homo sapiens
gaaauguuuuucaugugggcaa

SEQ ID NO: 244350 - RNA, 22 nt, Homo sapiens
gaacuguaaagaaauucuaagg

SEQ ID NO: 244351 - RNA, 22 nt, Homo sapiens
gaagaucacacuguagaucuau

SEQ ID NO: 244352 - RNA, 22 nt, Homo sapiens
gaagauucaaccaaaccagaac

SEQ ID NO: 244353 - RNA, 22 nt, Homo sapiens
gaagcgaggugauuagcagaca

SEQ ID NO: 244354 - RNA, 23 nt, Homo sapiens
gaaguaauaaauggauucuuaac

SEQ ID NO: 244355 - RNA, 23 nt, Homo sapiens
gaaguauagcaugcacauggaaa

SEQ ID NO: 244356 - RNA, 19 nt, Homo sapiens
gaaguguuguccuccagua

SEQ ID NO: 244357 - RNA, 22 nt, Homo sapiens
gaauggaacugacuauagcuga

SEQ ID NO: 244358 - RNA, 22 nt, Homo sapiens
gaauguuuacuuuguuuaauac

SEQ ID NO: 244359 - RNA, 22 nt, Homo sapiens
gaauugcacaaaaacugcuugu

SEQ ID NO: 244360 - RNA, 22 nt, Homo sapiens
gacaccugguguggaacuggag

SEQ ID NO: 244361 - RNA, 22 nt, Homo sapiens
gacagagcaagacccuauuuaa

SEQ ID NO: 244362 - RNA, 22 nt, Homo sapiens
gacagugugauacuuagucuca

SEQ ID NO: 244363 - RNA, 22 nt, Homo sapiens
gacaguuucucaggcuuccuua

SEQ ID NO: 244364 - RNA, 20 nt, Homo sapiens
gacauagagacucucaaaaa

SEQ ID NO: 244365 - RNA, 20 nt, Homo sapiens
gacaugacuaggagauagcc

SEQ ID NO: 244366 - RNA, 22 nt, Homo sapiens
gacauguuucucucuguuuacu

SEQ ID NO: 244367 - RNA, 22 nt, Homo sapiens
uuuuaguggacaaagguauuua

SEQ ID NO: 244368 - RNA, 23 nt, Homo sapiens
uuuugcaauaagucacuggaaua

SEQ ID NO: 244369 - RNA, 22 nt, Homo sapiens
uuuugcaccauccuaauaguau

SEQ ID NO: 244370 - RNA, 20 nt, Homo sapiens
uuuugcacuccuacuaaggu

SEQ ID NO: 244371 - RNA, 22 nt, Homo sapiens
uuuugcacuguuuuaucugaca

SEQ ID NO: 244372 - RNA, 22 nt, Homo sapiens
uuuugcaggcauuggaaguuua

SEQ ID NO: 244373 - RNA, 22 nt, Homo sapiens
uuuugcaguuacagagagugag

SEQ ID NO: 244374 - RNA, 22 nt, Homo sapiens
uuuugcauuggcugaggagugu

SEQ ID NO: 244375 - RNA, 20 nt, Homo sapiens
uuuuggacuaaaggcauccc

SEQ ID NO: 244376 - RNA, 22 nt, Homo sapiens
uuuugguguacaauucuaugga

SEQ ID NO: 244377 - RNA, 19 nt, Homo sapiens
uuuuguacucugugacuug

SEQ ID NO: 244378 - RNA, 22 nt, Homo sapiens
uuuuuauggccaauccucagaa

SEQ ID NO: 244379 - RNA, 22 nt, Homo sapiens
uuuuucacuuaaguuaggcuca

SEQ ID NO: 244380 - RNA, 22 nt, Homo sapiens
uuuuugagguauaguguggcua

SEQ ID NO: 244381 - RNA, 16 nt, Homo sapiens
uuuuugcagaaaugac

SEQ ID NO: 244382 - RNA, 22 nt, Homo sapiens
uuuuuggaggagguuagaucau

SEQ ID NO: 244383 - RNA, 22 nt, Homo sapiens
uuuuuggauaaugguacaugua

SEQ ID NO: 244384 - RNA, 22 nt, Homo sapiens
uuuuugguugguaggcuauuaa

SEQ ID NO: 244385 - RNA, 22 nt, Homo sapiens
uuuuugugguauauugcaacaa

SEQ ID NO: 244386 - RNA, 22 nt, Homo sapiens
uuuuuugcuguaugcaaacauc

SEQ ID NO: 244387 - RNA, 22 nt, Homo sapiens
uucacugugaacucauauucag

SEQ ID NO: 244388 - RNA, 22 nt, Homo sapiens
uucacuguuaagcaguuaaacu

SEQ ID NO: 244389 - RNA, 22 nt, Homo sapiens
uucaggcaccauggucauugau

SEQ ID NO: 244390 - RNA, 22 nt, Homo sapiens
uucaggguggagaguaugaggu

SEQ ID NO: 244391 - RNA, 20 nt, Homo sapiens
uucagugcagguaacaaucc

SEQ ID NO: 244392 - RNA, 18 nt, Homo sapiens
uucauauguugaaccaga

SEQ ID NO: 244393 - RNA, 22 nt, Homo sapiens
uucaucagcuguagaugucaug

SEQ ID NO: 244394 - RNA, 22 nt, Homo sapiens
uucaucaggaauauugaccugu

SEQ ID NO: 244395 - RNA, 18 nt, Homo sapiens
uucaucaguccucagcug

SEQ ID NO: 244396 - RNA, 22 nt, Homo sapiens
uucaucaguugagcugguugcu

SEQ ID NO: 244397 - RNA, 22 nt, Homo sapiens
uucauccccuccaaaucucaug

SEQ ID NO: 244398 - RNA, 21 nt, Homo sapiens
uucaucuggccguauuccagg

SEQ ID NO: 244399 - RNA, 22 nt, Homo sapiens
uucauggaugcauuugaggggu

SEQ ID NO: 244400 - RNA, 22 nt, Homo sapiens
uucauggguuaauuuguucgau

SEQ ID NO: 244401 - RNA, 22 nt, Homo sapiens
uucauguaaucaaggcagcuaa

SEQ ID NO: 244402 - RNA, 22 nt, Homo sapiens
uucauguagucaucauccugcu

SEQ ID NO: 244403 - RNA, 22 nt, Homo sapiens
uuccacaaugguugaacuagcu

SEQ ID NO: 244404 - RNA, 22 nt, Homo sapiens
uuccacaaugguugaacuaguu

SEQ ID NO: 244405 - RNA, 22 nt, Homo sapiens
uuccagaugggaguucuauucu

SEQ ID NO: 244406 - RNA, 22 nt, Homo sapiens
uuccaguuuuauggguauagag

SEQ ID NO: 244407 - RNA, 22 nt, Homo sapiens
uuccauuuguucggugucgcca

SEQ ID NO: 244408 - RNA, 22 nt, Homo sapiens
uucccagagaaaaggguuucuu

SEQ ID NO: 244409 - RNA, 22 nt, Homo sapiens
uucccagugccaggcacuggga

SEQ ID NO: 244410 - RNA, 22 nt, Homo sapiens
uucccugaguaucuuaccaugg

SEQ ID NO: 244411 - RNA, 22 nt, Homo sapiens
uucccugugugcagaugggugu

SEQ ID NO: 244412 - RNA, 22 nt, Homo sapiens
uucccuuugaauuggaaaggug

SEQ ID NO: 244413 - RNA, 22 nt, Homo sapiens
uuccucuagacugucgguuucu

SEQ ID NO: 244414 - RNA, 22 nt, Homo sapiens
uuccugagagggcugggugcag

SEQ ID NO: 244415 - RNA, 22 nt, Homo sapiens
uuccugagccuuguaucuagua

SEQ ID NO: 244416 - RNA, 22 nt, Homo sapiens
uuccugcacuugcuugccuaug

SEQ ID NO: 244417 - RNA, 22 nt, Homo sapiens
uuccugugacuguguggcaccc

SEQ ID NO: 244418 - RNA, 22 nt, Homo sapiens
uucuaaacaucuuacaaugcau

SEQ ID NO: 244419 - RNA, 21 nt, Homo sapiens
uucuacuccggcguuguuuuu

SEQ ID NO: 244420 - RNA, 22 nt, Homo sapiens
uucuacuccucauggcagguug

SEQ ID NO: 244421 - RNA, 22 nt, Homo sapiens
uucuaguacucccuggagcugg

SEQ ID NO: 244422 - RNA, 22 nt, Homo sapiens
uucucaauggcaacuuguugcu

SEQ ID NO: 244423 - RNA, 22 nt, Homo sapiens
uucucagcccccugacagucag

SEQ ID NO: 244424 - RNA, 22 nt, Homo sapiens
aagugguuuuuacaaagacaga

SEQ ID NO: 244425 - RNA, 22 nt, Homo sapiens
aaguguaugaaacaguccaugg

SEQ ID NO: 244426 - RNA, 22 nt, Homo sapiens
aauaaagucugaagugugcuua

SEQ ID NO: 244427 - RNA, 22 nt, Homo sapiens
aauaagcauaguaccugauagg

SEQ ID NO: 244428 - RNA, 22 nt, Homo sapiens
aauacagcacacagaugggucu

SEQ ID NO: 244429 - RNA, 22 nt, Homo sapiens
aauacugagaugugagguacua

SEQ ID NO: 244430 - RNA, 22 nt, Homo sapiens
aauacugugauaucgagcgauu

SEQ ID NO: 244431 - RNA, 22 nt, Homo sapiens
aauagcauugaaucuaccaauu

SEQ ID NO: 244432 - RNA, 22 nt, Homo sapiens
aauagugcugcaaaaacauacg

SEQ ID NO: 244433 - RNA, 22 nt, Homo sapiens
aauauagcuauguacaugucca

SEQ ID NO: 244434 - RNA, 22 nt, Homo sapiens
aauaucacaguggguguacacc

SEQ ID NO: 244435 - RNA, 23 nt, Homo sapiens
aauaucacaguggguguacaccc

SEQ ID NO: 244436 - RNA, 22 nt, Homo sapiens
aauauguccaguguuuugggag

SEQ ID NO: 244437 - RNA, 22 nt, Homo sapiens
aaucacaguguucuugugaggg

SEQ ID NO: 244438 - RNA, 21 nt, Homo sapiens
aaucacaguuguucugccuuc

SEQ ID NO: 244439 - RNA, 22 nt, Homo sapiens
aaucacguagcaguagggagaa

SEQ ID NO: 244440 - RNA, 22 nt, Homo sapiens
aaucacuuuggcaccaaccuaa

SEQ ID NO: 244441 - RNA, 22 nt, Homo sapiens
aaucauggaguauuuguccuug

SEQ ID NO: 244442 - RNA, 22 nt, Homo sapiens
aaucgcuuuugguaggcaagga

SEQ ID NO: 244443 - RNA, 22 nt, Homo sapiens
aaucuguagaaggugcacauuc

SEQ ID NO: 244444 - RNA, 22 nt, Homo sapiens
aaucugucuuuuguuauugagg

SEQ ID NO: 244445 - RNA, 22 nt, Homo sapiens
aaugacagccagauucuucucu

SEQ ID NO: 244446 - RNA, 22 nt, Homo sapiens
aaugacucugccuaaauuucac

SEQ ID NO: 244447 - RNA, 22 nt, Homo sapiens
aaugacugugauauuuuucuuc

SEQ ID NO: 244448 - RNA, 22 nt, Homo sapiens
aaugccacugugccugccaagg

SEQ ID NO: 244449 - RNA, 22 nt, Homo sapiens
aauggcacaagacaugaagaag

SEQ ID NO: 244450 - RNA, 22 nt, Homo sapiens
aauggccuuuuucauuauacug

SEQ ID NO: 244451 - RNA, 22 nt, Homo sapiens
aauggcucugauguuguuguga

SEQ ID NO: 244452 - RNA, 22 nt, Homo sapiens
aaugucacugugguccuccagu

SEQ ID NO: 244453 - RNA, 22 nt, Homo sapiens
aaugugcacuauuagggugaua

SEQ ID NO: 244454 - RNA, 22 nt, Homo sapiens
aaugugcuuugaaaagagcuga

SEQ ID NO: 244455 - RNA, 22 nt, Homo sapiens
aauguguuuugaaaucaggaag

SEQ ID NO: 244456 - RNA, 22 nt, Homo sapiens
aauuacauggcaauugggaaau

SEQ ID NO: 244457 - RNA, 22 nt, Homo sapiens
aauuacuucuacaccaaccuaa

SEQ ID NO: 244458 - RNA, 22 nt, Homo sapiens
aauucuguauuguuuagggacu

SEQ ID NO: 244459 - RNA, 22 nt, Homo sapiens
aauucugugagauggugcagau

SEQ ID NO: 244460 - RNA, 22 nt, Homo sapiens
aauugcaccaucuagaucaaga

SEQ ID NO: 244461 - RNA, 22 nt, Homo sapiens
aauugcuucuguauuuuggaca

SEQ ID NO: 244462 - RNA, 21 nt, Homo sapiens
acaaagcuggagggagacugc

SEQ ID NO: 244463 - RNA, 17 nt, Homo sapiens
acaaauugccagcuagg

SEQ ID NO: 244464 - RNA, 22 nt, Homo sapiens
acaagacuucuuguauucuagu

SEQ ID NO: 244465 - RNA, 22 nt, Homo sapiens
acacacgugcauguaugcguau

SEQ ID NO: 244466 - RNA, 22 nt, Homo sapiens
acacauacacauaugguguaua

SEQ ID NO: 244467 - RNA, 22 nt, Homo sapiens
acaccaguacuuuauacaagca

SEQ ID NO: 244468 - RNA, 22 nt, Homo sapiens
acaccauugcauuccagccugg

SEQ ID NO: 244469 - RNA, 22 nt, Homo sapiens
acacucucucauuacuuguuug

SEQ ID NO: 244470 - RNA, 22 nt, Homo sapiens
acacuggaggagagcuguugcu

SEQ ID NO: 244471 - RNA, 22 nt, Homo sapiens
acacugucucuugcugaccaug

SEQ ID NO: 244472 - RNA, 20 nt, Homo sapiens
acacugugcuaaggauuuuc

SEQ ID NO: 244473 - RNA, 22 nt, Homo sapiens
acagauagcacuaagggaucug

SEQ ID NO: 244474 - RNA, 20 nt, Homo sapiens
acagcauagccuuuuaaagc

SEQ ID NO: 244475 - RNA, 22 nt, Homo sapiens
acagguacaagggauuaggaug

SEQ ID NO: 244476 - RNA, 22 nt, Homo sapiens
acaguacaugauaaauaaggua

SEQ ID NO: 244477 - RNA, 22 nt, Homo sapiens
acaguagaaaacaauggauuug

SEQ ID NO: 244478 - RNA, 23 nt, Homo sapiens
acaguauguggauguggcuaagu

SEQ ID NO: 244479 - RNA, 22 nt, Homo sapiens
acagugcuucugauaugaugcc

SEQ ID NO: 244480 - RNA, 22 nt, Homo sapiens
acagugcuuuuguuccucuccu

SEQ ID NO: 244481 - RNA, 18 nt, Homo sapiens
acagugucuuacaccugu

SEQ ID NO: 244482 - RNA, 18 nt, Homo sapiens
acaguguguaaggguucu

SEQ ID NO: 244483 - RNA, 22 nt, Homo sapiens
acauaaagaagcaggacauugu

SEQ ID NO: 244484 - RNA, 22 nt, Homo sapiens
acauagaguagcuaccuguaga

SEQ ID NO: 244485 - RNA, 22 nt, Homo sapiens
acaugcauggcaugcauuguac

SEQ ID NO: 244486 - RNA, 19 nt, Homo sapiens
acauggauuuugugcaaac

SEQ ID NO: 244487 - RNA, 22 nt, Homo sapiens
accaccauugcacugaacuuuc

SEQ ID NO: 244488 - RNA, 22 nt, Homo sapiens
accauugcacuccuuucugggc

SEQ ID NO: 244489 - RNA, 22 nt, Homo sapiens
agcuuguuuucccauaacuaga

SEQ ID NO: 244490 - RNA, 18 nt, Homo sapiens
aggaaugguaauacuuca

SEQ ID NO: 244491 - RNA, 22 nt, Homo sapiens
aggacacugagcaugggagguu

SEQ ID NO: 244492 - RNA, 22 nt, Homo sapiens
aggagguaggaauugugcuagg

SEQ ID NO: 244493 - RNA, 22 nt, Homo sapiens
aggcaacaugguaaaacccugu

SEQ ID NO: 244494 - RNA, 22 nt, Homo sapiens
aggcaagaaugcuuguuucacc

SEQ ID NO: 244495 - RNA, 22 nt, Homo sapiens
aggcaaguugcucaaaugcaaa

SEQ ID NO: 244496 - RNA, 22 nt, Homo sapiens
aggcaaugugagaguuuauuca

SEQ ID NO: 244497 - RNA, 22 nt, Homo sapiens
aggcaggugaaagauaguuuua

SEQ ID NO: 244498 - RNA, 22 nt, Homo sapiens
aggcaugauuguauuuugcucu

SEQ ID NO: 244499 - RNA, 22 nt, Homo sapiens
aggccaguuuuuggagggaaac

SEQ ID NO: 244500 - RNA, 22 nt, Homo sapiens
aggcuagaaucuuccaucuugg

SEQ ID NO: 244501 - RNA, 22 nt, Homo sapiens
aggcugguauuuacaaaagcuc

SEQ ID NO: 244502 - RNA, 22 nt, Homo sapiens
aggcuguguggauaauauuggg

SEQ ID NO: 244503 - RNA, 22 nt, Homo sapiens
agggaagugugcuaugcauuua

SEQ ID NO: 244504 - RNA, 22 nt, Homo sapiens
agggcuuuugagcugagauggu

SEQ ID NO: 244505 - RNA, 20 nt, Homo sapiens
agguacacugacaugccuuc

SEQ ID NO: 244506 - RNA, 22 nt, Homo sapiens
agguagguugagaugggcauca

SEQ ID NO: 244507 - RNA, 21 nt, Homo sapiens
agguaguuuuccuuuuggagu

SEQ ID NO: 244508 - RNA, 21 nt, Homo sapiens
aggucaguaagaaugcagcac

SEQ ID NO: 244509 - RNA, 22 nt, Homo sapiens
agguccacuuacuacuccuguu

SEQ ID NO: 244510 - RNA, 22 nt, Homo sapiens
aggugaaugcucacauucuaau

SEQ ID NO: 244511 - RNA, 22 nt, Homo sapiens
aggugcacucagaaaacagaua

SEQ ID NO: 244512 - RNA, 22 nt, Homo sapiens
aggugcuauauuucgaggauag

SEQ ID NO: 244513 - RNA, 22 nt, Homo sapiens
agguuaugauuauagagcgagg

SEQ ID NO: 244514 - RNA, 22 nt, Homo sapiens
agguuaugauuguagagcgagg

SEQ ID NO: 244515 - RNA, 22 nt, Homo sapiens
aguaaacuucagaguucuuccu

SEQ ID NO: 244516 - RNA, 22 nt, Homo sapiens
aguaacacaccugcauggugug

SEQ ID NO: 244517 - RNA, 22 nt, Homo sapiens
aguaagucucaagguaggguag

SEQ ID NO: 244518 - RNA, 22 nt, Homo sapiens
aguacaauguugaguagaagug

SEQ ID NO: 244519 - RNA, 22 nt, Homo sapiens
aguaccauuacucacuuauuuu

SEQ ID NO: 244520 - RNA, 22 nt, Homo sapiens
aguaccauuccguuggagcugg

SEQ ID NO: 244521 - RNA, 22 nt, Homo sapiens
aguaucaucuuguuggccaggc

SEQ ID NO: 244522 - RNA, 22 nt, Homo sapiens
agucagugcauaagaaugaagu

SEQ ID NO: 244523 - RNA, 22 nt, Homo sapiens
agucagugucuguaaggagaac

SEQ ID NO: 244524 - RNA, 20 nt, Homo sapiens
agucaguuuauuuucucucu

SEQ ID NO: 244525 - RNA, 22 nt, Homo sapiens
agucgguguuacugacagaaug

SEQ ID NO: 244526 - RNA, 22 nt, Homo sapiens
agugaaaugucaccuuuuagga

SEQ ID NO: 244527 - RNA, 22 nt, Homo sapiens
agugacaugggaucaaaucuga

SEQ ID NO: 244528 - RNA, 17 nt, Homo sapiens
agugagaucauggcuua

SEQ ID NO: 244529 - RNA, 22 nt, Homo sapiens
agugagcugcagucuggggucc

SEQ ID NO: 244530 - RNA, 22 nt, Homo sapiens
agugauuuuaacuuccagcaau

SEQ ID NO: 244531 - RNA, 22 nt, Homo sapiens
agugcacuccagccugggcaac

SEQ ID NO: 244532 - RNA, 22 nt, Homo sapiens
agugcaguggcucaaaaugccu

SEQ ID NO: 244533 - RNA, 22 nt, Homo sapiens
agugcauugagacuugugaguu

SEQ ID NO: 244534 - RNA, 22 nt, Homo sapiens
agugccaaaucgagggcucuga

SEQ ID NO: 244535 - RNA, 22 nt, Homo sapiens
aguggaaucuguuauacuaacu

SEQ ID NO: 244536 - RNA, 22 nt, Homo sapiens
agugguuuuggaauggaauuca

SEQ ID NO: 244537 - RNA, 19 nt, Homo sapiens
agugucauggucauuauuu

SEQ ID NO: 244538 - RNA, 22 nt, Homo sapiens
aguucaaugcucuuucuacuau

SEQ ID NO: 244539 - RNA, 22 nt, Homo sapiens
aguugcaagucuugaguaaaga

SEQ ID NO: 244540 - RNA, 22 nt, Homo sapiens
aguuggcacugagcugugauug

SEQ ID NO: 244541 - RNA, 22 nt, Homo sapiens
auaaaagcaggucuaggucagg

SEQ ID NO: 244542 - RNA, 22 nt, Homo sapiens
auaaagcaagucucuggccuca

SEQ ID NO: 244543 - RNA, 22 nt, Homo sapiens
auaaaugcaaugguauuuuuga

SEQ ID NO: 244544 - RNA, 22 nt, Homo sapiens
auaaaugcauugagaacugcug

SEQ ID NO: 244545 - RNA, 22 nt, Homo sapiens
auaaaugcuuccagucauuaaa

SEQ ID NO: 244546 - RNA, 20 nt, Homo sapiens
auaaauguauagguguacau

SEQ ID NO: 244547 - RNA, 22 nt, Homo sapiens
auaacagcauuauugcauacgu

SEQ ID NO: 244548 - RNA, 22 nt, Homo sapiens
auaacauggaguuugucauuua

SEQ ID NO: 244549 - RNA, 22 nt, Homo sapiens
auaagaagugaaccagacgucu

SEQ ID NO: 244550 - RNA, 22 nt, Homo sapiens
auaagaguaguacauaugagac

SEQ ID NO: 244551 - RNA, 22 nt, Homo sapiens
auaaguauuuggacuuuacugu

SEQ ID NO: 244552 - RNA, 22 nt, Homo sapiens
auaagugagugauucaguguua

SEQ ID NO: 244553 - RNA, 22 nt, Homo sapiens
auaauacuuuuauuuugaggaa

SEQ ID NO: 244554 - RNA, 22 nt, Homo sapiens
acugcacuccagccugugagac

SEQ ID NO: 244555 - RNA, 22 nt, Homo sapiens
acugcacuccagccuucaggac

SEQ ID NO: 244556 - RNA, 22 nt, Homo sapiens
acugcacuccagccuuggccac

SEQ ID NO: 244557 - RNA, 22 nt, Homo sapiens
acugcacuccagccuuggcggc

SEQ ID NO: 244558 - RNA, 22 nt, Homo sapiens
acugcacuccaucuuagguggc

SEQ ID NO: 244559 - RNA, 22 nt, Homo sapiens
acugcacucuagccccugcgac

SEQ ID NO: 244560 - RNA, 22 nt, Homo sapiens
acugcacucuagccuuggcaac

SEQ ID NO: 244561 - RNA, 22 nt, Homo sapiens
acugcacucuagcuugggugac

SEQ ID NO: 244562 - RNA, 22 nt, Homo sapiens
acugcacuuauccuccaauguu

SEQ ID NO: 244563 - RNA, 22 nt, Homo sapiens
acugcacuucaaccucauugac

SEQ ID NO: 244564 - RNA, 22 nt, Homo sapiens
acugcacuucagccuguugaca

SEQ ID NO: 244565 - RNA, 22 nt, Homo sapiens
acugcacuucagccuugggaaa

SEQ ID NO: 244566 - RNA, 22 nt, Homo sapiens
acuggacuuaaugaugaauugu

SEQ ID NO: 244567 - RNA, 22 nt, Homo sapiens
acuggaguuuguucaagaaaua

SEQ ID NO: 244568 - RNA, 22 nt, Homo sapiens
acuggcuuaaggaugggccacu

SEQ ID NO: 244569 - RNA, 22 nt, Homo sapiens
acuguacuacagccugggugac

SEQ ID NO: 244570 - RNA, 22 nt, Homo sapiens
acuguacuccauccugggugac

SEQ ID NO: 244571 - RNA, 22 nt, Homo sapiens
acuguacucuacccugggcaac

SEQ ID NO: 244572 - RNA, 22 nt, Homo sapiens
acuguauagauggaguugauuu

SEQ ID NO: 244573 - RNA, 22 nt, Homo sapiens
acuguguguuugucuagcacag

SEQ ID NO: 244574 - RNA, 23 nt, Homo sapiens
agaaaugucuauucagggucccu

SEQ ID NO: 244575 - RNA, 22 nt, Homo sapiens
agaaauguuuauucaaacccgu

SEQ ID NO: 244576 - RNA, 19 nt, Homo sapiens
agaagugcauggucuagag

SEQ ID NO: 244577 - RNA, 22 nt, Homo sapiens
agaaugucaguauuggcuaaaa

SEQ ID NO: 244578 - RNA, 20 nt, Homo sapiens
agacagcugcagcccacauc

SEQ ID NO: 244579 - RNA, 20 nt, Homo sapiens
agacaguguggagauuccuu

SEQ ID NO: 244580 - RNA, 22 nt, Homo sapiens
agacaucauuugauggugggag

SEQ ID NO: 244581 - RNA, 22 nt, Homo sapiens
agaccacuuuagagauuguuca

SEQ ID NO: 244582 - RNA, 22 nt, Homo sapiens
agacuagaaaucauuuguugag

SEQ ID NO: 244583 - RNA, 22 nt, Homo sapiens
agacuagacagaugaacagcac

SEQ ID NO: 244584 - RNA, 22 nt, Homo sapiens
agagaacugauuggaugugggc

SEQ ID NO: 244585 - RNA, 19 nt, Homo sapiens
agagacucauuguagcauu

SEQ ID NO: 244586 - RNA, 22 nt, Homo sapiens
agagauaaagauuuuaauuuug

SEQ ID NO: 244587 - RNA, 22 nt, Homo sapiens
agagauacauucugagaagugc

SEQ ID NO: 244588 - RNA, 22 nt, Homo sapiens
agagaugaagauggggcucccg

SEQ ID NO: 244589 - RNA, 22 nt, Homo sapiens
agagcuguguuuuaacuuuuua

SEQ ID NO: 244590 - RNA, 22 nt, Homo sapiens
agagguaagaauaguaguugga

SEQ ID NO: 244591 - RNA, 22 nt, Homo sapiens
agagguagaagauaggcuacag

SEQ ID NO: 244592 - RNA, 22 nt, Homo sapiens
agagguauacauuugagagcca

SEQ ID NO: 244593 - RNA, 22 nt, Homo sapiens
agagguuuugcccucgagauaa

SEQ ID NO: 244594 - RNA, 22 nt, Homo sapiens
agaguaguaggaugaauggacu

SEQ ID NO: 244595 - RNA, 22 nt, Homo sapiens
agaguaguuuauuaugcuaagg

SEQ ID NO: 244596 - RNA, 22 nt, Homo sapiens
agagucacaugaggcccuucau

SEQ ID NO: 244597 - RNA, 22 nt, Homo sapiens
agagugcaaagguuggggcugg

SEQ ID NO: 244598 - RNA, 22 nt, Homo sapiens
agagugcaauggcaccaucucg

SEQ ID NO: 244599 - RNA, 22 nt, Homo sapiens
agauacaucuaugugucugugu

SEQ ID NO: 244600 - RNA, 22 nt, Homo sapiens
agauacauuggauaaugguggg

SEQ ID NO: 244601 - RNA, 22 nt, Homo sapiens
agauauuuguuaggucugucag

SEQ ID NO: 244602 - RNA, 22 nt, Homo sapiens
agaucacagucuuugguuuuag

SEQ ID NO: 244603 - RNA, 23 nt, Homo sapiens
agaugcauucuuguaggauauau

SEQ ID NO: 244604 - RNA, 22 nt, Homo sapiens
agauggauuuuguagccccagc

SEQ ID NO: 244605 - RNA, 22 nt, Homo sapiens
agauggucuucauaaguuuuaa

SEQ ID NO: 244606 - RNA, 22 nt, Homo sapiens
agauggugugcuaggaaaugua

SEQ ID NO: 244607 - RNA, 22 nt, Homo sapiens
agauguuguucaucugauuguu

SEQ ID NO: 244608 - RNA, 23 nt, Homo sapiens
agcaaaugcucuagcacuccaac

SEQ ID NO: 244609 - RNA, 22 nt, Homo sapiens
agcaacauagugagacccccau

SEQ ID NO: 244610 - RNA, 22 nt, Homo sapiens
agcaacauuuuugaccuuucuu

SEQ ID NO: 244611 - RNA, 22 nt, Homo sapiens
agcacagugguuaaguuucuua

SEQ ID NO: 244612 - RNA, 22 nt, Homo sapiens
agcacauuaguaucuaagaaca

SEQ ID NO: 244613 - RNA, 22 nt, Homo sapiens
agcaccacauacuacagagaua

SEQ ID NO: 244614 - RNA, 22 nt, Homo sapiens
agcaccauugcacuccagccug

SEQ ID NO: 244615 - RNA, 23 nt, Homo sapiens
agcaccuuuccuccacuaucugc

SEQ ID NO: 244616 - RNA, 19 nt, Homo sapiens
agcagaacaaauguguggg

SEQ ID NO: 244617 - RNA, 22 nt, Homo sapiens
agcagagcaguggauuuuguga

SEQ ID NO: 244618 - RNA, 22 nt, Homo sapiens
agcagagcauauucauucgggg

SEQ ID NO: 244619 - RNA, 21 nt, Homo sapiens
auuugguggcugugugacacu

SEQ ID NO: 244620 - RNA, 22 nt, Homo sapiens
caaagcuauagcaccagaggga

SEQ ID NO: 244621 - RNA, 22 nt, Homo sapiens
caaaggcuucugaaacugcaga

SEQ ID NO: 244622 - RNA, 22 nt, Homo sapiens
caaaguaauugugguuuugcca

SEQ ID NO: 244623 - RNA, 22 nt, Homo sapiens
caaagugcuggaauuggccggg

SEQ ID NO: 244624 - RNA, 22 nt, Homo sapiens
caaagugcugggacuggccggg

SEQ ID NO: 244625 - RNA, 22 nt, Homo sapiens
caaagugguuuauacaugauug

SEQ ID NO: 244626 - RNA, 20 nt, Homo sapiens
caaauugcuuucuugguuuu

SEQ ID NO: 244627 - RNA, 22 nt, Homo sapiens
caacacagugaaacccgucucu

SEQ ID NO: 244628 - RNA, 22 nt, Homo sapiens
caacacuguuuauuggauagcc

SEQ ID NO: 244629 - RNA, 22 nt, Homo sapiens
caagacuguccaacauauuggg

SEQ ID NO: 244630 - RNA, 22 nt, Homo sapiens
caaggaauucucaauagaguua

SEQ ID NO: 244631 - RNA, 22 nt, Homo sapiens
caagugaauaguugcucucaga

SEQ ID NO: 244632 - RNA, 22 nt, Homo sapiens
caaugcauuauucucccacuuc

SEQ ID NO: 244633 - RNA, 22 nt, Homo sapiens
caauugcacucuuagguguaca

SEQ ID NO: 244634 - RNA, 22 nt, Homo sapiens
cacaaugucuaagauguuucua

SEQ ID NO: 244635 - RNA, 22 nt, Homo sapiens
cacacugucuuucagaaugguu

SEQ ID NO: 244636 - RNA, 22 nt, Homo sapiens
cacagaauucauuggauuaccu

SEQ ID NO: 244637 - RNA, 22 nt, Homo sapiens
cacagcacaggcaugaguguca

SEQ ID NO: 244638 - RNA, 22 nt, Homo sapiens
cacaguagaauagagcacuagg

SEQ ID NO: 244639 - RNA, 22 nt, Homo sapiens
cacagugaacugguggguuuuu

SEQ ID NO: 244640 - RNA, 22 nt, Homo sapiens
cacaguguucauagccaucagg

SEQ ID NO: 244641 - RNA, 22 nt, Homo sapiens
cacauguucaggagcacuuaga

SEQ ID NO: 244642 - RNA, 22 nt, Homo sapiens
cacauugaauuucugaugacaa

SEQ ID NO: 244643 - RNA, 22 nt, Homo sapiens
cacauugcaggaaaguucauua

SEQ ID NO: 244644 - RNA, 22 nt, Homo sapiens
caccaaccucaguagcaucugu

SEQ ID NO: 244645 - RNA, 22 nt, Homo sapiens
caccagguggcugaggccauga

SEQ ID NO: 244646 - RNA, 22 nt, Homo sapiens
caccagguuggagugcaguggu

SEQ ID NO: 244647 - RNA, 19 nt, Homo sapiens
caccagugcaugcuacuau

SEQ ID NO: 244648 - RNA, 22 nt, Homo sapiens
caccauguguucagaaggauug

SEQ ID NO: 244649 - RNA, 22 nt, Homo sapiens
cacccuaucagauguccagaga

SEQ ID NO: 244650 - RNA, 22 nt, Homo sapiens
caccggauucauggggaagaag

SEQ ID NO: 244651 - RNA, 22 nt, Homo sapiens
caccuguacauggcaguguccu

SEQ ID NO: 244652 - RNA, 22 nt, Homo sapiens
caccuugugauccacccgccuu

SEQ ID NO: 244653 - RNA, 22 nt, Homo sapiens
gacauguuuucauguauuugga

SEQ ID NO: 244654 - RNA, 22 nt, Homo sapiens
gaccacauuccacacaggcuuu

SEQ ID NO: 244655 - RNA, 22 nt, Homo sapiens
gacccauagaagcgagcuugug

SEQ ID NO: 244656 - RNA, 22 nt, Homo sapiens
gaccuaggaggauugcuugagc

SEQ ID NO: 244657 - RNA, 22 nt, Homo sapiens
gaccuuguagaaucucaugauu

SEQ ID NO: 244658 - RNA, 22 nt, Homo sapiens
gacucagaacuaaggguguuuc

SEQ ID NO: 244659 - RNA, 22 nt, Homo sapiens
gacugaguaagcagaagcaauu

SEQ ID NO: 244660 - RNA, 22 nt, Homo sapiens
gacugcagugcagcuguuaggc

SEQ ID NO: 244661 - RNA, 22 nt, Homo sapiens
gacuggauagauaaaguuaguu

SEQ ID NO: 244662 - RNA, 22 nt, Homo sapiens
gacuuugguagaggaaaaaucu

SEQ ID NO: 244663 - RNA, 22 nt, Homo sapiens
gagaacagaagcauuccuaauu

SEQ ID NO: 244664 - RNA, 22 nt, Homo sapiens
gagaacauuaauaguuaauuuu

SEQ ID NO: 244665 - RNA, 22 nt, Homo sapiens
gagaacugagauaagugauauu

SEQ ID NO: 244666 - RNA, 22 nt, Homo sapiens
gagaaugagaggggaaggccac

SEQ ID NO: 244667 - RNA, 22 nt, Homo sapiens
gagaaugagauuaugguuacau

SEQ ID NO: 244668 - RNA, 23 nt, Homo sapiens
gagaccagcuucagaaagcacga

SEQ ID NO: 244669 - RNA, 20 nt, Homo sapiens
gagaccugagauucacucaa

SEQ ID NO: 244670 - RNA, 22 nt, Homo sapiens
gagacugagucucacucuguca

SEQ ID NO: 244671 - RNA, 22 nt, Homo sapiens
gagacugagucuugcucuguca

SEQ ID NO: 244672 - RNA, 21 nt, Homo sapiens
gagaggauucgccagccucuu

SEQ ID NO: 244673 - RNA, 22 nt, Homo sapiens
gagagguaguuuuuuggucguc

SEQ ID NO: 244674 - RNA, 22 nt, Homo sapiens
gagauaaauaggucacaguucu

SEQ ID NO: 244675 - RNA, 22 nt, Homo sapiens
gagauacuugguuucuguuucu

SEQ ID NO: 244676 - RNA, 22 nt, Homo sapiens
gagauauuauuucccuuucaca

SEQ ID NO: 244677 - RNA, 22 nt, Homo sapiens
gagaucaguuaaugaagugagc

SEQ ID NO: 244678 - RNA, 22 nt, Homo sapiens
gagaugaucaugugguuuuguc

SEQ ID NO: 244679 - RNA, 22 nt, Homo sapiens
gagaugauuugccccauguauu

SEQ ID NO: 244680 - RNA, 22 nt, Homo sapiens
gagauggagacuuggccuuaaa

SEQ ID NO: 244681 - RNA, 22 nt, Homo sapiens
gagauggaguuucacuucgcuc

SEQ ID NO: 244682 - RNA, 22 nt, Homo sapiens
gagaugguguuccacugccagu

SEQ ID NO: 244683 - RNA, 22 nt, Homo sapiens
gagaugugguucaaggguguuu

SEQ ID NO: 244684 - RNA, 22 nt, Homo sapiens
gagauguuuuguuaucaaagga

SEQ ID NO: 244685 - RNA, 19 nt, Homo sapiens
gcaguauugaaggccaguc

SEQ ID NO: 244686 - RNA, 22 nt, Homo sapiens
gcagucaucugaaggcuuaacu

SEQ ID NO: 244687 - RNA, 22 nt, Homo sapiens
gcagugcaugacgguauauaua

SEQ ID NO: 244688 - RNA, 22 nt, Homo sapiens
gcaguggugugugccagccuag

SEQ ID NO: 244689 - RNA, 16 nt, Homo sapiens
gcaguguguuuaauag

SEQ ID NO: 244690 - RNA, 20 nt, Homo sapiens
gcaguguucacuguauuccu

SEQ ID NO: 244691 - RNA, 22 nt, Homo sapiens
gcaguguuggggccggaggcug

SEQ ID NO: 244692 - RNA, 22 nt, Homo sapiens
gcauggccuuuaaaugucacag

SEQ ID NO: 244693 - RNA, 22 nt, Homo sapiens
gcaugguaguaaccuacauuug

SEQ ID NO: 244694 - RNA, 22 nt, Homo sapiens
gcauguaguagauguugaauaa

SEQ ID NO: 244695 - RNA, 22 nt, Homo sapiens
gccaagauuuaauucaucaguu

SEQ ID NO: 244696 - RNA, 22 nt, Homo sapiens
gccagauuguccaguuuuuuau

SEQ ID NO: 244697 - RNA, 22 nt, Homo sapiens
gccauugcacuccagcuugggc

SEQ ID NO: 244698 - RNA, 22 nt, Homo sapiens
gcccuguugcccaggcuggagu

SEQ ID NO: 244699 - RNA, 22 nt, Homo sapiens
gccucaguuguggccagggauu

SEQ ID NO: 244700 - RNA, 22 nt, Homo sapiens
gccuguagaagaguagaugacc

SEQ ID NO: 244701 - RNA, 22 nt, Homo sapiens
gcgcagugggcugugccaucca

SEQ ID NO: 244702 - RNA, 22 nt, Homo sapiens
gcuaaggcaggagcauugcuug

SEQ ID NO: 244703 - RNA, 19 nt, Homo sapiens
gcucaccuugcugcuccag

SEQ ID NO: 244704 - RNA, 22 nt, Homo sapiens
gcucaugagacaagcaggagua

SEQ ID NO: 244705 - RNA, 22 nt, Homo sapiens
gcucugguuacaaaggcaaauu

SEQ ID NO: 244706 - RNA, 22 nt, Homo sapiens
gcugagaucucuugccugaacu

SEQ ID NO: 244707 - RNA, 22 nt, Homo sapiens
gcugcuguaccagaugugguua

SEQ ID NO: 244708 - RNA, 22 nt, Homo sapiens
gcugcuguuucucuuucagcau

SEQ ID NO: 244709 - RNA, 22 nt, Homo sapiens
gcugcuuuugaugacaaaaaca

SEQ ID NO: 244710 - RNA, 22 nt, Homo sapiens
gcuggcaagaugcugaugcaac

SEQ ID NO: 244711 - RNA, 22 nt, Homo sapiens
gcuggcuuucuccugaucucag

SEQ ID NO: 244712 - RNA, 22 nt, Homo sapiens
gcuggugaaggcugaaaagugg

SEQ ID NO: 244713 - RNA, 22 nt, Homo sapiens
gcugguguagagugcagaaagg

SEQ ID NO: 244714 - RNA, 22 nt, Homo sapiens
gcugguguucaggcccucaguc

SEQ ID NO: 244715 - RNA, 22 nt, Homo sapiens
gcuguguucucgaggcggggga

SEQ ID NO: 244716 - RNA, 18 nt, Homo sapiens
gcuguugucagagcacau

SEQ ID NO: 244717 - RNA, 20 nt, Homo sapiens
guccauuugcugccauugcu

SEQ ID NO: 244718 - RNA, 22 nt, Homo sapiens
gucguggagucucuggcuugua

SEQ ID NO: 244719 - RNA, 22 nt, Homo sapiens
gucuggagacuugggucaucaa

SEQ ID NO: 244720 - RNA, 21 nt, Homo sapiens
gucugguguuuuaaugaggac

SEQ ID NO: 244721 - RNA, 22 nt, Homo sapiens
gucugguuccugggagauuucu

SEQ ID NO: 244722 - RNA, 22 nt, Homo sapiens
gucuguuuggggaccuguggcc

SEQ ID NO: 244723 - RNA, 21 nt, Homo sapiens
gucuuacagccagaugccucu

SEQ ID NO: 244724 - RNA, 20 nt, Homo sapiens
gucuugcuccguugcccagg

SEQ ID NO: 244725 - RNA, 22 nt, Homo sapiens
gucuuggagacauugccauuga

SEQ ID NO: 244726 - RNA, 22 nt, Homo sapiens
gucuuggcaugugcagcuggga

SEQ ID NO: 244727 - RNA, 20 nt, Homo sapiens
gucuuguagcucaaguuauu

SEQ ID NO: 244728 - RNA, 22 nt, Homo sapiens
gugaaagacagcauuaauggcu

SEQ ID NO: 244729 - RNA, 22 nt, Homo sapiens
gugaaagacauauaugguuuga

SEQ ID NO: 244730 - RNA, 22 nt, Homo sapiens
gugaaagcaucugacugugcca

SEQ ID NO: 244731 - RNA, 22 nt, Homo sapiens
gugaaauacauaaucccaagug

SEQ ID NO: 244732 - RNA, 22 nt, Homo sapiens
gugaaaugaaacgcuaugucuu

SEQ ID NO: 244733 - RNA, 22 nt, Homo sapiens
gugaaaugaaucuggaaauauu

SEQ ID NO: 244734 - RNA, 15 nt, Homo sapiens
gugaaauguuucaga

SEQ ID NO: 244735 - RNA, 22 nt, Homo sapiens
gugaacaauguuuuauccuggg

SEQ ID NO: 244736 - RNA, 22 nt, Homo sapiens
gugaacagcagaugagugagug

SEQ ID NO: 244737 - RNA, 22 nt, Homo sapiens
gugaaguuuuuugcugagaguc

SEQ ID NO: 244738 - RNA, 22 nt, Homo sapiens
gugacacagcaagacuccgucu

SEQ ID NO: 244739 - RNA, 22 nt, Homo sapiens
gugacacuggagcuggcacaau

SEQ ID NO: 244740 - RNA, 22 nt, Homo sapiens
gugacaucagcuccagguauaa

SEQ ID NO: 244741 - RNA, 22 nt, Homo sapiens
gugaccauuugacauauccuug

SEQ ID NO: 244742 - RNA, 22 nt, Homo sapiens
gugacugcauccauccaggcuu

SEQ ID NO: 244743 - RNA, 22 nt, Homo sapiens
gugagaagaaaaauauggcugu

SEQ ID NO: 244744 - RNA, 18 nt, Homo sapiens
gugagaaugacuguucug

SEQ ID NO: 244745 - RNA, 22 nt, Homo sapiens
gugagaccaauguacuaccuuc

SEQ ID NO: 244746 - RNA, 22 nt, Homo sapiens
gugagaugugacuucugccucu

SEQ ID NO: 244747 - RNA, 22 nt, Homo sapiens
gugagcaguguccuugggggca

SEQ ID NO: 244748 - RNA, 22 nt, Homo sapiens
gugagcauuacucaugggauca

SEQ ID NO: 244749 - RNA, 22 nt, Homo sapiens
gugagcauucaaggaaggagcu

SEQ ID NO: 244750 - RNA, 22 nt, Homo sapiens
gugaggcugguccugccuccca

SEQ ID NO: 244751 - RNA, 22 nt, Homo sapiens
gugagguaauuagcucccuuag

SEQ ID NO: 244752 - RNA, 22 nt, Homo sapiens
gugagguagagcaugugaaaga

SEQ ID NO: 244753 - RNA, 17 nt, Homo sapiens
gugagguauccucaaaa

SEQ ID NO: 244754 - RNA, 21 nt, Homo sapiens
gugaggucauugggcuuucug

SEQ ID NO: 244755 - RNA, 22 nt, Homo sapiens
gugagucagucuguguagggcu

SEQ ID NO: 244756 - RNA, 20 nt, Homo sapiens
gugagucauuaguaaccaaa

SEQ ID NO: 244757 - RNA, 22 nt, Homo sapiens
gugaugacauucagagaugaag

SEQ ID NO: 244758 - RNA, 22 nt, Homo sapiens
gugaugcaguacguagaggaga

SEQ ID NO: 244759 - RNA, 22 nt, Homo sapiens
gugauuauccacgucuuuguga

SEQ ID NO: 244760 - RNA, 22 nt, Homo sapiens
gugauuauuaugcacugcaugc

SEQ ID NO: 244761 - RNA, 22 nt, Homo sapiens
gugcaaccaucaccacugacuc

SEQ ID NO: 244762 - RNA, 22 nt, Homo sapiens
gugcaaguguaauacagcuagg

SEQ ID NO: 244763 - RNA, 22 nt, Homo sapiens
gugcacaaaucuuaaauguaca

SEQ ID NO: 244764 - RNA, 22 nt, Homo sapiens
gugcacaacgugcaggcuuguu

SEQ ID NO: 244765 - RNA, 21 nt, Homo sapiens
gugcacaguaguguuuaauag

SEQ ID NO: 244766 - RNA, 22 nt, Homo sapiens
gugcacaucgugcagguuuguu

SEQ ID NO: 244767 - RNA, 22 nt, Homo sapiens
gugcacaugcgugcgcacauau

SEQ ID NO: 244768 - RNA, 22 nt, Homo sapiens
gugcacuguagaacccuuuguu

SEQ ID NO: 244769 - RNA, 22 nt, Homo sapiens
gugcaguguuugcauggaauca

SEQ ID NO: 244770 - RNA, 22 nt, Homo sapiens
gugcaguuugaaaguagaaaca

SEQ ID NO: 244771 - RNA, 22 nt, Homo sapiens
gugcauacucuggagacauugu

SEQ ID NO: 244772 - RNA, 22 nt, Homo sapiens
gugcauauaaguuguuucuagu

SEQ ID NO: 244773 - RNA, 22 nt, Homo sapiens
gugcauaucugugguuggcuga

SEQ ID NO: 244774 - RNA, 22 nt, Homo sapiens
gugcauaugcaugugcaugcac

SEQ ID NO: 244775 - RNA, 22 nt, Homo sapiens
gugcauguccacuaguccauau

SEQ ID NO: 244776 - RNA, 22 nt, Homo sapiens
gugccacugcaccuggccuaag

SEQ ID NO: 244777 - RNA, 22 nt, Homo sapiens
gugccacugcacuccggccugg

SEQ ID NO: 244778 - RNA, 22 nt, Homo sapiens
gugccuuuucugagcaaugagc

SEQ ID NO: 244779 - RNA, 22 nt, Homo sapiens
gugcuuuguuguggcaguggca

SEQ ID NO: 244780 - RNA, 22 nt, Homo sapiens
guggaaaaguaguugcgguuuu

SEQ ID NO: 244781 - RNA, 22 nt, Homo sapiens
guggaaagaacacaaaauuagg

SEQ ID NO: 244782 - RNA, 22 nt, Homo sapiens
guggaagaccagacuuuccaac

SEQ ID NO: 244783 - RNA, 22 nt, Homo sapiens
guggaagguaaugcagcuuacu

SEQ ID NO: 244784 - RNA, 22 nt, Homo sapiens
guggaaguguaaaagcucuugg

SEQ ID NO: 244785 - RNA, 22 nt, Homo sapiens
guggaaguuaagugacuuucug

SEQ ID NO: 244786 - RNA, 22 nt, Homo sapiens
guggaaugauaucucauugugg

SEQ ID NO: 244787 - RNA, 22 nt, Homo sapiens
guggacagagacuaaauguugu

SEQ ID NO: 244788 - RNA, 18 nt, Homo sapiens
guggagugucuuccugga

SEQ ID NO: 244789 - RNA, 20 nt, Homo sapiens
ugcauguccucacuuacuug

SEQ ID NO: 244790 - RNA, 22 nt, Homo sapiens
ugcauuaucagauguuugcuuu

SEQ ID NO: 244791 - RNA, 22 nt, Homo sapiens
ugcauugcacuugcaugagaua

SEQ ID NO: 244792 - RNA, 19 nt, Homo sapiens
ugcauugucugggaaaugg

SEQ ID NO: 244793 - RNA, 22 nt, Homo sapiens
ugcauuguuuagaaacacuggg

SEQ ID NO: 244794 - RNA, 22 nt, Homo sapiens
ugccaacaugccuggcuguuuu

SEQ ID NO: 244795 - RNA, 22 nt, Homo sapiens
ugccaacugguuucuuuuaguu

SEQ ID NO: 244796 - RNA, 22 nt, Homo sapiens
ugccaggaugaggucaauguuu

SEQ ID NO: 244797 - RNA, 20 nt, Homo sapiens
ugccagugugucaauuuaua

SEQ ID NO: 244798 - RNA, 22 nt, Homo sapiens
ugccuggagagcuccuacauau

SEQ ID NO: 244799 - RNA, 22 nt, Homo sapiens
ugcuauguccccacccaaaucu

SEQ ID NO: 244800 - RNA, 16 nt, Homo sapiens
ugcuauguuggccagg

SEQ ID NO: 244801 - RNA, 21 nt, Homo sapiens
ugcuauguuguccaggcuggc

SEQ ID NO: 244802 - RNA, 21 nt, Homo sapiens
ugcucaugaguaaugcaguga

SEQ ID NO: 244803 - RNA, 18 nt, Homo sapiens
ugcuccccugggugagca

SEQ ID NO: 244804 - RNA, 23 nt, Homo sapiens
ugcugagaccuagauccuaaaga

SEQ ID NO: 244805 - RNA, 22 nt, Homo sapiens
ugcugaguguuaccggacaccg

SEQ ID NO: 244806 - RNA, 22 nt, Homo sapiens
ugcugcaaacaugagaggaagu

SEQ ID NO: 244807 - RNA, 22 nt, Homo sapiens
ugcugcaaucucggcacuuugg

SEQ ID NO: 244808 - RNA, 22 nt, Homo sapiens
ugcugcacuuauggcucugagg

SEQ ID NO: 244809 - RNA, 22 nt, Homo sapiens
ugcuggugauuaaauccugaag

SEQ ID NO: 244810 - RNA, 22 nt, Homo sapiens
ugcugguggucccauaugauua

SEQ ID NO: 244811 - RNA, 22 nt, Homo sapiens
ugcugguguggucuagccgcuu

SEQ ID NO: 244812 - RNA, 18 nt, Homo sapiens
ugcuuagucauuuucaau

SEQ ID NO: 244813 - RNA, 22 nt, Homo sapiens
ugcuuguguucagguaaccuuu

SEQ ID NO: 244814 - RNA, 21 nt, Homo sapiens
ugcuuuggucauacuucuucc

SEQ ID NO: 244815 - RNA, 22 nt, Homo sapiens
uggaaaacaugcacauuggauu

SEQ ID NO: 244816 - RNA, 22 nt, Homo sapiens
uggaaaguaguucuaaucuaag

SEQ ID NO: 244817 - RNA, 22 nt, Homo sapiens
uggaaauaaaauagaguuugcc

SEQ ID NO: 244818 - RNA, 23 nt, Homo sapiens
uggaacugaauuucuuagcauuu

SEQ ID NO: 244819 - RNA, 22 nt, Homo sapiens
uggaagacacauaccugauaac

SEQ ID NO: 244820 - RNA, 22 nt, Homo sapiens
uggaagacauugggugaagggu

SEQ ID NO: 244821 - RNA, 23 nt, Homo sapiens
uggaagacuccucucuuggcugc

SEQ ID NO: 244822 - RNA, 22 nt, Homo sapiens
uggaagcauagcagcgugugug

SEQ ID NO: 244823 - RNA, 20 nt, Homo sapiens
uggaaggcaucugcauuauu

SEQ ID NO: 244824 - RNA, 22 nt, Homo sapiens
uggaaggcuucauauguaaaga

SEQ ID NO: 244825 - RNA, 22 nt, Homo sapiens
uggaaggucauuguucauuuga

SEQ ID NO: 244826 - RNA, 22 nt, Homo sapiens
uggaagucauugagguguguua

SEQ ID NO: 244827 - RNA, 22 nt, Homo sapiens
uggaaguuaaaugacucuuucu

SEQ ID NO: 244828 - RNA, 22 nt, Homo sapiens
uggaauaucaugagaguuuguu

SEQ ID NO: 244829 - RNA, 22 nt, Homo sapiens
uggaaucuacuaaagcaaaauc

SEQ ID NO: 244830 - RNA, 22 nt, Homo sapiens
uggaaucuuaggugaaggcuuu

SEQ ID NO: 244831 - RNA, 22 nt, Homo sapiens
uggaaugguaucuuguuggggu

SEQ ID NO: 244832 - RNA, 22 nt, Homo sapiens
uggaaugguuggugugauuuua

SEQ ID NO: 244833 - RNA, 22 nt, Homo sapiens
uggaaugucagcuacaagaggg

SEQ ID NO: 244834 - RNA, 18 nt, Homo sapiens
uggaauguuuggguuaau

SEQ ID NO: 244835 - RNA, 22 nt, Homo sapiens
uggacagaaacauguuuucagu

SEQ ID NO: 244836 - RNA, 22 nt, Homo sapiens
uggacagagagaccggcauuuu

SEQ ID NO: 244837 - RNA, 21 nt, Homo sapiens
uggaccccuacuucucaccau

SEQ ID NO: 244838 - RNA, 21 nt, Homo sapiens
uggaccccuuucuuacaccgu

SEQ ID NO: 244839 - RNA, 22 nt, Homo sapiens
uggacugagauuucagcugcca

SEQ ID NO: 244840 - RNA, 22 nt, Homo sapiens
uggacuguaauagagaacagaa

SEQ ID NO: 244841 - RNA, 22 nt, Homo sapiens
uggagagucauuuauaguauuu

SEQ ID NO: 244842 - RNA, 22 nt, Homo sapiens
uggagagugagggccuccuuaa

SEQ ID NO: 244843 - RNA, 19 nt, Homo sapiens
uggagauauccccuucaca

SEQ ID NO: 244844 - RNA, 22 nt, Homo sapiens
uggagcccuaaacuucuaauau

SEQ ID NO: 244845 - RNA, 22 nt, Homo sapiens
uggagggcuagucauuucuuuu

SEQ ID NO: 244846 - RNA, 22 nt, Homo sapiens
uggagguagacauugggaagag

SEQ ID NO: 244847 - RNA, 22 nt, Homo sapiens
uggaggucauuggaucaugggg

SEQ ID NO: 244848 - RNA, 19 nt, Homo sapiens
uggagucaucaugcugcua

SEQ ID NO: 244849 - RNA, 22 nt, Homo sapiens
uggagucuugcucuguugccca

SEQ ID NO: 244850 - RNA, 21 nt, Homo sapiens
uggagugaagaguuuauugac

SEQ ID NO: 244851 - RNA, 22 nt, Homo sapiens
uggagugauaugguuauauggg

SEQ ID NO: 244852 - RNA, 20 nt, Homo sapiens
uggagugcuguguugagaag

SEQ ID NO: 244853 - RNA, 22 nt, Homo sapiens
uggaguguaaauuaguucagcc

SEQ ID NO: 244854 - RNA, 22 nt, Homo sapiens
uggaucauucuuucuugcaggg

SEQ ID NO: 244855 - RNA, 19 nt, Homo sapiens
uggaugacugucugggucu

SEQ ID NO: 244856 - RNA, 21 nt, Homo sapiens
uggaugccuaggcagaaguuu

SEQ ID NO: 244857 - RNA, 22 nt, Homo sapiens
uggcaagaaccacaauuacuuu

SEQ ID NO: 244858 - RNA, 22 nt, Homo sapiens
uggcaagaagagcaugagacca

SEQ ID NO: 244859 - RNA, 23 nt, Homo sapiens
uggcaagaauucuuaccgugugg

SEQ ID NO: 244860 - RNA, 22 nt, Homo sapiens
uggcaagagaacaacaucucuc

SEQ ID NO: 244861 - RNA, 20 nt, Homo sapiens
uggcaagauggcagaauaga

SEQ ID NO: 244862 - RNA, 22 nt, Homo sapiens
uggcaauguggaaugguccagg

SEQ ID NO: 244863 - RNA, 20 nt, Homo sapiens
uggcaccugacagauagcca

SEQ ID NO: 244864 - RNA, 22 nt, Homo sapiens
uggcagauggugacaccauuag

SEQ ID NO: 244865 - RNA, 22 nt, Homo sapiens
uggcagcgcaguugaaaaagaa

SEQ ID NO: 244866 - RNA, 22 nt, Homo sapiens
uggcagcugcuucaugggaugc

SEQ ID NO: 244867 - RNA, 22 nt, Homo sapiens
uggcaugaaguguguuuuaucu

SEQ ID NO: 244868 - RNA, 17 nt, Homo sapiens
uggcaugaggguguggg

SEQ ID NO: 244869 - RNA, 22 nt, Homo sapiens
uggcaugggguaguagcgcugg

SEQ ID NO: 244870 - RNA, 23 nt, Homo sapiens
uggcauuuuaguuagcuucagug

SEQ ID NO: 244871 - RNA, 22 nt, Homo sapiens
uggccagugucggaggccagga

SEQ ID NO: 244872 - RNA, 18 nt, Homo sapiens
uggcuacugaacuagaug

SEQ ID NO: 244873 - RNA, 22 nt, Homo sapiens
uggcuagaugagauguacugca

SEQ ID NO: 244874 - RNA, 22 nt, Homo sapiens
uggcuguuuauuucacaugggu

SEQ ID NO: 244875 - RNA, 22 nt, Homo sapiens
uggcuugauggcacaagguuuc

SEQ ID NO: 244876 - RNA, 22 nt, Homo sapiens
uggcuuuguaagguuucauuuu

SEQ ID NO: 244877 - RNA, 22 nt, Homo sapiens
uggcuuuuauuauguugaggua

SEQ ID NO: 244878 - RNA, 22 nt, Homo sapiens
uggcuuuuccaggcauuacgau

SEQ ID NO: 244879 - RNA, 20 nt, Homo sapiens
ugggaaauguccaggacaua

SEQ ID NO: 244880 - RNA, 22 nt, Homo sapiens
ugggaagaagguuuacuugcca

SEQ ID NO: 244881 - RNA, 22 nt, Homo sapiens
ugggaagaugcugcuucuuccu

SEQ ID NO: 244882 - RNA, 22 nt, Homo sapiens
ugggaagauucuguguuuuucc

SEQ ID NO: 244883 - RNA, 22 nt, Homo sapiens
ugggagcauugcauuagaagcc

SEQ ID NO: 244884 - RNA, 22 nt, Homo sapiens
ugggauccaugugguuuaagca

SEQ ID NO: 244885 - RNA, 22 nt, Homo sapiens
uggguaaaucucuguucagggc

SEQ ID NO: 244886 - RNA, 22 nt, Homo sapiens
uggguaggaccagaaaugcacu

SEQ ID NO: 244887 - RNA, 22 nt, Homo sapiens
ugguaagaggcccugaguuugu

SEQ ID NO: 244888 - RNA, 22 nt, Homo sapiens
ugguaagaucagaacuggaguc

SEQ ID NO: 244889 - RNA, 22 nt, Homo sapiens
ugguaaguuuaacaugcauccc

SEQ ID NO: 244890 - RNA, 22 nt, Homo sapiens
ugguagugugagucuaaauugg

SEQ ID NO: 244891 - RNA, 19 nt, Homo sapiens
uauguaguuuucucaauau

SEQ ID NO: 244892 - RNA, 22 nt, Homo sapiens
uaugucuggaguuacugagcug

SEQ ID NO: 244893 - RNA, 22 nt, Homo sapiens
uaugugcacaugcccuggugac

SEQ ID NO: 244894 - RNA, 22 nt, Homo sapiens
uauguuaucaaaaagcuaagga

SEQ ID NO: 244895 - RNA, 22 nt, Homo sapiens
uauuaguuguaugauucccaag

SEQ ID NO: 244896 - RNA, 22 nt, Homo sapiens
uauuaugcacuuuauaaaaauu

SEQ ID NO: 244897 - RNA, 18 nt, Homo sapiens
uauuccucuuccucuauc

SEQ ID NO: 244898 - RNA, 22 nt, Homo sapiens
uauugcaacagaagaaagaguc

SEQ ID NO: 244899 - RNA, 20 nt, Homo sapiens
uauugccuaaauaccagaau

SEQ ID NO: 244900 - RNA, 22 nt, Homo sapiens
uauugccucagugacuuugggg

SEQ ID NO: 244901 - RNA, 22 nt, Homo sapiens
uauugcuacuuugccuuccaaa

SEQ ID NO: 244902 - RNA, 22 nt, Homo sapiens
uauugucacuaaaggaagcugg

SEQ ID NO: 244903 - RNA, 22 nt, Homo sapiens
uauuguuaaagauguuaaugau

SEQ ID NO: 244904 - RNA, 22 nt, Homo sapiens
uauuugauugacuuuagcagga

SEQ ID NO: 244905 - RNA, 22 nt, Homo sapiens
uauuugcacucccaucauggug

SEQ ID NO: 244906 - RNA, 22 nt, Homo sapiens
uauuugguuauaugaguaaguu

SEQ ID NO: 244907 - RNA, 22 nt, Homo sapiens
ucaaaguagaaaaggggcaauu

SEQ ID NO: 244908 - RNA, 22 nt, Homo sapiens
ucaaaugauucacccaccuuug

SEQ ID NO: 244909 - RNA, 22 nt, Homo sapiens
ucaaauguucccuguacuggcc

SEQ ID NO: 244910 - RNA, 22 nt, Homo sapiens
ucaaauguuuguuuaaggcuua

SEQ ID NO: 244911 - RNA, 22 nt, Homo sapiens
ucaacaggucaauugcauagaa

SEQ ID NO: 244912 - RNA, 22 nt, Homo sapiens
ucaacagugauggaaaguuaua

SEQ ID NO: 244913 - RNA, 22 nt, Homo sapiens
ucaaugaaugaugguugguaug

SEQ ID NO: 244914 - RNA, 22 nt, Homo sapiens
ucaaugcaaccuccaccucugg

SEQ ID NO: 244915 - RNA, 22 nt, Homo sapiens
ucaaugcaugugacaaagagua

SEQ ID NO: 244916 - RNA, 22 nt, Homo sapiens
ucacaauggagacucgggcgga

SEQ ID NO: 244917 - RNA, 22 nt, Homo sapiens
ucacaccauucuucuacuucag

SEQ ID NO: 244918 - RNA, 19 nt, Homo sapiens
ucacacuguggcuucuuua

SEQ ID NO: 244919 - RNA, 22 nt, Homo sapiens
ucacacuguuuugauuauuaua

SEQ ID NO: 244920 - RNA, 21 nt, Homo sapiens
ucacagccuaggaccugaaga

SEQ ID NO: 244921 - RNA, 22 nt, Homo sapiens
uguggcaaagucuugugaauau

SEQ ID NO: 244922 - RNA, 22 nt, Homo sapiens
uguggcauuuucagaaaggaug

SEQ ID NO: 244923 - RNA, 18 nt, Homo sapiens
uguggcuguuuuccaaua

SEQ ID NO: 244924 - RNA, 22 nt, Homo sapiens
uguggcuucuuugguucaguau

SEQ ID NO: 244925 - RNA, 22 nt, Homo sapiens
ugugggugguaaaauacaauga

SEQ ID NO: 244926 - RNA, 22 nt, Homo sapiens
uguguaaagcuuguuccagaaa

SEQ ID NO: 244927 - RNA, 22 nt, Homo sapiens
uguguaauacucuaaugaugca

SEQ ID NO: 244928 - RNA, 22 nt, Homo sapiens
ugugucuccugaaaauucacau

SEQ ID NO: 244929 - RNA, 22 nt, Homo sapiens
ugugucuugagagucucgagaa

SEQ ID NO: 244930 - RNA, 22 nt, Homo sapiens
uguuaagaugucaauuuuccac

SEQ ID NO: 244931 - RNA, 22 nt, Homo sapiens
uguuacagcagaauugaaagag

SEQ ID NO: 244932 - RNA, 22 nt, Homo sapiens
uguuaguuguucauguuaagag

SEQ ID NO: 244933 - RNA, 22 nt, Homo sapiens
uguuaucauuacguucuuaguu

SEQ ID NO: 244934 - RNA, 22 nt, Homo sapiens
uguugcacucuagccugggcaa

SEQ ID NO: 244935 - RNA, 22 nt, Homo sapiens
uguugcacugguaauguacuga

SEQ ID NO: 244936 - RNA, 22 nt, Homo sapiens
uguuucuacugucucuguagua

SEQ ID NO: 244937 - RNA, 22 nt, Homo sapiens
uguuuguuugagauggagucuc

SEQ ID NO: 244938 - RNA, 22 nt, Homo sapiens
uuaaaagcuaucuccaagguca

SEQ ID NO: 244939 - RNA, 22 nt, Homo sapiens
uuaaaaguauaggccuggcaua

SEQ ID NO: 244940 - RNA, 22 nt, Homo sapiens
uuaaagccauaccugagagagu

SEQ ID NO: 244941 - RNA, 22 nt, Homo sapiens
uuaaauacagcaugguguuucu

SEQ ID NO: 244942 - RNA, 22 nt, Homo sapiens
uuaagagugggaguuggccaca

SEQ ID NO: 244943 - RNA, 22 nt, Homo sapiens
uuaagcaaagguaacaugagaa

SEQ ID NO: 244944 - RNA, 22 nt, Homo sapiens
uuaagcugaauuuaagcuucgg

SEQ ID NO: 244945 - RNA, 22 nt, Homo sapiens
gcggguguuuuacccuugcaga

SEQ ID NO: 244946 - RNA, 22 nt, Homo sapiens
gcuaaaugcaugaggcgaugug

SEQ ID NO: 244947 - RNA, 23 nt, Homo sapiens
gcuaggagagaugaaacacaggu

SEQ ID NO: 244948 - RNA, 22 nt, Homo sapiens
gcuaggagauccacugcucucu

SEQ ID NO: 244949 - RNA, 22 nt, Homo sapiens
gcugagguucaagaagguuaaa

SEQ ID NO: 244950 - RNA, 22 nt, Homo sapiens
gcugauggugcaguucuagccu

SEQ ID NO: 244951 - RNA, 17 nt, Homo sapiens
gcugauguuugcauuuu

SEQ ID NO: 244952 - RNA, 22 nt, Homo sapiens
gcugauguuuucagguaauucu

SEQ ID NO: 244953 - RNA, 17 nt, Homo sapiens
gcugcauucauguagaa

SEQ ID NO: 244954 - RNA, 22 nt, Homo sapiens
gcugguguugugaaucaggccg

SEQ ID NO: 244955 - RNA, 22 nt, Homo sapiens
gcuguguguuaucagaaauugc

SEQ ID NO: 244956 - RNA, 22 nt, Homo sapiens
gcuuguguauuaaaccuugcag

SEQ ID NO: 244957 - RNA, 22 nt, Homo sapiens
gcuuuggauaaaugucaguuua

SEQ ID NO: 244958 - RNA, 22 nt, Homo sapiens
gcuuuuggaggaacuuaagauu

SEQ ID NO: 244959 - RNA, 18 nt, Homo sapiens
ggaaaacuuuucuaagua

SEQ ID NO: 244960 - RNA, 22 nt, Homo sapiens
ggaaagacuauuguaaaggaug

SEQ ID NO: 244961 - RNA, 22 nt, Homo sapiens
ggaaaguaacccauucucuuac

SEQ ID NO: 244962 - RNA, 21 nt, Homo sapiens
ggaaaguuaaggaaauacccc

SEQ ID NO: 244963 - RNA, 22 nt, Homo sapiens
ggaaauguuggugucaugaguu

SEQ ID NO: 244964 - RNA, 23 nt, Homo sapiens
ggaaauguuuaagggguugggag

SEQ ID NO: 244965 - RNA, 22 nt, Homo sapiens
ggaagacaguguggugauuccu

SEQ ID NO: 244966 - RNA, 17 nt, Homo sapiens
ggaagccuuugguuuaa

SEQ ID NO: 244967 - RNA, 23 nt, Homo sapiens
ggaaugaaaccugguuaugauau

SEQ ID NO: 244968 - RNA, 22 nt, Homo sapiens
ggacaagagacugggacacuga

SEQ ID NO: 244969 - RNA, 22 nt, Homo sapiens
ggacagaugggcucccgggucu

SEQ ID NO: 244970 - RNA, 22 nt, Homo sapiens
ggacagugaaugccacuccucc

SEQ ID NO: 244971 - RNA, 22 nt, Homo sapiens
ggacuaggagcuaggaagaucu

SEQ ID NO: 244972 - RNA, 19 nt, Homo sapiens
ggacugucauggaguaguu

SEQ ID NO: 244973 - RNA, 22 nt, Homo sapiens
ggagaguaauuagacugaaaga

SEQ ID NO: 244974 - RNA, 22 nt, Homo sapiens
ggagauaauccagggagggacu

SEQ ID NO: 244975 - RNA, 22 nt, Homo sapiens
ggagaugaaaugagcuacuuaa

SEQ ID NO: 244976 - RNA, 22 nt, Homo sapiens
ggagcugugauuugaguccaga

SEQ ID NO: 244977 - RNA, 16 nt, Homo sapiens
ggaggucaucugggaa

SEQ ID NO: 244978 - RNA, 20 nt, Homo sapiens
ggagguuguauaaguacauc

SEQ ID NO: 244979 - RNA, 23 nt, Homo sapiens
ggaguguauuggcacgaucucag

SEQ ID NO: 244980 - RNA, 22 nt, Homo sapiens
ggaguguguaggagaaagguaa

SEQ ID NO: 244981 - RNA, 22 nt, Homo sapiens
ggaucacuugagaccaggaguu

SEQ ID NO: 244982 - RNA, 22 nt, Homo sapiens
ggcaaaaucgcaauuacuuuug

SEQ ID NO: 244983 - RNA, 22 nt, Homo sapiens
ggcaacauggugaaacucuguc

SEQ ID NO: 244984 - RNA, 22 nt, Homo sapiens
ggcaagaaagaaaucaucuguc

SEQ ID NO: 244985 - RNA, 22 nt, Homo sapiens
ggcaagaucuuggcucacugaa

SEQ ID NO: 244986 - RNA, 22 nt, Homo sapiens
ggcaaggaggggcacuuucacu

SEQ ID NO: 244987 - RNA, 22 nt, Homo sapiens
ggcaaggauguuuuucuggcaa

SEQ ID NO: 244988 - RNA, 22 nt, Homo sapiens
ggcaaguauguuuuaggaugcu

SEQ ID NO: 244989 - RNA, 22 nt, Homo sapiens
ggcaaguucuaaugauuagaau

SEQ ID NO: 244990 - RNA, 22 nt, Homo sapiens
ggcaaugaggcggaccagcagg

SEQ ID NO: 244991 - RNA, 22 nt, Homo sapiens
ggcacaaugucagcucacugca

SEQ ID NO: 244992 - RNA, 22 nt, Homo sapiens
ggcacaauugcagcaauaaaca

SEQ ID NO: 244993 - RNA, 22 nt, Homo sapiens
ggcaccauuuuacuccuucccu

SEQ ID NO: 244994 - RNA, 22 nt, Homo sapiens
ggcacuguggcucaagccugua

SEQ ID NO: 244995 - RNA, 22 nt, Homo sapiens
ggcacuguugccggccugaauu

SEQ ID NO: 244996 - RNA, 17 nt, Homo sapiens
ggcaggaauuaauguca

SEQ ID NO: 244997 - RNA, 22 nt, Homo sapiens
ggcagguaaggagugggagccu

SEQ ID NO: 244998 - RNA, 22 nt, Homo sapiens
augugcuuaaaaaugcagagaa

SEQ ID NO: 244999 - RNA, 22 nt, Homo sapiens
augugcuuauagguguauguuu

SEQ ID NO: 245000 - RNA, 22 nt, Homo sapiens
augugggaggaauguguuucca

SEQ ID NO: 245001 - RNA, 22 nt, Homo sapiens
augugggaggacuuggcuguug

SEQ ID NO: 245002 - RNA, 22 nt, Homo sapiens
augugugcuugugacacagccu

SEQ ID NO: 245003 - RNA, 22 nt, Homo sapiens
auguuagcaucaauauucauca

SEQ ID NO: 245004 - RNA, 22 nt, Homo sapiens
auguuguaguaugagucaaaau

SEQ ID NO: 245005 - RNA, 22 nt, Homo sapiens
auuaaguaaugguuccaauaau

SEQ ID NO: 245006 - RNA, 22 nt, Homo sapiens
auuaagugcuugccagugcugg

SEQ ID NO: 245007 - RNA, 22 nt, Homo sapiens
auuaaucaggcaaugcuugcua

SEQ ID NO: 245008 - RNA, 22 nt, Homo sapiens
auuauaugucaucacagacacc

SEQ ID NO: 245009 - RNA, 22 nt, Homo sapiens
auuauguuguauuuccuugcag

SEQ ID NO: 245010 - RNA, 22 nt, Homo sapiens
auucaaggacuggauugcggga

SEQ ID NO: 245011 - RNA, 22 nt, Homo sapiens
auucaagucaucucuccgcauu

SEQ ID NO: 245012 - RNA, 22 nt, Homo sapiens
auucaagugaugcagcuguuuu

SEQ ID NO: 245013 - RNA, 22 nt, Homo sapiens
auucaccauggcuaccaagggu

SEQ ID NO: 245014 - RNA, 22 nt, Homo sapiens
auucauagugcuaagguguauc

SEQ ID NO: 245015 - RNA, 22 nt, Homo sapiens
auucaucagggauauuggucug

SEQ ID NO: 245016 - RNA, 20 nt, Homo sapiens
auuccacuuguuugagguac

SEQ ID NO: 245017 - RNA, 22 nt, Homo sapiens
auuccagguggcgccauucaca

SEQ ID NO: 245018 - RNA, 22 nt, Homo sapiens
auuccaguuugugagaagcugu

SEQ ID NO: 245019 - RNA, 22 nt, Homo sapiens
auuccauuuguguggaauggcu

SEQ ID NO: 245020 - RNA, 22 nt, Homo sapiens
auuccauuuguuaucacacccg

SEQ ID NO: 245021 - RNA, 22 nt, Homo sapiens
auucccuguagaauaaggaugg

SEQ ID NO: 245022 - RNA, 22 nt, Homo sapiens
auucccuuagcugccucagccu

SEQ ID NO: 245023 - RNA, 20 nt, Homo sapiens
auugaacucaguauucugaa

SEQ ID NO: 245024 - RNA, 22 nt, Homo sapiens
auugaacuuuugucacugacau

SEQ ID NO: 245025 - RNA, 22 nt, Homo sapiens
auugaaucuaaaaugagucucu

SEQ ID NO: 245026 - RNA, 22 nt, Homo sapiens
auugaaugaaauggcagacacu

SEQ ID NO: 245027 - RNA, 22 nt, Homo sapiens
auugaauuugguuugcuaagaa

SEQ ID NO: 245028 - RNA, 22 nt, Homo sapiens
auugagcaaggucuccuaguau

SEQ ID NO: 245029 - RNA, 22 nt, Homo sapiens
auugcaaagcguagacucuaaa

SEQ ID NO: 245030 - RNA, 22 nt, Homo sapiens
auugcacaaagagggaaacuga

SEQ ID NO: 245031 - RNA, 19 nt, Homo sapiens
auugcacuccaaccugggu

SEQ ID NO: 245032 - RNA, 22 nt, Homo sapiens
auugcacuccagccccggggac

SEQ ID NO: 245033 - RNA, 22 nt, Homo sapiens
auugcacuccagcccgggugac

SEQ ID NO: 245034 - RNA, 23 nt, Homo sapiens
auugcacuccagccuaccugggc

SEQ ID NO: 245035 - RNA, 22 nt, Homo sapiens
auugcacuccagccuaggcaac

SEQ ID NO: 245036 - RNA, 22 nt, Homo sapiens
auugcacuccagccuggaugac

SEQ ID NO: 245037 - RNA, 22 nt, Homo sapiens
auugcacuccagccuggcaaua

SEQ ID NO: 245038 - RNA, 22 nt, Homo sapiens
auugcacuccagccuggcagca

SEQ ID NO: 245039 - RNA, 22 nt, Homo sapiens
auugcacuccagccugggcaac

SEQ ID NO: 245040 - RNA, 22 nt, Homo sapiens
auugcacuccagccugggggac

SEQ ID NO: 245041 - RNA, 22 nt, Homo sapiens
auugcacuccagccuugugaca

SEQ ID NO: 245042 - RNA, 22 nt, Homo sapiens
auugcacuccagucucaccagg

SEQ ID NO: 245043 - RNA, 22 nt, Homo sapiens
auugcacuccagucugggcaac

SEQ ID NO: 245044 - RNA, 22 nt, Homo sapiens
auugcacuccauccuaggugac

SEQ ID NO: 245045 - RNA, 22 nt, Homo sapiens
auugcacuccauccugggcaau

SEQ ID NO: 245046 - RNA, 22 nt, Homo sapiens
auugcacucuagccuuggcgac

SEQ ID NO: 245047 - RNA, 22 nt, Homo sapiens
auugcagaaaugacagagcgcc

SEQ ID NO: 245048 - RNA, 23 nt, Homo sapiens
auugcagucuugaacuccugggc

SEQ ID NO: 245049 - RNA, 19 nt, Homo sapiens
auugcaguguaaaacuauu

SEQ ID NO: 245050 - RNA, 22 nt, Homo sapiens
auugccacaucucagaggcaga

SEQ ID NO: 245051 - RNA, 22 nt, Homo sapiens
auugcuauuauuugaccauugu

SEQ ID NO: 245052 - RNA, 22 nt, Homo sapiens
auugcugagacauugcuaaucu

SEQ ID NO: 245053 - RNA, 16 nt, Homo sapiens
auuggcaagaugccuu

SEQ ID NO: 245054 - RNA, 22 nt, Homo sapiens
auuggcuauuuggugagugauu

SEQ ID NO: 245055 - RNA, 22 nt, Homo sapiens
auuguacuccagccuaggcaac

SEQ ID NO: 245056 - RNA, 22 nt, Homo sapiens
auugucacuuaaaagugcaugu

SEQ ID NO: 245057 - RNA, 22 nt, Homo sapiens
auugucauuuauaacuguguag

SEQ ID NO: 245058 - RNA, 22 nt, Homo sapiens
auugucccucuuaaucccagca

SEQ ID NO: 245059 - RNA, 22 nt, Homo sapiens
auuguguagucuuacugcuugc

SEQ ID NO: 245060 - RNA, 22 nt, Homo sapiens
acucacagcaaccuccgccucc

SEQ ID NO: 245061 - RNA, 22 nt, Homo sapiens
acucagagaacauucccagucu

SEQ ID NO: 245062 - RNA, 22 nt, Homo sapiens
acucugucuaguuguaaaauuu

SEQ ID NO: 245063 - RNA, 22 nt, Homo sapiens
acugagucauugggugcccaga

SEQ ID NO: 245064 - RNA, 22 nt, Homo sapiens
acugcacuccaaccuuggugac

SEQ ID NO: 245065 - RNA, 22 nt, Homo sapiens
acugcacuccagccucgugaca

SEQ ID NO: 245066 - RNA, 22 nt, Homo sapiens
acugcacuccagccugcccaac

SEQ ID NO: 245067 - RNA, 22 nt, Homo sapiens
acugcacuccagccugcugggu

SEQ ID NO: 245068 - RNA, 22 nt, Homo sapiens
acugcacuccagccuggacgac

SEQ ID NO: 245069 - RNA, 22 nt, Homo sapiens
acugcacuccagccugugcgua

SEQ ID NO: 245070 - RNA, 22 nt, Homo sapiens
acugcacuccagccuguugaca

SEQ ID NO: 245071 - RNA, 22 nt, Homo sapiens
acugcacuccagccuuagugac

SEQ ID NO: 245072 - RNA, 20 nt, Homo sapiens
acugcacuccagccuuccag

SEQ ID NO: 245073 - RNA, 22 nt, Homo sapiens
acugcacuccagccuucggaca

SEQ ID NO: 245074 - RNA, 22 nt, Homo sapiens
acugcacuccagccuugagagc

SEQ ID NO: 245075 - RNA, 22 nt, Homo sapiens
acugcacuccagccuugauggc

SEQ ID NO: 245076 - RNA, 22 nt, Homo sapiens
acugcacuccagccuugcgaca

SEQ ID NO: 245077 - RNA, 22 nt, Homo sapiens
acugcacuccagccuuggagac

SEQ ID NO: 245078 - RNA, 22 nt, Homo sapiens
acugcacuccagccuuggcaac

SEQ ID NO: 245079 - RNA, 22 nt, Homo sapiens
acugcacuccagccuugugaca

SEQ ID NO: 245080 - RNA, 22 nt, Homo sapiens
acugcacuccagcuugggugac

SEQ ID NO: 245081 - RNA, 20 nt, Homo sapiens
acugcacuccaggcugccca

SEQ ID NO: 245082 - RNA, 18 nt, Homo sapiens
acugcacuccauccuagg

SEQ ID NO: 245083 - RNA, 22 nt, Homo sapiens
acugcacucccgcccgggugac

SEQ ID NO: 245084 - RNA, 22 nt, Homo sapiens
acugcacugcagccuggccaac

SEQ ID NO: 245085 - RNA, 22 nt, Homo sapiens
acugcacugucaaccuccuggg

SEQ ID NO: 245086 - RNA, 22 nt, Homo sapiens
acugcacuucagccuuggcuac

SEQ ID NO: 245087 - RNA, 22 nt, Homo sapiens
acugcacuucagccuugugaca

SEQ ID NO: 245088 - RNA, 22 nt, Homo sapiens
acugcauaaauauguguaauau

SEQ ID NO: 245089 - RNA, 20 nt, Homo sapiens
acugcauuuaguccucagga

SEQ ID NO: 245090 - RNA, 20 nt, Homo sapiens
acugggcuaccgaaguaagg

SEQ ID NO: 245091 - RNA, 22 nt, Homo sapiens
acuggguuaauuugaagguuga

SEQ ID NO: 245092 - RNA, 22 nt, Homo sapiens
acuuggcaaaguuuuaaacagc

SEQ ID NO: 245093 - RNA, 17 nt, Homo sapiens
acuuuuugaggaggcau

SEQ ID NO: 245094 - RNA, 22 nt, Homo sapiens
acuuuuugauggggagaacauu

SEQ ID NO: 245095 - RNA, 22 nt, Homo sapiens
agaaacacagguggaauugcuu

SEQ ID NO: 245096 - RNA, 22 nt, Homo sapiens
aggaagguaaacuaacuugccu

SEQ ID NO: 245097 - RNA, 22 nt, Homo sapiens
aggaaucuaagguaucagguua

SEQ ID NO: 245098 - RNA, 22 nt, Homo sapiens
aggaaugucaaugguaguuuaa

SEQ ID NO: 245099 - RNA, 22 nt, Homo sapiens
aggaauguuaguacuucuuagu

SEQ ID NO: 245100 - RNA, 22 nt, Homo sapiens
aggaauuuaauguaugauaaua

SEQ ID NO: 245101 - RNA, 22 nt, Homo sapiens
aggaccaugguauugcuuuggg

SEQ ID NO: 245102 - RNA, 22 nt, Homo sapiens
aggagaauugguucuucuugau

SEQ ID NO: 245103 - RNA, 22 nt, Homo sapiens
aggagaucagccucccugcaac

SEQ ID NO: 245104 - RNA, 22 nt, Homo sapiens
aggagaugaagcuuuaucuaaa

SEQ ID NO: 245105 - RNA, 22 nt, Homo sapiens
aggcaacgcuucuuucucaggu

SEQ ID NO: 245106 - RNA, 22 nt, Homo sapiens
aggcagaugagguccucagcug

SEQ ID NO: 245107 - RNA, 22 nt, Homo sapiens
aggcagucugaguuuugaaagg

SEQ ID NO: 245108 - RNA, 22 nt, Homo sapiens
aggcaugugugcagacugucug

SEQ ID NO: 245109 - RNA, 23 nt, Homo sapiens
aggcauuguacaguaauggaaaa

SEQ ID NO: 245110 - RNA, 19 nt, Homo sapiens
aggcauugugcucaucugu

SEQ ID NO: 245111 - RNA, 22 nt, Homo sapiens
aggcuuuuggagaacacugcac

SEQ ID NO: 245112 - RNA, 22 nt, Homo sapiens
agggaauguaaguuuuaugaga

SEQ ID NO: 245113 - RNA, 22 nt, Homo sapiens
agggagcaaaguggucuuucuc

SEQ ID NO: 245114 - RNA, 22 nt, Homo sapiens
agggcuuguuuaacuaucauua

SEQ ID NO: 245115 - RNA, 22 nt, Homo sapiens
agguaaguauguuauuacuuuu

SEQ ID NO: 245116 - RNA, 22 nt, Homo sapiens
agguacuugagauucugaacug

SEQ ID NO: 245117 - RNA, 22 nt, Homo sapiens
agguagaguguuuuguucuucu

SEQ ID NO: 245118 - RNA, 22 nt, Homo sapiens
agguagcauagcgggaauauca

SEQ ID NO: 245119 - RNA, 20 nt, Homo sapiens
agguaguuauacaaaugugu

SEQ ID NO: 245120 - RNA, 22 nt, Homo sapiens
agguauguaugucuguacagcg

SEQ ID NO: 245121 - RNA, 22 nt, Homo sapiens
aggucaccucaggaaauacuga

SEQ ID NO: 245122 - RNA, 22 nt, Homo sapiens
agguccauuauuuucauucaug

SEQ ID NO: 245123 - RNA, 22 nt, Homo sapiens
aggugacugguuuaucuggcag

SEQ ID NO: 245124 - RNA, 22 nt, Homo sapiens
aggugcugacaggauagguuuc

SEQ ID NO: 245125 - RNA, 22 nt, Homo sapiens
aggugguuuuaggcagagacau

SEQ ID NO: 245126 - RNA, 21 nt, Homo sapiens
aggugucuuggguucccuggc

SEQ ID NO: 245127 - RNA, 21 nt, Homo sapiens
agguuguguuuccucuuacuu

SEQ ID NO: 245128 - RNA, 22 nt, Homo sapiens
agguuguugcaugcuccuuagg

SEQ ID NO: 245129 - RNA, 22 nt, Homo sapiens
aguaagauggcaacucuccaca

SEQ ID NO: 245130 - RNA, 22 nt, Homo sapiens
aguacacuguugaacagaagug

SEQ ID NO: 245131 - RNA, 22 nt, Homo sapiens
aguaccauuagauuaggaugac

SEQ ID NO: 245132 - RNA, 22 nt, Homo sapiens
aguacugucugguuaccugaca

SEQ ID NO: 245133 - RNA, 16 nt, Homo sapiens
aguaguuuuacagauu

SEQ ID NO: 245134 - RNA, 22 nt, Homo sapiens
aguaucacaagguguacaccca

SEQ ID NO: 245135 - RNA, 22 nt, Homo sapiens
aucugguguuuuucucccucgu

SEQ ID NO: 245136 - RNA, 22 nt, Homo sapiens
aucuuguguugaauggugcaga

SEQ ID NO: 245137 - RNA, 22 nt, Homo sapiens
aucuuuaguggcuguuuucaga

SEQ ID NO: 245138 - RNA, 22 nt, Homo sapiens
aucuuugcugagaugcauggca

SEQ ID NO: 245139 - RNA, 22 nt, Homo sapiens
augaaaacaugauuugccuguu

SEQ ID NO: 245140 - RNA, 22 nt, Homo sapiens
augaaaguguguggaaacuuga

SEQ ID NO: 245141 - RNA, 22 nt, Homo sapiens
augaaauguaugagucuggguu

SEQ ID NO: 245142 - RNA, 22 nt, Homo sapiens
augaacucaucaucuagguuuu

SEQ ID NO: 245143 - RNA, 22 nt, Homo sapiens
augaacucaucauuuuuauggc

SEQ ID NO: 245144 - RNA, 22 nt, Homo sapiens
augaacucaucauuuuuuaugg

SEQ ID NO: 245145 - RNA, 22 nt, Homo sapiens
augaagucguuacuaccaauug

SEQ ID NO: 245146 - RNA, 22 nt, Homo sapiens
augaagugcaugauaguugguu

SEQ ID NO: 245147 - RNA, 22 nt, Homo sapiens
augaauagaguuaauugaguac

SEQ ID NO: 245148 - RNA, 22 nt, Homo sapiens
augaauccauuccugccacaga

SEQ ID NO: 245149 - RNA, 23 nt, Homo sapiens
augaauguaaggaguguaagaaa

SEQ ID NO: 245150 - RNA, 20 nt, Homo sapiens
augaccuauggugguauaag

SEQ ID NO: 245151 - RNA, 22 nt, Homo sapiens
augacuauugcacuuuccuggu

SEQ ID NO: 245152 - RNA, 22 nt, Homo sapiens
augacugagacuaacuuacuuu

SEQ ID NO: 245153 - RNA, 22 nt, Homo sapiens
augagaccagcagaaaaccugu

SEQ ID NO: 245154 - RNA, 18 nt, Homo sapiens
augagagccgauuccugg

SEQ ID NO: 245155 - RNA, 22 nt, Homo sapiens
augagagcuaacuguggguaca

SEQ ID NO: 245156 - RNA, 22 nt, Homo sapiens
augagauauguuaaaaguuaaa

SEQ ID NO: 245157 - RNA, 22 nt, Homo sapiens
augagauucuuagagaagucug

SEQ ID NO: 245158 - RNA, 22 nt, Homo sapiens
augagcaaagagaugagacccu

SEQ ID NO: 245159 - RNA, 22 nt, Homo sapiens
augagcagaugcuccugccucu

SEQ ID NO: 245160 - RNA, 22 nt, Homo sapiens
augagcaucaccagaaucaaua

SEQ ID NO: 245161 - RNA, 20 nt, Homo sapiens
augagcucaucuugaaaacc

SEQ ID NO: 245162 - RNA, 22 nt, Homo sapiens
augaggaaggagccuuugucug

SEQ ID NO: 245163 - RNA, 22 nt, Homo sapiens
augaggaagucaggcccagggg

SEQ ID NO: 245164 - RNA, 22 nt, Homo sapiens
augagguaguagaaagucaggu

SEQ ID NO: 245165 - RNA, 22 nt, Homo sapiens
augagguccuagccaacuuuuu

SEQ ID NO: 245166 - RNA, 22 nt, Homo sapiens
augaggugauuucuguucgggu

SEQ ID NO: 245167 - RNA, 22 nt, Homo sapiens
augaggugggagaaucacuuga

SEQ ID NO: 245168 - RNA, 22 nt, Homo sapiens
augaggugggcggcuuggaaga

SEQ ID NO: 245169 - RNA, 20 nt, Homo sapiens
augagguguaugacacugaa

SEQ ID NO: 245170 - RNA, 22 nt, Homo sapiens
augauaaguuauuagaagaaga

SEQ ID NO: 245171 - RNA, 22 nt, Homo sapiens
augauaugagaaaggaucaaca

SEQ ID NO: 245172 - RNA, 22 nt, Homo sapiens
augauauggguugucaguugua

SEQ ID NO: 245173 - RNA, 22 nt, Homo sapiens
augaugcaguacuuugggaaca

SEQ ID NO: 245174 - RNA, 22 nt, Homo sapiens
augauguaggccauggguuucu

SEQ ID NO: 245175 - RNA, 22 nt, Homo sapiens
augauguguguuuaagaugucu

SEQ ID NO: 245176 - RNA, 22 nt, Homo sapiens
augauugugaauaugugguuuu

SEQ ID NO: 245177 - RNA, 22 nt, Homo sapiens
augcaaggaugguuagauauau

SEQ ID NO: 245178 - RNA, 22 nt, Homo sapiens
augcaauggaaaggacaauuac

SEQ ID NO: 245179 - RNA, 22 nt, Homo sapiens
augcacaucagcuccagggacc

SEQ ID NO: 245180 - RNA, 22 nt, Homo sapiens
augcagacacaaguuauaguaa

SEQ ID NO: 245181 - RNA, 22 nt, Homo sapiens
augcagaucacauuuuucuguc

SEQ ID NO: 245182 - RNA, 22 nt, Homo sapiens
augcagugugcaacagauuaag

SEQ ID NO: 245183 - RNA, 22 nt, Homo sapiens
augcauagugggaugcucugug

SEQ ID NO: 245184 - RNA, 22 nt, Homo sapiens
augcauauuccugggccucacu

SEQ ID NO: 245185 - RNA, 22 nt, Homo sapiens
augccaagaugagcacgcgucu

SEQ ID NO: 245186 - RNA, 22 nt, Homo sapiens
augccacuucucuaagucaugu

SEQ ID NO: 245187 - RNA, 22 nt, Homo sapiens
augccauugcacuccagccugg

SEQ ID NO: 245188 - RNA, 22 nt, Homo sapiens
augcccauuuguuuucugaaag

SEQ ID NO: 245189 - RNA, 22 nt, Homo sapiens
augcuggugguucacaugcgca

SEQ ID NO: 245190 - RNA, 22 nt, Homo sapiens
augcuguuuugaauucucuaga

SEQ ID NO: 245191 - RNA, 22 nt, Homo sapiens
auggaacauuauagauguaaaa

SEQ ID NO: 245192 - RNA, 22 nt, Homo sapiens
auggaaggagaggaaugaauga

SEQ ID NO: 245193 - RNA, 22 nt, Homo sapiens
auggacagaaaaaaauagaugu

SEQ ID NO: 245194 - RNA, 22 nt, Homo sapiens
auggacagacacuggccuucug

SEQ ID NO: 245195 - RNA, 21 nt, Homo sapiens
auggacugugugacccugcac

SEQ ID NO: 245196 - RNA, 22 nt, Homo sapiens
auggaggacaaugucaccuuca

SEQ ID NO: 245197 - RNA, 22 nt, Homo sapiens
auggaggccuacagaauuuugg

SEQ ID NO: 245198 - RNA, 22 nt, Homo sapiens
aggcaugauggcuccagaucau

SEQ ID NO: 245199 - RNA, 22 nt, Homo sapiens
aggcuagacuuugagaauuuuu

SEQ ID NO: 245200 - RNA, 21 nt, Homo sapiens
aggcuguuguuuugggaugga

SEQ ID NO: 245201 - RNA, 22 nt, Homo sapiens
agggcacuguagguccugccuc

SEQ ID NO: 245202 - RNA, 22 nt, Homo sapiens
agggcaguguuaggacugucug

SEQ ID NO: 245203 - RNA, 22 nt, Homo sapiens
agguaagucucuaauuaugaau

SEQ ID NO: 245204 - RNA, 22 nt, Homo sapiens
agguaguguuauuugcagcuga

SEQ ID NO: 245205 - RNA, 22 nt, Homo sapiens
agguauuuucaacuuagaaugg

SEQ ID NO: 245206 - RNA, 22 nt, Homo sapiens
aggugaauggauaaacuguggg

SEQ ID NO: 245207 - RNA, 22 nt, Homo sapiens
aggugcucuuccuguaggucac

SEQ ID NO: 245208 - RNA, 23 nt, Homo sapiens
agguuaugauuauagagcgagga

SEQ ID NO: 245209 - RNA, 22 nt, Homo sapiens
agguucccuuuuggccugggau

SEQ ID NO: 245210 - RNA, 22 nt, Homo sapiens
aguaaauuucugugcuuucaua

SEQ ID NO: 245211 - RNA, 22 nt, Homo sapiens
aguaacaggauccaaagaaugu

SEQ ID NO: 245212 - RNA, 22 nt, Homo sapiens
aguacacuguuaaaaagaagug

SEQ ID NO: 245213 - RNA, 23 nt, Homo sapiens
aguacuguaguaauugaggggaa

SEQ ID NO: 245214 - RNA, 22 nt, Homo sapiens
aguagcaauggcucugagcuau

SEQ ID NO: 245215 - RNA, 22 nt, Homo sapiens
aguauguagugcaaucagucag

SEQ ID NO: 245216 - RNA, 22 nt, Homo sapiens
aguauuaggugaguguauuuca

SEQ ID NO: 245217 - RNA, 22 nt, Homo sapiens
agucaagugggguuagauaguu

SEQ ID NO: 245218 - RNA, 22 nt, Homo sapiens
agucacagguucuugggauuag

SEQ ID NO: 245219 - RNA, 22 nt, Homo sapiens
agucagucuguccugugcugag

SEQ ID NO: 245220 - RNA, 22 nt, Homo sapiens
agucauggcagaaggcaccucu

SEQ ID NO: 245221 - RNA, 22 nt, Homo sapiens
agucaugggagagaugugaucg

SEQ ID NO: 245222 - RNA, 22 nt, Homo sapiens
aguccauuugaugaugauucca

SEQ ID NO: 245223 - RNA, 22 nt, Homo sapiens
agucugguguucucacacuagu

SEQ ID NO: 245224 - RNA, 22 nt, Homo sapiens
agugaaaucugaagaaggucau

SEQ ID NO: 245225 - RNA, 22 nt, Homo sapiens
agugaacacagcuucuuugguu

SEQ ID NO: 245226 - RNA, 22 nt, Homo sapiens
agugaauguuggaaaguuauuu

SEQ ID NO: 245227 - RNA, 19 nt, Homo sapiens
agugagccaagauccuacc

SEQ ID NO: 245228 - RNA, 22 nt, Homo sapiens
agugauguggaguuuggaugga

SEQ ID NO: 245229 - RNA, 22 nt, Homo sapiens
agugcaguggcauggucauaac

SEQ ID NO: 245230 - RNA, 22 nt, Homo sapiens
agugcagugguuaggagccagg

SEQ ID NO: 245231 - RNA, 22 nt, Homo sapiens
agugcauugcaucucugcuuca

SEQ ID NO: 245232 - RNA, 22 nt, Homo sapiens
agugccauggcugcuagauggc

SEQ ID NO: 245233 - RNA, 23 nt, Homo sapiens
agugccuaguauauaggaggcgc

SEQ ID NO: 245234 - RNA, 22 nt, Homo sapiens
aguggcacaauuuugacucccc

SEQ ID NO: 245235 - RNA, 22 nt, Homo sapiens
aguggcacuauucucagaguca

SEQ ID NO: 245236 - RNA, 22 nt, Homo sapiens
agugguuuuaaguagagcauac

SEQ ID NO: 245237 - RNA, 22 nt, Homo sapiens
agugucaggagacagguagcug

SEQ ID NO: 245238 - RNA, 22 nt, Homo sapiens
aguguuuuuaucaugaaagggu

SEQ ID NO: 245239 - RNA, 22 nt, Homo sapiens
aguucaaaucgagccuggccau

SEQ ID NO: 245240 - RNA, 21 nt, Homo sapiens
aguucacauggcuccuguguu

SEQ ID NO: 245241 - RNA, 22 nt, Homo sapiens
aguuccuacuggcuguaaagaa

SEQ ID NO: 245242 - RNA, 22 nt, Homo sapiens
aguuuugguugaguuacuagca

SEQ ID NO: 245243 - RNA, 22 nt, Homo sapiens
auaaaccuacauuuucacuucu

SEQ ID NO: 245244 - RNA, 22 nt, Homo sapiens
auaaacugucaguggagaguaa

SEQ ID NO: 245245 - RNA, 19 nt, Homo sapiens
auaaaugccuacaagggug

SEQ ID NO: 245246 - RNA, 22 nt, Homo sapiens
auaaaugccuguuguuuuaagc

SEQ ID NO: 245247 - RNA, 22 nt, Homo sapiens
auaaaugcuuagaucuguauau

SEQ ID NO: 245248 - RNA, 22 nt, Homo sapiens
auaaauucauuuaagcuccuua

SEQ ID NO: 245249 - RNA, 22 nt, Homo sapiens
auaaccuauggaucuacucggg

SEQ ID NO: 245250 - RNA, 22 nt, Homo sapiens
auaacucuguuuuuuucaugca

SEQ ID NO: 245251 - RNA, 22 nt, Homo sapiens
auaaggcuaguguaggagccag

SEQ ID NO: 245252 - RNA, 22 nt, Homo sapiens
auaaguaguaaagcagugacua

SEQ ID NO: 245253 - RNA, 22 nt, Homo sapiens
auaagucaauggaacagauuaa

SEQ ID NO: 245254 - RNA, 22 nt, Homo sapiens
auaauagguugauugacauugc

SEQ ID NO: 245255 - RNA, 22 nt, Homo sapiens
auaauaguguuuagauuuggga

SEQ ID NO: 245256 - RNA, 22 nt, Homo sapiens
auacaagcaguccaacuccaua

SEQ ID NO: 245257 - RNA, 19 nt, Homo sapiens
auacacguguauacauaca

SEQ ID NO: 245258 - RNA, 22 nt, Homo sapiens
auacagcuaaaauauuaaguua

SEQ ID NO: 245259 - RNA, 22 nt, Homo sapiens
auacaguaaugucuuaggcugu

SEQ ID NO: 245260 - RNA, 22 nt, Homo sapiens
auacaguaucuucuggcaagca

SEQ ID NO: 245261 - RNA, 22 nt, Homo sapiens
auacaguauggagggcccagcu

SEQ ID NO: 245262 - RNA, 22 nt, Homo sapiens
auacaucugccauguuggugug

SEQ ID NO: 245263 - RNA, 22 nt, Homo sapiens
auacaugugcaggucagguuac

SEQ ID NO: 245264 - RNA, 15 nt, Homo sapiens
auagaaugaaaggga

SEQ ID NO: 245265 - RNA, 22 nt, Homo sapiens
auagacacugaaaucccugcca

SEQ ID NO: 245266 - RNA, 23 nt, Homo sapiens
auagagcuaggaugcagacagau

SEQ ID NO: 245267 - RNA, 22 nt, Homo sapiens
auagaguuagaaagaaauguuu

SEQ ID NO: 245268 - RNA, 22 nt, Homo sapiens
auagcacauggcauccucucuu

SEQ ID NO: 245269 - RNA, 22 nt, Homo sapiens
auagcagaacagugucucacug

SEQ ID NO: 245270 - RNA, 20 nt, Homo sapiens
auagcagcaugauuuauagu

SEQ ID NO: 245271 - RNA, 22 nt, Homo sapiens
auagcagugccccaaacuccug

SEQ ID NO: 245272 - RNA, 22 nt, Homo sapiens
auagcagugugaaaacagacug

SEQ ID NO: 245273 - RNA, 22 nt, Homo sapiens
auagcagugugaaaauggacua

SEQ ID NO: 245274 - RNA, 22 nt, Homo sapiens
auagcccauuuguugguccugg

SEQ ID NO: 245275 - RNA, 22 nt, Homo sapiens
auaggagcacgaacucuagugu

SEQ ID NO: 245276 - RNA, 22 nt, Homo sapiens
auaguacuauugcaguguuaua

SEQ ID NO: 245277 - RNA, 22 nt, Homo sapiens
auaguagagagggcaaaaugcu

SEQ ID NO: 245278 - RNA, 22 nt, Homo sapiens
auagugcugcaaaaaacauacg

SEQ ID NO: 245279 - RNA, 22 nt, Homo sapiens
auagugcugcaacaaauauacg

SEQ ID NO: 245280 - RNA, 22 nt, Homo sapiens
auagugcugcaauaaacauacg

SEQ ID NO: 245281 - RNA, 22 nt, Homo sapiens
auagugcugcaauaaacauaug

SEQ ID NO: 245282 - RNA, 22 nt, Homo sapiens
auagugcugcaaugaacauaca

SEQ ID NO: 245283 - RNA, 22 nt, Homo sapiens
auagugcugcauuaaacauacg

SEQ ID NO: 245284 - RNA, 19 nt, Homo sapiens
auaguguaggaaaacagcu

SEQ ID NO: 245285 - RNA, 22 nt, Homo sapiens
auauagcaaugaaagagaugaa

SEQ ID NO: 245286 - RNA, 22 nt, Homo sapiens
auauaguguuuuuugguacgcu

SEQ ID NO: 245287 - RNA, 22 nt, Homo sapiens
auaucagugucuuacuguuuuu

SEQ ID NO: 245288 - RNA, 22 nt, Homo sapiens
auaugcaaauccauagagacag

SEQ ID NO: 245289 - RNA, 22 nt, Homo sapiens
uagcuccacagcuauauauaau

SEQ ID NO: 245290 - RNA, 22 nt, Homo sapiens
uagcugcugcuaggcuaaggau

SEQ ID NO: 245291 - RNA, 22 nt, Homo sapiens
uagcuggaguuuuuguuauagg

SEQ ID NO: 245292 - RNA, 22 nt, Homo sapiens
uaggacaaugguacagcagaaa

SEQ ID NO: 245293 - RNA, 22 nt, Homo sapiens
uaggcacacaucuacuacaaau

SEQ ID NO: 245294 - RNA, 22 nt, Homo sapiens
uaggcuuuucugggaugugggc

SEQ ID NO: 245295 - RNA, 22 nt, Homo sapiens
uaggcuuuuggacccugucucu

SEQ ID NO: 245296 - RNA, 22 nt, Homo sapiens
uagggagugucuucauuuugua

SEQ ID NO: 245297 - RNA, 22 nt, Homo sapiens
uagggcaugugggaaguuauaa

SEQ ID NO: 245298 - RNA, 22 nt, Homo sapiens
uagggcauugaacugaauucuu

SEQ ID NO: 245299 - RNA, 22 nt, Homo sapiens
uagggcauuuagaggcuauuaa

SEQ ID NO: 245300 - RNA, 22 nt, Homo sapiens
uaggucaguuuuggcuuggcuu

SEQ ID NO: 245301 - RNA, 22 nt, Homo sapiens
uaggugaauguaguaagguguu

SEQ ID NO: 245302 - RNA, 22 nt, Homo sapiens
uagguugucuguucacucugau

SEQ ID NO: 245303 - RNA, 22 nt, Homo sapiens
uaguaaacaccucagguaauuc

SEQ ID NO: 245304 - RNA, 22 nt, Homo sapiens
uaguagagauggggcacaugcc

SEQ ID NO: 245305 - RNA, 22 nt, Homo sapiens
uaguagcauaccuaaguauacu

SEQ ID NO: 245306 - RNA, 22 nt, Homo sapiens
uagugaauguuggcuauuaaua

SEQ ID NO: 245307 - RNA, 21 nt, Homo sapiens
uagugcugaggcaguauggga

SEQ ID NO: 245308 - RNA, 22 nt, Homo sapiens
uagugcugugauauuuuuggcc

SEQ ID NO: 245309 - RNA, 22 nt, Homo sapiens
uagugcugugauuaacauaaug

SEQ ID NO: 245310 - RNA, 20 nt, Homo sapiens
uaguuggugauacagugcau

SEQ ID NO: 245311 - RNA, 22 nt, Homo sapiens
uauaacacccacauauagucuu

SEQ ID NO: 245312 - RNA, 22 nt, Homo sapiens
uauaagguuaggaaaaauuucu

SEQ ID NO: 245313 - RNA, 22 nt, Homo sapiens
uauaaugcacauucccaaaucu

SEQ ID NO: 245314 - RNA, 20 nt, Homo sapiens
uauagcaauuuuuuucuccu

SEQ ID NO: 245315 - RNA, 22 nt, Homo sapiens
uauagcagugaguauugacuaa

SEQ ID NO: 245316 - RNA, 22 nt, Homo sapiens
uauagcuagugauuguguguau

SEQ ID NO: 245317 - RNA, 22 nt, Homo sapiens
uauagcuugaaggaauggucau

SEQ ID NO: 245318 - RNA, 22 nt, Homo sapiens
uauagcuugauuauggugaugg

SEQ ID NO: 245319 - RNA, 21 nt, Homo sapiens
uauaguaguaugauuuacaau

SEQ ID NO: 245320 - RNA, 22 nt, Homo sapiens
uauaguguuuucaaaaguaugu

SEQ ID NO: 245321 - RNA, 22 nt, Homo sapiens
uauaguuuuuccugggaggaaa

SEQ ID NO: 245322 - RNA, 22 nt, Homo sapiens
uauaucacaugcacucauuuuc

SEQ ID NO: 245323 - RNA, 22 nt, Homo sapiens
uauaugcacucagguguaugug

SEQ ID NO: 245324 - RNA, 22 nt, Homo sapiens
uauauguucugugucccuuucg

SEQ ID NO: 245325 - RNA, 22 nt, Homo sapiens
uauauguucuugcacuggaaag

SEQ ID NO: 245326 - RNA, 22 nt, Homo sapiens
uauauguuuucauaaggcuaga

SEQ ID NO: 245327 - RNA, 22 nt, Homo sapiens
uaucaacaggguggccagugua

SEQ ID NO: 245328 - RNA, 22 nt, Homo sapiens
uaucacacgccuugcuucauuu

SEQ ID NO: 245329 - RNA, 22 nt, Homo sapiens
uaucacagaggguauccuagag

SEQ ID NO: 245330 - RNA, 22 nt, Homo sapiens
uaucacagugcuggaguauucc

SEQ ID NO: 245331 - RNA, 22 nt, Homo sapiens
uaucagagcugucagccuaccu

SEQ ID NO: 245332 - RNA, 22 nt, Homo sapiens
uaucaucauuggcaggugagaa

SEQ ID NO: 245333 - RNA, 22 nt, Homo sapiens
uaucaugggggguguacacucc

SEQ ID NO: 245334 - RNA, 18 nt, Homo sapiens
uaucauguagggaaguug

SEQ ID NO: 245335 - RNA, 22 nt, Homo sapiens
uauccuagugggguuucaguca

SEQ ID NO: 245336 - RNA, 22 nt, Homo sapiens
uaucucagaguguacaagauua

SEQ ID NO: 245337 - RNA, 20 nt, Homo sapiens
uaucucaguuuguccuaaac

SEQ ID NO: 245338 - RNA, 22 nt, Homo sapiens
uaucugcacuucugucuagguc

SEQ ID NO: 245339 - RNA, 22 nt, Homo sapiens
uaucugguuauugcugcugauu

SEQ ID NO: 245340 - RNA, 22 nt, Homo sapiens
uaugaaagcuacuucucacaau

SEQ ID NO: 245341 - RNA, 22 nt, Homo sapiens
uaugaaucuggcuacuccaggg

SEQ ID NO: 245342 - RNA, 20 nt, Homo sapiens
uaugacaaagccuagugagu

SEQ ID NO: 245343 - RNA, 22 nt, Homo sapiens
uaugagcacauauguaucuaug

SEQ ID NO: 245344 - RNA, 21 nt, Homo sapiens
uaugagucugcaagaaccaca

SEQ ID NO: 245345 - RNA, 22 nt, Homo sapiens
guaauaacuguggaaaaagguu

SEQ ID NO: 245346 - RNA, 22 nt, Homo sapiens
guaaucucagcuacucgggagg

SEQ ID NO: 245347 - RNA, 22 nt, Homo sapiens
guacaguggguguagggaccag

SEQ ID NO: 245348 - RNA, 22 nt, Homo sapiens
guacaguuuagugcuuugagaa

SEQ ID NO: 245349 - RNA, 22 nt, Homo sapiens
guacauagucacacauauacau

SEQ ID NO: 245350 - RNA, 22 nt, Homo sapiens
guacccuggaacaacccaauuu

SEQ ID NO: 245351 - RNA, 22 nt, Homo sapiens
guagaagcacagggccuguauu

SEQ ID NO: 245352 - RNA, 22 nt, Homo sapiens
guagaggaauggcuccaccaua

SEQ ID NO: 245353 - RNA, 22 nt, Homo sapiens
guagcaccagugcucuucucaa

SEQ ID NO: 245354 - RNA, 22 nt, Homo sapiens
guagcagcaauuuacuccauac

SEQ ID NO: 245355 - RNA, 22 nt, Homo sapiens
guaguagcacgagcucugucuc

SEQ ID NO: 245356 - RNA, 22 nt, Homo sapiens
guaugcaagugauaugacauau

SEQ ID NO: 245357 - RNA, 22 nt, Homo sapiens
guauggcacuauccucucugau

SEQ ID NO: 245358 - RNA, 22 nt, Homo sapiens
guaugugacuggaacaguagga

SEQ ID NO: 245359 - RNA, 22 nt, Homo sapiens
guauuuggugaugccuccaaac

SEQ ID NO: 245360 - RNA, 22 nt, Homo sapiens
gucaaggaauuuauccauuucu

SEQ ID NO: 245361 - RNA, 22 nt, Homo sapiens
gucacggaauguaaguggaagu

SEQ ID NO: 245362 - RNA, 22 nt, Homo sapiens
gucacugacaagagagaagaac

SEQ ID NO: 245363 - RNA, 22 nt, Homo sapiens
gucacuggcugucuuguaugau

SEQ ID NO: 245364 - RNA, 21 nt, Homo sapiens
gucacuggggcuggauaauuc

SEQ ID NO: 245365 - RNA, 22 nt, Homo sapiens
gucagaaucucagaugacaacg

SEQ ID NO: 245366 - RNA, 22 nt, Homo sapiens
gucagagcacugaguugugggc

SEQ ID NO: 245367 - RNA, 22 nt, Homo sapiens
gucagcuuuuccuuacuuuagg

SEQ ID NO: 245368 - RNA, 22 nt, Homo sapiens
gucaggaccucgguggcauucu

SEQ ID NO: 245369 - RNA, 22 nt, Homo sapiens
gucagguaccugaaagcagcca

SEQ ID NO: 245370 - RNA, 22 nt, Homo sapiens
gucaguuugguuaaucauucca

SEQ ID NO: 245371 - RNA, 22 nt, Homo sapiens
gucauucauucagcaagcacug

SEQ ID NO: 245372 - RNA, 22 nt, Homo sapiens
gucauugcacuccagccuggac

SEQ ID NO: 245373 - RNA, 22 nt, Homo sapiens
guccaagacuaggaguuggcag

SEQ ID NO: 245374 - RNA, 22 nt, Homo sapiens
guccaguuguuuucugagguug

SEQ ID NO: 245375 - RNA, 22 nt, Homo sapiens
guccaugagaugaauccacaca

SEQ ID NO: 245376 - RNA, 22 nt, Homo sapiens
aagugcaaauucccaggcucug

SEQ ID NO: 245377 - RNA, 22 nt, Homo sapiens
aagugccauguggaugggcccu

SEQ ID NO: 245378 - RNA, 22 nt, Homo sapiens
aagugcuggccuacucaaucga

SEQ ID NO: 245379 - RNA, 22 nt, Homo sapiens
aagugcuucagaagacaauauu

SEQ ID NO: 245380 - RNA, 22 nt, Homo sapiens
aagugcuuuguacagggguuga

SEQ ID NO: 245381 - RNA, 22 nt, Homo sapiens
aagugcuuuuuagauaugguuu

SEQ ID NO: 245382 - RNA, 22 nt, Homo sapiens
aaguggaauguuuguggcacaa

SEQ ID NO: 245383 - RNA, 22 nt, Homo sapiens
aagugguuuuaaucuggugagu

SEQ ID NO: 245384 - RNA, 22 nt, Homo sapiens
aagugucuuaccgggagggagu

SEQ ID NO: 245385 - RNA, 22 nt, Homo sapiens
aaguugcuuuagguaagucaau

SEQ ID NO: 245386 - RNA, 22 nt, Homo sapiens
aauaagaaguggaagggaccgg

SEQ ID NO: 245387 - RNA, 22 nt, Homo sapiens
aauaaguugagaugaggucaua

SEQ ID NO: 245388 - RNA, 22 nt, Homo sapiens
aauaauggcaccaaagcacaag

SEQ ID NO: 245389 - RNA, 22 nt, Homo sapiens
aauaaugucacaggggguuagc

SEQ ID NO: 245390 - RNA, 22 nt, Homo sapiens
aauaucacaggguguacacuca

SEQ ID NO: 245391 - RNA, 22 nt, Homo sapiens
aauaugguuuuaugaagcaauu

SEQ ID NO: 245392 - RNA, 22 nt, Homo sapiens
aauauguccuugaaauggugcu

SEQ ID NO: 245393 - RNA, 22 nt, Homo sapiens
aauauugucaaaauggauucca

SEQ ID NO: 245394 - RNA, 22 nt, Homo sapiens
aaucacaggucuuggcugcaug

SEQ ID NO: 245395 - RNA, 22 nt, Homo sapiens
aaucaccaugcacuacagccuu

SEQ ID NO: 245396 - RNA, 22 nt, Homo sapiens
aauccugucuugccauccaaua

SEQ ID NO: 245397 - RNA, 22 nt, Homo sapiens
aaugaaguuagauguugagaag

SEQ ID NO: 245398 - RNA, 22 nt, Homo sapiens
aaugacagugcuaaagaacccu

SEQ ID NO: 245399 - RNA, 22 nt, Homo sapiens
aaugacuaagaugguacauuuu

SEQ ID NO: 245400 - RNA, 17 nt, Homo sapiens
aaugagacauuucugcu

SEQ ID NO: 245401 - RNA, 22 nt, Homo sapiens
aaugcaagauguuaauuauagg

SEQ ID NO: 245402 - RNA, 22 nt, Homo sapiens
aaugcacauaaaauccuccagg

SEQ ID NO: 245403 - RNA, 22 nt, Homo sapiens
aaugcaucuagaaaggugaauu

SEQ ID NO: 245404 - RNA, 22 nt, Homo sapiens
aauggagcugaguggccuuggg

SEQ ID NO: 245405 - RNA, 22 nt, Homo sapiens
aauggcaguagauggaugggua

SEQ ID NO: 245406 - RNA, 22 nt, Homo sapiens
aauggcucuguuggcccaagac

SEQ ID NO: 245407 - RNA, 22 nt, Homo sapiens
aauggcuuuuaauauccauaau

SEQ ID NO: 245408 - RNA, 22 nt, Homo sapiens
aaugucaucuucaguuguacag

SEQ ID NO: 245409 - RNA, 22 nt, Homo sapiens
aauugcucuccuccaaggucuu

SEQ ID NO: 245410 - RNA, 22 nt, Homo sapiens
aauuggugaccaagggaaggac

SEQ ID NO: 245411 - RNA, 22 nt, Homo sapiens
acaaagcuagggaauccaucuu

SEQ ID NO: 245412 - RNA, 22 nt, Homo sapiens
acaaaguauggaauguuggugu

SEQ ID NO: 245413 - RNA, 20 nt, Homo sapiens
acaaaugcauucugugacau

SEQ ID NO: 245414 - RNA, 22 nt, Homo sapiens
acaagcacaaaugcauagaugg

SEQ ID NO: 245415 - RNA, 22 nt, Homo sapiens
acaagugaauacaggauucucu

SEQ ID NO: 245416 - RNA, 23 nt, Homo sapiens
acacaguaaacuaaaagcuagcu

SEQ ID NO: 245417 - RNA, 22 nt, Homo sapiens
acacaguauaugacaaugcuuu

SEQ ID NO: 245418 - RNA, 22 nt, Homo sapiens
acacaugcuccacuguggccuc

SEQ ID NO: 245419 - RNA, 22 nt, Homo sapiens
acacaugugaaaaaaauguuac

SEQ ID NO: 245420 - RNA, 22 nt, Homo sapiens
acacaugugcguagacucuuua

SEQ ID NO: 245421 - RNA, 22 nt, Homo sapiens
acaccuguggucccaguaacuu

SEQ ID NO: 245422 - RNA, 22 nt, Homo sapiens
acacugcugaguaaauaauuuu

SEQ ID NO: 245423 - RNA, 20 nt, Homo sapiens
acacuggaguaucaaggccc

SEQ ID NO: 245424 - RNA, 22 nt, Homo sapiens
acacuggaguuaaaggugauuu

SEQ ID NO: 245425 - RNA, 20 nt, Homo sapiens
acacuggcuuugagauuuag

SEQ ID NO: 245426 - RNA, 22 nt, Homo sapiens
acacuguccaguuaggcuacau

SEQ ID NO: 245427 - RNA, 22 nt, Homo sapiens
acacugucugaugaaaguaguu

SEQ ID NO: 245428 - RNA, 22 nt, Homo sapiens
acagaccuauuucaaucauuua

SEQ ID NO: 245429 - RNA, 22 nt, Homo sapiens
acagagcaaugagcuacggucu

SEQ ID NO: 245430 - RNA, 22 nt, Homo sapiens
acaggugaaguauuacacuaag

SEQ ID NO: 245431 - RNA, 22 nt, Homo sapiens
acaguacucugcucuuuugauu

SEQ ID NO: 245432 - RNA, 21 nt, Homo sapiens
acaguacuugagaucuuuuga

SEQ ID NO: 245433 - RNA, 22 nt, Homo sapiens
acaguacuuuuggauuugugaa

SEQ ID NO: 245434 - RNA, 21 nt, Homo sapiens
acaguaguaauaguguagcca

SEQ ID NO: 245435 - RNA, 22 nt, Homo sapiens
acaguagugggcuacagaauca

SEQ ID NO: 245436 - RNA, 22 nt, Homo sapiens
acagugacagaaagcugauuau

SEQ ID NO: 245437 - RNA, 18 nt, Homo sapiens
acagugcugucacugcuu

SEQ ID NO: 245438 - RNA, 22 nt, Homo sapiens
acagugcuguuguguuuucacg

SEQ ID NO: 245439 - RNA, 17 nt, Homo sapiens
acagugcuuugcuuucc

SEQ ID NO: 245440 - RNA, 19 nt, Homo sapiens
acagugcuuugucagaagc

SEQ ID NO: 245441 - RNA, 22 nt, Homo sapiens
acaguguacaauagccuuuuaa

SEQ ID NO: 245442 - RNA, 22 nt, Homo sapiens
acaguguagugacugccaacuu

SEQ ID NO: 245443 - RNA, 18 nt, Homo sapiens
acagugucauggcucaau

SEQ ID NO: 245444 - RNA, 19 nt, Homo sapiens
acagugucucuauaaugau

SEQ ID NO: 245445 - RNA, 22 nt, Homo sapiens
acaguguuacuugauaguguau

SEQ ID NO: 245446 - RNA, 22 nt, Homo sapiens
acaucauugggggcuacaggug

SEQ ID NO: 245447 - RNA, 22 nt, Homo sapiens
acaucccuuucccacccuucac

SEQ ID NO: 245448 - RNA, 22 nt, Homo sapiens
acaugacauugggguggggaua

SEQ ID NO: 245449 - RNA, 22 nt, Homo sapiens
acaugcaucauuaggugguuua

SEQ ID NO: 245450 - RNA, 22 nt, Homo sapiens
acaugcauccaugugaagagac

SEQ ID NO: 245451 - RNA, 22 nt, Homo sapiens
acauggcacugcgggcuucuug

SEQ ID NO: 245452 - RNA, 22 nt, Homo sapiens
acauguaauugauuuuguguua

SEQ ID NO: 245453 - RNA, 22 nt, Homo sapiens
acauguagacaacggacaaagu

SEQ ID NO: 245454 - RNA, 22 nt, Homo sapiens
acauucagcuguuguuucaaug

SEQ ID NO: 245455 - RNA, 22 nt, Homo sapiens
accacaggguaaaguuagauau

SEQ ID NO: 245456 - RNA, 22 nt, Homo sapiens
accacagugcuuccugcucacg

SEQ ID NO: 245457 - RNA, 22 nt, Homo sapiens
accaccacucccgcauucuaaa

SEQ ID NO: 245458 - RNA, 17 nt, Homo sapiens
accagugcaugugcuuu

SEQ ID NO: 245459 - RNA, 22 nt, Homo sapiens
accauugcacuccagcccaggc

SEQ ID NO: 245460 - RNA, 22 nt, Homo sapiens
accauugcacuccagccugggc

SEQ ID NO: 245461 - RNA, 22 nt, Homo sapiens
acccagaagucauucaggaaca

SEQ ID NO: 245462 - RNA, 22 nt, Homo sapiens
acccaguagucauucaggagca

SEQ ID NO: 245463 - RNA, 22 nt, Homo sapiens
acccgugcucacugccucugcc

SEQ ID NO: 245464 - RNA, 22 nt, Homo sapiens
acccugaagccaugaguggaac

SEQ ID NO: 245465 - RNA, 22 nt, Homo sapiens
acccugucagcuggccugggca

SEQ ID NO: 245466 - RNA, 22 nt, Homo sapiens
acccuuagguuaaaguugaguc

SEQ ID NO: 245467 - RNA, 22 nt, Homo sapiens
acccuuugucaaucaguacuaa

SEQ ID NO: 245468 - RNA, 22 nt, Homo sapiens
accucagcccggggaaguugag

SEQ ID NO: 245469 - RNA, 23 nt, Homo sapiens
ugagguguuaagcagacuugucu

SEQ ID NO: 245470 - RNA, 22 nt, Homo sapiens
ugagguuauuuguucaagaagu

SEQ ID NO: 245471 - RNA, 22 nt, Homo sapiens
ugagguugucagugucauucuu

SEQ ID NO: 245472 - RNA, 22 nt, Homo sapiens
ugaguagagaauucagcuaagg

SEQ ID NO: 245473 - RNA, 23 nt, Homo sapiens
ugaguaggcaguuuuccccucac

SEQ ID NO: 245474 - RNA, 22 nt, Homo sapiens
ugaguauguuuaaugugacaau

SEQ ID NO: 245475 - RNA, 23 nt, Homo sapiens
ugagucacuuugcuggggucucu

SEQ ID NO: 245476 - RNA, 22 nt, Homo sapiens
ugaguguccaccccuuucacag

SEQ ID NO: 245477 - RNA, 22 nt, Homo sapiens
ugaguucaugcuuguaguucua

SEQ ID NO: 245478 - RNA, 22 nt, Homo sapiens
ugaguuccuugugugaccuugc

SEQ ID NO: 245479 - RNA, 22 nt, Homo sapiens
ugaguucuuccaccgggaccag

SEQ ID NO: 245480 - RNA, 22 nt, Homo sapiens
ugaguucuuccuaucucugccu

SEQ ID NO: 245481 - RNA, 22 nt, Homo sapiens
ugaguucuuuuacauuuugaau

SEQ ID NO: 245482 - RNA, 22 nt, Homo sapiens
ugauaagugagauagcaaguga

SEQ ID NO: 245483 - RNA, 22 nt, Homo sapiens
ugauaucucuugccuccaaaug

SEQ ID NO: 245484 - RNA, 22 nt, Homo sapiens
ugauaugcuuugaacucucugg

SEQ ID NO: 245485 - RNA, 21 nt, Homo sapiens
ugauaugguuuggauaugugu

SEQ ID NO: 245486 - RNA, 22 nt, Homo sapiens
ugauaugucacuugaucauggu

SEQ ID NO: 245487 - RNA, 20 nt, Homo sapiens
ugauauuuucugagcaggaa

SEQ ID NO: 245488 - RNA, 22 nt, Homo sapiens
ugauccuguccuuaugauguua

SEQ ID NO: 245489 - RNA, 22 nt, Homo sapiens
ugaucugucacuuaucacauuu

SEQ ID NO: 245490 - RNA, 22 nt, Homo sapiens
ugaugacacugauuucuucaau

SEQ ID NO: 245491 - RNA, 21 nt, Homo sapiens
ugaugcaauccgcuaggucgc

SEQ ID NO: 245492 - RNA, 22 nt, Homo sapiens
ugauggcauuuggaguugggac

SEQ ID NO: 245493 - RNA, 22 nt, Homo sapiens
ugaugguguuaccaucuuuacu

SEQ ID NO: 245494 - RNA, 22 nt, Homo sapiens
ugaugguuuuaaaaagaggagu

SEQ ID NO: 245495 - RNA, 20 nt, Homo sapiens
ugauguccaggcagagguuu

SEQ ID NO: 245496 - RNA, 22 nt, Homo sapiens
ugauuuguuucaggaguuuucu

SEQ ID NO: 245497 - RNA, 22 nt, Homo sapiens
ugcaaagaaauuuuggugacca

SEQ ID NO: 245498 - RNA, 22 nt, Homo sapiens
ugcaaaguccucauucuuaccc

SEQ ID NO: 245499 - RNA, 22 nt, Homo sapiens
ugcaaaugcugcuauuucucuu

SEQ ID NO: 245500 - RNA, 22 nt, Homo sapiens
ugcaaaugucaaggguuagugu

SEQ ID NO: 245501 - RNA, 19 nt, Homo sapiens
ugcaaauucuaaaaacuga

SEQ ID NO: 245502 - RNA, 22 nt, Homo sapiens
ugcaacauguguaccacucugu

SEQ ID NO: 245503 - RNA, 17 nt, Homo sapiens
ugcaauuuaagcuagau

SEQ ID NO: 245504 - RNA, 22 nt, Homo sapiens
ugcacacucuguaugagaaucu

SEQ ID NO: 245505 - RNA, 22 nt, Homo sapiens
ugcaccaauucuaaacaguucu

SEQ ID NO: 245506 - RNA, 22 nt, Homo sapiens
ugcaccacugcaccccagucug

SEQ ID NO: 245507 - RNA, 22 nt, Homo sapiens
ugcaccacugcacuccacccug

SEQ ID NO: 245508 - RNA, 22 nt, Homo sapiens
ugcaccacugcacuccaggcug

SEQ ID NO: 245509 - RNA, 19 nt, Homo sapiens
ugcagcaauguaaaagaca

SEQ ID NO: 245510 - RNA, 22 nt, Homo sapiens
ugcagcacugaacuucugggcu

SEQ ID NO: 245511 - RNA, 21 nt, Homo sapiens
ugcagccauucagcccuaugc

SEQ ID NO: 245512 - RNA, 22 nt, Homo sapiens
ugcagcucagcugcggaguuuu

SEQ ID NO: 245513 - RNA, 18 nt, Homo sapiens
ugcagcuuugugauuggc

SEQ ID NO: 245514 - RNA, 22 nt, Homo sapiens
ugcaguaggcccagcgggaggc

SEQ ID NO: 245515 - RNA, 22 nt, Homo sapiens
ugcagugugaaagagccugaca

SEQ ID NO: 245516 - RNA, 22 nt, Homo sapiens
ugcauacacaagcauacaugua

SEQ ID NO: 245517 - RNA, 22 nt, Homo sapiens
ugcauacugaaauauuuuagag

SEQ ID NO: 245518 - RNA, 21 nt, Homo sapiens
ugcauacuucucagaugauua

SEQ ID NO: 245519 - RNA, 22 nt, Homo sapiens
ugcauaggagcagggucuaugu

SEQ ID NO: 245520 - RNA, 21 nt, Homo sapiens
ugcauaucucuaaugaccagu

SEQ ID NO: 245521 - RNA, 22 nt, Homo sapiens
ugcauauguugaaccagccuug

SEQ ID NO: 245522 - RNA, 22 nt, Homo sapiens
ugcauauucuaggauuuuguau

SEQ ID NO: 245523 - RNA, 22 nt, Homo sapiens
ugcauccauucuagacucaucu

SEQ ID NO: 245524 - RNA, 21 nt, Homo sapiens
ugcauggagaacacugagggu

SEQ ID NO: 245525 - RNA, 21 nt, Homo sapiens
ugcaugguagucacaugauuc

SEQ ID NO: 245526 - RNA, 21 nt, Homo sapiens
ugcauuggagaauguuucuca

SEQ ID NO: 245527 - RNA, 19 nt, Homo sapiens
ugccaagaaagucagcuua

SEQ ID NO: 245528 - RNA, 22 nt, Homo sapiens
ugccaagauuucaggaauuaag

SEQ ID NO: 245529 - RNA, 22 nt, Homo sapiens
ugccaguauuuuauugaagauu

SEQ ID NO: 245530 - RNA, 22 nt, Homo sapiens
ugccaguauuuuauugaggauu

SEQ ID NO: 245531 - RNA, 22 nt, Homo sapiens
ugccaguguugccuuucacuag

SEQ ID NO: 245532 - RNA, 22 nt, Homo sapiens
ugccauagcaaugguaagcuga

SEQ ID NO: 245533 - RNA, 22 nt, Homo sapiens
ugccaugaaguaauggcaaaaa

SEQ ID NO: 245534 - RNA, 22 nt, Homo sapiens
ugcccuguaucccacuguuuca

SEQ ID NO: 245535 - RNA, 22 nt, Homo sapiens
ugccuuauuccaacugagcucu

SEQ ID NO: 245536 - RNA, 22 nt, Homo sapiens
ugcgccauugcauuccagccug

SEQ ID NO: 245537 - RNA, 22 nt, Homo sapiens
ugcugcuguuaucauuuuacca

SEQ ID NO: 245538 - RNA, 22 nt, Homo sapiens
ugcuggcguuacucuccaucag

SEQ ID NO: 245539 - RNA, 22 nt, Homo sapiens
ugcugguaguuuaugacuaauu

SEQ ID NO: 245540 - RNA, 22 nt, Homo sapiens
ugcugguuuaaaaugcaaauuc

SEQ ID NO: 245541 - RNA, 22 nt, Homo sapiens
ugcugguuuucaucaucagugg

SEQ ID NO: 245542 - RNA, 21 nt, Homo sapiens
ugcuuacugaauguuaauuuc

SEQ ID NO: 245543 - RNA, 17 nt, Homo sapiens
ugcuuagagagccucag

SEQ ID NO: 245544 - RNA, 22 nt, Homo sapiens
ugcuuagucuugcuuuagcuau

SEQ ID NO: 245545 - RNA, 19 nt, Homo sapiens
ugcuuaguuuuauguguaa

SEQ ID NO: 245546 - RNA, 22 nt, Homo sapiens
ugcuuugguagaaaucuuuggu

SEQ ID NO: 245547 - RNA, 22 nt, Homo sapiens
uggaaaauuaggggagguuaua

SEQ ID NO: 245548 - RNA, 20 nt, Homo sapiens
uggaaaguaagucaugauau

SEQ ID NO: 245549 - RNA, 22 nt, Homo sapiens
uggaaaguacuugaguuuguau

SEQ ID NO: 245550 - RNA, 22 nt, Homo sapiens
uggaagacucuagucucuugag

SEQ ID NO: 245551 - RNA, 22 nt, Homo sapiens
uggaagauggaguuuuaucauu

SEQ ID NO: 245552 - RNA, 22 nt, Homo sapiens
uggaagaugggaccucaguuuu

SEQ ID NO: 245553 - RNA, 22 nt, Homo sapiens
uggaagauucuagaagauucca

SEQ ID NO: 245554 - RNA, 22 nt, Homo sapiens
uggaagguaaguuuugagcauu

SEQ ID NO: 245555 - RNA, 22 nt, Homo sapiens
uggaaguaaccaugaauggaau

SEQ ID NO: 245556 - RNA, 22 nt, Homo sapiens
uggaauacaugucgcugagcug

SEQ ID NO: 245557 - RNA, 22 nt, Homo sapiens
uggaauacuauucugugcugga

SEQ ID NO: 245558 - RNA, 19 nt, Homo sapiens
uggaaugaaauguuagggg

SEQ ID NO: 245559 - RNA, 21 nt, Homo sapiens
uggaaugaauggccaacaugg

SEQ ID NO: 245560 - RNA, 22 nt, Homo sapiens
uggaaugugaauaacuuccuuc

SEQ ID NO: 245561 - RNA, 22 nt, Homo sapiens
uggaauuaauccuccugguuuc

SEQ ID NO: 245562 - RNA, 22 nt, Homo sapiens
uggacaagugcccuccaccuca

SEQ ID NO: 245563 - RNA, 22 nt, Homo sapiens
uggaccccugcucgggagcccu

SEQ ID NO: 245564 - RNA, 19 nt, Homo sapiens
uggaccccuuccuuacacc

SEQ ID NO: 245565 - RNA, 22 nt, Homo sapiens
uggaccccuucuccuauuaaaa

SEQ ID NO: 245566 - RNA, 22 nt, Homo sapiens
uggacuguaauuuuauaggcau

SEQ ID NO: 245567 - RNA, 22 nt, Homo sapiens
uggagacaaagauagaaaagca

SEQ ID NO: 245568 - RNA, 22 nt, Homo sapiens
uggagagcaaaaucaauccaaa

SEQ ID NO: 245569 - RNA, 22 nt, Homo sapiens
uggagagcaaagaauuuguuag

SEQ ID NO: 245570 - RNA, 22 nt, Homo sapiens
uggagcccuaguuccucauaac

SEQ ID NO: 245571 - RNA, 21 nt, Homo sapiens
uguggcaauggccucacagau

SEQ ID NO: 245572 - RNA, 22 nt, Homo sapiens
uguggcuuuuucuuggcugagg

SEQ ID NO: 245573 - RNA, 22 nt, Homo sapiens
ugugguauuagguguaguaucu

SEQ ID NO: 245574 - RNA, 22 nt, Homo sapiens
uguggucaucacuugaagguaa

SEQ ID NO: 245575 - RNA, 22 nt, Homo sapiens
ugugguuuuaguaaaacuaugu

SEQ ID NO: 245576 - RNA, 22 nt, Homo sapiens
ugugguuuuauaaacgugaccu

SEQ ID NO: 245577 - RNA, 22 nt, Homo sapiens
ugugguuuuucacauuuagaga

SEQ ID NO: 245578 - RNA, 22 nt, Homo sapiens
ugugguuuuuuucuccaauagg

SEQ ID NO: 245579 - RNA, 22 nt, Homo sapiens
uguguacaucucuacacacaug

SEQ ID NO: 245580 - RNA, 22 nt, Homo sapiens
ugugucacugaggguuagugua

SEQ ID NO: 245581 - RNA, 22 nt, Homo sapiens
ugugucacugcacuccagccug

SEQ ID NO: 245582 - RNA, 22 nt, Homo sapiens
uguguuuuuauguaaaauggaa

SEQ ID NO: 245583 - RNA, 22 nt, Homo sapiens
uguuacagugacuaauguuuua

SEQ ID NO: 245584 - RNA, 22 nt, Homo sapiens
uguucaugaguucucauuuuua

SEQ ID NO: 245585 - RNA, 22 nt, Homo sapiens
uguucuggagaggcaggccaca

SEQ ID NO: 245586 - RNA, 22 nt, Homo sapiens
uguugcacuccagccuagguga

SEQ ID NO: 245587 - RNA, 20 nt, Homo sapiens
uguugcacucuagccugggu

SEQ ID NO: 245588 - RNA, 22 nt, Homo sapiens
uguugccacuguuauuaaccua

SEQ ID NO: 245589 - RNA, 22 nt, Homo sapiens
uguugcuuaagccacccagucu

SEQ ID NO: 245590 - RNA, 22 nt, Homo sapiens
uguuggcauugcugcugacccu

SEQ ID NO: 245591 - RNA, 22 nt, Homo sapiens
uguuugcuguguggaguagcag

SEQ ID NO: 245592 - RNA, 22 nt, Homo sapiens
uguuugcuguuuucuccaauga

SEQ ID NO: 245593 - RNA, 22 nt, Homo sapiens
uguuugcuuaacguggagccag

SEQ ID NO: 245594 - RNA, 19 nt, Homo sapiens
uguuuggcuauaggucuaa

SEQ ID NO: 245595 - RNA, 22 nt, Homo sapiens
uguuuguuugugauacgguaca

SEQ ID NO: 245596 - RNA, 22 nt, Homo sapiens
uguuuuggagguccucacuaga

SEQ ID NO: 245597 - RNA, 22 nt, Homo sapiens
uuaaagcuggcguuacaguuug

SEQ ID NO: 245598 - RNA, 22 nt, Homo sapiens
uuaaaggcaugguuagacaugg

SEQ ID NO: 245599 - RNA, 22 nt, Homo sapiens
uuaaaggcauguacacuagagu

SEQ ID NO: 245600 - RNA, 22 nt, Homo sapiens
uuaaagugcuguuuuugccggg

SEQ ID NO: 245601 - RNA, 20 nt, Homo sapiens
uuaaaucuagugcagacuca

SEQ ID NO: 245602 - RNA, 22 nt, Homo sapiens
uuaaaugcacauacuugagaaa

SEQ ID NO: 245603 - RNA, 22 nt, Homo sapiens
uuaaaugcuagaauuuucuuug

SEQ ID NO: 245604 - RNA, 22 nt, Homo sapiens
uuaaaugucuguagaugugcug

SEQ ID NO: 245605 - RNA, 22 nt, Homo sapiens
uuaacagugucaaucuguagua

SEQ ID NO: 245606 - RNA, 22 nt, Homo sapiens
uuaacaguugcaugagacugag

SEQ ID NO: 245607 - RNA, 23 nt, Homo sapiens
uuaagcaacggcugcuuuucaga

SEQ ID NO: 245608 - RNA, 22 nt, Homo sapiens
uuaaggcuuguacuuguuuucu

SEQ ID NO: 245609 - RNA, 21 nt, Homo sapiens
uuaaguaauuacccaacucuc

SEQ ID NO: 245610 - RNA, 19 nt, Homo sapiens
uuaagugugauaucucagu

SEQ ID NO: 245611 - RNA, 22 nt, Homo sapiens
uuaauacugcuuaacuuuagga

SEQ ID NO: 245612 - RNA, 22 nt, Homo sapiens
uuaauagugacucauuuuccac

SEQ ID NO: 245613 - RNA, 22 nt, Homo sapiens
uuaaucacagugucuuccuuca

SEQ ID NO: 245614 - RNA, 22 nt, Homo sapiens
uuaauccugccuuauuucagua

SEQ ID NO: 245615 - RNA, 22 nt, Homo sapiens
uuaaugaacuuuauuuuguaga

SEQ ID NO: 245616 - RNA, 22 nt, Homo sapiens
uuaauucugucugcccucaucc

SEQ ID NO: 245617 - RNA, 22 nt, Homo sapiens
uuaauuguaucuauagauguca

SEQ ID NO: 245618 - RNA, 22 nt, Homo sapiens
uuacaagaugucuguccaacac

SEQ ID NO: 245619 - RNA, 21 nt, Homo sapiens
uuacaauggcuccuugaaggu

SEQ ID NO: 245620 - RNA, 22 nt, Homo sapiens
uuacagauggauggcagcuggc

SEQ ID NO: 245621 - RNA, 22 nt, Homo sapiens
uuacagguggagaaguaaggcu

SEQ ID NO: 245622 - RNA, 22 nt, Homo sapiens
uuacaguagaugaggguauaau

SEQ ID NO: 245623 - RNA, 22 nt, Homo sapiens
uuacaguaugaguaagaguucu

SEQ ID NO: 245624 - RNA, 22 nt, Homo sapiens
uuacaguauugcaaggacuagg

SEQ ID NO: 245625 - RNA, 23 nt, Homo sapiens
uuacaguggcaugaucucugcuc

SEQ ID NO: 245626 - RNA, 22 nt, Homo sapiens
uuacaguguuuguucuguuacu

SEQ ID NO: 245627 - RNA, 22 nt, Homo sapiens
uuacauguggugugaagaagag

SEQ ID NO: 245628 - RNA, 22 nt, Homo sapiens
uuacauguuguggguuguggcc

SEQ ID NO: 245629 - RNA, 22 nt, Homo sapiens
uuacuguagugucauaucguau

SEQ ID NO: 245630 - RNA, 22 nt, Homo sapiens
uuagaaaguagaaaagcugguu

SEQ ID NO: 245631 - RNA, 22 nt, Homo sapiens
uuagcagcaccccacucuacug

SEQ ID NO: 245632 - RNA, 22 nt, Homo sapiens
uuaggcuaguuucuuaaacucu

SEQ ID NO: 245633 - RNA, 22 nt, Homo sapiens
uuagguagucucugucagaggg

SEQ ID NO: 245634 - RNA, 22 nt, Homo sapiens
uuaguaguuugauaggaauagc

SEQ ID NO: 245635 - RNA, 20 nt, Homo sapiens
uuagucuccucugcccuguc

SEQ ID NO: 245636 - RNA, 22 nt, Homo sapiens
uuagugcuuacgaugagcuaag

SEQ ID NO: 245637 - RNA, 22 nt, Homo sapiens
uuaguggaugcugaauaaagaa

SEQ ID NO: 245638 - RNA, 22 nt, Homo sapiens
uuauagguuucuacaggacuau

SEQ ID NO: 245639 - RNA, 22 nt, Homo sapiens
uuauccugucaguaaauauuuu

SEQ ID NO: 245640 - RNA, 22 nt, Homo sapiens
uuaugcaucuuccacacucauu

SEQ ID NO: 245641 - RNA, 22 nt, Homo sapiens
uuauggcuauugaugacaauug

SEQ ID NO: 245642 - RNA, 22 nt, Homo sapiens
uuauguguuuaauguuucugaa

SEQ ID NO: 245643 - RNA, 22 nt, Homo sapiens
uucaaaguuggaggacaaacug

SEQ ID NO: 245644 - RNA, 22 nt, Homo sapiens
uucaaaucuuuggcucccacua

SEQ ID NO: 245645 - RNA, 23 nt, Homo sapiens
uucaacagguagacccucccugc

SEQ ID NO: 245646 - RNA, 22 nt, Homo sapiens
uucaaggacuaaggauuuuugg

SEQ ID NO: 245647 - RNA, 22 nt, Homo sapiens
uucaaguaagaaagacaucagg

SEQ ID NO: 245648 - RNA, 22 nt, Homo sapiens
uucacaguggugggagacguca

SEQ ID NO: 245649 - RNA, 22 nt, Homo sapiens
uucacaguguguacaccagggg

SEQ ID NO: 245650 - RNA, 22 nt, Homo sapiens
uucacaugguugccuuuugauc

SEQ ID NO: 245651 - RNA, 23 nt, Homo sapiens
uucaccguguuggccaggcuggu

SEQ ID NO: 245652 - RNA, 22 nt, Homo sapiens
uucaccuggguuggccaucauu

SEQ ID NO: 245653 - RNA, 20 nt, Homo sapiens
uucacugggcucucuguugg

SEQ ID NO: 245654 - RNA, 22 nt, Homo sapiens
uucacugggugugguggcucac

SEQ ID NO: 245655 - RNA, 22 nt, Homo sapiens
uucacuguaaaaugaagagggu

SEQ ID NO: 245656 - RNA, 22 nt, Homo sapiens
uucagaugcacacuguagucua

SEQ ID NO: 245657 - RNA, 22 nt, Homo sapiens
uucagauugcauaccgaaagua

SEQ ID NO: 245658 - RNA, 22 nt, Homo sapiens
uucagcaaugacagccuauaua

SEQ ID NO: 245659 - RNA, 22 nt, Homo sapiens
uucagcuacuugggaggcugaa

SEQ ID NO: 245660 - RNA, 22 nt, Homo sapiens
uucagguacugggggaguaugg

SEQ ID NO: 245661 - RNA, 22 nt, Homo sapiens
uucagguucauuugcugcuauu

SEQ ID NO: 245662 - RNA, 22 nt, Homo sapiens
uucaguaaauguucuuacuaua

SEQ ID NO: 245663 - RNA, 22 nt, Homo sapiens
uucagugagacgaaaacaacaa

SEQ ID NO: 245664 - RNA, 22 nt, Homo sapiens
uucagugccuggaagucgugcu

SEQ ID NO: 245665 - RNA, 22 nt, Homo sapiens
uucaguucugcacugaucuuag

SEQ ID NO: 245666 - RNA, 22 nt, Homo sapiens
uucaguucugcucugaucuuag

SEQ ID NO: 245667 - RNA, 22 nt, Homo sapiens
uucauagugaaaaauucaaagu

SEQ ID NO: 245668 - RNA, 22 nt, Homo sapiens
uucaucacagucuccgaugccc

SEQ ID NO: 245669 - RNA, 20 nt, Homo sapiens
uucaucaggauauuggucua

SEQ ID NO: 245670 - RNA, 22 nt, Homo sapiens
uucaucagggagaaauaauuuc

SEQ ID NO: 245671 - RNA, 23 nt, Homo sapiens
uucaucagggauauuggccugaa

SEQ ID NO: 245672 - RNA, 22 nt, Homo sapiens
uucaucuggcaauucagagauu

SEQ ID NO: 245673 - RNA, 22 nt, Homo sapiens
uuggaaaguuguuguaguuauu

SEQ ID NO: 245674 - RNA, 22 nt, Homo sapiens
uuggaauauaaccuguuucuaa

SEQ ID NO: 245675 - RNA, 22 nt, Homo sapiens
uuggaauuaagagauauuuucu

SEQ ID NO: 245676 - RNA, 22 nt, Homo sapiens
uuggaauuuauuuggaugggag

SEQ ID NO: 245677 - RNA, 22 nt, Homo sapiens
uuggacuggaacuauaccauug

SEQ ID NO: 245678 - RNA, 22 nt, Homo sapiens
uuggacuuuuauucugcaggca

SEQ ID NO: 245679 - RNA, 22 nt, Homo sapiens
uuggagagaaaggcaguuccug

SEQ ID NO: 245680 - RNA, 22 nt, Homo sapiens
uuggagcacuggggcacugaca

SEQ ID NO: 245681 - RNA, 22 nt, Homo sapiens
uuggauuuuaacaaacuaggug

SEQ ID NO: 245682 - RNA, 22 nt, Homo sapiens
uuggcaagaaccuucuuccaag

SEQ ID NO: 245683 - RNA, 22 nt, Homo sapiens
uuggcaagaauguaugccgauc

SEQ ID NO: 245684 - RNA, 22 nt, Homo sapiens
uuggcaaguuucugucagcaaa

SEQ ID NO: 245685 - RNA, 22 nt, Homo sapiens
uuggcacugagcaagaacaggg

SEQ ID NO: 245686 - RNA, 22 nt, Homo sapiens
uuggcagcacgcaguccagagg

SEQ ID NO: 245687 - RNA, 19 nt, Homo sapiens
uuggcccugguucucuucu

SEQ ID NO: 245688 - RNA, 23 nt, Homo sapiens
uuggccuccuugugucuagggcu

SEQ ID NO: 245689 - RNA, 21 nt, Homo sapiens
uuggccuggaggccugaaugu

SEQ ID NO: 245690 - RNA, 22 nt, Homo sapiens
uuggcuguguuuauaugcugga

SEQ ID NO: 245691 - RNA, 17 nt, Homo sapiens
uugggcaagguagguga

SEQ ID NO: 245692 - RNA, 22 nt, Homo sapiens
uuggggcacggccucuguugcc

SEQ ID NO: 245693 - RNA, 22 nt, Homo sapiens
uuggguccucugguccuugguu

SEQ ID NO: 245694 - RNA, 22 nt, Homo sapiens
uugguccacugugaaauuggga

SEQ ID NO: 245695 - RNA, 21 nt, Homo sapiens
uuggucuucucugugauucuu

SEQ ID NO: 245696 - RNA, 22 nt, Homo sapiens
uugguuuccuuccugcuuaacu

SEQ ID NO: 245697 - RNA, 22 nt, Homo sapiens
uuguaaacaucuguacauugcu

SEQ ID NO: 245698 - RNA, 22 nt, Homo sapiens
uuguaacaugcuuucacuucag

SEQ ID NO: 245699 - RNA, 22 nt, Homo sapiens
uuguaauguuaccaaauggugu

SEQ ID NO: 245700 - RNA, 22 nt, Homo sapiens
uuguacaggaguguaagcuuca

SEQ ID NO: 245701 - RNA, 22 nt, Homo sapiens
uuguagcaaauguguaaacaaa

SEQ ID NO: 245702 - RNA, 21 nt, Homo sapiens
uuguaugguugaacuugauac

SEQ ID NO: 245703 - RNA, 22 nt, Homo sapiens
uuguauguuucugugcacauga

SEQ ID NO: 245704 - RNA, 22 nt, Homo sapiens
uuguauguuuguucuuucagau

SEQ ID NO: 245705 - RNA, 22 nt, Homo sapiens
uuguauugucuugaugaguuga

SEQ ID NO: 245706 - RNA, 22 nt, Homo sapiens
uugucacauggggcggcugccc

SEQ ID NO: 245707 - RNA, 22 nt, Homo sapiens
uugucacuauaaauaagcauuu

SEQ ID NO: 245708 - RNA, 22 nt, Homo sapiens
uugucacucuuccuaggguagg

SEQ ID NO: 245709 - RNA, 22 nt, Homo sapiens
uugucacugcacuccagucugg

SEQ ID NO: 245710 - RNA, 22 nt, Homo sapiens
uuguccacugcuagccucugca

SEQ ID NO: 245711 - RNA, 22 nt, Homo sapiens
uuguccccaucugcugccagaa

SEQ ID NO: 245712 - RNA, 22 nt, Homo sapiens
uuguccucuccaaaucucaugu

SEQ ID NO: 245713 - RNA, 22 nt, Homo sapiens
uugugaaugaugucgcaauaaa

SEQ ID NO: 245714 - RNA, 22 nt, Homo sapiens
uugugaauggugccgcaauaaa

SEQ ID NO: 245715 - RNA, 22 nt, Homo sapiens
uugugauggugcauacugagcu

SEQ ID NO: 245716 - RNA, 22 nt, Homo sapiens
uugugcacauguacccuagaac

SEQ ID NO: 245717 - RNA, 21 nt, Homo sapiens
uugugccaaacccuggaggga

SEQ ID NO: 245718 - RNA, 22 nt, Homo sapiens
uugugcuuguaacuacauucag

SEQ ID NO: 245719 - RNA, 22 nt, Homo sapiens
uuguggcuuaucucauuuagcg

SEQ ID NO: 245720 - RNA, 19 nt, Homo sapiens
uugugggaggacagagggg

SEQ ID NO: 245721 - RNA, 22 nt, Homo sapiens
uugugguaggaugaagagauga

SEQ ID NO: 245722 - RNA, 22 nt, Homo sapiens
uugugguagugaaugagucuca

SEQ ID NO: 245723 - RNA, 22 nt, Homo sapiens
uugugguugauacacguaggaa

SEQ ID NO: 245724 - RNA, 22 nt, Homo sapiens
uugugguugaugaagacugucu

SEQ ID NO: 245725 - RNA, 22 nt, Homo sapiens
uugugguuuucagcuuauauau

SEQ ID NO: 245726 - RNA, 22 nt, Homo sapiens
uuguguacuacaguaugccaca

SEQ ID NO: 245727 - RNA, 22 nt, Homo sapiens
uuguguccccacucaaauuaca

SEQ ID NO: 245728 - RNA, 22 nt, Homo sapiens
uuguucaggagguuggggaugc

SEQ ID NO: 245729 - RNA, 22 nt, Homo sapiens
uuguuugguugaguauggaagu

SEQ ID NO: 245730 - RNA, 22 nt, Homo sapiens
uuuaaaguuagaaggaaagggc

SEQ ID NO: 245731 - RNA, 20 nt, Homo sapiens
uuuaagacaugcugaauuga

SEQ ID NO: 245732 - RNA, 22 nt, Homo sapiens
uuuaauagcagggacuuccggg

SEQ ID NO: 245733 - RNA, 22 nt, Homo sapiens
uuuaaugcaucccaaaauguag

SEQ ID NO: 245734 - RNA, 22 nt, Homo sapiens
uuuaaugcgucucugaguuuug

SEQ ID NO: 245735 - RNA, 22 nt, Homo sapiens
uuuaaugcugcccagucauggg

SEQ ID NO: 245736 - RNA, 22 nt, Homo sapiens
uuuaauguuacaguauugguau

SEQ ID NO: 245737 - RNA, 21 nt, Homo sapiens
uuuacuguggacccauugcuu

SEQ ID NO: 245738 - RNA, 22 nt, Homo sapiens
uuuaucaggccuuuggaaaaau

SEQ ID NO: 245739 - RNA, 22 nt, Homo sapiens
uuuauccagccucuagcaaggu

SEQ ID NO: 245740 - RNA, 19 nt, Homo sapiens
uuucaauguaaggauggag

SEQ ID NO: 245741 - RNA, 21 nt, Homo sapiens
uuucacugugaguuuuucugu

SEQ ID NO: 245742 - RNA, 17 nt, Homo sapiens
uuucagaguggaagugu

SEQ ID NO: 245743 - RNA, 23 nt, Homo sapiens
uuucaggcaggugaaagaccagc

SEQ ID NO: 245744 - RNA, 18 nt, Homo sapiens
uuucaggguggacaugag

SEQ ID NO: 245745 - RNA, 22 nt, Homo sapiens
uuucauagccuuugucgucuga

SEQ ID NO: 245746 - RNA, 22 nt, Homo sapiens
uuucaucaagcacagaguagau

SEQ ID NO: 245747 - RNA, 22 nt, Homo sapiens
uuucaucagccagggucagucu

SEQ ID NO: 245748 - RNA, 22 nt, Homo sapiens
uuucauggagaaucuucuuacu

SEQ ID NO: 245749 - RNA, 22 nt, Homo sapiens
uuucauggaggauuugcuucuu

SEQ ID NO: 245750 - RNA, 22 nt, Homo sapiens
uuucauggaggcauuuuagauu

SEQ ID NO: 245751 - RNA, 23 nt, Homo sapiens
uuucauggggauuuacucauucc

SEQ ID NO: 245752 - RNA, 22 nt, Homo sapiens
uuuccagguggccaacauuuua

SEQ ID NO: 245753 - RNA, 22 nt, Homo sapiens
uuuccauguuggugaaaugagg

SEQ ID NO: 245754 - RNA, 22 nt, Homo sapiens
uuucccauuguucugcucugug

SEQ ID NO: 245755 - RNA, 22 nt, Homo sapiens
uuucuacagggcuugccaggua

SEQ ID NO: 245756 - RNA, 22 nt, Homo sapiens
uuucuacagugaacgauuucua

SEQ ID NO: 245757 - RNA, 22 nt, Homo sapiens
uuucuauguugaccagucuaga

SEQ ID NO: 245758 - RNA, 22 nt, Homo sapiens
uuucugagaccaaaacuuguaa

SEQ ID NO: 245759 - RNA, 22 nt, Homo sapiens
uuucugcuugagagaauugcug

SEQ ID NO: 245760 - RNA, 22 nt, Homo sapiens
uuucugguuaauuucuaagagc

SEQ ID NO: 245761 - RNA, 23 nt, Homo sapiens
uuucuugggcaugcuaugucagu

SEQ ID NO: 245762 - RNA, 19 nt, Homo sapiens
uuugaauauaaugcagcua

SEQ ID NO: 245763 - RNA, 22 nt, Homo sapiens
uuugacaaugugugcuuguauu

SEQ ID NO: 245764 - RNA, 22 nt, Homo sapiens
uuugagaucuuuagaaucaggc

SEQ ID NO: 245765 - RNA, 22 nt, Homo sapiens
uuugagcaggcuaaucaauaua

SEQ ID NO: 245766 - RNA, 22 nt, Homo sapiens
uuugagcauuagggcaaaggca

SEQ ID NO: 245767 - RNA, 22 nt, Homo sapiens
uuugagcuugacucagcuggag

SEQ ID NO: 245768 - RNA, 22 nt, Homo sapiens
uuugaguuugaggugcugauga

SEQ ID NO: 245769 - RNA, 22 nt, Homo sapiens
uuugcaauagguuguggggagg

SEQ ID NO: 245770 - RNA, 22 nt, Homo sapiens
uuugcacuugaaaacacucuca

SEQ ID NO: 245771 - RNA, 22 nt, Homo sapiens
uuugcagagacuuguuaggaau

SEQ ID NO: 245772 - RNA, 22 nt, Homo sapiens
uuugcaucuuagaaaguucucc

SEQ ID NO: 245773 - RNA, 22 nt, Homo sapiens
uuugcuuaguaaauguagaaaa

SEQ ID NO: 245774 - RNA, 22 nt, Homo sapiens
uuuggaaugaaacagcagagcc

SEQ ID NO: 245775 - RNA, 22 nt, Homo sapiens
uaugauuuuugggagaggucaa

SEQ ID NO: 245776 - RNA, 22 nt, Homo sapiens
uaugcacacguguccaugugca

SEQ ID NO: 245777 - RNA, 22 nt, Homo sapiens
uaugcacaugcaugcuugaaua

SEQ ID NO: 245778 - RNA, 22 nt, Homo sapiens
uaugcccauuuaaauugaacaa

SEQ ID NO: 245779 - RNA, 22 nt, Homo sapiens
uauggaaaucuuaccuuauggu

SEQ ID NO: 245780 - RNA, 22 nt, Homo sapiens
uauggcaaugcauaggaaggaa

SEQ ID NO: 245781 - RNA, 22 nt, Homo sapiens
uauggcuucuauaaggaagcuu

SEQ ID NO: 245782 - RNA, 22 nt, Homo sapiens
uaugggauuucauuaagugucu

SEQ ID NO: 245783 - RNA, 19 nt, Homo sapiens
uaugggauuuuuagggugu

SEQ ID NO: 245784 - RNA, 21 nt, Homo sapiens
uaugguuucuaauucugcagg

SEQ ID NO: 245785 - RNA, 22 nt, Homo sapiens
uaugucuauuauguagcaggaa

SEQ ID NO: 245786 - RNA, 22 nt, Homo sapiens
uaugucuucuuuagagaaaugu

SEQ ID NO: 245787 - RNA, 22 nt, Homo sapiens
uaugucuuuugcuugcaaauag

SEQ ID NO: 245788 - RNA, 22 nt, Homo sapiens
uauuacagaccauaucgccggg

SEQ ID NO: 245789 - RNA, 22 nt, Homo sapiens
uauuacauccauaggcucugcu

SEQ ID NO: 245790 - RNA, 22 nt, Homo sapiens
uauuaguuuucuguggauuaca

SEQ ID NO: 245791 - RNA, 22 nt, Homo sapiens
uauuauuguccuucuauaccca

SEQ ID NO: 245792 - RNA, 20 nt, Homo sapiens
uauucacucuccagucuugc

SEQ ID NO: 245793 - RNA, 22 nt, Homo sapiens
uauucacuguaucauugauggg

SEQ ID NO: 245794 - RNA, 22 nt, Homo sapiens
uauuccacaauaugauuuuuaa

SEQ ID NO: 245795 - RNA, 22 nt, Homo sapiens
uauuccagcccuggugagccag

SEQ ID NO: 245796 - RNA, 22 nt, Homo sapiens
uauuccuuuugcauuuccacau

SEQ ID NO: 245797 - RNA, 22 nt, Homo sapiens
uauugacauuacagugggucuu

SEQ ID NO: 245798 - RNA, 22 nt, Homo sapiens
uauugcacaugaggagacauug

SEQ ID NO: 245799 - RNA, 22 nt, Homo sapiens
uauugcagauacccaggaaguu

SEQ ID NO: 245800 - RNA, 18 nt, Homo sapiens
uauugcuugguuuggaga

SEQ ID NO: 245801 - RNA, 22 nt, Homo sapiens
uauugguugcuaauuggcgcca

SEQ ID NO: 245802 - RNA, 22 nt, Homo sapiens
uauuguacauguuauagauuuu

SEQ ID NO: 245803 - RNA, 22 nt, Homo sapiens
uauuucccuuaacuuuccugca

SEQ ID NO: 245804 - RNA, 22 nt, Homo sapiens
uauuugguagcuauuuugcagu

SEQ ID NO: 245805 - RNA, 22 nt, Homo sapiens
uauuuguccccuccaaaaguca

SEQ ID NO: 245806 - RNA, 22 nt, Homo sapiens
ucaaaguaaagccucaggaugg

SEQ ID NO: 245807 - RNA, 22 nt, Homo sapiens
ucaaagugacaaaguugcagca

SEQ ID NO: 245808 - RNA, 18 nt, Homo sapiens
ucaaauacuuugggcagu

SEQ ID NO: 245809 - RNA, 22 nt, Homo sapiens
ucaaaucaucuuuuccaaagcu

SEQ ID NO: 245810 - RNA, 22 nt, Homo sapiens
ucaaaugaucugcccgccuugg

SEQ ID NO: 245811 - RNA, 22 nt, Homo sapiens
ucaaaugcuguauuguaguaau

SEQ ID NO: 245812 - RNA, 22 nt, Homo sapiens
ucaaaugguccacgugaacauu

SEQ ID NO: 245813 - RNA, 22 nt, Homo sapiens
ucaaccggugagagcuuccucc

SEQ ID NO: 245814 - RNA, 22 nt, Homo sapiens
ucaacugcuugagaucacaaau

SEQ ID NO: 245815 - RNA, 22 nt, Homo sapiens
ucaagcaauucgccugucucag

SEQ ID NO: 245816 - RNA, 18 nt, Homo sapiens
ucaagcuauugucaugcc

SEQ ID NO: 245817 - RNA, 20 nt, Homo sapiens
ucaaggcaggaacuguacau

SEQ ID NO: 245818 - RNA, 22 nt, Homo sapiens
ucacaaagcuuggccugcuucu

SEQ ID NO: 245819 - RNA, 22 nt, Homo sapiens
ucacaauguaaaugaggguugg

SEQ ID NO: 245820 - RNA, 22 nt, Homo sapiens
ucacaauucucaauuugugaaa

SEQ ID NO: 245821 - RNA, 22 nt, Homo sapiens
caaagugcuggaauuggccggg

SEQ ID NO: 245822 - RNA, 22 nt, Homo sapiens
caaagugcuggccgggcgcagu

SEQ ID NO: 245823 - RNA, 22 nt, Homo sapiens
caagugcuugaugaaugaucaa

SEQ ID NO: 245824 - RNA, 22 nt, Homo sapiens
cacccaguaagcaugaggcccu

SEQ ID NO: 245825 - RNA, 22 nt, Homo sapiens
cagcccuacacagacugacuca

SEQ ID NO: 245826 - RNA, 22 nt, Homo sapiens
caggugaaugccucuccuucug

SEQ ID NO: 245827 - RNA, 22 nt, Homo sapiens
cagucacagugacaggaugugg

SEQ ID NO: 245828 - RNA, 22 nt, Homo sapiens
caugccacugcacgccauccug

SEQ ID NO: 245829 - RNA, 22 nt, Homo sapiens
ccagugucugacagacacggcg

SEQ ID NO: 245830 - RNA, 22 nt, Homo sapiens
cccgugucuuggucuagggccu

SEQ ID NO: 245831 - RNA, 22 nt, Homo sapiens
ccucauggagaacaucugcuag

SEQ ID NO: 245832 - RNA, 22 nt, Homo sapiens
ccuucauugcaucuuuaagaga

SEQ ID NO: 245833 - RNA, 22 nt, Homo sapiens
cuaaaugucucuacuaaguuua

SEQ ID NO: 245834 - RNA, 22 nt, Homo sapiens
cuaaggaaggacugaaaggaca

SEQ ID NO: 245835 - RNA, 22 nt, Homo sapiens
cuccaggugucauccaccuccu

SEQ ID NO: 245836 - RNA, 22 nt, Homo sapiens
cuccauuuggaacagauguccu

SEQ ID NO: 245837 - RNA, 22 nt, Homo sapiens
cugagaagaaacagguaaggac

SEQ ID NO: 245838 - RNA, 18 nt, Homo sapiens
cuggaaggcuacuacagu

SEQ ID NO: 245839 - RNA, 22 nt, Homo sapiens
cugugaacaugggagaaauggc

SEQ ID NO: 245840 - RNA, 22 nt, Homo sapiens
cuuggcacucuguggaguuagg

SEQ ID NO: 245841 - RNA, 22 nt, Homo sapiens
cuuggcuccgacuccccuccaa

SEQ ID NO: 245842 - RNA, 22 nt, Homo sapiens
gaaagcugguauagauacauua

SEQ ID NO: 245843 - RNA, 22 nt, Homo sapiens
gaaaguaauuaacgauuguugc

SEQ ID NO: 245844 - RNA, 22 nt, Homo sapiens
gaaucauuguuucuaaguuugu

SEQ ID NO: 245845 - RNA, 22 nt, Homo sapiens
gagugcuguuagcccuggguuu

SEQ ID NO: 245846 - RNA, 22 nt, Homo sapiens
gauaaauccagauucugaugua

SEQ ID NO: 245847 - RNA, 22 nt, Homo sapiens
gaucugucuuuccuuauagucu

SEQ ID NO: 245848 - RNA, 22 nt, Homo sapiens
gaugguuuucaccugcaugcuu

SEQ ID NO: 245849 - RNA, 22 nt, Homo sapiens
gcaccccuuaccgggcuggguu

SEQ ID NO: 245850 - RNA, 22 nt, Homo sapiens
gcacccugucaaaauggaccaa

SEQ ID NO: 245851 - RNA, 22 nt, Homo sapiens
ggagaguaauuagacugaaaga

SEQ ID NO: 245852 - RNA, 22 nt, Homo sapiens
ggcaagugggagggaguguuuc

SEQ ID NO: 245853 - RNA, 22 nt, Homo sapiens
ggcacuguggcucaagccugua

SEQ ID NO: 245854 - RNA, 22 nt, Homo sapiens
ggcuagagacaaguugcugaga

SEQ ID NO: 245855 - RNA, 22 nt, Homo sapiens
gucacuguggagaagaaagugg

SEQ ID NO: 245856 - RNA, 22 nt, Homo sapiens
guccauuuguuuccagagcacu

SEQ ID NO: 245857 - RNA, 22 nt, Homo sapiens
gugauuauuaugcacugcaugc

SEQ ID NO: 245858 - RNA, 22 nt, Homo sapiens
guggaaugaaaacucucucaca

SEQ ID NO: 245859 - RNA, 22 nt, Homo sapiens
guggaauggaaugauuguguau

SEQ ID NO: 245860 - RNA, 17 nt, Homo sapiens
guggaaugucaugucaa

SEQ ID NO: 245861 - RNA, 22 nt, Homo sapiens
guguaaaucaaucuguugucuu

SEQ ID NO: 245862 - RNA, 20 nt, Homo sapiens
uaaaugccucaugcuuuauu

SEQ ID NO: 245863 - RNA, 22 nt, Homo sapiens
uaacaguguauuccuuuggaca

SEQ ID NO: 245864 - RNA, 22 nt, Homo sapiens
uaacaguguauuuacuacuucc

SEQ ID NO: 245865 - RNA, 22 nt, Homo sapiens
uaagugcuugacuuugauguuu

SEQ ID NO: 245866 - RNA, 22 nt, Homo sapiens
uacaaaguaacaguuccuguau

SEQ ID NO: 245867 - RNA, 22 nt, Homo sapiens
uagaacauuccaggugauguug

SEQ ID NO: 245868 - RNA, 20 nt, Homo sapiens
uagcacacauguagaauagu

SEQ ID NO: 245869 - RNA, 22 nt, Homo sapiens
uagugcuguaauucuaaugaaa

SEQ ID NO: 245870 - RNA, 22 nt, Homo sapiens
uagugcugugauauuuuuggcc

SEQ ID NO: 245871 - RNA, 18 nt, Homo sapiens
uagugcuguucucaugau

SEQ ID NO: 245872 - RNA, 22 nt, Homo sapiens
uaucaagauggauaaggauaga

SEQ ID NO: 245873 - RNA, 22 nt, Homo sapiens
uaucacuauucauccuagcucc

SEQ ID NO: 245874 - RNA, 22 nt, Homo sapiens
ucaacagugauggaaaguuaua

SEQ ID NO: 245875 - RNA, 22 nt, Homo sapiens
ucaagcaauucuccucucagcc

SEQ ID NO: 245876 - RNA, 22 nt, Homo sapiens
ucaagcaauucuccugccucag

SEQ ID NO: 245877 - RNA, 18 nt, Homo sapiens
ucaagcaauugucaugcc

SEQ ID NO: 245878 - RNA, 22 nt, Homo sapiens
ucacaaggcaggaaugaaaggg

SEQ ID NO: 245879 - RNA, 22 nt, Homo sapiens
ucacaugaauugucuuguucca

SEQ ID NO: 245880 - RNA, 20 nt, Homo sapiens
ucacccugacaucugcccag

SEQ ID NO: 245881 - RNA, 22 nt, Homo sapiens
ucagaguggagucugcagccuu

SEQ ID NO: 245882 - RNA, 22 nt, Homo sapiens
ucagaguggccucucuugaaga

SEQ ID NO: 245883 - RNA, 22 nt, Homo sapiens
ucagcguguggacggccaucuu

SEQ ID NO: 245884 - RNA, 22 nt, Homo sapiens
uccauaguugcacucuggagcc

SEQ ID NO: 245885 - RNA, 22 nt, Homo sapiens
uccauuuguucagcuucaggaa

SEQ ID NO: 245886 - RNA, 19 nt, Homo sapiens
uccccaguuuuccguucag

SEQ ID NO: 245887 - RNA, 22 nt, Homo sapiens
ucgcagcucacuggagccucga

SEQ ID NO: 245888 - RNA, 22 nt, Homo sapiens
ucuuauuuggggaaaggguccu

SEQ ID NO: 245889 - RNA, 22 nt, Homo sapiens
ugaaaguuauauugugaaauuc

SEQ ID NO: 245890 - RNA, 22 nt, Homo sapiens
ugaaauuguuugcaaggauagg

SEQ ID NO: 245891 - RNA, 22 nt, Homo sapiens
ugaauagaaguggcaggaguag

SEQ ID NO: 245892 - RNA, 22 nt, Homo sapiens
ugaauagacacuaaagacugua

SEQ ID NO: 245893 - RNA, 22 nt, Homo sapiens
ugaauagagcugcaguggacau

SEQ ID NO: 245894 - RNA, 22 nt, Homo sapiens
ugaaugcauggggccaagaagg

SEQ ID NO: 245895 - RNA, 22 nt, Homo sapiens
ugaauguuguugguugagauau

SEQ ID NO: 245896 - RNA, 22 nt, Homo sapiens
ugagaugagaaucaguucuaau

SEQ ID NO: 245897 - RNA, 22 nt, Homo sapiens
ugagaugaguugcgcucugucg

SEQ ID NO: 245898 - RNA, 22 nt, Homo sapiens
ugauaagaaauuguucauguag

SEQ ID NO: 245899 - RNA, 17 nt, Homo sapiens
ugcaauuuaagcuagau

SEQ ID NO: 245900 - RNA, 22 nt, Homo sapiens
ugcaccaauucuaaacaguucu

SEQ ID NO: 245901 - RNA, 22 nt, Homo sapiens
ugcagagucuguccugccugcc

SEQ ID NO: 245902 - RNA, 21 nt, Homo sapiens
uggaaugaauggccaacaugg

SEQ ID NO: 245903 - RNA, 22 nt, Homo sapiens
uggcaagcuuuaauugacucuu

SEQ ID NO: 245904 - RNA, 19 nt, Homo sapiens
uggcuagaggccaggcguu

SEQ ID NO: 245905 - RNA, 22 nt, Homo sapiens
ugucaaaugcagugauauuuga

SEQ ID NO: 245906 - RNA, 22 nt, Homo sapiens
ugugaguguguacuaguuauca

SEQ ID NO: 245907 - RNA, 22 nt, Homo sapiens
ugugauaguuggcuaaagcagu

SEQ ID NO: 245908 - RNA, 22 nt, Homo sapiens
ugugaugaagaguccaagaaca

SEQ ID NO: 245909 - RNA, 22 nt, Homo sapiens
caguuguuuuaugacauaagau

SEQ ID NO: 245910 - RNA, 19 nt, Homo sapiens
caugccacugcacuugagu

SEQ ID NO: 245911 - RNA, 22 nt, Homo sapiens
cccagcguucggcauggcugag

SEQ ID NO: 245912 - RNA, 22 nt, Homo sapiens
cggaaugaaaauguccuucagu

SEQ ID NO: 245913 - RNA, 20 nt, Homo sapiens
cucacagacagcuucuuucu

SEQ ID NO: 245914 - RNA, 22 nt, Homo sapiens
cucauugcaaucucugccuccc

SEQ ID NO: 245915 - RNA, 19 nt, Homo sapiens
cugcaagguaauaggucag

SEQ ID NO: 245916 - RNA, 22 nt, Homo sapiens
cuggaaugcagcuuuaggggcu

SEQ ID NO: 245917 - RNA, 22 nt, Homo sapiens
cugggaucaguucuagucagaa

SEQ ID NO: 245918 - RNA, 22 nt, Homo sapiens
cuuggguaagucauuaaaauua

SEQ ID NO: 245919 - RNA, 22 nt, Homo sapiens
gaaagugcugcaaggccaugca

SEQ ID NO: 245920 - RNA, 22 nt, Homo sapiens
gaaagugcugcuugacugggau

SEQ ID NO: 245921 - RNA, 22 nt, Homo sapiens
gagauucuucaauauuuauucu

SEQ ID NO: 245922 - RNA, 22 nt, Homo sapiens
gauaaaucuuggcuagucuaag

SEQ ID NO: 245923 - RNA, 22 nt, Homo sapiens
gcccagcguucagggaggggcu

SEQ ID NO: 245924 - RNA, 22 nt, Homo sapiens
gcugcuguuuaguuucuccugg

SEQ ID NO: 245925 - RNA, 22 nt, Homo sapiens
ggaauauaaaaagccccagaau

SEQ ID NO: 245926 - RNA, 22 nt, Homo sapiens
ggaauuaaggcaauugaaagcu

SEQ ID NO: 245927 - RNA, 22 nt, Homo sapiens
ggcaccacagacgccaggcgug

SEQ ID NO: 245928 - RNA, 18 nt, Homo sapiens
guccauuuguugguacac

SEQ ID NO: 245929 - RNA, 22 nt, Homo sapiens
gugagcaaacuuaccuaagguu

SEQ ID NO: 245930 - RNA, 16 nt, Homo sapiens
gugcuguguuguuagg

SEQ ID NO: 245931 - RNA, 22 nt, Homo sapiens
guggaaugcaguguugauucaa

SEQ ID NO: 245932 - RNA, 22 nt, Homo sapiens
gugguaucauuuaaccauuaga

SEQ ID NO: 245933 - RNA, 22 nt, Homo sapiens
gugucaguggggagugaucuuc

SEQ ID NO: 245934 - RNA, 22 nt, Homo sapiens
guucaagcaauucugcugccuc

SEQ ID NO: 245935 - RNA, 22 nt, Homo sapiens
guugguauuacagaaauuaguu

SEQ ID NO: 245936 - RNA, 22 nt, Homo sapiens
uaacauagucauauacuugcuu

SEQ ID NO: 245937 - RNA, 22 nt, Homo sapiens
uaacccagugucugugaugggu

SEQ ID NO: 245938 - RNA, 18 nt, Homo sapiens
uaacuggugugagauggu

SEQ ID NO: 245939 - RNA, 23 nt, Homo sapiens
uaagucacacagauuaauuuauu

SEQ ID NO: 245940 - RNA, 20 nt, Homo sapiens
uaagugcuugagacuucuga

SEQ ID NO: 245941 - RNA, 18 nt, Homo sapiens
uaagugcuuuaaacacau

SEQ ID NO: 245942 - RNA, 20 nt, Homo sapiens
uaagugcuuuauauugauua

SEQ ID NO: 245943 - RNA, 22 nt, Homo sapiens
uaauugaaugcagacaccaggg

SEQ ID NO: 245944 - RNA, 22 nt, Homo sapiens
uacagucauaaugccuagugac

SEQ ID NO: 245945 - RNA, 22 nt, Homo sapiens
uagugcugagauugagaagccc

SEQ ID NO: 245946 - RNA, 22 nt, Homo sapiens
uagugcugugauaaacauauau

SEQ ID NO: 245947 - RNA, 22 nt, Homo sapiens
uauggguauuuuauacauaacc

SEQ ID NO: 245948 - RNA, 22 nt, Homo sapiens
ucaacagugggcacuguaaaug

SEQ ID NO: 245949 - RNA, 22 nt, Homo sapiens
ucagaguguuuuccaacuuggu

SEQ ID NO: 245950 - RNA, 22 nt, Homo sapiens
ucagcaaugaccuaagcaaaua

SEQ ID NO: 245951 - RNA, 22 nt, Homo sapiens
ucauugcaaucucugccucccg

SEQ ID NO: 245952 - RNA, 22 nt, Homo sapiens
caguacaauguugauuagaagu

SEQ ID NO: 245953 - RNA, 22 nt, Homo sapiens
cauggcccugggcugggcgaac

SEQ ID NO: 245954 - RNA, 22 nt, Homo sapiens
cccagugugcugggugacagcu

SEQ ID NO: 245955 - RNA, 22 nt, Homo sapiens
ccuugguaauguguuuuauucu

SEQ ID NO: 245956 - RNA, 22 nt, Homo sapiens
cuaauucuguaccuggcacaua

SEQ ID NO: 245957 - RNA, 18 nt, Homo sapiens
cuaugccacuuuauauca

SEQ ID NO: 245958 - RNA, 20 nt, Homo sapiens
cucaccagguguaggcugag

SEQ ID NO: 245959 - RNA, 22 nt, Homo sapiens
cugaauagucaacgauggacug

SEQ ID NO: 245960 - RNA, 22 nt, Homo sapiens
cugaccucugucaaagacaccc

SEQ ID NO: 245961 - RNA, 22 nt, Homo sapiens
cugagguuguucuucucagugg

SEQ ID NO: 245962 - RNA, 22 nt, Homo sapiens
cugucucagccucuccaguagc

SEQ ID NO: 245963 - RNA, 22 nt, Homo sapiens
cugugccaagcuugcgaugugc

SEQ ID NO: 245964 - RNA, 21 nt, Homo sapiens
cuugucuugcuuagaauagac

SEQ ID NO: 245965 - RNA, 20 nt, Homo sapiens
cuuuggcaaugagaacaggg

SEQ ID NO: 245966 - RNA, 22 nt, Homo sapiens
gaaggugcuuggugaaugcauu

SEQ ID NO: 245967 - RNA, 22 nt, Homo sapiens
gacaguuucucaggcuuccuua

SEQ ID NO: 245968 - RNA, 22 nt, Homo sapiens
gagcugaauugcugccauuugc

SEQ ID NO: 245969 - RNA, 22 nt, Homo sapiens
gaggugaaggucucaauaaaua

SEQ ID NO: 245970 - RNA, 22 nt, Homo sapiens
gaguaacagcauaaauuuguga

SEQ ID NO: 245971 - RNA, 22 nt, Homo sapiens
gagugcugagcccacuuccuug

SEQ ID NO: 245972 - RNA, 22 nt, Homo sapiens
gaguggugguucugaaacuuuu

SEQ ID NO: 245973 - RNA, 21 nt, Homo sapiens
gcaaaguggcuaccuugcucc

SEQ ID NO: 245974 - RNA, 22 nt, Homo sapiens
gcaaaguguuuuccaacuuggu

SEQ ID NO: 245975 - RNA, 22 nt, Homo sapiens
gcacuacugcacuccagucuag

SEQ ID NO: 245976 - RNA, 22 nt, Homo sapiens
gcuggaauuaacauagaugugc

SEQ ID NO: 245977 - RNA, 22 nt, Homo sapiens
ggaagguaauuggcuaaugaga

SEQ ID NO: 245978 - RNA, 22 nt, Homo sapiens
guauuaguuaucuacugcugug

SEQ ID NO: 245979 - RNA, 22 nt, Homo sapiens
guauuaguuuccuguugcugcu

SEQ ID NO: 245980 - RNA, 22 nt, Homo sapiens
gucagugcuuuaguucaggaug

SEQ ID NO: 245981 - RNA, 22 nt, Homo sapiens
gugaaagacauauaugguuuga

SEQ ID NO: 245982 - RNA, 22 nt, Homo sapiens
gugacauuauuucagcuacaug

SEQ ID NO: 245983 - RNA, 22 nt, Homo sapiens
gugccacaguguuaagggauuc

SEQ ID NO: 245984 - RNA, 22 nt, Homo sapiens
guggaauuauagagacaucuug

SEQ ID NO: 245985 - RNA, 22 nt, Homo sapiens
uaaagcuuggauuuaggcuaau

SEQ ID NO: 245986 - RNA, 22 nt, Homo sapiens
uaaagugcugagaugaggcugg

SEQ ID NO: 245987 - RNA, 22 nt, Homo sapiens
uaagugcaugauuacaugcaua

SEQ ID NO: 245988 - RNA, 22 nt, Homo sapiens
uaagugcuguguuguuaccuaa

SEQ ID NO: 245989 - RNA, 20 nt, Homo sapiens
uaagugcuugaugaaugaac

SEQ ID NO: 245990 - RNA, 19 nt, Homo sapiens
uaaugccacugccuggcau

SEQ ID NO: 245991 - RNA, 22 nt, Homo sapiens
uacaguacagugacaccauuau

SEQ ID NO: 245992 - RNA, 22 nt, Homo sapiens
uaggugaaugcuggaagaaaug

SEQ ID NO: 245993 - RNA, 22 nt, Homo sapiens
uagucacacacucaacuuuuca

SEQ ID NO: 245994 - RNA, 22 nt, Homo sapiens
uagugcugugauuaacauaaug

SEQ ID NO: 245995 - RNA, 20 nt, Homo sapiens
uauaacaguuuggacccagu

SEQ ID NO: 245996 - RNA, 22 nt, Homo sapiens
uauugauuuucaguguucagcu

SEQ ID NO: 245997 - RNA, 22 nt, Homo sapiens
ucaagcaauucgccugucucag

SEQ ID NO: 245998 - RNA, 19 nt, Homo sapiens
ucaagcuauucuccugccu

SEQ ID NO: 245999 - RNA, 16 nt, Homo sapiens
ucaccccuagagaucc

SEQ ID NO: 246000 - RNA, 22 nt, Homo sapiens
ucacccugacaugcggccgaac

SEQ ID NO: 246001 - RNA, 22 nt, Homo sapiens
ucacuauugacaacagugugga

SEQ ID NO: 246002 - RNA, 22 nt, Homo sapiens
ucagagugcagggaguagcagc

SEQ ID NO: 246003 - RNA, 21 nt, Homo sapiens
ucagcucaucacugccuggag

SEQ ID NO: 246004 - RNA, 22 nt, Homo sapiens
ucaguuuagguguaacggccac

SEQ ID NO: 246005 - RNA, 22 nt, Homo sapiens
ucuccauuguccagaugaggaa

SEQ ID NO: 246006 - RNA, 22 nt, Homo sapiens
ugaaaaguuguugaaggcuuca

SEQ ID NO: 246007 - RNA, 22 nt, Homo sapiens
ugaaaucauguaguuauugcaa

SEQ ID NO: 246008 - RNA, 22 nt, Homo sapiens
ugaauagaaguuuacuccuuuu

SEQ ID NO: 246009 - RNA, 22 nt, Homo sapiens
ugaauagacagucacugccucc

SEQ ID NO: 246010 - RNA, 19 nt, Homo sapiens
ugagaugaagacagggguu

SEQ ID NO: 246011 - RNA, 22 nt, Homo sapiens
agagaucaauaugaaggaaaug

SEQ ID NO: 246012 - RNA, 22 nt, Homo sapiens
agaucauaugcaguaaugaacu

SEQ ID NO: 246013 - RNA, 22 nt, Homo sapiens
agcacauuaguaucuaagaaca

SEQ ID NO: 246014 - RNA, 22 nt, Homo sapiens
agcaccacaauuuccugccuaa

SEQ ID NO: 246015 - RNA, 22 nt, Homo sapiens
agccuucauucugacaguagga

SEQ ID NO: 246016 - RNA, 22 nt, Homo sapiens
agcuccuuucugcagguagguu

SEQ ID NO: 246017 - RNA, 22 nt, Homo sapiens
agcuccuuugcuuuuuccagga

SEQ ID NO: 246018 - RNA, 22 nt, Homo sapiens
agguauguaugucuguacagcg

SEQ ID NO: 246019 - RNA, 22 nt, Homo sapiens
aggugaaugcucacauucuaau

SEQ ID NO: 246020 - RNA, 22 nt, Homo sapiens
aggugaauggauaaacuguggg

SEQ ID NO: 246021 - RNA, 22 nt, Homo sapiens
aguggugucugaguggccaggg

SEQ ID NO: 246022 - RNA, 22 nt, Homo sapiens
auaaagcuauuccucucuuuuu

SEQ ID NO: 246023 - RNA, 22 nt, Homo sapiens
auaaaugcuuccagucauuaaa

SEQ ID NO: 246024 - RNA, 22 nt, Homo sapiens
auagugcugcaauaaacacacg

SEQ ID NO: 246025 - RNA, 22 nt, Homo sapiens
augaaauugcuaucgcaguacu

SEQ ID NO: 246026 - RNA, 22 nt, Homo sapiens
augaucuagaguaggaaacaga

SEQ ID NO: 246027 - RNA, 22 nt, Homo sapiens
augcaaaucuuaaguaugugug

SEQ ID NO: 246028 - RNA, 19 nt, Homo sapiens
augccuggagaugguuaua

SEQ ID NO: 246029 - RNA, 22 nt, Homo sapiens
augcuaucauucaggauuuguu

SEQ ID NO: 246030 - RNA, 22 nt, Homo sapiens
auggaauguaaguuauguuugc

SEQ ID NO: 246031 - RNA, 22 nt, Homo sapiens
auggaauguauagucauguagg

SEQ ID NO: 246032 - RNA, 22 nt, Homo sapiens
auuauuagucggccagcuguua

SEQ ID NO: 246033 - RNA, 22 nt, Homo sapiens
auucccuuagcugccucagccu

SEQ ID NO: 246034 - RNA, 22 nt, Homo sapiens
auucccuuggucaacggaugca

SEQ ID NO: 246035 - RNA, 22 nt, Homo sapiens
auugaacacagaguagcuuucc

SEQ ID NO: 246036 - RNA, 22 nt, Homo sapiens
auugcaacuuccgccuccuggg

SEQ ID NO: 246037 - RNA, 22 nt, Homo sapiens
caagugcucuaggauccugagu

SEQ ID NO: 246038 - RNA, 20 nt, Homo sapiens
cagcacgcacaugagacugu

SEQ ID NO: 246039 - RNA, 22 nt, Homo sapiens
cagcugguguuacaaaccagag

SEQ ID NO: 246040 - RNA, 22 nt, Homo sapiens
caguacaauguggaaaaggagu

SEQ ID NO: 246041 - RNA, 22 nt, Homo sapiens
uccccaguaggcaauuaacacc

SEQ ID NO: 246042 - RNA, 20 nt, Homo sapiens
ucccucaaacuuuuccacug

SEQ ID NO: 246043 - RNA, 22 nt, Homo sapiens
uccucauggagaaccucugcua

SEQ ID NO: 246044 - RNA, 22 nt, Homo sapiens
ucuggagugugaaguggauaug

SEQ ID NO: 246045 - RNA, 22 nt, Homo sapiens
ucuggcuuauuucacuuagcau

SEQ ID NO: 246046 - RNA, 22 nt, Homo sapiens
ucuuagguaagaaauuuuaaca

SEQ ID NO: 246047 - RNA, 22 nt, Homo sapiens
ucuucaugcuugaaauaauagc

SEQ ID NO: 246048 - RNA, 22 nt, Homo sapiens
ucuugguaaugucacauuuccu

SEQ ID NO: 246049 - RNA, 21 nt, Homo sapiens
ugaaaugcaugugcacauuaa

SEQ ID NO: 246050 - RNA, 22 nt, Homo sapiens
ugaagggcauuguuuugccaaa

SEQ ID NO: 246051 - RNA, 18 nt, Homo sapiens
ugaauacagcguugggaa

SEQ ID NO: 246052 - RNA, 22 nt, Homo sapiens
ugaauucuguccaaaauaacug

SEQ ID NO: 246053 - RNA, 22 nt, Homo sapiens
ugagaugaacuugauuguuuua

SEQ ID NO: 246054 - RNA, 22 nt, Homo sapiens
ugagaugagagaaugcuugccu

SEQ ID NO: 246055 - RNA, 22 nt, Homo sapiens
ugagaugagucucgcucuguca

SEQ ID NO: 246056 - RNA, 20 nt, Homo sapiens
ugagcucaauuguugcaagu

SEQ ID NO: 246057 - RNA, 22 nt, Homo sapiens
ugagcuguuugaagaagcauuu

SEQ ID NO: 246058 - RNA, 20 nt, Homo sapiens
ugaugcaaaucuuuaaaagu

SEQ ID NO: 246059 - RNA, 17 nt, Homo sapiens
ugcauaggcaggcucag

SEQ ID NO: 246060 - RNA, 22 nt, Homo sapiens
ugccuuuguucuggaaugggaa

SEQ ID NO: 246061 - RNA, 22 nt, Homo sapiens
uggagucuugaugauuuucaaa

SEQ ID NO: 246062 - RNA, 22 nt, Homo sapiens
ugggaugaugaaaaggcuuucu

SEQ ID NO: 246063 - RNA, 22 nt, Homo sapiens
uguaaugaucaaaucagaguaa

SEQ ID NO: 246064 - RNA, 22 nt, Homo sapiens
ugugagaaaugcagaaucucag

SEQ ID NO: 246065 - RNA, 22 nt, Homo sapiens
uuacaugucuugguaagguuag

SEQ ID NO: 246066 - RNA, 22 nt, Homo sapiens
uuaugguuuucucucacgcagg

SEQ ID NO: 246067 - RNA, 18 nt, Homo sapiens
uucauaguagcaugauuu

SEQ ID NO: 246068 - RNA, 19 nt, Homo sapiens
uuccuagugguugggaagu

SEQ ID NO: 246069 - RNA, 22 nt, Homo sapiens
uucuagcacuuugggagacuga

SEQ ID NO: 246070 - RNA, 22 nt, Homo sapiens
uucuggcucaggucaacacuuc

SEQ ID NO: 246071 - RNA, 22 nt, Homo sapiens
uucuugguguaguaguugaaaa

SEQ ID NO: 246072 - RNA, 22 nt, Homo sapiens
uugaauagaaguguugaaagug

SEQ ID NO: 246073 - RNA, 22 nt, Homo sapiens
uugauguugaggacauaaaccu

SEQ ID NO: 246074 - RNA, 22 nt, Homo sapiens
uugcacauugauuuuguauccu

SEQ ID NO: 246075 - RNA, 22 nt, Homo sapiens
uugcacauugauuuuguaucuu

SEQ ID NO: 246076 - RNA, 22 nt, Homo sapiens
uugcugagucuuucuagguugc

SEQ ID NO: 246077 - RNA, 22 nt, Homo sapiens
uuggaaagagguguuuaugacu

SEQ ID NO: 246078 - RNA, 22 nt, Homo sapiens
uuggaaugcaacagaaggauaa

SEQ ID NO: 246079 - RNA, 22 nt, Homo sapiens
uuggaaugcacacugagccugc

SEQ ID NO: 246080 - RNA, 21 nt, Homo sapiens
uuggcacucuucucuccuuau

SEQ ID NO: 246081 - RNA, 22 nt, Homo sapiens
uuggcacugggaaaaugaccac

SEQ ID NO: 246082 - RNA, 22 nt, Homo sapiens
uugggacuggaaggaguaaggg

SEQ ID NO: 246083 - RNA, 21 nt, Homo sapiens
uugucuagagaaauauaucuc

SEQ ID NO: 246084 - RNA, 22 nt, Homo sapiens
uuuagcaaugcuguggggaagu

SEQ ID NO: 246085 - RNA, 22 nt, Homo sapiens
uuucaccguguuggccaggcug

SEQ ID NO: 246086 - RNA, 19 nt, Homo sapiens
uuucauguuuuuggugaga

SEQ ID NO: 246087 - RNA, 22 nt, Homo sapiens
uuucccuuuagcuuagugauuu

SEQ ID NO: 246088 - RNA, 22 nt, Homo sapiens
aaacaccacgcggucccucgga

SEQ ID NO: 246089 - RNA, 22 nt, Homo sapiens
aaagcgcuguuaagaagacuga

SEQ ID NO: 246090 - RNA, 22 nt, Homo sapiens
aaagugcugagacagacuggga

SEQ ID NO: 246091 - RNA, 22 nt, Homo sapiens
aaagugcugggauuggccgggc

SEQ ID NO: 246092 - RNA, 22 nt, Homo sapiens
aaauccauuuguucagcuaugc

SEQ ID NO: 246093 - RNA, 22 nt, Homo sapiens
aacagaauccucuuuuccuggg

SEQ ID NO: 246094 - RNA, 22 nt, Homo sapiens
aacugcucuuaccagauggguc

SEQ ID NO: 246095 - RNA, 22 nt, Homo sapiens
aagcagauguguugaaaguacu

SEQ ID NO: 246096 - RNA, 22 nt, Homo sapiens
aagucaaggagagaggcgucag

SEQ ID NO: 246097 - RNA, 22 nt, Homo sapiens
aagugccauguggaugggcccu

SEQ ID NO: 246098 - RNA, 22 nt, Homo sapiens
aagugcucuugugggaagagag

SEQ ID NO: 246099 - RNA, 22 nt, Homo sapiens
aagugguguuugggagcuggac

SEQ ID NO: 246100 - RNA, 22 nt, Homo sapiens
aagugucuuaccgggagggagu

SEQ ID NO: 246101 - RNA, 22 nt, Homo sapiens
aauauugucaaaauggauucca

SEQ ID NO: 246102 - RNA, 22 nt, Homo sapiens
aaugccacugugccugccaagg

SEQ ID NO: 246103 - RNA, 22 nt, Homo sapiens
aauugaaugcagaugccaggga

SEQ ID NO: 246104 - RNA, 20 nt, Homo sapiens
acaguagaagggauuucaaa

SEQ ID NO: 246105 - RNA, 22 nt, Homo sapiens
agaauguaaacagaauagagga

SEQ ID NO: 246106 - RNA, 22 nt, Homo sapiens
agaauguaacucuaugaaggca

SEQ ID NO: 246107 - RNA, 18 nt, Homo sapiens
agaugguguugcuucugu

SEQ ID NO: 246108 - RNA, 23 nt, Homo sapiens
agcaccuuuccuccacuaucugc

SEQ ID NO: 246109 - RNA, 22 nt, Homo sapiens
agccgguguccacgaagaagag

SEQ ID NO: 246110 - RNA, 22 nt, Homo sapiens
agguaauagcacaugauaccuu

SEQ ID NO: 246111 - RNA, 17 nt, Homo sapiens
agucaguaguuuguauu

SEQ ID NO: 246112 - RNA, 19 nt, Homo sapiens
auaaaugccuacaagggug

SEQ ID NO: 246113 - RNA, 22 nt, Homo sapiens
aucaagcugcuuguuugaaucu

SEQ ID NO: 246114 - RNA, 22 nt, Homo sapiens
aucacugggcaagauaucauga

SEQ ID NO: 246115 - RNA, 22 nt, Homo sapiens
augaaaucuuuggcagaucuua

SEQ ID NO: 246116 - RNA, 22 nt, Homo sapiens
augaacagagccuugagaaccu

SEQ ID NO: 246117 - RNA, 22 nt, Homo sapiens
augacagagauaugugaauuuu

SEQ ID NO: 246118 - RNA, 22 nt, Homo sapiens
augaugaaguaagugcuuagga

SEQ ID NO: 246119 - RNA, 19 nt, Homo sapiens
augccacagugaggucaga

SEQ ID NO: 246120 - RNA, 22 nt, Homo sapiens
auggaaugccauuuauaaugga

SEQ ID NO: 246121 - RNA, 22 nt, Homo sapiens
augugcaauguguacguagccc

SEQ ID NO: 246122 - RNA, 22 nt, Homo sapiens
augugguaguuauagugauaag

SEQ ID NO: 246123 - RNA, 22 nt, Homo sapiens
auguuguaguaugagucaaaau

SEQ ID NO: 246124 - RNA, 22 nt, Homo sapiens
auuaacaucuagaguuuuggug

SEQ ID NO: 246125 - RNA, 23 nt, Homo sapiens
auuaagguuacuacaguaugagg

SEQ ID NO: 246126 - RNA, 22 nt, Homo sapiens
auugaauuugguuugcuaagaa

SEQ ID NO: 246127 - RNA, 22 nt, Homo sapiens
auuugguguuguuuggagccua

SEQ ID NO: 246128 - RNA, 22 nt, Homo sapiens
caaaggugcuuuccagguccaa

SEQ ID NO: 246129 - RNA, 22 nt, Homo sapiens
caaagugcugggaugggccagg

SEQ ID NO: 246130 - RNA, 22 nt, Homo sapiens
caccaggugcccagcacggcca

SEQ ID NO: 246131 - RNA, 22 nt, Homo sapiens
cacucaguuugugguacuuugu

SEQ ID NO: 246132 - RNA, 22 nt, Homo sapiens
cagagugcauguuuagaugagu

SEQ ID NO: 246133 - RNA, 22 nt, Homo sapiens
cagcagguuuuuaucaguuaag

SEQ ID NO: 246134 - RNA, 22 nt, Homo sapiens
cauaaaucuuguugaauagcac

SEQ ID NO: 246135 - RNA, 22 nt, Homo sapiens
caugccacugcacuccaaccug

SEQ ID NO: 246136 - RNA, 22 nt, Homo sapiens
caugccacuguggacaaagaca

SEQ ID NO: 246137 - RNA, 22 nt, Homo sapiens
ccacccuuccauucuuccucuu

SEQ ID NO: 246138 - RNA, 21 nt, Homo sapiens
ccagugguuggaaacuauggg

SEQ ID NO: 246139 - RNA, 22 nt, Homo sapiens
ccccauguucucucugcagcuc

SEQ ID NO: 246140 - RNA, 22 nt, Homo sapiens
cuauaacagugugguuuggaga

SEQ ID NO: 246141 - RNA, 22 nt, Homo sapiens
cuccauuuaguccuuuuagaag

SEQ ID NO: 246142 - RNA, 22 nt, Homo sapiens
cuccauuuaucugaaauuuuau

SEQ ID NO: 246143 - RNA, 22 nt, Homo sapiens
cuggaaugugagccccaaaaag

SEQ ID NO: 246144 - RNA, 22 nt, Homo sapiens
guacauggaaugaaauucaaaa

SEQ ID NO: 246145 - RNA, 22 nt, Homo sapiens
guagaaaguuugcugucacaug

SEQ ID NO: 246146 - RNA, 22 nt, Homo sapiens
gucacugugacggcaguuacau

SEQ ID NO: 246147 - RNA, 22 nt, Homo sapiens
gucauauaggguuuaccuguau

SEQ ID NO: 246148 - RNA, 20 nt, Homo sapiens
guccauuugcugccauugcu

SEQ ID NO: 246149 - RNA, 21 nt, Homo sapiens
gugaucaugucacugcacucc

SEQ ID NO: 246150 - RNA, 22 nt, Homo sapiens
gugcaaaucucugaguaucuuu

SEQ ID NO: 246151 - RNA, 22 nt, Homo sapiens
gugcaaauguuauugagguuuu

SEQ ID NO: 246152 - RNA, 22 nt, Homo sapiens
guggaaugauaucucauugugg

SEQ ID NO: 246153 - RNA, 22 nt, Homo sapiens
guguaaaucugcugugaacauu

SEQ ID NO: 246154 - RNA, 22 nt, Homo sapiens
guugcugagucccaucaccaga

SEQ ID NO: 246155 - RNA, 22 nt, Homo sapiens
uaacuacuucugcuucagagua

SEQ ID NO: 246156 - RNA, 22 nt, Homo sapiens
uaagccaccgugccuggccuaa

SEQ ID NO: 246157 - RNA, 22 nt, Homo sapiens
uaaguucauucaugaaacuuag

SEQ ID NO: 246158 - RNA, 18 nt, Homo sapiens
uaauaacugugaccuuga

SEQ ID NO: 246159 - RNA, 22 nt, Homo sapiens
uacccuuuaguauaaaaucaga

SEQ ID NO: 246160 - RNA, 22 nt, Homo sapiens
uacgccuguaauaucagcauuu

SEQ ID NO: 246161 - RNA, 22 nt, Homo sapiens
uagauuaucccugauuugucca

SEQ ID NO: 246162 - RNA, 22 nt, Homo sapiens
uaggugaauguaguaagguguu

SEQ ID NO: 246163 - RNA, 21 nt, Homo sapiens
uagugcugaggcaguauggga

SEQ ID NO: 246164 - RNA, 22 nt, Homo sapiens
uauaaccauuucuucucucuuc

SEQ ID NO: 246165 - RNA, 22 nt, Homo sapiens
uauggccacugucuuugaguca

SEQ ID NO: 246166 - RNA, 22 nt, Homo sapiens
uauugauuaauugugauuaggc

SEQ ID NO: 246167 - RNA, 22 nt, Homo sapiens
uauugcuuuacucucuuauccu

SEQ ID NO: 246168 - RNA, 22 nt, Homo sapiens
uauugcuuuuaacccaaucucu

SEQ ID NO: 246169 - RNA, 22 nt, Homo sapiens
ucaagcaauucugcugccucag

SEQ ID NO: 246170 - RNA, 19 nt, Homo sapiens
ucacacuguggcuucuuua

SEQ ID NO: 246171 - RNA, 22 nt, Homo sapiens
ucacugaaaccacugccuccug

SEQ ID NO: 246172 - RNA, 22 nt, Homo sapiens
ucacugcgaccucugccucccg

SEQ ID NO: 246173 - RNA, 23 nt, Homo sapiens
ucgcagcauucaauaccaggcag

SEQ ID NO: 246174 - RNA, 21 nt, Homo sapiens
ucuugguauguauuuaggagg

SEQ ID NO: 246175 - RNA, 22 nt, Homo sapiens
ucuuugauguucugaaagaugg

SEQ ID NO: 246176 - RNA, 22 nt, Homo sapiens
ugaaagguauagguucuggagg

SEQ ID NO: 246177 - RNA, 22 nt, Homo sapiens
ugaaagguuuaauucugugaga

SEQ ID NO: 246178 - RNA, 22 nt, Homo sapiens
ugaauacagcacacccaugggu

SEQ ID NO: 246179 - RNA, 22 nt, Homo sapiens
ugaauauagacagggguagaga

SEQ ID NO: 246180 - RNA, 22 nt, Homo sapiens
ugaaugauuuuaaaagccucuc

SEQ ID NO: 246181 - RNA, 22 nt, Homo sapiens
ugagugaaagaagcacuaagga

SEQ ID NO: 246182 - RNA, 19 nt, Homo sapiens
uggaaugaaauguuagggg

SEQ ID NO: 246183 - RNA, 22 nt, Homo sapiens
uggaguguagaagccagccucc

SEQ ID NO: 246184 - RNA, 22 nt, Homo sapiens
uggcuagaugagauguacugca

SEQ ID NO: 246185 - RNA, 22 nt, Homo sapiens
uggguaauggagaaauaaaucu

SEQ ID NO: 246186 - RNA, 18 nt, Homo sapiens
ugucagaguggauuguaa

SEQ ID NO: 246187 - RNA, 17 nt, Homo sapiens
ugugaucaucacccuug

SEQ ID NO: 246188 - RNA, 22 nt, Homo sapiens
ugugccaaaucccauaauaaau

SEQ ID NO: 246189 - RNA, 22 nt, Homo sapiens
ugugcugaucgggcacgguguc

SEQ ID NO: 246190 - RNA, 22 nt, Homo sapiens
uuagguauuaggaaauaugcuu

SEQ ID NO: 246191 - RNA, 22 nt, Homo sapiens
uuagucaaguguacugugaaug

SEQ ID NO: 246192 - RNA, 22 nt, Homo sapiens
uucauagugaaaaauucaaagu

SEQ ID NO: 246193 - RNA, 22 nt, Homo sapiens
uucauaguucuuuuagucauua

SEQ ID NO: 246194 - RNA, 22 nt, Homo sapiens
uucccuuugaauuggaaaggug

SEQ ID NO: 246195 - RNA, 22 nt, Homo sapiens
uugaauagugacuuugauucug

SEQ ID NO: 246196 - RNA, 22 nt, Homo sapiens
uugcuccucugccaggaccugu

SEQ ID NO: 246197 - RNA, 23 nt, Homo sapiens
uuggaaugagaccuaagaguuuu

SEQ ID NO: 246198 - RNA, 22 nt, Homo sapiens
uuggaauguauggcaucuugcg

SEQ ID NO: 246199 - RNA, 22 nt, Homo sapiens
uuggaaugugacugauaauauu

SEQ ID NO: 246200 - RNA, 22 nt, Homo sapiens
uuggcaauauuuacugaaguug

SEQ ID NO: 246201 - RNA, 22 nt, Homo sapiens
uugugaucauugucaaauagug

SEQ ID NO: 246202 - RNA, 19 nt, Homo sapiens
uuuagaucuuuuaugcagc

SEQ ID NO: 246203 - RNA, 18 nt, Homo sapiens
uuucaggguggacaugag

SEQ ID NO: 246204 - RNA, 22 nt, Homo sapiens
uuucauggaauauagucauuuu

SEQ ID NO: 246205 - RNA, 22 nt, Homo sapiens
uuucccuuugcuuugucagcca

SEQ ID NO: 246206 - RNA, 22 nt, Homo sapiens
uuuggcacuauagguaaauuug

SEQ ID NO: 246207 - RNA, 22 nt, Homo sapiens
uugcaaaucucuuguguuuggu

SEQ ID NO: 246208 - RNA, 22 nt, Homo sapiens
uuggcacuugauaauauucugg

SEQ ID NO: 246209 - RNA, 22 nt, Homo sapiens
uuggccccuuucauccacagcu

SEQ ID NO: 246210 - RNA, 22 nt, Homo sapiens
uuuagguaauauuaaguagcug

SEQ ID NO: 246211 - RNA, 22 nt, Homo sapiens
uuuucaguggccauaguggaga

SEQ ID NO: 246212 - RNA, 22 nt, Homo sapiens
uuuucaguuuuccagguagccg

SEQ ID NO: 246213 - RNA, 22 nt, Homo sapiens
aaagugcuguagacugggcgca

SEQ ID NO: 246214 - RNA, 22 nt, Homo sapiens
aacaccaucccuuugaugcuuu

SEQ ID NO: 246215 - RNA, 22 nt, Homo sapiens
aacugcucuaauguggugggag

SEQ ID NO: 246216 - RNA, 22 nt, Homo sapiens
aagaugauguucuuuuucuuag

SEQ ID NO: 246217 - RNA, 22 nt, Homo sapiens
aagugacuagacuaugaaaccu

SEQ ID NO: 246218 - RNA, 22 nt, Homo sapiens
aagugcuggccuacucaaucga

SEQ ID NO: 246219 - RNA, 22 nt, Homo sapiens
aagugcugggauuggccgggca

SEQ ID NO: 246220 - RNA, 22 nt, Homo sapiens
aagugcuguaugggagccuagg

SEQ ID NO: 246221 - RNA, 22 nt, Homo sapiens
aagugcuuuguacagggguuga

SEQ ID NO: 246222 - RNA, 22 nt, Homo sapiens
aauauguccuugaaauggugcu

SEQ ID NO: 246223 - RNA, 22 nt, Homo sapiens
aaugcacauauauuuccuuauu

SEQ ID NO: 246224 - RNA, 22 nt, Homo sapiens
aauugaaucaugugggcagacu

SEQ ID NO: 246225 - RNA, 22 nt, Homo sapiens
acaguguguguguucaccuaga

SEQ ID NO: 246226 - RNA, 22 nt, Homo sapiens
acauccauuugcuuuauuugcu

SEQ ID NO: 246227 - RNA, 22 nt, Homo sapiens
accaccacucccgcauucuaaa

SEQ ID NO: 246228 - RNA, 22 nt, Homo sapiens
agaaugauccuucucagaggca

SEQ ID NO: 246229 - RNA, 22 nt, Homo sapiens
agagauaaagauuuuaauuuug

SEQ ID NO: 246230 - RNA, 22 nt, Homo sapiens
agagauaauuagguuaaaugag

SEQ ID NO: 246231 - RNA, 22 nt, Homo sapiens
agagaucacugaaucacggggg

SEQ ID NO: 246232 - RNA, 22 nt, Homo sapiens
agagugcuaaggaaguaauuua

SEQ ID NO: 246233 - RNA, 22 nt, Homo sapiens
agcaacauagaaauuugggugg

SEQ ID NO: 246234 - RNA, 22 nt, Homo sapiens
agcaguguggccuuagacccgg

SEQ ID NO: 246235 - RNA, 22 nt, Homo sapiens
agugauuuuaacuuccagcaau

SEQ ID NO: 246236 - RNA, 22 nt, Homo sapiens
auagcaggagaauggucauggg

SEQ ID NO: 246237 - RNA, 22 nt, Homo sapiens
auagugcugcaaugaacauaca

SEQ ID NO: 246238 - RNA, 22 nt, Homo sapiens
auaucaacaugguaggguuggu

SEQ ID NO: 246239 - RNA, 22 nt, Homo sapiens
auaucccagugaugauugauag

SEQ ID NO: 246240 - RNA, 22 nt, Homo sapiens
auauuguacugcuacugguucu

SEQ ID NO: 246241 - RNA, 22 nt, Homo sapiens
augaagaucaugaagacggcuu

SEQ ID NO: 246242 - RNA, 22 nt, Homo sapiens
augaccauuucaauugauaugg

SEQ ID NO: 246243 - RNA, 22 nt, Homo sapiens
augagcuaauauggguaaguug

SEQ ID NO: 246244 - RNA, 22 nt, Homo sapiens
augagcuaguguaggguacuga

SEQ ID NO: 246245 - RNA, 22 nt, Homo sapiens
augauccagugaguuucaguuc

SEQ ID NO: 246246 - RNA, 22 nt, Homo sapiens
augccacagaaauaaccaaaau

SEQ ID NO: 246247 - RNA, 22 nt, Homo sapiens
auggaauggcacuuugaagauu

SEQ ID NO: 246248 - RNA, 22 nt, Homo sapiens
auggaauguggaaugguaagua

SEQ ID NO: 246249 - RNA, 22 nt, Homo sapiens
auggcccccuguuugugaacau

SEQ ID NO: 246250 - RNA, 20 nt, Homo sapiens
augucagaguguggguacgg

SEQ ID NO: 246251 - RNA, 22 nt, Homo sapiens
augugugaaucccagaaccugu

SEQ ID NO: 246252 - RNA, 22 nt, Homo sapiens
auugaacaugccauauguacca

SEQ ID NO: 246253 - RNA, 22 nt, Homo sapiens
caaagugcugggacuggccggg

SEQ ID NO: 246254 - RNA, 22 nt, Homo sapiens
caagugcuacagagaaaucuuu

SEQ ID NO: 246255 - RNA, 22 nt, Homo sapiens
caagugcuuucuuggggauuua

SEQ ID NO: 246256 - RNA, 22 nt, Homo sapiens
cuggaauguuccuaaagauuca

SEQ ID NO: 246257 - RNA, 18 nt, Homo sapiens
gaaaugccucuugcuuac

SEQ ID NO: 246258 - RNA, 22 nt, Homo sapiens
gaagugcuuuuggacuaacagu

SEQ ID NO: 246259 - RNA, 22 nt, Homo sapiens
gagaugaaaucuugcucuguca

SEQ ID NO: 246260 - RNA, 22 nt, Homo sapiens
gagcucaccuuaccucuggagc

SEQ ID NO: 246261 - RNA, 22 nt, Homo sapiens
gauauguucugagaaaugcauu

SEQ ID NO: 246262 - RNA, 22 nt, Homo sapiens
gcacaguguuacuugauauauu

SEQ ID NO: 246263 - RNA, 22 nt, Homo sapiens
gccccaguacaggcuccuuaga

SEQ ID NO: 246264 - RNA, 22 nt, Homo sapiens
ggaaagauguaauauuaucuaa

SEQ ID NO: 246265 - RNA, 22 nt, Homo sapiens
ggaauauaaaacuuuugacagg

SEQ ID NO: 246266 - RNA, 22 nt, Homo sapiens
gggaaugaagagaaccuuccca

SEQ ID NO: 246267 - RNA, 22 nt, Homo sapiens
gguaucuuggagagagaaguga

SEQ ID NO: 246268 - RNA, 22 nt, Homo sapiens
ggugagcacagaaugcccugag

SEQ ID NO: 246269 - RNA, 22 nt, Homo sapiens
guaauagucucaaacuccugga

SEQ ID NO: 246270 - RNA, 16 nt, Homo sapiens
uuucccuuugguguuu

SEQ ID NO: 246271 - RNA, 22 nt, Homo sapiens
uuaaaaguauaggccuggcaua

SEQ ID NO: 246272 - RNA, 22 nt, Homo sapiens
uuaagcuaguuuauucaggaaa

SEQ ID NO: 246273 - RNA, 22 nt, Homo sapiens
uuaauagugacucauuuuccac

SEQ ID NO: 246274 - RNA, 22 nt, Homo sapiens
uuaucauagugcaguuuucuga

SEQ ID NO: 246275 - RNA, 22 nt, Homo sapiens
uuauccugucaguaaauauuuu

SEQ ID NO: 246276 - RNA, 22 nt, Homo sapiens
uucaagauggccccagugagcc

SEQ ID NO: 246277 - RNA, 22 nt, Homo sapiens
uucauagucuaugcaaguaaga

SEQ ID NO: 246278 - RNA, 22 nt, Homo sapiens
uuccauuuguucggugucgcca

SEQ ID NO: 246279 - RNA, 22 nt, Homo sapiens
uuccuaguccugagucucugcg

SEQ ID NO: 246280 - RNA, 22 nt, Homo sapiens
uugaacuagaaccugcaaauuu

SEQ ID NO: 246281 - RNA, 18 nt, Homo sapiens
uugaauaguguccaaucu

SEQ ID NO: 246282 - RNA, 18 nt, Homo sapiens
uugaaugcgucccagaga

SEQ ID NO: 246283 - RNA, 23 nt, Homo sapiens
uugaauguuuccccucccaaauu

SEQ ID NO: 246284 - RNA, 22 nt, Homo sapiens
uugagcaacauagugagacugu

SEQ ID NO: 246285 - RNA, 22 nt, Homo sapiens
uuggaauguacucuagccuaug

SEQ ID NO: 246286 - RNA, 22 nt, Homo sapiens
uuggcacugagcaagaacaggg

SEQ ID NO: 246287 - RNA, 22 nt, Homo sapiens
uuuagcaauucauuuugugucu

SEQ ID NO: 246288 - RNA, 22 nt, Homo sapiens
uuuagguauuugguauagcagu

SEQ ID NO: 246289 - RNA, 22 nt, Homo sapiens
uuuaucaggccuuuggaaaaau

SEQ ID NO: 246290 - RNA, 22 nt, Homo sapiens
uuucauggcgaggcuucauggg

SEQ ID NO: 246291 - RNA, 22 nt, Homo sapiens
uuucccuuacuuaaacuuacuc

SEQ ID NO: 246292 - RNA, 20 nt, Homo sapiens
uuugaauguaaagcauguca

SEQ ID NO: 246293 - RNA, 22 nt, Homo sapiens
uuuggcucugugucccacccaa

SEQ ID NO: 246294 - RNA, 22 nt, Homo sapiens
uuuuuauggccaauccucagaa

SEQ ID NO: 246295 - RNA, 22 nt, Homo sapiens
ugagaugauagauauguuaauu

SEQ ID NO: 246296 - RNA, 23 nt, Homo sapiens
ugagcaauauucuacuauugagu

SEQ ID NO: 246297 - RNA, 22 nt, Homo sapiens
ugagguuggguaauuuaugaag

SEQ ID NO: 246298 - RNA, 22 nt, Homo sapiens
ugaguagaagugaagauagugg

SEQ ID NO: 246299 - RNA, 22 nt, Homo sapiens
ugagugaacgcugagaccaaau

SEQ ID NO: 246300 - RNA, 22 nt, Homo sapiens
ugaguucaauuguauuuuauua

SEQ ID NO: 246301 - RNA, 22 nt, Homo sapiens
ugauggcauuuggaguugggac

SEQ ID NO: 246302 - RNA, 22 nt, Homo sapiens
ugcaaauguuaguaacaccacu

SEQ ID NO: 246303 - RNA, 19 nt, Homo sapiens
ugcaaauucuaaaaacuga

SEQ ID NO: 246304 - RNA, 16 nt, Homo sapiens
ugcagaguaggugaau

SEQ ID NO: 246305 - RNA, 23 nt, Homo sapiens
uggaacugaauuucuuagcauuu

SEQ ID NO: 246306 - RNA, 22 nt, Homo sapiens
uggaguguaauuagccaucagu

SEQ ID NO: 246307 - RNA, 22 nt, Homo sapiens
uggauaguaauaaacauauagg

SEQ ID NO: 246308 - RNA, 22 nt, Homo sapiens
uggcuacagaaaguacuaguga

SEQ ID NO: 246309 - RNA, 22 nt, Homo sapiens
ugguaagaaaaccauuauuagc

SEQ ID NO: 246310 - RNA, 21 nt, Homo sapiens
ugugaaaucuaggcagagguu

SEQ ID NO: 246311 - RNA, 22 nt, Homo sapiens
ugugaucaaccugcagggcugg

SEQ ID NO: 246312 - RNA, 22 nt, Homo sapiens
ugugaucaauuagugaugucug

SEQ ID NO: 246313 - RNA, 22 nt, Homo sapiens
ugugaugaaggcauagggaugu

SEQ ID NO: 246314 - RNA, 22 nt, Homo sapiens
uguuggcauugcugcugacccu

SEQ ID NO: 246315 - RNA, 22 nt, Homo sapiens
uuaucagcagcaugaaaauaga

SEQ ID NO: 246316 - RNA, 22 nt, Homo sapiens
uuaugcuugugugaauuuuccc

SEQ ID NO: 246317 - RNA, 22 nt, Homo sapiens
uucaagauggcaccagugagug

SEQ ID NO: 246318 - RNA, 22 nt, Homo sapiens
uucuggcucgauucucugaccg

SEQ ID NO: 246319 - RNA, 22 nt, Homo sapiens
uugaauagacagccagcuuuaa

SEQ ID NO: 246320 - RNA, 22 nt, Homo sapiens
uugaauaggcucaugcuuauca

SEQ ID NO: 246321 - RNA, 22 nt, Homo sapiens
uugaauaguggugaaaguuuga

SEQ ID NO: 246322 - RNA, 22 nt, Homo sapiens
uugauauguguauagcaugugg

SEQ ID NO: 246323 - RNA, 22 nt, Homo sapiens
aaagugcugggauuuuaggcau

SEQ ID NO: 246324 - RNA, 22 nt, Homo sapiens
aaagugcuuacuaaguugccaa

SEQ ID NO: 246325 - RNA, 22 nt, Homo sapiens
aaagugcuuccuuuuugagggu

SEQ ID NO: 246326 - RNA, 22 nt, Homo sapiens
aaagugcuucucuuuggugggu

SEQ ID NO: 246327 - RNA, 22 nt, Homo sapiens
aaaguggacuaagugaauauga

SEQ ID NO: 246328 - RNA, 22 nt, Homo sapiens
aaauaacugucagguucuggaa

SEQ ID NO: 246329 - RNA, 22 nt, Homo sapiens
aaaugcauaucaagauugcccu

SEQ ID NO: 246330 - RNA, 22 nt, Homo sapiens
aaauugcaaugcgaggcagagg

SEQ ID NO: 246331 - RNA, 22 nt, Homo sapiens
aagugcuguccuaccuuuggga

SEQ ID NO: 246332 - RNA, 22 nt, Homo sapiens
aauaaaguaggaggugaggaaa

SEQ ID NO: 246333 - RNA, 22 nt, Homo sapiens
aaucauauugucugccaagagg

SEQ ID NO: 246334 - RNA, 22 nt, Homo sapiens
aaugugcuguucagaggagucc

SEQ ID NO: 246335 - RNA, 22 nt, Homo sapiens
aauuaguaaccuaauuccaucu

SEQ ID NO: 246336 - RNA, 22 nt, Homo sapiens
aauugaaugauaugggacauuu

SEQ ID NO: 246337 - RNA, 22 nt, Homo sapiens
aauugcauaugcaguagaucua

SEQ ID NO: 246338 - RNA, 22 nt, Homo sapiens
acaaaguauggaauguuggugu

SEQ ID NO: 246339 - RNA, 22 nt, Homo sapiens
acagugcuguggucaugggucu

SEQ ID NO: 246340 - RNA, 22 nt, Homo sapiens
acauauaaggagacuagggcau

SEQ ID NO: 246341 - RNA, 22 nt, Homo sapiens
agaaccaaucccacauggauac

SEQ ID NO: 246342 - RNA, 22 nt, Homo sapiens
aaagugcuaggauuaccugggg

SEQ ID NO: 246343 - RNA, 22 nt, Homo sapiens
aaagugcugagaguucuaacuu

SEQ ID NO: 246344 - RNA, 22 nt, Homo sapiens
aaagugcugagauuguaggcau

SEQ ID NO: 246345 - RNA, 22 nt, Homo sapiens
aaagugcugagucuaggcgggg

SEQ ID NO: 246346 - RNA, 22 nt, Homo sapiens
aaagugcugggaucacacugaa

SEQ ID NO: 246347 - RNA, 22 nt, Homo sapiens
aaagugcugggauuaggccagg

SEQ ID NO: 246348 - RNA, 22 nt, Homo sapiens
aaagugcugggauuggcugggc

SEQ ID NO: 246349 - RNA, 20 nt, Homo sapiens
aacaguguguaaguuuccuu

SEQ ID NO: 246350 - RNA, 22 nt, Homo sapiens
aacaguguuuuggguuuucugg

SEQ ID NO: 246351 - RNA, 18 nt, Homo sapiens
aagagcucagcacagguu

SEQ ID NO: 246352 - RNA, 22 nt, Homo sapiens
aagcacccagccucacgccugc

SEQ ID NO: 246353 - RNA, 22 nt, Homo sapiens
aaggaagcuagcaggaauuggu

SEQ ID NO: 246354 - RNA, 22 nt, Homo sapiens
aagguaguuagaaaauauaacu

SEQ ID NO: 246355 - RNA, 17 nt, Homo sapiens
aaguggcuuguucacca

SEQ ID NO: 246356 - RNA, 22 nt, Homo sapiens
aaguugcuuuagguaagucaau

SEQ ID NO: 246357 - RNA, 22 nt, Homo sapiens
aauaaagccugucucuuuagag

SEQ ID NO: 246358 - RNA, 22 nt, Homo sapiens
aauaagaaguggaagggaccgg

SEQ ID NO: 246359 - RNA, 22 nt, Homo sapiens
aaugaaguuagauguugagaag

SEQ ID NO: 246360 - RNA, 22 nt, Homo sapiens
acaacaguuuuaucaccccaga

SEQ ID NO: 246361 - RNA, 22 nt, Homo sapiens
acacugcugaguaaauaauuuu

SEQ ID NO: 246362 - RNA, 19 nt, Homo sapiens
acagugcuuugucagaagc

SEQ ID NO: 246363 - RNA, 22 nt, Homo sapiens
acauaugaguacaugugccaug

SEQ ID NO: 246364 - RNA, 17 nt, Homo sapiens
accagugcaugugcuuu

SEQ ID NO: 246365 - RNA, 22 nt, Homo sapiens
acccgcccagguguggccggga

SEQ ID NO: 246366 - RNA, 22 nt, Homo sapiens
agaaugugaacaucuugaaagu

SEQ ID NO: 246367 - RNA, 20 nt, Homo sapiens
agacaguguggagauuccuu

SEQ ID NO: 246368 - RNA, 22 nt, Homo sapiens
agagugcuuuauuagauguagc

SEQ ID NO: 246369 - RNA, 22 nt, Homo sapiens
agcaauaugacauugcuacauc

SEQ ID NO: 246370 - RNA, 22 nt, Homo sapiens
agcacacuggguggcuuaaaca

SEQ ID NO: 246371 - RNA, 22 nt, Homo sapiens
agcucacagccuagcacuguga

SEQ ID NO: 246372 - RNA, 22 nt, Homo sapiens
agcuccuuucugcaggcagguc

SEQ ID NO: 246373 - RNA, 22 nt, Homo sapiens
aggcagaugagguccucagcug

SEQ ID NO: 246374 - RNA, 22 nt, Homo sapiens
aguaaauuucugugcuuucaua

SEQ ID NO: 246375 - RNA, 22 nt, Homo sapiens
aguggaguguaaagcgucuuuu

SEQ ID NO: 246376 - RNA, 23 nt, Homo sapiens
auaaugcaaguggugguaaucug

SEQ ID NO: 246377 - RNA, 23 nt, Homo sapiens
auagagcuaggaugcagacagau

SEQ ID NO: 246378 - RNA, 21 nt, Homo sapiens
auagugcuagagaguagcagg

SEQ ID NO: 246379 - RNA, 22 nt, Homo sapiens
auagugcugugaugaacauaca

SEQ ID NO: 246380 - RNA, 22 nt, Homo sapiens
auauaugcuaagugcuaauaaa

SEQ ID NO: 246381 - RNA, 18 nt, Homo sapiens
auauugccuucagacuag

SEQ ID NO: 246382 - RNA, 22 nt, Homo sapiens
auauugcuuagugaugaagucu

SEQ ID NO: 246383 - RNA, 22 nt, Homo sapiens
aucacugggauggaacugcuga

SEQ ID NO: 246384 - RNA, 22 nt, Homo sapiens
augaagauguugccuuuuuaau

SEQ ID NO: 246385 - RNA, 22 nt, Homo sapiens
augaauagaguuaauugaguac

SEQ ID NO: 246386 - RNA, 23 nt, Homo sapiens
augaauguaaggaguguaagaaa

SEQ ID NO: 246387 - RNA, 22 nt, Homo sapiens
augcagagaaaucuaaaauaug

SEQ ID NO: 246388 - RNA, 22 nt, Homo sapiens
auggaaugguugggucauaagg

SEQ ID NO: 246389 - RNA, 22 nt, Homo sapiens
auggcacucaaucaaguugaga

SEQ ID NO: 246390 - RNA, 22 nt, Homo sapiens
augugaaugugaucggauaguc

SEQ ID NO: 246391 - RNA, 20 nt, Homo sapiens
auucaaguaugccuugagaa

SEQ ID NO: 246392 - RNA, 22 nt, Homo sapiens
auucaagugaugcagcuguuuu

SEQ ID NO: 246393 - RNA, 22 nt, Homo sapiens
auucuauaguccuaggauuggg

SEQ ID NO: 246394 - RNA, 22 nt, Homo sapiens
auuguaauuuuagagaaagugg

SEQ ID NO: 246395 - RNA, 22 nt, Homo sapiens
caaagugcugaaagaggccagg

SEQ ID NO: 246396 - RNA, 22 nt, Homo sapiens
ucuuugguaggaguaggaggcc

SEQ ID NO: 246397 - RNA, 22 nt, Homo sapiens
ucuuugguauugugaauagugu

SEQ ID NO: 246398 - RNA, 22 nt, Homo sapiens
ucuuugguucuguuuauguaau

SEQ ID NO: 246399 - RNA, 22 nt, Homo sapiens
ucuuuguucaggagccaacucc

SEQ ID NO: 246400 - RNA, 22 nt, Homo sapiens
ucuuuugugagucagccucucc

SEQ ID NO: 246401 - RNA, 22 nt, Homo sapiens
ugaaaagucuaagauuaagguu

SEQ ID NO: 246402 - RNA, 22 nt, Homo sapiens
ugaaacacacauugcccuuuau

SEQ ID NO: 246403 - RNA, 20 nt, Homo sapiens
ugaaacacauggacuggggu

SEQ ID NO: 246404 - RNA, 22 nt, Homo sapiens
ugaaagacugaagaauaggcau

SEQ ID NO: 246405 - RNA, 22 nt, Homo sapiens
ugaaagcuacagucuccuagga

SEQ ID NO: 246406 - RNA, 22 nt, Homo sapiens
ugaaagguuuaauucugugaga

SEQ ID NO: 246407 - RNA, 22 nt, Homo sapiens
ugaaauacuuaauuucuccaug

SEQ ID NO: 246408 - RNA, 22 nt, Homo sapiens
ugaaauacuuuggcucuuuguu

SEQ ID NO: 246409 - RNA, 22 nt, Homo sapiens
ugaaauaguuaaguugccuagu

SEQ ID NO: 246410 - RNA, 20 nt, Homo sapiens
ugaaaucuucacuaagucuc

SEQ ID NO: 246411 - RNA, 22 nt, Homo sapiens
ugaaaugaucaguuugguuacu

SEQ ID NO: 246412 - RNA, 22 nt, Homo sapiens
ugaaaugcagaacuuuaggucu

SEQ ID NO: 246413 - RNA, 22 nt, Homo sapiens
ugaaaugcugucuaggggaaau

SEQ ID NO: 246414 - RNA, 22 nt, Homo sapiens
ugaaauuguuugcaaggauagg

SEQ ID NO: 246415 - RNA, 22 nt, Homo sapiens
ugaacacaucuccugguaccug

SEQ ID NO: 246416 - RNA, 22 nt, Homo sapiens
ugaacagagaaacacuggccau

SEQ ID NO: 246417 - RNA, 22 nt, Homo sapiens
ugaacagcaccuccuagaguug

SEQ ID NO: 246418 - RNA, 22 nt, Homo sapiens
ugaacagcacguuuauucagaa

SEQ ID NO: 246419 - RNA, 22 nt, Homo sapiens
ugaacagcuaucuugucagugu

SEQ ID NO: 246420 - RNA, 22 nt, Homo sapiens
ugaacucauccuuucuuauggc

SEQ ID NO: 246421 - RNA, 22 nt, Homo sapiens
ugaagcuuguuucuguaccuuu

SEQ ID NO: 246422 - RNA, 22 nt, Homo sapiens
ugaaggcaggagggagaaaagu

SEQ ID NO: 246423 - RNA, 22 nt, Homo sapiens
ugaaggccgggcaugguggcuc

SEQ ID NO: 246424 - RNA, 22 nt, Homo sapiens
ugaagggcauuguuuugccaaa

SEQ ID NO: 246425 - RNA, 22 nt, Homo sapiens
ugaaguaauguuuuauucuauu

SEQ ID NO: 246426 - RNA, 22 nt, Homo sapiens
ugaagugggaaaugaguauuaa

SEQ ID NO: 246427 - RNA, 18 nt, Homo sapiens
ugaauacagcguugggaa

SEQ ID NO: 246428 - RNA, 22 nt, Homo sapiens
ugaauagacagucacugccucc

SEQ ID NO: 246429 - RNA, 22 nt, Homo sapiens
ugaaucauuucuugucuucagu

SEQ ID NO: 246430 - RNA, 22 nt, Homo sapiens
ugaauggauccaauucuuagua

SEQ ID NO: 246431 - RNA, 22 nt, Homo sapiens
ugaaugguaauuuaguaggcac

SEQ ID NO: 246432 - RNA, 22 nt, Homo sapiens
ugaaugguuuuuagagaacaau

SEQ ID NO: 246433 - RNA, 22 nt, Homo sapiens
ugaauucuguccaaaauaacug

SEQ ID NO: 246434 - RNA, 22 nt, Homo sapiens
ugacaagaguagagagggugcc

SEQ ID NO: 246435 - RNA, 22 nt, Homo sapiens
ugacaagauauggucuuaucaa

SEQ ID NO: 246436 - RNA, 20 nt, Homo sapiens
ugacaaggugcaaagaauca

SEQ ID NO: 246437 - RNA, 19 nt, Homo sapiens
ugacacuguuggugggagg

SEQ ID NO: 246438 - RNA, 17 nt, Homo sapiens
ugacagaaacuuguugu

SEQ ID NO: 246439 - RNA, 22 nt, Homo sapiens
ugacagagaagcauugaguuca

SEQ ID NO: 246440 - RNA, 22 nt, Homo sapiens
ugacagcaucaggauuggagag

SEQ ID NO: 246441 - RNA, 22 nt, Homo sapiens
ugacagugaauaagucucuuaa

SEQ ID NO: 246442 - RNA, 22 nt, Homo sapiens
ugacagugugagacuuugucuc

SEQ ID NO: 246443 - RNA, 20 nt, Homo sapiens
ugacaguuaagggauagaag

SEQ ID NO: 246444 - RNA, 22 nt, Homo sapiens
ugacaguuuccagggcugucuc

SEQ ID NO: 246445 - RNA, 22 nt, Homo sapiens
ugacaucugcuugugcccagga

SEQ ID NO: 246446 - RNA, 22 nt, Homo sapiens
ugacauggagggugcggcugca

SEQ ID NO: 246447 - RNA, 23 nt, Homo sapiens
ugacauguaauucaguccagcag

SEQ ID NO: 246448 - RNA, 22 nt, Homo sapiens
ugacauguauuagcucagugcu

SEQ ID NO: 246449 - RNA, 21 nt, Homo sapiens
ugacauguugguguucugcac

SEQ ID NO: 246450 - RNA, 21 nt, Homo sapiens
ugacauguugguuugcugcac

SEQ ID NO: 246451 - RNA, 22 nt, Homo sapiens
ugacauugggagugaagugaag

SEQ ID NO: 246452 - RNA, 22 nt, Homo sapiens
ugacuaaaacugaguuucauua

SEQ ID NO: 246453 - RNA, 22 nt, Homo sapiens
ugacuacauaaguaaucucaaa

SEQ ID NO: 246454 - RNA, 22 nt, Homo sapiens
ugacuauaguaaucacuucaca

SEQ ID NO: 246455 - RNA, 22 nt, Homo sapiens
ugacugaguaguauuccacuau

SEQ ID NO: 246456 - RNA, 22 nt, Homo sapiens
ugacuggagaccucaguagggu

SEQ ID NO: 246457 - RNA, 22 nt, Homo sapiens
ugacuucauuuuuggccaugag

SEQ ID NO: 246458 - RNA, 22 nt, Homo sapiens
ugacuuuagaauuuuauccaga

SEQ ID NO: 246459 - RNA, 17 nt, Homo sapiens
ugagaacaugugguauu

SEQ ID NO: 246460 - RNA, 18 nt, Homo sapiens
ugagaacauguguacaca

SEQ ID NO: 246461 - RNA, 22 nt, Homo sapiens
ugagaacugccuguauuuaucu

SEQ ID NO: 246462 - RNA, 22 nt, Homo sapiens
ugagaagacaucuuugcuuugu

SEQ ID NO: 246463 - RNA, 22 nt, Homo sapiens
ugagaauauuuuccaugucuca

SEQ ID NO: 246464 - RNA, 22 nt, Homo sapiens
ugagaaugacugggcaugcugc

SEQ ID NO: 246465 - RNA, 22 nt, Homo sapiens
ugagaaugaugauugguaaacc

SEQ ID NO: 246466 - RNA, 22 nt, Homo sapiens
ugagaauguagggcucucccag

SEQ ID NO: 246467 - RNA, 22 nt, Homo sapiens
ugagacacuucccagaucccuu

SEQ ID NO: 246468 - RNA, 22 nt, Homo sapiens
ugagacaugugaauauuuguac

SEQ ID NO: 246469 - RNA, 22 nt, Homo sapiens
ugagaccuuucauuucucagug

SEQ ID NO: 246470 - RNA, 22 nt, Homo sapiens
ugagacggaguuuugcucuugu

SEQ ID NO: 246471 - RNA, 22 nt, Homo sapiens
ugagacugagucucgcucuauu

SEQ ID NO: 246472 - RNA, 22 nt, Homo sapiens
ugagacugaguuuugcucguug

SEQ ID NO: 246473 - RNA, 22 nt, Homo sapiens
ugagagcugguuguuuaaagga

SEQ ID NO: 246474 - RNA, 22 nt, Homo sapiens
ugagagcuuugaugcacuguuu

SEQ ID NO: 246475 - RNA, 22 nt, Homo sapiens
ugagaggugauaaagcaagggu

SEQ ID NO: 246476 - RNA, 22 nt, Homo sapiens
ugagauaacuaaaaacauuuug

SEQ ID NO: 246477 - RNA, 21 nt, Homo sapiens
ugagauaauauguuucugaug

SEQ ID NO: 246478 - RNA, 22 nt, Homo sapiens
ugagauagcauaagggacagaa

SEQ ID NO: 246479 - RNA, 22 nt, Homo sapiens
ugagaucaacugagucagagca

SEQ ID NO: 246480 - RNA, 22 nt, Homo sapiens
ugagaucagugaagaaguguuu

SEQ ID NO: 246481 - RNA, 19 nt, Homo sapiens
ugagauccacugaagauuc

SEQ ID NO: 246482 - RNA, 22 nt, Homo sapiens
ugagauccugagaguugggacu

SEQ ID NO: 246483 - RNA, 22 nt, Homo sapiens
ugagaucuuugcuguccucacc

SEQ ID NO: 246484 - RNA, 22 nt, Homo sapiens
ugagaugacgacacaccucagu

SEQ ID NO: 246485 - RNA, 22 nt, Homo sapiens
ugagaugagucucgcucuguca

SEQ ID NO: 246486 - RNA, 22 nt, Homo sapiens
ugagaugaugggauaagagggc

SEQ ID NO: 246487 - RNA, 22 nt, Homo sapiens
ugagauggagucuugucgccua

SEQ ID NO: 246488 - RNA, 22 nt, Homo sapiens
ugagauggaguuucgcucuugu

SEQ ID NO: 246489 - RNA, 22 nt, Homo sapiens
ugagauggaucuuggauuugaa

SEQ ID NO: 246490 - RNA, 22 nt, Homo sapiens
ugagauggguaauuaaauggug

SEQ ID NO: 246491 - RNA, 22 nt, Homo sapiens
ugagauguagauauggauuaga

SEQ ID NO: 246492 - RNA, 22 nt, Homo sapiens
ugagauguguccagaucuaguu

SEQ ID NO: 246493 - RNA, 23 nt, Homo sapiens
ugagauuacccagaaagaguaua

SEQ ID NO: 246494 - RNA, 22 nt, Homo sapiens
ugagauuguuagaucaaauggu

SEQ ID NO: 246495 - RNA, 22 nt, Homo sapiens
ugagcaauaaaguuacacaguu

SEQ ID NO: 246496 - RNA, 22 nt, Homo sapiens
ugagcacagagccugggguggc

SEQ ID NO: 246497 - RNA, 22 nt, Homo sapiens
ugagcagaaagcugcaaggucg

SEQ ID NO: 246498 - RNA, 22 nt, Homo sapiens
ugucaaugggaauuuguuuuag

SEQ ID NO: 246499 - RNA, 22 nt, Homo sapiens
ugucaccauuuguaggugagga

SEQ ID NO: 246500 - RNA, 22 nt, Homo sapiens
ugucacugugaguuugacugcu

SEQ ID NO: 246501 - RNA, 18 nt, Homo sapiens
ugucagaguggauuguaa

SEQ ID NO: 246502 - RNA, 22 nt, Homo sapiens
ugucaguuuuaacuagggaaua

SEQ ID NO: 246503 - RNA, 22 nt, Homo sapiens
ugucaucauuccaucagggcuu

SEQ ID NO: 246504 - RNA, 22 nt, Homo sapiens
ugucaugaaauauguuuuucua

SEQ ID NO: 246505 - RNA, 22 nt, Homo sapiens
ugucaugagucuccuccaucuu

SEQ ID NO: 246506 - RNA, 22 nt, Homo sapiens
ugucaugguagcaaggacgagg

SEQ ID NO: 246507 - RNA, 22 nt, Homo sapiens
ugucauguaaagaguaaauggu

SEQ ID NO: 246508 - RNA, 22 nt, Homo sapiens
ugucaugucaacuauggaauuu

SEQ ID NO: 246509 - RNA, 22 nt, Homo sapiens
ugucauguugguguacugcacc

SEQ ID NO: 246510 - RNA, 22 nt, Homo sapiens
ugucccaguuggguauugaauu

SEQ ID NO: 246511 - RNA, 22 nt, Homo sapiens
uguccuagagggaugucacccc

SEQ ID NO: 246512 - RNA, 22 nt, Homo sapiens
uguccugaagcuuuguuaugua

SEQ ID NO: 246513 - RNA, 22 nt, Homo sapiens
uguccugcagagguguuugccu

SEQ ID NO: 246514 - RNA, 22 nt, Homo sapiens
ugucuaaagaauggcagacuca

SEQ ID NO: 246515 - RNA, 22 nt, Homo sapiens
ugucucaguuacggcaauucca

SEQ ID NO: 246516 - RNA, 22 nt, Homo sapiens
ugucucccuucccauuaggaag

SEQ ID NO: 246517 - RNA, 21 nt, Homo sapiens
ugugaaaucuaggcagagguu

SEQ ID NO: 246518 - RNA, 19 nt, Homo sapiens
ugugaagaaaugcugcaag

SEQ ID NO: 246519 - RNA, 22 nt, Homo sapiens
ugugaauggugcugccgugaag

SEQ ID NO: 246520 - RNA, 23 nt, Homo sapiens
ugugacacuuccgucaguucauu

SEQ ID NO: 246521 - RNA, 22 nt, Homo sapiens
ugugacagcacagcaucucuuu

SEQ ID NO: 246522 - RNA, 22 nt, Homo sapiens
ugugacaguguuacauuucaug

SEQ ID NO: 246523 - RNA, 18 nt, Homo sapiens
ugugacauugagcauguc

SEQ ID NO: 246524 - RNA, 22 nt, Homo sapiens
ugugagcuauggaguuguagag

SEQ ID NO: 246525 - RNA, 22 nt, Homo sapiens
ugugaguguguacuaguuauca

SEQ ID NO: 246526 - RNA, 22 nt, Homo sapiens
ugugauagagaaugguggagaa

SEQ ID NO: 246527 - RNA, 22 nt, Homo sapiens
ugugaucauuucaggaauuuug

SEQ ID NO: 246528 - RNA, 22 nt, Homo sapiens
ugugauuauuuaaauaggacag

SEQ ID NO: 246529 - RNA, 22 nt, Homo sapiens
ugugcaaauguuaaacuaacuu

SEQ ID NO: 246530 - RNA, 22 nt, Homo sapiens
ugugcaaucuuccauuuuuagg

SEQ ID NO: 246531 - RNA, 22 nt, Homo sapiens
ugugcacaaugugcagguuuga

SEQ ID NO: 246532 - RNA, 22 nt, Homo sapiens
ugugcacauaacauuuuuuuag

SEQ ID NO: 246533 - RNA, 22 nt, Homo sapiens
ugugcacaugauauaucacaua

SEQ ID NO: 246534 - RNA, 22 nt, Homo sapiens
ugugcauauaaguguguauaua

SEQ ID NO: 246535 - RNA, 22 nt, Homo sapiens
ugugcaugaaauuuaccuuuaa

SEQ ID NO: 246536 - RNA, 22 nt, Homo sapiens
ugugccacuccaggaggcuguu

SEQ ID NO: 246537 - RNA, 22 nt, Homo sapiens
ugugcguguaagagaucuaggu

SEQ ID NO: 246538 - RNA, 22 nt, Homo sapiens
ugugcuugaaauucaguuuuga

SEQ ID NO: 246539 - RNA, 22 nt, Homo sapiens
uguggcaaauggucaggaagaa

SEQ ID NO: 246540 - RNA, 21 nt, Homo sapiens
uguggcaauggccucacagau

SEQ ID NO: 246541 - RNA, 22 nt, Homo sapiens
uguggcacuguguccagagaaa

SEQ ID NO: 246542 - RNA, 22 nt, Homo sapiens
uguggcucuucuguucuccacu

SEQ ID NO: 246543 - RNA, 22 nt, Homo sapiens
ugugggaggugcuaauguaaau

SEQ ID NO: 246544 - RNA, 22 nt, Homo sapiens
ugugguagugcuuaccugcagu

SEQ ID NO: 246545 - RNA, 23 nt, Homo sapiens
ugugguauuauuccauuuauagg

SEQ ID NO: 246546 - RNA, 22 nt, Homo sapiens
ugugguuuuauaaacgugaccu

SEQ ID NO: 246547 - RNA, 22 nt, Homo sapiens
ugugguuuuuuucuccaauagg

SEQ ID NO: 246548 - RNA, 22 nt, Homo sapiens
uguguacaucucuacacacaug

SEQ ID NO: 246549 - RNA, 22 nt, Homo sapiens
ugugucuugagagucucgagaa

SEQ ID NO: 246550 - RNA, 22 nt, Homo sapiens
ugugucuuuuaucacacaaugu

SEQ ID NO: 246551 - RNA, 22 nt, Homo sapiens
uguguuugauaaguccauaguu

SEQ ID NO: 246552 - RNA, 22 nt, Homo sapiens
uguuaacauggucucagucugu

SEQ ID NO: 246553 - RNA, 22 nt, Homo sapiens
uguuacacugugcacuaaauuu

SEQ ID NO: 246554 - RNA, 22 nt, Homo sapiens
uguuacaguguaggccuugggu

SEQ ID NO: 246555 - RNA, 22 nt, Homo sapiens
uguuaucauuacguucuuaguu

SEQ ID NO: 246556 - RNA, 22 nt, Homo sapiens
uguucuugagccuuuagaccua

SEQ ID NO: 246557 - RNA, 22 nt, Homo sapiens
uguugcaccugccuugcuuuag

SEQ ID NO: 246558 - RNA, 19 nt, Homo sapiens
uguugcacuccagcuuggg

SEQ ID NO: 246559 - RNA, 22 nt, Homo sapiens
uguuggacuuacuuggcagauu

SEQ ID NO: 246560 - RNA, 22 nt, Homo sapiens
uguuuaguuaagacauagaauu

SEQ ID NO: 246561 - RNA, 22 nt, Homo sapiens
uguuuugguugucccuggccag

SEQ ID NO: 246562 - RNA, 21 nt, Homo sapiens
uguuuuugcuguguaucucuc

SEQ ID NO: 246563 - RNA, 22 nt, Homo sapiens
uuaaaccugucuucucacuaau

SEQ ID NO: 246564 - RNA, 22 nt, Homo sapiens
uuaaacugcuugaauuggguuu

SEQ ID NO: 246565 - RNA, 22 nt, Homo sapiens
uuaaagcuggcguuacaguuug

SEQ ID NO: 246566 - RNA, 22 nt, Homo sapiens
uuaaaguaauugaaauggccuu

SEQ ID NO: 246567 - RNA, 22 nt, Homo sapiens
uuaaaguguuugcagacaggug

SEQ ID NO: 246568 - RNA, 22 nt, Homo sapiens
uuaaaugcacauacuugagaaa

SEQ ID NO: 246569 - RNA, 22 nt, Homo sapiens
uuaaaugcauagaauguguagu

SEQ ID NO: 246570 - RNA, 22 nt, Homo sapiens
uuaacaguugcaugagacugag

SEQ ID NO: 246571 - RNA, 22 nt, Homo sapiens
uuaagagcauggugccagguug

SEQ ID NO: 246572 - RNA, 22 nt, Homo sapiens
uuaagagugggaguuggccaca

SEQ ID NO: 246573 - RNA, 22 nt, Homo sapiens
uuaaggaaggagucuuaaaugg

SEQ ID NO: 246574 - RNA, 18 nt, Homo sapiens
uuaaggcaggacuuuaag

SEQ ID NO: 246575 - RNA, 22 nt, Homo sapiens
uuaaggcuuguacuuguuuucu

SEQ ID NO: 246576 - RNA, 19 nt, Homo sapiens
uuaagguacuuagaugugu

SEQ ID NO: 246577 - RNA, 22 nt, Homo sapiens
uuaagugcucaguuacucaguu

SEQ ID NO: 246578 - RNA, 22 nt, Homo sapiens
uuaaguguaaguggugugggac

SEQ ID NO: 246579 - RNA, 22 nt, Homo sapiens
uuaauagcaaagaguuuagacu

SEQ ID NO: 246580 - RNA, 22 nt, Homo sapiens
uuaauagugacucauuuuccac

SEQ ID NO: 246581 - RNA, 22 nt, Homo sapiens
uuaaugcuuuugggauauuucu

SEQ ID NO: 246582 - RNA, 22 nt, Homo sapiens
uuaaugugaaucaggaugcauu

SEQ ID NO: 246583 - RNA, 22 nt, Homo sapiens
uuacagcugggugugucuggua

SEQ ID NO: 246584 - RNA, 20 nt, Homo sapiens
uuacagugggaccuuccuga

SEQ ID NO: 246585 - RNA, 22 nt, Homo sapiens
uuacaguggugaccuuguauug

SEQ ID NO: 246586 - RNA, 22 nt, Homo sapiens
uuacagugguugcuauugugaa

SEQ ID NO: 246587 - RNA, 19 nt, Homo sapiens
uuacagugugcccuuuuag

SEQ ID NO: 246588 - RNA, 22 nt, Homo sapiens
uuacaugcaugacaaggugcca

SEQ ID NO: 246589 - RNA, 22 nt, Homo sapiens
uuacugcuuaagugauucaaca

SEQ ID NO: 246590 - RNA, 22 nt, Homo sapiens
uuacuugagaugaguuggacaa

SEQ ID NO: 246591 - RNA, 22 nt, Homo sapiens
uuagaacagugcucaccacaaa

SEQ ID NO: 246592 - RNA, 18 nt, Homo sapiens
uuagaugguuuuaaaacu

SEQ ID NO: 246593 - RNA, 22 nt, Homo sapiens
uuagcaccacacacuuuagagg

SEQ ID NO: 246594 - RNA, 22 nt, Homo sapiens
uuagcagcucuaauaacugcua

SEQ ID NO: 246595 - RNA, 22 nt, Homo sapiens
uuagcucaguuggugagagcgu

SEQ ID NO: 246596 - RNA, 22 nt, Homo sapiens
uuaggacaauguucguuuuuug

SEQ ID NO: 246597 - RNA, 22 nt, Homo sapiens
uuagguaggugcuuuuuucaca

SEQ ID NO: 246598 - RNA, 22 nt, Homo sapiens
uuaggugcauggaaguguuuuc

SEQ ID NO: 246599 - RNA, 23 nt, Homo sapiens
uuaguaaacucaaugacaccaca

SEQ ID NO: 246600 - RNA, 22 nt, Homo sapiens
uugacauaguuucugaaauaga

SEQ ID NO: 246601 - RNA, 22 nt, Homo sapiens
uugacuuuuaggaggaaaauga

SEQ ID NO: 246602 - RNA, 22 nt, Homo sapiens
uugacuuuuauucacucugcua

SEQ ID NO: 246603 - RNA, 21 nt, Homo sapiens
uugagacggagucucacucug

SEQ ID NO: 246604 - RNA, 22 nt, Homo sapiens
uugagacggagucucacucugu

SEQ ID NO: 246605 - RNA, 22 nt, Homo sapiens
uugagagaaaaaauuuauuggu

SEQ ID NO: 246606 - RNA, 22 nt, Homo sapiens
uugagauaggaacucacuaugc

SEQ ID NO: 246607 - RNA, 22 nt, Homo sapiens
uugagauaggagcuguuguucu

SEQ ID NO: 246608 - RNA, 22 nt, Homo sapiens
uugagauggagucucacucugc

SEQ ID NO: 246609 - RNA, 22 nt, Homo sapiens
uugagauggagucucacucuuu

SEQ ID NO: 246610 - RNA, 22 nt, Homo sapiens
uugagauggagucucgcugugu

SEQ ID NO: 246611 - RNA, 22 nt, Homo sapiens
uugagauggagucucguucugu

SEQ ID NO: 246612 - RNA, 22 nt, Homo sapiens
uugagauggagucuugcacugu

SEQ ID NO: 246613 - RNA, 22 nt, Homo sapiens
uugagauggagucuugcucugu

SEQ ID NO: 246614 - RNA, 22 nt, Homo sapiens
uugagauggaguucauuuuugu

SEQ ID NO: 246615 - RNA, 22 nt, Homo sapiens
uugagauggaguuucacucugu

SEQ ID NO: 246616 - RNA, 22 nt, Homo sapiens
uugagauguaagauguuaauau

SEQ ID NO: 246617 - RNA, 22 nt, Homo sapiens
uugagauguaguuucacuccug

SEQ ID NO: 246618 - RNA, 22 nt, Homo sapiens
uugagauguauguauauaaugu

SEQ ID NO: 246619 - RNA, 19 nt, Homo sapiens
uugagaugugaacucacac

SEQ ID NO: 246620 - RNA, 22 nt, Homo sapiens
uugagcaaaacauuaauauuag

SEQ ID NO: 246621 - RNA, 22 nt, Homo sapiens
uugagcaccaugccuggccaug

SEQ ID NO: 246622 - RNA, 22 nt, Homo sapiens
uugagcacugucugugugcagu

SEQ ID NO: 246623 - RNA, 22 nt, Homo sapiens
uugagcaucauguuagcacuca

SEQ ID NO: 246624 - RNA, 22 nt, Homo sapiens
uugagcccuggaggcagaggcu

SEQ ID NO: 246625 - RNA, 22 nt, Homo sapiens
uugagcuuuuuacuuguccaau

SEQ ID NO: 246626 - RNA, 22 nt, Homo sapiens
uugaggacugcuaagcauuuga

SEQ ID NO: 246627 - RNA, 22 nt, Homo sapiens
uugaggaguacugauuagguau

SEQ ID NO: 246628 - RNA, 22 nt, Homo sapiens
uugaggccugauaacacacuga

SEQ ID NO: 246629 - RNA, 22 nt, Homo sapiens
uugagggaagccagaggucugc

SEQ ID NO: 246630 - RNA, 22 nt, Homo sapiens
uugagggaggcagggcuugucu

SEQ ID NO: 246631 - RNA, 22 nt, Homo sapiens
uugagguagcuuugauggaggu

SEQ ID NO: 246632 - RNA, 22 nt, Homo sapiens
uugagguaggaggagcuuggau

SEQ ID NO: 246633 - RNA, 22 nt, Homo sapiens
uugagguaguacuuauuauugg

SEQ ID NO: 246634 - RNA, 20 nt, Homo sapiens
uugaggugugaggggcagag

SEQ ID NO: 246635 - RNA, 22 nt, Homo sapiens
uugaguuuaucuaaagaccugg

SEQ ID NO: 246636 - RNA, 22 nt, Homo sapiens
uugauagaucagggauuugauu

SEQ ID NO: 246637 - RNA, 22 nt, Homo sapiens
uugauaguaccauugggaaauu

SEQ ID NO: 246638 - RNA, 22 nt, Homo sapiens
uugauauggcugcuuaccauaa

SEQ ID NO: 246639 - RNA, 22 nt, Homo sapiens
uugauaugguauaagauuucau

SEQ ID NO: 246640 - RNA, 22 nt, Homo sapiens
uugauguccaucucuagguaaa

SEQ ID NO: 246641 - RNA, 22 nt, Homo sapiens
uugcaaaguugccaaggaagga

SEQ ID NO: 246642 - RNA, 21 nt, Homo sapiens
uugcaaaugcugcugccugau

SEQ ID NO: 246643 - RNA, 22 nt, Homo sapiens
uugcaacauuguaaguuuauau

SEQ ID NO: 246644 - RNA, 22 nt, Homo sapiens
uugcaaugugaugugauuugga

SEQ ID NO: 246645 - RNA, 22 nt, Homo sapiens
uugcacagugcuuucuuugccc

SEQ ID NO: 246646 - RNA, 22 nt, Homo sapiens
uugcacauugcaccuuuuguau

SEQ ID NO: 246647 - RNA, 22 nt, Homo sapiens
uugcacauuuuuucuggcagaa

SEQ ID NO: 246648 - RNA, 22 nt, Homo sapiens
uugcaccacugcguuccagccu

SEQ ID NO: 246649 - RNA, 22 nt, Homo sapiens
uugcacuccagcucgggugaca

SEQ ID NO: 246650 - RNA, 22 nt, Homo sapiens
uugcacuccggccuggguaaca

SEQ ID NO: 246651 - RNA, 22 nt, Homo sapiens
uugcagagaaauuucugguuua

SEQ ID NO: 246652 - RNA, 20 nt, Homo sapiens
uugcagagcccaacccugga

SEQ ID NO: 246653 - RNA, 22 nt, Homo sapiens
uugcagcaacauggaugaaacu

SEQ ID NO: 246654 - RNA, 23 nt, Homo sapiens
uugcauagacauccucauagauu

SEQ ID NO: 246655 - RNA, 18 nt, Homo sapiens
uugcaucauuuuguuguu

SEQ ID NO: 246656 - RNA, 22 nt, Homo sapiens
uugcaugguggaacuuggagcu

SEQ ID NO: 246657 - RNA, 22 nt, Homo sapiens
uugcaugucauaacugauggaa

SEQ ID NO: 246658 - RNA, 22 nt, Homo sapiens
uugcauugacacaugaagcuca

SEQ ID NO: 246659 - RNA, 22 nt, Homo sapiens
uugcauuuucuaggagggcaaa

SEQ ID NO: 246660 - RNA, 22 nt, Homo sapiens
uugccauagugcugccagauau

SEQ ID NO: 246661 - RNA, 22 nt, Homo sapiens
uugccaucaucucuuacucagu

SEQ ID NO: 246662 - RNA, 22 nt, Homo sapiens
uugccuaggcuggagugcagua

SEQ ID NO: 246663 - RNA, 22 nt, Homo sapiens
uugccuauucacucugaugaua

SEQ ID NO: 246664 - RNA, 22 nt, Homo sapiens
uugcgcuuuuccuauguugccc

SEQ ID NO: 246665 - RNA, 22 nt, Homo sapiens
uugcuauguugcccagucugga

SEQ ID NO: 246666 - RNA, 22 nt, Homo sapiens
uugcucaccugagaagaauaga

SEQ ID NO: 246667 - RNA, 22 nt, Homo sapiens
uugcucaggcuggaguacaaug

SEQ ID NO: 246668 - RNA, 22 nt, Homo sapiens
uugcuucuuucgucuggcccca

SEQ ID NO: 246669 - RNA, 22 nt, Homo sapiens
uugcuuuguuacugcaguuucc

SEQ ID NO: 246670 - RNA, 22 nt, Homo sapiens
uuggaagacaaugcugauucuc

SEQ ID NO: 246671 - RNA, 22 nt, Homo sapiens
uuggaagacauucugucugcua

SEQ ID NO: 246672 - RNA, 22 nt, Homo sapiens
uuggaagagaagggagauaaac

SEQ ID NO: 246673 - RNA, 22 nt, Homo sapiens
uuggaauauuauuauugggcag

SEQ ID NO: 246674 - RNA, 22 nt, Homo sapiens
uuggaaugcaacagaaggauaa

SEQ ID NO: 246675 - RNA, 22 nt, Homo sapiens
uuggacuuuaagauagagaugu

SEQ ID NO: 246676 - RNA, 22 nt, Homo sapiens
uuggagagagaggacucccggc

SEQ ID NO: 246677 - RNA, 22 nt, Homo sapiens
uuggagugugucuuauuccauu

SEQ ID NO: 246678 - RNA, 22 nt, Homo sapiens
uuggaugauaaagaagccuaag

SEQ ID NO: 246679 - RNA, 22 nt, Homo sapiens
uuggcaaagaggaaugccacuu

SEQ ID NO: 246680 - RNA, 22 nt, Homo sapiens
uuggcaacauagugagaccccc

SEQ ID NO: 246681 - RNA, 22 nt, Homo sapiens
uuggcaauugcuaugauuugaa

SEQ ID NO: 246682 - RNA, 22 nt, Homo sapiens
uuggcacuugauaauauucugg

SEQ ID NO: 246683 - RNA, 22 nt, Homo sapiens
uuggcagugcccgaugcugggg

SEQ ID NO: 246684 - RNA, 22 nt, Homo sapiens
uuggcagugguucugacggacc

SEQ ID NO: 246685 - RNA, 22 nt, Homo sapiens
uuggcauagaggcucucaagcu

SEQ ID NO: 246686 - RNA, 22 nt, Homo sapiens
uuggcauaguugcacuuacuag

SEQ ID NO: 246687 - RNA, 22 nt, Homo sapiens
uuggcauuuauucuaaggucaa

SEQ ID NO: 246688 - RNA, 22 nt, Homo sapiens
uuggccccuuucauccacagcu

SEQ ID NO: 246689 - RNA, 19 nt, Homo sapiens
uuggcccugguucucuucu

SEQ ID NO: 246690 - RNA, 22 nt, Homo sapiens
uuggcucuggcugggcuccagc

SEQ ID NO: 246691 - RNA, 22 nt, Homo sapiens
uuggggcacggccucuguugcc

SEQ ID NO: 246692 - RNA, 22 nt, Homo sapiens
uugguaguuucugucuuuagau

SEQ ID NO: 246693 - RNA, 22 nt, Homo sapiens
uugguccccacuccccugccaa

SEQ ID NO: 246694 - RNA, 22 nt, Homo sapiens
uuguaaagucugucucagucag

SEQ ID NO: 246695 - RNA, 22 nt, Homo sapiens
uuguaacaguuuauugacucga

SEQ ID NO: 246696 - RNA, 22 nt, Homo sapiens
uuguaaucaacacaucauuggg

SEQ ID NO: 246697 - RNA, 22 nt, Homo sapiens
uuguaauguuaggguguccaug

SEQ ID NO: 246698 - RNA, 22 nt, Homo sapiens
uuguacuccagccugggugaca

SEQ ID NO: 246699 - RNA, 22 nt, Homo sapiens
uuguaguagcauuauuuauaau

SEQ ID NO: 246700 - RNA, 22 nt, Homo sapiens
uuguauaggcucaguaagaauc

SEQ ID NO: 246701 - RNA, 22 nt, Homo sapiens
uugucacuauaaauaagcauuu

SEQ ID NO: 246702 - RNA, 22 nt, Homo sapiens
uccacagugguugaacuaguuu

SEQ ID NO: 246703 - RNA, 22 nt, Homo sapiens
uccaguggacagacauaccaug

SEQ ID NO: 246704 - RNA, 22 nt, Homo sapiens
uccaguuauccuguggggagga

SEQ ID NO: 246705 - RNA, 22 nt, Homo sapiens
uccaguuuucuuuccuagggcu

SEQ ID NO: 246706 - RNA, 22 nt, Homo sapiens
uccaguuuuguuaacauauggu

SEQ ID NO: 246707 - RNA, 19 nt, Homo sapiens
uccaugagcccacagugau

SEQ ID NO: 246708 - RNA, 22 nt, Homo sapiens
uccaugaggcuacaguaaucuc

SEQ ID NO: 246709 - RNA, 22 nt, Homo sapiens
uccauguagaagacaggggaga

SEQ ID NO: 246710 - RNA, 18 nt, Homo sapiens
uccauugcagcauuauuu

SEQ ID NO: 246711 - RNA, 22 nt, Homo sapiens
uccauuuguucagcuucaggaa

SEQ ID NO: 246712 - RNA, 22 nt, Homo sapiens
ucccagucuagagccggauugg

SEQ ID NO: 246713 - RNA, 22 nt, Homo sapiens
ucccagugcuaugcaaaagccu

SEQ ID NO: 246714 - RNA, 22 nt, Homo sapiens
ucccaguggucuugaaacaggg

SEQ ID NO: 246715 - RNA, 19 nt, Homo sapiens
uccccgggucuagugcagc

SEQ ID NO: 246716 - RNA, 22 nt, Homo sapiens
uccccugagaccccucagcacu

SEQ ID NO: 246717 - RNA, 22 nt, Homo sapiens
uccccugagucaccugcuucuc

SEQ ID NO: 246718 - RNA, 22 nt, Homo sapiens
ucccuagacuccugccuuucag

SEQ ID NO: 246719 - RNA, 22 nt, Homo sapiens
ucccuagagaagugauuuuuga

SEQ ID NO: 246720 - RNA, 20 nt, Homo sapiens
ucccucaaacuuuuccacug

SEQ ID NO: 246721 - RNA, 22 nt, Homo sapiens
ucccugaacacauguugagaag

SEQ ID NO: 246722 - RNA, 22 nt, Homo sapiens
ucccugaaucucagguucugua

SEQ ID NO: 246723 - RNA, 22 nt, Homo sapiens
ucccugagguccuggauuauug

SEQ ID NO: 246724 - RNA, 22 nt, Homo sapiens
ucccugaguaucuaauguguuu

SEQ ID NO: 246725 - RNA, 22 nt, Homo sapiens
ucccuguuaggcacagauuuau

SEQ ID NO: 246726 - RNA, 22 nt, Homo sapiens
ucccuuagccaaauccccagcc

SEQ ID NO: 246727 - RNA, 22 nt, Homo sapiens
ucccuuucuggaguuucccaag

SEQ ID NO: 246728 - RNA, 22 nt, Homo sapiens
uccucaguggauuggauggugc

SEQ ID NO: 246729 - RNA, 22 nt, Homo sapiens
uccugagaauagaguugcaugu

SEQ ID NO: 246730 - RNA, 22 nt, Homo sapiens
uccuucaguccaguggguuuug

SEQ ID NO: 246731 - RNA, 19 nt, Homo sapiens
uccuugauugcaccacugc

SEQ ID NO: 246732 - RNA, 22 nt, Homo sapiens
uccuuugguggagucuuuaggg

SEQ ID NO: 246733 - RNA, 22 nt, Homo sapiens
uccuuugguuauaggcaccucu

SEQ ID NO: 246734 - RNA, 22 nt, Homo sapiens
cugcuggucuuuaaggucuagg

SEQ ID NO: 246735 - RNA, 22 nt, Homo sapiens
cuggaaugcagcuuuaggggcu

SEQ ID NO: 246736 - RNA, 22 nt, Homo sapiens
cuggaguaugaaccauguauca

SEQ ID NO: 246737 - RNA, 22 nt, Homo sapiens
cuggagucugacugacacaagg

SEQ ID NO: 246738 - RNA, 22 nt, Homo sapiens
cuggauauuaacauugaugaaa

SEQ ID NO: 246739 - RNA, 22 nt, Homo sapiens
cuggcaaauaguagagccagga

SEQ ID NO: 246740 - RNA, 19 nt, Homo sapiens
cuggcaaaugcuuuggcca

SEQ ID NO: 246741 - RNA, 22 nt, Homo sapiens
cuggccagagacauucauuaaa

SEQ ID NO: 246742 - RNA, 22 nt, Homo sapiens
cuggcucauuucauuuagcaua

SEQ ID NO: 246743 - RNA, 22 nt, Homo sapiens
cuggcucugagguguuuagggc

SEQ ID NO: 246744 - RNA, 22 nt, Homo sapiens
cugggauggaggagaauuagag

SEQ ID NO: 246745 - RNA, 22 nt, Homo sapiens
cuggugagaugucuuuccucuu

SEQ ID NO: 246746 - RNA, 22 nt, Homo sapiens
cugguuguuacaaagagccugg

SEQ ID NO: 246747 - RNA, 22 nt, Homo sapiens
cugucacaguuuuggaggccag

SEQ ID NO: 246748 - RNA, 22 nt, Homo sapiens
cugucaucauuucuaugugcca

SEQ ID NO: 246749 - RNA, 22 nt, Homo sapiens
cugucuaugagccaggaagcca

SEQ ID NO: 246750 - RNA, 22 nt, Homo sapiens
cugucuggaguccuucgugugc

SEQ ID NO: 246751 - RNA, 22 nt, Homo sapiens
cugugauagguuagucaugaau

SEQ ID NO: 246752 - RNA, 22 nt, Homo sapiens
cugugaucuuuuuucauguggu

SEQ ID NO: 246753 - RNA, 22 nt, Homo sapiens
cugugcaaacaagugaaccccu

SEQ ID NO: 246754 - RNA, 22 nt, Homo sapiens
cugugcauaucuuggacugugu

SEQ ID NO: 246755 - RNA, 22 nt, Homo sapiens
cugugccaagcuugcgaugugc

SEQ ID NO: 246756 - RNA, 23 nt, Homo sapiens
cuguggauaugaguuguaaaugg

SEQ ID NO: 246757 - RNA, 22 nt, Homo sapiens
cuguggauguauugcacagucu

SEQ ID NO: 246758 - RNA, 22 nt, Homo sapiens
cugugguuacguucuuugugcu

SEQ ID NO: 246759 - RNA, 22 nt, Homo sapiens
cuuaacagugguauugaugacc

SEQ ID NO: 246760 - RNA, 22 nt, Homo sapiens
cuuagcaaugucguguacucac

SEQ ID NO: 246761 - RNA, 22 nt, Homo sapiens
cuucaaaguuggcuaggagaca

SEQ ID NO: 246762 - RNA, 22 nt, Homo sapiens
cuucaaguaauucugauggcua

SEQ ID NO: 246763 - RNA, 22 nt, Homo sapiens
cuucaagucuuuggauaauuag

SEQ ID NO: 246764 - RNA, 22 nt, Homo sapiens
cuucaaguuggaagggaccuaa

SEQ ID NO: 246765 - RNA, 22 nt, Homo sapiens
cuucacggugccuacuuguguc

SEQ ID NO: 246766 - RNA, 22 nt, Homo sapiens
cuucaguucuguaaggacagca

SEQ ID NO: 246767 - RNA, 22 nt, Homo sapiens
cuucaugagacuuuuggaaggc

SEQ ID NO: 246768 - RNA, 22 nt, Homo sapiens
cuuccauaguuacacccaggga

SEQ ID NO: 246769 - RNA, 22 nt, Homo sapiens
cuucucagugcucaucuuauuu

SEQ ID NO: 246770 - RNA, 22 nt, Homo sapiens
cuucuugagacuuaggcuuugg

SEQ ID NO: 246771 - RNA, 22 nt, Homo sapiens
cuucuugcuguguccucacaug

SEQ ID NO: 246772 - RNA, 21 nt, Homo sapiens
cuucuuggggcagggcagggu

SEQ ID NO: 246773 - RNA, 22 nt, Homo sapiens
cuugcacuagugcagaggcgcu

SEQ ID NO: 246774 - RNA, 22 nt, Homo sapiens
cuugcacuguuguaagggacuu

SEQ ID NO: 246775 - RNA, 22 nt, Homo sapiens
cuugcauagaguuauugcccuu

SEQ ID NO: 246776 - RNA, 20 nt, Homo sapiens
cuugcuccccuuguucuaga

SEQ ID NO: 246777 - RNA, 22 nt, Homo sapiens
cuuggcacucuguggaguuagg

SEQ ID NO: 246778 - RNA, 22 nt, Homo sapiens
cuuggcuagucaaaccuccccg

SEQ ID NO: 246779 - RNA, 22 nt, Homo sapiens
cuuggcuugguaucaaauaacc

SEQ ID NO: 246780 - RNA, 22 nt, Homo sapiens
cuuguguuacauauuuaagaga

SEQ ID NO: 246781 - RNA, 22 nt, Homo sapiens
cuuuccauuguuggagcauaaa

SEQ ID NO: 246782 - RNA, 22 nt, Homo sapiens
cuuugaugagaaaauacuuugu

SEQ ID NO: 246783 - RNA, 18 nt, Homo sapiens
cuuugcagcuuccagagg

SEQ ID NO: 246784 - RNA, 23 nt, Homo sapiens
cuuuggucucugguugacuucag

SEQ ID NO: 246785 - RNA, 20 nt, Homo sapiens
cuuuggugagucaacuccuu

SEQ ID NO: 246786 - RNA, 22 nt, Homo sapiens
cuuugguggagucuuuagguuc

SEQ ID NO: 246787 - RNA, 23 nt, Homo sapiens
cuuuguccccacccaaaucucau

SEQ ID NO: 246788 - RNA, 22 nt, Homo sapiens
cuuuuacacugcuggugggaau

SEQ ID NO: 246789 - RNA, 20 nt, Homo sapiens
cuuuuagcagcagcaagaga

SEQ ID NO: 246790 - RNA, 21 nt, Homo sapiens
cuuuugcacuccagccugggu

SEQ ID NO: 246791 - RNA, 22 nt, Homo sapiens
cuuuuggucuaucagagaagca

SEQ ID NO: 246792 - RNA, 22 nt, Homo sapiens
cuuuuggugguucugaugcagg

SEQ ID NO: 246793 - RNA, 21 nt, Homo sapiens
cuuuuuacucguucauaugca

SEQ ID NO: 246794 - RNA, 22 nt, Homo sapiens
cuuuuugcugcagcaauacugg

SEQ ID NO: 246795 - RNA, 22 nt, Homo sapiens
gaaagacuuucugcuguggaua

SEQ ID NO: 246796 - RNA, 22 nt, Homo sapiens
gaaagauuuccugagcuagaaa

SEQ ID NO: 246797 - RNA, 22 nt, Homo sapiens
gaaagugcugcuugacugggau

SEQ ID NO: 246798 - RNA, 23 nt, Homo sapiens
gaaauguaagugaugccccacag

SEQ ID NO: 246799 - RNA, 22 nt, Homo sapiens
ugaaaguuauauugugaaauuc

SEQ ID NO: 246800 - RNA, 22 nt, Homo sapiens
ugaaaugauuauaugguguuug

SEQ ID NO: 246801 - RNA, 22 nt, Homo sapiens
ugaaaugccuuuaaugaauuua

SEQ ID NO: 246802 - RNA, 22 nt, Homo sapiens
ugaaaugcuaauucguagcuaa

SEQ ID NO: 246803 - RNA, 22 nt, Homo sapiens
ugaaauggaaagaguguagacu

SEQ ID NO: 246804 - RNA, 22 nt, Homo sapiens
ugaaauguaaguugucuagucu

SEQ ID NO: 246805 - RNA, 22 nt, Homo sapiens
ugaaauguguuaucugggccug

SEQ ID NO: 246806 - RNA, 22 nt, Homo sapiens
ugaacacagccugccucugcca

SEQ ID NO: 246807 - RNA, 21 nt, Homo sapiens
ugaacacuggacugagugucc

SEQ ID NO: 246808 - RNA, 22 nt, Homo sapiens
ugaacacuggauaaggagucag

SEQ ID NO: 246809 - RNA, 22 nt, Homo sapiens
ugaacagucaucucucuuguau

SEQ ID NO: 246810 - RNA, 22 nt, Homo sapiens
ugaagacucauacuugaaucag

SEQ ID NO: 246811 - RNA, 22 nt, Homo sapiens
ugaagcuaacuugauugugaug

SEQ ID NO: 246812 - RNA, 22 nt, Homo sapiens
ugaaggacauaaggcagaguga

SEQ ID NO: 246813 - RNA, 22 nt, Homo sapiens
ugaaggaguauggauaagucgu

SEQ ID NO: 246814 - RNA, 21 nt, Homo sapiens
ugaaguagcauaggaugucaa

SEQ ID NO: 246815 - RNA, 22 nt, Homo sapiens
ugaaguaggcauaaguuaagcu

SEQ ID NO: 246816 - RNA, 22 nt, Homo sapiens
ugaagugcugugggccaggcgu

SEQ ID NO: 246817 - RNA, 22 nt, Homo sapiens
ugaauacagcacacccaugggu

SEQ ID NO: 246818 - RNA, 22 nt, Homo sapiens
ugaauacuucaaaaaaauagcu

SEQ ID NO: 246819 - RNA, 22 nt, Homo sapiens
ugaauagaaguggcaggaguag

SEQ ID NO: 246820 - RNA, 22 nt, Homo sapiens
ugaauagaaguuuacuccuuuu

SEQ ID NO: 246821 - RNA, 22 nt, Homo sapiens
ugaauagugucacaauaaacau

SEQ ID NO: 246822 - RNA, 22 nt, Homo sapiens
ugaaugcauggggccaagaagg

SEQ ID NO: 246823 - RNA, 23 nt, Homo sapiens
ugaauguaucgaaugugggaaag

SEQ ID NO: 246824 - RNA, 22 nt, Homo sapiens
ugaauguccugacgcugcaguu

SEQ ID NO: 246825 - RNA, 22 nt, Homo sapiens
ugaauugucucucacuggguuc

SEQ ID NO: 246826 - RNA, 22 nt, Homo sapiens
ugaauuguuuacgagaugugag

SEQ ID NO: 246827 - RNA, 22 nt, Homo sapiens
ugacaagacuacauaucccauu

SEQ ID NO: 246828 - RNA, 22 nt, Homo sapiens
ugacaagggaaaugcaaaaugu

SEQ ID NO: 246829 - RNA, 20 nt, Homo sapiens
ugacaagugagaauuauggg

SEQ ID NO: 246830 - RNA, 22 nt, Homo sapiens
ugacaagugauuaaggcauauu

SEQ ID NO: 246831 - RNA, 22 nt, Homo sapiens
ccuuuguggggcgguggguaau

SEQ ID NO: 246832 - RNA, 22 nt, Homo sapiens
ccuuuguuaguuugcugagaau

SEQ ID NO: 246833 - RNA, 22 nt, Homo sapiens
cuaaagauagugacaugauuug

SEQ ID NO: 246834 - RNA, 22 nt, Homo sapiens
cuaagugaacugucacugagaa

SEQ ID NO: 246835 - RNA, 22 nt, Homo sapiens
cuaauacaguuguccaagcugg

SEQ ID NO: 246836 - RNA, 18 nt, Homo sapiens
cuaauacuauucaacaag

SEQ ID NO: 246837 - RNA, 20 nt, Homo sapiens
cuaaucaucccagaagaaau

SEQ ID NO: 246838 - RNA, 21 nt, Homo sapiens
cuaaucucacccuuuucuggg

SEQ ID NO: 246839 - RNA, 22 nt, Homo sapiens
cuacagaguaucuaaagaggua

SEQ ID NO: 246840 - RNA, 22 nt, Homo sapiens
cuacagcacugagcugugugca

SEQ ID NO: 246841 - RNA, 22 nt, Homo sapiens
cuacagcagcccaguccccgaa

SEQ ID NO: 246842 - RNA, 22 nt, Homo sapiens
cuacaguagagaggauguagaa

SEQ ID NO: 246843 - RNA, 22 nt, Homo sapiens
cuagaacuagaacugcuggggu

SEQ ID NO: 246844 - RNA, 22 nt, Homo sapiens
cuagacacugacguuccuccga

SEQ ID NO: 246845 - RNA, 22 nt, Homo sapiens
cuagcagcauaagaaucaccaa

SEQ ID NO: 246846 - RNA, 21 nt, Homo sapiens
cuaucucaguguuuacauuug

SEQ ID NO: 246847 - RNA, 22 nt, Homo sapiens
cuaucugcacaggguggaaauu

SEQ ID NO: 246848 - RNA, 22 nt, Homo sapiens
cuaugcuuucugggcccugggu

SEQ ID NO: 246849 - RNA, 22 nt, Homo sapiens
cuauggcucugguuauggcugu

SEQ ID NO: 246850 - RNA, 22 nt, Homo sapiens
cuauguaccuggaacuguauua

SEQ ID NO: 246851 - RNA, 22 nt, Homo sapiens
cuauucacaauggugaagauau

SEQ ID NO: 246852 - RNA, 22 nt, Homo sapiens
cuauuugguuggugaaaaaagu

SEQ ID NO: 246853 - RNA, 22 nt, Homo sapiens
cucaaagucaagggaaagcagg

SEQ ID NO: 246854 - RNA, 22 nt, Homo sapiens
cucaaagugcuaagauuaggcu

SEQ ID NO: 246855 - RNA, 22 nt, Homo sapiens
cucaaagugcugggacuggcug

SEQ ID NO: 246856 - RNA, 22 nt, Homo sapiens
cucaaagugcugggauuggcca

SEQ ID NO: 246857 - RNA, 22 nt, Homo sapiens
cucaaaugguccagcuaguggu

SEQ ID NO: 246858 - RNA, 20 nt, Homo sapiens
cucacagacagcuucuuucu

SEQ ID NO: 246859 - RNA, 18 nt, Homo sapiens
cucacaguaacuuuuaag

SEQ ID NO: 246860 - RNA, 22 nt, Homo sapiens
cucacagucucucccuaauuuu

SEQ ID NO: 246861 - RNA, 17 nt, Homo sapiens
cucacugagaacagcua

SEQ ID NO: 246862 - RNA, 22 nt, Homo sapiens
cucagagcacaguuuaugacag

SEQ ID NO: 246863 - RNA, 22 nt, Homo sapiens
cucagcuacuugagaggcuuag

SEQ ID NO: 246864 - RNA, 22 nt, Homo sapiens
cucagggugguggacucuaaua

SEQ ID NO: 246865 - RNA, 22 nt, Homo sapiens
cucagugaagggcaagaggcaa

SEQ ID NO: 246866 - RNA, 22 nt, Homo sapiens
cucaguguucccauucuaccuu

SEQ ID NO: 246867 - RNA, 22 nt, Homo sapiens
cucauugcaaucuccaccuccc

SEQ ID NO: 246868 - RNA, 22 nt, Homo sapiens
cucauuggcuacugaggcuugu

SEQ ID NO: 246869 - RNA, 22 nt, Homo sapiens
cuccaggugagguuaagggacu

SEQ ID NO: 246870 - RNA, 22 nt, Homo sapiens
cuccaguacagagagguuccuc

SEQ ID NO: 246871 - RNA, 22 nt, Homo sapiens
cucccacccucauuuuuaggca

SEQ ID NO: 246872 - RNA, 22 nt, Homo sapiens
cucccagugacccaggaacagg

SEQ ID NO: 246873 - RNA, 22 nt, Homo sapiens
cucccugagccagggcuuugac

SEQ ID NO: 246874 - RNA, 20 nt, Homo sapiens
cuccuucauuccuuuggacc

SEQ ID NO: 246875 - RNA, 22 nt, Homo sapiens
cucucaguugucuaauuaguuu

SEQ ID NO: 246876 - RNA, 22 nt, Homo sapiens
cucucugagccccagacaccuu

SEQ ID NO: 246877 - RNA, 22 nt, Homo sapiens
cucugcuuaaugucccacuuga

SEQ ID NO: 246878 - RNA, 22 nt, Homo sapiens
cucuggauauuccugucuaaaa

SEQ ID NO: 246879 - RNA, 22 nt, Homo sapiens
cucugguggaagcagggggcaa

SEQ ID NO: 246880 - RNA, 22 nt, Homo sapiens
cucugguuuuucuuccauuaag

SEQ ID NO: 246881 - RNA, 22 nt, Homo sapiens
cucuuggguagauuuugcagag

SEQ ID NO: 246882 - RNA, 22 nt, Homo sapiens
cugaaaagcaucugcauagcug

SEQ ID NO: 246883 - RNA, 19 nt, Homo sapiens
cugaaacacagagagggcu

SEQ ID NO: 246884 - RNA, 22 nt, Homo sapiens
cugaaagagcauguaacacagu

SEQ ID NO: 246885 - RNA, 22 nt, Homo sapiens
cugaaagguauacgcuuguuau

SEQ ID NO: 246886 - RNA, 22 nt, Homo sapiens
cugaaaguuauucaggggcaag

SEQ ID NO: 246887 - RNA, 22 nt, Homo sapiens
cugaaucauugguuaugaguac

SEQ ID NO: 246888 - RNA, 22 nt, Homo sapiens
cugaauguucuggauggaagag

SEQ ID NO: 246889 - RNA, 22 nt, Homo sapiens
cugacagaugacugccacugua

SEQ ID NO: 246890 - RNA, 22 nt, Homo sapiens
cugacauggggauccaccuuag

SEQ ID NO: 246891 - RNA, 22 nt, Homo sapiens
cugaccuaugauuuggcucaaa

SEQ ID NO: 246892 - RNA, 22 nt, Homo sapiens
cugacugaggaucaguucauca

SEQ ID NO: 246893 - RNA, 22 nt, Homo sapiens
cugagacacucuuaucugcaua

SEQ ID NO: 246894 - RNA, 22 nt, Homo sapiens
cugagauaauuucuagguguca

SEQ ID NO: 246895 - RNA, 22 nt, Homo sapiens
cugagcaauauagugagaucuu

SEQ ID NO: 246896 - RNA, 18 nt, Homo sapiens
cugagcacugcuuuauga

SEQ ID NO: 246897 - RNA, 22 nt, Homo sapiens
cugagcuagaccauuuggcucc

SEQ ID NO: 246898 - RNA, 22 nt, Homo sapiens
cugagcuaugccuggaaaggca

SEQ ID NO: 246899 - RNA, 22 nt, Homo sapiens
cugaggcacggcgaccuuaagu

SEQ ID NO: 246900 - RNA, 22 nt, Homo sapiens
cugagguaauuuuccagauaau

SEQ ID NO: 246901 - RNA, 22 nt, Homo sapiens
cugagguacccacuucaucuca

SEQ ID NO: 246902 - RNA, 20 nt, Homo sapiens
cugagguacgaggguuaaau

SEQ ID NO: 246903 - RNA, 22 nt, Homo sapiens
uagcagaauauaccucuuacuu

SEQ ID NO: 246904 - RNA, 22 nt, Homo sapiens
uagcagcauuuuuguagaguau

SEQ ID NO: 246905 - RNA, 22 nt, Homo sapiens
uagcauaauuuguagaaaauca

SEQ ID NO: 246906 - RNA, 22 nt, Homo sapiens
uagcauccuucucuaaacagga

SEQ ID NO: 246907 - RNA, 22 nt, Homo sapiens
uagcauggaggcggccauagug

SEQ ID NO: 246908 - RNA, 22 nt, Homo sapiens
uagcauggagucaugcacggcu

SEQ ID NO: 246909 - RNA, 22 nt, Homo sapiens
uagcugcaaaauauagacuucu

SEQ ID NO: 246910 - RNA, 21 nt, Homo sapiens
uagcugcacccaggccuccuu

SEQ ID NO: 246911 - RNA, 22 nt, Homo sapiens
uagcuggaauuacuugcaccug

SEQ ID NO: 246912 - RNA, 22 nt, Homo sapiens
uagcugguucuccaggagcuag

SEQ ID NO: 246913 - RNA, 22 nt, Homo sapiens
uaggagcacaaaccccauugug

SEQ ID NO: 246914 - RNA, 22 nt, Homo sapiens
uaggagcauaggauuguuugag

SEQ ID NO: 246915 - RNA, 22 nt, Homo sapiens
uaggagugugaacccuaugaac

SEQ ID NO: 246916 - RNA, 22 nt, Homo sapiens
uaggcaguggagaaauaaacag

SEQ ID NO: 246917 - RNA, 22 nt, Homo sapiens
uaggcuuuucugggaugugggc

SEQ ID NO: 246918 - RNA, 22 nt, Homo sapiens
uagggcauugaacugaauucuu

SEQ ID NO: 246919 - RNA, 22 nt, Homo sapiens
uagguagaacccagaaaucuga

SEQ ID NO: 246920 - RNA, 22 nt, Homo sapiens
uagguagaacuuuagacccugu

SEQ ID NO: 246921 - RNA, 22 nt, Homo sapiens
uagguagaaucuugaagccauu

SEQ ID NO: 246922 - RNA, 22 nt, Homo sapiens
uagguauguauauacacacaca

SEQ ID NO: 246923 - RNA, 22 nt, Homo sapiens
uaggucaguuuuggcuuggcuu

SEQ ID NO: 246924 - RNA, 22 nt, Homo sapiens
uaggucuuuuaugaaauauauu

SEQ ID NO: 246925 - RNA, 20 nt, Homo sapiens
uagguuuucacagaauugcc

SEQ ID NO: 246926 - RNA, 18 nt, Homo sapiens
uaguacuguucucaugau

SEQ ID NO: 246927 - RNA, 22 nt, Homo sapiens
uaguagcaccucucaugagcuu

SEQ ID NO: 246928 - RNA, 22 nt, Homo sapiens
uagugcacuacuugugggaaug

SEQ ID NO: 246929 - RNA, 21 nt, Homo sapiens
uagugcagugggguaugacuu

SEQ ID NO: 246930 - RNA, 18 nt, Homo sapiens
uagugcuguucucaugau

SEQ ID NO: 246931 - RNA, 22 nt, Homo sapiens
uaguguuuuucauuggcagagg

SEQ ID NO: 246932 - RNA, 20 nt, Homo sapiens
uauaacaguuuggacccagu

SEQ ID NO: 246933 - RNA, 22 nt, Homo sapiens
uauaagguuaggaaaaauuucu

SEQ ID NO: 246934 - RNA, 22 nt, Homo sapiens
uauacaguaggcacucaguggc

SEQ ID NO: 246935 - RNA, 22 nt, Homo sapiens
uauauaagcugaugagccacaa

SEQ ID NO: 246936 - RNA, 22 nt, Homo sapiens
uauaugcaacauaguguaugug

SEQ ID NO: 246937 - RNA, 22 nt, Homo sapiens
uauaugcucugggauccugaaa

SEQ ID NO: 246938 - RNA, 22 nt, Homo sapiens
uaucacagguggacugcacacc

SEQ ID NO: 246939 - RNA, 21 nt, Homo sapiens
uaucacaguagaauaggaucu

SEQ ID NO: 246940 - RNA, 20 nt, Homo sapiens
uaucacaguucaggaacucu

SEQ ID NO: 246941 - RNA, 22 nt, Homo sapiens
uaucaccuugcaggagcuauga

SEQ ID NO: 246942 - RNA, 22 nt, Homo sapiens
uaucacuguuguuuguuuaagg

SEQ ID NO: 246943 - RNA, 21 nt, Homo sapiens
uaucagagacauugagaggca

SEQ ID NO: 246944 - RNA, 22 nt, Homo sapiens
uaucagcacaguggguucaugg

SEQ ID NO: 246945 - RNA, 22 nt, Homo sapiens
uaucagcagcaggggcugcaga

SEQ ID NO: 246946 - RNA, 22 nt, Homo sapiens
uaucauaguuuggacuuucauu

SEQ ID NO: 246947 - RNA, 22 nt, Homo sapiens
uaucaucauuggcaggugagaa

SEQ ID NO: 246948 - RNA, 20 nt, Homo sapiens
uaucuacuugcaaaugccau

SEQ ID NO: 246949 - RNA, 23 nt, Homo sapiens
uaucucaaugcacagagaggaaa

SEQ ID NO: 246950 - RNA, 22 nt, Homo sapiens
uaucucagaguguacaagauua

SEQ ID NO: 246951 - RNA, 21 nt, Homo sapiens
uaucucaguuuuccuuugugg

SEQ ID NO: 246952 - RNA, 22 nt, Homo sapiens
uaucucuuuucauguguaaaug

SEQ ID NO: 246953 - RNA, 20 nt, Homo sapiens
uaugaaacaguguagagcaa

SEQ ID NO: 246954 - RNA, 22 nt, Homo sapiens
uaugagagcugguagguagaga

SEQ ID NO: 246955 - RNA, 22 nt, Homo sapiens
uaugagcaaaaugaggguuagu

SEQ ID NO: 246956 - RNA, 19 nt, Homo sapiens
uaugcuagagagggaagcu

SEQ ID NO: 246957 - RNA, 22 nt, Homo sapiens
uauggauguuaagguucacagc

SEQ ID NO: 246958 - RNA, 22 nt, Homo sapiens
uauggauuuuggaauauguggg

SEQ ID NO: 246959 - RNA, 22 nt, Homo sapiens
uauggcaaugcauaggaaggaa

SEQ ID NO: 246960 - RNA, 22 nt, Homo sapiens
uauggcccuuaaguauugguug

SEQ ID NO: 246961 - RNA, 22 nt, Homo sapiens
uauggcucuauuuccuugucua

SEQ ID NO: 246962 - RNA, 22 nt, Homo sapiens
uaugucacagguuuuggugaaa

SEQ ID NO: 246963 - RNA, 22 nt, Homo sapiens
uaugucaugggguuuuugagau

SEQ ID NO: 246964 - RNA, 22 nt, Homo sapiens
uaugugcaaauuaauugcuaga

SEQ ID NO: 246965 - RNA, 22 nt, Homo sapiens
uaugugcuuuguuaaacagaug

SEQ ID NO: 246966 - RNA, 22 nt, Homo sapiens
uauguuaucaaaaagcuaagga

SEQ ID NO: 246967 - RNA, 22 nt, Homo sapiens
uauuaagcuaguugucagugcu

SEQ ID NO: 246968 - RNA, 22 nt, Homo sapiens
uauuacuugucugugucucaau

SEQ ID NO: 246969 - RNA, 22 nt, Homo sapiens
uauucaagccaaauucaagcca

SEQ ID NO: 246970 - RNA, 22 nt, Homo sapiens
uauucacaggugugggacaaag

SEQ ID NO: 246971 - RNA, 22 nt, Homo sapiens
uauucacuguaucauugauggg

SEQ ID NO: 246972 - RNA, 22 nt, Homo sapiens
uauuccacucuguuggagguaa

SEQ ID NO: 246973 - RNA, 22 nt, Homo sapiens
uauuccacuuacaugagguauc

SEQ ID NO: 246974 - RNA, 22 nt, Homo sapiens
uauuccauuugugaaaggaagu

SEQ ID NO: 246975 - RNA, 22 nt, Homo sapiens
uauugaacuggaucagaaggcc

SEQ ID NO: 246976 - RNA, 22 nt, Homo sapiens
uauugcauauuauucuaguggc

SEQ ID NO: 246977 - RNA, 22 nt, Homo sapiens
uauugccucuuuuguaaaagug

SEQ ID NO: 246978 - RNA, 22 nt, Homo sapiens
uauugccugucuccaaaaauca

SEQ ID NO: 246979 - RNA, 22 nt, Homo sapiens
uauugcuaaauucuuuuccuag

SEQ ID NO: 246980 - RNA, 22 nt, Homo sapiens
uauugcucugacugauuggaug

SEQ ID NO: 246981 - RNA, 22 nt, Homo sapiens
uauugcugaaaaugcuaaugau

SEQ ID NO: 246982 - RNA, 18 nt, Homo sapiens
uauugcuugguuuggaga

SEQ ID NO: 246983 - RNA, 22 nt, Homo sapiens
gucauaucauuggccaguggaa

SEQ ID NO: 246984 - RNA, 22 nt, Homo sapiens
gucauggaggaugaauggccaa

SEQ ID NO: 246985 - RNA, 22 nt, Homo sapiens
gucaugggguacuacacauggg

SEQ ID NO: 246986 - RNA, 22 nt, Homo sapiens
gucauucauucagcaagcacug

SEQ ID NO: 246987 - RNA, 22 nt, Homo sapiens
gucauugcuuaucugcugacgu

SEQ ID NO: 246988 - RNA, 22 nt, Homo sapiens
guccaaagugggagaggugggg

SEQ ID NO: 246989 - RNA, 22 nt, Homo sapiens
guccaguuguuuucugagguug

SEQ ID NO: 246990 - RNA, 22 nt, Homo sapiens
guccuugaggcuuugacugugg

SEQ ID NO: 246991 - RNA, 22 nt, Homo sapiens
gucucacagcuagcugcuuuau

SEQ ID NO: 246992 - RNA, 22 nt, Homo sapiens
gucucccagccuacaucuuucu

SEQ ID NO: 246993 - RNA, 22 nt, Homo sapiens
gucuggcaauggcagacuggca

SEQ ID NO: 246994 - RNA, 22 nt, Homo sapiens
gucugguuggaguaguuuucag

SEQ ID NO: 246995 - RNA, 22 nt, Homo sapiens
gucuugcacuuaccuaagaacu

SEQ ID NO: 246996 - RNA, 20 nt, Homo sapiens
gucuugcuccguugcccagg

SEQ ID NO: 246997 - RNA, 22 nt, Homo sapiens
gucuuggagacauugccauuga

SEQ ID NO: 246998 - RNA, 22 nt, Homo sapiens
gucuuuaguugaaacauguggu

SEQ ID NO: 246999 - RNA, 22 nt, Homo sapiens
gucuuugaugucuaugugcuuc

SEQ ID NO: 247000 - RNA, 17 nt, Homo sapiens
gucuuugguugaguuua

SEQ ID NO: 247001 - RNA, 22 nt, Homo sapiens
gucuuuguuuggucuguaucag

SEQ ID NO: 247002 - RNA, 22 nt, Homo sapiens
gucuuuguuuugauuuaccaga

SEQ ID NO: 247003 - RNA, 22 nt, Homo sapiens
gucuuuugcuagccagagagcu

SEQ ID NO: 247004 - RNA, 22 nt, Homo sapiens
gugaaauauuuaacguccaggu

SEQ ID NO: 247005 - RNA, 22 nt, Homo sapiens
gugaauagggaauaaugggauc

SEQ ID NO: 247006 - RNA, 22 nt, Homo sapiens
gugacacagcaagacuccgucu

SEQ ID NO: 247007 - RNA, 22 nt, Homo sapiens
gugacagucaaagacaugacuu

SEQ ID NO: 247008 - RNA, 22 nt, Homo sapiens
gugaccauuugacauauccuug

SEQ ID NO: 247009 - RNA, 22 nt, Homo sapiens
gugagaacugugucuuauaaac

SEQ ID NO: 247010 - RNA, 22 nt, Homo sapiens
gugagaaucaaacuacauaaau

SEQ ID NO: 247011 - RNA, 22 nt, Homo sapiens
gugagaccaauguacuaccuuc

SEQ ID NO: 247012 - RNA, 22 nt, Homo sapiens
gugagagaaugacuauguguuu

SEQ ID NO: 247013 - RNA, 22 nt, Homo sapiens
gugagaggaggcagcuuuuaca

SEQ ID NO: 247014 - RNA, 22 nt, Homo sapiens
gugagauaaugucucauugugg

SEQ ID NO: 247015 - RNA, 22 nt, Homo sapiens
gugagauuagcugagauccuug

SEQ ID NO: 247016 - RNA, 22 nt, Homo sapiens
gugagcauaggaggcuucuguu

SEQ ID NO: 247017 - RNA, 22 nt, Homo sapiens
gugaggugguacaauauuaacu

SEQ ID NO: 247018 - RNA, 20 nt, Homo sapiens
gugagucauuaguaaccaaa

SEQ ID NO: 247019 - RNA, 22 nt, Homo sapiens
gugaguuauuauuuauguaaac

SEQ ID NO: 247020 - RNA, 22 nt, Homo sapiens
gugauauguuaggaucuaaguc

SEQ ID NO: 247021 - RNA, 21 nt, Homo sapiens
gugaucaugucacugcacucc

SEQ ID NO: 247022 - RNA, 22 nt, Homo sapiens
gugauugucuaaucaagauaca

SEQ ID NO: 247023 - RNA, 22 nt, Homo sapiens
gugauugugaaaacauuaagaa

SEQ ID NO: 247024 - RNA, 22 nt, Homo sapiens
gugcaagagugauugcaguuuu

SEQ ID NO: 247025 - RNA, 18 nt, Homo sapiens
gugcaaugaauagcagag

SEQ ID NO: 247026 - RNA, 22 nt, Homo sapiens
gugcaaugucaggagaugcagc

SEQ ID NO: 247027 - RNA, 22 nt, Homo sapiens
gugcacaacaugcaguuuuguu

SEQ ID NO: 247028 - RNA, 22 nt, Homo sapiens
gugcacaucuguguuccagcua

SEQ ID NO: 247029 - RNA, 22 nt, Homo sapiens
gugcagugugauccuuccguau

SEQ ID NO: 247030 - RNA, 22 nt, Homo sapiens
gugcaguuugaaaguagaaaca

SEQ ID NO: 247031 - RNA, 22 nt, Homo sapiens
gugcauacgucuuuauaguagc

SEQ ID NO: 247032 - RNA, 18 nt, Homo sapiens
gugcauagccauggcagc

SEQ ID NO: 247033 - RNA, 23 nt, Homo sapiens
gugcaugagucuuuauaguagca

SEQ ID NO: 247034 - RNA, 22 nt, Homo sapiens
gugccacaguguuaagggauuc

SEQ ID NO: 247035 - RNA, 23 nt, Homo sapiens
gugccuucugagccuagucucca

SEQ ID NO: 247036 - RNA, 22 nt, Homo sapiens
gugcuuguauuuaaaucaugug

SEQ ID NO: 247037 - RNA, 22 nt, Homo sapiens
guggaaaacauaugcuuguuga

SEQ ID NO: 247038 - RNA, 22 nt, Homo sapiens
guggaaaaguaguugcgguuuu

SEQ ID NO: 247039 - RNA, 22 nt, Homo sapiens
guggaagaccagacuuuccaac

SEQ ID NO: 247040 - RNA, 22 nt, Homo sapiens
guggaauggaaugauuguguau

SEQ ID NO: 247041 - RNA, 22 nt, Homo sapiens
guggacaugaauuuuggaggca

SEQ ID NO: 247042 - RNA, 22 nt, Homo sapiens
guggcaagaugacuacucacug

SEQ ID NO: 247043 - RNA, 22 nt, Homo sapiens
guggcagcacauauagguuguu

SEQ ID NO: 247044 - RNA, 22 nt, Homo sapiens
guggcaugaaagcagauaccac

SEQ ID NO: 247045 - RNA, 22 nt, Homo sapiens
guggcgagaucauagcucauug

SEQ ID NO: 247046 - RNA, 22 nt, Homo sapiens
guggcuaaagauuuggaaucug

SEQ ID NO: 247047 - RNA, 22 nt, Homo sapiens
gugggaagcuggaacucccucc

SEQ ID NO: 247048 - RNA, 22 nt, Homo sapiens
gugggagugucccguuuuucca

SEQ ID NO: 247049 - RNA, 19 nt, Homo sapiens
gugguauuaccuuuugauu

SEQ ID NO: 247050 - RNA, 22 nt, Homo sapiens
gugguucuagaauugaguaucc

SEQ ID NO: 247051 - RNA, 22 nt, Homo sapiens
gugguucuagagggacagaaug

SEQ ID NO: 247052 - RNA, 22 nt, Homo sapiens
gugguuuuacaaagagaaagau

SEQ ID NO: 247053 - RNA, 22 nt, Homo sapiens
gugguuuuaucccagaaauuaa

SEQ ID NO: 247054 - RNA, 22 nt, Homo sapiens
gugguuuuuaaaguaccugugg

SEQ ID NO: 247055 - RNA, 22 nt, Homo sapiens
gugguuuuuagauuucuacagu

SEQ ID NO: 247056 - RNA, 22 nt, Homo sapiens
gugguuuuuuucugccuuauag

SEQ ID NO: 247057 - RNA, 22 nt, Homo sapiens
uacugcaucuacuuagagccag

SEQ ID NO: 247058 - RNA, 22 nt, Homo sapiens
uacugcuuaaaagucaauuacu

SEQ ID NO: 247059 - RNA, 21 nt, Homo sapiens
uacuggagauacagucugcaa

SEQ ID NO: 247060 - RNA, 22 nt, Homo sapiens
uacuuagagacaugcagcacug

SEQ ID NO: 247061 - RNA, 22 nt, Homo sapiens
uacuucauucuugaccuugcau

SEQ ID NO: 247062 - RNA, 22 nt, Homo sapiens
uagaacaauugcuggauccgaa

SEQ ID NO: 247063 - RNA, 18 nt, Homo sapiens
uagaauauaggucauucu

SEQ ID NO: 247064 - RNA, 22 nt, Homo sapiens
uagaaucuaacucgcaugaaaa

SEQ ID NO: 247065 - RNA, 22 nt, Homo sapiens
uagaaugaaacaagcugugccu

SEQ ID NO: 247066 - RNA, 22 nt, Homo sapiens
uagaauguaaauuccaagggca

SEQ ID NO: 247067 - RNA, 22 nt, Homo sapiens
uagagagcuguuugaaagcagg

SEQ ID NO: 247068 - RNA, 22 nt, Homo sapiens
uagagauaucaauuucauggug

SEQ ID NO: 247069 - RNA, 22 nt, Homo sapiens
uagagcuagggacucgcaaugu

SEQ ID NO: 247070 - RNA, 22 nt, Homo sapiens
uagaggaaggauuggaaacgca

SEQ ID NO: 247071 - RNA, 22 nt, Homo sapiens
uagagguagguguaugaacuag

SEQ ID NO: 247072 - RNA, 22 nt, Homo sapiens
uagagguauguauaguauucuu

SEQ ID NO: 247073 - RNA, 21 nt, Homo sapiens
uagauaguugguucugaaucu

SEQ ID NO: 247074 - RNA, 21 nt, Homo sapiens
uagaugguguucuagagagaa

SEQ ID NO: 247075 - RNA, 22 nt, Homo sapiens
uagauuaucucaccacucgagu

SEQ ID NO: 247076 - RNA, 21 nt, Homo sapiens
uagcaaauugcuauuaaggca

SEQ ID NO: 247077 - RNA, 20 nt, Homo sapiens
uagcacacauguagaauagu

SEQ ID NO: 247078 - RNA, 22 nt, Homo sapiens
uagcacagggaauugguucucu

SEQ ID NO: 247079 - RNA, 19 nt, Homo sapiens
uagcacagggucccagacu

SEQ ID NO: 247080 - RNA, 20 nt, Homo sapiens
uagcacaucuggcuguagag

SEQ ID NO: 247081 - RNA, 22 nt, Homo sapiens
uagcacaugucagguaauuugc

SEQ ID NO: 247082 - RNA, 23 nt, Homo sapiens
uagcacuuuuuacauauggacau

SEQ ID NO: 247083 - RNA, 22 nt, Homo sapiens
uuccuaguccugagucucugcg

SEQ ID NO: 247084 - RNA, 19 nt, Homo sapiens
uuccugagaacaagggcuu

SEQ ID NO: 247085 - RNA, 22 nt, Homo sapiens
uuccugagagggcugggugcag

SEQ ID NO: 247086 - RNA, 22 nt, Homo sapiens
uuccuggaggggaaguguccaa

SEQ ID NO: 247087 - RNA, 22 nt, Homo sapiens
uuccuguagcgauuuuaguaau

SEQ ID NO: 247088 - RNA, 22 nt, Homo sapiens
uuccuucaugcuugaaggguau

SEQ ID NO: 247089 - RNA, 22 nt, Homo sapiens
uucuagcacuuugggagacuga

SEQ ID NO: 247090 - RNA, 21 nt, Homo sapiens
uucuauggucagaauucaaua

SEQ ID NO: 247091 - RNA, 21 nt, Homo sapiens
uucucaggguguguccuaccc

SEQ ID NO: 247092 - RNA, 22 nt, Homo sapiens
uucucaguaauuccagauuuuu

SEQ ID NO: 247093 - RNA, 22 nt, Homo sapiens
uucucagugaaguuuagaacau

SEQ ID NO: 247094 - RNA, 22 nt, Homo sapiens
uucucugggacauaggucgggu

SEQ ID NO: 247095 - RNA, 19 nt, Homo sapiens
uucucugguuguacuaccc

SEQ ID NO: 247096 - RNA, 22 nt, Homo sapiens
uucugguuaauacuugcaaaaa

SEQ ID NO: 247097 - RNA, 22 nt, Homo sapiens
uucugugcuuguggaugaagug

SEQ ID NO: 247098 - RNA, 22 nt, Homo sapiens
uucugugguagaaaucucaaau

SEQ ID NO: 247099 - RNA, 22 nt, Homo sapiens
uucugugguuucauuuaccugu

SEQ ID NO: 247100 - RNA, 22 nt, Homo sapiens
uucuucaggcauucccagaagc

SEQ ID NO: 247101 - RNA, 22 nt, Homo sapiens
uucuugguugcucacacccauc

SEQ ID NO: 247102 - RNA, 22 nt, Homo sapiens
uucuuugcuuggaagcggggga

SEQ ID NO: 247103 - RNA, 19 nt, Homo sapiens
uucuuuguugugggggcug

SEQ ID NO: 247104 - RNA, 22 nt, Homo sapiens
uugaaagucauuucuucuaagu

SEQ ID NO: 247105 - RNA, 22 nt, Homo sapiens
uugaaauguguaagcuccgaaa

SEQ ID NO: 247106 - RNA, 22 nt, Homo sapiens
uugaaauguuuagaaguuugga

SEQ ID NO: 247107 - RNA, 22 nt, Homo sapiens
uugaacuagaaccugcaaauuu

SEQ ID NO: 247108 - RNA, 22 nt, Homo sapiens
uugaacuguaagggucugugug

SEQ ID NO: 247109 - RNA, 22 nt, Homo sapiens
uugaauaguggugaaaguuuga

SEQ ID NO: 247110 - RNA, 22 nt, Homo sapiens
uugaauggaauguuggaacuau

SEQ ID NO: 247111 - RNA, 22 nt, Homo sapiens
uugacaaggagccauugcaucu

SEQ ID NO: 247112 - RNA, 22 nt, Homo sapiens
uugacauaaucauuucacagug

SEQ ID NO: 247113 - RNA, 22 nt, Homo sapiens
uugacauauuugugcuuaagaa

SEQ ID NO: 247114 - RNA, 22 nt, Homo sapiens
uugaccaaagaagagucauugc

SEQ ID NO: 247115 - RNA, 22 nt, Homo sapiens
uugagagagaacauuuguuaca

SEQ ID NO: 247116 - RNA, 22 nt, Homo sapiens
uugagagcugaugaaagauaaa

SEQ ID NO: 247117 - RNA, 22 nt, Homo sapiens
uugagaugaagucuugcucucu

SEQ ID NO: 247118 - RNA, 22 nt, Homo sapiens
uugagaugaaguuuugcucuuu

SEQ ID NO: 247119 - RNA, 22 nt, Homo sapiens
uugagauggagucucacuccuu

SEQ ID NO: 247120 - RNA, 22 nt, Homo sapiens
uugagauggagucucacucugu

SEQ ID NO: 247121 - RNA, 22 nt, Homo sapiens
uugagauggagucucacucuuc

SEQ ID NO: 247122 - RNA, 22 nt, Homo sapiens
uugagauggaguuucgcucuuu

SEQ ID NO: 247123 - RNA, 22 nt, Homo sapiens
uugagauggaguuuugcucuug

SEQ ID NO: 247124 - RNA, 22 nt, Homo sapiens
uugagauggauagacauagcau

SEQ ID NO: 247125 - RNA, 22 nt, Homo sapiens
uugagauggugccacuguacuc

SEQ ID NO: 247126 - RNA, 22 nt, Homo sapiens
uugagauguggguuggugacuu

SEQ ID NO: 247127 - RNA, 22 nt, Homo sapiens
uugagauuuuccucaaauauuu

SEQ ID NO: 247128 - RNA, 22 nt, Homo sapiens
uugagcaauccuccugccaugu

SEQ ID NO: 247129 - RNA, 22 nt, Homo sapiens
uugagcacaggaguuugagacc

SEQ ID NO: 247130 - RNA, 22 nt, Homo sapiens
uugagcacaguagguuguggcu

SEQ ID NO: 247131 - RNA, 22 nt, Homo sapiens
uugagcuauguacagaugcugu

SEQ ID NO: 247132 - RNA, 22 nt, Homo sapiens
uugaggaaugugauuucaaaua

SEQ ID NO: 247133 - RNA, 22 nt, Homo sapiens
uugagggagcauuuguuuugag

SEQ ID NO: 247134 - RNA, 22 nt, Homo sapiens
uugagggaggccucaguuuaca

SEQ ID NO: 247135 - RNA, 22 nt, Homo sapiens
uugagguaauaaacagccauuc

SEQ ID NO: 247136 - RNA, 22 nt, Homo sapiens
uugagguauugauaaaacauuu

SEQ ID NO: 247137 - RNA, 22 nt, Homo sapiens
uugagguauuuugucaacugua

SEQ ID NO: 247138 - RNA, 22 nt, Homo sapiens
uugagguuggaggccuugccug

SEQ ID NO: 247139 - RNA, 22 nt, Homo sapiens
uugaguaguaagaagaugauag

SEQ ID NO: 247140 - RNA, 21 nt, Homo sapiens
uugaguugaagcaaggaggga

SEQ ID NO: 247141 - RNA, 22 nt, Homo sapiens
uugauaagaaaaauauaccaga

SEQ ID NO: 247142 - RNA, 22 nt, Homo sapiens
uugauauguaguuggacuugau

SEQ ID NO: 247143 - RNA, 22 nt, Homo sapiens
uugauauguuguuagauucagu

SEQ ID NO: 247144 - RNA, 22 nt, Homo sapiens
uugauauucugagaagcugaag

SEQ ID NO: 247145 - RNA, 22 nt, Homo sapiens
uugauguaggcauucaaggcua

SEQ ID NO: 247146 - RNA, 22 nt, Homo sapiens
uugauguguuuccaggauuugu

SEQ ID NO: 247147 - RNA, 20 nt, Homo sapiens
uugauucccucuaaacucgc

SEQ ID NO: 247148 - RNA, 23 nt, Homo sapiens
uugcaaagccugaaacucuucag

SEQ ID NO: 247149 - RNA, 22 nt, Homo sapiens
uugcaaaguuugccuccuguag

SEQ ID NO: 247150 - RNA, 22 nt, Homo sapiens
uugcacagugguuuagagccug

SEQ ID NO: 247151 - RNA, 22 nt, Homo sapiens
uugcacauguugaaccagcaaa

SEQ ID NO: 247152 - RNA, 22 nt, Homo sapiens
uugcacauugauuuuguauccu

SEQ ID NO: 247153 - RNA, 22 nt, Homo sapiens
uugcacauugauuuuguaucuu

SEQ ID NO: 247154 - RNA, 22 nt, Homo sapiens
uugcacuccagccugggugaca

SEQ ID NO: 247155 - RNA, 22 nt, Homo sapiens
uugcacucuccagccucggcaa

SEQ ID NO: 247156 - RNA, 22 nt, Homo sapiens
uugcacugagauuuugcuuaca

SEQ ID NO: 247157 - RNA, 22 nt, Homo sapiens
uugcagcaaagagggaggggca

SEQ ID NO: 247158 - RNA, 22 nt, Homo sapiens
uugcagcaaauaggaaugagga

SEQ ID NO: 247159 - RNA, 22 nt, Homo sapiens
uugcaguagucugaaagcaaua

SEQ ID NO: 247160 - RNA, 22 nt, Homo sapiens
uugcauauguugaaccaagcgu

SEQ ID NO: 247161 - RNA, 22 nt, Homo sapiens
uugcauauucucugaggcagga

SEQ ID NO: 247162 - RNA, 22 nt, Homo sapiens
uugcaugggagcugggugaggc

SEQ ID NO: 247163 - RNA, 22 nt, Homo sapiens
uugcauuagugugguacauuug

SEQ ID NO: 247164 - RNA, 22 nt, Homo sapiens
uugcccuuuagguaacuauaua

SEQ ID NO: 247165 - RNA, 22 nt, Homo sapiens
uugccuaggcuggagugcagug

SEQ ID NO: 247166 - RNA, 22 nt, Homo sapiens
uugccuaguuuaggucugugcu

SEQ ID NO: 247167 - RNA, 22 nt, Homo sapiens
uugcuccucugccaggaccugu

SEQ ID NO: 247168 - RNA, 22 nt, Homo sapiens
uugcugagucuuucuagguugc

SEQ ID NO: 247169 - RNA, 22 nt, Homo sapiens
uugcuggugguucgagcaacac

SEQ ID NO: 247170 - RNA, 20 nt, Homo sapiens
uugcugguguuagaggaggc

SEQ ID NO: 247171 - RNA, 22 nt, Homo sapiens
uugcuuuguugucuggggaaua

SEQ ID NO: 247172 - RNA, 22 nt, Homo sapiens
uuggaaaccucugcagguguuu

SEQ ID NO: 247173 - RNA, 22 nt, Homo sapiens
uuggaaauauguuaagugucau

SEQ ID NO: 247174 - RNA, 22 nt, Homo sapiens
uuggaagauuacuuaguuuucu

SEQ ID NO: 247175 - RNA, 22 nt, Homo sapiens
uuggaaggcuccuaaugaaugg

SEQ ID NO: 247176 - RNA, 22 nt, Homo sapiens
uuggaaguguguauguauagcu

SEQ ID NO: 247177 - RNA, 22 nt, Homo sapiens
uuggaauacucaaaagguuggg

SEQ ID NO: 247178 - RNA, 22 nt, Homo sapiens
uguguacugcagaguauucugu

SEQ ID NO: 247179 - RNA, 22 nt, Homo sapiens
ugugucuuguuuauagcuuucu

SEQ ID NO: 247180 - RNA, 22 nt, Homo sapiens
uguuaagaugucaauuuuccac

SEQ ID NO: 247181 - RNA, 22 nt, Homo sapiens
uguucaugaguucucauuuuua

SEQ ID NO: 247182 - RNA, 22 nt, Homo sapiens
uguugcacucuagccugggcaa

SEQ ID NO: 247183 - RNA, 22 nt, Homo sapiens
uguugguuaaaucagguuuuaa

SEQ ID NO: 247184 - RNA, 22 nt, Homo sapiens
uguuugcuguguggaguagcag

SEQ ID NO: 247185 - RNA, 22 nt, Homo sapiens
uguuuguuugagauggagucuc

SEQ ID NO: 247186 - RNA, 22 nt, Homo sapiens
uuaaaagcuaucuccaagguca

SEQ ID NO: 247187 - RNA, 22 nt, Homo sapiens
uuaaacucaucacccagguagu

SEQ ID NO: 247188 - RNA, 22 nt, Homo sapiens
acacuguccaguuaggcuacau

SEQ ID NO: 247189 - RNA, 22 nt, Homo sapiens
acacuugcuugcaauagccucc

SEQ ID NO: 247190 - RNA, 22 nt, Homo sapiens
acagaaccauucacuccccugg

SEQ ID NO: 247191 - RNA, 22 nt, Homo sapiens
acagaucagagauauuuagguu

SEQ ID NO: 247192 - RNA, 22 nt, Homo sapiens
acagguacacagaauauccaga

SEQ ID NO: 247193 - RNA, 22 nt, Homo sapiens
acaguacuguuguuugcugcca

SEQ ID NO: 247194 - RNA, 21 nt, Homo sapiens
acaguacuugagaucuuuuga

SEQ ID NO: 247195 - RNA, 23 nt, Homo sapiens
acaguauguggauguggcuaagu

SEQ ID NO: 247196 - RNA, 22 nt, Homo sapiens
acagucauagcagccuuuguua

SEQ ID NO: 247197 - RNA, 22 nt, Homo sapiens
acaguggaauguaggguuugag

SEQ ID NO: 247198 - RNA, 22 nt, Homo sapiens
acauauaaggagacuagggcau

SEQ ID NO: 247199 - RNA, 22 nt, Homo sapiens
acauaugaguacaugugccaug

SEQ ID NO: 247200 - RNA, 21 nt, Homo sapiens
acaucagaguugugaagguag

SEQ ID NO: 247201 - RNA, 22 nt, Homo sapiens
acaucccuugcucggggccccu

SEQ ID NO: 247202 - RNA, 17 nt, Homo sapiens
acaugagacuggauucu

SEQ ID NO: 247203 - RNA, 22 nt, Homo sapiens
acaugcauccaugugaagagac

SEQ ID NO: 247204 - RNA, 22 nt, Homo sapiens
acaugcauggcaugcauuguac

SEQ ID NO: 247205 - RNA, 22 nt, Homo sapiens
acauggcacugcgggcuucuug

SEQ ID NO: 247206 - RNA, 19 nt, Homo sapiens
accagauugcauucuugga

SEQ ID NO: 247207 - RNA, 22 nt, Homo sapiens
accagucucagguaugucuuua

SEQ ID NO: 247208 - RNA, 22 nt, Homo sapiens
accauugcacuucagccuaggc

SEQ ID NO: 247209 - RNA, 22 nt, Homo sapiens
acccaguagucauucaggagca

SEQ ID NO: 247210 - RNA, 22 nt, Homo sapiens
acccauguaggugggauuacag

SEQ ID NO: 247211 - RNA, 22 nt, Homo sapiens
accccauuugcacugagcccuu

SEQ ID NO: 247212 - RNA, 22 nt, Homo sapiens
accccugagaucgaaucaugcu

SEQ ID NO: 247213 - RNA, 22 nt, Homo sapiens
acccugaagccaugaguggaac

SEQ ID NO: 247214 - RNA, 22 nt, Homo sapiens
acccuguaggacuauucuaauc

SEQ ID NO: 247215 - RNA, 22 nt, Homo sapiens
acccugucacucccaucaauuu

SEQ ID NO: 247216 - RNA, 22 nt, Homo sapiens
acccuuugucaaucaguacuaa

SEQ ID NO: 247217 - RNA, 22 nt, Homo sapiens
accgaguguucucccgcagcgg

SEQ ID NO: 247218 - RNA, 22 nt, Homo sapiens
accucagcccggggaaguugag

SEQ ID NO: 247219 - RNA, 21 nt, Homo sapiens
accugauguuucaguuggagu

SEQ ID NO: 247220 - RNA, 22 nt, Homo sapiens
accuggguguauguucaguuug

SEQ ID NO: 247221 - RNA, 22 nt, Homo sapiens
accugugguuacagucugucuc

SEQ ID NO: 247222 - RNA, 23 nt, Homo sapiens
accuucauucauucagcugaagu

SEQ ID NO: 247223 - RNA, 18 nt, Homo sapiens
accuucauuccuuugccu

SEQ ID NO: 247224 - RNA, 22 nt, Homo sapiens
accuucauuguugccaugucca

SEQ ID NO: 247225 - RNA, 22 nt, Homo sapiens
acgcagcacauucacagcuaug

SEQ ID NO: 247226 - RNA, 22 nt, Homo sapiens
acggcaguguggugcggucagg

SEQ ID NO: 247227 - RNA, 20 nt, Homo sapiens
acuaaaucucauuuuaugca

SEQ ID NO: 247228 - RNA, 22 nt, Homo sapiens
acuaaggcacaauuuucucaua

SEQ ID NO: 247229 - RNA, 22 nt, Homo sapiens
acucagagagaacugucauuug

SEQ ID NO: 247230 - RNA, 23 nt, Homo sapiens
acugagcaauguuuacauacuug

SEQ ID NO: 247231 - RNA, 22 nt, Homo sapiens
acugcaaugucgaauagagaug

SEQ ID NO: 247232 - RNA, 18 nt, Homo sapiens
acugcacuccaccuuggg

SEQ ID NO: 247233 - RNA, 22 nt, Homo sapiens
acugcacuccagccuggacgac

SEQ ID NO: 247234 - RNA, 22 nt, Homo sapiens
acugcacuccagccuguugaca

SEQ ID NO: 247235 - RNA, 22 nt, Homo sapiens
acugcacuccagccuuagugac

SEQ ID NO: 247236 - RNA, 22 nt, Homo sapiens
acugcacuccagccuucgugac

SEQ ID NO: 247237 - RNA, 22 nt, Homo sapiens
acugcacuccagccuugagagc

SEQ ID NO: 247238 - RNA, 22 nt, Homo sapiens
acugcacuccagccuugauggc

SEQ ID NO: 247239 - RNA, 22 nt, Homo sapiens
acugcacuccagccuuggagac

SEQ ID NO: 247240 - RNA, 22 nt, Homo sapiens
acugcacuccaguuccgggcaa

SEQ ID NO: 247241 - RNA, 22 nt, Homo sapiens
acugcacuucaaccucauugac

SEQ ID NO: 247242 - RNA, 22 nt, Homo sapiens
acugcacuucagccuuggggac

SEQ ID NO: 247243 - RNA, 22 nt, Homo sapiens
acugcauuugguaaagucaaga

SEQ ID NO: 247244 - RNA, 18 nt, Homo sapiens
acuggauguaaagggucc

SEQ ID NO: 247245 - RNA, 22 nt, Homo sapiens
acuggcucugcuuuacaaacag

SEQ ID NO: 247246 - RNA, 20 nt, Homo sapiens
acugggcuaccgaaguaagg

SEQ ID NO: 247247 - RNA, 22 nt, Homo sapiens
acuguauagauggaguugauuu

SEQ ID NO: 247248 - RNA, 22 nt, Homo sapiens
acuuaguauggggcuuuugaga

SEQ ID NO: 247249 - RNA, 22 nt, Homo sapiens
acuugacacuuauauuacucac

SEQ ID NO: 247250 - RNA, 22 nt, Homo sapiens
acuuugcuuagagggcauuaaa

SEQ ID NO: 247251 - RNA, 22 nt, Homo sapiens
acuuugguuuauagaauuuagg

SEQ ID NO: 247252 - RNA, 21 nt, Homo sapiens
agaaaaucuuaugggaaacau

SEQ ID NO: 247253 - RNA, 22 nt, Homo sapiens
agaauguaacucuaugaaggca

SEQ ID NO: 247254 - RNA, 22 nt, Homo sapiens
agaaugucagcuggauucagcu

SEQ ID NO: 247255 - RNA, 22 nt, Homo sapiens
agaaugucaguauuggcuaaaa

SEQ ID NO: 247256 - RNA, 22 nt, Homo sapiens
agacaucauuugauggugggag

SEQ ID NO: 247257 - RNA, 22 nt, Homo sapiens
agagagcuuuugguugcccuaa

SEQ ID NO: 247258 - RNA, 22 nt, Homo sapiens
agagauaaagauuuuaauuuug

SEQ ID NO: 247259 - RNA, 22 nt, Homo sapiens
agagaucaacugaauuacugga

SEQ ID NO: 247260 - RNA, 20 nt, Homo sapiens
agagaucaguaauucaucaa

SEQ ID NO: 247261 - RNA, 20 nt, Homo sapiens
agagcaaagccgcaccccua

SEQ ID NO: 247262 - RNA, 22 nt, Homo sapiens
agagcacugcugcaggguucug

SEQ ID NO: 247263 - RNA, 18 nt, Homo sapiens
agagcuaugaacauaugc

SEQ ID NO: 247264 - RNA, 22 nt, Homo sapiens
agagguaagaauaguaguugga

SEQ ID NO: 247265 - RNA, 22 nt, Homo sapiens
agagguagaagauaggcuacag

SEQ ID NO: 247266 - RNA, 22 nt, Homo sapiens
agaguacaggcaaguuagucau

SEQ ID NO: 247267 - RNA, 22 nt, Homo sapiens
agagugaagcuuuuuauauucu

SEQ ID NO: 247268 - RNA, 22 nt, Homo sapiens
agagugcaauggcaccaucucg

SEQ ID NO: 247269 - RNA, 23 nt, Homo sapiens
agagugcaauggugccaucucgg

SEQ ID NO: 247270 - RNA, 20 nt, Homo sapiens
agagugcuggacugaggagc

SEQ ID NO: 247271 - RNA, 22 nt, Homo sapiens
agauauguuauugauguuaaug

SEQ ID NO: 247272 - RNA, 22 nt, Homo sapiens
agaucacucagguuucucccug

SEQ ID NO: 247273 - RNA, 23 nt, Homo sapiens
agaugcaucuggcugcgaggcaa

SEQ ID NO: 247274 - RNA, 22 nt, Homo sapiens
agaugccuaugaagagaaauua

SEQ ID NO: 247275 - RNA, 22 nt, Homo sapiens
agaugccucauguucuagguuc

SEQ ID NO: 247276 - RNA, 22 nt, Homo sapiens
agauggauuuuguagccccagc

SEQ ID NO: 247277 - RNA, 22 nt, Homo sapiens
agauggugauaaaugugguacc

SEQ ID NO: 247278 - RNA, 22 nt, Homo sapiens
agaugguguuggcugaguguau

SEQ ID NO: 247279 - RNA, 22 nt, Homo sapiens
agcaagauccagucgcacagga

SEQ ID NO: 247280 - RNA, 22 nt, Homo sapiens
agcaagaugaaguugagcuagg

SEQ ID NO: 247281 - RNA, 22 nt, Homo sapiens
uuccaugugggcuugucaagua

SEQ ID NO: 247282 - RNA, 22 nt, Homo sapiens
uucccagucaaacgaaggacuu

SEQ ID NO: 247283 - RNA, 22 nt, Homo sapiens
uucccaguggaacauguaguca

SEQ ID NO: 247284 - RNA, 22 nt, Homo sapiens
uucccuagaacacauggaggga

SEQ ID NO: 247285 - RNA, 22 nt, Homo sapiens
uucccugagcaucuguugagcc

SEQ ID NO: 247286 - RNA, 22 nt, Homo sapiens
uucccuguaucuucugccaugu

SEQ ID NO: 247287 - RNA, 22 nt, Homo sapiens
uucccuugcaggaugaucugga

SEQ ID NO: 247288 - RNA, 22 nt, Homo sapiens
uucccuuuuuucuaguagguag

SEQ ID NO: 247289 - RNA, 22 nt, Homo sapiens
uuccuacugcccauuaaaaugg

SEQ ID NO: 247290 - RNA, 22 nt, Homo sapiens
auuguacuccagccuaggcaac

SEQ ID NO: 247291 - RNA, 22 nt, Homo sapiens
auuguacuccagccugggcgac

SEQ ID NO: 247292 - RNA, 22 nt, Homo sapiens
auuguacuccagccugggcugc

SEQ ID NO: 247293 - RNA, 22 nt, Homo sapiens
auugucauuuauaacuguguag

SEQ ID NO: 247294 - RNA, 22 nt, Homo sapiens
auugucauuuucugagaaguaa

SEQ ID NO: 247295 - RNA, 22 nt, Homo sapiens
auugugcuaaaguaauaaguca

SEQ ID NO: 247296 - RNA, 22 nt, Homo sapiens
auuucacuucgcaugguguccg

SEQ ID NO: 247297 - RNA, 22 nt, Homo sapiens
auuugacacugagagccucagu

SEQ ID NO: 247298 - RNA, 21 nt, Homo sapiens
auuugcacugagcuccugugc

SEQ ID NO: 247299 - RNA, 22 nt, Homo sapiens
auuuggcaauuuugaagaugcc

SEQ ID NO: 247300 - RNA, 22 nt, Homo sapiens
auuugucacuuaacagccauua

SEQ ID NO: 247301 - RNA, 22 nt, Homo sapiens
caaagcuauagcaccagaggga

SEQ ID NO: 247302 - RNA, 22 nt, Homo sapiens
caaaggauucauuuccaggagu

SEQ ID NO: 247303 - RNA, 22 nt, Homo sapiens
caaaguaauuacgguuuuggcc

SEQ ID NO: 247304 - RNA, 22 nt, Homo sapiens
caaagucuauucuacccuuacc

SEQ ID NO: 247305 - RNA, 22 nt, Homo sapiens
caaagucuucucauuaugucuu

SEQ ID NO: 247306 - RNA, 22 nt, Homo sapiens
caaagugcugggacuggccggg

SEQ ID NO: 247307 - RNA, 22 nt, Homo sapiens
caaauacuuucauguugucuug

SEQ ID NO: 247308 - RNA, 22 nt, Homo sapiens
caaaugacaucauuucauucaa

SEQ ID NO: 247309 - RNA, 22 nt, Homo sapiens
caaaugaucugcuggccucagc

SEQ ID NO: 247310 - RNA, 22 nt, Homo sapiens
caacacagugaaacccgucucu

SEQ ID NO: 247311 - RNA, 22 nt, Homo sapiens
caaggcacagccccuacuuccu

SEQ ID NO: 247312 - RNA, 22 nt, Homo sapiens
cacaaaguagauuagucuucca

SEQ ID NO: 247313 - RNA, 22 nt, Homo sapiens
cacacugucuucauuacuguag

SEQ ID NO: 247314 - RNA, 22 nt, Homo sapiens
cacagaauucauuggauuaccu

SEQ ID NO: 247315 - RNA, 22 nt, Homo sapiens
cacaggaagaggcacggucccu

SEQ ID NO: 247316 - RNA, 22 nt, Homo sapiens
cacagucuugcaauauugagau

SEQ ID NO: 247317 - RNA, 22 nt, Homo sapiens
cacagugaacaauauccucugu

SEQ ID NO: 247318 - RNA, 22 nt, Homo sapiens
cacauagucccugcuaaucuuc

SEQ ID NO: 247319 - RNA, 22 nt, Homo sapiens
caccaggugcccagcacggcca

SEQ ID NO: 247320 - RNA, 23 nt, Homo sapiens
caccaguauaauuagcuuuuaaa

SEQ ID NO: 247321 - RNA, 22 nt, Homo sapiens
ugacacuugcccuuagaaacau

SEQ ID NO: 247322 - RNA, 21 nt, Homo sapiens
ugacagaaaauugaguuugcu

SEQ ID NO: 247323 - RNA, 18 nt, Homo sapiens
ugacagcacaugugggga

SEQ ID NO: 247324 - RNA, 22 nt, Homo sapiens
ugacaggagauuaugugauguu

SEQ ID NO: 247325 - RNA, 22 nt, Homo sapiens
ugacagguugauaggugcagca

SEQ ID NO: 247326 - RNA, 23 nt, Homo sapiens
ugacagugcuugaaauugcucuu

SEQ ID NO: 247327 - RNA, 22 nt, Homo sapiens
ugacagugugagauccugucuc

SEQ ID NO: 247328 - RNA, 18 nt, Homo sapiens
ugacaucauuuagaaagg

SEQ ID NO: 247329 - RNA, 22 nt, Homo sapiens
ugacaugaagucucccucuguu

SEQ ID NO: 247330 - RNA, 22 nt, Homo sapiens
ugacaugaugagcaauaauggc

SEQ ID NO: 247331 - RNA, 22 nt, Homo sapiens
ugacauguugcauuauauuucc

SEQ ID NO: 247332 - RNA, 22 nt, Homo sapiens
ugaccagaaaacaaauuaguuu

SEQ ID NO: 247333 - RNA, 22 nt, Homo sapiens
ugacuaguuuugcuguuguuau

SEQ ID NO: 247334 - RNA, 22 nt, Homo sapiens
ugacuucauuugguaauugggu

SEQ ID NO: 247335 - RNA, 22 nt, Homo sapiens
ugacuugaucauuacacauucu

SEQ ID NO: 247336 - RNA, 22 nt, Homo sapiens
ugagaagaugaacuccuugguc

SEQ ID NO: 247337 - RNA, 22 nt, Homo sapiens
ugagaagugauauagaaguuaa

SEQ ID NO: 247338 - RNA, 22 nt, Homo sapiens
ugagacaucugagauuuuaagc

SEQ ID NO: 247339 - RNA, 22 nt, Homo sapiens
ugagacggagucucgcucucua

SEQ ID NO: 247340 - RNA, 22 nt, Homo sapiens
ugagacggagucucgcucuguc

SEQ ID NO: 247341 - RNA, 22 nt, Homo sapiens
ugagacggagucucgcucuguu

SEQ ID NO: 247342 - RNA, 22 nt, Homo sapiens
ugagacggagucuugcuaaguu

SEQ ID NO: 247343 - RNA, 22 nt, Homo sapiens
ugagacggagucuugcucuguc

SEQ ID NO: 247344 - RNA, 22 nt, Homo sapiens
ugagacggaguuucacucuugu

SEQ ID NO: 247345 - RNA, 22 nt, Homo sapiens
ugagacggaguuucgcucuugu

SEQ ID NO: 247346 - RNA, 22 nt, Homo sapiens
ugagacugagucucccucuguc

SEQ ID NO: 247347 - RNA, 22 nt, Homo sapiens
ugagacugagucuugcucuugu

SEQ ID NO: 247348 - RNA, 22 nt, Homo sapiens
ugagacugaguuucucucuugu

SEQ ID NO: 247349 - RNA, 22 nt, Homo sapiens
ugagacugaguuuugccuuugu

SEQ ID NO: 247350 - RNA, 22 nt, Homo sapiens
ugagagacaguuuguuaaaauu

SEQ ID NO: 247351 - RNA, 22 nt, Homo sapiens
ugagagaugauaaaauguuugu

SEQ ID NO: 247352 - RNA, 22 nt, Homo sapiens
ugagaguagggguugggauugg

SEQ ID NO: 247353 - RNA, 21 nt, Homo sapiens
ugagaguaguguauuauucuc

SEQ ID NO: 247354 - RNA, 22 nt, Homo sapiens
ugagauaauuuacuuguugagg

SEQ ID NO: 247355 - RNA, 22 nt, Homo sapiens
ugagauauugggaguaauguca

SEQ ID NO: 247356 - RNA, 22 nt, Homo sapiens
ugagaucaugucauuugcacuc

SEQ ID NO: 247357 - RNA, 22 nt, Homo sapiens
ugagaucgagucucgcucuguc

SEQ ID NO: 247358 - RNA, 22 nt, Homo sapiens
ugagaucugauaggccuggguu

SEQ ID NO: 247359 - RNA, 22 nt, Homo sapiens
ugagaucuuuuguggcugagaa

SEQ ID NO: 247360 - RNA, 22 nt, Homo sapiens
ugagaugaagcuagaagaaugg

SEQ ID NO: 247361 - RNA, 22 nt, Homo sapiens
ugagaugaagucuugcucuguu

SEQ ID NO: 247362 - RNA, 22 nt, Homo sapiens
ugagaugaagugauguaaaaca

SEQ ID NO: 247363 - RNA, 22 nt, Homo sapiens
ugagaugagggaagccuaggca

SEQ ID NO: 247364 - RNA, 22 nt, Homo sapiens
ugagaugaguucucgcucuguc

SEQ ID NO: 247365 - RNA, 22 nt, Homo sapiens
ugagaugaguugcuggcucuga

SEQ ID NO: 247366 - RNA, 22 nt, Homo sapiens
ugagaugauagauauguuaauu

SEQ ID NO: 247367 - RNA, 22 nt, Homo sapiens
ugagauggguucugguccccug

SEQ ID NO: 247368 - RNA, 22 nt, Homo sapiens
ugagaugguaaauuuuuguugu

SEQ ID NO: 247369 - RNA, 22 nt, Homo sapiens
ugagauguuuguuucagugccu

SEQ ID NO: 247370 - RNA, 22 nt, Homo sapiens
ugagauuaaucuuuaaguaaga

SEQ ID NO: 247371 - RNA, 23 nt, Homo sapiens
ugagauuauaaucuuuuacuucu

SEQ ID NO: 247372 - RNA, 22 nt, Homo sapiens
ugagauuaucguaauguaucuc

SEQ ID NO: 247373 - RNA, 22 nt, Homo sapiens
ugagauuguucuaugucugguu

SEQ ID NO: 247374 - RNA, 22 nt, Homo sapiens
ugagcaaaauuuuggacauaga

SEQ ID NO: 247375 - RNA, 22 nt, Homo sapiens
ugagcacauuuacaucaguucc

SEQ ID NO: 247376 - RNA, 21 nt, Homo sapiens
ugagcauuaguacaguaggga

SEQ ID NO: 247377 - RNA, 22 nt, Homo sapiens
ugagccaugggguaaaugugau

SEQ ID NO: 247378 - RNA, 22 nt, Homo sapiens
ugagcuccuucauaaaaaggca

SEQ ID NO: 247379 - RNA, 22 nt, Homo sapiens
ugagcugagacaauaaguuuuu

SEQ ID NO: 247380 - RNA, 22 nt, Homo sapiens
ugaggcaaggcugaaugaaggc

SEQ ID NO: 247381 - RNA, 22 nt, Homo sapiens
ugaggcacucuagacuuauuca

SEQ ID NO: 247382 - RNA, 22 nt, Homo sapiens
ugaggcaggagaacggcuugaa

SEQ ID NO: 247383 - RNA, 22 nt, Homo sapiens
ugagguaacaaacuaugaguua

SEQ ID NO: 247384 - RNA, 22 nt, Homo sapiens
ugagguaagauguucauuuuuc

SEQ ID NO: 247385 - RNA, 22 nt, Homo sapiens
ugagguaauagauaauauuuuu

SEQ ID NO: 247386 - RNA, 22 nt, Homo sapiens
ugaggugaggguaucaaaugcu

SEQ ID NO: 247387 - RNA, 22 nt, Homo sapiens
ugaguagaacaucaagucauac

SEQ ID NO: 247388 - RNA, 22 nt, Homo sapiens
ugaguagcuaagacgauaggca

SEQ ID NO: 247389 - RNA, 23 nt, Homo sapiens
ugaguagguccacguaugugagu

SEQ ID NO: 247390 - RNA, 22 nt, Homo sapiens
ugaguagugccacaauaagcau

SEQ ID NO: 247391 - RNA, 23 nt, Homo sapiens
ugagucacuuugcuggggucucu

SEQ ID NO: 247392 - RNA, 22 nt, Homo sapiens
agugcauuuguucugugucagg

SEQ ID NO: 247393 - RNA, 22 nt, Homo sapiens
agugccuacuauguagaugcug

SEQ ID NO: 247394 - RNA, 22 nt, Homo sapiens
aguggaaucuguuauacuaacu

SEQ ID NO: 247395 - RNA, 22 nt, Homo sapiens
aguggaauuaagaaacugaauu

SEQ ID NO: 247396 - RNA, 22 nt, Homo sapiens
aguggcacuauucucagaguca

SEQ ID NO: 247397 - RNA, 22 nt, Homo sapiens
agugguuuuaaguagagcauac

SEQ ID NO: 247398 - RNA, 22 nt, Homo sapiens
agugguuuuggaauggaauuca

SEQ ID NO: 247399 - RNA, 22 nt, Homo sapiens
aguguuuuuaacaagaaagggu

SEQ ID NO: 247400 - RNA, 22 nt, Homo sapiens
aguguuuuuacaagcacucugg

SEQ ID NO: 247401 - RNA, 22 nt, Homo sapiens
aguuaguguugugauaaaucca

SEQ ID NO: 247402 - RNA, 22 nt, Homo sapiens
aguucaaugcucuuucuacuau

SEQ ID NO: 247403 - RNA, 22 nt, Homo sapiens
aguuggccccuacugggaggug

SEQ ID NO: 247404 - RNA, 18 nt, Homo sapiens
aguuguuuuauccugccc

SEQ ID NO: 247405 - RNA, 19 nt, Homo sapiens
auaaacuagaacugucccc

SEQ ID NO: 247406 - RNA, 17 nt, Homo sapiens
auaaacucaucauuuuu

SEQ ID NO: 247407 - RNA, 18 nt, Homo sapiens
auaaacucaucauuuuua

SEQ ID NO: 247408 - RNA, 22 nt, Homo sapiens
auaaacugucaguggagaguaa

SEQ ID NO: 247409 - RNA, 22 nt, Homo sapiens
auaaagcaagucucuggccuca

SEQ ID NO: 247410 - RNA, 22 nt, Homo sapiens
auaacagcugcaaggcaaaagc

SEQ ID NO: 247411 - RNA, 22 nt, Homo sapiens
auaagaucauuugcuaagaggg

SEQ ID NO: 247412 - RNA, 22 nt, Homo sapiens
auaagucaauggaacagauuaa

SEQ ID NO: 247413 - RNA, 22 nt, Homo sapiens
auaagugcuuguugaauaauag

SEQ ID NO: 247414 - RNA, 22 nt, Homo sapiens
auaauaccugccacauuugaau

SEQ ID NO: 247415 - RNA, 22 nt, Homo sapiens
auaauguuugauugagcagaua

SEQ ID NO: 247416 - RNA, 22 nt, Homo sapiens
auacaaggaaugaagagauuug

SEQ ID NO: 247417 - RNA, 22 nt, Homo sapiens
auacaagugccauguuggugug

SEQ ID NO: 247418 - RNA, 22 nt, Homo sapiens
auacaguaucuucuggcaagca

SEQ ID NO: 247419 - RNA, 22 nt, Homo sapiens
auacccauacauauuggugacu

SEQ ID NO: 247420 - RNA, 22 nt, Homo sapiens
auacccucugggugguuaguug

SEQ ID NO: 247421 - RNA, 22 nt, Homo sapiens
auacuagucaagaauguaugag

SEQ ID NO: 247422 - RNA, 22 nt, Homo sapiens
auacugccuuuagcaaaacagu

SEQ ID NO: 247423 - RNA, 22 nt, Homo sapiens
auagaagcuauguauaggggcc

SEQ ID NO: 247424 - RNA, 22 nt, Homo sapiens
auagauucauuugaggagauuu

SEQ ID NO: 247425 - RNA, 21 nt, Homo sapiens
auagcacaucagauuuuauua

SEQ ID NO: 247426 - RNA, 22 nt, Homo sapiens
auagcagaagaagggacaauuc

SEQ ID NO: 247427 - RNA, 22 nt, Homo sapiens
auagcagaccaccucucccacu

SEQ ID NO: 247428 - RNA, 22 nt, Homo sapiens
auagccucauucuucagaugag

SEQ ID NO: 247429 - RNA, 22 nt, Homo sapiens
auaggagcacaaacuauuguga

SEQ ID NO: 247430 - RNA, 22 nt, Homo sapiens
auagguagcauagcaggaauau

SEQ ID NO: 247431 - RNA, 22 nt, Homo sapiens
auagguaguugaggagauuuca

SEQ ID NO: 247432 - RNA, 22 nt, Homo sapiens
auaguacuauugcaguguuaua

SEQ ID NO: 247433 - RNA, 21 nt, Homo sapiens
auagugcuagagaguagcagg

SEQ ID NO: 247434 - RNA, 22 nt, Homo sapiens
auagugcugcaauaaacauacg

SEQ ID NO: 247435 - RNA, 22 nt, Homo sapiens
auagugcugcaauaaccauggg

SEQ ID NO: 247436 - RNA, 22 nt, Homo sapiens
auagugcugcaaugaacauaca

SEQ ID NO: 247437 - RNA, 22 nt, Homo sapiens
auagugcugcacuaaacauaca

SEQ ID NO: 247438 - RNA, 22 nt, Homo sapiens
auagugcugcagucaauguacg

SEQ ID NO: 247439 - RNA, 19 nt, Homo sapiens
auaguguaggaaaacagcu

SEQ ID NO: 247440 - RNA, 22 nt, Homo sapiens
auauagcaaugaaagagaugaa

SEQ ID NO: 247441 - RNA, 22 nt, Homo sapiens
auaucacucccaauaucgcagg

SEQ ID NO: 247442 - RNA, 22 nt, Homo sapiens
auaucagugucuuacuguuuuu

SEQ ID NO: 247443 - RNA, 17 nt, Homo sapiens
auaugaauuuuggagau

SEQ ID NO: 247444 - RNA, 20 nt, Homo sapiens
auaugcauguguuuucacuu

SEQ ID NO: 247445 - RNA, 22 nt, Homo sapiens
auaugcuaauuuuuagucgagc

SEQ ID NO: 247446 - RNA, 22 nt, Homo sapiens
auaugguguuugcuauucagcu

SEQ ID NO: 247447 - RNA, 22 nt, Homo sapiens
auauguaguuucagaaguggaa

SEQ ID NO: 247448 - RNA, 22 nt, Homo sapiens
auaugucuauuauuagggcagg

SEQ ID NO: 247449 - RNA, 17 nt, Homo sapiens
auaugucugcuggggga

SEQ ID NO: 247450 - RNA, 22 nt, Homo sapiens
auauuacagagaggaccuggga

SEQ ID NO: 247451 - RNA, 22 nt, Homo sapiens
agaguaguuucuauauucuuca

SEQ ID NO: 247452 - RNA, 22 nt, Homo sapiens
agauacaucuaugugucugugu

SEQ ID NO: 247453 - RNA, 22 nt, Homo sapiens
agauaugucugcuauuugcugu

SEQ ID NO: 247454 - RNA, 22 nt, Homo sapiens
agaugauguuucuggcacauga

SEQ ID NO: 247455 - RNA, 23 nt, Homo sapiens
agaugcauucuuguaggauauau

SEQ ID NO: 247456 - RNA, 22 nt, Homo sapiens
agaugcuguuaucaacuguagc

SEQ ID NO: 247457 - RNA, 22 nt, Homo sapiens
agauggugugcuaggaaaugua

SEQ ID NO: 247458 - RNA, 22 nt, Homo sapiens
agcaacauagaaauuugggugg

SEQ ID NO: 247459 - RNA, 22 nt, Homo sapiens
agcaacauggaguuugugcgca

SEQ ID NO: 247460 - RNA, 22 nt, Homo sapiens
agcaacauugagacugcaguug

SEQ ID NO: 247461 - RNA, 22 nt, Homo sapiens
agcaagauuguucccauuuucu

SEQ ID NO: 247462 - RNA, 22 nt, Homo sapiens
agcacacuggguggcuuaaaca

SEQ ID NO: 247463 - RNA, 22 nt, Homo sapiens
agcacagccuuguguuuucuug

SEQ ID NO: 247464 - RNA, 22 nt, Homo sapiens
agcacagugaaugguuuacuca

SEQ ID NO: 247465 - RNA, 22 nt, Homo sapiens
agcaccacaauuuccugccuaa

SEQ ID NO: 247466 - RNA, 22 nt, Homo sapiens
agcaccaccguugcucuauccc

SEQ ID NO: 247467 - RNA, 22 nt, Homo sapiens
agcaccauugcacuccagccug

SEQ ID NO: 247468 - RNA, 23 nt, Homo sapiens
agcaccuuuccuccacuaucugc

SEQ ID NO: 247469 - RNA, 22 nt, Homo sapiens
agcagauguuuagugagcgccu

SEQ ID NO: 247470 - RNA, 22 nt, Homo sapiens
agcagcauuccaaaaaucugcu

SEQ ID NO: 247471 - RNA, 17 nt, Homo sapiens
agcagcccauaucccca

SEQ ID NO: 247472 - RNA, 22 nt, Homo sapiens
agcagcuuugcauggccugugg

SEQ ID NO: 247473 - RNA, 22 nt, Homo sapiens
agcagguguggcuuauccugaa

SEQ ID NO: 247474 - RNA, 22 nt, Homo sapiens
agcaucaugcaguugcuauuca

SEQ ID NO: 247475 - RNA, 19 nt, Homo sapiens
agcaucauuauuguuuugg

SEQ ID NO: 247476 - RNA, 22 nt, Homo sapiens
agcaugacauauuguagagaaa

SEQ ID NO: 247477 - RNA, 22 nt, Homo sapiens
agcaugauugggguugggcaca

SEQ ID NO: 247478 - RNA, 22 nt, Homo sapiens
agcauggucacuuugggcccca

SEQ ID NO: 247479 - RNA, 22 nt, Homo sapiens
agcauuaguugugaagccuuua

SEQ ID NO: 247480 - RNA, 22 nt, Homo sapiens
agccuguagugagcugugauug

SEQ ID NO: 247481 - RNA, 22 nt, Homo sapiens
agccuguguugaauuauagaaa

SEQ ID NO: 247482 - RNA, 22 nt, Homo sapiens
agcuaaaucucauguugaauug

SEQ ID NO: 247483 - RNA, 22 nt, Homo sapiens
agcuaacauuuuuccucuucca

SEQ ID NO: 247484 - RNA, 23 nt, Homo sapiens
agcuagagaggcuggggauacag

SEQ ID NO: 247485 - RNA, 19 nt, Homo sapiens
agcuagugcucagcuguca

SEQ ID NO: 247486 - RNA, 22 nt, Homo sapiens
agcuaugucugaugccugauua

SEQ ID NO: 247487 - RNA, 21 nt, Homo sapiens
agcuccacucguucccaaagc

SEQ ID NO: 247488 - RNA, 22 nt, Homo sapiens
agcuccauuguaaucaccuggu

SEQ ID NO: 247489 - RNA, 22 nt, Homo sapiens
agcugcacaaauggaugugagg

SEQ ID NO: 247490 - RNA, 20 nt, Homo sapiens
agcugcagauauaaauccgc

SEQ ID NO: 247491 - RNA, 22 nt, Homo sapiens
agcugcauuuacuuuugcacaa

SEQ ID NO: 247492 - RNA, 22 nt, Homo sapiens
agcuggaauuuaagguagauag

SEQ ID NO: 247493 - RNA, 22 nt, Homo sapiens
agcuggauguggaugacccugu

SEQ ID NO: 247494 - RNA, 22 nt, Homo sapiens
agcuggcuguagcugcaagucu

SEQ ID NO: 247495 - RNA, 21 nt, Homo sapiens
agcugguuucuucuuacuccu

SEQ ID NO: 247496 - RNA, 22 nt, Homo sapiens
agcuguuguacacuuuaccuuu

SEQ ID NO: 247497 - RNA, 20 nt, Homo sapiens
agcuguuguuaaaaaggagg

SEQ ID NO: 247498 - RNA, 22 nt, Homo sapiens
agcuguuguuaauuaacucauu

SEQ ID NO: 247499 - RNA, 22 nt, Homo sapiens
agcuguuguuuuaagauacuaa

SEQ ID NO: 247500 - RNA, 22 nt, Homo sapiens
agcuuaugcuuggaagagauga

SEQ ID NO: 247501 - RNA, 22 nt, Homo sapiens
agcuucauucugaauagguuga

SEQ ID NO: 247502 - RNA, 22 nt, Homo sapiens
agcuuguccuccacccacacug

SEQ ID NO: 247503 - RNA, 22 nt, Homo sapiens
agcuuguggugaauacugcuag

SEQ ID NO: 247504 - RNA, 22 nt, Homo sapiens
agcuuguguuugucugccuggg

SEQ ID NO: 247505 - RNA, 22 nt, Homo sapiens
agcuuuuugggcagcuauugac

SEQ ID NO: 247506 - RNA, 22 nt, Homo sapiens
aggaagguaaacuaacuugccu

SEQ ID NO: 247507 - RNA, 22 nt, Homo sapiens
aggaagugugcaauuaauuucu

SEQ ID NO: 247508 - RNA, 22 nt, Homo sapiens
gcagcagugugggcugaaccua

SEQ ID NO: 247509 - RNA, 22 nt, Homo sapiens
gcaggauuggagccucucugaa

SEQ ID NO: 247510 - RNA, 22 nt, Homo sapiens
gcaguagugcgaucucagcuca

SEQ ID NO: 247511 - RNA, 16 nt, Homo sapiens
gcaguguguuuaauag

SEQ ID NO: 247512 - RNA, 22 nt, Homo sapiens
gcaguguugugauccaggucuu

SEQ ID NO: 247513 - RNA, 17 nt, Homo sapiens
gcauauguugaaccagc

SEQ ID NO: 247514 - RNA, 17 nt, Homo sapiens
gcauauguugaaccagu

SEQ ID NO: 247515 - RNA, 22 nt, Homo sapiens
gcauggauguugauggcugcug

SEQ ID NO: 247516 - RNA, 22 nt, Homo sapiens
gcauggccuuuaaaugucacag

SEQ ID NO: 247517 - RNA, 22 nt, Homo sapiens
gccaagaugcugcccacagaca

SEQ ID NO: 247518 - RNA, 22 nt, Homo sapiens
gccauugcacuccagccuagcg

SEQ ID NO: 247519 - RNA, 22 nt, Homo sapiens
gccauugcacuccagccucggg

SEQ ID NO: 247520 - RNA, 22 nt, Homo sapiens
gccauugcacuccagccugagc

SEQ ID NO: 247521 - RNA, 22 nt, Homo sapiens
gccauugcacuccagcuugggc

SEQ ID NO: 247522 - RNA, 22 nt, Homo sapiens
gccauugcacucuagccugagc

SEQ ID NO: 247523 - RNA, 22 nt, Homo sapiens
gcccacuguuaaauuuguuuua

SEQ ID NO: 247524 - RNA, 22 nt, Homo sapiens
gcccuguugcccugaauacaua

SEQ ID NO: 247525 - RNA, 22 nt, Homo sapiens
gccuagagaaguaaauauuauc

SEQ ID NO: 247526 - RNA, 22 nt, Homo sapiens
gccuagagacuugguaucuugc

SEQ ID NO: 247527 - RNA, 22 nt, Homo sapiens
gcuaaggcaggagcauugcuug

SEQ ID NO: 247528 - RNA, 22 nt, Homo sapiens
gcuacugucuaucugugcuucu

SEQ ID NO: 247529 - RNA, 22 nt, Homo sapiens
gcuagcauucaaaugugcagcc

SEQ ID NO: 247530 - RNA, 22 nt, Homo sapiens
gcuaggagauccacugcucucu

SEQ ID NO: 247531 - RNA, 22 nt, Homo sapiens
gcuaggagaucugcugcucucu

SEQ ID NO: 247532 - RNA, 22 nt, Homo sapiens
gcucuuuugggguaauucugag

SEQ ID NO: 247533 - RNA, 22 nt, Homo sapiens
gcugacagugguuauacuuaga

SEQ ID NO: 247534 - RNA, 22 nt, Homo sapiens
gcugauggugcaguucuagccu

SEQ ID NO: 247535 - RNA, 22 nt, Homo sapiens
gcugguauuacaggcaugagcc

SEQ ID NO: 247536 - RNA, 22 nt, Homo sapiens
gcuguauugacuuuguaucaua

SEQ ID NO: 247537 - RNA, 22 nt, Homo sapiens
gcugugauucuguguagauagu

SEQ ID NO: 247538 - RNA, 22 nt, Homo sapiens
gcugugguuuaguagaaagaag

SEQ ID NO: 247539 - RNA, 22 nt, Homo sapiens
gcuguugugaacuauacaucua

SEQ ID NO: 247540 - RNA, 22 nt, Homo sapiens
gcuuggugugcaagugguacua

SEQ ID NO: 247541 - RNA, 22 nt, Homo sapiens
gcuuuggauaaaugucaguuua

SEQ ID NO: 247542 - RNA, 19 nt, Homo sapiens
gcuuuguggggaaggagcc

SEQ ID NO: 247543 - RNA, 22 nt, Homo sapiens
ggaaagacaccuuacuauguua

SEQ ID NO: 247544 - RNA, 17 nt, Homo sapiens
ccccugagcgaugcagu

SEQ ID NO: 247545 - RNA, 22 nt, Homo sapiens
cccugagaaaacuuuguccuua

SEQ ID NO: 247546 - RNA, 22 nt, Homo sapiens
cccuggacauucaucauuaugu

SEQ ID NO: 247547 - RNA, 22 nt, Homo sapiens
ccgagguaggaggaucacuuga

SEQ ID NO: 247548 - RNA, 22 nt, Homo sapiens
ccggguguuuuguucucucaga

SEQ ID NO: 247549 - RNA, 22 nt, Homo sapiens
ccuaggcacugggguccagccc

SEQ ID NO: 247550 - RNA, 22 nt, Homo sapiens
ccucuguaguccugcaagagga

SEQ ID NO: 247551 - RNA, 22 nt, Homo sapiens
ccugagaucauacuguuaguaa

SEQ ID NO: 247552 - RNA, 22 nt, Homo sapiens
ccuggaaugaagcuuauauugc

SEQ ID NO: 247553 - RNA, 22 nt, Homo sapiens
ccuggcaagagacugaagauag

SEQ ID NO: 247554 - RNA, 22 nt, Homo sapiens
ccuggcacugagcaguguucua

SEQ ID NO: 247555 - RNA, 22 nt, Homo sapiens
ccugucuugaagagauccuccu

SEQ ID NO: 247556 - RNA, 22 nt, Homo sapiens
ccuucacaggcacugguucaga

SEQ ID NO: 247557 - RNA, 22 nt, Homo sapiens
ccuucauucauuaauuuagccc

SEQ ID NO: 247558 - RNA, 22 nt, Homo sapiens
ccuugcacuucccaagugaggc

SEQ ID NO: 247559 - RNA, 22 nt, Homo sapiens
ccuuggcaauggcuggggcuga

SEQ ID NO: 247560 - RNA, 22 nt, Homo sapiens
ccuuuguuuaguugaauuguau

SEQ ID NO: 247561 - RNA, 22 nt, Homo sapiens
cgcccuguagcuagcuagaggu

SEQ ID NO: 247562 - RNA, 22 nt, Homo sapiens
cguugcacuccagccugggcaa

SEQ ID NO: 247563 - RNA, 22 nt, Homo sapiens
cuaaaguagccaggacugcagg

SEQ ID NO: 247564 - RNA, 23 nt, Homo sapiens
cuaaagucugucacugaggacuu

SEQ ID NO: 247565 - RNA, 22 nt, Homo sapiens
cuaaagugcugagauuauaggu

SEQ ID NO: 247566 - RNA, 22 nt, Homo sapiens
cuaaagugcuuaaaaucucauu

SEQ ID NO: 247567 - RNA, 22 nt, Homo sapiens
cuaaaugucucuacuaaguuua

SEQ ID NO: 247568 - RNA, 18 nt, Homo sapiens
cuaagacacuuggcagag

SEQ ID NO: 247569 - RNA, 21 nt, Homo sapiens
cuaaggaaagcuaugaacccu

SEQ ID NO: 247570 - RNA, 22 nt, Homo sapiens
cuaaugcagucaggagaaggaa

SEQ ID NO: 247571 - RNA, 22 nt, Homo sapiens
cuacacaugcaggcucccugcc

SEQ ID NO: 247572 - RNA, 22 nt, Homo sapiens
cuacagugggucuguaguccuu

SEQ ID NO: 247573 - RNA, 22 nt, Homo sapiens
cuagaagguaagagcuggaugc

SEQ ID NO: 247574 - RNA, 22 nt, Homo sapiens
cuagaguacuuaccacagcaug

SEQ ID NO: 247575 - RNA, 22 nt, Homo sapiens
cuagaguguaguuuucuuagga

SEQ ID NO: 247576 - RNA, 22 nt, Homo sapiens
cuagcagacaugggcugaacca

SEQ ID NO: 247577 - RNA, 22 nt, Homo sapiens
cuagcccagugcuccuggauca

SEQ ID NO: 247578 - RNA, 22 nt, Homo sapiens
cuaggaaguauguguuauugcu

SEQ ID NO: 247579 - RNA, 22 nt, Homo sapiens
cuauaguauaguuugaagucag

SEQ ID NO: 247580 - RNA, 22 nt, Homo sapiens
cuaugagucugcagaucuauua

SEQ ID NO: 247581 - RNA, 22 nt, Homo sapiens
cuaugcauuuuggaggagggaa

SEQ ID NO: 247582 - RNA, 18 nt, Homo sapiens
cuaugccacuuuauauca

SEQ ID NO: 247583 - RNA, 22 nt, Homo sapiens
cuauggccugcuuagaacauac

SEQ ID NO: 247584 - RNA, 22 nt, Homo sapiens
cuaugguuucucaaacuccuga

SEQ ID NO: 247585 - RNA, 22 nt, Homo sapiens
cuauuugcauucagaggcaugu

SEQ ID NO: 247586 - RNA, 22 nt, Homo sapiens
cucaaguacaugggauuacagg

SEQ ID NO: 247587 - RNA, 22 nt, Homo sapiens
cucacagucagaagggacuugc

SEQ ID NO: 247588 - RNA, 22 nt, Homo sapiens
cucacaguucuaaaggcaagaa

SEQ ID NO: 247589 - RNA, 22 nt, Homo sapiens
cucacuaguaaggcuguuuagu

SEQ ID NO: 247590 - RNA, 22 nt, Homo sapiens
cucagauacuugggagguugag

SEQ ID NO: 247591 - RNA, 20 nt, Homo sapiens
cucagauuauucugaagcaa

SEQ ID NO: 247592 - RNA, 22 nt, Homo sapiens
cucagcaguggauuuaccacca

SEQ ID NO: 247593 - RNA, 22 nt, Homo sapiens
cucaggcacucugauuccagug

SEQ ID NO: 247594 - RNA, 22 nt, Homo sapiens
cucaguagaaaauacauggacu

SEQ ID NO: 247595 - RNA, 22 nt, Homo sapiens
cucaguggauuagauaaugcac

SEQ ID NO: 247596 - RNA, 22 nt, Homo sapiens
cucaguguuucagcugcucaga

SEQ ID NO: 247597 - RNA, 22 nt, Homo sapiens
cucauggaauacuucacagcca

SEQ ID NO: 247598 - RNA, 19 nt, Homo sapiens
cucauggagaaggagaaua

SEQ ID NO: 247599 - RNA, 22 nt, Homo sapiens
cuccaguuucagaaucccaugu

SEQ ID NO: 247600 - RNA, 23 nt, Homo sapiens
cucccugaacaugacacaccaga

SEQ ID NO: 247601 - RNA, 20 nt, Homo sapiens
cucccugacaaauguggaaa

SEQ ID NO: 247602 - RNA, 22 nt, Homo sapiens
cucccuuugcugaauguuuuuc

SEQ ID NO: 247603 - RNA, 22 nt, Homo sapiens
cuccuggugauuggagugugaa

SEQ ID NO: 247604 - RNA, 22 nt, Homo sapiens
cucgagagaaaaugcuucacug

SEQ ID NO: 247605 - RNA, 22 nt, Homo sapiens
cucgcuccauuucggugaucaa

SEQ ID NO: 247606 - RNA, 22 nt, Homo sapiens
cucucugagccauggcugcccu

SEQ ID NO: 247607 - RNA, 22 nt, Homo sapiens
cucugagccugagguuccuacu

SEQ ID NO: 247608 - RNA, 22 nt, Homo sapiens
cucugguuaaggcugaacuaua

SEQ ID NO: 247609 - RNA, 20 nt, Homo sapiens
uucagcaaaggaaugggagu

SEQ ID NO: 247610 - RNA, 22 nt, Homo sapiens
uucagcacugaaaauaugucau

SEQ ID NO: 247611 - RNA, 22 nt, Homo sapiens
uucagcuacuugggaggcugaa

SEQ ID NO: 247612 - RNA, 22 nt, Homo sapiens
uucaggcaccauugucauugau

SEQ ID NO: 247613 - RNA, 22 nt, Homo sapiens
uucaggcuccugugagaaucua

SEQ ID NO: 247614 - RNA, 22 nt, Homo sapiens
uucagggcauuggaguuucuga

SEQ ID NO: 247615 - RNA, 22 nt, Homo sapiens
uucagguaauuaugguuugucu

SEQ ID NO: 247616 - RNA, 22 nt, Homo sapiens
uucagguacugggggaguaugg

SEQ ID NO: 247617 - RNA, 22 nt, Homo sapiens
uucaguagucuccauagaaccg

SEQ ID NO: 247618 - RNA, 22 nt, Homo sapiens
uucagugucauuaacacaguag

SEQ ID NO: 247619 - RNA, 22 nt, Homo sapiens
uucaguucugcucugaucuuag

SEQ ID NO: 247620 - RNA, 19 nt, Homo sapiens
uucauacagugagagcagc

SEQ ID NO: 247621 - RNA, 22 nt, Homo sapiens
uucauagucuaauuuuuuccac

SEQ ID NO: 247622 - RNA, 22 nt, Homo sapiens
uucauaguucuuuuagucauua

SEQ ID NO: 247623 - RNA, 22 nt, Homo sapiens
uucauaguuuauacugauauuu

SEQ ID NO: 247624 - RNA, 18 nt, Homo sapiens
uucauauguugaaccaga

SEQ ID NO: 247625 - RNA, 21 nt, Homo sapiens
uucaucagccagaaaucaagc

SEQ ID NO: 247626 - RNA, 22 nt, Homo sapiens
uucaucuggcaauucagagauu

SEQ ID NO: 247627 - RNA, 22 nt, Homo sapiens
uucauggacucaauaguuucgc

SEQ ID NO: 247628 - RNA, 22 nt, Homo sapiens
uucauggaguuuaaauuguagu

SEQ ID NO: 247629 - RNA, 22 nt, Homo sapiens
uucauggugguacaaaagcaau

SEQ ID NO: 247630 - RNA, 22 nt, Homo sapiens
uucauguaaucaaggcagcuaa

SEQ ID NO: 247631 - RNA, 22 nt, Homo sapiens
uucauguagucaucauccugcu

SEQ ID NO: 247632 - RNA, 22 nt, Homo sapiens
uucaugugagucuguauuaacu

SEQ ID NO: 247633 - RNA, 22 nt, Homo sapiens
uucauugaaugauuuuuagaag

SEQ ID NO: 247634 - RNA, 22 nt, Homo sapiens
uucauugcugcuuaucuccaga

SEQ ID NO: 247635 - RNA, 20 nt, Homo sapiens
uuccagcacauuagggaagc

SEQ ID NO: 247636 - RNA, 22 nt, Homo sapiens
uuccagcugggggcaacucugc

SEQ ID NO: 247637 - RNA, 22 nt, Homo sapiens
uuccaguguguucauccucaga

SEQ ID NO: 247638 - RNA, 22 nt, Homo sapiens
uucccagagagggacuucuaau

SEQ ID NO: 247639 - RNA, 22 nt, Homo sapiens
uucccagugccaggcacuggga

SEQ ID NO: 247640 - RNA, 22 nt, Homo sapiens
uucccagugguuagcucugguc

SEQ ID NO: 247641 - RNA, 22 nt, Homo sapiens
uucccugaaauauucacuuuca

SEQ ID NO: 247642 - RNA, 22 nt, Homo sapiens
uucccugaguaucuuaccaugg

SEQ ID NO: 247643 - RNA, 22 nt, Homo sapiens
uucccuuucugaaaaucucauu

SEQ ID NO: 247644 - RNA, 22 nt, Homo sapiens
uucccuuucugccuugaaucuu

SEQ ID NO: 247645 - RNA, 20 nt, Homo sapiens
uuccuuaggcauuggaagaa

SEQ ID NO: 247646 - RNA, 22 nt, Homo sapiens
uuccuugagaaaguacaaggcu

SEQ ID NO: 247647 - RNA, 22 nt, Homo sapiens
uuccuugagagcuugauaucac

SEQ ID NO: 247648 - RNA, 22 nt, Homo sapiens
uuccuugagucuuuuuccugag

SEQ ID NO: 247649 - RNA, 22 nt, Homo sapiens
uucgcagcucaguucaacuagg

SEQ ID NO: 247650 - RNA, 22 nt, Homo sapiens
uucuaaacaucuuacaaugcau

SEQ ID NO: 247651 - RNA, 22 nt, Homo sapiens
uucuaaguaauuuugcaugccu

SEQ ID NO: 247652 - RNA, 22 nt, Homo sapiens
uucuacaggcuguucaagaagc

SEQ ID NO: 247653 - RNA, 20 nt, Homo sapiens
uucuacagucacaggaagau

SEQ ID NO: 247654 - RNA, 22 nt, Homo sapiens
uucucacaguacagggagcucu

SEQ ID NO: 247655 - RNA, 22 nt, Homo sapiens
uucucagugcuaucuuuuaugc

SEQ ID NO: 247656 - RNA, 22 nt, Homo sapiens
uucucaguucgguggcagugcu

SEQ ID NO: 247657 - RNA, 22 nt, Homo sapiens
uucucauggugauggcaaaauc

SEQ ID NO: 247658 - RNA, 22 nt, Homo sapiens
uucugacuggugugagauggua

SEQ ID NO: 247659 - RNA, 22 nt, Homo sapiens
uucuggaaaucagcagagggug

SEQ ID NO: 247660 - RNA, 22 nt, Homo sapiens
uucuuagucauguaauagucca

SEQ ID NO: 247661 - RNA, 22 nt, Homo sapiens
uucuucaggccacaaaaauggu

SEQ ID NO: 247662 - RNA, 22 nt, Homo sapiens
uucuuccagccuugaggggccc

SEQ ID NO: 247663 - RNA, 22 nt, Homo sapiens
uucuugguuggcaaccaacagu

SEQ ID NO: 247664 - RNA, 22 nt, Homo sapiens
uucuuuaguucacuugcuccag

SEQ ID NO: 247665 - RNA, 22 nt, Homo sapiens
auagacacugaaaucccugcca

SEQ ID NO: 247666 - RNA, 22 nt, Homo sapiens
auagaucauugucauuuuagau

SEQ ID NO: 247667 - RNA, 22 nt, Homo sapiens
auagcaagaugauugauccauu

SEQ ID NO: 247668 - RNA, 22 nt, Homo sapiens
auagcaauuugggaaucagacu

SEQ ID NO: 247669 - RNA, 22 nt, Homo sapiens
auagcacaugugcaaauggcug

SEQ ID NO: 247670 - RNA, 20 nt, Homo sapiens
auagcaccagacagcccuag

SEQ ID NO: 247671 - RNA, 22 nt, Homo sapiens
auagcagaacagugucucacug

SEQ ID NO: 247672 - RNA, 22 nt, Homo sapiens
auagcagcaccccacuaccuca

SEQ ID NO: 247673 - RNA, 22 nt, Homo sapiens
uugguuccauuuuaccagcucu

SEQ ID NO: 247674 - RNA, 22 nt, Homo sapiens
uugguucucuuagccaucuuaa

SEQ ID NO: 247675 - RNA, 22 nt, Homo sapiens
uuguaaacaucuguacauugcu

SEQ ID NO: 247676 - RNA, 23 nt, Homo sapiens
uuguaacuggagaguaacauucc

SEQ ID NO: 247677 - RNA, 22 nt, Homo sapiens
uuguauacucuauuuuagcagu

SEQ ID NO: 247678 - RNA, 22 nt, Homo sapiens
uuguauguugaaugaugguaua

SEQ ID NO: 247679 - RNA, 22 nt, Homo sapiens
uuguauguuguuugucagagaa

SEQ ID NO: 247680 - RNA, 22 nt, Homo sapiens
uugucacucuuccuaggguagg

SEQ ID NO: 247681 - RNA, 22 nt, Homo sapiens
uuguccauggacagcaccacag

SEQ ID NO: 247682 - RNA, 21 nt, Homo sapiens
uugucuagagaaauauaucuc

SEQ ID NO: 247683 - RNA, 22 nt, Homo sapiens
uugucuugcagcuuaggcauca

SEQ ID NO: 247684 - RNA, 22 nt, Homo sapiens
uugugaaaaaccucucguggaa

SEQ ID NO: 247685 - RNA, 22 nt, Homo sapiens
uugugaauggugccucaguaaa

SEQ ID NO: 247686 - RNA, 22 nt, Homo sapiens
uugugcuuaaugaguguaaggu

SEQ ID NO: 247687 - RNA, 22 nt, Homo sapiens
uugugcuuuuuaaauagcuucc

SEQ ID NO: 247688 - RNA, 22 nt, Homo sapiens
uugugguugacuaaauuuguaa

SEQ ID NO: 247689 - RNA, 22 nt, Homo sapiens
uuguguuugaugcugacacgca

SEQ ID NO: 247690 - RNA, 22 nt, Homo sapiens
uuguuaugggguggcuugaaag

SEQ ID NO: 247691 - RNA, 22 nt, Homo sapiens
uuguucaggagguuggggaugc

SEQ ID NO: 247692 - RNA, 22 nt, Homo sapiens
uuuaaggcaggucuggugguga

SEQ ID NO: 247693 - RNA, 22 nt, Homo sapiens
uuuaagguauguggugaaaauu

SEQ ID NO: 247694 - RNA, 22 nt, Homo sapiens
uuuaaugcaucccaaaauguag

SEQ ID NO: 247695 - RNA, 21 nt, Homo sapiens
uuuacuguggacccauugcuu

SEQ ID NO: 247696 - RNA, 22 nt, Homo sapiens
uuuagcaaugcuguggggaagu

SEQ ID NO: 247697 - RNA, 22 nt, Homo sapiens
uuuagcaauggagggugacuuu

SEQ ID NO: 247698 - RNA, 22 nt, Homo sapiens
uuuagcgaaugcuugcuccugu

SEQ ID NO: 247699 - RNA, 22 nt, Homo sapiens
uuuaggcaauauauucaugucu

SEQ ID NO: 247700 - RNA, 22 nt, Homo sapiens
uuuagggcagggacaguucuuc

SEQ ID NO: 247701 - RNA, 22 nt, Homo sapiens
uuuaucuguuuaaaacuguuca

SEQ ID NO: 247702 - RNA, 22 nt, Homo sapiens
uuuaugagguagagugguuuau

SEQ ID NO: 247703 - RNA, 22 nt, Homo sapiens
uuuaugcuacauguguuggaaa

SEQ ID NO: 247704 - RNA, 22 nt, Homo sapiens
uuuauggcaugcucccucucaa

SEQ ID NO: 247705 - RNA, 22 nt, Homo sapiens
uuuauguggagcacuugacaca

SEQ ID NO: 247706 - RNA, 22 nt, Homo sapiens
uuuauugcucuaaaguugccau

SEQ ID NO: 247707 - RNA, 22 nt, Homo sapiens
uuucacguuggggaguugagug

SEQ ID NO: 247708 - RNA, 17 nt, Homo sapiens
uuucagaguggaagugu

SEQ ID NO: 247709 - RNA, 22 nt, Homo sapiens
uuucaggcagggagcuucagug

SEQ ID NO: 247710 - RNA, 22 nt, Homo sapiens
uuucaguguggcaggcauagcu

SEQ ID NO: 247711 - RNA, 22 nt, Homo sapiens
uuucauagaucaugcuuuugga

SEQ ID NO: 247712 - RNA, 22 nt, Homo sapiens
uuucauagccuucuaaugaguu

SEQ ID NO: 247713 - RNA, 22 nt, Homo sapiens
uuucauagccuuugucgucuga

SEQ ID NO: 247714 - RNA, 22 nt, Homo sapiens
uuucauaguuugcauagggcau

SEQ ID NO: 247715 - RNA, 22 nt, Homo sapiens
uuucauggaauauagucauuuu

SEQ ID NO: 247716 - RNA, 23 nt, Homo sapiens
uuucauggggauuuacucauucc

SEQ ID NO: 247717 - RNA, 19 nt, Homo sapiens
uuucauguuuuuggugaga

SEQ ID NO: 247718 - RNA, 18 nt, Homo sapiens
uuucauugagugugauau

SEQ ID NO: 247719 - RNA, 22 nt, Homo sapiens
uuuccagguggccaacauuuua

SEQ ID NO: 247720 - RNA, 22 nt, Homo sapiens
uuuccaguuguucuagaaagcu

SEQ ID NO: 247721 - RNA, 22 nt, Homo sapiens
uuucuacagugaacgauuucua

SEQ ID NO: 247722 - RNA, 22 nt, Homo sapiens
uuucuauguugaccagucuaga

SEQ ID NO: 247723 - RNA, 22 nt, Homo sapiens
uuucugcuugagagaauugcug

SEQ ID NO: 247724 - RNA, 22 nt, Homo sapiens
uuuugucccaugggcuguuccc

SEQ ID NO: 247725 - RNA, 18 nt, Homo sapiens
uuuuugaggcacagggga

SEQ ID NO: 247726 - RNA, 22 nt, Homo sapiens
uuuuugaguaaauauaaauugu

SEQ ID NO: 247727 - RNA, 22 nt, Homo sapiens
uuuuugauuaauggguagacca

SEQ ID NO: 247728 - RNA, 16 nt, Homo sapiens
uuuuugcagaaaugac

SEQ ID NO: 247729 - RNA, 22 nt, Homo sapiens
ugaagaucuuaggagcugaggg

SEQ ID NO: 247730 - RNA, 22 nt, Homo sapiens
ugaauacuucguucaaagauaa

SEQ ID NO: 247731 - RNA, 22 nt, Homo sapiens
ugaauauguuaaauaauguucu

SEQ ID NO: 247732 - RNA, 22 nt, Homo sapiens
ugaauauguuucuaaaagugca

SEQ ID NO: 247733 - RNA, 22 nt, Homo sapiens
ugaaugauuuuaaaagccucuc

SEQ ID NO: 247734 - RNA, 20 nt, Homo sapiens
ugaauguaauuacagaugua

SEQ ID NO: 247735 - RNA, 22 nt, Homo sapiens
ugaauguacacgcguacuuguu

SEQ ID NO: 247736 - RNA, 22 nt, Homo sapiens
ugaauguauuuauuaccauuca

SEQ ID NO: 247737 - RNA, 22 nt, Homo sapiens
ugaauguccauugauguuuuga

SEQ ID NO: 247738 - RNA, 22 nt, Homo sapiens
ugaauuguuucauucuuuacau

SEQ ID NO: 247739 - RNA, 22 nt, Homo sapiens
ugacaacugauuaacuccuuua

SEQ ID NO: 247740 - RNA, 22 nt, Homo sapiens
ugacaagaacuuuccauaguaa

SEQ ID NO: 247741 - RNA, 23 nt, Homo sapiens
ugacaagagcgagacuuggucuc

SEQ ID NO: 247742 - RNA, 22 nt, Homo sapiens
ugacaagcucccucugcaccuu

SEQ ID NO: 247743 - RNA, 22 nt, Homo sapiens
ugacaaguaaacagucagcacc

SEQ ID NO: 247744 - RNA, 22 nt, Homo sapiens
ugacagagcaggacuucaucuc

SEQ ID NO: 247745 - RNA, 22 nt, Homo sapiens
ugacagaggucuuuuaauagcu

SEQ ID NO: 247746 - RNA, 22 nt, Homo sapiens
ugacagguuggaauuaugggag

SEQ ID NO: 247747 - RNA, 22 nt, Homo sapiens
ugacagugaacagguuaccacu

SEQ ID NO: 247748 - RNA, 22 nt, Homo sapiens
ugagucuguucucacauugcua

SEQ ID NO: 247749 - RNA, 22 nt, Homo sapiens
ugagugaggcugggcagucccu

SEQ ID NO: 247750 - RNA, 21 nt, Homo sapiens
ugagugcugagugaggguuga

SEQ ID NO: 247751 - RNA, 22 nt, Homo sapiens
ugaguucaugcuuguaguucua

SEQ ID NO: 247752 - RNA, 22 nt, Homo sapiens
ugaguucauggucauuugucac

SEQ ID NO: 247753 - RNA, 22 nt, Homo sapiens
ugauacuggcuucauagaauga

SEQ ID NO: 247754 - RNA, 22 nt, Homo sapiens
ugauaucucuugccuccaaaug

SEQ ID NO: 247755 - RNA, 22 nt, Homo sapiens
ugauaucugaauagauacacaa

SEQ ID NO: 247756 - RNA, 22 nt, Homo sapiens
ugauaugacagcucugcugcca

SEQ ID NO: 247757 - RNA, 22 nt, Homo sapiens
ugauaugugaguauaugguuau

SEQ ID NO: 247758 - RNA, 22 nt, Homo sapiens
ugaugaaguauaggaagggcuu

SEQ ID NO: 247759 - RNA, 22 nt, Homo sapiens
ugaugacucuguggccccaggc

SEQ ID NO: 247760 - RNA, 23 nt, Homo sapiens
ugauguccacuuagggucuaggu

SEQ ID NO: 247761 - RNA, 20 nt, Homo sapiens
ugauguccaggcagagguuu

SEQ ID NO: 247762 - RNA, 22 nt, Homo sapiens
ugauuagagcccaagcuuugaa

SEQ ID NO: 247763 - RNA, 22 nt, Homo sapiens
ugauuggagaacaaacugcaua

SEQ ID NO: 247764 - RNA, 22 nt, Homo sapiens
aaagugcaguacuucguauauu

SEQ ID NO: 247765 - RNA, 22 nt, Homo sapiens
aaagugcugagacagacuggga

SEQ ID NO: 247766 - RNA, 22 nt, Homo sapiens
aaagugcugagucuaggcgggg

SEQ ID NO: 247767 - RNA, 22 nt, Homo sapiens
aaagugcugggauuaggccagg

SEQ ID NO: 247768 - RNA, 22 nt, Homo sapiens
aaagugcuuccuuuuugagggu

SEQ ID NO: 247769 - RNA, 22 nt, Homo sapiens
aaagugucuguuccuagcauga

SEQ ID NO: 247770 - RNA, 22 nt, Homo sapiens
aaaguguuucugcaguagguuu

SEQ ID NO: 247771 - RNA, 22 nt, Homo sapiens
aaaucccuugcucucucagacc

SEQ ID NO: 247772 - RNA, 22 nt, Homo sapiens
aaaugacuuuuuaugcagagua

SEQ ID NO: 247773 - RNA, 22 nt, Homo sapiens
aaaugcacagaaaggaugugga

SEQ ID NO: 247774 - RNA, 21 nt, Homo sapiens
aaaugcacauuacugcuggug

SEQ ID NO: 247775 - RNA, 22 nt, Homo sapiens
aaaugcaccacucuggugcagg

SEQ ID NO: 247776 - RNA, 22 nt, Homo sapiens
aaaugcaguugguggggauaug

SEQ ID NO: 247777 - RNA, 22 nt, Homo sapiens
ugauuugucucucagcccuacu

SEQ ID NO: 247778 - RNA, 22 nt, Homo sapiens
ugcaaagucgaaacugcaguuu

SEQ ID NO: 247779 - RNA, 22 nt, Homo sapiens
ugcaaaugcugcuauuucucuu

SEQ ID NO: 247780 - RNA, 22 nt, Homo sapiens
ugcaaauguuauuuugguuucu

SEQ ID NO: 247781 - RNA, 22 nt, Homo sapiens
ugcaagacacuguccugggcau

SEQ ID NO: 247782 - RNA, 22 nt, Homo sapiens
ugcaagaugauuucaauugaua

SEQ ID NO: 247783 - RNA, 20 nt, Homo sapiens
ugcaaguugccuuuggaggc

SEQ ID NO: 247784 - RNA, 22 nt, Homo sapiens
ugcaaugucuucugaggggagc

SEQ ID NO: 247785 - RNA, 17 nt, Homo sapiens
ugcaauuuaagcuagau

SEQ ID NO: 247786 - RNA, 22 nt, Homo sapiens
ugcaauuuaaugugucccaauu

SEQ ID NO: 247787 - RNA, 22 nt, Homo sapiens
ugcacuguggucugagagacag

SEQ ID NO: 247788 - RNA, 22 nt, Homo sapiens
ugcagagaaacauuuuguauuu

SEQ ID NO: 247789 - RNA, 22 nt, Homo sapiens
ugcagcacugaacuucugggcu

SEQ ID NO: 247790 - RNA, 22 nt, Homo sapiens
ugcagcauguaggcacguuauu

SEQ ID NO: 247791 - RNA, 22 nt, Homo sapiens
ugcaggauguucaguaauuucc

SEQ ID NO: 247792 - RNA, 22 nt, Homo sapiens
ugcaguagugugaucuuggcuc

SEQ ID NO: 247793 - RNA, 22 nt, Homo sapiens
ugcagugugauuuucuggcuga

SEQ ID NO: 247794 - RNA, 22 nt, Homo sapiens
ugcaguguggcucacgccugua

SEQ ID NO: 247795 - RNA, 22 nt, Homo sapiens
ugcaguuuaggaacugguaaca

SEQ ID NO: 247796 - RNA, 22 nt, Homo sapiens
ugcauauucgaguuauuuuggg

SEQ ID NO: 247797 - RNA, 22 nt, Homo sapiens
ugcauauuuuauaaagauggaa

SEQ ID NO: 247798 - RNA, 22 nt, Homo sapiens
ugcauccauucuagacucaucu

SEQ ID NO: 247799 - RNA, 21 nt, Homo sapiens
ugcaugguagucacaugauuc

SEQ ID NO: 247800 - RNA, 20 nt, Homo sapiens
ugcauguccucacuuacuug

SEQ ID NO: 247801 - RNA, 22 nt, Homo sapiens
ugcauuguuccgaauguguccu

SEQ ID NO: 247802 - RNA, 22 nt, Homo sapiens
ugccaacaugccuggcuguuuu

SEQ ID NO: 247803 - RNA, 22 nt, Homo sapiens
ugccaaggagucagucccuaga

SEQ ID NO: 247804 - RNA, 22 nt, Homo sapiens
ugccaguguuuuguugaagauu

SEQ ID NO: 247805 - RNA, 22 nt, Homo sapiens
ugccaguuuuuacauuuccugu

SEQ ID NO: 247806 - RNA, 22 nt, Homo sapiens
ugccaucauuaauauuaggcau

SEQ ID NO: 247807 - RNA, 22 nt, Homo sapiens
ugccuagucuauugagagucuu

SEQ ID NO: 247808 - RNA, 22 nt, Homo sapiens
ugccuaguggaaggagagcaaa

SEQ ID NO: 247809 - RNA, 22 nt, Homo sapiens
ugccugagcccagcccuguagu

SEQ ID NO: 247810 - RNA, 22 nt, Homo sapiens
ugccuuuguucuggaaugggaa

SEQ ID NO: 247811 - RNA, 22 nt, Homo sapiens
ugcgccauugcacuccagccug

SEQ ID NO: 247812 - RNA, 22 nt, Homo sapiens
ugcuauguaacacauuaccuuu

SEQ ID NO: 247813 - RNA, 21 nt, Homo sapiens
ugcuccauuuucuagccugaa

SEQ ID NO: 247814 - RNA, 18 nt, Homo sapiens
ugcuccccugggugagca

SEQ ID NO: 247815 - RNA, 22 nt, Homo sapiens
ugcugaguguuaccggacaccg

SEQ ID NO: 247816 - RNA, 22 nt, Homo sapiens
ugcuggcguuacucuccaucag

SEQ ID NO: 247817 - RNA, 22 nt, Homo sapiens
ugcuggugauucagauucaaau

SEQ ID NO: 247818 - RNA, 22 nt, Homo sapiens
ugcuguuguuugaugaaguaau

SEQ ID NO: 247819 - RNA, 22 nt, Homo sapiens
ugcuuuguugaaaaucauuugg

SEQ ID NO: 247820 - RNA, 22 nt, Homo sapiens
uggaaaauuaggggagguuaua

SEQ ID NO: 247821 - RNA, 22 nt, Homo sapiens
uggaagacaaguguuagcaugg

SEQ ID NO: 247822 - RNA, 22 nt, Homo sapiens
uggaagacucaagguggugaau

SEQ ID NO: 247823 - RNA, 22 nt, Homo sapiens
uggaagacucuagucucuugag

SEQ ID NO: 247824 - RNA, 20 nt, Homo sapiens
uggaaguaagaauauaggug

SEQ ID NO: 247825 - RNA, 22 nt, Homo sapiens
uggaaguaaucaugagguagca

SEQ ID NO: 247826 - RNA, 22 nt, Homo sapiens
uggaaguauagauaauugaaag

SEQ ID NO: 247827 - RNA, 22 nt, Homo sapiens
uggaauaucaugagaguuuguu

SEQ ID NO: 247828 - RNA, 22 nt, Homo sapiens
uggaaucuacuaaagcaaaauc

SEQ ID NO: 247829 - RNA, 22 nt, Homo sapiens
uggaaucuagagaaaugcaaac

SEQ ID NO: 247830 - RNA, 20 nt, Homo sapiens
uggaaucuaggcggagguuu

SEQ ID NO: 247831 - RNA, 20 nt, Homo sapiens
uggaaugcagccuccuucug

SEQ ID NO: 247832 - RNA, 22 nt, Homo sapiens
uggaauggagagagggugcacg

SEQ ID NO: 247833 - RNA, 17 nt, Homo sapiens
uggaaugucuaagccug

SEQ ID NO: 247834 - RNA, 18 nt, Homo sapiens
uggaauguuuggguuaau

SEQ ID NO: 247835 - RNA, 22 nt, Homo sapiens
uggacaugaagggcacaggagg

SEQ ID NO: 247836 - RNA, 22 nt, Homo sapiens
uggaccccugcucgggagcccu

SEQ ID NO: 247837 - RNA, 19 nt, Homo sapiens
uggaccccuuccuuacacc

SEQ ID NO: 247838 - RNA, 21 nt, Homo sapiens
uggaccccuuccuugcaccau

SEQ ID NO: 247839 - RNA, 21 nt, Homo sapiens
uggaccccuuucuuacaccgu

SEQ ID NO: 247840 - RNA, 22 nt, Homo sapiens
uggagaacugaugucuccaaga

SEQ ID NO: 247841 - RNA, 22 nt, Homo sapiens
uggagacugaucccucuuuccu

SEQ ID NO: 247842 - RNA, 22 nt, Homo sapiens
uggagagcaaagaauuuguuag

SEQ ID NO: 247843 - RNA, 22 nt, Homo sapiens
uggagagucauuuauaguauuu

SEQ ID NO: 247844 - RNA, 22 nt, Homo sapiens
uggagauguuuaaaauccacug

SEQ ID NO: 247845 - RNA, 22 nt, Homo sapiens
uggagcccuaaacuucuaauau

SEQ ID NO: 247846 - RNA, 23 nt, Homo sapiens
uggaggacaagcauggauaguga

SEQ ID NO: 247847 - RNA, 20 nt, Homo sapiens
uggagugaagguucuggacc

SEQ ID NO: 247848 - RNA, 21 nt, Homo sapiens
uggagugcaacacuagguaua

SEQ ID NO: 247849 - RNA, 22 nt, Homo sapiens
uggagugcgagggugaaacuuu

SEQ ID NO: 247850 - RNA, 22 nt, Homo sapiens
uggaguuugacaugccuuuggg

SEQ ID NO: 247851 - RNA, 20 nt, Homo sapiens
uggaguuugaguucuuggag

SEQ ID NO: 247852 - RNA, 18 nt, Homo sapiens
uggauaugaaauucugga

SEQ ID NO: 247853 - RNA, 22 nt, Homo sapiens
uggauauguucuuuguguaagg

SEQ ID NO: 247854 - RNA, 22 nt, Homo sapiens
uggaucuguucuauuuaucuga

SEQ ID NO: 247855 - RNA, 22 nt, Homo sapiens
uggauggagaggcuugugaugc

SEQ ID NO: 247856 - RNA, 22 nt, Homo sapiens
uggauugcaaaaucuuuuugag

SEQ ID NO: 247857 - RNA, 22 nt, Homo sapiens
uggcaaaauauuuugguuucug

SEQ ID NO: 247858 - RNA, 21 nt, Homo sapiens
uggcaaaaugggcaguggguu

SEQ ID NO: 247859 - RNA, 22 nt, Homo sapiens
uggcaaaugaagucagcuguac

SEQ ID NO: 247860 - RNA, 22 nt, Homo sapiens
uggcaaauguaguacccaauag

SEQ ID NO: 247861 - RNA, 22 nt, Homo sapiens
uggcaagaacgaaauguagggu

SEQ ID NO: 247862 - RNA, 22 nt, Homo sapiens
uggcaagagggaugcaagguuu

SEQ ID NO: 247863 - RNA, 20 nt, Homo sapiens
uggcaagauggcagaauaga

SEQ ID NO: 247864 - RNA, 23 nt, Homo sapiens
uggcaagauuuguauugccugga

SEQ ID NO: 247865 - RNA, 18 nt, Homo sapiens
uggcaaguuuaguagcac

SEQ ID NO: 247866 - RNA, 22 nt, Homo sapiens
gagacggagucucgcucugucg

SEQ ID NO: 247867 - RNA, 22 nt, Homo sapiens
gagacggagucuugcucuguug

SEQ ID NO: 247868 - RNA, 22 nt, Homo sapiens
gagacucuuagauuggaaaucu

SEQ ID NO: 247869 - RNA, 22 nt, Homo sapiens
gagacugagucuugcucugucg

SEQ ID NO: 247870 - RNA, 22 nt, Homo sapiens
gagauagguauuucauuuaccc

SEQ ID NO: 247871 - RNA, 22 nt, Homo sapiens
gagaucauguacuagaacaccu

SEQ ID NO: 247872 - RNA, 22 nt, Homo sapiens
gagaugguacacauacgauucu

SEQ ID NO: 247873 - RNA, 22 nt, Homo sapiens
gagaugugguucaaggguguuu

SEQ ID NO: 247874 - RNA, 22 nt, Homo sapiens
cauugcacuccagcuugggcga

SEQ ID NO: 247875 - RNA, 22 nt, Homo sapiens
cauugcacuccagucugggcaa

SEQ ID NO: 247876 - RNA, 22 nt, Homo sapiens
cauugcacuccaucccgggaaa

SEQ ID NO: 247877 - RNA, 22 nt, Homo sapiens
cauugcacuccaucuugggcaa

SEQ ID NO: 247878 - RNA, 16 nt, Homo sapiens
cauugcacucuagccu

SEQ ID NO: 247879 - RNA, 22 nt, Homo sapiens
cauugcacucugcauuccaguc

SEQ ID NO: 247880 - RNA, 22 nt, Homo sapiens
cauugcacugcuucuugggugu

SEQ ID NO: 247881 - RNA, 22 nt, Homo sapiens
cauugcacuuagacaacuuuug

SEQ ID NO: 247882 - RNA, 22 nt, Homo sapiens
cauugcaguggaguggggaaga

SEQ ID NO: 247883 - RNA, 20 nt, Homo sapiens
cauugcccuccagccugggc

SEQ ID NO: 247884 - RNA, 22 nt, Homo sapiens
cauugcccuccagccugggcaa

SEQ ID NO: 247885 - RNA, 22 nt, Homo sapiens
cauugcuuuuggugguuuagac

SEQ ID NO: 247886 - RNA, 22 nt, Homo sapiens
cauuuugcaguuucugucucca

SEQ ID NO: 247887 - RNA, 22 nt, Homo sapiens
ccacagucuaugcaacaagguc

SEQ ID NO: 247888 - RNA, 22 nt, Homo sapiens
ccacugggcaguuuauuaucag

SEQ ID NO: 247889 - RNA, 22 nt, Homo sapiens
ccacugggcuagguguuuugga

SEQ ID NO: 247890 - RNA, 22 nt, Homo sapiens
ccagaguuucugauucagcagg

SEQ ID NO: 247891 - RNA, 22 nt, Homo sapiens
ccaggguugagacccacugacu

SEQ ID NO: 247892 - RNA, 22 nt, Homo sapiens
ccaguauugaacacaaugaaag

SEQ ID NO: 247893 - RNA, 22 nt, Homo sapiens
ccagugauuguauggugaaggu

SEQ ID NO: 247894 - RNA, 22 nt, Homo sapiens
ccagugcauggaucccaggggg

SEQ ID NO: 247895 - RNA, 19 nt, Homo sapiens
ccaguguugccagagcuga

SEQ ID NO: 247896 - RNA, 22 nt, Homo sapiens
ccaguucaaugauauggaaacu

SEQ ID NO: 247897 - RNA, 22 nt, Homo sapiens
ccaucacaggccucagugggaa

SEQ ID NO: 247898 - RNA, 18 nt, Homo sapiens
ccauucaacagauuuguc

SEQ ID NO: 247899 - RNA, 22 nt, Homo sapiens
ccauugaacaugaaggaaugug

SEQ ID NO: 247900 - RNA, 18 nt, Homo sapiens
cccagugacuuauggccu

SEQ ID NO: 247901 - RNA, 22 nt, Homo sapiens
cccagugguuacauaaggagua

SEQ ID NO: 247902 - RNA, 22 nt, Homo sapiens
cccagugugcugggugacagcu

SEQ ID NO: 247903 - RNA, 22 nt, Homo sapiens
cccaguguuacgugacagccug

SEQ ID NO: 247904 - RNA, 22 nt, Homo sapiens
cccaguuuugcuucucaugagg

SEQ ID NO: 247905 - RNA, 19 nt, Homo sapiens
ccccuguggauaccgaggg

SEQ ID NO: 247906 - RNA, 23 nt, Homo sapiens
cccucagaagugcagggagagaa

SEQ ID NO: 247907 - RNA, 22 nt, Homo sapiens
cccugagaugcuguuaaucugu

SEQ ID NO: 247908 - RNA, 22 nt, Homo sapiens
cccugagaugugaauuucagag

SEQ ID NO: 247909 - RNA, 22 nt, Homo sapiens
cccugagcagccugaguuuccc

SEQ ID NO: 247910 - RNA, 21 nt, Homo sapiens
cccugguguuuggaguuugag

SEQ ID NO: 247911 - RNA, 22 nt, Homo sapiens
cccuucauucaaggguugugag

SEQ ID NO: 247912 - RNA, 22 nt, Homo sapiens
ccggcuguguggagaggccccu

SEQ ID NO: 247913 - RNA, 22 nt, Homo sapiens
ccucacaaccuuuauugaagag

SEQ ID NO: 247914 - RNA, 22 nt, Homo sapiens
ccuccauuugugucaggaaguc

SEQ ID NO: 247915 - RNA, 21 nt, Homo sapiens
ccucuuugagggaagaaaggg

SEQ ID NO: 247916 - RNA, 21 nt, Homo sapiens
ccugaguacaacccacuccac

SEQ ID NO: 247917 - RNA, 22 nt, Homo sapiens
ccugaugacacgggagauguac

SEQ ID NO: 247918 - RNA, 22 nt, Homo sapiens
ccuggaucauugucauucccaa

SEQ ID NO: 247919 - RNA, 22 nt, Homo sapiens
ccuugguaauguguuuuauucu

SEQ ID NO: 247920 - RNA, 22 nt, Homo sapiens
cgcuggugucuaagcgacagcu

SEQ ID NO: 247921 - RNA, 22 nt, Homo sapiens
cggcaguggguaagccaagcuu

SEQ ID NO: 247922 - RNA, 22 nt, Homo sapiens
cuaaaacuuucugagugcagca

SEQ ID NO: 247923 - RNA, 22 nt, Homo sapiens
cuaaaugcacugucaaaggaag

SEQ ID NO: 247924 - RNA, 17 nt, Homo sapiens
cuaaggcaagagucugc

SEQ ID NO: 247925 - RNA, 22 nt, Homo sapiens
cuaaggcaguagccugaauaau

SEQ ID NO: 247926 - RNA, 22 nt, Homo sapiens
cuaaucugugcauagaagaggc

SEQ ID NO: 247927 - RNA, 22 nt, Homo sapiens
cuaauucuggccaaagggauaa

SEQ ID NO: 247928 - RNA, 22 nt, Homo sapiens
cuacagguaugaaagggaguau

SEQ ID NO: 247929 - RNA, 23 nt, Homo sapiens
cuacagugccugucucuuuggcc

SEQ ID NO: 247930 - RNA, 22 nt, Homo sapiens
cuacaguucuuaauuaaguagu

SEQ ID NO: 247931 - RNA, 21 nt, Homo sapiens
cuacccuguauuagagaaaga

SEQ ID NO: 247932 - RNA, 22 nt, Homo sapiens
cuacugcacaucaucugaguua

SEQ ID NO: 247933 - RNA, 22 nt, Homo sapiens
cuagacuagacccaaauugaag

SEQ ID NO: 247934 - RNA, 22 nt, Homo sapiens
cuagcacauuuaucuuuauaca

SEQ ID NO: 247935 - RNA, 22 nt, Homo sapiens
cuagccuggagugcaguggugc

SEQ ID NO: 247936 - RNA, 22 nt, Homo sapiens
cuagcugcacuuccugcuacug

SEQ ID NO: 247937 - RNA, 22 nt, Homo sapiens
cuagguagcuuuucugucaugu

SEQ ID NO: 247938 - RNA, 22 nt, Homo sapiens
cuaggugcaugagccguacagu

SEQ ID NO: 247939 - RNA, 18 nt, Homo sapiens
cuaguguuucuugaauca

SEQ ID NO: 247940 - RNA, 22 nt, Homo sapiens
cuauaacagugugguuuggaga

SEQ ID NO: 247941 - RNA, 22 nt, Homo sapiens
cuaucucauugguuuuugaaag

SEQ ID NO: 247942 - RNA, 22 nt, Homo sapiens
cuauggcuguagucccugugua

SEQ ID NO: 247943 - RNA, 22 nt, Homo sapiens
cuauucacaauagccaagauuu

SEQ ID NO: 247944 - RNA, 21 nt, Homo sapiens
cucaaaguacugauauuacag

SEQ ID NO: 247945 - RNA, 22 nt, Homo sapiens
cucacagugacacgaaccccca

SEQ ID NO: 247946 - RNA, 22 nt, Homo sapiens
cucacaugcucaccugguguuc

SEQ ID NO: 247947 - RNA, 20 nt, Homo sapiens
cucaccagguguaggcugag

SEQ ID NO: 247948 - RNA, 22 nt, Homo sapiens
cucaccuugugauccaccggcc

SEQ ID NO: 247949 - RNA, 22 nt, Homo sapiens
cucaccuugugauccuccugcc

SEQ ID NO: 247950 - RNA, 22 nt, Homo sapiens
cucacugucaacauguauuugg

SEQ ID NO: 247951 - RNA, 22 nt, Homo sapiens
cucacugugguguccuuaggua

SEQ ID NO: 247952 - RNA, 22 nt, Homo sapiens
cucaggguacuucuccuuugcu

SEQ ID NO: 247953 - RNA, 22 nt, Homo sapiens
cucagguaguuccuuauagcaa

SEQ ID NO: 247954 - RNA, 22 nt, Homo sapiens
cucagucuaugauacuuugcua

SEQ ID NO: 247955 - RNA, 22 nt, Homo sapiens
cucagugucuggcacacagaaa

SEQ ID NO: 247956 - RNA, 22 nt, Homo sapiens
cucagugucuggggccccaggg

SEQ ID NO: 247957 - RNA, 22 nt, Homo sapiens
cucauugcaaucucugccuccc

SEQ ID NO: 247958 - RNA, 22 nt, Homo sapiens
cuccacugagcaggugggaggc

SEQ ID NO: 247959 - RNA, 22 nt, Homo sapiens
cuccaggugucauccaccuccu

SEQ ID NO: 247960 - RNA, 22 nt, Homo sapiens
cuccagugcaaagucaugauca

SEQ ID NO: 247961 - RNA, 22 nt, Homo sapiens
cuccauagucuucgaagaauga

SEQ ID NO: 247962 - RNA, 22 nt, Homo sapiens
cuccuguagccccaucaucuuu

SEQ ID NO: 247963 - RNA, 22 nt, Homo sapiens
cuccuugauuagaguauagagu

SEQ ID NO: 247964 - RNA, 22 nt, Homo sapiens
cucucaguguggaggccagaaa

SEQ ID NO: 247965 - RNA, 21 nt, Homo sapiens
cucucugcuuaugaauaguga

SEQ ID NO: 247966 - RNA, 17 nt, Homo sapiens
cucucugguuuaaagca

SEQ ID NO: 247967 - RNA, 20 nt, Homo sapiens
cucugguugugaauugucuu

SEQ ID NO: 247968 - RNA, 22 nt, Homo sapiens
cucugguuucgcaggaaauaga

SEQ ID NO: 247969 - RNA, 22 nt, Homo sapiens
cucuuagauuagccauccuaau

SEQ ID NO: 247970 - RNA, 22 nt, Homo sapiens
cucuuuggaugccuuaggguua

SEQ ID NO: 247971 - RNA, 22 nt, Homo sapiens
cugaaauggaaugugugcacag

SEQ ID NO: 247972 - RNA, 22 nt, Homo sapiens
cugaaggcagguagaauagaga

SEQ ID NO: 247973 - RNA, 22 nt, Homo sapiens
cugaagugcuugccacauaaaa

SEQ ID NO: 247974 - RNA, 22 nt, Homo sapiens
cugacaagauucaucacucagu

SEQ ID NO: 247975 - RNA, 22 nt, Homo sapiens
cugacaagugaucacagcagca

SEQ ID NO: 247976 - RNA, 21 nt, Homo sapiens
ugaaugucuaggcagaaguuu

SEQ ID NO: 247977 - RNA, 22 nt, Homo sapiens
ugaaugugauggguuucaugug

SEQ ID NO: 247978 - RNA, 22 nt, Homo sapiens
ugaauguuugcuuacuuccaua

SEQ ID NO: 247979 - RNA, 22 nt, Homo sapiens
ugacaagaaagcgucuucuuuu

SEQ ID NO: 247980 - RNA, 22 nt, Homo sapiens
ugacaagagaccccuccgcagg

SEQ ID NO: 247981 - RNA, 22 nt, Homo sapiens
ugacagcugaagauguugaacc

SEQ ID NO: 247982 - RNA, 22 nt, Homo sapiens
ugacagcuguugaggcauuuau

SEQ ID NO: 247983 - RNA, 22 nt, Homo sapiens
ugacagucaccaggacccacag

SEQ ID NO: 247984 - RNA, 23 nt, Homo sapiens
ugacagucucccgauggcuaggc

SEQ ID NO: 247985 - RNA, 22 nt, Homo sapiens
ugacaguguccucauucccaac

SEQ ID NO: 247986 - RNA, 22 nt, Homo sapiens
ugacaguguccuccuccugaga

SEQ ID NO: 247987 - RNA, 20 nt, Homo sapiens
ugacaucagcaauguaauaa

SEQ ID NO: 247988 - RNA, 22 nt, Homo sapiens
ugacaugagauuugggaggggc

SEQ ID NO: 247989 - RNA, 22 nt, Homo sapiens
ugacauguagagaacuucucau

SEQ ID NO: 247990 - RNA, 22 nt, Homo sapiens
ugacauuacagucacuugcugu

SEQ ID NO: 247991 - RNA, 19 nt, Homo sapiens
ugaccagggacagaaacca

SEQ ID NO: 247992 - RNA, 22 nt, Homo sapiens
ugaccuagaacucuaaugccug

SEQ ID NO: 247993 - RNA, 21 nt, Homo sapiens
ugacuagauuccagauuggcc

SEQ ID NO: 247994 - RNA, 22 nt, Homo sapiens
ugacuagcagagugagaaacuc

SEQ ID NO: 247995 - RNA, 22 nt, Homo sapiens
ugacuaggaaauuagaacuuuu

SEQ ID NO: 247996 - RNA, 22 nt, Homo sapiens
ugacucagauagguguguauuc

SEQ ID NO: 247997 - RNA, 22 nt, Homo sapiens
ugacucgaggcgccuccagucc

SEQ ID NO: 247998 - RNA, 22 nt, Homo sapiens
ugacugguguuuaaugagucaa

SEQ ID NO: 247999 - RNA, 18 nt, Homo sapiens
ugacuguccagguggacc

SEQ ID NO: 248000 - RNA, 23 nt, Homo sapiens
ugacuuaggccucaacuaugacu

SEQ ID NO: 248001 - RNA, 22 nt, Homo sapiens
ugagaacagcagcuugggacac

SEQ ID NO: 248002 - RNA, 19 nt, Homo sapiens
ugagaacaugugguauuug

SEQ ID NO: 248003 - RNA, 22 nt, Homo sapiens
ugagaacauuccucuuccuggc

SEQ ID NO: 248004 - RNA, 22 nt, Homo sapiens
ugagaacuaaaaugugguauau

SEQ ID NO: 248005 - RNA, 22 nt, Homo sapiens
ugagaacugguagcacuuguga

SEQ ID NO: 248006 - RNA, 22 nt, Homo sapiens
ugagaacuuugucuuuuacucu

SEQ ID NO: 248007 - RNA, 22 nt, Homo sapiens
ugagaagugacgcagcaggguu

SEQ ID NO: 248008 - RNA, 19 nt, Homo sapiens
ugagaauguuaccaggucc

SEQ ID NO: 248009 - RNA, 22 nt, Homo sapiens
ugagacaugugaacuguaguuc

SEQ ID NO: 248010 - RNA, 22 nt, Homo sapiens
ugagaccaacagauuccaguuc

SEQ ID NO: 248011 - RNA, 22 nt, Homo sapiens
ugagaccugaucuugguacugc

SEQ ID NO: 248012 - RNA, 22 nt, Homo sapiens
ugagacggagucucgcuguguc

SEQ ID NO: 248013 - RNA, 22 nt, Homo sapiens
ugagacggagucuggcacuguc

SEQ ID NO: 248014 - RNA, 22 nt, Homo sapiens
ugagacugaaauuaggaaacug

SEQ ID NO: 248015 - RNA, 22 nt, Homo sapiens
ugagacugaguuuccaucuugu

SEQ ID NO: 248016 - RNA, 22 nt, Homo sapiens
ugagacugaguuucgcucuugu

SEQ ID NO: 248017 - RNA, 22 nt, Homo sapiens
ugagacugaguuuugcucuugu

SEQ ID NO: 248018 - RNA, 22 nt, Homo sapiens
ugagacugguaauguguagggc

SEQ ID NO: 248019 - RNA, 22 nt, Homo sapiens
ugagagacaguuucgucggagg

SEQ ID NO: 248020 - RNA, 19 nt, Homo sapiens
ugagagcacaacugaacaa

SEQ ID NO: 248021 - RNA, 22 nt, Homo sapiens
ugagaguauaaauugaugcagc

SEQ ID NO: 248022 - RNA, 22 nt, Homo sapiens
ugagagucacugaccugguaua

SEQ ID NO: 248023 - RNA, 22 nt, Homo sapiens
ugagauaaagcauguacugugu

SEQ ID NO: 248024 - RNA, 22 nt, Homo sapiens
ugagauaaggaaauugaggcuc

SEQ ID NO: 248025 - RNA, 22 nt, Homo sapiens
ugagauaaucaugugguuuuug

SEQ ID NO: 248026 - RNA, 18 nt, Homo sapiens
ugagauacuagaauaggu

SEQ ID NO: 248027 - RNA, 22 nt, Homo sapiens
ugagauaggaucuugcucuguu

SEQ ID NO: 248028 - RNA, 22 nt, Homo sapiens
ugagauagggucucacucuguc

SEQ ID NO: 248029 - RNA, 22 nt, Homo sapiens
ugagaucuuggaggcuuuguga

SEQ ID NO: 248030 - RNA, 22 nt, Homo sapiens
ugagaugaacuugauuguuuua

SEQ ID NO: 248031 - RNA, 19 nt, Homo sapiens
ugagaugaagacagggguu

SEQ ID NO: 248032 - RNA, 22 nt, Homo sapiens
ugagaugagaaucaguucuaau

SEQ ID NO: 248033 - RNA, 22 nt, Homo sapiens
ugagaugaggucucgcucuguc

SEQ ID NO: 248034 - RNA, 22 nt, Homo sapiens
ugagaugaguugcgcucugucg

SEQ ID NO: 248035 - RNA, 22 nt, Homo sapiens
ugagaugauaucuuauuguaau

SEQ ID NO: 248036 - RNA, 22 nt, Homo sapiens
ugagaugauuuaauggagccca

SEQ ID NO: 248037 - RNA, 21 nt, Homo sapiens
ugagaugcaaucaccagggag

SEQ ID NO: 248038 - RNA, 22 nt, Homo sapiens
ugagaugcauauucuggcuccu

SEQ ID NO: 248039 - RNA, 22 nt, Homo sapiens
ugagauggaguuucacuuuugu

SEQ ID NO: 248040 - RNA, 22 nt, Homo sapiens
ugagauggaguuucgcccuugu

SEQ ID NO: 248041 - RNA, 21 nt, Homo sapiens
ugagaugugaccagggcauca

SEQ ID NO: 248042 - RNA, 22 nt, Homo sapiens
ugagauguugcucugaaacaag

SEQ ID NO: 248043 - RNA, 22 nt, Homo sapiens
ugagcaagaucuuuauaauuag

SEQ ID NO: 248044 - RNA, 22 nt, Homo sapiens
ugagcagagaucacggcauugu

SEQ ID NO: 248045 - RNA, 20 nt, Homo sapiens
ucccuaagagccuuuccuuc

SEQ ID NO: 248046 - RNA, 22 nt, Homo sapiens
ucccuacuggggcacugccuag

SEQ ID NO: 248047 - RNA, 22 nt, Homo sapiens
ucccuacugggguacugccuag

SEQ ID NO: 248048 - RNA, 19 nt, Homo sapiens
ucccugagucuuagcuuga

SEQ ID NO: 248049 - RNA, 22 nt, Homo sapiens
ucccuggagcaagagaagaagg

SEQ ID NO: 248050 - RNA, 17 nt, Homo sapiens
ucccuguuuuuucaguc

SEQ ID NO: 248051 - RNA, 22 nt, Homo sapiens
ucccuugguaauucuguuccuu

SEQ ID NO: 248052 - RNA, 18 nt, Homo sapiens
ucccuuuguagaugaccc

SEQ ID NO: 248053 - RNA, 22 nt, Homo sapiens
ucccuuuguccaacggauccac

SEQ ID NO: 248054 - RNA, 22 nt, Homo sapiens
uccugcauucugaaauacaagu

SEQ ID NO: 248055 - RNA, 22 nt, Homo sapiens
uccuucacucuacaucuuuguu

SEQ ID NO: 248056 - RNA, 22 nt, Homo sapiens
uccuugagaggacagagccaua

SEQ ID NO: 248057 - RNA, 22 nt, Homo sapiens
uccuugagccucccagacucag

SEQ ID NO: 248058 - RNA, 22 nt, Homo sapiens
uccuugagccugggaguuauag

SEQ ID NO: 248059 - RNA, 22 nt, Homo sapiens
uccuugagccuuaaauuauaaa

SEQ ID NO: 248060 - RNA, 22 nt, Homo sapiens
uccuugagucugaacuuuggau

SEQ ID NO: 248061 - RNA, 22 nt, Homo sapiens
uccuugcacuaacuuaaggagg

SEQ ID NO: 248062 - RNA, 22 nt, Homo sapiens
ucgcugggaaccagagguaaag

SEQ ID NO: 248063 - RNA, 22 nt, Homo sapiens
ucgcugggaagacugaaguguc

SEQ ID NO: 248064 - RNA, 22 nt, Homo sapiens
ucgugcaaacguaauugugguu

SEQ ID NO: 248065 - RNA, 22 nt, Homo sapiens
ucgugcugugucaucuuguggc

SEQ ID NO: 248066 - RNA, 19 nt, Homo sapiens
ucuaaaucucuugauagac

SEQ ID NO: 248067 - RNA, 22 nt, Homo sapiens
ucuaucacagccccacacucuc

SEQ ID NO: 248068 - RNA, 22 nt, Homo sapiens
ucuauugguaggggcugaggca

SEQ ID NO: 248069 - RNA, 22 nt, Homo sapiens
ucuauugguugaaauugcuuuu

SEQ ID NO: 248070 - RNA, 22 nt, Homo sapiens
ucucacauuucacagggauggg

SEQ ID NO: 248071 - RNA, 22 nt, Homo sapiens
ucucagugaauugguuuugucu

SEQ ID NO: 248072 - RNA, 22 nt, Homo sapiens
ucucaugaagguggagaguagg

SEQ ID NO: 248073 - RNA, 22 nt, Homo sapiens
ucucauuggucugagucaccug

SEQ ID NO: 248074 - RNA, 22 nt, Homo sapiens
ucuccauuuguaaggguuucuc

SEQ ID NO: 248075 - RNA, 22 nt, Homo sapiens
ucucccauccguacacggauug

SEQ ID NO: 248076 - RNA, 22 nt, Homo sapiens
ucucugagaaaaguuucuccca

SEQ ID NO: 248077 - RNA, 19 nt, Homo sapiens
ucucugguguuggagggga

SEQ ID NO: 248078 - RNA, 22 nt, Homo sapiens
ucucuuggcggaaguugcagug

SEQ ID NO: 248079 - RNA, 22 nt, Homo sapiens
ucugacagugagagaaaucuga

SEQ ID NO: 248080 - RNA, 22 nt, Homo sapiens
ucugacagugugaauauugacu

SEQ ID NO: 248081 - RNA, 22 nt, Homo sapiens
ucugagaugagacuuugaauuu

SEQ ID NO: 248082 - RNA, 22 nt, Homo sapiens
ucugccuuuucaugugggaugg

SEQ ID NO: 248083 - RNA, 23 nt, Homo sapiens
ucuggaucauucguagugccagc

SEQ ID NO: 248084 - RNA, 22 nt, Homo sapiens
ucuggccuacaaguaauuuuau

SEQ ID NO: 248085 - RNA, 22 nt, Homo sapiens
ucuggccuccuaugagaaucga

SEQ ID NO: 248086 - RNA, 22 nt, Homo sapiens
ucuggcuucugacuuaggggac

SEQ ID NO: 248087 - RNA, 18 nt, Homo sapiens
ucuggcuucuuuguucca

SEQ ID NO: 248088 - RNA, 22 nt, Homo sapiens
ucuggcuugugaacugucuucu

SEQ ID NO: 248089 - RNA, 22 nt, Homo sapiens
ucuggcuuuagcaugugggaag

SEQ ID NO: 248090 - RNA, 22 nt, Homo sapiens
ucuggcuuuuaacaucuauaaa

SEQ ID NO: 248091 - RNA, 22 nt, Homo sapiens
ucugggguuuccacuuuuacuu

SEQ ID NO: 248092 - RNA, 20 nt, Homo sapiens
ucuggguuuuggccacgccc

SEQ ID NO: 248093 - RNA, 22 nt, Homo sapiens
ucuggguuuuuacaauguuuac

SEQ ID NO: 248094 - RNA, 22 nt, Homo sapiens
ucugguuccuuggcuucggguc

SEQ ID NO: 248095 - RNA, 22 nt, Homo sapiens
ucugucacugaaucccugucac

SEQ ID NO: 248096 - RNA, 22 nt, Homo sapiens
ucugucuuugucaggaccagag

SEQ ID NO: 248097 - RNA, 22 nt, Homo sapiens
ucugugaaugaacacuugaaaa

SEQ ID NO: 248098 - RNA, 22 nt, Homo sapiens
ucugugcauggcagaggaauga

SEQ ID NO: 248099 - RNA, 22 nt, Homo sapiens
ucugugcugagaguugaaaguu

SEQ ID NO: 248100 - RNA, 19 nt, Homo sapiens
ucugugcuugucccccugu

SEQ ID NO: 248101 - RNA, 22 nt, Homo sapiens
ucugugguucaaaccagcaacu

SEQ ID NO: 248102 - RNA, 21 nt, Homo sapiens
ucuguguugaucucacuggga

SEQ ID NO: 248103 - RNA, 22 nt, Homo sapiens
ucuguguugaugcucauuaauu

SEQ ID NO: 248104 - RNA, 22 nt, Homo sapiens
ucuguugguucuuugaggagga

SEQ ID NO: 248105 - RNA, 22 nt, Homo sapiens
ucuguuguuguuuuaagagaca

SEQ ID NO: 248106 - RNA, 22 nt, Homo sapiens
ucuucagucauauuggccugga

SEQ ID NO: 248107 - RNA, 17 nt, Homo sapiens
ucuucuguuacuguggc

SEQ ID NO: 248108 - RNA, 20 nt, Homo sapiens
ucuugaacuuagucaacagg

SEQ ID NO: 248109 - RNA, 22 nt, Homo sapiens
ucuugcacaaauuauuuuaacu

SEQ ID NO: 248110 - RNA, 22 nt, Homo sapiens
ucuugcacacaguaaguguuuu

SEQ ID NO: 248111 - RNA, 22 nt, Homo sapiens
ucuugcuuuugcagagcuucuc

SEQ ID NO: 248112 - RNA, 22 nt, Homo sapiens
ucuuggcaaagaauuuuuggcu

SEQ ID NO: 248113 - RNA, 22 nt, Homo sapiens
ucuuuaguaauuucuguaaggc

SEQ ID NO: 248114 - RNA, 19 nt, Homo sapiens
ucuuuagucacauuuuuau

SEQ ID NO: 248115 - RNA, 22 nt, Homo sapiens
ucuuugaguuauugugcagacu

SEQ ID NO: 248116 - RNA, 22 nt, Homo sapiens
ucuuuggagacaaccccagucu

SEQ ID NO: 248117 - RNA, 22 nt, Homo sapiens
gucaguggauacugucucuguc

SEQ ID NO: 248118 - RNA, 22 nt, Homo sapiens
gucagugucuuaacagagauua

SEQ ID NO: 248119 - RNA, 22 nt, Homo sapiens
gucaguuugguuaaucauucca

SEQ ID NO: 248120 - RNA, 22 nt, Homo sapiens
gucaucaucaguccucugugca

SEQ ID NO: 248121 - RNA, 22 nt, Homo sapiens
gucauggaaaucuacauuguua

SEQ ID NO: 248122 - RNA, 22 nt, Homo sapiens
guccaguguuggagguuuuacc

SEQ ID NO: 248123 - RNA, 22 nt, Homo sapiens
gucccugcgauugugggauccu

SEQ ID NO: 248124 - RNA, 22 nt, Homo sapiens
guccuggagaagcguggaccgg

SEQ ID NO: 248125 - RNA, 22 nt, Homo sapiens
guccuguuuuuaagguucauag

SEQ ID NO: 248126 - RNA, 22 nt, Homo sapiens
gucucagugcgaaucucaaaga

SEQ ID NO: 248127 - RNA, 22 nt, Homo sapiens
gucucugagaugucaacaccua

SEQ ID NO: 248128 - RNA, 21 nt, Homo sapiens
gucugguguuuuaaugaggac

SEQ ID NO: 248129 - RNA, 22 nt, Homo sapiens
gucugguuccugggagauuucu

SEQ ID NO: 248130 - RNA, 22 nt, Homo sapiens
gucugguugacagcauguggcc

SEQ ID NO: 248131 - RNA, 22 nt, Homo sapiens
gucugugguuccuaugucaccu

SEQ ID NO: 248132 - RNA, 22 nt, Homo sapiens
gucuugaaggcugaguaccugu

SEQ ID NO: 248133 - RNA, 22 nt, Homo sapiens
gucuuggagaacucagcuuggc

SEQ ID NO: 248134 - RNA, 22 nt, Homo sapiens
gucuuugcauguauguucauga

SEQ ID NO: 248135 - RNA, 22 nt, Homo sapiens
gucuuuggaaaaaaugucuguu

SEQ ID NO: 248136 - RNA, 22 nt, Homo sapiens
gucuuuguuauuaugaaucaac

SEQ ID NO: 248137 - RNA, 22 nt, Homo sapiens
gugaaaugaaacgcuaugucuu

SEQ ID NO: 248138 - RNA, 15 nt, Homo sapiens
gugaaauguuucaga

SEQ ID NO: 248139 - RNA, 22 nt, Homo sapiens
gugaagugugaccucagcaucu

SEQ ID NO: 248140 - RNA, 22 nt, Homo sapiens
gugaaguuuuugugaggccuaa

SEQ ID NO: 248141 - RNA, 22 nt, Homo sapiens
gugacaguggagacuuacuuca

SEQ ID NO: 248142 - RNA, 22 nt, Homo sapiens
gugacauuauuucagcuacaug

SEQ ID NO: 248143 - RNA, 22 nt, Homo sapiens
gugaccucuguugcugucacua

SEQ ID NO: 248144 - RNA, 22 nt, Homo sapiens
gugagaugaggucucacucugu

SEQ ID NO: 248145 - RNA, 22 nt, Homo sapiens
gugagauggaguuggugucuuu

SEQ ID NO: 248146 - RNA, 22 nt, Homo sapiens
gugagaugguaucucauugugg

SEQ ID NO: 248147 - RNA, 22 nt, Homo sapiens
gugagauuaccauuuaaaucag

SEQ ID NO: 248148 - RNA, 22 nt, Homo sapiens
gugagauuaguucuggaccugg

SEQ ID NO: 248149 - RNA, 22 nt, Homo sapiens
gugagauuuucuccagguucag

SEQ ID NO: 248150 - RNA, 22 nt, Homo sapiens
gugagcaguguccuugggggca

SEQ ID NO: 248151 - RNA, 22 nt, Homo sapiens
gugagccaugauuuuaccacug

SEQ ID NO: 248152 - RNA, 22 nt, Homo sapiens
gugagcuaguuucuuugcugug

SEQ ID NO: 248153 - RNA, 22 nt, Homo sapiens
gugaggcacugcugcuuuccag

SEQ ID NO: 248154 - RNA, 22 nt, Homo sapiens
gugaggcugguccugccuccca

SEQ ID NO: 248155 - RNA, 17 nt, Homo sapiens
gugagguauccucaaaa

SEQ ID NO: 248156 - RNA, 17 nt, Homo sapiens
gugagguggguaguauc

SEQ ID NO: 248157 - RNA, 22 nt, Homo sapiens
gugagucaugucccaucugauu

SEQ ID NO: 248158 - RNA, 22 nt, Homo sapiens
gugaucuuucaggcuugaccau

SEQ ID NO: 248159 - RNA, 22 nt, Homo sapiens
gugaugcaguacguagaggaga

SEQ ID NO: 248160 - RNA, 22 nt, Homo sapiens
gugaugguccagggaaucucuu

SEQ ID NO: 248161 - RNA, 22 nt, Homo sapiens
gugcaaguguaauacagcuagg

SEQ ID NO: 248162 - RNA, 22 nt, Homo sapiens
gugcaauucacuguuaugucug

SEQ ID NO: 248163 - RNA, 22 nt, Homo sapiens
gugcacauauggugcauaagug

SEQ ID NO: 248164 - RNA, 22 nt, Homo sapiens
gugcacaucgugcagguuuguu

SEQ ID NO: 248165 - RNA, 22 nt, Homo sapiens
gugcacaugcgugcgcacauau

SEQ ID NO: 248166 - RNA, 22 nt, Homo sapiens
gugcacaugguagguauugagu

SEQ ID NO: 248167 - RNA, 22 nt, Homo sapiens
gugcacuguagaacccuuuguu

SEQ ID NO: 248168 - RNA, 22 nt, Homo sapiens
gugcagaugucuuuauaguagc

SEQ ID NO: 248169 - RNA, 22 nt, Homo sapiens
gugcaguuuacaguuacccagu

SEQ ID NO: 248170 - RNA, 22 nt, Homo sapiens
gugcccacugucuguccuguag

SEQ ID NO: 248171 - RNA, 22 nt, Homo sapiens
gugcuaggugcuaggaagauag

SEQ ID NO: 248172 - RNA, 22 nt, Homo sapiens
guggaaaauuauugcuguuuuu

SEQ ID NO: 248173 - RNA, 20 nt, Homo sapiens
guggaagauaaguagccuga

SEQ ID NO: 248174 - RNA, 22 nt, Homo sapiens
guggaagauaguguguuaaugu

SEQ ID NO: 248175 - RNA, 22 nt, Homo sapiens
guggaagcacaggccuccugga

SEQ ID NO: 248176 - RNA, 22 nt, Homo sapiens
guggaaguguaaaagcucuugg

SEQ ID NO: 248177 - RNA, 22 nt, Homo sapiens
guggaaguuaagugacuuucug

SEQ ID NO: 248178 - RNA, 22 nt, Homo sapiens
guggaaugauaucucauugugg

SEQ ID NO: 248179 - RNA, 17 nt, Homo sapiens
guggauagaacaaugaa

SEQ ID NO: 248180 - RNA, 22 nt, Homo sapiens
guggcaaagaugccuucuccaa

SEQ ID NO: 248181 - RNA, 22 nt, Homo sapiens
guggcacaauuaaguagcuauu

SEQ ID NO: 248182 - RNA, 22 nt, Homo sapiens
guggcuuuaaguacgauugagg

SEQ ID NO: 248183 - RNA, 22 nt, Homo sapiens
gugggguaggaggaguacuucc

SEQ ID NO: 248184 - RNA, 22 nt, Homo sapiens
gugggguaggcaauuccuagug

SEQ ID NO: 248185 - RNA, 22 nt, Homo sapiens
gugggguaggguaggacucaac

SEQ ID NO: 248186 - RNA, 22 nt, Homo sapiens
gugguaaaauggcauagagcua

SEQ ID NO: 248187 - RNA, 19 nt, Homo sapiens
caccagugcaugcuacuau

SEQ ID NO: 248188 - RNA, 22 nt, Homo sapiens
cacccgugcucccuccagcugc

SEQ ID NO: 248189 - RNA, 22 nt, Homo sapiens
cacuaggcuggagugcaguggc

SEQ ID NO: 248190 - RNA, 22 nt, Homo sapiens
cacugcacuccagcuugugggc

SEQ ID NO: 248191 - RNA, 22 nt, Homo sapiens
cacugcacuccagcuuugguga

SEQ ID NO: 248192 - RNA, 22 nt, Homo sapiens
cacugcacuccaguuucgguaa

SEQ ID NO: 248193 - RNA, 21 nt, Homo sapiens
cacugcaucacaggacagcau

SEQ ID NO: 248194 - RNA, 22 nt, Homo sapiens
cacugcauuacucaugagcaug

SEQ ID NO: 248195 - RNA, 22 nt, Homo sapiens
cacugggccaucacuuaauauu

SEQ ID NO: 248196 - RNA, 22 nt, Homo sapiens
cacugggugagauccauguuua

SEQ ID NO: 248197 - RNA, 21 nt, Homo sapiens
cacuggguucaggcuugugga

SEQ ID NO: 248198 - RNA, 22 nt, Homo sapiens
cagaaguauugguaugcucugu

SEQ ID NO: 248199 - RNA, 22 nt, Homo sapiens
cagacagugucccgagucccug

SEQ ID NO: 248200 - RNA, 21 nt, Homo sapiens
cagagaucaucucuguuuuaa

SEQ ID NO: 248201 - RNA, 22 nt, Homo sapiens
cagagaucaugcaacugcucgc

SEQ ID NO: 248202 - RNA, 22 nt, Homo sapiens
cagagcacuaaagguaaaaggc

SEQ ID NO: 248203 - RNA, 22 nt, Homo sapiens
cagaucaucuugagcuuaggaa

SEQ ID NO: 248204 - RNA, 22 nt, Homo sapiens
cagaugcaugaccugggcuugg

SEQ ID NO: 248205 - RNA, 22 nt, Homo sapiens
cagaugguggucccacagccca

SEQ ID NO: 248206 - RNA, 22 nt, Homo sapiens
cagcacauuacaaguacuuggu

SEQ ID NO: 248207 - RNA, 22 nt, Homo sapiens
cagcaguuguuucggauuggga

SEQ ID NO: 248208 - RNA, 22 nt, Homo sapiens
cagcccguaaucccagcacuuu

SEQ ID NO: 248209 - RNA, 22 nt, Homo sapiens
cagcgaggucugcgucacauug

SEQ ID NO: 248210 - RNA, 20 nt, Homo sapiens
cagcuagugguaggagucgg

SEQ ID NO: 248211 - RNA, 22 nt, Homo sapiens
cagcugaugucgaaugcacucu

SEQ ID NO: 248212 - RNA, 22 nt, Homo sapiens
cagcuggugcugcaccaguggg

SEQ ID NO: 248213 - RNA, 22 nt, Homo sapiens
caggcagugggagacaaaacug

SEQ ID NO: 248214 - RNA, 22 nt, Homo sapiens
caggcauuguccaugcugaagg

SEQ ID NO: 248215 - RNA, 22 nt, Homo sapiens
caggcuuuuccacacauggguu

SEQ ID NO: 248216 - RNA, 22 nt, Homo sapiens
cagguaguauuugguuacauaa

SEQ ID NO: 248217 - RNA, 19 nt, Homo sapiens
cagguagugugcugacaug

SEQ ID NO: 248218 - RNA, 22 nt, Homo sapiens
caguacaauguggaaaaggagu

SEQ ID NO: 248219 - RNA, 22 nt, Homo sapiens
cagugcaaccuccaucucucgg

SEQ ID NO: 248220 - RNA, 22 nt, Homo sapiens
cagugcauaggaucuaaaauuu

SEQ ID NO: 248221 - RNA, 22 nt, Homo sapiens
caguggaugauguuuucugugg

SEQ ID NO: 248222 - RNA, 22 nt, Homo sapiens
cagugguuuucaacccugguug

SEQ ID NO: 248223 - RNA, 22 nt, Homo sapiens
cagugucugcauuuggaacuca

SEQ ID NO: 248224 - RNA, 22 nt, Homo sapiens
caguguuuuuaacaggugcccg

SEQ ID NO: 248225 - RNA, 22 nt, Homo sapiens
caguuguuuuaugacauaagau

SEQ ID NO: 248226 - RNA, 21 nt, Homo sapiens
cauaaugcuacuuauuuuaug

SEQ ID NO: 248227 - RNA, 22 nt, Homo sapiens
cauacagcuaguaaguguaaga

SEQ ID NO: 248228 - RNA, 22 nt, Homo sapiens
cauagcacugagcucuacccuc

SEQ ID NO: 248229 - RNA, 22 nt, Homo sapiens
cauaguacuugcauaguacuau

SEQ ID NO: 248230 - RNA, 22 nt, Homo sapiens
caucaaaguggagggaaggacc

SEQ ID NO: 248231 - RNA, 22 nt, Homo sapiens
caucacuuugccuccgucucua

SEQ ID NO: 248232 - RNA, 22 nt, Homo sapiens
caucagcaauguaugaggguuc

SEQ ID NO: 248233 - RNA, 22 nt, Homo sapiens
caucccauucgaggggcacagc

SEQ ID NO: 248234 - RNA, 21 nt, Homo sapiens
cauccccugccauuguggucu

SEQ ID NO: 248235 - RNA, 22 nt, Homo sapiens
caucgcacuccagccugggcaa

SEQ ID NO: 248236 - RNA, 22 nt, Homo sapiens
caugaugcuagguauggaugaa

SEQ ID NO: 248237 - RNA, 22 nt, Homo sapiens
caugccacuguggacaaagaca

SEQ ID NO: 248238 - RNA, 22 nt, Homo sapiens
cauggagcuaggcuugaucccu

SEQ ID NO: 248239 - RNA, 22 nt, Homo sapiens
cauggcacugagcagguaugca

SEQ ID NO: 248240 - RNA, 22 nt, Homo sapiens
cauggcacuggugggagugucu

SEQ ID NO: 248241 - RNA, 22 nt, Homo sapiens
cauggcacuguaugaaaugugc

SEQ ID NO: 248242 - RNA, 23 nt, Homo sapiens
cauggcuguuaacacuguuugag

SEQ ID NO: 248243 - RNA, 22 nt, Homo sapiens
cauggcuuuauuuucagcuucu

SEQ ID NO: 248244 - RNA, 22 nt, Homo sapiens
caugguguuaggcacugggaau

SEQ ID NO: 248245 - RNA, 22 nt, Homo sapiens
cauuaagcuacuuagaaggugc

SEQ ID NO: 248246 - RNA, 20 nt, Homo sapiens
cauuccacuuuccugucagu

SEQ ID NO: 248247 - RNA, 19 nt, Homo sapiens
cauugcacuccacccuggg

SEQ ID NO: 248248 - RNA, 22 nt, Homo sapiens
cauugcacuccagccugaggga

SEQ ID NO: 248249 - RNA, 22 nt, Homo sapiens
cauugcacuccagccugcacga

SEQ ID NO: 248250 - RNA, 22 nt, Homo sapiens
cauugcacuccagccugccugg

SEQ ID NO: 248251 - RNA, 22 nt, Homo sapiens
cauugcacuccagccuggccaa

SEQ ID NO: 248252 - RNA, 22 nt, Homo sapiens
cauugcacuccagccuuggcaa

SEQ ID NO: 248253 - RNA, 22 nt, Homo sapiens
cauugcacuccagcuugggcaa

SEQ ID NO: 248254 - RNA, 22 nt, Homo sapiens
cauugguuccaguuuguccuua

SEQ ID NO: 248255 - RNA, 22 nt, Homo sapiens
cauugguuuauagauggggaaa

SEQ ID NO: 248256 - RNA, 22 nt, Homo sapiens
cauugguuuuucaggaguauau

SEQ ID NO: 248257 - RNA, 22 nt, Homo sapiens
cauuugguggcuacagaguaac

SEQ ID NO: 248258 - RNA, 22 nt, Homo sapiens
cauuuuacuuuccagacgugga

SEQ ID NO: 248259 - RNA, 22 nt, Homo sapiens
ccaagccucaguuucccucugu

SEQ ID NO: 248260 - RNA, 22 nt, Homo sapiens
ccaaguguuuucauuguuccau

SEQ ID NO: 248261 - RNA, 22 nt, Homo sapiens
ccacaguagucuugggaugggc

SEQ ID NO: 248262 - RNA, 22 nt, Homo sapiens
ccacccuuccauucuuccucuu

SEQ ID NO: 248263 - RNA, 22 nt, Homo sapiens
ccagcaccauuuauuaaauagg

SEQ ID NO: 248264 - RNA, 22 nt, Homo sapiens
ccagccgggugcaguggcucac

SEQ ID NO: 248265 - RNA, 22 nt, Homo sapiens
ccagugguucccuguggccuga

SEQ ID NO: 248266 - RNA, 21 nt, Homo sapiens
ccaguguaaugauagcaggca

SEQ ID NO: 248267 - RNA, 22 nt, Homo sapiens
ccaguuuuucauuuauacuagu

SEQ ID NO: 248268 - RNA, 22 nt, Homo sapiens
ccaucacacugugauuauuauc

SEQ ID NO: 248269 - RNA, 22 nt, Homo sapiens
ccauugcacuccagccuaggca

SEQ ID NO: 248270 - RNA, 22 nt, Homo sapiens
ccauugcacuucagccuaggug

SEQ ID NO: 248271 - RNA, 22 nt, Homo sapiens
cccagaguucuuaaauacugag

SEQ ID NO: 248272 - RNA, 22 nt, Homo sapiens
ccccaguguguaaaggccuugc

SEQ ID NO: 248273 - RNA, 22 nt, Homo sapiens
ccccggguggauguacauguga

SEQ ID NO: 248274 - RNA, 22 nt, Homo sapiens
cccugaagauacagaguuuggg

SEQ ID NO: 248275 - RNA, 22 nt, Homo sapiens
cccugagagcagggucuuucuc

SEQ ID NO: 248276 - RNA, 22 nt, Homo sapiens
cccuugcacuucagagcugcau

SEQ ID NO: 248277 - RNA, 19 nt, Homo sapiens
ccucaaguacuaauauguu

SEQ ID NO: 248278 - RNA, 22 nt, Homo sapiens
ccucauggagaacaucugcuag

SEQ ID NO: 248279 - RNA, 22 nt, Homo sapiens
ccucuuuguugagacuucacca

SEQ ID NO: 248280 - RNA, 21 nt, Homo sapiens
ccugaagaagugaccucugag

SEQ ID NO: 248281 - RNA, 22 nt, Homo sapiens
ccugagacugauugacucacaa

SEQ ID NO: 248282 - RNA, 19 nt, Homo sapiens
ccugcuguucuuuugcacc

SEQ ID NO: 248283 - RNA, 22 nt, Homo sapiens
ccuggaagaaaggugcuaaaua

SEQ ID NO: 248284 - RNA, 22 nt, Homo sapiens
ccuguagcauccaagaagcugc

SEQ ID NO: 248285 - RNA, 22 nt, Homo sapiens
ccuucauccuccagcaggcuag

SEQ ID NO: 248286 - RNA, 22 nt, Homo sapiens
ccuucauugcaucuuuaagaga

SEQ ID NO: 248287 - RNA, 22 nt, Homo sapiens
ccuucuuuuguaaggcugaaua

SEQ ID NO: 248288 - RNA, 19 nt, Homo sapiens
ccuuugguuuccaugacau

SEQ ID NO: 248289 - RNA, 22 nt, Homo sapiens
ugcagauucguuuugaggggua

SEQ ID NO: 248290 - RNA, 19 nt, Homo sapiens
ugcagcaauguaaaagaca

SEQ ID NO: 248291 - RNA, 22 nt, Homo sapiens
ugcagcacuguucacaauagcc

SEQ ID NO: 248292 - RNA, 18 nt, Homo sapiens
ugcagcaucaguacccag

SEQ ID NO: 248293 - RNA, 22 nt, Homo sapiens
ugcagcauugcacuccagccug

SEQ ID NO: 248294 - RNA, 22 nt, Homo sapiens
ugcagguacuugacaacuuggg

SEQ ID NO: 248295 - RNA, 22 nt, Homo sapiens
ugcaguacuuugaaauauacug

SEQ ID NO: 248296 - RNA, 23 nt, Homo sapiens
ugcaguagugagaucuaggcuca

SEQ ID NO: 248297 - RNA, 22 nt, Homo sapiens
ugcagugucaauaauaauuagu

SEQ ID NO: 248298 - RNA, 21 nt, Homo sapiens
ugcagugugguugcccugcug

SEQ ID NO: 248299 - RNA, 22 nt, Homo sapiens
ugcaguguucuuuagaggaaau

SEQ ID NO: 248300 - RNA, 22 nt, Homo sapiens
ugcauaggagcagggucuaugu

SEQ ID NO: 248301 - RNA, 21 nt, Homo sapiens
ugcauaucucuaaugaccagu

SEQ ID NO: 248302 - RNA, 22 nt, Homo sapiens
ugcauauguucaaaguauucug

SEQ ID NO: 248303 - RNA, 18 nt, Homo sapiens
ugcauauguugaaccagc

SEQ ID NO: 248304 - RNA, 22 nt, Homo sapiens
ugcaucacaguacuccagccug

SEQ ID NO: 248305 - RNA, 22 nt, Homo sapiens
ugcauggagauauacaguuuuu

SEQ ID NO: 248306 - RNA, 22 nt, Homo sapiens
ugcauuguaggauguuuagcag

SEQ ID NO: 248307 - RNA, 22 nt, Homo sapiens
ugccaagaacauuuucuguuuu

SEQ ID NO: 248308 - RNA, 20 nt, Homo sapiens
ugccaagaugacuauagcuc

SEQ ID NO: 248309 - RNA, 22 nt, Homo sapiens
ugccagaugcaguguucaacaa

SEQ ID NO: 248310 - RNA, 22 nt, Homo sapiens
ugccagaugcuggugugagggg

SEQ ID NO: 248311 - RNA, 22 nt, Homo sapiens
ugccauugcacuccagccuggg

SEQ ID NO: 248312 - RNA, 22 nt, Homo sapiens
ugccuacugaauuuaccuggcu

SEQ ID NO: 248313 - RNA, 22 nt, Homo sapiens
ugccuaggcuggaaugcaaugg

SEQ ID NO: 248314 - RNA, 22 nt, Homo sapiens
ugccuaggcuggaaugcagugg

SEQ ID NO: 248315 - RNA, 22 nt, Homo sapiens
ugccuaguagaaggugaacaug

SEQ ID NO: 248316 - RNA, 22 nt, Homo sapiens
ugccuaguggccuuaugaguau

SEQ ID NO: 248317 - RNA, 22 nt, Homo sapiens
ugccugagccagguuuuaggag

SEQ ID NO: 248318 - RNA, 22 nt, Homo sapiens
ugccuucuguuaaacgaggaug

SEQ ID NO: 248319 - RNA, 22 nt, Homo sapiens
ugcuagaagaucacacacauca

SEQ ID NO: 248320 - RNA, 22 nt, Homo sapiens
ugcuaucauugauuagugaugu

SEQ ID NO: 248321 - RNA, 22 nt, Homo sapiens
ugcuaugucuucucucacagag

SEQ ID NO: 248322 - RNA, 22 nt, Homo sapiens
ugcugcaaacaggcaucugugg

SEQ ID NO: 248323 - RNA, 20 nt, Homo sapiens
ugcugcacuuaagcaugggc

SEQ ID NO: 248324 - RNA, 22 nt, Homo sapiens
ugcugcacuuauggcucugagg

SEQ ID NO: 248325 - RNA, 22 nt, Homo sapiens
ugcugcuguuaucauuuuacca

SEQ ID NO: 248326 - RNA, 22 nt, Homo sapiens
ugcugcuguuguuguuacuagc

SEQ ID NO: 248327 - RNA, 22 nt, Homo sapiens
ugcugguguggucuagccgcuu

SEQ ID NO: 248328 - RNA, 22 nt, Homo sapiens
ugcugguuuucaucaucagugg

SEQ ID NO: 248329 - RNA, 21 nt, Homo sapiens
ugcuuuggucauacuucuucc

SEQ ID NO: 248330 - RNA, 22 nt, Homo sapiens
uggaaacuuauguucuucugug

SEQ ID NO: 248331 - RNA, 22 nt, Homo sapiens
uggaaaguacugagguccaccu

SEQ ID NO: 248332 - RNA, 19 nt, Homo sapiens
uggaacugauucaguucug

SEQ ID NO: 248333 - RNA, 20 nt, Homo sapiens
uggaacuuaauugauggaca

SEQ ID NO: 248334 - RNA, 22 nt, Homo sapiens
uggaagcaugcaaucugugggg

SEQ ID NO: 248335 - RNA, 22 nt, Homo sapiens
uggaagucaugcugcaagaaca

SEQ ID NO: 248336 - RNA, 22 nt, Homo sapiens
uggaagugaacaaccaaggcag

SEQ ID NO: 248337 - RNA, 22 nt, Homo sapiens
uggaaguuaaauuaguugauga

SEQ ID NO: 248338 - RNA, 22 nt, Homo sapiens
uggaaucaucaacgaaugaaau

SEQ ID NO: 248339 - RNA, 19 nt, Homo sapiens
uggaaugaaauguuagggg

SEQ ID NO: 248340 - RNA, 19 nt, Homo sapiens
uggaauggauuuaaaugug

SEQ ID NO: 248341 - RNA, 22 nt, Homo sapiens
uggaaugguaucuuguuggggu

SEQ ID NO: 248342 - RNA, 22 nt, Homo sapiens
uggaauguaacuugaaacuuuu

SEQ ID NO: 248343 - RNA, 22 nt, Homo sapiens
uggaaugucagcuacaagaggg

SEQ ID NO: 248344 - RNA, 22 nt, Homo sapiens
uggaauuaauuaaaauauacug

SEQ ID NO: 248345 - RNA, 22 nt, Homo sapiens
uggacaagugcccuccaccuca

SEQ ID NO: 248346 - RNA, 21 nt, Homo sapiens
uggaccccuuccuuacaucau

SEQ ID NO: 248347 - RNA, 22 nt, Homo sapiens
uggaccccuucuccuauuaaaa

SEQ ID NO: 248348 - RNA, 22 nt, Homo sapiens
uggacuguaauuuuauaggcau

SEQ ID NO: 248349 - RNA, 22 nt, Homo sapiens
uggagaacauucauuugcaaga

SEQ ID NO: 248350 - RNA, 22 nt, Homo sapiens
uggagguagacauugggaagag

SEQ ID NO: 248351 - RNA, 22 nt, Homo sapiens
uggaggucauuggaucaugggg

SEQ ID NO: 248352 - RNA, 16 nt, Homo sapiens
uggagucauccuugac

SEQ ID NO: 248353 - RNA, 22 nt, Homo sapiens
uggagugcaauggcaccaucuu

SEQ ID NO: 248354 - RNA, 22 nt, Homo sapiens
uggagugcaauggugagaucuu

SEQ ID NO: 248355 - RNA, 22 nt, Homo sapiens
uggagugcgugucugaguuuuu

SEQ ID NO: 248356 - RNA, 20 nt, Homo sapiens
uggagugcuguguugagaag

SEQ ID NO: 248357 - RNA, 22 nt, Homo sapiens
uggaguguaauuagccaucagu

SEQ ID NO: 248358 - RNA, 22 nt, Homo sapiens
uggaguguagaagccagccucc

SEQ ID NO: 248359 - RNA, 22 nt, Homo sapiens
uggauagaaauguacuguuuuc

SEQ ID NO: 248360 - RNA, 18 nt, Homo sapiens
uggauuggaaaaguuccu

SEQ ID NO: 248361 - RNA, 22 nt, Homo sapiens
uggcaaagugugacgugggggu

SEQ ID NO: 248362 - RNA, 21 nt, Homo sapiens
uggcaacgaggugugcauuau

SEQ ID NO: 248363 - RNA, 22 nt, Homo sapiens
uggcaagaacaacaauuacuuu

SEQ ID NO: 248364 - RNA, 22 nt, Homo sapiens
uggcaagaacugcaauugcuuu

SEQ ID NO: 248365 - RNA, 23 nt, Homo sapiens
uggcaagaauucuuaccgugugg

SEQ ID NO: 248366 - RNA, 22 nt, Homo sapiens
uggcaagaccccaucucuacaa

SEQ ID NO: 248367 - RNA, 22 nt, Homo sapiens
uggcaagagcugcauucaucug

SEQ ID NO: 248368 - RNA, 22 nt, Homo sapiens
uggcaagugggaccuaguuaaa

SEQ ID NO: 248369 - RNA, 22 nt, Homo sapiens
uggcaauaaaaugcaguuacuu

SEQ ID NO: 248370 - RNA, 18 nt, Homo sapiens
uggcaauaugguucuacc

SEQ ID NO: 248371 - RNA, 20 nt, Homo sapiens
uggcaccugacagauagcca

SEQ ID NO: 248372 - RNA, 22 nt, Homo sapiens
uggcacuggagauacauuaaua

SEQ ID NO: 248373 - RNA, 22 nt, Homo sapiens
uggcagauagaaaugugguuaa

SEQ ID NO: 248374 - RNA, 22 nt, Homo sapiens
uggcagcugcuucaugggaugc

SEQ ID NO: 248375 - RNA, 22 nt, Homo sapiens
uggcaguuuuugccuucaauac

SEQ ID NO: 248376 - RNA, 22 nt, Homo sapiens
uggcauggaaagcuuuucauac

SEQ ID NO: 248377 - RNA, 22 nt, Homo sapiens
uggccaguguuuuuccugggcu

SEQ ID NO: 248378 - RNA, 22 nt, Homo sapiens
uggcuccguuguacaggcugga

SEQ ID NO: 248379 - RNA, 22 nt, Homo sapiens
uggcuuucuggggcuucuguuc

SEQ ID NO: 248380 - RNA, 22 nt, Homo sapiens
uggcuuuuaucuacucucaacu

SEQ ID NO: 248381 - RNA, 22 nt, Homo sapiens
uggcuuuuauuauguugaggua

SEQ ID NO: 248382 - RNA, 20 nt, Homo sapiens
ugggaacaugugguauaugg

SEQ ID NO: 248383 - RNA, 22 nt, Homo sapiens
ugggaacugaggugaaaagaca

SEQ ID NO: 248384 - RNA, 22 nt, Homo sapiens
ugggaagagggagcgauuuugg

SEQ ID NO: 248385 - RNA, 22 nt, Homo sapiens
ugggaagcugcugaacuacagu

SEQ ID NO: 248386 - RNA, 22 nt, Homo sapiens
ugggaccccuacucuuuccaca

SEQ ID NO: 248387 - RNA, 22 nt, Homo sapiens
ugggaucagcugggcucucugu

SEQ ID NO: 248388 - RNA, 22 nt, Homo sapiens
ugggaucgucaagugaggcucg

SEQ ID NO: 248389 - RNA, 22 nt, Homo sapiens
ugggauguagccuucuauuuuc

SEQ ID NO: 248390 - RNA, 22 nt, Homo sapiens
uggggugugagggagaaagaaa

SEQ ID NO: 248391 - RNA, 22 nt, Homo sapiens
cacaggccugucucuuucuaac

SEQ ID NO: 248392 - RNA, 22 nt, Homo sapiens
cacagggcuaacauuuuugccc

SEQ ID NO: 248393 - RNA, 22 nt, Homo sapiens
cacagugaaugucaucauugcc

SEQ ID NO: 248394 - RNA, 22 nt, Homo sapiens
cacauguuuuagcauggcuguu

SEQ ID NO: 248395 - RNA, 22 nt, Homo sapiens
cacauugaauuucugaugacaa

SEQ ID NO: 248396 - RNA, 22 nt, Homo sapiens
caccacagccauuauugucccc

SEQ ID NO: 248397 - RNA, 22 nt, Homo sapiens
caccagguuggagugcaguggu

SEQ ID NO: 248398 - RNA, 22 nt, Homo sapiens
caccauguguucagaaggauug

SEQ ID NO: 248399 - RNA, 22 nt, Homo sapiens
caccuguagucccagcugaggc

SEQ ID NO: 248400 - RNA, 22 nt, Homo sapiens
cacgugcuuucuuuucauuuag

SEQ ID NO: 248401 - RNA, 22 nt, Homo sapiens
cacuaccucuacaggcagcugg

SEQ ID NO: 248402 - RNA, 22 nt, Homo sapiens
cacugcacucuucuucugggca

SEQ ID NO: 248403 - RNA, 22 nt, Homo sapiens
cacugcaguaaauugcgucggu

SEQ ID NO: 248404 - RNA, 22 nt, Homo sapiens
cacugcauccuccauauccugg

SEQ ID NO: 248405 - RNA, 22 nt, Homo sapiens
cacugcauggucuagcuggguu

SEQ ID NO: 248406 - RNA, 22 nt, Homo sapiens
cacugcgaccuccaccucccgg

SEQ ID NO: 248407 - RNA, 22 nt, Homo sapiens
cacugcgacguccgccucccgg

SEQ ID NO: 248408 - RNA, 22 nt, Homo sapiens
cagagaacugaguuauuuucuu

SEQ ID NO: 248409 - RNA, 22 nt, Homo sapiens
cagagagcuugcccuuguauau

SEQ ID NO: 248410 - RNA, 22 nt, Homo sapiens
cagagguaagcaagucagcauu

SEQ ID NO: 248411 - RNA, 22 nt, Homo sapiens
cagagugcauguuuagaugagu

SEQ ID NO: 248412 - RNA, 22 nt, Homo sapiens
cagauacuggccuggagcugug

SEQ ID NO: 248413 - RNA, 22 nt, Homo sapiens
cagauaguuguagauaugcagc

SEQ ID NO: 248414 - RNA, 22 nt, Homo sapiens
cagauggucuuaaggcagccuu

SEQ ID NO: 248415 - RNA, 22 nt, Homo sapiens
cagcaaaucauccuauuugagc

SEQ ID NO: 248416 - RNA, 22 nt, Homo sapiens
cagcaagucucuaagaguucau

SEQ ID NO: 248417 - RNA, 22 nt, Homo sapiens
cagcacauagcaguugcucagu

SEQ ID NO: 248418 - RNA, 22 nt, Homo sapiens
cagcagguuuuuaucaguuaag

SEQ ID NO: 248419 - RNA, 22 nt, Homo sapiens
cagcaucauucaucugggguaa

SEQ ID NO: 248420 - RNA, 22 nt, Homo sapiens
cagcugcuuuggaaaauauuuu

SEQ ID NO: 248421 - RNA, 22 nt, Homo sapiens
cagcugguggcaagaagacaga

SEQ ID NO: 248422 - RNA, 22 nt, Homo sapiens
cagcuguuguuccagucuuuua

SEQ ID NO: 248423 - RNA, 22 nt, Homo sapiens
caggaccucuugccuggaagcc

SEQ ID NO: 248424 - RNA, 22 nt, Homo sapiens
caggcaaggugaaguguacugg

SEQ ID NO: 248425 - RNA, 22 nt, Homo sapiens
cagguaggccaauguuuuccaa

SEQ ID NO: 248426 - RNA, 22 nt, Homo sapiens
caggugcauuggcugacaccug

SEQ ID NO: 248427 - RNA, 22 nt, Homo sapiens
cagugcaaagccucugcccaga

SEQ ID NO: 248428 - RNA, 22 nt, Homo sapiens
cagugcauagaugugccacauu

SEQ ID NO: 248429 - RNA, 22 nt, Homo sapiens
cagugcauguggcacucuccag

SEQ ID NO: 248430 - RNA, 22 nt, Homo sapiens
caguggacuaaauggggaauau

SEQ ID NO: 248431 - RNA, 22 nt, Homo sapiens
cauauucacuuuacagagcugu

SEQ ID NO: 248432 - RNA, 22 nt, Homo sapiens
caucagagugagauauaagauc

SEQ ID NO: 248433 - RNA, 22 nt, Homo sapiens
caucagauugagaucaucuaag

SEQ ID NO: 248434 - RNA, 22 nt, Homo sapiens
caucauugcacccuauagagaa

SEQ ID NO: 248435 - RNA, 22 nt, Homo sapiens
caucccugaaccccagaaaucu

SEQ ID NO: 248436 - RNA, 22 nt, Homo sapiens
caugaaagacugaggaauugga

SEQ ID NO: 248437 - RNA, 22 nt, Homo sapiens
caugacacuggcauguuucuuu

SEQ ID NO: 248438 - RNA, 22 nt, Homo sapiens
caugccacugcacgccauccug

SEQ ID NO: 248439 - RNA, 22 nt, Homo sapiens
cauggcuacugcagauguaggg

SEQ ID NO: 248440 - RNA, 22 nt, Homo sapiens
cauggcucuuguuuacucccag

SEQ ID NO: 248441 - RNA, 22 nt, Homo sapiens
caugggacugucuuggcuauac

SEQ ID NO: 248442 - RNA, 22 nt, Homo sapiens
caugguacugccacagaagagu

SEQ ID NO: 248443 - RNA, 22 nt, Homo sapiens
cauguauagauuccauaguggu

SEQ ID NO: 248444 - RNA, 22 nt, Homo sapiens
caugugcaugcuuucuuaugug

SEQ ID NO: 248445 - RNA, 22 nt, Homo sapiens
cauuccacauguaggacaauuu

SEQ ID NO: 248446 - RNA, 22 nt, Homo sapiens
cauuccacuggauaaacaaggu

SEQ ID NO: 248447 - RNA, 22 nt, Homo sapiens
cauugcaacuucugccucccag

SEQ ID NO: 248448 - RNA, 22 nt, Homo sapiens
cauugcacacauuuaccuaugu

SEQ ID NO: 248449 - RNA, 22 nt, Homo sapiens
cauugcacuccagcccuggcaa

SEQ ID NO: 248450 - RNA, 22 nt, Homo sapiens
cauugcacuccagccuaggcaa

SEQ ID NO: 248451 - RNA, 22 nt, Homo sapiens
cauugcacuccagccucggcaa

SEQ ID NO: 248452 - RNA, 22 nt, Homo sapiens
cauugcacuccagccugaguga

SEQ ID NO: 248453 - RNA, 20 nt, Homo sapiens
cauugcacuccagccugcug

SEQ ID NO: 248454 - RNA, 22 nt, Homo sapiens
cauugcacuccagccuugguga

SEQ ID NO: 248455 - RNA, 22 nt, Homo sapiens
cauugcacuccagcucugggcg

SEQ ID NO: 248456 - RNA, 22 nt, Homo sapiens
ucccuugagccuggcuucucac

SEQ ID NO: 248457 - RNA, 22 nt, Homo sapiens
uccgaguguuagagagcugugu

SEQ ID NO: 248458 - RNA, 22 nt, Homo sapiens
uccuacaugcaguacauucaaa

SEQ ID NO: 248459 - RNA, 22 nt, Homo sapiens
uccucugaacuccagacccaua

SEQ ID NO: 248460 - RNA, 22 nt, Homo sapiens
uccugcauucugacuugcuuuc

SEQ ID NO: 248461 - RNA, 22 nt, Homo sapiens
uccuggcuccacuguuuauucc

SEQ ID NO: 248462 - RNA, 22 nt, Homo sapiens
uccuguaaucccagcuaccaga

SEQ ID NO: 248463 - RNA, 22 nt, Homo sapiens
uccuugagucuuugcucagaug

SEQ ID NO: 248464 - RNA, 22 nt, Homo sapiens
uccuuggucauggaagagacag

SEQ ID NO: 248465 - RNA, 22 nt, Homo sapiens
uccuugguugauccugugcaga

SEQ ID NO: 248466 - RNA, 23 nt, Homo sapiens
uccuugguuggcgcccuaugugu

SEQ ID NO: 248467 - RNA, 22 nt, Homo sapiens
uccuuuggcuaacuuucuaagu

SEQ ID NO: 248468 - RNA, 22 nt, Homo sapiens
uccuuugguucuugucacccca

SEQ ID NO: 248469 - RNA, 22 nt, Homo sapiens
uccuuuguuacaguuggcucug

SEQ ID NO: 248470 - RNA, 22 nt, Homo sapiens
ucgcaccauugcacuccagcca

SEQ ID NO: 248471 - RNA, 22 nt, Homo sapiens
ucgcagcacgagcaugcaaggu

SEQ ID NO: 248472 - RNA, 23 nt, Homo sapiens
ucgcagcauucaauaccaggcag

SEQ ID NO: 248473 - RNA, 19 nt, Homo sapiens
ucgcgccauucuccugccu

SEQ ID NO: 248474 - RNA, 23 nt, Homo sapiens
ucgguccccuuggcugcccucgg

SEQ ID NO: 248475 - RNA, 22 nt, Homo sapiens
ucuacagccaguucaggaagaa

SEQ ID NO: 248476 - RNA, 22 nt, Homo sapiens
ucucaauggguuguagacaaag

SEQ ID NO: 248477 - RNA, 22 nt, Homo sapiens
ucucagagccuaggguuuuuca

SEQ ID NO: 248478 - RNA, 22 nt, Homo sapiens
ucucagugaaauaaauuauuuu

SEQ ID NO: 248479 - RNA, 22 nt, Homo sapiens
ucucaguggcacccccaacacc

SEQ ID NO: 248480 - RNA, 22 nt, Homo sapiens
ucucaguggcuuccucacuuuu

SEQ ID NO: 248481 - RNA, 22 nt, Homo sapiens
ucucaguguuaucuaucugccu

SEQ ID NO: 248482 - RNA, 20 nt, Homo sapiens
ucucauagagguagagaaua

SEQ ID NO: 248483 - RNA, 22 nt, Homo sapiens
ucucaugaagauagagaauaga

SEQ ID NO: 248484 - RNA, 22 nt, Homo sapiens
ucuccauugaaauggacauaau

SEQ ID NO: 248485 - RNA, 22 nt, Homo sapiens
ucuccauuguccagaugaggaa

SEQ ID NO: 248486 - RNA, 20 nt, Homo sapiens
ucucccaaacagcaggcccu

SEQ ID NO: 248487 - RNA, 22 nt, Homo sapiens
ucuccggguggcggcgaaggga

SEQ ID NO: 248488 - RNA, 22 nt, Homo sapiens
ucucugagaccacuccaaacuc

SEQ ID NO: 248489 - RNA, 22 nt, Homo sapiens
ucucuggauaucuacuuauguu

SEQ ID NO: 248490 - RNA, 22 nt, Homo sapiens
ucucugguuaugucauuaagca

SEQ ID NO: 248491 - RNA, 22 nt, Homo sapiens
ucucugguuuguggaaucuuag

SEQ ID NO: 248492 - RNA, 22 nt, Homo sapiens
ucugacaaugaacaaucuauag

SEQ ID NO: 248493 - RNA, 22 nt, Homo sapiens
ucugacucugugaugggcccaa

SEQ ID NO: 248494 - RNA, 22 nt, Homo sapiens
ucugagguaggugcauggauac

SEQ ID NO: 248495 - RNA, 22 nt, Homo sapiens
ucugagguuacugcuuuguaga

SEQ ID NO: 248496 - RNA, 23 nt, Homo sapiens
ucugcggguguggacccuagugc

SEQ ID NO: 248497 - RNA, 22 nt, Homo sapiens
ucuggagugugaaguggauaug

SEQ ID NO: 248498 - RNA, 21 nt, Homo sapiens
ucuggccccuccaaaucucau

SEQ ID NO: 248499 - RNA, 22 nt, Homo sapiens
ucuggccccucccaaaucucau

SEQ ID NO: 248500 - RNA, 22 nt, Homo sapiens
ucuggccuacaucauuuuuccg

SEQ ID NO: 248501 - RNA, 22 nt, Homo sapiens
ucuggcuuauuucacuuagcau

SEQ ID NO: 248502 - RNA, 17 nt, Homo sapiens
ucuggcuuucacaccug

SEQ ID NO: 248503 - RNA, 22 nt, Homo sapiens
ucuggcuuucuuuacuuaaugu

SEQ ID NO: 248504 - RNA, 22 nt, Homo sapiens
ucuggucccugcacauauuuuc

SEQ ID NO: 248505 - RNA, 22 nt, Homo sapiens
ucugguuccugcauucauucaa

SEQ ID NO: 248506 - RNA, 22 nt, Homo sapiens
ucuguacuccuugaguagugcu

SEQ ID NO: 248507 - RNA, 22 nt, Homo sapiens
ucugucaaaucuuauguuguag

SEQ ID NO: 248508 - RNA, 19 nt, Homo sapiens
ucugucacuggggguauuc

SEQ ID NO: 248509 - RNA, 22 nt, Homo sapiens
ucugucuuguccucacccuaga

SEQ ID NO: 248510 - RNA, 22 nt, Homo sapiens
ucugucuuugccuaaguuuguc

SEQ ID NO: 248511 - RNA, 22 nt, Homo sapiens
ucugugcuugucauaugcuuug

SEQ ID NO: 248512 - RNA, 22 nt, Homo sapiens
ucuguggucagcauccgccacu

SEQ ID NO: 248513 - RNA, 18 nt, Homo sapiens
ucugugguguaaauacgu

SEQ ID NO: 248514 - RNA, 22 nt, Homo sapiens
ucugugguucaggcuggagugc

SEQ ID NO: 248515 - RNA, 22 nt, Homo sapiens
ucuguguuugaucaagauugua

SEQ ID NO: 248516 - RNA, 22 nt, Homo sapiens
ucuugaacuucauaggucuaga

SEQ ID NO: 248517 - RNA, 22 nt, Homo sapiens
ucuugcauuuuuaaauagugcu

SEQ ID NO: 248518 - RNA, 22 nt, Homo sapiens
ucuugcuuguuguucccuucau

SEQ ID NO: 248519 - RNA, 22 nt, Homo sapiens
ucuuggcauggcugaagauucc

SEQ ID NO: 248520 - RNA, 17 nt, Homo sapiens
ucuugugguucuugaau

SEQ ID NO: 248521 - RNA, 23 nt, Homo sapiens
ucuuuggcucuaauauaccuugu

SEQ ID NO: 248522 - RNA, 22 nt, Homo sapiens
ucuuugguagaagcuauuuuau

SEQ ID NO: 248523 - RNA, 21 nt, Homo sapiens
ucuuuggucaccaguuuucau

SEQ ID NO: 248524 - RNA, 22 nt, Homo sapiens
ucuuugguuagguuuaguugau

SEQ ID NO: 248525 - RNA, 22 nt, Homo sapiens
ucuuugguugcacugcaggugu

SEQ ID NO: 248526 - RNA, 22 nt, Homo sapiens
ucuuuguguucaggagccacgu

SEQ ID NO: 248527 - RNA, 22 nt, Homo sapiens
ucuuuuggguauggagccauca

SEQ ID NO: 248528 - RNA, 22 nt, Homo sapiens
ucuuuugguuucuagaggccgc

SEQ ID NO: 248529 - RNA, 22 nt, Homo sapiens
ucuuuuguucuauucaggccuu

SEQ ID NO: 248530 - RNA, 22 nt, Homo sapiens
ugaaacacacagagaagggaga

SEQ ID NO: 248531 - RNA, 22 nt, Homo sapiens
ugaaaguaauugcaguuuuuac

SEQ ID NO: 248532 - RNA, 22 nt, Homo sapiens
ugaaaucauguaguuauugcaa

SEQ ID NO: 248533 - RNA, 22 nt, Homo sapiens
ugaaaucuaaaauguuccaaga

SEQ ID NO: 248534 - RNA, 22 nt, Homo sapiens
ugaaaucuuugaugguggcauu

SEQ ID NO: 248535 - RNA, 21 nt, Homo sapiens
ugaaaugcaugugcacauuaa

SEQ ID NO: 248536 - RNA, 22 nt, Homo sapiens
ugaaauggugcggucugcagca

SEQ ID NO: 248537 - RNA, 22 nt, Homo sapiens
ugaaaugguuaugugaggagau

SEQ ID NO: 248538 - RNA, 22 nt, Homo sapiens
ugaacuguaagguauaggugau

SEQ ID NO: 248539 - RNA, 22 nt, Homo sapiens
ucacagacauugaggggaccuu

SEQ ID NO: 248540 - RNA, 21 nt, Homo sapiens
ucacagccuaggaccugaaga

SEQ ID NO: 248541 - RNA, 22 nt, Homo sapiens
ucacagcuaaaaugaaaguagu

SEQ ID NO: 248542 - RNA, 22 nt, Homo sapiens
ucacaggguguuauuagaauua

SEQ ID NO: 248543 - RNA, 19 nt, Homo sapiens
ucacaggguugacuugagg

SEQ ID NO: 248544 - RNA, 22 nt, Homo sapiens
ucacaguaacuuuguugcuuuu

SEQ ID NO: 248545 - RNA, 22 nt, Homo sapiens
ucacaguagagcuucuuucaga

SEQ ID NO: 248546 - RNA, 22 nt, Homo sapiens
ucacaguagccccucccaucau

SEQ ID NO: 248547 - RNA, 22 nt, Homo sapiens
ucacagucacugucacguugaa

SEQ ID NO: 248548 - RNA, 22 nt, Homo sapiens
ucacagugcaggaucaguuaau

SEQ ID NO: 248549 - RNA, 23 nt, Homo sapiens
ucacaguuacuuuugcaucaacc

SEQ ID NO: 248550 - RNA, 22 nt, Homo sapiens
ucacaguucagcauggcugagg

SEQ ID NO: 248551 - RNA, 22 nt, Homo sapiens
ucacaguugauugaaacacagc

SEQ ID NO: 248552 - RNA, 22 nt, Homo sapiens
ucacaucucagguuucuugaca

SEQ ID NO: 248553 - RNA, 22 nt, Homo sapiens
ucacauuaagcuguuauuucuu

SEQ ID NO: 248554 - RNA, 22 nt, Homo sapiens
ucacauuguauauguaccuauc

SEQ ID NO: 248555 - RNA, 22 nt, Homo sapiens
ucacauuguguagccugcucac

SEQ ID NO: 248556 - RNA, 22 nt, Homo sapiens
ucacauuguuauguaaauguuu

SEQ ID NO: 248557 - RNA, 22 nt, Homo sapiens
ucaccggagguggguugaccag

SEQ ID NO: 248558 - RNA, 19 nt, Homo sapiens
ucacgugcagcagccacac

SEQ ID NO: 248559 - RNA, 22 nt, Homo sapiens
ucacuaggcuggagugcagugg

SEQ ID NO: 248560 - RNA, 22 nt, Homo sapiens
ucacuagggagaaacugaggcu

SEQ ID NO: 248561 - RNA, 22 nt, Homo sapiens
ucacugaaaccacugccuccug

SEQ ID NO: 248562 - RNA, 21 nt, Homo sapiens
ucacugagcaucaugguuuca

SEQ ID NO: 248563 - RNA, 22 nt, Homo sapiens
ucacugagcuagaucacuugac

SEQ ID NO: 248564 - RNA, 22 nt, Homo sapiens
ucacugcgaccuccaccuccug

SEQ ID NO: 248565 - RNA, 22 nt, Homo sapiens
ucacugcgaccuccgccucccg

SEQ ID NO: 248566 - RNA, 19 nt, Homo sapiens
ucacuggacagcacacuca

SEQ ID NO: 248567 - RNA, 22 nt, Homo sapiens
ucacuggaggagaggaagugga

SEQ ID NO: 248568 - RNA, 22 nt, Homo sapiens
ucacuggcaaauauauccguug

SEQ ID NO: 248569 - RNA, 22 nt, Homo sapiens
ucacuggucuaaguggaggggg

SEQ ID NO: 248570 - RNA, 22 nt, Homo sapiens
ucacuguggaacucaaaaagcu

SEQ ID NO: 248571 - RNA, 22 nt, Homo sapiens
ucacugugguuuugaugugcau

SEQ ID NO: 248572 - RNA, 22 nt, Homo sapiens
ucacuguguauguauaugcagg

SEQ ID NO: 248573 - RNA, 22 nt, Homo sapiens
ucagaacugauacuagaacuuu

SEQ ID NO: 248574 - RNA, 21 nt, Homo sapiens
ucagaagcucccagggaggac

SEQ ID NO: 248575 - RNA, 22 nt, Homo sapiens
ucagaguaguuccuggcagaaa

SEQ ID NO: 248576 - RNA, 22 nt, Homo sapiens
ucagagucuagaucacucacug

SEQ ID NO: 248577 - RNA, 18 nt, Homo sapiens
ucagagugcagacuauac

SEQ ID NO: 248578 - RNA, 22 nt, Homo sapiens
ucagaucauauucuucgcugcu

SEQ ID NO: 248579 - RNA, 22 nt, Homo sapiens
ucagaucuucagcaggggcccc

SEQ ID NO: 248580 - RNA, 22 nt, Homo sapiens
ucagaugauuccguugacgaga

SEQ ID NO: 248581 - RNA, 22 nt, Homo sapiens
ucagauguuugagaaguauacu

SEQ ID NO: 248582 - RNA, 22 nt, Homo sapiens
ucagcagucacuccuaugacaa

SEQ ID NO: 248583 - RNA, 20 nt, Homo sapiens
ucagcagucuggagcagagg

SEQ ID NO: 248584 - RNA, 22 nt, Homo sapiens
ucaggcacuaguaagaaaaagg

SEQ ID NO: 248585 - RNA, 21 nt, Homo sapiens
ucagggaccugcuguacugau

SEQ ID NO: 248586 - RNA, 22 nt, Homo sapiens
ucagggacgcuugacacaagcc

SEQ ID NO: 248587 - RNA, 22 nt, Homo sapiens
ucaggguacuuguggccaaagu

SEQ ID NO: 248588 - RNA, 20 nt, Homo sapiens
ucagguagggcuucaacauu

SEQ ID NO: 248589 - RNA, 22 nt, Homo sapiens
ucagguaguuugugggagauga

SEQ ID NO: 248590 - RNA, 22 nt, Homo sapiens
ucagguauuuuaucacaugaag

SEQ ID NO: 248591 - RNA, 22 nt, Homo sapiens
ucaggugcagagaagaaauggg

SEQ ID NO: 248592 - RNA, 22 nt, Homo sapiens
ucagguugcuaaguauaauauu

SEQ ID NO: 248593 - RNA, 23 nt, Homo sapiens
ucaguacuccacuuucaauagug

SEQ ID NO: 248594 - RNA, 23 nt, Homo sapiens
ucaguagucauugggaaagugug

SEQ ID NO: 248595 - RNA, 22 nt, Homo sapiens
ucagucauucaauuguugaaug

SEQ ID NO: 248596 - RNA, 22 nt, Homo sapiens
ucagucauugauggaguagguc

SEQ ID NO: 248597 - RNA, 22 nt, Homo sapiens
ucagucuuuuaccauuaaguau

SEQ ID NO: 248598 - RNA, 22 nt, Homo sapiens
ucagugcaggaauuuccuuaga

SEQ ID NO: 248599 - RNA, 22 nt, Homo sapiens
ucagugcuguuugcccucguuu

SEQ ID NO: 248600 - RNA, 22 nt, Homo sapiens
ucaguggacuuagucuuucccc

SEQ ID NO: 248601 - RNA, 22 nt, Homo sapiens
ucaguggauuauuaaagucacc

SEQ ID NO: 248602 - RNA, 22 nt, Homo sapiens
ucaguggauuuaaccugaauca

SEQ ID NO: 248603 - RNA, 22 nt, Homo sapiens
ucagugggcuauguaauuaacu

SEQ ID NO: 248604 - RNA, 22 nt, Homo sapiens
ucaguguuuuauccuccagagc

SEQ ID NO: 248605 - RNA, 22 nt, Homo sapiens
ucauaguacuuuguuuugaaaa

SEQ ID NO: 248606 - RNA, 22 nt, Homo sapiens
ucauaguagucacuuaauaaau

SEQ ID NO: 248607 - RNA, 16 nt, Homo sapiens
ucauaguaucucuucu

SEQ ID NO: 248608 - RNA, 22 nt, Homo sapiens
ucauauguaugugcaauuuugu

SEQ ID NO: 248609 - RNA, 23 nt, Homo sapiens
ucaucacagcauuuccugguauu

SEQ ID NO: 248610 - RNA, 22 nt, Homo sapiens
ucauccauacaguuagcaaagg

SEQ ID NO: 248611 - RNA, 22 nt, Homo sapiens
ucaucuggcgaaugugaagagu

SEQ ID NO: 248612 - RNA, 22 nt, Homo sapiens
ucaugacacagcauacugacuu

SEQ ID NO: 248613 - RNA, 22 nt, Homo sapiens
ucaugacacuggcaggagcuaa

SEQ ID NO: 248614 - RNA, 22 nt, Homo sapiens
ucaugcaaugcaaggggaaauu

SEQ ID NO: 248615 - RNA, 22 nt, Homo sapiens
ucauggcacugaugagaguuuc

SEQ ID NO: 248616 - RNA, 22 nt, Homo sapiens
ucauguauuaucauuagugggu

SEQ ID NO: 248617 - RNA, 22 nt, Homo sapiens
ucauucacucccuugaaguuag

SEQ ID NO: 248618 - RNA, 22 nt, Homo sapiens
ucauugcauguuaauuaaacag

SEQ ID NO: 248619 - RNA, 22 nt, Homo sapiens
ucauugcauuccagcccaagca

SEQ ID NO: 248620 - RNA, 22 nt, Homo sapiens
ucauugguagcucauggaaccg

SEQ ID NO: 248621 - RNA, 22 nt, Homo sapiens
ucauugguugcguaauuugauu

SEQ ID NO: 248622 - RNA, 19 nt, Homo sapiens
uccacagugguugaacuag

SEQ ID NO: 248623 - RNA, 22 nt, Homo sapiens
uccacagugguugaacuaguaa

SEQ ID NO: 248624 - RNA, 19 nt, Homo sapiens
uccaccgcgugcaccucua

SEQ ID NO: 248625 - RNA, 22 nt, Homo sapiens
uccagaguggugaugcuggggc

SEQ ID NO: 248626 - RNA, 22 nt, Homo sapiens
uccagguacucagggggcugag

SEQ ID NO: 248627 - RNA, 22 nt, Homo sapiens
uccaguguuucuuccacuauuu

SEQ ID NO: 248628 - RNA, 22 nt, Homo sapiens
uccaguuguuauuuuuauaaag

SEQ ID NO: 248629 - RNA, 22 nt, Homo sapiens
uccaguuguucucgaagcuccu

SEQ ID NO: 248630 - RNA, 22 nt, Homo sapiens
uccaugugaaaucuaugaggac

SEQ ID NO: 248631 - RNA, 22 nt, Homo sapiens
uccauuuguagguagugagaca

SEQ ID NO: 248632 - RNA, 22 nt, Homo sapiens
ucccagugaaaccccaccuuca

SEQ ID NO: 248633 - RNA, 22 nt, Homo sapiens
uccccgaggcuggagugcagug

SEQ ID NO: 248634 - RNA, 19 nt, Homo sapiens
uccccuguggauaccaaga

SEQ ID NO: 248635 - RNA, 22 nt, Homo sapiens
uccccuuuguaagauggaaacg

SEQ ID NO: 248636 - RNA, 18 nt, Homo sapiens
ucccucagaauuauagaa

SEQ ID NO: 248637 - RNA, 22 nt, Homo sapiens
ucccugaagcugcagcaacaca

SEQ ID NO: 248638 - RNA, 22 nt, Homo sapiens
ucccuggacagccuugccuggg

SEQ ID NO: 248639 - RNA, 22 nt, Homo sapiens
ucccuguguccugggggcaccu

SEQ ID NO: 248640 - RNA, 22 nt, Homo sapiens
ucccuguuguuucauaauuuua

SEQ ID NO: 248641 - RNA, 22 nt, Homo sapiens
uauuguacauguuauagauuuu

SEQ ID NO: 248642 - RNA, 22 nt, Homo sapiens
uauugucaccaucccuguuuua

SEQ ID NO: 248643 - RNA, 22 nt, Homo sapiens
uauuucaguugugcagguaguu

SEQ ID NO: 248644 - RNA, 22 nt, Homo sapiens
uauuugguuauaugaguaaguu

SEQ ID NO: 248645 - RNA, 22 nt, Homo sapiens
uauuuguccccuccaaaaguca

SEQ ID NO: 248646 - RNA, 22 nt, Homo sapiens
ucaaacugcuugaggccauuua

SEQ ID NO: 248647 - RNA, 22 nt, Homo sapiens
ucaaaguauucuucugagaacc

SEQ ID NO: 248648 - RNA, 22 nt, Homo sapiens
ucaaagucuucucaaguaacau

SEQ ID NO: 248649 - RNA, 22 nt, Homo sapiens
ucaaagugagcuccuucucacu

SEQ ID NO: 248650 - RNA, 22 nt, Homo sapiens
ucaaaugauucuccugccucag

SEQ ID NO: 248651 - RNA, 22 nt, Homo sapiens
ucaaaugcacguagagaaaaua

SEQ ID NO: 248652 - RNA, 22 nt, Homo sapiens
ucaaaugguccacgugaacauu

SEQ ID NO: 248653 - RNA, 22 nt, Homo sapiens
ucaagcaauucuccucucagcc

SEQ ID NO: 248654 - RNA, 22 nt, Homo sapiens
ucaagcaauucuccugccucag

SEQ ID NO: 248655 - RNA, 22 nt, Homo sapiens
ucaaggcacauuugacauuuuc

SEQ ID NO: 248656 - RNA, 22 nt, Homo sapiens
ucaaggcacuagcugagcugca

SEQ ID NO: 248657 - RNA, 22 nt, Homo sapiens
ucaaugcaaccuccaccucugg

SEQ ID NO: 248658 - RNA, 22 nt, Homo sapiens
ucaaugggcuacacauugagug

SEQ ID NO: 248659 - RNA, 22 nt, Homo sapiens
ucaauguaucuccaagaauuga

SEQ ID NO: 248660 - RNA, 18 nt, Homo sapiens
ucaauguggauguucuuu

SEQ ID NO: 248661 - RNA, 19 nt, Homo sapiens
ucaauucugucaauggcuu

SEQ ID NO: 248662 - RNA, 16 nt, Homo sapiens
ucacaaacucuagcag

SEQ ID NO: 248663 - RNA, 22 nt, Homo sapiens
ugugccuacugugggagcguca

SEQ ID NO: 248664 - RNA, 22 nt, Homo sapiens
ugugcuugcuucuucuccuagu

SEQ ID NO: 248665 - RNA, 20 nt, Homo sapiens
uguggcacuguaucucucag

SEQ ID NO: 248666 - RNA, 22 nt, Homo sapiens
uguggcauuuucagaaaggaug

SEQ ID NO: 248667 - RNA, 22 nt, Homo sapiens
uguggccccuagcuacuagaga

SEQ ID NO: 248668 - RNA, 18 nt, Homo sapiens
uguggcuguuuuccaaua

SEQ ID NO: 248669 - RNA, 22 nt, Homo sapiens
uguggcuuuguaaccauggguc

SEQ ID NO: 248670 - RNA, 22 nt, Homo sapiens
ugugguauuagguguaguaucu

SEQ ID NO: 248671 - RNA, 19 nt, Homo sapiens
uguggucauccugggacga

SEQ ID NO: 248672 - RNA, 22 nt, Homo sapiens
uguguaaagcuuguuccagaaa

SEQ ID NO: 248673 - RNA, 22 nt, Homo sapiens
uguguaaauaugauagaggaau

SEQ ID NO: 248674 - RNA, 22 nt, Homo sapiens
ugugucuacugagaugaucaug

SEQ ID NO: 248675 - RNA, 22 nt, Homo sapiens
ugugucuccugaaaauucacau

SEQ ID NO: 248676 - RNA, 22 nt, Homo sapiens
uguuacagcagaauugauugca

SEQ ID NO: 248677 - RNA, 22 nt, Homo sapiens
uguucacaguguuucuuugaga

SEQ ID NO: 248678 - RNA, 22 nt, Homo sapiens
uguucauggauccaguggcuuc

SEQ ID NO: 248679 - RNA, 22 nt, Homo sapiens
uguucuggagaguuuagucugg

SEQ ID NO: 248680 - RNA, 22 nt, Homo sapiens
uguugcacuccagccugggcaa

SEQ ID NO: 248681 - RNA, 22 nt, Homo sapiens
uguugcacuccauccugggcga

SEQ ID NO: 248682 - RNA, 22 nt, Homo sapiens
uguuucuacugucucuguagua

SEQ ID NO: 248683 - RNA, 22 nt, Homo sapiens
uuaaagccauaccugagagagu

SEQ ID NO: 248684 - RNA, 22 nt, Homo sapiens
uuaaaggcauguacacuagagu

SEQ ID NO: 248685 - RNA, 22 nt, Homo sapiens
uuaaaguauaguuccucugguu

SEQ ID NO: 248686 - RNA, 22 nt, Homo sapiens
uuaaagugaucauaaggauagu

SEQ ID NO: 248687 - RNA, 22 nt, Homo sapiens
uuaaagugcuguuuuugccggg

SEQ ID NO: 248688 - RNA, 20 nt, Homo sapiens
uuaaaucuagugcagacuca

SEQ ID NO: 248689 - RNA, 22 nt, Homo sapiens
uuaaaugcucacauaaagguag

SEQ ID NO: 248690 - RNA, 22 nt, Homo sapiens
uuaacacugccauugauacugu

SEQ ID NO: 248691 - RNA, 21 nt, Homo sapiens
uuaacagacaagugucuuccc

SEQ ID NO: 248692 - RNA, 22 nt, Homo sapiens
uuaagcaaagguaacaugagaa

SEQ ID NO: 248693 - RNA, 22 nt, Homo sapiens
guguaaaucaaucuguugucuu

SEQ ID NO: 248694 - RNA, 22 nt, Homo sapiens
guguaaaucugcugugaacauu

SEQ ID NO: 248695 - RNA, 22 nt, Homo sapiens
guguaauacacacauauaugca

SEQ ID NO: 248696 - RNA, 22 nt, Homo sapiens
guguaugguaggaugacggagu

SEQ ID NO: 248697 - RNA, 22 nt, Homo sapiens
guguauguuucucccugucccu

SEQ ID NO: 248698 - RNA, 21 nt, Homo sapiens
gugucacagacaugacagaug

SEQ ID NO: 248699 - RNA, 22 nt, Homo sapiens
gugucacuguauaauauuuauu

SEQ ID NO: 248700 - RNA, 22 nt, Homo sapiens
gugucaguggggagugaucuuc

SEQ ID NO: 248701 - RNA, 22 nt, Homo sapiens
gugugcaauuuugugggaggca

SEQ ID NO: 248702 - RNA, 22 nt, Homo sapiens
gugugcacaaucuggcaugugc

SEQ ID NO: 248703 - RNA, 22 nt, Homo sapiens
gugugcauggagggggcaguga

SEQ ID NO: 248704 - RNA, 22 nt, Homo sapiens
gugugcaugucuuuuuaguagg

SEQ ID NO: 248705 - RNA, 22 nt, Homo sapiens
gugugguaggauugguuacuca

SEQ ID NO: 248706 - RNA, 22 nt, Homo sapiens
guuaaugcuggaauaaguuaag

SEQ ID NO: 248707 - RNA, 22 nt, Homo sapiens
guuauugcucucgaagacucuc

SEQ ID NO: 248708 - RNA, 22 nt, Homo sapiens
guucaagcaauucugcugccuc

SEQ ID NO: 248709 - RNA, 21 nt, Homo sapiens
guucaagugauccuccugucu

SEQ ID NO: 248710 - RNA, 20 nt, Homo sapiens
guucacaggcuuccuuucag

SEQ ID NO: 248711 - RNA, 22 nt, Homo sapiens
guucacaguuaggacaacugcu

SEQ ID NO: 248712 - RNA, 22 nt, Homo sapiens
guucaguuuuaaagggaaauug

SEQ ID NO: 248713 - RNA, 17 nt, Homo sapiens
guucccaguggcauuug

SEQ ID NO: 248714 - RNA, 22 nt, Homo sapiens
guucccaguugaaaugauuagu

SEQ ID NO: 248715 - RNA, 18 nt, Homo sapiens
guugagcuuuuccuuuag

SEQ ID NO: 248716 - RNA, 22 nt, Homo sapiens
guuggcuguuucccccaaguga

SEQ ID NO: 248717 - RNA, 22 nt, Homo sapiens
guuuacagucgacuugggaaua

SEQ ID NO: 248718 - RNA, 22 nt, Homo sapiens
guuuggauuuucuaauuucugu

SEQ ID NO: 248719 - RNA, 22 nt, Homo sapiens
guuuguaacucuagugacuaga

SEQ ID NO: 248720 - RNA, 22 nt, Homo sapiens
uaaaagucaucacaacuggagu

SEQ ID NO: 248721 - RNA, 17 nt, Homo sapiens
uuuuggauuagaaaucc

SEQ ID NO: 248722 - RNA, 22 nt, Homo sapiens
uuuuggcucugucuguaucuuu

SEQ ID NO: 248723 - RNA, 22 nt, Homo sapiens
uuuugguuguuggguaagagua

SEQ ID NO: 248724 - RNA, 22 nt, Homo sapiens
uuuuguacgccuguguccauca

SEQ ID NO: 248725 - RNA, 22 nt, Homo sapiens
uuuugugcauggcccaguggua

SEQ ID NO: 248726 - RNA, 22 nt, Homo sapiens
uuuuugagaauuggugaaacac

SEQ ID NO: 248727 - RNA, 22 nt, Homo sapiens
uuggauugugaaaguauucucu

SEQ ID NO: 248728 - RNA, 22 nt, Homo sapiens
uuggcaaauagguuuuauugca

SEQ ID NO: 248729 - RNA, 22 nt, Homo sapiens
uuggccauaugacuugcuuugg

SEQ ID NO: 248730 - RNA, 22 nt, Homo sapiens
uuggcuguguuccucaaggagu

SEQ ID NO: 248731 - RNA, 22 nt, Homo sapiens
uugggaaugcuaaaccucuauu

SEQ ID NO: 248732 - RNA, 22 nt, Homo sapiens
uugggagugucucuggacugca

SEQ ID NO: 248733 - RNA, 22 nt, Homo sapiens
uugggauaaucacaaaguaaaa

SEQ ID NO: 248734 - RNA, 22 nt, Homo sapiens
uugggauggaaauuuguacccc

SEQ ID NO: 248735 - RNA, 22 nt, Homo sapiens
uugggccacuuuaguuuccuua

SEQ ID NO: 248736 - RNA, 22 nt, Homo sapiens
uugggguaggaauauggaauga

SEQ ID NO: 248737 - RNA, 22 nt, Homo sapiens
uuggucacugacauguuugaaa

SEQ ID NO: 248738 - RNA, 22 nt, Homo sapiens
uuggucaggagccucccucuuu

SEQ ID NO: 248739 - RNA, 22 nt, Homo sapiens
uuggucaggcuagaguguggug

SEQ ID NO: 248740 - RNA, 22 nt, Homo sapiens
uuggucaucucccuccuuuuag

SEQ ID NO: 248741 - RNA, 22 nt, Homo sapiens
uugguucucuuuauaugcugga

SEQ ID NO: 248742 - RNA, 22 nt, Homo sapiens
uugguuuccuuccugcuuaacu

SEQ ID NO: 248743 - RNA, 22 nt, Homo sapiens
uuguaacaguucugcgagcagc

SEQ ID NO: 248744 - RNA, 22 nt, Homo sapiens
uuguaagaaucuagcucuuuau

SEQ ID NO: 248745 - RNA, 22 nt, Homo sapiens
uuguaauggagcaaacagguug

SEQ ID NO: 248746 - RNA, 23 nt, Homo sapiens
uuguacacuaagaaucgcagaug

SEQ ID NO: 248747 - RNA, 22 nt, Homo sapiens
uuguacaggaguguaagcuuca

SEQ ID NO: 248748 - RNA, 22 nt, Homo sapiens
uuguacuagucauauuuugaaa

SEQ ID NO: 248749 - RNA, 22 nt, Homo sapiens
uuguauaguucuauguguuuug

SEQ ID NO: 248750 - RNA, 22 nt, Homo sapiens
uuguauguaaccauuuggcaaa

SEQ ID NO: 248751 - RNA, 22 nt, Homo sapiens
uuguauguuucugugcacauga

SEQ ID NO: 248752 - RNA, 22 nt, Homo sapiens
uugucaaacucauucuccaucc

SEQ ID NO: 248753 - RNA, 22 nt, Homo sapiens
uugucaguguucacucaaagcu

SEQ ID NO: 248754 - RNA, 22 nt, Homo sapiens
uuguccccaucugcugccagaa

SEQ ID NO: 248755 - RNA, 22 nt, Homo sapiens
uugucuccuagacgaccaggcg

SEQ ID NO: 248756 - RNA, 19 nt, Homo sapiens
uugucuuagaguugucauu

SEQ ID NO: 248757 - RNA, 22 nt, Homo sapiens
uugugacacagcugggccuaua

SEQ ID NO: 248758 - RNA, 22 nt, Homo sapiens
uugugagggagcuaagaugagu

SEQ ID NO: 248759 - RNA, 22 nt, Homo sapiens
uugugcaaaguugugguuucug

SEQ ID NO: 248760 - RNA, 22 nt, Homo sapiens
uugugccccuucucagucgggc

SEQ ID NO: 248761 - RNA, 22 nt, Homo sapiens
uugugcuuaauaaaaaguggua

SEQ ID NO: 248762 - RNA, 18 nt, Homo sapiens
uuguggccccuacaaauu

SEQ ID NO: 248763 - RNA, 19 nt, Homo sapiens
uugugggaggacagagggg

SEQ ID NO: 248764 - RNA, 22 nt, Homo sapiens
uugugguaggaugaagagauga

SEQ ID NO: 248765 - RNA, 22 nt, Homo sapiens
uugugguuuucagcuuauauau

SEQ ID NO: 248766 - RNA, 22 nt, Homo sapiens
uugugucaaauggcaauuagca

SEQ ID NO: 248767 - RNA, 19 nt, Homo sapiens
uuguguccccacaaaauuc

SEQ ID NO: 248768 - RNA, 22 nt, Homo sapiens
uuguguccccacucaaauuaca

SEQ ID NO: 248769 - RNA, 22 nt, Homo sapiens
uuguuauguaucucaagauaaa

SEQ ID NO: 248770 - RNA, 23 nt, Homo sapiens
uuguucccuuccacucagucucc

SEQ ID NO: 248771 - RNA, 22 nt, Homo sapiens
uuuaaggcacuucaugguuuca

SEQ ID NO: 248772 - RNA, 22 nt, Homo sapiens
uuuaauacugcaucuuuacucu

SEQ ID NO: 248773 - RNA, 22 nt, Homo sapiens
uuuaauguuacaguauugguau

SEQ ID NO: 248774 - RNA, 18 nt, Homo sapiens
uuuacaguagaaggacuu

SEQ ID NO: 248775 - RNA, 22 nt, Homo sapiens
uuuacccugaggaaucuauuuu

SEQ ID NO: 248776 - RNA, 22 nt, Homo sapiens
uuuagcaaagcaauuuacacca

SEQ ID NO: 248777 - RNA, 22 nt, Homo sapiens
uuuagcacugugauugacaaaa

SEQ ID NO: 248778 - RNA, 22 nt, Homo sapiens
uuuaucaggccuuuggaaaaau

SEQ ID NO: 248779 - RNA, 18 nt, Homo sapiens
uuucaagucuuaggugac

SEQ ID NO: 248780 - RNA, 22 nt, Homo sapiens
uuucacagagggcuucuuucua

SEQ ID NO: 248781 - RNA, 23 nt, Homo sapiens
uuucacaguagcuggaucagccu

SEQ ID NO: 248782 - RNA, 22 nt, Homo sapiens
uuucagcguggggugcugaaga

SEQ ID NO: 248783 - RNA, 22 nt, Homo sapiens
uuucaucaagcacagaguagau

SEQ ID NO: 248784 - RNA, 22 nt, Homo sapiens
uuuccacauggacuuaccuucg

SEQ ID NO: 248785 - RNA, 19 nt, Homo sapiens
uuucccugcagaccuacua

SEQ ID NO: 248786 - RNA, 22 nt, Homo sapiens
uuucccuuuagcuuagugauuu

SEQ ID NO: 248787 - RNA, 22 nt, Homo sapiens
uuuccuggagaaucuuaacaaa

SEQ ID NO: 248788 - RNA, 22 nt, Homo sapiens
uuucgguuaucuagcuuuauga

SEQ ID NO: 248789 - RNA, 22 nt, Homo sapiens
uuucuacagggcuugccaggua

SEQ ID NO: 248790 - RNA, 16 nt, Homo sapiens
uuucuauguuuuacua

SEQ ID NO: 248791 - RNA, 22 nt, Homo sapiens
uuugacuuuuagaauaugaguu

SEQ ID NO: 248792 - RNA, 22 nt, Homo sapiens
uuugagcauggaaauggcauga

SEQ ID NO: 248793 - RNA, 22 nt, Homo sapiens
uuugagcuugacucagcuggag

SEQ ID NO: 248794 - RNA, 22 nt, Homo sapiens
uuugcacauauuugggcaaaag

SEQ ID NO: 248795 - RNA, 22 nt, Homo sapiens
uuugcacuugaaaacacucuca

SEQ ID NO: 248796 - RNA, 22 nt, Homo sapiens
uuugcacuuuuguaauaugguu

SEQ ID NO: 248797 - RNA, 22 nt, Homo sapiens
uuugccaauauuuuauugagga

SEQ ID NO: 248798 - RNA, 22 nt, Homo sapiens
uuugccacugcaggcuguuuaa

SEQ ID NO: 248799 - RNA, 22 nt, Homo sapiens
uuugccuguagacacuuacccu

SEQ ID NO: 248800 - RNA, 22 nt, Homo sapiens
uuugcugagucauuccaugcug

SEQ ID NO: 248801 - RNA, 22 nt, Homo sapiens
uuugcuucacuguuuggcaaaa

SEQ ID NO: 248802 - RNA, 22 nt, Homo sapiens
uuuggcaacguuggaucccuca

SEQ ID NO: 248803 - RNA, 22 nt, Homo sapiens
uuuggcacuguaaauuucucuu

SEQ ID NO: 248804 - RNA, 22 nt, Homo sapiens
uuuggcauuuaaauaugcaugg

SEQ ID NO: 248805 - RNA, 22 nt, Homo sapiens
uuuggcauuugaguuuguagga

SEQ ID NO: 248806 - RNA, 22 nt, Homo sapiens
uuuggcauuuuacuacucaaau

SEQ ID NO: 248807 - RNA, 21 nt, Homo sapiens
uuuggcuucucugcugcagcc

SEQ ID NO: 248808 - RNA, 22 nt, Homo sapiens
uuugggaaaugaaguugguaga

SEQ ID NO: 248809 - RNA, 22 nt, Homo sapiens
uuugggaaugaguuuaucauuu

SEQ ID NO: 248810 - RNA, 22 nt, Homo sapiens
uuuggguuuuauguaacagcua

SEQ ID NO: 248811 - RNA, 22 nt, Homo sapiens
uuugguugucacaacuggggga

SEQ ID NO: 248812 - RNA, 22 nt, Homo sapiens
uuuguacuaugguuuuucacua

SEQ ID NO: 248813 - RNA, 18 nt, Homo sapiens
uuuguacuuuuucuaaug

SEQ ID NO: 248814 - RNA, 22 nt, Homo sapiens
uuuguagcuacaaagugagaug

SEQ ID NO: 248815 - RNA, 19 nt, Homo sapiens
uuuguauguuuccaguaau

SEQ ID NO: 248816 - RNA, 22 nt, Homo sapiens
uuuguccugccaugguuuauuu

SEQ ID NO: 248817 - RNA, 22 nt, Homo sapiens
uuugucuccuaagacucugugg

SEQ ID NO: 248818 - RNA, 22 nt, Homo sapiens
uuugugaggugauggauauguc

SEQ ID NO: 248819 - RNA, 22 nt, Homo sapiens
uuugugagguggauagauugca

SEQ ID NO: 248820 - RNA, 22 nt, Homo sapiens
uuugugcuccucucaguaugug

SEQ ID NO: 248821 - RNA, 22 nt, Homo sapiens
uuugugcuccuguugagaaucu

SEQ ID NO: 248822 - RNA, 21 nt, Homo sapiens
uuugugguuacugugugagcu

SEQ ID NO: 248823 - RNA, 22 nt, Homo sapiens
uuuguuugaagucgagacaacu

SEQ ID NO: 248824 - RNA, 22 nt, Homo sapiens
uuuuacacuucgguugugugca

SEQ ID NO: 248825 - RNA, 20 nt, Homo sapiens
uuuuagcuuuuauugaaagc

SEQ ID NO: 248826 - RNA, 22 nt, Homo sapiens
uuuuagcuuuucccaggacucc

SEQ ID NO: 248827 - RNA, 22 nt, Homo sapiens
uuuuaguggaauauuuacaguu

SEQ ID NO: 248828 - RNA, 22 nt, Homo sapiens
uuuuaguugcucagguauucuc

SEQ ID NO: 248829 - RNA, 22 nt, Homo sapiens
augcauggcagagucaggguac

SEQ ID NO: 248830 - RNA, 22 nt, Homo sapiens
augccaagagacaaagggaauc

SEQ ID NO: 248831 - RNA, 22 nt, Homo sapiens
augccaagaugagcacgcgucu

SEQ ID NO: 248832 - RNA, 19 nt, Homo sapiens
augccacagugaggucaga

SEQ ID NO: 248833 - RNA, 20 nt, Homo sapiens
augccacugagcagugguga

SEQ ID NO: 248834 - RNA, 22 nt, Homo sapiens
augccacugcacuucagccugg

SEQ ID NO: 248835 - RNA, 22 nt, Homo sapiens
augccacugcgcucuagccugg

SEQ ID NO: 248836 - RNA, 22 nt, Homo sapiens
augccagggagaauuguucaag

SEQ ID NO: 248837 - RNA, 22 nt, Homo sapiens
augccaguguccagaguggguu

SEQ ID NO: 248838 - RNA, 22 nt, Homo sapiens
augccauugcacuccagccuag

SEQ ID NO: 248839 - RNA, 22 nt, Homo sapiens
augcccauuuguuuucugaaag

SEQ ID NO: 248840 - RNA, 22 nt, Homo sapiens
augcuacugauaagcaaucauu

SEQ ID NO: 248841 - RNA, 22 nt, Homo sapiens
augcuguuuugaauucucuaga

SEQ ID NO: 248842 - RNA, 22 nt, Homo sapiens
augcuguuuuguagcucccucu

SEQ ID NO: 248843 - RNA, 21 nt, Homo sapiens
auggaaagacugccucuucaa

SEQ ID NO: 248844 - RNA, 22 nt, Homo sapiens
auggaagaaacgauuuucugga

SEQ ID NO: 248845 - RNA, 22 nt, Homo sapiens
auggaaggagaauggucuuuga

SEQ ID NO: 248846 - RNA, 22 nt, Homo sapiens
auggaauguauagucauguagg

SEQ ID NO: 248847 - RNA, 22 nt, Homo sapiens
auggaauguggaaugguaagua

SEQ ID NO: 248848 - RNA, 22 nt, Homo sapiens
auggaggaggaagcugaaacaa

SEQ ID NO: 248849 - RNA, 22 nt, Homo sapiens
auggaguguggaacugggaauc

SEQ ID NO: 248850 - RNA, 22 nt, Homo sapiens
auggaguguucugaauccuuug

SEQ ID NO: 248851 - RNA, 22 nt, Homo sapiens
auggaguuuacuuaguguaaua

SEQ ID NO: 248852 - RNA, 22 nt, Homo sapiens
auggaguuugaacaauuuccug

SEQ ID NO: 248853 - RNA, 19 nt, Homo sapiens
auggauacauuuucugcua

SEQ ID NO: 248854 - RNA, 22 nt, Homo sapiens
auggcagcaccccacucuacug

SEQ ID NO: 248855 - RNA, 22 nt, Homo sapiens
auggcaguuucacucugggauu

SEQ ID NO: 248856 - RNA, 22 nt, Homo sapiens
auggcauggugcaggguuuaag

SEQ ID NO: 248857 - RNA, 22 nt, Homo sapiens
auggcccaguuugcuaucccua

SEQ ID NO: 248858 - RNA, 22 nt, Homo sapiens
auggcccugggaaaggaggcau

SEQ ID NO: 248859 - RNA, 22 nt, Homo sapiens
auggccuuucuggcacauuucc

SEQ ID NO: 248860 - RNA, 22 nt, Homo sapiens
auggcucuggauagaaugcagg

SEQ ID NO: 248861 - RNA, 22 nt, Homo sapiens
auggcucuguuccaugugucuu

SEQ ID NO: 248862 - RNA, 22 nt, Homo sapiens
auggcuuuggucucccagugau

SEQ ID NO: 248863 - RNA, 22 nt, Homo sapiens
auggcuuuuauuguguugaggu

SEQ ID NO: 248864 - RNA, 22 nt, Homo sapiens
augggguagguagcucggggaa

SEQ ID NO: 248865 - RNA, 21 nt, Homo sapiens
auguaacugggaaugugagag

SEQ ID NO: 248866 - RNA, 22 nt, Homo sapiens
auguaauguuaaauugcuaauu

SEQ ID NO: 248867 - RNA, 22 nt, Homo sapiens
auguaauugagguuuuugccau

SEQ ID NO: 248868 - RNA, 22 nt, Homo sapiens
augucaacauagacaguagagu

SEQ ID NO: 248869 - RNA, 22 nt, Homo sapiens
augucaaggugggugauaguuu

SEQ ID NO: 248870 - RNA, 22 nt, Homo sapiens
augucacugcacuccugccugg

SEQ ID NO: 248871 - RNA, 22 nt, Homo sapiens
augucugguagccaccuggagg

SEQ ID NO: 248872 - RNA, 22 nt, Homo sapiens
augucuuucauagagacccaga

SEQ ID NO: 248873 - RNA, 22 nt, Homo sapiens
augugaaugugaucggauaguc

SEQ ID NO: 248874 - RNA, 22 nt, Homo sapiens
augugcaaauuuccaaacucuu

SEQ ID NO: 248875 - RNA, 18 nt, Homo sapiens
augugcaauuuuguauuu

SEQ ID NO: 248876 - RNA, 22 nt, Homo sapiens
augugcuaguaucaaacgagac

SEQ ID NO: 248877 - RNA, 22 nt, Homo sapiens
augugcuuuuuaaacagaugcu

SEQ ID NO: 248878 - RNA, 22 nt, Homo sapiens
auguggauaucuauaucuggau

SEQ ID NO: 248879 - RNA, 22 nt, Homo sapiens
augugguaggcccaugagucau

SEQ ID NO: 248880 - RNA, 22 nt, Homo sapiens
auguguauuaccucgauuguga

SEQ ID NO: 248881 - RNA, 22 nt, Homo sapiens
auguuaagauggaacaugggaa

SEQ ID NO: 248882 - RNA, 20 nt, Homo sapiens
auguucuggaggacagaagc

SEQ ID NO: 248883 - RNA, 22 nt, Homo sapiens
auguuuagagagggugucaaau

SEQ ID NO: 248884 - RNA, 22 nt, Homo sapiens
auuaaauguuggacguauacau

SEQ ID NO: 248885 - RNA, 22 nt, Homo sapiens
auuaacaucuagaguuuuggug

SEQ ID NO: 248886 - RNA, 22 nt, Homo sapiens
auuaagagcacauguucugggu

SEQ ID NO: 248887 - RNA, 22 nt, Homo sapiens
auuaagugaaugaaguuguucc

SEQ ID NO: 248888 - RNA, 22 nt, Homo sapiens
auuaagugcuugccagugcugg

SEQ ID NO: 248889 - RNA, 22 nt, Homo sapiens
auuacacuuucuauucaaugag

SEQ ID NO: 248890 - RNA, 22 nt, Homo sapiens
auuacuuugcaccaaccuaaua

SEQ ID NO: 248891 - RNA, 22 nt, Homo sapiens
auuagguaauauaaucauggca

SEQ ID NO: 248892 - RNA, 22 nt, Homo sapiens
auuauauguguaugugcauacc

SEQ ID NO: 248893 - RNA, 22 nt, Homo sapiens
auuauuagucggccagcuguua

SEQ ID NO: 248894 - RNA, 22 nt, Homo sapiens
auucaagggauuucaggaggcu

SEQ ID NO: 248895 - RNA, 22 nt, Homo sapiens
auucaagucaucucuccgcauu

SEQ ID NO: 248896 - RNA, 22 nt, Homo sapiens
auucaccauggcuaccaagggu

SEQ ID NO: 248897 - RNA, 22 nt, Homo sapiens
auucacugugcuuggccaaauu

SEQ ID NO: 248898 - RNA, 22 nt, Homo sapiens
auucacuguggguccuuuggau

SEQ ID NO: 248899 - RNA, 22 nt, Homo sapiens
auucaucagggauacuggccug

SEQ ID NO: 248900 - RNA, 22 nt, Homo sapiens
auuccacuuagugacucauuug

SEQ ID NO: 248901 - RNA, 22 nt, Homo sapiens
auuccacuuauaugagguaucu

SEQ ID NO: 248902 - RNA, 20 nt, Homo sapiens
auuccacuuauaugaggucc

SEQ ID NO: 248903 - RNA, 20 nt, Homo sapiens
auuccacuuguuugagguac

SEQ ID NO: 248904 - RNA, 22 nt, Homo sapiens
auuccuuaggcccuuugguuag

SEQ ID NO: 248905 - RNA, 22 nt, Homo sapiens
auucuugcuugaacuuggugca

SEQ ID NO: 248906 - RNA, 23 nt, Homo sapiens
auugaacacuuucauaugugagg

SEQ ID NO: 248907 - RNA, 22 nt, Homo sapiens
auugaauuugguuugcuaagaa

SEQ ID NO: 248908 - RNA, 22 nt, Homo sapiens
auugacaguuggccaguaagug

SEQ ID NO: 248909 - RNA, 22 nt, Homo sapiens
auugcacuccacccugggcaac

SEQ ID NO: 248910 - RNA, 22 nt, Homo sapiens
auugcacuccagccccggggac

SEQ ID NO: 248911 - RNA, 22 nt, Homo sapiens
auugcacuccagcccgggugac

SEQ ID NO: 248912 - RNA, 22 nt, Homo sapiens
auugcacuccagcccugcugac

SEQ ID NO: 248913 - RNA, 22 nt, Homo sapiens
auugcacuccagccuagguaac

SEQ ID NO: 248914 - RNA, 22 nt, Homo sapiens
auugcacuccagccuagucaac

SEQ ID NO: 248915 - RNA, 22 nt, Homo sapiens
auugcacuccagccugagcaaa

SEQ ID NO: 248916 - RNA, 22 nt, Homo sapiens
auugcacuccagccuggaugac

SEQ ID NO: 248917 - RNA, 22 nt, Homo sapiens
auugcacuccagccuggcaaua

SEQ ID NO: 248918 - RNA, 22 nt, Homo sapiens
auugcacuccagccugggcagc

SEQ ID NO: 248919 - RNA, 22 nt, Homo sapiens
auugcacuccagccugggcuag

SEQ ID NO: 248920 - RNA, 22 nt, Homo sapiens
auugcacuccagccugggggac

SEQ ID NO: 248921 - RNA, 22 nt, Homo sapiens
auugcacuccagccugggugac

SEQ ID NO: 248922 - RNA, 22 nt, Homo sapiens
auugcacuccagccuugacaca

SEQ ID NO: 248923 - RNA, 22 nt, Homo sapiens
auugcacuccagccuugggcaa

SEQ ID NO: 248924 - RNA, 22 nt, Homo sapiens
auugcacuccagccuuggggau

SEQ ID NO: 248925 - RNA, 22 nt, Homo sapiens
auugcacuccauccuaggugac

SEQ ID NO: 248926 - RNA, 22 nt, Homo sapiens
auugcacucuagccuuggcgac

SEQ ID NO: 248927 - RNA, 23 nt, Homo sapiens
auugcagucuugaacuccugggc

SEQ ID NO: 248928 - RNA, 22 nt, Homo sapiens
auugcccauaaggauauuguca

SEQ ID NO: 248929 - RNA, 22 nt, Homo sapiens
auugccuaugauugagguacua

SEQ ID NO: 248930 - RNA, 22 nt, Homo sapiens
auugcuauuauuugaccauugu

SEQ ID NO: 248931 - RNA, 22 nt, Homo sapiens
auugcucuuagaaauauuucuu

SEQ ID NO: 248932 - RNA, 22 nt, Homo sapiens
auugcuuuuacugggagcuuug

SEQ ID NO: 248933 - RNA, 22 nt, Homo sapiens
auuggaguuguacgcacgcuca

SEQ ID NO: 248934 - RNA, 22 nt, Homo sapiens
auuggcaaucgucuccauuuuu

SEQ ID NO: 248935 - RNA, 22 nt, Homo sapiens
auuggcaauguacauaucuugc

SEQ ID NO: 248936 - RNA, 22 nt, Homo sapiens
auuggccaaugggacgucagca

SEQ ID NO: 248937 - RNA, 18 nt, Homo sapiens
auuguaagauguauggga

SEQ ID NO: 248938 - RNA, 22 nt, Homo sapiens
auuguacauacaccggugugua

SEQ ID NO: 248939 - RNA, 22 nt, Homo sapiens
auuguacuccagccugggcaag

SEQ ID NO: 248940 - RNA, 22 nt, Homo sapiens
auuguacucuagccucugggca

SEQ ID NO: 248941 - RNA, 22 nt, Homo sapiens
auuguacugccccccuguugcu

SEQ ID NO: 248942 - RNA, 22 nt, Homo sapiens
auuguaguuugcuauggcaaua

SEQ ID NO: 248943 - RNA, 21 nt, Homo sapiens
auuguauguaaaccaaaugag

SEQ ID NO: 248944 - RNA, 22 nt, Homo sapiens
auugucacugugcuccaccagu

SEQ ID NO: 248945 - RNA, 22 nt, Homo sapiens
auugucacuuaaaagugcaugu

SEQ ID NO: 248946 - RNA, 22 nt, Homo sapiens
auuguccuacuaggguuccagu

SEQ ID NO: 248947 - RNA, 20 nt, Homo sapiens
auuguccuugauuacacaga

SEQ ID NO: 248948 - RNA, 22 nt, Homo sapiens
auugugauggucaaaggaaaua

SEQ ID NO: 248949 - RNA, 19 nt, Homo sapiens
auuuccuggagcuggucuc

SEQ ID NO: 248950 - RNA, 22 nt, Homo sapiens
auuuccuguaggggcuugcgaa

SEQ ID NO: 248951 - RNA, 22 nt, Homo sapiens
auuuggcaguauaaugcuuugg

SEQ ID NO: 248952 - RNA, 22 nt, Homo sapiens
auuuggcagugaagggaucaca

SEQ ID NO: 248953 - RNA, 22 nt, Homo sapiens
auuuggcauagaguaucauucu

SEQ ID NO: 248954 - RNA, 20 nt, Homo sapiens
auuuggcauaguuuaagcaa

SEQ ID NO: 248955 - RNA, 22 nt, Homo sapiens
auuugguugggugcgguggcuu

SEQ ID NO: 248956 - RNA, 22 nt, Homo sapiens
auuuuuggauauagggaaggau

SEQ ID NO: 248957 - RNA, 22 nt, Homo sapiens
auuuuugguugguaggcuauua

SEQ ID NO: 248958 - RNA, 22 nt, Homo sapiens
auuuuugguugucagcacuagg

SEQ ID NO: 248959 - RNA, 22 nt, Homo sapiens
auuuuugguuucaccugcacgc

SEQ ID NO: 248960 - RNA, 22 nt, Homo sapiens
caaaagugauugcgguuuuugc

SEQ ID NO: 248961 - RNA, 22 nt, Homo sapiens
caaagcacuuggcuuggaagau

SEQ ID NO: 248962 - RNA, 22 nt, Homo sapiens
caaagugcugggaugggccagg

SEQ ID NO: 248963 - RNA, 22 nt, Homo sapiens
caaaugcuucuauggacugucu

SEQ ID NO: 248964 - RNA, 22 nt, Homo sapiens
caagugaauaguugcucucaga

SEQ ID NO: 248965 - RNA, 22 nt, Homo sapiens
caagugcuacagagaaaucuuu

SEQ ID NO: 248966 - RNA, 22 nt, Homo sapiens
caagugcuugaugaaugaucaa

SEQ ID NO: 248967 - RNA, 22 nt, Homo sapiens
caagugcuuucuuggggauuua

SEQ ID NO: 248968 - RNA, 21 nt, Homo sapiens
caaugacacuguagcugugcu

SEQ ID NO: 248969 - RNA, 22 nt, Homo sapiens
caauggcaaugaaauagugaga

SEQ ID NO: 248970 - RNA, 22 nt, Homo sapiens
caauggcacuauuggaaaaggu

SEQ ID NO: 248971 - RNA, 22 nt, Homo sapiens
cacagcuagucaaugguagaca

SEQ ID NO: 248972 - RNA, 22 nt, Homo sapiens
cacagucugggcuuguuuguac

SEQ ID NO: 248973 - RNA, 22 nt, Homo sapiens
cacaguguuacugguaugaagu

SEQ ID NO: 248974 - RNA, 22 nt, Homo sapiens
cacaguguuccagcuauuugaa

SEQ ID NO: 248975 - RNA, 22 nt, Homo sapiens
caccagguggcugaggccauga

SEQ ID NO: 248976 - RNA, 23 nt, Homo sapiens
caccaguagaaugugugggaggg

SEQ ID NO: 248977 - RNA, 22 nt, Homo sapiens
cacccuuagaguuggaaguggg

SEQ ID NO: 248978 - RNA, 19 nt, Homo sapiens
caccgccugcccccugcug

SEQ ID NO: 248979 - RNA, 22 nt, Homo sapiens
caccugagcgggaugcucgccu

SEQ ID NO: 248980 - RNA, 22 nt, Homo sapiens
cacucaguuugugguacuuugu

SEQ ID NO: 248981 - RNA, 22 nt, Homo sapiens
cacugcacuccagccuaagagg

SEQ ID NO: 248982 - RNA, 22 nt, Homo sapiens
cacugcacuccagucuggcgac

SEQ ID NO: 248983 - RNA, 22 nt, Homo sapiens
cacugcauccuccaccuccugg

SEQ ID NO: 248984 - RNA, 22 nt, Homo sapiens
cacugggugccauauguuugcu

SEQ ID NO: 248985 - RNA, 22 nt, Homo sapiens
cacuggucucauggcaugagag

SEQ ID NO: 248986 - RNA, 21 nt, Homo sapiens
cacugguguugcuauaucaaa

SEQ ID NO: 248987 - RNA, 22 nt, Homo sapiens
cacuguggauggaacuauguga

SEQ ID NO: 248988 - RNA, 22 nt, Homo sapiens
cacuuugguucaccugaguuuc

SEQ ID NO: 248989 - RNA, 22 nt, Homo sapiens
cagacaugucuuguggccgugg

SEQ ID NO: 248990 - RNA, 22 nt, Homo sapiens
cagagcaaugcuuuugcuuuga

SEQ ID NO: 248991 - RNA, 22 nt, Homo sapiens
cagauacucauggaacuggguu

SEQ ID NO: 248992 - RNA, 22 nt, Homo sapiens
cagccgggugagguggcuuguu

SEQ ID NO: 248993 - RNA, 22 nt, Homo sapiens
cagcucauugcagucucgaccu

SEQ ID NO: 248994 - RNA, 22 nt, Homo sapiens
cagcuguguuauaaacuaccau

SEQ ID NO: 248995 - RNA, 23 nt, Homo sapiens
cagcuucauugaacauaacuccu

SEQ ID NO: 248996 - RNA, 22 nt, Homo sapiens
caggcagucuggcucccaagug

SEQ ID NO: 248997 - RNA, 22 nt, Homo sapiens
cagggcauuggcugguaccugg

SEQ ID NO: 248998 - RNA, 22 nt, Homo sapiens
cagguauagucacuugcccaag

SEQ ID NO: 248999 - RNA, 22 nt, Homo sapiens
caggugaaugccucuccuucug

SEQ ID NO: 249000 - RNA, 22 nt, Homo sapiens
caggugguauuugguuuucugu

SEQ ID NO: 249001 - RNA, 22 nt, Homo sapiens
caguagcaugccucagaaugag

SEQ ID NO: 249002 - RNA, 19 nt, Homo sapiens
caguaucauugcacauagu

SEQ ID NO: 249003 - RNA, 22 nt, Homo sapiens
cagucacagugacaggaugugg

SEQ ID NO: 249004 - RNA, 20 nt, Homo sapiens
cagucaugaagaacugugag

SEQ ID NO: 249005 - RNA, 22 nt, Homo sapiens
cagugcacugggauuauaagug

SEQ ID NO: 249006 - RNA, 20 nt, Homo sapiens
cagugcacuuucccacuggu

SEQ ID NO: 249007 - RNA, 23 nt, Homo sapiens
cagugcauuguggcauucagcau

SEQ ID NO: 249008 - RNA, 22 nt, Homo sapiens
cagugcuuguuauuguucuauu

SEQ ID NO: 249009 - RNA, 22 nt, Homo sapiens
cagugguuuuuagcuugcuggg

SEQ ID NO: 249010 - RNA, 22 nt, Homo sapiens
cauaaaucuuguugaauagcac

SEQ ID NO: 249011 - RNA, 22 nt, Homo sapiens
cauacaagcuacaaucacaaag

SEQ ID NO: 249012 - RNA, 21 nt, Homo sapiens
caucaaauugucauggugggu

SEQ ID NO: 249013 - RNA, 22 nt, Homo sapiens
caucacacuuggauguaagaca

SEQ ID NO: 249014 - RNA, 19 nt, Homo sapiens
caucacagagucuuccauu

SEQ ID NO: 249015 - RNA, 22 nt, Homo sapiens
caucacaucugcaugguaagua

SEQ ID NO: 249016 - RNA, 22 nt, Homo sapiens
caucccugucgucaagucucug

SEQ ID NO: 249017 - RNA, 22 nt, Homo sapiens
caucucauugaauugcugagca

SEQ ID NO: 249018 - RNA, 23 nt, Homo sapiens
caugaacuaguuugcagccauga

SEQ ID NO: 249019 - RNA, 22 nt, Homo sapiens
caugcagcacacaugucugugc

SEQ ID NO: 249020 - RNA, 22 nt, Homo sapiens
caugcauuggucuauuauguga

SEQ ID NO: 249021 - RNA, 22 nt, Homo sapiens
cauggcauuucaagauuuacca

SEQ ID NO: 249022 - RNA, 22 nt, Homo sapiens
cauggcccuggguccauaggaa

SEQ ID NO: 249023 - RNA, 22 nt, Homo sapiens
cauggucaccuuccaaguuauu

SEQ ID NO: 249024 - RNA, 21 nt, Homo sapiens
caugucacugcacucuagccu

SEQ ID NO: 249025 - RNA, 22 nt, Homo sapiens
caugucuuuuaaacauucaacu

SEQ ID NO: 249026 - RNA, 19 nt, Homo sapiens
caugugcacuacuggcuuc

SEQ ID NO: 249027 - RNA, 22 nt, Homo sapiens
cauuaguugaagugcagggaga

SEQ ID NO: 249028 - RNA, 22 nt, Homo sapiens
cauugcacuccaccuuggguaa

SEQ ID NO: 249029 - RNA, 22 nt, Homo sapiens
cauugcacuccacuccugaaca

SEQ ID NO: 249030 - RNA, 22 nt, Homo sapiens
cauugcacuccagccuggcaac

SEQ ID NO: 249031 - RNA, 20 nt, Homo sapiens
cauugcacuccagcuugggc

SEQ ID NO: 249032 - RNA, 22 nt, Homo sapiens
gccauugcacuccagccuaggu

SEQ ID NO: 249033 - RNA, 22 nt, Homo sapiens
gcccuguguuuggguaugguca

SEQ ID NO: 249034 - RNA, 17 nt, Homo sapiens
gcccuuugugccucuuc

SEQ ID NO: 249035 - RNA, 22 nt, Homo sapiens
gcccuuugugucuggcuggggu

SEQ ID NO: 249036 - RNA, 22 nt, Homo sapiens
gccugagaggauaugauccccu

SEQ ID NO: 249037 - RNA, 22 nt, Homo sapiens
gcgagcauuguaggaaguucag

SEQ ID NO: 249038 - RNA, 22 nt, Homo sapiens
gcgcagugggcugugccaucca

SEQ ID NO: 249039 - RNA, 22 nt, Homo sapiens
gcuccauuuuccauuucucuaa

SEQ ID NO: 249040 - RNA, 22 nt, Homo sapiens
gcucguuuuugccucugguugc

SEQ ID NO: 249041 - RNA, 19 nt, Homo sapiens
gcugauguuacauucuugc

SEQ ID NO: 249042 - RNA, 22 nt, Homo sapiens
gcugauguuggccucugggcuu

SEQ ID NO: 249043 - RNA, 22 nt, Homo sapiens
gcugcacuuuaaggcauccccu

SEQ ID NO: 249044 - RNA, 17 nt, Homo sapiens
gcugcauucauguagaa

SEQ ID NO: 249045 - RNA, 22 nt, Homo sapiens
gcugcuguaccagaugugguua

SEQ ID NO: 249046 - RNA, 22 nt, Homo sapiens
gcugcuguuauucaucagaacu

SEQ ID NO: 249047 - RNA, 22 nt, Homo sapiens
gcugcuguuuaguuucuccugg

SEQ ID NO: 249048 - RNA, 22 nt, Homo sapiens
gcugguguugugaaucaggccg

SEQ ID NO: 249049 - RNA, 22 nt, Homo sapiens
gcugucaugagcaacacaugaa

SEQ ID NO: 249050 - RNA, 22 nt, Homo sapiens
gcuguugguaaaaaggacauga

SEQ ID NO: 249051 - RNA, 22 nt, Homo sapiens
gcuucauggaggcugggcgcag

SEQ ID NO: 249052 - RNA, 22 nt, Homo sapiens
gcuuuuggaggaacuuaagauu

SEQ ID NO: 249053 - RNA, 21 nt, Homo sapiens
gcuuuuucggaagucuuuggc

SEQ ID NO: 249054 - RNA, 22 nt, Homo sapiens
ggaaagaucagcuaaauguaag

SEQ ID NO: 249055 - RNA, 22 nt, Homo sapiens
ggaaaguaacccauucucuuac

SEQ ID NO: 249056 - RNA, 19 nt, Homo sapiens
ggaaaugucuauuaagauc

SEQ ID NO: 249057 - RNA, 22 nt, Homo sapiens
ggaaauguuggugucaugaguu

SEQ ID NO: 249058 - RNA, 22 nt, Homo sapiens
ggaaggucaaagggaaagcaga

SEQ ID NO: 249059 - RNA, 22 nt, Homo sapiens
ggaaucugaaccaugggaaugg

SEQ ID NO: 249060 - RNA, 19 nt, Homo sapiens
ggaaugcuauucaaccuuu

SEQ ID NO: 249061 - RNA, 21 nt, Homo sapiens
ggaauuuagggaaugauuuag

SEQ ID NO: 249062 - RNA, 22 nt, Homo sapiens
ggacaaaguauuuucaaaugua

SEQ ID NO: 249063 - RNA, 22 nt, Homo sapiens
ggacagugaaugccacuccucc

SEQ ID NO: 249064 - RNA, 22 nt, Homo sapiens
ggacuagaacugagaaucauau

SEQ ID NO: 249065 - RNA, 22 nt, Homo sapiens
ggacuagaggugaaaagaagac

SEQ ID NO: 249066 - RNA, 22 nt, Homo sapiens
ggacugagaggacuacagugua

SEQ ID NO: 249067 - RNA, 22 nt, Homo sapiens
ggagaugaaaugagcuacuuaa

SEQ ID NO: 249068 - RNA, 22 nt, Homo sapiens
ggagaugauuaugaaucacuua

SEQ ID NO: 249069 - RNA, 22 nt, Homo sapiens
ggagcaaugccucauucucacu

SEQ ID NO: 249070 - RNA, 22 nt, Homo sapiens
ggagcucaucuagcauagaggu

SEQ ID NO: 249071 - RNA, 22 nt, Homo sapiens
ggaggcuaguaaaaagguagaa

SEQ ID NO: 249072 - RNA, 22 nt, Homo sapiens
ggagguaauaaguuccagugua

SEQ ID NO: 249073 - RNA, 20 nt, Homo sapiens
ggagguuguauaaguacauc

SEQ ID NO: 249074 - RNA, 22 nt, Homo sapiens
ggaguaggaaggaaauguuaaa

SEQ ID NO: 249075 - RNA, 22 nt, Homo sapiens
ggagucugauuuuuauguugcu

SEQ ID NO: 249076 - RNA, 23 nt, Homo sapiens
ggaguguaaugacucgaucucgg

SEQ ID NO: 249077 - RNA, 23 nt, Homo sapiens
ggaguguauuggcacgaucucag

SEQ ID NO: 249078 - RNA, 22 nt, Homo sapiens
ggauacauuuuuccuccucuuc

SEQ ID NO: 249079 - RNA, 22 nt, Homo sapiens
ggcaagaaaaugcaauuacugu

SEQ ID NO: 249080 - RNA, 22 nt, Homo sapiens
ggcaagaagaacuauaacuuuu

SEQ ID NO: 249081 - RNA, 22 nt, Homo sapiens
ggcaagaggagauucugcuccc

SEQ ID NO: 249082 - RNA, 19 nt, Homo sapiens
ggcaagaguuguucugugu

SEQ ID NO: 249083 - RNA, 23 nt, Homo sapiens
ggcacggaauucaaagaggcauu

SEQ ID NO: 249084 - RNA, 22 nt, Homo sapiens
ggcacugugaugugagggggua

SEQ ID NO: 249085 - RNA, 22 nt, Homo sapiens
ggcagaauugcugaggaugcua

SEQ ID NO: 249086 - RNA, 22 nt, Homo sapiens
ggcagagucuugcaucuuuaga

SEQ ID NO: 249087 - RNA, 22 nt, Homo sapiens
ggcagaucauuggccucaguuu

SEQ ID NO: 249088 - RNA, 22 nt, Homo sapiens
ggcagcauugccuuugcaguga

SEQ ID NO: 249089 - RNA, 22 nt, Homo sapiens
ggcagcuguguccuucguaagg

SEQ ID NO: 249090 - RNA, 22 nt, Homo sapiens
ggcaguguauuacuuaggguuc

SEQ ID NO: 249091 - RNA, 21 nt, Homo sapiens
ggcaugaauggaaaagugaga

SEQ ID NO: 249092 - RNA, 22 nt, Homo sapiens
ggcaugaggccauaaaaguaag

SEQ ID NO: 249093 - RNA, 23 nt, Homo sapiens
ggcauuguggcucacaucuguaa

SEQ ID NO: 249094 - RNA, 22 nt, Homo sapiens
ggccagaugaucuaugaaggaa

SEQ ID NO: 249095 - RNA, 22 nt, Homo sapiens
ggccagaugcaguggcucacac

SEQ ID NO: 249096 - RNA, 22 nt, Homo sapiens
ggccuguaggguauugguaggg

SEQ ID NO: 249097 - RNA, 22 nt, Homo sapiens
ggcuagagagcucagggauaug

SEQ ID NO: 249098 - RNA, 22 nt, Homo sapiens
ggcugguuuucaguuacugagu

SEQ ID NO: 249099 - RNA, 22 nt, Homo sapiens
ggcuuuggucacacaggggcaa

SEQ ID NO: 249100 - RNA, 22 nt, Homo sapiens
gggaagugugcagaguucucuu

SEQ ID NO: 249101 - RNA, 22 nt, Homo sapiens
gggaaugaagagaaccuuccca

SEQ ID NO: 249102 - RNA, 22 nt, Homo sapiens
gggaugaagcccuaggguuggu

SEQ ID NO: 249103 - RNA, 22 nt, Homo sapiens
gggaugaauuagguauguuuau

SEQ ID NO: 249104 - RNA, 22 nt, Homo sapiens
gggauuguaauacugaguuggu

SEQ ID NO: 249105 - RNA, 22 nt, Homo sapiens
gggcaagaagucuuguaguuuu

SEQ ID NO: 249106 - RNA, 18 nt, Homo sapiens
gggcaaguugccuggcuu

SEQ ID NO: 249107 - RNA, 22 nt, Homo sapiens
gggcaugauggugcacacaugu

SEQ ID NO: 249108 - RNA, 22 nt, Homo sapiens
gggcauugugggcagagggcag

SEQ ID NO: 249109 - RNA, 22 nt, Homo sapiens
gggggagugugguacccagcau

SEQ ID NO: 249110 - RNA, 22 nt, Homo sapiens
ggguaaaucucuuuucauggcu

SEQ ID NO: 249111 - RNA, 17 nt, Homo sapiens
gggucaccuugcaggua

SEQ ID NO: 249112 - RNA, 19 nt, Homo sapiens
gggucaguuugaaugauua

SEQ ID NO: 249113 - RNA, 22 nt, Homo sapiens
gggugguuuuaucucuucccuu

SEQ ID NO: 249114 - RNA, 22 nt, Homo sapiens
ggguucaaaucuuggcucuuac

SEQ ID NO: 249115 - RNA, 22 nt, Homo sapiens
ggguucccuucuggcucagggu

SEQ ID NO: 249116 - RNA, 22 nt, Homo sapiens
gguagacaucgugcucugugau

SEQ ID NO: 249117 - RNA, 22 nt, Homo sapiens
ggucaagcuagauuuuaaugau

SEQ ID NO: 249118 - RNA, 22 nt, Homo sapiens
ggucagauggcagcugggccug

SEQ ID NO: 249119 - RNA, 19 nt, Homo sapiens
ggucagcaaagucuagcug

SEQ ID NO: 249120 - RNA, 22 nt, Homo sapiens
ggucaguguuaucaccgaagga

SEQ ID NO: 249121 - RNA, 22 nt, Homo sapiens
ggugacugguuuaucuggcagu

SEQ ID NO: 249122 - RNA, 22 nt, Homo sapiens
ggugagauaucugcugauguuu

SEQ ID NO: 249123 - RNA, 22 nt, Homo sapiens
ggugaggaaaguugaguuucua

SEQ ID NO: 249124 - RNA, 22 nt, Homo sapiens
ggugagguaguaagguacaaua

SEQ ID NO: 249125 - RNA, 22 nt, Homo sapiens
ggugcagcacaccaacauggca

SEQ ID NO: 249126 - RNA, 22 nt, Homo sapiens
guaaauaccaguuucuggaaca

SEQ ID NO: 249127 - RNA, 22 nt, Homo sapiens
guaacacucuaaagggaugcac

SEQ ID NO: 249128 - RNA, 22 nt, Homo sapiens
guaacagucucaacaguggucu

SEQ ID NO: 249129 - RNA, 22 nt, Homo sapiens
guaacugguuuucuucccucuc

SEQ ID NO: 249130 - RNA, 22 nt, Homo sapiens
guaaguauuaggugugagauuc

SEQ ID NO: 249131 - RNA, 23 nt, Homo sapiens
guaauacuagucauaguagcagg

SEQ ID NO: 249132 - RNA, 22 nt, Homo sapiens
guaauacuuuugggauauuaga

SEQ ID NO: 249133 - RNA, 22 nt, Homo sapiens
guaaugcacucccaaagaucca

SEQ ID NO: 249134 - RNA, 22 nt, Homo sapiens
guacacauacauauaugugugu

SEQ ID NO: 249135 - RNA, 22 nt, Homo sapiens
guacaggcagcaaacaccauaa

SEQ ID NO: 249136 - RNA, 22 nt, Homo sapiens
guacaguaguaaaagugaauga

SEQ ID NO: 249137 - RNA, 22 nt, Homo sapiens
guacauagucacacauauacau

SEQ ID NO: 249138 - RNA, 22 nt, Homo sapiens
guagaauguauacaguauacag

SEQ ID NO: 249139 - RNA, 22 nt, Homo sapiens
guagggcaggcugagaaauaua

SEQ ID NO: 249140 - RNA, 22 nt, Homo sapiens
guauacaugucaaaacucacau

SEQ ID NO: 249141 - RNA, 22 nt, Homo sapiens
guaugacacaggaagcuuaacc

SEQ ID NO: 249142 - RNA, 22 nt, Homo sapiens
guaugauacuguaacagugggu

SEQ ID NO: 249143 - RNA, 22 nt, Homo sapiens
guauugccacuuuugaacaguu

SEQ ID NO: 249144 - RNA, 22 nt, Homo sapiens
gucaagugaagaccugacucuu

SEQ ID NO: 249145 - RNA, 22 nt, Homo sapiens
gucacagaggcuaagaccccac

SEQ ID NO: 249146 - RNA, 22 nt, Homo sapiens
gucacagcuggcauugucugca

SEQ ID NO: 249147 - RNA, 22 nt, Homo sapiens
gucacaggaaacuaauaugcgc

SEQ ID NO: 249148 - RNA, 22 nt, Homo sapiens
gucacugagcaauagaaaguuu

SEQ ID NO: 249149 - RNA, 22 nt, Homo sapiens
gucacugagcagaaggaagcga

SEQ ID NO: 249150 - RNA, 22 nt, Homo sapiens
gucacugccugaggcugaugca

SEQ ID NO: 249151 - RNA, 22 nt, Homo sapiens
gucacugggugcugcgccuguc

SEQ ID NO: 249152 - RNA, 22 nt, Homo sapiens
gucacuguggagaagaaagugg

SEQ ID NO: 249153 - RNA, 22 nt, Homo sapiens
gucagaaucucagaugacaacg

SEQ ID NO: 249154 - RNA, 22 nt, Homo sapiens
gucagagcacugaguugugggc

SEQ ID NO: 249155 - RNA, 22 nt, Homo sapiens
gucagcaaaguucuccugcaga

SEQ ID NO: 249156 - RNA, 22 nt, Homo sapiens
gucagggagggauagaugauua

SEQ ID NO: 249157 - RNA, 22 nt, Homo sapiens
gucaguuucacucagcuggaac

SEQ ID NO: 249158 - RNA, 22 nt, Homo sapiens
gucaucaggacgggucaucugc

SEQ ID NO: 249159 - RNA, 22 nt, Homo sapiens
gucauccaggcuggagugaagc

SEQ ID NO: 249160 - RNA, 22 nt, Homo sapiens
gucauggacaaggugugagcca

SEQ ID NO: 249161 - RNA, 22 nt, Homo sapiens
gucauugcacuccagccuggac

SEQ ID NO: 249162 - RNA, 22 nt, Homo sapiens
guccaagacuaggaguuggcag

SEQ ID NO: 249163 - RNA, 20 nt, Homo sapiens
guccauuugcugccauugcu

SEQ ID NO: 249164 - RNA, 18 nt, Homo sapiens
guccauuuguugguacac

SEQ ID NO: 249165 - RNA, 22 nt, Homo sapiens
guccauuuguuuccagagcacu

SEQ ID NO: 249166 - RNA, 22 nt, Homo sapiens
gucccagagauauugugucuuu

SEQ ID NO: 249167 - RNA, 22 nt, Homo sapiens
gucccaguggaaccuccaagcu

SEQ ID NO: 249168 - RNA, 22 nt, Homo sapiens
gucuaguuuuaauacauuaaga

SEQ ID NO: 249169 - RNA, 22 nt, Homo sapiens
gucuaugagucccugaauuuaa

SEQ ID NO: 249170 - RNA, 22 nt, Homo sapiens
gucucacaggcaugaugccagc

SEQ ID NO: 249171 - RNA, 22 nt, Homo sapiens
gucucccaaccccugugcccag

SEQ ID NO: 249172 - RNA, 22 nt, Homo sapiens
gucugagcauggggccggcagg

SEQ ID NO: 249173 - RNA, 22 nt, Homo sapiens
gucugcaugucauaugauagua

SEQ ID NO: 249174 - RNA, 22 nt, Homo sapiens
gucuggcacagggaaaguacaa

SEQ ID NO: 249175 - RNA, 22 nt, Homo sapiens
gucuggcuccugucuaaucacu

SEQ ID NO: 249176 - RNA, 22 nt, Homo sapiens
gucugguuuuuuauauccucac

SEQ ID NO: 249177 - RNA, 22 nt, Homo sapiens
gucugucuuuugucuuugaaau

SEQ ID NO: 249178 - RNA, 22 nt, Homo sapiens
gucuguuugauccagaucaaaa

SEQ ID NO: 249179 - RNA, 22 nt, Homo sapiens
gucuguuuggggaccuguggcc

SEQ ID NO: 249180 - RNA, 22 nt, Homo sapiens
gucuuagguuuaaucacuucua

SEQ ID NO: 249181 - RNA, 22 nt, Homo sapiens
gucuuccagccuccaucuuucu

SEQ ID NO: 249182 - RNA, 22 nt, Homo sapiens
gucuuuggaaagacaaaguuca

SEQ ID NO: 249183 - RNA, 22 nt, Homo sapiens
gugaaaagaugagcaccauaca

SEQ ID NO: 249184 - RNA, 22 nt, Homo sapiens
gugaaagacagcauuaauggcu

SEQ ID NO: 249185 - RNA, 22 nt, Homo sapiens
gugaaagauuaaaccagugugu

SEQ ID NO: 249186 - RNA, 22 nt, Homo sapiens
gugaaauguguagaggaucugg

SEQ ID NO: 249187 - RNA, 20 nt, Homo sapiens
gugaauacauuugguuucau

SEQ ID NO: 249188 - RNA, 22 nt, Homo sapiens
gugaauguaaagucaugugacu

SEQ ID NO: 249189 - RNA, 22 nt, Homo sapiens
gugaauguuuucuuacauggua

SEQ ID NO: 249190 - RNA, 22 nt, Homo sapiens
gugacauuuuuacugaugagag

SEQ ID NO: 249191 - RNA, 22 nt, Homo sapiens
gugaccagaugggcaggggugu

SEQ ID NO: 249192 - RNA, 22 nt, Homo sapiens
gugaccucauuacggggccugc

SEQ ID NO: 249193 - RNA, 22 nt, Homo sapiens
gugagaagaaaaauauggcugu

SEQ ID NO: 249194 - RNA, 18 nt, Homo sapiens
gugagaaugacuguucug

SEQ ID NO: 249195 - RNA, 22 nt, Homo sapiens
gugagauacuagagauauagug

SEQ ID NO: 249196 - RNA, 22 nt, Homo sapiens
gugagaugauggguauguuaau

SEQ ID NO: 249197 - RNA, 22 nt, Homo sapiens
gugagaugugacuucugccucu

SEQ ID NO: 249198 - RNA, 22 nt, Homo sapiens
gugagcagagaucgcgugauug

SEQ ID NO: 249199 - RNA, 22 nt, Homo sapiens
gugagcuccucuucugcugcag

SEQ ID NO: 249200 - RNA, 22 nt, Homo sapiens
gugaggaaggaaaccugcuagc

SEQ ID NO: 249201 - RNA, 21 nt, Homo sapiens
gugaggaguuacuggcuuuga

SEQ ID NO: 249202 - RNA, 22 nt, Homo sapiens
gugaggcuuuuccuguuagacu

SEQ ID NO: 249203 - RNA, 22 nt, Homo sapiens
gugagggaugugaaaaagguca

SEQ ID NO: 249204 - RNA, 22 nt, Homo sapiens
gugaggucagggcuguggacag

SEQ ID NO: 249205 - RNA, 22 nt, Homo sapiens
gugagguguuaaccaaccugug

SEQ ID NO: 249206 - RNA, 22 nt, Homo sapiens
gugagucagucuguguagggcu

SEQ ID NO: 249207 - RNA, 22 nt, Homo sapiens
gugauacugcuuauuaauuuaa

SEQ ID NO: 249208 - RNA, 21 nt, Homo sapiens
gugcaaacaucauagaaugua

SEQ ID NO: 249209 - RNA, 22 nt, Homo sapiens
gugcaaccaucaccacugacuc

SEQ ID NO: 249210 - RNA, 22 nt, Homo sapiens
gugcaaugaguguggcaaagcc

SEQ ID NO: 249211 - RNA, 22 nt, Homo sapiens
gugcacaacaugcagguuuguu

SEQ ID NO: 249212 - RNA, 22 nt, Homo sapiens
gugcacaacgugcaggcuuguu

SEQ ID NO: 249213 - RNA, 22 nt, Homo sapiens
gugcacaacgugcagguuuguu

SEQ ID NO: 249214 - RNA, 22 nt, Homo sapiens
gugcacaaugugcagguuuguu

SEQ ID NO: 249215 - RNA, 22 nt, Homo sapiens
gugcacauuguuuaugucuguu

SEQ ID NO: 249216 - RNA, 22 nt, Homo sapiens
gugcauguccacuaguccauau

SEQ ID NO: 249217 - RNA, 22 nt, Homo sapiens
gugcaugucuaugcgagucuaa

SEQ ID NO: 249218 - RNA, 22 nt, Homo sapiens
gugcuauguuauccagcaagau

SEQ ID NO: 249219 - RNA, 22 nt, Homo sapiens
gugcuuuguuguggcaguggca

SEQ ID NO: 249220 - RNA, 22 nt, Homo sapiens
guggaagguaaugcagcuuacu

SEQ ID NO: 249221 - RNA, 20 nt, Homo sapiens
guggaaguagaaacauaugu

SEQ ID NO: 249222 - RNA, 22 nt, Homo sapiens
guggaagugucuggggccaggg

SEQ ID NO: 249223 - RNA, 22 nt, Homo sapiens
guggaaugaaaacucucucaca

SEQ ID NO: 249224 - RNA, 22 nt, Homo sapiens
guggagacaaaggcugagugag

SEQ ID NO: 249225 - RNA, 22 nt, Homo sapiens
guggagcuguguggccuugggc

SEQ ID NO: 249226 - RNA, 22 nt, Homo sapiens
guggaggacuggauaaagaaaa

SEQ ID NO: 249227 - RNA, 22 nt, Homo sapiens
guggcaagaauguacaaaaggu

SEQ ID NO: 249228 - RNA, 22 nt, Homo sapiens
guggcaaggaaaugcugcucac

SEQ ID NO: 249229 - RNA, 22 nt, Homo sapiens
guggcagagucagagggaaaug

SEQ ID NO: 249230 - RNA, 22 nt, Homo sapiens
guggcaugaaagcaucugugau

SEQ ID NO: 249231 - RNA, 22 nt, Homo sapiens
guggcauuucccaaaguauucu

SEQ ID NO: 249232 - RNA, 22 nt, Homo sapiens
guggcuuuauuuagaagcaggg

SEQ ID NO: 249233 - RNA, 22 nt, Homo sapiens
gugggauauaaucaguccugua

SEQ ID NO: 249234 - RNA, 22 nt, Homo sapiens
gugggauggaaaugggcuucag

SEQ ID NO: 249235 - RNA, 22 nt, Homo sapiens
gugguacuaucuuugguuucag

SEQ ID NO: 249236 - RNA, 22 nt, Homo sapiens
guggugucuuguuuaauauaua

SEQ ID NO: 249237 - RNA, 22 nt, Homo sapiens
gugguuuuaauauucagucuag

SEQ ID NO: 249238 - RNA, 22 nt, Homo sapiens
guguaaaugagugcugaaggag

SEQ ID NO: 249239 - RNA, 22 nt, Homo sapiens
guguaauacauuagcaaaccaa

SEQ ID NO: 249240 - RNA, 22 nt, Homo sapiens
guguaugugagaaugcucaugu

SEQ ID NO: 249241 - RNA, 22 nt, Homo sapiens
guguauucaucuggcugaggua

SEQ ID NO: 249242 - RNA, 22 nt, Homo sapiens
guguccucgaguacacaucagg

SEQ ID NO: 249243 - RNA, 22 nt, Homo sapiens
gugucuccuguggagcuaugua

SEQ ID NO: 249244 - RNA, 23 nt, Homo sapiens
gugugguaggcuauaccaucuag

SEQ ID NO: 249245 - RNA, 22 nt, Homo sapiens
guguucaaacccaggucugucu

SEQ ID NO: 249246 - RNA, 22 nt, Homo sapiens
guguugcacauucuguggaugu

SEQ ID NO: 249247 - RNA, 22 nt, Homo sapiens
guguuugauugcaaauaaucua

SEQ ID NO: 249248 - RNA, 22 nt, Homo sapiens
guuaaagacauccacauaggag

SEQ ID NO: 249249 - RNA, 22 nt, Homo sapiens
guuauguuaguuacaaggcuag

SEQ ID NO: 249250 - RNA, 22 nt, Homo sapiens
guuauguuauguuauguuaugu

SEQ ID NO: 249251 - RNA, 22 nt, Homo sapiens
guuauuaguugauauuaaguuc

SEQ ID NO: 249252 - RNA, 22 nt, Homo sapiens
guuauuguccauuuauuuagca

SEQ ID NO: 249253 - RNA, 22 nt, Homo sapiens
guucaaguuuucucuugugggu

SEQ ID NO: 249254 - RNA, 22 nt, Homo sapiens
guucaguaguucauucauuuau

SEQ ID NO: 249255 - RNA, 22 nt, Homo sapiens
guucaguuuugaaauguuaauu

SEQ ID NO: 249256 - RNA, 22 nt, Homo sapiens
guucaucaggcuuucucuagag

SEQ ID NO: 249257 - RNA, 22 nt, Homo sapiens
guucucacuggugcugguaagu

SEQ ID NO: 249258 - RNA, 22 nt, Homo sapiens
guucuggagauaaagccaaggu

SEQ ID NO: 249259 - RNA, 20 nt, Homo sapiens
guucuugcucguguaucuuc

SEQ ID NO: 249260 - RNA, 22 nt, Homo sapiens
guugaaaucaucacuuggcaug

SEQ ID NO: 249261 - RNA, 22 nt, Homo sapiens
guugaucuauguugcuggcagu

SEQ ID NO: 249262 - RNA, 22 nt, Homo sapiens
guugccuaggcuggagugcagu

SEQ ID NO: 249263 - RNA, 22 nt, Homo sapiens
guugcucaggccggagugcagu

SEQ ID NO: 249264 - RNA, 22 nt, Homo sapiens
guugcucaggcuggagugcagu

SEQ ID NO: 249265 - RNA, 22 nt, Homo sapiens
guugggcccauagacugccagu

SEQ ID NO: 249266 - RNA, 22 nt, Homo sapiens
guuggguaauggggcgcaccgu

SEQ ID NO: 249267 - RNA, 22 nt, Homo sapiens
guugguuuccuguaacuggaca

SEQ ID NO: 249268 - RNA, 22 nt, Homo sapiens
guuuaacugguacuucaagucu

SEQ ID NO: 249269 - RNA, 22 nt, Homo sapiens
guuuaggaaugagaauauuuag

SEQ ID NO: 249270 - RNA, 22 nt, Homo sapiens
guuugcacuccuaugagaaucu

SEQ ID NO: 249271 - RNA, 22 nt, Homo sapiens
guuugcauagugcugggagggg

SEQ ID NO: 249272 - RNA, 22 nt, Homo sapiens
guuugguugcauggaaaauuua

SEQ ID NO: 249273 - RNA, 15 nt, Homo sapiens
guuuuuggauacaau

SEQ ID NO: 249274 - RNA, 22 nt, Homo sapiens
guuuuuggggucacuauuaccg

SEQ ID NO: 249275 - RNA, 21 nt, Homo sapiens
uaaaacuguaacuuuguccug

SEQ ID NO: 249276 - RNA, 22 nt, Homo sapiens
uaaaccuagcauuuugcauaug

SEQ ID NO: 249277 - RNA, 22 nt, Homo sapiens
uaaagagcuuuugaggugucau

SEQ ID NO: 249278 - RNA, 17 nt, Homo sapiens
uaaagccagucaaguca

SEQ ID NO: 249279 - RNA, 21 nt, Homo sapiens
uaaagcuagaaccuuagcuuu

SEQ ID NO: 249280 - RNA, 21 nt, Homo sapiens
uaaagcuuagcuauaguggcu

SEQ ID NO: 249281 - RNA, 21 nt, Homo sapiens
uaaaggcuccaauuauacccc

SEQ ID NO: 249282 - RNA, 22 nt, Homo sapiens
uaaagugaggauggcaguaggu

SEQ ID NO: 249283 - RNA, 22 nt, Homo sapiens
uaaauggauaaaugaauaccua

SEQ ID NO: 249284 - RNA, 22 nt, Homo sapiens
uaaauugcauaaguacaaauga

SEQ ID NO: 249285 - RNA, 22 nt, Homo sapiens
uaacaacauucuaacugacggc

SEQ ID NO: 249286 - RNA, 19 nt, Homo sapiens
uaacacaguuguguuugag

SEQ ID NO: 249287 - RNA, 22 nt, Homo sapiens
uaacagcauuugugucuaguag

SEQ ID NO: 249288 - RNA, 22 nt, Homo sapiens
uaacagucaagguuugaccagg

SEQ ID NO: 249289 - RNA, 22 nt, Homo sapiens
uaacauagucauauacuugcuu

SEQ ID NO: 249290 - RNA, 22 nt, Homo sapiens
uaacuccauuuggacucaguau

SEQ ID NO: 249291 - RNA, 22 nt, Homo sapiens
uaacugucucaggccaugggcg

SEQ ID NO: 249292 - RNA, 22 nt, Homo sapiens
uaacuucaucauaagucaagaa

SEQ ID NO: 249293 - RNA, 22 nt, Homo sapiens
uaagacacuuaaaauguuacau

SEQ ID NO: 249294 - RNA, 21 nt, Homo sapiens
uaagacugccaguagggcugu

SEQ ID NO: 249295 - RNA, 22 nt, Homo sapiens
uaagagcuaggauuuuaaauca

SEQ ID NO: 249296 - RNA, 22 nt, Homo sapiens
uaagaugaaggcucaccuagaa

SEQ ID NO: 249297 - RNA, 21 nt, Homo sapiens
uaagcuaaacauucaguuaac

SEQ ID NO: 249298 - RNA, 22 nt, Homo sapiens
uaaggaguagaauaguaaggca

SEQ ID NO: 249299 - RNA, 22 nt, Homo sapiens
uaaggcacccuucugaguagag

SEQ ID NO: 249300 - RNA, 22 nt, Homo sapiens
uaaggcacuacuuuaggcuuuc

SEQ ID NO: 249301 - RNA, 20 nt, Homo sapiens
uaaggcacugugcuuuuagg

SEQ ID NO: 249302 - RNA, 22 nt, Homo sapiens
uaaggcccauucuaugaagcag

SEQ ID NO: 249303 - RNA, 22 nt, Homo sapiens
uaaggcccggccuuuccaagca

SEQ ID NO: 249304 - RNA, 22 nt, Homo sapiens
uaaggcuuugcuggacucaguc

SEQ ID NO: 249305 - RNA, 22 nt, Homo sapiens
uaaggcuuugguagguuugguc

SEQ ID NO: 249306 - RNA, 22 nt, Homo sapiens
uaaguaaaugaaagguugauuu

SEQ ID NO: 249307 - RNA, 22 nt, Homo sapiens
uaaguaauuuguauuuuaccca

SEQ ID NO: 249308 - RNA, 22 nt, Homo sapiens
uaaguagaggaaucauuuugug

SEQ ID NO: 249309 - RNA, 19 nt, Homo sapiens
uaaguagaugacugaugcu

SEQ ID NO: 249310 - RNA, 22 nt, Homo sapiens
uaaguaguccugauuuaaccuu

SEQ ID NO: 249311 - RNA, 22 nt, Homo sapiens
uaagugaauauggacaguuagc

SEQ ID NO: 249312 - RNA, 22 nt, Homo sapiens
uaagugaauuucacuacugagu

SEQ ID NO: 249313 - RNA, 20 nt, Homo sapiens
uaagugcuuuauauugauua

SEQ ID NO: 249314 - RNA, 22 nt, Homo sapiens
uaauacucuucucauuuuacag

SEQ ID NO: 249315 - RNA, 22 nt, Homo sapiens
uaauagcucggauaaacaugau

SEQ ID NO: 249316 - RNA, 22 nt, Homo sapiens
uaauccuggcacuuugggaggc

SEQ ID NO: 249317 - RNA, 22 nt, Homo sapiens
uaaugcuccauggguuauuaaa

SEQ ID NO: 249318 - RNA, 22 nt, Homo sapiens
uaaugcuguggucuaaugggga

SEQ ID NO: 249319 - RNA, 22 nt, Homo sapiens
uacaaagugggaaacgaagguu

SEQ ID NO: 249320 - RNA, 22 nt, Homo sapiens
uacaaaucuagguuuguuacug

SEQ ID NO: 249321 - RNA, 22 nt, Homo sapiens
uacaacacugguucgacaugug

SEQ ID NO: 249322 - RNA, 22 nt, Homo sapiens
uacaagcacaggcagcaggcug

SEQ ID NO: 249323 - RNA, 21 nt, Homo sapiens
uacaagcuguagcacaugcca

SEQ ID NO: 249324 - RNA, 22 nt, Homo sapiens
uacaccauuugauucuuuaagc

SEQ ID NO: 249325 - RNA, 22 nt, Homo sapiens
uacacgugcacaacgugcacgu

SEQ ID NO: 249326 - RNA, 18 nt, Homo sapiens
uacagaacuggaguagaa

SEQ ID NO: 249327 - RNA, 22 nt, Homo sapiens
uacagccacauaauguaugauu

SEQ ID NO: 249328 - RNA, 22 nt, Homo sapiens
uacagcuaugugcaugcaugcu

SEQ ID NO: 249329 - RNA, 22 nt, Homo sapiens
uacaggacuucucagaguuauu

SEQ ID NO: 249330 - RNA, 22 nt, Homo sapiens
uacaggcaccuggcuaauuuuu

SEQ ID NO: 249331 - RNA, 22 nt, Homo sapiens
uacagguaugugucuauauaca

SEQ ID NO: 249332 - RNA, 22 nt, Homo sapiens
uacaguacacagguaccaagcu

SEQ ID NO: 249333 - RNA, 22 nt, Homo sapiens
uacagucuagaggagaaucagg

SEQ ID NO: 249334 - RNA, 22 nt, Homo sapiens
uacagugggcacuggcgcccug

SEQ ID NO: 249335 - RNA, 22 nt, Homo sapiens
uacauccauccugcugggcagu

SEQ ID NO: 249336 - RNA, 22 nt, Homo sapiens
uacauguauccauuguuuuugg

SEQ ID NO: 249337 - RNA, 22 nt, Homo sapiens
uacaugugcacaacgugcaggu

SEQ ID NO: 249338 - RNA, 22 nt, Homo sapiens
uaccacaggcuggguaaucuau

SEQ ID NO: 249339 - RNA, 22 nt, Homo sapiens
uaccucagccaaugcccagaag

SEQ ID NO: 249340 - RNA, 22 nt, Homo sapiens
uaccugagacaacuuugaggaa

SEQ ID NO: 249341 - RNA, 22 nt, Homo sapiens
uaccugagucuagagucuagaa

SEQ ID NO: 249342 - RNA, 22 nt, Homo sapiens
uacuacuuucugacaucuuuaa

SEQ ID NO: 249343 - RNA, 22 nt, Homo sapiens
uacuagaaccuuauucagagug

SEQ ID NO: 249344 - RNA, 23 nt, Homo sapiens
uacuaguaagcguguucuuugca

SEQ ID NO: 249345 - RNA, 22 nt, Homo sapiens
uacugcacuccaaccugagaga

SEQ ID NO: 249346 - RNA, 22 nt, Homo sapiens
uacugcacuccacccuggguga

SEQ ID NO: 249347 - RNA, 22 nt, Homo sapiens
uacugcacuccagcuuaggaga

SEQ ID NO: 249348 - RNA, 22 nt, Homo sapiens
uacugcacuccaggcucaccug

SEQ ID NO: 249349 - RNA, 20 nt, Homo sapiens
uacugcacuccauccugggu

SEQ ID NO: 249350 - RNA, 22 nt, Homo sapiens
uacugcacucuagccuggguga

SEQ ID NO: 249351 - RNA, 22 nt, Homo sapiens
uacugcacuugaccuccugggc

SEQ ID NO: 249352 - RNA, 20 nt, Homo sapiens
uacugcacuuuccucauggu

SEQ ID NO: 249353 - RNA, 22 nt, Homo sapiens
uacuggccccaaaguagguagu

SEQ ID NO: 249354 - RNA, 22 nt, Homo sapiens
uagaacauuccaggugauguug

SEQ ID NO: 249355 - RNA, 22 nt, Homo sapiens
uagaagcuacucuucuuguggc

SEQ ID NO: 249356 - RNA, 22 nt, Homo sapiens
uagaauggaaggcauguuugcc

SEQ ID NO: 249357 - RNA, 22 nt, Homo sapiens
uagaauguaacaguuaaaagca

SEQ ID NO: 249358 - RNA, 22 nt, Homo sapiens
uagaaugucagcuucuugaggg

SEQ ID NO: 249359 - RNA, 23 nt, Homo sapiens
uagaauguuuuuccauguuucuu

SEQ ID NO: 249360 - RNA, 22 nt, Homo sapiens
uagacacuagauaugugacuga

SEQ ID NO: 249361 - RNA, 20 nt, Homo sapiens
uagacagcuagauuagauag

SEQ ID NO: 249362 - RNA, 22 nt, Homo sapiens
uagacugguuuagcacugaaua

SEQ ID NO: 249363 - RNA, 21 nt, Homo sapiens
uagagagcaauaccuccagag

SEQ ID NO: 249364 - RNA, 21 nt, Homo sapiens
uagagcaacacacgcccucuc

SEQ ID NO: 249365 - RNA, 22 nt, Homo sapiens
uagagcuaguuuuuaaucuaac

SEQ ID NO: 249366 - RNA, 22 nt, Homo sapiens
uagagcuugacacuuuccaugg

SEQ ID NO: 249367 - RNA, 21 nt, Homo sapiens
uagagcuuggcacagaguaga

SEQ ID NO: 249368 - RNA, 22 nt, Homo sapiens
uagaggaaugaauuuggccaga

SEQ ID NO: 249369 - RNA, 22 nt, Homo sapiens
uagagguucuaagauucucaga

SEQ ID NO: 249370 - RNA, 22 nt, Homo sapiens
uagaguguuuuguuaggcagca

SEQ ID NO: 249371 - RNA, 22 nt, Homo sapiens
uagaucauauacuugccaugac

SEQ ID NO: 249372 - RNA, 20 nt, Homo sapiens
uagaugcauuuagauucauu

SEQ ID NO: 249373 - RNA, 22 nt, Homo sapiens
uagauuaucauucauacaggga

SEQ ID NO: 249374 - RNA, 22 nt, Homo sapiens
uagauuguuuaaguggcacaca

SEQ ID NO: 249375 - RNA, 17 nt, Homo sapiens
uagcacagugccuggua

SEQ ID NO: 249376 - RNA, 22 nt, Homo sapiens
uagcacagugucauucuaggua

SEQ ID NO: 249377 - RNA, 22 nt, Homo sapiens
uagcacccucuccuaguccugc

SEQ ID NO: 249378 - RNA, 22 nt, Homo sapiens
uagcacuaucuauugcaugcaa

SEQ ID NO: 249379 - RNA, 22 nt, Homo sapiens
uagcagaauaacuugccagccu

SEQ ID NO: 249380 - RNA, 22 nt, Homo sapiens
uagcagcaccccacucuacugg

SEQ ID NO: 249381 - RNA, 19 nt, Homo sapiens
uagcagcaugauuuauaau

SEQ ID NO: 249382 - RNA, 22 nt, Homo sapiens
uagcagcuuuauugagguaaau

SEQ ID NO: 249383 - RNA, 20 nt, Homo sapiens
uagcaggugucaggugauau

SEQ ID NO: 249384 - RNA, 22 nt, Homo sapiens
uagcaguauacguacugggucc

SEQ ID NO: 249385 - RNA, 22 nt, Homo sapiens
uagcaguauaugagagcuauug

SEQ ID NO: 249386 - RNA, 22 nt, Homo sapiens
uagcagugugaaaacagacuaa

SEQ ID NO: 249387 - RNA, 22 nt, Homo sapiens
uagcaucaauucauguuaugau

SEQ ID NO: 249388 - RNA, 22 nt, Homo sapiens
uagcuaaauucagcucuaggua

SEQ ID NO: 249389 - RNA, 19 nt, Homo sapiens
uagcuagauuggguacuua

SEQ ID NO: 249390 - RNA, 21 nt, Homo sapiens
uagcucagugguguugccaua

SEQ ID NO: 249391 - RNA, 17 nt, Homo sapiens
uagcucuauuucuagcc

SEQ ID NO: 249392 - RNA, 22 nt, Homo sapiens
uagcugcacuuacaagugagaa

SEQ ID NO: 249393 - RNA, 22 nt, Homo sapiens
uagcugcauccugugcacucaa

SEQ ID NO: 249394 - RNA, 22 nt, Homo sapiens
uagcugcccagcacgaaguugg

SEQ ID NO: 249395 - RNA, 17 nt, Homo sapiens
uagcuucacauuaggaa

SEQ ID NO: 249396 - RNA, 22 nt, Homo sapiens
uaggcacacaucuacuacaaau

SEQ ID NO: 249397 - RNA, 22 nt, Homo sapiens
uaggcaguguucucacuuguaa

SEQ ID NO: 249398 - RNA, 22 nt, Homo sapiens
uagggcauguguggaguguaug

SEQ ID NO: 249399 - RNA, 19 nt, Homo sapiens
uagguacauucaagucucc

SEQ ID NO: 249400 - RNA, 22 nt, Homo sapiens
uagguacuuaagaucucagcua

SEQ ID NO: 249401 - RNA, 22 nt, Homo sapiens
uagguacuuuacauguuaucuc

SEQ ID NO: 249402 - RNA, 22 nt, Homo sapiens
uagguuaugauccaucuuggcu

SEQ ID NO: 249403 - RNA, 22 nt, Homo sapiens
uagguuauucauucaucauuua

SEQ ID NO: 249404 - RNA, 22 nt, Homo sapiens
uaguaacacauugaacgaucgc

SEQ ID NO: 249405 - RNA, 22 nt, Homo sapiens
uaguaucacauggucuuaauua

SEQ ID NO: 249406 - RNA, 20 nt, Homo sapiens
uagucaugagauucuccaag

SEQ ID NO: 249407 - RNA, 22 nt, Homo sapiens
uagugcaguggcuccaucucag

SEQ ID NO: 249408 - RNA, 22 nt, Homo sapiens
uagugcugugauaaacauauau

SEQ ID NO: 249409 - RNA, 22 nt, Homo sapiens
uagugcugugauuaacauaaug

SEQ ID NO: 249410 - RNA, 22 nt, Homo sapiens
uaguugcauuggcugcuaugcu

SEQ ID NO: 249411 - RNA, 22 nt, Homo sapiens
uaguuuaucuucuggauggaca

SEQ ID NO: 249412 - RNA, 22 nt, Homo sapiens
uauagcacugcaauauuucccu

SEQ ID NO: 249413 - RNA, 17 nt, Homo sapiens
uauagcacuucucacau

SEQ ID NO: 249414 - RNA, 22 nt, Homo sapiens
uauagcuaugggauguauuugc

SEQ ID NO: 249415 - RNA, 21 nt, Homo sapiens
uauaguaguaugauuuacaau

SEQ ID NO: 249416 - RNA, 22 nt, Homo sapiens
uauaugcuaaacaagggguggg

SEQ ID NO: 249417 - RNA, 22 nt, Homo sapiens
uauaugucuucuuguaauuggc

SEQ ID NO: 249418 - RNA, 22 nt, Homo sapiens
uauauguuuucauaaggcuaga

SEQ ID NO: 249419 - RNA, 22 nt, Homo sapiens
uaucaaguuggaagagaaguaa

SEQ ID NO: 249420 - RNA, 22 nt, Homo sapiens
uaucacagaggguauccuagag

SEQ ID NO: 249421 - RNA, 22 nt, Homo sapiens
uaucacagauauuaugggccaa

SEQ ID NO: 249422 - RNA, 22 nt, Homo sapiens
uaucacaguugcauauuuaagg

SEQ ID NO: 249423 - RNA, 22 nt, Homo sapiens
uaucacccuuucauuguucuuc

SEQ ID NO: 249424 - RNA, 22 nt, Homo sapiens
uaucaugucuguguguaccuag

SEQ ID NO: 249425 - RNA, 22 nt, Homo sapiens
uaucucagagaaucagauuuac

SEQ ID NO: 249426 - RNA, 20 nt, Homo sapiens
uaucucaguuuguccuaaac

SEQ ID NO: 249427 - RNA, 19 nt, Homo sapiens
uaugagcuaugacaugcau

SEQ ID NO: 249428 - RNA, 22 nt, Homo sapiens
uaugaucauuauguuauugcag

SEQ ID NO: 249429 - RNA, 22 nt, Homo sapiens
uaugaugcuguuuagaaucucu

SEQ ID NO: 249430 - RNA, 22 nt, Homo sapiens
uaugcacuauagcauauguggu

SEQ ID NO: 249431 - RNA, 23 nt, Homo sapiens
uaugccuguuucaaacaaacuuu

SEQ ID NO: 249432 - RNA, 19 nt, Homo sapiens
uaugcuauuuauuagaagu

SEQ ID NO: 249433 - RNA, 22 nt, Homo sapiens
uaugcuuguuuauuuaagaaac

SEQ ID NO: 249434 - RNA, 22 nt, Homo sapiens
uauggaaaucuuaccuuauggu

SEQ ID NO: 249435 - RNA, 22 nt, Homo sapiens
uauggccacugucuuugaguca

SEQ ID NO: 249436 - RNA, 22 nt, Homo sapiens
uauggcugcuuucacacuacaa

SEQ ID NO: 249437 - RNA, 22 nt, Homo sapiens
uauggcuucuauaaggaagcuu

SEQ ID NO: 249438 - RNA, 22 nt, Homo sapiens
uauggcuucuuauucuuucccg

SEQ ID NO: 249439 - RNA, 22 nt, Homo sapiens
uuuuauguuuguucccugccaa

SEQ ID NO: 249440 - RNA, 19 nt, Homo sapiens
uuuuccccuuucuuaagac

SEQ ID NO: 249441 - RNA, 23 nt, Homo sapiens
uuuugcaauaagucacuggaaua

SEQ ID NO: 249442 - RNA, 22 nt, Homo sapiens
uuuugcaguuacagagagugag

SEQ ID NO: 249443 - RNA, 20 nt, Homo sapiens
uuuuggcuuaaagcagucug

SEQ ID NO: 249444 - RNA, 22 nt, Homo sapiens
uuuuggugguuaugugucaaug

SEQ ID NO: 249445 - RNA, 22 nt, Homo sapiens
uuuugguguacaauucuaugga

SEQ ID NO: 249446 - RNA, 22 nt, Homo sapiens
uuuugguuuuauccagggucuc

SEQ ID NO: 249447 - RNA, 22 nt, Homo sapiens
uuuuugagguauaguguggcua

SEQ ID NO: 249448 - RNA, 22 nt, Homo sapiens
uuuuugaguagcuggagagcag

SEQ ID NO: 249449 - RNA, 21 nt, Homo sapiens
uuuuugguggucauggauaga

SEQ ID NO: 249450 - RNA, 22 nt, Homo sapiens
uuuuuugcuguaugcaaacauc

SEQ ID NO: 249451 - RNA, 22 nt, Homo sapiens
augcacuguuuucuugaugaga

SEQ ID NO: 249452 - RNA, 22 nt, Homo sapiens
augcagagucccagccccuagc

SEQ ID NO: 249453 - RNA, 22 nt, Homo sapiens
augcagaucacauuuuucuguc

SEQ ID NO: 249454 - RNA, 22 nt, Homo sapiens
augcauagugggaugcucugug

SEQ ID NO: 249455 - RNA, 22 nt, Homo sapiens
augcauauuuuaccuagaagag

SEQ ID NO: 249456 - RNA, 22 nt, Homo sapiens
augcauggagucuuucacaagu

SEQ ID NO: 249457 - RNA, 22 nt, Homo sapiens
gagacugagucuugcuuuguca

SEQ ID NO: 249458 - RNA, 22 nt, Homo sapiens
gagagcuaggccacuggggcuu

SEQ ID NO: 249459 - RNA, 22 nt, Homo sapiens
gagagguaguuuuuuggucguc

SEQ ID NO: 249460 - RNA, 22 nt, Homo sapiens
gagauaauuugaaucauggggg

SEQ ID NO: 249461 - RNA, 22 nt, Homo sapiens
gagauacacccagugcagaggc

SEQ ID NO: 249462 - RNA, 22 nt, Homo sapiens
gagauaggauucacuuucaugu

SEQ ID NO: 249463 - RNA, 22 nt, Homo sapiens
gagauauuuagaaauguguucu

SEQ ID NO: 249464 - RNA, 22 nt, Homo sapiens
gagaucaguuaaugaagugagc

SEQ ID NO: 249465 - RNA, 23 nt, Homo sapiens
gagaucauucuggaauuagagug

SEQ ID NO: 249466 - RNA, 22 nt, Homo sapiens
gagauggugugcuguuggaagu

SEQ ID NO: 249467 - RNA, 22 nt, Homo sapiens
gagauguagucuugcccuguca

SEQ ID NO: 249468 - RNA, 22 nt, Homo sapiens
gagauuaauacacaucaaaugc

SEQ ID NO: 249469 - RNA, 22 nt, Homo sapiens
gagcaucaguggccucaucuca

SEQ ID NO: 249470 - RNA, 22 nt, Homo sapiens
gagccauggagaaaacagcuau

SEQ ID NO: 249471 - RNA, 22 nt, Homo sapiens
gagcuaguguuuacuugccacu

SEQ ID NO: 249472 - RNA, 22 nt, Homo sapiens
gagcugaauugcugccauuugc

SEQ ID NO: 249473 - RNA, 22 nt, Homo sapiens
gagcugaucuuuucugauucca

SEQ ID NO: 249474 - RNA, 22 nt, Homo sapiens
gaggcaaguggccaccgagucu

SEQ ID NO: 249475 - RNA, 22 nt, Homo sapiens
gaggcagucugucccuuagcag

SEQ ID NO: 249476 - RNA, 22 nt, Homo sapiens
gaggcaguguguccguucucgg

SEQ ID NO: 249477 - RNA, 22 nt, Homo sapiens
gagguaaguggauuaugagguc

SEQ ID NO: 249478 - RNA, 22 nt, Homo sapiens
gagguagguacaauugccacca

SEQ ID NO: 249479 - RNA, 17 nt, Homo sapiens
gagguaguuuacuuuca

SEQ ID NO: 249480 - RNA, 22 nt, Homo sapiens
gagguaucauuauguugcccag

SEQ ID NO: 249481 - RNA, 22 nt, Homo sapiens
gagguaugauugacauauaaaa

SEQ ID NO: 249482 - RNA, 22 nt, Homo sapiens
gaggucuuacauuuuaauauuu

SEQ ID NO: 249483 - RNA, 22 nt, Homo sapiens
gagguggugguggaggcauagc

SEQ ID NO: 249484 - RNA, 22 nt, Homo sapiens
gaguaaaugucaaguacuuagg

SEQ ID NO: 249485 - RNA, 22 nt, Homo sapiens
gaguagaacugguuaucuaaua

SEQ ID NO: 249486 - RNA, 22 nt, Homo sapiens
gaguauuuuacaucguguaauu

SEQ ID NO: 249487 - RNA, 21 nt, Homo sapiens
gagugcaaauaaagagagggc

SEQ ID NO: 249488 - RNA, 22 nt, Homo sapiens
gagugcaagguuuuucugagug

SEQ ID NO: 249489 - RNA, 22 nt, Homo sapiens
gagugcaauggcaagaucuugg

SEQ ID NO: 249490 - RNA, 22 nt, Homo sapiens
gagugcaauggugcuaucucgg

SEQ ID NO: 249491 - RNA, 22 nt, Homo sapiens
gagugcuguuagcccuggguuu

SEQ ID NO: 249492 - RNA, 18 nt, Homo sapiens
gaguggugcuucccuugu

SEQ ID NO: 249493 - RNA, 22 nt, Homo sapiens
gaguuuguaaacuauucacuaa

SEQ ID NO: 249494 - RNA, 22 nt, Homo sapiens
gauagguagaagauguuuucau

SEQ ID NO: 249495 - RNA, 22 nt, Homo sapiens
gauauguaguaguugaaaaaga

SEQ ID NO: 249496 - RNA, 22 nt, Homo sapiens
gaucacauguguacucaaugug

SEQ ID NO: 249497 - RNA, 22 nt, Homo sapiens
gaucacauuguuucauacauau

SEQ ID NO: 249498 - RNA, 22 nt, Homo sapiens
gaucuggagguuuuccucauga

SEQ ID NO: 249499 - RNA, 22 nt, Homo sapiens
gaucuguguuuguaugcauaag

SEQ ID NO: 249500 - RNA, 22 nt, Homo sapiens
gaucuguuucaauugucuuagu

SEQ ID NO: 249501 - RNA, 22 nt, Homo sapiens
gaucuguuuuccuauuguuugu

SEQ ID NO: 249502 - RNA, 22 nt, Homo sapiens
gaugagauguucucauggauug

SEQ ID NO: 249503 - RNA, 22 nt, Homo sapiens
gaugaucucuggugguaaagac

SEQ ID NO: 249504 - RNA, 22 nt, Homo sapiens
gaugcaaauuaagcuugggaca

SEQ ID NO: 249505 - RNA, 22 nt, Homo sapiens
gauggaguaauguaaucuugag

SEQ ID NO: 249506 - RNA, 22 nt, Homo sapiens
gauggaguugacuaagacaaca

SEQ ID NO: 249507 - RNA, 22 nt, Homo sapiens
gauggcucugcaggugagggua

SEQ ID NO: 249508 - RNA, 22 nt, Homo sapiens
gauggguuuuuugaagacagca

SEQ ID NO: 249509 - RNA, 22 nt, Homo sapiens
gauguguuuccaggauuuguuu

SEQ ID NO: 249510 - RNA, 22 nt, Homo sapiens
gauuggcauugcugcaccugag

SEQ ID NO: 249511 - RNA, 22 nt, Homo sapiens
gauuuguuggccugugagcuag

SEQ ID NO: 249512 - RNA, 22 nt, Homo sapiens
gauuuuccaguggcccugauca

SEQ ID NO: 249513 - RNA, 22 nt, Homo sapiens
gcaaaguguuuuuaggaagucu

SEQ ID NO: 249514 - RNA, 20 nt, Homo sapiens
gcaaaguuuagcucccacua

SEQ ID NO: 249515 - RNA, 22 nt, Homo sapiens
gcaaaugcuacaccauuuugua

SEQ ID NO: 249516 - RNA, 22 nt, Homo sapiens
gcaaaugcuaugccauuuuaua

SEQ ID NO: 249517 - RNA, 22 nt, Homo sapiens
gcaagaaugagaaggauuaauu

SEQ ID NO: 249518 - RNA, 22 nt, Homo sapiens
gcaaugcugucugugcacagau

SEQ ID NO: 249519 - RNA, 22 nt, Homo sapiens
gcacacguagaagcaugcauca

SEQ ID NO: 249520 - RNA, 22 nt, Homo sapiens
gcacaggguuacauucuaaggu

SEQ ID NO: 249521 - RNA, 22 nt, Homo sapiens
gcacugggccacauuuauuuuc

SEQ ID NO: 249522 - RNA, 22 nt, Homo sapiens
gcagcagugcccuggauggaaa

SEQ ID NO: 249523 - RNA, 22 nt, Homo sapiens
ggugaucauugucucuaguaug

SEQ ID NO: 249524 - RNA, 22 nt, Homo sapiens
gguggcaaaucugaguggcgcu

SEQ ID NO: 249525 - RNA, 22 nt, Homo sapiens
guaacaccaguuauaucaguuc

SEQ ID NO: 249526 - RNA, 22 nt, Homo sapiens
guaagagcauguaguggcucua

SEQ ID NO: 249527 - RNA, 22 nt, Homo sapiens
guaaggcuucuggcccuuaacu

SEQ ID NO: 249528 - RNA, 22 nt, Homo sapiens
guaaucuguaguaaagcaccau

SEQ ID NO: 249529 - RNA, 22 nt, Homo sapiens
guacacaacaugcagguuuguu

SEQ ID NO: 249530 - RNA, 22 nt, Homo sapiens
guacaggugcaggaugggcagg

SEQ ID NO: 249531 - RNA, 22 nt, Homo sapiens
guacagugcucacaaugagagc

SEQ ID NO: 249532 - RNA, 22 nt, Homo sapiens
guacaguucucuuuguugucag

SEQ ID NO: 249533 - RNA, 22 nt, Homo sapiens
guacccaguagauaguuuuuca

SEQ ID NO: 249534 - RNA, 22 nt, Homo sapiens
guaccugggugacaggauuauu

SEQ ID NO: 249535 - RNA, 22 nt, Homo sapiens
guagcaccagugcucuucucaa

SEQ ID NO: 249536 - RNA, 22 nt, Homo sapiens
guagcagaauaucagauaauuu

SEQ ID NO: 249537 - RNA, 22 nt, Homo sapiens
guaguuuaucagaaagaauagg

SEQ ID NO: 249538 - RNA, 22 nt, Homo sapiens
guauacaguugacccuugaacc

SEQ ID NO: 249539 - RNA, 22 nt, Homo sapiens
guauaugccucaguuauagcac

SEQ ID NO: 249540 - RNA, 22 nt, Homo sapiens
guaucaucauguuggccaggcu

SEQ ID NO: 249541 - RNA, 22 nt, Homo sapiens
guaugaaaaucggagauugggu

SEQ ID NO: 249542 - RNA, 22 nt, Homo sapiens
guaugcacauauguguauguau

SEQ ID NO: 249543 - RNA, 22 nt, Homo sapiens
guaugucuugucuauggcugcu

SEQ ID NO: 249544 - RNA, 22 nt, Homo sapiens
guauuagaugguauuugaagau

SEQ ID NO: 249545 - RNA, 22 nt, Homo sapiens
guauuaguuaucuacugcugug

SEQ ID NO: 249546 - RNA, 22 nt, Homo sapiens
guauugaguaaauguuuauugg

SEQ ID NO: 249547 - RNA, 19 nt, Homo sapiens
guauuugacuuucuuguuu

SEQ ID NO: 249548 - RNA, 22 nt, Homo sapiens
gucacugagauugguauuaaug

SEQ ID NO: 249549 - RNA, 20 nt, Homo sapiens
gucacuggcccagggcuugu

SEQ ID NO: 249550 - RNA, 22 nt, Homo sapiens
gucacuggcugucuuguaugau

SEQ ID NO: 249551 - RNA, 22 nt, Homo sapiens
gucacugucuacuguaauagcc

SEQ ID NO: 249552 - RNA, 22 nt, Homo sapiens
gucagauaauuugcauccaucu

SEQ ID NO: 249553 - RNA, 22 nt, Homo sapiens
gucagcuuguccagagacucug

SEQ ID NO: 249554 - RNA, 22 nt, Homo sapiens
gucagggagucucuaucagugg

SEQ ID NO: 249555 - RNA, 22 nt, Homo sapiens
gucagguauguuccaaaggcgg

SEQ ID NO: 249556 - RNA, 22 nt, Homo sapiens
gucagugcuuuaguucaggaug

SEQ ID NO: 249557 - RNA, 20 nt, Homo sapiens
aauaacagccccagggaggu

SEQ ID NO: 249558 - RNA, 22 nt, Homo sapiens
aauaaguugagaugaggucaua

SEQ ID NO: 249559 - RNA, 19 nt, Homo sapiens
aauaaugccagaugucugu

SEQ ID NO: 249560 - RNA, 22 nt, Homo sapiens
aauagugcugcaaaaacauacg

SEQ ID NO: 249561 - RNA, 22 nt, Homo sapiens
aauauagcuauguacaugucca

SEQ ID NO: 249562 - RNA, 19 nt, Homo sapiens
aauauugacaguggugucu

SEQ ID NO: 249563 - RNA, 22 nt, Homo sapiens
aaucaacauuguuuuaagucaa

SEQ ID NO: 249564 - RNA, 22 nt, Homo sapiens
aaucacaguguucuugugaggg

SEQ ID NO: 249565 - RNA, 22 nt, Homo sapiens
aaucauauugucugccaagagg

SEQ ID NO: 249566 - RNA, 22 nt, Homo sapiens
aaucauggaguauuuguccuug

SEQ ID NO: 249567 - RNA, 22 nt, Homo sapiens
aaucccuuuguccagucucuuu

SEQ ID NO: 249568 - RNA, 22 nt, Homo sapiens
aaugacuaagaugguacauuuu

SEQ ID NO: 249569 - RNA, 22 nt, Homo sapiens
aaugacugugauauuuuucuuc

SEQ ID NO: 249570 - RNA, 22 nt, Homo sapiens
aaugcacauaaaauccuccagg

SEQ ID NO: 249571 - RNA, 22 nt, Homo sapiens
aaugcacuccagccugggcgac

SEQ ID NO: 249572 - RNA, 22 nt, Homo sapiens
aauggcagaugaaauugucauu

SEQ ID NO: 249573 - RNA, 18 nt, Homo sapiens
aaugggacuacaaagcca

SEQ ID NO: 249574 - RNA, 22 nt, Homo sapiens
aaugguguuuccguuaagcuga

SEQ ID NO: 249575 - RNA, 22 nt, Homo sapiens
aaugucacugugguccuccagu

SEQ ID NO: 249576 - RNA, 22 nt, Homo sapiens
aaugugcacuauuagggugaua

SEQ ID NO: 249577 - RNA, 22 nt, Homo sapiens
aaugugcuucuggcugugguca

SEQ ID NO: 249578 - RNA, 22 nt, Homo sapiens
aaugugcuuucuuucacacagu

SEQ ID NO: 249579 - RNA, 22 nt, Homo sapiens
aaugugcuuugaaaagagcuga

SEQ ID NO: 249580 - RNA, 22 nt, Homo sapiens
aauuaguuggcugggugcggug

SEQ ID NO: 249581 - RNA, 22 nt, Homo sapiens
aauugaaugauaugggacauuu

SEQ ID NO: 249582 - RNA, 22 nt, Homo sapiens
aauugcuuuuauuuagggccag

SEQ ID NO: 249583 - RNA, 22 nt, Homo sapiens
aauuguacucccaucauuccua

SEQ ID NO: 249584 - RNA, 20 nt, Homo sapiens
acaaaugcauucugugacau

SEQ ID NO: 249585 - RNA, 17 nt, Homo sapiens
acaaauugccagcuagg

SEQ ID NO: 249586 - RNA, 22 nt, Homo sapiens
acacaguguuuauugugguuag

SEQ ID NO: 249587 - RNA, 22 nt, Homo sapiens
acacaugugaaaaaaauguuac

SEQ ID NO: 249588 - RNA, 22 nt, Homo sapiens
acaccauugcauuccagccugg

SEQ ID NO: 249589 - RNA, 22 nt, Homo sapiens
acacucuaguguucuuaaucag

SEQ ID NO: 249590 - RNA, 22 nt, Homo sapiens
acacugcugaguaaauaauuuu

SEQ ID NO: 249591 - RNA, 22 nt, Homo sapiens
acacuggguaacauaucuguua

SEQ ID NO: 249592 - RNA, 22 nt, Homo sapiens
acacuguagcugagggcaugcg

SEQ ID NO: 249593 - RNA, 22 nt, Homo sapiens
acacuguauccuucuguccuuu

SEQ ID NO: 249594 - RNA, 20 nt, Homo sapiens
acagcacugguuucaagcaa

SEQ ID NO: 249595 - RNA, 20 nt, Homo sapiens
acagcauagccuuuuaaagc

SEQ ID NO: 249596 - RNA, 22 nt, Homo sapiens
acaguacaugauaaauaaggua

SEQ ID NO: 249597 - RNA, 22 nt, Homo sapiens
acaguagaaaacaauggauuug

SEQ ID NO: 249598 - RNA, 19 nt, Homo sapiens
acaguauugugcacagguu

SEQ ID NO: 249599 - RNA, 22 nt, Homo sapiens
acagucuggagaaugggugcuc

SEQ ID NO: 249600 - RNA, 18 nt, Homo sapiens
acagugcugucacugcuu

SEQ ID NO: 249601 - RNA, 17 nt, Homo sapiens
acagugcuuugcuuucc

SEQ ID NO: 249602 - RNA, 18 nt, Homo sapiens
acaguguguaaggguucu

SEQ ID NO: 249603 - RNA, 18 nt, Homo sapiens
aggaaugguaauacuuca

SEQ ID NO: 249604 - RNA, 21 nt, Homo sapiens
aggagcauuguugugguggag

SEQ ID NO: 249605 - RNA, 20 nt, Homo sapiens
aggagcauuuacauuggcuc

SEQ ID NO: 249606 - RNA, 22 nt, Homo sapiens
aggaggauugcuuucaucuuuu

SEQ ID NO: 249607 - RNA, 22 nt, Homo sapiens
aggagguagaacauugccauuu

SEQ ID NO: 249608 - RNA, 22 nt, Homo sapiens
aggcaguuucagugagagguga

SEQ ID NO: 249609 - RNA, 22 nt, Homo sapiens
aggcaugaaauacaugcauuga

SEQ ID NO: 249610 - RNA, 22 nt, Homo sapiens
aggcaugauuguauuuugcucu

SEQ ID NO: 249611 - RNA, 22 nt, Homo sapiens
aggccaguuuuuggagggaaac

SEQ ID NO: 249612 - RNA, 22 nt, Homo sapiens
aggcuagacuuugagaauuuuu

SEQ ID NO: 249613 - RNA, 21 nt, Homo sapiens
aggcuguuguuuugggaugga

SEQ ID NO: 249614 - RNA, 22 nt, Homo sapiens
agggaagugugcuaugcauuua

SEQ ID NO: 249615 - RNA, 22 nt, Homo sapiens
agggccuuuguagauguacuca

SEQ ID NO: 249616 - RNA, 22 nt, Homo sapiens
agguaagaugugacuugguguu

SEQ ID NO: 249617 - RNA, 22 nt, Homo sapiens
agguagaguguuuuguucuucu

SEQ ID NO: 249618 - RNA, 22 nt, Homo sapiens
agguaguguuauuugcagcuga

SEQ ID NO: 249619 - RNA, 22 nt, Homo sapiens
agguauuuuuuauccuccagca

SEQ ID NO: 249620 - RNA, 21 nt, Homo sapiens
aggucaguaagaaugcagcac

SEQ ID NO: 249621 - RNA, 22 nt, Homo sapiens
agguccacuuacuacuccuguu

SEQ ID NO: 249622 - RNA, 22 nt, Homo sapiens
aggugcugacaggauagguuuc

SEQ ID NO: 249623 - RNA, 22 nt, Homo sapiens
aggugguguuggguuccagccc

SEQ ID NO: 249624 - RNA, 22 nt, Homo sapiens
aggugguuuuucaacacacacu

SEQ ID NO: 249625 - RNA, 20 nt, Homo sapiens
agguuauuauaauuagaaga

SEQ ID NO: 249626 - RNA, 22 nt, Homo sapiens
agguuguguuugugauuagaua

SEQ ID NO: 249627 - RNA, 22 nt, Homo sapiens
agguuuucagccccagccuagg

SEQ ID NO: 249628 - RNA, 22 nt, Homo sapiens
aguaaagccagaccuguuaauu

SEQ ID NO: 249629 - RNA, 22 nt, Homo sapiens
aguaacauuucuaguagagagu

SEQ ID NO: 249630 - RNA, 22 nt, Homo sapiens
aguacacuguugaacagaagug

SEQ ID NO: 249631 - RNA, 22 nt, Homo sapiens
aguacaucuggcuggauagaua

SEQ ID NO: 249632 - RNA, 21 nt, Homo sapiens
aguagcacugugucuuacaaa

SEQ ID NO: 249633 - RNA, 22 nt, Homo sapiens
aguauuuguuggaauaccuguu

SEQ ID NO: 249634 - RNA, 22 nt, Homo sapiens
agucacagguucuugggauuag

SEQ ID NO: 249635 - RNA, 22 nt, Homo sapiens
agucacagugaccuugucugac

SEQ ID NO: 249636 - RNA, 22 nt, Homo sapiens
agucagauuggcauuuguuggg

SEQ ID NO: 249637 - RNA, 23 nt, Homo sapiens
agucaguaugcuccuuggauccc

SEQ ID NO: 249638 - RNA, 22 nt, Homo sapiens
agucauggcagaaggcaccucu

SEQ ID NO: 249639 - RNA, 22 nt, Homo sapiens
agugaauguuggaaaguuauuu

SEQ ID NO: 249640 - RNA, 22 nt, Homo sapiens
agugaauuguucaacaggagga

SEQ ID NO: 249641 - RNA, 17 nt, Homo sapiens
agugagaucauggcuua

SEQ ID NO: 249642 - RNA, 22 nt, Homo sapiens
agugagcugcagucuggggucc

SEQ ID NO: 249643 - RNA, 22 nt, Homo sapiens
agugagcuguuuuuacuuucug

SEQ ID NO: 249644 - RNA, 21 nt, Homo sapiens
agugagucauuuggaaagcaa

SEQ ID NO: 249645 - RNA, 22 nt, Homo sapiens
agugcacucuuuccucucuuac

SEQ ID NO: 249646 - RNA, 22 nt, Homo sapiens
agugcaguggugccaucauaac

SEQ ID NO: 249647 - RNA, 22 nt, Homo sapiens
agugcagugguuaggagccagg

SEQ ID NO: 249648 - RNA, 22 nt, Homo sapiens
uauggcuuuguuaacauuuucu

SEQ ID NO: 249649 - RNA, 22 nt, Homo sapiens
uauggcuuuguucaacagccuc

SEQ ID NO: 249650 - RNA, 22 nt, Homo sapiens
uauggcuuuucacuuaaguccu

SEQ ID NO: 249651 - RNA, 19 nt, Homo sapiens
uauguaguuuucucaauau

SEQ ID NO: 249652 - RNA, 22 nt, Homo sapiens
uaugucacuugguuuggugcua

SEQ ID NO: 249653 - RNA, 22 nt, Homo sapiens
uaugugcacaugcccuggugac

SEQ ID NO: 249654 - RNA, 22 nt, Homo sapiens
uaugugguuaauaggaauuugu

SEQ ID NO: 249655 - RNA, 22 nt, Homo sapiens
uauuacauccauaggcucugcu

SEQ ID NO: 249656 - RNA, 22 nt, Homo sapiens
uauuaguuuucuguggauuaca

SEQ ID NO: 249657 - RNA, 22 nt, Homo sapiens
uauuauagugauaggucuacug

SEQ ID NO: 249658 - RNA, 22 nt, Homo sapiens
uauucaucuuaagcuuuggcuu

SEQ ID NO: 249659 - RNA, 22 nt, Homo sapiens
uauuccacaauaugauuuuuaa

SEQ ID NO: 249660 - RNA, 22 nt, Homo sapiens
uauuccagcccuggugagccag

SEQ ID NO: 249661 - RNA, 22 nt, Homo sapiens
uauugaacgugggauauugaag

SEQ ID NO: 249662 - RNA, 22 nt, Homo sapiens
uauugaauuugagcugucucuu

SEQ ID NO: 249663 - RNA, 22 nt, Homo sapiens
uauugacauuacagugggucuu

SEQ ID NO: 249664 - RNA, 22 nt, Homo sapiens
uauugacuugaugagggagggu

SEQ ID NO: 249665 - RNA, 22 nt, Homo sapiens
uauugcaacagaagaaagaguc

SEQ ID NO: 249666 - RNA, 22 nt, Homo sapiens
uauugcacuccucaugcauuug

SEQ ID NO: 249667 - RNA, 22 nt, Homo sapiens
uauugcagaaugugaguuggca

SEQ ID NO: 249668 - RNA, 20 nt, Homo sapiens
uauugccuaaauaccagaau

SEQ ID NO: 249669 - RNA, 22 nt, Homo sapiens
uauugcuaaaacucaugguugc

SEQ ID NO: 249670 - RNA, 22 nt, Homo sapiens
uauugcuggcacauaguagguc

SEQ ID NO: 249671 - RNA, 22 nt, Homo sapiens
uauugcuugaggaaaugguaau

SEQ ID NO: 249672 - RNA, 22 nt, Homo sapiens
uauugcuuuacucucuuauccu

SEQ ID NO: 249673 - RNA, 22 nt, Homo sapiens
uauugcuuuugauucaaggcag

SEQ ID NO: 249674 - RNA, 22 nt, Homo sapiens
uauugucacuaaaggaagcugg

SEQ ID NO: 249675 - RNA, 22 nt, Homo sapiens
uauuucccuuaacuuuccugca

SEQ ID NO: 249676 - RNA, 22 nt, Homo sapiens
uauuuggugaaugaaugcaugu

SEQ ID NO: 249677 - RNA, 22 nt, Homo sapiens
uauuugguuacuugaauagcua

SEQ ID NO: 249678 - RNA, 22 nt, Homo sapiens
ucaaagacacacaaggagaagg

SEQ ID NO: 249679 - RNA, 22 nt, Homo sapiens
ucaaaguaaagccucaggaugg

SEQ ID NO: 249680 - RNA, 22 nt, Homo sapiens
ucaaaugcucuuugcagagagg

SEQ ID NO: 249681 - RNA, 22 nt, Homo sapiens
ucaacacaguuaaauggggaaa

SEQ ID NO: 249682 - RNA, 22 nt, Homo sapiens
ucaacaggucaauugcauagaa

SEQ ID NO: 249683 - RNA, 22 nt, Homo sapiens
ucaacagugauggaaaguuaua

SEQ ID NO: 249684 - RNA, 22 nt, Homo sapiens
ucaagcaauucugcugccucag

SEQ ID NO: 249685 - RNA, 21 nt, Homo sapiens
ucaaggaguauacguaugcca

SEQ ID NO: 249686 - RNA, 20 nt, Homo sapiens
ucaaggcacgaauaaaaguu

SEQ ID NO: 249687 - RNA, 22 nt, Homo sapiens
ucaaguaagaagugggcauaaa

SEQ ID NO: 249688 - RNA, 22 nt, Homo sapiens
ucaaguaauacucccaucuugg

SEQ ID NO: 249689 - RNA, 22 nt, Homo sapiens
ucaagugcauaugcuaacgguu

SEQ ID NO: 249690 - RNA, 22 nt, Homo sapiens
ucacaagcuccugccuuugcuu

SEQ ID NO: 249691 - RNA, 22 nt, Homo sapiens
ucacaagugagaggaauuagau

SEQ ID NO: 249692 - RNA, 22 nt, Homo sapiens
ucacaaguguauagacaugucc

SEQ ID NO: 249693 - RNA, 21 nt, Homo sapiens
ucacaaugaacagcagcagaa

SEQ ID NO: 249694 - RNA, 22 nt, Homo sapiens
ucacaauucacuacaggcuuga

SEQ ID NO: 249695 - RNA, 22 nt, Homo sapiens
ucacacugaaacuaggguguga

SEQ ID NO: 249696 - RNA, 22 nt, Homo sapiens
ucacacugcaucuguuggaauu

SEQ ID NO: 249697 - RNA, 19 nt, Homo sapiens
ucacacuguggcuucuuua

SEQ ID NO: 249698 - RNA, 23 nt, Homo sapiens
ucacacuuaagagaaaugcagcu

SEQ ID NO: 249699 - RNA, 22 nt, Homo sapiens
ucacagaggagaagaccuuuaa

SEQ ID NO: 249700 - RNA, 22 nt, Homo sapiens
ucacagaugaggcgagaggcag

SEQ ID NO: 249701 - RNA, 18 nt, Homo sapiens
ucacagguaaaguugaca

SEQ ID NO: 249702 - RNA, 22 nt, Homo sapiens
ucacaguagggaacugacaaag

SEQ ID NO: 249703 - RNA, 22 nt, Homo sapiens
ucacaguauggggggugguuau

SEQ ID NO: 249704 - RNA, 20 nt, Homo sapiens
ucacagucacacauaauccu

SEQ ID NO: 249705 - RNA, 22 nt, Homo sapiens
ucacagucugcgugaugagaca

SEQ ID NO: 249706 - RNA, 22 nt, Homo sapiens
ucacaguuggccuggccuuuua

SEQ ID NO: 249707 - RNA, 22 nt, Homo sapiens
ucacauucaauuguaauccccg

SEQ ID NO: 249708 - RNA, 22 nt, Homo sapiens
ucaccaccugcugauuguagag

SEQ ID NO: 249709 - RNA, 22 nt, Homo sapiens
ucaccaccuuccaggaccacug

SEQ ID NO: 249710 - RNA, 22 nt, Homo sapiens
ucaccuggagaagauggaucau

SEQ ID NO: 249711 - RNA, 22 nt, Homo sapiens
ucaccuggggaucuuguuuaca

SEQ ID NO: 249712 - RNA, 22 nt, Homo sapiens
ucacucagaccuggugauaugc

SEQ ID NO: 249713 - RNA, 22 nt, Homo sapiens
ucacugaaaccgccuccaccuc

SEQ ID NO: 249714 - RNA, 22 nt, Homo sapiens
ucacugagaaugauguuucuga

SEQ ID NO: 249715 - RNA, 22 nt, Homo sapiens
ucacugagcacaggagaugugc

SEQ ID NO: 249716 - RNA, 22 nt, Homo sapiens
ucacugcacuccagccuuuaug

SEQ ID NO: 249717 - RNA, 22 nt, Homo sapiens
ucacugcgaccuccaccucccg

SEQ ID NO: 249718 - RNA, 22 nt, Homo sapiens
ucacuggacucuagccugggug

SEQ ID NO: 249719 - RNA, 20 nt, Homo sapiens
ucacuggagcucauuugauu

SEQ ID NO: 249720 - RNA, 22 nt, Homo sapiens
ucacugggagaccaaagccauc

SEQ ID NO: 249721 - RNA, 22 nt, Homo sapiens
ucacugggagcauuugagccuu

SEQ ID NO: 249722 - RNA, 22 nt, Homo sapiens
ucacugugcacauaugauaggu

SEQ ID NO: 249723 - RNA, 22 nt, Homo sapiens
ucacugugguuugggaaagugc

SEQ ID NO: 249724 - RNA, 18 nt, Homo sapiens
ucacugugugucuugggu

SEQ ID NO: 249725 - RNA, 22 nt, Homo sapiens
ucagaacugaacaaaccagucu

SEQ ID NO: 249726 - RNA, 22 nt, Homo sapiens
ucagaauguaacuuuaguugga

SEQ ID NO: 249727 - RNA, 22 nt, Homo sapiens
ucagacacuguggccuuuggac

SEQ ID NO: 249728 - RNA, 22 nt, Homo sapiens
ucagagcaaagacacuuuauca

SEQ ID NO: 249729 - RNA, 22 nt, Homo sapiens
ucagaguagcugucugaggugc

SEQ ID NO: 249730 - RNA, 22 nt, Homo sapiens
ucagagugguuguaccauuuga

SEQ ID NO: 249731 - RNA, 22 nt, Homo sapiens
ucagaugaucugguaagaacuu

SEQ ID NO: 249732 - RNA, 22 nt, Homo sapiens
ucagaugcauccauaccccacu

SEQ ID NO: 249733 - RNA, 22 nt, Homo sapiens
ucagauugaugcauacuuaaau

SEQ ID NO: 249734 - RNA, 22 nt, Homo sapiens
ucagauuggugcaaaaguaauu

SEQ ID NO: 249735 - RNA, 22 nt, Homo sapiens
ucagcaaugaccuaagcaaaua

SEQ ID NO: 249736 - RNA, 19 nt, Homo sapiens
ucagcaguaaucaacuuca

SEQ ID NO: 249737 - RNA, 21 nt, Homo sapiens
ucagcucaucacugccuggag

SEQ ID NO: 249738 - RNA, 22 nt, Homo sapiens
ucagguaaucuauuugucuuuu

SEQ ID NO: 249739 - RNA, 22 nt, Homo sapiens
ucagguauuucuuuuagcugug

SEQ ID NO: 249740 - RNA, 22 nt, Homo sapiens
ucaggugccuuggcuaauuguu

SEQ ID NO: 249741 - RNA, 23 nt, Homo sapiens
ucaguacucuauaagugccagcu

SEQ ID NO: 249742 - RNA, 22 nt, Homo sapiens
ucaguacuuuggagcucacaua

SEQ ID NO: 249743 - RNA, 19 nt, Homo sapiens
ucaguagugcacauaagcc

SEQ ID NO: 249744 - RNA, 22 nt, Homo sapiens
ucagucauucacucacucggac

SEQ ID NO: 249745 - RNA, 22 nt, Homo sapiens
ucaguccccucgcugagucuac

SEQ ID NO: 249746 - RNA, 22 nt, Homo sapiens
ucagugaacgaggaggagggug

SEQ ID NO: 249747 - RNA, 23 nt, Homo sapiens
ucagugaaggaacaacuaaauag

SEQ ID NO: 249748 - RNA, 22 nt, Homo sapiens
ucagugaauguuggccacuacu

SEQ ID NO: 249749 - RNA, 20 nt, Homo sapiens
ucagugcagauuguccaagu

SEQ ID NO: 249750 - RNA, 22 nt, Homo sapiens
cugacucagacacauguauaug

SEQ ID NO: 249751 - RNA, 22 nt, Homo sapiens
cugagaagaaacagguaaggac

SEQ ID NO: 249752 - RNA, 22 nt, Homo sapiens
cugagacuggguaauguauaaa

SEQ ID NO: 249753 - RNA, 22 nt, Homo sapiens
cugagauacacuaauagucucu

SEQ ID NO: 249754 - RNA, 22 nt, Homo sapiens
cugagaucguggggcugcuguc

SEQ ID NO: 249755 - RNA, 22 nt, Homo sapiens
cugagcaugacaucaugugacu

SEQ ID NO: 249756 - RNA, 22 nt, Homo sapiens
cugagcuaguagcauuguguca

SEQ ID NO: 249757 - RNA, 22 nt, Homo sapiens
cugaggacaucagggaagcauc

SEQ ID NO: 249758 - RNA, 22 nt, Homo sapiens
cugaggauauucagccucugug

SEQ ID NO: 249759 - RNA, 22 nt, Homo sapiens
cugaggguagaaggaucacuug

SEQ ID NO: 249760 - RNA, 22 nt, Homo sapiens
cugagguauuuaggugaaagaa

SEQ ID NO: 249761 - RNA, 22 nt, Homo sapiens
cugagugcaagugauccuccca

SEQ ID NO: 249762 - RNA, 22 nt, Homo sapiens
cugauaugaugggugauuuuca

SEQ ID NO: 249763 - RNA, 22 nt, Homo sapiens
cugaucuguuauacuuuucuau

SEQ ID NO: 249764 - RNA, 22 nt, Homo sapiens
cugauugucuauuuaguucacu

SEQ ID NO: 249765 - RNA, 19 nt, Homo sapiens
cugcaagguaauaggucag

SEQ ID NO: 249766 - RNA, 22 nt, Homo sapiens
cugcaauggagaaagugagacu

SEQ ID NO: 249767 - RNA, 22 nt, Homo sapiens
cugcaauguuugaaauggcaaa

SEQ ID NO: 249768 - RNA, 19 nt, Homo sapiens
cugcaugagacaguugguu

SEQ ID NO: 249769 - RNA, 22 nt, Homo sapiens
cuggaaagcaaguccauugcuc

SEQ ID NO: 249770 - RNA, 22 nt, Homo sapiens
cuggaguuugaggcugcaguga

SEQ ID NO: 249771 - RNA, 18 nt, Homo sapiens
cuggaugucgaguguguu

SEQ ID NO: 249772 - RNA, 22 nt, Homo sapiens
cuggcaaauguuuucuguaaag

SEQ ID NO: 249773 - RNA, 22 nt, Homo sapiens
cuggcaauaggcagugucccaa

SEQ ID NO: 249774 - RNA, 22 nt, Homo sapiens
cuggcccaguucugcguuuugc

SEQ ID NO: 249775 - RNA, 22 nt, Homo sapiens
cuggcgagacagcuccaucacu

SEQ ID NO: 249776 - RNA, 22 nt, Homo sapiens
cugguuguucuggaugggcagg

SEQ ID NO: 249777 - RNA, 22 nt, Homo sapiens
cuguaacagaauaaauuuguuu

SEQ ID NO: 249778 - RNA, 22 nt, Homo sapiens
cuguaugugagaaauaauaagu

SEQ ID NO: 249779 - RNA, 22 nt, Homo sapiens
cuguauguuucuaugaauguga

SEQ ID NO: 249780 - RNA, 22 nt, Homo sapiens
cugucuagagggcacaugaugc

SEQ ID NO: 249781 - RNA, 22 nt, Homo sapiens
cugucucagugaauugguuuua

SEQ ID NO: 249782 - RNA, 22 nt, Homo sapiens
cugugcacaucuggcggcccga

SEQ ID NO: 249783 - RNA, 22 nt, Homo sapiens
cugugcauggauuuuaagauug

SEQ ID NO: 249784 - RNA, 22 nt, Homo sapiens
cugugcauguaugcgugaguuc

SEQ ID NO: 249785 - RNA, 22 nt, Homo sapiens
cugugcauguuguccaauucuu

SEQ ID NO: 249786 - RNA, 22 nt, Homo sapiens
cugugcuuggagucccccuagg

SEQ ID NO: 249787 - RNA, 22 nt, Homo sapiens
cugugguauuauuagaaauauc

SEQ ID NO: 249788 - RNA, 22 nt, Homo sapiens
cugugguguaacucuuggggcg

SEQ ID NO: 249789 - RNA, 22 nt, Homo sapiens
cuguucaaauuguuugugaagu

SEQ ID NO: 249790 - RNA, 22 nt, Homo sapiens
cuguucaggaggcauuuggugg

SEQ ID NO: 249791 - RNA, 22 nt, Homo sapiens
cuguugcaguuauggcugcagg

SEQ ID NO: 249792 - RNA, 22 nt, Homo sapiens
cuguuugaggguuugcuuucag

SEQ ID NO: 249793 - RNA, 22 nt, Homo sapiens
cuguuuguuuaggguacucaga

SEQ ID NO: 249794 - RNA, 22 nt, Homo sapiens
cuuaaggccagauaauuucuau

SEQ ID NO: 249795 - RNA, 22 nt, Homo sapiens
cuuaaguaguuguggaaugaau

SEQ ID NO: 249796 - RNA, 22 nt, Homo sapiens
cuucacuuuguuaaacuccaau

SEQ ID NO: 249797 - RNA, 22 nt, Homo sapiens
cuucagcaauauauccccuggg

SEQ ID NO: 249798 - RNA, 22 nt, Homo sapiens
cuuccagcuggguucagucagu

SEQ ID NO: 249799 - RNA, 22 nt, Homo sapiens
cuuccugaguccugggcucaca

SEQ ID NO: 249800 - RNA, 22 nt, Homo sapiens
cuucggugaguagauggguuaa

SEQ ID NO: 249801 - RNA, 22 nt, Homo sapiens
cuugacaaugcuucaggcugaa

SEQ ID NO: 249802 - RNA, 22 nt, Homo sapiens
cuugagcuugagauccuuucug

SEQ ID NO: 249803 - RNA, 22 nt, Homo sapiens
cuugcagagcccauggauguca

SEQ ID NO: 249804 - RNA, 22 nt, Homo sapiens
cuugcagaggcccuggggagag

SEQ ID NO: 249805 - RNA, 22 nt, Homo sapiens
cuuggcacugcucacccuccuu

SEQ ID NO: 249806 - RNA, 22 nt, Homo sapiens
cuuggcauugccccuggaauuu

SEQ ID NO: 249807 - RNA, 22 nt, Homo sapiens
cuuggcauuguguugauagaag

SEQ ID NO: 249808 - RNA, 22 nt, Homo sapiens
cuuggcuccgacuccccuccaa

SEQ ID NO: 249809 - RNA, 22 nt, Homo sapiens
cuuggcuuguuguccccugcuc

SEQ ID NO: 249810 - RNA, 22 nt, Homo sapiens
cuugguuacauuuuccuagaaa

SEQ ID NO: 249811 - RNA, 22 nt, Homo sapiens
cuugucacuguuggcuuuagaa

SEQ ID NO: 249812 - RNA, 19 nt, Homo sapiens
cuugugccugaagcuuggg

SEQ ID NO: 249813 - RNA, 22 nt, Homo sapiens
cuuuagcaauugauuaugccau

SEQ ID NO: 249814 - RNA, 22 nt, Homo sapiens
cuuuaguugucuccucaagggu

SEQ ID NO: 249815 - RNA, 22 nt, Homo sapiens
cuuuggagaaaaguucuugggc

SEQ ID NO: 249816 - RNA, 20 nt, Homo sapiens
cuuuggcaaugagaacaggg

SEQ ID NO: 249817 - RNA, 22 nt, Homo sapiens
cuuuggcacuuccuaagugcca

SEQ ID NO: 249818 - RNA, 22 nt, Homo sapiens
cuuugggaccgcgguuuauacu

SEQ ID NO: 249819 - RNA, 20 nt, Homo sapiens
cuuuguccuccugcugugcu

SEQ ID NO: 249820 - RNA, 22 nt, Homo sapiens
cuuuguguggacauuucaggca

SEQ ID NO: 249821 - RNA, 22 nt, Homo sapiens
cuuuuacacuguuggugggaau

SEQ ID NO: 249822 - RNA, 22 nt, Homo sapiens
gaaaacugcuucucuggguuuc

SEQ ID NO: 249823 - RNA, 22 nt, Homo sapiens
gaaaauccauccccagggagua

SEQ ID NO: 249824 - RNA, 22 nt, Homo sapiens
gaaagugcugcaaggccaugca

SEQ ID NO: 249825 - RNA, 22 nt, Homo sapiens
gaaauguauuaaugaguugaaa

SEQ ID NO: 249826 - RNA, 23 nt, Homo sapiens
gaaaugucuuagugaaauugcuu

SEQ ID NO: 249827 - RNA, 22 nt, Homo sapiens
gaaauguugauagugggcauug

SEQ ID NO: 249828 - RNA, 22 nt, Homo sapiens
gaaauguuuuucaugugggcaa

SEQ ID NO: 249829 - RNA, 22 nt, Homo sapiens
gaacccuggaggcggagguugc

SEQ ID NO: 249830 - RNA, 22 nt, Homo sapiens
gaagauaucuaguaccauuguc

SEQ ID NO: 249831 - RNA, 22 nt, Homo sapiens
gaagcauugauccacaggcgug

SEQ ID NO: 249832 - RNA, 22 nt, Homo sapiens
gaauaaacuagagaggacugag

SEQ ID NO: 249833 - RNA, 22 nt, Homo sapiens
gaaugcuaaguuuccucccugu

SEQ ID NO: 249834 - RNA, 22 nt, Homo sapiens
gaauguuuacuuuguuuaauac

SEQ ID NO: 249835 - RNA, 22 nt, Homo sapiens
gaauugcacaaaaacugcuugu

SEQ ID NO: 249836 - RNA, 22 nt, Homo sapiens
gacaccauuucaguacuagguu

SEQ ID NO: 249837 - RNA, 22 nt, Homo sapiens
gacacuggguguuuguuggcgu

SEQ ID NO: 249838 - RNA, 22 nt, Homo sapiens
gacagugagaugucaugugaaa

SEQ ID NO: 249839 - RNA, 18 nt, Homo sapiens
gacaguguggcaauuccu

SEQ ID NO: 249840 - RNA, 22 nt, Homo sapiens
gacauguaaggcucucucuguu

SEQ ID NO: 249841 - RNA, 22 nt, Homo sapiens
gaccuaggaggauugcuugagc

SEQ ID NO: 249842 - RNA, 22 nt, Homo sapiens
gacuagaaauuauuuagugagc

SEQ ID NO: 249843 - RNA, 22 nt, Homo sapiens
gacugaguaagcagaagcaauu

SEQ ID NO: 249844 - RNA, 22 nt, Homo sapiens
gacuggauagauaaaguuaguu

SEQ ID NO: 249845 - RNA, 22 nt, Homo sapiens
gacuggguuaguuugaaagacu

SEQ ID NO: 249846 - RNA, 22 nt, Homo sapiens
gacuucaucauacuaugugugg

SEQ ID NO: 249847 - RNA, 22 nt, Homo sapiens
gagaacagaagcauuccuaauu

SEQ ID NO: 249848 - RNA, 22 nt, Homo sapiens
gagaacaguguuguauuuuuuc

SEQ ID NO: 249849 - RNA, 22 nt, Homo sapiens
gagaacauacggcauuugguuu

SEQ ID NO: 249850 - RNA, 20 nt, Homo sapiens
gagaacugagaugcguuuga

SEQ ID NO: 249851 - RNA, 22 nt, Homo sapiens
gagaacuggcugauucaaggac

SEQ ID NO: 249852 - RNA, 22 nt, Homo sapiens
gagcaacaguggcagugguggg

SEQ ID NO: 249853 - RNA, 22 nt, Homo sapiens
gagcaaugauugagccacugua

SEQ ID NO: 249854 - RNA, 22 nt, Homo sapiens
gagcacauaugacauuuucuuc

SEQ ID NO: 249855 - RNA, 22 nt, Homo sapiens
gagcccauuucacuuguccagc

SEQ ID NO: 249856 - RNA, 22 nt, Homo sapiens
gagcuagugcuuaugcaccacu

SEQ ID NO: 249857 - RNA, 22 nt, Homo sapiens
gagcucauuguugcuaaagaga

SEQ ID NO: 249858 - RNA, 22 nt, Homo sapiens
gagcuccuccccuuggcuuuca

SEQ ID NO: 249859 - RNA, 22 nt, Homo sapiens
gagcugaucuuuauguaaauuc

SEQ ID NO: 249860 - RNA, 22 nt, Homo sapiens
gagcuguuuuucacuagaccaa

SEQ ID NO: 249861 - RNA, 22 nt, Homo sapiens
gaggaaguaauuuuaggccugu

SEQ ID NO: 249862 - RNA, 22 nt, Homo sapiens
gaggaaguagcuacugucuuuc

SEQ ID NO: 249863 - RNA, 22 nt, Homo sapiens
gaggaaguuuacaaagcaucug

SEQ ID NO: 249864 - RNA, 22 nt, Homo sapiens
gaggagauauucugcuggaugg

SEQ ID NO: 249865 - RNA, 22 nt, Homo sapiens
gaggcaagaguaguuaaguuag

SEQ ID NO: 249866 - RNA, 22 nt, Homo sapiens
gaggcacucuguacaaaucugc

SEQ ID NO: 249867 - RNA, 22 nt, Homo sapiens
gaggcagucuguccauucucag

SEQ ID NO: 249868 - RNA, 22 nt, Homo sapiens
gagggcacugcuuuccuuucaa

SEQ ID NO: 249869 - RNA, 22 nt, Homo sapiens
gaggguguuguguugcuuaaua

SEQ ID NO: 249870 - RNA, 22 nt, Homo sapiens
gagguagaauguuuuucagcug

SEQ ID NO: 249871 - RNA, 22 nt, Homo sapiens
gagguaggaggauugcuuaagg

SEQ ID NO: 249872 - RNA, 22 nt, Homo sapiens
gagguaggggccuuaaagaugc

SEQ ID NO: 249873 - RNA, 22 nt, Homo sapiens
gagguagggucccacuauguug

SEQ ID NO: 249874 - RNA, 22 nt, Homo sapiens
gagguaguuaaugcauucacua

SEQ ID NO: 249875 - RNA, 22 nt, Homo sapiens
gagguaugugggcagacauuua

SEQ ID NO: 249876 - RNA, 22 nt, Homo sapiens
gaggucaugucgggccccagga

SEQ ID NO: 249877 - RNA, 22 nt, Homo sapiens
gaggucauguggcaggcagcca

SEQ ID NO: 249878 - RNA, 22 nt, Homo sapiens
gaguaaauguccuagcuucuug

SEQ ID NO: 249879 - RNA, 22 nt, Homo sapiens
gagugcaaagguccugaggugg

SEQ ID NO: 249880 - RNA, 22 nt, Homo sapiens
gagugcaauggcgcgaucuggg

SEQ ID NO: 249881 - RNA, 22 nt, Homo sapiens
gagugcugagcccacuuccuug

SEQ ID NO: 249882 - RNA, 23 nt, Homo sapiens
gaguggagacucauugauuuccu

SEQ ID NO: 249883 - RNA, 22 nt, Homo sapiens
gaguucaaaucucagcucuguu

SEQ ID NO: 249884 - RNA, 22 nt, Homo sapiens
gauaacagauaaugucaguuau

SEQ ID NO: 249885 - RNA, 18 nt, Homo sapiens
gauaacaguggacuaugc

SEQ ID NO: 249886 - RNA, 22 nt, Homo sapiens
gauaagagaugauuuugccaug

SEQ ID NO: 249887 - RNA, 21 nt, Homo sapiens
gauaaguuggcagccagcacc

SEQ ID NO: 249888 - RNA, 19 nt, Homo sapiens
gauaucuagggggagguuc

SEQ ID NO: 249889 - RNA, 21 nt, Homo sapiens
gauaucuuuauucccaagagc

SEQ ID NO: 249890 - RNA, 22 nt, Homo sapiens
gauaugaguagucgcauugaug

SEQ ID NO: 249891 - RNA, 22 nt, Homo sapiens
gauauguugaguagaguuuuug

SEQ ID NO: 249892 - RNA, 22 nt, Homo sapiens
gauauuacuuccaauauugcaa

SEQ ID NO: 249893 - RNA, 22 nt, Homo sapiens
gauauugacuuauucuauguuu

SEQ ID NO: 249894 - RNA, 22 nt, Homo sapiens
gaucaauuggcugaagacacgu

SEQ ID NO: 249895 - RNA, 22 nt, Homo sapiens
gaucacaugggagaaugagagu

SEQ ID NO: 249896 - RNA, 22 nt, Homo sapiens
gaucuggucuuugauuagacac

SEQ ID NO: 249897 - RNA, 22 nt, Homo sapiens
gaucugucuuuccuuauagucu

SEQ ID NO: 249898 - RNA, 22 nt, Homo sapiens
gaugacacugggucaaaucuca

SEQ ID NO: 249899 - RNA, 22 nt, Homo sapiens
gaugacagcugacucccuugcu

SEQ ID NO: 249900 - RNA, 22 nt, Homo sapiens
gaugagaucauaaguguggagc

SEQ ID NO: 249901 - RNA, 22 nt, Homo sapiens
gaugaggcuagagacaugugua

SEQ ID NO: 249902 - RNA, 22 nt, Homo sapiens
gaugagguagaagacucagcaa

SEQ ID NO: 249903 - RNA, 22 nt, Homo sapiens
gauguguuuguuucuggaggag

SEQ ID NO: 249904 - RNA, 20 nt, Homo sapiens
gauuagagagaggcugugca

SEQ ID NO: 249905 - RNA, 22 nt, Homo sapiens
gauuccacuuacuuagcauucc

SEQ ID NO: 249906 - RNA, 22 nt, Homo sapiens
gauuccacuuucugucucuaug

SEQ ID NO: 249907 - RNA, 22 nt, Homo sapiens
gauuccauugcgaauuuucaga

SEQ ID NO: 249908 - RNA, 22 nt, Homo sapiens
gauugguugaaaguagaauacu

SEQ ID NO: 249909 - RNA, 22 nt, Homo sapiens
gauuguguucauaggcauguua

SEQ ID NO: 249910 - RNA, 22 nt, Homo sapiens
gauuucaucuuuagaggaagga

SEQ ID NO: 249911 - RNA, 22 nt, Homo sapiens
gcaaagaaugcagauuugccuc

SEQ ID NO: 249912 - RNA, 21 nt, Homo sapiens
gcaaaguggcuaccuugcucc

SEQ ID NO: 249913 - RNA, 23 nt, Homo sapiens
gcaaauaucguagagugucccug

SEQ ID NO: 249914 - RNA, 22 nt, Homo sapiens
gcaagaaucugggaguaaaauu

SEQ ID NO: 249915 - RNA, 22 nt, Homo sapiens
gcaagacaugucuaagguuuaa

SEQ ID NO: 249916 - RNA, 22 nt, Homo sapiens
gcacagaugaggagaggucuca

SEQ ID NO: 249917 - RNA, 22 nt, Homo sapiens
gcacaguguuacuugauauauu

SEQ ID NO: 249918 - RNA, 22 nt, Homo sapiens
gcacauauguaaauagcugccu

SEQ ID NO: 249919 - RNA, 22 nt, Homo sapiens
gcaccacugcacucucagcuug

SEQ ID NO: 249920 - RNA, 22 nt, Homo sapiens
gcacccugucaaaauggaccaa

SEQ ID NO: 249921 - RNA, 17 nt, Homo sapiens
gcacuggcguaucccac

SEQ ID NO: 249922 - RNA, 22 nt, Homo sapiens
gcagagaaacaggucuaaggag

SEQ ID NO: 249923 - RNA, 22 nt, Homo sapiens
gcagaucucuucauuucucuua

SEQ ID NO: 249924 - RNA, 22 nt, Homo sapiens
gcagaucuucgcgguaaguguu

SEQ ID NO: 249925 - RNA, 22 nt, Homo sapiens
gcagcacaugacuguauguaua

SEQ ID NO: 249926 - RNA, 22 nt, Homo sapiens
gcaggcaugacauuucacucuu

SEQ ID NO: 249927 - RNA, 22 nt, Homo sapiens
gcaguacacuguugguaggaau

SEQ ID NO: 249928 - RNA, 23 nt, Homo sapiens
gcagucauuuggaaaagguugaa

SEQ ID NO: 249929 - RNA, 22 nt, Homo sapiens
gcagugcaguggcgcgaucucg

SEQ ID NO: 249930 - RNA, 22 nt, Homo sapiens
gcaguguggguagagggcaaga

SEQ ID NO: 249931 - RNA, 22 nt, Homo sapiens
gcaguguucaaaucaugcccau

SEQ ID NO: 249932 - RNA, 22 nt, Homo sapiens
gcaguguuggggccggaggcug

SEQ ID NO: 249933 - RNA, 22 nt, Homo sapiens
gcauaaagcuaauaagacgaag

SEQ ID NO: 249934 - RNA, 19 nt, Homo sapiens
gcaucauuaguugcuuuuc

SEQ ID NO: 249935 - RNA, 20 nt, Homo sapiens
gcaugagucuuuauaguaga

SEQ ID NO: 249936 - RNA, 22 nt, Homo sapiens
gcaugauuuuauaucuauguaa

SEQ ID NO: 249937 - RNA, 22 nt, Homo sapiens
gcauggagcauacauuucuguu

SEQ ID NO: 249938 - RNA, 22 nt, Homo sapiens
gcaugugaauguguaagaaaau

SEQ ID NO: 249939 - RNA, 22 nt, Homo sapiens
gccaagaagugucuaagcagga

SEQ ID NO: 249940 - RNA, 22 nt, Homo sapiens
gccaagauugguuuaauauucc

SEQ ID NO: 249941 - RNA, 22 nt, Homo sapiens
gccaguauuuuauugagaauuu

SEQ ID NO: 249942 - RNA, 22 nt, Homo sapiens
gccaguauuuuguugagaauuu

SEQ ID NO: 249943 - RNA, 22 nt, Homo sapiens
gccagugugaugugaucauggc

SEQ ID NO: 249944 - RNA, 22 nt, Homo sapiens
gccauggugucuuauuuuugug

SEQ ID NO: 249945 - RNA, 22 nt, Homo sapiens
gccauugcacuccagccuaggc

SEQ ID NO: 249946 - RNA, 22 nt, Homo sapiens
ucagugcuguaccaucuaagga

SEQ ID NO: 249947 - RNA, 22 nt, Homo sapiens
ucagugguuaaaagauucuaga

SEQ ID NO: 249948 - RNA, 22 nt, Homo sapiens
ucagugucugcauucuuauugu

SEQ ID NO: 249949 - RNA, 22 nt, Homo sapiens
ucaguguugauggcugcugacu

SEQ ID NO: 249950 - RNA, 22 nt, Homo sapiens
ucauaaaguuguuuuaauggga

SEQ ID NO: 249951 - RNA, 22 nt, Homo sapiens
ucauacuguugugaaacaaaac

SEQ ID NO: 249952 - RNA, 22 nt, Homo sapiens
ucauagaucaaguaauaagaca

SEQ ID NO: 249953 - RNA, 22 nt, Homo sapiens
ucaucagaaucccuuagggaug

SEQ ID NO: 249954 - RNA, 22 nt, Homo sapiens
ucaucagugcuugcaaauuauu

SEQ ID NO: 249955 - RNA, 22 nt, Homo sapiens
ucaucaguuuuuuauaugugau

SEQ ID NO: 249956 - RNA, 23 nt, Homo sapiens
ucaugaggccauucaaauccauu

SEQ ID NO: 249957 - RNA, 22 nt, Homo sapiens
ucaugucuuguuguauuuauuu

SEQ ID NO: 249958 - RNA, 22 nt, Homo sapiens
ucauguguugcacugaggaccu

SEQ ID NO: 249959 - RNA, 22 nt, Homo sapiens
ucauugcacuccagccugggug

SEQ ID NO: 249960 - RNA, 22 nt, Homo sapiens
ucauugcacuucuuuaguugca

SEQ ID NO: 249961 - RNA, 22 nt, Homo sapiens
uccaagaugcuggcagcuacag

SEQ ID NO: 249962 - RNA, 22 nt, Homo sapiens
uccacaguggugaggugcagca

SEQ ID NO: 249963 - RNA, 18 nt, Homo sapiens
uccacgugcuuuccagau

SEQ ID NO: 249964 - RNA, 18 nt, Homo sapiens
uccaguuuucccagcauc

SEQ ID NO: 249965 - RNA, 20 nt, Homo sapiens
uccaguuuuggagacauucu

SEQ ID NO: 249966 - RNA, 22 nt, Homo sapiens
uccauguagaugcuauguuguc

SEQ ID NO: 249967 - RNA, 22 nt, Homo sapiens
uccaugugaaaaggucgugaua

SEQ ID NO: 249968 - RNA, 22 nt, Homo sapiens
uccauuuguuguaggguauagu

SEQ ID NO: 249969 - RNA, 22 nt, Homo sapiens
ucccaagaugagaugggggcug

SEQ ID NO: 249970 - RNA, 19 nt, Homo sapiens
ucccaauguuuccaggcag

SEQ ID NO: 249971 - RNA, 16 nt, Homo sapiens
ucccaccauugcuugu

SEQ ID NO: 249972 - RNA, 22 nt, Homo sapiens
ucccacugucuucucgugcucg

SEQ ID NO: 249973 - RNA, 23 nt, Homo sapiens
uccccgggagcaccagcuuguug

SEQ ID NO: 249974 - RNA, 22 nt, Homo sapiens
ucccgaggacaucugggggcaa

SEQ ID NO: 249975 - RNA, 22 nt, Homo sapiens
ucccguuauuaaccccugccuu

SEQ ID NO: 249976 - RNA, 18 nt, Homo sapiens
ucuuuggcugaacuguag

SEQ ID NO: 249977 - RNA, 22 nt, Homo sapiens
ucuuugguaauggaugucugau

SEQ ID NO: 249978 - RNA, 19 nt, Homo sapiens
ucuuugguacgugcuuuga

SEQ ID NO: 249979 - RNA, 22 nt, Homo sapiens
ucuuuggucaucaugggaagca

SEQ ID NO: 249980 - RNA, 22 nt, Homo sapiens
ucuuuggucuacuuucauaugu

SEQ ID NO: 249981 - RNA, 22 nt, Homo sapiens
ucuuuggugaauggucauccag

SEQ ID NO: 249982 - RNA, 22 nt, Homo sapiens
ucuuugguuguuuagggugcau

SEQ ID NO: 249983 - RNA, 22 nt, Homo sapiens
ucuuugucuacauccuguuaaa

SEQ ID NO: 249984 - RNA, 22 nt, Homo sapiens
ucuuuguguaggucaaucuggc

SEQ ID NO: 249985 - RNA, 22 nt, Homo sapiens
ucuuuguuggaguccaaggaua

SEQ ID NO: 249986 - RNA, 22 nt, Homo sapiens
ucuuuugggccucuugucagac

SEQ ID NO: 249987 - RNA, 22 nt, Homo sapiens
ugaaaaguuguugaaggcuuca

SEQ ID NO: 249988 - RNA, 22 nt, Homo sapiens
ugaaacauacacucugaugggg

SEQ ID NO: 249989 - RNA, 22 nt, Homo sapiens
ugaaagguauagguucuggagg

SEQ ID NO: 249990 - RNA, 22 nt, Homo sapiens
ugaaaugccuugagauuuugac

SEQ ID NO: 249991 - RNA, 22 nt, Homo sapiens
ugaaauggaagaagucccuuuu

SEQ ID NO: 249992 - RNA, 22 nt, Homo sapiens
ugaaaugucuuuaggaggcuuc

SEQ ID NO: 249993 - RNA, 22 nt, Homo sapiens
ugaaauguuaaacaaguggcuc

SEQ ID NO: 249994 - RNA, 22 nt, Homo sapiens
ugaaauguugggugauggaauc

SEQ ID NO: 249995 - RNA, 22 nt, Homo sapiens
ugaacuaguaguuuacuugaug

SEQ ID NO: 249996 - RNA, 22 nt, Homo sapiens
ugaacugagacuagacuuguuc

SEQ ID NO: 249997 - RNA, 20 nt, Homo sapiens
ugaacugguuacuuucuguc

SEQ ID NO: 249998 - RNA, 22 nt, Homo sapiens
ugaagagucuaaaucugucuuc

SEQ ID NO: 249999 - RNA, 19 nt, Homo sapiens
ugaaguauagggcuucuga

SEQ ID NO: 250000 - RNA, 22 nt, Homo sapiens
ugaagugaagacucacagaagg

SEQ ID NO: 250001 - RNA, 22 nt, Homo sapiens
ugaaguguuuuuucaggcaugu

SEQ ID NO: 250002 - RNA, 22 nt, Homo sapiens
ugaauagacacuaaagacugua

SEQ ID NO: 250003 - RNA, 22 nt, Homo sapiens
ugaauaggcaguuaaguuuaug

SEQ ID NO: 250004 - RNA, 22 nt, Homo sapiens
ugaauaguuugacagaacucuu

SEQ ID NO: 250005 - RNA, 22 nt, Homo sapiens
ugaaugguaaagaaaagcacug

SEQ ID NO: 250006 - RNA, 22 nt, Homo sapiens
ugaauguaacuaaaccugugaa

SEQ ID NO: 250007 - RNA, 22 nt, Homo sapiens
ugaauguaagaugucugcuggu

SEQ ID NO: 250008 - RNA, 22 nt, Homo sapiens
ugaauguacuuaacacuggauu

SEQ ID NO: 250009 - RNA, 18 nt, Homo sapiens
aaaaagugcucaggccua

SEQ ID NO: 250010 - RNA, 22 nt, Homo sapiens
aaaagagcugagagguauucuu

SEQ ID NO: 250011 - RNA, 22 nt, Homo sapiens
aaaagugguguuguuucuaaau

SEQ ID NO: 250012 - RNA, 22 nt, Homo sapiens
aaagaguucagguagauuucaa

SEQ ID NO: 250013 - RNA, 22 nt, Homo sapiens
aaagcacuggagucaucaucua

SEQ ID NO: 250014 - RNA, 22 nt, Homo sapiens
aaaggcacuagaaguuaccuuu

SEQ ID NO: 250015 - RNA, 20 nt, Homo sapiens
aaaggcugugagaacgagau

SEQ ID NO: 250016 - RNA, 22 nt, Homo sapiens
aaagggcuuuguaaacuucaag

SEQ ID NO: 250017 - RNA, 22 nt, Homo sapiens
aaagugacuuagugccccauuu

SEQ ID NO: 250018 - RNA, 22 nt, Homo sapiens
aaagugauuguaguuuuugcca

SEQ ID NO: 250019 - RNA, 22 nt, Homo sapiens
aaagugcacuuggaagagggcc

SEQ ID NO: 250020 - RNA, 22 nt, Homo sapiens
aaagugcuuacuaaguugccaa

SEQ ID NO: 250021 - RNA, 22 nt, Homo sapiens
aaagugguuuuucagacuuuga

SEQ ID NO: 250022 - RNA, 22 nt, Homo sapiens
aaauaguagcugaaugagggaa

SEQ ID NO: 250023 - RNA, 22 nt, Homo sapiens
aaaugcacaaagauuuugcacu

SEQ ID NO: 250024 - RNA, 22 nt, Homo sapiens
aaaugcacgcuacccagcuaga

SEQ ID NO: 250025 - RNA, 22 nt, Homo sapiens
aaaugcaucauuaggugauuuu

SEQ ID NO: 250026 - RNA, 22 nt, Homo sapiens
aaaugcaugaauaagcucgugu

SEQ ID NO: 250027 - RNA, 22 nt, Homo sapiens
aaaugcauggacagcuggucuu

SEQ ID NO: 250028 - RNA, 22 nt, Homo sapiens
aaaugcucuguggguaguaaug

SEQ ID NO: 250029 - RNA, 20 nt, Homo sapiens
aaaugcuguaauguuuggga

SEQ ID NO: 250030 - RNA, 22 nt, Homo sapiens
aaauggcacaguaagggcauuu

SEQ ID NO: 250031 - RNA, 22 nt, Homo sapiens
aaauucauuucagcucugggua

SEQ ID NO: 250032 - RNA, 22 nt, Homo sapiens
aaauugcuuuugaagacuuagu

SEQ ID NO: 250033 - RNA, 22 nt, Homo sapiens
aacacuaucugccuuacaggga

SEQ ID NO: 250034 - RNA, 22 nt, Homo sapiens
aacagagcuggugacuccaggu

SEQ ID NO: 250035 - RNA, 22 nt, Homo sapiens
aacagcuaguaccaauccacua

SEQ ID NO: 250036 - RNA, 22 nt, Homo sapiens
aacagugccugucauuuaguag

SEQ ID NO: 250037 - RNA, 21 nt, Homo sapiens
aacagugcuuaguagauguuc

SEQ ID NO: 250038 - RNA, 22 nt, Homo sapiens
aacagugcuucauucacacauu

SEQ ID NO: 250039 - RNA, 22 nt, Homo sapiens
aacccugacacaagcagaauuu

SEQ ID NO: 250040 - RNA, 22 nt, Homo sapiens
aacccugagucaugagucuaga

SEQ ID NO: 250041 - RNA, 22 nt, Homo sapiens
aaccugaagaaaauauuugcug

SEQ ID NO: 250042 - RNA, 15 nt, Homo sapiens
aaccuggaggagcuu

SEQ ID NO: 250043 - RNA, 22 nt, Homo sapiens
aacuacaucucuuugaggcagg

SEQ ID NO: 250044 - RNA, 22 nt, Homo sapiens
aacugcauuuucugauugugug

SEQ ID NO: 250045 - RNA, 22 nt, Homo sapiens
aacugcuguuuggguacuggug

SEQ ID NO: 250046 - RNA, 21 nt, Homo sapiens
aacuggugugagaugguaugu

SEQ ID NO: 250047 - RNA, 22 nt, Homo sapiens
aagaccuaugcaggaagaaaug

SEQ ID NO: 250048 - RNA, 22 nt, Homo sapiens
aagacuguaauccaucuugagu

SEQ ID NO: 250049 - RNA, 22 nt, Homo sapiens
aagagagccagcugguauauuu

SEQ ID NO: 250050 - RNA, 22 nt, Homo sapiens
aagagaugaagguccugacugu

SEQ ID NO: 250051 - RNA, 23 nt, Homo sapiens
aagagguaugacuaugaagugga

SEQ ID NO: 250052 - RNA, 22 nt, Homo sapiens
aagagguuuaacugacucacag

SEQ ID NO: 250053 - RNA, 22 nt, Homo sapiens
aagauaguaaacauuuucugcu

SEQ ID NO: 250054 - RNA, 22 nt, Homo sapiens
aagaugauguuguguuuucacu

SEQ ID NO: 250055 - RNA, 22 nt, Homo sapiens
aagaugcagaagcccagauguu

SEQ ID NO: 250056 - RNA, 22 nt, Homo sapiens
aagcacccagccucacgccugc

SEQ ID NO: 250057 - RNA, 22 nt, Homo sapiens
aagcaggugugggaggaaaugg

SEQ ID NO: 250058 - RNA, 22 nt, Homo sapiens
aagcaguguggacuaaugggaa

SEQ ID NO: 250059 - RNA, 22 nt, Homo sapiens
aagcaucacauaauggaucaug

SEQ ID NO: 250060 - RNA, 22 nt, Homo sapiens
aagcauccagcauggaacugaa

SEQ ID NO: 250061 - RNA, 22 nt, Homo sapiens
aagcaugguuuccaggggucac

SEQ ID NO: 250062 - RNA, 22 nt, Homo sapiens
aagcccauuguaaguugaggag

SEQ ID NO: 250063 - RNA, 22 nt, Homo sapiens
aagcuccauuucugccaugaga

SEQ ID NO: 250064 - RNA, 22 nt, Homo sapiens
aagcugcauuuucuagaugcuu

SEQ ID NO: 250065 - RNA, 22 nt, Homo sapiens
aaggaauacuggugguugcuau

SEQ ID NO: 250066 - RNA, 22 nt, Homo sapiens
aaggagcagagagcccuguuuc

SEQ ID NO: 250067 - RNA, 22 nt, Homo sapiens
aaggagcuaagagaucauacau

SEQ ID NO: 250068 - RNA, 22 nt, Homo sapiens
aaggcaagaagagaaccaucgg

SEQ ID NO: 250069 - RNA, 22 nt, Homo sapiens
aaggcaagagaaaauuucgagu

SEQ ID NO: 250070 - RNA, 22 nt, Homo sapiens
aaggcagugugcacauaacacu

SEQ ID NO: 250071 - RNA, 22 nt, Homo sapiens
aagggaauguuguggcugguug

SEQ ID NO: 250072 - RNA, 22 nt, Homo sapiens
aagggagcugcauaaucuugug

SEQ ID NO: 250073 - RNA, 22 nt, Homo sapiens
aaguaaacauugagagacaaga

SEQ ID NO: 250074 - RNA, 22 nt, Homo sapiens
aaguacuguuuaaauugcagaa

SEQ ID NO: 250075 - RNA, 19 nt, Homo sapiens
aaguacuugucuuuugaag

SEQ ID NO: 250076 - RNA, 22 nt, Homo sapiens
aaguagugcuugugcucaucuc

SEQ ID NO: 250077 - RNA, 22 nt, Homo sapiens
aaguaguuaggaacauucucuc

SEQ ID NO: 250078 - RNA, 19 nt, Homo sapiens
aaguaguugugacagaugc

SEQ ID NO: 250079 - RNA, 22 nt, Homo sapiens
aaguaucaggaauaguuauugg

SEQ ID NO: 250080 - RNA, 22 nt, Homo sapiens
aagucacugagacuuguggcug

SEQ ID NO: 250081 - RNA, 22 nt, Homo sapiens
aagucaguuugggagaagcuau

SEQ ID NO: 250082 - RNA, 23 nt, Homo sapiens
aagucauggaaucaaaugaggug

SEQ ID NO: 250083 - RNA, 22 nt, Homo sapiens
acugcacuccagccuccugaca

SEQ ID NO: 250084 - RNA, 22 nt, Homo sapiens
acugcacuccagccucggugac

SEQ ID NO: 250085 - RNA, 22 nt, Homo sapiens
acugcacuccagccugagccug

SEQ ID NO: 250086 - RNA, 22 nt, Homo sapiens
acugcacuccagccugaugaaa

SEQ ID NO: 250087 - RNA, 22 nt, Homo sapiens
acugcacuccagccugccgaca

SEQ ID NO: 250088 - RNA, 22 nt, Homo sapiens
acugcacuccagccugcuggca

SEQ ID NO: 250089 - RNA, 22 nt, Homo sapiens
acugcacuccagccuggaccac

SEQ ID NO: 250090 - RNA, 22 nt, Homo sapiens
acugcacuccagccuucaggac

SEQ ID NO: 250091 - RNA, 20 nt, Homo sapiens
acugcacuccagccuuccag

SEQ ID NO: 250092 - RNA, 22 nt, Homo sapiens
acugcacuccagccuuggcaac

SEQ ID NO: 250093 - RNA, 22 nt, Homo sapiens
acugcacuccagccuuggcggc

SEQ ID NO: 250094 - RNA, 22 nt, Homo sapiens
acugcacuccagccuuugcgau

SEQ ID NO: 250095 - RNA, 22 nt, Homo sapiens
acugcacuccagcuuuggguga

SEQ ID NO: 250096 - RNA, 20 nt, Homo sapiens
acugcacuccaggcugccca

SEQ ID NO: 250097 - RNA, 22 nt, Homo sapiens
acugcacucccgcccgggugac

SEQ ID NO: 250098 - RNA, 22 nt, Homo sapiens
acugcacuccggccucgugaca

SEQ ID NO: 250099 - RNA, 22 nt, Homo sapiens
acugcacucuagcuugggugac

SEQ ID NO: 250100 - RNA, 22 nt, Homo sapiens
acugcauuugucccuuuugaac

SEQ ID NO: 250101 - RNA, 22 nt, Homo sapiens
acuggaguuuguucaagaaaua

SEQ ID NO: 250102 - RNA, 22 nt, Homo sapiens
acuggauguuagggauuuuauu

SEQ ID NO: 250103 - RNA, 22 nt, Homo sapiens
acuggcuuaaggaugggccacu

SEQ ID NO: 250104 - RNA, 22 nt, Homo sapiens
acuggcuuuugagaaaaacacu

SEQ ID NO: 250105 - RNA, 22 nt, Homo sapiens
acuggguuaauuugaagguuga

SEQ ID NO: 250106 - RNA, 21 nt, Homo sapiens
acuuucuguggcaguccauuc

SEQ ID NO: 250107 - RNA, 19 nt, Homo sapiens
acuuuggugauuagaggga

SEQ ID NO: 250108 - RNA, 22 nt, Homo sapiens
acuuugguuaucauacuuucag

SEQ ID NO: 250109 - RNA, 22 nt, Homo sapiens
agaaaugcagcaugaggcggca

SEQ ID NO: 250110 - RNA, 22 nt, Homo sapiens
agaacacugaguucagggucag

SEQ ID NO: 250111 - RNA, 22 nt, Homo sapiens
agaacuguccauucagcaugaa

SEQ ID NO: 250112 - RNA, 22 nt, Homo sapiens
agaagaacauagggugacugaa

SEQ ID NO: 250113 - RNA, 19 nt, Homo sapiens
agaaucuaaauuauuucug

SEQ ID NO: 250114 - RNA, 22 nt, Homo sapiens
agaaugauccuucucagaggca

SEQ ID NO: 250115 - RNA, 22 nt, Homo sapiens
agaaugugaccuuauuuggaga

SEQ ID NO: 250116 - RNA, 22 nt, Homo sapiens
agaauucugucauguuuauauu

SEQ ID NO: 250117 - RNA, 20 nt, Homo sapiens
agacagcugcagcccacauc

SEQ ID NO: 250118 - RNA, 22 nt, Homo sapiens
agacccuguauguguuuaguuu

SEQ ID NO: 250119 - RNA, 22 nt, Homo sapiens
agacucauuuccauagucagcu

SEQ ID NO: 250120 - RNA, 22 nt, Homo sapiens
agagaccuguaaaguucaggca

SEQ ID NO: 250121 - RNA, 19 nt, Homo sapiens
agagacucauuguagcauu

SEQ ID NO: 250122 - RNA, 22 nt, Homo sapiens
agagauacauucugagaagugc

SEQ ID NO: 250123 - RNA, 22 nt, Homo sapiens
agagcacuguggguccaaauau

SEQ ID NO: 250124 - RNA, 22 nt, Homo sapiens
agagguuuuggggcugagagcu

SEQ ID NO: 250125 - RNA, 22 nt, Homo sapiens
agaguauacaugugagugagau

SEQ ID NO: 250126 - RNA, 22 nt, Homo sapiens
agaguauagcaacuuaguaaaa

SEQ ID NO: 250127 - RNA, 19 nt, Homo sapiens
agaguauugaauuugcccu

SEQ ID NO: 250128 - RNA, 19 nt, Homo sapiens
agaguauuguuacuucucu

SEQ ID NO: 250129 - RNA, 22 nt, Homo sapiens
agagugcuuuauuagauguagc

SEQ ID NO: 250130 - RNA, 22 nt, Homo sapiens
agaugauguuuacugagcauca

SEQ ID NO: 250131 - RNA, 22 nt, Homo sapiens
agaugguguuuucucaccagau

SEQ ID NO: 250132 - RNA, 22 nt, Homo sapiens
agcaaaucuaugaauguauauu

SEQ ID NO: 250133 - RNA, 22 nt, Homo sapiens
agcaacauuguucauaauagcu

SEQ ID NO: 250134 - RNA, 22 nt, Homo sapiens
agcaacauuuuugaccuuucuu

SEQ ID NO: 250135 - RNA, 22 nt, Homo sapiens
agcaagaaugaacucucccaga

SEQ ID NO: 250136 - RNA, 22 nt, Homo sapiens
agcaauaugacauugcuacauc

SEQ ID NO: 250137 - RNA, 22 nt, Homo sapiens
agcacauuaguaucuaagaaca

SEQ ID NO: 250138 - RNA, 17 nt, Homo sapiens
agcaccacacucucuug

SEQ ID NO: 250139 - RNA, 22 nt, Homo sapiens
agcaccagaaucugaguuauuc

SEQ ID NO: 250140 - RNA, 22 nt, Homo sapiens
agcagcacaucccuuucuggcc

SEQ ID NO: 250141 - RNA, 22 nt, Homo sapiens
agcagcauauuuuuauaaugua

SEQ ID NO: 250142 - RNA, 22 nt, Homo sapiens
agcagcaugcaaauggacuaau

SEQ ID NO: 250143 - RNA, 22 nt, Homo sapiens
agcagcauuaguggaaucuugu

SEQ ID NO: 250144 - RNA, 22 nt, Homo sapiens
agcaggucuuaacuugugaggu

SEQ ID NO: 250145 - RNA, 22 nt, Homo sapiens
agcaucacaugggcugcuuggg

SEQ ID NO: 250146 - RNA, 22 nt, Homo sapiens
agcaucacguagacuuuaccau

SEQ ID NO: 250147 - RNA, 18 nt, Homo sapiens
agcaucacugaucauccu

SEQ ID NO: 250148 - RNA, 20 nt, Homo sapiens
agcauugguuagaacaguag

SEQ ID NO: 250149 - RNA, 22 nt, Homo sapiens
agccaguauuuccacagagugg

SEQ ID NO: 250150 - RNA, 22 nt, Homo sapiens
agccaguauuuugaguuggucu

SEQ ID NO: 250151 - RNA, 22 nt, Homo sapiens
agccaguuuggcuaauuuuggc

SEQ ID NO: 250152 - RNA, 20 nt, Homo sapiens
agccccauguaaaccacaug

SEQ ID NO: 250153 - RNA, 17 nt, Homo sapiens
agccccauuagcuaguu

SEQ ID NO: 250154 - RNA, 23 nt, Homo sapiens
agcccugugacucgaacgaggag

SEQ ID NO: 250155 - RNA, 22 nt, Homo sapiens
agcccugugauuacuuuuauaa

SEQ ID NO: 250156 - RNA, 21 nt, Homo sapiens
agccugugggucauaguugcc

SEQ ID NO: 250157 - RNA, 22 nt, Homo sapiens
agccuucauucugacaguagga

SEQ ID NO: 250158 - RNA, 22 nt, Homo sapiens
agcgccacugcacuccagccug

SEQ ID NO: 250159 - RNA, 22 nt, Homo sapiens
agcgccauugcacuccagccuu

SEQ ID NO: 250160 - RNA, 21 nt, Homo sapiens
agcuaaauuggaaauuucugu

SEQ ID NO: 250161 - RNA, 22 nt, Homo sapiens
agcuaguauuuucuuaaggauu

SEQ ID NO: 250162 - RNA, 22 nt, Homo sapiens
agcuaguauuuuguuaaggauu

SEQ ID NO: 250163 - RNA, 22 nt, Homo sapiens
agcucauugcuguccuggagga

SEQ ID NO: 250164 - RNA, 22 nt, Homo sapiens
agcuccaucuucagggguucag

SEQ ID NO: 250165 - RNA, 22 nt, Homo sapiens
agcuccuuucugcaggcagguc

SEQ ID NO: 250166 - RNA, 21 nt, Homo sapiens
agcugcguuuaggcauuuucc

SEQ ID NO: 250167 - RNA, 22 nt, Homo sapiens
agcugguucuuugccuuguaga

SEQ ID NO: 250168 - RNA, 21 nt, Homo sapiens
agcugguuuccacagugugcu

SEQ ID NO: 250169 - RNA, 20 nt, Homo sapiens
agcugguuuuaugaaucuuu

SEQ ID NO: 250170 - RNA, 22 nt, Homo sapiens
agcuucauuguuaugaauguca

SEQ ID NO: 250171 - RNA, 20 nt, Homo sapiens
agcuugguuuggaugaucac

SEQ ID NO: 250172 - RNA, 22 nt, Homo sapiens
agcuuguguuuuucuaaguauc

SEQ ID NO: 250173 - RNA, 22 nt, Homo sapiens
aggaacuguaacuaugucucug

SEQ ID NO: 250174 - RNA, 22 nt, Homo sapiens
aggaagugucuucuuuuaggca

SEQ ID NO: 250175 - RNA, 22 nt, Homo sapiens
aggaccccucaucagcaccagu

SEQ ID NO: 250176 - RNA, 21 nt, Homo sapiens
aggagcauucaugacgagguu

SEQ ID NO: 250177 - RNA, 21 nt, Homo sapiens
aggcaaaugaagcagccgcuc

SEQ ID NO: 250178 - RNA, 22 nt, Homo sapiens
aggcaagagugacuacgugaaa

SEQ ID NO: 250179 - RNA, 21 nt, Homo sapiens
aggcaagguguuauuauugaa

SEQ ID NO: 250180 - RNA, 22 nt, Homo sapiens
aggcacacaacccuggaccuga

SEQ ID NO: 250181 - RNA, 22 nt, Homo sapiens
aggcacgguggcucacaccugu

SEQ ID NO: 250182 - RNA, 22 nt, Homo sapiens
aggcacggugucucaugccugu

SEQ ID NO: 250183 - RNA, 22 nt, Homo sapiens
aggcagaugagguccucagcug

SEQ ID NO: 250184 - RNA, 22 nt, Homo sapiens
aggcaugaguucagaggguaug

SEQ ID NO: 250185 - RNA, 22 nt, Homo sapiens
aucacaauuguacguaggagcc

SEQ ID NO: 250186 - RNA, 22 nt, Homo sapiens
aucacacuguuauuuuaguuaa

SEQ ID NO: 250187 - RNA, 22 nt, Homo sapiens
aucacagagucacgggcaacuu

SEQ ID NO: 250188 - RNA, 22 nt, Homo sapiens
aucacagauauggguuuaaauc

SEQ ID NO: 250189 - RNA, 22 nt, Homo sapiens
aucacagugaaaacagucaauu

SEQ ID NO: 250190 - RNA, 22 nt, Homo sapiens
aucacaguggcucacaagagcc

SEQ ID NO: 250191 - RNA, 22 nt, Homo sapiens
aucacaguuaagaggugaugaa

SEQ ID NO: 250192 - RNA, 22 nt, Homo sapiens
aucacaguuauaacauccuuuu

SEQ ID NO: 250193 - RNA, 22 nt, Homo sapiens
aucaccagaugcuucaagcaga

SEQ ID NO: 250194 - RNA, 22 nt, Homo sapiens
aucacugggagcagccauuaau

SEQ ID NO: 250195 - RNA, 22 nt, Homo sapiens
aucacugggcaagauaucauga

SEQ ID NO: 250196 - RNA, 20 nt, Homo sapiens
aucagagccggugaaagggc

SEQ ID NO: 250197 - RNA, 22 nt, Homo sapiens
aucagauguuuguauaggagua

SEQ ID NO: 250198 - RNA, 22 nt, Homo sapiens
aucagcagcaugaaaacggacu

SEQ ID NO: 250199 - RNA, 22 nt, Homo sapiens
aucaggcacacauuggaguuug

SEQ ID NO: 250200 - RNA, 18 nt, Homo sapiens
aucagggugaagagagga

SEQ ID NO: 250201 - RNA, 22 nt, Homo sapiens
aucagugaaagugaaaucuccg

SEQ ID NO: 250202 - RNA, 22 nt, Homo sapiens
aucagugcagugggaacuagaa

SEQ ID NO: 250203 - RNA, 22 nt, Homo sapiens
aucauaucaucugcaaacaaag

SEQ ID NO: 250204 - RNA, 22 nt, Homo sapiens
aucaucacaguuguguguaaug

SEQ ID NO: 250205 - RNA, 22 nt, Homo sapiens
aucauccugucaggagcuguga

SEQ ID NO: 250206 - RNA, 22 nt, Homo sapiens
aucauguuuauguguaggauau

SEQ ID NO: 250207 - RNA, 22 nt, Homo sapiens
aucauugugugaguugauggga

SEQ ID NO: 250208 - RNA, 22 nt, Homo sapiens
auccauguggauaaauguguau

SEQ ID NO: 250209 - RNA, 22 nt, Homo sapiens
auccauugcacuauggaaagug

SEQ ID NO: 250210 - RNA, 22 nt, Homo sapiens
aucccaguaaaaauggcuucua

SEQ ID NO: 250211 - RNA, 22 nt, Homo sapiens
auccccugcacggggugucauu

SEQ ID NO: 250212 - RNA, 22 nt, Homo sapiens
aucccugagaacuuuuaauguu

SEQ ID NO: 250213 - RNA, 22 nt, Homo sapiens
aucccuguaguaauauucuagc

SEQ ID NO: 250214 - RNA, 22 nt, Homo sapiens
aucccugugacgagcaucccua

SEQ ID NO: 250215 - RNA, 22 nt, Homo sapiens
aucccugugauccaaucacuuc

SEQ ID NO: 250216 - RNA, 22 nt, Homo sapiens
aucccuuucucuggcuaggggg

SEQ ID NO: 250217 - RNA, 22 nt, Homo sapiens
aucccuuucugauacuuucccu

SEQ ID NO: 250218 - RNA, 22 nt, Homo sapiens
auccucugagagaguuucauaa

SEQ ID NO: 250219 - RNA, 22 nt, Homo sapiens
auccugaagcuuuacugaauuc

SEQ ID NO: 250220 - RNA, 22 nt, Homo sapiens
auccugagacuuugcugaaguu

SEQ ID NO: 250221 - RNA, 22 nt, Homo sapiens
auccuguagagaugagggugga

SEQ ID NO: 250222 - RNA, 22 nt, Homo sapiens
auccuugagaaaauaaaugacc

SEQ ID NO: 250223 - RNA, 22 nt, Homo sapiens
aucgcacuccauccugggcaac

SEQ ID NO: 250224 - RNA, 22 nt, Homo sapiens
aucuagagacauaguaaagaau

SEQ ID NO: 250225 - RNA, 22 nt, Homo sapiens
aucucaguuaaugacccuaugc

SEQ ID NO: 250226 - RNA, 22 nt, Homo sapiens
aucucaguuaauuccaucuuuc

SEQ ID NO: 250227 - RNA, 22 nt, Homo sapiens
aucuccaggugccagcugcgcc

SEQ ID NO: 250228 - RNA, 22 nt, Homo sapiens
aucucugagauguucugauuuu

SEQ ID NO: 250229 - RNA, 22 nt, Homo sapiens
aucugauggagagcguguggcu

SEQ ID NO: 250230 - RNA, 22 nt, Homo sapiens
aucugcacaucuguguuuuugu

SEQ ID NO: 250231 - RNA, 22 nt, Homo sapiens
aucugugguuguaugcauauua

SEQ ID NO: 250232 - RNA, 22 nt, Homo sapiens
aucuucucuugaagggugggga

SEQ ID NO: 250233 - RNA, 22 nt, Homo sapiens
aucuuguguugaauggugcaga

SEQ ID NO: 250234 - RNA, 22 nt, Homo sapiens
augaaagucaauccccaagugu

SEQ ID NO: 250235 - RNA, 22 nt, Homo sapiens
augaaaucuuuggcagaucuua

SEQ ID NO: 250236 - RNA, 22 nt, Homo sapiens
augaacagagccuugagaaccu

SEQ ID NO: 250237 - RNA, 17 nt, Homo sapiens
augaacucaucauuuuu

SEQ ID NO: 250238 - RNA, 18 nt, Homo sapiens
augaacucaucauuuuua

SEQ ID NO: 250239 - RNA, 22 nt, Homo sapiens
augaagaucucugccuuguguc

SEQ ID NO: 250240 - RNA, 22 nt, Homo sapiens
augaagucguuacuaccaauug

SEQ ID NO: 250241 - RNA, 23 nt, Homo sapiens
augaauguaaagaaugugggaag

SEQ ID NO: 250242 - RNA, 22 nt, Homo sapiens
augaaugucuuauuuugagaaa

SEQ ID NO: 250243 - RNA, 22 nt, Homo sapiens
augacaaugaaucccuguuuca

SEQ ID NO: 250244 - RNA, 22 nt, Homo sapiens
augacaguaugacuccaaaagu

SEQ ID NO: 250245 - RNA, 22 nt, Homo sapiens
augacauguauuuccaggauuu

SEQ ID NO: 250246 - RNA, 22 nt, Homo sapiens
augaccagagagugcgcagggu

SEQ ID NO: 250247 - RNA, 22 nt, Homo sapiens
augacguugugggcucucaagc

SEQ ID NO: 250248 - RNA, 17 nt, Homo sapiens
augacuucuucagugug

SEQ ID NO: 250249 - RNA, 22 nt, Homo sapiens
augacuuuucugaaaaccacca

SEQ ID NO: 250250 - RNA, 22 nt, Homo sapiens
augagacauuaaaguguguuug

SEQ ID NO: 250251 - RNA, 22 nt, Homo sapiens
augagagugagagcagccccuu

SEQ ID NO: 250252 - RNA, 22 nt, Homo sapiens
augagauacuacaaaugaguuu

SEQ ID NO: 250253 - RNA, 22 nt, Homo sapiens
augagauauguuaaaaguuaaa

SEQ ID NO: 250254 - RNA, 22 nt, Homo sapiens
augagaugaggaauggcccucc

SEQ ID NO: 250255 - RNA, 22 nt, Homo sapiens
augagauucuuagagaagucug

SEQ ID NO: 250256 - RNA, 22 nt, Homo sapiens
augagauuguuugugugaaaua

SEQ ID NO: 250257 - RNA, 17 nt, Homo sapiens
augagcucaucauuuuu

SEQ ID NO: 250258 - RNA, 22 nt, Homo sapiens
augagcugauuuccuuaccaua

SEQ ID NO: 250259 - RNA, 22 nt, Homo sapiens
augagcuguuuggaagacacuu

SEQ ID NO: 250260 - RNA, 22 nt, Homo sapiens
augaggaaggagccuuugucug

SEQ ID NO: 250261 - RNA, 22 nt, Homo sapiens
augaggagauauuaaauaccau

SEQ ID NO: 250262 - RNA, 22 nt, Homo sapiens
augaggcaggaaaggcguaucu

SEQ ID NO: 250263 - RNA, 22 nt, Homo sapiens
augaggugcagaggaaaugagu

SEQ ID NO: 250264 - RNA, 20 nt, Homo sapiens
augagguguaugacacugaa

SEQ ID NO: 250265 - RNA, 22 nt, Homo sapiens
augagguguuuauuguauccug

SEQ ID NO: 250266 - RNA, 22 nt, Homo sapiens
augauaugagaaaggaucaaca

SEQ ID NO: 250267 - RNA, 22 nt, Homo sapiens
augauauuauucuagcccagag

SEQ ID NO: 250268 - RNA, 22 nt, Homo sapiens
augaucaucugaaagcuuuuac

SEQ ID NO: 250269 - RNA, 22 nt, Homo sapiens
augaucuagaguaggaaacaga

SEQ ID NO: 250270 - RNA, 22 nt, Homo sapiens
augauggaggccgugauggacg

SEQ ID NO: 250271 - RNA, 22 nt, Homo sapiens
augaugucauuuuaauuucuaa

SEQ ID NO: 250272 - RNA, 22 nt, Homo sapiens
augauguccacagggguguuca

SEQ ID NO: 250273 - RNA, 22 nt, Homo sapiens
augauugugaauaugugguuuu

SEQ ID NO: 250274 - RNA, 22 nt, Homo sapiens
augauuguucucacucaagaga

SEQ ID NO: 250275 - RNA, 22 nt, Homo sapiens
augcaaacaucauagaguguac

SEQ ID NO: 250276 - RNA, 22 nt, Homo sapiens
augcaaacaucugaagagacau

SEQ ID NO: 250277 - RNA, 22 nt, Homo sapiens
augcacauauguacugcccuau

SEQ ID NO: 250278 - RNA, 19 nt, Homo sapiens
augcacgugaaaugcauuu

SEQ ID NO: 250279 - RNA, 22 nt, Homo sapiens
augcacuguauaggaucuugcg

SEQ ID NO: 250280 - RNA, 22 nt, Homo sapiens
augcacuuggcaggaugauucc

SEQ ID NO: 250281 - RNA, 22 nt, Homo sapiens
augcagagaaaucuaaaauaug

SEQ ID NO: 250282 - RNA, 22 nt, Homo sapiens
augcagugugcaacagauuaag

SEQ ID NO: 250283 - RNA, 22 nt, Homo sapiens
augcauaugucuuuauaguggc

SEQ ID NO: 250284 - RNA, 18 nt, Homo sapiens
augcauauuuuaaguugu

SEQ ID NO: 250285 - RNA, 22 nt, Homo sapiens
augcauggucugaagucaaccu

SEQ ID NO: 250286 - RNA, 22 nt, Homo sapiens
augcaugucaaauuuguagguu

SEQ ID NO: 250287 - RNA, 22 nt, Homo sapiens
auuguacuccagccuguggagc

SEQ ID NO: 250288 - RNA, 22 nt, Homo sapiens
auuguacuccagccuuggggac

SEQ ID NO: 250289 - RNA, 22 nt, Homo sapiens
auuguacuuauugccagaauuu

SEQ ID NO: 250290 - RNA, 22 nt, Homo sapiens
auuguguagucuuacugcuugc

SEQ ID NO: 250291 - RNA, 22 nt, Homo sapiens
auuguuccccggucauuuuugu

SEQ ID NO: 250292 - RNA, 22 nt, Homo sapiens
auuguucuuguguccuuuuccu

SEQ ID NO: 250293 - RNA, 22 nt, Homo sapiens
auuuaaccaucugcaguggcac

SEQ ID NO: 250294 - RNA, 22 nt, Homo sapiens
auuuaugguuaauauaggaagu

SEQ ID NO: 250295 - RNA, 15 nt, Homo sapiens
auuucacuuagcaug

SEQ ID NO: 250296 - RNA, 22 nt, Homo sapiens
auuucuacuccuguguccagaa

SEQ ID NO: 250297 - RNA, 21 nt, Homo sapiens
auuugguguuagaaauaaauu

SEQ ID NO: 250298 - RNA, 22 nt, Homo sapiens
auuugguuauucaguuguucag

SEQ ID NO: 250299 - RNA, 22 nt, Homo sapiens
auuugucacuauguggcuaaua

SEQ ID NO: 250300 - RNA, 22 nt, Homo sapiens
auuuugguuacauaguugagcu

SEQ ID NO: 250301 - RNA, 22 nt, Homo sapiens
caaaagugguucuuauccuuuu

SEQ ID NO: 250302 - RNA, 22 nt, Homo sapiens
caaaggcuguuauaggccagga

SEQ ID NO: 250303 - RNA, 22 nt, Homo sapiens
caaaguaauugcuguuuugcca

SEQ ID NO: 250304 - RNA, 22 nt, Homo sapiens
caaaguaauugugguuuugcca

SEQ ID NO: 250305 - RNA, 22 nt, Homo sapiens
caaagugcuggaauuggccggg

SEQ ID NO: 250306 - RNA, 22 nt, Homo sapiens
caaagugcuggccgggcgcagu

SEQ ID NO: 250307 - RNA, 22 nt, Homo sapiens
caaauugcuugucuguagugga

SEQ ID NO: 250308 - RNA, 22 nt, Homo sapiens
caacacuguuuauuggauagcc

SEQ ID NO: 250309 - RNA, 22 nt, Homo sapiens
caacaguaaagcauuuuuaagu

SEQ ID NO: 250310 - RNA, 22 nt, Homo sapiens
caagagaccugagugucauucu

SEQ ID NO: 250311 - RNA, 22 nt, Homo sapiens
caagagagcugaugguuuuaaa

SEQ ID NO: 250312 - RNA, 22 nt, Homo sapiens
caaggaauucucaauagaguua

SEQ ID NO: 250313 - RNA, 22 nt, Homo sapiens
caaggugcugagacaggagccc

SEQ ID NO: 250314 - RNA, 21 nt, Homo sapiens
caagugaugcuucugcuuuaa

SEQ ID NO: 250315 - RNA, 22 nt, Homo sapiens
caagugcucuaggauccugagu

SEQ ID NO: 250316 - RNA, 22 nt, Homo sapiens
caauacuguuaccugaaauagg

SEQ ID NO: 250317 - RNA, 19 nt, Homo sapiens
caauacuucuuggcauaca

SEQ ID NO: 250318 - RNA, 22 nt, Homo sapiens
caaugcagcuuuuggagagaaa

SEQ ID NO: 250319 - RNA, 21 nt, Homo sapiens
caauggcacaaucucugcuca

SEQ ID NO: 250320 - RNA, 21 nt, Homo sapiens
caauggcacgaucuuggcuca

SEQ ID NO: 250321 - RNA, 22 nt, Homo sapiens
cacaaugucuaagauguuucua

SEQ ID NO: 250322 - RNA, 22 nt, Homo sapiens
cacaaugucugguaggccacuu

SEQ ID NO: 250323 - RNA, 22 nt, Homo sapiens
cacacugucuucaauggguggu

SEQ ID NO: 250324 - RNA, 22 nt, Homo sapiens
cacacuguuuuccauggggguu

SEQ ID NO: 250325 - RNA, 22 nt, Homo sapiens
cacagagugagacccugucucu

SEQ ID NO: 250326 - RNA, 22 nt, Homo sapiens
cacagcacaggcaugaguguca

SEQ ID NO: 250327 - RNA, 22 nt, Homo sapiens
cacagcuaacaacuguuucuuc

SEQ ID NO: 250328 - RNA, 22 nt, Homo sapiens
cacaguagaauagagcacuagg

SEQ ID NO: 250329 - RNA, 22 nt, Homo sapiens
cacagugaacugguggguuuuu

SEQ ID NO: 250330 - RNA, 22 nt, Homo sapiens
cacaguguucauagccaucagg

SEQ ID NO: 250331 - RNA, 22 nt, Homo sapiens
cacaguugccuaucuccugaag

SEQ ID NO: 250332 - RNA, 21 nt, Homo sapiens
cacauggaggcagagagugua

SEQ ID NO: 250333 - RNA, 22 nt, Homo sapiens
cacauguuugcuacauuuuucu

SEQ ID NO: 250334 - RNA, 22 nt, Homo sapiens
caccaaccucaguagcaucugu

SEQ ID NO: 250335 - RNA, 22 nt, Homo sapiens
caccacauuccauugaucaggc

SEQ ID NO: 250336 - RNA, 22 nt, Homo sapiens
caccacuacaccccaggcuggg

SEQ ID NO: 250337 - RNA, 22 nt, Homo sapiens
caccccuaccugagucaggagu

SEQ ID NO: 250338 - RNA, 22 nt, Homo sapiens
cacccuugcagggacagcuuug

SEQ ID NO: 250339 - RNA, 18 nt, Homo sapiens
cacugagcccuucacucu

SEQ ID NO: 250340 - RNA, 22 nt, Homo sapiens
cacugcacuccagucccgucuc

SEQ ID NO: 250341 - RNA, 22 nt, Homo sapiens
cacugcacuccagucugacgac

SEQ ID NO: 250342 - RNA, 22 nt, Homo sapiens
cacugcacuccaguuuggauga

SEQ ID NO: 250343 - RNA, 21 nt, Homo sapiens
cacugcacuugccuucugggu

SEQ ID NO: 250344 - RNA, 22 nt, Homo sapiens
cacugcaguggaagauuaagaa

SEQ ID NO: 250345 - RNA, 22 nt, Homo sapiens
cacugcaguguaauuaagguug

SEQ ID NO: 250346 - RNA, 22 nt, Homo sapiens
cacugcauccuugaccuucugg

SEQ ID NO: 250347 - RNA, 23 nt, Homo sapiens
cacugggcagcagguguucccag

SEQ ID NO: 250348 - RNA, 17 nt, Homo sapiens
cacugggugcaagagga

SEQ ID NO: 250349 - RNA, 22 nt, Homo sapiens
cacuggguuagaacaugcuccu

SEQ ID NO: 250350 - RNA, 22 nt, Homo sapiens
cacuggucagugaaacaguauu

SEQ ID NO: 250351 - RNA, 22 nt, Homo sapiens
cacugugcaaccuccaccuccc

SEQ ID NO: 250352 - RNA, 22 nt, Homo sapiens
cagagaacauucagagcuguag

SEQ ID NO: 250353 - RNA, 20 nt, Homo sapiens
cagagcaaagcaguccuggc

SEQ ID NO: 250354 - RNA, 22 nt, Homo sapiens
cagagcacugauacuggguucu

SEQ ID NO: 250355 - RNA, 22 nt, Homo sapiens
cagagguauugcaaaagccuag

SEQ ID NO: 250356 - RNA, 22 nt, Homo sapiens
cagagucaagcucuuguuccau

SEQ ID NO: 250357 - RNA, 22 nt, Homo sapiens
cagauacuccuggucucaggag

SEQ ID NO: 250358 - RNA, 22 nt, Homo sapiens
cagauacuggaguccugaaguu

SEQ ID NO: 250359 - RNA, 22 nt, Homo sapiens
cagcuaaauuguuaaauccaag

SEQ ID NO: 250360 - RNA, 22 nt, Homo sapiens
cagcuggugggagcuggguucc

SEQ ID NO: 250361 - RNA, 22 nt, Homo sapiens
cagcuguuguuaugucugcagg

SEQ ID NO: 250362 - RNA, 22 nt, Homo sapiens
caggcaacauggcgaaacucug

SEQ ID NO: 250363 - RNA, 22 nt, Homo sapiens
caggcagucuggggguguaucc

SEQ ID NO: 250364 - RNA, 20 nt, Homo sapiens
cagggcaaugaggagguaaa

SEQ ID NO: 250365 - RNA, 22 nt, Homo sapiens
cagggcaugugggucuauuggc

SEQ ID NO: 250366 - RNA, 22 nt, Homo sapiens
cagggcauugucuucuuaguac

SEQ ID NO: 250367 - RNA, 22 nt, Homo sapiens
caggguccccuaccuuuugaug

SEQ ID NO: 250368 - RNA, 22 nt, Homo sapiens
cagguaagaugcuuucucuuau

SEQ ID NO: 250369 - RNA, 22 nt, Homo sapiens
cagguagucaacgggucuugga

SEQ ID NO: 250370 - RNA, 21 nt, Homo sapiens
cagguagugucugaagccaga

SEQ ID NO: 250371 - RNA, 22 nt, Homo sapiens
caggucaucugaguuuaguucu

SEQ ID NO: 250372 - RNA, 22 nt, Homo sapiens
caguacaauguugauuagaagu

SEQ ID NO: 250373 - RNA, 22 nt, Homo sapiens
cagucacugggauuauggucau

SEQ ID NO: 250374 - RNA, 22 nt, Homo sapiens
cagugaauuucaggucaagagu

SEQ ID NO: 250375 - RNA, 22 nt, Homo sapiens
cagugacacugaaaaguucggg

SEQ ID NO: 250376 - RNA, 18 nt, Homo sapiens
cagugcaauacaggagag

SEQ ID NO: 250377 - RNA, 20 nt, Homo sapiens
cagugcaccuggcguguuga

SEQ ID NO: 250378 - RNA, 22 nt, Homo sapiens
cagugcaugacuguauauuauc

SEQ ID NO: 250379 - RNA, 22 nt, Homo sapiens
caguggaugaacaagaagugau

SEQ ID NO: 250380 - RNA, 22 nt, Homo sapiens
caguggauuggauggauaaugc

SEQ ID NO: 250381 - RNA, 22 nt, Homo sapiens
caguguaugcuucuauuuuugg

SEQ ID NO: 250382 - RNA, 22 nt, Homo sapiens
cauaaagauggaggaggccagg

SEQ ID NO: 250383 - RNA, 22 nt, Homo sapiens
cauacaugugcuugucuuaugc

SEQ ID NO: 250384 - RNA, 22 nt, Homo sapiens
cauagcacugcacuucagccug

SEQ ID NO: 250385 - RNA, 18 nt, Homo sapiens
cauagcacuucagcacau

SEQ ID NO: 250386 - RNA, 22 nt, Homo sapiens
caucacaguacuaaucgucaua

SEQ ID NO: 250387 - RNA, 22 nt, Homo sapiens
caucacaugcuuauuuuccuca

SEQ ID NO: 250388 - RNA, 21 nt, Homo sapiens
caucacauuacucaaaguccu

SEQ ID NO: 250389 - RNA, 22 nt, Homo sapiens
cucacugggaccacucugaagu

SEQ ID NO: 250390 - RNA, 22 nt, Homo sapiens
cucagaguacuuuucccacuuc

SEQ ID NO: 250391 - RNA, 20 nt, Homo sapiens
cucagugcacccccauaaaa

SEQ ID NO: 250392 - RNA, 22 nt, Homo sapiens
cucaguguuaaggccaccucug

SEQ ID NO: 250393 - RNA, 22 nt, Homo sapiens
cucaguuuugccuuguuuaagg

SEQ ID NO: 250394 - RNA, 22 nt, Homo sapiens
cucaugcugucuucugggguaa

SEQ ID NO: 250395 - RNA, 22 nt, Homo sapiens
cucauggauggucuggcagcca

SEQ ID NO: 250396 - RNA, 23 nt, Homo sapiens
cuccaugagccguccagggccug

SEQ ID NO: 250397 - RNA, 22 nt, Homo sapiens
cuccauuuaguccuuuuagaag

SEQ ID NO: 250398 - RNA, 22 nt, Homo sapiens
cuccccuuuaguuucuuaauaa

SEQ ID NO: 250399 - RNA, 22 nt, Homo sapiens
cucucuguuugucuguuauugg

SEQ ID NO: 250400 - RNA, 22 nt, Homo sapiens
cucugacagugguuagcacugu

SEQ ID NO: 250401 - RNA, 19 nt, Homo sapiens
cucuuuggugucucuucuu

SEQ ID NO: 250402 - RNA, 22 nt, Homo sapiens
cugaaucauugcauuaucaagg

SEQ ID NO: 250403 - RNA, 20 nt, Homo sapiens
cugaaugucaaggcagaggu

SEQ ID NO: 250404 - RNA, 22 nt, Homo sapiens
cugaauguuuucuucuauucug

SEQ ID NO: 250405 - RNA, 22 nt, Homo sapiens
cugacauuguugaucacagcca

SEQ ID NO: 250406 - RNA, 22 nt, Homo sapiens
cugacuaguuuuaaugcagauu

SEQ ID NO: 250407 - RNA, 22 nt, Homo sapiens
cugacuuuagaacccaaaaagu

SEQ ID NO: 250408 - RNA, 22 nt, Homo sapiens
cugagaaugaugauuuccaguu

SEQ ID NO: 250409 - RNA, 22 nt, Homo sapiens
cugagagaggagcuaaaacugc

SEQ ID NO: 250410 - RNA, 22 nt, Homo sapiens
cugagaguugaugaaauauggu

SEQ ID NO: 250411 - RNA, 22 nt, Homo sapiens
cugagaucaugggucagguggu

SEQ ID NO: 250412 - RNA, 22 nt, Homo sapiens
cugagaucugaaccaggagugu

SEQ ID NO: 250413 - RNA, 22 nt, Homo sapiens
cugagauggagucucgcauugu

SEQ ID NO: 250414 - RNA, 22 nt, Homo sapiens
cugagauuuuuagauccuggcg

SEQ ID NO: 250415 - RNA, 22 nt, Homo sapiens
cugagcacugagauccucuagc

SEQ ID NO: 250416 - RNA, 22 nt, Homo sapiens
cugagcuagaccacuuggcucc

SEQ ID NO: 250417 - RNA, 22 nt, Homo sapiens
cugagguaauuuguugccagua

SEQ ID NO: 250418 - RNA, 22 nt, Homo sapiens
cugaggugggaguuuuucucau

SEQ ID NO: 250419 - RNA, 22 nt, Homo sapiens
cugauauuuuucuggcuugugu

SEQ ID NO: 250420 - RNA, 22 nt, Homo sapiens
cugaugaaguauuuguucugga

SEQ ID NO: 250421 - RNA, 22 nt, Homo sapiens
cugauugucaucaauauuauua

SEQ ID NO: 250422 - RNA, 22 nt, Homo sapiens
cugauuguuugccucuaaaauc

SEQ ID NO: 250423 - RNA, 20 nt, Homo sapiens
cugcacauccacucuacuuc

SEQ ID NO: 250424 - RNA, 19 nt, Homo sapiens
cugcacugagaaaaggagg

SEQ ID NO: 250425 - RNA, 22 nt, Homo sapiens
cugcacugagacccucuuugcu

SEQ ID NO: 250426 - RNA, 22 nt, Homo sapiens
cugcagguaggggcagcuuugg

SEQ ID NO: 250427 - RNA, 20 nt, Homo sapiens
cugcuccccuacaaaucuca

SEQ ID NO: 250428 - RNA, 22 nt, Homo sapiens
cuggaaacaucuuaggaaugca

SEQ ID NO: 250429 - RNA, 22 nt, Homo sapiens
cuggaaagaaacccuuaauucu

SEQ ID NO: 250430 - RNA, 22 nt, Homo sapiens
cuggaagaaaaucacgccaucu

SEQ ID NO: 250431 - RNA, 18 nt, Homo sapiens
cuggaaggcuacuacagu

SEQ ID NO: 250432 - RNA, 22 nt, Homo sapiens
cuggaaugugagccccaaaaag

SEQ ID NO: 250433 - RNA, 22 nt, Homo sapiens
cuggaauucaaaaucugaauuu

SEQ ID NO: 250434 - RNA, 22 nt, Homo sapiens
cuggagauauuggaagaaagaa

SEQ ID NO: 250435 - RNA, 22 nt, Homo sapiens
cuggagcaaaggugacucuugu

SEQ ID NO: 250436 - RNA, 22 nt, Homo sapiens
cuggaggccugaacauaaaugg

SEQ ID NO: 250437 - RNA, 22 nt, Homo sapiens
cuggauauguugcaacauuucc

SEQ ID NO: 250438 - RNA, 20 nt, Homo sapiens
cuggaucaucaguaaaguua

SEQ ID NO: 250439 - RNA, 22 nt, Homo sapiens
cuggcacagugucagaaacaca

SEQ ID NO: 250440 - RNA, 22 nt, Homo sapiens
cuggcaguguuucuugugggcu

SEQ ID NO: 250441 - RNA, 22 nt, Homo sapiens
cuggcaucuaaauacuugaugu

SEQ ID NO: 250442 - RNA, 22 nt, Homo sapiens
cuggcucugggcuaaagaaaua

SEQ ID NO: 250443 - RNA, 22 nt, Homo sapiens
cuggcugagugguaaguagagg

SEQ ID NO: 250444 - RNA, 22 nt, Homo sapiens
cugggaugauguaaauaggcua

SEQ ID NO: 250445 - RNA, 22 nt, Homo sapiens
cugggcaaugcggcuggauaga

SEQ ID NO: 250446 - RNA, 22 nt, Homo sapiens
cugggguaggacuggcuuuuga

SEQ ID NO: 250447 - RNA, 22 nt, Homo sapiens
cuggugugugacuuuucauuau

SEQ ID NO: 250448 - RNA, 22 nt, Homo sapiens
cuguagacauuaggccugcacu

SEQ ID NO: 250449 - RNA, 19 nt, Homo sapiens
cugucacugaggaagacug

SEQ ID NO: 250450 - RNA, 22 nt, Homo sapiens
cugucacuggggcacauguccc

SEQ ID NO: 250451 - RNA, 22 nt, Homo sapiens
cugucagugggaguucaggcuu

SEQ ID NO: 250452 - RNA, 22 nt, Homo sapiens
cugucuggaggccugcaaauaa

SEQ ID NO: 250453 - RNA, 22 nt, Homo sapiens
cugucuguuucaaaagugguua

SEQ ID NO: 250454 - RNA, 22 nt, Homo sapiens
cugugcaaagcgcucucggggu

SEQ ID NO: 250455 - RNA, 22 nt, Homo sapiens
cugugcauucuuaaaucaggaa

SEQ ID NO: 250456 - RNA, 19 nt, Homo sapiens
cugugcauuucuguggaag

SEQ ID NO: 250457 - RNA, 22 nt, Homo sapiens
cugugcuugauuauaugagugu

SEQ ID NO: 250458 - RNA, 22 nt, Homo sapiens
cuguggguuuuacuguuuuacu

SEQ ID NO: 250459 - RNA, 20 nt, Homo sapiens
cugugguagggaccaggaau

SEQ ID NO: 250460 - RNA, 22 nt, Homo sapiens
cugugguugagcuuugccauga

SEQ ID NO: 250461 - RNA, 22 nt, Homo sapiens
cugugguuuaaggaauuuugac

SEQ ID NO: 250462 - RNA, 22 nt, Homo sapiens
cuguguaguacuagauugagca

SEQ ID NO: 250463 - RNA, 22 nt, Homo sapiens
cuguugguguuuaaucacugca

SEQ ID NO: 250464 - RNA, 18 nt, Homo sapiens
cuuaacauugggaugaua

SEQ ID NO: 250465 - RNA, 21 nt, Homo sapiens
cuuaagccacuaaguuuugga

SEQ ID NO: 250466 - RNA, 19 nt, Homo sapiens
cuuaggugaccaguuccca

SEQ ID NO: 250467 - RNA, 22 nt, Homo sapiens
cuucaccaguuuggcagucuca

SEQ ID NO: 250468 - RNA, 22 nt, Homo sapiens
cuucacuggagucccuggauuc

SEQ ID NO: 250469 - RNA, 18 nt, Homo sapiens
cuucauugcuguuuugcu

SEQ ID NO: 250470 - RNA, 20 nt, Homo sapiens
cuuccaguggccccaucuuu

SEQ ID NO: 250471 - RNA, 22 nt, Homo sapiens
cuuccauaguauuuuuacaaaa

SEQ ID NO: 250472 - RNA, 18 nt, Homo sapiens
cuuccuuagucugguuaa

SEQ ID NO: 250473 - RNA, 22 nt, Homo sapiens
cuucuugagggccugcugggaa

SEQ ID NO: 250474 - RNA, 22 nt, Homo sapiens
cuugaauguaaauaauguacag

SEQ ID NO: 250475 - RNA, 22 nt, Homo sapiens
cuugaccaauauggugaaaccc

SEQ ID NO: 250476 - RNA, 22 nt, Homo sapiens
cuugcacucagaagauucaguu

SEQ ID NO: 250477 - RNA, 21 nt, Homo sapiens
cuugucuugcuuagaauagac

SEQ ID NO: 250478 - RNA, 22 nt, Homo sapiens
cuugugccugaucuuagggggc

SEQ ID NO: 250479 - RNA, 22 nt, Homo sapiens
cuuguucuccuaagaugaaugc

SEQ ID NO: 250480 - RNA, 22 nt, Homo sapiens
cuuguuguggaggggagugcag

SEQ ID NO: 250481 - RNA, 22 nt, Homo sapiens
cuuuacaguuggacucacgagg

SEQ ID NO: 250482 - RNA, 22 nt, Homo sapiens
cuuucugaggagaauagagaac

SEQ ID NO: 250483 - RNA, 22 nt, Homo sapiens
cuuugauuauaaaaggguguuu

SEQ ID NO: 250484 - RNA, 22 nt, Homo sapiens
cuuugcacaucucugcuuuccc

SEQ ID NO: 250485 - RNA, 21 nt, Homo sapiens
cuuugcacugcuccucagcuc

SEQ ID NO: 250486 - RNA, 22 nt, Homo sapiens
cuuuggcauuagccuguauaga

SEQ ID NO: 250487 - RNA, 22 nt, Homo sapiens
cuuuggccauagcuaaaugauu

SEQ ID NO: 250488 - RNA, 22 nt, Homo sapiens
cuuugguuaauaggauauggca

SEQ ID NO: 250489 - RNA, 19 nt, Homo sapiens
cuuugguugagcguguugg

SEQ ID NO: 250490 - RNA, 22 nt, Homo sapiens
cuuugguugugcucuccacuuu

SEQ ID NO: 250491 - RNA, 22 nt, Homo sapiens
ggcccugauacaaguaaggucu

SEQ ID NO: 250492 - RNA, 22 nt, Homo sapiens
ggccugaugaaauguuagagua

SEQ ID NO: 250493 - RNA, 22 nt, Homo sapiens
ggcgguguccuccaagugcuuc

SEQ ID NO: 250494 - RNA, 22 nt, Homo sapiens
ggcucaguugcaaaucaguuca

SEQ ID NO: 250495 - RNA, 22 nt, Homo sapiens
ggcucaguuuccuccgucugcu

SEQ ID NO: 250496 - RNA, 22 nt, Homo sapiens
gggaaaaugucuauugaaugaa

SEQ ID NO: 250497 - RNA, 22 nt, Homo sapiens
gggaagaaggagugguuuacuc

SEQ ID NO: 250498 - RNA, 22 nt, Homo sapiens
gggagcaaaaaugaugcccaag

SEQ ID NO: 250499 - RNA, 22 nt, Homo sapiens
gggaucauuuuucauccuacag

SEQ ID NO: 250500 - RNA, 23 nt, Homo sapiens
gggauuguaaaauaugagggcag

SEQ ID NO: 250501 - RNA, 22 nt, Homo sapiens
gggcgagaaucggcugcucagc

SEQ ID NO: 250502 - RNA, 22 nt, Homo sapiens
gggguauguaagugagugagug

SEQ ID NO: 250503 - RNA, 22 nt, Homo sapiens
gggguuuuaccuucguauucuu

SEQ ID NO: 250504 - RNA, 22 nt, Homo sapiens
gggucauggaugugaagcuaga

SEQ ID NO: 250505 - RNA, 22 nt, Homo sapiens
gguauguagugugaaguaggga

SEQ ID NO: 250506 - RNA, 22 nt, Homo sapiens
ggucacauugcuagcauggguu

SEQ ID NO: 250507 - RNA, 22 nt, Homo sapiens
ggucacccugaugcuggugguc

SEQ ID NO: 250508 - RNA, 19 nt, Homo sapiens
ggucccucucaagucauuc

SEQ ID NO: 250509 - RNA, 21 nt, Homo sapiens
ggugagaaaggagacauagac

SEQ ID NO: 250510 - RNA, 22 nt, Homo sapiens
ggugagauguucagacgaacug

SEQ ID NO: 250511 - RNA, 23 nt, Homo sapiens
ggugaggaguacagagucuucau

SEQ ID NO: 250512 - RNA, 22 nt, Homo sapiens
ggugagguaggaaaaguuagga

SEQ ID NO: 250513 - RNA, 22 nt, Homo sapiens
guaaaugcagaugcaugaccuu

SEQ ID NO: 250514 - RNA, 22 nt, Homo sapiens
guaaauguccugcuacagagug

SEQ ID NO: 250515 - RNA, 22 nt, Homo sapiens
guaagugauagaauuaggauuc

SEQ ID NO: 250516 - RNA, 17 nt, Homo sapiens
guacacuucuucuguga

SEQ ID NO: 250517 - RNA, 22 nt, Homo sapiens
guacaugugcacagugugcagg

SEQ ID NO: 250518 - RNA, 22 nt, Homo sapiens
guagaaagcauuucagauuugc

SEQ ID NO: 250519 - RNA, 22 nt, Homo sapiens
guagagugcugggcacuggcuc

SEQ ID NO: 250520 - RNA, 22 nt, Homo sapiens
guagcagucacauagcagauug

SEQ ID NO: 250521 - RNA, 22 nt, Homo sapiens
guaguggcaugaucuuggcuca

SEQ ID NO: 250522 - RNA, 22 nt, Homo sapiens
guauaggcuuucaccacgccau

SEQ ID NO: 250523 - RNA, 22 nt, Homo sapiens
guaugaguuuucugaugugugg

SEQ ID NO: 250524 - RNA, 18 nt, Homo sapiens
guauuccagccugaguga

SEQ ID NO: 250525 - RNA, 22 nt, Homo sapiens
guauugacauuuuuaaggaacu

SEQ ID NO: 250526 - RNA, 22 nt, Homo sapiens
guauuguacuacaagcucuuua

SEQ ID NO: 250527 - RNA, 22 nt, Homo sapiens
guauuugauuauagcaugcuua

SEQ ID NO: 250528 - RNA, 22 nt, Homo sapiens
guauuuguugcagcagcacuau

SEQ ID NO: 250529 - RNA, 22 nt, Homo sapiens
guauuuuguuagggugugguau

SEQ ID NO: 250530 - RNA, 22 nt, Homo sapiens
gucaaaugcacagaaccauuaa

SEQ ID NO: 250531 - RNA, 22 nt, Homo sapiens
gucaagagaacuuucuaucacu

SEQ ID NO: 250532 - RNA, 22 nt, Homo sapiens
gucacagaaaaagauaugccaa

SEQ ID NO: 250533 - RNA, 22 nt, Homo sapiens
gucacauugaugcccauggugg

SEQ ID NO: 250534 - RNA, 22 nt, Homo sapiens
gucaccagcuguguuagccccu

SEQ ID NO: 250535 - RNA, 22 nt, Homo sapiens
gucacugacaagagagaagaac

SEQ ID NO: 250536 - RNA, 21 nt, Homo sapiens
gucacuggggcuggauaauuc

SEQ ID NO: 250537 - RNA, 22 nt, Homo sapiens
gucacugugacggcaguuacau

SEQ ID NO: 250538 - RNA, 22 nt, Homo sapiens
gucaggcaccgauacaguuuuu

SEQ ID NO: 250539 - RNA, 22 nt, Homo sapiens
gucagucugucccugccuggcg

SEQ ID NO: 250540 - RNA, 22 nt, Homo sapiens
gucagugauugauuuaaagacg

SEQ ID NO: 250541 - RNA, 22 nt, Homo sapiens
gucaguggagaaaaggacaugu

SEQ ID NO: 250542 - RNA, 22 nt, Homo sapiens
gucaugcaggguucgccagccc

SEQ ID NO: 250543 - RNA, 22 nt, Homo sapiens
gucaugucuugaaauucaguuu

SEQ ID NO: 250544 - RNA, 22 nt, Homo sapiens
gucauugagucagggaguaucu

SEQ ID NO: 250545 - RNA, 22 nt, Homo sapiens
gucccugaggaacauccagggc

SEQ ID NO: 250546 - RNA, 18 nt, Homo sapiens
gucucacaugguggaagc

SEQ ID NO: 250547 - RNA, 22 nt, Homo sapiens
gucucccagccuacauauuucu

SEQ ID NO: 250548 - RNA, 22 nt, Homo sapiens
gucucugguugcuuuuguacca

SEQ ID NO: 250549 - RNA, 22 nt, Homo sapiens
gucuggagacuugggucaucaa

SEQ ID NO: 250550 - RNA, 20 nt, Homo sapiens
gucugucuccgaguagaauu

SEQ ID NO: 250551 - RNA, 20 nt, Homo sapiens
gucuuguagcucaaguuauu

SEQ ID NO: 250552 - RNA, 22 nt, Homo sapiens
gucuuugagauaggguuauuuu

SEQ ID NO: 250553 - RNA, 22 nt, Homo sapiens
gucuuugcuuuuaaccagaggu

SEQ ID NO: 250554 - RNA, 22 nt, Homo sapiens
gugaaagacauauaugguuuga

SEQ ID NO: 250555 - RNA, 22 nt, Homo sapiens
gugaaagcaucugacugugcca

SEQ ID NO: 250556 - RNA, 22 nt, Homo sapiens
gugaaauacauaaucccaagug

SEQ ID NO: 250557 - RNA, 17 nt, Homo sapiens
gugaaaucaucauuuuu

SEQ ID NO: 250558 - RNA, 22 nt, Homo sapiens
gugaacaagcaaaggcaggagg

SEQ ID NO: 250559 - RNA, 22 nt, Homo sapiens
gugaacagaaccugggaucgaa

SEQ ID NO: 250560 - RNA, 22 nt, Homo sapiens
gugaaugaaugggugaauacau

SEQ ID NO: 250561 - RNA, 22 nt, Homo sapiens
gugaaugcauuaagaaggggga

SEQ ID NO: 250562 - RNA, 22 nt, Homo sapiens
gugaccaaagauagcucaaguu

SEQ ID NO: 250563 - RNA, 22 nt, Homo sapiens
gugacuaagauucuuugauaug

SEQ ID NO: 250564 - RNA, 22 nt, Homo sapiens
gugagauaucuagacuagggaa

SEQ ID NO: 250565 - RNA, 22 nt, Homo sapiens
gugagauggagucuugcuuugu

SEQ ID NO: 250566 - RNA, 22 nt, Homo sapiens
gugagcaaacuuaccuaagguu

SEQ ID NO: 250567 - RNA, 22 nt, Homo sapiens
gugagcauauuaguauugcacu

SEQ ID NO: 250568 - RNA, 22 nt, Homo sapiens
gugagggagcuggaauauuuau

SEQ ID NO: 250569 - RNA, 22 nt, Homo sapiens
gugagguaauuagcucccuuag

SEQ ID NO: 250570 - RNA, 21 nt, Homo sapiens
gugaggucauugggcuuucug

SEQ ID NO: 250571 - RNA, 22 nt, Homo sapiens
gugaguaaagguucauugaauu

SEQ ID NO: 250572 - RNA, 22 nt, Homo sapiens
gugagucaaucugagggguuca

SEQ ID NO: 250573 - RNA, 20 nt, Homo sapiens
gugauuggucacugguuguu

SEQ ID NO: 250574 - RNA, 22 nt, Homo sapiens
gugauuguuaaacugccucucu

SEQ ID NO: 250575 - RNA, 22 nt, Homo sapiens
gugauuuaguagaugcuaguua

SEQ ID NO: 250576 - RNA, 22 nt, Homo sapiens
gugcaaaucucugaguaucuuu

SEQ ID NO: 250577 - RNA, 22 nt, Homo sapiens
gugcaagagugacugcaguuuu

SEQ ID NO: 250578 - RNA, 22 nt, Homo sapiens
gugcaaugagaaggggcucugg

SEQ ID NO: 250579 - RNA, 22 nt, Homo sapiens
gugcacaacgugcaaguuuguu

SEQ ID NO: 250580 - RNA, 22 nt, Homo sapiens
gugcacaacguguagguuuguu

SEQ ID NO: 250581 - RNA, 22 nt, Homo sapiens
gugcacaaucgugcauuccuug

SEQ ID NO: 250582 - RNA, 23 nt, Homo sapiens
gugcaguggcgagauuucggcuc

SEQ ID NO: 250583 - RNA, 22 nt, Homo sapiens
gugcaguuuuaagugaguuucu

SEQ ID NO: 250584 - RNA, 22 nt, Homo sapiens
gugcaguuuugagugaguuucu

SEQ ID NO: 250585 - RNA, 19 nt, Homo sapiens
gugcauaguuauuaaagag

SEQ ID NO: 250586 - RNA, 22 nt, Homo sapiens
gugccuucuagcuaugguuggc

SEQ ID NO: 250587 - RNA, 22 nt, Homo sapiens
gugccuuuucugagcaaugagc

SEQ ID NO: 250588 - RNA, 22 nt, Homo sapiens
gugcgggaggcgcgccuaggug

SEQ ID NO: 250589 - RNA, 22 nt, Homo sapiens
gugcuauguuguuuuggccgaa

SEQ ID NO: 250590 - RNA, 16 nt, Homo sapiens
gugcuguguuguuagg

SEQ ID NO: 250591 - RNA, 22 nt, Homo sapiens
guggaaagaacacaaaauuagg

SEQ ID NO: 250592 - RNA, 21 nt, Homo sapiens
guggaaauggaauuuacuaau

SEQ ID NO: 250593 - RNA, 22 nt, Homo sapiens
uacaggcagguguucccugguu

SEQ ID NO: 250594 - RNA, 22 nt, Homo sapiens
uacaguacagugacaccauuau

SEQ ID NO: 250595 - RNA, 22 nt, Homo sapiens
uacauacuucacagacuuuaaa

SEQ ID NO: 250596 - RNA, 22 nt, Homo sapiens
uacauaguaagcaucuccugug

SEQ ID NO: 250597 - RNA, 22 nt, Homo sapiens
uacauaguagauauaggguuua

SEQ ID NO: 250598 - RNA, 22 nt, Homo sapiens
uacauguauacaggguuuacuu

SEQ ID NO: 250599 - RNA, 22 nt, Homo sapiens
uacauugcacuuuauuagauac

SEQ ID NO: 250600 - RNA, 22 nt, Homo sapiens
uaccacugccgagaaaacagau

SEQ ID NO: 250601 - RNA, 22 nt, Homo sapiens
uaccagcauuucucuuuaagua

SEQ ID NO: 250602 - RNA, 22 nt, Homo sapiens
uaccagugaauuccaggggcua

SEQ ID NO: 250603 - RNA, 22 nt, Homo sapiens
uaccaugcagguguauguuugu

SEQ ID NO: 250604 - RNA, 22 nt, Homo sapiens
uacccuguaaucugaaacauga

SEQ ID NO: 250605 - RNA, 22 nt, Homo sapiens
uacuacuuucucuucugggaaa

SEQ ID NO: 250606 - RNA, 22 nt, Homo sapiens
uacucaguagacacucauaugu

SEQ ID NO: 250607 - RNA, 22 nt, Homo sapiens
uacucaguagucuguugcuguc

SEQ ID NO: 250608 - RNA, 22 nt, Homo sapiens
uacugcacuccagccucgguga

SEQ ID NO: 250609 - RNA, 22 nt, Homo sapiens
uacugcacuccagccugccaac

SEQ ID NO: 250610 - RNA, 22 nt, Homo sapiens
uacugcacuccagccugggaga

SEQ ID NO: 250611 - RNA, 22 nt, Homo sapiens
uacugcacuccagccuugccaa

SEQ ID NO: 250612 - RNA, 18 nt, Homo sapiens
uacugcacucuccagccu

SEQ ID NO: 250613 - RNA, 22 nt, Homo sapiens
uacugcaguugcagcuugagga

SEQ ID NO: 250614 - RNA, 22 nt, Homo sapiens
uacugcauuucacuguuaaaga

SEQ ID NO: 250615 - RNA, 22 nt, Homo sapiens
uacugcuuaagggcaugggccc

SEQ ID NO: 250616 - RNA, 22 nt, Homo sapiens
uacuggccuugaacucuggugu

SEQ ID NO: 250617 - RNA, 22 nt, Homo sapiens
uacuguacugcaguucugcaaa

SEQ ID NO: 250618 - RNA, 21 nt, Homo sapiens
uacuugagacagggucuugcu

SEQ ID NO: 250619 - RNA, 22 nt, Homo sapiens
uagaauguauaauauuuuacuu

SEQ ID NO: 250620 - RNA, 22 nt, Homo sapiens
uagagcaaugacucuggaaacc

SEQ ID NO: 250621 - RNA, 22 nt, Homo sapiens
uagagcacagugauuagaccua

SEQ ID NO: 250622 - RNA, 22 nt, Homo sapiens
uagagccauugcagauguuuga

SEQ ID NO: 250623 - RNA, 22 nt, Homo sapiens
uagagcuacagcccucacuguc

SEQ ID NO: 250624 - RNA, 22 nt, Homo sapiens
uagagguauuaacaguagaaga

SEQ ID NO: 250625 - RNA, 19 nt, Homo sapiens
uagagguuuaagaaaagaa

SEQ ID NO: 250626 - RNA, 22 nt, Homo sapiens
uagaguguaaaccacauaguga

SEQ ID NO: 250627 - RNA, 22 nt, Homo sapiens
uagauucauuuuagcaaaaguu

SEQ ID NO: 250628 - RNA, 22 nt, Homo sapiens
uagcaaaucaauggaauugaag

SEQ ID NO: 250629 - RNA, 23 nt, Homo sapiens
uagcaacaguuggaggugaggua

SEQ ID NO: 250630 - RNA, 22 nt, Homo sapiens
uagcaacauucagcucagguac

SEQ ID NO: 250631 - RNA, 22 nt, Homo sapiens
uagcaagaugaauuugugcaaa

SEQ ID NO: 250632 - RNA, 22 nt, Homo sapiens
uagcagcaucucuggcuucuac

SEQ ID NO: 250633 - RNA, 22 nt, Homo sapiens
uagcagccaggaagggcuggcu

SEQ ID NO: 250634 - RNA, 21 nt, Homo sapiens
uagcagcguuguugcaaaugu

SEQ ID NO: 250635 - RNA, 22 nt, Homo sapiens
uagcaggaaaccuguguugagg

SEQ ID NO: 250636 - RNA, 22 nt, Homo sapiens
uagcccagugagguugauuugg

SEQ ID NO: 250637 - RNA, 22 nt, Homo sapiens
uagccuguggugaauguuucug

SEQ ID NO: 250638 - RNA, 18 nt, Homo sapiens
uagcucuuguugguccau

SEQ ID NO: 250639 - RNA, 22 nt, Homo sapiens
uagcuggaguuuuuguuauagg

SEQ ID NO: 250640 - RNA, 18 nt, Homo sapiens
uaggaacauugauuggag

SEQ ID NO: 250641 - RNA, 22 nt, Homo sapiens
uaggaaguuucuugauuacuua

SEQ ID NO: 250642 - RNA, 19 nt, Homo sapiens
uaggacccugguggccccc

SEQ ID NO: 250643 - RNA, 22 nt, Homo sapiens
uaggagcacaaacccuacugug

SEQ ID NO: 250644 - RNA, 22 nt, Homo sapiens
uaggauaguccuccugagaccu

SEQ ID NO: 250645 - RNA, 22 nt, Homo sapiens
uaggcagccagcuguggauuga

SEQ ID NO: 250646 - RNA, 19 nt, Homo sapiens
uagggcacgaggcagaguc

SEQ ID NO: 250647 - RNA, 22 nt, Homo sapiens
uagguagauuuaaagauuuucu

SEQ ID NO: 250648 - RNA, 22 nt, Homo sapiens
uaggucuuuuagcauaggagcu

SEQ ID NO: 250649 - RNA, 19 nt, Homo sapiens
uaggugguuuuccccucac

SEQ ID NO: 250650 - RNA, 22 nt, Homo sapiens
uagguucucaggaaugagcuuc

SEQ ID NO: 250651 - RNA, 22 nt, Homo sapiens
uaguagcauaccuaaguauacu

SEQ ID NO: 250652 - RNA, 22 nt, Homo sapiens
uaguauguuuauagcauugagu

SEQ ID NO: 250653 - RNA, 22 nt, Homo sapiens
uagucacacacucaacuuuuca

SEQ ID NO: 250654 - RNA, 22 nt, Homo sapiens
uagugaauguuggcuauuaaua

SEQ ID NO: 250655 - RNA, 22 nt, Homo sapiens
uagugcugagauugagaagccc

SEQ ID NO: 250656 - RNA, 22 nt, Homo sapiens
uagugcuguaauucuaaugaaa

SEQ ID NO: 250657 - RNA, 22 nt, Homo sapiens
uauaaaguaauuucuaggggcu

SEQ ID NO: 250658 - RNA, 22 nt, Homo sapiens
uauagcaaugugccacucucug

SEQ ID NO: 250659 - RNA, 20 nt, Homo sapiens
uauagcaauuuuuuucuccu

SEQ ID NO: 250660 - RNA, 22 nt, Homo sapiens
uauagcacaucuguguguacau

SEQ ID NO: 250661 - RNA, 22 nt, Homo sapiens
uauagcaguguaagaaucgagu

SEQ ID NO: 250662 - RNA, 22 nt, Homo sapiens
uauagcauuuugauccuguaga

SEQ ID NO: 250663 - RNA, 22 nt, Homo sapiens
uauagcuugauuauggugaugg

SEQ ID NO: 250664 - RNA, 22 nt, Homo sapiens
uauaucuagagcggaccaggcu

SEQ ID NO: 250665 - RNA, 22 nt, Homo sapiens
uauauguucugugucccuuucg

SEQ ID NO: 250666 - RNA, 22 nt, Homo sapiens
uauauguucuugcacuggaaag

SEQ ID NO: 250667 - RNA, 22 nt, Homo sapiens
uaucaagaugacaaacuuugcu

SEQ ID NO: 250668 - RNA, 22 nt, Homo sapiens
uaucaagauggauaaggauaga

SEQ ID NO: 250669 - RNA, 22 nt, Homo sapiens
uaucacacaucaugguaaaucu

SEQ ID NO: 250670 - RNA, 22 nt, Homo sapiens
uaucacaggucaggaaccuugu

SEQ ID NO: 250671 - RNA, 22 nt, Homo sapiens
uaucacaguaucuagcacagug

SEQ ID NO: 250672 - RNA, 22 nt, Homo sapiens
uaucacagugcuggaguauucc

SEQ ID NO: 250673 - RNA, 20 nt, Homo sapiens
uaucacauggggagaaaccu

SEQ ID NO: 250674 - RNA, 21 nt, Homo sapiens
uaucacauuggugauuaaguu

SEQ ID NO: 250675 - RNA, 22 nt, Homo sapiens
uaucaccuugcaguggaugcua

SEQ ID NO: 250676 - RNA, 19 nt, Homo sapiens
uaucacuucccuggaaaca

SEQ ID NO: 250677 - RNA, 22 nt, Homo sapiens
uaucacuuugauaguuuaaaug

SEQ ID NO: 250678 - RNA, 22 nt, Homo sapiens
uaucauagucacuuccaguuug

SEQ ID NO: 250679 - RNA, 22 nt, Homo sapiens
uaucaucauguuuuugcugugu

SEQ ID NO: 250680 - RNA, 18 nt, Homo sapiens
uaucauguagggaaguug

SEQ ID NO: 250681 - RNA, 22 nt, Homo sapiens
uaucccaauguaauaucacaaa

SEQ ID NO: 250682 - RNA, 21 nt, Homo sapiens
uaucccagucacaucuaccca

SEQ ID NO: 250683 - RNA, 22 nt, Homo sapiens
uaucccaguggauguaccccau

SEQ ID NO: 250684 - RNA, 22 nt, Homo sapiens
uaucccuguggacuucccaaca

SEQ ID NO: 250685 - RNA, 22 nt, Homo sapiens
uaucguaguguuggaaaacaag

SEQ ID NO: 250686 - RNA, 22 nt, Homo sapiens
uaucucacauauucaguagguu

SEQ ID NO: 250687 - RNA, 22 nt, Homo sapiens
uaucucagaugagacuuguaac

SEQ ID NO: 250688 - RNA, 22 nt, Homo sapiens
uaucucaguguacaggaugaua

SEQ ID NO: 250689 - RNA, 22 nt, Homo sapiens
uaugaaacucuaagauucacau

SEQ ID NO: 250690 - RNA, 20 nt, Homo sapiens
uaugacacugucauaaaaau

SEQ ID NO: 250691 - RNA, 22 nt, Homo sapiens
uaugacucagaaggcacacaca

SEQ ID NO: 250692 - RNA, 22 nt, Homo sapiens
uaugacuuuggaaaaauuacuu

SEQ ID NO: 250693 - RNA, 22 nt, Homo sapiens
uaugacuuuugaauacagaugg

SEQ ID NO: 250694 - RNA, 22 nt, Homo sapiens
uaugagacugguuaauuuuugu

SEQ ID NO: 250695 - RNA, 22 nt, Homo sapiens
ucagucauguuuaccagacgua

SEQ ID NO: 250696 - RNA, 22 nt, Homo sapiens
ucagugaauacauguacucaug

SEQ ID NO: 250697 - RNA, 22 nt, Homo sapiens
ucagugaauauauaacagcgau

SEQ ID NO: 250698 - RNA, 22 nt, Homo sapiens
ucagugccauugccauaugagu

SEQ ID NO: 250699 - RNA, 22 nt, Homo sapiens
ucaguggagccucacucugugg

SEQ ID NO: 250700 - RNA, 22 nt, Homo sapiens
ucaguggagcuacaauucuggg

SEQ ID NO: 250701 - RNA, 23 nt, Homo sapiens
ucagugucuggauccugcucagu

SEQ ID NO: 250702 - RNA, 22 nt, Homo sapiens
ucaguuuagguguaacggccac

SEQ ID NO: 250703 - RNA, 22 nt, Homo sapiens
ucauacaggccaccagggaagu

SEQ ID NO: 250704 - RNA, 22 nt, Homo sapiens
ucauacaguaguccucacuugu

SEQ ID NO: 250705 - RNA, 22 nt, Homo sapiens
ucauacuguccaauucuagugg

SEQ ID NO: 250706 - RNA, 22 nt, Homo sapiens
ucauaucauuagaucuacugua

SEQ ID NO: 250707 - RNA, 22 nt, Homo sapiens
ucauauugcgguucauugacuu

SEQ ID NO: 250708 - RNA, 21 nt, Homo sapiens
ucaucagucaaagacaauggu

SEQ ID NO: 250709 - RNA, 20 nt, Homo sapiens
ucaucaguuggugcucgcug

SEQ ID NO: 250710 - RNA, 22 nt, Homo sapiens
ucaugaaguaguuaacugguug

SEQ ID NO: 250711 - RNA, 22 nt, Homo sapiens
ucaugaccaugguauagaccac

SEQ ID NO: 250712 - RNA, 21 nt, Homo sapiens
ucaugccacugcacuuuagcc

SEQ ID NO: 250713 - RNA, 22 nt, Homo sapiens
ucauggcauuguuaaggguuuu

SEQ ID NO: 250714 - RNA, 22 nt, Homo sapiens
ucauggggugcuuugcuagauu

SEQ ID NO: 250715 - RNA, 22 nt, Homo sapiens
ucauggguuuugguccaagcaa

SEQ ID NO: 250716 - RNA, 19 nt, Homo sapiens
ucaugugcauacauuuggg

SEQ ID NO: 250717 - RNA, 22 nt, Homo sapiens
ucauucauuugcucacuccaca

SEQ ID NO: 250718 - RNA, 21 nt, Homo sapiens
ucauugggugcagcccacccu

SEQ ID NO: 250719 - RNA, 22 nt, Homo sapiens
ucauuguccaacuucuuucagu

SEQ ID NO: 250720 - RNA, 22 nt, Homo sapiens
uccaaaucucuggcacugggau

SEQ ID NO: 250721 - RNA, 22 nt, Homo sapiens
uccacaauggcugaacuagauu

SEQ ID NO: 250722 - RNA, 22 nt, Homo sapiens
uccagguuuggcuuuauaacuu

SEQ ID NO: 250723 - RNA, 22 nt, Homo sapiens
uccagugcauucagacacuugg

SEQ ID NO: 250724 - RNA, 22 nt, Homo sapiens
uccagugugcaggcaaguuuga

SEQ ID NO: 250725 - RNA, 22 nt, Homo sapiens
uccaguguuauaauaugcgucu

SEQ ID NO: 250726 - RNA, 22 nt, Homo sapiens
uccaguuuggaggcuugaugug

SEQ ID NO: 250727 - RNA, 22 nt, Homo sapiens
uccauaguugcacucuggagcc

SEQ ID NO: 250728 - RNA, 22 nt, Homo sapiens
uccauugucuagauguaacaca

SEQ ID NO: 250729 - RNA, 19 nt, Homo sapiens
ucccaagaugcucauacau

SEQ ID NO: 250730 - RNA, 23 nt, Homo sapiens
ucccaagauggaccagaccaagg

SEQ ID NO: 250731 - RNA, 22 nt, Homo sapiens
ucccagaaacgcauauguucau

SEQ ID NO: 250732 - RNA, 22 nt, Homo sapiens
ucccaguguguagcuugucucu

SEQ ID NO: 250733 - RNA, 22 nt, Homo sapiens
ucccaguuuuucugaauaguca

SEQ ID NO: 250734 - RNA, 19 nt, Homo sapiens
uccccaguuuuccguucag

SEQ ID NO: 250735 - RNA, 22 nt, Homo sapiens
uccccgagcccaggcugugacu

SEQ ID NO: 250736 - RNA, 22 nt, Homo sapiens
ucccugacagggucugagcuuu

SEQ ID NO: 250737 - RNA, 22 nt, Homo sapiens
ucccugacagucacagagcuac

SEQ ID NO: 250738 - RNA, 22 nt, Homo sapiens
ucccugagcaaaguuuucugua

SEQ ID NO: 250739 - RNA, 22 nt, Homo sapiens
ucccugagugauugaaaauaaa

SEQ ID NO: 250740 - RNA, 19 nt, Homo sapiens
ucccuuuguagguaaccug

SEQ ID NO: 250741 - RNA, 19 nt, Homo sapiens
ucccuuuguauggacauac

SEQ ID NO: 250742 - RNA, 22 nt, Homo sapiens
uccugagacucacaggcucccc

SEQ ID NO: 250743 - RNA, 22 nt, Homo sapiens
uccugagagcagacccucuaua

SEQ ID NO: 250744 - RNA, 22 nt, Homo sapiens
uccuucauuugucaacucuagu

SEQ ID NO: 250745 - RNA, 22 nt, Homo sapiens
uccuugaaacaggaagaauuca

SEQ ID NO: 250746 - RNA, 22 nt, Homo sapiens
uccuuggucaaaaagaaagugu

SEQ ID NO: 250747 - RNA, 22 nt, Homo sapiens
uccuuuagacugaauccugaga

SEQ ID NO: 250748 - RNA, 22 nt, Homo sapiens
uccuuuggguagcuguucagau

SEQ ID NO: 250749 - RNA, 22 nt, Homo sapiens
uccuuuggucaguauucuuuug

SEQ ID NO: 250750 - RNA, 22 nt, Homo sapiens
ucgguacuugagagagacacag

SEQ ID NO: 250751 - RNA, 22 nt, Homo sapiens
ucguggccugugaguccucccc

SEQ ID NO: 250752 - RNA, 22 nt, Homo sapiens
ucguucuugucaguuuauaaag

SEQ ID NO: 250753 - RNA, 22 nt, Homo sapiens
ucuaaaguacuacuacuguugg

SEQ ID NO: 250754 - RNA, 22 nt, Homo sapiens
ucucaaguggucgcaguuagau

SEQ ID NO: 250755 - RNA, 22 nt, Homo sapiens
ucucaauuugauuacauucaua

SEQ ID NO: 250756 - RNA, 22 nt, Homo sapiens
ucucacacugaauguguguggg

SEQ ID NO: 250757 - RNA, 22 nt, Homo sapiens
ucucagugacugcugggucccc

SEQ ID NO: 250758 - RNA, 22 nt, Homo sapiens
ucucaguggugcuggcagggga

SEQ ID NO: 250759 - RNA, 22 nt, Homo sapiens
ucucagugugguaaaaguuuuu

SEQ ID NO: 250760 - RNA, 22 nt, Homo sapiens
ucucaguuuucaagcugucgau

SEQ ID NO: 250761 - RNA, 21 nt, Homo sapiens
ucucauagaguuucacuuucu

SEQ ID NO: 250762 - RNA, 22 nt, Homo sapiens
ucucauggcucacccugcauag

SEQ ID NO: 250763 - RNA, 22 nt, Homo sapiens
ucucccauccaugaacuucugu

SEQ ID NO: 250764 - RNA, 17 nt, Homo sapiens
ucucccaucccuuucuc

SEQ ID NO: 250765 - RNA, 22 nt, Homo sapiens
ucucugaaacucuugacauccu

SEQ ID NO: 250766 - RNA, 22 nt, Homo sapiens
ucucugauuaaacaagauagug

SEQ ID NO: 250767 - RNA, 22 nt, Homo sapiens
ucugagcaauagauguggauau

SEQ ID NO: 250768 - RNA, 22 nt, Homo sapiens
ucugagcaugcaucuugccugg

SEQ ID NO: 250769 - RNA, 21 nt, Homo sapiens
ucugagucauucaguggccug

SEQ ID NO: 250770 - RNA, 22 nt, Homo sapiens
ucugaguggcagaaugagcuga

SEQ ID NO: 250771 - RNA, 23 nt, Homo sapiens
ucugauguuauaaaauucuuugg

SEQ ID NO: 250772 - RNA, 22 nt, Homo sapiens
ucugcauaucaugcagaacuau

SEQ ID NO: 250773 - RNA, 22 nt, Homo sapiens
ucugccuacugguuggaggaac

SEQ ID NO: 250774 - RNA, 22 nt, Homo sapiens
ucuggcaagagccgagggcagu

SEQ ID NO: 250775 - RNA, 21 nt, Homo sapiens
ucuggcccccucaaaucucau

SEQ ID NO: 250776 - RNA, 22 nt, Homo sapiens
ucuggccccucucaaaucucau

SEQ ID NO: 250777 - RNA, 22 nt, Homo sapiens
ucuggccuagaacaauuaauua

SEQ ID NO: 250778 - RNA, 22 nt, Homo sapiens
ucuggcuccaaagucuauuuuu

SEQ ID NO: 250779 - RNA, 16 nt, Homo sapiens
ucuggcucuacaguuc

SEQ ID NO: 250780 - RNA, 23 nt, Homo sapiens
ucuggcuuugggaugcucaaggg

SEQ ID NO: 250781 - RNA, 22 nt, Homo sapiens
ucugguguuauucauguaguuu

SEQ ID NO: 250782 - RNA, 22 nt, Homo sapiens
ucugucacugguggacgaucac

SEQ ID NO: 250783 - RNA, 22 nt, Homo sapiens
ucugucuugugguuugagugcc

SEQ ID NO: 250784 - RNA, 22 nt, Homo sapiens
ucuguguuugguuggcaauuuc

SEQ ID NO: 250785 - RNA, 22 nt, Homo sapiens
ucuuaggugaugauugauguga

SEQ ID NO: 250786 - RNA, 22 nt, Homo sapiens
ucuuaguuuagauuagcaauuc

SEQ ID NO: 250787 - RNA, 22 nt, Homo sapiens
ucuucuagcggaacccucuugu

SEQ ID NO: 250788 - RNA, 22 nt, Homo sapiens
ucuugccacuucauccccuuuc

SEQ ID NO: 250789 - RNA, 22 nt, Homo sapiens
ucuuggguuugccuugcugcug

SEQ ID NO: 250790 - RNA, 22 nt, Homo sapiens
ucuuggguuuguccuucuccua

SEQ ID NO: 250791 - RNA, 22 nt, Homo sapiens
ucuugguaaugucacauuuccu

SEQ ID NO: 250792 - RNA, 21 nt, Homo sapiens
ucuugguauguauuuaggagg

SEQ ID NO: 250793 - RNA, 22 nt, Homo sapiens
ucuugucacugcauccccagcu

SEQ ID NO: 250794 - RNA, 22 nt, Homo sapiens
ucuuuaguuaagggacauuuua

SEQ ID NO: 250795 - RNA, 22 nt, Homo sapiens
ucuuugccuaacccaaggucau

SEQ ID NO: 250796 - RNA, 22 nt, Homo sapiens
ucuuuggaggcgaucuguuuga

SEQ ID NO: 250797 - RNA, 22 nt, Homo sapiens
aaaaugcugauauugggcccca

SEQ ID NO: 250798 - RNA, 22 nt, Homo sapiens
aaacagucuucuccugagggac

SEQ ID NO: 250799 - RNA, 22 nt, Homo sapiens
aaacucuguagcagagacagau

SEQ ID NO: 250800 - RNA, 22 nt, Homo sapiens
aaagaagucagccuguccuuug

SEQ ID NO: 250801 - RNA, 22 nt, Homo sapiens
aaagcacugaauaaauuugcuu

SEQ ID NO: 250802 - RNA, 22 nt, Homo sapiens
aaagcaucacuuuuccuacuuu

SEQ ID NO: 250803 - RNA, 22 nt, Homo sapiens
aaagcuaagguagcauuggaga

SEQ ID NO: 250804 - RNA, 22 nt, Homo sapiens
aaagcuacaggaccugcucauu

SEQ ID NO: 250805 - RNA, 22 nt, Homo sapiens
aaagcuagagaagcugcuguca

SEQ ID NO: 250806 - RNA, 22 nt, Homo sapiens
aaagcugucaaggcaggaggcu

SEQ ID NO: 250807 - RNA, 22 nt, Homo sapiens
aaaggauucuaauggaaaugcu

SEQ ID NO: 250808 - RNA, 22 nt, Homo sapiens
aaaggcacugugacuuuauagg

SEQ ID NO: 250809 - RNA, 22 nt, Homo sapiens
aaaggcaucauuaguaccaagu

SEQ ID NO: 250810 - RNA, 22 nt, Homo sapiens
aaagggcuguuucuugacuugg

SEQ ID NO: 250811 - RNA, 22 nt, Homo sapiens
aaaguaauugcaguuuuugcaa

SEQ ID NO: 250812 - RNA, 22 nt, Homo sapiens
aaagucacuggagaaggaauau

SEQ ID NO: 250813 - RNA, 22 nt, Homo sapiens
aaagucuagaggaucaugugug

SEQ ID NO: 250814 - RNA, 22 nt, Homo sapiens
aaagugauguccaggcuuucag

SEQ ID NO: 250815 - RNA, 22 nt, Homo sapiens
aaagugauugcgguuuuugcca

SEQ ID NO: 250816 - RNA, 22 nt, Homo sapiens
aaagugcaguauuugggcagaa

SEQ ID NO: 250817 - RNA, 22 nt, Homo sapiens
aaagugcaguauuugggcagga

SEQ ID NO: 250818 - RNA, 22 nt, Homo sapiens
aaagugccugacucauaguuag

SEQ ID NO: 250819 - RNA, 22 nt, Homo sapiens
aaagugcuaggauuaccugggg

SEQ ID NO: 250820 - RNA, 22 nt, Homo sapiens
aaagugcugagaguucuaacuu

SEQ ID NO: 250821 - RNA, 22 nt, Homo sapiens
aaagugcugggaucacacugaa

SEQ ID NO: 250822 - RNA, 22 nt, Homo sapiens
aaagugcugggauuggccgggc

SEQ ID NO: 250823 - RNA, 22 nt, Homo sapiens
aaagugcugggauuuuaggcau

SEQ ID NO: 250824 - RNA, 22 nt, Homo sapiens
aaagugcuguagacugggcgca

SEQ ID NO: 250825 - RNA, 22 nt, Homo sapiens
aaagugcuucucuuuggugggu

SEQ ID NO: 250826 - RNA, 22 nt, Homo sapiens
aaaguggacuaagugaauauga

SEQ ID NO: 250827 - RNA, 22 nt, Homo sapiens
aaaguggugggauuccaggcau

SEQ ID NO: 250828 - RNA, 22 nt, Homo sapiens
aaaguggugugaguauguaucu

SEQ ID NO: 250829 - RNA, 19 nt, Homo sapiens
aaaguguuuuaaagaggau

SEQ ID NO: 250830 - RNA, 22 nt, Homo sapiens
aaaguucugcguuagggcuaaa

SEQ ID NO: 250831 - RNA, 22 nt, Homo sapiens
aaaugcagcacucaagugggaa

SEQ ID NO: 250832 - RNA, 22 nt, Homo sapiens
aaaugcccuaaaauggagcauc

SEQ ID NO: 250833 - RNA, 23 nt, Homo sapiens
aaaugcucucaggugccaguaga

SEQ ID NO: 250834 - RNA, 22 nt, Homo sapiens
aaaugcugcuuuggccucuucu

SEQ ID NO: 250835 - RNA, 22 nt, Homo sapiens
aaaugcuuucuuggaccauuug

SEQ ID NO: 250836 - RNA, 22 nt, Homo sapiens
aaauggcuuugaggguaggaca

SEQ ID NO: 250837 - RNA, 22 nt, Homo sapiens
aaauggcuuuuugggcaaggug

SEQ ID NO: 250838 - RNA, 22 nt, Homo sapiens
aaaugggacugggguccuuuga

SEQ ID NO: 250839 - RNA, 22 nt, Homo sapiens
aaaugucauggaguguuucccc

SEQ ID NO: 250840 - RNA, 19 nt, Homo sapiens
aaaugugcacuguuuucca

SEQ ID NO: 250841 - RNA, 22 nt, Homo sapiens
aaauugcaaugcgaggcagagg

SEQ ID NO: 250842 - RNA, 22 nt, Homo sapiens
aaauugcauugagcugcuuauu

SEQ ID NO: 250843 - RNA, 22 nt, Homo sapiens
aacagacugucacauaaaauug

SEQ ID NO: 250844 - RNA, 22 nt, Homo sapiens
aacaggcuccuaggggugcacc

SEQ ID NO: 250845 - RNA, 22 nt, Homo sapiens
aacaggguggugccugguccau

SEQ ID NO: 250846 - RNA, 22 nt, Homo sapiens
aacauagucaugggguaauguu

SEQ ID NO: 250847 - RNA, 22 nt, Homo sapiens
aacaucaaccaugaggguugga

SEQ ID NO: 250848 - RNA, 22 nt, Homo sapiens
aacuccauuuuagacccuagau

SEQ ID NO: 250849 - RNA, 22 nt, Homo sapiens
aacugcacuaggacagguuuuu

SEQ ID NO: 250850 - RNA, 22 nt, Homo sapiens
aacuggcauauucugguugcgg

SEQ ID NO: 250851 - RNA, 22 nt, Homo sapiens
aacuggcauguuuuaaggcuua

SEQ ID NO: 250852 - RNA, 18 nt, Homo sapiens
aagagcucagcacagguu

SEQ ID NO: 250853 - RNA, 22 nt, Homo sapiens
aagaggcuguaggauaaugccu

SEQ ID NO: 250854 - RNA, 22 nt, Homo sapiens
aagagguuauagaguguauacu

SEQ ID NO: 250855 - RNA, 22 nt, Homo sapiens
aagaguuaguaaaauuuccucu

SEQ ID NO: 250856 - RNA, 22 nt, Homo sapiens
aagaugauguucuuuuucuuag

SEQ ID NO: 250857 - RNA, 19 nt, Homo sapiens
aagaugauguuugggcuaa

SEQ ID NO: 250858 - RNA, 22 nt, Homo sapiens
aagaugcagucauacuggagua

SEQ ID NO: 250859 - RNA, 22 nt, Homo sapiens
aagcaaacaucagcuugguuaa

SEQ ID NO: 250860 - RNA, 20 nt, Homo sapiens
aagcagacauuuggaugaaa

SEQ ID NO: 250861 - RNA, 22 nt, Homo sapiens
aagccacuguaccugucucuua

SEQ ID NO: 250862 - RNA, 22 nt, Homo sapiens
aagcuacauuuuauuuauguca

SEQ ID NO: 250863 - RNA, 22 nt, Homo sapiens
aagcugccaggcaugguggcug

SEQ ID NO: 250864 - RNA, 22 nt, Homo sapiens
aagcugccuugcugaggagaaa

SEQ ID NO: 250865 - RNA, 22 nt, Homo sapiens
aagcuggauuucgcauccuguu

SEQ ID NO: 250866 - RNA, 22 nt, Homo sapiens
aagcuguuguucauccugaauu

SEQ ID NO: 250867 - RNA, 22 nt, Homo sapiens
aaggaagcuagcaggaauuggu

SEQ ID NO: 250868 - RNA, 22 nt, Homo sapiens
aaggaauucaaauuuucucugg

SEQ ID NO: 250869 - RNA, 22 nt, Homo sapiens
aaggagcuuaagugacuuguac

SEQ ID NO: 250870 - RNA, 22 nt, Homo sapiens
aaggaguaucuguuuucucacc

SEQ ID NO: 250871 - RNA, 22 nt, Homo sapiens
aaggagugugauucuucaguuu

SEQ ID NO: 250872 - RNA, 22 nt, Homo sapiens
aaggcaagguggauaaugaagc

SEQ ID NO: 250873 - RNA, 22 nt, Homo sapiens
aaggcacugaacuuaaauucug

SEQ ID NO: 250874 - RNA, 22 nt, Homo sapiens
aaggcaguggcagaagauguca

SEQ ID NO: 250875 - RNA, 22 nt, Homo sapiens
aaggcaugcugaguccuaaaag

SEQ ID NO: 250876 - RNA, 22 nt, Homo sapiens
aaggcauucucaaacuaguucu

SEQ ID NO: 250877 - RNA, 22 nt, Homo sapiens
aaggcuagagaagaagggcauc

SEQ ID NO: 250878 - RNA, 22 nt, Homo sapiens
aaggcucuuucaacguaaauua

SEQ ID NO: 250879 - RNA, 20 nt, Homo sapiens
aaggcuuucgaguuccaggg

SEQ ID NO: 250880 - RNA, 22 nt, Homo sapiens
aagggaauguuguggcugguuu

SEQ ID NO: 250881 - RNA, 22 nt, Homo sapiens
aagggaauguugugguugguuu

SEQ ID NO: 250882 - RNA, 22 nt, Homo sapiens
aaggugcuguaagcauccaugu

SEQ ID NO: 250883 - RNA, 22 nt, Homo sapiens
aagguggugucagagagcuuau

SEQ ID NO: 250884 - RNA, 22 nt, Homo sapiens
aaggugguuuucucuuggaguc

SEQ ID NO: 250885 - RNA, 22 nt, Homo sapiens
aaguaaacauuuuguacaauaa

SEQ ID NO: 250886 - RNA, 22 nt, Homo sapiens
aaguaaauauccgguaguccca

SEQ ID NO: 250887 - RNA, 22 nt, Homo sapiens
aaguccccugacagaggggagg

SEQ ID NO: 250888 - RNA, 22 nt, Homo sapiens
aagugaaugaugugaaguguaa

SEQ ID NO: 250889 - RNA, 22 nt, Homo sapiens
aagugaaugugcuggaauagcu

SEQ ID NO: 250890 - RNA, 22 nt, Homo sapiens
aagugcauguauuaguguaguc

SEQ ID NO: 250891 - RNA, 21 nt, Homo sapiens
aagugcucugggacucuaaau

SEQ ID NO: 250892 - RNA, 22 nt, Homo sapiens
aagugcugggauuggccgggca

SEQ ID NO: 250893 - RNA, 22 nt, Homo sapiens
aagugcuguaugggagccuagg

SEQ ID NO: 250894 - RNA, 22 nt, Homo sapiens
aagugcuguccuaccuuuggga

SEQ ID NO: 250895 - RNA, 22 nt, Homo sapiens
aagugcuuuacacaugcaugau

SEQ ID NO: 250896 - RNA, 22 nt, Homo sapiens
aaguggcauugaggaaaaaaau

SEQ ID NO: 250897 - RNA, 22 nt, Homo sapiens
aauaaagccugucucuuuagag

SEQ ID NO: 250898 - RNA, 22 nt, Homo sapiens
aauaaagcugaauccuuccuga

SEQ ID NO: 250899 - RNA, 22 nt, Homo sapiens
cauugcacuccauccuuggcaa

SEQ ID NO: 250900 - RNA, 22 nt, Homo sapiens
cauugcacucuagccucggcaa

SEQ ID NO: 250901 - RNA, 22 nt, Homo sapiens
cauugcacugcauucugggcaa

SEQ ID NO: 250902 - RNA, 22 nt, Homo sapiens
cauugcaguaagagugggcucu

SEQ ID NO: 250903 - RNA, 22 nt, Homo sapiens
cauugcaguuuuugguguaucu

SEQ ID NO: 250904 - RNA, 22 nt, Homo sapiens
cauugcaugccagccugggcaa

SEQ ID NO: 250905 - RNA, 22 nt, Homo sapiens
cauugcuaaaagucauauauaa

SEQ ID NO: 250906 - RNA, 22 nt, Homo sapiens
cauuguacauaaguauggagua

SEQ ID NO: 250907 - RNA, 22 nt, Homo sapiens
cauuuugguuaaauagguagcu

SEQ ID NO: 250908 - RNA, 22 nt, Homo sapiens
ccaaggaauacccucccuuuuu

SEQ ID NO: 250909 - RNA, 19 nt, Homo sapiens
ccacaaugguugaacuaga

SEQ ID NO: 250910 - RNA, 22 nt, Homo sapiens
ccacaguugaaauuuugacugu

SEQ ID NO: 250911 - RNA, 22 nt, Homo sapiens
ccaccgggucccagcucugcuc

SEQ ID NO: 250912 - RNA, 22 nt, Homo sapiens
ccacugugguaucugauacugg

SEQ ID NO: 250913 - RNA, 22 nt, Homo sapiens
ccagauguuuucauucagcaag

SEQ ID NO: 250914 - RNA, 20 nt, Homo sapiens
ccagcaucauuagauucugg

SEQ ID NO: 250915 - RNA, 22 nt, Homo sapiens
ccaggguuccacgccuggcugu

SEQ ID NO: 250916 - RNA, 22 nt, Homo sapiens
ccaggguugcuuuagauucuga

SEQ ID NO: 250917 - RNA, 22 nt, Homo sapiens
ccagguuucuagaauaauuccu

SEQ ID NO: 250918 - RNA, 22 nt, Homo sapiens
ccagugaacugcaagguuuuuc

SEQ ID NO: 250919 - RNA, 18 nt, Homo sapiens
ccagugcaaggaaagccc

SEQ ID NO: 250920 - RNA, 22 nt, Homo sapiens
ccaguuuucaagauaaugguuu

SEQ ID NO: 250921 - RNA, 17 nt, Homo sapiens
ccaguuuucccucagug

SEQ ID NO: 250922 - RNA, 22 nt, Homo sapiens
ccaguuuuuggcaaugaugaau

SEQ ID NO: 250923 - RNA, 22 nt, Homo sapiens
ccaucacgugcaguggccccac

SEQ ID NO: 250924 - RNA, 22 nt, Homo sapiens
ccaugaacuagaauagaacaug

SEQ ID NO: 250925 - RNA, 19 nt, Homo sapiens
ccauggcaaugaucugaug

SEQ ID NO: 250926 - RNA, 22 nt, Homo sapiens
ccauggcuauucuguaaggguu

SEQ ID NO: 250927 - RNA, 22 nt, Homo sapiens
ccauugcacuccagccucggca

SEQ ID NO: 250928 - RNA, 22 nt, Homo sapiens
ccauugcacucuggccuaggug

SEQ ID NO: 250929 - RNA, 21 nt, Homo sapiens
cccagguucucugaggguaga

SEQ ID NO: 250930 - RNA, 22 nt, Homo sapiens
cccaguagagauugccgaauug

SEQ ID NO: 250931 - RNA, 22 nt, Homo sapiens
cccagugaagagaaccuuacga

SEQ ID NO: 250932 - RNA, 22 nt, Homo sapiens
cccagugugaacuuggcauuuu

SEQ ID NO: 250933 - RNA, 22 nt, Homo sapiens
cccaguuuugccacuuacuagc

SEQ ID NO: 250934 - RNA, 22 nt, Homo sapiens
ccccagguuucaauaaagccca

SEQ ID NO: 250935 - RNA, 22 nt, Homo sapiens
ccccauguucucucugcagcuc

SEQ ID NO: 250936 - RNA, 22 nt, Homo sapiens
acaguguguguguucaccuaga

SEQ ID NO: 250937 - RNA, 22 nt, Homo sapiens
acaucauugggggcuacaggug

SEQ ID NO: 250938 - RNA, 22 nt, Homo sapiens
acaucuguacaguggguguggu

SEQ ID NO: 250939 - RNA, 22 nt, Homo sapiens
acaugagacuggguuuguaggg

SEQ ID NO: 250940 - RNA, 22 nt, Homo sapiens
acauguaauugauuuuguguua

SEQ ID NO: 250941 - RNA, 22 nt, Homo sapiens
acauugcucuuaccaaguuugu

SEQ ID NO: 250942 - RNA, 22 nt, Homo sapiens
accacaggguaaaguuagauau

SEQ ID NO: 250943 - RNA, 22 nt, Homo sapiens
accacagugcuuccugcucacg

SEQ ID NO: 250944 - RNA, 22 nt, Homo sapiens
accaccacucccgcauucuaaa

SEQ ID NO: 250945 - RNA, 22 nt, Homo sapiens
accaccauugcacugaacuuuc

SEQ ID NO: 250946 - RNA, 17 nt, Homo sapiens
accagugcaugugcuuu

SEQ ID NO: 250947 - RNA, 22 nt, Homo sapiens
accaguguuuaccaaguagcau

SEQ ID NO: 250948 - RNA, 22 nt, Homo sapiens
accauugcacuccaaccugggc

SEQ ID NO: 250949 - RNA, 22 nt, Homo sapiens
accauugcacuccagcccgggc

SEQ ID NO: 250950 - RNA, 22 nt, Homo sapiens
accauugcacuccagccuuggc

SEQ ID NO: 250951 - RNA, 17 nt, Homo sapiens
acccagucuuuuugcac

SEQ ID NO: 250952 - RNA, 22 nt, Homo sapiens
acccaguguucaacauucacau

SEQ ID NO: 250953 - RNA, 23 nt, Homo sapiens
accccuacaggcuuguguccugc

SEQ ID NO: 250954 - RNA, 17 nt, Homo sapiens
accccuaccucagaagc

SEQ ID NO: 250955 - RNA, 22 nt, Homo sapiens
acccgcccagguguggccggga

SEQ ID NO: 250956 - RNA, 22 nt, Homo sapiens
acccuacauaguagauccuaca

SEQ ID NO: 250957 - RNA, 22 nt, Homo sapiens
acccucagaccaguuucccugg

SEQ ID NO: 250958 - RNA, 22 nt, Homo sapiens
acccuggaggucuacagugcag

SEQ ID NO: 250959 - RNA, 22 nt, Homo sapiens
acccuguugucagaauguggau

SEQ ID NO: 250960 - RNA, 18 nt, Homo sapiens
acccuucagcacugggcc

SEQ ID NO: 250961 - RNA, 22 nt, Homo sapiens
accuggcacuuagcaaaucuga

SEQ ID NO: 250962 - RNA, 19 nt, Homo sapiens
accuguagaaaguacaaca

SEQ ID NO: 250963 - RNA, 22 nt, Homo sapiens
accuugcacugagccgagauug

SEQ ID NO: 250964 - RNA, 22 nt, Homo sapiens
acgaagacuauucaaaagguua

SEQ ID NO: 250965 - RNA, 22 nt, Homo sapiens
acuacaugugaugucaguauau

SEQ ID NO: 250966 - RNA, 19 nt, Homo sapiens
acuaggccuacaaagcuau

SEQ ID NO: 250967 - RNA, 22 nt, Homo sapiens
acucagagugggccccuagaua

SEQ ID NO: 250968 - RNA, 22 nt, Homo sapiens
acuccauuuccagagcagcccc

SEQ ID NO: 250969 - RNA, 22 nt, Homo sapiens
acugaauguaaacacggagugu

SEQ ID NO: 250970 - RNA, 20 nt, Homo sapiens
acugauauguuccuguucuc

SEQ ID NO: 250971 - RNA, 21 nt, Homo sapiens
acugcacuccaaccucaacag

SEQ ID NO: 250972 - RNA, 22 nt, Homo sapiens
acugcacuccaccuugggcaac

SEQ ID NO: 250973 - RNA, 22 nt, Homo sapiens
acugcacuccagcccgggugac

SEQ ID NO: 250974 - RNA, 22 nt, Homo sapiens
acugcacuccagccucaugaca

SEQ ID NO: 250975 - RNA, 22 nt, Homo sapiens
acugcacuccagccuccugggu

SEQ ID NO: 250976 - RNA, 22 nt, Homo sapiens
acugcacuccagccucguggac

SEQ ID NO: 250977 - RNA, 22 nt, Homo sapiens
acugcacuccagccugcccaac

SEQ ID NO: 250978 - RNA, 22 nt, Homo sapiens
acugcacuccagccugcugaca

SEQ ID NO: 250979 - RNA, 22 nt, Homo sapiens
acugcacuccagccugcugggu

SEQ ID NO: 250980 - RNA, 22 nt, Homo sapiens
acugcacuccagccuggcggac

SEQ ID NO: 250981 - RNA, 22 nt, Homo sapiens
acugcacuccagccugugagac

SEQ ID NO: 250982 - RNA, 22 nt, Homo sapiens
acugcacuccagccuucggaca

SEQ ID NO: 250983 - RNA, 22 nt, Homo sapiens
acugcacuccagccuugcgaca

SEQ ID NO: 250984 - RNA, 22 nt, Homo sapiens
acugcacuccagccuuggccac

SEQ ID NO: 250985 - RNA, 22 nt, Homo sapiens
acugcacuccagcuccagggug

SEQ ID NO: 250986 - RNA, 22 nt, Homo sapiens
acugcacuccagcuugggugac

SEQ ID NO: 250987 - RNA, 22 nt, Homo sapiens
acugcacuccaguuugggcagc

SEQ ID NO: 250988 - RNA, 22 nt, Homo sapiens
acugcacuccaucuuagguggc

SEQ ID NO: 250989 - RNA, 22 nt, Homo sapiens
acugcacuccggccuggcaaca

SEQ ID NO: 250990 - RNA, 22 nt, Homo sapiens
acugcacucuagcauggguaau

SEQ ID NO: 250991 - RNA, 22 nt, Homo sapiens
acugcacucuagccccugcgac

SEQ ID NO: 250992 - RNA, 22 nt, Homo sapiens
uuagcacuugggaguauuuauu

SEQ ID NO: 250993 - RNA, 22 nt, Homo sapiens
uuagcagugugaaaaaagacua

SEQ ID NO: 250994 - RNA, 22 nt, Homo sapiens
uuaggaucacagaaaauccucu

SEQ ID NO: 250995 - RNA, 21 nt, Homo sapiens
uuaggcagugucagaggugag

SEQ ID NO: 250996 - RNA, 21 nt, Homo sapiens
uuagugcucaguuugacaaaa

SEQ ID NO: 250997 - RNA, 22 nt, Homo sapiens
uuaguggaugcugaauaaagaa

SEQ ID NO: 250998 - RNA, 22 nt, Homo sapiens
uuaguucccucauucuugacuu

SEQ ID NO: 250999 - RNA, 22 nt, Homo sapiens
uuauaaacaugaagauuugggg

SEQ ID NO: 251000 - RNA, 22 nt, Homo sapiens
uuauaacagagacuccugugcu

SEQ ID NO: 251001 - RNA, 22 nt, Homo sapiens
uuauaacucugcagccugguau

SEQ ID NO: 251002 - RNA, 18 nt, Homo sapiens
uuauacuccccaggcaau

SEQ ID NO: 251003 - RNA, 22 nt, Homo sapiens
uuauagacacguuguaacaaac

SEQ ID NO: 251004 - RNA, 20 nt, Homo sapiens
uuauagcuacaucuugacug

SEQ ID NO: 251005 - RNA, 22 nt, Homo sapiens
uuauaggcaggugguguagaug

SEQ ID NO: 251006 - RNA, 18 nt, Homo sapiens
uuauaugcauguguagga

SEQ ID NO: 251007 - RNA, 22 nt, Homo sapiens
uuauauguuacucccucuagca

SEQ ID NO: 251008 - RNA, 22 nt, Homo sapiens
uuauauguuagacauggugggu

SEQ ID NO: 251009 - RNA, 22 nt, Homo sapiens
uuaucagcagugcgaaaacaga

SEQ ID NO: 251010 - RNA, 21 nt, Homo sapiens
uuaucccagugucucugcagg

SEQ ID NO: 251011 - RNA, 22 nt, Homo sapiens
uuauccucuagacauagguuua

SEQ ID NO: 251012 - RNA, 22 nt, Homo sapiens
uuaugcagcaaagugcuugaaa

SEQ ID NO: 251013 - RNA, 22 nt, Homo sapiens
uuaugccuauugugccuuggau

SEQ ID NO: 251014 - RNA, 22 nt, Homo sapiens
uuauggccauucuuguaggagu

SEQ ID NO: 251015 - RNA, 22 nt, Homo sapiens
uuauggcucuuggggaaguaga

SEQ ID NO: 251016 - RNA, 22 nt, Homo sapiens
uuaugucacuguucagucuccc

SEQ ID NO: 251017 - RNA, 22 nt, Homo sapiens
uuaugucauuuuuggauguuaa

SEQ ID NO: 251018 - RNA, 22 nt, Homo sapiens
uuauguguuuaauguuucugaa

SEQ ID NO: 251019 - RNA, 22 nt, Homo sapiens
uuauuagagauauuugguuagg

SEQ ID NO: 251020 - RNA, 22 nt, Homo sapiens
uuauuagcacccuaccaugugg

SEQ ID NO: 251021 - RNA, 22 nt, Homo sapiens
uuauucauuaauugcuaagguu

SEQ ID NO: 251022 - RNA, 22 nt, Homo sapiens
uucaaaguguugguuuugggcu

SEQ ID NO: 251023 - RNA, 23 nt, Homo sapiens
uucaaauguucucugguugucag

SEQ ID NO: 251024 - RNA, 22 nt, Homo sapiens
uucaaguaguucucaugccuca

SEQ ID NO: 251025 - RNA, 22 nt, Homo sapiens
uucaagugguucagaagucuga

SEQ ID NO: 251026 - RNA, 22 nt, Homo sapiens
uucaauacuguugauccuuaug

SEQ ID NO: 251027 - RNA, 19 nt, Homo sapiens
uucaaugcagcauugccac

SEQ ID NO: 251028 - RNA, 22 nt, Homo sapiens
uucacacuagccacucugguag

SEQ ID NO: 251029 - RNA, 22 nt, Homo sapiens
uucacagaaaaaggcgaugagg

SEQ ID NO: 251030 - RNA, 22 nt, Homo sapiens
uucacagagagaacucaaacca

SEQ ID NO: 251031 - RNA, 16 nt, Homo sapiens
uucacauggcagcagg

SEQ ID NO: 251032 - RNA, 22 nt, Homo sapiens
uucaccuggguuggccaucauu

SEQ ID NO: 251033 - RNA, 22 nt, Homo sapiens
uucaccuguagcaugcccuugg

SEQ ID NO: 251034 - RNA, 22 nt, Homo sapiens
uucaccuugcccacagcagucu

SEQ ID NO: 251035 - RNA, 22 nt, Homo sapiens
uucacugugaauaaaggcuccc

SEQ ID NO: 251036 - RNA, 22 nt, Homo sapiens
uucacuguuaagcaguuaaacu

SEQ ID NO: 251037 - RNA, 22 nt, Homo sapiens
uucagauugcauaccgaaagua

SEQ ID NO: 251038 - RNA, 22 nt, Homo sapiens
uugcacauggcaggugcucaau

SEQ ID NO: 251039 - RNA, 22 nt, Homo sapiens
uugcacuccagccuggaugaca

SEQ ID NO: 251040 - RNA, 22 nt, Homo sapiens
uugcacuccagccuuggggaga

SEQ ID NO: 251041 - RNA, 22 nt, Homo sapiens
uugcacuccagucuggggggca

SEQ ID NO: 251042 - RNA, 22 nt, Homo sapiens
uugcacucugaagaccuacugu

SEQ ID NO: 251043 - RNA, 22 nt, Homo sapiens
uugcacuguaauuuauuuaugu

SEQ ID NO: 251044 - RNA, 22 nt, Homo sapiens
uugcagagccccacacugggcu

SEQ ID NO: 251045 - RNA, 22 nt, Homo sapiens
uugcagagccccugcaaggguc

SEQ ID NO: 251046 - RNA, 22 nt, Homo sapiens
uugcagagucaguuauuuugcc

SEQ ID NO: 251047 - RNA, 22 nt, Homo sapiens
uugcagugguuucacuggcaaa

SEQ ID NO: 251048 - RNA, 22 nt, Homo sapiens
uugcauaaguugaaccagccuu

SEQ ID NO: 251049 - RNA, 22 nt, Homo sapiens
uugcauaauaagagggauacgu

SEQ ID NO: 251050 - RNA, 22 nt, Homo sapiens
uugcauagaccgaugucuugga

SEQ ID NO: 251051 - RNA, 22 nt, Homo sapiens
uugcauguacguacagagagag

SEQ ID NO: 251052 - RNA, 23 nt, Homo sapiens
uugcauugcccuccauaguacuc

SEQ ID NO: 251053 - RNA, 22 nt, Homo sapiens
uugccacuucucuugccccauu

SEQ ID NO: 251054 - RNA, 22 nt, Homo sapiens
uugccuaggcuggaguguggug

SEQ ID NO: 251055 - RNA, 22 nt, Homo sapiens
uugcuaagucaagagaaaugau

SEQ ID NO: 251056 - RNA, 22 nt, Homo sapiens
uugcuacuuggauguacaugug

SEQ ID NO: 251057 - RNA, 22 nt, Homo sapiens
uugcuccccaggaaaggaagca

SEQ ID NO: 251058 - RNA, 22 nt, Homo sapiens
uugcugguuuucauaugagcag

SEQ ID NO: 251059 - RNA, 22 nt, Homo sapiens
uuggaaacauuuaugguaacag

SEQ ID NO: 251060 - RNA, 22 nt, Homo sapiens
uuggaaauguguuugcauucag

SEQ ID NO: 251061 - RNA, 22 nt, Homo sapiens
uuggaacacauguuuuucuacc

SEQ ID NO: 251062 - RNA, 22 nt, Homo sapiens
uuggaagcacauuguuuaauua

SEQ ID NO: 251063 - RNA, 22 nt, Homo sapiens
uuggacaagauugcagagaauu

SEQ ID NO: 251064 - RNA, 22 nt, Homo sapiens
uuggacugagaguuccaccauu

SEQ ID NO: 251065 - RNA, 22 nt, Homo sapiens
uuggacuuuuauucugcaggca

SEQ ID NO: 251066 - RNA, 22 nt, Homo sapiens
uuggagagucacuaguuagugc

SEQ ID NO: 251067 - RNA, 22 nt, Homo sapiens
uuggagagugauauucagaugc

SEQ ID NO: 251068 - RNA, 22 nt, Homo sapiens
uuggagugugagagcagccugg

SEQ ID NO: 251069 - RNA, 22 nt, Homo sapiens
uuggagugugcucauaacugcu

SEQ ID NO: 251070 - RNA, 22 nt, Homo sapiens
uuggauccauccugucuucucu

SEQ ID NO: 251071 - RNA, 22 nt, Homo sapiens
uuggauuuuaacaaacuaggug

SEQ ID NO: 251072 - RNA, 22 nt, Homo sapiens
uuggauuuugguggcaacucau

SEQ ID NO: 251073 - RNA, 22 nt, Homo sapiens
uuggcaauucagauucuuuuau

SEQ ID NO: 251074 - RNA, 22 nt, Homo sapiens
uuggcagaauguuagaaacuua

SEQ ID NO: 251075 - RNA, 20 nt, Homo sapiens
uuggcagagucuuuagggua

SEQ ID NO: 251076 - RNA, 19 nt, Homo sapiens
uuggcagaguugcccccua

SEQ ID NO: 251077 - RNA, 22 nt, Homo sapiens
uuggcagucugaggcacagacu

SEQ ID NO: 251078 - RNA, 22 nt, Homo sapiens
uuggccccuccaaaucucaugu

SEQ ID NO: 251079 - RNA, 22 nt, Homo sapiens
uuggcuaugaguccuaugugca

SEQ ID NO: 251080 - RNA, 22 nt, Homo sapiens
uuggcucugcgucucgcggacg

SEQ ID NO: 251081 - RNA, 22 nt, Homo sapiens
uuggcuuuuaugcagcuuaggu

SEQ ID NO: 251082 - RNA, 22 nt, Homo sapiens
uugggacccuguccuguaacaa

SEQ ID NO: 251083 - RNA, 21 nt, Homo sapiens
uuggggaauggagagguuuuc

SEQ ID NO: 251084 - RNA, 22 nt, Homo sapiens
uuggucagcuagauuauucccu

SEQ ID NO: 251085 - RNA, 22 nt, Homo sapiens
uuggucagcucaauggagaggg

SEQ ID NO: 251086 - RNA, 19 nt, Homo sapiens
uuggucccuuuggguucuu

SEQ ID NO: 251087 - RNA, 23 nt, Homo sapiens
uuggucucccaaaguguugagau

SEQ ID NO: 251088 - RNA, 22 nt, Homo sapiens
uugguuaucaucauuucagcaa

SEQ ID NO: 251089 - RNA, 22 nt, Homo sapiens
uugguucaguuuaacgaguaau

SEQ ID NO: 251090 - RNA, 22 nt, Homo sapiens
auauuacuggcuauaucgcaag

SEQ ID NO: 251091 - RNA, 22 nt, Homo sapiens
auauugacuuucucuuagauca

SEQ ID NO: 251092 - RNA, 18 nt, Homo sapiens
auauugccuucagacuag

SEQ ID NO: 251093 - RNA, 22 nt, Homo sapiens
aucaaacugcaaggcagcagca

SEQ ID NO: 251094 - RNA, 19 nt, Homo sapiens
aucaaacugcucuuugagg

SEQ ID NO: 251095 - RNA, 20 nt, Homo sapiens
aucaaagacuuagaggggga

SEQ ID NO: 251096 - RNA, 22 nt, Homo sapiens
aucaaaguaggcauauguuuuu

SEQ ID NO: 251097 - RNA, 22 nt, Homo sapiens
aucaaagugaauuaaugagaau

SEQ ID NO: 251098 - RNA, 22 nt, Homo sapiens
aucaagcuggcauauguaguuc

SEQ ID NO: 251099 - RNA, 22 nt, Homo sapiens
aucacagaguuaaaacuuucuu

SEQ ID NO: 251100 - RNA, 22 nt, Homo sapiens
aucacaggcaaaauuccuucuc

SEQ ID NO: 251101 - RNA, 22 nt, Homo sapiens
aucacauggccuagccuaaccu

SEQ ID NO: 251102 - RNA, 22 nt, Homo sapiens
aucacauuuauaguggcacgca

SEQ ID NO: 251103 - RNA, 19 nt, Homo sapiens
aucaccagucuuuccacug

SEQ ID NO: 251104 - RNA, 22 nt, Homo sapiens
aucaccugagcaguauacacug

SEQ ID NO: 251105 - RNA, 22 nt, Homo sapiens
aucaccuggaggugaucacuug

SEQ ID NO: 251106 - RNA, 22 nt, Homo sapiens
aucacuaugcaggugucucggg

SEQ ID NO: 251107 - RNA, 22 nt, Homo sapiens
aucacuggccuuuuuaaaugcu

SEQ ID NO: 251108 - RNA, 22 nt, Homo sapiens
aucacugggauggaacugcuga

SEQ ID NO: 251109 - RNA, 22 nt, Homo sapiens
aucacuggucaugagagaagua

SEQ ID NO: 251110 - RNA, 22 nt, Homo sapiens
aucacuguccacucaucuuucu

SEQ ID NO: 251111 - RNA, 22 nt, Homo sapiens
aucacuuugcucuccagugugg

SEQ ID NO: 251112 - RNA, 22 nt, Homo sapiens
aucagaaucucuugagaguguu

SEQ ID NO: 251113 - RNA, 20 nt, Homo sapiens
aucagagacuaggauugcca

SEQ ID NO: 251114 - RNA, 22 nt, Homo sapiens
aucagaguugucagggagcuuu

SEQ ID NO: 251115 - RNA, 22 nt, Homo sapiens
aucagugauugauuuaaagacg

SEQ ID NO: 251116 - RNA, 22 nt, Homo sapiens
aucagugcauguuuguugagcu

SEQ ID NO: 251117 - RNA, 22 nt, Homo sapiens
aucauggaguauuugcaagucu

SEQ ID NO: 251118 - RNA, 22 nt, Homo sapiens
aucauguaguaagacacauuua

SEQ ID NO: 251119 - RNA, 22 nt, Homo sapiens
aucaugucuucccagugauucu

SEQ ID NO: 251120 - RNA, 22 nt, Homo sapiens
aucauugugcaucuucauucca

SEQ ID NO: 251121 - RNA, 22 nt, Homo sapiens
auccaucagacggcaggcguug

SEQ ID NO: 251122 - RNA, 22 nt, Homo sapiens
auccauugcucaagagaaguca

SEQ ID NO: 251123 - RNA, 22 nt, Homo sapiens
aucccaguucagccucugacac

SEQ ID NO: 251124 - RNA, 22 nt, Homo sapiens
auccccuugcagugaccggggc

SEQ ID NO: 251125 - RNA, 22 nt, Homo sapiens
aucccgagacuuugcugaaguu

SEQ ID NO: 251126 - RNA, 22 nt, Homo sapiens
aucccuagaaaaaucagcacau

SEQ ID NO: 251127 - RNA, 22 nt, Homo sapiens
aucccugagccugacucucaga

SEQ ID NO: 251128 - RNA, 22 nt, Homo sapiens
aucccuguaacuagcagccccu

SEQ ID NO: 251129 - RNA, 22 nt, Homo sapiens
aucccuguguccagcaccugug

SEQ ID NO: 251130 - RNA, 22 nt, Homo sapiens
auccuagguuagagaacaaaac

SEQ ID NO: 251131 - RNA, 22 nt, Homo sapiens
auccugagacuuuucugaaguu

SEQ ID NO: 251132 - RNA, 21 nt, Homo sapiens
auccuucuuuuucaaccugug

SEQ ID NO: 251133 - RNA, 22 nt, Homo sapiens
ugagcagagggagaaguaaauu

SEQ ID NO: 251134 - RNA, 22 nt, Homo sapiens
ugagccaaugauuugaauagag

SEQ ID NO: 251135 - RNA, 22 nt, Homo sapiens
ugagcuaagugccaauauuaau

SEQ ID NO: 251136 - RNA, 22 nt, Homo sapiens
ugagcuaggauccugucacugu

SEQ ID NO: 251137 - RNA, 22 nt, Homo sapiens
ugagcuaggucuugcucuguca

SEQ ID NO: 251138 - RNA, 22 nt, Homo sapiens
ugagcucaguauuucauaaaca

SEQ ID NO: 251139 - RNA, 22 nt, Homo sapiens
ugagcugagaaaugcagcagcu

SEQ ID NO: 251140 - RNA, 22 nt, Homo sapiens
ugagcugagaucaugcuauugu

SEQ ID NO: 251141 - RNA, 20 nt, Homo sapiens
ugagcuuguaaacacuguuu

SEQ ID NO: 251142 - RNA, 18 nt, Homo sapiens
ugaggaaaggguuugcua

SEQ ID NO: 251143 - RNA, 22 nt, Homo sapiens
ugaggaaugaccccgugugguc

SEQ ID NO: 251144 - RNA, 22 nt, Homo sapiens
ugaggacugagaggcacugugg

SEQ ID NO: 251145 - RNA, 22 nt, Homo sapiens
ugaggagugaacuauuucugau

SEQ ID NO: 251146 - RNA, 22 nt, Homo sapiens
ugaggaguguauuucauucgcu

SEQ ID NO: 251147 - RNA, 22 nt, Homo sapiens
ugaggauaguguugaaggcagg

SEQ ID NO: 251148 - RNA, 22 nt, Homo sapiens
ugaggcacucccuagcggggug

SEQ ID NO: 251149 - RNA, 22 nt, Homo sapiens
ugaggcuagucagaucagauga

SEQ ID NO: 251150 - RNA, 22 nt, Homo sapiens
ugagguaaaacaaggauuggau

SEQ ID NO: 251151 - RNA, 22 nt, Homo sapiens
ugagguacaacauggacugaag

SEQ ID NO: 251152 - RNA, 22 nt, Homo sapiens
ugagguaucauugcccaggcug

SEQ ID NO: 251153 - RNA, 22 nt, Homo sapiens
ugaggucauguucugucagguu

SEQ ID NO: 251154 - RNA, 22 nt, Homo sapiens
ugaggugaaguaauauucuaag

SEQ ID NO: 251155 - RNA, 22 nt, Homo sapiens
ugagguuguccacuauaaucca

SEQ ID NO: 251156 - RNA, 22 nt, Homo sapiens
ugaguagaaauaaacgcaaacu

SEQ ID NO: 251157 - RNA, 22 nt, Homo sapiens
ugaguagagaauucagcuaagg

SEQ ID NO: 251158 - RNA, 22 nt, Homo sapiens
ugaguaugaguucaggaaaggc

SEQ ID NO: 251159 - RNA, 22 nt, Homo sapiens
ugagucagucucacucugcugc

SEQ ID NO: 251160 - RNA, 22 nt, Homo sapiens
ugagugccuggagggcagggac

SEQ ID NO: 251161 - RNA, 22 nt, Homo sapiens
ugaguggagaucgcaccauugc

SEQ ID NO: 251162 - RNA, 22 nt, Homo sapiens
ugagugugacuuagcagaagga

SEQ ID NO: 251163 - RNA, 22 nt, Homo sapiens
ugagugugaggaagaauuagaa

SEQ ID NO: 251164 - RNA, 22 nt, Homo sapiens
ugaguguguaugugcauacaca

SEQ ID NO: 251165 - RNA, 17 nt, Homo sapiens
ugaguuaaucuuugugc

SEQ ID NO: 251166 - RNA, 22 nt, Homo sapiens
ugauaacauugggggaagcuga

SEQ ID NO: 251167 - RNA, 18 nt, Homo sapiens
ugauaucaaugauagcca

SEQ ID NO: 251168 - RNA, 22 nt, Homo sapiens
ugauaugaaagggaaauaagug

SEQ ID NO: 251169 - RNA, 22 nt, Homo sapiens
ugauaugaaguuagcuggcugu

SEQ ID NO: 251170 - RNA, 22 nt, Homo sapiens
ugauaugaaguucaaaccaggu

SEQ ID NO: 251171 - RNA, 22 nt, Homo sapiens
ugauauguagguggcaagcaua

SEQ ID NO: 251172 - RNA, 22 nt, Homo sapiens
ugauaugucacuugaucauggu

SEQ ID NO: 251173 - RNA, 22 nt, Homo sapiens
ugauaugucccucgacaucagg

SEQ ID NO: 251174 - RNA, 22 nt, Homo sapiens
ugauauguggauucagcucaaa

SEQ ID NO: 251175 - RNA, 22 nt, Homo sapiens
ugauauguggcuauugagauug

SEQ ID NO: 251176 - RNA, 22 nt, Homo sapiens
ugauauguuagaaucuugcaag

SEQ ID NO: 251177 - RNA, 22 nt, Homo sapiens
ugauauuuuugauccuuaaguu

SEQ ID NO: 251178 - RNA, 22 nt, Homo sapiens
ugaucuguguaacauaggaguc

SEQ ID NO: 251179 - RNA, 22 nt, Homo sapiens
ugaucuuuuuaauguccauggg

SEQ ID NO: 251180 - RNA, 22 nt, Homo sapiens
ugaugacauugucacagucuga

SEQ ID NO: 251181 - RNA, 22 nt, Homo sapiens
ugaugcugaugccugccagaag

SEQ ID NO: 251182 - RNA, 21 nt, Homo sapiens
ugaugcuuuucuuaaccuugc

SEQ ID NO: 251183 - RNA, 22 nt, Homo sapiens
ugauggcauuuggaguugggac

SEQ ID NO: 251184 - RNA, 22 nt, Homo sapiens
ugaugguguuaccaucuuuacu

SEQ ID NO: 251185 - RNA, 22 nt, Homo sapiens
ugaugucuugagauggagcuua

SEQ ID NO: 251186 - RNA, 22 nt, Homo sapiens
ugaugucuugcaggcacgagau

SEQ ID NO: 251187 - RNA, 22 nt, Homo sapiens
ugauuagagagcuggguguccu

SEQ ID NO: 251188 - RNA, 22 nt, Homo sapiens
ugauuagaggaaugguagauua

SEQ ID NO: 251189 - RNA, 18 nt, Homo sapiens
ugcaaacauguguguguu

SEQ ID NO: 251190 - RNA, 22 nt, Homo sapiens
ugcaaaguccucauucuuaccc

SEQ ID NO: 251191 - RNA, 19 nt, Homo sapiens
ugcaaagucuuuuccuauu

SEQ ID NO: 251192 - RNA, 22 nt, Homo sapiens
ugcaagcacacccagggauugu

SEQ ID NO: 251193 - RNA, 22 nt, Homo sapiens
ugcaccauugucaccuggguga

SEQ ID NO: 251194 - RNA, 20 nt, Homo sapiens
ugcagauucaaccaacugug

SEQ ID NO: 251195 - RNA, 17 nt, Homo sapiens
ugcagcacacugauggg

SEQ ID NO: 251196 - RNA, 21 nt, Homo sapiens
ugcagccauucagcccuaugc

SEQ ID NO: 251197 - RNA, 18 nt, Homo sapiens
ugcagcuuugugauuggc

SEQ ID NO: 251198 - RNA, 22 nt, Homo sapiens
ugcaguacugucagacuucuua

SEQ ID NO: 251199 - RNA, 22 nt, Homo sapiens
ugcagugcaugacuguguuaug

SEQ ID NO: 251200 - RNA, 22 nt, Homo sapiens
ugcauacacaagcauacaugua

SEQ ID NO: 251201 - RNA, 18 nt, Homo sapiens
ugcauacuaucugauuuu

SEQ ID NO: 251202 - RNA, 19 nt, Homo sapiens
ugcauaggguuacauacuc

SEQ ID NO: 251203 - RNA, 23 nt, Homo sapiens
ugcauaguacccaauacuuuauc

SEQ ID NO: 251204 - RNA, 22 nt, Homo sapiens
ugcauaucuucuuuugagaaau

SEQ ID NO: 251205 - RNA, 22 nt, Homo sapiens
ugcauauguauacaugugccau

SEQ ID NO: 251206 - RNA, 22 nt, Homo sapiens
ugcauauucuaggauuuuguau

SEQ ID NO: 251207 - RNA, 22 nt, Homo sapiens
ugcaucaggcugcuuauuacaa

SEQ ID NO: 251208 - RNA, 22 nt, Homo sapiens
ugcauggaagggagggaaagag

SEQ ID NO: 251209 - RNA, 21 nt, Homo sapiens
ugcauggagaacacugagggu

SEQ ID NO: 251210 - RNA, 22 nt, Homo sapiens
ugcauuguggaucuaaaugcau

SEQ ID NO: 251211 - RNA, 22 nt, Homo sapiens
ugccaaaaugggcuuuauaccg

SEQ ID NO: 251212 - RNA, 19 nt, Homo sapiens
ugccaagaaagucagcuua

SEQ ID NO: 251213 - RNA, 22 nt, Homo sapiens
ugccagagacguagggaauauu

SEQ ID NO: 251214 - RNA, 22 nt, Homo sapiens
ugccaggaugaggucaauguuu

SEQ ID NO: 251215 - RNA, 22 nt, Homo sapiens
ugccaguauuuuauuaagaauu

SEQ ID NO: 251216 - RNA, 22 nt, Homo sapiens
ugccaguauuuuauugaggauu

SEQ ID NO: 251217 - RNA, 19 nt, Homo sapiens
ugccauguaacaggaaaau

SEQ ID NO: 251218 - RNA, 22 nt, Homo sapiens
ugccaugucauagguuaagccu

SEQ ID NO: 251219 - RNA, 22 nt, Homo sapiens
ugcccuguaucccacuguuuca

SEQ ID NO: 251220 - RNA, 22 nt, Homo sapiens
ugccuacugagacuggguggcc

SEQ ID NO: 251221 - RNA, 22 nt, Homo sapiens
ugccuacuuugcaucugucagg

SEQ ID NO: 251222 - RNA, 22 nt, Homo sapiens
ugccuaggcuggagugcagugg

SEQ ID NO: 251223 - RNA, 22 nt, Homo sapiens
ugccuaggcuggaguguagugg

SEQ ID NO: 251224 - RNA, 22 nt, Homo sapiens
ugccuaguguguugagaguuuu

SEQ ID NO: 251225 - RNA, 22 nt, Homo sapiens
ugccugauacccucugucucuc

SEQ ID NO: 251226 - RNA, 23 nt, Homo sapiens
ugcuauguaagcauuuauuaaau

SEQ ID NO: 251227 - RNA, 23 nt, Homo sapiens
ugcugagaccuagauccuaaaga

SEQ ID NO: 251228 - RNA, 22 nt, Homo sapiens
ugcugcacaguucuuaagauua

SEQ ID NO: 251229 - RNA, 22 nt, Homo sapiens
ugcugguaguuuaugacuaauu

SEQ ID NO: 251230 - RNA, 22 nt, Homo sapiens
ugcuggugauuaaauccugaag

SEQ ID NO: 251231 - RNA, 17 nt, Homo sapiens
ugcuuagagagccucag

SEQ ID NO: 251232 - RNA, 22 nt, Homo sapiens
ugcuuagucuugcuuuagcuau

SEQ ID NO: 251233 - RNA, 22 nt, Homo sapiens
ugcuuugguagaaaucuuuggu

SEQ ID NO: 251234 - RNA, 22 nt, Homo sapiens
uggaaaacaugcacauuggauu

SEQ ID NO: 251235 - RNA, 22 nt, Homo sapiens
uggaagacaggcuguauuuuaa

SEQ ID NO: 251236 - RNA, 22 nt, Homo sapiens
uggaagcauagcagcgugugug

SEQ ID NO: 251237 - RNA, 22 nt, Homo sapiens
uggaaggcuucauauguaaaga

SEQ ID NO: 251238 - RNA, 22 nt, Homo sapiens
uggaagucauugagguguguua

SEQ ID NO: 251239 - RNA, 22 nt, Homo sapiens
uggaagucuauggcauuugagu

SEQ ID NO: 251240 - RNA, 22 nt, Homo sapiens
uggaagucuucauuauguauag

SEQ ID NO: 251241 - RNA, 21 nt, Homo sapiens
uggaaucuauuauuccaguuu

SEQ ID NO: 251242 - RNA, 20 nt, Homo sapiens
uggaaucugaagaucucagu

SEQ ID NO: 251243 - RNA, 22 nt, Homo sapiens
uggaaucuuaggugaaggcuuu

SEQ ID NO: 251244 - RNA, 22 nt, Homo sapiens
uggaauguagcguugacacgag

SEQ ID NO: 251245 - RNA, 22 nt, Homo sapiens
uggaaugugaauaacuuccuuc

SEQ ID NO: 251246 - RNA, 21 nt, Homo sapiens
uggaauuaauggagagguguu

SEQ ID NO: 251247 - RNA, 20 nt, Homo sapiens
uggaccagagagguggggac

SEQ ID NO: 251248 - RNA, 21 nt, Homo sapiens
uggaccccuacuucucaccau

SEQ ID NO: 251249 - RNA, 21 nt, Homo sapiens
uggaccccuuccagucaucau

SEQ ID NO: 251250 - RNA, 22 nt, Homo sapiens
uggagcccuaguuccucauaac

SEQ ID NO: 251251 - RNA, 22 nt, Homo sapiens
uggagggcuagucauuucuuuu

SEQ ID NO: 251252 - RNA, 22 nt, Homo sapiens
uggagguagagaugggaucucc

SEQ ID NO: 251253 - RNA, 20 nt, Homo sapiens
uggaggucaucugucacuac

SEQ ID NO: 251254 - RNA, 22 nt, Homo sapiens
uggaguaggccuaagaaugaca

SEQ ID NO: 251255 - RNA, 22 nt, Homo sapiens
uggaguauuauguaauuucaau

SEQ ID NO: 251256 - RNA, 19 nt, Homo sapiens
uggagucaucaugcugcua

SEQ ID NO: 251257 - RNA, 22 nt, Homo sapiens
uggagugauaugguuauauggg

SEQ ID NO: 251258 - RNA, 22 nt, Homo sapiens
uggagugucaguuuccagaguu

SEQ ID NO: 251259 - RNA, 22 nt, Homo sapiens
uggauagauacuauccaggacu

SEQ ID NO: 251260 - RNA, 22 nt, Homo sapiens
uggaugaagagaugguaguugc

SEQ ID NO: 251261 - RNA, 19 nt, Homo sapiens
uggaugacugucugggucu

SEQ ID NO: 251262 - RNA, 21 nt, Homo sapiens
uggaugccuaggcagaaguuu

SEQ ID NO: 251263 - RNA, 22 nt, Homo sapiens
uggauguacagucaguauuugu

SEQ ID NO: 251264 - RNA, 21 nt, Homo sapiens
uggauugagaaccccaggagg

SEQ ID NO: 251265 - RNA, 19 nt, Homo sapiens
uggauuguuagagcagugu

SEQ ID NO: 251266 - RNA, 22 nt, Homo sapiens
uggauuguuucucuugguauga

SEQ ID NO: 251267 - RNA, 22 nt, Homo sapiens
uggcaaaauggaauauguuggg

SEQ ID NO: 251268 - RNA, 22 nt, Homo sapiens
uggcaaaugaaagaaagccagu

SEQ ID NO: 251269 - RNA, 22 nt, Homo sapiens
uggcaacaucuggggacauguu

SEQ ID NO: 251270 - RNA, 22 nt, Homo sapiens
uggcaagaaccacaauuacuuu

SEQ ID NO: 251271 - RNA, 22 nt, Homo sapiens
uggcaagaaccacaguuacuuu

SEQ ID NO: 251272 - RNA, 22 nt, Homo sapiens
uggcaagaaggauuuauuccuu

SEQ ID NO: 251273 - RNA, 22 nt, Homo sapiens
uggcaagagcaaaauguacagu

SEQ ID NO: 251274 - RNA, 22 nt, Homo sapiens
uggcaagaucacaauuacuuuu

SEQ ID NO: 251275 - RNA, 22 nt, Homo sapiens
uggcaagauuguuccgguuugg

SEQ ID NO: 251276 - RNA, 22 nt, Homo sapiens
uggcaauaauucagugugggcu

SEQ ID NO: 251277 - RNA, 19 nt, Homo sapiens
uggcaaugucagcagagau

SEQ ID NO: 251278 - RNA, 19 nt, Homo sapiens
uggcacauguauacuuaug

SEQ ID NO: 251279 - RNA, 19 nt, Homo sapiens
uggcacuugacguccggau

SEQ ID NO: 251280 - RNA, 22 nt, Homo sapiens
uggcagauaggauacaggacua

SEQ ID NO: 251281 - RNA, 22 nt, Homo sapiens
uggcagcgugaauguggcugaa

SEQ ID NO: 251282 - RNA, 22 nt, Homo sapiens
uggcaguuuacagcuuuaggag

SEQ ID NO: 251283 - RNA, 22 nt, Homo sapiens
uggcaguuucacauggcucaac

SEQ ID NO: 251284 - RNA, 22 nt, Homo sapiens
uggcaguuuuaugugguucaac

SEQ ID NO: 251285 - RNA, 22 nt, Homo sapiens
uggcaguuuugauguggagaga

SEQ ID NO: 251286 - RNA, 22 nt, Homo sapiens
uggcauggaguggauggcccca

SEQ ID NO: 251287 - RNA, 22 nt, Homo sapiens
uggcaugggguaguagcgcugg

SEQ ID NO: 251288 - RNA, 22 nt, Homo sapiens
uggcauuuuguuuuagaauuag

SEQ ID NO: 251289 - RNA, 22 nt, Homo sapiens
uggcccccucccaaaucucaua

SEQ ID NO: 251290 - RNA, 22 nt, Homo sapiens
uggcuaagaugcacacuucacu

SEQ ID NO: 251291 - RNA, 19 nt, Homo sapiens
uggcuagagcagauauccu

SEQ ID NO: 251292 - RNA, 22 nt, Homo sapiens
uggcuagaugagauguacugca

SEQ ID NO: 251293 - RNA, 21 nt, Homo sapiens
uggcuauuucuguggcauaca

SEQ ID NO: 251294 - RNA, 20 nt, Homo sapiens
uggcucuuugcugcuaaagu

SEQ ID NO: 251295 - RNA, 22 nt, Homo sapiens
uggcuguuuauuucacgugggu

SEQ ID NO: 251296 - RNA, 21 nt, Homo sapiens
uggcuguuuucaugcuagaac

SEQ ID NO: 251297 - RNA, 22 nt, Homo sapiens
uggcuuuguaagguuucauuuu

SEQ ID NO: 251298 - RNA, 22 nt, Homo sapiens
uggcuuuucauccugggacauu

SEQ ID NO: 251299 - RNA, 22 nt, Homo sapiens
uggcuuuuguuauuuggaagcu

SEQ ID NO: 251300 - RNA, 22 nt, Homo sapiens
ugggaaacauccagcacauacu

SEQ ID NO: 251301 - RNA, 22 nt, Homo sapiens
ugggaacaugaagguuaaagag

SEQ ID NO: 251302 - RNA, 22 nt, Homo sapiens
ugggaagaagguuuacuugcca

SEQ ID NO: 251303 - RNA, 22 nt, Homo sapiens
ugggaagaugcugcuucuuccu

SEQ ID NO: 251304 - RNA, 22 nt, Homo sapiens
ugggaaugaaauuacauagcuu

SEQ ID NO: 251305 - RNA, 19 nt, Homo sapiens
ugggaauguaaauuaguuc

SEQ ID NO: 251306 - RNA, 22 nt, Homo sapiens
ugggagugugcacaauuucagc

SEQ ID NO: 251307 - RNA, 22 nt, Homo sapiens
ugggcaaaacuaagagcugugg

SEQ ID NO: 251308 - RNA, 22 nt, Homo sapiens
ugggcaagagagcaugacccug

SEQ ID NO: 251309 - RNA, 22 nt, Homo sapiens
ugggcauggaguggccuuaugu

SEQ ID NO: 251310 - RNA, 22 nt, Homo sapiens
ugggcggagacgugcagccgcc

SEQ ID NO: 251311 - RNA, 22 nt, Homo sapiens
uggguaggcccucauuggacag

SEQ ID NO: 251312 - RNA, 22 nt, Homo sapiens
uggguaguuuuucagcucuugc

SEQ ID NO: 251313 - RNA, 23 nt, Homo sapiens
uggguucauucuugaagucagug

SEQ ID NO: 251314 - RNA, 22 nt, Homo sapiens
ugguaaaaugucauuuaccaga

SEQ ID NO: 251315 - RNA, 20 nt, Homo sapiens
ugguaauguaagagaggaga

SEQ ID NO: 251316 - RNA, 22 nt, Homo sapiens
uggucaccuucuugcucugucu

SEQ ID NO: 251317 - RNA, 22 nt, Homo sapiens
uggucagaaaauuacuugauau

SEQ ID NO: 251318 - RNA, 22 nt, Homo sapiens
uggucaguugaguccuugccaa

SEQ ID NO: 251319 - RNA, 21 nt, Homo sapiens
uggucaguuuucucacuagga

SEQ ID NO: 251320 - RNA, 22 nt, Homo sapiens
ugguccacuaacccucaguauc

SEQ ID NO: 251321 - RNA, 22 nt, Homo sapiens
ugguccccaauacuucuauaga

SEQ ID NO: 251322 - RNA, 22 nt, Homo sapiens
ugguccucugcuuccagaauuc

SEQ ID NO: 251323 - RNA, 22 nt, Homo sapiens
uggugagaaacuagauauuuuu

SEQ ID NO: 251324 - RNA, 19 nt, Homo sapiens
uggugccuuguucuuggau

SEQ ID NO: 251325 - RNA, 22 nt, Homo sapiens
ugguuagucuguguguauauau

SEQ ID NO: 251326 - RNA, 23 nt, Homo sapiens
uguaaaagcauuugucagccugg

SEQ ID NO: 251327 - RNA, 22 nt, Homo sapiens
uguaagcagcagagacuauccu

SEQ ID NO: 251328 - RNA, 22 nt, Homo sapiens
uguaagcauuauauaauuguug

SEQ ID NO: 251329 - RNA, 20 nt, Homo sapiens
uguaaucuaaguuuuaagcc

SEQ ID NO: 251330 - RNA, 22 nt, Homo sapiens
uguaauguuucaucauuauuaa

SEQ ID NO: 251331 - RNA, 22 nt, Homo sapiens
uguagacagcacguaguugagu

SEQ ID NO: 251332 - RNA, 22 nt, Homo sapiens
uguagguagggucuguuuuuga

SEQ ID NO: 251333 - RNA, 22 nt, Homo sapiens
uguagucauuuggaguccagcu

SEQ ID NO: 251334 - RNA, 22 nt, Homo sapiens
uguauacauauguauguuuugu

SEQ ID NO: 251335 - RNA, 21 nt, Homo sapiens
uguauacauauguuaggugca

SEQ ID NO: 251336 - RNA, 22 nt, Homo sapiens
uguauguugauguuauauucug

SEQ ID NO: 251337 - RNA, 22 nt, Homo sapiens
uguauguuuaaggccaguggaa

SEQ ID NO: 251338 - RNA, 16 nt, Homo sapiens
uguauugcuaaaaaga

SEQ ID NO: 251339 - RNA, 22 nt, Homo sapiens
uguauuuguuguuaaauggaga

SEQ ID NO: 251340 - RNA, 22 nt, Homo sapiens
ugucaaaugcagugauauuuga

SEQ ID NO: 251341 - RNA, 22 nt, Homo sapiens
ugucaacauuuaucaaguuauu

SEQ ID NO: 251342 - RNA, 22 nt, Homo sapiens
ugucaauauguaauaacugaau

SEQ ID NO: 251343 - RNA, 22 nt, Homo sapiens
ugucacuuugccuucuggacuu

SEQ ID NO: 251344 - RNA, 22 nt, Homo sapiens
ugucagcacaacucagguuccu

SEQ ID NO: 251345 - RNA, 22 nt, Homo sapiens
ugucaguggucuggaugcagcc

SEQ ID NO: 251346 - RNA, 22 nt, Homo sapiens
ugucauacaguaacaugguugg

SEQ ID NO: 251347 - RNA, 22 nt, Homo sapiens
ugucauguuucuacugaccaaa

SEQ ID NO: 251348 - RNA, 20 nt, Homo sapiens
ugucauuaagcacugugcca

SEQ ID NO: 251349 - RNA, 22 nt, Homo sapiens
uguccaaaucagagguaccaaa

SEQ ID NO: 251350 - RNA, 20 nt, Homo sapiens
ugucccaaccccauggguuc

SEQ ID NO: 251351 - RNA, 22 nt, Homo sapiens
ugucccguuuucgaggcugcag

SEQ ID NO: 251352 - RNA, 22 nt, Homo sapiens
uguccuggugaugcccaaauuc

SEQ ID NO: 251353 - RNA, 22 nt, Homo sapiens
ugucucagugauuggcuuucug

SEQ ID NO: 251354 - RNA, 22 nt, Homo sapiens
ugucucaguucccuucucugga

SEQ ID NO: 251355 - RNA, 22 nt, Homo sapiens
ugucugagacuguuuuacuuuc

SEQ ID NO: 251356 - RNA, 22 nt, Homo sapiens
ugucuggaaggguggccuccug

SEQ ID NO: 251357 - RNA, 22 nt, Homo sapiens
ugucuuggagaauccuggguuu

SEQ ID NO: 251358 - RNA, 22 nt, Homo sapiens
ugugaaacacgaaagucuaaaa

SEQ ID NO: 251359 - RNA, 22 nt, Homo sapiens
ugugaagaugagaugacgcccu

SEQ ID NO: 251360 - RNA, 22 nt, Homo sapiens
ugugaagauggacuaauauagu

SEQ ID NO: 251361 - RNA, 22 nt, Homo sapiens
ugugaaugauggagugucgaau

SEQ ID NO: 251362 - RNA, 22 nt, Homo sapiens
ugugaauggugcuuccuagaug

SEQ ID NO: 251363 - RNA, 22 nt, Homo sapiens
ugugacaguuaguuugguguua

SEQ ID NO: 251364 - RNA, 21 nt, Homo sapiens
ugugaccucugucucugaguc

SEQ ID NO: 251365 - RNA, 22 nt, Homo sapiens
ugugagaaaugcagaaucucag

SEQ ID NO: 251366 - RNA, 22 nt, Homo sapiens
ugugagaucucagaauugaacu

SEQ ID NO: 251367 - RNA, 19 nt, Homo sapiens
ugugagcauuagcauuuag

SEQ ID NO: 251368 - RNA, 22 nt, Homo sapiens
ugugauuauuuauagacaguca

SEQ ID NO: 251369 - RNA, 22 nt, Homo sapiens
ugugcaaucagcuucauuacau

SEQ ID NO: 251370 - RNA, 22 nt, Homo sapiens
ugugcacaaccugcagguuugu

SEQ ID NO: 251371 - RNA, 22 nt, Homo sapiens
ugugcacaauguacagguuagu

SEQ ID NO: 251372 - RNA, 22 nt, Homo sapiens
ugugcaguuuuagcguauuuua

SEQ ID NO: 251373 - RNA, 22 nt, Homo sapiens
ugugcauagugugugcggggcg

SEQ ID NO: 251374 - RNA, 22 nt, Homo sapiens
ugugccacuccagcucuagcuu

SEQ ID NO: 251375 - RNA, 22 nt, Homo sapiens
ugugccuucuaagaaggagucu

SEQ ID NO: 251376 - RNA, 22 nt, Homo sapiens
ugugcuauguuauucacauggg

SEQ ID NO: 251377 - RNA, 22 nt, Homo sapiens
uguggcaaagucuugugaauau

SEQ ID NO: 251378 - RNA, 22 nt, Homo sapiens
uguggcagugcuuuaugaaacc

SEQ ID NO: 251379 - RNA, 22 nt, Homo sapiens
uguggccuuuguuucaguuggg

SEQ ID NO: 251380 - RNA, 17 nt, Homo sapiens
uguggcucuuaugcuga

SEQ ID NO: 251381 - RNA, 22 nt, Homo sapiens
uguggcuuuacagcaugguuca

SEQ ID NO: 251382 - RNA, 22 nt, Homo sapiens
ugugguuuuucacauuuagaga

SEQ ID NO: 251383 - RNA, 22 nt, Homo sapiens
ugugucacugcacuccagccug

SEQ ID NO: 251384 - RNA, 22 nt, Homo sapiens
ugugucuuguuuuuucccaggc

SEQ ID NO: 251385 - RNA, 22 nt, Homo sapiens
uguguuuuuauguaaaauggaa

SEQ ID NO: 251386 - RNA, 22 nt, Homo sapiens
uguuacagcagaauugaaagag

SEQ ID NO: 251387 - RNA, 22 nt, Homo sapiens
uguuacagcagcacaaaaugga

SEQ ID NO: 251388 - RNA, 22 nt, Homo sapiens
uguuacagugacuaauguuuua

SEQ ID NO: 251389 - RNA, 22 nt, Homo sapiens
uguuauuuuguguuagggcaca

SEQ ID NO: 251390 - RNA, 22 nt, Homo sapiens
uguucuggagccgguucaaaug

SEQ ID NO: 251391 - RNA, 22 nt, Homo sapiens
uguucuugaguugggaguacaa

SEQ ID NO: 251392 - RNA, 22 nt, Homo sapiens
uguugcacugguaauguacuga

SEQ ID NO: 251393 - RNA, 22 nt, Homo sapiens
uguugcauuugucaaggucaag

SEQ ID NO: 251394 - RNA, 22 nt, Homo sapiens
uguuggcauugcugcugacccu

SEQ ID NO: 251395 - RNA, 22 nt, Homo sapiens
uguuugcuuaacguggagccag

SEQ ID NO: 251396 - RNA, 22 nt, Homo sapiens
uguuugguggucucuucacaug

SEQ ID NO: 251397 - RNA, 22 nt, Homo sapiens
uguuuuggaggccagaagucca

SEQ ID NO: 251398 - RNA, 22 nt, Homo sapiens
uguuuuggaguggacuuugcau

SEQ ID NO: 251399 - RNA, 22 nt, Homo sapiens
uuaaaaguauaggccuggcaua

SEQ ID NO: 251400 - RNA, 22 nt, Homo sapiens
uuaaaggcaugguuagacaugg

SEQ ID NO: 251401 - RNA, 22 nt, Homo sapiens
uuaacagugucaaucuguagua

SEQ ID NO: 251402 - RNA, 22 nt, Homo sapiens
uuaagaugcauuuugaaguuaa

SEQ ID NO: 251403 - RNA, 22 nt, Homo sapiens
uuaaggcauucuuugucuucau

SEQ ID NO: 251404 - RNA, 22 nt, Homo sapiens
uuaaggcuccuguuggcuuuua

SEQ ID NO: 251405 - RNA, 22 nt, Homo sapiens
uuaagggaggagcuucaagaug

SEQ ID NO: 251406 - RNA, 22 nt, Homo sapiens
uuaagguuuuuguagcaaggau

SEQ ID NO: 251407 - RNA, 22 nt, Homo sapiens
uuaagucacacuagacaacuga

SEQ ID NO: 251408 - RNA, 22 nt, Homo sapiens
uuaagugaauuaucuaacaugu

SEQ ID NO: 251409 - RNA, 21 nt, Homo sapiens
uuaagugcuuuguaugcacua

SEQ ID NO: 251410 - RNA, 23 nt, Homo sapiens
uuaagugcuuuucugaaacucuu

SEQ ID NO: 251411 - RNA, 22 nt, Homo sapiens
uuaaguuaggcuucagcagucu

SEQ ID NO: 251412 - RNA, 22 nt, Homo sapiens
uuaaguuguagcuacaaauaca

SEQ ID NO: 251413 - RNA, 22 nt, Homo sapiens
uuaauacucuucuaaguagucc

SEQ ID NO: 251414 - RNA, 22 nt, Homo sapiens
uuaauacugcuuaacuuuagga

SEQ ID NO: 251415 - RNA, 22 nt, Homo sapiens
uuaaugaacuuuauuuuguaga

SEQ ID NO: 251416 - RNA, 22 nt, Homo sapiens
uuaauggagaguuucauuggug

SEQ ID NO: 251417 - RNA, 22 nt, Homo sapiens
uuaauguaucuaucacaucaca

SEQ ID NO: 251418 - RNA, 22 nt, Homo sapiens
uuacaaguggcaucucucugga

SEQ ID NO: 251419 - RNA, 22 nt, Homo sapiens
uuacacaguaggucccuaguaa

SEQ ID NO: 251420 - RNA, 22 nt, Homo sapiens
uuacacaguugguaggggcaga

SEQ ID NO: 251421 - RNA, 22 nt, Homo sapiens
uuacaccuguaauccagcacuu

SEQ ID NO: 251422 - RNA, 22 nt, Homo sapiens
uuacagauggcacacucaaggg

SEQ ID NO: 251423 - RNA, 22 nt, Homo sapiens
uuacaguauugcaaggacuagg

SEQ ID NO: 251424 - RNA, 22 nt, Homo sapiens
uuacagucuuaggcagugcuuu

SEQ ID NO: 251425 - RNA, 22 nt, Homo sapiens
uuacaguucugguggagaggua

SEQ ID NO: 251426 - RNA, 22 nt, Homo sapiens
uuacaucaucacauuaguuugc

SEQ ID NO: 251427 - RNA, 19 nt, Homo sapiens
uuacauccauugcauuuca

SEQ ID NO: 251428 - RNA, 22 nt, Homo sapiens
uuaccaguggugcuguaaacuu

SEQ ID NO: 251429 - RNA, 22 nt, Homo sapiens
uuaccuguguuuugggcccaga

SEQ ID NO: 251430 - RNA, 22 nt, Homo sapiens
uuacuacucucuaugaccaguu

SEQ ID NO: 251431 - RNA, 20 nt, Homo sapiens
uuacuauguaguauuggcuc

SEQ ID NO: 251432 - RNA, 22 nt, Homo sapiens
uuagaaaguagaaaagcugguu

SEQ ID NO: 251433 - RNA, 22 nt, Homo sapiens
uuagaacuagaggaguuugagu

SEQ ID NO: 251434 - RNA, 22 nt, Homo sapiens
uuagaauggaaaugcgagguua

SEQ ID NO: 251435 - RNA, 22 nt, Homo sapiens
uuagagcacugaucugcucuuu

SEQ ID NO: 251436 - RNA, 20 nt, Homo sapiens
uuagaguaguaugauuuaua

SEQ ID NO: 251437 - RNA, 22 nt, Homo sapiens
uuagcacaguucauucauguua

SEQ ID NO: 251438 - RNA, 22 nt, Homo sapiens
uuagcacugagaauggcuugcu

SEQ ID NO: 251439 - RNA, 18 nt, Homo sapiens
ugacaguuucuuuauauu

SEQ ID NO: 251440 - RNA, 22 nt, Homo sapiens
ugacauagcuauuaagugaugc

SEQ ID NO: 251441 - RNA, 22 nt, Homo sapiens
ugacaugaagaaaaacagauuu

SEQ ID NO: 251442 - RNA, 22 nt, Homo sapiens
ugacaugauguuccuacacugu

SEQ ID NO: 251443 - RNA, 22 nt, Homo sapiens
ugacauguauaucuuacgcuau

SEQ ID NO: 251444 - RNA, 21 nt, Homo sapiens
ugacauuauuucaugucagua

SEQ ID NO: 251445 - RNA, 22 nt, Homo sapiens
ugaccacagaaagugagggagc

SEQ ID NO: 251446 - RNA, 22 nt, Homo sapiens
ugacggaggacaccugcggaau

SEQ ID NO: 251447 - RNA, 22 nt, Homo sapiens
ugacuaaggaaggauuaugugc

SEQ ID NO: 251448 - RNA, 22 nt, Homo sapiens
ugacuacaggucaggaagcugu

SEQ ID NO: 251449 - RNA, 22 nt, Homo sapiens
ugacuagagcaauuggaaacaa

SEQ ID NO: 251450 - RNA, 22 nt, Homo sapiens
ugacuagcgauccccuuucuag

SEQ ID NO: 251451 - RNA, 22 nt, Homo sapiens
ugacuagugcccuuugcugccu

SEQ ID NO: 251452 - RNA, 19 nt, Homo sapiens
ugacuauagccugaucagu

SEQ ID NO: 251453 - RNA, 22 nt, Homo sapiens
ugacucaguuguuagucuucau

SEQ ID NO: 251454 - RNA, 22 nt, Homo sapiens
ugacucaguuucucagguagua

SEQ ID NO: 251455 - RNA, 22 nt, Homo sapiens
ugacuucagacugaaaugauuc

SEQ ID NO: 251456 - RNA, 22 nt, Homo sapiens
ugacuugauccauggggcucca

SEQ ID NO: 251457 - RNA, 22 nt, Homo sapiens
ugagaacagauggcuuuauuau

SEQ ID NO: 251458 - RNA, 22 nt, Homo sapiens
ugagaacaugcacuugagguug

SEQ ID NO: 251459 - RNA, 22 nt, Homo sapiens
ugagaacucaugaaucuuucca

SEQ ID NO: 251460 - RNA, 22 nt, Homo sapiens
ugagaagacaucagcuuucgga

SEQ ID NO: 251461 - RNA, 22 nt, Homo sapiens
ugagaagcauaccagugucugu

SEQ ID NO: 251462 - RNA, 22 nt, Homo sapiens
ugagaauauuugaagauguuag

SEQ ID NO: 251463 - RNA, 22 nt, Homo sapiens
ugagaaugaugauuuccaguuu

SEQ ID NO: 251464 - RNA, 22 nt, Homo sapiens
ugagacaaaguuguuggauguu

SEQ ID NO: 251465 - RNA, 22 nt, Homo sapiens
ugagacggagucucacucuguu

SEQ ID NO: 251466 - RNA, 22 nt, Homo sapiens
ugagacggagucuugcccuguc

SEQ ID NO: 251467 - RNA, 22 nt, Homo sapiens
ugagacggaguuauuuauaaua

SEQ ID NO: 251468 - RNA, 22 nt, Homo sapiens
ugagacugagucucgcucuugu

SEQ ID NO: 251469 - RNA, 22 nt, Homo sapiens
ugagacugagucuugcucuauu

SEQ ID NO: 251470 - RNA, 22 nt, Homo sapiens
ugagacugauaggacauuuucu

SEQ ID NO: 251471 - RNA, 22 nt, Homo sapiens
ugagagaugaacuauucuugaa

SEQ ID NO: 251472 - RNA, 22 nt, Homo sapiens
ugagagaugaacucugauaugu

SEQ ID NO: 251473 - RNA, 22 nt, Homo sapiens
ugagagcugcauucuugaaagc

SEQ ID NO: 251474 - RNA, 22 nt, Homo sapiens
ugagaggugaauggcaggcuca

SEQ ID NO: 251475 - RNA, 22 nt, Homo sapiens
ugagagucauacaaauaaaaau

SEQ ID NO: 251476 - RNA, 22 nt, Homo sapiens
ugagauaaucaugugauuucau

SEQ ID NO: 251477 - RNA, 22 nt, Homo sapiens
ugagauaaugcaugugaagauc

SEQ ID NO: 251478 - RNA, 22 nt, Homo sapiens
ugagaucaagguuaauauaauc

SEQ ID NO: 251479 - RNA, 22 nt, Homo sapiens
ugagaucacuaagagguaaugg

SEQ ID NO: 251480 - RNA, 22 nt, Homo sapiens
ugagaucagaaggauuucucug

SEQ ID NO: 251481 - RNA, 18 nt, Homo sapiens
ugagaucagcaucaaggg

SEQ ID NO: 251482 - RNA, 20 nt, Homo sapiens
ugagauccacgugaaguaug

SEQ ID NO: 251483 - RNA, 23 nt, Homo sapiens
ugagaucuacagaucucagaucu

SEQ ID NO: 251484 - RNA, 22 nt, Homo sapiens
ugagaugaaagcagaaagacuu

SEQ ID NO: 251485 - RNA, 22 nt, Homo sapiens
ugagaugaagucucacucuguc

SEQ ID NO: 251486 - RNA, 22 nt, Homo sapiens
ugagaugagagaaugcuugccu

SEQ ID NO: 251487 - RNA, 22 nt, Homo sapiens
ugagaugagggcugcacucaaa

SEQ ID NO: 251488 - RNA, 22 nt, Homo sapiens
ugagaugaggucucacucuguu

SEQ ID NO: 251489 - RNA, 22 nt, Homo sapiens
ugagaugaucaaaguauaggcu

SEQ ID NO: 251490 - RNA, 21 nt, Homo sapiens
ugagaugauccugcaugcaug

SEQ ID NO: 251491 - RNA, 22 nt, Homo sapiens
ugagauggaguuucgcuuuugu

SEQ ID NO: 251492 - RNA, 22 nt, Homo sapiens
ugagauggcugaauucagaaua

SEQ ID NO: 251493 - RNA, 22 nt, Homo sapiens
ugagauggcuuuauugcugaau

SEQ ID NO: 251494 - RNA, 23 nt, Homo sapiens
ugagaugucugauugcgaggguc

SEQ ID NO: 251495 - RNA, 22 nt, Homo sapiens
ugagauguggcuagagagguug

SEQ ID NO: 251496 - RNA, 22 nt, Homo sapiens
ugagauuaucuugaucuugaaa

SEQ ID NO: 251497 - RNA, 22 nt, Homo sapiens
ugagauuguaucugcaaugugu

SEQ ID NO: 251498 - RNA, 19 nt, Homo sapiens
ugagauuguaugaggagau

SEQ ID NO: 251499 - RNA, 22 nt, Homo sapiens
ugagcacagcgugugggagagc

SEQ ID NO: 251500 - RNA, 22 nt, Homo sapiens
ugagcagaaguuuugauuggcg

SEQ ID NO: 251501 - RNA, 22 nt, Homo sapiens
ugagcagagaagugcccugcgc

SEQ ID NO: 251502 - RNA, 22 nt, Homo sapiens
ugagcagaguuguuucuccuga

SEQ ID NO: 251503 - RNA, 22 nt, Homo sapiens
ugagccauggcaccuugucuaa

SEQ ID NO: 251504 - RNA, 22 nt, Homo sapiens
ugagccaugguuagcuucucau

SEQ ID NO: 251505 - RNA, 22 nt, Homo sapiens
ugagcgaugggaggaagugaua

SEQ ID NO: 251506 - RNA, 17 nt, Homo sapiens
ugagcuaagauuacccc

SEQ ID NO: 251507 - RNA, 20 nt, Homo sapiens
ugagcucaugacauuuuucu

SEQ ID NO: 251508 - RNA, 22 nt, Homo sapiens
ugaggaauguguguuaaagaua

SEQ ID NO: 251509 - RNA, 22 nt, Homo sapiens
ugaggagugagaaauugguuuc

SEQ ID NO: 251510 - RNA, 22 nt, Homo sapiens
ugaggcaagauacugauuucau

SEQ ID NO: 251511 - RNA, 22 nt, Homo sapiens
ugagggaugccugguuuguuuu

SEQ ID NO: 251512 - RNA, 22 nt, Homo sapiens
ugagggcguauccuucauuaag

SEQ ID NO: 251513 - RNA, 22 nt, Homo sapiens
ugagguaaugcuguagcuguga

SEQ ID NO: 251514 - RNA, 22 nt, Homo sapiens
ugagguagguaccauuaucacu

SEQ ID NO: 251515 - RNA, 22 nt, Homo sapiens
ugagguuggggucagggcuagc

SEQ ID NO: 251516 - RNA, 22 nt, Homo sapiens
ugagguuggguaauuuaugaag

SEQ ID NO: 251517 - RNA, 22 nt, Homo sapiens
ugaguagaacuagucuagagcu

SEQ ID NO: 251518 - RNA, 22 nt, Homo sapiens
ugaguagcuaauguuuacugag

SEQ ID NO: 251519 - RNA, 22 nt, Homo sapiens
ugaguagugcugcaauaaacau

SEQ ID NO: 251520 - RNA, 22 nt, Homo sapiens
ugaguauagaucaguucaagug

SEQ ID NO: 251521 - RNA, 22 nt, Homo sapiens
ugaguauguuuagaaguaaagg

SEQ ID NO: 251522 - RNA, 22 nt, Homo sapiens
ugagucaauggaggcucagagc

SEQ ID NO: 251523 - RNA, 22 nt, Homo sapiens
ugagucaugcuggagucauggc

SEQ ID NO: 251524 - RNA, 22 nt, Homo sapiens
ugagucuguuccaaagaaauaa

SEQ ID NO: 251525 - RNA, 21 nt, Homo sapiens
uggcacuauucacaauagcaa

SEQ ID NO: 251526 - RNA, 22 nt, Homo sapiens
uggcagacaaauuugagcauau

SEQ ID NO: 251527 - RNA, 22 nt, Homo sapiens
uggcagaugggugagcuggaga

SEQ ID NO: 251528 - RNA, 22 nt, Homo sapiens
uggcagugggagauauuuuauu

SEQ ID NO: 251529 - RNA, 22 nt, Homo sapiens
uggcaugauguguucauugaaa

SEQ ID NO: 251530 - RNA, 22 nt, Homo sapiens
uggcaugucagguuucuggguu

SEQ ID NO: 251531 - RNA, 22 nt, Homo sapiens
uggcaugucguuuuucauagga

SEQ ID NO: 251532 - RNA, 22 nt, Homo sapiens
uggcaugugugaagugcccagc

SEQ ID NO: 251533 - RNA, 22 nt, Homo sapiens
uggcauuuugugugaauuagaa

SEQ ID NO: 251534 - RNA, 22 nt, Homo sapiens
uggccagagggcaauuagcugu

SEQ ID NO: 251535 - RNA, 22 nt, Homo sapiens
uggccagugucuauugguuucc

SEQ ID NO: 251536 - RNA, 22 nt, Homo sapiens
uggcgagaaaccauaugcuuuc

SEQ ID NO: 251537 - RNA, 22 nt, Homo sapiens
uggcuacagaaaguacuaguga

SEQ ID NO: 251538 - RNA, 22 nt, Homo sapiens
auugcccaggcuggagugcagu

SEQ ID NO: 251539 - RNA, 22 nt, Homo sapiens
auuggcaagauagcauaugagg

SEQ ID NO: 251540 - RNA, 22 nt, Homo sapiens
auuggcaauccauauauuuucu

SEQ ID NO: 251541 - RNA, 22 nt, Homo sapiens
auuggcaauggcaaagcagagu

SEQ ID NO: 251542 - RNA, 22 nt, Homo sapiens
auuggcuauuuggugagugauu

SEQ ID NO: 251543 - RNA, 22 nt, Homo sapiens
auuguaccccaauguacaauau

SEQ ID NO: 251544 - RNA, 22 nt, Homo sapiens
auuguacuccagccugggcagc

SEQ ID NO: 251545 - RNA, 22 nt, Homo sapiens
auugucacccgggcaguaagca

SEQ ID NO: 251546 - RNA, 22 nt, Homo sapiens
auuguguuugaaugaggcucca

SEQ ID NO: 251547 - RNA, 22 nt, Homo sapiens
auuguucuuacaugcugucauc

SEQ ID NO: 251548 - RNA, 22 nt, Homo sapiens
auuuagcaauggagguagugua

SEQ ID NO: 251549 - RNA, 22 nt, Homo sapiens
auuucacugagacaugugccca

SEQ ID NO: 251550 - RNA, 20 nt, Homo sapiens
auuugcauuauggagcaccc

SEQ ID NO: 251551 - RNA, 22 nt, Homo sapiens
auuuggcaacguagggaggcau

SEQ ID NO: 251552 - RNA, 22 nt, Homo sapiens
auuuggccuuuguaugcaguau

SEQ ID NO: 251553 - RNA, 22 nt, Homo sapiens
auuugggaaugugcauuauacu

SEQ ID NO: 251554 - RNA, 22 nt, Homo sapiens
auuugguuauggucauggacac

SEQ ID NO: 251555 - RNA, 22 nt, Homo sapiens
auuuguccugccuuuuccuccu

SEQ ID NO: 251556 - RNA, 22 nt, Homo sapiens
auuuugcauugcuguaaaggaa

SEQ ID NO: 251557 - RNA, 18 nt, Homo sapiens
auuuuugcaguccacaug

SEQ ID NO: 251558 - RNA, 22 nt, Homo sapiens
caaaccuguaggggccaagagg

SEQ ID NO: 251559 - RNA, 22 nt, Homo sapiens
caaaggcuuccacugcauccuu

SEQ ID NO: 251560 - RNA, 22 nt, Homo sapiens
caaaggcuucugaaacugcaga

SEQ ID NO: 251561 - RNA, 22 nt, Homo sapiens
caaaggugcuuuccagguccaa

SEQ ID NO: 251562 - RNA, 22 nt, Homo sapiens
caaagugcugaaagaggccagg

SEQ ID NO: 251563 - RNA, 22 nt, Homo sapiens
caaagugguuuauacaugauug

SEQ ID NO: 251564 - RNA, 22 nt, Homo sapiens
caaauccucaccucaucaugaa

SEQ ID NO: 251565 - RNA, 22 nt, Homo sapiens
caacagucagcccauccacaga

SEQ ID NO: 251566 - RNA, 19 nt, Homo sapiens
caacccugcagagaaagga

SEQ ID NO: 251567 - RNA, 22 nt, Homo sapiens
caacugguuuuauacaguuuag

SEQ ID NO: 251568 - RNA, 22 nt, Homo sapiens
caagacuguccaacauauuggg

SEQ ID NO: 251569 - RNA, 22 nt, Homo sapiens
caagggguggaaaugguagugu

SEQ ID NO: 251570 - RNA, 22 nt, Homo sapiens
caaguguuggcuuguauacaaa

SEQ ID NO: 251571 - RNA, 23 nt, Homo sapiens
caauacugaccucacguuaauag

SEQ ID NO: 251572 - RNA, 22 nt, Homo sapiens
caauacuguguugaauaagagu

SEQ ID NO: 251573 - RNA, 22 nt, Homo sapiens
caaugcauuauucucccacuuc

SEQ ID NO: 251574 - RNA, 22 nt, Homo sapiens
caauggcacgaucucgucucac

SEQ ID NO: 251575 - RNA, 22 nt, Homo sapiens
caaugugcuuggggcacaugag

SEQ ID NO: 251576 - RNA, 22 nt, Homo sapiens
cacacugucuuucagaaugguu

SEQ ID NO: 251577 - RNA, 22 nt, Homo sapiens
cacagcgacuuccgccuaccgg

SEQ ID NO: 251578 - RNA, 22 nt, Homo sapiens
acaaaguauggaauguuggugu

SEQ ID NO: 251579 - RNA, 22 nt, Homo sapiens
acaaagugccuccuuuuagagu

SEQ ID NO: 251580 - RNA, 22 nt, Homo sapiens
acaaaguguuuucugaaggccu

SEQ ID NO: 251581 - RNA, 22 nt, Homo sapiens
acaacaguuuuaucaccccaga

SEQ ID NO: 251582 - RNA, 22 nt, Homo sapiens
acaagcacaaauuuaauccugu

SEQ ID NO: 251583 - RNA, 22 nt, Homo sapiens
acacaaugguaaguguuugugu

SEQ ID NO: 251584 - RNA, 22 nt, Homo sapiens
acacagugucuguguauuuaaa

SEQ ID NO: 251585 - RNA, 22 nt, Homo sapiens
acacguguugaaauuuaauugc

SEQ ID NO: 251586 - RNA, 20 nt, Homo sapiens
acacuggaguaucaaggccc

SEQ ID NO: 251587 - RNA, 22 nt, Homo sapiens
acacuggaguuaaaggugauuu

SEQ ID NO: 251588 - RNA, 22 nt, Homo sapiens
uggcucauuucuaaacccagcu

SEQ ID NO: 251589 - RNA, 22 nt, Homo sapiens
uggcuguguccucucccaaauc

SEQ ID NO: 251590 - RNA, 22 nt, Homo sapiens
uggcuuuuccuugaaucugccu

SEQ ID NO: 251591 - RNA, 22 nt, Homo sapiens
ugggaagauucuguguuuuucc

SEQ ID NO: 251592 - RNA, 22 nt, Homo sapiens
ugggaauaugauacaggucuuu

SEQ ID NO: 251593 - RNA, 22 nt, Homo sapiens
ugggagcauugcauuagaagcc

SEQ ID NO: 251594 - RNA, 22 nt, Homo sapiens
ugggaucauuaugcauagugua

SEQ ID NO: 251595 - RNA, 22 nt, Homo sapiens
ugggaucuuuccuauuagcgag

SEQ ID NO: 251596 - RNA, 22 nt, Homo sapiens
ugggaugaaaauagcuucuucc

SEQ ID NO: 251597 - RNA, 23 nt, Homo sapiens
ugggauguuuuuggaaacuucug

SEQ ID NO: 251598 - RNA, 22 nt, Homo sapiens
ugggcaaauugugagggaggua

SEQ ID NO: 251599 - RNA, 22 nt, Homo sapiens
ugggcagugggacagcuuugug

SEQ ID NO: 251600 - RNA, 22 nt, Homo sapiens
ugggguaggcuguauacucugu

SEQ ID NO: 251601 - RNA, 22 nt, Homo sapiens
uggggucguaggugcccgccag

SEQ ID NO: 251602 - RNA, 22 nt, Homo sapiens
uggguagagcacugggggcgag

SEQ ID NO: 251603 - RNA, 22 nt, Homo sapiens
ugggugugaccgcucaaggggg

SEQ ID NO: 251604 - RNA, 23 nt, Homo sapiens
uggguucccuaagcgcaugcugc

SEQ ID NO: 251605 - RNA, 22 nt, Homo sapiens
ugguaaacaacaggagaacuug

SEQ ID NO: 251606 - RNA, 22 nt, Homo sapiens
ugguaauguaauuuggagaagg

SEQ ID NO: 251607 - RNA, 22 nt, Homo sapiens
ugguauguaugauuaacaugga

SEQ ID NO: 251608 - RNA, 22 nt, Homo sapiens
ugguaugucuagauggggaagu

SEQ ID NO: 251609 - RNA, 22 nt, Homo sapiens
ugguauguugucucuuuguucu

SEQ ID NO: 251610 - RNA, 22 nt, Homo sapiens
ugguauuuaauauaugagaguu

SEQ ID NO: 251611 - RNA, 19 nt, Homo sapiens
uggucaguucugggagcug

SEQ ID NO: 251612 - RNA, 21 nt, Homo sapiens
uggucccuucagaucggauuu

SEQ ID NO: 251613 - RNA, 17 nt, Homo sapiens
uggugcuugaaaguugc

SEQ ID NO: 251614 - RNA, 20 nt, Homo sapiens
uggugucuuggaaagagcuc

SEQ ID NO: 251615 - RNA, 23 nt, Homo sapiens
ugguuuguaagagauggacugga

SEQ ID NO: 251616 - RNA, 22 nt, Homo sapiens
uguaaacauguauguguuuaug

SEQ ID NO: 251617 - RNA, 22 nt, Homo sapiens
uguaaaccauauauguauguag

SEQ ID NO: 251618 - RNA, 20 nt, Homo sapiens
uguaaaggagauugcagcug

SEQ ID NO: 251619 - RNA, 22 nt, Homo sapiens
uguaaaucuauuuuuaguguuu

SEQ ID NO: 251620 - RNA, 22 nt, Homo sapiens
uguaaaucuuucacaguugaug

SEQ ID NO: 251621 - RNA, 20 nt, Homo sapiens
uguaacaaucuggauguugc

SEQ ID NO: 251622 - RNA, 22 nt, Homo sapiens
uguaacacacacuguuuacucc

SEQ ID NO: 251623 - RNA, 22 nt, Homo sapiens
uguaauuuaaaugauccuugga

SEQ ID NO: 251624 - RNA, 22 nt, Homo sapiens
uguacaaauuucugugguggug

SEQ ID NO: 251625 - RNA, 20 nt, Homo sapiens
uguacacaguguacccacau

SEQ ID NO: 251626 - RNA, 22 nt, Homo sapiens
uguagauaucauuagugcugug

SEQ ID NO: 251627 - RNA, 20 nt, Homo sapiens
uguagguguacaguaaggag

SEQ ID NO: 251628 - RNA, 23 nt, Homo sapiens
uguauacacccugugcaucuggg

SEQ ID NO: 251629 - RNA, 22 nt, Homo sapiens
uguauacauguguguucacgca

SEQ ID NO: 251630 - RNA, 22 nt, Homo sapiens
uguaugagagugaaagcauuuc

SEQ ID NO: 251631 - RNA, 22 nt, Homo sapiens
uguauguaaagacaggauaaca

SEQ ID NO: 251632 - RNA, 22 nt, Homo sapiens
uguauugcuugaagagugaauu

SEQ ID NO: 251633 - RNA, 20 nt, Homo sapiens
ugucaagaaacauuacuuau

SEQ ID NO: 251634 - RNA, 20 nt, Homo sapiens
ugucaaggaauucccaaauc

SEQ ID NO: 251635 - RNA, 22 nt, Homo sapiens
ugucacauccaagaaggugcag

SEQ ID NO: 251636 - RNA, 22 nt, Homo sapiens
ugucaggagcaaugauaaauuu

SEQ ID NO: 251637 - RNA, 22 nt, Homo sapiens
ugucaguguacuguaagaauua

SEQ ID NO: 251638 - RNA, 22 nt, Homo sapiens
ugucaguuucaguguuagccuu

SEQ ID NO: 251639 - RNA, 23 nt, Homo sapiens
ugucaucaagaugaggucacacu

SEQ ID NO: 251640 - RNA, 22 nt, Homo sapiens
ugucauggggaaaauaacagac

SEQ ID NO: 251641 - RNA, 22 nt, Homo sapiens
ugucauucaggaaauucuaagu

SEQ ID NO: 251642 - RNA, 22 nt, Homo sapiens
ugucauuggacuucuuucaugg

SEQ ID NO: 251643 - RNA, 22 nt, Homo sapiens
ugucauuguggugcagauauaa

SEQ ID NO: 251644 - RNA, 22 nt, Homo sapiens
uguccaaauugaaucaucuggu

SEQ ID NO: 251645 - RNA, 19 nt, Homo sapiens
ugucccagccauagaggca

SEQ ID NO: 251646 - RNA, 22 nt, Homo sapiens
ugucccugagccuggauuccug

SEQ ID NO: 251647 - RNA, 22 nt, Homo sapiens
uguccuguaggaggcagaacaa

SEQ ID NO: 251648 - RNA, 21 nt, Homo sapiens
ugucugagagaggagaucuac

SEQ ID NO: 251649 - RNA, 22 nt, Homo sapiens
ugucuuguagacaauguauagu

SEQ ID NO: 251650 - RNA, 22 nt, Homo sapiens
ugucuuguagacugaaggcuuc

SEQ ID NO: 251651 - RNA, 22 nt, Homo sapiens
ugucuuuguuaguuguccuagu

SEQ ID NO: 251652 - RNA, 22 nt, Homo sapiens
ugugaaaucagauagccuuuuu

SEQ ID NO: 251653 - RNA, 22 nt, Homo sapiens
ugugaacagaauuagucaccua

SEQ ID NO: 251654 - RNA, 22 nt, Homo sapiens
ugugaacagcuccaaaugugga

SEQ ID NO: 251655 - RNA, 19 nt, Homo sapiens
ugugaacaucacagagugu

SEQ ID NO: 251656 - RNA, 22 nt, Homo sapiens
ugugaacauuuuguauauauua

SEQ ID NO: 251657 - RNA, 22 nt, Homo sapiens
ugugaauggugcugcaaugaac

SEQ ID NO: 251658 - RNA, 17 nt, Homo sapiens
ugugacccugggcuacc

SEQ ID NO: 251659 - RNA, 22 nt, Homo sapiens
ugugacucugcauuuuggguuc

SEQ ID NO: 251660 - RNA, 19 nt, Homo sapiens
ugugacugggccagccuag

SEQ ID NO: 251661 - RNA, 22 nt, Homo sapiens
ugugauaguuggcuaaagcagu

SEQ ID NO: 251662 - RNA, 22 nt, Homo sapiens
ugugaucaaccugcagggcugg

SEQ ID NO: 251663 - RNA, 22 nt, Homo sapiens
ugugaucaugguauuaaucugc

SEQ ID NO: 251664 - RNA, 22 nt, Homo sapiens
ugugaucaugugugccuuaguc

SEQ ID NO: 251665 - RNA, 22 nt, Homo sapiens
ugugaugugaugagaaguuccu

SEQ ID NO: 251666 - RNA, 20 nt, Homo sapiens
ugugauuauuuaguugcaug

SEQ ID NO: 251667 - RNA, 17 nt, Homo sapiens
ugugauugaagucaucc

SEQ ID NO: 251668 - RNA, 22 nt, Homo sapiens
ugugcacaacaugcagguuugu

SEQ ID NO: 251669 - RNA, 22 nt, Homo sapiens
ugugccaaucauagggcuuggu

SEQ ID NO: 251670 - RNA, 22 nt, Homo sapiens
ugugccacuccaaccuggguga

SEQ ID NO: 251671 - RNA, 22 nt, Homo sapiens
ugugccacugcacuccugccug

SEQ ID NO: 251672 - RNA, 22 nt, Homo sapiens
ugugccacugcacucuggccug

SEQ ID NO: 251673 - RNA, 22 nt, Homo sapiens
ugugccacuguucuguaaagug

SEQ ID NO: 251674 - RNA, 22 nt, Homo sapiens
ugugcucaucucagucaacugu

SEQ ID NO: 251675 - RNA, 22 nt, Homo sapiens
ugugcugaucgggcacgguguc

SEQ ID NO: 251676 - RNA, 22 nt, Homo sapiens
uguggaguguaugugacagaga

SEQ ID NO: 251677 - RNA, 22 nt, Homo sapiens
uguggcauugaauaaccuugga

SEQ ID NO: 251678 - RNA, 22 nt, Homo sapiens
uguggcugguggcaccuuuucc

SEQ ID NO: 251679 - RNA, 22 nt, Homo sapiens
ugugguuuuaguaaaacuaugu

SEQ ID NO: 251680 - RNA, 22 nt, Homo sapiens
ggagucugaacuggacaaugac

SEQ ID NO: 251681 - RNA, 22 nt, Homo sapiens
ggagucugacuuauaggaaccu

SEQ ID NO: 251682 - RNA, 22 nt, Homo sapiens
ggagucugauguucuaaggcag

SEQ ID NO: 251683 - RNA, 22 nt, Homo sapiens
ggaguguguuuuccaacuuggu

SEQ ID NO: 251684 - RNA, 22 nt, Homo sapiens
ggaucacagagcuugggaaagg

SEQ ID NO: 251685 - RNA, 22 nt, Homo sapiens
ggaucacuugagaccaggaguu

SEQ ID NO: 251686 - RNA, 22 nt, Homo sapiens
ggcaaagagacaugcaucgggg

SEQ ID NO: 251687 - RNA, 22 nt, Homo sapiens
ggcaaagaugaccauuacuuuu

SEQ ID NO: 251688 - RNA, 22 nt, Homo sapiens
ggcaacaauuccuacuucuuuu

SEQ ID NO: 251689 - RNA, 22 nt, Homo sapiens
ggcaagaaccacaauuacuuuu

SEQ ID NO: 251690 - RNA, 22 nt, Homo sapiens
ggcaagaaccagggauuugcgu

SEQ ID NO: 251691 - RNA, 22 nt, Homo sapiens
ggcaagaacuucacucacuuuu

SEQ ID NO: 251692 - RNA, 21 nt, Homo sapiens
ggcaagagaauacaacauaaa

SEQ ID NO: 251693 - RNA, 22 nt, Homo sapiens
ggcaagauagauaucaguguca

SEQ ID NO: 251694 - RNA, 22 nt, Homo sapiens
ggcaagaucuuggcucacugaa

SEQ ID NO: 251695 - RNA, 22 nt, Homo sapiens
ggcaagugggagggaguguuuc

SEQ ID NO: 251696 - RNA, 22 nt, Homo sapiens
ggcaagugucagcagcaacacc

SEQ ID NO: 251697 - RNA, 19 nt, Homo sapiens
ggcaauacuuucuuguugg

SEQ ID NO: 251698 - RNA, 22 nt, Homo sapiens
ggcaauauauucugaauucagu

SEQ ID NO: 251699 - RNA, 22 nt, Homo sapiens
ggcaauauuauuaacccucugu

SEQ ID NO: 251700 - RNA, 22 nt, Homo sapiens
ggcacaauugcagcaauaaaca

SEQ ID NO: 251701 - RNA, 22 nt, Homo sapiens
ggcaccacagacgccaggcgug

SEQ ID NO: 251702 - RNA, 22 nt, Homo sapiens
ggcagcacaauuuucugaugga

SEQ ID NO: 251703 - RNA, 22 nt, Homo sapiens
ggcagcaugggugccuuuguga

SEQ ID NO: 251704 - RNA, 22 nt, Homo sapiens
ggcagcgugguggauugaaaau

SEQ ID NO: 251705 - RNA, 22 nt, Homo sapiens
ggcagcucaggccccgcgcuga

SEQ ID NO: 251706 - RNA, 22 nt, Homo sapiens
ggcaguguaauaauuuauuaau

SEQ ID NO: 251707 - RNA, 22 nt, Homo sapiens
ggcaguuucucaggcaggggua

SEQ ID NO: 251708 - RNA, 22 nt, Homo sapiens
ggcaguuuggcaguuucauaaa

SEQ ID NO: 251709 - RNA, 22 nt, Homo sapiens
ggcaugguggugugugccuaua

SEQ ID NO: 251710 - RNA, 22 nt, Homo sapiens
ggcauguaauuauucaaagugg

SEQ ID NO: 251711 - RNA, 22 nt, Homo sapiens
ggcauguauucuuauuauuccu

SEQ ID NO: 251712 - RNA, 22 nt, Homo sapiens
ggcauguugauagguagaugua

SEQ ID NO: 251713 - RNA, 22 nt, Homo sapiens
ggccagaugcgguggcucacac

SEQ ID NO: 251714 - RNA, 22 nt, Homo sapiens
ggccuguaaacuagagacccug

SEQ ID NO: 251715 - RNA, 22 nt, Homo sapiens
ggcuagaugcuagagauaucau

SEQ ID NO: 251716 - RNA, 19 nt, Homo sapiens
ggcucagucaacugacugu

SEQ ID NO: 251717 - RNA, 22 nt, Homo sapiens
ggcucagugggguccugguucu

SEQ ID NO: 251718 - RNA, 22 nt, Homo sapiens
ggcucguguuuucuguccaguu

SEQ ID NO: 251719 - RNA, 22 nt, Homo sapiens
ggcuguguguuaaaauaggcuu

SEQ ID NO: 251720 - RNA, 22 nt, Homo sapiens
gggaaauguaaagucauaagau

SEQ ID NO: 251721 - RNA, 22 nt, Homo sapiens
gggaacauggaaauucugcucu

SEQ ID NO: 251722 - RNA, 22 nt, Homo sapiens
gggaauguagcaaaucugcaau

SEQ ID NO: 251723 - RNA, 22 nt, Homo sapiens
gggaugaaguugauguagaaag

SEQ ID NO: 251724 - RNA, 22 nt, Homo sapiens
gggaugauuaugguucacuaca

SEQ ID NO: 251725 - RNA, 22 nt, Homo sapiens
gggauguaugauauauguuggu

SEQ ID NO: 251726 - RNA, 22 nt, Homo sapiens
gggcagaugucuggacaccuca

SEQ ID NO: 251727 - RNA, 22 nt, Homo sapiens
gggcauaucacuugaggucagg

SEQ ID NO: 251728 - RNA, 22 nt, Homo sapiens
ggggcauugugucuggguuccu

SEQ ID NO: 251729 - RNA, 22 nt, Homo sapiens
gggucaguuuugagaaagcgug

SEQ ID NO: 251730 - RNA, 22 nt, Homo sapiens
ggguucccugaugagaguuagu

SEQ ID NO: 251731 - RNA, 22 nt, Homo sapiens
gguaaacauaagagagcugacu

SEQ ID NO: 251732 - RNA, 22 nt, Homo sapiens
gguaaacauacugcugucuucu

SEQ ID NO: 251733 - RNA, 22 nt, Homo sapiens
gguauguuuagaccauuuacau

SEQ ID NO: 251734 - RNA, 22 nt, Homo sapiens
gguauuauuugccuuuuacuga

SEQ ID NO: 251735 - RNA, 22 nt, Homo sapiens
ggucagugcauucuaaaggcaa

SEQ ID NO: 251736 - RNA, 22 nt, Homo sapiens
ggucauagagaauucaccagga

SEQ ID NO: 251737 - RNA, 22 nt, Homo sapiens
ggucauggauaagauccagaag

SEQ ID NO: 251738 - RNA, 22 nt, Homo sapiens
ggucccccuccacucucgcaaa

SEQ ID NO: 251739 - RNA, 22 nt, Homo sapiens
ggucugguguugaaauucuuca

SEQ ID NO: 251740 - RNA, 22 nt, Homo sapiens
ggucuuggagaauuguccuggg

SEQ ID NO: 251741 - RNA, 22 nt, Homo sapiens
ggugagaaaaacauagucucag

SEQ ID NO: 251742 - RNA, 22 nt, Homo sapiens
ggugcuugaggaacggaggcug

SEQ ID NO: 251743 - RNA, 22 nt, Homo sapiens
gguggcuuuuugugauggcuga

SEQ ID NO: 251744 - RNA, 22 nt, Homo sapiens
gguggucuuccccuggaguucg

SEQ ID NO: 251745 - RNA, 22 nt, Homo sapiens
guaaacuuccccucaugaauga

SEQ ID NO: 251746 - RNA, 18 nt, Homo sapiens
guaaauguaucuauugcc

SEQ ID NO: 251747 - RNA, 22 nt, Homo sapiens
guaacacaugcugcucucuggu

SEQ ID NO: 251748 - RNA, 20 nt, Homo sapiens
guaacagcacuuucccaaag

SEQ ID NO: 251749 - RNA, 22 nt, Homo sapiens
guaacucugucacuuacuaguu

SEQ ID NO: 251750 - RNA, 22 nt, Homo sapiens
guaagauaguauguuuaaccca

SEQ ID NO: 251751 - RNA, 22 nt, Homo sapiens
guaagugguagagcugggcuau

SEQ ID NO: 251752 - RNA, 22 nt, Homo sapiens
guaauaacuguggaaaaagguu

SEQ ID NO: 251753 - RNA, 20 nt, Homo sapiens
uaggagcaaugagaguagaa

SEQ ID NO: 251754 - RNA, 22 nt, Homo sapiens
uaggagcacagcagcauguggg

SEQ ID NO: 251755 - RNA, 22 nt, Homo sapiens
uaggcaaaugcaagaguagaac

SEQ ID NO: 251756 - RNA, 22 nt, Homo sapiens
uaggcaauggagauagaggaug

SEQ ID NO: 251757 - RNA, 22 nt, Homo sapiens
uaggcaguuuuccuuucacagu

SEQ ID NO: 251758 - RNA, 22 nt, Homo sapiens
uaggcuguguggccguggggcu

SEQ ID NO: 251759 - RNA, 22 nt, Homo sapiens
uaggcuuuuggacccugucucu

SEQ ID NO: 251760 - RNA, 22 nt, Homo sapiens
uagggaguuuuggggugcagaa

SEQ ID NO: 251761 - RNA, 22 nt, Homo sapiens
uagggcaugugggaaguuauaa

SEQ ID NO: 251762 - RNA, 22 nt, Homo sapiens
uagggcauuuagaggcuauuaa

SEQ ID NO: 251763 - RNA, 22 nt, Homo sapiens
uaggggcacacuucgguuagca

SEQ ID NO: 251764 - RNA, 22 nt, Homo sapiens
uagguaagauguuaacagcuga

SEQ ID NO: 251765 - RNA, 22 nt, Homo sapiens
uagguaaguaauauacagauga

SEQ ID NO: 251766 - RNA, 22 nt, Homo sapiens
uaggucccguuucagacugaga

SEQ ID NO: 251767 - RNA, 22 nt, Homo sapiens
uaggugguuugaaauacucaag

SEQ ID NO: 251768 - RNA, 22 nt, Homo sapiens
uagguucuccacagguucucca

SEQ ID NO: 251769 - RNA, 22 nt, Homo sapiens
uaguacuggcauguauuuccca

SEQ ID NO: 251770 - RNA, 22 nt, Homo sapiens
uaguaguuuuguguauaauaau

SEQ ID NO: 251771 - RNA, 22 nt, Homo sapiens
uagucaaaucugaaggaaauuu

SEQ ID NO: 251772 - RNA, 22 nt, Homo sapiens
uagucccuuucuauuaaugaga

SEQ ID NO: 251773 - RNA, 21 nt, Homo sapiens
uagugcugaggcaguauggga

SEQ ID NO: 251774 - RNA, 22 nt, Homo sapiens
uagugcugugauauuuuuggcc

SEQ ID NO: 251775 - RNA, 22 nt, Homo sapiens
uauaacaaugcaagaauggccu

SEQ ID NO: 251776 - RNA, 22 nt, Homo sapiens
uauacaugugggcaucaggaga

SEQ ID NO: 251777 - RNA, 22 nt, Homo sapiens
uauaccacugauuuuauucuga

SEQ ID NO: 251778 - RNA, 22 nt, Homo sapiens
uauacugucuuuguaugccuag

SEQ ID NO: 251779 - RNA, 22 nt, Homo sapiens
uauacuguuuucuauaguggcu

SEQ ID NO: 251780 - RNA, 22 nt, Homo sapiens
uauaucacaugcacucauuuuc

SEQ ID NO: 251781 - RNA, 22 nt, Homo sapiens
uauaugcacucagguguaugug

SEQ ID NO: 251782 - RNA, 22 nt, Homo sapiens
uauaugcauugugggguacuga

SEQ ID NO: 251783 - RNA, 22 nt, Homo sapiens
uauaugucuuuguuauguugag

SEQ ID NO: 251784 - RNA, 22 nt, Homo sapiens
uaucaaacccaaggaggggguu

SEQ ID NO: 251785 - RNA, 22 nt, Homo sapiens
uaucaacaggguggccagugua

SEQ ID NO: 251786 - RNA, 19 nt, Homo sapiens
uaucaaguaugcacuguac

SEQ ID NO: 251787 - RNA, 22 nt, Homo sapiens
uaucaaguguuagggagaugug

SEQ ID NO: 251788 - RNA, 22 nt, Homo sapiens
uaucacaaacuuagcaguuuaa

SEQ ID NO: 251789 - RNA, 22 nt, Homo sapiens
uaucacagcauugucuauaaua

SEQ ID NO: 251790 - RNA, 22 nt, Homo sapiens
uaucacagcgggguguacaccc

SEQ ID NO: 251791 - RNA, 20 nt, Homo sapiens
uaucacaggucagaaacccu

SEQ ID NO: 251792 - RNA, 22 nt, Homo sapiens
uaucacaggucaggaaucuugc

SEQ ID NO: 251793 - RNA, 22 nt, Homo sapiens
uaucacugucaggcccucauau

SEQ ID NO: 251794 - RNA, 22 nt, Homo sapiens
uaucaguauggauucauggauu

SEQ ID NO: 251795 - RNA, 22 nt, Homo sapiens
uaucagugaaucuuauuuugcc

SEQ ID NO: 251796 - RNA, 22 nt, Homo sapiens
uaucauagacaaucaguuauug

SEQ ID NO: 251797 - RNA, 22 nt, Homo sapiens
uaucauggaaugagguuggaca

SEQ ID NO: 251798 - RNA, 22 nt, Homo sapiens
uaucccuuagagcggggugguu

SEQ ID NO: 251799 - RNA, 22 nt, Homo sapiens
uaucuacauguagguauguaug

SEQ ID NO: 251800 - RNA, 22 nt, Homo sapiens
uaucugcacauacacuuauagc

SEQ ID NO: 251801 - RNA, 22 nt, Homo sapiens
uaucugcacuucugucuagguc

SEQ ID NO: 251802 - RNA, 22 nt, Homo sapiens
uaucugcaucccauuuuuauca

SEQ ID NO: 251803 - RNA, 22 nt, Homo sapiens
uaucuuggaguuugacaaccaa

SEQ ID NO: 251804 - RNA, 22 nt, Homo sapiens
uaugaaagcuacuucucacaau

SEQ ID NO: 251805 - RNA, 22 nt, Homo sapiens
uaugaauuuuauccaggauaua

SEQ ID NO: 251806 - RNA, 20 nt, Homo sapiens
uaugacaaagccuagugagu

SEQ ID NO: 251807 - RNA, 22 nt, Homo sapiens
uaugacuuguuuucuggucugc

SEQ ID NO: 251808 - RNA, 22 nt, Homo sapiens
uaugagcacauauguaucuaug

SEQ ID NO: 251809 - RNA, 22 nt, Homo sapiens
uaugauuuuugggagaggucaa

SEQ ID NO: 251810 - RNA, 22 nt, Homo sapiens
uaugcacacacguguuuaugug

SEQ ID NO: 251811 - RNA, 22 nt, Homo sapiens
uaugcacuaggcacuguguuug

SEQ ID NO: 251812 - RNA, 22 nt, Homo sapiens
uaugcagacauuguuccaacca

SEQ ID NO: 251813 - RNA, 22 nt, Homo sapiens
uaugccuuuuggcucaagaaac

SEQ ID NO: 251814 - RNA, 21 nt, Homo sapiens
uauggauuugccuauucugga

SEQ ID NO: 251815 - RNA, 22 nt, Homo sapiens
uauggccccuacaugugcaaaa

SEQ ID NO: 251816 - RNA, 22 nt, Homo sapiens
uauggccugcguccagugguau

SEQ ID NO: 251817 - RNA, 22 nt, Homo sapiens
uauggguguuauugcaugggag

SEQ ID NO: 251818 - RNA, 22 nt, Homo sapiens
uaugucacuggacauaaguucu

SEQ ID NO: 251819 - RNA, 22 nt, Homo sapiens
uaugucuucuuuagagaaaugu

SEQ ID NO: 251820 - RNA, 22 nt, Homo sapiens
uaugucuuuugcuugcaaauag

SEQ ID NO: 251821 - RNA, 22 nt, Homo sapiens
uauuaugcacuuuauaaaaauu

SEQ ID NO: 251822 - RNA, 22 nt, Homo sapiens
uauuccacacuguuggugggau

SEQ ID NO: 251823 - RNA, 22 nt, Homo sapiens
gagaacauuuaagccacucagg

SEQ ID NO: 251824 - RNA, 22 nt, Homo sapiens
gagaacugagauaagugauauu

SEQ ID NO: 251825 - RNA, 22 nt, Homo sapiens
gagaaguaaauuuauuugcaaa

SEQ ID NO: 251826 - RNA, 22 nt, Homo sapiens
gagaaugagauuaugguuacau

SEQ ID NO: 251827 - RNA, 22 nt, Homo sapiens
gagaaugaugauuuccaauuuc

SEQ ID NO: 251828 - RNA, 22 nt, Homo sapiens
gagacagugucagccauugaaa

SEQ ID NO: 251829 - RNA, 22 nt, Homo sapiens
gagacugagucuugcccuguca

SEQ ID NO: 251830 - RNA, 21 nt, Homo sapiens
gagaggauucgccagccucuu

SEQ ID NO: 251831 - RNA, 22 nt, Homo sapiens
gagagucacagugaauguggca

SEQ ID NO: 251832 - RNA, 22 nt, Homo sapiens
gagagugcuuuggguguaggcc

SEQ ID NO: 251833 - RNA, 22 nt, Homo sapiens
gagagugugucagaggcugcga

SEQ ID NO: 251834 - RNA, 21 nt, Homo sapiens
gagauagguaccgaagcuuag

SEQ ID NO: 251835 - RNA, 22 nt, Homo sapiens
gagauauucugguuuacuaaau

SEQ ID NO: 251836 - RNA, 22 nt, Homo sapiens
gagauggagacuuggccuuaaa

SEQ ID NO: 251837 - RNA, 22 nt, Homo sapiens
gagauggaguuucacuucgcuc

SEQ ID NO: 251838 - RNA, 22 nt, Homo sapiens
gagaugguguuccacugccagu

SEQ ID NO: 251839 - RNA, 22 nt, Homo sapiens
gagauuauuuaaaaggugauuu

SEQ ID NO: 251840 - RNA, 22 nt, Homo sapiens
gagauucuucaauauuuauucu

SEQ ID NO: 251841 - RNA, 22 nt, Homo sapiens
gagauuuucagcuugacuggga

SEQ ID NO: 251842 - RNA, 22 nt, Homo sapiens
gagcaaaaguauguauugguua

SEQ ID NO: 251843 - RNA, 22 nt, Homo sapiens
gagcaccagucccugucagugc

SEQ ID NO: 251844 - RNA, 22 nt, Homo sapiens
gagcacugaauacugugguggu

SEQ ID NO: 251845 - RNA, 22 nt, Homo sapiens
gagcagacaugaggaccgcugg

SEQ ID NO: 251846 - RNA, 22 nt, Homo sapiens
gagcuaguagauuuuaaauauu

SEQ ID NO: 251847 - RNA, 22 nt, Homo sapiens
gagcuaguguaauauuuugggg

SEQ ID NO: 251848 - RNA, 22 nt, Homo sapiens
gagcucaccuuaccucuggagc

SEQ ID NO: 251849 - RNA, 22 nt, Homo sapiens
gagcugaaguuuccauuuguac

SEQ ID NO: 251850 - RNA, 22 nt, Homo sapiens
gagcugccuugccuaugcaaga

SEQ ID NO: 251851 - RNA, 22 nt, Homo sapiens
gagcugguccuuuaaggaugca

SEQ ID NO: 251852 - RNA, 20 nt, Homo sapiens
gagcugguguacugccgggc

SEQ ID NO: 251853 - RNA, 23 nt, Homo sapiens
uuaagcaacggcugcuuuucaga

SEQ ID NO: 251854 - RNA, 22 nt, Homo sapiens
uuaagcaguaguuaaggagagg

SEQ ID NO: 251855 - RNA, 22 nt, Homo sapiens
uuaaggcagugcaucuggaguu

SEQ ID NO: 251856 - RNA, 23 nt, Homo sapiens
uuaaggugaugucuuugugccuc

SEQ ID NO: 251857 - RNA, 22 nt, Homo sapiens
uuaaguaaucagagaagagaac

SEQ ID NO: 251858 - RNA, 22 nt, Homo sapiens
uuaaucaggccguuuccuaaga

SEQ ID NO: 251859 - RNA, 22 nt, Homo sapiens
uuaauccugccuuauuucagua

SEQ ID NO: 251860 - RNA, 22 nt, Homo sapiens
uuaaugcuuggggaguaguucu

SEQ ID NO: 251861 - RNA, 22 nt, Homo sapiens
uuaauucugucugcccucaucc

SEQ ID NO: 251862 - RNA, 22 nt, Homo sapiens
uuacaagaugucuguccaacac

SEQ ID NO: 251863 - RNA, 21 nt, Homo sapiens
uuacaauggcuccuugaaggu

SEQ ID NO: 251864 - RNA, 22 nt, Homo sapiens
uuacagcagugccccacuccca

SEQ ID NO: 251865 - RNA, 22 nt, Homo sapiens
uuacaggacuaagcagcuuugc

SEQ ID NO: 251866 - RNA, 22 nt, Homo sapiens
uuacagguggagaaguaaggcu

SEQ ID NO: 251867 - RNA, 22 nt, Homo sapiens
uuacagucaaguuacauuucuc

SEQ ID NO: 251868 - RNA, 22 nt, Homo sapiens
uuacaguguuuguucuguuacu

SEQ ID NO: 251869 - RNA, 21 nt, Homo sapiens
uuacaguugguugugaggugg

SEQ ID NO: 251870 - RNA, 22 nt, Homo sapiens
uuacaugucuugguaagguuag

SEQ ID NO: 251871 - RNA, 22 nt, Homo sapiens
uuaccacagugccugucuaaug

SEQ ID NO: 251872 - RNA, 22 nt, Homo sapiens
uuaccagagaagacgaggggga

SEQ ID NO: 251873 - RNA, 22 nt, Homo sapiens
uuacccauuagagaauuuaaga

SEQ ID NO: 251874 - RNA, 22 nt, Homo sapiens
uuacguaguuuuggagaucaua

SEQ ID NO: 251875 - RNA, 22 nt, Homo sapiens
uuacuagaacauuuagggaacu

SEQ ID NO: 251876 - RNA, 22 nt, Homo sapiens
uuacuguagugucauaucguau

SEQ ID NO: 251877 - RNA, 22 nt, Homo sapiens
uuagaacaguguuugccucgcu

SEQ ID NO: 251878 - RNA, 22 nt, Homo sapiens
uuagaguacaggggaaucaagg

SEQ ID NO: 251879 - RNA, 18 nt, Homo sapiens
uuagagugcauuacuuug

SEQ ID NO: 251880 - RNA, 22 nt, Homo sapiens
uuagcacaucuuucuauguaag

SEQ ID NO: 251881 - RNA, 22 nt, Homo sapiens
uuagcagcacaaaagcagacua

SEQ ID NO: 251882 - RNA, 22 nt, Homo sapiens
uuagcagcaugaaaauggacug

SEQ ID NO: 251883 - RNA, 22 nt, Homo sapiens
uuagcagcucuggugacaaggu

SEQ ID NO: 251884 - RNA, 22 nt, Homo sapiens
uuagcccagugggugcuucucu

SEQ ID NO: 251885 - RNA, 22 nt, Homo sapiens
uuaggcaaugcucucaaauuug

SEQ ID NO: 251886 - RNA, 22 nt, Homo sapiens
uuaggcaggauaguuacauauu

SEQ ID NO: 251887 - RNA, 22 nt, Homo sapiens
uuaggcucuuugaggugcccag

SEQ ID NO: 251888 - RNA, 22 nt, Homo sapiens
uuagggaggcucaggacaagag

SEQ ID NO: 251889 - RNA, 22 nt, Homo sapiens
uuagguauuuuguuaugucagc

SEQ ID NO: 251890 - RNA, 22 nt, Homo sapiens
uuaguaguagcugcaugucagu

SEQ ID NO: 251891 - RNA, 22 nt, Homo sapiens
uuaguugcauucaugugagagu

SEQ ID NO: 251892 - RNA, 22 nt, Homo sapiens
uuauacuacuauaaagagguag

SEQ ID NO: 251893 - RNA, 22 nt, Homo sapiens
uuauacucgucugaaugauucu

SEQ ID NO: 251894 - RNA, 22 nt, Homo sapiens
uuauauguuucuguuuggaggc

SEQ ID NO: 251895 - RNA, 22 nt, Homo sapiens
uuauauguuucuuagggacaga

SEQ ID NO: 251896 - RNA, 22 nt, Homo sapiens
uuaucucaguguuuguaaacaa

SEQ ID NO: 251897 - RNA, 22 nt, Homo sapiens
uuaugacauugacaguuuuuag

SEQ ID NO: 251898 - RNA, 22 nt, Homo sapiens
uuaugcuguuuucuggagauuu

SEQ ID NO: 251899 - RNA, 22 nt, Homo sapiens
uuauuacuccuauuuuguagau

SEQ ID NO: 251900 - RNA, 22 nt, Homo sapiens
uuauucauuaacagggaccaaa

SEQ ID NO: 251901 - RNA, 22 nt, Homo sapiens
uuauugcucauuugggcauucu

SEQ ID NO: 251902 - RNA, 22 nt, Homo sapiens
uuauugcuuuugugcaggugag

SEQ ID NO: 251903 - RNA, 23 nt, Homo sapiens
uucaaaggaugcuuuauggaauu

SEQ ID NO: 251904 - RNA, 22 nt, Homo sapiens
uucaaaguaaagggauggagac

SEQ ID NO: 251905 - RNA, 22 nt, Homo sapiens
uucaaaucuuuggcucccacua

SEQ ID NO: 251906 - RNA, 23 nt, Homo sapiens
uucaacagguagacccucccugc

SEQ ID NO: 251907 - RNA, 22 nt, Homo sapiens
uucaaguaagaaagacaucagg

SEQ ID NO: 251908 - RNA, 22 nt, Homo sapiens
uucaagugaacaaaaugaggag

SEQ ID NO: 251909 - RNA, 20 nt, Homo sapiens
uucaagugauucucaugccu

SEQ ID NO: 251910 - RNA, 22 nt, Homo sapiens
uucaaguguucaggagcuacag

SEQ ID NO: 251911 - RNA, 22 nt, Homo sapiens
uucacagacaacuggucccuua

SEQ ID NO: 251912 - RNA, 22 nt, Homo sapiens
uucacagucacccuucuccaug

SEQ ID NO: 251913 - RNA, 22 nt, Homo sapiens
uucacagugugaucuaugggca

SEQ ID NO: 251914 - RNA, 22 nt, Homo sapiens
uucaccaguuuugucacgaaug

SEQ ID NO: 251915 - RNA, 22 nt, Homo sapiens
uucacccugguuguagauggac

SEQ ID NO: 251916 - RNA, 22 nt, Homo sapiens
uucagagcauugguuuuuugaa

SEQ ID NO: 251917 - RNA, 22 nt, Homo sapiens
uucagaugcacacuguagucua

SEQ ID NO: 251918 - RNA, 22 nt, Homo sapiens
uucagcaggccaggcccugacu

SEQ ID NO: 251919 - RNA, 22 nt, Homo sapiens
uucagcuacuuggaaacagcaa

SEQ ID NO: 251920 - RNA, 22 nt, Homo sapiens
uucagggacuuuagacaagaga

SEQ ID NO: 251921 - RNA, 22 nt, Homo sapiens
uucagggagaaggcaaacguug

SEQ ID NO: 251922 - RNA, 22 nt, Homo sapiens
uucaggguggagaguaugaggu

SEQ ID NO: 251923 - RNA, 22 nt, Homo sapiens
uucagguaguuuaacuguucca

SEQ ID NO: 251924 - RNA, 22 nt, Homo sapiens
uucaguaaauguucuuacuaua

SEQ ID NO: 251925 - RNA, 22 nt, Homo sapiens
uucaguaguaaguuggaacucu

SEQ ID NO: 251926 - RNA, 22 nt, Homo sapiens
uucaguauugcaccuggagucc

SEQ ID NO: 251927 - RNA, 22 nt, Homo sapiens
uucauagugaaaaauucaaagu

SEQ ID NO: 251928 - RNA, 22 nt, Homo sapiens
uucauccccuccaaaucucaug

SEQ ID NO: 251929 - RNA, 22 nt, Homo sapiens
uucaugcaucuguagugguuaa

SEQ ID NO: 251930 - RNA, 22 nt, Homo sapiens
uucauggaauauugaccauuuu

SEQ ID NO: 251931 - RNA, 22 nt, Homo sapiens
uucauggaugcauuugaggggu

SEQ ID NO: 251932 - RNA, 22 nt, Homo sapiens
uucauguaauuccauaagguaa

SEQ ID NO: 251933 - RNA, 22 nt, Homo sapiens
uucaugucuuggcuguuagagu

SEQ ID NO: 251934 - RNA, 22 nt, Homo sapiens
uuccacaaugguugaacuagcu

SEQ ID NO: 251935 - RNA, 22 nt, Homo sapiens
uuccacaaugguugaacuaguu

SEQ ID NO: 251936 - RNA, 22 nt, Homo sapiens
uuccagagucaccuuucugucg

SEQ ID NO: 251937 - RNA, 22 nt, Homo sapiens
uuccagaugggaguucuauucu

SEQ ID NO: 251938 - RNA, 22 nt, Homo sapiens
uuccaggugggcgugggccugg

SEQ ID NO: 251939 - RNA, 22 nt, Homo sapiens
uuccaguaauagcacagcauug

SEQ ID NO: 251940 - RNA, 21 nt, Homo sapiens
uuccagugagccuagaugccu

SEQ ID NO: 251941 - RNA, 22 nt, Homo sapiens
uuccaguuauuauaccucuuaa

SEQ ID NO: 251942 - RNA, 22 nt, Homo sapiens
uuccauguaguugaacgguuuu

SEQ ID NO: 251943 - RNA, 22 nt, Homo sapiens
uuccauguugauacgugaaguu

SEQ ID NO: 251944 - RNA, 22 nt, Homo sapiens
uucccaguaaacucuaucccuc

SEQ ID NO: 251945 - RNA, 22 nt, Homo sapiens
uucccauuguuggccagcaugu

SEQ ID NO: 251946 - RNA, 22 nt, Homo sapiens
uucccucagaaacacacagccc

SEQ ID NO: 251947 - RNA, 22 nt, Homo sapiens
uucccuuuguuaaauuggaaga

SEQ ID NO: 251948 - RNA, 22 nt, Homo sapiens
uuccugagaucagaauucaaau

SEQ ID NO: 251949 - RNA, 22 nt, Homo sapiens
uuccuugagaaaggcacaaguu

SEQ ID NO: 251950 - RNA, 22 nt, Homo sapiens
uucgucaugagacagaugcuga

SEQ ID NO: 251951 - RNA, 21 nt, Homo sapiens
uucuaaguaaauguuggacau

SEQ ID NO: 251952 - RNA, 22 nt, Homo sapiens
uucuagagagaagacuuaagcu

SEQ ID NO: 251953 - RNA, 23 nt, Homo sapiens
uucuaucaggcccaggagcccug

SEQ ID NO: 251954 - RNA, 22 nt, Homo sapiens
gagcuuggguuaaaguugccuu

SEQ ID NO: 251955 - RNA, 22 nt, Homo sapiens
gaggcagucugacccuuagcag

SEQ ID NO: 251956 - RNA, 22 nt, Homo sapiens
gaggcauugaaauauugcuuau

SEQ ID NO: 251957 - RNA, 22 nt, Homo sapiens
gagguagugagcagcugaacua

SEQ ID NO: 251958 - RNA, 22 nt, Homo sapiens
gagguaguuuaguuuuggggaa

SEQ ID NO: 251959 - RNA, 22 nt, Homo sapiens
gagguauggauaucuggagagg

SEQ ID NO: 251960 - RNA, 22 nt, Homo sapiens
gaggucaggacauuuuugcuuu

SEQ ID NO: 251961 - RNA, 22 nt, Homo sapiens
gaggucauucugugguacccag

SEQ ID NO: 251962 - RNA, 22 nt, Homo sapiens
gaggugguagguucacagcagc

SEQ ID NO: 251963 - RNA, 22 nt, Homo sapiens
gagguguagucaugccaagauc

SEQ ID NO: 251964 - RNA, 23 nt, Homo sapiens
gaguacauuaaaagcccagacug

SEQ ID NO: 251965 - RNA, 22 nt, Homo sapiens
gaguauguauaugagugugucu

SEQ ID NO: 251966 - RNA, 22 nt, Homo sapiens
gagugcaauggcaccgucucgg

SEQ ID NO: 251967 - RNA, 22 nt, Homo sapiens
gagugcaauggcagaucuccgc

SEQ ID NO: 251968 - RNA, 22 nt, Homo sapiens
gagugcaauggcaugaucuggg

SEQ ID NO: 251969 - RNA, 22 nt, Homo sapiens
gagugcauugguggucaggugu

SEQ ID NO: 251970 - RNA, 22 nt, Homo sapiens
gaguuagguugucaaugucuua

SEQ ID NO: 251971 - RNA, 19 nt, Homo sapiens
gaguugggguuuacuguaa

SEQ ID NO: 251972 - RNA, 22 nt, Homo sapiens
gaguuuguacuaauuuguugua

SEQ ID NO: 251973 - RNA, 22 nt, Homo sapiens
gauaaaucuuggcuagucuaag

SEQ ID NO: 251974 - RNA, 22 nt, Homo sapiens
gauagugaaccaagggguaauu

SEQ ID NO: 251975 - RNA, 22 nt, Homo sapiens
gauauguaaaaauuauaucuga

SEQ ID NO: 251976 - RNA, 22 nt, Homo sapiens
gauauguacagcucucuaggau

SEQ ID NO: 251977 - RNA, 22 nt, Homo sapiens
gauauguguaucuauguacaug

SEQ ID NO: 251978 - RNA, 22 nt, Homo sapiens
gaucucaguggauacugugaug

SEQ ID NO: 251979 - RNA, 22 nt, Homo sapiens
gaucuguuguuuggaaguauca

SEQ ID NO: 251980 - RNA, 22 nt, Homo sapiens
gaugacagugaguaaccccaac

SEQ ID NO: 251981 - RNA, 22 nt, Homo sapiens
gaugauauuugagucauuagaa

SEQ ID NO: 251982 - RNA, 22 nt, Homo sapiens
gaugauguuggaaacuuggugc

SEQ ID NO: 251983 - RNA, 19 nt, Homo sapiens
gaugcaaugcacugagguc

SEQ ID NO: 251984 - RNA, 22 nt, Homo sapiens
gauggauuuuaagugaaugaaa

SEQ ID NO: 251985 - RNA, 22 nt, Homo sapiens
gauggcacuaagccauguagga

SEQ ID NO: 251986 - RNA, 22 nt, Homo sapiens
gauggcaugugcugccaccaag

SEQ ID NO: 251987 - RNA, 22 nt, Homo sapiens
gauguagaaagagugggcugga

SEQ ID NO: 251988 - RNA, 22 nt, Homo sapiens
gauguguuuuaggaucucagca

SEQ ID NO: 251989 - RNA, 22 nt, Homo sapiens
gauuuugguuagggaaggauac

SEQ ID NO: 251990 - RNA, 22 nt, Homo sapiens
gcaaaauugagaagggaauaua

SEQ ID NO: 251991 - RNA, 22 nt, Homo sapiens
gcaaaucuuauguccucacauu

SEQ ID NO: 251992 - RNA, 20 nt, Homo sapiens
gcaaauggaucccacaagcc

SEQ ID NO: 251993 - RNA, 20 nt, Homo sapiens
gcaacauggccagagugaau

SEQ ID NO: 251994 - RNA, 22 nt, Homo sapiens
gcaacugguuucaguuuuucag

SEQ ID NO: 251995 - RNA, 22 nt, Homo sapiens
gcaagaauggaacaggagagcc

SEQ ID NO: 251996 - RNA, 22 nt, Homo sapiens
gcaagaugagagcccgggcagu

SEQ ID NO: 251997 - RNA, 22 nt, Homo sapiens
gcaagauguuaccauuagggaa

SEQ ID NO: 251998 - RNA, 22 nt, Homo sapiens
gcaauguuacugaauguguuuu

SEQ ID NO: 251999 - RNA, 22 nt, Homo sapiens
gcacacuuacacgaaccuagau

SEQ ID NO: 252000 - RNA, 22 nt, Homo sapiens
gcaccccuuaccgggcuggguu

SEQ ID NO: 252001 - RNA, 22 nt, Homo sapiens
gcacgugcacccacaugcacgu

SEQ ID NO: 252002 - RNA, 22 nt, Homo sapiens
gcacugagagaagccccaagua

SEQ ID NO: 252003 - RNA, 22 nt, Homo sapiens
gcagaauugguuucuucuaagg

SEQ ID NO: 252004 - RNA, 22 nt, Homo sapiens
gcagcacauggcagaacauauu

SEQ ID NO: 252005 - RNA, 20 nt, Homo sapiens
gcagcaccauauuucuaaga

SEQ ID NO: 252006 - RNA, 22 nt, Homo sapiens
gcagcaucaaaucacacaagau

SEQ ID NO: 252007 - RNA, 22 nt, Homo sapiens
gcaggaaucuugagaaggauuc

SEQ ID NO: 252008 - RNA, 22 nt, Homo sapiens
gcagguguuaugcaaacaacug

SEQ ID NO: 252009 - RNA, 22 nt, Homo sapiens
gcagucaucugaaggcuuaacu

SEQ ID NO: 252010 - RNA, 22 nt, Homo sapiens
gcagugaugugaucauagcuca

SEQ ID NO: 252011 - RNA, 20 nt, Homo sapiens
gcauaugucuuuauagcaga

SEQ ID NO: 252012 - RNA, 22 nt, Homo sapiens
gcauauguuuggguguguauau

SEQ ID NO: 252013 - RNA, 22 nt, Homo sapiens
gcaucacagggagacaggccuc

SEQ ID NO: 252014 - RNA, 22 nt, Homo sapiens
gcaugacaaugauugcucuuca

SEQ ID NO: 252015 - RNA, 22 nt, Homo sapiens
gcaugcacuguauuuaaguauc

SEQ ID NO: 252016 - RNA, 22 nt, Homo sapiens
gcauugcacuuggcauagacug

SEQ ID NO: 252017 - RNA, 18 nt, Homo sapiens
gccaacauguaaacaggu

SEQ ID NO: 252018 - RNA, 20 nt, Homo sapiens
gccacaguuaagcuucugcc

SEQ ID NO: 252019 - RNA, 21 nt, Homo sapiens
gccaguguggcaauuuuucaa

SEQ ID NO: 252020 - RNA, 22 nt, Homo sapiens
gccaguguguguuguucuccgc

SEQ ID NO: 252021 - RNA, 22 nt, Homo sapiens
gccauugcacuacagccuaggc

SEQ ID NO: 252022 - RNA, 22 nt, Homo sapiens
gccauugcacucuagccuaggu

SEQ ID NO: 252023 - RNA, 22 nt, Homo sapiens
gcccugagauucuuggauucug

SEQ ID NO: 252024 - RNA, 22 nt, Homo sapiens
gcccuguugcccaggcuggagu

SEQ ID NO: 252025 - RNA, 22 nt, Homo sapiens
gcgugguguuagaaugagaagu

SEQ ID NO: 252026 - RNA, 22 nt, Homo sapiens
gcucaguuuccucagcugcaaa

SEQ ID NO: 252027 - RNA, 22 nt, Homo sapiens
gcuccuuugaguagcuucugug

SEQ ID NO: 252028 - RNA, 22 nt, Homo sapiens
gcugagcuaugccauauaugcc

SEQ ID NO: 252029 - RNA, 17 nt, Homo sapiens
gcugauguuugcauuuu

SEQ ID NO: 252030 - RNA, 22 nt, Homo sapiens
gcugauguuuucagguaauucu

SEQ ID NO: 252031 - RNA, 22 nt, Homo sapiens
gcugcuguggcagauuggauuc

SEQ ID NO: 252032 - RNA, 22 nt, Homo sapiens
gcugcuguuucucuuucagcau

SEQ ID NO: 252033 - RNA, 22 nt, Homo sapiens
gcuggcuuucuccugaucucag

SEQ ID NO: 252034 - RNA, 22 nt, Homo sapiens
gcuggguugccagguuacuuaa

SEQ ID NO: 252035 - RNA, 22 nt, Homo sapiens
gcugguguucaggcccucaguc

SEQ ID NO: 252036 - RNA, 22 nt, Homo sapiens
gcuguguugugcccagcaucau

SEQ ID NO: 252037 - RNA, 16 nt, Homo sapiens
gcuguuguuuuguccu

SEQ ID NO: 252038 - RNA, 18 nt, Homo sapiens
ggaaaacuuuucuaagua

SEQ ID NO: 252039 - RNA, 22 nt, Homo sapiens
ggaaagacuauuguaaaggaug

SEQ ID NO: 252040 - RNA, 22 nt, Homo sapiens
ggaagaauaaugggccuuagag

SEQ ID NO: 252041 - RNA, 22 nt, Homo sapiens
ggaagacaguguggugauuccu

SEQ ID NO: 252042 - RNA, 17 nt, Homo sapiens
ggaagccuuugguuuaa

SEQ ID NO: 252043 - RNA, 22 nt, Homo sapiens
ggaagguaauugucagcucaua

SEQ ID NO: 252044 - RNA, 22 nt, Homo sapiens
ggaaugggauuugaagucuggc

SEQ ID NO: 252045 - RNA, 22 nt, Homo sapiens
ggaauguuaaagacuacacuga

SEQ ID NO: 252046 - RNA, 22 nt, Homo sapiens
ggacaagaucuuccaccauuca

SEQ ID NO: 252047 - RNA, 22 nt, Homo sapiens
ggacagaaaggguucaccaaac

SEQ ID NO: 252048 - RNA, 22 nt, Homo sapiens
ggacugucagggcuauuaguca

SEQ ID NO: 252049 - RNA, 22 nt, Homo sapiens
ggagagcuaggcagagguuugu

SEQ ID NO: 252050 - RNA, 22 nt, Homo sapiens
ggagagugacauauuucuaggc

SEQ ID NO: 252051 - RNA, 22 nt, Homo sapiens
ggagcugugauuugaguccaga

SEQ ID NO: 252052 - RNA, 22 nt, Homo sapiens
ggagguagguuugugauuugua

SEQ ID NO: 252053 - RNA, 20 nt, Homo sapiens
ggagguguuggauuucuagu

SEQ ID NO: 252054 - RNA, 22 nt, Homo sapiens
ggaguaaaagaguaggaggaau

SEQ ID NO: 252055 - RNA, 22 nt, Homo sapiens
ggaguaugaaacccacuccaau

SEQ ID NO: 252056 - RNA, 22 nt, Homo sapiens
uucuauguuugaaaaugccaaa

SEQ ID NO: 252057 - RNA, 21 nt, Homo sapiens
uucucagaggcaggggauaaa

SEQ ID NO: 252058 - RNA, 22 nt, Homo sapiens
uucucagugaacuccagcuugu

SEQ ID NO: 252059 - RNA, 22 nt, Homo sapiens
uucucaguuccuacuuugguga

SEQ ID NO: 252060 - RNA, 22 nt, Homo sapiens
uucucuggucagaggggagguu

SEQ ID NO: 252061 - RNA, 23 nt, Homo sapiens
uucugccacugaaaaugccucag

SEQ ID NO: 252062 - RNA, 22 nt, Homo sapiens
uucuggccuccauuuuucuccu

SEQ ID NO: 252063 - RNA, 22 nt, Homo sapiens
uucugugguugaaaggagagau

SEQ ID NO: 252064 - RNA, 22 nt, Homo sapiens
uucuuagucaaguuguauuuca

SEQ ID NO: 252065 - RNA, 21 nt, Homo sapiens
uucuucaggcagaaggauuau

SEQ ID NO: 252066 - RNA, 22 nt, Homo sapiens
uucuugcugaauugugcccuuc

SEQ ID NO: 252067 - RNA, 23 nt, Homo sapiens
uugaaaagucaguagccucugau

SEQ ID NO: 252068 - RNA, 22 nt, Homo sapiens
uugaaagacagaggggcaaguu

SEQ ID NO: 252069 - RNA, 22 nt, Homo sapiens
uugaaagcuaucagagauucca

SEQ ID NO: 252070 - RNA, 22 nt, Homo sapiens
uugaaaguaaacaucacaaaga

SEQ ID NO: 252071 - RNA, 22 nt, Homo sapiens
uugaaguagaaagacgaaauuu

SEQ ID NO: 252072 - RNA, 22 nt, Homo sapiens
uugaauagaagguuuuuuguuc

SEQ ID NO: 252073 - RNA, 22 nt, Homo sapiens
uugaauagcauguuuagugcau

SEQ ID NO: 252074 - RNA, 22 nt, Homo sapiens
uugaaugaaaugaugucauuug

SEQ ID NO: 252075 - RNA, 17 nt, Homo sapiens
uugaaugcauuacuugg

SEQ ID NO: 252076 - RNA, 22 nt, Homo sapiens
uugaauguguugggaagcccuu

SEQ ID NO: 252077 - RNA, 22 nt, Homo sapiens
uugacaaugcacugugcuaagu

SEQ ID NO: 252078 - RNA, 22 nt, Homo sapiens
uugacacuaauuauuauaggug

SEQ ID NO: 252079 - RNA, 22 nt, Homo sapiens
uugacacuuuguaagaaagggg

SEQ ID NO: 252080 - RNA, 20 nt, Homo sapiens
uugacaguggguuguuaaag

SEQ ID NO: 252081 - RNA, 22 nt, Homo sapiens
uugacauugcuguaguguccag

SEQ ID NO: 252082 - RNA, 22 nt, Homo sapiens
uugaccuaugggaguuugacua

SEQ ID NO: 252083 - RNA, 22 nt, Homo sapiens
uugacuagaccaucuuucuaga

SEQ ID NO: 252084 - RNA, 22 nt, Homo sapiens
uugagacgaagucucacucuug

SEQ ID NO: 252085 - RNA, 17 nt, Homo sapiens
uugagaguauaucuuac

SEQ ID NO: 252086 - RNA, 22 nt, Homo sapiens
uugagaguggaggcuauaucuu

SEQ ID NO: 252087 - RNA, 22 nt, Homo sapiens
uugagauacauaauuaugaaug

SEQ ID NO: 252088 - RNA, 22 nt, Homo sapiens
uugagauagaauaggaauggga

SEQ ID NO: 252089 - RNA, 22 nt, Homo sapiens
uugagauggagucucacgcauu

SEQ ID NO: 252090 - RNA, 22 nt, Homo sapiens
uugagauggagucucacucuug

SEQ ID NO: 252091 - RNA, 22 nt, Homo sapiens
uugagauggagucucgcucuuu

SEQ ID NO: 252092 - RNA, 22 nt, Homo sapiens
uugagauggagucuugcucucu

SEQ ID NO: 252093 - RNA, 22 nt, Homo sapiens
uugagauggagucuugcucuug

SEQ ID NO: 252094 - RNA, 22 nt, Homo sapiens
uugagauggagucuuguucuuu

SEQ ID NO: 252095 - RNA, 22 nt, Homo sapiens
uugagauggaguguugcucugu

SEQ ID NO: 252096 - RNA, 22 nt, Homo sapiens
uugagauggaguuucacucucg

SEQ ID NO: 252097 - RNA, 22 nt, Homo sapiens
uugagauguggcaguuuaugag

SEQ ID NO: 252098 - RNA, 22 nt, Homo sapiens
uugagccaaggauugucuuucc

SEQ ID NO: 252099 - RNA, 22 nt, Homo sapiens
uugagcccuggagguggaggcu

SEQ ID NO: 252100 - RNA, 22 nt, Homo sapiens
uugagcucuucuagcaauucua

SEQ ID NO: 252101 - RNA, 21 nt, Homo sapiens
uugagcuuuuaguacagacag

SEQ ID NO: 252102 - RNA, 22 nt, Homo sapiens
uugaggcaaugaggagaagcug

SEQ ID NO: 252103 - RNA, 23 nt, Homo sapiens
uugaggcauguaccaucaauauc

SEQ ID NO: 252104 - RNA, 22 nt, Homo sapiens
uugaggcuuuugaccucaugug

SEQ ID NO: 252105 - RNA, 22 nt, Homo sapiens
uugagggagcacagauucuuau

SEQ ID NO: 252106 - RNA, 22 nt, Homo sapiens
uugagggagccuguuagucccg

SEQ ID NO: 252107 - RNA, 22 nt, Homo sapiens
uugagguauaaagguagguugu

SEQ ID NO: 252108 - RNA, 22 nt, Homo sapiens
uugaggucagagguucgagacc

SEQ ID NO: 252109 - RNA, 20 nt, Homo sapiens
uugaggucaggaguuuggga

SEQ ID NO: 252110 - RNA, 22 nt, Homo sapiens
uugaguaguaagugguucaccg

SEQ ID NO: 252111 - RNA, 22 nt, Homo sapiens
uugaguccccacacuggguccc

SEQ ID NO: 252112 - RNA, 22 nt, Homo sapiens
uugaguuugaguauucuaaagc

SEQ ID NO: 252113 - RNA, 22 nt, Homo sapiens
uugauuagauccaguugauuga

SEQ ID NO: 252114 - RNA, 22 nt, Homo sapiens
uugauuagugacuggcuacacg

SEQ ID NO: 252115 - RNA, 22 nt, Homo sapiens
uugcaaagaccucuucacuucc

SEQ ID NO: 252116 - RNA, 18 nt, Homo sapiens
uugcaaauucuucccugu

SEQ ID NO: 252117 - RNA, 22 nt, Homo sapiens
uugcaagaaaucagagccuucc

SEQ ID NO: 252118 - RNA, 22 nt, Homo sapiens
uugcaagauguuaacauuggag

SEQ ID NO: 252119 - RNA, 22 nt, Homo sapiens
uugcaaguggagcuuccagggc

SEQ ID NO: 252120 - RNA, 22 nt, Homo sapiens
uugcaccuuaugucuguucucu

SEQ ID NO: 252121 - RNA, 22 nt, Homo sapiens
uugcacuccagcucuaggugac

SEQ ID NO: 252122 - RNA, 22 nt, Homo sapiens
uugcacuccauccuggguugac

SEQ ID NO: 252123 - RNA, 18 nt, Homo sapiens
uugcacuccugccugggu

SEQ ID NO: 252124 - RNA, 22 nt, Homo sapiens
uugcacucuagccugggugaca

SEQ ID NO: 252125 - RNA, 22 nt, Homo sapiens
uugcacuuccgccugggugaca

SEQ ID NO: 252126 - RNA, 22 nt, Homo sapiens
uugcacuugcugaggagugauu

SEQ ID NO: 252127 - RNA, 22 nt, Homo sapiens
uugcaggugguuuaugcaagac

SEQ ID NO: 252128 - RNA, 22 nt, Homo sapiens
uugcagugugacgacuauauuu

SEQ ID NO: 252129 - RNA, 22 nt, Homo sapiens
uugcauaagugcauucugugau

SEQ ID NO: 252130 - RNA, 22 nt, Homo sapiens
uugcauaauaagauuggggggg

SEQ ID NO: 252131 - RNA, 22 nt, Homo sapiens
uugcaugggagcugggugaagc

SEQ ID NO: 252132 - RNA, 22 nt, Homo sapiens
uugcaugguuuuuaucugaaau

SEQ ID NO: 252133 - RNA, 22 nt, Homo sapiens
uugccauggaguagaauugaag

SEQ ID NO: 252134 - RNA, 22 nt, Homo sapiens
uugccgggugcaguggcucaug

SEQ ID NO: 252135 - RNA, 22 nt, Homo sapiens
uugccuuuguuggaaacaagug

SEQ ID NO: 252136 - RNA, 22 nt, Homo sapiens
uugcuagagaugagggaugugu

SEQ ID NO: 252137 - RNA, 22 nt, Homo sapiens
uugcuucauucaacauugaggg

SEQ ID NO: 252138 - RNA, 22 nt, Homo sapiens
uuggaaaaauccaccuugaucu

SEQ ID NO: 252139 - RNA, 22 nt, Homo sapiens
uuggaaacaccuggugagguua

SEQ ID NO: 252140 - RNA, 22 nt, Homo sapiens
uuggaagcaugguuauugacgu

SEQ ID NO: 252141 - RNA, 22 nt, Homo sapiens
uuggaauauaaccuguuucuaa

SEQ ID NO: 252142 - RNA, 22 nt, Homo sapiens
uuggaaugugacugauaauauu

SEQ ID NO: 252143 - RNA, 22 nt, Homo sapiens
uuggagucaucucuguacugua

SEQ ID NO: 252144 - RNA, 22 nt, Homo sapiens
uuggaguguucugguccgggcu

SEQ ID NO: 252145 - RNA, 22 nt, Homo sapiens
uuggcaaagugucuggcauuua

SEQ ID NO: 252146 - RNA, 22 nt, Homo sapiens
uuggcaaaugucacaaaucagg

SEQ ID NO: 252147 - RNA, 21 nt, Homo sapiens
uuggcacucuucucuccuuau

SEQ ID NO: 252148 - RNA, 22 nt, Homo sapiens
uuggcagaguuaauuuguugag

SEQ ID NO: 252149 - RNA, 22 nt, Homo sapiens
uuggcagcacgcaguccagagg

SEQ ID NO: 252150 - RNA, 22 nt, Homo sapiens
uuggcagcauuccagccaagca

SEQ ID NO: 252151 - RNA, 22 nt, Homo sapiens
uuggcagcuguggaaucugggc

SEQ ID NO: 252152 - RNA, 22 nt, Homo sapiens
uuggcaguaucuacuacagcua

SEQ ID NO: 252153 - RNA, 23 nt, Homo sapiens
uuggcaucugggacacaagcuga

SEQ ID NO: 252154 - RNA, 22 nt, Homo sapiens
uuggcauugaguuucaaaucau

SEQ ID NO: 252155 - RNA, 22 nt, Homo sapiens
uuggccagugucuuuuuuuccu

SEQ ID NO: 252156 - RNA, 22 nt, Homo sapiens
uuggccccucccaaauuucaug

SEQ ID NO: 252157 - RNA, 22 nt, Homo sapiens
uuggccuuucucuaaauacuuu

SEQ ID NO: 252158 - RNA, 22 nt, Homo sapiens
uagaauggaagguugagaagaa

SEQ ID NO: 252159 - RNA, 22 nt, Homo sapiens
uagaauguaacuuccaugucau

SEQ ID NO: 252160 - RNA, 22 nt, Homo sapiens
uagacccauuguucagagagug

SEQ ID NO: 252161 - RNA, 20 nt, Homo sapiens
uagagagauauggggguucc

SEQ ID NO: 252162 - RNA, 22 nt, Homo sapiens
uagagcacauuaucauuuccaa

SEQ ID NO: 252163 - RNA, 22 nt, Homo sapiens
uagagcuaguugcucacugcuu

SEQ ID NO: 252164 - RNA, 22 nt, Homo sapiens
uagagguagccuacuacacacc

SEQ ID NO: 252165 - RNA, 22 nt, Homo sapiens
uagauaauuagaggguuuuaag

SEQ ID NO: 252166 - RNA, 22 nt, Homo sapiens
uagauaguaaagccauuagcuu

SEQ ID NO: 252167 - RNA, 22 nt, Homo sapiens
uagauaguuaugauuugaugau

SEQ ID NO: 252168 - RNA, 22 nt, Homo sapiens
uagaugauucacuuuacuucca

SEQ ID NO: 252169 - RNA, 19 nt, Homo sapiens
uagaugucuuugcauagau

SEQ ID NO: 252170 - RNA, 22 nt, Homo sapiens
uagauuauuggcugauuugauc

SEQ ID NO: 252171 - RNA, 22 nt, Homo sapiens
uagauuguaauaugcagaaugg

SEQ ID NO: 252172 - RNA, 22 nt, Homo sapiens
uagcacaguucacccucgauuu

SEQ ID NO: 252173 - RNA, 22 nt, Homo sapiens
uagcacaucuucuuggccugca

SEQ ID NO: 252174 - RNA, 22 nt, Homo sapiens
uagcaccucuuuggccuuucgu

SEQ ID NO: 252175 - RNA, 22 nt, Homo sapiens
uagcaccugugcacaccaggca

SEQ ID NO: 252176 - RNA, 22 nt, Homo sapiens
uagcaccuuagcauuucuagug

SEQ ID NO: 252177 - RNA, 22 nt, Homo sapiens
uagcagcaaagcaggaucugcu

SEQ ID NO: 252178 - RNA, 20 nt, Homo sapiens
uagcagcagacagagggagg

SEQ ID NO: 252179 - RNA, 22 nt, Homo sapiens
uagcagcagugguguauuuaga

SEQ ID NO: 252180 - RNA, 22 nt, Homo sapiens
uagcagcauaaauggacuaaga

SEQ ID NO: 252181 - RNA, 22 nt, Homo sapiens
uagcaggaaaggggucagaucu

SEQ ID NO: 252182 - RNA, 22 nt, Homo sapiens
uagcagguggugaccacauuuu

SEQ ID NO: 252183 - RNA, 22 nt, Homo sapiens
uagcagucucagaaugcauggu

SEQ ID NO: 252184 - RNA, 22 nt, Homo sapiens
uagcagugugaaaacggacuaa

SEQ ID NO: 252185 - RNA, 22 nt, Homo sapiens
uagccucacaaagugcuuaaga

SEQ ID NO: 252186 - RNA, 22 nt, Homo sapiens
uagcucagcccagcuaagcuca

SEQ ID NO: 252187 - RNA, 22 nt, Homo sapiens
uagcuucuccauagcuccaugu

SEQ ID NO: 252188 - RNA, 22 nt, Homo sapiens
uaggaaguacaucucagaaucu

SEQ ID NO: 252189 - RNA, 22 nt, Homo sapiens
uaggacauugcccuuguggaga

SEQ ID NO: 252190 - RNA, 22 nt, Homo sapiens
aauaagcauaguaccugauagg

SEQ ID NO: 252191 - RNA, 22 nt, Homo sapiens
aauaauggcaccaaagcacaag

SEQ ID NO: 252192 - RNA, 22 nt, Homo sapiens
aauacugaaaguauuuucaaau

SEQ ID NO: 252193 - RNA, 22 nt, Homo sapiens
aauacuuccaaaucuagucauu

SEQ ID NO: 252194 - RNA, 23 nt, Homo sapiens
aauaucacaguggguguacaccc

SEQ ID NO: 252195 - RNA, 22 nt, Homo sapiens
aauaugucuugaaauuggguaa

SEQ ID NO: 252196 - RNA, 22 nt, Homo sapiens
aaucacacuugauguugagcaa

SEQ ID NO: 252197 - RNA, 21 nt, Homo sapiens
aaucacugucuguuuccccuu

SEQ ID NO: 252198 - RNA, 22 nt, Homo sapiens
aauccaugugcuuuaccauuuu

SEQ ID NO: 252199 - RNA, 22 nt, Homo sapiens
aaucucagagauaucugugucc

SEQ ID NO: 252200 - RNA, 22 nt, Homo sapiens
aaucucagcauuuugggcugag

SEQ ID NO: 252201 - RNA, 22 nt, Homo sapiens
aaucugauguuaucagcuuaag

SEQ ID NO: 252202 - RNA, 22 nt, Homo sapiens
aaugacacugagcaucuuucau

SEQ ID NO: 252203 - RNA, 22 nt, Homo sapiens
aaugacagugcuaaagaacccu

SEQ ID NO: 252204 - RNA, 22 nt, Homo sapiens
aaugcuaucuggaacauuguug

SEQ ID NO: 252205 - RNA, 22 nt, Homo sapiens
aauggcaagagccacagaggcg

SEQ ID NO: 252206 - RNA, 22 nt, Homo sapiens
aauggcaguagauggaugggua

SEQ ID NO: 252207 - RNA, 22 nt, Homo sapiens
aauggcaucuacguuaaauguc

SEQ ID NO: 252208 - RNA, 22 nt, Homo sapiens
aauggcaucuagaguggugaau

SEQ ID NO: 252209 - RNA, 18 nt, Homo sapiens
aauggcucuggguucuaa

SEQ ID NO: 252210 - RNA, 22 nt, Homo sapiens
aaugggacugacgccucccaga

SEQ ID NO: 252211 - RNA, 22 nt, Homo sapiens
aaugucaugaguccaaccagaa

SEQ ID NO: 252212 - RNA, 22 nt, Homo sapiens
aaugugcuguucagaggagucc

SEQ ID NO: 252213 - RNA, 22 nt, Homo sapiens
aauuaggcuagaauguuauuaa

SEQ ID NO: 252214 - RNA, 22 nt, Homo sapiens
aauucacuucuuuuaggcaggg

SEQ ID NO: 252215 - RNA, 22 nt, Homo sapiens
aauucugugagauggugcagau

SEQ ID NO: 252216 - RNA, 22 nt, Homo sapiens
aauugaaugcagaugccaggga

SEQ ID NO: 252217 - RNA, 23 nt, Homo sapiens
aauugcacauuccuugcuggcag

SEQ ID NO: 252218 - RNA, 22 nt, Homo sapiens
aauugcacuaagcauaguccag

SEQ ID NO: 252219 - RNA, 22 nt, Homo sapiens
aauugcauaugcaguagaucua

SEQ ID NO: 252220 - RNA, 22 nt, Homo sapiens
aauuggcagugcucuugccaca

SEQ ID NO: 252221 - RNA, 22 nt, Homo sapiens
acaaagcuagggaauccaucuu

SEQ ID NO: 252222 - RNA, 23 nt, Homo sapiens
acacaguaaacuaaaagcuagcu

SEQ ID NO: 252223 - RNA, 22 nt, Homo sapiens
acacagucaaauccacuuggcu

SEQ ID NO: 252224 - RNA, 22 nt, Homo sapiens
acacauacacauaugguguaua

SEQ ID NO: 252225 - RNA, 22 nt, Homo sapiens
acacaugugcguagacucuuua

SEQ ID NO: 252226 - RNA, 22 nt, Homo sapiens
acaccuguggucccaguaacuu

SEQ ID NO: 252227 - RNA, 22 nt, Homo sapiens
acacuguaacucuuugagggca

SEQ ID NO: 252228 - RNA, 22 nt, Homo sapiens
acacugucaugucucacaggca

SEQ ID NO: 252229 - RNA, 22 nt, Homo sapiens
acacugucugaugaaaguaguu

SEQ ID NO: 252230 - RNA, 20 nt, Homo sapiens
acacugugcuaaggauuuuc

SEQ ID NO: 252231 - RNA, 22 nt, Homo sapiens
acacuguuuuaguuauuauagc

SEQ ID NO: 252232 - RNA, 22 nt, Homo sapiens
acacuuucuggagcugcacaua

SEQ ID NO: 252233 - RNA, 22 nt, Homo sapiens
acagaauucucagaacugggag

SEQ ID NO: 252234 - RNA, 22 nt, Homo sapiens
acagaccuauuucaaucauuua

SEQ ID NO: 252235 - RNA, 22 nt, Homo sapiens
acagcagugccccacucuacug

SEQ ID NO: 252236 - RNA, 22 nt, Homo sapiens
acaggagugggauuugaguccu

SEQ ID NO: 252237 - RNA, 22 nt, Homo sapiens
acaggugaaguauuacacuaag

SEQ ID NO: 252238 - RNA, 22 nt, Homo sapiens
acaguaaugggccccuuuuccu

SEQ ID NO: 252239 - RNA, 22 nt, Homo sapiens
acaguacucugcucuuuugauu

SEQ ID NO: 252240 - RNA, 22 nt, Homo sapiens
acaguacuuuuggauuugugaa

SEQ ID NO: 252241 - RNA, 21 nt, Homo sapiens
acaguaguaauaguguagcca

SEQ ID NO: 252242 - RNA, 22 nt, Homo sapiens
acagucacaauuuguaccuuuu

SEQ ID NO: 252243 - RNA, 22 nt, Homo sapiens
acagugacagaaagcugauuau

SEQ ID NO: 252244 - RNA, 22 nt, Homo sapiens
acagugcuguuguguuuucacg

SEQ ID NO: 252245 - RNA, 22 nt, Homo sapiens
acagugcuucugauaugaugcc

SEQ ID NO: 252246 - RNA, 22 nt, Homo sapiens
acagugcuuggcacacaguaau

SEQ ID NO: 252247 - RNA, 22 nt, Homo sapiens
acagugcuuucaauguucagua

SEQ ID NO: 252248 - RNA, 22 nt, Homo sapiens
acauaaagaagcaggacauugu

SEQ ID NO: 252249 - RNA, 22 nt, Homo sapiens
acauccauuugcuuuauuugcu

SEQ ID NO: 252250 - RNA, 22 nt, Homo sapiens
acaucccuuucccacccuucac

SEQ ID NO: 252251 - RNA, 22 nt, Homo sapiens
acauguauauaaugcauagcga

SEQ ID NO: 252252 - RNA, 18 nt, Homo sapiens
acauucagcuugaagaua

SEQ ID NO: 252253 - RNA, 22 nt, Homo sapiens
accaguuuuuuauacaucuucu

SEQ ID NO: 252254 - RNA, 22 nt, Homo sapiens
accauugcacuccagccugggc

SEQ ID NO: 252255 - RNA, 22 nt, Homo sapiens
acccagaguuccuugucuuuca

SEQ ID NO: 252256 - RNA, 22 nt, Homo sapiens
acccaguguugggcagaacugu

SEQ ID NO: 252257 - RNA, 22 nt, Homo sapiens
acccugucaaaacggaccaauc

SEQ ID NO: 252258 - RNA, 22 nt, Homo sapiens
acccugucaaaauggaccaauc

SEQ ID NO: 252259 - RNA, 22 nt, Homo sapiens
acccuguugagcaacuggccau

SEQ ID NO: 252260 - RNA, 22 nt, Homo sapiens
guggucagaaaucucaguggca

SEQ ID NO: 252261 - RNA, 22 nt, Homo sapiens
gugguguuugagcugccaggga

SEQ ID NO: 252262 - RNA, 22 nt, Homo sapiens
guguagagaaauagccugaagg

SEQ ID NO: 252263 - RNA, 18 nt, Homo sapiens
guguauggauggaggcca

SEQ ID NO: 252264 - RNA, 22 nt, Homo sapiens
guguauguuguccauggaugcg

SEQ ID NO: 252265 - RNA, 22 nt, Homo sapiens
gugucacuguugagaaguccac

SEQ ID NO: 252266 - RNA, 18 nt, Homo sapiens
gugucugguuaugggagu

SEQ ID NO: 252267 - RNA, 22 nt, Homo sapiens
gugugacagcuauagacaugau

SEQ ID NO: 252268 - RNA, 22 nt, Homo sapiens
gugugauguaaagaacugggga

SEQ ID NO: 252269 - RNA, 21 nt, Homo sapiens
gugugcuugaauucagcuguc

SEQ ID NO: 252270 - RNA, 22 nt, Homo sapiens
guguggcaggugggggcucaga

SEQ ID NO: 252271 - RNA, 22 nt, Homo sapiens
guguucaaagcugauugagauu

SEQ ID NO: 252272 - RNA, 22 nt, Homo sapiens
guguucaaauucugacagagag

SEQ ID NO: 252273 - RNA, 22 nt, Homo sapiens
guuaagaaguguaacuuaaguu

SEQ ID NO: 252274 - RNA, 22 nt, Homo sapiens
guuacagucuuguguaagguua

SEQ ID NO: 252275 - RNA, 22 nt, Homo sapiens
guuaugcagcaauugauaaucu

SEQ ID NO: 252276 - RNA, 22 nt, Homo sapiens
guuauguuaaauuguuguaugc

SEQ ID NO: 252277 - RNA, 22 nt, Homo sapiens
guucaaggaauguuggcuucuc

SEQ ID NO: 252278 - RNA, 22 nt, Homo sapiens
guucaagugauagcugggauua

SEQ ID NO: 252279 - RNA, 22 nt, Homo sapiens
guucacagugguugccuuccag

SEQ ID NO: 252280 - RNA, 22 nt, Homo sapiens
guucacaguuucuaaucccagc

SEQ ID NO: 252281 - RNA, 20 nt, Homo sapiens
guucccuguaggugugcgga

SEQ ID NO: 252282 - RNA, 22 nt, Homo sapiens
guucuauguugggaguucacua

SEQ ID NO: 252283 - RNA, 22 nt, Homo sapiens
guugcaauugauguaugucuga

SEQ ID NO: 252284 - RNA, 22 nt, Homo sapiens
guugccuaggcuggucuugaac

SEQ ID NO: 252285 - RNA, 22 nt, Homo sapiens
guugcucaggcugaagugcagu

SEQ ID NO: 252286 - RNA, 22 nt, Homo sapiens
guuguauaggcauggggagaau

SEQ ID NO: 252287 - RNA, 22 nt, Homo sapiens
guugugcuuaagccuauugauu

SEQ ID NO: 252288 - RNA, 22 nt, Homo sapiens
uaaacugucuugcaguuacaug

SEQ ID NO: 252289 - RNA, 22 nt, Homo sapiens
uaaagauaaggcucgcuuggau

SEQ ID NO: 252290 - RNA, 22 nt, Homo sapiens
uaaagcacuuuuuucugcaugg

SEQ ID NO: 252291 - RNA, 22 nt, Homo sapiens
uaaagcauguaauuagguuaga

SEQ ID NO: 252292 - RNA, 22 nt, Homo sapiens
augaguauguucuguauuuuca

SEQ ID NO: 252293 - RNA, 22 nt, Homo sapiens
augauagucuugagaagcauuu

SEQ ID NO: 252294 - RNA, 22 nt, Homo sapiens
augauauggguugucaguugua

SEQ ID NO: 252295 - RNA, 22 nt, Homo sapiens
augaucauggaaguuuuccugu

SEQ ID NO: 252296 - RNA, 22 nt, Homo sapiens
augaugcugagguuugggguau

SEQ ID NO: 252297 - RNA, 22 nt, Homo sapiens
augauuagaacucauuuccagg

SEQ ID NO: 252298 - RNA, 22 nt, Homo sapiens
augauucugaucuagagcuugg

SEQ ID NO: 252299 - RNA, 20 nt, Homo sapiens
augcaaacccugcuuugugg

SEQ ID NO: 252300 - RNA, 22 nt, Homo sapiens
augcaagcacacaagaggaaau

SEQ ID NO: 252301 - RNA, 19 nt, Homo sapiens
augcaaugucacaggcugc

SEQ ID NO: 252302 - RNA, 22 nt, Homo sapiens
augcacaguccagcccaugugg

SEQ ID NO: 252303 - RNA, 22 nt, Homo sapiens
augccacuguacucuagccuag

SEQ ID NO: 252304 - RNA, 22 nt, Homo sapiens
augccacuguccuccugccuag

SEQ ID NO: 252305 - RNA, 22 nt, Homo sapiens
augccacuguuuaugucacuua

SEQ ID NO: 252306 - RNA, 19 nt, Homo sapiens
augccuggagaugguuaua

SEQ ID NO: 252307 - RNA, 22 nt, Homo sapiens
augcuacuggauuuguauaaau

SEQ ID NO: 252308 - RNA, 22 nt, Homo sapiens
augcuggugcuagaaacuggaa

SEQ ID NO: 252309 - RNA, 19 nt, Homo sapiens
augcugguguugcucaaac

SEQ ID NO: 252310 - RNA, 22 nt, Homo sapiens
augcuuguguuggggcagugga

SEQ ID NO: 252311 - RNA, 22 nt, Homo sapiens
auggaaacauaagaguauagau

SEQ ID NO: 252312 - RNA, 22 nt, Homo sapiens
auggaaagcuguuccuacacaa

SEQ ID NO: 252313 - RNA, 20 nt, Homo sapiens
auggaacugugagccaauua

SEQ ID NO: 252314 - RNA, 22 nt, Homo sapiens
auggaagcauaguauucuauug

SEQ ID NO: 252315 - RNA, 22 nt, Homo sapiens
auggaaugccauuuauaaugga

SEQ ID NO: 252316 - RNA, 22 nt, Homo sapiens
auggagcaaaacagauuuggga

SEQ ID NO: 252317 - RNA, 22 nt, Homo sapiens
auggagugagaauggagguucc

SEQ ID NO: 252318 - RNA, 22 nt, Homo sapiens
auggauuuuaggauacaguuga

SEQ ID NO: 252319 - RNA, 22 nt, Homo sapiens
auggcaauaugaugcacuguuu

SEQ ID NO: 252320 - RNA, 22 nt, Homo sapiens
auggcaaugcgaugaugacuga

SEQ ID NO: 252321 - RNA, 22 nt, Homo sapiens
auggcacuccagccugggcaac

SEQ ID NO: 252322 - RNA, 22 nt, Homo sapiens
auggcagugucuagggguguuu

SEQ ID NO: 252323 - RNA, 22 nt, Homo sapiens
auggcaucgucaccuuuucagu

SEQ ID NO: 252324 - RNA, 22 nt, Homo sapiens
auggcccccuguuugugaacau

SEQ ID NO: 252325 - RNA, 20 nt, Homo sapiens
auggcccugcugggaguguc

SEQ ID NO: 252326 - RNA, 22 nt, Homo sapiens
auggcccuguguggagcugcug

SEQ ID NO: 252327 - RNA, 22 nt, Homo sapiens
auggcucaguguguaucuauca

SEQ ID NO: 252328 - RNA, 22 nt, Homo sapiens
auggcugagugauuucaaacag

SEQ ID NO: 252329 - RNA, 22 nt, Homo sapiens
auggcuuucaggacguggcgag

SEQ ID NO: 252330 - RNA, 22 nt, Homo sapiens
auggcuuuuuaaaucauguugu

SEQ ID NO: 252331 - RNA, 22 nt, Homo sapiens
auggcuuuuuucuugggcacuc

SEQ ID NO: 252332 - RNA, 22 nt, Homo sapiens
augggaaaaucagaaggccugg

SEQ ID NO: 252333 - RNA, 22 nt, Homo sapiens
aaaacgcauccucacaggucug

SEQ ID NO: 252334 - RNA, 22 nt, Homo sapiens
aaaagcauucagagugcugggc

SEQ ID NO: 252335 - RNA, 22 nt, Homo sapiens
aaaaggcuagcuaguaacagaa

SEQ ID NO: 252336 - RNA, 22 nt, Homo sapiens
aaaagucuguagugaaagguga

SEQ ID NO: 252337 - RNA, 18 nt, Homo sapiens
aaacagugucucuuucug

SEQ ID NO: 252338 - RNA, 20 nt, Homo sapiens
aaacucugucuucuuuauca

SEQ ID NO: 252339 - RNA, 22 nt, Homo sapiens
aaacugccuuccuuguaggugc

SEQ ID NO: 252340 - RNA, 22 nt, Homo sapiens
aaaggcacacacuccuuguuau

SEQ ID NO: 252341 - RNA, 22 nt, Homo sapiens
aaaggcacugaucuuauccagu

SEQ ID NO: 252342 - RNA, 22 nt, Homo sapiens
aaaggcaucugcucggcucccu

SEQ ID NO: 252343 - RNA, 22 nt, Homo sapiens
aaaguacucaguucaguuccgu

SEQ ID NO: 252344 - RNA, 22 nt, Homo sapiens
aaaguaguagcaguuucugcca

SEQ ID NO: 252345 - RNA, 18 nt, Homo sapiens
aaagugaugucauucuuu

SEQ ID NO: 252346 - RNA, 22 nt, Homo sapiens
aaagugcugagauuguaggcau

SEQ ID NO: 252347 - RNA, 22 nt, Homo sapiens
aaagugcugggauuggcugggc

SEQ ID NO: 252348 - RNA, 22 nt, Homo sapiens
aaaguucuugcugaaggauuau

SEQ ID NO: 252349 - RNA, 22 nt, Homo sapiens
aaauaacugucagguucuggaa

SEQ ID NO: 252350 - RNA, 15 nt, Homo sapiens
aaauaugucaguucu

SEQ ID NO: 252351 - RNA, 22 nt, Homo sapiens
aaauccauuuguucagcuaugc

SEQ ID NO: 252352 - RNA, 22 nt, Homo sapiens
aaaugcagauucugcuuagguu

SEQ ID NO: 252353 - RNA, 22 nt, Homo sapiens
aaaugcauaucaagauugcccu

SEQ ID NO: 252354 - RNA, 22 nt, Homo sapiens
aaaugcauugagggaaaaggca

SEQ ID NO: 252355 - RNA, 22 nt, Homo sapiens
aaaugcucucuacacguuucug

SEQ ID NO: 252356 - RNA, 22 nt, Homo sapiens
aaaugcucuuuaugaaguugga

SEQ ID NO: 252357 - RNA, 18 nt, Homo sapiens
aaauucugucccuucuuc

SEQ ID NO: 252358 - RNA, 23 nt, Homo sapiens
aaauuugccuauuauuccuaugg

SEQ ID NO: 252359 - RNA, 22 nt, Homo sapiens
aacaccaucccuuugaugcuuu

SEQ ID NO: 252360 - RNA, 22 nt, Homo sapiens
aacaccauucucuguaacaaga

SEQ ID NO: 252361 - RNA, 22 nt, Homo sapiens
aacacuguuuccagucaugauc

SEQ ID NO: 252362 - RNA, 22 nt, Homo sapiens
aacagcauaguacccgugauaa

SEQ ID NO: 252363 - RNA, 22 nt, Homo sapiens
aacaguguuuuggguuuucugg

SEQ ID NO: 252364 - RNA, 22 nt, Homo sapiens
aacauguuuagcagauaccugu

SEQ ID NO: 252365 - RNA, 22 nt, Homo sapiens
aacauugaacuuggcacaccca

SEQ ID NO: 252366 - RNA, 22 nt, Homo sapiens
aacugccucugacauaggcagg

SEQ ID NO: 252367 - RNA, 22 nt, Homo sapiens
aacuggcacuacaucaagagcu

SEQ ID NO: 252368 - RNA, 22 nt, Homo sapiens
aacuggccuccuugggaaauua

SEQ ID NO: 252369 - RNA, 22 nt, Homo sapiens
aacuggccugagaugaaaagug

SEQ ID NO: 252370 - RNA, 22 nt, Homo sapiens
aacugggcaagcauuacauggu

SEQ ID NO: 252371 - RNA, 22 nt, Homo sapiens
aacugguauugaauuuaggaag

SEQ ID NO: 252372 - RNA, 22 nt, Homo sapiens
aacugguauuucccaugaauuu

SEQ ID NO: 252373 - RNA, 21 nt, Homo sapiens
aagaaagcuggacuugccgcu

SEQ ID NO: 252374 - RNA, 22 nt, Homo sapiens
aagagaacugacaguaccuggg

SEQ ID NO: 252375 - RNA, 22 nt, Homo sapiens
aagagcucucuguagcauguga

SEQ ID NO: 252376 - RNA, 22 nt, Homo sapiens
aagaggccuaggaaucuguauu

SEQ ID NO: 252377 - RNA, 22 nt, Homo sapiens
aagagguaauaacaaagcuucu

SEQ ID NO: 252378 - RNA, 22 nt, Homo sapiens
aagagguaggaaauggucauuu

SEQ ID NO: 252379 - RNA, 22 nt, Homo sapiens
aagagguagucugucccuuagc

SEQ ID NO: 252380 - RNA, 22 nt, Homo sapiens
aagaugcagucauacuggagga

SEQ ID NO: 252381 - RNA, 22 nt, Homo sapiens
aagaugguauuucauuaguuuu

SEQ ID NO: 252382 - RNA, 22 nt, Homo sapiens
aagcacaauuucaccuucuugu

SEQ ID NO: 252383 - RNA, 21 nt, Homo sapiens
aagcacauugaguguguguga

SEQ ID NO: 252384 - RNA, 22 nt, Homo sapiens
aagcagacauguucauuuugaa

SEQ ID NO: 252385 - RNA, 22 nt, Homo sapiens
aagcagauguguugaaaguacu

SEQ ID NO: 252386 - RNA, 20 nt, Homo sapiens
aagcauggguuuuaggguca

SEQ ID NO: 252387 - RNA, 21 nt, Homo sapiens
aagcaugguguaucuuuccau

SEQ ID NO: 252388 - RNA, 22 nt, Homo sapiens
aagcuaccauuuguauauaaag

SEQ ID NO: 252389 - RNA, 22 nt, Homo sapiens
aagcugccuugugaaggcauuc

SEQ ID NO: 252390 - RNA, 22 nt, Homo sapiens
aagcuggauuuaguguggagca

SEQ ID NO: 252391 - RNA, 22 nt, Homo sapiens
aagcuggcuuucauugagugcu

SEQ ID NO: 252392 - RNA, 22 nt, Homo sapiens
aagcugguguugcugcucuguu

SEQ ID NO: 252393 - RNA, 22 nt, Homo sapiens
aagcuguugguggaucuaccau

SEQ ID NO: 252394 - RNA, 22 nt, Homo sapiens
aaggaacuggaauauuuugaac

SEQ ID NO: 252395 - RNA, 22 nt, Homo sapiens
aaggaaguaauuugguuuauag

SEQ ID NO: 252396 - RNA, 23 nt, Homo sapiens
aaggacacugaacacuucccagc

SEQ ID NO: 252397 - RNA, 22 nt, Homo sapiens
aaggaguagaggaauagcaaug

SEQ ID NO: 252398 - RNA, 22 nt, Homo sapiens
aaggcaagauacugguugcuga

SEQ ID NO: 252399 - RNA, 22 nt, Homo sapiens
aaggcaugcaguacguuucuau

SEQ ID NO: 252400 - RNA, 22 nt, Homo sapiens
aaggcauggugacuauuuaggc

SEQ ID NO: 252401 - RNA, 22 nt, Homo sapiens
aaggcuguucauuuagcacagu

SEQ ID NO: 252402 - RNA, 22 nt, Homo sapiens
aaggcuuuuugcugacguccuu

SEQ ID NO: 252403 - RNA, 22 nt, Homo sapiens
aagggaaugcuuccaguuugug

SEQ ID NO: 252404 - RNA, 22 nt, Homo sapiens
aagggaauguuguagcugguuu

SEQ ID NO: 252405 - RNA, 22 nt, Homo sapiens
aagguaguuuucuuuaaugcug

SEQ ID NO: 252406 - RNA, 22 nt, Homo sapiens
aagguauuucuaugggaauaga

SEQ ID NO: 252407 - RNA, 22 nt, Homo sapiens
aagguauuuuugucuauaucuu

SEQ ID NO: 252408 - RNA, 22 nt, Homo sapiens
aaggucauugugguuuuugcca

SEQ ID NO: 252409 - RNA, 22 nt, Homo sapiens
aaggugcucucuuauguagaaa

SEQ ID NO: 252410 - RNA, 22 nt, Homo sapiens
aagguucuugcuugcaugacug

SEQ ID NO: 252411 - RNA, 22 nt, Homo sapiens
aaguaaaucuuaugucagggag

SEQ ID NO: 252412 - RNA, 22 nt, Homo sapiens
aaguagcuggaugcaguggcac

SEQ ID NO: 252413 - RNA, 22 nt, Homo sapiens
aagucaaggagagaagcuucag

SEQ ID NO: 252414 - RNA, 22 nt, Homo sapiens
aagucaaggagagaggcgucag

SEQ ID NO: 252415 - RNA, 22 nt, Homo sapiens
aagucauggaggaguaugugag

SEQ ID NO: 252416 - RNA, 22 nt, Homo sapiens
aagugagugacaaaaacugggc

SEQ ID NO: 252417 - RNA, 20 nt, Homo sapiens
aagugaguguuaaacugaac

SEQ ID NO: 252418 - RNA, 20 nt, Homo sapiens
aagugcaucguugugucugc

SEQ ID NO: 252419 - RNA, 22 nt, Homo sapiens
aagugcuggccuacucaaucga

SEQ ID NO: 252420 - RNA, 22 nt, Homo sapiens
aagugcuuaggauagugugugg

SEQ ID NO: 252421 - RNA, 22 nt, Homo sapiens
aagugcuuccuuucagaggguu

SEQ ID NO: 252422 - RNA, 22 nt, Homo sapiens
aagugguagggucaggauugga

SEQ ID NO: 252423 - RNA, 22 nt, Homo sapiens
aaguguaaguuaauguuuaggu

SEQ ID NO: 252424 - RNA, 22 nt, Homo sapiens
aaguugcuuuagguaagucaau

SEQ ID NO: 252425 - RNA, 22 nt, Homo sapiens
aauaaagcagcuuuuugggacu

SEQ ID NO: 252426 - RNA, 22 nt, Homo sapiens
aauaaagcaggguccuugcacu

SEQ ID NO: 252427 - RNA, 22 nt, Homo sapiens
aauaaagcuuugagcuuugcug

SEQ ID NO: 252428 - RNA, 22 nt, Homo sapiens
uaaagccauugucaaguuugua

SEQ ID NO: 252429 - RNA, 16 nt, Homo sapiens
uaaagcuaaucacuuu

SEQ ID NO: 252430 - RNA, 22 nt, Homo sapiens
uaaagcuacagagcggaaaauu

SEQ ID NO: 252431 - RNA, 22 nt, Homo sapiens
uaaagcuuggauuuaggcuaau

SEQ ID NO: 252432 - RNA, 18 nt, Homo sapiens
uaaaggcacuguguuguu

SEQ ID NO: 252433 - RNA, 22 nt, Homo sapiens
uaaaugcucuuuaaaagugcuu

SEQ ID NO: 252434 - RNA, 22 nt, Homo sapiens
uaaaugcuugagaugauggaua

SEQ ID NO: 252435 - RNA, 22 nt, Homo sapiens
uaacaagagagucagucagucc

SEQ ID NO: 252436 - RNA, 22 nt, Homo sapiens
uaacauucacaugcugcaaaaa

SEQ ID NO: 252437 - RNA, 23 nt, Homo sapiens
uaacauugcaugauuaccugcau

SEQ ID NO: 252438 - RNA, 22 nt, Homo sapiens
uaacauuguugauuauacuaag

SEQ ID NO: 252439 - RNA, 22 nt, Homo sapiens
uaacccacgcagaauggacaag

SEQ ID NO: 252440 - RNA, 18 nt, Homo sapiens
uaacuggugugagauggu

SEQ ID NO: 252441 - RNA, 22 nt, Homo sapiens
uaacugucucccuugguccuga

SEQ ID NO: 252442 - RNA, 22 nt, Homo sapiens
uaagacuguguaauuuaugaag

SEQ ID NO: 252443 - RNA, 22 nt, Homo sapiens
uaagacuguuggcaauuuuugc

SEQ ID NO: 252444 - RNA, 22 nt, Homo sapiens
uaagagagcuccaucuuuuccu

SEQ ID NO: 252445 - RNA, 22 nt, Homo sapiens
uaagcaguaaaugaagucuugc

SEQ ID NO: 252446 - RNA, 22 nt, Homo sapiens
uaagccaccgugccuggccuaa

SEQ ID NO: 252447 - RNA, 22 nt, Homo sapiens
uaaggcaaaccuuggcugcagu

SEQ ID NO: 252448 - RNA, 18 nt, Homo sapiens
uaaggcacuauaggcauu

SEQ ID NO: 252449 - RNA, 22 nt, Homo sapiens
uaaggcacucuucugugugccu

SEQ ID NO: 252450 - RNA, 22 nt, Homo sapiens
uaaggcuugaucuuggugagau

SEQ ID NO: 252451 - RNA, 22 nt, Homo sapiens
uaaggcuugcuucagucuugaa

SEQ ID NO: 252452 - RNA, 22 nt, Homo sapiens
uaaggcuuugucuuaggacuuu

SEQ ID NO: 252453 - RNA, 22 nt, Homo sapiens
uaagggacgcccccuucucucu

SEQ ID NO: 252454 - RNA, 22 nt, Homo sapiens
uaaguaauuguuaauagggaag

SEQ ID NO: 252455 - RNA, 20 nt, Homo sapiens
uaagugcauaggauauuucu

SEQ ID NO: 252456 - RNA, 22 nt, Homo sapiens
uaagugcuugacuuugauguuu

SEQ ID NO: 252457 - RNA, 18 nt, Homo sapiens
uaagugcuuuaaacacau

SEQ ID NO: 252458 - RNA, 22 nt, Homo sapiens
uaaguguaaugucugaaguuug

SEQ ID NO: 252459 - RNA, 21 nt, Homo sapiens
uaauaaugucucagacaccua

SEQ ID NO: 252460 - RNA, 22 nt, Homo sapiens
uaauagcaguguuacuaggacu

SEQ ID NO: 252461 - RNA, 22 nt, Homo sapiens
uaauaguuucagaaguuguuuu

SEQ ID NO: 252462 - RNA, 22 nt, Homo sapiens
uaauccugucuugaccaucagg

SEQ ID NO: 252463 - RNA, 22 nt, Homo sapiens
uaaugcuguggucugguuuaaa

SEQ ID NO: 252464 - RNA, 22 nt, Homo sapiens
uaaugugaauagugcuguaaug

SEQ ID NO: 252465 - RNA, 22 nt, Homo sapiens
uaauucacauaaagcacuuaga

SEQ ID NO: 252466 - RNA, 22 nt, Homo sapiens
uaauugaaugcagacaccaggg

SEQ ID NO: 252467 - RNA, 22 nt, Homo sapiens
uaauugcaguucuguguuauau

SEQ ID NO: 252468 - RNA, 22 nt, Homo sapiens
uacaaagcuuugaugugucuuu

SEQ ID NO: 252469 - RNA, 22 nt, Homo sapiens
uacaaaguaacaguuccuguau

SEQ ID NO: 252470 - RNA, 22 nt, Homo sapiens
uacaaguauuuuuauuagugcc

SEQ ID NO: 252471 - RNA, 21 nt, Homo sapiens
uacaaugcacaggagagccuc

SEQ ID NO: 252472 - RNA, 22 nt, Homo sapiens
uacaggaaugucagguugcugu

SEQ ID NO: 252473 - RNA, 22 nt, Homo sapiens
uacaggugcuuauguggacaua

SEQ ID NO: 252474 - RNA, 19 nt, Homo sapiens
uacaguacacaacaccuuu

SEQ ID NO: 252475 - RNA, 22 nt, Homo sapiens
uacagucauaaugccuagugac

SEQ ID NO: 252476 - RNA, 22 nt, Homo sapiens
uacauaguaagcacuaugccaa

SEQ ID NO: 252477 - RNA, 22 nt, Homo sapiens
uacauaguuacuuccauuucca

SEQ ID NO: 252478 - RNA, 22 nt, Homo sapiens
uacaucagccugaaagagcucg

SEQ ID NO: 252479 - RNA, 22 nt, Homo sapiens
uacauugucauauucucucucu

SEQ ID NO: 252480 - RNA, 22 nt, Homo sapiens
uaccacagucauuacacuugua

SEQ ID NO: 252481 - RNA, 22 nt, Homo sapiens
uaccaguaaugggucaaaggca

SEQ ID NO: 252482 - RNA, 19 nt, Homo sapiens
uacccagaagcagcauugu

SEQ ID NO: 252483 - RNA, 19 nt, Homo sapiens
uacccuaguauauacagaa

SEQ ID NO: 252484 - RNA, 22 nt, Homo sapiens
uaccucaguucaauaacagaua

SEQ ID NO: 252485 - RNA, 22 nt, Homo sapiens
uacuacagccugagcgacugag

SEQ ID NO: 252486 - RNA, 16 nt, Homo sapiens
uacuacugccuauuau

SEQ ID NO: 252487 - RNA, 22 nt, Homo sapiens
uacucaguaagugcuggcugcu

SEQ ID NO: 252488 - RNA, 22 nt, Homo sapiens
uacugcacauaugaagguuccc

SEQ ID NO: 252489 - RNA, 19 nt, Homo sapiens
uacugcaccucaaccuggg

SEQ ID NO: 252490 - RNA, 22 nt, Homo sapiens
uacugcacuggaggccucagau

SEQ ID NO: 252491 - RNA, 22 nt, Homo sapiens
uacugcagucagacuccugggc

SEQ ID NO: 252492 - RNA, 22 nt, Homo sapiens
uacugcugucagugccaaguag

SEQ ID NO: 252493 - RNA, 22 nt, Homo sapiens
uacuggguguucugagaaaaua

SEQ ID NO: 252494 - RNA, 22 nt, Homo sapiens
uacuuagagauuccaggaacuc

SEQ ID NO: 252495 - RNA, 22 nt, Homo sapiens
uacuuuguagagugugagaauu

SEQ ID NO: 252496 - RNA, 22 nt, Homo sapiens
uagaaagcaugaccuucagaua

SEQ ID NO: 252497 - RNA, 22 nt, Homo sapiens
uagaaaguagggaagguaggau

SEQ ID NO: 252498 - RNA, 22 nt, Homo sapiens
acccuguugguggaucagauug

SEQ ID NO: 252499 - RNA, 23 nt, Homo sapiens
accugauguuucuguggggagcc

SEQ ID NO: 252500 - RNA, 22 nt, Homo sapiens
acuacauaugacaucuucuuua

SEQ ID NO: 252501 - RNA, 22 nt, Homo sapiens
acuacugucagacugccacuga

SEQ ID NO: 252502 - RNA, 22 nt, Homo sapiens
acuagagaugcauuuguaguuu

SEQ ID NO: 252503 - RNA, 22 nt, Homo sapiens
acuagaugauuauguuccauug

SEQ ID NO: 252504 - RNA, 22 nt, Homo sapiens
acuaugagacgaaugcaucagu

SEQ ID NO: 252505 - RNA, 22 nt, Homo sapiens
acuaugcuuuucuuagaauuaa

SEQ ID NO: 252506 - RNA, 22 nt, Homo sapiens
acucagagauuagcacauguuu

SEQ ID NO: 252507 - RNA, 22 nt, Homo sapiens
acugacaugaucaggcauguuc

SEQ ID NO: 252508 - RNA, 22 nt, Homo sapiens
acugagaucuuuaaauaaauaa

SEQ ID NO: 252509 - RNA, 22 nt, Homo sapiens
acugagucauugaggcccucuc

SEQ ID NO: 252510 - RNA, 22 nt, Homo sapiens
acugagucauugggugcccaga

SEQ ID NO: 252511 - RNA, 23 nt, Homo sapiens
acugcaauuacguuugcaccaac

SEQ ID NO: 252512 - RNA, 19 nt, Homo sapiens
acugcacuccaaccuccug

SEQ ID NO: 252513 - RNA, 20 nt, Homo sapiens
acugcacuccaaccuuugug

SEQ ID NO: 252514 - RNA, 22 nt, Homo sapiens
acugcacuccacccuuggcagc

SEQ ID NO: 252515 - RNA, 22 nt, Homo sapiens
acugcacuccagcccaggugac

SEQ ID NO: 252516 - RNA, 22 nt, Homo sapiens
acugcacuccagccucccgucu

SEQ ID NO: 252517 - RNA, 22 nt, Homo sapiens
acugcacuccagccucgcaaca

SEQ ID NO: 252518 - RNA, 22 nt, Homo sapiens
acugcacuccagccucggcaau

SEQ ID NO: 252519 - RNA, 22 nt, Homo sapiens
acugcacuccagccucggggac

SEQ ID NO: 252520 - RNA, 22 nt, Homo sapiens
acugcacuccagccucgugaca

SEQ ID NO: 252521 - RNA, 22 nt, Homo sapiens
acugcacuccagccugcuggau

SEQ ID NO: 252522 - RNA, 22 nt, Homo sapiens
acugcacuccagccuggacgaa

SEQ ID NO: 252523 - RNA, 22 nt, Homo sapiens
acugcacuccagccugugcgua

SEQ ID NO: 252524 - RNA, 22 nt, Homo sapiens
acugcacuccagccuugugaca

SEQ ID NO: 252525 - RNA, 22 nt, Homo sapiens
acugcacuccagcuuuggugac

SEQ ID NO: 252526 - RNA, 20 nt, Homo sapiens
acugcacuccagucucuggg

SEQ ID NO: 252527 - RNA, 18 nt, Homo sapiens
acugcacuccauccuagg

SEQ ID NO: 252528 - RNA, 19 nt, Homo sapiens
acugcacuccuccuugggu

SEQ ID NO: 252529 - RNA, 22 nt, Homo sapiens
acugcacuccuccuugggugac

SEQ ID NO: 252530 - RNA, 22 nt, Homo sapiens
uauuccacuauuaguccagaug

SEQ ID NO: 252531 - RNA, 22 nt, Homo sapiens
uauuccacuggcacugcauuug

SEQ ID NO: 252532 - RNA, 22 nt, Homo sapiens
uauuccuuuugcauuuccacau

SEQ ID NO: 252533 - RNA, 22 nt, Homo sapiens
uauugacuugagaagggauuag

SEQ ID NO: 252534 - RNA, 22 nt, Homo sapiens
uauugauuaauugugauuaggc

SEQ ID NO: 252535 - RNA, 22 nt, Homo sapiens
uauugcacuuuuccauaggagu

SEQ ID NO: 252536 - RNA, 22 nt, Homo sapiens
uauugcagauacccaggaaguu

SEQ ID NO: 252537 - RNA, 22 nt, Homo sapiens
uauugccucagugacuuugggg

SEQ ID NO: 252538 - RNA, 22 nt, Homo sapiens
uauugcuggauguauuacaugu

SEQ ID NO: 252539 - RNA, 22 nt, Homo sapiens
uauugcuggcucugucuucauu

SEQ ID NO: 252540 - RNA, 22 nt, Homo sapiens
uauuguacauauccucccuuca

SEQ ID NO: 252541 - RNA, 22 nt, Homo sapiens
uauuucaguugcguuucccgag

SEQ ID NO: 252542 - RNA, 22 nt, Homo sapiens
uauuugauuaacaagagccuaa

SEQ ID NO: 252543 - RNA, 22 nt, Homo sapiens
uauuugcacucccaucauggug

SEQ ID NO: 252544 - RNA, 22 nt, Homo sapiens
uauuugguagcuauuuugcagu

SEQ ID NO: 252545 - RNA, 20 nt, Homo sapiens
uauuugguuauuuccauggu

SEQ ID NO: 252546 - RNA, 22 nt, Homo sapiens
uauuugguuggugcaaaaguaa

SEQ ID NO: 252547 - RNA, 22 nt, Homo sapiens
ucaaaaccucagagaguagagc

SEQ ID NO: 252548 - RNA, 22 nt, Homo sapiens
ucaaacacuccauaucgcgauu

SEQ ID NO: 252549 - RNA, 20 nt, Homo sapiens
ucaaagacauggcugucaga

SEQ ID NO: 252550 - RNA, 20 nt, Homo sapiens
ucaaaguaugcucugcacua

SEQ ID NO: 252551 - RNA, 22 nt, Homo sapiens
ucaaagugacaaaguugcagca

SEQ ID NO: 252552 - RNA, 21 nt, Homo sapiens
ucaaaguguucuuuuguugaa

SEQ ID NO: 252553 - RNA, 22 nt, Homo sapiens
ucaaaucaucuuuuccaaagcu

SEQ ID NO: 252554 - RNA, 17 nt, Homo sapiens
ucaaaugcucccaguga

SEQ ID NO: 252555 - RNA, 22 nt, Homo sapiens
ucaaaugcuguauuguaguaau

SEQ ID NO: 252556 - RNA, 22 nt, Homo sapiens
ucaaauguuuguuuaaggcuua

SEQ ID NO: 252557 - RNA, 22 nt, Homo sapiens
ucaacagugggcacuguaaaug

SEQ ID NO: 252558 - RNA, 22 nt, Homo sapiens
ucaacugcuugagaucacaaau

SEQ ID NO: 252559 - RNA, 22 nt, Homo sapiens
ucaagaccucacauagaggaga

SEQ ID NO: 252560 - RNA, 22 nt, Homo sapiens
ucacaauggcugaacuaauuua

SEQ ID NO: 252561 - RNA, 22 nt, Homo sapiens
ucacacuguuuugauuauuaua

SEQ ID NO: 252562 - RNA, 22 nt, Homo sapiens
acugcacuucagccuugggaaa

SEQ ID NO: 252563 - RNA, 22 nt, Homo sapiens
acugcacuucagccuugugaca

SEQ ID NO: 252564 - RNA, 22 nt, Homo sapiens
acugccuaaugacuuauguuuu

SEQ ID NO: 252565 - RNA, 18 nt, Homo sapiens
acuggaauuaaacuuuuu

SEQ ID NO: 252566 - RNA, 22 nt, Homo sapiens
acuggcaauggcagaaauaguu

SEQ ID NO: 252567 - RNA, 22 nt, Homo sapiens
acugggauauuauugguaauau

SEQ ID NO: 252568 - RNA, 22 nt, Homo sapiens
acuguacuccagccugggugac

SEQ ID NO: 252569 - RNA, 19 nt, Homo sapiens
acuguacuccagucugggc

SEQ ID NO: 252570 - RNA, 22 nt, Homo sapiens
acugugcuguuuuaauuauuga

SEQ ID NO: 252571 - RNA, 22 nt, Homo sapiens
acuguguguuugucuagcacag

SEQ ID NO: 252572 - RNA, 22 nt, Homo sapiens
acuuggcaaaguuuuaaacagc

SEQ ID NO: 252573 - RNA, 22 nt, Homo sapiens
acuuuuguuauacagugugaua

SEQ ID NO: 252574 - RNA, 22 nt, Homo sapiens
acuuuuugaugaggucguuugu

SEQ ID NO: 252575 - RNA, 22 nt, Homo sapiens
agaaagcgcuucccuuugcugg

SEQ ID NO: 252576 - RNA, 22 nt, Homo sapiens
agaaagugcuucccuuugguga

SEQ ID NO: 252577 - RNA, 22 nt, Homo sapiens
agaaauguuuacucacccccuu

SEQ ID NO: 252578 - RNA, 22 nt, Homo sapiens
agaaauguuuauucaaacccgu

SEQ ID NO: 252579 - RNA, 22 nt, Homo sapiens
agaagacuauucuggguugggc

SEQ ID NO: 252580 - RNA, 22 nt, Homo sapiens
agaauguuuuagaccaauacaa

SEQ ID NO: 252581 - RNA, 22 nt, Homo sapiens
agacacugaaauguauugaaga

SEQ ID NO: 252582 - RNA, 21 nt, Homo sapiens
agacacuuggaagguuuuaga

SEQ ID NO: 252583 - RNA, 22 nt, Homo sapiens
agacagcugguagcacuuccug

SEQ ID NO: 252584 - RNA, 22 nt, Homo sapiens
agacaguguguguauauauggu

SEQ ID NO: 252585 - RNA, 22 nt, Homo sapiens
agacuagacagaugaacagcac

SEQ ID NO: 252586 - RNA, 21 nt, Homo sapiens
agagaacugaaacaugugacu

SEQ ID NO: 252587 - RNA, 22 nt, Homo sapiens
agagaacugauucagggaaaau

SEQ ID NO: 252588 - RNA, 22 nt, Homo sapiens
agagaacugauuggaguugggc

SEQ ID NO: 252589 - RNA, 22 nt, Homo sapiens
agagaacugauuggaugugggc

SEQ ID NO: 252590 - RNA, 22 nt, Homo sapiens
agagaacuguuuacacguuaau

SEQ ID NO: 252591 - RNA, 22 nt, Homo sapiens
agagagcuuuaacuacccauuu

SEQ ID NO: 252592 - RNA, 22 nt, Homo sapiens
agagagguggguggagccccca

SEQ ID NO: 252593 - RNA, 22 nt, Homo sapiens
agagauaauuagguuaaaugag

SEQ ID NO: 252594 - RNA, 22 nt, Homo sapiens
agagauaguuuccaacucauac

SEQ ID NO: 252595 - RNA, 22 nt, Homo sapiens
agagaugauuaacauuuuggua

SEQ ID NO: 252596 - RNA, 22 nt, Homo sapiens
agagguaagcaguggcaagugc

SEQ ID NO: 252597 - RNA, 22 nt, Homo sapiens
agagguauacauuugagagcca

SEQ ID NO: 252598 - RNA, 22 nt, Homo sapiens
agaguacugacguuugcaaauu

SEQ ID NO: 252599 - RNA, 22 nt, Homo sapiens
agagucacaugaggcccuucau

SEQ ID NO: 252600 - RNA, 22 nt, Homo sapiens
agagugcuauagauuagauuuc

SEQ ID NO: 252601 - RNA, 22 nt, Homo sapiens
agaucacagucuuugguuuuag

SEQ ID NO: 252602 - RNA, 22 nt, Homo sapiens
agaugcauugguggcauauuca

SEQ ID NO: 252603 - RNA, 22 nt, Homo sapiens
agauguuguucaucugauuguu

SEQ ID NO: 252604 - RNA, 23 nt, Homo sapiens
agcaaaugcucuagcacuccaac

SEQ ID NO: 252605 - RNA, 22 nt, Homo sapiens
agcaacauagugagacccccau

SEQ ID NO: 252606 - RNA, 22 nt, Homo sapiens
agcaacaucagcagcaggaaaa

SEQ ID NO: 252607 - RNA, 22 nt, Homo sapiens
agcaagauugauggccugcagg

SEQ ID NO: 252608 - RNA, 22 nt, Homo sapiens
agcacaguuaaaugaggcuucu

SEQ ID NO: 252609 - RNA, 22 nt, Homo sapiens
agcaccaauaaucagaguucuu

SEQ ID NO: 252610 - RNA, 23 nt, Homo sapiens
agcaccaccccaggucacaagug

SEQ ID NO: 252611 - RNA, 22 nt, Homo sapiens
agcaccguucaaacccagguua

SEQ ID NO: 252612 - RNA, 22 nt, Homo sapiens
agcacgaaaccaaauucuguga

SEQ ID NO: 252613 - RNA, 22 nt, Homo sapiens
agcagcauggguauaaaucucc

SEQ ID NO: 252614 - RNA, 22 nt, Homo sapiens
agcagcgacacccuguggugag

SEQ ID NO: 252615 - RNA, 21 nt, Homo sapiens
agcagcuuugguugaagcaga

SEQ ID NO: 252616 - RNA, 22 nt, Homo sapiens
agcaggacaauaugggaucagg

SEQ ID NO: 252617 - RNA, 22 nt, Homo sapiens
agcaggauuguuacaauaguaa

SEQ ID NO: 252618 - RNA, 22 nt, Homo sapiens
agcagguauucgggucaugggg

SEQ ID NO: 252619 - RNA, 22 nt, Homo sapiens
agcagguauuuaagaaacucag

SEQ ID NO: 252620 - RNA, 22 nt, Homo sapiens
agcaguagugaaaguagacuua

SEQ ID NO: 252621 - RNA, 22 nt, Homo sapiens
agcagugugaaaauggacuaau

SEQ ID NO: 252622 - RNA, 22 nt, Homo sapiens
agcaguguggccuuagacccgg

SEQ ID NO: 252623 - RNA, 22 nt, Homo sapiens
agcaucacacacuacagggaaa

SEQ ID NO: 252624 - RNA, 20 nt, Homo sapiens
agcaucacagagccgggugu

SEQ ID NO: 252625 - RNA, 20 nt, Homo sapiens
agcaucagugguaguguugc

SEQ ID NO: 252626 - RNA, 22 nt, Homo sapiens
agcaucauaccaaucugguccu

SEQ ID NO: 252627 - RNA, 20 nt, Homo sapiens
agcaucauugcaauuuguca

SEQ ID NO: 252628 - RNA, 22 nt, Homo sapiens
agcaucauuugauguucccgag

SEQ ID NO: 252629 - RNA, 20 nt, Homo sapiens
agcaucguuguguuauagcc

SEQ ID NO: 252630 - RNA, 22 nt, Homo sapiens
agccaagacucuguuccccuug

SEQ ID NO: 252631 - RNA, 22 nt, Homo sapiens
agccaguauuuuauugaggauu

SEQ ID NO: 252632 - RNA, 22 nt, Homo sapiens
agcccagagacuguguaaauuu

SEQ ID NO: 252633 - RNA, 22 nt, Homo sapiens
agcccauguggcugaggcuucu

SEQ ID NO: 252634 - RNA, 22 nt, Homo sapiens
agccuagagagccacuuugaga

SEQ ID NO: 252635 - RNA, 22 nt, Homo sapiens
agcggcuguuccccuggucuau

SEQ ID NO: 252636 - RNA, 22 nt, Homo sapiens
agcuacaucuugcucugggaug

SEQ ID NO: 252637 - RNA, 22 nt, Homo sapiens
agcucacagccuagcacuguga

SEQ ID NO: 252638 - RNA, 22 nt, Homo sapiens
agcuccaugauaguaugucugu

SEQ ID NO: 252639 - RNA, 22 nt, Homo sapiens
agcuccuuugcuuuuuccagga

SEQ ID NO: 252640 - RNA, 22 nt, Homo sapiens
agcugaguguuccaagagcgag

SEQ ID NO: 252641 - RNA, 22 nt, Homo sapiens
agcugcaaagggagagaugauu

SEQ ID NO: 252642 - RNA, 22 nt, Homo sapiens
agcugcaauguuuaguauaaua

SEQ ID NO: 252643 - RNA, 22 nt, Homo sapiens
agcugccagucuuguaaggccu

SEQ ID NO: 252644 - RNA, 22 nt, Homo sapiens
agcuggauuguuuaccuggggc

SEQ ID NO: 252645 - RNA, 22 nt, Homo sapiens
agcugguauuuugucgaggacu

SEQ ID NO: 252646 - RNA, 22 nt, Homo sapiens
agcuggucuacguguguaugag

SEQ ID NO: 252647 - RNA, 22 nt, Homo sapiens
agcuggucucaggugcccugcu

SEQ ID NO: 252648 - RNA, 22 nt, Homo sapiens
agcuggucugauacuuaccucc

SEQ ID NO: 252649 - RNA, 22 nt, Homo sapiens
agcuuuuugggaggccuuagga

SEQ ID NO: 252650 - RNA, 22 nt, Homo sapiens
aggaaauguuggucccauuucu

SEQ ID NO: 252651 - RNA, 21 nt, Homo sapiens
aggaagacuaugaucaauugg

SEQ ID NO: 252652 - RNA, 23 nt, Homo sapiens
aggaauggaaaaccaaguaucau

SEQ ID NO: 252653 - RNA, 22 nt, Homo sapiens
aggaaugucaaugguaguuuaa

SEQ ID NO: 252654 - RNA, 22 nt, Homo sapiens
aggaauuuaauguaugauaaua

SEQ ID NO: 252655 - RNA, 22 nt, Homo sapiens
aggagcacaggacuuugauuau

SEQ ID NO: 252656 - RNA, 22 nt, Homo sapiens
aggagcacuggccuuggaguca

SEQ ID NO: 252657 - RNA, 18 nt, Homo sapiens
aggagcauagugcuauga

SEQ ID NO: 252658 - RNA, 22 nt, Homo sapiens
aggagcuuuggggaaaacagau

SEQ ID NO: 252659 - RNA, 22 nt, Homo sapiens
aggagguaggaauugugcuagg

SEQ ID NO: 252660 - RNA, 22 nt, Homo sapiens
aggagguagggugugaaacagc

SEQ ID NO: 252661 - RNA, 22 nt, Homo sapiens
aggauacugguaugggcugaau

SEQ ID NO: 252662 - RNA, 21 nt, Homo sapiens
aggauaguagauuaaauauuu

SEQ ID NO: 252663 - RNA, 22 nt, Homo sapiens
aggcaaaugccagcaaucacac

SEQ ID NO: 252664 - RNA, 21 nt, Homo sapiens
augggacuaacugaugggucu

SEQ ID NO: 252665 - RNA, 22 nt, Homo sapiens
augggguaggcuugcuguagua

SEQ ID NO: 252666 - RNA, 22 nt, Homo sapiens
augggugaguaugaguugacuu

SEQ ID NO: 252667 - RNA, 22 nt, Homo sapiens
augguauggaaggucuggagga

SEQ ID NO: 252668 - RNA, 22 nt, Homo sapiens
auggucccuguuccaugcuccu

SEQ ID NO: 252669 - RNA, 22 nt, Homo sapiens
auggucuuuauuguguugagug

SEQ ID NO: 252670 - RNA, 21 nt, Homo sapiens
auggugagaaaguagugucaa

SEQ ID NO: 252671 - RNA, 22 nt, Homo sapiens
augguguauugauuauugcugu

SEQ ID NO: 252672 - RNA, 22 nt, Homo sapiens
augguugguuaaaucuguguau

SEQ ID NO: 252673 - RNA, 22 nt, Homo sapiens
auguaaacagaugugcagcuug

SEQ ID NO: 252674 - RNA, 22 nt, Homo sapiens
auguaacugggacacaagccuc

SEQ ID NO: 252675 - RNA, 20 nt, Homo sapiens
auguaauguaugauauguac

SEQ ID NO: 252676 - RNA, 22 nt, Homo sapiens
auguauacaugcaggucacagg

SEQ ID NO: 252677 - RNA, 22 nt, Homo sapiens
auguauggcagguuugggguuu

SEQ ID NO: 252678 - RNA, 22 nt, Homo sapiens
augucaaagaggaaaacuggau

SEQ ID NO: 252679 - RNA, 22 nt, Homo sapiens
augucacagguccuagccaagu

SEQ ID NO: 252680 - RNA, 22 nt, Homo sapiens
augucuagagugauacugaagc

SEQ ID NO: 252681 - RNA, 22 nt, Homo sapiens
augugacugauggagaauaugu

SEQ ID NO: 252682 - RNA, 22 nt, Homo sapiens
augugacugauguaaucagaca

SEQ ID NO: 252683 - RNA, 22 nt, Homo sapiens
augugcaauguguacguagccc

SEQ ID NO: 252684 - RNA, 22 nt, Homo sapiens
augugcacaacgugcagguuug

SEQ ID NO: 252685 - RNA, 22 nt, Homo sapiens
augugcacaugcuuacauguga

SEQ ID NO: 252686 - RNA, 22 nt, Homo sapiens
augugcacauucugguaaauau

SEQ ID NO: 252687 - RNA, 22 nt, Homo sapiens
augugcagauguuacaaauugu

SEQ ID NO: 252688 - RNA, 22 nt, Homo sapiens
auguggcuuuucaacuguguga

SEQ ID NO: 252689 - RNA, 18 nt, Homo sapiens
auguggcuuuugaaggcu

SEQ ID NO: 252690 - RNA, 22 nt, Homo sapiens
augugggaggacuuggcuguug

SEQ ID NO: 252691 - RNA, 23 nt, Homo sapiens
augugguuuuagguguugaacug

SEQ ID NO: 252692 - RNA, 22 nt, Homo sapiens
augugugaaucccagaaccugu

SEQ ID NO: 252693 - RNA, 23 nt, Homo sapiens
augugugcuuggagagcaggaug

SEQ ID NO: 252694 - RNA, 22 nt, Homo sapiens
auguugcaguuuaauuauccua

SEQ ID NO: 252695 - RNA, 22 nt, Homo sapiens
auuaaucaggcaaugcuugcua

SEQ ID NO: 252696 - RNA, 20 nt, Homo sapiens
auuagagcuacauggcuaca

SEQ ID NO: 252697 - RNA, 22 nt, Homo sapiens
auuagguauuuguccuaaauau

SEQ ID NO: 252698 - RNA, 22 nt, Homo sapiens
auuauaguguauacuugaaauu

SEQ ID NO: 252699 - RNA, 22 nt, Homo sapiens
auuaucacaguuuugcauaugg

SEQ ID NO: 252700 - RNA, 22 nt, Homo sapiens
auuauguuguauuuccuugcag

SEQ ID NO: 252701 - RNA, 22 nt, Homo sapiens
auuauugacucauagaaaggau

SEQ ID NO: 252702 - RNA, 22 nt, Homo sapiens
auucaaagugcauguucccacu

SEQ ID NO: 252703 - RNA, 22 nt, Homo sapiens
auucaaggacuggauugcggga

SEQ ID NO: 252704 - RNA, 23 nt, Homo sapiens
auucaaguagugagagugguuau

SEQ ID NO: 252705 - RNA, 20 nt, Homo sapiens
auucaaguaugccuugagaa

SEQ ID NO: 252706 - RNA, 22 nt, Homo sapiens
auucaagugaugugauucuucu

SEQ ID NO: 252707 - RNA, 22 nt, Homo sapiens
auucacuuuuauagacaggucu

SEQ ID NO: 252708 - RNA, 22 nt, Homo sapiens
auuccacagccgauaccaugac

SEQ ID NO: 252709 - RNA, 22 nt, Homo sapiens
auuccacaguuaacacagaccg

SEQ ID NO: 252710 - RNA, 21 nt, Homo sapiens
auuccacuuuuccuucaggga

SEQ ID NO: 252711 - RNA, 22 nt, Homo sapiens
auucccuguagaauaaggaugg

SEQ ID NO: 252712 - RNA, 22 nt, Homo sapiens
auucccuuagcugccucagccu

SEQ ID NO: 252713 - RNA, 22 nt, Homo sapiens
auugaacaugccauauguacca

SEQ ID NO: 252714 - RNA, 22 nt, Homo sapiens
auugagacaaauuuguaugcag

SEQ ID NO: 252715 - RNA, 21 nt, Homo sapiens
auugagcacaugaaacauggc

SEQ ID NO: 252716 - RNA, 22 nt, Homo sapiens
auugaguaaaaaauagugaugu

SEQ ID NO: 252717 - RNA, 22 nt, Homo sapiens
auugcacuccagccugggcgac

SEQ ID NO: 252718 - RNA, 22 nt, Homo sapiens
auugcacuccagccuggugaca

SEQ ID NO: 252719 - RNA, 22 nt, Homo sapiens
auugcacuccagccuugugaca

SEQ ID NO: 252720 - RNA, 22 nt, Homo sapiens
auugcacuccagcuuaggcgac

SEQ ID NO: 252721 - RNA, 22 nt, Homo sapiens
auugcacuccauccugggcaau

SEQ ID NO: 252722 - RNA, 22 nt, Homo sapiens
auugcacucuaaccuaggugac

SEQ ID NO: 252723 - RNA, 22 nt, Homo sapiens
auugcacucuagccugggugac

SEQ ID NO: 252724 - RNA, 22 nt, Homo sapiens
auugcagcccacccugggugau

SEQ ID NO: 252725 - RNA, 22 nt, Homo sapiens
auugccacaucucagaggcaga

SEQ ID NO: 252726 - RNA, 22 nt, Homo sapiens
aucgcgccauuguacuccagcc

SEQ ID NO: 252727 - RNA, 22 nt, Homo sapiens
aucuaaaucucauaugggcaca

SEQ ID NO: 252728 - RNA, 22 nt, Homo sapiens
aucucagagaaaauuacuaaga

SEQ ID NO: 252729 - RNA, 22 nt, Homo sapiens
aucucauuccuucugggcugau

SEQ ID NO: 252730 - RNA, 22 nt, Homo sapiens
aucugcaaagcugggcugagac

SEQ ID NO: 252731 - RNA, 19 nt, Homo sapiens
aucuggaguuccuggggcu

SEQ ID NO: 252732 - RNA, 22 nt, Homo sapiens
aucuggcuucuuuuaguccaca

SEQ ID NO: 252733 - RNA, 22 nt, Homo sapiens
aucugggguuggcaaaguuugg

SEQ ID NO: 252734 - RNA, 22 nt, Homo sapiens
aucugguguccucgugggaguc

SEQ ID NO: 252735 - RNA, 22 nt, Homo sapiens
aucugguguggcugugauccuc

SEQ ID NO: 252736 - RNA, 22 nt, Homo sapiens
aucuguguuuaaggucccagaa

SEQ ID NO: 252737 - RNA, 22 nt, Homo sapiens
aucuuggauuaccugggugggu

SEQ ID NO: 252738 - RNA, 22 nt, Homo sapiens
aucuuuaguggcuguuuucaga

SEQ ID NO: 252739 - RNA, 22 nt, Homo sapiens
aucuuuggcgggaauaucacag

SEQ ID NO: 252740 - RNA, 22 nt, Homo sapiens
aucuuuggugcaugauacuuug

SEQ ID NO: 252741 - RNA, 22 nt, Homo sapiens
augaaacuggcuaauuuuugua

SEQ ID NO: 252742 - RNA, 22 nt, Homo sapiens
augaaagguauguuuucuguga

SEQ ID NO: 252743 - RNA, 22 nt, Homo sapiens
augaaagguugucuuaagccau

SEQ ID NO: 252744 - RNA, 22 nt, Homo sapiens
augaaaucacugugaugcccua

SEQ ID NO: 252745 - RNA, 22 nt, Homo sapiens
augaaaucuuuccugugaggau

SEQ ID NO: 252746 - RNA, 22 nt, Homo sapiens
augaaaugcauguuaaguccgu

SEQ ID NO: 252747 - RNA, 19 nt, Homo sapiens
augaacucaucauuucuca

SEQ ID NO: 252748 - RNA, 18 nt, Homo sapiens
augaacucaucauuuuuu

SEQ ID NO: 252749 - RNA, 22 nt, Homo sapiens
augaagauguugccuuuuuaau

SEQ ID NO: 252750 - RNA, 20 nt, Homo sapiens
augaaggcaggugugaguuu

SEQ ID NO: 252751 - RNA, 22 nt, Homo sapiens
augaaguauuaggacacauuua

SEQ ID NO: 252752 - RNA, 22 nt, Homo sapiens
augaaguuagcucauuucuuuu

SEQ ID NO: 252753 - RNA, 22 nt, Homo sapiens
augaauacagcuaugcgugcau

SEQ ID NO: 252754 - RNA, 22 nt, Homo sapiens
augaauacugcugcaaugaaca

SEQ ID NO: 252755 - RNA, 22 nt, Homo sapiens
augaauuuucugauguugggua

SEQ ID NO: 252756 - RNA, 22 nt, Homo sapiens
augacaagaguguucagggaga

SEQ ID NO: 252757 - RNA, 22 nt, Homo sapiens
augacagugagugagcucucac

SEQ ID NO: 252758 - RNA, 22 nt, Homo sapiens
augacaguguggauuauuguaa

SEQ ID NO: 252759 - RNA, 22 nt, Homo sapiens
augacauugaugcucuggcugg

SEQ ID NO: 252760 - RNA, 22 nt, Homo sapiens
augaccauuucaauugauaugg

SEQ ID NO: 252761 - RNA, 20 nt, Homo sapiens
augaccuauggugguauaag

SEQ ID NO: 252762 - RNA, 18 nt, Homo sapiens
augaccugcggguuauau

SEQ ID NO: 252763 - RNA, 22 nt, Homo sapiens
augacuaaaggguuuauguuga

SEQ ID NO: 252764 - RNA, 22 nt, Homo sapiens
augacugagacuaacuuacuuu

SEQ ID NO: 252765 - RNA, 22 nt, Homo sapiens
augacugaguagcauuccauua

SEQ ID NO: 252766 - RNA, 22 nt, Homo sapiens
augagaauguaaguuaaugaaa

SEQ ID NO: 252767 - RNA, 22 nt, Homo sapiens
augagacuagaagagaauaaua

SEQ ID NO: 252768 - RNA, 22 nt, Homo sapiens
augagagcaacaccuucacuug

SEQ ID NO: 252769 - RNA, 22 nt, Homo sapiens
augagauauuuuauaagaucau

SEQ ID NO: 252770 - RNA, 22 nt, Homo sapiens
augagaugaauaccgacgaugu

SEQ ID NO: 252771 - RNA, 22 nt, Homo sapiens
augagaugcaagauuagauggg

SEQ ID NO: 252772 - RNA, 21 nt, Homo sapiens
augagauguuagacuuuagac

SEQ ID NO: 252773 - RNA, 22 nt, Homo sapiens
augagauuguuuguacuccaca

SEQ ID NO: 252774 - RNA, 19 nt, Homo sapiens
augagcaauaguuuuaauc

SEQ ID NO: 252775 - RNA, 22 nt, Homo sapiens
augagcagaagagauacacugu

SEQ ID NO: 252776 - RNA, 22 nt, Homo sapiens
augagcagaugcuccugccucu

SEQ ID NO: 252777 - RNA, 22 nt, Homo sapiens
augagcuaggacagaaugucag

SEQ ID NO: 252778 - RNA, 22 nt, Homo sapiens
augagcucauaaagagugauuu

SEQ ID NO: 252779 - RNA, 22 nt, Homo sapiens
augaggaagucaggcccagggg

SEQ ID NO: 252780 - RNA, 22 nt, Homo sapiens
augaggagguaugauuuucuga

SEQ ID NO: 252781 - RNA, 22 nt, Homo sapiens
augaggauagguuucuauuagg

SEQ ID NO: 252782 - RNA, 22 nt, Homo sapiens
augagggagggcaccugaccuu

SEQ ID NO: 252783 - RNA, 22 nt, Homo sapiens
augagguaguagaaagucaggu

SEQ ID NO: 252784 - RNA, 23 nt, Homo sapiens
augagguaucugagcccagaaau

SEQ ID NO: 252785 - RNA, 22 nt, Homo sapiens
augaggugauuucuguucgggu

SEQ ID NO: 252786 - RNA, 22 nt, Homo sapiens
augaggugggagaaucacuuga

SEQ ID NO: 252787 - RNA, 22 nt, Homo sapiens
aaaagcuuagaugggcuuguau

SEQ ID NO: 252788 - RNA, 22 nt, Homo sapiens
aaacccauauaccagcugugcu

SEQ ID NO: 252789 - RNA, 22 nt, Homo sapiens
aaacugaucugaaggccaggcu

SEQ ID NO: 252790 - RNA, 18 nt, Homo sapiens
aaacugcuuccuuggccu

SEQ ID NO: 252791 - RNA, 22 nt, Homo sapiens
aaacugcuuuccaugguggcug

SEQ ID NO: 252792 - RNA, 22 nt, Homo sapiens
aaagagaucuaugggcacuaug

SEQ ID NO: 252793 - RNA, 22 nt, Homo sapiens
aaagagcugagaccugguggag

SEQ ID NO: 252794 - RNA, 22 nt, Homo sapiens
aaaggaccacauauaugguggc

SEQ ID NO: 252795 - RNA, 22 nt, Homo sapiens
aaaggcuucggaucagaaggua

SEQ ID NO: 252796 - RNA, 22 nt, Homo sapiens
aaagggcacugugcuuuggcaa

SEQ ID NO: 252797 - RNA, 22 nt, Homo sapiens
aaagggcuugaauacucuuuuu

SEQ ID NO: 252798 - RNA, 17 nt, Homo sapiens
aaaguccuuugcuaucu

SEQ ID NO: 252799 - RNA, 22 nt, Homo sapiens
aaagucuguuacagcuauuucu

SEQ ID NO: 252800 - RNA, 22 nt, Homo sapiens
aaagucuguuuugucagagacu

SEQ ID NO: 252801 - RNA, 22 nt, Homo sapiens
aaagugaauguaucccguaagu

SEQ ID NO: 252802 - RNA, 22 nt, Homo sapiens
guaauacuggacaggguaucag

SEQ ID NO: 252803 - RNA, 22 nt, Homo sapiens
guaaucucagcuacucaggagg

SEQ ID NO: 252804 - RNA, 19 nt, Homo sapiens
guaaucucaguacuuuggu

SEQ ID NO: 252805 - RNA, 22 nt, Homo sapiens
guacaguuuucaguguucacug

SEQ ID NO: 252806 - RNA, 22 nt, Homo sapiens
guacaugcauacaugcacaucu

SEQ ID NO: 252807 - RNA, 22 nt, Homo sapiens
guacauguaugcaugcaugcau

SEQ ID NO: 252808 - RNA, 22 nt, Homo sapiens
guacccuauggauauagaugaa

SEQ ID NO: 252809 - RNA, 22 nt, Homo sapiens
guacuuuguuauaacccacagg

SEQ ID NO: 252810 - RNA, 22 nt, Homo sapiens
guagaaaguuugcugucacaug

SEQ ID NO: 252811 - RNA, 22 nt, Homo sapiens
guagagagaaauacaaagcugu

SEQ ID NO: 252812 - RNA, 22 nt, Homo sapiens
guagagguagauucuguuuuga

SEQ ID NO: 252813 - RNA, 22 nt, Homo sapiens
guagcagaacauguuccuugua

SEQ ID NO: 252814 - RNA, 22 nt, Homo sapiens
guauacuucugaaaauagcuau

SEQ ID NO: 252815 - RNA, 22 nt, Homo sapiens
guauaguaguacaaaaguuuuu

SEQ ID NO: 252816 - RNA, 22 nt, Homo sapiens
guaucauugccuaaugcucuca

SEQ ID NO: 252817 - RNA, 22 nt, Homo sapiens
guaucauuggcauguaaccaga

SEQ ID NO: 252818 - RNA, 22 nt, Homo sapiens
guauccugaaguucucagcacu

SEQ ID NO: 252819 - RNA, 22 nt, Homo sapiens
guaugaccucgcuuuauugcag

SEQ ID NO: 252820 - RNA, 22 nt, Homo sapiens
guaugucuuuauagcagugugg

SEQ ID NO: 252821 - RNA, 22 nt, Homo sapiens
guauugcuugagcccaggaguu

SEQ ID NO: 252822 - RNA, 22 nt, Homo sapiens
gucaacauauuaauuauguucu

SEQ ID NO: 252823 - RNA, 22 nt, Homo sapiens
gucaaggaauuuauccauuucu

SEQ ID NO: 252824 - RNA, 22 nt, Homo sapiens
gucacggaauguaaguggaagu

SEQ ID NO: 252825 - RNA, 22 nt, Homo sapiens
gucacugagaagguuaguuugu

SEQ ID NO: 252826 - RNA, 22 nt, Homo sapiens
gucagcaucaccaugucuauga

SEQ ID NO: 252827 - RNA, 22 nt, Homo sapiens
gucagugccugucccaggcuuu

SEQ ID NO: 252828 - RNA, 22 nt, Homo sapiens
gucagugucuuugcagcucaga

SEQ ID NO: 252829 - RNA, 22 nt, Homo sapiens
gucagugugauaucugcagggg

SEQ ID NO: 252830 - RNA, 22 nt, Homo sapiens
uuggcuauagauacauggauua

SEQ ID NO: 252831 - RNA, 22 nt, Homo sapiens
uuggcuucuggacuauugugca

SEQ ID NO: 252832 - RNA, 22 nt, Homo sapiens
uugggaauguccuaauaucucg

SEQ ID NO: 252833 - RNA, 22 nt, Homo sapiens
uugggacuggaaggaguaaggg

SEQ ID NO: 252834 - RNA, 22 nt, Homo sapiens
uugggguagaauugcaacauau

SEQ ID NO: 252835 - RNA, 22 nt, Homo sapiens
uugguaaucccuagugucuaga

SEQ ID NO: 252836 - RNA, 22 nt, Homo sapiens
uuggucaggcuaaucucgaacg

SEQ ID NO: 252837 - RNA, 22 nt, Homo sapiens
uugguccccuucaaccagcugu

SEQ ID NO: 252838 - RNA, 22 nt, Homo sapiens
uuguaaagaucauaugcuguuc

SEQ ID NO: 252839 - RNA, 22 nt, Homo sapiens
uuguaauguuaccaaauggugu

SEQ ID NO: 252840 - RNA, 22 nt, Homo sapiens
uuguaccacagggcaugaagug

SEQ ID NO: 252841 - RNA, 22 nt, Homo sapiens
uuguacuucagacaugccaaag

SEQ ID NO: 252842 - RNA, 22 nt, Homo sapiens
uuguaguagucucguucuuuua

SEQ ID NO: 252843 - RNA, 22 nt, Homo sapiens
uuguaugucuucauuugaaaaa

SEQ ID NO: 252844 - RNA, 22 nt, Homo sapiens
uuguauguuuguucuuucagau

SEQ ID NO: 252845 - RNA, 22 nt, Homo sapiens
uugucacccuacauaacaggga

SEQ ID NO: 252846 - RNA, 22 nt, Homo sapiens
uugucauuuucagaguguuacg

SEQ ID NO: 252847 - RNA, 22 nt, Homo sapiens
uuguccaagucccauuuguuga

SEQ ID NO: 252848 - RNA, 22 nt, Homo sapiens
uuguccacugcuagccucugca

SEQ ID NO: 252849 - RNA, 22 nt, Homo sapiens
uuguccccacccaaaugucauc

SEQ ID NO: 252850 - RNA, 22 nt, Homo sapiens
uuguccuccacauuugaucagu

SEQ ID NO: 252851 - RNA, 22 nt, Homo sapiens
uuguccucuccaaaucucaugu

SEQ ID NO: 252852 - RNA, 22 nt, Homo sapiens
uugugaucauugucaaauagug

SEQ ID NO: 252853 - RNA, 22 nt, Homo sapiens
uugugcacauguacccuagaac

SEQ ID NO: 252854 - RNA, 20 nt, Homo sapiens
uugugcauugggccauuggg

SEQ ID NO: 252855 - RNA, 21 nt, Homo sapiens
uugugccaaacccuggaggga

SEQ ID NO: 252856 - RNA, 22 nt, Homo sapiens
uugugcuuguaacuacauucag

SEQ ID NO: 252857 - RNA, 22 nt, Homo sapiens
uugugcuuuugagcugagauga

SEQ ID NO: 252858 - RNA, 22 nt, Homo sapiens
uugugggaggugauuagaucau

SEQ ID NO: 252859 - RNA, 22 nt, Homo sapiens
uugugguaaucugugacagcag

SEQ ID NO: 252860 - RNA, 22 nt, Homo sapiens
uugugguagugaaugagucuca

SEQ ID NO: 252861 - RNA, 22 nt, Homo sapiens
uugugguugaugaagacugucu

SEQ ID NO: 252862 - RNA, 22 nt, Homo sapiens
uuguguuuuuaguagggaaggg

SEQ ID NO: 252863 - RNA, 22 nt, Homo sapiens
uuguuuuggagaugagcuaaaa

SEQ ID NO: 252864 - RNA, 22 nt, Homo sapiens
uuuaaagcuaaaauauguuuau

SEQ ID NO: 252865 - RNA, 22 nt, Homo sapiens
uuuaagccaggugcaguggcuc

SEQ ID NO: 252866 - RNA, 22 nt, Homo sapiens
uuuaaugcugcccagucauggg

SEQ ID NO: 252867 - RNA, 22 nt, Homo sapiens
uuuacaguuuucuaggcuacca

SEQ ID NO: 252868 - RNA, 22 nt, Homo sapiens
uuuagggcaggccuggugguga

SEQ ID NO: 252869 - RNA, 22 nt, Homo sapiens
uuuagugcaucagacacccucu

SEQ ID NO: 252870 - RNA, 22 nt, Homo sapiens
uuuauagucaggaacuugagga

SEQ ID NO: 252871 - RNA, 22 nt, Homo sapiens
uuuaugucuguacaucgggcgg

SEQ ID NO: 252872 - RNA, 22 nt, Homo sapiens
uuucaacaggucuggggugguc

SEQ ID NO: 252873 - RNA, 22 nt, Homo sapiens
uuucaagugcugucuuagcugu

SEQ ID NO: 252874 - RNA, 22 nt, Homo sapiens
uuucacaguguucucccccaga

SEQ ID NO: 252875 - RNA, 18 nt, Homo sapiens
uuucaggguggacaugag

SEQ ID NO: 252876 - RNA, 16 nt, Homo sapiens
uuucaucaguuuuaau

SEQ ID NO: 252877 - RNA, 22 nt, Homo sapiens
uuucauggaggcauuuuagauu

SEQ ID NO: 252878 - RNA, 22 nt, Homo sapiens
uuucauguuuuucugugaggca

SEQ ID NO: 252879 - RNA, 22 nt, Homo sapiens
uuuccaguuuggaggaugcauu

SEQ ID NO: 252880 - RNA, 22 nt, Homo sapiens
uuuccauguuggugaaaugagg

SEQ ID NO: 252881 - RNA, 22 nt, Homo sapiens
uuucccugaaggcucugaaguc

SEQ ID NO: 252882 - RNA, 22 nt, Homo sapiens
uuucucaguguuucaggguagg

SEQ ID NO: 252883 - RNA, 20 nt, Homo sapiens
uuucuccccuauaaaucuca

SEQ ID NO: 252884 - RNA, 22 nt, Homo sapiens
uuucugggggugcugauggaaa

SEQ ID NO: 252885 - RNA, 23 nt, Homo sapiens
uuucuugggcaugcuaugucagu

SEQ ID NO: 252886 - RNA, 22 nt, Homo sapiens
uuucuugguuguauuuagacuu

SEQ ID NO: 252887 - RNA, 22 nt, Homo sapiens
uuugaaccauuugaagaaugau

SEQ ID NO: 252888 - RNA, 22 nt, Homo sapiens
uuugaagacuacugggagugaa

SEQ ID NO: 252889 - RNA, 22 nt, Homo sapiens
uuugaagugugaugccuugaug

SEQ ID NO: 252890 - RNA, 22 nt, Homo sapiens
uuugaaguguggcacugaguuu

SEQ ID NO: 252891 - RNA, 22 nt, Homo sapiens
uuugaauguaaugagcaggaag

SEQ ID NO: 252892 - RNA, 22 nt, Homo sapiens
uuugagguguauggcaaguuga

SEQ ID NO: 252893 - RNA, 22 nt, Homo sapiens
uuugauugguguaccugaaagu

SEQ ID NO: 252894 - RNA, 22 nt, Homo sapiens
uuugcacuggagauucaauggg

SEQ ID NO: 252895 - RNA, 20 nt, Homo sapiens
uuugcagaaucuaagaagag

SEQ ID NO: 252896 - RNA, 22 nt, Homo sapiens
uuugcaguuuauuccuggggcu

SEQ ID NO: 252897 - RNA, 21 nt, Homo sapiens
uuugcauauguugaaccagcc

SEQ ID NO: 252898 - RNA, 22 nt, Homo sapiens
uuugcauauguugaaccagccu

SEQ ID NO: 252899 - RNA, 22 nt, Homo sapiens
uuugcaucuuagaaaguucucc

SEQ ID NO: 252900 - RNA, 22 nt, Homo sapiens
uuugccaaugggaauuuuccua

SEQ ID NO: 252901 - RNA, 22 nt, Homo sapiens
uuuggcauauuuuaagcugguu

SEQ ID NO: 252902 - RNA, 22 nt, Homo sapiens
uuuggcaugggcuauuugcuuu

SEQ ID NO: 252903 - RNA, 21 nt, Homo sapiens
uuuggcauuaugucaccagag

SEQ ID NO: 252904 - RNA, 22 nt, Homo sapiens
uuuggccauaauuuuaauuggc

SEQ ID NO: 252905 - RNA, 22 nt, Homo sapiens
uuuggccauguuggucaggcug

SEQ ID NO: 252906 - RNA, 22 nt, Homo sapiens
uuugggaaugguuugucuccca

SEQ ID NO: 252907 - RNA, 22 nt, Homo sapiens
uuugggccauggcuuuuccacg

SEQ ID NO: 252908 - RNA, 22 nt, Homo sapiens
uuuggucuuuuguaaguuaucu

SEQ ID NO: 252909 - RNA, 22 nt, Homo sapiens
uuugguguauaaaaaugcuagu

SEQ ID NO: 252910 - RNA, 22 nt, Homo sapiens
uuugguugccucuaugagccug

SEQ ID NO: 252911 - RNA, 22 nt, Homo sapiens
uuuguacucccuuuagauaaaa

SEQ ID NO: 252912 - RNA, 22 nt, Homo sapiens
uuuguacugagccaagauggua

SEQ ID NO: 252913 - RNA, 22 nt, Homo sapiens
uuuguacuucauugguucuacu

SEQ ID NO: 252914 - RNA, 22 nt, Homo sapiens
uuuguacuugaagaaucuuuau

SEQ ID NO: 252915 - RNA, 21 nt, Homo sapiens
uuuguaguagcaugauuuaua

SEQ ID NO: 252916 - RNA, 22 nt, Homo sapiens
uuugucacccugaauguaagau

SEQ ID NO: 252917 - RNA, 22 nt, Homo sapiens
uuugucauagcagcaggaaugg

SEQ ID NO: 252918 - RNA, 22 nt, Homo sapiens
uuugugcuauguuauauauucu

SEQ ID NO: 252919 - RNA, 18 nt, Homo sapiens
uuugugcuccacaaagga

SEQ ID NO: 252920 - RNA, 22 nt, Homo sapiens
uuugugcuccugugagaaucua

SEQ ID NO: 252921 - RNA, 22 nt, Homo sapiens
uuuuaagcuacaagagacauau

SEQ ID NO: 252922 - RNA, 22 nt, Homo sapiens
uuuuagcagccaugacaaagau

SEQ ID NO: 252923 - RNA, 22 nt, Homo sapiens
uuuuaugggcuauuugcauuag

SEQ ID NO: 252924 - RNA, 22 nt, Homo sapiens
uuuucaguggccauaguggaga

SEQ ID NO: 252925 - RNA, 22 nt, Homo sapiens
uuuugcaauauguuccugaaua

SEQ ID NO: 252926 - RNA, 20 nt, Homo sapiens
uuuugcacuccuacuaaggu

SEQ ID NO: 252927 - RNA, 22 nt, Homo sapiens
uuuugcaggcauuggaaguuua

SEQ ID NO: 252928 - RNA, 22 nt, Homo sapiens
uuuugcauuggcugaggagugu

SEQ ID NO: 252929 - RNA, 22 nt, Homo sapiens
uuuugcucuugguaaugaaaga

SEQ ID NO: 252930 - RNA, 19 nt, Homo sapiens
uuuugcucuuuauaccuau

SEQ ID NO: 252931 - RNA, 20 nt, Homo sapiens
uuuuggacuaaaggcauccc

SEQ ID NO: 252932 - RNA, 18 nt, Homo sapiens
aaaugcucuucuggaaua

SEQ ID NO: 252933 - RNA, 22 nt, Homo sapiens
aaaugcugucaaauuguguucu

SEQ ID NO: 252934 - RNA, 22 nt, Homo sapiens
aaaugcuucuauguggcauguu

SEQ ID NO: 252935 - RNA, 22 nt, Homo sapiens
aaauggauuaaguucacuugcu

SEQ ID NO: 252936 - RNA, 22 nt, Homo sapiens
aaauggcaccggcucuucccuc

SEQ ID NO: 252937 - RNA, 22 nt, Homo sapiens
aaaugguguuaguagaucuuua

SEQ ID NO: 252938 - RNA, 22 nt, Homo sapiens
aacaccauuuuucugcagccuu

SEQ ID NO: 252939 - RNA, 22 nt, Homo sapiens
aacacggcccgcagagcaagcu

SEQ ID NO: 252940 - RNA, 22 nt, Homo sapiens
aacagaccuagauaguauaguc

SEQ ID NO: 252941 - RNA, 22 nt, Homo sapiens
aacagcacacccgcugcuucca

SEQ ID NO: 252942 - RNA, 20 nt, Homo sapiens
aacagcacugucugaagcuu

SEQ ID NO: 252943 - RNA, 22 nt, Homo sapiens
aacaggguguuugcaguuucuu

SEQ ID NO: 252944 - RNA, 22 nt, Homo sapiens
aacaguaucuaacgagugauga

SEQ ID NO: 252945 - RNA, 22 nt, Homo sapiens
aacagucuccaguuguauccau

SEQ ID NO: 252946 - RNA, 22 nt, Homo sapiens
aacagugcauucagggauauau

SEQ ID NO: 252947 - RNA, 22 nt, Homo sapiens
aaccacauggcucaguggacau

SEQ ID NO: 252948 - RNA, 22 nt, Homo sapiens
aacucugucuccuucaaguuca

SEQ ID NO: 252949 - RNA, 22 nt, Homo sapiens
aacugcacauauuuguaugggu

SEQ ID NO: 252950 - RNA, 22 nt, Homo sapiens
aacuggcauagccagacuucuc

SEQ ID NO: 252951 - RNA, 22 nt, Homo sapiens
aacuggcauaugaacuuguucu

SEQ ID NO: 252952 - RNA, 22 nt, Homo sapiens
aacuggccuggcgugcagaggg

SEQ ID NO: 252953 - RNA, 22 nt, Homo sapiens
aagagagcuaugugcauaauua

SEQ ID NO: 252954 - RNA, 22 nt, Homo sapiens
aagagcauuauuuaguaauuuc

SEQ ID NO: 252955 - RNA, 22 nt, Homo sapiens
aagagcauuggauggggagauu

SEQ ID NO: 252956 - RNA, 22 nt, Homo sapiens
aagagccgcaagggugaagggu

SEQ ID NO: 252957 - RNA, 22 nt, Homo sapiens
aagagcgcugauaacauguuug

SEQ ID NO: 252958 - RNA, 20 nt, Homo sapiens
aagagcucaccagaauaucu

SEQ ID NO: 252959 - RNA, 22 nt, Homo sapiens
aagagugcucgugggacucagc

SEQ ID NO: 252960 - RNA, 22 nt, Homo sapiens
aagauauguuaguuauaaacuc

SEQ ID NO: 252961 - RNA, 22 nt, Homo sapiens
aagaucaucauagagggcauga

SEQ ID NO: 252962 - RNA, 22 nt, Homo sapiens
aagaucauucagggaaggcuga

SEQ ID NO: 252963 - RNA, 22 nt, Homo sapiens
aagcaacacaucugccccgguu

SEQ ID NO: 252964 - RNA, 22 nt, Homo sapiens
aagccagugugacaggaaacuu

SEQ ID NO: 252965 - RNA, 22 nt, Homo sapiens
aagcgguguugaauuuuguuga

SEQ ID NO: 252966 - RNA, 22 nt, Homo sapiens
aagcucuuguugaaucuuguca

SEQ ID NO: 252967 - RNA, 22 nt, Homo sapiens
aagcuggcauucauucguucuu

SEQ ID NO: 252968 - RNA, 22 nt, Homo sapiens
aagcugugucuugucagcuacc

SEQ ID NO: 252969 - RNA, 22 nt, Homo sapiens
aagcuguguguaagcucucaca

SEQ ID NO: 252970 - RNA, 22 nt, Homo sapiens
aagcuguugguggauguaccau

SEQ ID NO: 252971 - RNA, 22 nt, Homo sapiens
aaggaguguggugaucuugggc

SEQ ID NO: 252972 - RNA, 22 nt, Homo sapiens
aaggcaagaaaauggauucucc

SEQ ID NO: 252973 - RNA, 22 nt, Homo sapiens
aaggcaagaaugcgugcuuuca

SEQ ID NO: 252974 - RNA, 22 nt, Homo sapiens
aaggcaauuuguugugaggauu

SEQ ID NO: 252975 - RNA, 22 nt, Homo sapiens
aaggcagucacuaaauagugag

SEQ ID NO: 252976 - RNA, 22 nt, Homo sapiens
aaggcaugcaaagaacauuuua

SEQ ID NO: 252977 - RNA, 22 nt, Homo sapiens
aaggcuguuguguaauaggauu

SEQ ID NO: 252978 - RNA, 22 nt, Homo sapiens
aagggaaugcgcugccuguguu

SEQ ID NO: 252979 - RNA, 22 nt, Homo sapiens
aagggaaugugguagcugguuu

SEQ ID NO: 252980 - RNA, 21 nt, Homo sapiens
aaggugguggugauugagaug

SEQ ID NO: 252981 - RNA, 22 nt, Homo sapiens
aagguuguauuuaauauacugu

SEQ ID NO: 252982 - RNA, 21 nt, Homo sapiens
aagguuuuuagugcuugacuu

SEQ ID NO: 252983 - RNA, 22 nt, Homo sapiens
aaguaauugagguuuuugcugu

SEQ ID NO: 252984 - RNA, 22 nt, Homo sapiens
aaguauagcuaugauaaacauu

SEQ ID NO: 252985 - RNA, 22 nt, Homo sapiens
aagucaugaagaggaaaggaca

SEQ ID NO: 252986 - RNA, 22 nt, Homo sapiens
aagugcaaauucccaggcucug

SEQ ID NO: 252987 - RNA, 22 nt, Homo sapiens
aagugcuucuuuccucgagaag

SEQ ID NO: 252988 - RNA, 22 nt, Homo sapiens
aagugguguuugggagcuggac

SEQ ID NO: 252989 - RNA, 22 nt, Homo sapiens
aaguuguaguuagagaguugcu

SEQ ID NO: 252990 - RNA, 22 nt, Homo sapiens
aauaaagcauggcuacuccaua

SEQ ID NO: 252991 - RNA, 22 nt, Homo sapiens
aauaagaaguggaagggaccgg

SEQ ID NO: 252992 - RNA, 22 nt, Homo sapiens
aauacugugauaucgagcgauu

SEQ ID NO: 252993 - RNA, 22 nt, Homo sapiens
aauagcacuguagauggaggaa

SEQ ID NO: 252994 - RNA, 22 nt, Homo sapiens
aauagugcugugcagugagugg

SEQ ID NO: 252995 - RNA, 22 nt, Homo sapiens
aauaucacaggguguacacuca

SEQ ID NO: 252996 - RNA, 22 nt, Homo sapiens
aauaucacaguuggguguacac

SEQ ID NO: 252997 - RNA, 22 nt, Homo sapiens
aauauugucaaaauggauucca

SEQ ID NO: 252998 - RNA, 22 nt, Homo sapiens
aaucacagccagcuuccgcuau

SEQ ID NO: 252999 - RNA, 22 nt, Homo sapiens
aaucacaggucuuggcugcaug

SEQ ID NO: 253000 - RNA, 22 nt, Homo sapiens
aaucacaguuaguaagggagaa

SEQ ID NO: 253001 - RNA, 22 nt, Homo sapiens
aaucacuuugcuacaaggcagu

SEQ ID NO: 253002 - RNA, 22 nt, Homo sapiens
aaucacuuuggcaccaaccuaa

SEQ ID NO: 253003 - RNA, 22 nt, Homo sapiens
aaucagcacacugugcuuucca

SEQ ID NO: 253004 - RNA, 22 nt, Homo sapiens
aauccauuugccgucuauccau

SEQ ID NO: 253005 - RNA, 20 nt, Homo sapiens
aaucuacuugcccauuuagc

SEQ ID NO: 253006 - RNA, 22 nt, Homo sapiens
aaucugucaguuuuguguuaau

SEQ ID NO: 253007 - RNA, 22 nt, Homo sapiens
aaugacccugauuggcaaguug

SEQ ID NO: 253008 - RNA, 22 nt, Homo sapiens
aaugacucugccuaaauuucac

SEQ ID NO: 253009 - RNA, 22 nt, Homo sapiens
aaugcaagauguuaauuauagg

SEQ ID NO: 253010 - RNA, 22 nt, Homo sapiens
aaugcacauauauuuccuuauu

SEQ ID NO: 253011 - RNA, 22 nt, Homo sapiens
aaugcuguguuauuucaugacc

SEQ ID NO: 253012 - RNA, 22 nt, Homo sapiens
aaugcuguucuuugcuuaaguu

SEQ ID NO: 253013 - RNA, 22 nt, Homo sapiens
aauggcaaauguuuucuguuga

SEQ ID NO: 253014 - RNA, 22 nt, Homo sapiens
aauggcucuuccuggaguugug

SEQ ID NO: 253015 - RNA, 22 nt, Homo sapiens
aaugugcacuuggagccuugcu

SEQ ID NO: 253016 - RNA, 22 nt, Homo sapiens
aauguguuuugaaaucaggaag

SEQ ID NO: 253017 - RNA, 22 nt, Homo sapiens
aauuaguugaaagucugcuuuu

SEQ ID NO: 253018 - RNA, 22 nt, Homo sapiens
aauucuguauuguuuagggacu

SEQ ID NO: 253019 - RNA, 22 nt, Homo sapiens
aauugaaucaugugggcagacu

SEQ ID NO: 253020 - RNA, 22 nt, Homo sapiens
aauugcacuacugcacucccac

SEQ ID NO: 253021 - RNA, 22 nt, Homo sapiens
aauugcaucuguucuuugccag

SEQ ID NO: 253022 - RNA, 22 nt, Homo sapiens
aauugcauugaauuuguagcuu

SEQ ID NO: 253023 - RNA, 22 nt, Homo sapiens
acugcacucuagccuuggcaac

SEQ ID NO: 253024 - RNA, 22 nt, Homo sapiens
acugcacugcagccuggccaac

SEQ ID NO: 253025 - RNA, 22 nt, Homo sapiens
acugcacugucaaccuccuggg

SEQ ID NO: 253026 - RNA, 22 nt, Homo sapiens
acugcacuguccuagaguccuc

SEQ ID NO: 253027 - RNA, 22 nt, Homo sapiens
acugcacuuauccuccaauguu

SEQ ID NO: 253028 - RNA, 20 nt, Homo sapiens
acugcacuucagccugcugg

SEQ ID NO: 253029 - RNA, 22 nt, Homo sapiens
acugcacuucagccuguugaca

SEQ ID NO: 253030 - RNA, 22 nt, Homo sapiens
acugcacuucagccuuggcuac

SEQ ID NO: 253031 - RNA, 20 nt, Homo sapiens
acugcauuuaguccucagga

SEQ ID NO: 253032 - RNA, 22 nt, Homo sapiens
acuggacuuaaugaugaauugu

SEQ ID NO: 253033 - RNA, 22 nt, Homo sapiens
acuggcuuauuucacuuagcau

SEQ ID NO: 253034 - RNA, 22 nt, Homo sapiens
acuguacuacagccugggugac

SEQ ID NO: 253035 - RNA, 22 nt, Homo sapiens
acuguacuccauccugggugac

SEQ ID NO: 253036 - RNA, 22 nt, Homo sapiens
acuucauucucuggaucagaau

SEQ ID NO: 253037 - RNA, 22 nt, Homo sapiens
agaaacauucucuugccuccuu

SEQ ID NO: 253038 - RNA, 23 nt, Homo sapiens
agaaaugucuauucagggucccu

SEQ ID NO: 253039 - RNA, 22 nt, Homo sapiens
agaaccaaucccacauggauac

SEQ ID NO: 253040 - RNA, 22 nt, Homo sapiens
agaaccauuagagggagauauu

SEQ ID NO: 253041 - RNA, 20 nt, Homo sapiens
agaaccuguaguguagaggg

SEQ ID NO: 253042 - RNA, 22 nt, Homo sapiens
agaauaauguccccccaaggga

SEQ ID NO: 253043 - RNA, 22 nt, Homo sapiens
agaauacugucuauucauggua

SEQ ID NO: 253044 - RNA, 22 nt, Homo sapiens
agaauguaaacagaauagagga

SEQ ID NO: 253045 - RNA, 22 nt, Homo sapiens
agaaugugaacaucuugaaagu

SEQ ID NO: 253046 - RNA, 22 nt, Homo sapiens
agacaagauggcuugagguuca

SEQ ID NO: 253047 - RNA, 22 nt, Homo sapiens
agacagcuggaguaucauagcu

SEQ ID NO: 253048 - RNA, 22 nt, Homo sapiens
agacaguauuggcaaagugugu

SEQ ID NO: 253049 - RNA, 22 nt, Homo sapiens
agaccacuuuagagauuguuca

SEQ ID NO: 253050 - RNA, 22 nt, Homo sapiens
agagaacuggcuucaccauucu

SEQ ID NO: 253051 - RNA, 22 nt, Homo sapiens
agagacauugcuccaacucacc

SEQ ID NO: 253052 - RNA, 22 nt, Homo sapiens
agagagcuugggguguuaaauu

SEQ ID NO: 253053 - RNA, 22 nt, Homo sapiens
agagaucacugaaucacggggg

SEQ ID NO: 253054 - RNA, 22 nt, Homo sapiens
agagauccucauuuuauagaca

SEQ ID NO: 253055 - RNA, 22 nt, Homo sapiens
agagaugaagauggggcucccg

SEQ ID NO: 253056 - RNA, 22 nt, Homo sapiens
agagauuauccuggcuucucug

SEQ ID NO: 253057 - RNA, 22 nt, Homo sapiens
agagcaaugacaugcuaugugg

SEQ ID NO: 253058 - RNA, 22 nt, Homo sapiens
agagcaaugggugaauauuaaa

SEQ ID NO: 253059 - RNA, 22 nt, Homo sapiens
agagcaauguuaucagucucug

SEQ ID NO: 253060 - RNA, 22 nt, Homo sapiens
agagcauugaguuaaugguuca

SEQ ID NO: 253061 - RNA, 22 nt, Homo sapiens
agagccacacucuccuaacuca

SEQ ID NO: 253062 - RNA, 22 nt, Homo sapiens
agagccacauuaaauaugggaa

SEQ ID NO: 253063 - RNA, 22 nt, Homo sapiens
agagcuguguuuuaacuuuuua

SEQ ID NO: 253064 - RNA, 21 nt, Homo sapiens
agaggacugaccacagcccua

SEQ ID NO: 253065 - RNA, 22 nt, Homo sapiens
agagguauuggaaggaguguca

SEQ ID NO: 253066 - RNA, 22 nt, Homo sapiens
agagguuuaauugauucacagu

SEQ ID NO: 253067 - RNA, 22 nt, Homo sapiens
agaguaguaggaugaauggacu

SEQ ID NO: 253068 - RNA, 22 nt, Homo sapiens
agaguaguuuauuaugcuaagg

SEQ ID NO: 253069 - RNA, 22 nt, Homo sapiens
cucuuugaugugaaccgugguu

SEQ ID NO: 253070 - RNA, 22 nt, Homo sapiens
cucuuuuguuccuaguuugauc

SEQ ID NO: 253071 - RNA, 22 nt, Homo sapiens
cucuuuuguuuagcugagaggg

SEQ ID NO: 253072 - RNA, 22 nt, Homo sapiens
cugaauagagcacacugauggg

SEQ ID NO: 253073 - RNA, 22 nt, Homo sapiens
cugaauguccaggcagagguuu

SEQ ID NO: 253074 - RNA, 22 nt, Homo sapiens
cugaauguucuauagaagccgc

SEQ ID NO: 253075 - RNA, 22 nt, Homo sapiens
cugaauguuucacucugaaaug

SEQ ID NO: 253076 - RNA, 22 nt, Homo sapiens
cugacagucucauugauuugcu

SEQ ID NO: 253077 - RNA, 22 nt, Homo sapiens
cugacugugcaugcccagcccc

SEQ ID NO: 253078 - RNA, 22 nt, Homo sapiens
cugagacuggugauuuaugaag

SEQ ID NO: 253079 - RNA, 22 nt, Homo sapiens
cugagagaugagaccucucacu

SEQ ID NO: 253080 - RNA, 22 nt, Homo sapiens
cugagauaggacucugcuggcu

SEQ ID NO: 253081 - RNA, 22 nt, Homo sapiens
cugagcaaagaagugauaauga

SEQ ID NO: 253082 - RNA, 22 nt, Homo sapiens
cugagcccauucuggggagaag

SEQ ID NO: 253083 - RNA, 22 nt, Homo sapiens
cugaggaaguucuuuaacaguu

SEQ ID NO: 253084 - RNA, 22 nt, Homo sapiens
cugaggucugaauccagguauc

SEQ ID NO: 253085 - RNA, 22 nt, Homo sapiens
cugagguuaggaguuugagacc

SEQ ID NO: 253086 - RNA, 20 nt, Homo sapiens
cugagguugggguccuuccc

SEQ ID NO: 253087 - RNA, 22 nt, Homo sapiens
cugagguuguucuucucagugg

SEQ ID NO: 253088 - RNA, 18 nt, Homo sapiens
cugagucauuccuggguc

SEQ ID NO: 253089 - RNA, 22 nt, Homo sapiens
cugauaaguuuuucuuuauaag

SEQ ID NO: 253090 - RNA, 22 nt, Homo sapiens
cugauauuuuaaaauuggcugg

SEQ ID NO: 253091 - RNA, 22 nt, Homo sapiens
cugaucuggaggugucugggga

SEQ ID NO: 253092 - RNA, 22 nt, Homo sapiens
cugaucuguagcagccaccaca

SEQ ID NO: 253093 - RNA, 22 nt, Homo sapiens
cugauuguucuugcugggccuu

SEQ ID NO: 253094 - RNA, 20 nt, Homo sapiens
cugcaaaugcugcugcugau

SEQ ID NO: 253095 - RNA, 22 nt, Homo sapiens
cugcaguaaacuuucccauuca

SEQ ID NO: 253096 - RNA, 22 nt, Homo sapiens
cugcagucaucugaagauuuug

SEQ ID NO: 253097 - RNA, 22 nt, Homo sapiens
cugcauaaucaucucucugcau

SEQ ID NO: 253098 - RNA, 22 nt, Homo sapiens
cugcauuagucuguuuaguguu

SEQ ID NO: 253099 - RNA, 22 nt, Homo sapiens
cugcauuggguuaugcauuuuu

SEQ ID NO: 253100 - RNA, 22 nt, Homo sapiens
cugccacugacaccucaaggac

SEQ ID NO: 253101 - RNA, 18 nt, Homo sapiens
cugccagugugcucuccg

SEQ ID NO: 253102 - RNA, 22 nt, Homo sapiens
cugcccuuucuauaugauguaa

SEQ ID NO: 253103 - RNA, 22 nt, Homo sapiens
cugccuaaagaaaaagacguug

SEQ ID NO: 253104 - RNA, 22 nt, Homo sapiens
cugccuagauguuguagggggu

SEQ ID NO: 253105 - RNA, 22 nt, Homo sapiens
cugccugagaaaauggagggca

SEQ ID NO: 253106 - RNA, 22 nt, Homo sapiens
ggaaaguccuucuguaggcucc

SEQ ID NO: 253107 - RNA, 22 nt, Homo sapiens
ggaaauguuuagcauccacuuu

SEQ ID NO: 253108 - RNA, 22 nt, Homo sapiens
ggaacaccauuuuuccugccuu

SEQ ID NO: 253109 - RNA, 22 nt, Homo sapiens
ggaagacuuagaguagcaucag

SEQ ID NO: 253110 - RNA, 22 nt, Homo sapiens
ggaagccugcacucgggcaggg

SEQ ID NO: 253111 - RNA, 22 nt, Homo sapiens
ggaaguauaaacuuaguggagu

SEQ ID NO: 253112 - RNA, 17 nt, Homo sapiens
ggaaugaauuccagccc

SEQ ID NO: 253113 - RNA, 22 nt, Homo sapiens
ggaaugagaaauauuacacaau

SEQ ID NO: 253114 - RNA, 22 nt, Homo sapiens
ggaaugugugucaugcuuuugc

SEQ ID NO: 253115 - RNA, 20 nt, Homo sapiens
ggaauguuaaucuccaugau

SEQ ID NO: 253116 - RNA, 22 nt, Homo sapiens
ggacaagagacugggacacuga

SEQ ID NO: 253117 - RNA, 22 nt, Homo sapiens
ggacauguauauauaugugugu

SEQ ID NO: 253118 - RNA, 22 nt, Homo sapiens
ggacauuaacugcaagauagau

SEQ ID NO: 253119 - RNA, 22 nt, Homo sapiens
ggacuagaucucccggcuucua

SEQ ID NO: 253120 - RNA, 19 nt, Homo sapiens
ggacugucauggaguaguu

SEQ ID NO: 253121 - RNA, 22 nt, Homo sapiens
ggagaguaauuagacugaaaga

SEQ ID NO: 253122 - RNA, 22 nt, Homo sapiens
ggagaucuuuaggaguuggacu

SEQ ID NO: 253123 - RNA, 22 nt, Homo sapiens
ggagggugagaucaauuuggga

SEQ ID NO: 253124 - RNA, 22 nt, Homo sapiens
ggagguagucuuucccuuauca

SEQ ID NO: 253125 - RNA, 22 nt, Homo sapiens
ggaguaggcuguccggcaccca

SEQ ID NO: 253126 - RNA, 23 nt, Homo sapiens
ggaguguaaauuauuucaaccau

SEQ ID NO: 253127 - RNA, 22 nt, Homo sapiens
ggaguguaguggcuccaucucg

SEQ ID NO: 253128 - RNA, 22 nt, Homo sapiens
ggagugugauucaguauaauau

SEQ ID NO: 253129 - RNA, 22 nt, Homo sapiens
ggaucacagccagcucccagaa

SEQ ID NO: 253130 - RNA, 22 nt, Homo sapiens
ggauuagagauguuauuaagag

SEQ ID NO: 253131 - RNA, 22 nt, Homo sapiens
ggcaaaauauugucugguauag

SEQ ID NO: 253132 - RNA, 22 nt, Homo sapiens
ggcaaaugaagauggagaggcu

SEQ ID NO: 253133 - RNA, 22 nt, Homo sapiens
ggcaacaugaugaaaugccauc

SEQ ID NO: 253134 - RNA, 22 nt, Homo sapiens
ggcaacaugccgaaaccacguc

SEQ ID NO: 253135 - RNA, 22 nt, Homo sapiens
ggcaacauggugaaacucuguc

SEQ ID NO: 253136 - RNA, 21 nt, Homo sapiens
ggcaagaaacacaaucaagua

SEQ ID NO: 253137 - RNA, 22 nt, Homo sapiens
ggcaaggaggggcacuuucacu

SEQ ID NO: 253138 - RNA, 22 nt, Homo sapiens
ggcaaggauguuuuucuggcaa

SEQ ID NO: 253139 - RNA, 21 nt, Homo sapiens
ggcaagugugagguuuggggu

SEQ ID NO: 253140 - RNA, 22 nt, Homo sapiens
ggcacaguuaagugcuaccuaa

SEQ ID NO: 253141 - RNA, 22 nt, Homo sapiens
ggcaccauuuuacuccuucccu

SEQ ID NO: 253142 - RNA, 22 nt, Homo sapiens
ggcacuguugccggccugaauu

SEQ ID NO: 253143 - RNA, 22 nt, Homo sapiens
ggcaguuuguucuugcuccuuu

SEQ ID NO: 253144 - RNA, 22 nt, Homo sapiens
ggcaguuuguuugugaggucca

SEQ ID NO: 253145 - RNA, 22 nt, Homo sapiens
ggcaugauggcugaggcuucug

SEQ ID NO: 253146 - RNA, 22 nt, Homo sapiens
ggcccaguugcgggugguaccg

SEQ ID NO: 253147 - RNA, 22 nt, Homo sapiens
ggcccugagacaggaaaaagcu

SEQ ID NO: 253148 - RNA, 22 nt, Homo sapiens
ggcgccauugcacuccagccug

SEQ ID NO: 253149 - RNA, 22 nt, Homo sapiens
ggcuagagaauagugccacuaa

SEQ ID NO: 253150 - RNA, 22 nt, Homo sapiens
ggcuagauauucacauauggcu

SEQ ID NO: 253151 - RNA, 22 nt, Homo sapiens
ggcucagugaucuguuucugua

SEQ ID NO: 253152 - RNA, 21 nt, Homo sapiens
ggcucuguggucucagguuuc

SEQ ID NO: 253153 - RNA, 22 nt, Homo sapiens
ggcuuggaggaaugugagggcu

SEQ ID NO: 253154 - RNA, 22 nt, Homo sapiens
gggaagauauaggcugggcacc

SEQ ID NO: 253155 - RNA, 22 nt, Homo sapiens
gggaagugugguuucuuuacag

SEQ ID NO: 253156 - RNA, 22 nt, Homo sapiens
gggagguagguauuagcuuuuc

SEQ ID NO: 253157 - RNA, 22 nt, Homo sapiens
gggaggucauuguucaaugcug

SEQ ID NO: 253158 - RNA, 22 nt, Homo sapiens
gggaguguguaggacccagugu

SEQ ID NO: 253159 - RNA, 22 nt, Homo sapiens
gggaugaagaagaauaguucgu

SEQ ID NO: 253160 - RNA, 22 nt, Homo sapiens
gggauguuuuauacugagccug

SEQ ID NO: 253161 - RNA, 22 nt, Homo sapiens
gggcaacauugaguacccugaa

SEQ ID NO: 253162 - RNA, 22 nt, Homo sapiens
gggcaguauggucauuuucaca

SEQ ID NO: 253163 - RNA, 22 nt, Homo sapiens
gggcaugaugucuuaugccuau

SEQ ID NO: 253164 - RNA, 23 nt, Homo sapiens
gggcuagaugagagcuuccuggg

SEQ ID NO: 253165 - RNA, 22 nt, Homo sapiens
ggggaauguuaaagaauuugca

SEQ ID NO: 253166 - RNA, 22 nt, Homo sapiens
ggggaguguggacaucacccug

SEQ ID NO: 253167 - RNA, 22 nt, Homo sapiens
gggguaggcuacacugaguucc

SEQ ID NO: 253168 - RNA, 22 nt, Homo sapiens
ggguaggcaagcggaugucaga

SEQ ID NO: 253169 - RNA, 22 nt, Homo sapiens
ggucacauuggacuaucaaguu

SEQ ID NO: 253170 - RNA, 22 nt, Homo sapiens
ggucaguuuucuccaggaucca

SEQ ID NO: 253171 - RNA, 22 nt, Homo sapiens
ggugagaaagggauuccuguuc

SEQ ID NO: 253172 - RNA, 22 nt, Homo sapiens
ggugaguggugcuuaaguucag

SEQ ID NO: 253173 - RNA, 22 nt, Homo sapiens
gaacuguuucuggugaaagagu

SEQ ID NO: 253174 - RNA, 18 nt, Homo sapiens
gaagaaguaggcauggca

SEQ ID NO: 253175 - RNA, 22 nt, Homo sapiens
gaaggcacugugugccacccug

SEQ ID NO: 253176 - RNA, 22 nt, Homo sapiens
gaagugcaguggcacagucaug

SEQ ID NO: 253177 - RNA, 22 nt, Homo sapiens
gaauacugacuauuucaucugg

SEQ ID NO: 253178 - RNA, 22 nt, Homo sapiens
gaauagugcugcaauaaacaua

SEQ ID NO: 253179 - RNA, 22 nt, Homo sapiens
gaauagugcugcaaugaacaua

SEQ ID NO: 253180 - RNA, 22 nt, Homo sapiens
gaaucacagauuaugaguaucu

SEQ ID NO: 253181 - RNA, 22 nt, Homo sapiens
gaaucacugugguaucccaugc

SEQ ID NO: 253182 - RNA, 22 nt, Homo sapiens
gaaugcagcagugacagggcug

SEQ ID NO: 253183 - RNA, 22 nt, Homo sapiens
gaaugcuaaguuuccucccuau

SEQ ID NO: 253184 - RNA, 21 nt, Homo sapiens
gaauggcaccauuagcauaua

SEQ ID NO: 253185 - RNA, 22 nt, Homo sapiens
gacaaguuugauuuauuccaag

SEQ ID NO: 253186 - RNA, 22 nt, Homo sapiens
gacacagugaagucucuacuug

SEQ ID NO: 253187 - RNA, 22 nt, Homo sapiens
gacaccugguguggaacuggag

SEQ ID NO: 253188 - RNA, 22 nt, Homo sapiens
gacacugucuucugcucuuaaa

SEQ ID NO: 253189 - RNA, 22 nt, Homo sapiens
gacagacacaauugauccauga

SEQ ID NO: 253190 - RNA, 22 nt, Homo sapiens
gacagugugauacuuagucuca

SEQ ID NO: 253191 - RNA, 22 nt, Homo sapiens
gacaguuuggugaggaagacga

SEQ ID NO: 253192 - RNA, 17 nt, Homo sapiens
gacauaggaaaaggaga

SEQ ID NO: 253193 - RNA, 20 nt, Homo sapiens
gacaugacuaggagauagcc

SEQ ID NO: 253194 - RNA, 20 nt, Homo sapiens
gacauguugguuugcugcac

SEQ ID NO: 253195 - RNA, 22 nt, Homo sapiens
gacauuaucagguuuguuuucu

SEQ ID NO: 253196 - RNA, 22 nt, Homo sapiens
gaccacagacuggaaagagggc

SEQ ID NO: 253197 - RNA, 22 nt, Homo sapiens
gacuaggagagcagcugcccau

SEQ ID NO: 253198 - RNA, 22 nt, Homo sapiens
gacucagaacuaaggguguuuc

SEQ ID NO: 253199 - RNA, 22 nt, Homo sapiens
gacugaggaagcgcucucuccu

SEQ ID NO: 253200 - RNA, 22 nt, Homo sapiens
gacuggccauugauacagaggu

SEQ ID NO: 253201 - RNA, 18 nt, Homo sapiens
gacuuggaguuuacagug

SEQ ID NO: 253202 - RNA, 22 nt, Homo sapiens
gacuuugguagaggaaaaaucu

SEQ ID NO: 253203 - RNA, 22 nt, Homo sapiens
gagaacagagauaauuuuacuu

SEQ ID NO: 253204 - RNA, 22 nt, Homo sapiens
gagaacuaaugguuugauaagg

SEQ ID NO: 253205 - RNA, 22 nt, Homo sapiens
gagaacugacauuaucguguau

SEQ ID NO: 253206 - RNA, 22 nt, Homo sapiens
gagaacugagugugcuggcgga

SEQ ID NO: 253207 - RNA, 22 nt, Homo sapiens
gagaaugaacagacugccucuu

SEQ ID NO: 253208 - RNA, 22 nt, Homo sapiens
gagaaugagaggggaaggccac

SEQ ID NO: 253209 - RNA, 22 nt, Homo sapiens
gagacggagucucgcucuguca

SEQ ID NO: 253210 - RNA, 22 nt, Homo sapiens
uaaacugcuugaggguaaguac

SEQ ID NO: 253211 - RNA, 22 nt, Homo sapiens
uaaagcacaaguaaagaauacu

SEQ ID NO: 253212 - RNA, 22 nt, Homo sapiens
uaaagccagugauuaugucucu

SEQ ID NO: 253213 - RNA, 22 nt, Homo sapiens
uaaagcuacaguauaugguauu

SEQ ID NO: 253214 - RNA, 22 nt, Homo sapiens
uaaagcuagagcuggaguggca

SEQ ID NO: 253215 - RNA, 22 nt, Homo sapiens
uaaagcuaucacauuggugauu

SEQ ID NO: 253216 - RNA, 22 nt, Homo sapiens
uaaagcugaaaugauuaugaca

SEQ ID NO: 253217 - RNA, 22 nt, Homo sapiens
uaaagcuuagauccaugguggc

SEQ ID NO: 253218 - RNA, 22 nt, Homo sapiens
uaaagugcugagaugaggcugg

SEQ ID NO: 253219 - RNA, 22 nt, Homo sapiens
uaaaguuauugccccucaguua

SEQ ID NO: 253220 - RNA, 20 nt, Homo sapiens
uaaaugccucaugcuuuauu

SEQ ID NO: 253221 - RNA, 22 nt, Homo sapiens
uaaauggauauugccaucuccu

SEQ ID NO: 253222 - RNA, 22 nt, Homo sapiens
uaacacagagcuccuaaucccu

SEQ ID NO: 253223 - RNA, 16 nt, Homo sapiens
uaacacaguucccacc

SEQ ID NO: 253224 - RNA, 22 nt, Homo sapiens
uaacagcucuacagcugcucuu

SEQ ID NO: 253225 - RNA, 22 nt, Homo sapiens
uaacaguauauuuaccaaaccu

SEQ ID NO: 253226 - RNA, 18 nt, Homo sapiens
uaacagucucucaggauc

SEQ ID NO: 253227 - RNA, 22 nt, Homo sapiens
uaacuacuucugcuucagagua

SEQ ID NO: 253228 - RNA, 22 nt, Homo sapiens
uaacuaguggaauuugauuuca

SEQ ID NO: 253229 - RNA, 22 nt, Homo sapiens
uaacugcaaccuccgccucccg

SEQ ID NO: 253230 - RNA, 22 nt, Homo sapiens
uaacugcaaccucugccugcug

SEQ ID NO: 253231 - RNA, 22 nt, Homo sapiens
uaacuguggaaaugacuuuaaa

SEQ ID NO: 253232 - RNA, 20 nt, Homo sapiens
uaagacaugguccacaugcc

SEQ ID NO: 253233 - RNA, 22 nt, Homo sapiens
uaaggcaaguuuuuaguggaca

SEQ ID NO: 253234 - RNA, 22 nt, Homo sapiens
uaaggcuaggaauucucugaag

SEQ ID NO: 253235 - RNA, 22 nt, Homo sapiens
uaaggcucuuguuauuuugagg

SEQ ID NO: 253236 - RNA, 22 nt, Homo sapiens
uaaggcuuaugguaaaguccug

SEQ ID NO: 253237 - RNA, 22 nt, Homo sapiens
uaaggcuuuuguucagcguggg

SEQ ID NO: 253238 - RNA, 22 nt, Homo sapiens
uaagguuacaaaggacuucaua

SEQ ID NO: 253239 - RNA, 22 nt, Homo sapiens
uaagguuuuugauaugcugcug

SEQ ID NO: 253240 - RNA, 22 nt, Homo sapiens
uaaguauuuuaauuccuggcau

SEQ ID NO: 253241 - RNA, 23 nt, Homo sapiens
uaagucacacagauuaauuuauu

SEQ ID NO: 253242 - RNA, 22 nt, Homo sapiens
uaagucuuuuuggaguuuauaa

SEQ ID NO: 253243 - RNA, 22 nt, Homo sapiens
uaagugaauguuggcuacugaa

SEQ ID NO: 253244 - RNA, 22 nt, Homo sapiens
uaagugcaugauuacaugcaua

SEQ ID NO: 253245 - RNA, 22 nt, Homo sapiens
uaagugcuguguuguuaccuaa

SEQ ID NO: 253246 - RNA, 20 nt, Homo sapiens
uaagugcuugagacuucuga

SEQ ID NO: 253247 - RNA, 22 nt, Homo sapiens
uaaguucauucaugaaacuuag

SEQ ID NO: 253248 - RNA, 22 nt, Homo sapiens
uaaguuguagaacguuuucuua

SEQ ID NO: 253249 - RNA, 22 nt, Homo sapiens
uaauaauguuaggcuuacucaa

SEQ ID NO: 253250 - RNA, 22 nt, Homo sapiens
uaauacauucaaggugguaguu

SEQ ID NO: 253251 - RNA, 22 nt, Homo sapiens
uaauacuagugaauagcaggau

SEQ ID NO: 253252 - RNA, 22 nt, Homo sapiens
uaauacuugucauaaaggcauu

SEQ ID NO: 253253 - RNA, 22 nt, Homo sapiens
uaauaguuggcacuggagaaag

SEQ ID NO: 253254 - RNA, 22 nt, Homo sapiens
uaauauguauacagacagauac

SEQ ID NO: 253255 - RNA, 22 nt, Homo sapiens
uaauaugugguugcuugggcac

SEQ ID NO: 253256 - RNA, 22 nt, Homo sapiens
uaauauguuuugaaaucaggaa

SEQ ID NO: 253257 - RNA, 22 nt, Homo sapiens
uaauccuagcacuuuggaagac

SEQ ID NO: 253258 - RNA, 22 nt, Homo sapiens
uaaugcuaucugggccaggggu

SEQ ID NO: 253259 - RNA, 22 nt, Homo sapiens
uaaugcuugguuguuuggaaaa

SEQ ID NO: 253260 - RNA, 22 nt, Homo sapiens
uaauucugacaacaguggcguu

SEQ ID NO: 253261 - RNA, 22 nt, Homo sapiens
uaauucuguauguaucagaguu

SEQ ID NO: 253262 - RNA, 22 nt, Homo sapiens
uaauuggaucucaaaaaagugu

SEQ ID NO: 253263 - RNA, 22 nt, Homo sapiens
uacaaguaauaagggaagaauu

SEQ ID NO: 253264 - RNA, 22 nt, Homo sapiens
uacaccugaguuugugguuuuc

SEQ ID NO: 253265 - RNA, 22 nt, Homo sapiens
uacagaauauuucugcccugag

SEQ ID NO: 253266 - RNA, 22 nt, Homo sapiens
uacagaguagaagauuugcaga

SEQ ID NO: 253267 - RNA, 22 nt, Homo sapiens
uacagaguauccauuugaguuc

SEQ ID NO: 253268 - RNA, 22 nt, Homo sapiens
uacagcacaggugcagguguug

SEQ ID NO: 253269 - RNA, 23 nt, Homo sapiens
uacagcugcagaaucaggcuaag

SEQ ID NO: 253270 - RNA, 19 nt, Homo sapiens
uacaggacugagcugaggu

SEQ ID NO: 253271 - RNA, 22 nt, Homo sapiens
uacagguauagauguguguucu

SEQ ID NO: 253272 - RNA, 22 nt, Homo sapiens
uacaggugcucuacagacagga

SEQ ID NO: 253273 - RNA, 22 nt, Homo sapiens
uacaguaguaucuucauuuguu

SEQ ID NO: 253274 - RNA, 22 nt, Homo sapiens
uacagucuggaggccuguguug

SEQ ID NO: 253275 - RNA, 22 nt, Homo sapiens
uacaugcaugggcaugugugca

SEQ ID NO: 253276 - RNA, 22 nt, Homo sapiens
uaccaaaguuucggccucuguu

SEQ ID NO: 253277 - RNA, 22 nt, Homo sapiens
uaccacccuuuuuccagaagcc

SEQ ID NO: 253278 - RNA, 22 nt, Homo sapiens
uaccaguaaugguucuagagga

SEQ ID NO: 253279 - RNA, 22 nt, Homo sapiens
uacccucuggauacccuuguuc

SEQ ID NO: 253280 - RNA, 22 nt, Homo sapiens
uacgccuguaauaucagcauuu

SEQ ID NO: 253281 - RNA, 22 nt, Homo sapiens
uacguuaucagguaugcaagag

SEQ ID NO: 253282 - RNA, 22 nt, Homo sapiens
uacuccccuuguucugugagcu

SEQ ID NO: 253283 - RNA, 20 nt, Homo sapiens
uacugcacuccaaccuaggc

SEQ ID NO: 253284 - RNA, 22 nt, Homo sapiens
uacugcacuccagccuggguga

SEQ ID NO: 253285 - RNA, 19 nt, Homo sapiens
uacugcacuccagucuggg

SEQ ID NO: 253286 - RNA, 22 nt, Homo sapiens
cugagguacugggggccaggau

SEQ ID NO: 253287 - RNA, 22 nt, Homo sapiens
cugagguagcucaggguauugc

SEQ ID NO: 253288 - RNA, 22 nt, Homo sapiens
cugagguaggcccugagaauau

SEQ ID NO: 253289 - RNA, 22 nt, Homo sapiens
cugagguaggugaucagugcuu

SEQ ID NO: 253290 - RNA, 20 nt, Homo sapiens
cugaggugggagaaucgcuu

SEQ ID NO: 253291 - RNA, 22 nt, Homo sapiens
cugaggugggaggauuggcuug

SEQ ID NO: 253292 - RNA, 22 nt, Homo sapiens
cugauaguucucuuuagaguuu

SEQ ID NO: 253293 - RNA, 22 nt, Homo sapiens
cugauuguagagccccagggcu

SEQ ID NO: 253294 - RNA, 22 nt, Homo sapiens
cugauugugcagagguguaauu

SEQ ID NO: 253295 - RNA, 21 nt, Homo sapiens
cugcaaaugcugcugccugau

SEQ ID NO: 253296 - RNA, 21 nt, Homo sapiens
cugcauccauuucugagugau

SEQ ID NO: 253297 - RNA, 22 nt, Homo sapiens
cugccaguuugauucgggccac

SEQ ID NO: 253298 - RNA, 22 nt, Homo sapiens
cuggacaaaucuggaaagaacc

SEQ ID NO: 253299 - RNA, 22 nt, Homo sapiens
cuggacguugaggcugcaguga

SEQ ID NO: 253300 - RNA, 22 nt, Homo sapiens
cuggagcauugguggauuuguu

SEQ ID NO: 253301 - RNA, 22 nt, Homo sapiens
cuggauagagauugaugaugcu

SEQ ID NO: 253302 - RNA, 22 nt, Homo sapiens
cuggauagucaggagauauaua

SEQ ID NO: 253303 - RNA, 22 nt, Homo sapiens
cuggauggugagauaaagaaaa

SEQ ID NO: 253304 - RNA, 22 nt, Homo sapiens
cuggcaaaaagagggcaauaau

SEQ ID NO: 253305 - RNA, 22 nt, Homo sapiens
cuggcagucugccucuucacug

SEQ ID NO: 253306 - RNA, 22 nt, Homo sapiens
cuggcucuguuagaagaaccag

SEQ ID NO: 253307 - RNA, 22 nt, Homo sapiens
cugggaucaguucuagucagaa

SEQ ID NO: 253308 - RNA, 22 nt, Homo sapiens
cuggguacccuuuaaacaggaa

SEQ ID NO: 253309 - RNA, 21 nt, Homo sapiens
cugguccccuuuauguaugug

SEQ ID NO: 253310 - RNA, 22 nt, Homo sapiens
cuguaaaguaagagguaaguua

SEQ ID NO: 253311 - RNA, 22 nt, Homo sapiens
cugucacugggaggggcagcag

SEQ ID NO: 253312 - RNA, 22 nt, Homo sapiens
cuguccugcagagucagaauga

SEQ ID NO: 253313 - RNA, 22 nt, Homo sapiens
cugugaacaugggagaaauggc

SEQ ID NO: 253314 - RNA, 22 nt, Homo sapiens
cugugcaugcgcggagcugaaa

SEQ ID NO: 253315 - RNA, 22 nt, Homo sapiens
cugugcuugagagaugacacag

SEQ ID NO: 253316 - RNA, 22 nt, Homo sapiens
uggguagauaucauaguugccc

SEQ ID NO: 253317 - RNA, 22 nt, Homo sapiens
uggguaggaccagaaaugcacu

SEQ ID NO: 253318 - RNA, 22 nt, Homo sapiens
uggguaguguaaagcacuccag

SEQ ID NO: 253319 - RNA, 19 nt, Homo sapiens
uggguaguuuucuggcugg

SEQ ID NO: 253320 - RNA, 22 nt, Homo sapiens
ugggucaguagcauguaugucu

SEQ ID NO: 253321 - RNA, 22 nt, Homo sapiens
ugguaguuucuguaucucacag

SEQ ID NO: 253322 - RNA, 22 nt, Homo sapiens
ugguauguauacuagcgacacu

SEQ ID NO: 253323 - RNA, 22 nt, Homo sapiens
uggucagaugcugaguggaucu

SEQ ID NO: 253324 - RNA, 22 nt, Homo sapiens
ugguccuuuccauuggagacac

SEQ ID NO: 253325 - RNA, 22 nt, Homo sapiens
uggucuccuuuguacccugggc

SEQ ID NO: 253326 - RNA, 22 nt, Homo sapiens
uggucucuuugcuuuagucauc

SEQ ID NO: 253327 - RNA, 22 nt, Homo sapiens
uggucuucuggccuccagaacc

SEQ ID NO: 253328 - RNA, 22 nt, Homo sapiens
uggugagaaaagaugucuuugu

SEQ ID NO: 253329 - RNA, 22 nt, Homo sapiens
uggugcaaauguaauugugguu

SEQ ID NO: 253330 - RNA, 22 nt, Homo sapiens
uggugcccuguccuucuguggc

SEQ ID NO: 253331 - RNA, 22 nt, Homo sapiens
uggugccgugguccuggggcca

SEQ ID NO: 253332 - RNA, 22 nt, Homo sapiens
ugguguuugagaagcugauguc

SEQ ID NO: 253333 - RNA, 18 nt, Homo sapiens
uguaaacuaccucaaccu

SEQ ID NO: 253334 - RNA, 22 nt, Homo sapiens
uguaaacuaugagcugauuauu

SEQ ID NO: 253335 - RNA, 21 nt, Homo sapiens
uguaacugcaaaccucagauu

SEQ ID NO: 253336 - RNA, 22 nt, Homo sapiens
uguaagugugcaauucagugau

SEQ ID NO: 253337 - RNA, 22 nt, Homo sapiens
uguaaugaucaaaucagaguaa

SEQ ID NO: 253338 - RNA, 22 nt, Homo sapiens
uguacaaaacaagaugggggua

SEQ ID NO: 253339 - RNA, 22 nt, Homo sapiens
uguacccuuagagagugaucga

SEQ ID NO: 253340 - RNA, 22 nt, Homo sapiens
uguacuucaagauuaugguuua

SEQ ID NO: 253341 - RNA, 22 nt, Homo sapiens
uguagacaccaaagacagcaua

SEQ ID NO: 253342 - RNA, 22 nt, Homo sapiens
uguagcaaauaaaagucuggau

SEQ ID NO: 253343 - RNA, 22 nt, Homo sapiens
uguagggagagggaguugcacc

SEQ ID NO: 253344 - RNA, 21 nt, Homo sapiens
uguauacauggaagaaugguc

SEQ ID NO: 253345 - RNA, 22 nt, Homo sapiens
uguauaguugagucaaguuuca

SEQ ID NO: 253346 - RNA, 22 nt, Homo sapiens
uguauguaauugaaguuaaguu

SEQ ID NO: 253347 - RNA, 22 nt, Homo sapiens
uguauguugggucaaaguacau

SEQ ID NO: 253348 - RNA, 22 nt, Homo sapiens
ugucaaagagacaucugcacuc

SEQ ID NO: 253349 - RNA, 22 nt, Homo sapiens
ugucaaauucuggguuaaaaca

SEQ ID NO: 253350 - RNA, 21 nt, Homo sapiens
ugucaagaugacugcugcggc

SEQ ID NO: 253351 - RNA, 22 nt, Homo sapiens
ugucacagagauuuugguaugu

SEQ ID NO: 253352 - RNA, 22 nt, Homo sapiens
ugucacaguuuguacuuuauag

SEQ ID NO: 253353 - RNA, 22 nt, Homo sapiens
ugucacccuuuauccauuuccu

SEQ ID NO: 253354 - RNA, 18 nt, Homo sapiens
ugucacuggauaaugguc

SEQ ID NO: 253355 - RNA, 22 nt, Homo sapiens
ugucacugugcagucaugcauu

SEQ ID NO: 253356 - RNA, 22 nt, Homo sapiens
ugucagaaucuagaggcugcua

SEQ ID NO: 253357 - RNA, 22 nt, Homo sapiens
ugucagaaucugagacgacaac

SEQ ID NO: 253358 - RNA, 22 nt, Homo sapiens
ugucaggaugcuccuuuuggcu

SEQ ID NO: 253359 - RNA, 22 nt, Homo sapiens
ugucaguggacugugaaaggca

SEQ ID NO: 253360 - RNA, 21 nt, Homo sapiens
ugucaguuuccagaguucaac

SEQ ID NO: 253361 - RNA, 22 nt, Homo sapiens
ugucaucauuggaaucugccuc

SEQ ID NO: 253362 - RNA, 22 nt, Homo sapiens
ugucaucuagguauuaagcccc

SEQ ID NO: 253363 - RNA, 22 nt, Homo sapiens
ugucaucuagguuuuaagccuu

SEQ ID NO: 253364 - RNA, 22 nt, Homo sapiens
ugucaugaacucacauucuggg

SEQ ID NO: 253365 - RNA, 22 nt, Homo sapiens
ugucauguugagaaacuuggau

SEQ ID NO: 253366 - RNA, 16 nt, Homo sapiens
uguccaaauaaauaca

SEQ ID NO: 253367 - RNA, 18 nt, Homo sapiens
ugucccuuugcuguucau

SEQ ID NO: 253368 - RNA, 22 nt, Homo sapiens
ugucuacugaugauguaguuaa

SEQ ID NO: 253369 - RNA, 22 nt, Homo sapiens
ugucuggaguccauagaagugu

SEQ ID NO: 253370 - RNA, 22 nt, Homo sapiens
ugucuuagagauaaagaaugaa

SEQ ID NO: 253371 - RNA, 22 nt, Homo sapiens
ugucuuugguucaggcaaggag

SEQ ID NO: 253372 - RNA, 22 nt, Homo sapiens
ugugaacaaaauuuguugcaua

SEQ ID NO: 253373 - RNA, 20 nt, Homo sapiens
ugugaacuguagauagucuu

SEQ ID NO: 253374 - RNA, 22 nt, Homo sapiens
ugugaaugaagaaugcuaaccu

SEQ ID NO: 253375 - RNA, 22 nt, Homo sapiens
ugugaauguaaccuuauuugga

SEQ ID NO: 253376 - RNA, 22 nt, Homo sapiens
ugugacagguauccuguguucu

SEQ ID NO: 253377 - RNA, 22 nt, Homo sapiens
ugugaugaagaguccaagaaca

SEQ ID NO: 253378 - RNA, 22 nt, Homo sapiens
ugugauguggagggcagaucca

SEQ ID NO: 253379 - RNA, 22 nt, Homo sapiens
ugugcacaacgugcagguuugu

SEQ ID NO: 253380 - RNA, 22 nt, Homo sapiens
ugugcacaaugugcagguuugu

SEQ ID NO: 253381 - RNA, 23 nt, Homo sapiens
ugugcacauuuacauauauacac

SEQ ID NO: 253382 - RNA, 22 nt, Homo sapiens
ugugcacuggaccuugucuucu

SEQ ID NO: 253383 - RNA, 22 nt, Homo sapiens
ugugcauaugucuuuauaguag

SEQ ID NO: 253384 - RNA, 22 nt, Homo sapiens
ugugccacugcacucccgccug

SEQ ID NO: 253385 - RNA, 22 nt, Homo sapiens
ugugccacugcacuccugggug

SEQ ID NO: 253386 - RNA, 22 nt, Homo sapiens
ugugccacugcacucugggcaa

SEQ ID NO: 253387 - RNA, 22 nt, Homo sapiens
ugugccacugcacuucagccug

SEQ ID NO: 253388 - RNA, 20 nt, Homo sapiens
aucacuggagaaggaaaccu

SEQ ID NO: 253389 - RNA, 22 nt, Homo sapiens
aucacugugauuucuacugugc

SEQ ID NO: 253390 - RNA, 16 nt, Homo sapiens
aucacuugcuucuuuu

SEQ ID NO: 253391 - RNA, 22 nt, Homo sapiens
aucagaaucucuagugggacca

SEQ ID NO: 253392 - RNA, 21 nt, Homo sapiens
aucagagacccaggcuuccuc

SEQ ID NO: 253393 - RNA, 22 nt, Homo sapiens
aucagagccugugugcccugaa

SEQ ID NO: 253394 - RNA, 22 nt, Homo sapiens
aucagauaccuguugggaaaug

SEQ ID NO: 253395 - RNA, 22 nt, Homo sapiens
aucagcacugaucauacagcuu

SEQ ID NO: 253396 - RNA, 22 nt, Homo sapiens
aucagcagcaugaaaacaggcu

SEQ ID NO: 253397 - RNA, 22 nt, Homo sapiens
aucagcagcaugaaaagcaacu

SEQ ID NO: 253398 - RNA, 22 nt, Homo sapiens
aucaggaaccuuuuuggugugu

SEQ ID NO: 253399 - RNA, 22 nt, Homo sapiens
aucagugagugguuagugaaug

SEQ ID NO: 253400 - RNA, 22 nt, Homo sapiens
aucauacuguuuugauuacugu

SEQ ID NO: 253401 - RNA, 22 nt, Homo sapiens
aucauccagccccagaagggag

SEQ ID NO: 253402 - RNA, 22 nt, Homo sapiens
auccacagugucaauguuguga

SEQ ID NO: 253403 - RNA, 22 nt, Homo sapiens
auccacaugcaguuggaaacag

SEQ ID NO: 253404 - RNA, 23 nt, Homo sapiens
auccacauucuaguccuuuaugc

SEQ ID NO: 253405 - RNA, 22 nt, Homo sapiens
auccaguuuuaggagauuucua

SEQ ID NO: 253406 - RNA, 22 nt, Homo sapiens
aucccuugacguggagucucug

SEQ ID NO: 253407 - RNA, 22 nt, Homo sapiens
auccucaguggcuuaaguauag

SEQ ID NO: 253408 - RNA, 22 nt, Homo sapiens
auccuguaggcuaguagacagu

SEQ ID NO: 253409 - RNA, 22 nt, Homo sapiens
auccuuuagacuguccaguuga

SEQ ID NO: 253410 - RNA, 22 nt, Homo sapiens
aucgcaccauugcacuccagca

SEQ ID NO: 253411 - RNA, 20 nt, Homo sapiens
aucucugggcaaaggaaaau

SEQ ID NO: 253412 - RNA, 22 nt, Homo sapiens
aucucuugccagucagaauggu

SEQ ID NO: 253413 - RNA, 22 nt, Homo sapiens
aucugcauucccauguuuauug

SEQ ID NO: 253414 - RNA, 22 nt, Homo sapiens
aucugugaaugaaguuauuuug

SEQ ID NO: 253415 - RNA, 22 nt, Homo sapiens
aucuuugauuguagguacaaug

SEQ ID NO: 253416 - RNA, 22 nt, Homo sapiens
aucuuuggugaguucuuugguc

SEQ ID NO: 253417 - RNA, 22 nt, Homo sapiens
augaaaacaugauuugccuguu

SEQ ID NO: 253418 - RNA, 22 nt, Homo sapiens
augaaaagcauaaacgcugaag

SEQ ID NO: 253419 - RNA, 22 nt, Homo sapiens
augaaacuggagcgccuggagg

SEQ ID NO: 253420 - RNA, 22 nt, Homo sapiens
augaaagugauaaaugucucua

SEQ ID NO: 253421 - RNA, 22 nt, Homo sapiens
augaaaguguguggaaacuuga

SEQ ID NO: 253422 - RNA, 22 nt, Homo sapiens
augaaauguaugagucuggguu

SEQ ID NO: 253423 - RNA, 18 nt, Homo sapiens
augaagucaucacuuuua

SEQ ID NO: 253424 - RNA, 17 nt, Homo sapiens
augaagucaucauuuuu

SEQ ID NO: 253425 - RNA, 20 nt, Homo sapiens
augaagugaaguuagggaac

SEQ ID NO: 253426 - RNA, 22 nt, Homo sapiens
augaaguguguguucaagucuu

SEQ ID NO: 253427 - RNA, 22 nt, Homo sapiens
augaauccauuccugccacaga

SEQ ID NO: 253428 - RNA, 22 nt, Homo sapiens
augaauguaaagaaugugggaa

SEQ ID NO: 253429 - RNA, 20 nt, Homo sapiens
augaauguccuugauggcau

SEQ ID NO: 253430 - RNA, 22 nt, Homo sapiens
augaccagagguaugauguuug

SEQ ID NO: 253431 - RNA, 21 nt, Homo sapiens
augacccuggguguccuuucc

SEQ ID NO: 253432 - RNA, 22 nt, Homo sapiens
augaccuuggggaaccaugucu

SEQ ID NO: 253433 - RNA, 22 nt, Homo sapiens
augacucagaucuguuccuggu

SEQ ID NO: 253434 - RNA, 22 nt, Homo sapiens
augacuggaacggcacuuuaca

SEQ ID NO: 253435 - RNA, 22 nt, Homo sapiens
augacugucagggcagucauug

SEQ ID NO: 253436 - RNA, 19 nt, Homo sapiens
augagaacagacuccauuu

SEQ ID NO: 253437 - RNA, 18 nt, Homo sapiens
augagagccgauuccugg

SEQ ID NO: 253438 - RNA, 22 nt, Homo sapiens
augagauaaaccaucucuuaag

SEQ ID NO: 253439 - RNA, 22 nt, Homo sapiens
augagauaggaacaaacuuaca

SEQ ID NO: 253440 - RNA, 22 nt, Homo sapiens
augagauuauguaaagagacca

SEQ ID NO: 253441 - RNA, 22 nt, Homo sapiens
augagcuauggagacagggcca

SEQ ID NO: 253442 - RNA, 22 nt, Homo sapiens
augaggcacugcgcccuacuga

SEQ ID NO: 253443 - RNA, 22 nt, Homo sapiens
augaggcuauaauuuuuaugua

SEQ ID NO: 253444 - RNA, 22 nt, Homo sapiens
augagggaagcucacgugucca

SEQ ID NO: 253445 - RNA, 22 nt, Homo sapiens
augagguauccaagcccagaaa

SEQ ID NO: 253446 - RNA, 22 nt, Homo sapiens
augaggugaggucaguaaggua

SEQ ID NO: 253447 - RNA, 22 nt, Homo sapiens
augaggugggcggcuuggaaga

SEQ ID NO: 253448 - RNA, 22 nt, Homo sapiens
augaguaguugcuaaauauuga

SEQ ID NO: 253449 - RNA, 18 nt, Homo sapiens
augagucauuguggaaau

SEQ ID NO: 253450 - RNA, 19 nt, Homo sapiens
augagucugcaagaaccag

SEQ ID NO: 253451 - RNA, 22 nt, Homo sapiens
augagugugaccugccaagaga

SEQ ID NO: 253452 - RNA, 22 nt, Homo sapiens
augauauggucacccuuaugaa

SEQ ID NO: 253453 - RNA, 22 nt, Homo sapiens
augaucacaccacugcacucca

SEQ ID NO: 253454 - RNA, 22 nt, Homo sapiens
augaugaaguaagugcuuagga

SEQ ID NO: 253455 - RNA, 22 nt, Homo sapiens
augaugcugcaguuguugccaa

SEQ ID NO: 253456 - RNA, 22 nt, Homo sapiens
augauggagguagauuguccau

SEQ ID NO: 253457 - RNA, 22 nt, Homo sapiens
augauugaccaucugcugggcu

SEQ ID NO: 253458 - RNA, 22 nt, Homo sapiens
augauuuuuguaucgccugaug

SEQ ID NO: 253459 - RNA, 22 nt, Homo sapiens
augcacaugcgaaaacuugugu

SEQ ID NO: 253460 - RNA, 22 nt, Homo sapiens
augcacauggcuaacuuuuuuc

SEQ ID NO: 253461 - RNA, 22 nt, Homo sapiens
augccacugcacuucagccugc

SEQ ID NO: 253462 - RNA, 22 nt, Homo sapiens
augccacugcacuucagcuugg

SEQ ID NO: 253463 - RNA, 22 nt, Homo sapiens
augccuaagacccuguggggga

SEQ ID NO: 253464 - RNA, 22 nt, Homo sapiens
augccucugacaauuggauucu

SEQ ID NO: 253465 - RNA, 22 nt, Homo sapiens
auggaacauaacuauuugggga

SEQ ID NO: 253466 - RNA, 22 nt, Homo sapiens
auggaacauuauagauguaaaa

SEQ ID NO: 253467 - RNA, 19 nt, Homo sapiens
auggaacugcuggagccac

SEQ ID NO: 253468 - RNA, 22 nt, Homo sapiens
auggaagcugauuagauaguac

SEQ ID NO: 253469 - RNA, 22 nt, Homo sapiens
auggaaggagaggaaugaauga

SEQ ID NO: 253470 - RNA, 22 nt, Homo sapiens
auggaagucucuguuaaguuuc

SEQ ID NO: 253471 - RNA, 22 nt, Homo sapiens
auggaaugguugggucauaagg

SEQ ID NO: 253472 - RNA, 22 nt, Homo sapiens
auggaauguaaguuauguuugc

SEQ ID NO: 253473 - RNA, 22 nt, Homo sapiens
auggagcuugacaguuguagag

SEQ ID NO: 253474 - RNA, 22 nt, Homo sapiens
auggaucauauucuugaggagg

SEQ ID NO: 253475 - RNA, 22 nt, Homo sapiens
auggauguucuagggaugugau

SEQ ID NO: 253476 - RNA, 22 nt, Homo sapiens
auggcaaaaaaugcaauuacuu

SEQ ID NO: 253477 - RNA, 22 nt, Homo sapiens
auggcacagacucuuggucaag

SEQ ID NO: 253478 - RNA, 22 nt, Homo sapiens
auggcacagaguagaugcucaa

SEQ ID NO: 253479 - RNA, 22 nt, Homo sapiens
auggcacuaaugggaguuuacu

SEQ ID NO: 253480 - RNA, 22 nt, Homo sapiens
auggcagagucagaaagucagg

SEQ ID NO: 253481 - RNA, 22 nt, Homo sapiens
auggcaguuuggucucugugcu

SEQ ID NO: 253482 - RNA, 22 nt, Homo sapiens
auggccauuacuaagaauguuu

SEQ ID NO: 253483 - RNA, 23 nt, Homo sapiens
auggcccuggugggagugucuuu

SEQ ID NO: 253484 - RNA, 22 nt, Homo sapiens
auggccugaugcaccuguccca

SEQ ID NO: 253485 - RNA, 22 nt, Homo sapiens
auggccuuguauaccuggcaaa

SEQ ID NO: 253486 - RNA, 22 nt, Homo sapiens
auggccuuuacaauuugguaug

SEQ ID NO: 253487 - RNA, 22 nt, Homo sapiens
auggcucuuauuauuugaggua

SEQ ID NO: 253488 - RNA, 22 nt, Homo sapiens
auggcugugaaaugguaggugg

SEQ ID NO: 253489 - RNA, 22 nt, Homo sapiens
auggcuugugacccaugcuuca

SEQ ID NO: 253490 - RNA, 18 nt, Homo sapiens
uccuuuugggguaggaga

SEQ ID NO: 253491 - RNA, 22 nt, Homo sapiens
ucgcauggucuccaggcagcuc

SEQ ID NO: 253492 - RNA, 22 nt, Homo sapiens
ucgcgccauucuccugccucag

SEQ ID NO: 253493 - RNA, 22 nt, Homo sapiens
ucgugccacugcacuccagccu

SEQ ID NO: 253494 - RNA, 22 nt, Homo sapiens
ucuaaaacuagauugugaugau

SEQ ID NO: 253495 - RNA, 22 nt, Homo sapiens
ucuaaggcaccuagagucauca

SEQ ID NO: 253496 - RNA, 17 nt, Homo sapiens
ucuaauaauaugcauuu

SEQ ID NO: 253497 - RNA, 22 nt, Homo sapiens
ucuaauguaaccugcaaauauu

SEQ ID NO: 253498 - RNA, 22 nt, Homo sapiens
ucuauggaguuugaaugagaaa

SEQ ID NO: 253499 - RNA, 22 nt, Homo sapiens
ucuauguuuuugcuaguagugu

SEQ ID NO: 253500 - RNA, 22 nt, Homo sapiens
ucucagcacagucagggcgccu

SEQ ID NO: 253501 - RNA, 22 nt, Homo sapiens
ucucagcggacaggccggccag

SEQ ID NO: 253502 - RNA, 22 nt, Homo sapiens
ucucagugaauguggaaaaagc

SEQ ID NO: 253503 - RNA, 19 nt, Homo sapiens
ucucaguguuggucaggug

SEQ ID NO: 253504 - RNA, 22 nt, Homo sapiens
ucucauggagucaggagcagaa

SEQ ID NO: 253505 - RNA, 21 nt, Homo sapiens
ucucauugugguuuuaauugg

SEQ ID NO: 253506 - RNA, 22 nt, Homo sapiens
ucucugguuuucaaagcaguau

SEQ ID NO: 253507 - RNA, 22 nt, Homo sapiens
ucucuguuuagagccagcaauu

SEQ ID NO: 253508 - RNA, 22 nt, Homo sapiens
ucucuguuugucuguuacuggu

SEQ ID NO: 253509 - RNA, 19 nt, Homo sapiens
ucugacagccccagucaac

SEQ ID NO: 253510 - RNA, 22 nt, Homo sapiens
ucugacucuggagucucagguu

SEQ ID NO: 253511 - RNA, 22 nt, Homo sapiens
ucugagcaauaaacaacauauu

SEQ ID NO: 253512 - RNA, 22 nt, Homo sapiens
ucugagucaucacaaaugaugc

SEQ ID NO: 253513 - RNA, 20 nt, Homo sapiens
ucugauugcaacugcaugag

SEQ ID NO: 253514 - RNA, 22 nt, Homo sapiens
ucugccaaccacaaaauuuauu

SEQ ID NO: 253515 - RNA, 22 nt, Homo sapiens
ucugccacugucauugugugau

SEQ ID NO: 253516 - RNA, 22 nt, Homo sapiens
ucugccuacugagcacacagug

SEQ ID NO: 253517 - RNA, 22 nt, Homo sapiens
ucuggauuuuugaggcaauaua

SEQ ID NO: 253518 - RNA, 22 nt, Homo sapiens
ucuggcauuuucucugcuugca

SEQ ID NO: 253519 - RNA, 20 nt, Homo sapiens
ucuggccccuccaaaucuca

SEQ ID NO: 253520 - RNA, 20 nt, Homo sapiens
ucuggccccucuaaaucuca

SEQ ID NO: 253521 - RNA, 21 nt, Homo sapiens
ucuggcuuucauuccccuucu

SEQ ID NO: 253522 - RNA, 22 nt, Homo sapiens
ucuggcuuugugaguugccaga

SEQ ID NO: 253523 - RNA, 22 nt, Homo sapiens
ucuggguuuuguaccgugcucg

SEQ ID NO: 253524 - RNA, 22 nt, Homo sapiens
ucugguggugaugagagacagu

SEQ ID NO: 253525 - RNA, 22 nt, Homo sapiens
ucuguacugccaaguuucuuua

SEQ ID NO: 253526 - RNA, 22 nt, Homo sapiens
ucuguaguuaacagcuucagcu

SEQ ID NO: 253527 - RNA, 22 nt, Homo sapiens
ucugugcauuacacuuuucuca

SEQ ID NO: 253528 - RNA, 22 nt, Homo sapiens
ucugugcauuguaacaacuaaa

SEQ ID NO: 253529 - RNA, 22 nt, Homo sapiens
ucugugguaagaaacgcauguc

SEQ ID NO: 253530 - RNA, 22 nt, Homo sapiens
ucugugguuguugcauggaaug

SEQ ID NO: 253531 - RNA, 22 nt, Homo sapiens
ucuguguuuagacccaggguag

SEQ ID NO: 253532 - RNA, 22 nt, Homo sapiens
ucuguuguuaucauaauauuga

SEQ ID NO: 253533 - RNA, 22 nt, Homo sapiens
ucuuagugcggcugcugcagcc

SEQ ID NO: 253534 - RNA, 22 nt, Homo sapiens
ucuuauuuggggaaaggguccu

SEQ ID NO: 253535 - RNA, 22 nt, Homo sapiens
ucuucaugcuugaaauaauagc

SEQ ID NO: 253536 - RNA, 19 nt, Homo sapiens
ucuugcacaugugaacuca

SEQ ID NO: 253537 - RNA, 22 nt, Homo sapiens
ucuugcaccuacaugcuuuguc

SEQ ID NO: 253538 - RNA, 22 nt, Homo sapiens
ucuuggguggauucauucuuuc

SEQ ID NO: 253539 - RNA, 21 nt, Homo sapiens
ucuuggguugaauucucccag

SEQ ID NO: 253540 - RNA, 22 nt, Homo sapiens
ucuugguuaggggaaauaggca

SEQ ID NO: 253541 - RNA, 23 nt, Homo sapiens
ucuugguuauagaaaaauaguug

SEQ ID NO: 253542 - RNA, 22 nt, Homo sapiens
ucuugguuuauugauggagagg

SEQ ID NO: 253543 - RNA, 22 nt, Homo sapiens
ucuuuagugacaguugugcaag

SEQ ID NO: 253544 - RNA, 22 nt, Homo sapiens
ucuuucacuuagcaugauguuu

SEQ ID NO: 253545 - RNA, 19 nt, Homo sapiens
ucuuugaggcaucgcccuc

SEQ ID NO: 253546 - RNA, 22 nt, Homo sapiens
ucuuugauguucugaaagaugg

SEQ ID NO: 253547 - RNA, 22 nt, Homo sapiens
ucuuugauuuuguuacuaagac

SEQ ID NO: 253548 - RNA, 19 nt, Homo sapiens
ucuuugcuuuucuaagagg

SEQ ID NO: 253549 - RNA, 22 nt, Homo sapiens
ucuuuggcugugaagaauaaug

SEQ ID NO: 253550 - RNA, 22 nt, Homo sapiens
ucuuugguaugugcaugugcuu

SEQ ID NO: 253551 - RNA, 22 nt, Homo sapiens
ucuuugguauuuguggggaauu

SEQ ID NO: 253552 - RNA, 22 nt, Homo sapiens
ucuuuggucagaaagauuacac

SEQ ID NO: 253553 - RNA, 22 nt, Homo sapiens
ucuuugguucugugcagccuau

SEQ ID NO: 253554 - RNA, 22 nt, Homo sapiens
ucuuugguuucugucucuguaa

SEQ ID NO: 253555 - RNA, 22 nt, Homo sapiens
ucuuuguuagaacccucuccuu

SEQ ID NO: 253556 - RNA, 22 nt, Homo sapiens
ucuuuguuuucugauccugaag

SEQ ID NO: 253557 - RNA, 20 nt, Homo sapiens
ucuuuuuguggccccagagu

SEQ ID NO: 253558 - RNA, 22 nt, Homo sapiens
ugaaacacaccuccucuccauc

SEQ ID NO: 253559 - RNA, 22 nt, Homo sapiens
ugaaacugcagugggcuuggca

SEQ ID NO: 253560 - RNA, 22 nt, Homo sapiens
aggcaagaaugcuuguuucacc

SEQ ID NO: 253561 - RNA, 16 nt, Homo sapiens
aggcaagaauugaggu

SEQ ID NO: 253562 - RNA, 21 nt, Homo sapiens
aggcaagauuacuuacgagca

SEQ ID NO: 253563 - RNA, 22 nt, Homo sapiens
aggcaugauggcuccagaucau

SEQ ID NO: 253564 - RNA, 22 nt, Homo sapiens
aggcauguggcucuguucugac

SEQ ID NO: 253565 - RNA, 22 nt, Homo sapiens
aggcaugugugcagacugucug

SEQ ID NO: 253566 - RNA, 19 nt, Homo sapiens
aggcauugugcucaucugu

SEQ ID NO: 253567 - RNA, 22 nt, Homo sapiens
aggcuagaaucuuccaucuugg

SEQ ID NO: 253568 - RNA, 22 nt, Homo sapiens
agggcuuaucuguguagaguuc

SEQ ID NO: 253569 - RNA, 22 nt, Homo sapiens
aggguuuuuauuuauguggcau

SEQ ID NO: 253570 - RNA, 20 nt, Homo sapiens
agguacacugacaugccuuc

SEQ ID NO: 253571 - RNA, 20 nt, Homo sapiens
agguagauagaugauagaua

SEQ ID NO: 253572 - RNA, 22 nt, Homo sapiens
agguauauuggacagauguaaa

SEQ ID NO: 253573 - RNA, 22 nt, Homo sapiens
agguauguauguaugggagaaa

SEQ ID NO: 253574 - RNA, 22 nt, Homo sapiens
aggucaccucaggaaauacuga

SEQ ID NO: 253575 - RNA, 22 nt, Homo sapiens
aggugcugagcagagaauccug

SEQ ID NO: 253576 - RNA, 22 nt, Homo sapiens
aggugguuuugaugagcaggua

SEQ ID NO: 253577 - RNA, 21 nt, Homo sapiens
aggugucuuggguucccuggc

SEQ ID NO: 253578 - RNA, 22 nt, Homo sapiens
agguuguugcaugcuccuuagg

SEQ ID NO: 253579 - RNA, 22 nt, Homo sapiens
aguaaauuucugugcuuucaua

SEQ ID NO: 253580 - RNA, 22 nt, Homo sapiens
aguaagauggcaacucuccaca

SEQ ID NO: 253581 - RNA, 22 nt, Homo sapiens
aguacaauguugaguagaagug

SEQ ID NO: 253582 - RNA, 22 nt, Homo sapiens
aguacacuguuaaaaagaagug

SEQ ID NO: 253583 - RNA, 17 nt, Homo sapiens
aguacugucccauccuu

SEQ ID NO: 253584 - RNA, 22 nt, Homo sapiens
aguauguagugcaaucagucag

SEQ ID NO: 253585 - RNA, 22 nt, Homo sapiens
aguauguuuugaaaccaagaag

SEQ ID NO: 253586 - RNA, 22 nt, Homo sapiens
agucagugucuguaaggagaac

SEQ ID NO: 253587 - RNA, 23 nt, Homo sapiens
agucuguguuuacaggcucucug

SEQ ID NO: 253588 - RNA, 22 nt, Homo sapiens
agugaaaucugaagaaggucau

SEQ ID NO: 253589 - RNA, 22 nt, Homo sapiens
agugaaaugucaccuuuuagga

SEQ ID NO: 253590 - RNA, 22 nt, Homo sapiens
agugacaugggaucaaaucuga

SEQ ID NO: 253591 - RNA, 22 nt, Homo sapiens
agugauuuuaacuuccagcaau

SEQ ID NO: 253592 - RNA, 22 nt, Homo sapiens
agugcaaagccgagguuucuug

SEQ ID NO: 253593 - RNA, 22 nt, Homo sapiens
agugcaauaaggauguagaacu

SEQ ID NO: 253594 - RNA, 22 nt, Homo sapiens
agugcaguggcacaaucuuggc

SEQ ID NO: 253595 - RNA, 22 nt, Homo sapiens
agugcaguugucacgugccuuc

SEQ ID NO: 253596 - RNA, 22 nt, Homo sapiens
agugcauugcaucucugcuuca

SEQ ID NO: 253597 - RNA, 22 nt, Homo sapiens
agugcauuugcaucucaauaua

SEQ ID NO: 253598 - RNA, 23 nt, Homo sapiens
agugccuaguauauaggaggcgc

SEQ ID NO: 253599 - RNA, 22 nt, Homo sapiens
aguggauguuguggccugggag

SEQ ID NO: 253600 - RNA, 22 nt, Homo sapiens
aguggcuuuuuaguggcagaug

SEQ ID NO: 253601 - RNA, 19 nt, Homo sapiens
agugggcuagaaaucaggg

SEQ ID NO: 253602 - RNA, 22 nt, Homo sapiens
agugucaggagacagguagcug

SEQ ID NO: 253603 - RNA, 22 nt, Homo sapiens
aguuuugguugaguuacuagca

SEQ ID NO: 253604 - RNA, 22 nt, Homo sapiens
aguuuuugcugauagcaugcuu

SEQ ID NO: 253605 - RNA, 22 nt, Homo sapiens
auaaaagcaggucuaggucagg

SEQ ID NO: 253606 - RNA, 22 nt, Homo sapiens
auaaacagcuuauccucuauuc

SEQ ID NO: 253607 - RNA, 22 nt, Homo sapiens
auaaagccaggagacguaauug

SEQ ID NO: 253608 - RNA, 22 nt, Homo sapiens
auaaagguaauaauaguugcau

SEQ ID NO: 253609 - RNA, 22 nt, Homo sapiens
auaaaguagaggugaggugcau

SEQ ID NO: 253610 - RNA, 22 nt, Homo sapiens
auaaauaguaguugugguggcc

SEQ ID NO: 253611 - RNA, 22 nt, Homo sapiens
auaaaugcuuccagucauuaaa

SEQ ID NO: 253612 - RNA, 22 nt, Homo sapiens
auaaauucauuuaagcuccuua

SEQ ID NO: 253613 - RNA, 22 nt, Homo sapiens
auaacauggaguuugucauuua

SEQ ID NO: 253614 - RNA, 22 nt, Homo sapiens
auaagauaguggaagugggauu

SEQ ID NO: 253615 - RNA, 22 nt, Homo sapiens
auaaggcugguauagacauuca

SEQ ID NO: 253616 - RNA, 22 nt, Homo sapiens
auaauaccugccucagagaguu

SEQ ID NO: 253617 - RNA, 22 nt, Homo sapiens
auaauacuuuuauuuugaggaa

SEQ ID NO: 253618 - RNA, 22 nt, Homo sapiens
auaauaguguuuagauuuggga

SEQ ID NO: 253619 - RNA, 22 nt, Homo sapiens
auaauaucagguugugaugaug

SEQ ID NO: 253620 - RNA, 22 nt, Homo sapiens
auaaucaugucugaaaccuuug

SEQ ID NO: 253621 - RNA, 22 nt, Homo sapiens
auaauguuuauccagaggaguu

SEQ ID NO: 253622 - RNA, 22 nt, Homo sapiens
auaauugcuaagugaagauggu

SEQ ID NO: 253623 - RNA, 22 nt, Homo sapiens
auacaagcaguccaacuccaua

SEQ ID NO: 253624 - RNA, 22 nt, Homo sapiens
auacacgugcagaacaugcagg

SEQ ID NO: 253625 - RNA, 22 nt, Homo sapiens
auacagugaauacuuacagugu

SEQ ID NO: 253626 - RNA, 22 nt, Homo sapiens
auacaguugccauuucuugugc

SEQ ID NO: 253627 - RNA, 22 nt, Homo sapiens
auaccuuuuaggggaacguucu

SEQ ID NO: 253628 - RNA, 22 nt, Homo sapiens
auacuccugucucagcugagau

SEQ ID NO: 253629 - RNA, 22 nt, Homo sapiens
auacuguacugaaguacccauu

SEQ ID NO: 253630 - RNA, 21 nt, Homo sapiens
auacuugagacuggguaauuu

SEQ ID NO: 253631 - RNA, 22 nt, Homo sapiens
auagaaucaucugugcacuagu

SEQ ID NO: 253632 - RNA, 22 nt, Homo sapiens
auagaauguauuaguaaauuug

SEQ ID NO: 253633 - RNA, 22 nt, Homo sapiens
auagcacugguuuuucuugguu

SEQ ID NO: 253634 - RNA, 22 nt, Homo sapiens
auagcauagucagcuucgcuga

SEQ ID NO: 253635 - RNA, 22 nt, Homo sapiens
auagcauaucccacaugucaga

SEQ ID NO: 253636 - RNA, 22 nt, Homo sapiens
auaggagcacgaacucuagugu

SEQ ID NO: 253637 - RNA, 22 nt, Homo sapiens
auaguauaguugaggauggcau

SEQ ID NO: 253638 - RNA, 22 nt, Homo sapiens
auagucaguagucucauaauga

SEQ ID NO: 253639 - RNA, 22 nt, Homo sapiens
auagugcugcaaucaacauaca

SEQ ID NO: 253640 - RNA, 22 nt, Homo sapiens
auagugcuguauuaaacauacg

SEQ ID NO: 253641 - RNA, 22 nt, Homo sapiens
auauagcucuggcuggaugacu

SEQ ID NO: 253642 - RNA, 22 nt, Homo sapiens
auaucaagugacuggaguucca

SEQ ID NO: 253643 - RNA, 22 nt, Homo sapiens
auaucacagguguuuaccugau

SEQ ID NO: 253644 - RNA, 22 nt, Homo sapiens
auauccaugccauagguuuuga

SEQ ID NO: 253645 - RNA, 22 nt, Homo sapiens
auaucugcauugccauuuaugu

SEQ ID NO: 253646 - RNA, 22 nt, Homo sapiens
auaugcauguacccacacaggc

SEQ ID NO: 253647 - RNA, 22 nt, Homo sapiens
auaugccacugaacuguaccca

SEQ ID NO: 253648 - RNA, 22 nt, Homo sapiens
auauggcauucagaacuguaua

SEQ ID NO: 253649 - RNA, 22 nt, Homo sapiens
auaugguacuuaugcucaaacu

SEQ ID NO: 253650 - RNA, 22 nt, Homo sapiens
auauggucccuguucucaagga

SEQ ID NO: 253651 - RNA, 22 nt, Homo sapiens
auaugucuguuuagucuguaau

SEQ ID NO: 253652 - RNA, 22 nt, Homo sapiens
auaugucuuaguuaccuugggc

SEQ ID NO: 253653 - RNA, 22 nt, Homo sapiens
auauucacagguaucagagauu

SEQ ID NO: 253654 - RNA, 22 nt, Homo sapiens
aucaaauugucauuuuaaggau

SEQ ID NO: 253655 - RNA, 22 nt, Homo sapiens
aucaagcuugacuccuuaaagg

SEQ ID NO: 253656 - RNA, 22 nt, Homo sapiens
aucacagaacuuugagcagaga

SEQ ID NO: 253657 - RNA, 22 nt, Homo sapiens
aucacagguacuauggcugaca

SEQ ID NO: 253658 - RNA, 22 nt, Homo sapiens
aucacagugagcauaugucuau

SEQ ID NO: 253659 - RNA, 22 nt, Homo sapiens
aucacaguuuuaccauuuggua

SEQ ID NO: 253660 - RNA, 22 nt, Homo sapiens
aucacauggccagguaguaauc

SEQ ID NO: 253661 - RNA, 22 nt, Homo sapiens
aucacuagaucauagguaaaca

SEQ ID NO: 253662 - RNA, 22 nt, Homo sapiens
ucacaguagcaaauguuagaaa

SEQ ID NO: 253663 - RNA, 22 nt, Homo sapiens
ucacagucggugacuucuugcu

SEQ ID NO: 253664 - RNA, 22 nt, Homo sapiens
ucacaugaauugucuuguucca

SEQ ID NO: 253665 - RNA, 22 nt, Homo sapiens
ucacaugugcguuuuggcaugu

SEQ ID NO: 253666 - RNA, 19 nt, Homo sapiens
ucaccaguacacaauacaa

SEQ ID NO: 253667 - RNA, 22 nt, Homo sapiens
ucaccagugucagggaacugcu

SEQ ID NO: 253668 - RNA, 22 nt, Homo sapiens
ucaccggcagacguggccugau

SEQ ID NO: 253669 - RNA, 22 nt, Homo sapiens
ucaccuggagacaugaagacug

SEQ ID NO: 253670 - RNA, 22 nt, Homo sapiens
ucacuagaucaagggagagaaa

SEQ ID NO: 253671 - RNA, 22 nt, Homo sapiens
ucacuagggaucacuuuacccg

SEQ ID NO: 253672 - RNA, 22 nt, Homo sapiens
ucacugaaaccuccaccucucg

SEQ ID NO: 253673 - RNA, 22 nt, Homo sapiens
ucacugaaaccuccgccuucug

SEQ ID NO: 253674 - RNA, 21 nt, Homo sapiens
ucacugagguuaaauaggguu

SEQ ID NO: 253675 - RNA, 20 nt, Homo sapiens
ucacugagugguccacagua

SEQ ID NO: 253676 - RNA, 22 nt, Homo sapiens
ucacuggagauagcaaucuggu

SEQ ID NO: 253677 - RNA, 20 nt, Homo sapiens
ucacuggguucuugaagucu

SEQ ID NO: 253678 - RNA, 20 nt, Homo sapiens
ucacugugaacuucuugagg

SEQ ID NO: 253679 - RNA, 22 nt, Homo sapiens
ucacugugcaugaaggaugcug

SEQ ID NO: 253680 - RNA, 22 nt, Homo sapiens
ucacugugguuggaaggcuuaa

SEQ ID NO: 253681 - RNA, 22 nt, Homo sapiens
ucacugugugucucuguaucug

SEQ ID NO: 253682 - RNA, 22 nt, Homo sapiens
ucacuuuguauagcgacuggcu

SEQ ID NO: 253683 - RNA, 22 nt, Homo sapiens
ucagagugcagggaguagcagc

SEQ ID NO: 253684 - RNA, 22 nt, Homo sapiens
ucagaguggccucucuugaaga

SEQ ID NO: 253685 - RNA, 22 nt, Homo sapiens
ucagaguguuuuccaacuuggu

SEQ ID NO: 253686 - RNA, 22 nt, Homo sapiens
ucagauguuuuguuuaucugcu

SEQ ID NO: 253687 - RNA, 22 nt, Homo sapiens
ucagcacauucaaggccugccu

SEQ ID NO: 253688 - RNA, 22 nt, Homo sapiens
ucagcagugagagaccucaccc

SEQ ID NO: 253689 - RNA, 22 nt, Homo sapiens
ucagcagugccccacucuacug

SEQ ID NO: 253690 - RNA, 22 nt, Homo sapiens
ucagcagugugaaaauggacua

SEQ ID NO: 253691 - RNA, 22 nt, Homo sapiens
ucagcaucacaggcagugagug

SEQ ID NO: 253692 - RNA, 16 nt, Homo sapiens
ucagcgagggagccag

SEQ ID NO: 253693 - RNA, 22 nt, Homo sapiens
ucagcguguggacggccaucuu

SEQ ID NO: 253694 - RNA, 22 nt, Homo sapiens
ucaggcaugcagcaaugcagug

SEQ ID NO: 253695 - RNA, 20 nt, Homo sapiens
ucaggcuccgcauuaacuua

SEQ ID NO: 253696 - RNA, 22 nt, Homo sapiens
ucagggacuuacaaaccagaag

SEQ ID NO: 253697 - RNA, 23 nt, Homo sapiens
ucagguaggccuagaguauucuu

SEQ ID NO: 253698 - RNA, 22 nt, Homo sapiens
ucaggugcaguggcucugaccu

SEQ ID NO: 253699 - RNA, 22 nt, Homo sapiens
ucaguaaauguuaggacauuuc

SEQ ID NO: 253700 - RNA, 22 nt, Homo sapiens
ucaguagcaugaaaacagacua

SEQ ID NO: 253701 - RNA, 22 nt, Homo sapiens
ucaguagcauugcuuauacagu

SEQ ID NO: 253702 - RNA, 22 nt, Homo sapiens
ucaguaguaaauggauuuggaa

SEQ ID NO: 253703 - RNA, 22 nt, Homo sapiens
ucaguaguuccaguggguauuu

SEQ ID NO: 253704 - RNA, 22 nt, Homo sapiens
ucaguaguuuuuuuacuaggug

SEQ ID NO: 253705 - RNA, 20 nt, Homo sapiens
ucaguauauuguuuccacag

SEQ ID NO: 253706 - RNA, 22 nt, Homo sapiens
ucagucuuuuuuuggcaagcau

SEQ ID NO: 253707 - RNA, 21 nt, Homo sapiens
ucagugcaauucuauggggaa

SEQ ID NO: 253708 - RNA, 22 nt, Homo sapiens
ucagugcaggaaucucuagcca

SEQ ID NO: 253709 - RNA, 17 nt, Homo sapiens
ucagugcauuuaagaga

SEQ ID NO: 253710 - RNA, 22 nt, Homo sapiens
ucagugcuuggcacagagagcu

SEQ ID NO: 253711 - RNA, 22 nt, Homo sapiens
ucagugcuuuuuguugucauca

SEQ ID NO: 253712 - RNA, 22 nt, Homo sapiens
ucaguggagagcuuccaggauu

SEQ ID NO: 253713 - RNA, 22 nt, Homo sapiens
ucagugucugugauggagaggu

SEQ ID NO: 253714 - RNA, 22 nt, Homo sapiens
ucaguguuuggaaucucaauuu

SEQ ID NO: 253715 - RNA, 22 nt, Homo sapiens
ucaguucauggaggugucugcu

SEQ ID NO: 253716 - RNA, 20 nt, Homo sapiens
ucauacuguggaguaccagg

SEQ ID NO: 253717 - RNA, 18 nt, Homo sapiens
ucauagaucaugacagug

SEQ ID NO: 253718 - RNA, 21 nt, Homo sapiens
ucauauguaucuuugugccuc

SEQ ID NO: 253719 - RNA, 21 nt, Homo sapiens
ucaucaagcuguagacaugau

SEQ ID NO: 253720 - RNA, 22 nt, Homo sapiens
ucaucagaguuuacaagcucag

SEQ ID NO: 253721 - RNA, 22 nt, Homo sapiens
ucaucaggaaacuuaugcagug

SEQ ID NO: 253722 - RNA, 22 nt, Homo sapiens
ucaucucaguuucuugccguac

SEQ ID NO: 253723 - RNA, 22 nt, Homo sapiens
ucaugagacacacuggaaagga

SEQ ID NO: 253724 - RNA, 22 nt, Homo sapiens
ucaugcaaugagucaggaggca

SEQ ID NO: 253725 - RNA, 22 nt, Homo sapiens
ucauggcuuuuauuauguugag

SEQ ID NO: 253726 - RNA, 22 nt, Homo sapiens
ucaugggagcccccaucaugag

SEQ ID NO: 253727 - RNA, 22 nt, Homo sapiens
ucauucauucuucaguggguac

SEQ ID NO: 253728 - RNA, 22 nt, Homo sapiens
ucauucuuucuguggaggggcu

SEQ ID NO: 253729 - RNA, 22 nt, Homo sapiens
ucauugcaaucucugccucccg

SEQ ID NO: 253730 - RNA, 22 nt, Homo sapiens
ucauugcacucccagacacccu

SEQ ID NO: 253731 - RNA, 22 nt, Homo sapiens
uccacagugguggaauuguuca

SEQ ID NO: 253732 - RNA, 22 nt, Homo sapiens
cuuacagucuaucagccacaac

SEQ ID NO: 253733 - RNA, 22 nt, Homo sapiens
cuucaaguguggccaccugacc

SEQ ID NO: 253734 - RNA, 20 nt, Homo sapiens
cuucacagaaguggaaucau

SEQ ID NO: 253735 - RNA, 22 nt, Homo sapiens
cuuccauauucuaggacaggcu

SEQ ID NO: 253736 - RNA, 22 nt, Homo sapiens
cuucuguuaguucugauaacuu

SEQ ID NO: 253737 - RNA, 22 nt, Homo sapiens
cuugaccuauggaucuguuuuu

SEQ ID NO: 253738 - RNA, 22 nt, Homo sapiens
cuugauagugguaaucauuuuu

SEQ ID NO: 253739 - RNA, 22 nt, Homo sapiens
cuugcacauuacagaucugcau

SEQ ID NO: 253740 - RNA, 22 nt, Homo sapiens
cuugcacuccacuguucuccug

SEQ ID NO: 253741 - RNA, 22 nt, Homo sapiens
cuugcacuugaaauuccaguuu

SEQ ID NO: 253742 - RNA, 22 nt, Homo sapiens
cuugcauuuuggagaaugcuga

SEQ ID NO: 253743 - RNA, 19 nt, Homo sapiens
cuugccccauucauccucu

SEQ ID NO: 253744 - RNA, 22 nt, Homo sapiens
cuugccuuugucuucaaaggcu

SEQ ID NO: 253745 - RNA, 22 nt, Homo sapiens
cuuggauuauaauggaauauuu

SEQ ID NO: 253746 - RNA, 22 nt, Homo sapiens
cuugggcagugugcauguguau

SEQ ID NO: 253747 - RNA, 22 nt, Homo sapiens
cuuguacacuguuggugggaau

SEQ ID NO: 253748 - RNA, 18 nt, Homo sapiens
cuugucaaaucuuuccuc

SEQ ID NO: 253749 - RNA, 22 nt, Homo sapiens
cuugucuugcacacgguugcca

SEQ ID NO: 253750 - RNA, 22 nt, Homo sapiens
cuuuaugagguuggauggaucu

SEQ ID NO: 253751 - RNA, 22 nt, Homo sapiens
cuuucucagugagacccgagau

SEQ ID NO: 253752 - RNA, 22 nt, Homo sapiens
cuuugcaaauggccuuuccaag

SEQ ID NO: 253753 - RNA, 22 nt, Homo sapiens
cuuugcguugaacaaagccaua

SEQ ID NO: 253754 - RNA, 22 nt, Homo sapiens
cuuugcuaauccaacccucauc

SEQ ID NO: 253755 - RNA, 22 nt, Homo sapiens
cuuuggcaaugucauuuucaau

SEQ ID NO: 253756 - RNA, 22 nt, Homo sapiens
cuuugguucuguuuauaugcug

SEQ ID NO: 253757 - RNA, 22 nt, Homo sapiens
cuuugguuuacuuggugcuagu

SEQ ID NO: 253758 - RNA, 21 nt, Homo sapiens
cuuugguuucugacuugcaua

SEQ ID NO: 253759 - RNA, 22 nt, Homo sapiens
cuuugugcccuucugcccauca

SEQ ID NO: 253760 - RNA, 22 nt, Homo sapiens
cuuugugugggccaagggcugg

SEQ ID NO: 253761 - RNA, 22 nt, Homo sapiens
cuuuuacacugguggugggaau

SEQ ID NO: 253762 - RNA, 22 nt, Homo sapiens
cuuuuacacuguuagugggaau

SEQ ID NO: 253763 - RNA, 23 nt, Homo sapiens
cuuuugcaaugugaucuugccac

SEQ ID NO: 253764 - RNA, 22 nt, Homo sapiens
cuuuuggcuuaagauugucuug

SEQ ID NO: 253765 - RNA, 22 nt, Homo sapiens
cuuuugugauuccucaguuacu

SEQ ID NO: 253766 - RNA, 22 nt, Homo sapiens
cuuuugugauucuucaguuacu

SEQ ID NO: 253767 - RNA, 22 nt, Homo sapiens
cuuuuugguagagcaggugugc

SEQ ID NO: 253768 - RNA, 22 nt, Homo sapiens
gaaagcugguauagauacauua

SEQ ID NO: 253769 - RNA, 22 nt, Homo sapiens
gaaaucucuacuauuuugaucu

SEQ ID NO: 253770 - RNA, 22 nt, Homo sapiens
gaaauggaucagagcaagcuuu

SEQ ID NO: 253771 - RNA, 22 nt, Homo sapiens
gaacuggcuuagugaaacuucc

SEQ ID NO: 253772 - RNA, 22 nt, Homo sapiens
gaacugggguuggguugcgaua

SEQ ID NO: 253773 - RNA, 22 nt, Homo sapiens
gaacuguaaagaaauucuaagg

SEQ ID NO: 253774 - RNA, 22 nt, Homo sapiens
gaacuuguguugcuucacaugu

SEQ ID NO: 253775 - RNA, 22 nt, Homo sapiens
gaagaacuaggugagaucuaga

SEQ ID NO: 253776 - RNA, 22 nt, Homo sapiens
gaagaaguacaagacaaauuuu

SEQ ID NO: 253777 - RNA, 22 nt, Homo sapiens
gaagacauuuacaugggagacc

SEQ ID NO: 253778 - RNA, 22 nt, Homo sapiens
gaagagacagguucccacaaaa

SEQ ID NO: 253779 - RNA, 22 nt, Homo sapiens
gaagaucacacuguagaucuau

SEQ ID NO: 253780 - RNA, 22 nt, Homo sapiens
gaagcagcauucugguuuuugg

SEQ ID NO: 253781 - RNA, 22 nt, Homo sapiens
gaaggcaugcugcauggccaga

SEQ ID NO: 253782 - RNA, 23 nt, Homo sapiens
gaaguaauaaauggauucuuaac

SEQ ID NO: 253783 - RNA, 23 nt, Homo sapiens
gaaguauagcaugcacauggaaa

SEQ ID NO: 253784 - RNA, 17 nt, Homo sapiens
gaaguguuucagcagcu

SEQ ID NO: 253785 - RNA, 17 nt, Homo sapiens
gaaguguuucuucauga

SEQ ID NO: 253786 - RNA, 19 nt, Homo sapiens
gaaguguuuguucuccaug

SEQ ID NO: 253787 - RNA, 22 nt, Homo sapiens
gaauacuguccaagagugaugg

SEQ ID NO: 253788 - RNA, 22 nt, Homo sapiens
gaauagugcugcgauaaacaua

SEQ ID NO: 253789 - RNA, 22 nt, Homo sapiens
gaaucauuggguugauucaaga

SEQ ID NO: 253790 - RNA, 22 nt, Homo sapiens
gaaugcuaccagcaucuagugg

SEQ ID NO: 253791 - RNA, 22 nt, Homo sapiens
gaauucugucgcuuacuagaug

SEQ ID NO: 253792 - RNA, 20 nt, Homo sapiens
gacaaaccuagaugguacag

SEQ ID NO: 253793 - RNA, 18 nt, Homo sapiens
gacaguguggugauuccu

SEQ ID NO: 253794 - RNA, 22 nt, Homo sapiens
gacauguuucucucuguuuacu

SEQ ID NO: 253795 - RNA, 22 nt, Homo sapiens
gacauguuuucaagauuuauaa

SEQ ID NO: 253796 - RNA, 22 nt, Homo sapiens
gacccuguugggguuuagggcu

SEQ ID NO: 253797 - RNA, 21 nt, Homo sapiens
gaccuguaguaagcauucaca

SEQ ID NO: 253798 - RNA, 22 nt, Homo sapiens
gaccuguaguuuaguugccugu

SEQ ID NO: 253799 - RNA, 18 nt, Homo sapiens
gacuccauuucagccaga

SEQ ID NO: 253800 - RNA, 22 nt, Homo sapiens
gacuggagcuguaugugguuac

SEQ ID NO: 253801 - RNA, 22 nt, Homo sapiens
gacuggccuauaauggcgaauu

SEQ ID NO: 253802 - RNA, 16 nt, Homo sapiens
gacugggcugaggaau

SEQ ID NO: 253803 - RNA, 22 nt, Homo sapiens
gacuuagaauuuuugccugcua

SEQ ID NO: 253804 - RNA, 22 nt, Homo sapiens
agcagcuuugcauggccuguga

SEQ ID NO: 253805 - RNA, 22 nt, Homo sapiens
agcaguacauaaaaagcauccu

SEQ ID NO: 253806 - RNA, 22 nt, Homo sapiens
agcagugugagaauggacuaau

SEQ ID NO: 253807 - RNA, 22 nt, Homo sapiens
agcaucauguuuucgagguuca

SEQ ID NO: 253808 - RNA, 17 nt, Homo sapiens
agcauguguuugagauu

SEQ ID NO: 253809 - RNA, 16 nt, Homo sapiens
agccaccauuuacuug

SEQ ID NO: 253810 - RNA, 21 nt, Homo sapiens
agccaguguuccuuguggcuc

SEQ ID NO: 253811 - RNA, 19 nt, Homo sapiens
agccaguuuucccagcacc

SEQ ID NO: 253812 - RNA, 22 nt, Homo sapiens
agccccauuuguugaaaagacg

SEQ ID NO: 253813 - RNA, 23 nt, Homo sapiens
agccuguugccuaggcagcucau

SEQ ID NO: 253814 - RNA, 22 nt, Homo sapiens
agcuacuguuagucuaguuagg

SEQ ID NO: 253815 - RNA, 18 nt, Homo sapiens
agcucaguguuugcuuac

SEQ ID NO: 253816 - RNA, 22 nt, Homo sapiens
agcuccuuucugcagguagguu

SEQ ID NO: 253817 - RNA, 22 nt, Homo sapiens
agcugauggucuuguaugaugu

SEQ ID NO: 253818 - RNA, 22 nt, Homo sapiens
agcugauuuuaaguccuugucc

SEQ ID NO: 253819 - RNA, 22 nt, Homo sapiens
agcugcacgugguaaauguaaa

SEQ ID NO: 253820 - RNA, 22 nt, Homo sapiens
agcugcacugguauaggagaaa

SEQ ID NO: 253821 - RNA, 22 nt, Homo sapiens
agcugcauucguaucauauugu

SEQ ID NO: 253822 - RNA, 22 nt, Homo sapiens
agcuggacuugauaaaugaaua

SEQ ID NO: 253823 - RNA, 20 nt, Homo sapiens
agcuggguguguuggugcau

SEQ ID NO: 253824 - RNA, 22 nt, Homo sapiens
agcugguccugugacuugcuuc

SEQ ID NO: 253825 - RNA, 22 nt, Homo sapiens
agcuggucuuggggaagaguag

SEQ ID NO: 253826 - RNA, 22 nt, Homo sapiens
agcugguuuaauaugcugucug

SEQ ID NO: 253827 - RNA, 22 nt, Homo sapiens
agcugguuuauuucuauauccu

SEQ ID NO: 253828 - RNA, 22 nt, Homo sapiens
agcugguuuauuucucacaaca

SEQ ID NO: 253829 - RNA, 22 nt, Homo sapiens
agcugugucuucuuaaagauuu

SEQ ID NO: 253830 - RNA, 19 nt, Homo sapiens
agcuguguugccugugaga

SEQ ID NO: 253831 - RNA, 22 nt, Homo sapiens
agcuguuguucucagaggcuuu

SEQ ID NO: 253832 - RNA, 22 nt, Homo sapiens
agcuguuuuugugggcauguga

SEQ ID NO: 253833 - RNA, 22 nt, Homo sapiens
agcuuuggauaccugcuguucc

SEQ ID NO: 253834 - RNA, 22 nt, Homo sapiens
aggaaaucuuagcugaggggau

SEQ ID NO: 253835 - RNA, 22 nt, Homo sapiens
aggaagacauauagaacuaaaa

SEQ ID NO: 253836 - RNA, 22 nt, Homo sapiens
aggaagcuagcauuuguucagu

SEQ ID NO: 253837 - RNA, 22 nt, Homo sapiens
aggaaucuaagguaucagguua

SEQ ID NO: 253838 - RNA, 22 nt, Homo sapiens
aggaauggaaacuuuugauggu

SEQ ID NO: 253839 - RNA, 22 nt, Homo sapiens
aggacacugagcaugggagguu

SEQ ID NO: 253840 - RNA, 19 nt, Homo sapiens
aggacuaaagacuagaagu

SEQ ID NO: 253841 - RNA, 22 nt, Homo sapiens
aggcaacaugguaaaacccugu

SEQ ID NO: 253842 - RNA, 21 nt, Homo sapiens
aggcaagacuuuuagguuugu

SEQ ID NO: 253843 - RNA, 22 nt, Homo sapiens
aggcaagugggagacagcauuu

SEQ ID NO: 253844 - RNA, 22 nt, Homo sapiens
aggcaaugugagaguuuauuca

SEQ ID NO: 253845 - RNA, 22 nt, Homo sapiens
aggcagcuguuauauacugagu

SEQ ID NO: 253846 - RNA, 22 nt, Homo sapiens
aggcagucugaguuuugaaagg

SEQ ID NO: 253847 - RNA, 22 nt, Homo sapiens
aggcuuuuggagaacacugcac

SEQ ID NO: 253848 - RNA, 22 nt, Homo sapiens
agggagcaaaguggucuuucuc

SEQ ID NO: 253849 - RNA, 23 nt, Homo sapiens
agggcacuauagauguuauucua

SEQ ID NO: 253850 - RNA, 22 nt, Homo sapiens
agggcacuguagguccugccuc

SEQ ID NO: 253851 - RNA, 22 nt, Homo sapiens
agggcuuguuuaacuaucauua

SEQ ID NO: 253852 - RNA, 22 nt, Homo sapiens
agguauuuucaacuuagaaugg

SEQ ID NO: 253853 - RNA, 21 nt, Homo sapiens
aggucaugaagauguucuaau

SEQ ID NO: 253854 - RNA, 22 nt, Homo sapiens
aggugacugguuuaucuggcag

SEQ ID NO: 253855 - RNA, 22 nt, Homo sapiens
aggugcuugaaucuaugagcuc

SEQ ID NO: 253856 - RNA, 22 nt, Homo sapiens
aguaaagcuacucacugugggc

SEQ ID NO: 253857 - RNA, 22 nt, Homo sapiens
aguaccauuacucacuuauuuu

SEQ ID NO: 253858 - RNA, 22 nt, Homo sapiens
aguacugucugguuaccugaca

SEQ ID NO: 253859 - RNA, 22 nt, Homo sapiens
aguaucaagccacacaugguca

SEQ ID NO: 253860 - RNA, 22 nt, Homo sapiens
agucaaaugcuuauguauaaag

SEQ ID NO: 253861 - RNA, 22 nt, Homo sapiens
agucaagauggcaagguaaggc

SEQ ID NO: 253862 - RNA, 22 nt, Homo sapiens
agucaaguuuuuucagagaaua

SEQ ID NO: 253863 - RNA, 22 nt, Homo sapiens
agucauggaucacaguagccuc

SEQ ID NO: 253864 - RNA, 22 nt, Homo sapiens
agucaugggagagaugugaucg

SEQ ID NO: 253865 - RNA, 22 nt, Homo sapiens
agucugguguucucacacuagu

SEQ ID NO: 253866 - RNA, 22 nt, Homo sapiens
agugaacaaagaagugcagaua

SEQ ID NO: 253867 - RNA, 22 nt, Homo sapiens
agugauguggaguuuggaugga

SEQ ID NO: 253868 - RNA, 22 nt, Homo sapiens
agugcaaugauccggugcuggg

SEQ ID NO: 253869 - RNA, 22 nt, Homo sapiens
agugcacuccagccugggcaac

SEQ ID NO: 253870 - RNA, 22 nt, Homo sapiens
agugcacugcccgcuuccuguc

SEQ ID NO: 253871 - RNA, 22 nt, Homo sapiens
agugcaguggcucaaaaugccu

SEQ ID NO: 253872 - RNA, 22 nt, Homo sapiens
aguggaguguaaagcgucuuuu

SEQ ID NO: 253873 - RNA, 22 nt, Homo sapiens
aguggguguuccauuggauaaa

SEQ ID NO: 253874 - RNA, 22 nt, Homo sapiens
aguguuuuuaucaugaaagggu

SEQ ID NO: 253875 - RNA, 22 nt, Homo sapiens
aguguuuuucaugggauacuuu

SEQ ID NO: 253876 - RNA, 22 nt, Homo sapiens
aguuggugauugauugggucug

SEQ ID NO: 253877 - RNA, 22 nt, Homo sapiens
auaaaguucugcuggcauauau

SEQ ID NO: 253878 - RNA, 22 nt, Homo sapiens
auaaaugcaaugguauuuuuga

SEQ ID NO: 253879 - RNA, 22 nt, Homo sapiens
auaaaugcauugagaacugcug

SEQ ID NO: 253880 - RNA, 19 nt, Homo sapiens
auaaaugccuacaagggug

SEQ ID NO: 253881 - RNA, 22 nt, Homo sapiens
auaaaugccuguuguuuuaagc

SEQ ID NO: 253882 - RNA, 22 nt, Homo sapiens
auaaaugcuuagaucuguauau

SEQ ID NO: 253883 - RNA, 20 nt, Homo sapiens
auaaauguauagguguacau

SEQ ID NO: 253884 - RNA, 22 nt, Homo sapiens
auaacucuguuuuuuucaugca

SEQ ID NO: 253885 - RNA, 22 nt, Homo sapiens
auaagaagugaaccagacgucu

SEQ ID NO: 253886 - RNA, 22 nt, Homo sapiens
auaagagcaggcuucuggccag

SEQ ID NO: 253887 - RNA, 22 nt, Homo sapiens
auaagaguaguacauaugagac

SEQ ID NO: 253888 - RNA, 22 nt, Homo sapiens
auaagguuagcucugagaaagu

SEQ ID NO: 253889 - RNA, 18 nt, Homo sapiens
auacaagcagcagagauu

SEQ ID NO: 253890 - RNA, 22 nt, Homo sapiens
auacaaguuauuugaacugcgg

SEQ ID NO: 253891 - RNA, 22 nt, Homo sapiens
auacacauuccugggccucacc

SEQ ID NO: 253892 - RNA, 22 nt, Homo sapiens
auacagucuguuagauuuccuc

SEQ ID NO: 253893 - RNA, 22 nt, Homo sapiens
auacaguguucugggaagaagu

SEQ ID NO: 253894 - RNA, 19 nt, Homo sapiens
auacccacuagguuacuua

SEQ ID NO: 253895 - RNA, 22 nt, Homo sapiens
auacuaugagauaauaaagacu

SEQ ID NO: 253896 - RNA, 22 nt, Homo sapiens
auacugcacauuuagggaggga

SEQ ID NO: 253897 - RNA, 22 nt, Homo sapiens
auacugucucuugcuccugccc

SEQ ID NO: 253898 - RNA, 22 nt, Homo sapiens
uuggaauacuuguuaaagucca

SEQ ID NO: 253899 - RNA, 18 nt, Homo sapiens
uuggacggagagucaaau

SEQ ID NO: 253900 - RNA, 22 nt, Homo sapiens
uuggacuucucaaggcaauaaa

SEQ ID NO: 253901 - RNA, 22 nt, Homo sapiens
uuggagagaaaggcaguuccug

SEQ ID NO: 253902 - RNA, 22 nt, Homo sapiens
uuggagcacuggggcacugaca

SEQ ID NO: 253903 - RNA, 22 nt, Homo sapiens
uuggagcccuaacucucaguac

SEQ ID NO: 253904 - RNA, 22 nt, Homo sapiens
uuggauuauaaacugagauuug

SEQ ID NO: 253905 - RNA, 22 nt, Homo sapiens
auagcagcuugucagggcagac

SEQ ID NO: 253906 - RNA, 22 nt, Homo sapiens
auagcagugugaaaauguacua

SEQ ID NO: 253907 - RNA, 22 nt, Homo sapiens
auagcaucauuucuugaaaaga

SEQ ID NO: 253908 - RNA, 22 nt, Homo sapiens
auaggcaagaugagguuuuuau

SEQ ID NO: 253909 - RNA, 22 nt, Homo sapiens
auagugcugcaauaaacacacg

SEQ ID NO: 253910 - RNA, 22 nt, Homo sapiens
auagugcugcaauaaacauaca

SEQ ID NO: 253911 - RNA, 22 nt, Homo sapiens
auagugcugcauuaaacauacg

SEQ ID NO: 253912 - RNA, 22 nt, Homo sapiens
auagugcuggaauaaauauacg

SEQ ID NO: 253913 - RNA, 22 nt, Homo sapiens
auagugcugugaugaacauaca

SEQ ID NO: 253914 - RNA, 22 nt, Homo sapiens
auaguggcaugaucauagcuca

SEQ ID NO: 253915 - RNA, 22 nt, Homo sapiens
auaucaacaucgugucauuagu

SEQ ID NO: 253916 - RNA, 22 nt, Homo sapiens
auaucaaggccauuuucuaaau

SEQ ID NO: 253917 - RNA, 22 nt, Homo sapiens
auauccguacaguggaauauua

SEQ ID NO: 253918 - RNA, 22 nt, Homo sapiens
auaugcaaauccauagagacag

SEQ ID NO: 253919 - RNA, 22 nt, Homo sapiens
auaugcauacauguaugcagga

SEQ ID NO: 253920 - RNA, 22 nt, Homo sapiens
auaugcauacccucaccaacua

SEQ ID NO: 253921 - RNA, 20 nt, Homo sapiens
auaugguugugagugauuuu

SEQ ID NO: 253922 - RNA, 22 nt, Homo sapiens
auauguaguauggaaacauugu

SEQ ID NO: 253923 - RNA, 22 nt, Homo sapiens
auaugugacuucaugcaaggcu

SEQ ID NO: 253924 - RNA, 22 nt, Homo sapiens
auauuacuggccauaucgcagg

SEQ ID NO: 253925 - RNA, 22 nt, Homo sapiens
auauuagguuggugcaaaagua

SEQ ID NO: 253926 - RNA, 22 nt, Homo sapiens
auauuagguuggugccaaagua

SEQ ID NO: 253927 - RNA, 22 nt, Homo sapiens
auauucacuauaugcagaacca

SEQ ID NO: 253928 - RNA, 18 nt, Homo sapiens
auauugcauuggauggau

SEQ ID NO: 253929 - RNA, 22 nt, Homo sapiens
auauuggucuucaagaccugug

SEQ ID NO: 253930 - RNA, 22 nt, Homo sapiens
auauugguuaaauauuauguga

SEQ ID NO: 253931 - RNA, 22 nt, Homo sapiens
auauuguacugcuacugguucu

SEQ ID NO: 253932 - RNA, 22 nt, Homo sapiens
aucaaagcagcauggcccaguc

SEQ ID NO: 253933 - RNA, 22 nt, Homo sapiens
aucaaaguuucccagaaguugu

SEQ ID NO: 253934 - RNA, 22 nt, Homo sapiens
aucaagcuacacccuuuggaaa

SEQ ID NO: 253935 - RNA, 22 nt, Homo sapiens
aucaaguaguuauacguaaagg

SEQ ID NO: 253936 - RNA, 22 nt, Homo sapiens
aucacagcccuccucuuggaug

SEQ ID NO: 253937 - RNA, 22 nt, Homo sapiens
aucacaguggucagguauagau

SEQ ID NO: 253938 - RNA, 20 nt, Homo sapiens
aucaccacagcucguucaug

SEQ ID NO: 253939 - RNA, 22 nt, Homo sapiens
aucaccuuucccuuucugaauc

SEQ ID NO: 253940 - RNA, 22 nt, Homo sapiens
aucacuguaaguuuacacuuug

SEQ ID NO: 253941 - RNA, 22 nt, Homo sapiens
aucacuuucuauuucugugcca

SEQ ID NO: 253942 - RNA, 22 nt, Homo sapiens
aucagaaucucuagaggacugu

SEQ ID NO: 253943 - RNA, 22 nt, Homo sapiens
aucagagugaauaaugacaaaa

SEQ ID NO: 253944 - RNA, 23 nt, Homo sapiens
aucagauaguuguagguaugugg

SEQ ID NO: 253945 - RNA, 22 nt, Homo sapiens
aucagauuccacauuuuaucag

SEQ ID NO: 253946 - RNA, 22 nt, Homo sapiens
aucagauuccagaggcagcacc

SEQ ID NO: 253947 - RNA, 22 nt, Homo sapiens
aucagcaguguaaaaacggacu

SEQ ID NO: 253948 - RNA, 22 nt, Homo sapiens
aucagcauucccaaaugaugug

SEQ ID NO: 253949 - RNA, 22 nt, Homo sapiens
aucagucuguuggaauaucgcu

SEQ ID NO: 253950 - RNA, 22 nt, Homo sapiens
aucauaucauuggugaacagug

SEQ ID NO: 253951 - RNA, 22 nt, Homo sapiens
aucauauccuagauauaacuuc

SEQ ID NO: 253952 - RNA, 22 nt, Homo sapiens
aucauuaguuguggaauucuug

SEQ ID NO: 253953 - RNA, 22 nt, Homo sapiens
auccacauucauggaccagucc

SEQ ID NO: 253954 - RNA, 22 nt, Homo sapiens
auccagaugggcuuaauguaau

SEQ ID NO: 253955 - RNA, 22 nt, Homo sapiens
auccauugucuaaugcuaagau

SEQ ID NO: 253956 - RNA, 22 nt, Homo sapiens
aucccugaggaauuucugcacu

SEQ ID NO: 253957 - RNA, 22 nt, Homo sapiens
aucccuuccuagcacuuggugu

SEQ ID NO: 253958 - RNA, 22 nt, Homo sapiens
auccucugagaucuaggcagag

SEQ ID NO: 253959 - RNA, 22 nt, Homo sapiens
aucucaguucaggcuggccaca

SEQ ID NO: 253960 - RNA, 22 nt, Homo sapiens
aucucauggagguagagaguaa

SEQ ID NO: 253961 - RNA, 22 nt, Homo sapiens
aucugacuuuuaauuugaaaac

SEQ ID NO: 253962 - RNA, 22 nt, Homo sapiens
aucugcaaauaaugaagauugg

SEQ ID NO: 253963 - RNA, 22 nt, Homo sapiens
aucugguguuuuucucccucgu

SEQ ID NO: 253964 - RNA, 22 nt, Homo sapiens
aucuugcauuugcuaaaaugca

SEQ ID NO: 253965 - RNA, 22 nt, Homo sapiens
aucuuguccugagguuuuauug

SEQ ID NO: 253966 - RNA, 22 nt, Homo sapiens
aucuuugauugaagggacccug

SEQ ID NO: 253967 - RNA, 22 nt, Homo sapiens
aucuuugcugagaugcauggca

SEQ ID NO: 253968 - RNA, 22 nt, Homo sapiens
aucuuuggucaucacagcuaga

SEQ ID NO: 253969 - RNA, 23 nt, Homo sapiens
augaaagcccuugcaaaugcugg

SEQ ID NO: 253970 - RNA, 22 nt, Homo sapiens
augaacuaugugggauguuuua

SEQ ID NO: 253971 - RNA, 22 nt, Homo sapiens
augaagagaaaguggaucuugg

SEQ ID NO: 253972 - RNA, 22 nt, Homo sapiens
augaagugcaugauaguugguu

SEQ ID NO: 253973 - RNA, 22 nt, Homo sapiens
augaaugcuuuuggauguaucu

SEQ ID NO: 253974 - RNA, 21 nt, Homo sapiens
augaauguaaagaauguggga

SEQ ID NO: 253975 - RNA, 23 nt, Homo sapiens
augaauguaaggaguguaagaaa

SEQ ID NO: 253976 - RNA, 22 nt, Homo sapiens
augacaagagccuucuuuccuu

SEQ ID NO: 253977 - RNA, 22 nt, Homo sapiens
augacauuccacagccguagag

SEQ ID NO: 253978 - RNA, 22 nt, Homo sapiens
augacauugaaaagcaagugga

SEQ ID NO: 253979 - RNA, 19 nt, Homo sapiens
augacauuuggggguggac

SEQ ID NO: 253980 - RNA, 22 nt, Homo sapiens
augaccaaagaaaugcuauagg

SEQ ID NO: 253981 - RNA, 22 nt, Homo sapiens
augaccaaugggcagagcuaga

SEQ ID NO: 253982 - RNA, 22 nt, Homo sapiens
augacugucuugcagaggcuau

SEQ ID NO: 253983 - RNA, 22 nt, Homo sapiens
augagaaugauucuguuauggu

SEQ ID NO: 253984 - RNA, 22 nt, Homo sapiens
augagaccagcagaaaaccugu

SEQ ID NO: 253985 - RNA, 22 nt, Homo sapiens
augagagcugacuuuaaggcaa

SEQ ID NO: 253986 - RNA, 22 nt, Homo sapiens
augagaugauaggcguucuaac

SEQ ID NO: 253987 - RNA, 22 nt, Homo sapiens
augagggagggguggugccgca

SEQ ID NO: 253988 - RNA, 22 nt, Homo sapiens
augagggcggacgcccuggaga

SEQ ID NO: 253989 - RNA, 22 nt, Homo sapiens
augagucacuuauuauuggggu

SEQ ID NO: 253990 - RNA, 22 nt, Homo sapiens
augaguugaagcuacaagaggc

SEQ ID NO: 253991 - RNA, 22 nt, Homo sapiens
augauacuguucuaagauuuuu

SEQ ID NO: 253992 - RNA, 22 nt, Homo sapiens
augaugcaguacuuugggaaca

SEQ ID NO: 253993 - RNA, 19 nt, Homo sapiens
augauugucuauggaggaa

SEQ ID NO: 253994 - RNA, 22 nt, Homo sapiens
augcaaacagcuaucuggcugg

SEQ ID NO: 253995 - RNA, 22 nt, Homo sapiens
augcaaaucuuaaguaugugug

SEQ ID NO: 253996 - RNA, 22 nt, Homo sapiens
augcaagaaauaucucuuuuuc

SEQ ID NO: 253997 - RNA, 22 nt, Homo sapiens
augcaagacaccgauuagcuuu

SEQ ID NO: 253998 - RNA, 22 nt, Homo sapiens
augcaauucuagauugauagua

SEQ ID NO: 253999 - RNA, 22 nt, Homo sapiens
augcacuguuguuauuggauaa

SEQ ID NO: 254000 - RNA, 22 nt, Homo sapiens
auggcuuuguguucagagcuga

SEQ ID NO: 254001 - RNA, 22 nt, Homo sapiens
auggcuuuucacagaggguucu

SEQ ID NO: 254002 - RNA, 22 nt, Homo sapiens
auggcuuuuccugucuugcaug

SEQ ID NO: 254003 - RNA, 22 nt, Homo sapiens
auggcuuuugaccugguaggau

SEQ ID NO: 254004 - RNA, 22 nt, Homo sapiens
augggacugggugccguggagc

SEQ ID NO: 254005 - RNA, 22 nt, Homo sapiens
augggagugugguuagagaccu

SEQ ID NO: 254006 - RNA, 22 nt, Homo sapiens
augggcaaauguuggaaauucc

SEQ ID NO: 254007 - RNA, 22 nt, Homo sapiens
augggcacugauguauucugug

SEQ ID NO: 254008 - RNA, 21 nt, Homo sapiens
augggguagaagagaaggcuu

SEQ ID NO: 254009 - RNA, 22 nt, Homo sapiens
augguaagcugaaaauaucgaa

SEQ ID NO: 254010 - RNA, 22 nt, Homo sapiens
augguacuagaguaagaauugu

SEQ ID NO: 254011 - RNA, 22 nt, Homo sapiens
auguaaacuacagauuuugggu

SEQ ID NO: 254012 - RNA, 22 nt, Homo sapiens
auguaacuaucugagccauggg

SEQ ID NO: 254013 - RNA, 22 nt, Homo sapiens
auguaagugugcucaaauguua

SEQ ID NO: 254014 - RNA, 17 nt, Homo sapiens
auguaauccucaucucu

SEQ ID NO: 254015 - RNA, 21 nt, Homo sapiens
auguaaugaagaagccacugg

SEQ ID NO: 254016 - RNA, 20 nt, Homo sapiens
augucagaguguggguacgg

SEQ ID NO: 254017 - RNA, 22 nt, Homo sapiens
auguccaugagcacauguauca

SEQ ID NO: 254018 - RNA, 22 nt, Homo sapiens
auguccauggaaucuguagcaa

SEQ ID NO: 254019 - RNA, 22 nt, Homo sapiens
auguccuaaucuccuguucuua

SEQ ID NO: 254020 - RNA, 22 nt, Homo sapiens
auguccuggacccagacaaagc

SEQ ID NO: 254021 - RNA, 22 nt, Homo sapiens
augucuggcagaagacuucuca

SEQ ID NO: 254022 - RNA, 22 nt, Homo sapiens
augugaacaucauagaaugcac

SEQ ID NO: 254023 - RNA, 22 nt, Homo sapiens
augugaacugaauuaauucaca

SEQ ID NO: 254024 - RNA, 17 nt, Homo sapiens
augugaauguucaaaua

SEQ ID NO: 254025 - RNA, 22 nt, Homo sapiens
augugacagugguuuuaagcgu

SEQ ID NO: 254026 - RNA, 22 nt, Homo sapiens
augugcaaagcacuguucagca

SEQ ID NO: 254027 - RNA, 21 nt, Homo sapiens
augugcacuaugucauuuaau

SEQ ID NO: 254028 - RNA, 22 nt, Homo sapiens
augugcuuaaaaaugcagagaa

SEQ ID NO: 254029 - RNA, 22 nt, Homo sapiens
augugcuuuuggugagagauuu

SEQ ID NO: 254030 - RNA, 22 nt, Homo sapiens
auguggaaagcagcaugauaug

SEQ ID NO: 254031 - RNA, 22 nt, Homo sapiens
auguggcacuugacuuucucgc

SEQ ID NO: 254032 - RNA, 22 nt, Homo sapiens
auguggcauuucucauucauuu

SEQ ID NO: 254033 - RNA, 22 nt, Homo sapiens
auguggcuuuccuagaucuuag

SEQ ID NO: 254034 - RNA, 22 nt, Homo sapiens
augugggaggaauguguuucca

SEQ ID NO: 254035 - RNA, 22 nt, Homo sapiens
augugguaguuauagugauaag

SEQ ID NO: 254036 - RNA, 19 nt, Homo sapiens
augugguuagcaugacugc

SEQ ID NO: 254037 - RNA, 22 nt, Homo sapiens
auguguaaagcuuuucuuuguu

SEQ ID NO: 254038 - RNA, 22 nt, Homo sapiens
auguuaacaucuuaguuuucau

SEQ ID NO: 254039 - RNA, 22 nt, Homo sapiens
auuaauguaauuaguaaaguug

SEQ ID NO: 254040 - RNA, 22 nt, Homo sapiens
auuacaugucuauccaugaaca

SEQ ID NO: 254041 - RNA, 22 nt, Homo sapiens
auuagguagugagaugcugcug

SEQ ID NO: 254042 - RNA, 22 nt, Homo sapiens
auuagguauuuucuggacaggg

SEQ ID NO: 254043 - RNA, 22 nt, Homo sapiens
auucaaggagucuucgucccaa

SEQ ID NO: 254044 - RNA, 22 nt, Homo sapiens
auucaagugaugcagcuguuuu

SEQ ID NO: 254045 - RNA, 22 nt, Homo sapiens
auucaucagggauauugguuga

SEQ ID NO: 254046 - RNA, 22 nt, Homo sapiens
auuccacuuacaugaaguaccu

SEQ ID NO: 254047 - RNA, 22 nt, Homo sapiens
auuccacuuccacuaguuucuc

SEQ ID NO: 254048 - RNA, 22 nt, Homo sapiens
auuccaguggguuuacauccca

SEQ ID NO: 254049 - RNA, 22 nt, Homo sapiens
auugacuugauauauagcugau

SEQ ID NO: 254050 - RNA, 22 nt, Homo sapiens
auugaggcaggaggaccaucua

SEQ ID NO: 254051 - RNA, 22 nt, Homo sapiens
auugcaaagcguagacucuaaa

SEQ ID NO: 254052 - RNA, 21 nt, Homo sapiens
auugcacaauauacccaugua

SEQ ID NO: 254053 - RNA, 18 nt, Homo sapiens
auugcacaccagccuggg

SEQ ID NO: 254054 - RNA, 22 nt, Homo sapiens
auugcacaccagucugggcaaa

SEQ ID NO: 254055 - RNA, 22 nt, Homo sapiens
auugcacaucugcacuacagcc

SEQ ID NO: 254056 - RNA, 23 nt, Homo sapiens
auugcacuccagccuaccugggc

SEQ ID NO: 254057 - RNA, 22 nt, Homo sapiens
auugcacuccagccuaggcaac

SEQ ID NO: 254058 - RNA, 22 nt, Homo sapiens
auugcacuccagccucggugac

SEQ ID NO: 254059 - RNA, 22 nt, Homo sapiens
auugcacuccagccugcggaac

SEQ ID NO: 254060 - RNA, 22 nt, Homo sapiens
auugcacuccagccugggcaac

SEQ ID NO: 254061 - RNA, 21 nt, Homo sapiens
auugcacuccagccugggcga

SEQ ID NO: 254062 - RNA, 22 nt, Homo sapiens
auugcacuccagucucaccagg

SEQ ID NO: 254063 - RNA, 22 nt, Homo sapiens
auugcacuccagucugggcaac

SEQ ID NO: 254064 - RNA, 18 nt, Homo sapiens
auugcacuccugccuggg

SEQ ID NO: 254065 - RNA, 22 nt, Homo sapiens
auugcacucugaucugcacucc

SEQ ID NO: 254066 - RNA, 22 nt, Homo sapiens
auugcaguuucaacuccagggc

SEQ ID NO: 254067 - RNA, 21 nt, Homo sapiens
auugcgcuccagccuccuggg

SEQ ID NO: 254068 - RNA, 22 nt, Homo sapiens
auuggcagaaaucuuuauagua

SEQ ID NO: 254069 - RNA, 22 nt, Homo sapiens
auuguaauuuuagagaaagugg

SEQ ID NO: 254070 - RNA, 22 nt, Homo sapiens
auuguacuagguccuagggcuu

SEQ ID NO: 254071 - RNA, 22 nt, Homo sapiens
ugagccaaguucacaccauugc

SEQ ID NO: 254072 - RNA, 20 nt, Homo sapiens
ugagccccuggacucaagcg

SEQ ID NO: 254073 - RNA, 17 nt, Homo sapiens
ugagcuaugauccuguc

SEQ ID NO: 254074 - RNA, 20 nt, Homo sapiens
ugagcucaauuguugcaagu

SEQ ID NO: 254075 - RNA, 22 nt, Homo sapiens
ugagcucaugcauucuugagga

SEQ ID NO: 254076 - RNA, 22 nt, Homo sapiens
ugagcugagaucgugccauugu

SEQ ID NO: 254077 - RNA, 22 nt, Homo sapiens
ugagcugguacuaauauuauca

SEQ ID NO: 254078 - RNA, 22 nt, Homo sapiens
ugagcuguuugaagaagcauuu

SEQ ID NO: 254079 - RNA, 22 nt, Homo sapiens
ugaggaguauguucuguagacc

SEQ ID NO: 254080 - RNA, 17 nt, Homo sapiens
ugaggcacuaguaucac

SEQ ID NO: 254081 - RNA, 22 nt, Homo sapiens
ugaggcuaggauaggcugauuc

SEQ ID NO: 254082 - RNA, 22 nt, Homo sapiens
ugagguagaaugauucuaauau

SEQ ID NO: 254083 - RNA, 22 nt, Homo sapiens
ugagguagaggugaacuugacc

SEQ ID NO: 254084 - RNA, 22 nt, Homo sapiens
ugagguaggugaagaaugcacg

SEQ ID NO: 254085 - RNA, 22 nt, Homo sapiens
ugagguaugugaugucuuuuag

SEQ ID NO: 254086 - RNA, 22 nt, Homo sapiens
ugaggucacuuguuuuaugcuu

SEQ ID NO: 254087 - RNA, 22 nt, Homo sapiens
ugaggugagggguuaggugcua

SEQ ID NO: 254088 - RNA, 22 nt, Homo sapiens
ugaggugcagcaauccucaugu

SEQ ID NO: 254089 - RNA, 22 nt, Homo sapiens
ugagguguuauccagaguucuu

SEQ ID NO: 254090 - RNA, 22 nt, Homo sapiens
ugagguguuugugcaccaucug

SEQ ID NO: 254091 - RNA, 22 nt, Homo sapiens
ugagguuauuuguucaagaagu

SEQ ID NO: 254092 - RNA, 22 nt, Homo sapiens
ugagguugaaggacauuuuuau

SEQ ID NO: 254093 - RNA, 22 nt, Homo sapiens
ugagguugguauuacugucucu

SEQ ID NO: 254094 - RNA, 22 nt, Homo sapiens
ugaguacugauuuaagauacac

SEQ ID NO: 254095 - RNA, 22 nt, Homo sapiens
ugaguagaacuccuggagaugu

SEQ ID NO: 254096 - RNA, 22 nt, Homo sapiens
ugagugaacgcugagaccaaau

SEQ ID NO: 254097 - RNA, 22 nt, Homo sapiens
ugaguguccaaguaaggugaaa

SEQ ID NO: 254098 - RNA, 22 nt, Homo sapiens
ugaguguccaccccuuucacag

SEQ ID NO: 254099 - RNA, 22 nt, Homo sapiens
ugaguuaaucucuacgauagaa

SEQ ID NO: 254100 - RNA, 22 nt, Homo sapiens
ugaguuaauuuuuguaucaugu

SEQ ID NO: 254101 - RNA, 22 nt, Homo sapiens
ugaguucaauuguauuuuauua

SEQ ID NO: 254102 - RNA, 22 nt, Homo sapiens
ugaguuccuuucccaguccagu

SEQ ID NO: 254103 - RNA, 22 nt, Homo sapiens
ugauaagaaauuguucauguag

SEQ ID NO: 254104 - RNA, 22 nt, Homo sapiens
ugauaauguuaggcuuuauuca

SEQ ID NO: 254105 - RNA, 22 nt, Homo sapiens
ugauauguaugugaccuagaaa

SEQ ID NO: 254106 - RNA, 22 nt, Homo sapiens
ugaucaaagugcuggaauuaca

SEQ ID NO: 254107 - RNA, 22 nt, Homo sapiens
ugauccuguccuuaugauguua

SEQ ID NO: 254108 - RNA, 22 nt, Homo sapiens
ugaucugucacuuaucacauuu

SEQ ID NO: 254109 - RNA, 22 nt, Homo sapiens
ugaugcugaguggcuauuugaa

SEQ ID NO: 254110 - RNA, 22 nt, Homo sapiens
ugauggcauuucauguuuguaa

SEQ ID NO: 254111 - RNA, 22 nt, Homo sapiens
ugauggccuguucuccauaugu

SEQ ID NO: 254112 - RNA, 22 nt, Homo sapiens
ugaugguccauaguucauggua

SEQ ID NO: 254113 - RNA, 22 nt, Homo sapiens
ugauguccaguucauagaaacu

SEQ ID NO: 254114 - RNA, 22 nt, Homo sapiens
ugauguguuuuguaguucaacu

SEQ ID NO: 254115 - RNA, 22 nt, Homo sapiens
ugauugcacaccugcacucaag

SEQ ID NO: 254116 - RNA, 19 nt, Homo sapiens
ugauuguaagcuuggugag

SEQ ID NO: 254117 - RNA, 22 nt, Homo sapiens
ugauuuccaugagaacaugccu

SEQ ID NO: 254118 - RNA, 22 nt, Homo sapiens
ugcaaauuauugggccccaacu

SEQ ID NO: 254119 - RNA, 22 nt, Homo sapiens
ugcaaccauuguuaagugugca

SEQ ID NO: 254120 - RNA, 22 nt, Homo sapiens
ugcaagaaacauauuccacaag

SEQ ID NO: 254121 - RNA, 22 nt, Homo sapiens
ugcaagaaucagccuaucauua

SEQ ID NO: 254122 - RNA, 22 nt, Homo sapiens
ugcaagaaucuuucaggcuagc

SEQ ID NO: 254123 - RNA, 22 nt, Homo sapiens
ugcaaguaauuccagcuacuga

SEQ ID NO: 254124 - RNA, 22 nt, Homo sapiens
ugcaauauccucuacuauaggu

SEQ ID NO: 254125 - RNA, 22 nt, Homo sapiens
ugcaaucauuuggaggagaaga

SEQ ID NO: 254126 - RNA, 18 nt, Homo sapiens
ugcaauggagaugcagcc

SEQ ID NO: 254127 - RNA, 23 nt, Homo sapiens
ugcaccacuacacacucuugggu

SEQ ID NO: 254128 - RNA, 22 nt, Homo sapiens
ugcaccacuacacuccaggcug

SEQ ID NO: 254129 - RNA, 22 nt, Homo sapiens
ugcaccacugcacuccacccug

SEQ ID NO: 254130 - RNA, 22 nt, Homo sapiens
ugcaccacugcacugccugggu

SEQ ID NO: 254131 - RNA, 18 nt, Homo sapiens
ugcaccaguuuacacuuc

SEQ ID NO: 254132 - RNA, 22 nt, Homo sapiens
ugcaccauugcauuccagccug

SEQ ID NO: 254133 - RNA, 22 nt, Homo sapiens
ugcagcacaguagguuugcaau

SEQ ID NO: 254134 - RNA, 20 nt, Homo sapiens
ugcagcacugggaaugcagu

SEQ ID NO: 254135 - RNA, 22 nt, Homo sapiens
ugcagcucaaauuccuaacaag

SEQ ID NO: 254136 - RNA, 22 nt, Homo sapiens
ugcagcucagcugcggaguuuu

SEQ ID NO: 254137 - RNA, 22 nt, Homo sapiens
ugcaggguccauugucccaagu

SEQ ID NO: 254138 - RNA, 22 nt, Homo sapiens
ugcaguacauucagcauccucu

SEQ ID NO: 254139 - RNA, 22 nt, Homo sapiens
ugcaguaggcccagcgggaggc

SEQ ID NO: 254140 - RNA, 22 nt, Homo sapiens
ugcauaauuccuugcaccagaa

SEQ ID NO: 254141 - RNA, 22 nt, Homo sapiens
ugcauaucuuguggaauaucuc

SEQ ID NO: 254142 - RNA, 22 nt, Homo sapiens
ugcaugaugcugagauuuggga

SEQ ID NO: 254143 - RNA, 22 nt, Homo sapiens
ugcauggauguuugaacacacu

SEQ ID NO: 254144 - RNA, 22 nt, Homo sapiens
ugcauggucauacauggcaccc

SEQ ID NO: 254145 - RNA, 22 nt, Homo sapiens
ugcauuaguaaguaauuuuaau

SEQ ID NO: 254146 - RNA, 21 nt, Homo sapiens
ugcauuggagaauguuucuca

SEQ ID NO: 254147 - RNA, 20 nt, Homo sapiens
ugccaagaaaugaggguauu

SEQ ID NO: 254148 - RNA, 22 nt, Homo sapiens
ugccaagauuucaggaauuaag

SEQ ID NO: 254149 - RNA, 22 nt, Homo sapiens
ugccagaugugcccucuccacc

SEQ ID NO: 254150 - RNA, 22 nt, Homo sapiens
ugccaguauuuuguugaggauu

SEQ ID NO: 254151 - RNA, 22 nt, Homo sapiens
ugccaguguugccuuucacuag

SEQ ID NO: 254152 - RNA, 22 nt, Homo sapiens
ugccuaggcccaguccucagaa

SEQ ID NO: 254153 - RNA, 22 nt, Homo sapiens
ugccugcugucuaauauauucu

SEQ ID NO: 254154 - RNA, 22 nt, Homo sapiens
ugccuggagagcuccuacauau

SEQ ID NO: 254155 - RNA, 22 nt, Homo sapiens
ugcgccauugcacuccagucuu

SEQ ID NO: 254156 - RNA, 22 nt, Homo sapiens
ugcgccauugcacucuagccug

SEQ ID NO: 254157 - RNA, 22 nt, Homo sapiens
ugcgccauugcauuccagccug

SEQ ID NO: 254158 - RNA, 22 nt, Homo sapiens
ugcuacccuucgucucucuggu

SEQ ID NO: 254159 - RNA, 21 nt, Homo sapiens
ugcuacugucacuuccuuugu

SEQ ID NO: 254160 - RNA, 22 nt, Homo sapiens
ugcuauagcuauaucaucuccu

SEQ ID NO: 254161 - RNA, 22 nt, Homo sapiens
ugcucaccugcugcucaccucc

SEQ ID NO: 254162 - RNA, 21 nt, Homo sapiens
ugcucaugaguaaugcaguga

SEQ ID NO: 254163 - RNA, 23 nt, Homo sapiens
ugcuccccucauggaugaauaaa

SEQ ID NO: 254164 - RNA, 22 nt, Homo sapiens
ugcugguauuuggaccagccug

SEQ ID NO: 254165 - RNA, 22 nt, Homo sapiens
ugcugguuuaaaaugcaaauuc

SEQ ID NO: 254166 - RNA, 22 nt, Homo sapiens
ugcuguguugcuggcuuaaaga

SEQ ID NO: 254167 - RNA, 22 nt, Homo sapiens
ugcuuaggcuaacaaaaauagc

SEQ ID NO: 254168 - RNA, 22 nt, Homo sapiens
ugcuuguguucagguaaccuuu

SEQ ID NO: 254169 - RNA, 21 nt, Homo sapiens
uggaaacuucuagcuuacgua

SEQ ID NO: 254170 - RNA, 20 nt, Homo sapiens
uggaaaguaagucaugauau

SEQ ID NO: 254171 - RNA, 22 nt, Homo sapiens
uggaaauuaacagggauugucc

SEQ ID NO: 254172 - RNA, 22 nt, Homo sapiens
uggaacaccaggcuggcguggc

SEQ ID NO: 254173 - RNA, 23 nt, Homo sapiens
uggaacugaauuucuuagcauuu

SEQ ID NO: 254174 - RNA, 22 nt, Homo sapiens
uggaacugauauugauggaaaa

SEQ ID NO: 254175 - RNA, 23 nt, Homo sapiens
uggaagacuccucucuuggcugc

SEQ ID NO: 254176 - RNA, 20 nt, Homo sapiens
uggaagccuggugcuaucuu

SEQ ID NO: 254177 - RNA, 20 nt, Homo sapiens
uggaaggcaucugcauuauu

SEQ ID NO: 254178 - RNA, 22 nt, Homo sapiens
uggaagguaaguuuugagcauu

SEQ ID NO: 254179 - RNA, 23 nt, Homo sapiens
uggaaguauggaggaggcagaau

SEQ ID NO: 254180 - RNA, 22 nt, Homo sapiens
uggaagugucugugcccagcuc

SEQ ID NO: 254181 - RNA, 21 nt, Homo sapiens
uggaaucuauagaggcaguag

SEQ ID NO: 254182 - RNA, 22 nt, Homo sapiens
uggaaugguuggugugauuuua

SEQ ID NO: 254183 - RNA, 22 nt, Homo sapiens
uggaauguauaucguuuuuugu

SEQ ID NO: 254184 - RNA, 22 nt, Homo sapiens
uggaaugucuauguuuuugauu

SEQ ID NO: 254185 - RNA, 22 nt, Homo sapiens
uggaaugucuuuuccccaaagc

SEQ ID NO: 254186 - RNA, 22 nt, Homo sapiens
uggaauguuauggcuuuaaucu

SEQ ID NO: 254187 - RNA, 21 nt, Homo sapiens
uggaauguucugacuucaggg

SEQ ID NO: 254188 - RNA, 22 nt, Homo sapiens
uggaauguuuaucaaaacagua

SEQ ID NO: 254189 - RNA, 22 nt, Homo sapiens
uggaauuuagguugauaguaua

SEQ ID NO: 254190 - RNA, 22 nt, Homo sapiens
uggacagagagaccggcauuuu

SEQ ID NO: 254191 - RNA, 22 nt, Homo sapiens
uggacugagauuucagcugcca

SEQ ID NO: 254192 - RNA, 22 nt, Homo sapiens
uggacuguaaauuggggacucu

SEQ ID NO: 254193 - RNA, 22 nt, Homo sapiens
uggacuguaauagagaacagaa

SEQ ID NO: 254194 - RNA, 22 nt, Homo sapiens
uggagacaaagauagaaaagca

SEQ ID NO: 254195 - RNA, 22 nt, Homo sapiens
uggagagcaaaaucaauccaaa

SEQ ID NO: 254196 - RNA, 22 nt, Homo sapiens
uggagagugagggccuccuuaa

SEQ ID NO: 254197 - RNA, 22 nt, Homo sapiens
uggaggacugcagaacugaggc

SEQ ID NO: 254198 - RNA, 22 nt, Homo sapiens
uggagguaggacgaagaacucu

SEQ ID NO: 254199 - RNA, 22 nt, Homo sapiens
uggagguagggccuaggaaucu

SEQ ID NO: 254200 - RNA, 22 nt, Homo sapiens
uggagguaggugauauguagca

SEQ ID NO: 254201 - RNA, 22 nt, Homo sapiens
uggagucuugcucuguugccca

SEQ ID NO: 254202 - RNA, 22 nt, Homo sapiens
uggagugagaacuucaaugaug

SEQ ID NO: 254203 - RNA, 22 nt, Homo sapiens
uggaguguguugcagaugaagg

SEQ ID NO: 254204 - RNA, 20 nt, Homo sapiens
uggaguuguggcaguuugga

SEQ ID NO: 254205 - RNA, 22 nt, Homo sapiens
uggcaaaucagaggcauggaca

SEQ ID NO: 254206 - RNA, 22 nt, Homo sapiens
uggcaaaugugagaugagaacu

SEQ ID NO: 254207 - RNA, 22 nt, Homo sapiens
uggcaaauuccaaaguuaauuc

SEQ ID NO: 254208 - RNA, 22 nt, Homo sapiens
uggcaacuugcaaccucauucu

SEQ ID NO: 254209 - RNA, 22 nt, Homo sapiens
uggcaagaagagcaugagacca

SEQ ID NO: 254210 - RNA, 22 nt, Homo sapiens
uggcaagagaacaacaucucuc

SEQ ID NO: 254211 - RNA, 22 nt, Homo sapiens
uggcaagagauaugugucuaua

SEQ ID NO: 254212 - RNA, 20 nt, Homo sapiens
uggcaagugggaauuguggg

SEQ ID NO: 254213 - RNA, 22 nt, Homo sapiens
uggcaaguuucaauccgaggga

SEQ ID NO: 254214 - RNA, 22 nt, Homo sapiens
uggcacaaugacccuugugggc

SEQ ID NO: 254215 - RNA, 19 nt, Homo sapiens
uggcacauguauacauaug

SEQ ID NO: 254216 - RNA, 22 nt, Homo sapiens
uggcaccauccaggugucucua

SEQ ID NO: 254217 - RNA, 22 nt, Homo sapiens
uggcaggugcacuggcuuugaa

SEQ ID NO: 254218 - RNA, 22 nt, Homo sapiens
uggcaguuuacaaaugccauga

SEQ ID NO: 254219 - RNA, 22 nt, Homo sapiens
uggcaguuucauaugguucaac

SEQ ID NO: 254220 - RNA, 22 nt, Homo sapiens
uggcaucuguucuacacauaaa

SEQ ID NO: 254221 - RNA, 17 nt, Homo sapiens
uggcaugaggguguggg

SEQ ID NO: 254222 - RNA, 20 nt, Homo sapiens
uggcauguugguaugcaccc

SEQ ID NO: 254223 - RNA, 23 nt, Homo sapiens
uggcauuuuaguuagcuucagug

SEQ ID NO: 254224 - RNA, 23 nt, Homo sapiens
uggcauuuuuggcaaugccuucu

SEQ ID NO: 254225 - RNA, 22 nt, Homo sapiens
uggccaagagcacagauauugg

SEQ ID NO: 254226 - RNA, 23 nt, Homo sapiens
uggccaagauaaucucaguuuuc

SEQ ID NO: 254227 - RNA, 22 nt, Homo sapiens
uggccagugucggaggccagga

SEQ ID NO: 254228 - RNA, 22 nt, Homo sapiens
uggccaguugaagacaaugcuc

SEQ ID NO: 254229 - RNA, 22 nt, Homo sapiens
uggccaguuuuuaauugggucu

SEQ ID NO: 254230 - RNA, 22 nt, Homo sapiens
uggcgagaugcucgugugcaga

SEQ ID NO: 254231 - RNA, 22 nt, Homo sapiens
uggcggagacauggacuucaga

SEQ ID NO: 254232 - RNA, 22 nt, Homo sapiens
uggcgggaaaguugggagaaga

SEQ ID NO: 254233 - RNA, 22 nt, Homo sapiens
uggcuacugaccugcuaggggg

SEQ ID NO: 254234 - RNA, 22 nt, Homo sapiens
uggcuauuucgucaugcucccc

SEQ ID NO: 254235 - RNA, 20 nt, Homo sapiens
uggcuucuuaauugcaggca

SEQ ID NO: 254236 - RNA, 22 nt, Homo sapiens
uggcuuuuccaggcauuacgau

SEQ ID NO: 254237 - RNA, 22 nt, Homo sapiens
ugggaaauguagccuagcugug

SEQ ID NO: 254238 - RNA, 20 nt, Homo sapiens
ugggaaauguccaggacaua

SEQ ID NO: 254239 - RNA, 18 nt, Homo sapiens
ugggaagaaauucuucuc

SEQ ID NO: 254240 - RNA, 22 nt, Homo sapiens
ugggaugaugcuugagaauauc

SEQ ID NO: 254241 - RNA, 22 nt, Homo sapiens
ugggcaagugacuuggcuucuc

SEQ ID NO: 254242 - RNA, 22 nt, Homo sapiens
ugggcaguauggucauuuucgu

SEQ ID NO: 254243 - RNA, 22 nt, Homo sapiens
ugggcauuguuccuaguuaucu

SEQ ID NO: 254244 - RNA, 21 nt, Homo sapiens
ugggccccuuccuuacaucau

SEQ ID NO: 254245 - RNA, 22 nt, Homo sapiens
ugggccgcugcaggaugguccc

SEQ ID NO: 254246 - RNA, 22 nt, Homo sapiens
uggggcaaugaacauuuuugca

SEQ ID NO: 254247 - RNA, 22 nt, Homo sapiens
ugggguagaauagaauugauau

SEQ ID NO: 254248 - RNA, 22 nt, Homo sapiens
uggguagagaaucaggaucuua

SEQ ID NO: 254249 - RNA, 23 nt, Homo sapiens
ugggucaguuuuucugacaucau

SEQ ID NO: 254250 - RNA, 22 nt, Homo sapiens
ugguaagaucugugagccaggc

SEQ ID NO: 254251 - RNA, 22 nt, Homo sapiens
ugguauguuuauaaguauagga

SEQ ID NO: 254252 - RNA, 22 nt, Homo sapiens
uggucaaaucugaugugagaaa

SEQ ID NO: 254253 - RNA, 22 nt, Homo sapiens
uggucaccugaauuaugcaugu

SEQ ID NO: 254254 - RNA, 20 nt, Homo sapiens
uggucaccuucaggagguuc

SEQ ID NO: 254255 - RNA, 22 nt, Homo sapiens
uggucaguugugccucaauucc

SEQ ID NO: 254256 - RNA, 22 nt, Homo sapiens
uggucauggggcagcugacacu

SEQ ID NO: 254257 - RNA, 20 nt, Homo sapiens
ugguccccugagucuggcuu

SEQ ID NO: 254258 - RNA, 23 nt, Homo sapiens
uggucccguguucuggcuuuagg

SEQ ID NO: 254259 - RNA, 22 nt, Homo sapiens
uggucuuuucaacaaaugguau

SEQ ID NO: 254260 - RNA, 20 nt, Homo sapiens
ugguguuugaacagugaaug

SEQ ID NO: 254261 - RNA, 22 nt, Homo sapiens
ugguucaguugcacaggcuguu

SEQ ID NO: 254262 - RNA, 22 nt, Homo sapiens
uguaaaaagcccagccgcugag

SEQ ID NO: 254263 - RNA, 22 nt, Homo sapiens
uguaauguuugguagguuaggu

SEQ ID NO: 254264 - RNA, 19 nt, Homo sapiens
uguacacuguaaaccugug

SEQ ID NO: 254265 - RNA, 22 nt, Homo sapiens
uguacaugggacaggaggagag

SEQ ID NO: 254266 - RNA, 22 nt, Homo sapiens
uguagauaucuaucaggucaau

SEQ ID NO: 254267 - RNA, 22 nt, Homo sapiens
uguagcagccauaaacacagug

SEQ ID NO: 254268 - RNA, 22 nt, Homo sapiens
uguagguguacauacaugguua

SEQ ID NO: 254269 - RNA, 22 nt, Homo sapiens
uguagucauuugaaggaugucc

SEQ ID NO: 254270 - RNA, 22 nt, Homo sapiens
uguaguuugaaagcucccucug

SEQ ID NO: 254271 - RNA, 22 nt, Homo sapiens
uguauauguuuguacauauguc

SEQ ID NO: 254272 - RNA, 22 nt, Homo sapiens
uguaugaguuguuuauaaauuu

SEQ ID NO: 254273 - RNA, 22 nt, Homo sapiens
ugucaagaaaucaaggugugag

SEQ ID NO: 254274 - RNA, 22 nt, Homo sapiens
ugucaagaugguuugauguugu

SEQ ID NO: 254275 - RNA, 22 nt, Homo sapiens
uuaguccacuggaacuguuaua

SEQ ID NO: 254276 - RNA, 22 nt, Homo sapiens
uuaguuuaucagugguuucuga

SEQ ID NO: 254277 - RNA, 22 nt, Homo sapiens
uuauagcagugcaggaacagac

SEQ ID NO: 254278 - RNA, 22 nt, Homo sapiens
uuaucacauugacugauuugca

SEQ ID NO: 254279 - RNA, 22 nt, Homo sapiens
uuauccugucaguaaauauuuu

SEQ ID NO: 254280 - RNA, 22 nt, Homo sapiens
uuaugacaggcucaggagcccc

SEQ ID NO: 254281 - RNA, 22 nt, Homo sapiens
uuaugcaucuuccacacucauu

SEQ ID NO: 254282 - RNA, 22 nt, Homo sapiens
uuaugccagugauuauaagggc

SEQ ID NO: 254283 - RNA, 22 nt, Homo sapiens
uuauggcaaugccccacuccua

SEQ ID NO: 254284 - RNA, 23 nt, Homo sapiens
uuauggcuuuuauuauguugagg

SEQ ID NO: 254285 - RNA, 22 nt, Homo sapiens
uuaugguacaugugcacaaugu

SEQ ID NO: 254286 - RNA, 22 nt, Homo sapiens
uuaugguuuucucucacgcagg

SEQ ID NO: 254287 - RNA, 22 nt, Homo sapiens
uuauguaaaucaaucuggaauc

SEQ ID NO: 254288 - RNA, 22 nt, Homo sapiens
uuauugcuaaaucaugaccaca

SEQ ID NO: 254289 - RNA, 22 nt, Homo sapiens
uuauugcuuaugauuagguguu

SEQ ID NO: 254290 - RNA, 22 nt, Homo sapiens
uucaaaggauuuagauuagcua

SEQ ID NO: 254291 - RNA, 22 nt, Homo sapiens
uucaaaguuggaggacaaacug

SEQ ID NO: 254292 - RNA, 22 nt, Homo sapiens
uucaaauguucuuucaccaccc

SEQ ID NO: 254293 - RNA, 22 nt, Homo sapiens
uucaagcuacaguggcaggguu

SEQ ID NO: 254294 - RNA, 22 nt, Homo sapiens
uucaagcuauggugaucuuuuc

SEQ ID NO: 254295 - RNA, 22 nt, Homo sapiens
uucaaguagguaggaccacagg

SEQ ID NO: 254296 - RNA, 22 nt, Homo sapiens
uucaauaugucauuggcaggca

SEQ ID NO: 254297 - RNA, 22 nt, Homo sapiens
uucaauuaauauuauacucuca

SEQ ID NO: 254298 - RNA, 22 nt, Homo sapiens
uucacaaugccuuguugauggu

SEQ ID NO: 254299 - RNA, 22 nt, Homo sapiens
uucacagaguuauuuuuaugcu

SEQ ID NO: 254300 - RNA, 22 nt, Homo sapiens
uucaccagggaagucucaacuc

SEQ ID NO: 254301 - RNA, 21 nt, Homo sapiens
uucaccauggcuccacacucu

SEQ ID NO: 254302 - RNA, 22 nt, Homo sapiens
uucaccggggaccccuggcugu

SEQ ID NO: 254303 - RNA, 22 nt, Homo sapiens
uucacugagccagacuaagaca

SEQ ID NO: 254304 - RNA, 22 nt, Homo sapiens
uucacugcaugaaaaggacagc

SEQ ID NO: 254305 - RNA, 20 nt, Homo sapiens
uucacugggcucucuguugg

SEQ ID NO: 254306 - RNA, 22 nt, Homo sapiens
uucacugggugugguggcucac

SEQ ID NO: 254307 - RNA, 22 nt, Homo sapiens
uucacuguagccucagccucuu

SEQ ID NO: 254308 - RNA, 22 nt, Homo sapiens
uucacuguagcuuggauguuua

SEQ ID NO: 254309 - RNA, 22 nt, Homo sapiens
uucacugugcuuaaauucugcu

SEQ ID NO: 254310 - RNA, 22 nt, Homo sapiens
uucagagugguaugaagugaug

SEQ ID NO: 254311 - RNA, 22 nt, Homo sapiens
uucagcacaguguggaucauuc

SEQ ID NO: 254312 - RNA, 22 nt, Homo sapiens
uucagcaguggccaguggaaau

SEQ ID NO: 254313 - RNA, 19 nt, Homo sapiens
uucagcagugucugcucuu

SEQ ID NO: 254314 - RNA, 22 nt, Homo sapiens
uucagguacuauaggcuguugg

SEQ ID NO: 254315 - RNA, 22 nt, Homo sapiens
uucagguucauuugcugcuauu

SEQ ID NO: 254316 - RNA, 22 nt, Homo sapiens
uucaguacacguguucucauuu

SEQ ID NO: 254317 - RNA, 23 nt, Homo sapiens
uucaguauugaaugauggcgcug

SEQ ID NO: 254318 - RNA, 20 nt, Homo sapiens
uucagugcagguaacaaucc

SEQ ID NO: 254319 - RNA, 18 nt, Homo sapiens
uucaguuuguaucugggg

SEQ ID NO: 254320 - RNA, 18 nt, Homo sapiens
uucauaguagcaugauuu

SEQ ID NO: 254321 - RNA, 22 nt, Homo sapiens
uucauaguguuuccuuccagug

SEQ ID NO: 254322 - RNA, 21 nt, Homo sapiens
uucauaugcacugagugccca

SEQ ID NO: 254323 - RNA, 22 nt, Homo sapiens
uucaucagggagaaauaauuuc

SEQ ID NO: 254324 - RNA, 21 nt, Homo sapiens
uucaucuggccguauuccagg

SEQ ID NO: 254325 - RNA, 20 nt, Homo sapiens
uucaugggagcaaagaggcc

SEQ ID NO: 254326 - RNA, 22 nt, Homo sapiens
uucauguaauauuucacagcuu

SEQ ID NO: 254327 - RNA, 22 nt, Homo sapiens
uuccacagggauuugcauugau

SEQ ID NO: 254328 - RNA, 22 nt, Homo sapiens
uuccacaggguugaacuaguuu

SEQ ID NO: 254329 - RNA, 16 nt, Homo sapiens
uuccacagucgaggug

SEQ ID NO: 254330 - RNA, 23 nt, Homo sapiens
uuccaccauugacuaguuacaua

SEQ ID NO: 254331 - RNA, 22 nt, Homo sapiens
uuccaguggacuacuucauccu

SEQ ID NO: 254332 - RNA, 22 nt, Homo sapiens
uuccaguggaguaaauggacaa

SEQ ID NO: 254333 - RNA, 22 nt, Homo sapiens
uuccaugagaugcaucaaagcu

SEQ ID NO: 254334 - RNA, 22 nt, Homo sapiens
uuccauguaguugagcaguuuu

SEQ ID NO: 254335 - RNA, 22 nt, Homo sapiens
uuccauuuguucggugucgcca

SEQ ID NO: 254336 - RNA, 22 nt, Homo sapiens
uucccaguuggggaaagcgacc

SEQ ID NO: 254337 - RNA, 22 nt, Homo sapiens
uucccugaaguguuacucuaga

SEQ ID NO: 254338 - RNA, 22 nt, Homo sapiens
uucccugugggcuggugcucca

SEQ ID NO: 254339 - RNA, 22 nt, Homo sapiens
uucccugugguauagaagccgu

SEQ ID NO: 254340 - RNA, 22 nt, Homo sapiens
uucccuuucuuaaagaguuagg

SEQ ID NO: 254341 - RNA, 22 nt, Homo sapiens
uucccuuugaaacuaaacuugc

SEQ ID NO: 254342 - RNA, 22 nt, Homo sapiens
uucccuuugaauuggaaaggug

SEQ ID NO: 254343 - RNA, 22 nt, Homo sapiens
uucccuuugugcauaggauuug

SEQ ID NO: 254344 - RNA, 22 nt, Homo sapiens
uuccugagccuuguaucuagua

SEQ ID NO: 254345 - RNA, 22 nt, Homo sapiens
uuccugaggccuccccagaagc

SEQ ID NO: 254346 - RNA, 22 nt, Homo sapiens
uuccugcacuugcuugccuaug

SEQ ID NO: 254347 - RNA, 22 nt, Homo sapiens
uuccuugaaacagucaagagaa

SEQ ID NO: 254348 - RNA, 22 nt, Homo sapiens
uuccuugguucagggaaggucc

SEQ ID NO: 254349 - RNA, 22 nt, Homo sapiens
uucgagagaaaaggcauauaug

SEQ ID NO: 254350 - RNA, 22 nt, Homo sapiens
uucuacagugacugcagccaua

SEQ ID NO: 254351 - RNA, 22 nt, Homo sapiens
uucuagcaauggcagagugucu

SEQ ID NO: 254352 - RNA, 22 nt, Homo sapiens
uucucaaggagccuucguaacu

SEQ ID NO: 254353 - RNA, 22 nt, Homo sapiens
uucucaauggcaacuuguugcu

SEQ ID NO: 254354 - RNA, 17 nt, Homo sapiens
uucucaguucugaucuc

SEQ ID NO: 254355 - RNA, 22 nt, Homo sapiens
uucucauggaacaucuguacug

SEQ ID NO: 254356 - RNA, 22 nt, Homo sapiens
uucuccugguggacccuaaacg

SEQ ID NO: 254357 - RNA, 22 nt, Homo sapiens
uucucgcuuuuuccaccuguau

SEQ ID NO: 254358 - RNA, 22 nt, Homo sapiens
uucugagguuauauucucucaa

SEQ ID NO: 254359 - RNA, 22 nt, Homo sapiens
uucuggccccucccaaucucau

SEQ ID NO: 254360 - RNA, 22 nt, Homo sapiens
uucuggcucaggucaacacuuc

SEQ ID NO: 254361 - RNA, 22 nt, Homo sapiens
uucuggcuuuuaaagaaauguu

SEQ ID NO: 254362 - RNA, 22 nt, Homo sapiens
uucuucaguuacaacaaggggg

SEQ ID NO: 254363 - RNA, 20 nt, Homo sapiens
uucuugaguuaacaaguuac

SEQ ID NO: 254364 - RNA, 22 nt, Homo sapiens
uucuugcuguauccucacaugg

SEQ ID NO: 254365 - RNA, 22 nt, Homo sapiens
uucuugguguaguaguugaaaa

SEQ ID NO: 254366 - RNA, 22 nt, Homo sapiens
uucuuugcaugaucucaaaguc

SEQ ID NO: 254367 - RNA, 22 nt, Homo sapiens
uucuuuggaaacaguacuaauu

SEQ ID NO: 254368 - RNA, 22 nt, Homo sapiens
uucuuuggauaaaguuuuaugc

SEQ ID NO: 254369 - RNA, 22 nt, Homo sapiens
uugaaagucuaggcuuacagua

SEQ ID NO: 254370 - RNA, 22 nt, Homo sapiens
uugaagacuaccuaccauacuu

SEQ ID NO: 254371 - RNA, 22 nt, Homo sapiens
uugaagacuauaugauucuuca

SEQ ID NO: 254372 - RNA, 22 nt, Homo sapiens
uugaagguagaaguucucaauu

SEQ ID NO: 254373 - RNA, 22 nt, Homo sapiens
uugaaguagcauuucaugucua

SEQ ID NO: 254374 - RNA, 22 nt, Homo sapiens
uugaagugaagaacaauaucac

SEQ ID NO: 254375 - RNA, 22 nt, Homo sapiens
uugaaugaauggaaagaagggu

SEQ ID NO: 254376 - RNA, 22 nt, Homo sapiens
uugaaugucuauuaaguuguuu

SEQ ID NO: 254377 - RNA, 22 nt, Homo sapiens
uugucacugcacuccagucugg

SEQ ID NO: 254378 - RNA, 22 nt, Homo sapiens
uugugaaaucuaggcagagguu

SEQ ID NO: 254379 - RNA, 18 nt, Homo sapiens
uugugccugagaaggugg

SEQ ID NO: 254380 - RNA, 22 nt, Homo sapiens
uugugcuucaucaccuagcaga

SEQ ID NO: 254381 - RNA, 22 nt, Homo sapiens
uugugcuugauuugccuagcug

SEQ ID NO: 254382 - RNA, 22 nt, Homo sapiens
uugugguaggaguugccauguu

SEQ ID NO: 254383 - RNA, 22 nt, Homo sapiens
uugugguaggcauguaagauga

SEQ ID NO: 254384 - RNA, 22 nt, Homo sapiens
uugugguuuuuaaaacuaggug

SEQ ID NO: 254385 - RNA, 22 nt, Homo sapiens
uuguuaagaugcagauucugga

SEQ ID NO: 254386 - RNA, 22 nt, Homo sapiens
uuguuugguugaguauggaagu

SEQ ID NO: 254387 - RNA, 22 nt, Homo sapiens
uuuaaagcaugacgagaagaag

SEQ ID NO: 254388 - RNA, 22 nt, Homo sapiens
uuuaacauuggaugagaucguc

SEQ ID NO: 254389 - RNA, 20 nt, Homo sapiens
uuuaagacaugcugaauuga

SEQ ID NO: 254390 - RNA, 22 nt, Homo sapiens
uuuaaugcgucucugaguuuug

SEQ ID NO: 254391 - RNA, 22 nt, Homo sapiens
uuuacagucucauagguggaag

SEQ ID NO: 254392 - RNA, 22 nt, Homo sapiens
uuuacagucuuuugugugaguc

SEQ ID NO: 254393 - RNA, 22 nt, Homo sapiens
uuuagcaauucauuuugugucu

SEQ ID NO: 254394 - RNA, 22 nt, Homo sapiens
uuuauccagccucuagcaaggu

SEQ ID NO: 254395 - RNA, 22 nt, Homo sapiens
uuuauucggcuaggagcuucgg

SEQ ID NO: 254396 - RNA, 19 nt, Homo sapiens
uuucaauguaaggauggag

SEQ ID NO: 254397 - RNA, 22 nt, Homo sapiens
uuucacagcaauugccuauugu

SEQ ID NO: 254398 - RNA, 22 nt, Homo sapiens
uuucaccguguuggccaggcug

SEQ ID NO: 254399 - RNA, 21 nt, Homo sapiens
uuucacugugaguuuuucugu

SEQ ID NO: 254400 - RNA, 22 nt, Homo sapiens
uuucagagucaucugcccaagu

SEQ ID NO: 254401 - RNA, 22 nt, Homo sapiens
uuucauccggcuguguauuaug

SEQ ID NO: 254402 - RNA, 19 nt, Homo sapiens
uuuccaguaaucuuaugug

SEQ ID NO: 254403 - RNA, 22 nt, Homo sapiens
uuuccaguuggaagaaggggga

SEQ ID NO: 254404 - RNA, 22 nt, Homo sapiens
uuucccauuguucugcucugug

SEQ ID NO: 254405 - RNA, 16 nt, Homo sapiens
uuucccuuugguguuu

SEQ ID NO: 254406 - RNA, 21 nt, Homo sapiens
uuuccuggagcguauggcuuc

SEQ ID NO: 254407 - RNA, 22 nt, Homo sapiens
uuuccuguaggaaggaaauaga

SEQ ID NO: 254408 - RNA, 22 nt, Homo sapiens
uuuccuguagggggcaaggccu

SEQ ID NO: 254409 - RNA, 17 nt, Homo sapiens
uuucucagcccucuucu

SEQ ID NO: 254410 - RNA, 22 nt, Homo sapiens
uuucugagaccaaaacuuguaa

SEQ ID NO: 254411 - RNA, 22 nt, Homo sapiens
uuucugugguccucuugaaggu

SEQ ID NO: 254412 - RNA, 22 nt, Homo sapiens
uuucuuggagcucuuagggucg

SEQ ID NO: 254413 - RNA, 19 nt, Homo sapiens
uuugaauauaaugcagcua

SEQ ID NO: 254414 - RNA, 22 nt, Homo sapiens
uuugacuacugaugguguacgc

SEQ ID NO: 254415 - RNA, 22 nt, Homo sapiens
uuugacuagaguguuuuacaac

SEQ ID NO: 254416 - RNA, 18 nt, Homo sapiens
uuugacugguguccuuau

SEQ ID NO: 254417 - RNA, 22 nt, Homo sapiens
uuugagcaagaggugacauuau

SEQ ID NO: 254418 - RNA, 22 nt, Homo sapiens
uuugaguaggcuuauauuuugg

SEQ ID NO: 254419 - RNA, 22 nt, Homo sapiens
uuugaguuugaggugcugauga

SEQ ID NO: 254420 - RNA, 22 nt, Homo sapiens
uuugcaauagguuguggggagg

SEQ ID NO: 254421 - RNA, 22 nt, Homo sapiens
uuugcaccuuccuaguggcuga

SEQ ID NO: 254422 - RNA, 22 nt, Homo sapiens
uuugcacuucugagugugacau

SEQ ID NO: 254423 - RNA, 22 nt, Homo sapiens
uuugcacuuuaauauaauguga

SEQ ID NO: 254424 - RNA, 22 nt, Homo sapiens
uuugcagugucagcuucugugu

SEQ ID NO: 254425 - RNA, 19 nt, Homo sapiens
uuugcauagugagaauaua

SEQ ID NO: 254426 - RNA, 22 nt, Homo sapiens
uuugcaugcuccuuaugagaau

SEQ ID NO: 254427 - RNA, 19 nt, Homo sapiens
uuugccuaggcacauggcc

SEQ ID NO: 254428 - RNA, 22 nt, Homo sapiens
uuugccuuugugauauggucua

SEQ ID NO: 254429 - RNA, 22 nt, Homo sapiens
uuugcuuaaaguccuuguggga

SEQ ID NO: 254430 - RNA, 20 nt, Homo sapiens
uuuggcacugagugguauaa

SEQ ID NO: 254431 - RNA, 22 nt, Homo sapiens
uuuggcagaaaacuaaaaggua

SEQ ID NO: 254432 - RNA, 22 nt, Homo sapiens
uuuggcauuagagagacuugca

SEQ ID NO: 254433 - RNA, 22 nt, Homo sapiens
uuugguuauuugaaacuagcau

SEQ ID NO: 254434 - RNA, 22 nt, Homo sapiens
uuuguaagaugcauagauugca

SEQ ID NO: 254435 - RNA, 22 nt, Homo sapiens
uuuguaauccuauuccaaagga

SEQ ID NO: 254436 - RNA, 22 nt, Homo sapiens
uuuguacacgugggugaauugu

SEQ ID NO: 254437 - RNA, 22 nt, Homo sapiens
uuugugaaugucauaagcucca

SEQ ID NO: 254438 - RNA, 22 nt, Homo sapiens
uuugugacacaaacacauauau

SEQ ID NO: 254439 - RNA, 22 nt, Homo sapiens
uuugugauugcacacucaagau

SEQ ID NO: 254440 - RNA, 22 nt, Homo sapiens
uuugugcaugaagagggggugc

SEQ ID NO: 254441 - RNA, 22 nt, Homo sapiens
uuugugcuaaugcuagauuacu

SEQ ID NO: 254442 - RNA, 22 nt, Homo sapiens
uuugugcuccuaugagaaucua

SEQ ID NO: 254443 - RNA, 21 nt, Homo sapiens
uuuguguccccacccaaaucu

SEQ ID NO: 254444 - RNA, 22 nt, Homo sapiens
uuuguguggccuuggccuggca

SEQ ID NO: 254445 - RNA, 22 nt, Homo sapiens
uuuguucuucguuccugagcca

SEQ ID NO: 254446 - RNA, 22 nt, Homo sapiens
uuuuaacagccaggggacggcc

SEQ ID NO: 254447 - RNA, 22 nt, Homo sapiens
uuuuacacuguugguuggaaug

SEQ ID NO: 254448 - RNA, 22 nt, Homo sapiens
uuuuacagaggagguugcugau

SEQ ID NO: 254449 - RNA, 20 nt, Homo sapiens
uuuuagcacuuguuauggug

SEQ ID NO: 254450 - RNA, 22 nt, Homo sapiens
uuuucaguuuuccagguagccg

SEQ ID NO: 254451 - RNA, 22 nt, Homo sapiens
uuuuccagugggacucccauua

SEQ ID NO: 254452 - RNA, 22 nt, Homo sapiens
uuuugcacauugauuugguauc

SEQ ID NO: 254453 - RNA, 22 nt, Homo sapiens
uuuugcaggucaggggcagaga

SEQ ID NO: 254454 - RNA, 19 nt, Homo sapiens
uuuuggaaaugugaacagc

SEQ ID NO: 254455 - RNA, 22 nt, Homo sapiens
uuuugguauacacaaggguccu

SEQ ID NO: 254456 - RNA, 21 nt, Homo sapiens
uuuuggucauucaggaagaaa

SEQ ID NO: 254457 - RNA, 22 nt, Homo sapiens
uuuugguguauuguauaaggua

SEQ ID NO: 254458 - RNA, 19 nt, Homo sapiens
uuuuguacucugugacuug

SEQ ID NO: 254459 - RNA, 22 nt, Homo sapiens
uuuuuauggccaauccucagaa

SEQ ID NO: 254460 - RNA, 22 nt, Homo sapiens
uuuuucacuuaaguuaggcuca

SEQ ID NO: 254461 - RNA, 22 nt, Homo sapiens
uuuuugguugguaggcuauuaa

SEQ ID NO: 254462 - RNA, 22 nt, Homo sapiens
uuuuuugguaauugaacaauga

SEQ ID NO: 254463 - RNA, 22 nt, Homo sapiens
agcacagugguuaaguuucuua

SEQ ID NO: 254464 - RNA, 22 nt, Homo sapiens
agcaccauuguacuccagccug

SEQ ID NO: 254465 - RNA, 22 nt, Homo sapiens
agcagcaauuuuguaugguuua

SEQ ID NO: 254466 - RNA, 22 nt, Homo sapiens
agcagcaucgggaaguuggcca

SEQ ID NO: 254467 - RNA, 22 nt, Homo sapiens
agcagcaugaggggacuucugc

SEQ ID NO: 254468 - RNA, 22 nt, Homo sapiens
agcagcauuaugauauaucuua

SEQ ID NO: 254469 - RNA, 20 nt, Homo sapiens
agcagccacagauuccucag

SEQ ID NO: 254470 - RNA, 22 nt, Homo sapiens
agcagcucaugccuuugggagg

SEQ ID NO: 254471 - RNA, 22 nt, Homo sapiens
agcagcuuugaucugaaugauu

SEQ ID NO: 254472 - RNA, 22 nt, Homo sapiens
uuaaagugcacacgggucaggc

SEQ ID NO: 254473 - RNA, 22 nt, Homo sapiens
uuaaaguguuuucaaaauguca

SEQ ID NO: 254474 - RNA, 22 nt, Homo sapiens
uuaaauacagcaugguguuucu

SEQ ID NO: 254475 - RNA, 22 nt, Homo sapiens
uuaaaugcuagaauuuucuuug

SEQ ID NO: 254476 - RNA, 22 nt, Homo sapiens
uuaaaugucuguagaugugcug

SEQ ID NO: 254477 - RNA, 22 nt, Homo sapiens
uuaacagucacuuagcucauuu

SEQ ID NO: 254478 - RNA, 22 nt, Homo sapiens
uuaacaguuaauucuuuggcaa

SEQ ID NO: 254479 - RNA, 22 nt, Homo sapiens
uuaagaucagugcaaacuggag

SEQ ID NO: 254480 - RNA, 22 nt, Homo sapiens
uuaagcaguggauuagaauuuu

SEQ ID NO: 254481 - RNA, 22 nt, Homo sapiens
uuaagccacucaagagauagag

SEQ ID NO: 254482 - RNA, 22 nt, Homo sapiens
uuaagccaggugugguggcaca

SEQ ID NO: 254483 - RNA, 22 nt, Homo sapiens
uuaaggaaagcauuuaauucag

SEQ ID NO: 254484 - RNA, 22 nt, Homo sapiens
uuaaggcagugucuaugccagu

SEQ ID NO: 254485 - RNA, 22 nt, Homo sapiens
uuaaggcuuucccuauguaaaa

SEQ ID NO: 254486 - RNA, 22 nt, Homo sapiens
uuaaggguuuuagaauuuucca

SEQ ID NO: 254487 - RNA, 22 nt, Homo sapiens
uuaaggugaaguucucagaugc

SEQ ID NO: 254488 - RNA, 21 nt, Homo sapiens
uuaaguaauuacccaacucuc

SEQ ID NO: 254489 - RNA, 22 nt, Homo sapiens
uuaagugguagguggugcccaa

SEQ ID NO: 254490 - RNA, 22 nt, Homo sapiens
uuaaugacaucauaggugaagu

SEQ ID NO: 254491 - RNA, 21 nt, Homo sapiens
uuaaugcuaugcagaaaaucu

SEQ ID NO: 254492 - RNA, 22 nt, Homo sapiens
uuaauuguaucuauagauguca

SEQ ID NO: 254493 - RNA, 22 nt, Homo sapiens
uuaauuguccaaguucaucucu

SEQ ID NO: 254494 - RNA, 22 nt, Homo sapiens
uuaauuguccauuauucuguuc

SEQ ID NO: 254495 - RNA, 22 nt, Homo sapiens
uuacaaccucagcagugcaaag

SEQ ID NO: 254496 - RNA, 22 nt, Homo sapiens
uuacaacugucuuacugguuau

SEQ ID NO: 254497 - RNA, 22 nt, Homo sapiens
uuacagauggauggcagcuggc

SEQ ID NO: 254498 - RNA, 17 nt, Homo sapiens
uuacaggugcugagagu

SEQ ID NO: 254499 - RNA, 22 nt, Homo sapiens
uuacaguaugaguaagaguucu

SEQ ID NO: 254500 - RNA, 22 nt, Homo sapiens
uuacauguggugugaagaagag

SEQ ID NO: 254501 - RNA, 22 nt, Homo sapiens
uuacauugcuucaaauucagug

SEQ ID NO: 254502 - RNA, 22 nt, Homo sapiens
uuaccucuguggcucucggacu

SEQ ID NO: 254503 - RNA, 20 nt, Homo sapiens
uuacuccuuaaugagguuuu

SEQ ID NO: 254504 - RNA, 22 nt, Homo sapiens
uuacuugagauggggugucacu

SEQ ID NO: 254505 - RNA, 17 nt, Homo sapiens
uuagacagacauccugc

SEQ ID NO: 254506 - RNA, 22 nt, Homo sapiens
uuagacaguggugcacugcacu

SEQ ID NO: 254507 - RNA, 22 nt, Homo sapiens
uuagauaguacugaaugguucu

SEQ ID NO: 254508 - RNA, 22 nt, Homo sapiens
uuagauaguacuuagggaaaua

SEQ ID NO: 254509 - RNA, 22 nt, Homo sapiens
uuagaugguucaccaugaguag

SEQ ID NO: 254510 - RNA, 22 nt, Homo sapiens
uuagcaauugauucucauaagc

SEQ ID NO: 254511 - RNA, 22 nt, Homo sapiens
uuagcagcaugagaauggacua

SEQ ID NO: 254512 - RNA, 20 nt, Homo sapiens
uuagcagcaugauuuauaau

SEQ ID NO: 254513 - RNA, 22 nt, Homo sapiens
uuagcagugugagcacagacua

SEQ ID NO: 254514 - RNA, 21 nt, Homo sapiens
uuagcauccauguucaucaac

SEQ ID NO: 254515 - RNA, 22 nt, Homo sapiens
uuaggcucuuuaucaguuaacu

SEQ ID NO: 254516 - RNA, 22 nt, Homo sapiens
uuagggcaggcaugagagaacu

SEQ ID NO: 254517 - RNA, 22 nt, Homo sapiens
uuagugaaugcaccacuucuga

SEQ ID NO: 254518 - RNA, 19 nt, Homo sapiens
uuauauaguuucugaggcu

SEQ ID NO: 254519 - RNA, 22 nt, Homo sapiens
uuauaugcuaaacaaggggugg

SEQ ID NO: 254520 - RNA, 22 nt, Homo sapiens
uuaucagcagcaugaaacugga

SEQ ID NO: 254521 - RNA, 22 nt, Homo sapiens
uuaucauagugcaguuuucuga

SEQ ID NO: 254522 - RNA, 17 nt, Homo sapiens
uuaugagacuucuuagc

SEQ ID NO: 254523 - RNA, 22 nt, Homo sapiens
uuaugucuuugagcaaugcugu

SEQ ID NO: 254524 - RNA, 22 nt, Homo sapiens
uuaugucuuuuguguucagcua

SEQ ID NO: 254525 - RNA, 22 nt, Homo sapiens
uuauuagguuagugcaaaaguu

SEQ ID NO: 254526 - RNA, 22 nt, Homo sapiens
uuauuauguuggugcaaaggua

SEQ ID NO: 254527 - RNA, 22 nt, Homo sapiens
uuauucagcaccugcuguguuc

SEQ ID NO: 254528 - RNA, 22 nt, Homo sapiens
uuauugaguaaaaagaaugguu

SEQ ID NO: 254529 - RNA, 22 nt, Homo sapiens
uuauugcacuccagccugggua

SEQ ID NO: 254530 - RNA, 17 nt, Homo sapiens
uuauugcuauaagcuga

SEQ ID NO: 254531 - RNA, 22 nt, Homo sapiens
uucaaaguaaaaauguguucac

SEQ ID NO: 254532 - RNA, 22 nt, Homo sapiens
uucaacugcuucagccucccaa

SEQ ID NO: 254533 - RNA, 22 nt, Homo sapiens
uucaagaauuaaaguggcuuuu

SEQ ID NO: 254534 - RNA, 22 nt, Homo sapiens
uucaagcugggcaaauaagggg

SEQ ID NO: 254535 - RNA, 22 nt, Homo sapiens
uucaagucaacaagcacuugag

SEQ ID NO: 254536 - RNA, 22 nt, Homo sapiens
uucaagucaaggaaagaggucu

SEQ ID NO: 254537 - RNA, 22 nt, Homo sapiens
uucaagucuuggcuuugccacc

SEQ ID NO: 254538 - RNA, 22 nt, Homo sapiens
uucacaauuaaaugugguuauu

SEQ ID NO: 254539 - RNA, 22 nt, Homo sapiens
uucacacugggccuacucugug

SEQ ID NO: 254540 - RNA, 22 nt, Homo sapiens
uucacaguacucccuggaauua

SEQ ID NO: 254541 - RNA, 22 nt, Homo sapiens
uucacaguguguacaccagggg

SEQ ID NO: 254542 - RNA, 22 nt, Homo sapiens
uucacaguguuucucacgguua

SEQ ID NO: 254543 - RNA, 22 nt, Homo sapiens
uucacaugacagggugaagcau

SEQ ID NO: 254544 - RNA, 22 nt, Homo sapiens
uucacaugguugccuuuugauc

SEQ ID NO: 254545 - RNA, 23 nt, Homo sapiens
uucaccguguuggccaggcuggu

SEQ ID NO: 254546 - RNA, 22 nt, Homo sapiens
uucaccuggaguucaggauaag

SEQ ID NO: 254547 - RNA, 22 nt, Homo sapiens
uucaccuugggucccacuugcu

SEQ ID NO: 254548 - RNA, 22 nt, Homo sapiens
uucacgguguucacgggggucc

SEQ ID NO: 254549 - RNA, 21 nt, Homo sapiens
uucacuggucuauuucccuuu

SEQ ID NO: 254550 - RNA, 22 nt, Homo sapiens
uucagagagggagggauaccua

SEQ ID NO: 254551 - RNA, 22 nt, Homo sapiens
uucagagugaggcucucggaac

SEQ ID NO: 254552 - RNA, 22 nt, Homo sapiens
uucaggcaccauggucauugau

SEQ ID NO: 254553 - RNA, 22 nt, Homo sapiens
uucaguggagaggcugaguggu

SEQ ID NO: 254554 - RNA, 22 nt, Homo sapiens
uucaguucugcacugaucuuag

SEQ ID NO: 254555 - RNA, 22 nt, Homo sapiens
uucauaguguaccugaaggcac

SEQ ID NO: 254556 - RNA, 22 nt, Homo sapiens
uucauggaacaaguggguucaa

SEQ ID NO: 254557 - RNA, 22 nt, Homo sapiens
uucauggaguugagaaggcuaa

SEQ ID NO: 254558 - RNA, 22 nt, Homo sapiens
uucauguaauauauuucaggcc

SEQ ID NO: 254559 - RNA, 22 nt, Homo sapiens
uucauuggacuuguguucuuga

SEQ ID NO: 254560 - RNA, 22 nt, Homo sapiens
uucauuggauguuacacugugu

SEQ ID NO: 254561 - RNA, 22 nt, Homo sapiens
uuccacaauggcugaacuaguu

SEQ ID NO: 254562 - RNA, 22 nt, Homo sapiens
uuccagugggacgagaugugga

SEQ ID NO: 254563 - RNA, 22 nt, Homo sapiens
uuccaguguuugacucaccuuu

SEQ ID NO: 254564 - RNA, 22 nt, Homo sapiens
uuccauagucauagugcugaug

SEQ ID NO: 254565 - RNA, 22 nt, Homo sapiens
uucuuugguacaagggccgacc

SEQ ID NO: 254566 - RNA, 22 nt, Homo sapiens
uugaaccauucuuuugauagag

SEQ ID NO: 254567 - RNA, 22 nt, Homo sapiens
uugaaggaggugcucacucucg

SEQ ID NO: 254568 - RNA, 19 nt, Homo sapiens
uugaaggccgccuugcaga

SEQ ID NO: 254569 - RNA, 22 nt, Homo sapiens
uugaauagacagccagcuuuaa

SEQ ID NO: 254570 - RNA, 22 nt, Homo sapiens
uugaauaggcucaugcuuauca

SEQ ID NO: 254571 - RNA, 22 nt, Homo sapiens
uugaauagugacuuugauucug

SEQ ID NO: 254572 - RNA, 22 nt, Homo sapiens
uugaaugaaauuggugugggga

SEQ ID NO: 254573 - RNA, 22 nt, Homo sapiens
uugaauguacuuguucucacua

SEQ ID NO: 254574 - RNA, 22 nt, Homo sapiens
uugaauguaugcuggguuuacu

SEQ ID NO: 254575 - RNA, 23 nt, Homo sapiens
uugaauguuuccccucccaaauu

SEQ ID NO: 254576 - RNA, 22 nt, Homo sapiens
uugacauauguguguccacaua

SEQ ID NO: 254577 - RNA, 23 nt, Homo sapiens
uugacuguggguacaaugugaua

SEQ ID NO: 254578 - RNA, 22 nt, Homo sapiens
uugacugugguaauggaagcug

SEQ ID NO: 254579 - RNA, 22 nt, Homo sapiens
uugacuucagagcugauucaag

SEQ ID NO: 254580 - RNA, 21 nt, Homo sapiens
uugagaagaauuagcucuucc

SEQ ID NO: 254581 - RNA, 22 nt, Homo sapiens
uugagagaaaaggccaugccuu

SEQ ID NO: 254582 - RNA, 22 nt, Homo sapiens
uugagauagggucuaccucugu

SEQ ID NO: 254583 - RNA, 22 nt, Homo sapiens
uugagauauccauaaaugggaa

SEQ ID NO: 254584 - RNA, 22 nt, Homo sapiens
uugagauaucuuggccuuugca

SEQ ID NO: 254585 - RNA, 22 nt, Homo sapiens
uugagaugauggauaugcuaau

SEQ ID NO: 254586 - RNA, 22 nt, Homo sapiens
uugagauggaaucucgcuuugu

SEQ ID NO: 254587 - RNA, 22 nt, Homo sapiens
uugagauggagccucacucugc

SEQ ID NO: 254588 - RNA, 22 nt, Homo sapiens
uugagauggagcuucacucuug

SEQ ID NO: 254589 - RNA, 22 nt, Homo sapiens
uugagauggagucucacugugu

SEQ ID NO: 254590 - RNA, 22 nt, Homo sapiens
uugagauggagucucgcacugu

SEQ ID NO: 254591 - RNA, 22 nt, Homo sapiens
uugagauggagucucgcucugu

SEQ ID NO: 254592 - RNA, 22 nt, Homo sapiens
uugagauggagucuugcgcugu

SEQ ID NO: 254593 - RNA, 22 nt, Homo sapiens
uugagauggagucuuguucucu

SEQ ID NO: 254594 - RNA, 22 nt, Homo sapiens
uugagauggaguuucaauauug

SEQ ID NO: 254595 - RNA, 22 nt, Homo sapiens
uugagauggaguuucacucuug

SEQ ID NO: 254596 - RNA, 22 nt, Homo sapiens
uugagauggaguuucgcucuug

SEQ ID NO: 254597 - RNA, 22 nt, Homo sapiens
uugagcaaugaacgauucaggg

SEQ ID NO: 254598 - RNA, 22 nt, Homo sapiens
uugaggaagugguuccccagag

SEQ ID NO: 254599 - RNA, 22 nt, Homo sapiens
uugaggaaugucauuuguguuu

SEQ ID NO: 254600 - RNA, 16 nt, Homo sapiens
uugaggcaugucucag

SEQ ID NO: 254601 - RNA, 22 nt, Homo sapiens
uugaggucuuugagcaaacgca

SEQ ID NO: 254602 - RNA, 22 nt, Homo sapiens
uugaggugaagggcagagcagc

SEQ ID NO: 254603 - RNA, 22 nt, Homo sapiens
uugagugaaggcuguguucuug

SEQ ID NO: 254604 - RNA, 22 nt, Homo sapiens
uugauagacacauauccaugug

SEQ ID NO: 254605 - RNA, 22 nt, Homo sapiens
uugauauguggaauauuuaucu

SEQ ID NO: 254606 - RNA, 22 nt, Homo sapiens
uugauauguguauagcaugugg

SEQ ID NO: 254607 - RNA, 22 nt, Homo sapiens
uugauauuaaguacugaagugg

SEQ ID NO: 254608 - RNA, 22 nt, Homo sapiens
uugauauuacucaguaacagau

SEQ ID NO: 254609 - RNA, 22 nt, Homo sapiens
uugauguugaggacauaaaccu

SEQ ID NO: 254610 - RNA, 22 nt, Homo sapiens
uugcaacauguauucuggugau

SEQ ID NO: 254611 - RNA, 22 nt, Homo sapiens
uugcaacuuagaaaaaucauuu

SEQ ID NO: 254612 - RNA, 22 nt, Homo sapiens
uugcaagaaaugcagauucuca

SEQ ID NO: 254613 - RNA, 22 nt, Homo sapiens
uugcacaauccugugagugagu

SEQ ID NO: 254614 - RNA, 22 nt, Homo sapiens
uuugaaugcaacaaaugcggga

SEQ ID NO: 254615 - RNA, 22 nt, Homo sapiens
uuugaauggaaguuuugugaaa

SEQ ID NO: 254616 - RNA, 22 nt, Homo sapiens
uuugacuaccaggaauguucuu

SEQ ID NO: 254617 - RNA, 22 nt, Homo sapiens
uuugacucacagccuggcugcc

SEQ ID NO: 254618 - RNA, 22 nt, Homo sapiens
uuugagaaugcuaccagagaag

SEQ ID NO: 254619 - RNA, 22 nt, Homo sapiens
uuugagcaggcuaaucaauaua

SEQ ID NO: 254620 - RNA, 22 nt, Homo sapiens
uuugagcaugcagauugccagg

SEQ ID NO: 254621 - RNA, 22 nt, Homo sapiens
uuugaggaaaggcauaaguagg

SEQ ID NO: 254622 - RNA, 21 nt, Homo sapiens
uuugaucauuaaaagugaauc

SEQ ID NO: 254623 - RNA, 22 nt, Homo sapiens
uuugcaauguugugauggugaa

SEQ ID NO: 254624 - RNA, 22 nt, Homo sapiens
uuugcacucaguaagugggagc

SEQ ID NO: 254625 - RNA, 23 nt, Homo sapiens
uuugcacuugcuccuucuauggc

SEQ ID NO: 254626 - RNA, 21 nt, Homo sapiens
uuugcacuuugcaaaucccua

SEQ ID NO: 254627 - RNA, 22 nt, Homo sapiens
uuugcagagacuuguuaggaau

SEQ ID NO: 254628 - RNA, 22 nt, Homo sapiens
uuugcaguguaguuggccagca

SEQ ID NO: 254629 - RNA, 22 nt, Homo sapiens
uuugcauaauaagauuagggug

SEQ ID NO: 254630 - RNA, 22 nt, Homo sapiens
uuugccaaucagaggcaucuug

SEQ ID NO: 254631 - RNA, 23 nt, Homo sapiens
uuugccacuuauuagcugggagg

SEQ ID NO: 254632 - RNA, 18 nt, Homo sapiens
uuugccacuucccagaaa

SEQ ID NO: 254633 - RNA, 22 nt, Homo sapiens
uuugcuauagugaauagugcug

SEQ ID NO: 254634 - RNA, 22 nt, Homo sapiens
uuugcugagucugacuucaugg

SEQ ID NO: 254635 - RNA, 22 nt, Homo sapiens
uuuggaaugugcacucagauug

SEQ ID NO: 254636 - RNA, 22 nt, Homo sapiens
uuuggcacuauagguaaauuug

SEQ ID NO: 254637 - RNA, 22 nt, Homo sapiens
uuuggcucugugucccacccaa

SEQ ID NO: 254638 - RNA, 18 nt, Homo sapiens
uuuggcuguucaugacuc

SEQ ID NO: 254639 - RNA, 22 nt, Homo sapiens
uuugggcuuuuaaucuagagca

SEQ ID NO: 254640 - RNA, 22 nt, Homo sapiens
uuugguaauguuucauugcaga

SEQ ID NO: 254641 - RNA, 22 nt, Homo sapiens
uuugguuauauauauacacucu

SEQ ID NO: 254642 - RNA, 22 nt, Homo sapiens
uuugguugcauucacauauuuc

SEQ ID NO: 254643 - RNA, 22 nt, Homo sapiens
uuuguacacuguugguaggauu

SEQ ID NO: 254644 - RNA, 22 nt, Homo sapiens
uuuguacacuguuggugguuau

SEQ ID NO: 254645 - RNA, 22 nt, Homo sapiens
uuuguacuugguguucuggaaa

SEQ ID NO: 254646 - RNA, 23 nt, Homo sapiens
uuuguaguagcaugauuuauaau

SEQ ID NO: 254647 - RNA, 22 nt, Homo sapiens
uuugucacucuuggagguuguu

SEQ ID NO: 254648 - RNA, 21 nt, Homo sapiens
uuuguccaccuguguucacca

SEQ ID NO: 254649 - RNA, 22 nt, Homo sapiens
uuugucccccguaguucauaua

SEQ ID NO: 254650 - RNA, 22 nt, Homo sapiens
uuugugcuaacuuuaacucuua

SEQ ID NO: 254651 - RNA, 23 nt, Homo sapiens
uuugugcuaauuuaugggcucuu

SEQ ID NO: 254652 - RNA, 22 nt, Homo sapiens
uuugugcugcaauuaauuuccc

SEQ ID NO: 254653 - RNA, 22 nt, Homo sapiens
uuugugucccucuaaaauuuau

SEQ ID NO: 254654 - RNA, 21 nt, Homo sapiens
uuuugcacacuaugcagcuuu

SEQ ID NO: 254655 - RNA, 22 nt, Homo sapiens
uuuugcaccauccuaauaguau

SEQ ID NO: 254656 - RNA, 22 nt, Homo sapiens
uuuugcacuagaaccagagguu

SEQ ID NO: 254657 - RNA, 22 nt, Homo sapiens
uuuugcacuguuuuaucugaca

SEQ ID NO: 254658 - RNA, 22 nt, Homo sapiens
uuuuggacuucaauuugacacu

SEQ ID NO: 254659 - RNA, 22 nt, Homo sapiens
uuuuggacuugcuccccugucc

SEQ ID NO: 254660 - RNA, 22 nt, Homo sapiens
uuuuggcacuuugucugauucu

SEQ ID NO: 254661 - RNA, 22 nt, Homo sapiens
uuuuggcucuugguaggucaga

SEQ ID NO: 254662 - RNA, 22 nt, Homo sapiens
uuuugguaaugaacuuaggaag

SEQ ID NO: 254663 - RNA, 22 nt, Homo sapiens
uuuugguuaggauggguggcau

SEQ ID NO: 254664 - RNA, 22 nt, Homo sapiens
uuuugguucaauuaauuugcua

SEQ ID NO: 254665 - RNA, 22 nt, Homo sapiens
aagucauggagaagguggaggu

SEQ ID NO: 254666 - RNA, 22 nt, Homo sapiens
aagugacauugugcccauuuga

SEQ ID NO: 254667 - RNA, 22 nt, Homo sapiens
aagugcaaaucuguggcugaaa

SEQ ID NO: 254668 - RNA, 22 nt, Homo sapiens
aagugcacuguaagugcaggau

SEQ ID NO: 254669 - RNA, 22 nt, Homo sapiens
aagugcucuugaaacugccuua

SEQ ID NO: 254670 - RNA, 22 nt, Homo sapiens
aagugcuuacagggaacaugau

SEQ ID NO: 254671 - RNA, 22 nt, Homo sapiens
aagugcuucagaagacaauauu

SEQ ID NO: 254672 - RNA, 20 nt, Homo sapiens
aagugcuuccuuuuagaggg

SEQ ID NO: 254673 - RNA, 22 nt, Homo sapiens
aagugcuuuuuagauaugguuu

SEQ ID NO: 254674 - RNA, 22 nt, Homo sapiens
aaguggaauguuuguggcacaa

SEQ ID NO: 254675 - RNA, 22 nt, Homo sapiens
aagugguuuuuacaaagacaga

SEQ ID NO: 254676 - RNA, 22 nt, Homo sapiens
aagugucuuaccgggagggagu

SEQ ID NO: 254677 - RNA, 22 nt, Homo sapiens
aaguuaauguuuaagacuccua

SEQ ID NO: 254678 - RNA, 21 nt, Homo sapiens
aauaaagcaaccuuaugccau

SEQ ID NO: 254679 - RNA, 22 nt, Homo sapiens
aauaaagucugaagugugcuua

SEQ ID NO: 254680 - RNA, 21 nt, Homo sapiens
aauacucuagguuaagagagc

SEQ ID NO: 254681 - RNA, 22 nt, Homo sapiens
aauagcauugaaucuaccaauu

SEQ ID NO: 254682 - RNA, 22 nt, Homo sapiens
aauaucacaguggguguacacc

SEQ ID NO: 254683 - RNA, 22 nt, Homo sapiens
aauaugucugcuaauuguuucu

SEQ ID NO: 254684 - RNA, 21 nt, Homo sapiens
aaucacaguuguucugccuuc

SEQ ID NO: 254685 - RNA, 22 nt, Homo sapiens
aaucacuaugccaugaaguaca

SEQ ID NO: 254686 - RNA, 17 nt, Homo sapiens
aaucagauuucugagga

SEQ ID NO: 254687 - RNA, 22 nt, Homo sapiens
aauccuguagauucuaauuccu

SEQ ID NO: 254688 - RNA, 22 nt, Homo sapiens
aaucuguagaaggugcacauuc

SEQ ID NO: 254689 - RNA, 22 nt, Homo sapiens
aaucugucuuuuguuauugagg

SEQ ID NO: 254690 - RNA, 22 nt, Homo sapiens
aaugacagccagauucuucucu

SEQ ID NO: 254691 - RNA, 17 nt, Homo sapiens
aaugagacauuucugcu

SEQ ID NO: 254692 - RNA, 22 nt, Homo sapiens
aauggcacacaccuggucuaac

SEQ ID NO: 254693 - RNA, 22 nt, Homo sapiens
aauggcuauuucaugugguagg

SEQ ID NO: 254694 - RNA, 22 nt, Homo sapiens
aaugucaucuucaguuguacag

SEQ ID NO: 254695 - RNA, 22 nt, Homo sapiens
aauuacauggcaauugggaaau

SEQ ID NO: 254696 - RNA, 22 nt, Homo sapiens
aauugcaauggacaaugcagca

SEQ ID NO: 254697 - RNA, 22 nt, Homo sapiens
aauugcuucuguauuuuggaca

SEQ ID NO: 254698 - RNA, 23 nt, Homo sapiens
aauugcuuuugaggacuuaguug

SEQ ID NO: 254699 - RNA, 22 nt, Homo sapiens
aauuguacucccauaauucccu

SEQ ID NO: 254700 - RNA, 22 nt, Homo sapiens
acaaaguaggcagugggcugga

SEQ ID NO: 254701 - RNA, 22 nt, Homo sapiens
acaaccauuguaagggcuuugg

SEQ ID NO: 254702 - RNA, 22 nt, Homo sapiens
acaauggaauggaguggaaagu

SEQ ID NO: 254703 - RNA, 22 nt, Homo sapiens
acaauguauauuuuacuguagg

SEQ ID NO: 254704 - RNA, 22 nt, Homo sapiens
acacauuagcaagugcuguuau

SEQ ID NO: 254705 - RNA, 22 nt, Homo sapiens
acaccaguacuuuauacaagca

SEQ ID NO: 254706 - RNA, 22 nt, Homo sapiens
acacuacuggguauauguguuu

SEQ ID NO: 254707 - RNA, 22 nt, Homo sapiens
acacuauugagguuuguuugca

SEQ ID NO: 254708 - RNA, 22 nt, Homo sapiens
acacucucucauuacuuguuug

SEQ ID NO: 254709 - RNA, 22 nt, Homo sapiens
acacuggaggagagcuguugcu

SEQ ID NO: 254710 - RNA, 20 nt, Homo sapiens
acacuggcuuugagauuuag

SEQ ID NO: 254711 - RNA, 22 nt, Homo sapiens
acacugucucuugcugaccaug

SEQ ID NO: 254712 - RNA, 22 nt, Homo sapiens
acacuguugacauuuuguagug

SEQ ID NO: 254713 - RNA, 22 nt, Homo sapiens
acacuguuuuguggagaaugua

SEQ ID NO: 254714 - RNA, 22 nt, Homo sapiens
acagagcaaugagcuacggucu

SEQ ID NO: 254715 - RNA, 22 nt, Homo sapiens
acagauagacauauauagcuca

SEQ ID NO: 254716 - RNA, 22 nt, Homo sapiens
acagauugcugggccccagccc

SEQ ID NO: 254717 - RNA, 22 nt, Homo sapiens
acagcacugccaagugacccau

SEQ ID NO: 254718 - RNA, 19 nt, Homo sapiens
acagcugguuuugguuucu

SEQ ID NO: 254719 - RNA, 22 nt, Homo sapiens
acagguacaagggauuaggaug

SEQ ID NO: 254720 - RNA, 19 nt, Homo sapiens
acaguaccuggcaugaggu

SEQ ID NO: 254721 - RNA, 22 nt, Homo sapiens
acaguagugggcuacagaauca

SEQ ID NO: 254722 - RNA, 18 nt, Homo sapiens
acagugcuggcaugagau

SEQ ID NO: 254723 - RNA, 19 nt, Homo sapiens
acagugcuuugucagaagc

SEQ ID NO: 254724 - RNA, 23 nt, Homo sapiens
acaguggugugaucuuggcucag

SEQ ID NO: 254725 - RNA, 22 nt, Homo sapiens
acaguguagugacugccaacuu

SEQ ID NO: 254726 - RNA, 18 nt, Homo sapiens
acagugucauggcucaau

SEQ ID NO: 254727 - RNA, 22 nt, Homo sapiens
acauaguagacacugaaaauau

SEQ ID NO: 254728 - RNA, 18 nt, Homo sapiens
acaucccaugcuggggug

SEQ ID NO: 254729 - RNA, 22 nt, Homo sapiens
acaugacauugggguggggaua

SEQ ID NO: 254730 - RNA, 19 nt, Homo sapiens
acauggauuuugugcaaac

SEQ ID NO: 254731 - RNA, 22 nt, Homo sapiens
acaugguacugauuuacgaaau

SEQ ID NO: 254732 - RNA, 22 nt, Homo sapiens
acauucagcuguuguuucaaug

SEQ ID NO: 254733 - RNA, 22 nt, Homo sapiens
acauugcagauguguuuaaugu

SEQ ID NO: 254734 - RNA, 22 nt, Homo sapiens
acauugcauauggcacccucuu

SEQ ID NO: 254735 - RNA, 19 nt, Homo sapiens
acauugcauuuguaggcuu

SEQ ID NO: 254736 - RNA, 22 nt, Homo sapiens
accacuguuucaagaagcuugu

SEQ ID NO: 254737 - RNA, 22 nt, Homo sapiens
accauugcacuccagcccaggc

SEQ ID NO: 254738 - RNA, 22 nt, Homo sapiens
accauugcacuccuuucugggc

SEQ ID NO: 254739 - RNA, 22 nt, Homo sapiens
acccagaagucauucaggaaca

SEQ ID NO: 254740 - RNA, 22 nt, Homo sapiens
acccagaauucagucuuaggcc

SEQ ID NO: 254741 - RNA, 22 nt, Homo sapiens
acccaguguucagacuaccugu

SEQ ID NO: 254742 - RNA, 21 nt, Homo sapiens
acccccacaccuccuuaguuc

SEQ ID NO: 254743 - RNA, 22 nt, Homo sapiens
acccggagagcaggcgagaagg

SEQ ID NO: 254744 - RNA, 22 nt, Homo sapiens
acccucaagggacugacagaau

SEQ ID NO: 254745 - RNA, 21 nt, Homo sapiens
acccucuaguuuucaacaggc

SEQ ID NO: 254746 - RNA, 22 nt, Homo sapiens
acccuggagagugcuguaguaa

SEQ ID NO: 254747 - RNA, 22 nt, Homo sapiens
acccuggaguaguaggaaucug

SEQ ID NO: 254748 - RNA, 22 nt, Homo sapiens
acccuggauucguggccuugaa

SEQ ID NO: 254749 - RNA, 22 nt, Homo sapiens
acccugugaauauuuaaacuuc

SEQ ID NO: 254750 - RNA, 22 nt, Homo sapiens
acccuuaagcacuaguucagcu

SEQ ID NO: 254751 - RNA, 22 nt, Homo sapiens
accugagauuacaggugcuggc

SEQ ID NO: 254752 - RNA, 22 nt, Homo sapiens
accuggacacuuugggcuccuc

SEQ ID NO: 254753 - RNA, 23 nt, Homo sapiens
accugugguuauuuuacucuucc

SEQ ID NO: 254754 - RNA, 22 nt, Homo sapiens
accuuguaucuguuaggauugc

SEQ ID NO: 254755 - RNA, 22 nt, Homo sapiens
acucagagaacauucccagucu

SEQ ID NO: 254756 - RNA, 22 nt, Homo sapiens
acuccauuucauuuuagcucuu

SEQ ID NO: 254757 - RNA, 22 nt, Homo sapiens
acuccauuuggacucugggagg

SEQ ID NO: 254758 - RNA, 22 nt, Homo sapiens
acucugucuaguuguaaaauuu

SEQ ID NO: 254759 - RNA, 21 nt, Homo sapiens
acugagagaucuggggcacau

SEQ ID NO: 254760 - RNA, 22 nt, Homo sapiens
acugagccuuuaaaugacuuca

SEQ ID NO: 254761 - RNA, 19 nt, Homo sapiens
acugagcuaccugggggca

SEQ ID NO: 254762 - RNA, 21 nt, Homo sapiens
acugauguuugaaauucgcug

SEQ ID NO: 254763 - RNA, 22 nt, Homo sapiens
acugcacuccaaccuguugggc

SEQ ID NO: 254764 - RNA, 22 nt, Homo sapiens
acugcacuccaaccuuggugac

SEQ ID NO: 254765 - RNA, 22 nt, Homo sapiens
acugcacuccagacucugucuc

SEQ ID NO: 254766 - RNA, 22 nt, Homo sapiens
acugcacuccagccuaggcgac

SEQ ID NO: 254767 - RNA, 22 nt, Homo sapiens
aggcaugguggcacauacaugu

SEQ ID NO: 254768 - RNA, 23 nt, Homo sapiens
aggccaguuuuuccugcuugcug

SEQ ID NO: 254769 - RNA, 22 nt, Homo sapiens
aggcugguauuuacaaaagcuc

SEQ ID NO: 254770 - RNA, 22 nt, Homo sapiens
aggcuguguggauaauauuggg

SEQ ID NO: 254771 - RNA, 22 nt, Homo sapiens
aggcuuuauuacagggucucag

SEQ ID NO: 254772 - RNA, 22 nt, Homo sapiens
aggcuuuuggagguggcuuucu

SEQ ID NO: 254773 - RNA, 22 nt, Homo sapiens
aggcuuuuguuuuggucucagg

SEQ ID NO: 254774 - RNA, 22 nt, Homo sapiens
agggcaagacuuguuaagaaca

SEQ ID NO: 254775 - RNA, 22 nt, Homo sapiens
agggcaguguuaggacugucug

SEQ ID NO: 254776 - RNA, 22 nt, Homo sapiens
agggcuuuugagcugagauggu

SEQ ID NO: 254777 - RNA, 22 nt, Homo sapiens
agguaaguauguuauuacuuuu

SEQ ID NO: 254778 - RNA, 22 nt, Homo sapiens
agguaagucucuaauuaugaau

SEQ ID NO: 254779 - RNA, 22 nt, Homo sapiens
agguaauagcacaugauaccuu

SEQ ID NO: 254780 - RNA, 22 nt, Homo sapiens
agguagucuuuuccuauuguca

SEQ ID NO: 254781 - RNA, 20 nt, Homo sapiens
agguaguuauacaaaugugu

SEQ ID NO: 254782 - RNA, 22 nt, Homo sapiens
agguauguaugucuguacagcg

SEQ ID NO: 254783 - RNA, 22 nt, Homo sapiens
agguccauuauuuucauucaug

SEQ ID NO: 254784 - RNA, 22 nt, Homo sapiens
aggucccauguccucccugacc

SEQ ID NO: 254785 - RNA, 22 nt, Homo sapiens
aggugaaugcucacauucuaau

SEQ ID NO: 254786 - RNA, 22 nt, Homo sapiens
aggugcaugcuucacuggauau

SEQ ID NO: 254787 - RNA, 22 nt, Homo sapiens
aggugguuuuaggcagagacau

SEQ ID NO: 254788 - RNA, 22 nt, Homo sapiens
agguuaucccgcauuauuuggu

SEQ ID NO: 254789 - RNA, 16 nt, Homo sapiens
aguaguuuuacagauu

SEQ ID NO: 254790 - RNA, 22 nt, Homo sapiens
aguaucacaguggguguauacc

SEQ ID NO: 254791 - RNA, 22 nt, Homo sapiens
aguaucaucuuguuggccaggc

SEQ ID NO: 254792 - RNA, 20 nt, Homo sapiens
aguauucacuuuuuucaugg

SEQ ID NO: 254793 - RNA, 22 nt, Homo sapiens
agucaacaucaugaaguggaaa

SEQ ID NO: 254794 - RNA, 22 nt, Homo sapiens
agucaagugggguuagauaguu

SEQ ID NO: 254795 - RNA, 22 nt, Homo sapiens
agucacagccuuuuacuuuaga

SEQ ID NO: 254796 - RNA, 22 nt, Homo sapiens
agucacaugcauuuucuucaau

SEQ ID NO: 254797 - RNA, 22 nt, Homo sapiens
agucacaugccagcacacccag

SEQ ID NO: 254798 - RNA, 22 nt, Homo sapiens
agucagucuguccugugcugag

SEQ ID NO: 254799 - RNA, 22 nt, Homo sapiens
agucagugcauaagaaugaagu

SEQ ID NO: 254800 - RNA, 22 nt, Homo sapiens
agucaguggaguaaauguaauu

SEQ ID NO: 254801 - RNA, 22 nt, Homo sapiens
agucaguguguauugauggcac

SEQ ID NO: 254802 - RNA, 20 nt, Homo sapiens
agucaguuuauuuucucucu

SEQ ID NO: 254803 - RNA, 22 nt, Homo sapiens
agucaugguaguaaauuuggac

SEQ ID NO: 254804 - RNA, 22 nt, Homo sapiens
aguccaguguuaugaucaguag

SEQ ID NO: 254805 - RNA, 22 nt, Homo sapiens
agucgguguuacugacagaaug

SEQ ID NO: 254806 - RNA, 22 nt, Homo sapiens
agugauggagccaggauuuaau

SEQ ID NO: 254807 - RNA, 22 nt, Homo sapiens
agugcauugagacuugugaguu

SEQ ID NO: 254808 - RNA, 22 nt, Homo sapiens
agugccaaaucgagggcucuga

SEQ ID NO: 254809 - RNA, 22 nt, Homo sapiens
agugccuacuugaauuguagug

SEQ ID NO: 254810 - RNA, 22 nt, Homo sapiens
aguggcacaauuuugacucccc

SEQ ID NO: 254811 - RNA, 22 nt, Homo sapiens
agugggccccuagaggugaggu

SEQ ID NO: 254812 - RNA, 22 nt, Homo sapiens
agugguauaauauuauuuugaa

SEQ ID NO: 254813 - RNA, 23 nt, Homo sapiens
aguggucuccugggcccagcugu

SEQ ID NO: 254814 - RNA, 22 nt, Homo sapiens
agugguuugaucacagcucacu

SEQ ID NO: 254815 - RNA, 22 nt, Homo sapiens
aguucaauggguuuucacucau

SEQ ID NO: 254816 - RNA, 22 nt, Homo sapiens
auaaagccaugagcuugagaug

SEQ ID NO: 254817 - RNA, 22 nt, Homo sapiens
auaaaguguuuaguauaggcaa

SEQ ID NO: 254818 - RNA, 22 nt, Homo sapiens
auaacagcauuauugcauacgu

SEQ ID NO: 254819 - RNA, 22 nt, Homo sapiens
auaaggcagcugcuaaaaggca

SEQ ID NO: 254820 - RNA, 22 nt, Homo sapiens
auaaguauuuggacuuuacugu

SEQ ID NO: 254821 - RNA, 22 nt, Homo sapiens
auaagugagugauucaguguua

SEQ ID NO: 254822 - RNA, 22 nt, Homo sapiens
auaauacugggaagaugagcau

SEQ ID NO: 254823 - RNA, 22 nt, Homo sapiens
auaauagcugaucauuuagaag

SEQ ID NO: 254824 - RNA, 22 nt, Homo sapiens
auaauagguugauugacauugc

SEQ ID NO: 254825 - RNA, 19 nt, Homo sapiens
auacacguguauacauaca

SEQ ID NO: 254826 - RNA, 22 nt, Homo sapiens
auacagcuaaaauauuaaguua

SEQ ID NO: 254827 - RNA, 22 nt, Homo sapiens
auacagguauacaaugcauaau

SEQ ID NO: 254828 - RNA, 22 nt, Homo sapiens
auacaguauggagggcccagcu

SEQ ID NO: 254829 - RNA, 22 nt, Homo sapiens
auacaugugugagcgaagaugu

SEQ ID NO: 254830 - RNA, 22 nt, Homo sapiens
auacauguucaagggcauauau

SEQ ID NO: 254831 - RNA, 20 nt, Homo sapiens
auacccaguagcacaacagc

SEQ ID NO: 254832 - RNA, 22 nt, Homo sapiens
auaccugguagucuugcuacac

SEQ ID NO: 254833 - RNA, 22 nt, Homo sapiens
auacugguuuuugucaugugga

SEQ ID NO: 254834 - RNA, 20 nt, Homo sapiens
auagaagacuagugcagcag

SEQ ID NO: 254835 - RNA, 22 nt, Homo sapiens
auagagcuaccauagaauccag

SEQ ID NO: 254836 - RNA, 22 nt, Homo sapiens
auagcaaugcaagaauggcuua

SEQ ID NO: 254837 - RNA, 22 nt, Homo sapiens
auagcacacuauagcuucaaac

SEQ ID NO: 254838 - RNA, 22 nt, Homo sapiens
auagcacaguguguguacacca

SEQ ID NO: 254839 - RNA, 22 nt, Homo sapiens
auagcacuuaccacaggcugca

SEQ ID NO: 254840 - RNA, 22 nt, Homo sapiens
auagcagacauuucaaggcagg

SEQ ID NO: 254841 - RNA, 22 nt, Homo sapiens
auaggagcagaaaccguauuuu

SEQ ID NO: 254842 - RNA, 22 nt, Homo sapiens
auaggagugugcacagaguagg

SEQ ID NO: 254843 - RNA, 22 nt, Homo sapiens
auagggcacgagaugugagccu

SEQ ID NO: 254844 - RNA, 21 nt, Homo sapiens
auagggcuuguugauaguuaa

SEQ ID NO: 254845 - RNA, 22 nt, Homo sapiens
auagugcugcaaaaaacauacg

SEQ ID NO: 254846 - RNA, 22 nt, Homo sapiens
auagugcugcaacaaauauacg

SEQ ID NO: 254847 - RNA, 22 nt, Homo sapiens
auagugcugcaagaaacauacg

SEQ ID NO: 254848 - RNA, 22 nt, Homo sapiens
auagugcugcaauaaacauaug

SEQ ID NO: 254849 - RNA, 22 nt, Homo sapiens
auagugcugcaauuaacauaca

SEQ ID NO: 254850 - RNA, 22 nt, Homo sapiens
auagugcugccauaaacauacg

SEQ ID NO: 254851 - RNA, 19 nt, Homo sapiens
auauaacauccaggagcag

SEQ ID NO: 254852 - RNA, 22 nt, Homo sapiens
auauaugcacacgugugcauau

SEQ ID NO: 254853 - RNA, 22 nt, Homo sapiens
auauaugcuaagugcuaauaaa

SEQ ID NO: 254854 - RNA, 22 nt, Homo sapiens
auauauguuuucugggaagaaa

SEQ ID NO: 254855 - RNA, 22 nt, Homo sapiens
auaucacaaacaagucuguacu

SEQ ID NO: 254856 - RNA, 22 nt, Homo sapiens
auaucacaggaaaggaagauac

SEQ ID NO: 254857 - RNA, 22 nt, Homo sapiens
auaugcacaguggaguacuauu

SEQ ID NO: 254858 - RNA, 22 nt, Homo sapiens
auaugcacuauacacacguaua

SEQ ID NO: 254859 - RNA, 22 nt, Homo sapiens
auauggcuuuuauuauguugag

SEQ ID NO: 254860 - RNA, 22 nt, Homo sapiens
auaugguuuuuggaagcauauc

SEQ ID NO: 254861 - RNA, 22 nt, Homo sapiens
auauguucucauucauaugugg

SEQ ID NO: 254862 - RNA, 21 nt, Homo sapiens
auauuacuguuagaggacugc

SEQ ID NO: 254863 - RNA, 22 nt, Homo sapiens
auauucaagugaggauggcuaa

SEQ ID NO: 254864 - RNA, 22 nt, Homo sapiens
auauugcuuagugaugaagucu

SEQ ID NO: 254865 - RNA, 22 nt, Homo sapiens
auauuggacugugcuaguuaga

SEQ ID NO: 254866 - RNA, 22 nt, Homo sapiens
aucaaaguaucucaauauggua

SEQ ID NO: 254867 - RNA, 22 nt, Homo sapiens
aucaaguaaucugaguaagagu

SEQ ID NO: 254868 - RNA, 22 nt, Homo sapiens
aucaaguacuguacugaaagug

SEQ ID NO: 254869 - RNA, 22 nt, Homo sapiens
augccacagaaauaaccaaaau

SEQ ID NO: 254870 - RNA, 22 nt, Homo sapiens
augccacugcacucuagccugg

SEQ ID NO: 254871 - RNA, 22 nt, Homo sapiens
augccacugcauaagguuuuca

SEQ ID NO: 254872 - RNA, 22 nt, Homo sapiens
augccacuucucuaagucaugu

SEQ ID NO: 254873 - RNA, 22 nt, Homo sapiens
augccauugcacuccagccugg

SEQ ID NO: 254874 - RNA, 22 nt, Homo sapiens
augcuacugaccccuacuuaca

SEQ ID NO: 254875 - RNA, 22 nt, Homo sapiens
augcuacuggacaauggugacu

SEQ ID NO: 254876 - RNA, 22 nt, Homo sapiens
augcuggugguucacaugcgca

SEQ ID NO: 254877 - RNA, 22 nt, Homo sapiens
auggaagacuccucuuugggua

SEQ ID NO: 254878 - RNA, 21 nt, Homo sapiens
auggacaugguuaggcuuugu

SEQ ID NO: 254879 - RNA, 22 nt, Homo sapiens
auggagagaauuauucucucag

SEQ ID NO: 254880 - RNA, 22 nt, Homo sapiens
auggagaugugcgaacugagua

SEQ ID NO: 254881 - RNA, 22 nt, Homo sapiens
auggaggccuacagaauuuugg

SEQ ID NO: 254882 - RNA, 22 nt, Homo sapiens
auggagguguggggagugaguu

SEQ ID NO: 254883 - RNA, 22 nt, Homo sapiens
auggaguguaauauugagagcu

SEQ ID NO: 254884 - RNA, 22 nt, Homo sapiens
auggauaugcuuccaacugccu

SEQ ID NO: 254885 - RNA, 22 nt, Homo sapiens
auggauauuuuuugaacauaga

SEQ ID NO: 254886 - RNA, 22 nt, Homo sapiens
auggaucuuucugcuuuugaau

SEQ ID NO: 254887 - RNA, 22 nt, Homo sapiens
auggauuuguaguacaugguug

SEQ ID NO: 254888 - RNA, 22 nt, Homo sapiens
auggauuuugaacuugagaguu

SEQ ID NO: 254889 - RNA, 22 nt, Homo sapiens
auggauuuuggggccagaggca

SEQ ID NO: 254890 - RNA, 22 nt, Homo sapiens
auggcaaaauguuccuaguggu

SEQ ID NO: 254891 - RNA, 22 nt, Homo sapiens
auggcaaugcgauggugacuga

SEQ ID NO: 254892 - RNA, 22 nt, Homo sapiens
auggcaauguaagucagaaaaa

SEQ ID NO: 254893 - RNA, 22 nt, Homo sapiens
auggcacugaagcguauugaca

SEQ ID NO: 254894 - RNA, 22 nt, Homo sapiens
auggcacugauggaaguaccuu

SEQ ID NO: 254895 - RNA, 18 nt, Homo sapiens
auggcagaacaauuuaca

SEQ ID NO: 254896 - RNA, 22 nt, Homo sapiens
auggcagaaucaagccgacagc

SEQ ID NO: 254897 - RNA, 22 nt, Homo sapiens
auggcagcugacacuuccgucu

SEQ ID NO: 254898 - RNA, 22 nt, Homo sapiens
auggcguguggcuuggaggcug

SEQ ID NO: 254899 - RNA, 22 nt, Homo sapiens
auggcucaauucuuucccugaa

SEQ ID NO: 254900 - RNA, 22 nt, Homo sapiens
auggcucuguuuuuuaugcucu

SEQ ID NO: 254901 - RNA, 22 nt, Homo sapiens
auggcucuuauuauuuugaggu

SEQ ID NO: 254902 - RNA, 22 nt, Homo sapiens
auggcuguuucugcaaugucua

SEQ ID NO: 254903 - RNA, 22 nt, Homo sapiens
auggcuucuuacucuucugcau

SEQ ID NO: 254904 - RNA, 22 nt, Homo sapiens
auggcuucuucuaaaagugggg

SEQ ID NO: 254905 - RNA, 22 nt, Homo sapiens
auggcuuuaagagugucugaau

SEQ ID NO: 254906 - RNA, 22 nt, Homo sapiens
auggcuuugggcugcucugccc

SEQ ID NO: 254907 - RNA, 22 nt, Homo sapiens
auggcuuuugcccuaaauggau

SEQ ID NO: 254908 - RNA, 22 nt, Homo sapiens
augggguaggcuuugcugcagu

SEQ ID NO: 254909 - RNA, 22 nt, Homo sapiens
augguauuuaacagucuuucua

SEQ ID NO: 254910 - RNA, 22 nt, Homo sapiens
augguauuuugugauaccuugu

SEQ ID NO: 254911 - RNA, 22 nt, Homo sapiens
auggucuuuuuguuaugagaga

SEQ ID NO: 254912 - RNA, 22 nt, Homo sapiens
augguguccuguuuccccagga

SEQ ID NO: 254913 - RNA, 22 nt, Homo sapiens
auggugugugaauuaaauguua

SEQ ID NO: 254914 - RNA, 22 nt, Homo sapiens
augguuuauuuguaagcagagu

SEQ ID NO: 254915 - RNA, 22 nt, Homo sapiens
augguuuuacugcaaaauggga

SEQ ID NO: 254916 - RNA, 22 nt, Homo sapiens
auguaaacauuuggucuaaauu

SEQ ID NO: 254917 - RNA, 22 nt, Homo sapiens
auguaacacagugcggcugggc

SEQ ID NO: 254918 - RNA, 22 nt, Homo sapiens
auguaacaguauuuggagaugu

SEQ ID NO: 254919 - RNA, 22 nt, Homo sapiens
auguagugugauuuucacuaga

SEQ ID NO: 254920 - RNA, 22 nt, Homo sapiens
augucaaggugaagaaagauca

SEQ ID NO: 254921 - RNA, 22 nt, Homo sapiens
augucauagaagccugugaacc

SEQ ID NO: 254922 - RNA, 21 nt, Homo sapiens
augucauggaugacuaauuca

SEQ ID NO: 254923 - RNA, 22 nt, Homo sapiens
augugacuuuuuccugugccuu

SEQ ID NO: 254924 - RNA, 22 nt, Homo sapiens
augugcaagaucauuaaagcuc

SEQ ID NO: 254925 - RNA, 20 nt, Homo sapiens
augugcaguguggcaaccaa

SEQ ID NO: 254926 - RNA, 22 nt, Homo sapiens
augugcauaugaagcacagaca

SEQ ID NO: 254927 - RNA, 22 nt, Homo sapiens
augugcaugcuguucugccaga

SEQ ID NO: 254928 - RNA, 22 nt, Homo sapiens
augugccauucucauggcgcuu

SEQ ID NO: 254929 - RNA, 22 nt, Homo sapiens
augugcuuauagguguauguuu

SEQ ID NO: 254930 - RNA, 22 nt, Homo sapiens
auguggugguagccaggacagg

SEQ ID NO: 254931 - RNA, 22 nt, Homo sapiens
auguuagcaucaauauucauca

SEQ ID NO: 254932 - RNA, 22 nt, Homo sapiens
auguugcuugaaggcauuuugu

SEQ ID NO: 254933 - RNA, 22 nt, Homo sapiens
auguuguaguaugagucaaaau

SEQ ID NO: 254934 - RNA, 22 nt, Homo sapiens
auuaaggaguggguucauggug

SEQ ID NO: 254935 - RNA, 22 nt, Homo sapiens
auuaaguaaugguuccaauaau

SEQ ID NO: 254936 - RNA, 22 nt, Homo sapiens
auuaagugcuugcagaagucca

SEQ ID NO: 254937 - RNA, 22 nt, Homo sapiens
auuaaguuaggauuuugagaua

SEQ ID NO: 254938 - RNA, 22 nt, Homo sapiens
auuaaguugugccugaaaacuu

SEQ ID NO: 254939 - RNA, 22 nt, Homo sapiens
auuauaugucaucacagacacc

SEQ ID NO: 254940 - RNA, 22 nt, Homo sapiens
auuauuaguuguugaaugaagu

SEQ ID NO: 254941 - RNA, 22 nt, Homo sapiens
auucacuguggcuuucucugau

SEQ ID NO: 254942 - RNA, 22 nt, Homo sapiens
auucagaggggcagcugucuug

SEQ ID NO: 254943 - RNA, 22 nt, Homo sapiens
auuccauuuguguggaauggcu

SEQ ID NO: 254944 - RNA, 22 nt, Homo sapiens
auugaacuguuggagagguuuu

SEQ ID NO: 254945 - RNA, 22 nt, Homo sapiens
auugaacuuuugucacugacau

SEQ ID NO: 254946 - RNA, 22 nt, Homo sapiens
auugaguaaaugaaaauugccu

SEQ ID NO: 254947 - RNA, 22 nt, Homo sapiens
auugcaacaguguugagaggug

SEQ ID NO: 254948 - RNA, 22 nt, Homo sapiens
auugcaaugggaaacuaugaaa

SEQ ID NO: 254949 - RNA, 22 nt, Homo sapiens
auugcacacagaaucaggguaa

SEQ ID NO: 254950 - RNA, 19 nt, Homo sapiens
auugcacuccaaccugggu

SEQ ID NO: 254951 - RNA, 22 nt, Homo sapiens
auugcacuccagccuggcagca

SEQ ID NO: 254952 - RNA, 22 nt, Homo sapiens
auugcacuccagccuggccaac

SEQ ID NO: 254953 - RNA, 22 nt, Homo sapiens
auugcacuccagccuggccgag

SEQ ID NO: 254954 - RNA, 22 nt, Homo sapiens
auugcacuccagccuggggaac

SEQ ID NO: 254955 - RNA, 22 nt, Homo sapiens
auugcacuccagccugggugag

SEQ ID NO: 254956 - RNA, 22 nt, Homo sapiens
auugcacuccagcuugggugac

SEQ ID NO: 254957 - RNA, 22 nt, Homo sapiens
auugcacuccggccugggugac

SEQ ID NO: 254958 - RNA, 22 nt, Homo sapiens
auugcacugcagccugggcaac

SEQ ID NO: 254959 - RNA, 22 nt, Homo sapiens
auugcacuggggguuagaauuu

SEQ ID NO: 254960 - RNA, 22 nt, Homo sapiens
auugcaguuagaacagaagucu

SEQ ID NO: 254961 - RNA, 22 nt, Homo sapiens
auugcauaaacacauuucuuau

SEQ ID NO: 254962 - RNA, 22 nt, Homo sapiens
auugccucaauuccaagacugc

SEQ ID NO: 254963 - RNA, 22 nt, Homo sapiens
auugcuaacugaaauaagacca

SEQ ID NO: 254964 - RNA, 22 nt, Homo sapiens
auugcugagacauugcuaaucu

SEQ ID NO: 254965 - RNA, 22 nt, Homo sapiens
auuggaacugaaauaauaacuu

SEQ ID NO: 254966 - RNA, 22 nt, Homo sapiens
auuggauagucuuuaucuguug

SEQ ID NO: 254967 - RNA, 22 nt, Homo sapiens
auuggcaauagcuuucuuacua

SEQ ID NO: 254968 - RNA, 22 nt, Homo sapiens
auuggguuaaaggauaugaaca

SEQ ID NO: 254969 - RNA, 22 nt, Homo sapiens
auuguacuccagccugggcaaa

SEQ ID NO: 254970 - RNA, 22 nt, Homo sapiens
auuguacuccagccugggcuaa

SEQ ID NO: 254971 - RNA, 22 nt, Homo sapiens
caucacuguugguacaaguaau

SEQ ID NO: 254972 - RNA, 22 nt, Homo sapiens
caucacuuuuccuuuuacagau

SEQ ID NO: 254973 - RNA, 22 nt, Homo sapiens
cauccccugcaccaaccuuuac

SEQ ID NO: 254974 - RNA, 22 nt, Homo sapiens
caugaaagugagaaacuccugg

SEQ ID NO: 254975 - RNA, 22 nt, Homo sapiens
caugcacugagagggucucggc

SEQ ID NO: 254976 - RNA, 22 nt, Homo sapiens
caugcacugaguccaccucugg

SEQ ID NO: 254977 - RNA, 22 nt, Homo sapiens
caugcauagccauucauucguu

SEQ ID NO: 254978 - RNA, 22 nt, Homo sapiens
cauggcccugggcugggcgaac

SEQ ID NO: 254979 - RNA, 22 nt, Homo sapiens
caugucacuuccucucugaugg

SEQ ID NO: 254980 - RNA, 22 nt, Homo sapiens
caugucuuuuauucugugugau

SEQ ID NO: 254981 - RNA, 22 nt, Homo sapiens
cauugcaauccagccugggcaa

SEQ ID NO: 254982 - RNA, 22 nt, Homo sapiens
cauugcacuccagcccagguga

SEQ ID NO: 254983 - RNA, 22 nt, Homo sapiens
cauugcacuccagccuagccaa

SEQ ID NO: 254984 - RNA, 22 nt, Homo sapiens
cauugcacuccagccugaccaa

SEQ ID NO: 254985 - RNA, 22 nt, Homo sapiens
cauugcacuccagccugcugac

SEQ ID NO: 254986 - RNA, 22 nt, Homo sapiens
cauugcacucuagucuggguga

SEQ ID NO: 254987 - RNA, 22 nt, Homo sapiens
cauugcacucuaucccgguggg

SEQ ID NO: 254988 - RNA, 22 nt, Homo sapiens
cauugcacugcagcccgggcaa

SEQ ID NO: 254989 - RNA, 22 nt, Homo sapiens
cauuugcacugagacucagcuu

SEQ ID NO: 254990 - RNA, 22 nt, Homo sapiens
ccaaggcacugauucuguacuc

SEQ ID NO: 254991 - RNA, 22 nt, Homo sapiens
ccaagugcuuaaaauuucauuu

SEQ ID NO: 254992 - RNA, 22 nt, Homo sapiens
ccacaaccucaacagcaucuau

SEQ ID NO: 254993 - RNA, 22 nt, Homo sapiens
ccacaaccuccauauccugggu

SEQ ID NO: 254994 - RNA, 23 nt, Homo sapiens
ccacaaugguugaacuagauuac

SEQ ID NO: 254995 - RNA, 22 nt, Homo sapiens
ccacacugucuuggugggaaac

SEQ ID NO: 254996 - RNA, 23 nt, Homo sapiens
ccacacuguuuagaauggcauca

SEQ ID NO: 254997 - RNA, 22 nt, Homo sapiens
ccacaguggauuaaaguuacug

SEQ ID NO: 254998 - RNA, 22 nt, Homo sapiens
ccaccuguacuuaagucacuuu

SEQ ID NO: 254999 - RNA, 22 nt, Homo sapiens
ccagaguggagccuuugcgagg

SEQ ID NO: 255000 - RNA, 22 nt, Homo sapiens
ccagaguugccucagguuucug

SEQ ID NO: 255001 - RNA, 22 nt, Homo sapiens
ccagcaccauuuguugaauagg

SEQ ID NO: 255002 - RNA, 22 nt, Homo sapiens
ccagugcugugcaguguaugag

SEQ ID NO: 255003 - RNA, 22 nt, Homo sapiens
ccaguguucuggaaggcugagu

SEQ ID NO: 255004 - RNA, 22 nt, Homo sapiens
ccaguuuucccagcaccauuaa

SEQ ID NO: 255005 - RNA, 22 nt, Homo sapiens
ccaguuuucucacuguugcagu

SEQ ID NO: 255006 - RNA, 20 nt, Homo sapiens
ccaucaguccucucuuguuc

SEQ ID NO: 255007 - RNA, 22 nt, Homo sapiens
ccaucccuuucugagcaguucc

SEQ ID NO: 255008 - RNA, 21 nt, Homo sapiens
ccauggcaaugguaaacugac

SEQ ID NO: 255009 - RNA, 22 nt, Homo sapiens
ccauggcaauggucagucuauu

SEQ ID NO: 255010 - RNA, 21 nt, Homo sapiens
ccaugggacggaaugaauaca

SEQ ID NO: 255011 - RNA, 23 nt, Homo sapiens
ccauugcacuccagccucaguga

SEQ ID NO: 255012 - RNA, 22 nt, Homo sapiens
ccauugcacuccauccugggca

SEQ ID NO: 255013 - RNA, 22 nt, Homo sapiens
ccauuucacucuuccugaagga

SEQ ID NO: 255014 - RNA, 22 nt, Homo sapiens
cccagagacagaaugauaaacu

SEQ ID NO: 255015 - RNA, 19 nt, Homo sapiens
cccagugucagagaagggu

SEQ ID NO: 255016 - RNA, 23 nt, Homo sapiens
cccaguuaauccuuaaucuccac

SEQ ID NO: 255017 - RNA, 22 nt, Homo sapiens
ccccagugguugcaacagcaga

SEQ ID NO: 255018 - RNA, 22 nt, Homo sapiens
ccccauuugaacuccuucaacu

SEQ ID NO: 255019 - RNA, 20 nt, Homo sapiens
ccccuggaguggggcugcuu

SEQ ID NO: 255020 - RNA, 22 nt, Homo sapiens
ccccuguaaacuggcuucccug

SEQ ID NO: 255021 - RNA, 22 nt, Homo sapiens
cccuaagacagugaggggugca

SEQ ID NO: 255022 - RNA, 22 nt, Homo sapiens
cccucgagaaaccaucugcuga

SEQ ID NO: 255023 - RNA, 22 nt, Homo sapiens
cccugaagaaagccuaggacau

SEQ ID NO: 255024 - RNA, 22 nt, Homo sapiens
cccugacauucggagauguagu

SEQ ID NO: 255025 - RNA, 22 nt, Homo sapiens
cccuggacacacacuuuuauuc

SEQ ID NO: 255026 - RNA, 22 nt, Homo sapiens
cccuuagaauuuuguaguuauu

SEQ ID NO: 255027 - RNA, 22 nt, Homo sapiens
ccggcugugugacugugggcag

SEQ ID NO: 255028 - RNA, 23 nt, Homo sapiens
ccgugagagaguucauagaaagc

SEQ ID NO: 255029 - RNA, 21 nt, Homo sapiens
ccuccauuuguauucuugccc

SEQ ID NO: 255030 - RNA, 22 nt, Homo sapiens
ccucccuuuguugcaagggaaa

SEQ ID NO: 255031 - RNA, 21 nt, Homo sapiens
ccugaugaccucugagaguua

SEQ ID NO: 255032 - RNA, 21 nt, Homo sapiens
ccugauguucacuuggccuuc

SEQ ID NO: 255033 - RNA, 22 nt, Homo sapiens
ccuggcacugggccccguggcu

SEQ ID NO: 255034 - RNA, 22 nt, Homo sapiens
ccuggguuacaggugugagcca

SEQ ID NO: 255035 - RNA, 22 nt, Homo sapiens
ccugguguuuugauggucgggu

SEQ ID NO: 255036 - RNA, 22 nt, Homo sapiens
ccugucuugauuaaauuacuua

SEQ ID NO: 255037 - RNA, 22 nt, Homo sapiens
ccuguguuaugguuucuaaugu

SEQ ID NO: 255038 - RNA, 21 nt, Homo sapiens
ccuugagaacaucaauuugcu

SEQ ID NO: 255039 - RNA, 22 nt, Homo sapiens
ccuugcacuucccaggugaggc

SEQ ID NO: 255040 - RNA, 22 nt, Homo sapiens
ccuugguggccacaagacauug

SEQ ID NO: 255041 - RNA, 22 nt, Homo sapiens
ccuuuuugaguugccagaguuc

SEQ ID NO: 255042 - RNA, 22 nt, Homo sapiens
cgccgggggaugggcaccagcg

SEQ ID NO: 255043 - RNA, 22 nt, Homo sapiens
cgccugagcugaggaagcugca

SEQ ID NO: 255044 - RNA, 22 nt, Homo sapiens
cggucacagugauucaaggguc

SEQ ID NO: 255045 - RNA, 20 nt, Homo sapiens
cguugcacuccagccugggc

SEQ ID NO: 255046 - RNA, 22 nt, Homo sapiens
cuaaaguauugagugguaaaga

SEQ ID NO: 255047 - RNA, 22 nt, Homo sapiens
cuaaagucacgauuugugggua

SEQ ID NO: 255048 - RNA, 22 nt, Homo sapiens
cuaaggaaggacugaaaggaca

SEQ ID NO: 255049 - RNA, 22 nt, Homo sapiens
cuaagugaguauaauuuuaaga

SEQ ID NO: 255050 - RNA, 22 nt, Homo sapiens
cuaauccugugguagcacucaa

SEQ ID NO: 255051 - RNA, 22 nt, Homo sapiens
cuacauuguagguauucaaacu

SEQ ID NO: 255052 - RNA, 22 nt, Homo sapiens
cuaccuggguggcucaugacuu

SEQ ID NO: 255053 - RNA, 22 nt, Homo sapiens
cuacucuggagagugacaauca

SEQ ID NO: 255054 - RNA, 22 nt, Homo sapiens
cuacugacacuacugcaaucau

SEQ ID NO: 255055 - RNA, 22 nt, Homo sapiens
cuagaauguauaaaaccaagcu

SEQ ID NO: 255056 - RNA, 22 nt, Homo sapiens
cuagagagaagcugugugaccu

SEQ ID NO: 255057 - RNA, 22 nt, Homo sapiens
cuagauuguuuccauaaugaca

SEQ ID NO: 255058 - RNA, 22 nt, Homo sapiens
cuagcagcaugagaauggacca

SEQ ID NO: 255059 - RNA, 21 nt, Homo sapiens
cuaggaccaguucuguaauuc

SEQ ID NO: 255060 - RNA, 22 nt, Homo sapiens
cuaggcacgccugggucuccag

SEQ ID NO: 255061 - RNA, 22 nt, Homo sapiens
cuaggcacugauaguuguauuu

SEQ ID NO: 255062 - RNA, 22 nt, Homo sapiens
cuaggcuguagagaaguucagu

SEQ ID NO: 255063 - RNA, 22 nt, Homo sapiens
cuaggcuuuucuuggauccagg

SEQ ID NO: 255064 - RNA, 22 nt, Homo sapiens
cuaggugauccacugcucucuu

SEQ ID NO: 255065 - RNA, 22 nt, Homo sapiens
cuaguaaugucugucuuaugga

SEQ ID NO: 255066 - RNA, 22 nt, Homo sapiens
cuauauacugccugcugauuag

SEQ ID NO: 255067 - RNA, 22 nt, Homo sapiens
cuauggcuguaaggauaguaac

SEQ ID NO: 255068 - RNA, 22 nt, Homo sapiens
cuauggcuguaugacgugcaug

SEQ ID NO: 255069 - RNA, 22 nt, Homo sapiens
cuaugucuuucauauuuugggg

SEQ ID NO: 255070 - RNA, 22 nt, Homo sapiens
cucaaaguguggucuguggguu

SEQ ID NO: 255071 - RNA, 22 nt, Homo sapiens
cucaauuuggaauugucaguaa

SEQ ID NO: 255072 - RNA, 22 nt, Homo sapiens
cucacaaccuuaugaagcauga

SEQ ID NO: 255073 - RNA, 22 nt, Homo sapiens
cuuuguccuucaagguguguca

SEQ ID NO: 255074 - RNA, 22 nt, Homo sapiens
cuuuguguaggugccucuggcu

SEQ ID NO: 255075 - RNA, 22 nt, Homo sapiens
cuuuuacacuguuggcaggauu

SEQ ID NO: 255076 - RNA, 22 nt, Homo sapiens
cuuuuggcuuagaauugucuug

SEQ ID NO: 255077 - RNA, 22 nt, Homo sapiens
cuuuuggugugaagaagcucuu

SEQ ID NO: 255078 - RNA, 22 nt, Homo sapiens
cuuuuguggaucuucuguugcu

SEQ ID NO: 255079 - RNA, 22 nt, Homo sapiens
cuuuuugcuagagucuaggguc

SEQ ID NO: 255080 - RNA, 22 nt, Homo sapiens
gaaacugcauuucuaacaagcu

SEQ ID NO: 255081 - RNA, 22 nt, Homo sapiens
gaaaguaauuaacgauuguugc

SEQ ID NO: 255082 - RNA, 21 nt, Homo sapiens
gaaauacugccuuaggagcug

SEQ ID NO: 255083 - RNA, 18 nt, Homo sapiens
gaaaugccucuugcuuac

SEQ ID NO: 255084 - RNA, 20 nt, Homo sapiens
gaacugguguauguuuaacu

SEQ ID NO: 255085 - RNA, 22 nt, Homo sapiens
gaacuuucuacauuaccucuuu

SEQ ID NO: 255086 - RNA, 22 nt, Homo sapiens
gaagacauuugcugcacguccu

SEQ ID NO: 255087 - RNA, 22 nt, Homo sapiens
gaagauguugcuuaccuuggag

SEQ ID NO: 255088 - RNA, 22 nt, Homo sapiens
gaaggugcuuggugaaugcauu

SEQ ID NO: 255089 - RNA, 22 nt, Homo sapiens
gaaguaauaaauggauucuuaa

SEQ ID NO: 255090 - RNA, 22 nt, Homo sapiens
gaagugcuuuuggacuaacagu

SEQ ID NO: 255091 - RNA, 22 nt, Homo sapiens
gaauagugcugcaagaaacaua

SEQ ID NO: 255092 - RNA, 22 nt, Homo sapiens
gaauagugcugcaguaaacaua

SEQ ID NO: 255093 - RNA, 22 nt, Homo sapiens
gaaucauuguuucuaaguuugu

SEQ ID NO: 255094 - RNA, 22 nt, Homo sapiens
gaaugaauguuuauccuuagau

SEQ ID NO: 255095 - RNA, 22 nt, Homo sapiens
gaaugauacuguuaacgaaaga

SEQ ID NO: 255096 - RNA, 22 nt, Homo sapiens
gacaagagaacacugcuauauu

SEQ ID NO: 255097 - RNA, 22 nt, Homo sapiens
gacagguuuucuguuucugaaa

SEQ ID NO: 255098 - RNA, 18 nt, Homo sapiens
gacagugugaagauuccu

SEQ ID NO: 255099 - RNA, 18 nt, Homo sapiens
gacaguguggcgauuccu

SEQ ID NO: 255100 - RNA, 22 nt, Homo sapiens
gacaguuucucaggcuuccuua

SEQ ID NO: 255101 - RNA, 20 nt, Homo sapiens
gacauagagacucucaaaaa

SEQ ID NO: 255102 - RNA, 21 nt, Homo sapiens
gacauggcgauacuccgucuc

SEQ ID NO: 255103 - RNA, 22 nt, Homo sapiens
gacauguuuacaguguugagag

SEQ ID NO: 255104 - RNA, 22 nt, Homo sapiens
gacauguuuucauguauuugga

SEQ ID NO: 255105 - RNA, 22 nt, Homo sapiens
gaccaaagaggcaggcauuaga

SEQ ID NO: 255106 - RNA, 22 nt, Homo sapiens
gacccucuagagggaagcgcuu

SEQ ID NO: 255107 - RNA, 22 nt, Homo sapiens
gacccucuagauggaagcacug

SEQ ID NO: 255108 - RNA, 22 nt, Homo sapiens
gaccuggugguccacccgccuu

SEQ ID NO: 255109 - RNA, 17 nt, Homo sapiens
gacgaucaucaggaggc

SEQ ID NO: 255110 - RNA, 22 nt, Homo sapiens
gacuauguuaccuuacacauca

SEQ ID NO: 255111 - RNA, 22 nt, Homo sapiens
gacugcagugcagcuguuaggc

SEQ ID NO: 255112 - RNA, 22 nt, Homo sapiens
gacuuagagauguuguauuugg

SEQ ID NO: 255113 - RNA, 20 nt, Homo sapiens
gacuucagaagcuucagagu

SEQ ID NO: 255114 - RNA, 22 nt, Homo sapiens
gagaacauuaauaguuaauuuu

SEQ ID NO: 255115 - RNA, 22 nt, Homo sapiens
gagaaccauuuggagaaaaagu

SEQ ID NO: 255116 - RNA, 22 nt, Homo sapiens
gagaacuggcgugaacugcacg

SEQ ID NO: 255117 - RNA, 22 nt, Homo sapiens
gagacauguuugccaauaauuu

SEQ ID NO: 255118 - RNA, 23 nt, Homo sapiens
gagaccagcuucagaaagcacga

SEQ ID NO: 255119 - RNA, 20 nt, Homo sapiens
gagaccugagauucacucaa

SEQ ID NO: 255120 - RNA, 22 nt, Homo sapiens
gagacugagucucacucuguca

SEQ ID NO: 255121 - RNA, 22 nt, Homo sapiens
gagacugagucuugcucuguca

SEQ ID NO: 255122 - RNA, 22 nt, Homo sapiens
gagacugaguuuugcucuuguu

SEQ ID NO: 255123 - RNA, 22 nt, Homo sapiens
gagagaguacuugauauaauuu

SEQ ID NO: 255124 - RNA, 22 nt, Homo sapiens
gagagcaugugcuggcaucagu

SEQ ID NO: 255125 - RNA, 22 nt, Homo sapiens
gagauaaauaggucacaguucu

SEQ ID NO: 255126 - RNA, 22 nt, Homo sapiens
gagauaauagcuauaggaucuu

SEQ ID NO: 255127 - RNA, 22 nt, Homo sapiens
gagaucuuuaagaacuacugcu

SEQ ID NO: 255128 - RNA, 22 nt, Homo sapiens
gagaugaaaucuugcucuguca

SEQ ID NO: 255129 - RNA, 22 nt, Homo sapiens
gagaugugugugauuauauaau

SEQ ID NO: 255130 - RNA, 22 nt, Homo sapiens
gagauguuuuguuaucaaagga

SEQ ID NO: 255131 - RNA, 22 nt, Homo sapiens
gagcaaugagcugccugcugag

SEQ ID NO: 255132 - RNA, 22 nt, Homo sapiens
gagcacauguggagagucuggg

SEQ ID NO: 255133 - RNA, 22 nt, Homo sapiens
gagcaguugagagugcuggcca

SEQ ID NO: 255134 - RNA, 22 nt, Homo sapiens
gagccggugugauggggcuucu

SEQ ID NO: 255135 - RNA, 22 nt, Homo sapiens
gagccuguaggaggagaggugg

SEQ ID NO: 255136 - RNA, 22 nt, Homo sapiens
gagcuacacugauucauuuguu

SEQ ID NO: 255137 - RNA, 22 nt, Homo sapiens
gagcuagaauauuuuguauagu

SEQ ID NO: 255138 - RNA, 22 nt, Homo sapiens
gagcuagggucaugcuacugca

SEQ ID NO: 255139 - RNA, 22 nt, Homo sapiens
gagcuggacuucuuaccuuuuc

SEQ ID NO: 255140 - RNA, 22 nt, Homo sapiens
gaggagucagacugugcaaggu

SEQ ID NO: 255141 - RNA, 22 nt, Homo sapiens
gaggcggugugaugucacaugc

SEQ ID NO: 255142 - RNA, 22 nt, Homo sapiens
gaggcuagauggggaugugucc

SEQ ID NO: 255143 - RNA, 22 nt, Homo sapiens
gagguaagaugauucguguccu

SEQ ID NO: 255144 - RNA, 22 nt, Homo sapiens
gagguaaguaagaauggcaagc

SEQ ID NO: 255145 - RNA, 22 nt, Homo sapiens
gagguagagacuauguauuaga

SEQ ID NO: 255146 - RNA, 22 nt, Homo sapiens
gagguagagaguuuugauucug

SEQ ID NO: 255147 - RNA, 22 nt, Homo sapiens
gagguaggaauaaacauuugaa

SEQ ID NO: 255148 - RNA, 21 nt, Homo sapiens
gagguagggauuaaagaccuc

SEQ ID NO: 255149 - RNA, 22 nt, Homo sapiens
gagguguaaggacaacagagac

SEQ ID NO: 255150 - RNA, 22 nt, Homo sapiens
gagguugggaugagggauacag

SEQ ID NO: 255151 - RNA, 22 nt, Homo sapiens
gagguuuuagugagucccacug

SEQ ID NO: 255152 - RNA, 22 nt, Homo sapiens
gaguaaaugucacuguugcugu

SEQ ID NO: 255153 - RNA, 22 nt, Homo sapiens
gaguauauuugcacuguuaugu

SEQ ID NO: 255154 - RNA, 23 nt, Homo sapiens
gagugcaaugacaugaucucgga

SEQ ID NO: 255155 - RNA, 22 nt, Homo sapiens
gagugcaauggcaugaucuugg

SEQ ID NO: 255156 - RNA, 22 nt, Homo sapiens
gagugcaauggcgcgaucucgg

SEQ ID NO: 255157 - RNA, 22 nt, Homo sapiens
gagugcaauggugccaucucgg

SEQ ID NO: 255158 - RNA, 21 nt, Homo sapiens
gaguggcuuuuguuucaccag

SEQ ID NO: 255159 - RNA, 22 nt, Homo sapiens
gaguucaauuuccagcuguucu

SEQ ID NO: 255160 - RNA, 22 nt, Homo sapiens
gaguucauaucuaugagugugc

SEQ ID NO: 255161 - RNA, 22 nt, Homo sapiens
gaguuccuuugagccugagagg

SEQ ID NO: 255162 - RNA, 22 nt, Homo sapiens
gauaaagauagcaauagggaca

SEQ ID NO: 255163 - RNA, 22 nt, Homo sapiens
gauaaauccagauucugaugua

SEQ ID NO: 255164 - RNA, 22 nt, Homo sapiens
gauacuguauccuaaaagcuuu

SEQ ID NO: 255165 - RNA, 22 nt, Homo sapiens
gauaucuuuuguauggugagcu

SEQ ID NO: 255166 - RNA, 21 nt, Homo sapiens
gauaugacauggguaaaacca

SEQ ID NO: 255167 - RNA, 22 nt, Homo sapiens
gauauguuucuucaauaccuag

SEQ ID NO: 255168 - RNA, 22 nt, Homo sapiens
gaucacaguuccucacgggcau

SEQ ID NO: 255169 - RNA, 22 nt, Homo sapiens
gaucacauggccauuucuagcu

SEQ ID NO: 255170 - RNA, 22 nt, Homo sapiens
gaucacuuugaugccaggaacu

SEQ ID NO: 255171 - RNA, 22 nt, Homo sapiens
gaucaguuucuggagauacgua

SEQ ID NO: 255172 - RNA, 22 nt, Homo sapiens
gaucugugugauuggaugcauu

SEQ ID NO: 255173 - RNA, 19 nt, Homo sapiens
gaucuguugaucaaugugu

SEQ ID NO: 255174 - RNA, 22 nt, Homo sapiens
gaugaacugucuuacuacucac

SEQ ID NO: 255175 - RNA, 22 nt, Homo sapiens
gaugaucaugaccuacagaugg

SEQ ID NO: 255176 - RNA, 22 nt, Homo sapiens
gaugcaguaagaaugcauagcg

SEQ ID NO: 255177 - RNA, 22 nt, Homo sapiens
gauggaguugucgccugggcug

SEQ ID NO: 255178 - RNA, 22 nt, Homo sapiens
gauggcacuuaagagcaagagc

SEQ ID NO: 255179 - RNA, 22 nt, Homo sapiens
gaugugaaaucauaguuucuag

SEQ ID NO: 255180 - RNA, 22 nt, Homo sapiens
gauguguugggaagauuucaag

SEQ ID NO: 255181 - RNA, 22 nt, Homo sapiens
gauguuguuuagccuuugaugu

SEQ ID NO: 255182 - RNA, 22 nt, Homo sapiens
gauuauagaaguaauggguuua

SEQ ID NO: 255183 - RNA, 22 nt, Homo sapiens
gauuccacuuucaaauucaaau

SEQ ID NO: 255184 - RNA, 22 nt, Homo sapiens
gauuugagagaggguguuuaua

SEQ ID NO: 255185 - RNA, 22 nt, Homo sapiens
gauuugguguucuggcucaaga

SEQ ID NO: 255186 - RNA, 21 nt, Homo sapiens
gcaaacauccuuugaugccag

SEQ ID NO: 255187 - RNA, 21 nt, Homo sapiens
gcaaaggaauugccuaagcuu

SEQ ID NO: 255188 - RNA, 22 nt, Homo sapiens
gcaaaguguuuuccaacuuggu

SEQ ID NO: 255189 - RNA, 22 nt, Homo sapiens
gcaagaguauuucaaggaagau

SEQ ID NO: 255190 - RNA, 22 nt, Homo sapiens
gcaaggacucccugggucauuc

SEQ ID NO: 255191 - RNA, 22 nt, Homo sapiens
gcacaguaggugguaggacuuu

SEQ ID NO: 255192 - RNA, 22 nt, Homo sapiens
gcacaguggcucccgucuauaa

SEQ ID NO: 255193 - RNA, 22 nt, Homo sapiens
gcacaguuaaagggucauguga

SEQ ID NO: 255194 - RNA, 22 nt, Homo sapiens
gcacauuacaaguauuagcuca

SEQ ID NO: 255195 - RNA, 22 nt, Homo sapiens
gcaccguggaguauggggagga

SEQ ID NO: 255196 - RNA, 22 nt, Homo sapiens
gcacgugcucauuugaggucuu

SEQ ID NO: 255197 - RNA, 19 nt, Homo sapiens
gcagagaugugguagcuug

SEQ ID NO: 255198 - RNA, 23 nt, Homo sapiens
gcagcaaugucacagggguccgg

SEQ ID NO: 255199 - RNA, 22 nt, Homo sapiens
gcagcaguggcaguuaauauuu

SEQ ID NO: 255200 - RNA, 22 nt, Homo sapiens
gcagcauuaccaagacauggca

SEQ ID NO: 255201 - RNA, 22 nt, Homo sapiens
gcagguaguuucugacuuuuac

SEQ ID NO: 255202 - RNA, 17 nt, Homo sapiens
gcaguacuuaguaagga

SEQ ID NO: 255203 - RNA, 20 nt, Homo sapiens
gcaguacuuuuaguucuaag

SEQ ID NO: 255204 - RNA, 22 nt, Homo sapiens
gcagugcaugacgguauauaua

SEQ ID NO: 255205 - RNA, 22 nt, Homo sapiens
gcagugugaucacagcuuacug

SEQ ID NO: 255206 - RNA, 22 nt, Homo sapiens
gcagugugugaggaauuugggu

SEQ ID NO: 255207 - RNA, 20 nt, Homo sapiens
gcaguguucacuguauuccu

SEQ ID NO: 255208 - RNA, 22 nt, Homo sapiens
gcaguguucugggcaggaagaa

SEQ ID NO: 255209 - RNA, 22 nt, Homo sapiens
gcaguucuguaguugaaauuua

SEQ ID NO: 255210 - RNA, 22 nt, Homo sapiens
gcauauuuuaaaguguaaccug

SEQ ID NO: 255211 - RNA, 22 nt, Homo sapiens
gcaugaugaauaauaucacaag

SEQ ID NO: 255212 - RNA, 22 nt, Homo sapiens
gcauggagaaggggacugauuc

SEQ ID NO: 255213 - RNA, 22 nt, Homo sapiens
gcauggaguggaaauucuuggg

SEQ ID NO: 255214 - RNA, 22 nt, Homo sapiens
gccauagucauagauggcaggg

SEQ ID NO: 255215 - RNA, 22 nt, Homo sapiens
gccauugcacuccagccucggc

SEQ ID NO: 255216 - RNA, 22 nt, Homo sapiens
gccauugcacuccgcccugggc

SEQ ID NO: 255217 - RNA, 22 nt, Homo sapiens
gccccgggugaugcagccguca

SEQ ID NO: 255218 - RNA, 22 nt, Homo sapiens
gccuagagaguuaucaggcugu

SEQ ID NO: 255219 - RNA, 22 nt, Homo sapiens
gccuagggacaaaccguccgac

SEQ ID NO: 255220 - RNA, 22 nt, Homo sapiens
gccucaguuguggccagggauu

SEQ ID NO: 255221 - RNA, 22 nt, Homo sapiens
gccuuuggugacaggcaugugu

SEQ ID NO: 255222 - RNA, 20 nt, Homo sapiens
gcuaaggcacgggaauuacu

SEQ ID NO: 255223 - RNA, 22 nt, Homo sapiens
gcuaaggcagggcaaucauuug

SEQ ID NO: 255224 - RNA, 23 nt, Homo sapiens
gcuaggagagaugaaacacaggu

SEQ ID NO: 255225 - RNA, 19 nt, Homo sapiens
gcucaccuugcugcuccag

SEQ ID NO: 255226 - RNA, 22 nt, Homo sapiens
gcucaugagacaagcaggagua

SEQ ID NO: 255227 - RNA, 22 nt, Homo sapiens
gcucguccccuccugacucugc

SEQ ID NO: 255228 - RNA, 22 nt, Homo sapiens
gcucugguuacaaaggcaaauu

SEQ ID NO: 255229 - RNA, 22 nt, Homo sapiens
gcugaaauguuuaauuugggag

SEQ ID NO: 255230 - RNA, 22 nt, Homo sapiens
gcugauguugaccuugaucacc

SEQ ID NO: 255231 - RNA, 22 nt, Homo sapiens
gcuggauguuucaauacaaaua

SEQ ID NO: 255232 - RNA, 22 nt, Homo sapiens
gcuggguucagagugggcugcg

SEQ ID NO: 255233 - RNA, 22 nt, Homo sapiens
gcuggucugccguaguaggugc

SEQ ID NO: 255234 - RNA, 22 nt, Homo sapiens
gcugguguagagugcagaaagg

SEQ ID NO: 255235 - RNA, 20 nt, Homo sapiens
gcugugcuuaauacacuuuc

SEQ ID NO: 255236 - RNA, 18 nt, Homo sapiens
gcuguugucagagcacau

SEQ ID NO: 255237 - RNA, 22 nt, Homo sapiens
gcuuugcaauggcauugaccau

SEQ ID NO: 255238 - RNA, 22 nt, Homo sapiens
gcuuugguucaaccaggcaauu

SEQ ID NO: 255239 - RNA, 22 nt, Homo sapiens
gcuuuguugauggugagucugu

SEQ ID NO: 255240 - RNA, 22 nt, Homo sapiens
gcuuuugcaggaaaggaagaau

SEQ ID NO: 255241 - RNA, 22 nt, Homo sapiens
ggaaagcuagguguggguguac

SEQ ID NO: 255242 - RNA, 22 nt, Homo sapiens
ggaaaucaucauucucgguaua

SEQ ID NO: 255243 - RNA, 22 nt, Homo sapiens
ggaaauguaaacaauggggcua

SEQ ID NO: 255244 - RNA, 23 nt, Homo sapiens
ggaaauguuuaagggguugggag

SEQ ID NO: 255245 - RNA, 22 nt, Homo sapiens
ggaagaauauuaggggauuucg

SEQ ID NO: 255246 - RNA, 22 nt, Homo sapiens
ggaagugcuguguggaagucug

SEQ ID NO: 255247 - RNA, 23 nt, Homo sapiens
ggaaugaaaccugguuaugauau

SEQ ID NO: 255248 - RNA, 21 nt, Homo sapiens
ggaauguugccagcagccaga

SEQ ID NO: 255249 - RNA, 22 nt, Homo sapiens
ggagauaauccagggagggacu

SEQ ID NO: 255250 - RNA, 22 nt, Homo sapiens
ggagaucuuugaaguguugugc

SEQ ID NO: 255251 - RNA, 22 nt, Homo sapiens
ggagugcuguuguuacacaagg

SEQ ID NO: 255252 - RNA, 22 nt, Homo sapiens
ggaguguaauggcgccaucuca

SEQ ID NO: 255253 - RNA, 22 nt, Homo sapiens
ggagugucagaaacaguguccu

SEQ ID NO: 255254 - RNA, 22 nt, Homo sapiens
ggagugugauuguucucuguua

SEQ ID NO: 255255 - RNA, 22 nt, Homo sapiens
ggaguguguaggagaaagguaa

SEQ ID NO: 255256 - RNA, 22 nt, Homo sapiens
ggaguuuaagucuugugcaucu

SEQ ID NO: 255257 - RNA, 23 nt, Homo sapiens
ggauggaaaguuuugagggccac

SEQ ID NO: 255258 - RNA, 22 nt, Homo sapiens
ggcaaaaucgcaauuacuuuug

SEQ ID NO: 255259 - RNA, 22 nt, Homo sapiens
ggcaacaaagacauuucaacau

SEQ ID NO: 255260 - RNA, 22 nt, Homo sapiens
ggcaagaaagaaaucaucuguc

SEQ ID NO: 255261 - RNA, 22 nt, Homo sapiens
ggcaagaagagaguuuaaacau

SEQ ID NO: 255262 - RNA, 17 nt, Homo sapiens
ggcaagaaguggaacuc

SEQ ID NO: 255263 - RNA, 20 nt, Homo sapiens
ggcaagacccaaagugugug

SEQ ID NO: 255264 - RNA, 22 nt, Homo sapiens
ggcaaugaggcggaccagcagg

SEQ ID NO: 255265 - RNA, 22 nt, Homo sapiens
ggcaaugucagcuaaugaugga

SEQ ID NO: 255266 - RNA, 22 nt, Homo sapiens
ggcaccauggaaggacgggagc

SEQ ID NO: 255267 - RNA, 22 nt, Homo sapiens
ggcacgguggcucacgccugua

SEQ ID NO: 255268 - RNA, 22 nt, Homo sapiens
ggcacuguggcucaagccugua

SEQ ID NO: 255269 - RNA, 19 nt, Homo sapiens
ggcacugugugagugagga

SEQ ID NO: 255270 - RNA, 22 nt, Homo sapiens
ggcagaguggacauuuaaaugu

SEQ ID NO: 255271 - RNA, 22 nt, Homo sapiens
ggcagcgugcacuuucgccacu

SEQ ID NO: 255272 - RNA, 17 nt, Homo sapiens
ggcaggaauuaauguca

SEQ ID NO: 255273 - RNA, 23 nt, Homo sapiens
ggcagguuggucuaggucuauuc

SEQ ID NO: 255274 - RNA, 22 nt, Homo sapiens
ggcaguggaagugccaguuucu

SEQ ID NO: 255275 - RNA, 22 nt, Homo sapiens
ggcaguguggcugcauauagca

SEQ ID NO: 255276 - RNA, 16 nt, Homo sapiens
ggcauguaauaagcaa

SEQ ID NO: 255277 - RNA, 22 nt, Homo sapiens
guggaaggucaugaauguucuu

SEQ ID NO: 255278 - RNA, 17 nt, Homo sapiens
guggaaugucaugucaa

SEQ ID NO: 255279 - RNA, 22 nt, Homo sapiens
guggaauuauagagacaucuug

SEQ ID NO: 255280 - RNA, 22 nt, Homo sapiens
guggacggagguugcagugagc

SEQ ID NO: 255281 - RNA, 22 nt, Homo sapiens
guggagucaucacucagagugg

SEQ ID NO: 255282 - RNA, 18 nt, Homo sapiens
guggagugucuuccugga

SEQ ID NO: 255283 - RNA, 22 nt, Homo sapiens
guggcaaacucagcaugcccca

SEQ ID NO: 255284 - RNA, 22 nt, Homo sapiens
guggcaaguguuccaagaggcg

SEQ ID NO: 255285 - RNA, 22 nt, Homo sapiens
guggcagaaaagagaagcaaug

SEQ ID NO: 255286 - RNA, 22 nt, Homo sapiens
guggcaguuuuaaauaugaaaa

SEQ ID NO: 255287 - RNA, 21 nt, Homo sapiens
guggccuuuggagcaugucag

SEQ ID NO: 255288 - RNA, 23 nt, Homo sapiens
guggccuuuggccaguccgaguc

SEQ ID NO: 255289 - RNA, 22 nt, Homo sapiens
gugggaugaucacaguucacug

SEQ ID NO: 255290 - RNA, 22 nt, Homo sapiens
gugggaugaucgcuugagccca

SEQ ID NO: 255291 - RNA, 22 nt, Homo sapiens
gugggguagcaggcuccuaucu

SEQ ID NO: 255292 - RNA, 22 nt, Homo sapiens
gugggguaggugacuugaugag

SEQ ID NO: 255293 - RNA, 22 nt, Homo sapiens
guggggucaucucauuugugga

SEQ ID NO: 255294 - RNA, 22 nt, Homo sapiens
gugguaguagaauuucggaaau

SEQ ID NO: 255295 - RNA, 22 nt, Homo sapiens
guggugucuuuuuugauuagga

SEQ ID NO: 255296 - RNA, 22 nt, Homo sapiens
gugguucuaaaccuuuuuuggu

SEQ ID NO: 255297 - RNA, 21 nt, Homo sapiens
gugguucuagagaaacagaau

SEQ ID NO: 255298 - RNA, 22 nt, Homo sapiens
gugguuuucaacuccaccugca

SEQ ID NO: 255299 - RNA, 22 nt, Homo sapiens
guguaaaacaauuagaggauuu

SEQ ID NO: 255300 - RNA, 20 nt, Homo sapiens
guguaagagcaagcuuccua

SEQ ID NO: 255301 - RNA, 22 nt, Homo sapiens
guguauauccuauuaguucugu

SEQ ID NO: 255302 - RNA, 22 nt, Homo sapiens
guguaugguuguuguagagaga

SEQ ID NO: 255303 - RNA, 22 nt, Homo sapiens
gugucccagugugcauacaggu

SEQ ID NO: 255304 - RNA, 22 nt, Homo sapiens
gugucucagcccagaccuauuu

SEQ ID NO: 255305 - RNA, 22 nt, Homo sapiens
gugucuccugccuucaugcagc

SEQ ID NO: 255306 - RNA, 22 nt, Homo sapiens
gugugacuagucaugccugaau

SEQ ID NO: 255307 - RNA, 19 nt, Homo sapiens
gugugcauaucacagagca

SEQ ID NO: 255308 - RNA, 22 nt, Homo sapiens
gugugcauaugucuuuauagua

SEQ ID NO: 255309 - RNA, 20 nt, Homo sapiens
gugugcauuucagauuuugg

SEQ ID NO: 255310 - RNA, 22 nt, Homo sapiens
gugugcucaucacaugcaauag

SEQ ID NO: 255311 - RNA, 21 nt, Homo sapiens
gugugcuugagugaugggauu

SEQ ID NO: 255312 - RNA, 22 nt, Homo sapiens
gugugguauuauaacuagguau

SEQ ID NO: 255313 - RNA, 22 nt, Homo sapiens
guguuaaucucaaguacucuca

SEQ ID NO: 255314 - RNA, 22 nt, Homo sapiens
guguucauggaauuugcaauug

SEQ ID NO: 255315 - RNA, 22 nt, Homo sapiens
guucaagugauucuacugccuc

SEQ ID NO: 255316 - RNA, 22 nt, Homo sapiens
guucaguuugcugaugcguuga

SEQ ID NO: 255317 - RNA, 22 nt, Homo sapiens
guuccuuguagaugcuggauau

SEQ ID NO: 255318 - RNA, 22 nt, Homo sapiens
guugaaauccuaacccccuagu

SEQ ID NO: 255319 - RNA, 22 nt, Homo sapiens
guugagcaagcuuuggagccua

SEQ ID NO: 255320 - RNA, 22 nt, Homo sapiens
guuggaauguauugcuacuucu

SEQ ID NO: 255321 - RNA, 22 nt, Homo sapiens
guuugcagaucaugaagaaccc

SEQ ID NO: 255322 - RNA, 22 nt, Homo sapiens
guuuggauauuaggcaagagua

SEQ ID NO: 255323 - RNA, 22 nt, Homo sapiens
guuugugcuccuaugagaaccu

SEQ ID NO: 255324 - RNA, 22 nt, Homo sapiens
guuugugcuccuaugagaaucu

SEQ ID NO: 255325 - RNA, 22 nt, Homo sapiens
guuugugguuaaagccuuucau

SEQ ID NO: 255326 - RNA, 22 nt, Homo sapiens
guuuugguuauauggaucaguu

SEQ ID NO: 255327 - RNA, 22 nt, Homo sapiens
uaaaccacguuuacauuugaga

SEQ ID NO: 255328 - RNA, 22 nt, Homo sapiens
uaaacugcuugaaaugguguca

SEQ ID NO: 255329 - RNA, 22 nt, Homo sapiens
uaaagcuauuauaguuauguuu

SEQ ID NO: 255330 - RNA, 22 nt, Homo sapiens
uaaaugacugucaguagaugaa

SEQ ID NO: 255331 - RNA, 22 nt, Homo sapiens
uaaaugcuuaauugaaugugga

SEQ ID NO: 255332 - RNA, 21 nt, Homo sapiens
uaaaugucauacaaagcaaug

SEQ ID NO: 255333 - RNA, 18 nt, Homo sapiens
uaaauugcuucaccugag

SEQ ID NO: 255334 - RNA, 22 nt, Homo sapiens
uaacaaugucuuaugggcuuaa

SEQ ID NO: 255335 - RNA, 22 nt, Homo sapiens
uaacaccuuugauagcacuuuu

SEQ ID NO: 255336 - RNA, 22 nt, Homo sapiens
uaacaguauaugugguaucuau

SEQ ID NO: 255337 - RNA, 22 nt, Homo sapiens
uaacauugucuugcuuaguuuu

SEQ ID NO: 255338 - RNA, 22 nt, Homo sapiens
uaacccagugucugugaugggu

SEQ ID NO: 255339 - RNA, 22 nt, Homo sapiens
uaacccugaggggcuuggggac

SEQ ID NO: 255340 - RNA, 22 nt, Homo sapiens
uaacuauagagaauguugagua

SEQ ID NO: 255341 - RNA, 22 nt, Homo sapiens
uaacucugccuagugacauggu

SEQ ID NO: 255342 - RNA, 22 nt, Homo sapiens
uaacugccuacugugcaaauau

SEQ ID NO: 255343 - RNA, 22 nt, Homo sapiens
uaagacugccccagacagcaag

SEQ ID NO: 255344 - RNA, 20 nt, Homo sapiens
uaagccacacagucuaaggu

SEQ ID NO: 255345 - RNA, 22 nt, Homo sapiens
uaagcuaauguguuuucucuua

SEQ ID NO: 255346 - RNA, 22 nt, Homo sapiens
uaaggcaaucagucaugguguu

SEQ ID NO: 255347 - RNA, 22 nt, Homo sapiens
uaaggcacauaggccuggaaac

SEQ ID NO: 255348 - RNA, 22 nt, Homo sapiens
uaaggcccgugaguuucauauc

SEQ ID NO: 255349 - RNA, 22 nt, Homo sapiens
uaaggcuucuuggaauacugca

SEQ ID NO: 255350 - RNA, 22 nt, Homo sapiens
uaagggacauguguugccuaag

SEQ ID NO: 255351 - RNA, 22 nt, Homo sapiens
uaagguguagacuggucacaag

SEQ ID NO: 255352 - RNA, 22 nt, Homo sapiens
uaaguacuuuacagacauuauc

SEQ ID NO: 255353 - RNA, 22 nt, Homo sapiens
uaaguaucaguuuagcuaugau

SEQ ID NO: 255354 - RNA, 22 nt, Homo sapiens
uaaguauuaggccccaggcugg

SEQ ID NO: 255355 - RNA, 22 nt, Homo sapiens
uaaguauuaugugcugcauuuu

SEQ ID NO: 255356 - RNA, 22 nt, Homo sapiens
uaagugaaggaaguguguuuac

SEQ ID NO: 255357 - RNA, 22 nt, Homo sapiens
uaagugaauuugacagguaaug

SEQ ID NO: 255358 - RNA, 22 nt, Homo sapiens
uaagugcaacauaaguguuaaa

SEQ ID NO: 255359 - RNA, 20 nt, Homo sapiens
uaagugcuugaugaaugaac

SEQ ID NO: 255360 - RNA, 22 nt, Homo sapiens
uaaguggaagaugucaaucaua

SEQ ID NO: 255361 - RNA, 23 nt, Homo sapiens
uaaguucaucucuaauaggugga

SEQ ID NO: 255362 - RNA, 22 nt, Homo sapiens
uaaguugcagguugugauucca

SEQ ID NO: 255363 - RNA, 18 nt, Homo sapiens
uaauaacugugaccuuga

SEQ ID NO: 255364 - RNA, 22 nt, Homo sapiens
uaauacugcugugcuugaguug

SEQ ID NO: 255365 - RNA, 22 nt, Homo sapiens
uaauacuguaauggugguuccg

SEQ ID NO: 255366 - RNA, 22 nt, Homo sapiens
uaaucucagcuacucaggaggc

SEQ ID NO: 255367 - RNA, 22 nt, Homo sapiens
uacaaagcuacucgagggcagg

SEQ ID NO: 255368 - RNA, 22 nt, Homo sapiens
uacaaagcuuucugcaaaucau

SEQ ID NO: 255369 - RNA, 16 nt, Homo sapiens
uacaacagugaguaug

SEQ ID NO: 255370 - RNA, 22 nt, Homo sapiens
uacaagcaggaaaugguauaug

SEQ ID NO: 255371 - RNA, 22 nt, Homo sapiens
uacaagcuaaaauggaagauca

SEQ ID NO: 255372 - RNA, 22 nt, Homo sapiens
uacaagguaucagugaccguaa

SEQ ID NO: 255373 - RNA, 22 nt, Homo sapiens
uacaaguggguuugugcaggag

SEQ ID NO: 255374 - RNA, 22 nt, Homo sapiens
uacacagucaaaaauuuccagg

SEQ ID NO: 255375 - RNA, 22 nt, Homo sapiens
uacaccugcacucuagccuggg

SEQ ID NO: 255376 - RNA, 21 nt, Homo sapiens
uacacuacugguggaaaugca

SEQ ID NO: 255377 - RNA, 22 nt, Homo sapiens
uacagaauugcagguguggcag

SEQ ID NO: 255378 - RNA, 22 nt, Homo sapiens
uacaggacuauagaacuuuccc

SEQ ID NO: 255379 - RNA, 19 nt, Homo sapiens
uaugcaacuuauagugcug

SEQ ID NO: 255380 - RNA, 22 nt, Homo sapiens
uaugcacuauggaaguagcuca

SEQ ID NO: 255381 - RNA, 22 nt, Homo sapiens
uaugccucuucauaaaguauga

SEQ ID NO: 255382 - RNA, 22 nt, Homo sapiens
uaugcuuauaaacauuugucag

SEQ ID NO: 255383 - RNA, 22 nt, Homo sapiens
uauggcacuaguacuggaaagc

SEQ ID NO: 255384 - RNA, 17 nt, Homo sapiens
uauggcuauguuuagau

SEQ ID NO: 255385 - RNA, 21 nt, Homo sapiens
uauggcuuagucaguguuucc

SEQ ID NO: 255386 - RNA, 22 nt, Homo sapiens
uauggcuuucuacuugaguucu

SEQ ID NO: 255387 - RNA, 22 nt, Homo sapiens
uauggcuuuuauuauguuguag

SEQ ID NO: 255388 - RNA, 21 nt, Homo sapiens
uaugguuucuaauucugcagg

SEQ ID NO: 255389 - RNA, 22 nt, Homo sapiens
uaugucuggaguuacugagcug

SEQ ID NO: 255390 - RNA, 22 nt, Homo sapiens
uauuaguuguaugauucccaag

SEQ ID NO: 255391 - RNA, 18 nt, Homo sapiens
uauuccucuuccucuauc

SEQ ID NO: 255392 - RNA, 22 nt, Homo sapiens
uauugaauuuuuaagcccuuug

SEQ ID NO: 255393 - RNA, 22 nt, Homo sapiens
uauugacuuuuuuguuaggagg

SEQ ID NO: 255394 - RNA, 22 nt, Homo sapiens
uauugauuuucaguguucagcu

SEQ ID NO: 255395 - RNA, 22 nt, Homo sapiens
uauugcaaauggugaucccagg

SEQ ID NO: 255396 - RNA, 22 nt, Homo sapiens
uauugcaauuggggaaacuggg

SEQ ID NO: 255397 - RNA, 20 nt, Homo sapiens
uauugcacuccagucugggc

SEQ ID NO: 255398 - RNA, 22 nt, Homo sapiens
uauugcauuugagguugguuga

SEQ ID NO: 255399 - RNA, 22 nt, Homo sapiens
uauugccuugccuacuuuucca

SEQ ID NO: 255400 - RNA, 22 nt, Homo sapiens
uauugcugaugcugaagggaag

SEQ ID NO: 255401 - RNA, 22 nt, Homo sapiens
uauugcuuaugaugcugaauua

SEQ ID NO: 255402 - RNA, 22 nt, Homo sapiens
uauugcuuuuaacccaaucucu

SEQ ID NO: 255403 - RNA, 22 nt, Homo sapiens
uauuguccacuuugcacugugu

SEQ ID NO: 255404 - RNA, 22 nt, Homo sapiens
uauuguuaaagauguuaaugau

SEQ ID NO: 255405 - RNA, 22 nt, Homo sapiens
uauuugauugacuuuagcagga

SEQ ID NO: 255406 - RNA, 22 nt, Homo sapiens
ucaaaaucucuuagcugugucu

SEQ ID NO: 255407 - RNA, 22 nt, Homo sapiens
ucaaacauccccaccagggacu

SEQ ID NO: 255408 - RNA, 22 nt, Homo sapiens
ucaaacugucagguugaccaga

SEQ ID NO: 255409 - RNA, 22 nt, Homo sapiens
ucaacauugcugucaggcaucu

SEQ ID NO: 255410 - RNA, 19 nt, Homo sapiens
ucaagcuauucuccugccu

SEQ ID NO: 255411 - RNA, 20 nt, Homo sapiens
ucaaggcaggaacuguacau

SEQ ID NO: 255412 - RNA, 22 nt, Homo sapiens
ucaaggcaguggccuuccuucu

SEQ ID NO: 255413 - RNA, 22 nt, Homo sapiens
ucaagguacguugccucagauu

SEQ ID NO: 255414 - RNA, 22 nt, Homo sapiens
ucaagugauucuugugccuuag

SEQ ID NO: 255415 - RNA, 22 nt, Homo sapiens
ucaaugaaugaugguugguaug

SEQ ID NO: 255416 - RNA, 22 nt, Homo sapiens
ucaaugcaugugacaaagagua

SEQ ID NO: 255417 - RNA, 22 nt, Homo sapiens
ucaauugcaucaacaguguaca

SEQ ID NO: 255418 - RNA, 22 nt, Homo sapiens
ucacaaagcuuggccugcuucu

SEQ ID NO: 255419 - RNA, 18 nt, Homo sapiens
ucacaaccacagugcugu

SEQ ID NO: 255420 - RNA, 22 nt, Homo sapiens
ucacaaggcaggaaugaaaggg

SEQ ID NO: 255421 - RNA, 22 nt, Homo sapiens
ucacaauucucaauuugugaaa

SEQ ID NO: 255422 - RNA, 22 nt, Homo sapiens
ucacaccauucuucuacuucag

SEQ ID NO: 255423 - RNA, 22 nt, Homo sapiens
ucacacugaauuugaagcaaug

SEQ ID NO: 255424 - RNA, 22 nt, Homo sapiens
ucacacugucuugguuacucuu

SEQ ID NO: 255425 - RNA, 22 nt, Homo sapiens
ucacagacugagccaaauagag

SEQ ID NO: 255426 - RNA, 22 nt, Homo sapiens
ucacagauaaauaaagaugauu

SEQ ID NO: 255427 - RNA, 22 nt, Homo sapiens
ucacagccuaguuuuauacauu

SEQ ID NO: 255428 - RNA, 22 nt, Homo sapiens
ucacaguaaauccagaagaaau

SEQ ID NO: 255429 - RNA, 22 nt, Homo sapiens
ucacaguaucaugggggacaga

SEQ ID NO: 255430 - RNA, 22 nt, Homo sapiens
ucacaguauucaugaacaugga

SEQ ID NO: 255431 - RNA, 22 nt, Homo sapiens
ucacagugaguggaguggggug

SEQ ID NO: 255432 - RNA, 23 nt, Homo sapiens
ucacaguggcugcuuaauuguga

SEQ ID NO: 255433 - RNA, 22 nt, Homo sapiens
ucacaguguuaaaccuuucuuu

SEQ ID NO: 255434 - RNA, 17 nt, Homo sapiens
ucacaguguuaggauga

SEQ ID NO: 255435 - RNA, 22 nt, Homo sapiens
ucacaugaagauuuuaguauac

SEQ ID NO: 255436 - RNA, 18 nt, Homo sapiens
ucacauggccgagagaga

SEQ ID NO: 255437 - RNA, 22 nt, Homo sapiens
ucacaugugaagauugggagua

SEQ ID NO: 255438 - RNA, 22 nt, Homo sapiens
ucacaugugacauauauauuug

SEQ ID NO: 255439 - RNA, 22 nt, Homo sapiens
ucacauguguaugagcuuugau

SEQ ID NO: 255440 - RNA, 22 nt, Homo sapiens
ucacauuguacaaacagguaag

SEQ ID NO: 255441 - RNA, 22 nt, Homo sapiens
ucaccaccugcugaucauagag

SEQ ID NO: 255442 - RNA, 22 nt, Homo sapiens
ucaccaguggcacuccagccug

SEQ ID NO: 255443 - RNA, 16 nt, Homo sapiens
ucaccccuagagaucc

SEQ ID NO: 255444 - RNA, 20 nt, Homo sapiens
ucacccugacaucugcccag

SEQ ID NO: 255445 - RNA, 22 nt, Homo sapiens
ucaccgugaauuaacaacacuu

SEQ ID NO: 255446 - RNA, 22 nt, Homo sapiens
ucaccuuacuugcuucugaacu

SEQ ID NO: 255447 - RNA, 22 nt, Homo sapiens
ucacgugguucauaaggcagaa

SEQ ID NO: 255448 - RNA, 22 nt, Homo sapiens
ucacuaaagaaaauggcaugga

SEQ ID NO: 255449 - RNA, 23 nt, Homo sapiens
ucacuagaguccuggaguuugag

SEQ ID NO: 255450 - RNA, 22 nt, Homo sapiens
ucacuauugacaacagugugga

SEQ ID NO: 255451 - RNA, 22 nt, Homo sapiens
ucacugaaacuguccuggguua

SEQ ID NO: 255452 - RNA, 22 nt, Homo sapiens
ucacugaggucugagcuuuaug

SEQ ID NO: 255453 - RNA, 20 nt, Homo sapiens
ucacugaguaucuacgauua

SEQ ID NO: 255454 - RNA, 22 nt, Homo sapiens
ucacugcacuucaggcuuucuc

SEQ ID NO: 255455 - RNA, 22 nt, Homo sapiens
ucacugcgaccucugccucccg

SEQ ID NO: 255456 - RNA, 22 nt, Homo sapiens
ucacuggacagaaauaaaggug

SEQ ID NO: 255457 - RNA, 22 nt, Homo sapiens
ucacuggagguuccugaaguuc

SEQ ID NO: 255458 - RNA, 22 nt, Homo sapiens
ucacuggccaaauucuggguga

SEQ ID NO: 255459 - RNA, 22 nt, Homo sapiens
ucacugugagaguuuauccugu

SEQ ID NO: 255460 - RNA, 22 nt, Homo sapiens
ucacuguugaugggcaugcagg

SEQ ID NO: 255461 - RNA, 22 nt, Homo sapiens
ucacuuugacggccaacuucua

SEQ ID NO: 255462 - RNA, 22 nt, Homo sapiens
ucagacacugcccuccaccugu

SEQ ID NO: 255463 - RNA, 22 nt, Homo sapiens
ucagaccauuucauuacagacu

SEQ ID NO: 255464 - RNA, 22 nt, Homo sapiens
ucagaguagaaacacuuccaua

SEQ ID NO: 255465 - RNA, 22 nt, Homo sapiens
ucagaguagagcgacuucuccu

SEQ ID NO: 255466 - RNA, 22 nt, Homo sapiens
ucagaguggagucugcagccuu

SEQ ID NO: 255467 - RNA, 22 nt, Homo sapiens
ucagauacuggugacaugaaug

SEQ ID NO: 255468 - RNA, 22 nt, Homo sapiens
ucagaucaguuccacaagaacu

SEQ ID NO: 255469 - RNA, 19 nt, Homo sapiens
ucagaugcauuagggguua

SEQ ID NO: 255470 - RNA, 22 nt, Homo sapiens
ucagauguuucuuuaacgcaug

SEQ ID NO: 255471 - RNA, 22 nt, Homo sapiens
ucagcaguggacagaaugguag

SEQ ID NO: 255472 - RNA, 22 nt, Homo sapiens
ucagcagugugaaaacaaacua

SEQ ID NO: 255473 - RNA, 21 nt, Homo sapiens
ucaggaccucuaguuagccag

SEQ ID NO: 255474 - RNA, 20 nt, Homo sapiens
ucagguagaucuuugagguc

SEQ ID NO: 255475 - RNA, 22 nt, Homo sapiens
ucagguagcauuuuggaaacag

SEQ ID NO: 255476 - RNA, 22 nt, Homo sapiens
ucagguagcuagauuaugugag

SEQ ID NO: 255477 - RNA, 23 nt, Homo sapiens
ucagguaguuucagaggaccuug

SEQ ID NO: 255478 - RNA, 22 nt, Homo sapiens
ucaggugcaguggcucaugcuu

SEQ ID NO: 255479 - RNA, 22 nt, Homo sapiens
ucaguagagacaggauuucacc

SEQ ID NO: 255480 - RNA, 22 nt, Homo sapiens
ucaguauaugaaucuggggcag

SEQ ID NO: 255481 - RNA, 22 nt, Homo sapiens
ugagucauguaauaaugcugcu

SEQ ID NO: 255482 - RNA, 22 nt, Homo sapiens
ugagucauuuccuuaugcuacu

SEQ ID NO: 255483 - RNA, 22 nt, Homo sapiens
ugagucgagauugcgccacugu

SEQ ID NO: 255484 - RNA, 22 nt, Homo sapiens
ugagugaaagaagcacuaagga

SEQ ID NO: 255485 - RNA, 22 nt, Homo sapiens
ugagugagguucuacucuguga

SEQ ID NO: 255486 - RNA, 22 nt, Homo sapiens
ugaguucaauguuaaugaagca

SEQ ID NO: 255487 - RNA, 22 nt, Homo sapiens
ugaguuccuugugugaccuugc

SEQ ID NO: 255488 - RNA, 22 nt, Homo sapiens
ugaguucuuuuagggauauugc

SEQ ID NO: 255489 - RNA, 22 nt, Homo sapiens
ugaguuuaucuaaagaccuggg

SEQ ID NO: 255490 - RNA, 23 nt, Homo sapiens
ugauaacagcauaugaagauucu

SEQ ID NO: 255491 - RNA, 22 nt, Homo sapiens
ugauauauugaaugaugaaaca

SEQ ID NO: 255492 - RNA, 18 nt, Homo sapiens
ugauaucaucacaauuga

SEQ ID NO: 255493 - RNA, 22 nt, Homo sapiens
ugauaugaucgcccuagcuuga

SEQ ID NO: 255494 - RNA, 22 nt, Homo sapiens
ugauauguguaaacaauguaua

SEQ ID NO: 255495 - RNA, 22 nt, Homo sapiens
ugaucuguguauauugaaccag

SEQ ID NO: 255496 - RNA, 22 nt, Homo sapiens
ugaugacacugauuucuucaau

SEQ ID NO: 255497 - RNA, 20 nt, Homo sapiens
ugaugcaaaucuuuaaaagu

SEQ ID NO: 255498 - RNA, 22 nt, Homo sapiens
ugauggcaauggcauucauuuu

SEQ ID NO: 255499 - RNA, 22 nt, Homo sapiens
ugauuuguuucaggaguuuucu

SEQ ID NO: 255500 - RNA, 22 nt, Homo sapiens
ugcaaaugucaaggguuagugu

SEQ ID NO: 255501 - RNA, 22 nt, Homo sapiens
ugcaaauguuaggugucauuau

SEQ ID NO: 255502 - RNA, 22 nt, Homo sapiens
ugcaaauguuaguaacaccacu

SEQ ID NO: 255503 - RNA, 19 nt, Homo sapiens
ugcaaauucuaaaaacuga

SEQ ID NO: 255504 - RNA, 22 nt, Homo sapiens
ugcaagacugcaguuacuuuug

SEQ ID NO: 255505 - RNA, 22 nt, Homo sapiens
ugcaaugugaaauaagcacauc

SEQ ID NO: 255506 - RNA, 22 nt, Homo sapiens
ugcaccacugcaccccagucug

SEQ ID NO: 255507 - RNA, 22 nt, Homo sapiens
ugcaccacugcacuccagcuug

SEQ ID NO: 255508 - RNA, 22 nt, Homo sapiens
ugcaccacugcacuccaggcug

SEQ ID NO: 255509 - RNA, 22 nt, Homo sapiens
ugcaccauugcacuccagccug

SEQ ID NO: 255510 - RNA, 22 nt, Homo sapiens
ugcagagucuguccugccugcc

SEQ ID NO: 255511 - RNA, 22 nt, Homo sapiens
acccugucauccacauggugcu

SEQ ID NO: 255512 - RNA, 22 nt, Homo sapiens
acccuuuagguuggaugaggau

SEQ ID NO: 255513 - RNA, 22 nt, Homo sapiens
accgaguguucucccgcagcgg

SEQ ID NO: 255514 - RNA, 22 nt, Homo sapiens
accugagacuaggcauuuuaua

SEQ ID NO: 255515 - RNA, 22 nt, Homo sapiens
accuggguguauguucaguuug

SEQ ID NO: 255516 - RNA, 22 nt, Homo sapiens
acugagaucuuuaaauaaauaa

SEQ ID NO: 255517 - RNA, 23 nt, Homo sapiens
acugagcaauguuuacauacuug

SEQ ID NO: 255518 - RNA, 20 nt, Homo sapiens
acugauauguuccuguucuc

SEQ ID NO: 255519 - RNA, 18 nt, Homo sapiens
acugcacuccaccuuggg

SEQ ID NO: 255520 - RNA, 22 nt, Homo sapiens
acugcacuccagacucugucuc

SEQ ID NO: 255521 - RNA, 22 nt, Homo sapiens
acugcacuccagccuaggcgac

SEQ ID NO: 255522 - RNA, 22 nt, Homo sapiens
acugcacuccagccucaugaca

SEQ ID NO: 255523 - RNA, 22 nt, Homo sapiens
acugcacuccagccuccugaca

SEQ ID NO: 255524 - RNA, 22 nt, Homo sapiens
acugcacuccagccugcccaac

SEQ ID NO: 255525 - RNA, 22 nt, Homo sapiens
acugcacuccagccugugcgua

SEQ ID NO: 255526 - RNA, 22 nt, Homo sapiens
acugcacuccagccuucaggac

SEQ ID NO: 255527 - RNA, 20 nt, Homo sapiens
acugcacuccagccuuccag

SEQ ID NO: 255528 - RNA, 22 nt, Homo sapiens
acugcacuccagccuuggagac

SEQ ID NO: 255529 - RNA, 22 nt, Homo sapiens
acugcacuccagccuuggcggc

SEQ ID NO: 255530 - RNA, 22 nt, Homo sapiens
acugcacugcagccuggccaac

SEQ ID NO: 255531 - RNA, 22 nt, Homo sapiens
acugcacuuauccuccaauguu

SEQ ID NO: 255532 - RNA, 21 nt, Homo sapiens
acuggaccccuuccauacacc

SEQ ID NO: 255533 - RNA, 22 nt, Homo sapiens
acuggaguuuguucaagaaaua

SEQ ID NO: 255534 - RNA, 22 nt, Homo sapiens
acuggcuguuaggaauuaccuc

SEQ ID NO: 255535 - RNA, 21 nt, Homo sapiens
acuuucuguggcaguccauuc

SEQ ID NO: 255536 - RNA, 22 nt, Homo sapiens
acuuuuugcaaccauuuggacc

SEQ ID NO: 255537 - RNA, 21 nt, Homo sapiens
agaaaaucuuaugggaaacau

SEQ ID NO: 255538 - RNA, 22 nt, Homo sapiens
agaaacauucucuugccuccuu

SEQ ID NO: 255539 - RNA, 22 nt, Homo sapiens
agaaagugcuucccuuugguga

SEQ ID NO: 255540 - RNA, 22 nt, Homo sapiens
agaaccauuagagggagauauu

SEQ ID NO: 255541 - RNA, 20 nt, Homo sapiens
agaaccuguaguguagaggg

SEQ ID NO: 255542 - RNA, 22 nt, Homo sapiens
agaagacuauucuggguugggc

SEQ ID NO: 255543 - RNA, 20 nt, Homo sapiens
agaagcauugcucucuucag

SEQ ID NO: 255544 - RNA, 22 nt, Homo sapiens
agaaugugaacaucuugaaagu

SEQ ID NO: 255545 - RNA, 22 nt, Homo sapiens
agacaagauggcuugagguuca

SEQ ID NO: 255546 - RNA, 22 nt, Homo sapiens
agacuagagcagagcccucucu

SEQ ID NO: 255547 - RNA, 22 nt, Homo sapiens
agagacauugcuccaacucacc

SEQ ID NO: 255548 - RNA, 22 nt, Homo sapiens
agagauacauucugagaagugc

SEQ ID NO: 255549 - RNA, 22 nt, Homo sapiens
agagaugauuaacauuuuggua

SEQ ID NO: 255550 - RNA, 22 nt, Homo sapiens
agagguauuggaaggaguguca

SEQ ID NO: 255551 - RNA, 22 nt, Homo sapiens
agagguuuuggggcugagagcu

SEQ ID NO: 255552 - RNA, 22 nt, Homo sapiens
agaguaguaggaugaauggacu

SEQ ID NO: 255553 - RNA, 21 nt, Homo sapiens
agagucaucucuaucuguacc

SEQ ID NO: 255554 - RNA, 22 nt, Homo sapiens
agauggucuucauaaguuuuaa

SEQ ID NO: 255555 - RNA, 23 nt, Homo sapiens
agcaaaugcucuagcacuccaac

SEQ ID NO: 255556 - RNA, 22 nt, Homo sapiens
agcaacauuguucauaauagcu

SEQ ID NO: 255557 - RNA, 22 nt, Homo sapiens
agcaagaugaaguugagcuagg

SEQ ID NO: 255558 - RNA, 22 nt, Homo sapiens
agcaccaccguugcucuauccc

SEQ ID NO: 255559 - RNA, 22 nt, Homo sapiens
agcacuacugcacuccagccug

SEQ ID NO: 255560 - RNA, 22 nt, Homo sapiens
agcagcaauuuuguaugguuua

SEQ ID NO: 255561 - RNA, 22 nt, Homo sapiens
agcagcacaucccuuucuggcc

SEQ ID NO: 255562 - RNA, 22 nt, Homo sapiens
agcagcaccaaacagacuaaga

SEQ ID NO: 255563 - RNA, 22 nt, Homo sapiens
agcagcauuaguggaaucuugu

SEQ ID NO: 255564 - RNA, 20 nt, Homo sapiens
agcagccacagauuccucag

SEQ ID NO: 255565 - RNA, 22 nt, Homo sapiens
agcagcucaagacuuaaauuug

SEQ ID NO: 255566 - RNA, 17 nt, Homo sapiens
agcauguguuugagauu

SEQ ID NO: 255567 - RNA, 16 nt, Homo sapiens
agccaccauuuacuug

SEQ ID NO: 255568 - RNA, 17 nt, Homo sapiens
agccccauuagcuaguu

SEQ ID NO: 255569 - RNA, 22 nt, Homo sapiens
agcuccuacuguuacaucauug

SEQ ID NO: 255570 - RNA, 22 nt, Homo sapiens
agcugauggucuuguaugaugu

SEQ ID NO: 255571 - RNA, 20 nt, Homo sapiens
agcugcagauauaaauccgc

SEQ ID NO: 255572 - RNA, 22 nt, Homo sapiens
agcuggaauuuaagguagauag

SEQ ID NO: 255573 - RNA, 22 nt, Homo sapiens
agcuggauuguuuaccuggggc

SEQ ID NO: 255574 - RNA, 22 nt, Homo sapiens
agcuggcuguggagaaaccccu

SEQ ID NO: 255575 - RNA, 22 nt, Homo sapiens
agcugguauuuguuagggaguu

SEQ ID NO: 255576 - RNA, 22 nt, Homo sapiens
agcuguuguuuuaagauacuaa

SEQ ID NO: 255577 - RNA, 22 nt, Homo sapiens
aggaaucuaagguaucagguua

SEQ ID NO: 255578 - RNA, 22 nt, Homo sapiens
aggaaugucaaugguaguuuaa

SEQ ID NO: 255579 - RNA, 22 nt, Homo sapiens
aggaauuuaauguaugauaaua

SEQ ID NO: 255580 - RNA, 19 nt, Homo sapiens
aggacuaaagacuagaagu

SEQ ID NO: 255581 - RNA, 22 nt, Homo sapiens
aggagaucagccucccugcaac

SEQ ID NO: 255582 - RNA, 21 nt, Homo sapiens
aggagcauucaugacgagguu

SEQ ID NO: 255583 - RNA, 21 nt, Homo sapiens
aggagcauucucuugcuuugu

SEQ ID NO: 255584 - RNA, 22 nt, Homo sapiens
aggcaagagugacuacgugaaa

SEQ ID NO: 255585 - RNA, 22 nt, Homo sapiens
aggcaaguugcucaaaugcaaa

SEQ ID NO: 255586 - RNA, 22 nt, Homo sapiens
aggcaugauuguauuuugcucu

SEQ ID NO: 255587 - RNA, 22 nt, Homo sapiens
aggcaugguggcacauacaugu

SEQ ID NO: 255588 - RNA, 22 nt, Homo sapiens
aggcauugugcaucgaugauuu

SEQ ID NO: 255589 - RNA, 23 nt, Homo sapiens
aggccaguuuuuccugcuugcug

SEQ ID NO: 255590 - RNA, 22 nt, Homo sapiens
agggagcaaaguggucuuucuc

SEQ ID NO: 255591 - RNA, 22 nt, Homo sapiens
agguaaacauggggacugcuac

SEQ ID NO: 255592 - RNA, 22 nt, Homo sapiens
agguaaguauguuauuacuuuu

SEQ ID NO: 255593 - RNA, 22 nt, Homo sapiens
agguaagucucuaauuaugaau

SEQ ID NO: 255594 - RNA, 22 nt, Homo sapiens
agguacuugagauucugaacug

SEQ ID NO: 255595 - RNA, 20 nt, Homo sapiens
agguagauagaugauagaua

SEQ ID NO: 255596 - RNA, 20 nt, Homo sapiens
agguaguuauacaaaugugu

SEQ ID NO: 255597 - RNA, 21 nt, Homo sapiens
aggucaguaagaaugcagcac

SEQ ID NO: 255598 - RNA, 22 nt, Homo sapiens
aggucccauguccucccugacc

SEQ ID NO: 255599 - RNA, 22 nt, Homo sapiens
aggugcucuuccuguaggucac

SEQ ID NO: 255600 - RNA, 22 nt, Homo sapiens
agguuaucccgcauuauuuggu

SEQ ID NO: 255601 - RNA, 22 nt, Homo sapiens
agguuuucagccccagccuagg

SEQ ID NO: 255602 - RNA, 22 nt, Homo sapiens
aguaaauuucugugcuuucaua

SEQ ID NO: 255603 - RNA, 22 nt, Homo sapiens
aguaacaggauccaaagaaugu

SEQ ID NO: 255604 - RNA, 22 nt, Homo sapiens
auggcagcccucuuuauccaug

SEQ ID NO: 255605 - RNA, 22 nt, Homo sapiens
auggcagcugacacuuccgucu

SEQ ID NO: 255606 - RNA, 22 nt, Homo sapiens
auggcagcugguuuuacccuag

SEQ ID NO: 255607 - RNA, 22 nt, Homo sapiens
auggcaguuucacucugggauu

SEQ ID NO: 255608 - RNA, 22 nt, Homo sapiens
auggcauugaagaguugucccu

SEQ ID NO: 255609 - RNA, 22 nt, Homo sapiens
auggcucuuauuauuugaggua

SEQ ID NO: 255610 - RNA, 22 nt, Homo sapiens
auggcuuuggucucccagugau

SEQ ID NO: 255611 - RNA, 22 nt, Homo sapiens
auggcuuuucacagaggguucu

SEQ ID NO: 255612 - RNA, 22 nt, Homo sapiens
auggcuuuuccugucuugcaug

SEQ ID NO: 255613 - RNA, 22 nt, Homo sapiens
auggcuuuugcccuaaauggau

SEQ ID NO: 255614 - RNA, 21 nt, Homo sapiens
augggguagaagagaaggcuu

SEQ ID NO: 255615 - RNA, 22 nt, Homo sapiens
augguauuuugugauaccuugu

SEQ ID NO: 255616 - RNA, 22 nt, Homo sapiens
auguaauugagguuuuugccau

SEQ ID NO: 255617 - RNA, 22 nt, Homo sapiens
auguaguagauauuuauggaaa

SEQ ID NO: 255618 - RNA, 22 nt, Homo sapiens
auguaguagcagaaaauauuuu

SEQ ID NO: 255619 - RNA, 22 nt, Homo sapiens
auguagugugauuuucacuaga

SEQ ID NO: 255620 - RNA, 22 nt, Homo sapiens
augucaaagaggaaaacuggau

SEQ ID NO: 255621 - RNA, 22 nt, Homo sapiens
augucacagguccuagccaagu

SEQ ID NO: 255622 - RNA, 20 nt, Homo sapiens
augucagaguguggguacgg

SEQ ID NO: 255623 - RNA, 22 nt, Homo sapiens
augucuggcagaagacuucuca

SEQ ID NO: 255624 - RNA, 22 nt, Homo sapiens
augucugguagccaccuggagg

SEQ ID NO: 255625 - RNA, 22 nt, Homo sapiens
augugacugauguaaucagaca

SEQ ID NO: 255626 - RNA, 22 nt, Homo sapiens
augugacuugugaaaaguucag

SEQ ID NO: 255627 - RNA, 22 nt, Homo sapiens
auguggaaagcagcaugauaug

SEQ ID NO: 255628 - RNA, 19 nt, Homo sapiens
augugguuagcaugacugc

SEQ ID NO: 255629 - RNA, 22 nt, Homo sapiens
auuaacaucuagaguuuuggug

SEQ ID NO: 255630 - RNA, 22 nt, Homo sapiens
auuaaguaaugguuccaauaau

SEQ ID NO: 255631 - RNA, 22 nt, Homo sapiens
auuacaugucuauccaugaaca

SEQ ID NO: 255632 - RNA, 22 nt, Homo sapiens
auucaagugaugugauucuucu

SEQ ID NO: 255633 - RNA, 22 nt, Homo sapiens
auucacuguggcuuucucugau

SEQ ID NO: 255634 - RNA, 22 nt, Homo sapiens
auucccuguagaauaaggaugg

SEQ ID NO: 255635 - RNA, 22 nt, Homo sapiens
auugaguaaaugaaaauugccu

SEQ ID NO: 255636 - RNA, 22 nt, Homo sapiens
auugagucauuucaaauccaag

SEQ ID NO: 255637 - RNA, 22 nt, Homo sapiens
auugcacuccagccugggcgac

SEQ ID NO: 255638 - RNA, 22 nt, Homo sapiens
auugcaguuucaacuccagggc

SEQ ID NO: 255639 - RNA, 22 nt, Homo sapiens
auugcuaacugaaauaagacca

SEQ ID NO: 255640 - RNA, 22 nt, Homo sapiens
auuggcagaaaucuuuauagua

SEQ ID NO: 255641 - RNA, 22 nt, Homo sapiens
auuggccaaugggacgucagca

SEQ ID NO: 255642 - RNA, 22 nt, Homo sapiens
auuggcuuuauacauaagaaua

SEQ ID NO: 255643 - RNA, 22 nt, Homo sapiens
auuggucuauuaaaccuaaguu

SEQ ID NO: 255644 - RNA, 22 nt, Homo sapiens
auuggucuugaaaccagagaga

SEQ ID NO: 255645 - RNA, 22 nt, Homo sapiens
auugucacccgggcaguaagca

SEQ ID NO: 255646 - RNA, 22 nt, Homo sapiens
auugucacugugcuccaccagu

SEQ ID NO: 255647 - RNA, 21 nt, Homo sapiens
auuugcacugagcuccugugc

SEQ ID NO: 255648 - RNA, 21 nt, Homo sapiens
auuugguguuagaaauaaauu

SEQ ID NO: 255649 - RNA, 22 nt, Homo sapiens
auuuugcauugcuguaaaggaa

SEQ ID NO: 255650 - RNA, 22 nt, Homo sapiens
caaaggcuguuauaggccagga

SEQ ID NO: 255651 - RNA, 22 nt, Homo sapiens
caaagucuucaguugauucuga

SEQ ID NO: 255652 - RNA, 22 nt, Homo sapiens
caaagucuucucauuaugucuu

SEQ ID NO: 255653 - RNA, 22 nt, Homo sapiens
caaagugcugaaagaggccagg

SEQ ID NO: 255654 - RNA, 22 nt, Homo sapiens
caaauugcuuguggaggauaau

SEQ ID NO: 255655 - RNA, 22 nt, Homo sapiens
caagaggcuguguauaaagcca

SEQ ID NO: 255656 - RNA, 22 nt, Homo sapiens
caagugcucuaggauccugagu

SEQ ID NO: 255657 - RNA, 22 nt, Homo sapiens
caaugcagcuuuuggagagaaa

SEQ ID NO: 255658 - RNA, 21 nt, Homo sapiens
caauggcacgaucuuggcuca

SEQ ID NO: 255659 - RNA, 22 nt, Homo sapiens
caauggcacuauuggaaaaggu

SEQ ID NO: 255660 - RNA, 22 nt, Homo sapiens
caaugguuuuuuaguauaagua

SEQ ID NO: 255661 - RNA, 22 nt, Homo sapiens
cacaaugucugguaggccacuu

SEQ ID NO: 255662 - RNA, 22 nt, Homo sapiens
cacagcuaacaacuguuucuuc

SEQ ID NO: 255663 - RNA, 22 nt, Homo sapiens
cacagucuugcaauauugagau

SEQ ID NO: 255664 - RNA, 22 nt, Homo sapiens
cacaguguuacugguaugaagu

SEQ ID NO: 255665 - RNA, 22 nt, Homo sapiens
cacauguuugcuacauuuuucu

SEQ ID NO: 255666 - RNA, 22 nt, Homo sapiens
cacccuugcagggacagcuuug

SEQ ID NO: 255667 - RNA, 22 nt, Homo sapiens
cacuaccucuacaggcagcugg

SEQ ID NO: 255668 - RNA, 22 nt, Homo sapiens
cacucaguuugugguacuuugu

SEQ ID NO: 255669 - RNA, 22 nt, Homo sapiens
cacugaaugugagguuggggag

SEQ ID NO: 255670 - RNA, 22 nt, Homo sapiens
cacugcacuccagucugacgac

SEQ ID NO: 255671 - RNA, 22 nt, Homo sapiens
cacugcauccuccaccugccag

SEQ ID NO: 255672 - RNA, 22 nt, Homo sapiens
cacugcgaccuccaccucccgg

SEQ ID NO: 255673 - RNA, 22 nt, Homo sapiens
cacugcgacguccgccucccgg

SEQ ID NO: 255674 - RNA, 22 nt, Homo sapiens
cacuggguuagaacaugcuccu

SEQ ID NO: 255675 - RNA, 22 nt, Homo sapiens
cagacaugucuuguggccgugg

SEQ ID NO: 255676 - RNA, 22 nt, Homo sapiens
cagagaaugucuuuuuuaacca

SEQ ID NO: 255677 - RNA, 21 nt, Homo sapiens
cagagaucaucucuguuuuaa

SEQ ID NO: 255678 - RNA, 20 nt, Homo sapiens
cagcaaccugcucucuuccu

SEQ ID NO: 255679 - RNA, 22 nt, Homo sapiens
cagcaucauucaucugggguaa

SEQ ID NO: 255680 - RNA, 22 nt, Homo sapiens
cagcccguaaucccagcacuuu

SEQ ID NO: 255681 - RNA, 22 nt, Homo sapiens
cagccggguggcuccuagggua

SEQ ID NO: 255682 - RNA, 22 nt, Homo sapiens
cagcugguggcaagaagacaga

SEQ ID NO: 255683 - RNA, 22 nt, Homo sapiens
cagcuguuguugggguauagga

SEQ ID NO: 255684 - RNA, 22 nt, Homo sapiens
caggcagucuggcucccaagug

SEQ ID NO: 255685 - RNA, 22 nt, Homo sapiens
caggcagugggagacaaaacug

SEQ ID NO: 255686 - RNA, 22 nt, Homo sapiens
cagucacugggauuauggucau

SEQ ID NO: 255687 - RNA, 22 nt, Homo sapiens
cagugcaaagccucugcccaga

SEQ ID NO: 255688 - RNA, 22 nt, Homo sapiens
cagugcauagaugugccacauu

SEQ ID NO: 255689 - RNA, 22 nt, Homo sapiens
cauacaagcuacaaucacaaag

SEQ ID NO: 255690 - RNA, 21 nt, Homo sapiens
caucaaauugucauggugggu

SEQ ID NO: 255691 - RNA, 22 nt, Homo sapiens
caucagagugagauauaagauc

SEQ ID NO: 255692 - RNA, 22 nt, Homo sapiens
caucagcaauguaugaggguuc

SEQ ID NO: 255693 - RNA, 21 nt, Homo sapiens
cauccccugccauuguggucu

SEQ ID NO: 255694 - RNA, 19 nt, Homo sapiens
caucccugagcugaagugg

SEQ ID NO: 255695 - RNA, 22 nt, Homo sapiens
caucccugucgucaagucucug

SEQ ID NO: 255696 - RNA, 20 nt, Homo sapiens
gcaaauggaucccacaagcc

SEQ ID NO: 255697 - RNA, 22 nt, Homo sapiens
gcaagaaucugggaguaaaauu

SEQ ID NO: 255698 - RNA, 20 nt, Homo sapiens
gcaagcaugaagaguagaga

SEQ ID NO: 255699 - RNA, 22 nt, Homo sapiens
gcaaggaugagugcccaugaga

SEQ ID NO: 255700 - RNA, 22 nt, Homo sapiens
gcacaguggcucccgucuauaa

SEQ ID NO: 255701 - RNA, 22 nt, Homo sapiens
gcacccugucaaaauggaccaa

SEQ ID NO: 255702 - RNA, 22 nt, Homo sapiens
gcacugagagaagccccaagua

SEQ ID NO: 255703 - RNA, 22 nt, Homo sapiens
gcacugggccacauuuauuuuc

SEQ ID NO: 255704 - RNA, 22 nt, Homo sapiens
gcagaauugacucuguuuuuuc

SEQ ID NO: 255705 - RNA, 22 nt, Homo sapiens
gcagaguauagagggcugggcc

SEQ ID NO: 255706 - RNA, 22 nt, Homo sapiens
gcagaucucuucauuucucuua

SEQ ID NO: 255707 - RNA, 22 nt, Homo sapiens
gcagcauuaccaagacauggca

SEQ ID NO: 255708 - RNA, 19 nt, Homo sapiens
gcaguauugaaggccaguc

SEQ ID NO: 255709 - RNA, 23 nt, Homo sapiens
gcagucauuuggaaaagguugaa

SEQ ID NO: 255710 - RNA, 22 nt, Homo sapiens
gcagugcaguggcgcgaucucg

SEQ ID NO: 255711 - RNA, 22 nt, Homo sapiens
gcagugugugaggaauuugggu

SEQ ID NO: 255712 - RNA, 16 nt, Homo sapiens
gcaguguguuuaauag

SEQ ID NO: 255713 - RNA, 22 nt, Homo sapiens
gcaguguugugauccaggucuu

SEQ ID NO: 255714 - RNA, 22 nt, Homo sapiens
gcaugacaaugauugcucuuca

SEQ ID NO: 255715 - RNA, 20 nt, Homo sapiens
gcaugagucuuuauaguaga

SEQ ID NO: 255716 - RNA, 22 nt, Homo sapiens
gcaugcacuguauuuaaguauc

SEQ ID NO: 255717 - RNA, 22 nt, Homo sapiens
gcauggaguggaaauucuuggg

SEQ ID NO: 255718 - RNA, 22 nt, Homo sapiens
gcauggauguugauggcugcug

SEQ ID NO: 255719 - RNA, 19 nt, Homo sapiens
gccaccuggugcguguucu

SEQ ID NO: 255720 - RNA, 21 nt, Homo sapiens
gccaguguggcaauuuuucaa

SEQ ID NO: 255721 - RNA, 22 nt, Homo sapiens
gccauugcacuccagccuagcg

SEQ ID NO: 255722 - RNA, 22 nt, Homo sapiens
gccauugcacuccagccuaggu

SEQ ID NO: 255723 - RNA, 22 nt, Homo sapiens
gccauugcacuccagccugagc

SEQ ID NO: 255724 - RNA, 22 nt, Homo sapiens
gccauugcacucuagccugagc

SEQ ID NO: 255725 - RNA, 22 nt, Homo sapiens
gcccugagauucuuggauucug

SEQ ID NO: 255726 - RNA, 22 nt, Homo sapiens
gccuagggacaaaccguccgac

SEQ ID NO: 255727 - RNA, 19 nt, Homo sapiens
gcggcacuggagacacagc

SEQ ID NO: 255728 - RNA, 22 nt, Homo sapiens
gcuaggagauccacugcucucu

SEQ ID NO: 255729 - RNA, 19 nt, Homo sapiens
gcucaccuugcugcuccag

SEQ ID NO: 255730 - RNA, 22 nt, Homo sapiens
gcugguauuacaggcaugagcc

SEQ ID NO: 255731 - RNA, 22 nt, Homo sapiens
gcuguauuguugaaggaaaugu

SEQ ID NO: 255732 - RNA, 22 nt, Homo sapiens
gcuguguucucgaggcggggga

SEQ ID NO: 255733 - RNA, 18 nt, Homo sapiens
gcuguugucagagcacau

SEQ ID NO: 255734 - RNA, 19 nt, Homo sapiens
gcuuuguggggaaggagcc

SEQ ID NO: 255735 - RNA, 22 nt, Homo sapiens
ggaaagaucagcuaaauguaag

SEQ ID NO: 255736 - RNA, 22 nt, Homo sapiens
ggaagacaguguggugauuccu

SEQ ID NO: 255737 - RNA, 22 nt, Homo sapiens
ggaagccugcacucgggcaggg

SEQ ID NO: 255738 - RNA, 22 nt, Homo sapiens
ggaaggucaaagggaaagcaga

SEQ ID NO: 255739 - RNA, 22 nt, Homo sapiens
ggaaugggauuugaagucuggc

SEQ ID NO: 255740 - RNA, 21 nt, Homo sapiens
ggaauuuagggaaugauuuag

SEQ ID NO: 255741 - RNA, 23 nt, Homo sapiens
ggaguguauuggcacgaucucag

SEQ ID NO: 255742 - RNA, 22 nt, Homo sapiens
ggaguuuaagucuugugcaucu

SEQ ID NO: 255743 - RNA, 22 nt, Homo sapiens
ggaugcauucaacuuccaguuc

SEQ ID NO: 255744 - RNA, 23 nt, Homo sapiens
ggauggaaaguuuugagggccac

SEQ ID NO: 255745 - RNA, 22 nt, Homo sapiens
ggcaaggauguuuuucuggcaa

SEQ ID NO: 255746 - RNA, 22 nt, Homo sapiens
ggcaaggauuagauucuccccu

SEQ ID NO: 255747 - RNA, 22 nt, Homo sapiens
ggcaaugucagcuaaugaugga

SEQ ID NO: 255748 - RNA, 22 nt, Homo sapiens
ggcacaauugcagcaauaaaca

SEQ ID NO: 255749 - RNA, 22 nt, Homo sapiens
ggcacgguggcucacaccugua

SEQ ID NO: 255750 - RNA, 22 nt, Homo sapiens
ggcagcaugggugccuuuguga

SEQ ID NO: 255751 - RNA, 22 nt, Homo sapiens
ggcagcgugcacuuucgccacu

SEQ ID NO: 255752 - RNA, 22 nt, Homo sapiens
ggcagguaaggagugggagccu

SEQ ID NO: 255753 - RNA, 22 nt, Homo sapiens
ggcaguguuauuauauuuuugg

SEQ ID NO: 255754 - RNA, 22 nt, Homo sapiens
ggcaguuuggcaguuucauaaa

SEQ ID NO: 255755 - RNA, 22 nt, Homo sapiens
ggcaguuuguucuugcuccuuu

SEQ ID NO: 255756 - RNA, 22 nt, Homo sapiens
ggcccugagacaggaaaaagcu

SEQ ID NO: 255757 - RNA, 22 nt, Homo sapiens
ggcucguguuuucuguccaguu

SEQ ID NO: 255758 - RNA, 22 nt, Homo sapiens
ggcuuuggucacacaggggcaa

SEQ ID NO: 255759 - RNA, 22 nt, Homo sapiens
gggaaaaugucuauugaaugaa

SEQ ID NO: 255760 - RNA, 22 nt, Homo sapiens
gggaagaaggagugguuuacuc

SEQ ID NO: 255761 - RNA, 22 nt, Homo sapiens
gggagcacaagaaauguuucau

SEQ ID NO: 255762 - RNA, 22 nt, Homo sapiens
gggcaagaagucuuguaguuuu

SEQ ID NO: 255763 - RNA, 18 nt, Homo sapiens
gggcaaguugccuggcuu

SEQ ID NO: 255764 - RNA, 22 nt, Homo sapiens
gggcagaugucuggacaccuca

SEQ ID NO: 255765 - RNA, 22 nt, Homo sapiens
gggcaugauggugcacacaugu

SEQ ID NO: 255766 - RNA, 22 nt, Homo sapiens
gggcaugaugucuuaugccuau

SEQ ID NO: 255767 - RNA, 22 nt, Homo sapiens
ggggaguguggacaucacccug

SEQ ID NO: 255768 - RNA, 17 nt, Homo sapiens
gggucaccuugcaggua

SEQ ID NO: 255769 - RNA, 15 nt, Homo sapiens
ggguccucucccaaa

SEQ ID NO: 255770 - RNA, 22 nt, Homo sapiens
ggguucccuucuggcucagggu

SEQ ID NO: 255771 - RNA, 22 nt, Homo sapiens
gguaacaguggggcuaugcuua

SEQ ID NO: 255772 - RNA, 22 nt, Homo sapiens
gguauuuaaaguaccugucugc

SEQ ID NO: 255773 - RNA, 22 nt, Homo sapiens
ggucacccugaugcuggugguc

SEQ ID NO: 255774 - RNA, 19 nt, Homo sapiens
ggucagcaaagucuagcug

SEQ ID NO: 255775 - RNA, 22 nt, Homo sapiens
ggucaggagaaugguaacugag

SEQ ID NO: 255776 - RNA, 22 nt, Homo sapiens
ggugagcacagaaugcccugag

SEQ ID NO: 255777 - RNA, 22 nt, Homo sapiens
guaacacaugcugcucucuggu

SEQ ID NO: 255778 - RNA, 22 nt, Homo sapiens
guaacagucucaacaguggucu

SEQ ID NO: 255779 - RNA, 22 nt, Homo sapiens
guaagugguagagcugggcuau

SEQ ID NO: 255780 - RNA, 22 nt, Homo sapiens
guacaggcagcaaacaccauaa

SEQ ID NO: 255781 - RNA, 22 nt, Homo sapiens
guacauggaaugaaauucaaaa

SEQ ID NO: 255782 - RNA, 22 nt, Homo sapiens
guagagagaaauacaaagcugu

SEQ ID NO: 255783 - RNA, 22 nt, Homo sapiens
guagcagaacauguuccuugua

SEQ ID NO: 255784 - RNA, 22 nt, Homo sapiens
guagcagccacacuugauaacu

SEQ ID NO: 255785 - RNA, 18 nt, Homo sapiens
guauuccagccugaguga

SEQ ID NO: 255786 - RNA, 22 nt, Homo sapiens
guauuuuguuagggugugguau

SEQ ID NO: 255787 - RNA, 22 nt, Homo sapiens
gucaaaugcacagaaccauuaa

SEQ ID NO: 255788 - RNA, 22 nt, Homo sapiens
gucaagagaacuuucuaucacu

SEQ ID NO: 255789 - RNA, 22 nt, Homo sapiens
ucugucuuugccuaaguuuguc

SEQ ID NO: 255790 - RNA, 22 nt, Homo sapiens
ucugucuuugucaggaccagag

SEQ ID NO: 255791 - RNA, 22 nt, Homo sapiens
ucugugcauuguaacaacuaaa

SEQ ID NO: 255792 - RNA, 22 nt, Homo sapiens
ucugugcauuguaggauguuua

SEQ ID NO: 255793 - RNA, 22 nt, Homo sapiens
ucugugcauuuucuuuuagacu

SEQ ID NO: 255794 - RNA, 22 nt, Homo sapiens
ucugugcugagaguugaaaguu

SEQ ID NO: 255795 - RNA, 19 nt, Homo sapiens
ucugugcuugucccccugu

SEQ ID NO: 255796 - RNA, 22 nt, Homo sapiens
ucuguuguuguuuuaagagaca

SEQ ID NO: 255797 - RNA, 22 nt, Homo sapiens
ucuuagugcggcugcugcagcc

SEQ ID NO: 255798 - RNA, 22 nt, Homo sapiens
ucuuauuuggggaaaggguccu

SEQ ID NO: 255799 - RNA, 22 nt, Homo sapiens
ucuugcaguucccaaauucaca

SEQ ID NO: 255800 - RNA, 22 nt, Homo sapiens
ucuugcuuguuguucccuucau

SEQ ID NO: 255801 - RNA, 22 nt, Homo sapiens
ucuuggcauggcugaagauucc

SEQ ID NO: 255802 - RNA, 20 nt, Homo sapiens
ucuugggaauguagccuagg

SEQ ID NO: 255803 - RNA, 22 nt, Homo sapiens
ucuuugauuuuguuacuaagac

SEQ ID NO: 255804 - RNA, 22 nt, Homo sapiens
ucuuugccuaacccaaggucau

SEQ ID NO: 255805 - RNA, 22 nt, Homo sapiens
ucuuuggaggcgaucuguuuga

SEQ ID NO: 255806 - RNA, 22 nt, Homo sapiens
ucuuuggucuacuuucauaugu

SEQ ID NO: 255807 - RNA, 20 nt, Homo sapiens
ucuuuuuguggccccagagu

SEQ ID NO: 255808 - RNA, 18 nt, Homo sapiens
ugaaacacauuuuuuccu

SEQ ID NO: 255809 - RNA, 22 nt, Homo sapiens
ugaaagcuacagucuccuagga

SEQ ID NO: 255810 - RNA, 20 nt, Homo sapiens
ugaaaucuucacuaagucuc

SEQ ID NO: 255811 - RNA, 22 nt, Homo sapiens
ugaaauguuaaacaaguggcuc

SEQ ID NO: 255812 - RNA, 20 nt, Homo sapiens
ugaacugguuacuuucuguc

SEQ ID NO: 255813 - RNA, 22 nt, Homo sapiens
ugaagacauuuuugggugugua

SEQ ID NO: 255814 - RNA, 22 nt, Homo sapiens
ugaagacucaauuauuaugaac

SEQ ID NO: 255815 - RNA, 22 nt, Homo sapiens
ugaagggcauuguuuugccaaa

SEQ ID NO: 255816 - RNA, 22 nt, Homo sapiens
ugaagugaagcaguaguguggg

SEQ ID NO: 255817 - RNA, 22 nt, Homo sapiens
ugaauacugugcaaaggauuug

SEQ ID NO: 255818 - RNA, 22 nt, Homo sapiens
ugaauacuucguucaaagauaa

SEQ ID NO: 255819 - RNA, 22 nt, Homo sapiens
ugaauucuguccaaaauaacug

SEQ ID NO: 255820 - RNA, 21 nt, Homo sapiens
ugacagaaaauugaguuugcu

SEQ ID NO: 255821 - RNA, 23 nt, Homo sapiens
ugacagaccuucuggaagaaguc

SEQ ID NO: 255822 - RNA, 22 nt, Homo sapiens
ugacagugaauaagucucuuaa

SEQ ID NO: 255823 - RNA, 22 nt, Homo sapiens
ugacaucaccaccuccgucauc

SEQ ID NO: 255824 - RNA, 18 nt, Homo sapiens
ugacaucauuuagaaagg

SEQ ID NO: 255825 - RNA, 22 nt, Homo sapiens
ugacaugaagaaaaacagauuu

SEQ ID NO: 255826 - RNA, 22 nt, Homo sapiens
ugacauugggagugaagugaag

SEQ ID NO: 255827 - RNA, 21 nt, Homo sapiens
ugacuagauuccagauuggcc

SEQ ID NO: 255828 - RNA, 22 nt, Homo sapiens
ugacuaggaaauuagaacuuuu

SEQ ID NO: 255829 - RNA, 22 nt, Homo sapiens
ugacuaggaggcuggaggauga

SEQ ID NO: 255830 - RNA, 22 nt, Homo sapiens
ugacucaagagccugacucauc

SEQ ID NO: 255831 - RNA, 23 nt, Homo sapiens
ugacugaguauauguuuggugcu

SEQ ID NO: 255832 - RNA, 21 nt, Homo sapiens
ugagaacaacaggucaagcag

SEQ ID NO: 255833 - RNA, 22 nt, Homo sapiens
ugagaacuaaugaagaauuuau

SEQ ID NO: 255834 - RNA, 22 nt, Homo sapiens
ugagaaugaugauugguaaacc

SEQ ID NO: 255835 - RNA, 22 nt, Homo sapiens
ugagaccaacagauuccaguuc

SEQ ID NO: 255836 - RNA, 22 nt, Homo sapiens
ugagaccuuucauuucucagug

SEQ ID NO: 255837 - RNA, 22 nt, Homo sapiens
ugagacugagucucgcucuauu

SEQ ID NO: 255838 - RNA, 22 nt, Homo sapiens
ugagagcuuugaugcacuguuu

SEQ ID NO: 255839 - RNA, 22 nt, Homo sapiens
ugagauaaugcaugugaagauc

SEQ ID NO: 255840 - RNA, 18 nt, Homo sapiens
ugagauacuagaauaggu

SEQ ID NO: 255841 - RNA, 22 nt, Homo sapiens
ugagauaucauuucacacccag

SEQ ID NO: 255842 - RNA, 19 nt, Homo sapiens
ugagaucuuuacuggguuu

SEQ ID NO: 255843 - RNA, 22 nt, Homo sapiens
ugagaucuuugcuguccucacc

SEQ ID NO: 255844 - RNA, 22 nt, Homo sapiens
ugagaugaaagcagaaagacuu

SEQ ID NO: 255845 - RNA, 22 nt, Homo sapiens
ugagaugauagauauguuaauu

SEQ ID NO: 255846 - RNA, 21 nt, Homo sapiens
ugagaugauccugcaugcaug

SEQ ID NO: 255847 - RNA, 22 nt, Homo sapiens
ugagaugauuuaauggagccca

SEQ ID NO: 255848 - RNA, 22 nt, Homo sapiens
ugagauggaucuuggauuugaa

SEQ ID NO: 255849 - RNA, 22 nt, Homo sapiens
ugagauggcuuuauugcugaau

SEQ ID NO: 255850 - RNA, 22 nt, Homo sapiens
ugagauggguucugguccccug

SEQ ID NO: 255851 - RNA, 22 nt, Homo sapiens
ugagaugugaagaucacaugaa

SEQ ID NO: 255852 - RNA, 23 nt, Homo sapiens
ugagauuauaaucuuuuacuucu

SEQ ID NO: 255853 - RNA, 20 nt, Homo sapiens
ugagccccuggacucaagcg

SEQ ID NO: 255854 - RNA, 22 nt, Homo sapiens
ugagcugagaucgugccauugu

SEQ ID NO: 255855 - RNA, 22 nt, Homo sapiens
ugagcugagauuaagcugcugc

SEQ ID NO: 255856 - RNA, 18 nt, Homo sapiens
ugaggaaaggguuugcua

SEQ ID NO: 255857 - RNA, 22 nt, Homo sapiens
ugaggacugagaggcacugugg

SEQ ID NO: 255858 - RNA, 22 nt, Homo sapiens
ugaggagugagaaauugguuuc

SEQ ID NO: 255859 - RNA, 22 nt, Homo sapiens
ugagguaacaaacuaugaguua

SEQ ID NO: 255860 - RNA, 22 nt, Homo sapiens
ugagguaauagauaauauuuuu

SEQ ID NO: 255861 - RNA, 22 nt, Homo sapiens
ugagguagguaccauuaucacu

SEQ ID NO: 255862 - RNA, 22 nt, Homo sapiens
ugaguacuacuaguuacugcua

SEQ ID NO: 255863 - RNA, 23 nt, Homo sapiens
ugaguaggcaguuuuccccucac

SEQ ID NO: 255864 - RNA, 22 nt, Homo sapiens
ugagucaugcuggagucauggc

SEQ ID NO: 255865 - RNA, 22 nt, Homo sapiens
ugagucauguaauaaugcugcu

SEQ ID NO: 255866 - RNA, 22 nt, Homo sapiens
ugagugccuggagggcagggac

SEQ ID NO: 255867 - RNA, 22 nt, Homo sapiens
ugaguuagguaauaauaaauau

SEQ ID NO: 255868 - RNA, 20 nt, Homo sapiens
ugaguuccuuguucagaagc

SEQ ID NO: 255869 - RNA, 22 nt, Homo sapiens
ugauaacugaucuggauuugua

SEQ ID NO: 255870 - RNA, 22 nt, Homo sapiens
ugauauauugaaugaugaaaca

SEQ ID NO: 255871 - RNA, 18 nt, Homo sapiens
ugauaucaucacaauuga

SEQ ID NO: 255872 - RNA, 22 nt, Homo sapiens
ugauaucugaauagauacacaa

SEQ ID NO: 255873 - RNA, 22 nt, Homo sapiens
ugauauuuuugauccuuaaguu

SEQ ID NO: 255874 - RNA, 22 nt, Homo sapiens
ugaucacagcuugacuaaagga

SEQ ID NO: 255875 - RNA, 22 nt, Homo sapiens
ugaucucagcucacugguugaa

SEQ ID NO: 255876 - RNA, 22 nt, Homo sapiens
ugaucucauuagcaccuuuagc

SEQ ID NO: 255877 - RNA, 22 nt, Homo sapiens
ugaucuguccaccucagcuucc

SEQ ID NO: 255878 - RNA, 22 nt, Homo sapiens
ugcaaauuauugggccccaacu

SEQ ID NO: 255879 - RNA, 22 nt, Homo sapiens
ugcaagacacuguccugggcau

SEQ ID NO: 255880 - RNA, 22 nt, Homo sapiens
ugcaagaugagauuuuggaugg

SEQ ID NO: 255881 - RNA, 22 nt, Homo sapiens
ugcaagaugauuucaauugaua

SEQ ID NO: 255882 - RNA, 22 nt, Homo sapiens
uugaauagaaguguugaaagug

SEQ ID NO: 255883 - RNA, 22 nt, Homo sapiens
uugacacuaauuauuauaggug

SEQ ID NO: 255884 - RNA, 22 nt, Homo sapiens
uugaccaaagaagagucauugc

SEQ ID NO: 255885 - RNA, 22 nt, Homo sapiens
uugacuuuuaggaggaaaauga

SEQ ID NO: 255886 - RNA, 22 nt, Homo sapiens
uugagaaucuuugcuaaaggaa

SEQ ID NO: 255887 - RNA, 22 nt, Homo sapiens
uugagacggagucuugcucuuu

SEQ ID NO: 255888 - RNA, 22 nt, Homo sapiens
uugagacggaguuuugcucuug

SEQ ID NO: 255889 - RNA, 22 nt, Homo sapiens
uugagacugagucucgcccugu

SEQ ID NO: 255890 - RNA, 22 nt, Homo sapiens
uugagauggagcuucacucuug

SEQ ID NO: 255891 - RNA, 22 nt, Homo sapiens
uugagauggagucucacgcauu

SEQ ID NO: 255892 - RNA, 22 nt, Homo sapiens
uugagauggagucucacuccuu

SEQ ID NO: 255893 - RNA, 22 nt, Homo sapiens
uugagauggagucucgcucuuu

SEQ ID NO: 255894 - RNA, 22 nt, Homo sapiens
uugagauggagucucgcugugu

SEQ ID NO: 255895 - RNA, 22 nt, Homo sapiens
uugagauggagucuugcucuug

SEQ ID NO: 255896 - RNA, 22 nt, Homo sapiens
uugagauggaguuucacucuug

SEQ ID NO: 255897 - RNA, 22 nt, Homo sapiens
uugagauggaguuucgcucuug

SEQ ID NO: 255898 - RNA, 19 nt, Homo sapiens
uugagaugugaacucacac

SEQ ID NO: 255899 - RNA, 22 nt, Homo sapiens
uugagcacugucugugugcagu

SEQ ID NO: 255900 - RNA, 22 nt, Homo sapiens
uugaggaggcagucugcccauu

SEQ ID NO: 255901 - RNA, 22 nt, Homo sapiens
uugaggaucauuguuuucggag

SEQ ID NO: 255902 - RNA, 22 nt, Homo sapiens
uugaggugaagggcagagcagc

SEQ ID NO: 255903 - RNA, 22 nt, Homo sapiens
uugaucugugucccugcccaau

SEQ ID NO: 255904 - RNA, 22 nt, Homo sapiens
uugauguccaucucuagguaaa

SEQ ID NO: 255905 - RNA, 23 nt, Homo sapiens
uugcaaagccugaaacucuucag

SEQ ID NO: 255906 - RNA, 22 nt, Homo sapiens
uugcaaaguugccaaggaagga

SEQ ID NO: 255907 - RNA, 22 nt, Homo sapiens
uugcaaaucucuuguguuuggu

SEQ ID NO: 255908 - RNA, 22 nt, Homo sapiens
uugcaacauuguaaguuuauau

SEQ ID NO: 255909 - RNA, 22 nt, Homo sapiens
uugcacaauggaauuuaucuuu

SEQ ID NO: 255910 - RNA, 22 nt, Homo sapiens
uugcacuguaauuuauuuaugu

SEQ ID NO: 255911 - RNA, 22 nt, Homo sapiens
uugcagagaaauuucugguuua

SEQ ID NO: 255912 - RNA, 22 nt, Homo sapiens
uugcagagccccacacugggcu

SEQ ID NO: 255913 - RNA, 22 nt, Homo sapiens
uugcagcaaagagggaggggca

SEQ ID NO: 255914 - RNA, 23 nt, Homo sapiens
uugcauagacauccucauagauu

SEQ ID NO: 255915 - RNA, 18 nt, Homo sapiens
uugcauaguguauccaaa

SEQ ID NO: 255916 - RNA, 22 nt, Homo sapiens
uugcuacuuggauguacaugug

SEQ ID NO: 255917 - RNA, 22 nt, Homo sapiens
uugcuauguugcccagucugga

SEQ ID NO: 255918 - RNA, 22 nt, Homo sapiens
uugcuggugguucgagcaacac

SEQ ID NO: 255919 - RNA, 22 nt, Homo sapiens
uugcuuuguuacugcaguuucc

SEQ ID NO: 255920 - RNA, 22 nt, Homo sapiens
uuggaaaccucugcagguguuu

SEQ ID NO: 255921 - RNA, 22 nt, Homo sapiens
uuggaagagaagggagauaaac

SEQ ID NO: 255922 - RNA, 22 nt, Homo sapiens
uuggaagguaaucaaaaguucu

SEQ ID NO: 255923 - RNA, 22 nt, Homo sapiens
uuggaauuuauuuggaugggag

SEQ ID NO: 255924 - RNA, 19 nt, Homo sapiens
uuggaauuuuagaguuuga

SEQ ID NO: 255925 - RNA, 22 nt, Homo sapiens
uuggacugugagguuucguggg

SEQ ID NO: 255926 - RNA, 22 nt, Homo sapiens
uuggacuuuaagauagagaugu

SEQ ID NO: 255927 - RNA, 22 nt, Homo sapiens
uuggagagaaaggcaguuccug

SEQ ID NO: 255928 - RNA, 22 nt, Homo sapiens
uuggagagugauauucagaugc

SEQ ID NO: 255929 - RNA, 22 nt, Homo sapiens
uuggcaaagaggaaugccacuu

SEQ ID NO: 255930 - RNA, 22 nt, Homo sapiens
uuggcaaagugucuggcauuua

SEQ ID NO: 255931 - RNA, 22 nt, Homo sapiens
uuggcacuugauaauauucugg

SEQ ID NO: 255932 - RNA, 22 nt, Homo sapiens
uuggcagaauguuagaaacuua

SEQ ID NO: 255933 - RNA, 22 nt, Homo sapiens
uuggcagucugaggcacagacu

SEQ ID NO: 255934 - RNA, 22 nt, Homo sapiens
uuggcagugcccgaugcugggg

SEQ ID NO: 255935 - RNA, 22 nt, Homo sapiens
uuggcauuguggauggaaucau

SEQ ID NO: 255936 - RNA, 22 nt, Homo sapiens
uuggccauaugacuugcuuugg

SEQ ID NO: 255937 - RNA, 22 nt, Homo sapiens
uugggccacuuuaguuuccuua

SEQ ID NO: 255938 - RNA, 22 nt, Homo sapiens
uugggcuugagggugcccaguc

SEQ ID NO: 255939 - RNA, 22 nt, Homo sapiens
uuggggcacggccucuguugcc

SEQ ID NO: 255940 - RNA, 22 nt, Homo sapiens
uuggucagcucaauggagaggg

SEQ ID NO: 255941 - RNA, 22 nt, Homo sapiens
uuguaacaugcuuucacuucag

SEQ ID NO: 255942 - RNA, 22 nt, Homo sapiens
uuguacuuuuaguagagacggg

SEQ ID NO: 255943 - RNA, 22 nt, Homo sapiens
uuguaguguuuauucugucaac

SEQ ID NO: 255944 - RNA, 22 nt, Homo sapiens
uuguauugucuugaugaguuga

SEQ ID NO: 255945 - RNA, 22 nt, Homo sapiens
uugucaacaugaaacuguguuu

SEQ ID NO: 255946 - RNA, 22 nt, Homo sapiens
uugucacauggggcggcugccc

SEQ ID NO: 255947 - RNA, 22 nt, Homo sapiens
uugucacccuacauaacaggga

SEQ ID NO: 255948 - RNA, 22 nt, Homo sapiens
uugucaccucuaaaucucauau

SEQ ID NO: 255949 - RNA, 22 nt, Homo sapiens
uugucacucuuccuaggguagg

SEQ ID NO: 255950 - RNA, 22 nt, Homo sapiens
uugucaguguucacucaaagcu

SEQ ID NO: 255951 - RNA, 16 nt, Homo sapiens
uugucccuucccaaau

SEQ ID NO: 255952 - RNA, 22 nt, Homo sapiens
uuguccuggagguucuugcaag

SEQ ID NO: 255953 - RNA, 22 nt, Homo sapiens
uugugaauggaguagcaggauc

SEQ ID NO: 255954 - RNA, 18 nt, Homo sapiens
uugugccugagaaggugg

SEQ ID NO: 255955 - RNA, 22 nt, Homo sapiens
uugugcuuguaacuacauucag

SEQ ID NO: 255956 - RNA, 22 nt, Homo sapiens
uugugguaggaguugccauguu

SEQ ID NO: 255957 - RNA, 22 nt, Homo sapiens
uugugucccugcggcugaggag

SEQ ID NO: 255958 - RNA, 22 nt, Homo sapiens
uuguguuugaugcugacacgca

SEQ ID NO: 255959 - RNA, 22 nt, Homo sapiens
uuuaaagcuaaaauauguuuau

SEQ ID NO: 255960 - RNA, 22 nt, Homo sapiens
uuuaaaguuagaaggaaagggc

SEQ ID NO: 255961 - RNA, 22 nt, Homo sapiens
uuuaauguuacaguauugguau

SEQ ID NO: 255962 - RNA, 22 nt, Homo sapiens
uuuacugugggguuucuuagag

SEQ ID NO: 255963 - RNA, 22 nt, Homo sapiens
uuuagguagucaaagguuaguc

SEQ ID NO: 255964 - RNA, 22 nt, Homo sapiens
uuuaguacugcuuuaugugugu

SEQ ID NO: 255965 - RNA, 22 nt, Homo sapiens
uuuaugagguagagugguuuau

SEQ ID NO: 255966 - RNA, 18 nt, Homo sapiens
uuucaagucuuaggugac

SEQ ID NO: 255967 - RNA, 21 nt, Homo sapiens
uuucacugugaguuuuucugu

SEQ ID NO: 255968 - RNA, 22 nt, Homo sapiens
uuucagagucaucugcccaagu

SEQ ID NO: 255969 - RNA, 22 nt, Homo sapiens
uuucagcguggggugcugaaga

SEQ ID NO: 255970 - RNA, 22 nt, Homo sapiens
uuucagguauuuaagggccguu

SEQ ID NO: 255971 - RNA, 22 nt, Homo sapiens
uuucaguagagacacgguuuug

SEQ ID NO: 255972 - RNA, 23 nt, Homo sapiens
uuucaguaguuguauccuguugc

SEQ ID NO: 255973 - RNA, 22 nt, Homo sapiens
uuucauagccuuugucgucuga

SEQ ID NO: 255974 - RNA, 22 nt, Homo sapiens
cuugaauguaaauaauguacag

SEQ ID NO: 255975 - RNA, 22 nt, Homo sapiens
cuugaccuauggaucuguuuuu

SEQ ID NO: 255976 - RNA, 22 nt, Homo sapiens
cuugcauuuuggagaaugcuga

SEQ ID NO: 255977 - RNA, 22 nt, Homo sapiens
cuugccuaaucugcaugauuuu

SEQ ID NO: 255978 - RNA, 22 nt, Homo sapiens
cuuggcuuguuguccccugcuc

SEQ ID NO: 255979 - RNA, 20 nt, Homo sapiens
cuuggcuuucuugguguuaa

SEQ ID NO: 255980 - RNA, 22 nt, Homo sapiens
cuuuccauuguuggagcauaaa

SEQ ID NO: 255981 - RNA, 22 nt, Homo sapiens
cuuugauuauaaaaggguguuu

SEQ ID NO: 255982 - RNA, 18 nt, Homo sapiens
cuuugcagcuuccagagg

SEQ ID NO: 255983 - RNA, 22 nt, Homo sapiens
cuuuggcauuagccuguauaga

SEQ ID NO: 255984 - RNA, 22 nt, Homo sapiens
cuuugguggagucuuuagguuc

SEQ ID NO: 255985 - RNA, 22 nt, Homo sapiens
cuuugguguauuuucagagacc

SEQ ID NO: 255986 - RNA, 22 nt, Homo sapiens
cuuuguggggucuuuccucaaa

SEQ ID NO: 255987 - RNA, 22 nt, Homo sapiens
cuuuguguggacauuucaggca

SEQ ID NO: 255988 - RNA, 23 nt, Homo sapiens
cuuuugcaaugugaucuugccac

SEQ ID NO: 255989 - RNA, 22 nt, Homo sapiens
cuuuugcugggucagcgguggu

SEQ ID NO: 255990 - RNA, 22 nt, Homo sapiens
cuuuuggcuuaagauugucuug

SEQ ID NO: 255991 - RNA, 22 nt, Homo sapiens
cuuuuggucuaucagagaagca

SEQ ID NO: 255992 - RNA, 22 nt, Homo sapiens
cuuuuggugugaagaagcucuu

SEQ ID NO: 255993 - RNA, 22 nt, Homo sapiens
gaaagauuuccugagcuagaaa

SEQ ID NO: 255994 - RNA, 18 nt, Homo sapiens
gaaaugccucuugcuuac

SEQ ID NO: 255995 - RNA, 23 nt, Homo sapiens
gaaauguaagugaugccccacag

SEQ ID NO: 255996 - RNA, 18 nt, Homo sapiens
gaagaaguaggcauggca

SEQ ID NO: 255997 - RNA, 22 nt, Homo sapiens
gaagacauuuacaugggagacc

SEQ ID NO: 255998 - RNA, 22 nt, Homo sapiens
gaagauaucuaguaccauuguc

SEQ ID NO: 255999 - RNA, 22 nt, Homo sapiens
gaaggagcuuaucugccauuuc

SEQ ID NO: 256000 - RNA, 19 nt, Homo sapiens
gaaguguuguccuccagua

SEQ ID NO: 256001 - RNA, 22 nt, Homo sapiens
gaaugugcuguuggcugggcgu

SEQ ID NO: 256002 - RNA, 22 nt, Homo sapiens
gacagagcaagacccuauuuaa

SEQ ID NO: 256003 - RNA, 17 nt, Homo sapiens
gacauaggaaaaggaga

SEQ ID NO: 256004 - RNA, 22 nt, Homo sapiens
gacauguuuacaguguugagag

SEQ ID NO: 256005 - RNA, 22 nt, Homo sapiens
gacauguuucucucuguuuacu

SEQ ID NO: 256006 - RNA, 22 nt, Homo sapiens
gaccuaggaggauugcuugagc

SEQ ID NO: 256007 - RNA, 22 nt, Homo sapiens
gacuacaacuucuauuauucag

SEQ ID NO: 256008 - RNA, 22 nt, Homo sapiens
gacugcagugcagcuguuaggc

SEQ ID NO: 256009 - RNA, 22 nt, Homo sapiens
gagaaugagaggggaaggccac

SEQ ID NO: 256010 - RNA, 22 nt, Homo sapiens
gagaaugagauuaugguuacau

SEQ ID NO: 256011 - RNA, 22 nt, Homo sapiens
gagacauugacuuuguuccaga

SEQ ID NO: 256012 - RNA, 22 nt, Homo sapiens
gagacugagucucacucuguca

SEQ ID NO: 256013 - RNA, 22 nt, Homo sapiens
gagagcuaggccacuggggcuu

SEQ ID NO: 256014 - RNA, 22 nt, Homo sapiens
gagaucaauucauggcauaguu

SEQ ID NO: 256015 - RNA, 22 nt, Homo sapiens
gagauuaauacacaucaaaugc

SEQ ID NO: 256016 - RNA, 22 nt, Homo sapiens
gagauucuucaauauuuauucu

SEQ ID NO: 256017 - RNA, 22 nt, Homo sapiens
gagauuuucagcuugacuggga

SEQ ID NO: 256018 - RNA, 21 nt, Homo sapiens
gagcacauuguccucuaacgc

SEQ ID NO: 256019 - RNA, 22 nt, Homo sapiens
gagcacugauuuauuuuugucu

SEQ ID NO: 256020 - RNA, 22 nt, Homo sapiens
gagccauggagaaaacagcuau

SEQ ID NO: 256021 - RNA, 20 nt, Homo sapiens
gagcucaucuucuuuaccac

SEQ ID NO: 256022 - RNA, 22 nt, Homo sapiens
gagcuuguggucuucguguuau

SEQ ID NO: 256023 - RNA, 22 nt, Homo sapiens
gaggagucagacugugcaaggu

SEQ ID NO: 256024 - RNA, 22 nt, Homo sapiens
gaggcaaguggccaccgagucu

SEQ ID NO: 256025 - RNA, 22 nt, Homo sapiens
gaggcaauaugagggaggcuuc

SEQ ID NO: 256026 - RNA, 22 nt, Homo sapiens
gaggcacucuguacaaaucugc

SEQ ID NO: 256027 - RNA, 21 nt, Homo sapiens
gagguagggauuaaagaccuc

SEQ ID NO: 256028 - RNA, 22 nt, Homo sapiens
gaguauguauaugagugugucu

SEQ ID NO: 256029 - RNA, 22 nt, Homo sapiens
gagucagugucuugcucuguca

SEQ ID NO: 256030 - RNA, 23 nt, Homo sapiens
gagugcaaugacaugaucucgga

SEQ ID NO: 256031 - RNA, 22 nt, Homo sapiens
gagugcugagcccacuuccuug

SEQ ID NO: 256032 - RNA, 22 nt, Homo sapiens
gauaaaucuuggcuagucuaag

SEQ ID NO: 256033 - RNA, 18 nt, Homo sapiens
gauaacaguggacuaugc

SEQ ID NO: 256034 - RNA, 22 nt, Homo sapiens
gauaucuuuuguauggugagcu

SEQ ID NO: 256035 - RNA, 22 nt, Homo sapiens
gauauguaguaguugaaaaaga

SEQ ID NO: 256036 - RNA, 22 nt, Homo sapiens
gucucacagcuagcugcuuuau

SEQ ID NO: 256037 - RNA, 18 nt, Homo sapiens
gucucacaugguggaagc

SEQ ID NO: 256038 - RNA, 22 nt, Homo sapiens
gucugcaugucauaugauagua

SEQ ID NO: 256039 - RNA, 22 nt, Homo sapiens
gucuggagacuugggucaucaa

SEQ ID NO: 256040 - RNA, 22 nt, Homo sapiens
gucugguugacagcauguggcc

SEQ ID NO: 256041 - RNA, 22 nt, Homo sapiens
gucuuuguuuggucuguaucag

SEQ ID NO: 256042 - RNA, 22 nt, Homo sapiens
gucuuuguuuugauuuaccaga

SEQ ID NO: 256043 - RNA, 22 nt, Homo sapiens
gugaagaugugcaucagaucca

SEQ ID NO: 256044 - RNA, 22 nt, Homo sapiens
gugacgucauuguuccuggcuc

SEQ ID NO: 256045 - RNA, 22 nt, Homo sapiens
gugacugcauccauccaggcuu

SEQ ID NO: 256046 - RNA, 18 nt, Homo sapiens
gugagaaugacuguucug

SEQ ID NO: 256047 - RNA, 22 nt, Homo sapiens
gugagacugguccugaacccag

SEQ ID NO: 256048 - RNA, 22 nt, Homo sapiens
gugagaggaggcagcuuuuaca

SEQ ID NO: 256049 - RNA, 22 nt, Homo sapiens
gugagauggaguuggugucuuu

SEQ ID NO: 256050 - RNA, 22 nt, Homo sapiens
gugagcauaacaacagaguuua

SEQ ID NO: 256051 - RNA, 22 nt, Homo sapiens
gugagcauucaaggaaggagcu

SEQ ID NO: 256052 - RNA, 22 nt, Homo sapiens
gugaggaaggaaaccugcuagc

SEQ ID NO: 256053 - RNA, 21 nt, Homo sapiens
gugaggaguuacuggcuuuga

SEQ ID NO: 256054 - RNA, 22 nt, Homo sapiens
gugagggaugugaaaaagguca

SEQ ID NO: 256055 - RNA, 22 nt, Homo sapiens
gugagguagagcaugugaaaga

SEQ ID NO: 256056 - RNA, 17 nt, Homo sapiens
gugagguggguaguauc

SEQ ID NO: 256057 - RNA, 22 nt, Homo sapiens
gugaguuauuauuuauguaaac

SEQ ID NO: 256058 - RNA, 22 nt, Homo sapiens
gugauauguuaggaucuaaguc

SEQ ID NO: 256059 - RNA, 22 nt, Homo sapiens
gugauuuaguagaugcuaguua

SEQ ID NO: 256060 - RNA, 22 nt, Homo sapiens
gugcaaauguuauugagguuuu

SEQ ID NO: 256061 - RNA, 22 nt, Homo sapiens
gugcaaauuccagcucaacucc

SEQ ID NO: 256062 - RNA, 22 nt, Homo sapiens
gugcacaacaugcaguuuuguu

SEQ ID NO: 256063 - RNA, 22 nt, Homo sapiens
gugcacauauggugcauaagug

SEQ ID NO: 256064 - RNA, 22 nt, Homo sapiens
ugaagcuaacuugauugugaug

SEQ ID NO: 256065 - RNA, 22 nt, Homo sapiens
ugaauauagacagggguagaga

SEQ ID NO: 256066 - RNA, 22 nt, Homo sapiens
ugaauauguuucuaaaagugca

SEQ ID NO: 256067 - RNA, 22 nt, Homo sapiens
ugaauggauccaauucuuagua

SEQ ID NO: 256068 - RNA, 22 nt, Homo sapiens
ugaauguaagaugucugcuggu

SEQ ID NO: 256069 - RNA, 22 nt, Homo sapiens
ugacacagugggggauccuuuu

SEQ ID NO: 256070 - RNA, 22 nt, Homo sapiens
ugacagagcaggacuucaucuc

SEQ ID NO: 256071 - RNA, 22 nt, Homo sapiens
uaguagcaccucucaugagcuu

SEQ ID NO: 256072 - RNA, 18 nt, Homo sapiens
uagugcuguucucaugau

SEQ ID NO: 256073 - RNA, 22 nt, Homo sapiens
uauaacaaugcaagaauggccu

SEQ ID NO: 256074 - RNA, 22 nt, Homo sapiens
uauacuguuuucuauaguggcu

SEQ ID NO: 256075 - RNA, 22 nt, Homo sapiens
uauaucacaugcacucauuuuc

SEQ ID NO: 256076 - RNA, 22 nt, Homo sapiens
uauaugcacucagguguaugug

SEQ ID NO: 256077 - RNA, 22 nt, Homo sapiens
uauaugucuucuuguaauuggc

SEQ ID NO: 256078 - RNA, 22 nt, Homo sapiens
uauaugucuuuguuauguugag

SEQ ID NO: 256079 - RNA, 22 nt, Homo sapiens
uauauguucuugcacuggaaag

SEQ ID NO: 256080 - RNA, 22 nt, Homo sapiens
uauauguuuucauaaggcuaga

SEQ ID NO: 256081 - RNA, 22 nt, Homo sapiens
uaucaacaggguggccagugua

SEQ ID NO: 256082 - RNA, 20 nt, Homo sapiens
uaucacauggggagaaaccu

SEQ ID NO: 256083 - RNA, 21 nt, Homo sapiens
uaucagagacauugagaggca

SEQ ID NO: 256084 - RNA, 22 nt, Homo sapiens
uaucucagagaaucagauuuac

SEQ ID NO: 256085 - RNA, 22 nt, Homo sapiens
uaucucagaugagacuuguaac

SEQ ID NO: 256086 - RNA, 22 nt, Homo sapiens
uaucuuggaguuugacaaccaa

SEQ ID NO: 256087 - RNA, 20 nt, Homo sapiens
uaugacaaagccuagugagu

SEQ ID NO: 256088 - RNA, 22 nt, Homo sapiens
uaugagacugguuaauuuuugu

SEQ ID NO: 256089 - RNA, 22 nt, Homo sapiens
uaugcacacacguguuuaugug

SEQ ID NO: 256090 - RNA, 19 nt, Homo sapiens
uaugcuauuuauuagaagu

SEQ ID NO: 256091 - RNA, 22 nt, Homo sapiens
uauggcauuauuuugauagaca

SEQ ID NO: 256092 - RNA, 22 nt, Homo sapiens
uauggcccuuaaguauugguug

SEQ ID NO: 256093 - RNA, 22 nt, Homo sapiens
uauuccauuugugaaaggaagu

SEQ ID NO: 256094 - RNA, 22 nt, Homo sapiens
uauugccugucuccaaaaauca

SEQ ID NO: 256095 - RNA, 22 nt, Homo sapiens
uauugcuggauguauuacaugu

SEQ ID NO: 256096 - RNA, 22 nt, Homo sapiens
uauuugguagcuauuuugcagu

SEQ ID NO: 256097 - RNA, 22 nt, Homo sapiens
uauuugguuggugcaaaaguaa

SEQ ID NO: 256098 - RNA, 20 nt, Homo sapiens
ucaaaguaugcucugcacua

SEQ ID NO: 256099 - RNA, 22 nt, Homo sapiens
ucaaagugagcuccuucucacu

SEQ ID NO: 256100 - RNA, 22 nt, Homo sapiens
ucaaaugcucuuugcagagagg

SEQ ID NO: 256101 - RNA, 22 nt, Homo sapiens
ucaacaggucaauugcauagaa

SEQ ID NO: 256102 - RNA, 22 nt, Homo sapiens
ucaaccggugagagcuuccucc

SEQ ID NO: 256103 - RNA, 22 nt, Homo sapiens
ucaaguaauacucccaucuugg

SEQ ID NO: 256104 - RNA, 22 nt, Homo sapiens
ucaaguacuuugcauagugccg

SEQ ID NO: 256105 - RNA, 19 nt, Homo sapiens
ucaauucugucaauggcuu

SEQ ID NO: 256106 - RNA, 22 nt, Homo sapiens
ucacaccauucuucuacuucag

SEQ ID NO: 256107 - RNA, 22 nt, Homo sapiens
ucacacuguuuugauuauuaua

SEQ ID NO: 256108 - RNA, 23 nt, Homo sapiens
ucacacuuaagagaaaugcagcu

SEQ ID NO: 256109 - RNA, 18 nt, Homo sapiens
ucacagguaaaguugaca

SEQ ID NO: 256110 - RNA, 22 nt, Homo sapiens
ucacagugaguggaguggggug

SEQ ID NO: 256111 - RNA, 22 nt, Homo sapiens
ucacaugaauugucuuguucca

SEQ ID NO: 256112 - RNA, 22 nt, Homo sapiens
ucaccaccugcugaucauagag

SEQ ID NO: 256113 - RNA, 22 nt, Homo sapiens
ucaccaccuuccaggaccacug

SEQ ID NO: 256114 - RNA, 22 nt, Homo sapiens
ucaccuggagacaugaagacug

SEQ ID NO: 256115 - RNA, 18 nt, Homo sapiens
ucaccuugcuuuuagaac

SEQ ID NO: 256116 - RNA, 22 nt, Homo sapiens
ucacgugguucauaaggcagaa

SEQ ID NO: 256117 - RNA, 22 nt, Homo sapiens
ucacugagcacaggagaugugc

SEQ ID NO: 256118 - RNA, 22 nt, Homo sapiens
ucacugaggucugagcuuuaug

SEQ ID NO: 256119 - RNA, 22 nt, Homo sapiens
ucacuggacagaaauaaaggug

SEQ ID NO: 256120 - RNA, 20 nt, Homo sapiens
ucacuggguucuugaagucu

SEQ ID NO: 256121 - RNA, 22 nt, Homo sapiens
ucacuguguauguauaugcagg

SEQ ID NO: 256122 - RNA, 22 nt, Homo sapiens
ucagaacugaacaaaccagucu

SEQ ID NO: 256123 - RNA, 22 nt, Homo sapiens
ucagagugguuguaccauuuga

SEQ ID NO: 256124 - RNA, 22 nt, Homo sapiens
ucagaguguuuuccaacuuggu

SEQ ID NO: 256125 - RNA, 22 nt, Homo sapiens
ucagaucaguuccacaagaacu

SEQ ID NO: 256126 - RNA, 22 nt, Homo sapiens
ucagaucaugcuuaugauggga

SEQ ID NO: 256127 - RNA, 22 nt, Homo sapiens
ucagaucauuaagguagguuua

SEQ ID NO: 256128 - RNA, 22 nt, Homo sapiens
ucagaucuucagcaggggcccc

SEQ ID NO: 256129 - RNA, 22 nt, Homo sapiens
ucagauguuuuguuuaucugcu

SEQ ID NO: 256130 - RNA, 22 nt, Homo sapiens
ucagauugaugcauacuuaaau

SEQ ID NO: 256131 - RNA, 22 nt, Homo sapiens
ucagcaaugaccuaagcaaaua

SEQ ID NO: 256132 - RNA, 19 nt, Homo sapiens
ucagcaguaaucaacuuca

SEQ ID NO: 256133 - RNA, 22 nt, Homo sapiens
ucagcagugagagaccucaccc

SEQ ID NO: 256134 - RNA, 22 nt, Homo sapiens
ucagcagugccccacucuacug

SEQ ID NO: 256135 - RNA, 22 nt, Homo sapiens
ucagcagugugaaaacaaacua

SEQ ID NO: 256136 - RNA, 22 nt, Homo sapiens
ucaggcacucagcuuagagucu

SEQ ID NO: 256137 - RNA, 20 nt, Homo sapiens
ucaggcuccgcauuaacuua

SEQ ID NO: 256138 - RNA, 22 nt, Homo sapiens
ucagguagcuagauuaugugag

SEQ ID NO: 256139 - RNA, 22 nt, Homo sapiens
ucagguauuuauagcaaugcaa

SEQ ID NO: 256140 - RNA, 22 nt, Homo sapiens
ucaggucauuccaggagggcca

SEQ ID NO: 256141 - RNA, 22 nt, Homo sapiens
cacaguagaauagagcacuagg

SEQ ID NO: 256142 - RNA, 22 nt, Homo sapiens
cacagugaacaauauccucugu

SEQ ID NO: 256143 - RNA, 22 nt, Homo sapiens
cacagugaaugucaucauugcc

SEQ ID NO: 256144 - RNA, 22 nt, Homo sapiens
cacauagucccugcuaaucuuc

SEQ ID NO: 256145 - RNA, 22 nt, Homo sapiens
caccagcuggcauugaauaccu

SEQ ID NO: 256146 - RNA, 22 nt, Homo sapiens
caccaguuuuucagugauucaa

SEQ ID NO: 256147 - RNA, 22 nt, Homo sapiens
cacccaguaagcaugaggcccu

SEQ ID NO: 256148 - RNA, 22 nt, Homo sapiens
cacccuuguaggcaaauaauuu

SEQ ID NO: 256149 - RNA, 22 nt, Homo sapiens
cacugggugagauccauguuua

SEQ ID NO: 256150 - RNA, 21 nt, Homo sapiens
cacuggguucaggcuugugga

SEQ ID NO: 256151 - RNA, 22 nt, Homo sapiens
cagagcacuaaagguaaaaggc

SEQ ID NO: 256152 - RNA, 22 nt, Homo sapiens
cagcgaggucugcgucacauug

SEQ ID NO: 256153 - RNA, 22 nt, Homo sapiens
cagcuguguuauaaacuaccau

SEQ ID NO: 256154 - RNA, 22 nt, Homo sapiens
cagcuguuguuaugucugcagg

SEQ ID NO: 256155 - RNA, 22 nt, Homo sapiens
cagcuugugguauugcugguug

SEQ ID NO: 256156 - RNA, 22 nt, Homo sapiens
caggcaaggugaaguguacugg

SEQ ID NO: 256157 - RNA, 22 nt, Homo sapiens
caggcauuguauuguaaucccc

SEQ ID NO: 256158 - RNA, 22 nt, Homo sapiens
cagggcauugucuucuuaguac

SEQ ID NO: 256159 - RNA, 22 nt, Homo sapiens
cagguacaugcaugugugugca

SEQ ID NO: 256160 - RNA, 22 nt, Homo sapiens
cagguaggccaauguuuuccaa

SEQ ID NO: 256161 - RNA, 22 nt, Homo sapiens
cagguagucaacgggucuugga

SEQ ID NO: 256162 - RNA, 20 nt, Homo sapiens
cagucaugaagaacugugag

SEQ ID NO: 256163 - RNA, 22 nt, Homo sapiens
cagugaauuucaggucaagagu

SEQ ID NO: 256164 - RNA, 22 nt, Homo sapiens
cagugguuuuuagcuugcuggg

SEQ ID NO: 256165 - RNA, 22 nt, Homo sapiens
caguucaugguaggcaccauag

SEQ ID NO: 256166 - RNA, 22 nt, Homo sapiens
caguuguuuuaugacauaagau

SEQ ID NO: 256167 - RNA, 18 nt, Homo sapiens
cauagcacuucagcacau

SEQ ID NO: 256168 - RNA, 22 nt, Homo sapiens
cauauucacuuuacagagcugu

SEQ ID NO: 256169 - RNA, 22 nt, Homo sapiens
caugauauugcagaauguuggu

SEQ ID NO: 256170 - RNA, 22 nt, Homo sapiens
caugccacugcacgccauccug

SEQ ID NO: 256171 - RNA, 22 nt, Homo sapiens
caugccauugcucuccugggug

SEQ ID NO: 256172 - RNA, 22 nt, Homo sapiens
cauggcaucuguguggccucca

SEQ ID NO: 256173 - RNA, 22 nt, Homo sapiens
cauggcucuuguuuacucccag

SEQ ID NO: 256174 - RNA, 19 nt, Homo sapiens
caugugcacuacuggcuuc

SEQ ID NO: 256175 - RNA, 22 nt, Homo sapiens
caugugcaugcuuucuuaugug

SEQ ID NO: 256176 - RNA, 22 nt, Homo sapiens
cauugcaacuucugccucccag

SEQ ID NO: 256177 - RNA, 22 nt, Homo sapiens
ccaaguguucucauuguucaau

SEQ ID NO: 256178 - RNA, 19 nt, Homo sapiens
ccacaaugguugaacuaga

SEQ ID NO: 256179 - RNA, 22 nt, Homo sapiens
ccagucuuggugucuguagcac

SEQ ID NO: 256180 - RNA, 22 nt, Homo sapiens
ccagugauuguauggugaaggu

SEQ ID NO: 256181 - RNA, 19 nt, Homo sapiens
ccaguguugccagagcuga

SEQ ID NO: 256182 - RNA, 22 nt, Homo sapiens
ccaguuuucucacuguugcagu

SEQ ID NO: 256183 - RNA, 22 nt, Homo sapiens
ccaguuuuuggcaaugaugaau

SEQ ID NO: 256184 - RNA, 22 nt, Homo sapiens
ccaucccuuucugagcaguucc

SEQ ID NO: 256185 - RNA, 22 nt, Homo sapiens
ccaugaacuagaauagaacaug

SEQ ID NO: 256186 - RNA, 22 nt, Homo sapiens
ccauggcaauggucagucuauu

SEQ ID NO: 256187 - RNA, 22 nt, Homo sapiens
ccauggcuucugcauucuguca

SEQ ID NO: 256188 - RNA, 22 nt, Homo sapiens
ccauuucacucuuccugaagga

SEQ ID NO: 256189 - RNA, 22 nt, Homo sapiens
cccacaguggccucauauccuu

SEQ ID NO: 256190 - RNA, 22 nt, Homo sapiens
cccagaguucuuaaauacugag

SEQ ID NO: 256191 - RNA, 22 nt, Homo sapiens
cccaguuuugcuucucaugagg

SEQ ID NO: 256192 - RNA, 22 nt, Homo sapiens
ccccagguuucaauaaagccca

SEQ ID NO: 256193 - RNA, 20 nt, Homo sapiens
ccccuggaguggggcugcuu

SEQ ID NO: 256194 - RNA, 22 nt, Homo sapiens
cccugagagcagggucuuucuc

SEQ ID NO: 256195 - RNA, 22 nt, Homo sapiens
cccugagaugugaauuucagag

SEQ ID NO: 256196 - RNA, 21 nt, Homo sapiens
ccucuuugagggaagaaaggg

SEQ ID NO: 256197 - RNA, 22 nt, Homo sapiens
ccugagacugauugacucacaa

SEQ ID NO: 256198 - RNA, 22 nt, Homo sapiens
ccugagaucauacuguuaguaa

SEQ ID NO: 256199 - RNA, 22 nt, Homo sapiens
ccugugguuaaccagcuagaug

SEQ ID NO: 256200 - RNA, 22 nt, Homo sapiens
ccuuggcacuacugacauugua

SEQ ID NO: 256201 - RNA, 22 nt, Homo sapiens
cgcaguguuugugucccugggu

SEQ ID NO: 256202 - RNA, 22 nt, Homo sapiens
cgugaggaaaacagaggguguu

SEQ ID NO: 256203 - RNA, 22 nt, Homo sapiens
cgugaggaguauuuuuaggugc

SEQ ID NO: 256204 - RNA, 22 nt, Homo sapiens
cuaagauugucuuaguguguug

SEQ ID NO: 256205 - RNA, 22 nt, Homo sapiens
cuacagcacugagcugugugca

SEQ ID NO: 256206 - RNA, 22 nt, Homo sapiens
cuacaguucuuaauuaaguagu

SEQ ID NO: 256207 - RNA, 22 nt, Homo sapiens
cuacuauguagagauauugaau

SEQ ID NO: 256208 - RNA, 22 nt, Homo sapiens
cuagaagcauauucagaacaga

SEQ ID NO: 256209 - RNA, 22 nt, Homo sapiens
cuagcagacacuuccagagagu

SEQ ID NO: 256210 - RNA, 22 nt, Homo sapiens
cuagguagcuuuucugucaugu

SEQ ID NO: 256211 - RNA, 22 nt, Homo sapiens
cuagguucucaaaccagcguca

SEQ ID NO: 256212 - RNA, 21 nt, Homo sapiens
cuaucucaguguuuacauuug

SEQ ID NO: 256213 - RNA, 22 nt, Homo sapiens
cuauucacaauagccaagauuu

SEQ ID NO: 256214 - RNA, 22 nt, Homo sapiens
cucaaguaauccucccgccuug

SEQ ID NO: 256215 - RNA, 20 nt, Homo sapiens
cucacagacagcuucuuucu

SEQ ID NO: 256216 - RNA, 22 nt, Homo sapiens
cucaccuugugauccuccugcc

SEQ ID NO: 256217 - RNA, 17 nt, Homo sapiens
cucacugagaacagcua

SEQ ID NO: 256218 - RNA, 22 nt, Homo sapiens
cucaguagaaaauacauggacu

SEQ ID NO: 256219 - RNA, 22 nt, Homo sapiens
cucaguuuugccuuguuuaagg

SEQ ID NO: 256220 - RNA, 22 nt, Homo sapiens
cucauugcaaucucugccuccc

SEQ ID NO: 256221 - RNA, 22 nt, Homo sapiens
cuccacugagcaggugggaggc

SEQ ID NO: 256222 - RNA, 22 nt, Homo sapiens
cuccauuuaucugaaauuuuau

SEQ ID NO: 256223 - RNA, 22 nt, Homo sapiens
cuccccuuuaguuucuuaauaa

SEQ ID NO: 256224 - RNA, 20 nt, Homo sapiens
cuccuucauuccuuuggacc

SEQ ID NO: 256225 - RNA, 22 nt, Homo sapiens
cucucaguguggaggccagaaa

SEQ ID NO: 256226 - RNA, 22 nt, Homo sapiens
cucucuguuugucuguuauugg

SEQ ID NO: 256227 - RNA, 22 nt, Homo sapiens
cucugagccugagguuccuacu

SEQ ID NO: 256228 - RNA, 22 nt, Homo sapiens
cugacaagauucaucacucagu

SEQ ID NO: 256229 - RNA, 22 nt, Homo sapiens
cugacucagacacauguauaug

SEQ ID NO: 256230 - RNA, 22 nt, Homo sapiens
cugagaaugaugauuuccaguu

SEQ ID NO: 256231 - RNA, 22 nt, Homo sapiens
cugagagaggagcuaaaacugc

SEQ ID NO: 256232 - RNA, 22 nt, Homo sapiens
cugagcacugagauccucuagc

SEQ ID NO: 256233 - RNA, 23 nt, Homo sapiens
uagaauguuuuuccauguuucuu

SEQ ID NO: 256234 - RNA, 21 nt, Homo sapiens
uagagcuuggcacagaguaga

SEQ ID NO: 256235 - RNA, 19 nt, Homo sapiens
uagagguuuaagaaaagaa

SEQ ID NO: 256236 - RNA, 22 nt, Homo sapiens
uagaucuuuaaaaggugcuaga

SEQ ID NO: 256237 - RNA, 22 nt, Homo sapiens
uagauuguuuaaguggcacaca

SEQ ID NO: 256238 - RNA, 22 nt, Homo sapiens
uagcaaaucaauggaauugaag

SEQ ID NO: 256239 - RNA, 22 nt, Homo sapiens
uagcacagggaauugguucucu

SEQ ID NO: 256240 - RNA, 22 nt, Homo sapiens
uagcacagugucauucuaggua

SEQ ID NO: 256241 - RNA, 22 nt, Homo sapiens
uagcacaugucagguaauuugc

SEQ ID NO: 256242 - RNA, 22 nt, Homo sapiens
uagcaccucuuuggccuuucgu

SEQ ID NO: 256243 - RNA, 22 nt, Homo sapiens
uagcacugucuugcaccugugc

SEQ ID NO: 256244 - RNA, 22 nt, Homo sapiens
uagcagcaucucuggcuucuac

SEQ ID NO: 256245 - RNA, 22 nt, Homo sapiens
uagcagcauuuuuguagaguau

SEQ ID NO: 256246 - RNA, 22 nt, Homo sapiens
uagcaguauggagcgaggccca

SEQ ID NO: 256247 - RNA, 22 nt, Homo sapiens
uagcucagcccagcuaagcuca

SEQ ID NO: 256248 - RNA, 22 nt, Homo sapiens
uagcugcccagcacgaaguugg

SEQ ID NO: 256249 - RNA, 22 nt, Homo sapiens
uaggagcacaaacccuacugug

SEQ ID NO: 256250 - RNA, 22 nt, Homo sapiens
uaggcaaguugcccaaucucuc

SEQ ID NO: 256251 - RNA, 22 nt, Homo sapiens
uaggcaauguggcgaaacucug

SEQ ID NO: 256252 - RNA, 22 nt, Homo sapiens
uaggcacugagaauaugaggau

SEQ ID NO: 256253 - RNA, 22 nt, Homo sapiens
uaggcacuguguuuguaggagu

SEQ ID NO: 256254 - RNA, 22 nt, Homo sapiens
uaggggcacacuucgguuagca

SEQ ID NO: 256255 - RNA, 22 nt, Homo sapiens
uaguaaacauuuuucuaucauu

SEQ ID NO: 256256 - RNA, 22 nt, Homo sapiens
uaguagagauggggcacaugcc

SEQ ID NO: 256257 - RNA, 22 nt, Homo sapiens
aaaagucuguagugaaagguga

SEQ ID NO: 256258 - RNA, 22 nt, Homo sapiens
aaacauugaccucauccuggca

SEQ ID NO: 256259 - RNA, 22 nt, Homo sapiens
aaagaguucagguagauuucaa

SEQ ID NO: 256260 - RNA, 22 nt, Homo sapiens
aaagcacuggagucaucaucua

SEQ ID NO: 256261 - RNA, 22 nt, Homo sapiens
aaaggcacugaucuuauccagu

SEQ ID NO: 256262 - RNA, 22 nt, Homo sapiens
aaaggcaucauuaguaccaagu

SEQ ID NO: 256263 - RNA, 22 nt, Homo sapiens
aaagggcuugaauacucuuuuu

SEQ ID NO: 256264 - RNA, 22 nt, Homo sapiens
aaagucuagaggaucaugugug

SEQ ID NO: 256265 - RNA, 22 nt, Homo sapiens
aaagucuguuacagcuauuucu

SEQ ID NO: 256266 - RNA, 18 nt, Homo sapiens
aaagugaugucauucuuu

SEQ ID NO: 256267 - RNA, 22 nt, Homo sapiens
aaagugcugagacagacuggga

SEQ ID NO: 256268 - RNA, 22 nt, Homo sapiens
aaagugcugggaucacacugaa

SEQ ID NO: 256269 - RNA, 22 nt, Homo sapiens
aaaguggacuaagugaauauga

SEQ ID NO: 256270 - RNA, 22 nt, Homo sapiens
aaaguucugcguuagggcuaaa

SEQ ID NO: 256271 - RNA, 15 nt, Homo sapiens
aaauaugucaguucu

SEQ ID NO: 256272 - RNA, 22 nt, Homo sapiens
aauacuggcacugaagaccaug

SEQ ID NO: 256273 - RNA, 22 nt, Homo sapiens
aauacugugauaucgagcgauu

SEQ ID NO: 256274 - RNA, 22 nt, Homo sapiens
aauagcacuguagauggaggaa

SEQ ID NO: 256275 - RNA, 22 nt, Homo sapiens
aauaugguuuuaugaagcaauu

SEQ ID NO: 256276 - RNA, 22 nt, Homo sapiens
aauauugucaaaauggauucca

SEQ ID NO: 256277 - RNA, 22 nt, Homo sapiens
aaucacacuugauguugagcaa

SEQ ID NO: 256278 - RNA, 22 nt, Homo sapiens
aaucacuaugccaugaaguaca

SEQ ID NO: 256279 - RNA, 22 nt, Homo sapiens
aauccuguagauucuaauuccu

SEQ ID NO: 256280 - RNA, 20 nt, Homo sapiens
aaucuacuugcccauuuagc

SEQ ID NO: 256281 - RNA, 22 nt, Homo sapiens
aaucucagcauuuugggcugag

SEQ ID NO: 256282 - RNA, 22 nt, Homo sapiens
aaugcaagauguuaauuauagg

SEQ ID NO: 256283 - RNA, 22 nt, Homo sapiens
aauggagcugaguggccuuggg

SEQ ID NO: 256284 - RNA, 22 nt, Homo sapiens
aauggcagaugaaauugucauu

SEQ ID NO: 256285 - RNA, 22 nt, Homo sapiens
aauucuguauuguuuagggacu

SEQ ID NO: 256286 - RNA, 22 nt, Homo sapiens
aauugugcuuguaggccaggca

SEQ ID NO: 256287 - RNA, 21 nt, Homo sapiens
acaaagcuggagggagacugc

SEQ ID NO: 256288 - RNA, 22 nt, Homo sapiens
acaaaguaggcagugggcugga

SEQ ID NO: 256289 - RNA, 22 nt, Homo sapiens
acaauggaauggaguggaaagu

SEQ ID NO: 256290 - RNA, 22 nt, Homo sapiens
acaauguauauuuuacuguagg

SEQ ID NO: 256291 - RNA, 22 nt, Homo sapiens
acacaguauaugacaaugcuuu

SEQ ID NO: 256292 - RNA, 22 nt, Homo sapiens
acaccaucuccuuauuucucuu

SEQ ID NO: 256293 - RNA, 22 nt, Homo sapiens
acacgugcguauauguacguau

SEQ ID NO: 256294 - RNA, 22 nt, Homo sapiens
acacuguauccuucuguccuuu

SEQ ID NO: 256295 - RNA, 22 nt, Homo sapiens
acacuuucuagacaagggaaua

SEQ ID NO: 256296 - RNA, 21 nt, Homo sapiens
aguagcacugugucuuacaaa

SEQ ID NO: 256297 - RNA, 16 nt, Homo sapiens
aguaguuuuacagauu

SEQ ID NO: 256298 - RNA, 22 nt, Homo sapiens
agucaaaugcuuauguauaaag

SEQ ID NO: 256299 - RNA, 22 nt, Homo sapiens
agucacagugaccuugucugac

SEQ ID NO: 256300 - RNA, 22 nt, Homo sapiens
agucacggugguuugcacuugu

SEQ ID NO: 256301 - RNA, 22 nt, Homo sapiens
agucugguguucucacacuagu

SEQ ID NO: 256302 - RNA, 19 nt, Homo sapiens
agugagccaagauccuacc

SEQ ID NO: 256303 - RNA, 22 nt, Homo sapiens
agugagcugcagucuggggucc

SEQ ID NO: 256304 - RNA, 22 nt, Homo sapiens
agugcaaagccgagguuucuug

SEQ ID NO: 256305 - RNA, 22 nt, Homo sapiens
agugcacugcccgcuuccuguc

SEQ ID NO: 256306 - RNA, 22 nt, Homo sapiens
aguggaaucuguuauacuaacu

SEQ ID NO: 256307 - RNA, 19 nt, Homo sapiens
aguggguguuuucuguuug

SEQ ID NO: 256308 - RNA, 23 nt, Homo sapiens
aguggucuccugggcccagcugu

SEQ ID NO: 256309 - RNA, 22 nt, Homo sapiens
aguguuuuuaucaugaaagggu

SEQ ID NO: 256310 - RNA, 22 nt, Homo sapiens
aguguuuuucaugggauacuuu

SEQ ID NO: 256311 - RNA, 22 nt, Homo sapiens
aguugcaagucuugaguaaaga

SEQ ID NO: 256312 - RNA, 18 nt, Homo sapiens
aguuguuuuauccugccc

SEQ ID NO: 256313 - RNA, 22 nt, Homo sapiens
aguuuuugcugauagcaugcuu

SEQ ID NO: 256314 - RNA, 22 nt, Homo sapiens
auaaagcaaauaggacuauugc

SEQ ID NO: 256315 - RNA, 22 nt, Homo sapiens
auaaaugcauugagaacugcug

SEQ ID NO: 256316 - RNA, 22 nt, Homo sapiens
auacacauuccugggccucacc

SEQ ID NO: 256317 - RNA, 22 nt, Homo sapiens
auacaguguauguauaguacau

SEQ ID NO: 256318 - RNA, 20 nt, Homo sapiens
auagaagacuagugcagcag

SEQ ID NO: 256319 - RNA, 22 nt, Homo sapiens
auagaauguuugcgccagguga

SEQ ID NO: 256320 - RNA, 22 nt, Homo sapiens
auagaucuauuuauguaucccu

SEQ ID NO: 256321 - RNA, 22 nt, Homo sapiens
auagcaaugccccaauccuugg

SEQ ID NO: 256322 - RNA, 22 nt, Homo sapiens
auagcagugugaaaauggacua

SEQ ID NO: 256323 - RNA, 22 nt, Homo sapiens
auagcauaucccacaugucaga

SEQ ID NO: 256324 - RNA, 22 nt, Homo sapiens
auaggagcacaaacuauuguga

SEQ ID NO: 256325 - RNA, 22 nt, Homo sapiens
auagugaacuuugugagaacaa

SEQ ID NO: 256326 - RNA, 22 nt, Homo sapiens
auagugcugcaacaaauauacg

SEQ ID NO: 256327 - RNA, 22 nt, Homo sapiens
auagugcugugaugaacauaca

SEQ ID NO: 256328 - RNA, 19 nt, Homo sapiens
auaguguaggaaaacagcu

SEQ ID NO: 256329 - RNA, 22 nt, Homo sapiens
auaugcacgugcauacacacuu

SEQ ID NO: 256330 - RNA, 22 nt, Homo sapiens
auaugucuauuauuagggcagg

SEQ ID NO: 256331 - RNA, 22 nt, Homo sapiens
auaugucuguuuagucuguaau

SEQ ID NO: 256332 - RNA, 22 nt, Homo sapiens
auauucaagugaggauggcuaa

SEQ ID NO: 256333 - RNA, 22 nt, Homo sapiens
auauucacagguaucagagauu

SEQ ID NO: 256334 - RNA, 22 nt, Homo sapiens
auauucacuauaugcagaacca

SEQ ID NO: 256335 - RNA, 22 nt, Homo sapiens
aucaaagccaugcucaguuuuc

SEQ ID NO: 256336 - RNA, 22 nt, Homo sapiens
aucaaagugaauuaaugagaau

SEQ ID NO: 256337 - RNA, 22 nt, Homo sapiens
aucaaguaaucugaguaagagu

SEQ ID NO: 256338 - RNA, 22 nt, Homo sapiens
aucacaggcaaaauuccuucuc

SEQ ID NO: 256339 - RNA, 22 nt, Homo sapiens
aucaccuggaguagcccguccc

SEQ ID NO: 256340 - RNA, 20 nt, Homo sapiens
aucacuggagaaggaaaccu

SEQ ID NO: 256341 - RNA, 22 nt, Homo sapiens
aucacuguaaguuuacacuuug

SEQ ID NO: 256342 - RNA, 23 nt, Homo sapiens
aucacuguuaacaauuucuuccu

SEQ ID NO: 256343 - RNA, 22 nt, Homo sapiens
aucagagccugugugcccugaa

SEQ ID NO: 256344 - RNA, 22 nt, Homo sapiens
aucagaguugucagggagcuuu

SEQ ID NO: 256345 - RNA, 22 nt, Homo sapiens
aucagauuccacauuuuaucag

SEQ ID NO: 256346 - RNA, 22 nt, Homo sapiens
aucagauuccagaggcagcacc

SEQ ID NO: 256347 - RNA, 22 nt, Homo sapiens
aucagcagcaugaaaagcaacu

SEQ ID NO: 256348 - RNA, 18 nt, Homo sapiens
aucagggugaagagagga

SEQ ID NO: 256349 - RNA, 22 nt, Homo sapiens
aucauguuuauguguaggauau

SEQ ID NO: 256350 - RNA, 22 nt, Homo sapiens
aucauugugugaguugauggga

SEQ ID NO: 256351 - RNA, 22 nt, Homo sapiens
auccacagugucaauguuguga

SEQ ID NO: 256352 - RNA, 22 nt, Homo sapiens
auccauguggauaaauguguau

SEQ ID NO: 256353 - RNA, 22 nt, Homo sapiens
aucccagaaacucggguuucuc

SEQ ID NO: 256354 - RNA, 22 nt, Homo sapiens
aucccaguaaaaauggcuucua

SEQ ID NO: 256355 - RNA, 22 nt, Homo sapiens
auccucaguggcuuaaguauag

SEQ ID NO: 256356 - RNA, 22 nt, Homo sapiens
aucuacuugcugggucucugga

SEQ ID NO: 256357 - RNA, 22 nt, Homo sapiens
aucucauggagguagagaguaa

SEQ ID NO: 256358 - RNA, 22 nt, Homo sapiens
aucucuugccagucagaauggu

SEQ ID NO: 256359 - RNA, 22 nt, Homo sapiens
aucugugguuguaugcauauua

SEQ ID NO: 256360 - RNA, 22 nt, Homo sapiens
aucuuguguugaauggugcaga

SEQ ID NO: 256361 - RNA, 22 nt, Homo sapiens
aucuuugcugagaugcauggca

SEQ ID NO: 256362 - RNA, 22 nt, Homo sapiens
aucuuuggucaucacagcuaga

SEQ ID NO: 256363 - RNA, 22 nt, Homo sapiens
aucuuuggugcaugauacuuug

SEQ ID NO: 256364 - RNA, 22 nt, Homo sapiens
augaaagugauaaaugucucua

SEQ ID NO: 256365 - RNA, 22 nt, Homo sapiens
augaaaguguguggaaacuuga

SEQ ID NO: 256366 - RNA, 22 nt, Homo sapiens
augaaauguaugagucuggguu

SEQ ID NO: 256367 - RNA, 22 nt, Homo sapiens
gauaagagaugauuuugccaug

SEQ ID NO: 256368 - RNA, 22 nt, Homo sapiens
gauauguucugagaaaugcauu

SEQ ID NO: 256369 - RNA, 22 nt, Homo sapiens
gauauguucuuucacguuggug

SEQ ID NO: 256370 - RNA, 22 nt, Homo sapiens
gauauguuucuucaauaccuag

SEQ ID NO: 256371 - RNA, 22 nt, Homo sapiens
gaucuguguuuguaugcauaag

SEQ ID NO: 256372 - RNA, 22 nt, Homo sapiens
gaugacacugggucaaaucuca

SEQ ID NO: 256373 - RNA, 22 nt, Homo sapiens
gaugacagugaguaaccccaac

SEQ ID NO: 256374 - RNA, 22 nt, Homo sapiens
gaugacuaagaauuuuauaauu

SEQ ID NO: 256375 - RNA, 22 nt, Homo sapiens
gauggaauuaaaaucagaauca

SEQ ID NO: 256376 - RNA, 22 nt, Homo sapiens
gauguguuuguuucuggaggag

SEQ ID NO: 256377 - RNA, 22 nt, Homo sapiens
gauuccauugcgaauuuucaga

SEQ ID NO: 256378 - RNA, 22 nt, Homo sapiens
gauuccauuuguggcuauuuac

SEQ ID NO: 256379 - RNA, 22 nt, Homo sapiens
gcaaaguguuuuuaggaagucu

SEQ ID NO: 256380 - RNA, 22 nt, Homo sapiens
gcaagaauggaacaggagagcc

SEQ ID NO: 256381 - RNA, 22 nt, Homo sapiens
gcaauacugacagcauuaguuu

SEQ ID NO: 256382 - RNA, 22 nt, Homo sapiens
gcaauggaaucccuugaucaau

SEQ ID NO: 256383 - RNA, 22 nt, Homo sapiens
uagauuguaauaugcagaaugg

SEQ ID NO: 256384 - RNA, 21 nt, Homo sapiens
uagcaaauugcuauuaaggca

SEQ ID NO: 256385 - RNA, 19 nt, Homo sapiens
uagcacagggucccagacu

SEQ ID NO: 256386 - RNA, 17 nt, Homo sapiens
uagcacagugccuggua

SEQ ID NO: 256387 - RNA, 22 nt, Homo sapiens
uagcacaucuucuuggccugca

SEQ ID NO: 256388 - RNA, 18 nt, Homo sapiens
uagcagacaucauugggg

SEQ ID NO: 256389 - RNA, 22 nt, Homo sapiens
uagcagcaccccacucuacugg

SEQ ID NO: 256390 - RNA, 22 nt, Homo sapiens
uagcagcauaaauggacuaaga

SEQ ID NO: 256391 - RNA, 19 nt, Homo sapiens
uagcagcaugauuuauaau

SEQ ID NO: 256392 - RNA, 22 nt, Homo sapiens
uagcagguggugaccacauuuu

SEQ ID NO: 256393 - RNA, 22 nt, Homo sapiens
gucaaggaauuuauccauuucu

SEQ ID NO: 256394 - RNA, 22 nt, Homo sapiens
gucaagugaagaccugacucuu

SEQ ID NO: 256395 - RNA, 22 nt, Homo sapiens
gucaagugaagcagugggagua

SEQ ID NO: 256396 - RNA, 21 nt, Homo sapiens
gucacuggggcuggauaauuc

SEQ ID NO: 256397 - RNA, 22 nt, Homo sapiens
gucaguuucacucagcuggaac

SEQ ID NO: 256398 - RNA, 22 nt, Homo sapiens
guccauuuguuuccagagcacu

SEQ ID NO: 256399 - RNA, 22 nt, Homo sapiens
gucccugaggaacauccagggc

SEQ ID NO: 256400 - RNA, 22 nt, Homo sapiens
gucucccaaccccugugcccag

SEQ ID NO: 256401 - RNA, 20 nt, Homo sapiens
gucuugcuccguugcccagg

SEQ ID NO: 256402 - RNA, 22 nt, Homo sapiens
gugaaagcaucugacugugcca

SEQ ID NO: 256403 - RNA, 22 nt, Homo sapiens
gugaaaugaaucuggaaauauu

SEQ ID NO: 256404 - RNA, 22 nt, Homo sapiens
gugaacuguuugaggaagagaa

SEQ ID NO: 256405 - RNA, 22 nt, Homo sapiens
gugacacuggagcuggcacaau

SEQ ID NO: 256406 - RNA, 22 nt, Homo sapiens
uguguacugcagaguauucugu

SEQ ID NO: 256407 - RNA, 22 nt, Homo sapiens
ugugucacugcacuccagcgug

SEQ ID NO: 256408 - RNA, 22 nt, Homo sapiens
ugugucuuguuuauagcuuucu

SEQ ID NO: 256409 - RNA, 22 nt, Homo sapiens
uguuacagcagaauugauugca

SEQ ID NO: 256410 - RNA, 22 nt, Homo sapiens
uguuacagcagcacaaaaugga

SEQ ID NO: 256411 - RNA, 22 nt, Homo sapiens
uguuuuggagguccucacuaga

SEQ ID NO: 256412 - RNA, 22 nt, Homo sapiens
uuaaaguguuugcagacaggug

SEQ ID NO: 256413 - RNA, 20 nt, Homo sapiens
uuaaaucuagugcagacuca

SEQ ID NO: 256414 - RNA, 22 nt, Homo sapiens
uuaacagucacuuagcucauuu

SEQ ID NO: 256415 - RNA, 22 nt, Homo sapiens
uuaacaguugcaugagacugag

SEQ ID NO: 256416 - RNA, 22 nt, Homo sapiens
uuaaggcagugcaucuggaguu

SEQ ID NO: 256417 - RNA, 22 nt, Homo sapiens
uuaaggcuuguacuuguuuucu

SEQ ID NO: 256418 - RNA, 22 nt, Homo sapiens
uuaagggaggagcuucaagaug

SEQ ID NO: 256419 - RNA, 19 nt, Homo sapiens
uuaagguacuuagaugugu

SEQ ID NO: 256420 - RNA, 21 nt, Homo sapiens
uuaaugcuaugcagaaaaucu

SEQ ID NO: 256421 - RNA, 22 nt, Homo sapiens
uuaauuguccauuauucuguuc

SEQ ID NO: 256422 - RNA, 22 nt, Homo sapiens
uuacaaccucagcagugcaaag

SEQ ID NO: 256423 - RNA, 22 nt, Homo sapiens
uuacagguggagaaguaaggcu

SEQ ID NO: 256424 - RNA, 22 nt, Homo sapiens
uuacagucuuaggcagugcuuu

SEQ ID NO: 256425 - RNA, 22 nt, Homo sapiens
uuacaugucuugguaagguuag

SEQ ID NO: 256426 - RNA, 22 nt, Homo sapiens
uuacguaguuuuggagaucaua

SEQ ID NO: 256427 - RNA, 22 nt, Homo sapiens
uuacuguagugucauaucguau

SEQ ID NO: 256428 - RNA, 22 nt, Homo sapiens
uuagaacaguguuugccucgcu

SEQ ID NO: 256429 - RNA, 22 nt, Homo sapiens
uuagauuauugguguuuugcaa

SEQ ID NO: 256430 - RNA, 22 nt, Homo sapiens
uuagccggguguguuggcgggc

SEQ ID NO: 256431 - RNA, 22 nt, Homo sapiens
uuaggacaauguucguuuuuug

SEQ ID NO: 256432 - RNA, 22 nt, Homo sapiens
uuaggcaggauaguuacauauu

SEQ ID NO: 256433 - RNA, 22 nt, Homo sapiens
uuaguaguagugcuguaauuuu

SEQ ID NO: 256434 - RNA, 22 nt, Homo sapiens
uuagugaaugggugugauuugu

SEQ ID NO: 256435 - RNA, 20 nt, Homo sapiens
uuaguucauuuagaagguuu

SEQ ID NO: 256436 - RNA, 22 nt, Homo sapiens
uuaguuuaucagugguuucuga

SEQ ID NO: 256437 - RNA, 22 nt, Homo sapiens
uuauaaacaugaagauuugggg

SEQ ID NO: 256438 - RNA, 22 nt, Homo sapiens
uuauagcagugcaggaacagac

SEQ ID NO: 256439 - RNA, 18 nt, Homo sapiens
uuauaugcauguguagga

SEQ ID NO: 256440 - RNA, 22 nt, Homo sapiens
uuaugacaggcucaggagcccc

SEQ ID NO: 256441 - RNA, 22 nt, Homo sapiens
uuaugucacuguucagucuccc

SEQ ID NO: 256442 - RNA, 22 nt, Homo sapiens
uuauugaguaaaaagaaugguu

SEQ ID NO: 256443 - RNA, 16 nt, Homo sapiens
uuauugcauucuucuc

SEQ ID NO: 256444 - RNA, 20 nt, Homo sapiens
uuauugcggcaucauucaug

SEQ ID NO: 256445 - RNA, 22 nt, Homo sapiens
uucaaauguucuuucaccaccc

SEQ ID NO: 256446 - RNA, 22 nt, Homo sapiens
uucaaggacuaaggauuuuugg

SEQ ID NO: 256447 - RNA, 22 nt, Homo sapiens
uucaagugaacaaaaugaggag

SEQ ID NO: 256448 - RNA, 22 nt, Homo sapiens
uucacacuagccacucugguag

SEQ ID NO: 256449 - RNA, 22 nt, Homo sapiens
uucacagcuuaauaaggcucag

SEQ ID NO: 256450 - RNA, 22 nt, Homo sapiens
uucacaguguguacaccagggg

SEQ ID NO: 256451 - RNA, 22 nt, Homo sapiens
uucacuggagcccaggaguugg

SEQ ID NO: 256452 - RNA, 22 nt, Homo sapiens
uucacuguaaaaugaagagggu

SEQ ID NO: 256453 - RNA, 20 nt, Homo sapiens
uucagcaaaggaaugggagu

SEQ ID NO: 256454 - RNA, 22 nt, Homo sapiens
uucaggcaccauugucauugau

SEQ ID NO: 256455 - RNA, 22 nt, Homo sapiens
uucaggguggagaguaugaggu

SEQ ID NO: 256456 - RNA, 22 nt, Homo sapiens
uucaguaaauguucuuacuaua

SEQ ID NO: 256457 - RNA, 22 nt, Homo sapiens
uucaguaguacauucccguguu

SEQ ID NO: 256458 - RNA, 22 nt, Homo sapiens
uucaguucugcacugaucuuag

SEQ ID NO: 256459 - RNA, 18 nt, Homo sapiens
uucaguuuguaucugggg

SEQ ID NO: 256460 - RNA, 22 nt, Homo sapiens
uucauaguaacaguaacuaugg

SEQ ID NO: 256461 - RNA, 22 nt, Homo sapiens
uucauaguuuauacugauauuu

SEQ ID NO: 256462 - RNA, 22 nt, Homo sapiens
uucaucagggagaaauaauuuc

SEQ ID NO: 256463 - RNA, 22 nt, Homo sapiens
uucaucaguugagcugguugcu

SEQ ID NO: 256464 - RNA, 22 nt, Homo sapiens
uucauccccuccaaaucucaug

SEQ ID NO: 256465 - RNA, 20 nt, Homo sapiens
uucaugggagcaaagaggcc

SEQ ID NO: 256466 - RNA, 22 nt, Homo sapiens
uuccacaauggcugaacuaguu

SEQ ID NO: 256467 - RNA, 22 nt, Homo sapiens
uuccacagggauuugcauugau

SEQ ID NO: 256468 - RNA, 16 nt, Homo sapiens
uuccacagucgaggug

SEQ ID NO: 256469 - RNA, 22 nt, Homo sapiens
uuccagcugggggcaacucugc

SEQ ID NO: 256470 - RNA, 22 nt, Homo sapiens
uuccauuuguucggugucgcca

SEQ ID NO: 256471 - RNA, 22 nt, Homo sapiens
uucccuagaacacauggaggga

SEQ ID NO: 256472 - RNA, 22 nt, Homo sapiens
uuccuugagagcuugauaucac

SEQ ID NO: 256473 - RNA, 21 nt, Homo sapiens
uucuacuccggcguuguuuuu

SEQ ID NO: 256474 - RNA, 20 nt, Homo sapiens
uucuaguacuucuguuucca

SEQ ID NO: 256475 - RNA, 22 nt, Homo sapiens
uucucacaguacagggagcucu

SEQ ID NO: 256476 - RNA, 22 nt, Homo sapiens
uucucagcccccugacagucag

SEQ ID NO: 256477 - RNA, 21 nt, Homo sapiens
uucucaggguguguccuaccc

SEQ ID NO: 256478 - RNA, 22 nt, Homo sapiens
uucucaguaauuccagauuuuu

SEQ ID NO: 256479 - RNA, 22 nt, Homo sapiens
uucucaguuccuacuuugguga

SEQ ID NO: 256480 - RNA, 22 nt, Homo sapiens
uucugcuugaucuaguguguug

SEQ ID NO: 256481 - RNA, 22 nt, Homo sapiens
uucuggcucgauucucugaccg

SEQ ID NO: 256482 - RNA, 22 nt, Homo sapiens
uucugugguuucauuuaccugu

SEQ ID NO: 256483 - RNA, 22 nt, Homo sapiens
uucuugcacuuaacugacauuc

SEQ ID NO: 256484 - RNA, 22 nt, Homo sapiens
uucuuuaguucacuugcuccag

SEQ ID NO: 256485 - RNA, 22 nt, Homo sapiens
uucuuugcuuggaagcggggga

SEQ ID NO: 256486 - RNA, 22 nt, Homo sapiens
uugaaagcuaucagagauucca

SEQ ID NO: 256487 - RNA, 22 nt, Homo sapiens
uugaaaguguucacaaugguau

SEQ ID NO: 256488 - RNA, 22 nt, Homo sapiens
uugaacuguaagggucugugug

SEQ ID NO: 256489 - RNA, 22 nt, Homo sapiens
uugaagguaggaugugcuauca

SEQ ID NO: 256490 - RNA, 22 nt, Homo sapiens
uugaauagaagguuuuuuguuc

SEQ ID NO: 256491 - RNA, 22 nt, Homo sapiens
uugacauauuugugcuuaagaa

SEQ ID NO: 256492 - RNA, 22 nt, Homo sapiens
uugagauaggaacucacuaugc

SEQ ID NO: 256493 - RNA, 22 nt, Homo sapiens
uugagaugauggauaugcuaau

SEQ ID NO: 256494 - RNA, 22 nt, Homo sapiens
uugagauggagucucacucuuc

SEQ ID NO: 256495 - RNA, 22 nt, Homo sapiens
uugagauggagucucacucuuu

SEQ ID NO: 256496 - RNA, 22 nt, Homo sapiens
uugagauggagucucacugugu

SEQ ID NO: 256497 - RNA, 22 nt, Homo sapiens
uugagauggaguuucacucugu

SEQ ID NO: 256498 - RNA, 22 nt, Homo sapiens
uugagauggauagacauagcau

SEQ ID NO: 256499 - RNA, 22 nt, Homo sapiens
uugagauguauguauauaaugu

SEQ ID NO: 256500 - RNA, 22 nt, Homo sapiens
uugagauuuuccucaaauauuu

SEQ ID NO: 256501 - RNA, 22 nt, Homo sapiens
uugaggugaauuugcaggaugc

SEQ ID NO: 256502 - RNA, 20 nt, Homo sapiens
uugaggugugaggggcagag

SEQ ID NO: 256503 - RNA, 22 nt, Homo sapiens
uugauaauguuaacuuugguca

SEQ ID NO: 256504 - RNA, 22 nt, Homo sapiens
uugauauguggaauauuuaucu

SEQ ID NO: 256505 - RNA, 22 nt, Homo sapiens
uugaucaaaucugagugagaau

SEQ ID NO: 256506 - RNA, 22 nt, Homo sapiens
uugcaaaguuugccuccuguag

SEQ ID NO: 256507 - RNA, 22 nt, Homo sapiens
uugcaagauguucaugggcugu

SEQ ID NO: 256508 - RNA, 22 nt, Homo sapiens
uugcacaauccugugagugagu

SEQ ID NO: 256509 - RNA, 22 nt, Homo sapiens
uugcacugagauuuugcuuaca

SEQ ID NO: 256510 - RNA, 22 nt, Homo sapiens
uugcagcaacauggaugaaacu

SEQ ID NO: 256511 - RNA, 22 nt, Homo sapiens
uugcagugguuucacuggcaaa

SEQ ID NO: 256512 - RNA, 22 nt, Homo sapiens
uugcauagacaauauuaaucuu

SEQ ID NO: 256513 - RNA, 22 nt, Homo sapiens
uugcauguacguacagagagag

SEQ ID NO: 256514 - RNA, 22 nt, Homo sapiens
uuggaaauguguuugcauucag

SEQ ID NO: 256515 - RNA, 22 nt, Homo sapiens
uuggaaggcuccuaaugaaugg

SEQ ID NO: 256516 - RNA, 22 nt, Homo sapiens
uuggaaugcaacagaaggauaa

SEQ ID NO: 256517 - RNA, 22 nt, Homo sapiens
uuggaauguauggcaucuugcg

SEQ ID NO: 256518 - RNA, 22 nt, Homo sapiens
uuggaauuagacaagugguggu

SEQ ID NO: 256519 - RNA, 22 nt, Homo sapiens
uuggacuuuuauucugcaggca

SEQ ID NO: 256520 - RNA, 22 nt, Homo sapiens
uuggcaacauagugagaccccc

SEQ ID NO: 256521 - RNA, 22 nt, Homo sapiens
uuggcaagcuguuaauuauaaa

SEQ ID NO: 256522 - RNA, 22 nt, Homo sapiens
uuggcacugagcaagaacaggg

SEQ ID NO: 256523 - RNA, 22 nt, Homo sapiens
uuggcacugggaaaaugaccac

SEQ ID NO: 256524 - RNA, 20 nt, Homo sapiens
uuggcauuuagacaagaguu

SEQ ID NO: 256525 - RNA, 22 nt, Homo sapiens
uuggcccugcugaccauucccu

SEQ ID NO: 256526 - RNA, 23 nt, Homo sapiens
uuggccuccuugugucuagggcu

SEQ ID NO: 256527 - RNA, 21 nt, Homo sapiens
uuggccuggaggccugaaugu

SEQ ID NO: 256528 - RNA, 22 nt, Homo sapiens
uuggucaaaucugaugggagaa

SEQ ID NO: 256529 - RNA, 22 nt, Homo sapiens
uuggucaggcuaaucucgaacg

SEQ ID NO: 256530 - RNA, 22 nt, Homo sapiens
uugguccucccaugcucaagag

SEQ ID NO: 256531 - RNA, 22 nt, Homo sapiens
uuguaaacaucuguacauugcu

SEQ ID NO: 256532 - RNA, 22 nt, Homo sapiens
uuguaauguuaggguguccaug

SEQ ID NO: 256533 - RNA, 21 nt, Homo sapiens
uuguaugguugaacuugauac

SEQ ID NO: 256534 - RNA, 22 nt, Homo sapiens
uugucacugcacuccagucugg

SEQ ID NO: 256535 - RNA, 22 nt, Homo sapiens
uuguccccuuccaaaucucaug

SEQ ID NO: 256536 - RNA, 22 nt, Homo sapiens
uugucucacuggaguuuaguaa

SEQ ID NO: 256537 - RNA, 19 nt, Homo sapiens
uugucuuagaguugucauu

SEQ ID NO: 256538 - RNA, 22 nt, Homo sapiens
uugucuugcagcuuaggcauca

SEQ ID NO: 256539 - RNA, 22 nt, Homo sapiens
uugugaauggugccacaauaaa

SEQ ID NO: 256540 - RNA, 22 nt, Homo sapiens
uugugagggagcuaagaugagu

SEQ ID NO: 256541 - RNA, 22 nt, Homo sapiens
uugugcacauguacccuagaac

SEQ ID NO: 256542 - RNA, 22 nt, Homo sapiens
uugugccccuucucagucgggc

SEQ ID NO: 256543 - RNA, 18 nt, Homo sapiens
uuguggccccuacaaauu

SEQ ID NO: 256544 - RNA, 22 nt, Homo sapiens
uugugucaaauggcaauuagca

SEQ ID NO: 256545 - RNA, 22 nt, Homo sapiens
uuguguuuuuaguagggaaggg

SEQ ID NO: 256546 - RNA, 22 nt, Homo sapiens
uuguuauguuggucaguaaugu

SEQ ID NO: 256547 - RNA, 18 nt, Homo sapiens
uuuacaguagaaggacuu

SEQ ID NO: 256548 - RNA, 22 nt, Homo sapiens
uuuagggcaggccuggugguga

SEQ ID NO: 256549 - RNA, 22 nt, Homo sapiens
uuuagguauuugguauagcagu

SEQ ID NO: 256550 - RNA, 19 nt, Homo sapiens
uuucaauguaaggauggag

SEQ ID NO: 256551 - RNA, 19 nt, Homo sapiens
uuucacacucgccuacuuc

SEQ ID NO: 256552 - RNA, 17 nt, Homo sapiens
uuucagaguggaagugu

SEQ ID NO: 256553 - RNA, 22 nt, Homo sapiens
uuucaggcagggagcuucagug

SEQ ID NO: 256554 - RNA, 22 nt, Homo sapiens
uuucaucaagcacagaguagau

SEQ ID NO: 256555 - RNA, 22 nt, Homo sapiens
uuucauggacgcaaugccuuuu

SEQ ID NO: 256556 - RNA, 22 nt, Homo sapiens
uuucauggcgaggcuucauggg

SEQ ID NO: 256557 - RNA, 22 nt, Homo sapiens
uuuccaagaugcuuacuuucuc

SEQ ID NO: 256558 - RNA, 22 nt, Homo sapiens
uuucccuuugcuuugucagcca

SEQ ID NO: 256559 - RNA, 21 nt, Homo sapiens
uuuccuggagcguauggcuuc

SEQ ID NO: 256560 - RNA, 22 nt, Homo sapiens
uuucuacagggcuugccaggua

SEQ ID NO: 256561 - RNA, 22 nt, Homo sapiens
uuucucaguguuucaggguagg

SEQ ID NO: 256562 - RNA, 23 nt, Homo sapiens
uuucuugggcaugcuaugucagu

SEQ ID NO: 256563 - RNA, 19 nt, Homo sapiens
uuugaauauaaugcagcua

SEQ ID NO: 256564 - RNA, 22 nt, Homo sapiens
uuugagcaggcuaaucaauaua

SEQ ID NO: 256565 - RNA, 22 nt, Homo sapiens
uuugagcauggaaauggcauga

SEQ ID NO: 256566 - RNA, 21 nt, Homo sapiens
uuugcauauguugaaccagcc

SEQ ID NO: 256567 - RNA, 22 nt, Homo sapiens
uuugccacugcaggcuguuuaa

SEQ ID NO: 256568 - RNA, 22 nt, Homo sapiens
uuugcuuaaaucuuaaucagau

SEQ ID NO: 256569 - RNA, 22 nt, Homo sapiens
uuugcuucacuguuuggcaaaa

SEQ ID NO: 256570 - RNA, 21 nt, Homo sapiens
uuuggcauuaugucaccagag

SEQ ID NO: 256571 - RNA, 22 nt, Homo sapiens
uuugggacuguauuaaaugccu

SEQ ID NO: 256572 - RNA, 22 nt, Homo sapiens
uuugggccauggcuuuuccacg

SEQ ID NO: 256573 - RNA, 22 nt, Homo sapiens
uuugguuuuuguuaucacucau

SEQ ID NO: 256574 - RNA, 22 nt, Homo sapiens
uuuguacuaugguuuuucacua

SEQ ID NO: 256575 - RNA, 18 nt, Homo sapiens
uuuguacuuuuucuaaug

SEQ ID NO: 256576 - RNA, 22 nt, Homo sapiens
uuugucacucuuggagguuguu

SEQ ID NO: 256577 - RNA, 22 nt, Homo sapiens
uuugugcaugaagagggggugc

SEQ ID NO: 256578 - RNA, 23 nt, Homo sapiens
uuuguguccccacccaaaucuca

SEQ ID NO: 256579 - RNA, 23 nt, Homo sapiens
uuugugucccucuagaauucaug

SEQ ID NO: 256580 - RNA, 22 nt, Homo sapiens
uuuuagcagccaugacaaagau

SEQ ID NO: 256581 - RNA, 22 nt, Homo sapiens
uuuugcaccauccuaauaguau

SEQ ID NO: 256582 - RNA, 22 nt, Homo sapiens
uuuugcaguuacagagagugag

SEQ ID NO: 256583 - RNA, 22 nt, Homo sapiens
uuuugcucuugguaaugaaaga

SEQ ID NO: 256584 - RNA, 22 nt, Homo sapiens
uuuugcuugugaauagccacau

SEQ ID NO: 256585 - RNA, 22 nt, Homo sapiens
uuuugcuuuuccucggucccac

SEQ ID NO: 256586 - RNA, 22 nt, Homo sapiens
uuuuggucuccaguuucugcug

SEQ ID NO: 256587 - RNA, 22 nt, Homo sapiens
gugacugcauauaaguguaugu

SEQ ID NO: 256588 - RNA, 22 nt, Homo sapiens
gugagacugaguuucgcucuug

SEQ ID NO: 256589 - RNA, 22 nt, Homo sapiens
gugagacugguucugaacccag

SEQ ID NO: 256590 - RNA, 22 nt, Homo sapiens
gugagcuagaccacuuggcucc

SEQ ID NO: 256591 - RNA, 22 nt, Homo sapiens
gugaugguaguuuguauuucug

SEQ ID NO: 256592 - RNA, 22 nt, Homo sapiens
gugauguguuuguucuaucucu

SEQ ID NO: 256593 - RNA, 22 nt, Homo sapiens
gugcaaacuccaggucucuuca

SEQ ID NO: 256594 - RNA, 22 nt, Homo sapiens
gugcaaaucucugaguaucuuu

SEQ ID NO: 256595 - RNA, 22 nt, Homo sapiens
gugcacaacgugcagguuuguu

SEQ ID NO: 256596 - RNA, 22 nt, Homo sapiens
gugcagugugauccuuccguau

SEQ ID NO: 256597 - RNA, 22 nt, Homo sapiens
gugcaguuuuaagugaguuucu

SEQ ID NO: 256598 - RNA, 22 nt, Homo sapiens
gugcgggaggcgcgccuaggug

SEQ ID NO: 256599 - RNA, 22 nt, Homo sapiens
gugcuuguguuaauauguagcu

SEQ ID NO: 256600 - RNA, 22 nt, Homo sapiens
guggaaagaacacaaaauuagg

SEQ ID NO: 256601 - RNA, 22 nt, Homo sapiens
guggcaaacucagcaugcccca

SEQ ID NO: 256602 - RNA, 22 nt, Homo sapiens
guggcaaguguuccaagaggcg

SEQ ID NO: 256603 - RNA, 22 nt, Homo sapiens
guggcaugaaagcagauaccac

SEQ ID NO: 256604 - RNA, 22 nt, Homo sapiens
guggcuuuaaguacgauugagg

SEQ ID NO: 256605 - RNA, 22 nt, Homo sapiens
guggggucaucucauuugugga

SEQ ID NO: 256606 - RNA, 22 nt, Homo sapiens
gugguacuaucuuugguuucag

SEQ ID NO: 256607 - RNA, 22 nt, Homo sapiens
gugguuuuacaaagagaaagau

SEQ ID NO: 256608 - RNA, 22 nt, Homo sapiens
gugguuuucaacuccaccugca

SEQ ID NO: 256609 - RNA, 22 nt, Homo sapiens
gugucccagugugcauacaggu

SEQ ID NO: 256610 - RNA, 22 nt, Homo sapiens
guguguaaauggcagugagcuc

SEQ ID NO: 256611 - RNA, 22 nt, Homo sapiens
guguucaaacccaggucugucu

SEQ ID NO: 256612 - RNA, 22 nt, Homo sapiens
guuaaagacauccacauaggag

SEQ ID NO: 256613 - RNA, 22 nt, Homo sapiens
guuaagaaguguaacuuaaguu

SEQ ID NO: 256614 - RNA, 22 nt, Homo sapiens
guuauguuauguuauguuaugu

SEQ ID NO: 256615 - RNA, 22 nt, Homo sapiens
guuauugcucucgaagacucuc

SEQ ID NO: 256616 - RNA, 22 nt, Homo sapiens
guucacacuugcaaccccagca

SEQ ID NO: 256617 - RNA, 22 nt, Homo sapiens
guucucacuggugcugguaagu

SEQ ID NO: 256618 - RNA, 22 nt, Homo sapiens
guugaaauccuaacccccuagu

SEQ ID NO: 256619 - RNA, 22 nt, Homo sapiens
guugagcaagcuuuggagccua

SEQ ID NO: 256620 - RNA, 22 nt, Homo sapiens
guugccuaggcuggagugcagu

SEQ ID NO: 256621 - RNA, 22 nt, Homo sapiens
guugcucaggccggagugcagu

SEQ ID NO: 256622 - RNA, 22 nt, Homo sapiens
guuggcaaguggcugagcuggg

SEQ ID NO: 256623 - RNA, 22 nt, Homo sapiens
guuggucucguauaaaucaagg

SEQ ID NO: 256624 - RNA, 22 nt, Homo sapiens
uaaacugcuugaaaugguguca

SEQ ID NO: 256625 - RNA, 22 nt, Homo sapiens
uaaagauaaggcucgcuuggau

SEQ ID NO: 256626 - RNA, 22 nt, Homo sapiens
uaaagcacaaguaaagaauacu

SEQ ID NO: 256627 - RNA, 17 nt, Homo sapiens
uaaagccagucaaguca

SEQ ID NO: 256628 - RNA, 22 nt, Homo sapiens
uaaagugaggauggcaguaggu

SEQ ID NO: 256629 - RNA, 22 nt, Homo sapiens
uaaaguguuuguuauuaaaggu

SEQ ID NO: 256630 - RNA, 22 nt, Homo sapiens
uaacaagagagucagucagucc

SEQ ID NO: 256631 - RNA, 21 nt, Homo sapiens
uaacagcuccacuccauucuc

SEQ ID NO: 256632 - RNA, 22 nt, Homo sapiens
uaacagucaagguuugaccagg

SEQ ID NO: 256633 - RNA, 22 nt, Homo sapiens
uaacaguguauuuacuacuucc

SEQ ID NO: 256634 - RNA, 22 nt, Homo sapiens
uaacugucucccuugguccuga

SEQ ID NO: 256635 - RNA, 22 nt, Homo sapiens
uaacuguggaaaugacuuuaaa

SEQ ID NO: 256636 - RNA, 22 nt, Homo sapiens
uaagacacuuaaaauguuacau

SEQ ID NO: 256637 - RNA, 20 nt, Homo sapiens
uaagccacacagucuaaggu

SEQ ID NO: 256638 - RNA, 22 nt, Homo sapiens
uaaggcaaaccuuggcugcagu

SEQ ID NO: 256639 - RNA, 20 nt, Homo sapiens
uaaggcacugugcuuuuagg

SEQ ID NO: 256640 - RNA, 22 nt, Homo sapiens
uaaggcuucuuggaauacugca

SEQ ID NO: 256641 - RNA, 22 nt, Homo sapiens
uaaguaauugugguuucugcca

SEQ ID NO: 256642 - RNA, 19 nt, Homo sapiens
uaaguagaugacugaugcu

SEQ ID NO: 256643 - RNA, 22 nt, Homo sapiens
uaagugaauauggacaguuagc

SEQ ID NO: 256644 - RNA, 20 nt, Homo sapiens
uaagugcauaggauauuucu

SEQ ID NO: 256645 - RNA, 22 nt, Homo sapiens
uaaguuagugugagaauuuugc

SEQ ID NO: 256646 - RNA, 22 nt, Homo sapiens
uaaguugcagguugugauucca

SEQ ID NO: 256647 - RNA, 22 nt, Homo sapiens
uaauccuggcacuuugggaggc

SEQ ID NO: 256648 - RNA, 22 nt, Homo sapiens
uaaugcauguaaugggcugaua

SEQ ID NO: 256649 - RNA, 22 nt, Homo sapiens
uaauuggaucucaaaaaagugu

SEQ ID NO: 256650 - RNA, 22 nt, Homo sapiens
uacaagcaggaaaugguauaug

SEQ ID NO: 256651 - RNA, 21 nt, Homo sapiens
uacaaugcacaggagagccuc

SEQ ID NO: 256652 - RNA, 22 nt, Homo sapiens
uacagaguauccauuugaguuc

SEQ ID NO: 256653 - RNA, 22 nt, Homo sapiens
uacaguacacagguaccaagcu

SEQ ID NO: 256654 - RNA, 22 nt, Homo sapiens
uaccucagccaaugcccagaag

SEQ ID NO: 256655 - RNA, 22 nt, Homo sapiens
uaccuguagacuacagcuucag

SEQ ID NO: 256656 - RNA, 22 nt, Homo sapiens
uacuacagccugagcgacugag

SEQ ID NO: 256657 - RNA, 22 nt, Homo sapiens
uacucuuuagcuccuuaaggaa

SEQ ID NO: 256658 - RNA, 22 nt, Homo sapiens
uacugcacuccagccugggaga

SEQ ID NO: 256659 - RNA, 22 nt, Homo sapiens
uacugcaguugcagcuugagga

SEQ ID NO: 256660 - RNA, 22 nt, Homo sapiens
uacuggguguucugagaaaaua

SEQ ID NO: 256661 - RNA, 22 nt, Homo sapiens
uagaauggaaggcauguuugcc

SEQ ID NO: 256662 - RNA, 22 nt, Homo sapiens
uagaauguauaauauuuuacuu

SEQ ID NO: 256663 - RNA, 22 nt, Homo sapiens
uagacaacugaaacacugugca

SEQ ID NO: 256664 - RNA, 22 nt, Homo sapiens
uagacacuagauaugugacuga

SEQ ID NO: 256665 - RNA, 22 nt, Homo sapiens
uagauaauuagaggguuuuaag

SEQ ID NO: 256666 - RNA, 22 nt, Homo sapiens
uagauuaucauucauacaggga

SEQ ID NO: 256667 - RNA, 22 nt, Homo sapiens
uagauuaucucaccacucgagu

SEQ ID NO: 256668 - RNA, 22 nt, Homo sapiens
uuccacaggguugaacuaguuu

SEQ ID NO: 256669 - RNA, 22 nt, Homo sapiens
uuccagugggacgagaugugga

SEQ ID NO: 256670 - RNA, 22 nt, Homo sapiens
uucccugaaguguuacucuaga

SEQ ID NO: 256671 - RNA, 22 nt, Homo sapiens
uucccugaguaucuuaccaugg

SEQ ID NO: 256672 - RNA, 22 nt, Homo sapiens
uucccugugggcuggugcucca

SEQ ID NO: 256673 - RNA, 22 nt, Homo sapiens
uuccuggaggggaaguguccaa

SEQ ID NO: 256674 - RNA, 22 nt, Homo sapiens
uuccugucuuccaagagagauu

SEQ ID NO: 256675 - RNA, 22 nt, Homo sapiens
uucuacagugacugcagccaua

SEQ ID NO: 256676 - RNA, 22 nt, Homo sapiens
uucuauugguaauauuuucugu

SEQ ID NO: 256677 - RNA, 22 nt, Homo sapiens
uucucaaggagccuucguaacu

SEQ ID NO: 256678 - RNA, 22 nt, Homo sapiens
uucucaauggcaacuuguugcu

SEQ ID NO: 256679 - RNA, 22 nt, Homo sapiens
uucucuggucagaggggagguu

SEQ ID NO: 256680 - RNA, 22 nt, Homo sapiens
uucugcacaucgaucacaagau

SEQ ID NO: 256681 - RNA, 22 nt, Homo sapiens
uucuggccccucccaaucucau

SEQ ID NO: 256682 - RNA, 22 nt, Homo sapiens
uucugugguugaaaggagagau

SEQ ID NO: 256683 - RNA, 22 nt, Homo sapiens
uucuuccagccuugaggggccc

SEQ ID NO: 256684 - RNA, 22 nt, Homo sapiens
uucuugcuguauccucacaugg

SEQ ID NO: 256685 - RNA, 22 nt, Homo sapiens
uucuuugcaugaucucaaaguc

SEQ ID NO: 256686 - RNA, 22 nt, Homo sapiens
uugaaagaaaggagacugaguu

SEQ ID NO: 256687 - RNA, 22 nt, Homo sapiens
uugaaagucauggcacaggcaa

SEQ ID NO: 256688 - RNA, 22 nt, Homo sapiens
uugaagacuaaguuaucaggau

SEQ ID NO: 256689 - RNA, 22 nt, Homo sapiens
uugaagacuaccuaccauacuu

SEQ ID NO: 256690 - RNA, 22 nt, Homo sapiens
uugaagacuauaugauucuuca

SEQ ID NO: 256691 - RNA, 22 nt, Homo sapiens
uugaauagacagccagcuuuaa

SEQ ID NO: 256692 - RNA, 22 nt, Homo sapiens
uugaaugaaaugaugucauuug

SEQ ID NO: 256693 - RNA, 22 nt, Homo sapiens
uugacaaggagugggguugaga

SEQ ID NO: 256694 - RNA, 22 nt, Homo sapiens
uugacaaguuguccaguaugag

SEQ ID NO: 256695 - RNA, 22 nt, Homo sapiens
uugacaaugcacugugcuaagu

SEQ ID NO: 256696 - RNA, 22 nt, Homo sapiens
uugacaguggcuuaaauugguu

SEQ ID NO: 256697 - RNA, 20 nt, Homo sapiens
uugacaguggguuguuaaag

SEQ ID NO: 256698 - RNA, 22 nt, Homo sapiens
uugagaagugucuguucauguc

SEQ ID NO: 256699 - RNA, 22 nt, Homo sapiens
uugagaaucuuucgaauguucu

SEQ ID NO: 256700 - RNA, 22 nt, Homo sapiens
uugagacugaacauuuguguac

SEQ ID NO: 256701 - RNA, 22 nt, Homo sapiens
uugagagaaaaaauuuauuggu

SEQ ID NO: 256702 - RNA, 22 nt, Homo sapiens
uugagaugaagucuugcucucu

SEQ ID NO: 256703 - RNA, 22 nt, Homo sapiens
uugagaugaaguuuugcucuuu

SEQ ID NO: 256704 - RNA, 22 nt, Homo sapiens
uugagauggaaucucgcuuugu

SEQ ID NO: 256705 - RNA, 22 nt, Homo sapiens
uugagauggagucucacucuug

SEQ ID NO: 256706 - RNA, 22 nt, Homo sapiens
uugagauggagucucgcacugu

SEQ ID NO: 256707 - RNA, 22 nt, Homo sapiens
uugagauggagucucgcucugu

SEQ ID NO: 256708 - RNA, 22 nt, Homo sapiens
uugagauggagucuugcucucu

SEQ ID NO: 256709 - RNA, 22 nt, Homo sapiens
uugagauggaguguugcucugu

SEQ ID NO: 256710 - RNA, 22 nt, Homo sapiens
uugagauggaguucauuuuugu

SEQ ID NO: 256711 - RNA, 22 nt, Homo sapiens
uugagauggaguuucacucucg

SEQ ID NO: 256712 - RNA, 22 nt, Homo sapiens
uugagauguaguuucacuccug

SEQ ID NO: 256713 - RNA, 22 nt, Homo sapiens
uugagauguggguuggugacuu

SEQ ID NO: 256714 - RNA, 22 nt, Homo sapiens
uugagcaaugaacgauucaggg

SEQ ID NO: 256715 - RNA, 19 nt, Homo sapiens
uugagcacugccggaguua

SEQ ID NO: 256716 - RNA, 22 nt, Homo sapiens
uugaggaggcagucucuccauu

SEQ ID NO: 256717 - RNA, 22 nt, Homo sapiens
uugaggaggcagucuguccguu

SEQ ID NO: 256718 - RNA, 22 nt, Homo sapiens
uugauaagaaaaauauaccaga

SEQ ID NO: 256719 - RNA, 22 nt, Homo sapiens
uugauacuagagucuuucugac

SEQ ID NO: 256720 - RNA, 22 nt, Homo sapiens
uugauagaucagggauuugauu

SEQ ID NO: 256721 - RNA, 22 nt, Homo sapiens
uugauaguaccauugggaaauu

SEQ ID NO: 256722 - RNA, 22 nt, Homo sapiens
uugauaguguccucuuuggcag

SEQ ID NO: 256723 - RNA, 22 nt, Homo sapiens
uugauaguuuuaaaauuaaucu

SEQ ID NO: 256724 - RNA, 22 nt, Homo sapiens
uugaucaucagcuuugucaucu

SEQ ID NO: 256725 - RNA, 22 nt, Homo sapiens
uugcacaguguguacagcacca

SEQ ID NO: 256726 - RNA, 22 nt, Homo sapiens
gauaugucuauuagcuugauug

SEQ ID NO: 256727 - RNA, 19 nt, Homo sapiens
gauauguugagcacccuuu

SEQ ID NO: 256728 - RNA, 22 nt, Homo sapiens
gauauugacuuauucuauguuu

SEQ ID NO: 256729 - RNA, 22 nt, Homo sapiens
gaucucaguggauacugugaug

SEQ ID NO: 256730 - RNA, 22 nt, Homo sapiens
gaucugagaaagugucauaaca

SEQ ID NO: 256731 - RNA, 22 nt, Homo sapiens
gaucuguuucaauugucuuagu

SEQ ID NO: 256732 - RNA, 22 nt, Homo sapiens
gaugcaguaagaaugcauagcg

SEQ ID NO: 256733 - RNA, 22 nt, Homo sapiens
gauggauuuuaagugaaugaaa

SEQ ID NO: 256734 - RNA, 22 nt, Homo sapiens
gauggcacuguagcaacacaaa

SEQ ID NO: 256735 - RNA, 22 nt, Homo sapiens
gauggcagugcagccccuggcu

SEQ ID NO: 256736 - RNA, 22 nt, Homo sapiens
gauggcucugcaggugagggua

SEQ ID NO: 256737 - RNA, 22 nt, Homo sapiens
gauuugguguucuggcucaaga

SEQ ID NO: 256738 - RNA, 22 nt, Homo sapiens
gauuuguuggccugugagcuag

SEQ ID NO: 256739 - RNA, 22 nt, Homo sapiens
gcacaguuaaagggucauguga

SEQ ID NO: 256740 - RNA, 22 nt, Homo sapiens
gcagagaaacaggucuaaggag

SEQ ID NO: 256741 - RNA, 19 nt, Homo sapiens
gcagagaugugguagcuug

SEQ ID NO: 256742 - RNA, 22 nt, Homo sapiens
gcagaucuucgcgguaaguguu

SEQ ID NO: 256743 - RNA, 22 nt, Homo sapiens
gcagcacaugacuguauguaua

SEQ ID NO: 256744 - RNA, 22 nt, Homo sapiens
gcagcacauggcagaacauauu

SEQ ID NO: 256745 - RNA, 22 nt, Homo sapiens
gcagcagugcccuggauggaaa

SEQ ID NO: 256746 - RNA, 22 nt, Homo sapiens
gcaggaauuucucugcagaccc

SEQ ID NO: 256747 - RNA, 22 nt, Homo sapiens
gcaggcaugacauuucacucuu

SEQ ID NO: 256748 - RNA, 22 nt, Homo sapiens
gcagucaucugaaggcuuaacu

SEQ ID NO: 256749 - RNA, 22 nt, Homo sapiens
gcagugcaugacgguauauaua

SEQ ID NO: 256750 - RNA, 22 nt, Homo sapiens
gcagugugauguuuuaaucuau

SEQ ID NO: 256751 - RNA, 22 nt, Homo sapiens
gcaucacagggagacaggccuc

SEQ ID NO: 256752 - RNA, 22 nt, Homo sapiens
gcauggagaaggggacugauuc

SEQ ID NO: 256753 - RNA, 22 nt, Homo sapiens
gcauggagcauacauuucuguu

SEQ ID NO: 256754 - RNA, 22 nt, Homo sapiens
gccaagaagugucuaagcagga

SEQ ID NO: 256755 - RNA, 20 nt, Homo sapiens
gccacaguuaagcuucugcc

SEQ ID NO: 256756 - RNA, 22 nt, Homo sapiens
gccagauuguccaguuuuuuau

SEQ ID NO: 256757 - RNA, 22 nt, Homo sapiens
gccauggugucuuauuuuugug

SEQ ID NO: 256758 - RNA, 22 nt, Homo sapiens
gccuagauccaaauauggugca

SEQ ID NO: 256759 - RNA, 22 nt, Homo sapiens
gccuguagaagaguagaugacc

SEQ ID NO: 256760 - RNA, 22 nt, Homo sapiens
gcgcagugggcugugccaucca

SEQ ID NO: 256761 - RNA, 22 nt, Homo sapiens
gcuaggagaucugcugcucucu

SEQ ID NO: 256762 - RNA, 22 nt, Homo sapiens
gcucugguuacaaaggcaaauu

SEQ ID NO: 256763 - RNA, 17 nt, Homo sapiens
gcugcauucauguagaa

SEQ ID NO: 256764 - RNA, 22 nt, Homo sapiens
gcuggguucagagugggcugcg

SEQ ID NO: 256765 - RNA, 22 nt, Homo sapiens
gcuguauugacuuuguaucaua

SEQ ID NO: 256766 - RNA, 22 nt, Homo sapiens
gcugugguuuaguagaaagaag

SEQ ID NO: 256767 - RNA, 22 nt, Homo sapiens
gcuguguugugcccagcaucau

SEQ ID NO: 256768 - RNA, 22 nt, Homo sapiens
gcuuugguucaaccaggcaauu

SEQ ID NO: 256769 - RNA, 18 nt, Homo sapiens
ggaaaacuuuucuaagua

SEQ ID NO: 256770 - RNA, 22 nt, Homo sapiens
ggaaauguaaacaauggggcua

SEQ ID NO: 256771 - RNA, 22 nt, Homo sapiens
ggaagugugaguaggauuugga

SEQ ID NO: 256772 - RNA, 20 nt, Homo sapiens
ggaauguuaaucuccaugau

SEQ ID NO: 256773 - RNA, 22 nt, Homo sapiens
ggacaaaguauuuucaaaugua

SEQ ID NO: 256774 - RNA, 22 nt, Homo sapiens
ggacuagggacauggggagcug

SEQ ID NO: 256775 - RNA, 22 nt, Homo sapiens
ggagagugacauauuucuaggc

SEQ ID NO: 256776 - RNA, 22 nt, Homo sapiens
ggagauccucugcgggcaaaga

SEQ ID NO: 256777 - RNA, 22 nt, Homo sapiens
ggagaucuuguuaaaguacaga

SEQ ID NO: 256778 - RNA, 22 nt, Homo sapiens
ggagaucuuuaggaguuggacu

SEQ ID NO: 256779 - RNA, 22 nt, Homo sapiens
ggagcucaucuagcauagaggu

SEQ ID NO: 256780 - RNA, 22 nt, Homo sapiens
ggagugugauuguucucuguua

SEQ ID NO: 256781 - RNA, 22 nt, Homo sapiens
ggaugcauuuuugguugucaca

SEQ ID NO: 256782 - RNA, 22 nt, Homo sapiens
ggcaacaauuccuacuucuuuu

SEQ ID NO: 256783 - RNA, 22 nt, Homo sapiens
ggcaagaaccacaauuacuuuu

SEQ ID NO: 256784 - RNA, 19 nt, Homo sapiens
ggcaagaguuguucugugu

SEQ ID NO: 256785 - RNA, 23 nt, Homo sapiens
ggcaagaucucagcucacugcaa

SEQ ID NO: 256786 - RNA, 21 nt, Homo sapiens
ggcaagugugagguuuggggu

SEQ ID NO: 256787 - RNA, 22 nt, Homo sapiens
ggcaaugaggcggaccagcagg

SEQ ID NO: 256788 - RNA, 22 nt, Homo sapiens
ggcacaaugucagcucacugca

SEQ ID NO: 256789 - RNA, 22 nt, Homo sapiens
ggcaccauuuuacuccuucccu

SEQ ID NO: 256790 - RNA, 22 nt, Homo sapiens
ggcagcacaauuuucugaugga

SEQ ID NO: 256791 - RNA, 22 nt, Homo sapiens
ggcagcauugccuuugcaguga

SEQ ID NO: 256792 - RNA, 22 nt, Homo sapiens
ggcagcucaggccccgcgcuga

SEQ ID NO: 256793 - RNA, 22 nt, Homo sapiens
ggcaguuucucaggcaggggua

SEQ ID NO: 256794 - RNA, 22 nt, Homo sapiens
ggcaguuuguuugugaggucca

SEQ ID NO: 256795 - RNA, 22 nt, Homo sapiens
ggcuagagaauagugccacuaa

SEQ ID NO: 256796 - RNA, 19 nt, Homo sapiens
ggcucagucaacugacugu

SEQ ID NO: 256797 - RNA, 22 nt, Homo sapiens
ggcucagugggguccugguucu

SEQ ID NO: 256798 - RNA, 22 nt, Homo sapiens
ggcucaguugcaaaucaguuca

SEQ ID NO: 256799 - RNA, 22 nt, Homo sapiens
gggagguagguauuagcuuuuc

SEQ ID NO: 256800 - RNA, 22 nt, Homo sapiens
gggcaacauugaguacccugaa

SEQ ID NO: 256801 - RNA, 22 nt, Homo sapiens
ggggucauuaaauuccgcuggu

SEQ ID NO: 256802 - RNA, 22 nt, Homo sapiens
gguauguagcaaaagaggugcu

SEQ ID NO: 256803 - RNA, 19 nt, Homo sapiens
ggucacagggguuacaagg

SEQ ID NO: 256804 - RNA, 19 nt, Homo sapiens
ggucauggagguuguguga

SEQ ID NO: 256805 - RNA, 22 nt, Homo sapiens
ggucugguguugaaauucuuca

SEQ ID NO: 256806 - RNA, 22 nt, Homo sapiens
ggugaguggugcuuaaguucag

SEQ ID NO: 256807 - RNA, 22 nt, Homo sapiens
guagaagcacagggccuguauu

SEQ ID NO: 256808 - RNA, 22 nt, Homo sapiens
guagaagcacaggugaguuggu

SEQ ID NO: 256809 - RNA, 22 nt, Homo sapiens
guaguggcaugaucuuggcuca

SEQ ID NO: 256810 - RNA, 22 nt, Homo sapiens
guauaguaguacaaaaguuuuu

SEQ ID NO: 256811 - RNA, 22 nt, Homo sapiens
guaucaucauguuggccaggcu

SEQ ID NO: 256812 - RNA, 22 nt, Homo sapiens
gucacagaaaaagauaugccaa

SEQ ID NO: 256813 - RNA, 22 nt, Homo sapiens
gucacagcacuuuuaguaagug

SEQ ID NO: 256814 - RNA, 22 nt, Homo sapiens
gucacaggaaacuaauaugcgc

SEQ ID NO: 256815 - RNA, 22 nt, Homo sapiens
gucacuggcugucuuguaugau

SEQ ID NO: 256816 - RNA, 22 nt, Homo sapiens
gucagaaucucagaugacaacg

SEQ ID NO: 256817 - RNA, 22 nt, Homo sapiens
gucauguuuaacuucuugagga

SEQ ID NO: 256818 - RNA, 20 nt, Homo sapiens
uugcagagcccaacccugga

SEQ ID NO: 256819 - RNA, 22 nt, Homo sapiens
uugcagcaaauaggaaugagga

SEQ ID NO: 256820 - RNA, 22 nt, Homo sapiens
uugcauaagugcauucugugau

SEQ ID NO: 256821 - RNA, 22 nt, Homo sapiens
uugcaugcuccuuaugagaauc

SEQ ID NO: 256822 - RNA, 22 nt, Homo sapiens
uugcaugucauaacugauggaa

SEQ ID NO: 256823 - RNA, 22 nt, Homo sapiens
uugccuaggcuggaguguggug

SEQ ID NO: 256824 - RNA, 22 nt, Homo sapiens
uugcuaagucaagagaaaugau

SEQ ID NO: 256825 - RNA, 22 nt, Homo sapiens
uugcuuaggcuggagugcagug

SEQ ID NO: 256826 - RNA, 22 nt, Homo sapiens
uuggaaaaauccaccuugaucu

SEQ ID NO: 256827 - RNA, 22 nt, Homo sapiens
uuggaaauauguuaagugucau

SEQ ID NO: 256828 - RNA, 22 nt, Homo sapiens
uuggaauuaaccuggugcugga

SEQ ID NO: 256829 - RNA, 22 nt, Homo sapiens
uuggagagagaggacucccggc

SEQ ID NO: 256830 - RNA, 22 nt, Homo sapiens
uuggagcacuggggcacugaca

SEQ ID NO: 256831 - RNA, 22 nt, Homo sapiens
uuggagcccuaacucucaguac

SEQ ID NO: 256832 - RNA, 22 nt, Homo sapiens
uuggauuuugguggcaacucau

SEQ ID NO: 256833 - RNA, 22 nt, Homo sapiens
uuggcaaauagguuuuauugca

SEQ ID NO: 256834 - RNA, 22 nt, Homo sapiens
uuggcaaaugucacaaaucagg

SEQ ID NO: 256835 - RNA, 22 nt, Homo sapiens
uuggcaaguuucugucagcaaa

SEQ ID NO: 256836 - RNA, 21 nt, Homo sapiens
uuggcacucuucucuccuuau

SEQ ID NO: 256837 - RNA, 22 nt, Homo sapiens
uuggcagaaaaggucggggguu

SEQ ID NO: 256838 - RNA, 22 nt, Homo sapiens
uuggcaguaucuacuacagcua

SEQ ID NO: 256839 - RNA, 22 nt, Homo sapiens
uuggcauagaggcucucaagcu

SEQ ID NO: 256840 - RNA, 22 nt, Homo sapiens
uuggcauuuuuagucaugggaa

SEQ ID NO: 256841 - RNA, 22 nt, Homo sapiens
uuggcuauagauacauggauua

SEQ ID NO: 256842 - RNA, 22 nt, Homo sapiens
uuggcuucuggacuauugugca

SEQ ID NO: 256843 - RNA, 22 nt, Homo sapiens
uugggacuggaaggaguaaggg

SEQ ID NO: 256844 - RNA, 22 nt, Homo sapiens
uuggucacugacauguuugaaa

SEQ ID NO: 256845 - RNA, 22 nt, Homo sapiens
uugguuaucaucauuucagcaa

SEQ ID NO: 256846 - RNA, 22 nt, Homo sapiens
uuguacaggaguguaagcuuca

SEQ ID NO: 256847 - RNA, 22 nt, Homo sapiens
uuguaccacagggcaugaagug

SEQ ID NO: 256848 - RNA, 22 nt, Homo sapiens
uuguacuucagacaugccaaag

SEQ ID NO: 256849 - RNA, 22 nt, Homo sapiens
uuguauguuucugugcacauga

SEQ ID NO: 256850 - RNA, 22 nt, Homo sapiens
uugucacuauaaauaagcauuu

SEQ ID NO: 256851 - RNA, 22 nt, Homo sapiens
uuguccccacccaaaugucauc

SEQ ID NO: 256852 - RNA, 22 nt, Homo sapiens
uuguccccaucugcugccagaa

SEQ ID NO: 256853 - RNA, 23 nt, Homo sapiens
uuguccccuccaaagcucauguu

SEQ ID NO: 256854 - RNA, 22 nt, Homo sapiens
uuguccucuccaaaucucaugu

SEQ ID NO: 256855 - RNA, 22 nt, Homo sapiens
uugugauugagugauccuuguu

SEQ ID NO: 256856 - RNA, 22 nt, Homo sapiens
uugugcaaaguugugguuucug

SEQ ID NO: 256857 - RNA, 22 nt, Homo sapiens
uugugcuuuacuuacuaccaga

SEQ ID NO: 256858 - RNA, 22 nt, Homo sapiens
uugugcuuuugagcugagauga

SEQ ID NO: 256859 - RNA, 19 nt, Homo sapiens
uugugggaggacagagggg

SEQ ID NO: 256860 - RNA, 22 nt, Homo sapiens
uugugguaggcauguaagauga

SEQ ID NO: 256861 - RNA, 22 nt, Homo sapiens
uugugguagugaaugagucuca

SEQ ID NO: 256862 - RNA, 22 nt, Homo sapiens
uuuaacauuggaugagaucguc

SEQ ID NO: 256863 - RNA, 22 nt, Homo sapiens
uuuaagccaggugcaguggcuc

SEQ ID NO: 256864 - RNA, 22 nt, Homo sapiens
uuuagcaaugcuguggggaagu

SEQ ID NO: 256865 - RNA, 22 nt, Homo sapiens
uuuagguaauauuaaguagcug

SEQ ID NO: 256866 - RNA, 22 nt, Homo sapiens
uuucaacaggucuggggugguc

SEQ ID NO: 256867 - RNA, 22 nt, Homo sapiens
uuucacaguguucucccccaga

SEQ ID NO: 256868 - RNA, 18 nt, Homo sapiens
uuucaggguggacaugag

SEQ ID NO: 256869 - RNA, 22 nt, Homo sapiens
uuucaguguggcaggcauagcu

SEQ ID NO: 256870 - RNA, 22 nt, Homo sapiens
uuucauagaucaugcuuuugga

SEQ ID NO: 256871 - RNA, 22 nt, Homo sapiens
uuucauggaauauagucauuuu

SEQ ID NO: 256872 - RNA, 22 nt, Homo sapiens
uuucauguuuuucugugaggca

SEQ ID NO: 256873 - RNA, 22 nt, Homo sapiens
uuuccaguuuggaggaugcauu

SEQ ID NO: 256874 - RNA, 19 nt, Homo sapiens
uuucccugcagaccuacua

SEQ ID NO: 256875 - RNA, 22 nt, Homo sapiens
uuuccuggagaaucuuaacaaa

SEQ ID NO: 256876 - RNA, 22 nt, Homo sapiens
uuugaagacuacugggagugaa

SEQ ID NO: 256877 - RNA, 22 nt, Homo sapiens
uuugagaaugcuaccagagaag

SEQ ID NO: 256878 - RNA, 22 nt, Homo sapiens
uuugagcauuagggcaaaggca

SEQ ID NO: 256879 - RNA, 22 nt, Homo sapiens
uuugaguuugaggugcugauga

SEQ ID NO: 256880 - RNA, 21 nt, Homo sapiens
uuugaucauuaaaagugaauc

SEQ ID NO: 256881 - RNA, 22 nt, Homo sapiens
uuugcaguuuauuccuggggcu

SEQ ID NO: 256882 - RNA, 22 nt, Homo sapiens
uuugcaugcuccuuaugagaau

SEQ ID NO: 256883 - RNA, 22 nt, Homo sapiens
uuugcuuaguaaauguagaaaa

SEQ ID NO: 256884 - RNA, 22 nt, Homo sapiens
uuuggaagaugccacuguauca

SEQ ID NO: 256885 - RNA, 22 nt, Homo sapiens
uuuggcagaaaacaagaaucug

SEQ ID NO: 256886 - RNA, 22 nt, Homo sapiens
uuuggguuaguuuuccaaucuu

SEQ ID NO: 256887 - RNA, 22 nt, Homo sapiens
uuuggucuuuuguaaguuaucu

SEQ ID NO: 256888 - RNA, 22 nt, Homo sapiens
uuuguaagaugcauagauugca

SEQ ID NO: 256889 - RNA, 21 nt, Homo sapiens
uuuguaguagcaugauuuaua

SEQ ID NO: 256890 - RNA, 22 nt, Homo sapiens
uuugugcugcaauuaauuuccc

SEQ ID NO: 256891 - RNA, 16 nt, Homo sapiens
uuugugugugacgaga

SEQ ID NO: 256892 - RNA, 22 nt, Homo sapiens
uuuguucuucguuccugagcca

SEQ ID NO: 256893 - RNA, 22 nt, Homo sapiens
uuuguuugaagucgagacaacu

SEQ ID NO: 256894 - RNA, 22 nt, Homo sapiens
uuuuagcaaagagacugguggc

SEQ ID NO: 256895 - RNA, 22 nt, Homo sapiens
uuuuaguggaauauuuacaguu

SEQ ID NO: 256896 - RNA, 22 nt, Homo sapiens
uuuuaugggcuauuugcauuag

SEQ ID NO: 256897 - RNA, 21 nt, Homo sapiens
uuuugcacacuaugcagcuuu

SEQ ID NO: 256898 - RNA, 22 nt, Homo sapiens
uuuugcacauugauuugguauc

SEQ ID NO: 256899 - RNA, 20 nt, Homo sapiens
uuuugcacuccuacuaaggu

SEQ ID NO: 256900 - RNA, 22 nt, Homo sapiens
uuuugcauuggcugaggagugu

SEQ ID NO: 256901 - RNA, 18 nt, Homo sapiens
uuuugcuuaacugcgcca

SEQ ID NO: 256902 - RNA, 19 nt, Homo sapiens
uuuuggaaaugugaacagc

SEQ ID NO: 256903 - RNA, 22 nt, Homo sapiens
uuuuggcacuuugucugauucu

SEQ ID NO: 256904 - RNA, 22 nt, Homo sapiens
uuuuugaguaaauauaaauugu

SEQ ID NO: 256905 - RNA, 22 nt, Homo sapiens
uuuuugaguagcuggagagcag

SEQ ID NO: 256906 - RNA, 16 nt, Homo sapiens
uuuuugcagaaaugac

SEQ ID NO: 256907 - RNA, 21 nt, Homo sapiens
uuuuugggcuuucauaguguu

SEQ ID NO: 256908 - RNA, 22 nt, Homo sapiens
uuuuugguugguaggcuauuaa

SEQ ID NO: 256909 - RNA, 22 nt, Homo sapiens
uuuuuugcuguaugcaaacauc

SEQ ID NO: 256910 - RNA, 22 nt, Homo sapiens
uuuuuugguaauugaacaauga

SEQ ID NO: 256911 - RNA, 22 nt, Homo sapiens
ucaggugcaguggcucaugcuu

SEQ ID NO: 256912 - RNA, 22 nt, Homo sapiens
ucaggugcaguggcucugaccu

SEQ ID NO: 256913 - RNA, 22 nt, Homo sapiens
ucaguaaucuuagcugugcaga

SEQ ID NO: 256914 - RNA, 23 nt, Homo sapiens
ucaguagucauugggaaagugug

SEQ ID NO: 256915 - RNA, 22 nt, Homo sapiens
ucagucauguuuaccagacgua

SEQ ID NO: 256916 - RNA, 22 nt, Homo sapiens
ucagucauucaauuguugaaug

SEQ ID NO: 256917 - RNA, 22 nt, Homo sapiens
ucagucauugauggaguagguc

SEQ ID NO: 256918 - RNA, 22 nt, Homo sapiens
ucagucuuuuaccauuaaguau

SEQ ID NO: 256919 - RNA, 22 nt, Homo sapiens
ucagucuuuuuuuggcaagcau

SEQ ID NO: 256920 - RNA, 22 nt, Homo sapiens
ucagugcaggaauuuccuuaga

SEQ ID NO: 256921 - RNA, 22 nt, Homo sapiens
ucaguuuguauuucagguugca

SEQ ID NO: 256922 - RNA, 22 nt, Homo sapiens
ucauaaaguuguuuuaauggga

SEQ ID NO: 256923 - RNA, 22 nt, Homo sapiens
ucauacgucuccuugugccacc

SEQ ID NO: 256924 - RNA, 21 nt, Homo sapiens
ucauauguaucuuugugccuc

SEQ ID NO: 256925 - RNA, 22 nt, Homo sapiens
ucaucaggcucauucaagcuga

SEQ ID NO: 256926 - RNA, 22 nt, Homo sapiens
ucauccauacaguuagcaaagg

SEQ ID NO: 256927 - RNA, 21 nt, Homo sapiens
ucaugccacugcacuuuagcc

SEQ ID NO: 256928 - RNA, 22 nt, Homo sapiens
ucauggggugcuuugcuagauu

SEQ ID NO: 256929 - RNA, 22 nt, Homo sapiens
ucauugcauuccagcccaagca

SEQ ID NO: 256930 - RNA, 22 nt, Homo sapiens
uccauugucuagauguaacaca

SEQ ID NO: 256931 - RNA, 18 nt, Homo sapiens
uccauuuguaugggaugg

SEQ ID NO: 256932 - RNA, 22 nt, Homo sapiens
aguaacauuucuaguagagagu

SEQ ID NO: 256933 - RNA, 22 nt, Homo sapiens
aguagguguugguagagguuuc

SEQ ID NO: 256934 - RNA, 22 nt, Homo sapiens
aguauuaggugaguguauuuca

SEQ ID NO: 256935 - RNA, 22 nt, Homo sapiens
agucacagccuuuuacuuuaga

SEQ ID NO: 256936 - RNA, 22 nt, Homo sapiens
agucacaugcauuuucuucaau

SEQ ID NO: 256937 - RNA, 22 nt, Homo sapiens
agucagauuggcauuuguuggg

SEQ ID NO: 256938 - RNA, 22 nt, Homo sapiens
aguggaauuaagaaacugaauu

SEQ ID NO: 256939 - RNA, 22 nt, Homo sapiens
aguggguguuccauuggauaaa

SEQ ID NO: 256940 - RNA, 22 nt, Homo sapiens
aguuuugguugaguuacuagca

SEQ ID NO: 256941 - RNA, 22 nt, Homo sapiens
auaaaguucugcuggcauauau

SEQ ID NO: 256942 - RNA, 22 nt, Homo sapiens
auaaguaguaaagcagugacua

SEQ ID NO: 256943 - RNA, 22 nt, Homo sapiens
auaauagcugaucauuuagaag

SEQ ID NO: 256944 - RNA, 22 nt, Homo sapiens
auacaaggaaugaagagauuug

SEQ ID NO: 256945 - RNA, 22 nt, Homo sapiens
auagaguuagaaagaaauguuu

SEQ ID NO: 256946 - RNA, 22 nt, Homo sapiens
auagcaucauuucuugaaaaga

SEQ ID NO: 256947 - RNA, 22 nt, Homo sapiens
auagccaguagagagcuguuag

SEQ ID NO: 256948 - RNA, 22 nt, Homo sapiens
auagcccuuuucuaacuaugug

SEQ ID NO: 256949 - RNA, 22 nt, Homo sapiens
auaggagcacgaacucuagugu

SEQ ID NO: 256950 - RNA, 22 nt, Homo sapiens
auaggagcagaaaccguauuuu

SEQ ID NO: 256951 - RNA, 22 nt, Homo sapiens
auagguagcauagcaggaauau

SEQ ID NO: 256952 - RNA, 22 nt, Homo sapiens
auagguaguugaggagauuuca

SEQ ID NO: 256953 - RNA, 22 nt, Homo sapiens
auauaccuaggcuacaugguuu

SEQ ID NO: 256954 - RNA, 22 nt, Homo sapiens
auauagcaaugaaagagaugaa

SEQ ID NO: 256955 - RNA, 22 nt, Homo sapiens
auaucaacaucgugucauuagu

SEQ ID NO: 256956 - RNA, 22 nt, Homo sapiens
auaucaacaugguaggguuggu

SEQ ID NO: 256957 - RNA, 22 nt, Homo sapiens
auaucaaggccauuuucuaaau

SEQ ID NO: 256958 - RNA, 22 nt, Homo sapiens
auauccguacaguggaauauua

SEQ ID NO: 256959 - RNA, 20 nt, Homo sapiens
auaugcauguguuuucacuu

SEQ ID NO: 256960 - RNA, 22 nt, Homo sapiens
auauggcauucagaacuguaua

SEQ ID NO: 256961 - RNA, 22 nt, Homo sapiens
auauguauuuuaacguguaagg

SEQ ID NO: 256962 - RNA, 17 nt, Homo sapiens
auaugucugcuggggga

SEQ ID NO: 256963 - RNA, 18 nt, Homo sapiens
auauugcauuggauggau

SEQ ID NO: 256964 - RNA, 20 nt, Homo sapiens
aucaaagacuuagaggggga

SEQ ID NO: 256965 - RNA, 22 nt, Homo sapiens
aucacacucaccuucuguccuu

SEQ ID NO: 256966 - RNA, 22 nt, Homo sapiens
aucacagagucacgggcaacuu

SEQ ID NO: 256967 - RNA, 22 nt, Homo sapiens
aucacauuuauaguggcacgca

SEQ ID NO: 256968 - RNA, 22 nt, Homo sapiens
aucaccauguguacauuagacc

SEQ ID NO: 256969 - RNA, 22 nt, Homo sapiens
aucagaaucucuagaggacugu

SEQ ID NO: 256970 - RNA, 22 nt, Homo sapiens
aucaucacaguuguguguaaug

SEQ ID NO: 256971 - RNA, 22 nt, Homo sapiens
aucauguaguaagacacauuua

SEQ ID NO: 256972 - RNA, 22 nt, Homo sapiens
aucccaguucagccucugacac

SEQ ID NO: 256973 - RNA, 22 nt, Homo sapiens
aucccugugacgagcaucccua

SEQ ID NO: 256974 - RNA, 22 nt, Homo sapiens
auccucugagagaguuucauaa

SEQ ID NO: 256975 - RNA, 21 nt, Homo sapiens
auccuucuuuuucaaccugug

SEQ ID NO: 256976 - RNA, 22 nt, Homo sapiens
aucucagagaaaauuacuaaga

SEQ ID NO: 256977 - RNA, 20 nt, Homo sapiens
aucucugggcaaaggaaaau

SEQ ID NO: 256978 - RNA, 22 nt, Homo sapiens
aucugcauucccauguuuauug

SEQ ID NO: 256979 - RNA, 22 nt, Homo sapiens
aucugggguuggcaaaguuugg

SEQ ID NO: 256980 - RNA, 22 nt, Homo sapiens
aucugguguggcugugauccuc

SEQ ID NO: 256981 - RNA, 21 nt, Homo sapiens
aucugugagaccuuggggguu

SEQ ID NO: 256982 - RNA, 22 nt, Homo sapiens
aucuugcauuugcuaaaaugca

SEQ ID NO: 256983 - RNA, 22 nt, Homo sapiens
aucuuuggauacuugauauagu

SEQ ID NO: 256984 - RNA, 22 nt, Homo sapiens
augaaacuggcuaauuuuugua

SEQ ID NO: 256985 - RNA, 22 nt, Homo sapiens
augaaaucuuuggcagaucuua

SEQ ID NO: 256986 - RNA, 22 nt, Homo sapiens
augaacuaugugggauguuuua

SEQ ID NO: 256987 - RNA, 23 nt, Homo sapiens
augaacucaucauuuuuuauggc

SEQ ID NO: 256988 - RNA, 22 nt, Homo sapiens
augaagacaucgucugggauua

SEQ ID NO: 256989 - RNA, 22 nt, Homo sapiens
augaagauguugccuuuuuaau

SEQ ID NO: 256990 - RNA, 18 nt, Homo sapiens
augaagucaucacuuuua

SEQ ID NO: 256991 - RNA, 22 nt, Homo sapiens
augacaagagccuucuuuccuu

SEQ ID NO: 256992 - RNA, 22 nt, Homo sapiens
augacagugagugagcucucac

SEQ ID NO: 256993 - RNA, 22 nt, Homo sapiens
augacauugaaaagcaagugga

SEQ ID NO: 256994 - RNA, 20 nt, Homo sapiens
augaccuauggugguauaag

SEQ ID NO: 256995 - RNA, 18 nt, Homo sapiens
augaccugcggguuauau

SEQ ID NO: 256996 - RNA, 22 nt, Homo sapiens
augaccuuggggaaccaugucu

SEQ ID NO: 256997 - RNA, 22 nt, Homo sapiens
augagaacauaucaagugauug

SEQ ID NO: 256998 - RNA, 22 nt, Homo sapiens
augagacaguucccuuuaucuu

SEQ ID NO: 256999 - RNA, 22 nt, Homo sapiens
augagagcuaacuguggguaca

SEQ ID NO: 257000 - RNA, 22 nt, Homo sapiens
augagcucauaaagagugauuu

SEQ ID NO: 257001 - RNA, 17 nt, Homo sapiens
augagcucaucauuuuu

SEQ ID NO: 257002 - RNA, 22 nt, Homo sapiens
augaggaaggagccuuugucug

SEQ ID NO: 257003 - RNA, 22 nt, Homo sapiens
augaggagauauuaaauaccau

SEQ ID NO: 257004 - RNA, 22 nt, Homo sapiens
augauacugaguugaguucuca

SEQ ID NO: 257005 - RNA, 22 nt, Homo sapiens
augauacuguucuaagauuuuu

SEQ ID NO: 257006 - RNA, 22 nt, Homo sapiens
augcaaacaucugaagagacau

SEQ ID NO: 257007 - RNA, 22 nt, Homo sapiens
augcaagacaccgauuagcuuu

SEQ ID NO: 257008 - RNA, 22 nt, Homo sapiens
augcaaggaugguuagauauau

SEQ ID NO: 257009 - RNA, 22 nt, Homo sapiens
augcacaguccagcccaugugg

SEQ ID NO: 257010 - RNA, 22 nt, Homo sapiens
augcacuguauaggaucuugcg

SEQ ID NO: 257011 - RNA, 22 nt, Homo sapiens
augccaagagacaaagggaauc

SEQ ID NO: 257012 - RNA, 22 nt, Homo sapiens
augccacagaaauaaccaaaau

SEQ ID NO: 257013 - RNA, 22 nt, Homo sapiens
augcuggugcuagaaacuggaa

SEQ ID NO: 257014 - RNA, 22 nt, Homo sapiens
auggaaagcuguuccuacacaa

SEQ ID NO: 257015 - RNA, 22 nt, Homo sapiens
auggaagaauugucggggaugu

SEQ ID NO: 257016 - RNA, 22 nt, Homo sapiens
auggagaugugcgaacugagua

SEQ ID NO: 257017 - RNA, 22 nt, Homo sapiens
auggaguguggaacugggaauc

SEQ ID NO: 257018 - RNA, 22 nt, Homo sapiens
auggaucuuucugcuuuugaau

SEQ ID NO: 257019 - RNA, 22 nt, Homo sapiens
auggcaaugcgaugaugacuga

SEQ ID NO: 257020 - RNA, 22 nt, Homo sapiens
auggcacuaaugggaguuuacu

SEQ ID NO: 257021 - RNA, 22 nt, Homo sapiens
auggcacugauggaaguaccuu

SEQ ID NO: 257022 - RNA, 22 nt, Homo sapiens
auggcacuguguauuuuucugu

SEQ ID NO: 257023 - RNA, 22 nt, Homo sapiens
auggcacuuuggacugcuagau

SEQ ID NO: 257024 - RNA, 22 nt, Homo sapiens
caucgcacuccagcuugggcaa

SEQ ID NO: 257025 - RNA, 22 nt, Homo sapiens
caugcacugaguccaccucugg

SEQ ID NO: 257026 - RNA, 22 nt, Homo sapiens
caugccacuguggacaaagaca

SEQ ID NO: 257027 - RNA, 22 nt, Homo sapiens
cauggcccuggguccauaggaa

SEQ ID NO: 257028 - RNA, 22 nt, Homo sapiens
cauggcuuuauuuucagcuucu

SEQ ID NO: 257029 - RNA, 22 nt, Homo sapiens
cauguauagauuccauaguggu

SEQ ID NO: 257030 - RNA, 22 nt, Homo sapiens
cauugucccucaaugucuauga

SEQ ID NO: 257031 - RNA, 22 nt, Homo sapiens
cauuguccuccuggggcuauuu

SEQ ID NO: 257032 - RNA, 22 nt, Homo sapiens
ccaagccucaguuucccucugu

SEQ ID NO: 257033 - RNA, 22 nt, Homo sapiens
ccaaguguuuucauuguuccau

SEQ ID NO: 257034 - RNA, 23 nt, Homo sapiens
ccacacuguuuagaauggcauca

SEQ ID NO: 257035 - RNA, 22 nt, Homo sapiens
ccaccuguacuuaagucacuuu

SEQ ID NO: 257036 - RNA, 22 nt, Homo sapiens
ccagcaccauuuguugaauagg

SEQ ID NO: 257037 - RNA, 20 nt, Homo sapiens
ccagcaucauuagauucugg

SEQ ID NO: 257038 - RNA, 22 nt, Homo sapiens
ccaguuuucaagauaaugguuu

SEQ ID NO: 257039 - RNA, 22 nt, Homo sapiens
ccaguuuucccagcaccauuaa

SEQ ID NO: 257040 - RNA, 22 nt, Homo sapiens
ccaucacaggccucagugggaa

SEQ ID NO: 257041 - RNA, 18 nt, Homo sapiens
ccauucaacagauuuguc

SEQ ID NO: 257042 - RNA, 21 nt, Homo sapiens
cccagguucucugaggguaga

SEQ ID NO: 257043 - RNA, 23 nt, Homo sapiens
cccucagaagugcagggagagaa

SEQ ID NO: 257044 - RNA, 22 nt, Homo sapiens
cccugaagacuccaccgucaug

SEQ ID NO: 257045 - RNA, 22 nt, Homo sapiens
cccugacauucggagauguagu

SEQ ID NO: 257046 - RNA, 19 nt, Homo sapiens
cccuggcacauggaaaaug

SEQ ID NO: 257047 - RNA, 22 nt, Homo sapiens
ccucauggagaaccucugcuag

SEQ ID NO: 257048 - RNA, 22 nt, Homo sapiens
ccucauugcuaucccaggcuga

SEQ ID NO: 257049 - RNA, 22 nt, Homo sapiens
ccuggcacugggccccguggcu

SEQ ID NO: 257050 - RNA, 22 nt, Homo sapiens
ccuugguggccacaagacauug

SEQ ID NO: 257051 - RNA, 22 nt, Homo sapiens
cgcuggugucuaagcgacagcu

SEQ ID NO: 257052 - RNA, 22 nt, Homo sapiens
cggugcaaauguaauugcaguu

SEQ ID NO: 257053 - RNA, 22 nt, Homo sapiens
cuaaaacuuucugagugcagca

SEQ ID NO: 257054 - RNA, 22 nt, Homo sapiens
cuaacacagagguuuauuucuc

SEQ ID NO: 257055 - RNA, 18 nt, Homo sapiens
cuaauacuauucaacaag

SEQ ID NO: 257056 - RNA, 22 nt, Homo sapiens
cuaauccugugguagcacucaa

SEQ ID NO: 257057 - RNA, 22 nt, Homo sapiens
cuaauucuggccaaagggauaa

SEQ ID NO: 257058 - RNA, 22 nt, Homo sapiens
cuacugacacuacugcaaucau

SEQ ID NO: 257059 - RNA, 22 nt, Homo sapiens
cuagaauguauaaaaccaagcu

SEQ ID NO: 257060 - RNA, 22 nt, Homo sapiens
cuagcagcauaagaaucaccaa

SEQ ID NO: 257061 - RNA, 22 nt, Homo sapiens
cuagcuccauauaaagcaggau

SEQ ID NO: 257062 - RNA, 22 nt, Homo sapiens
cuaugcuuucugggcccugggu

SEQ ID NO: 257063 - RNA, 22 nt, Homo sapiens
cucaaaugguccagcuaguggu

SEQ ID NO: 257064 - RNA, 22 nt, Homo sapiens
cucaaguacaugggauuacagg

SEQ ID NO: 257065 - RNA, 22 nt, Homo sapiens
cucaccuugugauccacccacc

SEQ ID NO: 257066 - RNA, 22 nt, Homo sapiens
cucagggugguggacucuaaua

SEQ ID NO: 257067 - RNA, 22 nt, Homo sapiens
cucagucuaugauacuuugcua

SEQ ID NO: 257068 - RNA, 22 nt, Homo sapiens
cuccauuuggaacagauguccu

SEQ ID NO: 257069 - RNA, 22 nt, Homo sapiens
cucccauugcaaacaacagaag

SEQ ID NO: 257070 - RNA, 20 nt, Homo sapiens
cucccugacaaauguggaaa

SEQ ID NO: 257071 - RNA, 17 nt, Homo sapiens
cucucugguuuaaagca

SEQ ID NO: 257072 - RNA, 22 nt, Homo sapiens
cucuuagauuagccauccuaau

SEQ ID NO: 257073 - RNA, 22 nt, Homo sapiens
cugaaagagcauuugaaugggu

SEQ ID NO: 257074 - RNA, 22 nt, Homo sapiens
cugaaaugaauuauuuucuuuc

SEQ ID NO: 257075 - RNA, 22 nt, Homo sapiens
cugaagugugaaagucuuuuuu

SEQ ID NO: 257076 - RNA, 22 nt, Homo sapiens
cugacauuguugaucacagcca

SEQ ID NO: 257077 - RNA, 22 nt, Homo sapiens
cugaccucugucaaagacaccc

SEQ ID NO: 257078 - RNA, 22 nt, Homo sapiens
cugacuuauguggacuauuuca

SEQ ID NO: 257079 - RNA, 22 nt, Homo sapiens
cugagaauguaaaugaagcuuu

SEQ ID NO: 257080 - RNA, 22 nt, Homo sapiens
cugagacacucuuaucugcaua

SEQ ID NO: 257081 - RNA, 22 nt, Homo sapiens
cugagacuggugauuuaugaag

SEQ ID NO: 257082 - RNA, 22 nt, Homo sapiens
cugagauaggacucugcuggcu

SEQ ID NO: 257083 - RNA, 22 nt, Homo sapiens
cugagaucugaaccaggagugu

SEQ ID NO: 257084 - RNA, 22 nt, Homo sapiens
cugagauuuuuagauccuggcg

SEQ ID NO: 257085 - RNA, 18 nt, Homo sapiens
cugagcacugcuuuauga

SEQ ID NO: 257086 - RNA, 22 nt, Homo sapiens
cugagcaucauggcagaaucuu

SEQ ID NO: 257087 - RNA, 22 nt, Homo sapiens
cugaggaaguucuuuaacaguu

SEQ ID NO: 257088 - RNA, 22 nt, Homo sapiens
cugaggugggagaaucacauaa

SEQ ID NO: 257089 - RNA, 22 nt, Homo sapiens
cugaggugggaggauuggcuug

SEQ ID NO: 257090 - RNA, 22 nt, Homo sapiens
cugauuguuugccucuaaaauc

SEQ ID NO: 257091 - RNA, 20 nt, Homo sapiens
cugcaaaugcugcugcugau

SEQ ID NO: 257092 - RNA, 19 nt, Homo sapiens
cugcaagguaauaggucag

SEQ ID NO: 257093 - RNA, 22 nt, Homo sapiens
cugcagguaggggcagcuuugg

SEQ ID NO: 257094 - RNA, 22 nt, Homo sapiens
cugcuaagagaaugagacuuag

SEQ ID NO: 257095 - RNA, 22 nt, Homo sapiens
cuggaaagcaaguccauugcuc

SEQ ID NO: 257096 - RNA, 22 nt, Homo sapiens
cuggaauucaaaaucugaauuu

SEQ ID NO: 257097 - RNA, 22 nt, Homo sapiens
cuggagcauugguggauuuguu

SEQ ID NO: 257098 - RNA, 22 nt, Homo sapiens
cuggaguaugaaccauguauca

SEQ ID NO: 257099 - RNA, 22 nt, Homo sapiens
cuggaguaugauguuagcguug

SEQ ID NO: 257100 - RNA, 22 nt, Homo sapiens
cuggagucugacugacacaagg

SEQ ID NO: 257101 - RNA, 22 nt, Homo sapiens
cuggauauuaacauugaugaaa

SEQ ID NO: 257102 - RNA, 22 nt, Homo sapiens
cuggcaagagugaaccagcugu

SEQ ID NO: 257103 - RNA, 22 nt, Homo sapiens
cuggcacagugucagaaacaca

SEQ ID NO: 257104 - RNA, 22 nt, Homo sapiens
cuggcaccauuuugaucaaagg

SEQ ID NO: 257105 - RNA, 22 nt, Homo sapiens
cugggcaaugcggcuggauaga

SEQ ID NO: 257106 - RNA, 22 nt, Homo sapiens
cugggucaguuucugauuauug

SEQ ID NO: 257107 - RNA, 22 nt, Homo sapiens
cugguuguuacaugcuugccag

SEQ ID NO: 257108 - RNA, 22 nt, Homo sapiens
cuguauguuucuaugaauguga

SEQ ID NO: 257109 - RNA, 22 nt, Homo sapiens
cugucucagugaauugguuuua

SEQ ID NO: 257110 - RNA, 22 nt, Homo sapiens
cugucuggaguccuucgugugc

SEQ ID NO: 257111 - RNA, 22 nt, Homo sapiens
cugugcacaucuggcggcccga

SEQ ID NO: 257112 - RNA, 22 nt, Homo sapiens
cugugccaagcuugcgaugugc

SEQ ID NO: 257113 - RNA, 22 nt, Homo sapiens
cugugguauuauuagaaauauc

SEQ ID NO: 257114 - RNA, 22 nt, Homo sapiens
cuguucaggaggcauuuggugg

SEQ ID NO: 257115 - RNA, 20 nt, Homo sapiens
cuuaucaguggcaaguauaa

SEQ ID NO: 257116 - RNA, 22 nt, Homo sapiens
gucacugagcaauagaaaguuu

SEQ ID NO: 257117 - RNA, 22 nt, Homo sapiens
gucacugccugaggcugaugca

SEQ ID NO: 257118 - RNA, 20 nt, Homo sapiens
gucacuggcccagggcuugu

SEQ ID NO: 257119 - RNA, 22 nt, Homo sapiens
gucacugggugcugcgccuguc

SEQ ID NO: 257120 - RNA, 22 nt, Homo sapiens
gucagagcacugaguugugggc

SEQ ID NO: 257121 - RNA, 18 nt, Homo sapiens
gucauagaaugaugguuc

SEQ ID NO: 257122 - RNA, 22 nt, Homo sapiens
gucauccaggcuggagugaagc

SEQ ID NO: 257123 - RNA, 22 nt, Homo sapiens
guccaguacucuuuccugaaaa

SEQ ID NO: 257124 - RNA, 22 nt, Homo sapiens
guccaugagaugaauccacaca

SEQ ID NO: 257125 - RNA, 20 nt, Homo sapiens
guccauuugcugccauugcu

SEQ ID NO: 257126 - RNA, 18 nt, Homo sapiens
guccauuuguugguacac

SEQ ID NO: 257127 - RNA, 22 nt, Homo sapiens
gucccugcgauugugggauccu

SEQ ID NO: 257128 - RNA, 22 nt, Homo sapiens
guccugaagaccuuccucugga

SEQ ID NO: 257129 - RNA, 22 nt, Homo sapiens
guccuggagaagcguggaccgg

SEQ ID NO: 257130 - RNA, 22 nt, Homo sapiens
gucucacaggcaugaugccagc

SEQ ID NO: 257131 - RNA, 22 nt, Homo sapiens
gucucccagccuacaucuuucu

SEQ ID NO: 257132 - RNA, 22 nt, Homo sapiens
gucucugguugcuuuuguacca

SEQ ID NO: 257133 - RNA, 22 nt, Homo sapiens
gucucuuguuaucauuucugag

SEQ ID NO: 257134 - RNA, 22 nt, Homo sapiens
gucugagcauggggccggcagg

SEQ ID NO: 257135 - RNA, 22 nt, Homo sapiens
gucuggcaauggcagacuggca

SEQ ID NO: 257136 - RNA, 22 nt, Homo sapiens
gucuggcacagggaaaguacaa

SEQ ID NO: 257137 - RNA, 22 nt, Homo sapiens
gucuggcuuaucucacuuacca

SEQ ID NO: 257138 - RNA, 21 nt, Homo sapiens
gucugguguuuuaaugaggac

SEQ ID NO: 257139 - RNA, 22 nt, Homo sapiens
gucugugguuccuaugucaccu

SEQ ID NO: 257140 - RNA, 22 nt, Homo sapiens
gucuuuggaaagacaaaguuca

SEQ ID NO: 257141 - RNA, 22 nt, Homo sapiens
gugaaaagaugagcaccauaca

SEQ ID NO: 257142 - RNA, 22 nt, Homo sapiens
gugaaacuggguggugagagac

SEQ ID NO: 257143 - RNA, 22 nt, Homo sapiens
gugacuggacucugaagaaaau

SEQ ID NO: 257144 - RNA, 20 nt, Homo sapiens
gugagaacaugugguauuug

SEQ ID NO: 257145 - RNA, 22 nt, Homo sapiens
gugagaauauuuuaaauacuaa

SEQ ID NO: 257146 - RNA, 22 nt, Homo sapiens
gugagaaucaaacuacauaaau

SEQ ID NO: 257147 - RNA, 22 nt, Homo sapiens
gugagaauugacacccuugucu

SEQ ID NO: 257148 - RNA, 22 nt, Homo sapiens
gugagauuagcugagauccuug

SEQ ID NO: 257149 - RNA, 22 nt, Homo sapiens
gugagauuuucuccagguucag

SEQ ID NO: 257150 - RNA, 19 nt, Homo sapiens
gugagcacagacaauacaa

SEQ ID NO: 257151 - RNA, 22 nt, Homo sapiens
gugagcauaggaggcuucuguu

SEQ ID NO: 257152 - RNA, 22 nt, Homo sapiens
gugagcauauuaguauugcacu

SEQ ID NO: 257153 - RNA, 22 nt, Homo sapiens
gugagguacgugucaagaacca

SEQ ID NO: 257154 - RNA, 22 nt, Homo sapiens
gugagguauacugggaucacua

SEQ ID NO: 257155 - RNA, 22 nt, Homo sapiens
gugaggugguacaauauuaacu

SEQ ID NO: 257156 - RNA, 22 nt, Homo sapiens
gugcacaaaucuuaaauguaca

SEQ ID NO: 257157 - RNA, 22 nt, Homo sapiens
gugcacaacaugcagguuuguu

SEQ ID NO: 257158 - RNA, 22 nt, Homo sapiens
gugcacaacgugcaaguuuguu

SEQ ID NO: 257159 - RNA, 22 nt, Homo sapiens
gugcacaacgugcaggcuuguu

SEQ ID NO: 257160 - RNA, 22 nt, Homo sapiens
gugcacaaucgugcauuccuug

SEQ ID NO: 257161 - RNA, 22 nt, Homo sapiens
gugcacaaugugcagguuuguu

SEQ ID NO: 257162 - RNA, 22 nt, Homo sapiens
gugcaguuuacaguuacccagu

SEQ ID NO: 257163 - RNA, 22 nt, Homo sapiens
gugcaguuuugagugaguuucu

SEQ ID NO: 257164 - RNA, 22 nt, Homo sapiens
guggaaaucucugugugacuua

SEQ ID NO: 257165 - RNA, 22 nt, Homo sapiens
guggaagugucuggggccaggg

SEQ ID NO: 257166 - RNA, 22 nt, Homo sapiens
guggagcuguguggccuugggc

SEQ ID NO: 257167 - RNA, 22 nt, Homo sapiens
guggaucacuugaggucaagag

SEQ ID NO: 257168 - RNA, 22 nt, Homo sapiens
guggcagagucagagggaaaug

SEQ ID NO: 257169 - RNA, 22 nt, Homo sapiens
guggcaugaaagcaucugugau

SEQ ID NO: 257170 - RNA, 22 nt, Homo sapiens
guggcauuucccaaaguauucu

SEQ ID NO: 257171 - RNA, 22 nt, Homo sapiens
guggcuaaagauuuggaaucug

SEQ ID NO: 257172 - RNA, 22 nt, Homo sapiens
gugggauggagagaagguauga

SEQ ID NO: 257173 - RNA, 22 nt, Homo sapiens
guggguaaaucucuggggcucu

SEQ ID NO: 257174 - RNA, 22 nt, Homo sapiens
gugguagaaaguaccaaacuag

SEQ ID NO: 257175 - RNA, 22 nt, Homo sapiens
guggucagaaaucucaguggca

SEQ ID NO: 257176 - RNA, 21 nt, Homo sapiens
gugguucuagagaaacagaau

SEQ ID NO: 257177 - RNA, 22 nt, Homo sapiens
gugguuuuuagauuucuacagu

SEQ ID NO: 257178 - RNA, 22 nt, Homo sapiens
guguaaaacaauuagaggauuu

SEQ ID NO: 257179 - RNA, 20 nt, Homo sapiens
guguaagagcaagcuuccua

SEQ ID NO: 257180 - RNA, 22 nt, Homo sapiens
guguaauacacacauauaugca

SEQ ID NO: 257181 - RNA, 22 nt, Homo sapiens
guguauguuucucccugucccu

SEQ ID NO: 257182 - RNA, 22 nt, Homo sapiens
guguauucaucuggcugaggua

SEQ ID NO: 257183 - RNA, 22 nt, Homo sapiens
gugucacugugaggauauugua

SEQ ID NO: 257184 - RNA, 18 nt, Homo sapiens
gugucugguuaugggagu

SEQ ID NO: 257185 - RNA, 22 nt, Homo sapiens
gugugguaggauugguuacuca

SEQ ID NO: 257186 - RNA, 22 nt, Homo sapiens
guuauuguccauuuauuuagca

SEQ ID NO: 257187 - RNA, 22 nt, Homo sapiens
guucacagugguugccuuccag

SEQ ID NO: 257188 - RNA, 22 nt, Homo sapiens
guucagcaggggcuucaauggu

SEQ ID NO: 257189 - RNA, 22 nt, Homo sapiens
guucaucaggcuuucucuagag

SEQ ID NO: 257190 - RNA, 20 nt, Homo sapiens
guucccuguaggugugcgga

SEQ ID NO: 257191 - RNA, 22 nt, Homo sapiens
guucucacuggacugugaaaau

SEQ ID NO: 257192 - RNA, 22 nt, Homo sapiens
guugaaaucaucacuuggcaug

SEQ ID NO: 257193 - RNA, 18 nt, Homo sapiens
guugagcuuuuccuuuag

SEQ ID NO: 257194 - RNA, 22 nt, Homo sapiens
guugaggcaggagaauuacuug

SEQ ID NO: 257195 - RNA, 22 nt, Homo sapiens
guugcagcacacaggcugucag

SEQ ID NO: 257196 - RNA, 22 nt, Homo sapiens
guugcucaggcugaagugcagu

SEQ ID NO: 257197 - RNA, 22 nt, Homo sapiens
guugcugagucccaucaccaga

SEQ ID NO: 257198 - RNA, 22 nt, Homo sapiens
guuggaauguauugcuacuucu

SEQ ID NO: 257199 - RNA, 22 nt, Homo sapiens
guuggguaauggggcgcaccgu

SEQ ID NO: 257200 - RNA, 22 nt, Homo sapiens
guuuggauuuucuaauuucugu

SEQ ID NO: 257201 - RNA, 22 nt, Homo sapiens
guuuuuggggucacuauuaccg

SEQ ID NO: 257202 - RNA, 21 nt, Homo sapiens
uaaaacuguaacuuuguccug

SEQ ID NO: 257203 - RNA, 22 nt, Homo sapiens
uaaauugcauaaguacaaauga

SEQ ID NO: 257204 - RNA, 22 nt, Homo sapiens
uaacagucuccucaagguguug

SEQ ID NO: 257205 - RNA, 22 nt, Homo sapiens
uaacuacuucugcuucagagua

SEQ ID NO: 257206 - RNA, 22 nt, Homo sapiens
uaacugucucaggccaugggcg

SEQ ID NO: 257207 - RNA, 22 nt, Homo sapiens
uaaggaguagaauaguaaggca

SEQ ID NO: 257208 - RNA, 22 nt, Homo sapiens
ugugcaugacagcauacaaacg

SEQ ID NO: 257209 - RNA, 22 nt, Homo sapiens
ugugccacugcacuccugccug

SEQ ID NO: 257210 - RNA, 22 nt, Homo sapiens
ugugccacugcacuccugggug

SEQ ID NO: 257211 - RNA, 22 nt, Homo sapiens
ugugccacugcacuucagccug

SEQ ID NO: 257212 - RNA, 22 nt, Homo sapiens
ugugcucaucucagucaacugu

SEQ ID NO: 257213 - RNA, 22 nt, Homo sapiens
ugugcuugaaauucaguuuuga

SEQ ID NO: 257214 - RNA, 21 nt, Homo sapiens
uguggcaauggccucacagau

SEQ ID NO: 257215 - RNA, 22 nt, Homo sapiens
uguguaaagcuuguuccagaaa

SEQ ID NO: 257216 - RNA, 22 nt, Homo sapiens
uguguacaucucuacacacaug

SEQ ID NO: 257217 - RNA, 22 nt, Homo sapiens
ugugucacugcacuccagccug

SEQ ID NO: 257218 - RNA, 22 nt, Homo sapiens
ugugucuuuuaucacacaaugu

SEQ ID NO: 257219 - RNA, 22 nt, Homo sapiens
uguuaacauggucucagucugu

SEQ ID NO: 257220 - RNA, 22 nt, Homo sapiens
uguuaagaugucaauuuuccac

SEQ ID NO: 257221 - RNA, 22 nt, Homo sapiens
uguuacagcagaauugaaagag

SEQ ID NO: 257222 - RNA, 22 nt, Homo sapiens
uguucacaguguuucuuugaga

SEQ ID NO: 257223 - RNA, 22 nt, Homo sapiens
uguucuggagaguuuagucugg

SEQ ID NO: 257224 - RNA, 22 nt, Homo sapiens
uuaaaagcuaucuccaagguca

SEQ ID NO: 257225 - RNA, 22 nt, Homo sapiens
uuaaaaguauaggccuggcaua

SEQ ID NO: 257226 - RNA, 22 nt, Homo sapiens
uuaaaggcauguacacuagagu

SEQ ID NO: 257227 - RNA, 22 nt, Homo sapiens
uuaaaugcauagaauguguagu

SEQ ID NO: 257228 - RNA, 22 nt, Homo sapiens
uuaaaugucuguagaugugcug

SEQ ID NO: 257229 - RNA, 22 nt, Homo sapiens
uuaacagcacuacguggggauc

SEQ ID NO: 257230 - RNA, 22 nt, Homo sapiens
uuaaggaaggagucuuaaaugg

SEQ ID NO: 257231 - RNA, 19 nt, Homo sapiens
uuaagugugauaucucagu

SEQ ID NO: 257232 - RNA, 22 nt, Homo sapiens
uuaauacucuucuaaguagucc

SEQ ID NO: 257233 - RNA, 22 nt, Homo sapiens
uuaaugcuuuugggauauuucu

SEQ ID NO: 257234 - RNA, 22 nt, Homo sapiens
uuaauguaucuaucacaucaca

SEQ ID NO: 257235 - RNA, 22 nt, Homo sapiens
uuaauuguaucuauagauguca

SEQ ID NO: 257236 - RNA, 22 nt, Homo sapiens
uuacagcagugccccacuccca

SEQ ID NO: 257237 - RNA, 17 nt, Homo sapiens
uuacaggugcugagagu

SEQ ID NO: 257238 - RNA, 22 nt, Homo sapiens
uuacagucucaagagugcugca

SEQ ID NO: 257239 - RNA, 22 nt, Homo sapiens
uuacagugguugcuauugugaa

SEQ ID NO: 257240 - RNA, 22 nt, Homo sapiens
uuacaguugugagccaccaugc

SEQ ID NO: 257241 - RNA, 22 nt, Homo sapiens
uuacugcuuaagugauucaaca

SEQ ID NO: 257242 - RNA, 22 nt, Homo sapiens
uuagaaaguagaaaagcugguu

SEQ ID NO: 257243 - RNA, 22 nt, Homo sapiens
uuagaacagugcucaccacaaa

SEQ ID NO: 257244 - RNA, 22 nt, Homo sapiens
uuagcccagugggugcuucucu

SEQ ID NO: 257245 - RNA, 22 nt, Homo sapiens
uuaggacacuguggguggguca

SEQ ID NO: 257246 - RNA, 22 nt, Homo sapiens
uuaggcuaguuucuuaaacucu

SEQ ID NO: 257247 - RNA, 22 nt, Homo sapiens
uuagggcaggcaugagagaacu

SEQ ID NO: 257248 - RNA, 22 nt, Homo sapiens
uuaggugcauggaaguguuuuc

SEQ ID NO: 257249 - RNA, 23 nt, Homo sapiens
uuaguaaacucaaugacaccaca

SEQ ID NO: 257250 - RNA, 22 nt, Homo sapiens
uuaguaucauccuucugcauuc

SEQ ID NO: 257251 - RNA, 21 nt, Homo sapiens
uuauaguggcaugauuuauaa

SEQ ID NO: 257252 - RNA, 22 nt, Homo sapiens
uuauaugcuaaacaaggggugg

SEQ ID NO: 257253 - RNA, 22 nt, Homo sapiens
uuaugcagcaaagugcuugaaa

SEQ ID NO: 257254 - RNA, 22 nt, Homo sapiens
uuaugcuuauugguguacggua

SEQ ID NO: 257255 - RNA, 22 nt, Homo sapiens
uuaugcuugugugaauuuuccc

SEQ ID NO: 257256 - RNA, 17 nt, Homo sapiens
uuauugcuauaagcuga

SEQ ID NO: 257257 - RNA, 22 nt, Homo sapiens
uucaaaguuggaggacaaacug

SEQ ID NO: 257258 - RNA, 22 nt, Homo sapiens
uucaaaucuucguuuugccaua

SEQ ID NO: 257259 - RNA, 22 nt, Homo sapiens
uucacagacaacuggucccuua

SEQ ID NO: 257260 - RNA, 20 nt, Homo sapiens
uucacaggcagcuucuuucu

SEQ ID NO: 257261 - RNA, 22 nt, Homo sapiens
uucacagugugaucuaugggca

SEQ ID NO: 257262 - RNA, 22 nt, Homo sapiens
uucaccuugggucccacuugcu

SEQ ID NO: 257263 - RNA, 22 nt, Homo sapiens
uucacugcaugaaaaggacagc

SEQ ID NO: 257264 - RNA, 22 nt, Homo sapiens
uucacugcauuucagccugggc

SEQ ID NO: 257265 - RNA, 22 nt, Homo sapiens
uucagaugcacacuguagucua

SEQ ID NO: 257266 - RNA, 19 nt, Homo sapiens
uucagcagugucugcucuu

SEQ ID NO: 257267 - RNA, 22 nt, Homo sapiens
uucaggcuuuuauuuacugaua

SEQ ID NO: 257268 - RNA, 22 nt, Homo sapiens
uucagguacugggggaguaugg

SEQ ID NO: 257269 - RNA, 22 nt, Homo sapiens
uucaguaguaaguuggaacucu

SEQ ID NO: 257270 - RNA, 22 nt, Homo sapiens
uucaguggagaggcugaguggu

SEQ ID NO: 257271 - RNA, 22 nt, Homo sapiens
uucauacaguggcugcacucca

SEQ ID NO: 257272 - RNA, 22 nt, Homo sapiens
uucaugugagucuguauuaacu

SEQ ID NO: 257273 - RNA, 22 nt, Homo sapiens
uuccagaugggaguucuauucu

SEQ ID NO: 257274 - RNA, 22 nt, Homo sapiens
uuccaggugggcgugggccugg

SEQ ID NO: 257275 - RNA, 22 nt, Homo sapiens
uuccaguggacuacuucauccu

SEQ ID NO: 257276 - RNA, 22 nt, Homo sapiens
uucccgggguggaaugcaguga

SEQ ID NO: 257277 - RNA, 22 nt, Homo sapiens
uucccugaaauauucacuuuca

SEQ ID NO: 257278 - RNA, 22 nt, Homo sapiens
uucccugagcaucuguugagcc

SEQ ID NO: 257279 - RNA, 22 nt, Homo sapiens
uuccuugagaaaggcacaaguu

SEQ ID NO: 257280 - RNA, 22 nt, Homo sapiens
uuccuuguagcaaaugcgauga

SEQ ID NO: 257281 - RNA, 22 nt, Homo sapiens
uucuaaacaucuuacaaugcau

SEQ ID NO: 257282 - RNA, 22 nt, Homo sapiens
uucuacaggcuguucaagaagc

SEQ ID NO: 257283 - RNA, 22 nt, Homo sapiens
uucuagcaauggcagagugucu

SEQ ID NO: 257284 - RNA, 21 nt, Homo sapiens
uucucagaggcaggggauaaa

SEQ ID NO: 257285 - RNA, 22 nt, Homo sapiens
uucucagugcuaucuuuuaugc

SEQ ID NO: 257286 - RNA, 17 nt, Homo sapiens
uucucaguucugaucuc

SEQ ID NO: 257287 - RNA, 22 nt, Homo sapiens
uucuccugguggacccuaaacg

SEQ ID NO: 257288 - RNA, 22 nt, Homo sapiens
uucucugggacauaggucgggu

SEQ ID NO: 257289 - RNA, 19 nt, Homo sapiens
uucucugguuguacuaccc

SEQ ID NO: 257290 - RNA, 22 nt, Homo sapiens
uucugccaaucaacccacaucc

SEQ ID NO: 257291 - RNA, 23 nt, Homo sapiens
uucugccacugaaaaugccucag

SEQ ID NO: 257292 - RNA, 22 nt, Homo sapiens
uucugugguagaaaucucaaau

SEQ ID NO: 257293 - RNA, 22 nt, Homo sapiens
uucuucaggcauucccagaagc

SEQ ID NO: 257294 - RNA, 22 nt, Homo sapiens
uucuucaguuacaacaaggggg

SEQ ID NO: 257295 - RNA, 22 nt, Homo sapiens
uugaaagacaucaccuacugcu

SEQ ID NO: 257296 - RNA, 22 nt, Homo sapiens
uugaaaguaaacaucacaaaga

SEQ ID NO: 257297 - RNA, 22 nt, Homo sapiens
uugaaagucauuucuucuaagu

SEQ ID NO: 257298 - RNA, 22 nt, Homo sapiens
uugaaagucuaggcuuacagua

SEQ ID NO: 257299 - RNA, 22 nt, Homo sapiens
uugaacugguaguuggaaaucu

SEQ ID NO: 257300 - RNA, 16 nt, Homo sapiens
uuucaucaguuuuaau

SEQ ID NO: 257301 - RNA, 23 nt, Homo sapiens
uuucauggggauuuacucauucc

SEQ ID NO: 257302 - RNA, 22 nt, Homo sapiens
uuuccaguuggaaagccuguuu

SEQ ID NO: 257303 - RNA, 22 nt, Homo sapiens
uuucccugaaggcucugaaguc

SEQ ID NO: 257304 - RNA, 22 nt, Homo sapiens
uuucccuuuagcuuagugauuu

SEQ ID NO: 257305 - RNA, 22 nt, Homo sapiens
uuucuacagugaacgauuucua

SEQ ID NO: 257306 - RNA, 22 nt, Homo sapiens
uuugacucacagccuggcugcc

SEQ ID NO: 257307 - RNA, 22 nt, Homo sapiens
uuugacuguggagucgaugcuu

SEQ ID NO: 257308 - RNA, 22 nt, Homo sapiens
uuugcaagaugaaaaaguucua

SEQ ID NO: 257309 - RNA, 22 nt, Homo sapiens
uuugcacauauuugggcaaaag

SEQ ID NO: 257310 - RNA, 23 nt, Homo sapiens
uuugcacuugcuccuucuauggc

SEQ ID NO: 257311 - RNA, 22 nt, Homo sapiens
uuugccaaucagaggcaucuug

SEQ ID NO: 257312 - RNA, 22 nt, Homo sapiens
uuugcugagucauuccaugcug

SEQ ID NO: 257313 - RNA, 22 nt, Homo sapiens
uuugcuugaggucuagcuaccc

SEQ ID NO: 257314 - RNA, 22 nt, Homo sapiens
uuuggauagugugguccuuuua

SEQ ID NO: 257315 - RNA, 22 nt, Homo sapiens
uuuggcacuauagguaaauuug

SEQ ID NO: 257316 - RNA, 22 nt, Homo sapiens
uuuggcagaaaacuaaaaggua

SEQ ID NO: 257317 - RNA, 22 nt, Homo sapiens
uuuggcagaugacccucaaguu

SEQ ID NO: 257318 - RNA, 22 nt, Homo sapiens
uuuggcauuaagaugcuguauc

SEQ ID NO: 257319 - RNA, 22 nt, Homo sapiens
uuuggcuuaagauugacugcaa

SEQ ID NO: 257320 - RNA, 21 nt, Homo sapiens
uuuggcuucucugcugcagcc

SEQ ID NO: 257321 - RNA, 22 nt, Homo sapiens
uuugggccaugcuucccgguca

SEQ ID NO: 257322 - RNA, 22 nt, Homo sapiens
uuuggucagcugcgggucagcu

SEQ ID NO: 257323 - RNA, 22 nt, Homo sapiens
uuugguugcauucacauauuuc

SEQ ID NO: 257324 - RNA, 22 nt, Homo sapiens
uuugguugucacaacuggggga

SEQ ID NO: 257325 - RNA, 22 nt, Homo sapiens
uuuguacacuguugguaggauu

SEQ ID NO: 257326 - RNA, 22 nt, Homo sapiens
uuuguacugagccaagauggua

SEQ ID NO: 257327 - RNA, 22 nt, Homo sapiens
uuuguacuugaagaaucuuuau

SEQ ID NO: 257328 - RNA, 23 nt, Homo sapiens
uuuguaguagcaugauuuauaau

SEQ ID NO: 257329 - RNA, 22 nt, Homo sapiens
uuugucaauaacuaccaacagg

SEQ ID NO: 257330 - RNA, 22 nt, Homo sapiens
uuugucauagcagcaggaaugg

SEQ ID NO: 257331 - RNA, 18 nt, Homo sapiens
uuugugcuccacaaagga

SEQ ID NO: 257332 - RNA, 22 nt, Homo sapiens
uuuguggaaugcccuuauuuau

SEQ ID NO: 257333 - RNA, 22 nt, Homo sapiens
uuuguggaaugcucauguguag

SEQ ID NO: 257334 - RNA, 22 nt, Homo sapiens
uuuguguggccuuggccuggca

SEQ ID NO: 257335 - RNA, 22 nt, Homo sapiens
uuugugugugauuauaaaaggu

SEQ ID NO: 257336 - RNA, 22 nt, Homo sapiens
uuuuacagaggagguugcugau

SEQ ID NO: 257337 - RNA, 20 nt, Homo sapiens
uuuuagcacuuguuauggug

SEQ ID NO: 257338 - RNA, 22 nt, Homo sapiens
uuuucaguuuuccagguagccg

SEQ ID NO: 257339 - RNA, 19 nt, Homo sapiens
uuuuccccuuucuuaagac

SEQ ID NO: 257340 - RNA, 22 nt, Homo sapiens
uuuuggacuugcuccccugucc

SEQ ID NO: 257341 - RNA, 22 nt, Homo sapiens
uuuugguguauuguauaaggua

SEQ ID NO: 257342 - RNA, 21 nt, Homo sapiens
uuuuugguggucauggauaga

SEQ ID NO: 257343 - RNA, 19 nt, Homo sapiens
uggugccuuguucuuggau

SEQ ID NO: 257344 - RNA, 22 nt, Homo sapiens
ugguuguuuuaaaugucgucug

SEQ ID NO: 257345 - RNA, 22 nt, Homo sapiens
uguaauuuaaaugauccuugga

SEQ ID NO: 257346 - RNA, 22 nt, Homo sapiens
uguacaaauuucugugguggug

SEQ ID NO: 257347 - RNA, 22 nt, Homo sapiens
uguagauauucuuucaguuuuu

SEQ ID NO: 257348 - RNA, 20 nt, Homo sapiens
ugucaagaaacauuacuuau

SEQ ID NO: 257349 - RNA, 22 nt, Homo sapiens
ugucacugugcagucaugcauu

SEQ ID NO: 257350 - RNA, 22 nt, Homo sapiens
ugucagaaucugagacgacaac

SEQ ID NO: 257351 - RNA, 22 nt, Homo sapiens
ugucaggaggguccagagaaaa

SEQ ID NO: 257352 - RNA, 22 nt, Homo sapiens
ugucauggggaaaauaacagac

SEQ ID NO: 257353 - RNA, 22 nt, Homo sapiens
ugucauucaggaaauucuaagu

SEQ ID NO: 257354 - RNA, 22 nt, Homo sapiens
ugucuaguuuugaaguauagca

SEQ ID NO: 257355 - RNA, 22 nt, Homo sapiens
ugucucaguuacggcaauucca

SEQ ID NO: 257356 - RNA, 22 nt, Homo sapiens
ugucucaguuucuguggguuag

SEQ ID NO: 257357 - RNA, 22 nt, Homo sapiens
ugucugagacuguuuuacuuuc

SEQ ID NO: 257358 - RNA, 22 nt, Homo sapiens
ugucuggaaggguggccuccug

SEQ ID NO: 257359 - RNA, 22 nt, Homo sapiens
ugugaaacacgaaagucuaaaa

SEQ ID NO: 257360 - RNA, 22 nt, Homo sapiens
ugugaacagcagcugggcuuug

SEQ ID NO: 257361 - RNA, 18 nt, Homo sapiens
ugugacauugagcauguc

SEQ ID NO: 257362 - RNA, 19 nt, Homo sapiens
ugugacugggccagccuag

SEQ ID NO: 257363 - RNA, 22 nt, Homo sapiens
ugugagcuauggaguuguagag

SEQ ID NO: 257364 - RNA, 18 nt, Homo sapiens
ugugcaauauuaaccacc

SEQ ID NO: 257365 - RNA, 22 nt, Homo sapiens
ugugcaaucuuccauuuuuagg

SEQ ID NO: 257366 - RNA, 22 nt, Homo sapiens
ugugcacauugugcagguugau

SEQ ID NO: 257367 - RNA, 22 nt, Homo sapiens
ugugccacuccagcucuagcuu

SEQ ID NO: 257368 - RNA, 22 nt, Homo sapiens
ugugccacugcacucccgccug

SEQ ID NO: 257369 - RNA, 22 nt, Homo sapiens
ugugccacugcacucugggcaa

SEQ ID NO: 257370 - RNA, 22 nt, Homo sapiens
uguggaaauaaaagaaagguua

SEQ ID NO: 257371 - RNA, 22 nt, Homo sapiens
uguggaaauuguuguauuuaau

SEQ ID NO: 257372 - RNA, 22 nt, Homo sapiens
uguggcagugcuuuaugaaacc

SEQ ID NO: 257373 - RNA, 22 nt, Homo sapiens
ugugggaggugcuaauguaaau

SEQ ID NO: 257374 - RNA, 22 nt, Homo sapiens
ugugguagugcuuaccugcagu

SEQ ID NO: 257375 - RNA, 22 nt, Homo sapiens
ugugguauuagguguaguaucu

SEQ ID NO: 257376 - RNA, 23 nt, Homo sapiens
ugugguauuauuccauuuauagg

SEQ ID NO: 257377 - RNA, 22 nt, Homo sapiens
uguguaaauauauacacacgug

SEQ ID NO: 257378 - RNA, 22 nt, Homo sapiens
uguguaauacucuaaugaugca

SEQ ID NO: 257379 - RNA, 21 nt, Homo sapiens
uguuaacaugcagauuacugg

SEQ ID NO: 257380 - RNA, 22 nt, Homo sapiens
uguuaucauuacguucuuaguu

SEQ ID NO: 257381 - RNA, 22 nt, Homo sapiens
uguugcuuaagccacccagucu

SEQ ID NO: 257382 - RNA, 22 nt, Homo sapiens
uguuuaguuaagacauagaauu

SEQ ID NO: 257383 - RNA, 22 nt, Homo sapiens
uguuuguuugagauggagucuc

SEQ ID NO: 257384 - RNA, 22 nt, Homo sapiens
uuaaagugcuguuuuugccggg

SEQ ID NO: 257385 - RNA, 22 nt, Homo sapiens
uuaaaugcucacauaaagguag

SEQ ID NO: 257386 - RNA, 22 nt, Homo sapiens
uuaagacaccaaucauuggauu

SEQ ID NO: 257387 - RNA, 22 nt, Homo sapiens
uuaagaugcauuuugaaguuaa

SEQ ID NO: 257388 - RNA, 22 nt, Homo sapiens
uuaaguagcugggcaugguggu

SEQ ID NO: 257389 - RNA, 22 nt, Homo sapiens
uuaagucacacuagacaacuga

SEQ ID NO: 257390 - RNA, 22 nt, Homo sapiens
uuacaagaugucuguccaacac

SEQ ID NO: 257391 - RNA, 21 nt, Homo sapiens
uuacaauggcuccuugaaggu

SEQ ID NO: 257392 - RNA, 22 nt, Homo sapiens
uuacaggacuaagcagcuuugc

SEQ ID NO: 257393 - RNA, 22 nt, Homo sapiens
uuacagucaaguuacauuucuc

SEQ ID NO: 257394 - RNA, 22 nt, Homo sapiens
uuacauugcuucaaauucagug

SEQ ID NO: 257395 - RNA, 22 nt, Homo sapiens
uuacugcauaauuccugggaag

SEQ ID NO: 257396 - RNA, 22 nt, Homo sapiens
uuagaugaaugucucuuaaaca

SEQ ID NO: 257397 - RNA, 18 nt, Homo sapiens
uuagaugguuuuaaaacu

SEQ ID NO: 257398 - RNA, 22 nt, Homo sapiens
uuagcacaguucauucauguua

SEQ ID NO: 257399 - RNA, 22 nt, Homo sapiens
uuagcagcaugagaauggacua

SEQ ID NO: 257400 - RNA, 22 nt, Homo sapiens
uuagcagccuucaagcuccaag

SEQ ID NO: 257401 - RNA, 22 nt, Homo sapiens
uuaggcaguuuauugauuuuca

SEQ ID NO: 257402 - RNA, 22 nt, Homo sapiens
uuauacacugugggaguguaaa

SEQ ID NO: 257403 - RNA, 22 nt, Homo sapiens
uuaucaaacccuaggagguggu

SEQ ID NO: 257404 - RNA, 22 nt, Homo sapiens
acauagaguaguggugaggaug

SEQ ID NO: 257405 - RNA, 22 nt, Homo sapiens
acccagaagucauucaggaaca

SEQ ID NO: 257406 - RNA, 22 nt, Homo sapiens
acccuacauaguagauccuaca

SEQ ID NO: 257407 - RNA, 22 nt, Homo sapiens
acccugacacgauucuucacuu

SEQ ID NO: 257408 - RNA, 22 nt, Homo sapiens
acccuggauucguggccuugaa

SEQ ID NO: 257409 - RNA, 22 nt, Homo sapiens
acccugguagcuaugaagucuu

SEQ ID NO: 257410 - RNA, 22 nt, Homo sapiens
acccuguaacauacaagugguu

SEQ ID NO: 257411 - RNA, 18 nt, Homo sapiens
acccuucagcacugggcc

SEQ ID NO: 257412 - RNA, 22 nt, Homo sapiens
acccuugaguguguuucaggca

SEQ ID NO: 257413 - RNA, 22 nt, Homo sapiens
acuacugucagacugccacuga

SEQ ID NO: 257414 - RNA, 22 nt, Homo sapiens
acuaugagacgaaugcaucagu

SEQ ID NO: 257415 - RNA, 22 nt, Homo sapiens
acucagagugggccccuagaua

SEQ ID NO: 257416 - RNA, 22 nt, Homo sapiens
acuccauuucauuuuagcucuu

SEQ ID NO: 257417 - RNA, 22 nt, Homo sapiens
acugagucauugggugcccaga

SEQ ID NO: 257418 - RNA, 21 nt, Homo sapiens
acugcacuccaaccucaacag

SEQ ID NO: 257419 - RNA, 20 nt, Homo sapiens
acugcacuccaaccuuugug

SEQ ID NO: 257420 - RNA, 22 nt, Homo sapiens
acugcacuccagcccaggugac

SEQ ID NO: 257421 - RNA, 22 nt, Homo sapiens
acugcacuccagcuccagggug

SEQ ID NO: 257422 - RNA, 18 nt, Homo sapiens
acugcacuccauccuagg

SEQ ID NO: 257423 - RNA, 22 nt, Homo sapiens
acugcacuucagccuugggaaa

SEQ ID NO: 257424 - RNA, 22 nt, Homo sapiens
acuggcuuaaggaugggccacu

SEQ ID NO: 257425 - RNA, 22 nt, Homo sapiens
acugguguaugggaggucccaa

SEQ ID NO: 257426 - RNA, 22 nt, Homo sapiens
acuuuguguuacccagcaagga

SEQ ID NO: 257427 - RNA, 22 nt, Homo sapiens
agaaauguuuacucacccccuu

SEQ ID NO: 257428 - RNA, 22 nt, Homo sapiens
agaacuguccauucagcaugaa

SEQ ID NO: 257429 - RNA, 21 nt, Homo sapiens
agacacuuggaagguuuuaga

SEQ ID NO: 257430 - RNA, 22 nt, Homo sapiens
agacagcuggaguaucauagcu

SEQ ID NO: 257431 - RNA, 20 nt, Homo sapiens
agacuagggagcagaaagcc

SEQ ID NO: 257432 - RNA, 23 nt, Homo sapiens
agacugaaguaucugagacucag

SEQ ID NO: 257433 - RNA, 21 nt, Homo sapiens
agagaacugaaacaugugacu

SEQ ID NO: 257434 - RNA, 22 nt, Homo sapiens
agagaucaauaugaaggaaaug

SEQ ID NO: 257435 - RNA, 20 nt, Homo sapiens
agagcaaagccgcaccccua

SEQ ID NO: 257436 - RNA, 22 nt, Homo sapiens
agagccacacucuccuaacuca

SEQ ID NO: 257437 - RNA, 22 nt, Homo sapiens
agagccacauuaaauaugggaa

SEQ ID NO: 257438 - RNA, 22 nt, Homo sapiens
agagugaagcuuuuuauauucu

SEQ ID NO: 257439 - RNA, 23 nt, Homo sapiens
agagugcaauggugccaucucgg

SEQ ID NO: 257440 - RNA, 22 nt, Homo sapiens
agagugcuuuauuagauguagc

SEQ ID NO: 257441 - RNA, 22 nt, Homo sapiens
agauauguuauugauguuaaug

SEQ ID NO: 257442 - RNA, 20 nt, Homo sapiens
agaugcaugcacauaaacac

SEQ ID NO: 257443 - RNA, 22 nt, Homo sapiens
agcaccacaauuuccugccuaa

SEQ ID NO: 257444 - RNA, 22 nt, Homo sapiens
agcaccauuucucuaaagcacu

SEQ ID NO: 257445 - RNA, 17 nt, Homo sapiens
agcagcccauaucccca

SEQ ID NO: 257446 - RNA, 22 nt, Homo sapiens
agcagcuuugaucugaaugauu

SEQ ID NO: 257447 - RNA, 22 nt, Homo sapiens
agcagguguggcuuauccugaa

SEQ ID NO: 257448 - RNA, 16 nt, Homo sapiens
agcagguguuagguga

SEQ ID NO: 257449 - RNA, 22 nt, Homo sapiens
agcaguacauaaaaagcauccu

SEQ ID NO: 257450 - RNA, 22 nt, Homo sapiens
agcaucauguuuucgagguuca

SEQ ID NO: 257451 - RNA, 23 nt, Homo sapiens
agccugguuucccugcuucuccc

SEQ ID NO: 257452 - RNA, 23 nt, Homo sapiens
agcuagagaggcuggggauacag

SEQ ID NO: 257453 - RNA, 22 nt, Homo sapiens
agcucacagccuagcacuguga

SEQ ID NO: 257454 - RNA, 18 nt, Homo sapiens
agcucaguguuugcuuac

SEQ ID NO: 257455 - RNA, 22 nt, Homo sapiens
aguggcacaauuuugacucccc

SEQ ID NO: 257456 - RNA, 22 nt, Homo sapiens
aguggcacuauucucagaguca

SEQ ID NO: 257457 - RNA, 22 nt, Homo sapiens
aguguuuuuaacaagaaagggu

SEQ ID NO: 257458 - RNA, 22 nt, Homo sapiens
aguucaaaucgagccuggccau

SEQ ID NO: 257459 - RNA, 21 nt, Homo sapiens
aguucacauggcuccuguguu

SEQ ID NO: 257460 - RNA, 22 nt, Homo sapiens
auaaaccuacauuuucacuucu

SEQ ID NO: 257461 - RNA, 17 nt, Homo sapiens
auaaacucaucauuuuu

SEQ ID NO: 257462 - RNA, 22 nt, Homo sapiens
auaaacugucaguggagaguaa

SEQ ID NO: 257463 - RNA, 22 nt, Homo sapiens
auaaagguaagcacuauccuga

SEQ ID NO: 257464 - RNA, 22 nt, Homo sapiens
auaaaguguuuaguauaggcaa

SEQ ID NO: 257465 - RNA, 22 nt, Homo sapiens
auaaaugccuguuguuuuaagc

SEQ ID NO: 257466 - RNA, 22 nt, Homo sapiens
auaacagcauuauugcauacgu

SEQ ID NO: 257467 - RNA, 22 nt, Homo sapiens
auaagaguaguacauaugagac

SEQ ID NO: 257468 - RNA, 22 nt, Homo sapiens
auaagaugaaggaagccauauc

SEQ ID NO: 257469 - RNA, 22 nt, Homo sapiens
auaauagguugauugacauugc

SEQ ID NO: 257470 - RNA, 22 nt, Homo sapiens
auacaaguuauuugaacugcgg

SEQ ID NO: 257471 - RNA, 22 nt, Homo sapiens
auacagugaauacuuacagugu

SEQ ID NO: 257472 - RNA, 22 nt, Homo sapiens
auacauguucaagggcauauau

SEQ ID NO: 257473 - RNA, 16 nt, Homo sapiens
auaccacagugacaca

SEQ ID NO: 257474 - RNA, 22 nt, Homo sapiens
auacuaugagauaauaaagacu

SEQ ID NO: 257475 - RNA, 22 nt, Homo sapiens
auagcacaugugcaaauggcug

SEQ ID NO: 257476 - RNA, 20 nt, Homo sapiens
auagcauugauggacucaaa

SEQ ID NO: 257477 - RNA, 22 nt, Homo sapiens
auagcugcucaggcuuuccuca

SEQ ID NO: 257478 - RNA, 22 nt, Homo sapiens
auaggagugugcacagaguagg

SEQ ID NO: 257479 - RNA, 22 nt, Homo sapiens
auagugcuggaauaaauauacg

SEQ ID NO: 257480 - RNA, 22 nt, Homo sapiens
auaugcauacauguaugcagga

SEQ ID NO: 257481 - RNA, 22 nt, Homo sapiens
auaugcuuauuagcaagaaaua

SEQ ID NO: 257482 - RNA, 20 nt, Homo sapiens
auaugguugugagugauuuu

SEQ ID NO: 257483 - RNA, 22 nt, Homo sapiens
auaugguuuuuggaagcauauc

SEQ ID NO: 257484 - RNA, 22 nt, Homo sapiens
auauguucucauucauaugugg

SEQ ID NO: 257485 - RNA, 22 nt, Homo sapiens
aucaaagcagcauggcccaguc

SEQ ID NO: 257486 - RNA, 22 nt, Homo sapiens
aucaaaguaggcauauguuuuu

SEQ ID NO: 257487 - RNA, 22 nt, Homo sapiens
aucaaauugucauuuuaaggau

SEQ ID NO: 257488 - RNA, 22 nt, Homo sapiens
aucaagccaaagaaaguccuug

SEQ ID NO: 257489 - RNA, 22 nt, Homo sapiens
aucaaguacuguacugaaagug

SEQ ID NO: 257490 - RNA, 22 nt, Homo sapiens
aucacagcccuccucuuggaug

SEQ ID NO: 257491 - RNA, 22 nt, Homo sapiens
aucaccuuucccuuucugaauc

SEQ ID NO: 257492 - RNA, 22 nt, Homo sapiens
aucacugggagcagccauuaau

SEQ ID NO: 257493 - RNA, 22 nt, Homo sapiens
aucacuuucuauuucugugcca

SEQ ID NO: 257494 - RNA, 22 nt, Homo sapiens
aucagaaucucuagugggacca

SEQ ID NO: 257495 - RNA, 22 nt, Homo sapiens
aucagaaucucuugagaguguu

SEQ ID NO: 257496 - RNA, 20 nt, Homo sapiens
aucagagccggugaaagggc

SEQ ID NO: 257497 - RNA, 22 nt, Homo sapiens
aucagauggcuaaaacagaaga

SEQ ID NO: 257498 - RNA, 22 nt, Homo sapiens
aucagcacugaucauacagcuu

SEQ ID NO: 257499 - RNA, 22 nt, Homo sapiens
aucaggaaccuuuuuggugugu

SEQ ID NO: 257500 - RNA, 22 nt, Homo sapiens
aucagugcauguuuguugagcu

SEQ ID NO: 257501 - RNA, 22 nt, Homo sapiens
aucauccugucaggagcuguga

SEQ ID NO: 257502 - RNA, 22 nt, Homo sapiens
aucauugugcaucuucauucca

SEQ ID NO: 257503 - RNA, 22 nt, Homo sapiens
aucccgagacuuugcugaaguu

SEQ ID NO: 257504 - RNA, 22 nt, Homo sapiens
aucccugagaacuuuuaauguu

SEQ ID NO: 257505 - RNA, 22 nt, Homo sapiens
aucccugaggaauuucugcacu

SEQ ID NO: 257506 - RNA, 22 nt, Homo sapiens
auccucugagaucuaggcagag

SEQ ID NO: 257507 - RNA, 22 nt, Homo sapiens
auccuugagaaaauaaaugacc

SEQ ID NO: 257508 - RNA, 22 nt, Homo sapiens
aucucagcaacuaaagauccuu

SEQ ID NO: 257509 - RNA, 22 nt, Homo sapiens
ugaggcuaggauaggcugauuc

SEQ ID NO: 257510 - RNA, 22 nt, Homo sapiens
ugaggcuagucagaucagauga

SEQ ID NO: 257511 - RNA, 17 nt, Homo sapiens
ugagggaugccugguuc

SEQ ID NO: 257512 - RNA, 22 nt, Homo sapiens
ugagguaagauguucauuuuuc

SEQ ID NO: 257513 - RNA, 22 nt, Homo sapiens
ugaggugaaguaauauucuaag

SEQ ID NO: 257514 - RNA, 22 nt, Homo sapiens
ugagguguauugggggaaauuc

SEQ ID NO: 257515 - RNA, 22 nt, Homo sapiens
ugagguuauuuguucaagaagu

SEQ ID NO: 257516 - RNA, 22 nt, Homo sapiens
ugaguagaagugaagauagugg

SEQ ID NO: 257517 - RNA, 22 nt, Homo sapiens
ugagucgagauugcgccacugu

SEQ ID NO: 257518 - RNA, 22 nt, Homo sapiens
ugagucuguucucacauugcua

SEQ ID NO: 257519 - RNA, 22 nt, Homo sapiens
ugaguuaauuuuuguaucaugu

SEQ ID NO: 257520 - RNA, 22 nt, Homo sapiens
ugaguucaauguuaaugaagca

SEQ ID NO: 257521 - RNA, 22 nt, Homo sapiens
ugaguucaugcuuguaguucua

SEQ ID NO: 257522 - RNA, 22 nt, Homo sapiens
ugaguucuuccuaucucugccu

SEQ ID NO: 257523 - RNA, 17 nt, Homo sapiens
ugauaagugugagguga

SEQ ID NO: 257524 - RNA, 22 nt, Homo sapiens
ugauaauuuugucagguuuugg

SEQ ID NO: 257525 - RNA, 22 nt, Homo sapiens
ugauaugaaagggaaauaagug

SEQ ID NO: 257526 - RNA, 22 nt, Homo sapiens
ugauaugugaguauaugguuau

SEQ ID NO: 257527 - RNA, 22 nt, Homo sapiens
ugaugcugaugccugccagaag

SEQ ID NO: 257528 - RNA, 22 nt, Homo sapiens
ugauggcauuucauguuuguaa

SEQ ID NO: 257529 - RNA, 22 nt, Homo sapiens
ugcaaaucuuguguaguuguga

SEQ ID NO: 257530 - RNA, 22 nt, Homo sapiens
ugcaagacugcaguuacuuuug

SEQ ID NO: 257531 - RNA, 22 nt, Homo sapiens
ugcaagaggagacuguacucag

SEQ ID NO: 257532 - RNA, 20 nt, Homo sapiens
ugcaaguugccuuuggaggc

SEQ ID NO: 257533 - RNA, 18 nt, Homo sapiens
ugcaauggagaugcagcc

SEQ ID NO: 257534 - RNA, 22 nt, Homo sapiens
ugcacaguccagugcccacuga

SEQ ID NO: 257535 - RNA, 23 nt, Homo sapiens
ugcagcacacugaugggucuuga

SEQ ID NO: 257536 - RNA, 22 nt, Homo sapiens
ugcagcacuguucacaauagcc

SEQ ID NO: 257537 - RNA, 21 nt, Homo sapiens
ugcagccauucagcccuaugc

SEQ ID NO: 257538 - RNA, 22 nt, Homo sapiens
ugcagcucagcugcggaguuuu

SEQ ID NO: 257539 - RNA, 22 nt, Homo sapiens
ugcagugcaugacuguguuaug

SEQ ID NO: 257540 - RNA, 22 nt, Homo sapiens
ugcaguguggcucacgccugua

SEQ ID NO: 257541 - RNA, 22 nt, Homo sapiens
ugcauacugaaauauuuuagag

SEQ ID NO: 257542 - RNA, 22 nt, Homo sapiens
ugcauauucuaggauuuuguau

SEQ ID NO: 257543 - RNA, 22 nt, Homo sapiens
ugcauccauucuagacucaucu

SEQ ID NO: 257544 - RNA, 19 nt, Homo sapiens
ugccaagaaagucagcuua

SEQ ID NO: 257545 - RNA, 20 nt, Homo sapiens
ugccaagaaaugaggguauu

SEQ ID NO: 257546 - RNA, 22 nt, Homo sapiens
ugccagaugcaguguucaacaa

SEQ ID NO: 257547 - RNA, 22 nt, Homo sapiens
ugccauagcaaugguaagcuga

SEQ ID NO: 257548 - RNA, 22 nt, Homo sapiens
ugccauugcacuccagccuggg

SEQ ID NO: 257549 - RNA, 22 nt, Homo sapiens
ugccuaguagaaggugaacaug

SEQ ID NO: 257550 - RNA, 22 nt, Homo sapiens
ugcuaugucuucucucacagag

SEQ ID NO: 257551 - RNA, 23 nt, Homo sapiens
ugcuccccucauggaugaauaaa

SEQ ID NO: 257552 - RNA, 22 nt, Homo sapiens
ugcugcauuggggauuaaguuu

SEQ ID NO: 257553 - RNA, 22 nt, Homo sapiens
ugcuguuguuugaugaaguaau

SEQ ID NO: 257554 - RNA, 17 nt, Homo sapiens
ugcuuagagagccucag

SEQ ID NO: 257555 - RNA, 22 nt, Homo sapiens
uggaaaauuaggggagguuaua

SEQ ID NO: 257556 - RNA, 22 nt, Homo sapiens
uggaaaguacugagguccaccu

SEQ ID NO: 257557 - RNA, 22 nt, Homo sapiens
uggaaaguacuugaguuuguau

SEQ ID NO: 257558 - RNA, 22 nt, Homo sapiens
uggaaauuaacagggauugucc

SEQ ID NO: 257559 - RNA, 22 nt, Homo sapiens
uggaagacacauaccugauaac

SEQ ID NO: 257560 - RNA, 22 nt, Homo sapiens
uggaagcauagcagcgugugug

SEQ ID NO: 257561 - RNA, 22 nt, Homo sapiens
uggaaguagauagauuguguca

SEQ ID NO: 257562 - RNA, 22 nt, Homo sapiens
uggaagucuauggcauuugagu

SEQ ID NO: 257563 - RNA, 22 nt, Homo sapiens
uggaagugaacaaccaaggcag

SEQ ID NO: 257564 - RNA, 22 nt, Homo sapiens
uggaaugugaauaacuuccuuc

SEQ ID NO: 257565 - RNA, 22 nt, Homo sapiens
uggaauuuacuuauuuaggggc

SEQ ID NO: 257566 - RNA, 22 nt, Homo sapiens
uggaauuuagguugauaguaua

SEQ ID NO: 257567 - RNA, 22 nt, Homo sapiens
uggacagaaacauguuuucagu

SEQ ID NO: 257568 - RNA, 22 nt, Homo sapiens
uggacauguacauauguguaug

SEQ ID NO: 257569 - RNA, 20 nt, Homo sapiens
uggaccagagagguggggac

SEQ ID NO: 257570 - RNA, 22 nt, Homo sapiens
uggagguagacauugggaagag

SEQ ID NO: 257571 - RNA, 22 nt, Homo sapiens
uggaguaggccuaagaaugaca

SEQ ID NO: 257572 - RNA, 22 nt, Homo sapiens
uggaguguuggggcaggaucuc

SEQ ID NO: 257573 - RNA, 22 nt, Homo sapiens
aagcugccuugugaaggcauuc

SEQ ID NO: 257574 - RNA, 22 nt, Homo sapiens
aagcuggcauucaugagauuac

SEQ ID NO: 257575 - RNA, 22 nt, Homo sapiens
aagcuguauuguguugcuauaa

SEQ ID NO: 257576 - RNA, 22 nt, Homo sapiens
aaggaacuggaauauuuugaac

SEQ ID NO: 257577 - RNA, 22 nt, Homo sapiens
aaggaguagaauagaugcaccu

SEQ ID NO: 257578 - RNA, 22 nt, Homo sapiens
aaggcaagagaaaauuucgagu

SEQ ID NO: 257579 - RNA, 22 nt, Homo sapiens
aaggcaagauacugguugcuga

SEQ ID NO: 257580 - RNA, 22 nt, Homo sapiens
aaggcaagguggauaaugaagc

SEQ ID NO: 257581 - RNA, 22 nt, Homo sapiens
aaggcauggugacuauuuaggc

SEQ ID NO: 257582 - RNA, 22 nt, Homo sapiens
aaggcuagagaagaagggcauc

SEQ ID NO: 257583 - RNA, 22 nt, Homo sapiens
aagggaaugugguagcugguuu

SEQ ID NO: 257584 - RNA, 22 nt, Homo sapiens
aagggaauguugugguugguuu

SEQ ID NO: 257585 - RNA, 22 nt, Homo sapiens
aagguucuugcuugcaugacug

SEQ ID NO: 257586 - RNA, 22 nt, Homo sapiens
aaguaguuaggaacauucucuc

SEQ ID NO: 257587 - RNA, 22 nt, Homo sapiens
aagucaaggagagaagcuucag

SEQ ID NO: 257588 - RNA, 22 nt, Homo sapiens
aagucauggagaagguggaggu

SEQ ID NO: 257589 - RNA, 22 nt, Homo sapiens
aagugagugacaaaaacugggc

SEQ ID NO: 257590 - RNA, 22 nt, Homo sapiens
aagugcacuguaagugcaggau

SEQ ID NO: 257591 - RNA, 22 nt, Homo sapiens
aagugcugggauuggccgggca

SEQ ID NO: 257592 - RNA, 22 nt, Homo sapiens
aagugcuuacagggaacaugau

SEQ ID NO: 257593 - RNA, 22 nt, Homo sapiens
aaguggcauugaggaaaaaaau

SEQ ID NO: 257594 - RNA, 22 nt, Homo sapiens
aagugucagaguugcuaaugac

SEQ ID NO: 257595 - RNA, 22 nt, Homo sapiens
aauacagcacacagaugggucu

SEQ ID NO: 257596 - RNA, 22 nt, Homo sapiens
aaucucagagauaucugugucc

SEQ ID NO: 257597 - RNA, 22 nt, Homo sapiens
aaugacacugagcaucuuucau

SEQ ID NO: 257598 - RNA, 22 nt, Homo sapiens
aaugacuaagaugguacauuuu

SEQ ID NO: 257599 - RNA, 22 nt, Homo sapiens
aaugcacauaaaauccuccagg

SEQ ID NO: 257600 - RNA, 22 nt, Homo sapiens
aaugccuagugugugacaggug

SEQ ID NO: 257601 - RNA, 22 nt, Homo sapiens
aauggcaguagauggaugggua

SEQ ID NO: 257602 - RNA, 22 nt, Homo sapiens
aaugggacugacgccucccaga

SEQ ID NO: 257603 - RNA, 22 nt, Homo sapiens
aauucugugagauggugcagau

SEQ ID NO: 257604 - RNA, 22 nt, Homo sapiens
aauugguuaagauaagaucaua

SEQ ID NO: 257605 - RNA, 22 nt, Homo sapiens
acaaagugccuccuuuuagagu

SEQ ID NO: 257606 - RNA, 22 nt, Homo sapiens
acaagugaauacaggauucucu

SEQ ID NO: 257607 - RNA, 22 nt, Homo sapiens
acacaugugcguagacucuuua

SEQ ID NO: 257608 - RNA, 20 nt, Homo sapiens
acacuggaguaucaaggccc

SEQ ID NO: 257609 - RNA, 22 nt, Homo sapiens
acacuugcuugcaauagccucc

SEQ ID NO: 257610 - RNA, 19 nt, Homo sapiens
acagcugguuuugguuucu

SEQ ID NO: 257611 - RNA, 22 nt, Homo sapiens
acagguacacagaauauccaga

SEQ ID NO: 257612 - RNA, 22 nt, Homo sapiens
acaguacuuuuggauuugugaa

SEQ ID NO: 257613 - RNA, 22 nt, Homo sapiens
acagucauagcagccuuuguua

SEQ ID NO: 257614 - RNA, 19 nt, Homo sapiens
acagugcuuugucagaagc

SEQ ID NO: 257615 - RNA, 22 nt, Homo sapiens
acaguggugcgaucucggcuca

SEQ ID NO: 257616 - RNA, 23 nt, Homo sapiens
acaguggugugaucuuggcucag

SEQ ID NO: 257617 - RNA, 22 nt, Homo sapiens
cacauguucaggagcacuuaga

SEQ ID NO: 257618 - RNA, 22 nt, Homo sapiens
cacauugcaggaaaguucauua

SEQ ID NO: 257619 - RNA, 22 nt, Homo sapiens
caccaggugcccagcacggcca

SEQ ID NO: 257620 - RNA, 22 nt, Homo sapiens
caccagguuggagugcaguggu

SEQ ID NO: 257621 - RNA, 22 nt, Homo sapiens
cacugcacuccagccuaagagg

SEQ ID NO: 257622 - RNA, 22 nt, Homo sapiens
cacugcacuccagcuuugguga

SEQ ID NO: 257623 - RNA, 22 nt, Homo sapiens
cacugcacuccaguuuggauga

SEQ ID NO: 257624 - RNA, 22 nt, Homo sapiens
uccucauggagaaccucugcua

SEQ ID NO: 257625 - RNA, 22 nt, Homo sapiens
uccuguaaucccagcuaccaga

SEQ ID NO: 257626 - RNA, 22 nt, Homo sapiens
uccuuugguuauaggcaccucu

SEQ ID NO: 257627 - RNA, 18 nt, Homo sapiens
uccuuuugggguaggaga

SEQ ID NO: 257628 - RNA, 22 nt, Homo sapiens
ucggcucagugcaagcucugcc

SEQ ID NO: 257629 - RNA, 22 nt, Homo sapiens
ucuaaaguacuacuacuguugg

SEQ ID NO: 257630 - RNA, 21 nt, Homo sapiens
ucuaccuacugcucacaggcu

SEQ ID NO: 257631 - RNA, 15 nt, Homo sapiens
ucuaguuuugaagac

SEQ ID NO: 257632 - RNA, 22 nt, Homo sapiens
ucucaaccuccacacuacaaua

SEQ ID NO: 257633 - RNA, 22 nt, Homo sapiens
ucucaaguaacugggacaauaa

SEQ ID NO: 257634 - RNA, 22 nt, Homo sapiens
ucucacagccauuucucccucu

SEQ ID NO: 257635 - RNA, 22 nt, Homo sapiens
ucuccaguuuccuucgucuauc

SEQ ID NO: 257636 - RNA, 20 nt, Homo sapiens
ucucccaaacagcaggcccu

SEQ ID NO: 257637 - RNA, 17 nt, Homo sapiens
ucucccaucccuuucuc

SEQ ID NO: 257638 - RNA, 22 nt, Homo sapiens
ucucugauuaaacaagauagug

SEQ ID NO: 257639 - RNA, 19 nt, Homo sapiens
ucucugguguuggagggga

SEQ ID NO: 257640 - RNA, 22 nt, Homo sapiens
ucugacucugugaugggcccaa

SEQ ID NO: 257641 - RNA, 23 nt, Homo sapiens
ucuggaucauucguagugccagc

SEQ ID NO: 257642 - RNA, 22 nt, Homo sapiens
ucuggcaagagccgagggcagu

SEQ ID NO: 257643 - RNA, 22 nt, Homo sapiens
ucuggccccucccaaaucucau

SEQ ID NO: 257644 - RNA, 20 nt, Homo sapiens
ucuggccccucuaaaucuca

SEQ ID NO: 257645 - RNA, 22 nt, Homo sapiens
ucuggccuacaaguaauuuuau

SEQ ID NO: 257646 - RNA, 22 nt, Homo sapiens
ucuggccuccuaugagaaucga

SEQ ID NO: 257647 - RNA, 22 nt, Homo sapiens
ucuggcuuugugaguugccaga

SEQ ID NO: 257648 - RNA, 22 nt, Homo sapiens
ucugggguuuccacuuuuacuu

SEQ ID NO: 257649 - RNA, 22 nt, Homo sapiens
ucuggguuuuguaccgugcucg

SEQ ID NO: 257650 - RNA, 22 nt, Homo sapiens
ucugucuugugguuugagugcc

SEQ ID NO: 257651 - RNA, 22 nt, Homo sapiens
ucugugaaugaacacuugaaaa

SEQ ID NO: 257652 - RNA, 22 nt, Homo sapiens
ucugugaaugugaccuuauuug

SEQ ID NO: 257653 - RNA, 22 nt, Homo sapiens
ucugugcauuacacuuuucuca

SEQ ID NO: 257654 - RNA, 22 nt, Homo sapiens
ucugugcggucuguguuaugaa

SEQ ID NO: 257655 - RNA, 22 nt, Homo sapiens
ucugugcuugucauaugcuuug

SEQ ID NO: 257656 - RNA, 18 nt, Homo sapiens
ucugugguguaaauacgu

SEQ ID NO: 257657 - RNA, 22 nt, Homo sapiens
ucugugguucuagcuacuuugg

SEQ ID NO: 257658 - RNA, 22 nt, Homo sapiens
ucuguugguucuuugaggagga

SEQ ID NO: 257659 - RNA, 22 nt, Homo sapiens
ucuuggcaaagaauuuuuggcu

SEQ ID NO: 257660 - RNA, 22 nt, Homo sapiens
ucuuggccaugaauggcaaggc

SEQ ID NO: 257661 - RNA, 22 nt, Homo sapiens
ucuuggguggauucauucuuuc

SEQ ID NO: 257662 - RNA, 23 nt, Homo sapiens
ucuuguacuuugagugagcaugg

SEQ ID NO: 257663 - RNA, 22 nt, Homo sapiens
ucuuuaguaauuucuguaaggc

SEQ ID NO: 257664 - RNA, 22 nt, Homo sapiens
ucuuugaguggagcgaggcaga

SEQ ID NO: 257665 - RNA, 22 nt, Homo sapiens
ucuuuguuggaguccaaggaua

SEQ ID NO: 257666 - RNA, 22 nt, Homo sapiens
ucuuuuugagucaguuucggua

SEQ ID NO: 257667 - RNA, 22 nt, Homo sapiens
ugaaacacacagagaagggaga

SEQ ID NO: 257668 - RNA, 22 nt, Homo sapiens
ugaaacacaccuccucuccauc

SEQ ID NO: 257669 - RNA, 20 nt, Homo sapiens
ugaaacacauggacuggggu

SEQ ID NO: 257670 - RNA, 22 nt, Homo sapiens
ugaaauacuuaauuucuccaug

SEQ ID NO: 257671 - RNA, 22 nt, Homo sapiens
ugaaaugauuauaugguguuug

SEQ ID NO: 257672 - RNA, 22 nt, Homo sapiens
ugaaauguugggugauggaauc

SEQ ID NO: 257673 - RNA, 21 nt, Homo sapiens
ugaaguagcauaggaugucaa

SEQ ID NO: 257674 - RNA, 22 nt, Homo sapiens
ugaagugcugugggccaggcgu

SEQ ID NO: 257675 - RNA, 21 nt, Homo sapiens
ugaaguguaaccgugcagggc

SEQ ID NO: 257676 - RNA, 22 nt, Homo sapiens
ugaauguacacgcguacuuguu

SEQ ID NO: 257677 - RNA, 22 nt, Homo sapiens
ugaauugucucucacuggguuc

SEQ ID NO: 257678 - RNA, 22 nt, Homo sapiens
ugacaaguaaacagucagcacc

SEQ ID NO: 257679 - RNA, 22 nt, Homo sapiens
ugacaagugauuaaggcauauu

SEQ ID NO: 257680 - RNA, 22 nt, Homo sapiens
ugacacagcaagauggaaccau

SEQ ID NO: 257681 - RNA, 22 nt, Homo sapiens
ugacacuugcccuuagaaacau

SEQ ID NO: 257682 - RNA, 17 nt, Homo sapiens
ugacagaaacuuguugu

SEQ ID NO: 257683 - RNA, 18 nt, Homo sapiens
ugacaguuucuuuauauu

SEQ ID NO: 257684 - RNA, 22 nt, Homo sapiens
ugacccuguggcagcgucuaag

SEQ ID NO: 257685 - RNA, 22 nt, Homo sapiens
ugacuacauaaguaaucucaaa

SEQ ID NO: 257686 - RNA, 22 nt, Homo sapiens
ugacuucauuuuuggccaugag

SEQ ID NO: 257687 - RNA, 22 nt, Homo sapiens
ugacuugauacauguuuuugaa

SEQ ID NO: 257688 - RNA, 22 nt, Homo sapiens
ugagaacauuccucuuccuggc

SEQ ID NO: 257689 - RNA, 22 nt, Homo sapiens
ugagaacucaugaaucuuucca

SEQ ID NO: 257690 - RNA, 22 nt, Homo sapiens
augacaguaugacuccaaaagu

SEQ ID NO: 257691 - RNA, 22 nt, Homo sapiens
augacaguguggauuauuguaa

SEQ ID NO: 257692 - RNA, 22 nt, Homo sapiens
augacugucagggcagucauug

SEQ ID NO: 257693 - RNA, 22 nt, Homo sapiens
augacugucuugcagaggcuau

SEQ ID NO: 257694 - RNA, 22 nt, Homo sapiens
augagaauguaaguuaaugaaa

SEQ ID NO: 257695 - RNA, 22 nt, Homo sapiens
augagacuguucuuccucauug

SEQ ID NO: 257696 - RNA, 18 nt, Homo sapiens
augagagccgauuccugg

SEQ ID NO: 257697 - RNA, 22 nt, Homo sapiens
augagaucaaauuuaagcuguu

SEQ ID NO: 257698 - RNA, 22 nt, Homo sapiens
augagaucugugaacaccuguc

SEQ ID NO: 257699 - RNA, 22 nt, Homo sapiens
augagauuauguaaagagacca

SEQ ID NO: 257700 - RNA, 22 nt, Homo sapiens
augagauuguuugugugaaaua

SEQ ID NO: 257701 - RNA, 22 nt, Homo sapiens
augagcacuuguuuugggcaca

SEQ ID NO: 257702 - RNA, 22 nt, Homo sapiens
augaggaagucaggcccagggg

SEQ ID NO: 257703 - RNA, 22 nt, Homo sapiens
augaggagguaugauuuucuga

SEQ ID NO: 257704 - RNA, 22 nt, Homo sapiens
augaggugauaucuggaaauua

SEQ ID NO: 257705 - RNA, 22 nt, Homo sapiens
augaguaugagaauacauuaag

SEQ ID NO: 257706 - RNA, 22 nt, Homo sapiens
augauacuggcuucauagaaug

SEQ ID NO: 257707 - RNA, 22 nt, Homo sapiens
augauauggguugucaguugua

SEQ ID NO: 257708 - RNA, 22 nt, Homo sapiens
augaucaucugaaagcuuuuac

SEQ ID NO: 257709 - RNA, 22 nt, Homo sapiens
augauucugaucuagagcuugg

SEQ ID NO: 257710 - RNA, 22 nt, Homo sapiens
augcacuguuuucuugaugaga

SEQ ID NO: 257711 - RNA, 22 nt, Homo sapiens
augcagaucacauuuuucuguc

SEQ ID NO: 257712 - RNA, 22 nt, Homo sapiens
augcauggcagagucaggguac

SEQ ID NO: 257713 - RNA, 22 nt, Homo sapiens
augccaagaugagcacgcgucu

SEQ ID NO: 257714 - RNA, 19 nt, Homo sapiens
augccucaguuuuguacuu

SEQ ID NO: 257715 - RNA, 22 nt, Homo sapiens
augcuggugguucacaugcgca

SEQ ID NO: 257716 - RNA, 21 nt, Homo sapiens
auggaaagacugccucuucaa

SEQ ID NO: 257717 - RNA, 22 nt, Homo sapiens
auggagguguggggagugaguu

SEQ ID NO: 257718 - RNA, 22 nt, Homo sapiens
auggagugagaauggagguucc

SEQ ID NO: 257719 - RNA, 22 nt, Homo sapiens
auggaucauauucuugaggagg

SEQ ID NO: 257720 - RNA, 22 nt, Homo sapiens
auggcaaaaaaugcaauuacuu

SEQ ID NO: 257721 - RNA, 22 nt, Homo sapiens
auggcaaaauguuccuaguggu

SEQ ID NO: 257722 - RNA, 22 nt, Homo sapiens
auggcacuaaguucaacacuua

SEQ ID NO: 257723 - RNA, 18 nt, Homo sapiens
auggcagaacaauuuaca

SEQ ID NO: 257724 - RNA, 22 nt, Homo sapiens
auggcagcaccccacucuacug

SEQ ID NO: 257725 - RNA, 22 nt, Homo sapiens
auggcagugagucucuaguauu

SEQ ID NO: 257726 - RNA, 22 nt, Homo sapiens
auggcccccuguuugugaacau

SEQ ID NO: 257727 - RNA, 22 nt, Homo sapiens
auggcccuguguggagcugcug

SEQ ID NO: 257728 - RNA, 22 nt, Homo sapiens
auggcuuguuaugcauuaguac

SEQ ID NO: 257729 - RNA, 22 nt, Homo sapiens
auggcuuuugaccugguaggau

SEQ ID NO: 257730 - RNA, 22 nt, Homo sapiens
auggcuuuuuucuugggcacuc

SEQ ID NO: 257731 - RNA, 22 nt, Homo sapiens
augggguaggcuuugcugcagu

SEQ ID NO: 257732 - RNA, 22 nt, Homo sapiens
augguauuuaacagucuuucua

SEQ ID NO: 257733 - RNA, 22 nt, Homo sapiens
auggucccuguuccaugcuccu

SEQ ID NO: 257734 - RNA, 22 nt, Homo sapiens
auguaacaguauuuggagaugu

SEQ ID NO: 257735 - RNA, 22 nt, Homo sapiens
auguaacuaucugagccauggg

SEQ ID NO: 257736 - RNA, 22 nt, Homo sapiens
augucaacauagacaguagagu

SEQ ID NO: 257737 - RNA, 22 nt, Homo sapiens
augucacugcacuccugccugg

SEQ ID NO: 257738 - RNA, 22 nt, Homo sapiens
augugacagcaacccccagccc

SEQ ID NO: 257739 - RNA, 22 nt, Homo sapiens
augugcaauguguacguagccc

SEQ ID NO: 257740 - RNA, 22 nt, Homo sapiens
augugcacauucugguaaauau

SEQ ID NO: 257741 - RNA, 21 nt, Homo sapiens
augugcacuaugucauuuaau

SEQ ID NO: 257742 - RNA, 22 nt, Homo sapiens
augugggaggacuuggcuguug

SEQ ID NO: 257743 - RNA, 22 nt, Homo sapiens
augugugcuugauguaaaaagu

SEQ ID NO: 257744 - RNA, 20 nt, Homo sapiens
auguucuggaggacagaagc

SEQ ID NO: 257745 - RNA, 22 nt, Homo sapiens
auguugcuugaaggcauuuugu

SEQ ID NO: 257746 - RNA, 22 nt, Homo sapiens
auuaaguuaggauuuugagaua

SEQ ID NO: 257747 - RNA, 22 nt, Homo sapiens
auuacuuugcaccaaccuaaua

SEQ ID NO: 257748 - RNA, 20 nt, Homo sapiens
auucauggaggagcaauugg

SEQ ID NO: 257749 - RNA, 22 nt, Homo sapiens
auuccagguggcgccauucaca

SEQ ID NO: 257750 - RNA, 22 nt, Homo sapiens
auuccauuuguuaucacacccg

SEQ ID NO: 257751 - RNA, 22 nt, Homo sapiens
auuccuuaggcccuuugguuag

SEQ ID NO: 257752 - RNA, 22 nt, Homo sapiens
auugaacuguuggagagguuuu

SEQ ID NO: 257753 - RNA, 22 nt, Homo sapiens
auugagcaaggucuccuaguau

SEQ ID NO: 257754 - RNA, 22 nt, Homo sapiens
auugaggcaggaggaccaucua

SEQ ID NO: 257755 - RNA, 22 nt, Homo sapiens
auugcaacuuccgccuccuggg

SEQ ID NO: 257756 - RNA, 22 nt, Homo sapiens
auugcauugugaucuucccaga

SEQ ID NO: 257757 - RNA, 22 nt, Homo sapiens
auugcuauuauuugaccauugu

SEQ ID NO: 257758 - RNA, 22 nt, Homo sapiens
auuggcaagauagcauaugagg

SEQ ID NO: 257759 - RNA, 22 nt, Homo sapiens
auuguacuccagccugggugac

SEQ ID NO: 257760 - RNA, 22 nt, Homo sapiens
auuguacuuaagccugggugaa

SEQ ID NO: 257761 - RNA, 21 nt, Homo sapiens
auuguauguaaaccaaaugag

SEQ ID NO: 257762 - RNA, 22 nt, Homo sapiens
auuuggcaacguagggaggcau

SEQ ID NO: 257763 - RNA, 22 nt, Homo sapiens
auuuggcaauuuugaagaugcc

SEQ ID NO: 257764 - RNA, 22 nt, Homo sapiens
auuugguguuguuuggagccua

SEQ ID NO: 257765 - RNA, 22 nt, Homo sapiens
auuugucaauacacuucuucca

SEQ ID NO: 257766 - RNA, 22 nt, Homo sapiens
auuugucacuauguggcuaaua

SEQ ID NO: 257767 - RNA, 21 nt, Homo sapiens
auuuuugcagagcugguagug

SEQ ID NO: 257768 - RNA, 22 nt, Homo sapiens
auuuuugguugucagcacuagg

SEQ ID NO: 257769 - RNA, 22 nt, Homo sapiens
caaagucuauucuacccuuacc

SEQ ID NO: 257770 - RNA, 22 nt, Homo sapiens
caaagugcuggccgggcgcagu

SEQ ID NO: 257771 - RNA, 22 nt, Homo sapiens
caaauccucaccucaucaugaa

SEQ ID NO: 257772 - RNA, 19 nt, Homo sapiens
caacccugcagagaaagga

SEQ ID NO: 257773 - RNA, 22 nt, Homo sapiens
caagagaccugagugucauucu

SEQ ID NO: 257774 - RNA, 22 nt, Homo sapiens
caaggugcugagacaggagccc

SEQ ID NO: 257775 - RNA, 22 nt, Homo sapiens
caagugcuugaugaaugaucaa

SEQ ID NO: 257776 - RNA, 22 nt, Homo sapiens
caaguguuggcuuguauacaaa

SEQ ID NO: 257777 - RNA, 22 nt, Homo sapiens
caaucugucuuuuagggggcca

SEQ ID NO: 257778 - RNA, 22 nt, Homo sapiens
caauggcacgaucucgucucac

SEQ ID NO: 257779 - RNA, 22 nt, Homo sapiens
cacaggucauccuggaucaagg

SEQ ID NO: 257780 - RNA, 22 nt, Homo sapiens
cacagucugggcuuguuuguac

SEQ ID NO: 257781 - RNA, 22 nt, Homo sapiens
uggagggcuagucauuucuuuu

SEQ ID NO: 257782 - RNA, 22 nt, Homo sapiens
uggagucuugaugauuuucaaa

SEQ ID NO: 257783 - RNA, 22 nt, Homo sapiens
uggagugcgagggugaaacuuu

SEQ ID NO: 257784 - RNA, 22 nt, Homo sapiens
uggagugcgugucugaguuuuu

SEQ ID NO: 257785 - RNA, 20 nt, Homo sapiens
uggagugcuguguugagaag

SEQ ID NO: 257786 - RNA, 22 nt, Homo sapiens
uggaguguaaauuaguucagcc

SEQ ID NO: 257787 - RNA, 22 nt, Homo sapiens
uggaguguaauuagccaucagu

SEQ ID NO: 257788 - RNA, 20 nt, Homo sapiens
uggaguuugaguucuuggag

SEQ ID NO: 257789 - RNA, 22 nt, Homo sapiens
uggcaaaauggaauauguuggg

SEQ ID NO: 257790 - RNA, 22 nt, Homo sapiens
uggcaaagugugacgugggggu

SEQ ID NO: 257791 - RNA, 22 nt, Homo sapiens
uggcaaauagcaauaggagggu

SEQ ID NO: 257792 - RNA, 22 nt, Homo sapiens
uggcaagaaccacaguuacuuu

SEQ ID NO: 257793 - RNA, 22 nt, Homo sapiens
uggcaagaacugcaauugcuuu

SEQ ID NO: 257794 - RNA, 22 nt, Homo sapiens
uggcaagaagagcaugagacca

SEQ ID NO: 257795 - RNA, 22 nt, Homo sapiens
uggcaagagaacaacaucucuc

SEQ ID NO: 257796 - RNA, 18 nt, Homo sapiens
uggcaauaugguucuacc

SEQ ID NO: 257797 - RNA, 22 nt, Homo sapiens
uggcaccauccaggugucucua

SEQ ID NO: 257798 - RNA, 22 nt, Homo sapiens
uggcagacaaauuugagcauau

SEQ ID NO: 257799 - RNA, 22 nt, Homo sapiens
uggcagcugcuucaugggaugc

SEQ ID NO: 257800 - RNA, 22 nt, Homo sapiens
uggcaucuguucuacacauaaa

SEQ ID NO: 257801 - RNA, 22 nt, Homo sapiens
uggcauggaacuacuuugaaac

SEQ ID NO: 257802 - RNA, 22 nt, Homo sapiens
uggcauguaaugcagaaguugc

SEQ ID NO: 257803 - RNA, 22 nt, Homo sapiens
uggcauguguuugaaugaguau

SEQ ID NO: 257804 - RNA, 22 nt, Homo sapiens
uggccuguaacgcugucucagc

SEQ ID NO: 257805 - RNA, 22 nt, Homo sapiens
uggcuaagaugcacacuucacu

SEQ ID NO: 257806 - RNA, 23 nt, Homo sapiens
uggcuagacguccuuuccugaug

SEQ ID NO: 257807 - RNA, 19 nt, Homo sapiens
uggcuagagcagauauccu

SEQ ID NO: 257808 - RNA, 20 nt, Homo sapiens
ugggaaauguccaggacaua

SEQ ID NO: 257809 - RNA, 22 nt, Homo sapiens
ugggaagaugcugcuucuuccu

SEQ ID NO: 257810 - RNA, 22 nt, Homo sapiens
ugggaagauucuguguuuuucc

SEQ ID NO: 257811 - RNA, 22 nt, Homo sapiens
ugggaccccuacucuuuccaca

SEQ ID NO: 257812 - RNA, 22 nt, Homo sapiens
ugggagacuacauuuuuaacaa

SEQ ID NO: 257813 - RNA, 22 nt, Homo sapiens
ugggagcauugcauuagaagcc

SEQ ID NO: 257814 - RNA, 22 nt, Homo sapiens
ugggauauaaaaaacgcuauuc

SEQ ID NO: 257815 - RNA, 22 nt, Homo sapiens
ugggaucauuaugcauagugua

SEQ ID NO: 257816 - RNA, 22 nt, Homo sapiens
ugggaugaugaaaaggcuuucu

SEQ ID NO: 257817 - RNA, 21 nt, Homo sapiens
ugggccccuuccuuacaucau

SEQ ID NO: 257818 - RNA, 22 nt, Homo sapiens
ugggccgcugcaggaugguccc

SEQ ID NO: 257819 - RNA, 22 nt, Homo sapiens
ugggguaggcuguauacucugu

SEQ ID NO: 257820 - RNA, 22 nt, Homo sapiens
uggguaggcccucauuggacag

SEQ ID NO: 257821 - RNA, 22 nt, Homo sapiens
uggguaguguaaagcacuccag

SEQ ID NO: 257822 - RNA, 21 nt, Homo sapiens
uggguaguuuucaaggccccg

SEQ ID NO: 257823 - RNA, 22 nt, Homo sapiens
ugggugaguaucuauuauucag

SEQ ID NO: 257824 - RNA, 22 nt, Homo sapiens
ugguauguaugauuaacaugga

SEQ ID NO: 257825 - RNA, 22 nt, Homo sapiens
ugguauuuaauauaugagaguu

SEQ ID NO: 257826 - RNA, 21 nt, Homo sapiens
uggucaguuuucucacuagga

SEQ ID NO: 257827 - RNA, 17 nt, Homo sapiens
uggugcuugaaaguugc

SEQ ID NO: 257828 - RNA, 20 nt, Homo sapiens
uguaaaggagauugcagcug

SEQ ID NO: 257829 - RNA, 22 nt, Homo sapiens
uguaaaucuuucacaguugaug

SEQ ID NO: 257830 - RNA, 22 nt, Homo sapiens
uguauacauauguauguuuugu

SEQ ID NO: 257831 - RNA, 22 nt, Homo sapiens
uguauacugucuaauauguugu

SEQ ID NO: 257832 - RNA, 22 nt, Homo sapiens
uguaugucugcucuuuggaacu

SEQ ID NO: 257833 - RNA, 22 nt, Homo sapiens
ugucaaagagacaucugcacuc

SEQ ID NO: 257834 - RNA, 22 nt, Homo sapiens
ugucaaaugcagugauauuuga

SEQ ID NO: 257835 - RNA, 22 nt, Homo sapiens
ugucaaauucuggguuaaaaca

SEQ ID NO: 257836 - RNA, 22 nt, Homo sapiens
ugucaagaugguuugauguugu

SEQ ID NO: 257837 - RNA, 22 nt, Homo sapiens
ugucacaguuuguacuuuauag

SEQ ID NO: 257838 - RNA, 22 nt, Homo sapiens
ugucacccuuuauccauuuccu

SEQ ID NO: 257839 - RNA, 22 nt, Homo sapiens
ugucacuuugccuucuggacuu

SEQ ID NO: 257840 - RNA, 22 nt, Homo sapiens
ugucagaaucuagaggcugcua

SEQ ID NO: 257841 - RNA, 22 nt, Homo sapiens
ugucaugguagcaaggacgagg

SEQ ID NO: 257842 - RNA, 22 nt, Homo sapiens
ugucauguaaagaguaaauggu

SEQ ID NO: 257843 - RNA, 22 nt, Homo sapiens
uguccuggugaugcccaaauuc

SEQ ID NO: 257844 - RNA, 22 nt, Homo sapiens
ugugaaacauggauagaacugg

SEQ ID NO: 257845 - RNA, 22 nt, Homo sapiens
ugugaacauuuuguauauauua

SEQ ID NO: 257846 - RNA, 22 nt, Homo sapiens
ugugaauggugcuuccuagaug

SEQ ID NO: 257847 - RNA, 22 nt, Homo sapiens
ugugacagcacgguucaacugc

SEQ ID NO: 257848 - RNA, 22 nt, Homo sapiens
ugugaccaaaaucaacauaccu

SEQ ID NO: 257849 - RNA, 22 nt, Homo sapiens
ugugacuaguggugaaugacgc

SEQ ID NO: 257850 - RNA, 19 nt, Homo sapiens
ugugagcauuagcauuuag

SEQ ID NO: 257851 - RNA, 22 nt, Homo sapiens
ugugcaaauguuaaacuaacuu

SEQ ID NO: 257852 - RNA, 22 nt, Homo sapiens
ugugcaccucuucacacaggga

SEQ ID NO: 257853 - RNA, 22 nt, Homo sapiens
ugugccacuccaggaggcuguu

SEQ ID NO: 257854 - RNA, 22 nt, Homo sapiens
uguggcaaagucuugugaauau

SEQ ID NO: 257855 - RNA, 22 nt, Homo sapiens
uguggcaaauggucaggaagaa

SEQ ID NO: 257856 - RNA, 22 nt, Homo sapiens
uguggcauuuucagaaaggaug

SEQ ID NO: 257857 - RNA, 18 nt, Homo sapiens
uguggcuguuuuccaaua

SEQ ID NO: 257858 - RNA, 22 nt, Homo sapiens
uguggcuuuuucuuggcugagg

SEQ ID NO: 257859 - RNA, 19 nt, Homo sapiens
uguggucauccugggacga

SEQ ID NO: 257860 - RNA, 22 nt, Homo sapiens
ugugguuuuuuucuccaauagg

SEQ ID NO: 257861 - RNA, 22 nt, Homo sapiens
uggagucuugcucuguugccca

SEQ ID NO: 257862 - RNA, 20 nt, Homo sapiens
uggagugaagguucuggacc

SEQ ID NO: 257863 - RNA, 21 nt, Homo sapiens
uggagugcaacacuagguaua

SEQ ID NO: 257864 - RNA, 22 nt, Homo sapiens
uggaguguagaagccagccucc

SEQ ID NO: 257865 - RNA, 22 nt, Homo sapiens
uggaguguagcggcaccuauua

SEQ ID NO: 257866 - RNA, 22 nt, Homo sapiens
uggaguguguuaacuuuacaag

SEQ ID NO: 257867 - RNA, 18 nt, Homo sapiens
uggauuggaaaaguuccu

SEQ ID NO: 257868 - RNA, 22 nt, Homo sapiens
uggauuuuaauuauucugucau

SEQ ID NO: 257869 - RNA, 22 nt, Homo sapiens
uggcaaauauuuuguuuuguaa

SEQ ID NO: 257870 - RNA, 22 nt, Homo sapiens
uggcaagagcugcauucaucug

SEQ ID NO: 257871 - RNA, 23 nt, Homo sapiens
uggcaagauuuguauugccugga

SEQ ID NO: 257872 - RNA, 22 nt, Homo sapiens
uggcaaguuucaauccgaggga

SEQ ID NO: 257873 - RNA, 22 nt, Homo sapiens
uggcaccugacuccgagaugca

SEQ ID NO: 257874 - RNA, 22 nt, Homo sapiens
uggcagauggugacaccauuag

SEQ ID NO: 257875 - RNA, 22 nt, Homo sapiens
uggcaguuuuugccuucaauac

SEQ ID NO: 257876 - RNA, 22 nt, Homo sapiens
uggcauggggcagaacauuaca

SEQ ID NO: 257877 - RNA, 22 nt, Homo sapiens
uggcaugugugaagugcccagc

SEQ ID NO: 257878 - RNA, 22 nt, Homo sapiens
uggcauuuugugugaauuagaa

SEQ ID NO: 257879 - RNA, 23 nt, Homo sapiens
uggcauuuuuggcaaugccuucu

SEQ ID NO: 257880 - RNA, 22 nt, Homo sapiens
uggcuacuguacuugagcuauu

SEQ ID NO: 257881 - RNA, 20 nt, Homo sapiens
uggcucuuugcugcuaaagu

SEQ ID NO: 257882 - RNA, 22 nt, Homo sapiens
uggcuguuguuacuaacaguuc

SEQ ID NO: 257883 - RNA, 20 nt, Homo sapiens
uggcuucuuaauugcaggca

SEQ ID NO: 257884 - RNA, 22 nt, Homo sapiens
uggcuuuuauuauguugaggua

SEQ ID NO: 257885 - RNA, 22 nt, Homo sapiens
ugggaagaagguuuacuugcca

SEQ ID NO: 257886 - RNA, 22 nt, Homo sapiens
ugggaucuuuccuauuagcgag

SEQ ID NO: 257887 - RNA, 22 nt, Homo sapiens
ugggaugugagucuucgcuuuc

SEQ ID NO: 257888 - RNA, 22 nt, Homo sapiens
ugggcaaaacuaagagcugugg

SEQ ID NO: 257889 - RNA, 22 nt, Homo sapiens
uggguagauaucauaguugccc

SEQ ID NO: 257890 - RNA, 22 nt, Homo sapiens
uggguccccuacucuuuccaca

SEQ ID NO: 257891 - RNA, 22 nt, Homo sapiens
ugggugugaccgcucaaggggg

SEQ ID NO: 257892 - RNA, 22 nt, Homo sapiens
ugguaaaaugucauuuaccaga

SEQ ID NO: 257893 - RNA, 22 nt, Homo sapiens
ugguacuucaugcucacagaua

SEQ ID NO: 257894 - RNA, 22 nt, Homo sapiens
ugguauguuuauaaguauagga

SEQ ID NO: 257895 - RNA, 22 nt, Homo sapiens
uggucccaugaacuuuagguca

SEQ ID NO: 257896 - RNA, 21 nt, Homo sapiens
uggucccuucagaucggauuu

SEQ ID NO: 257897 - RNA, 22 nt, Homo sapiens
uggugagaaacuagauauuuuu

SEQ ID NO: 257898 - RNA, 20 nt, Homo sapiens
ugguguuugaacagugaaug

SEQ ID NO: 257899 - RNA, 22 nt, Homo sapiens
ugguucaguugcacaggcuguu

SEQ ID NO: 257900 - RNA, 23 nt, Homo sapiens
ugguuuguaagagauggacugga

SEQ ID NO: 257901 - RNA, 18 nt, Homo sapiens
uguaaacuaccucaaccu

SEQ ID NO: 257902 - RNA, 22 nt, Homo sapiens
uguaacaggaggaaaaugugaa

SEQ ID NO: 257903 - RNA, 22 nt, Homo sapiens
uguaacaguaguuacuauucuu

SEQ ID NO: 257904 - RNA, 20 nt, Homo sapiens
uguaaucuaaguuuuaagcc

SEQ ID NO: 257905 - RNA, 22 nt, Homo sapiens
uguaaugaucaaaucagaguaa

SEQ ID NO: 257906 - RNA, 22 nt, Homo sapiens
uguagggagagggaguugcacc

SEQ ID NO: 257907 - RNA, 22 nt, Homo sapiens
uguaugcuuuugagagauauuu

SEQ ID NO: 257908 - RNA, 22 nt, Homo sapiens
uguauuuguuguuaaauggaga

SEQ ID NO: 257909 - RNA, 19 nt, Homo sapiens
ugucaaaugucuccugggg

SEQ ID NO: 257910 - RNA, 21 nt, Homo sapiens
ugucaagugggaaaacaugua

SEQ ID NO: 257911 - RNA, 22 nt, Homo sapiens
ugucaccuugcucauccucgga

SEQ ID NO: 257912 - RNA, 22 nt, Homo sapiens
ugucacugugaguuugacugcu

SEQ ID NO: 257913 - RNA, 22 nt, Homo sapiens
ugucaguggacugugaaaggca

SEQ ID NO: 257914 - RNA, 22 nt, Homo sapiens
ugucaguguaugagccccggau

SEQ ID NO: 257915 - RNA, 22 nt, Homo sapiens
ugucaguuuuaacuagggaaua

SEQ ID NO: 257916 - RNA, 19 nt, Homo sapiens
ugucaucaucuuuucuugc

SEQ ID NO: 257917 - RNA, 22 nt, Homo sapiens
ugucauguugguguacugcacc

SEQ ID NO: 257918 - RNA, 22 nt, Homo sapiens
ugucuaaagaauggcagacuca

SEQ ID NO: 257919 - RNA, 22 nt, Homo sapiens
ugucucagugauuggcuuucug

SEQ ID NO: 257920 - RNA, 22 nt, Homo sapiens
ugucuugagagaggacaugacu

SEQ ID NO: 257921 - RNA, 22 nt, Homo sapiens
ugucuuggagaauccuggguuu

SEQ ID NO: 257922 - RNA, 22 nt, Homo sapiens
ugugaacagaauuagucaccua

SEQ ID NO: 257923 - RNA, 22 nt, Homo sapiens
ugugacacugaauggcagaacu

SEQ ID NO: 257924 - RNA, 22 nt, Homo sapiens
ugugacagcacagcaucucuuu

SEQ ID NO: 257925 - RNA, 22 nt, Homo sapiens
ugugaguguguacuaguuauca

SEQ ID NO: 257926 - RNA, 22 nt, Homo sapiens
ugugaucaaccugcagggcugg

SEQ ID NO: 257927 - RNA, 22 nt, Homo sapiens
ugugauguggagggcagaucca

SEQ ID NO: 257928 - RNA, 20 nt, Homo sapiens
ugugauuauuuaguugcaug

SEQ ID NO: 257929 - RNA, 22 nt, Homo sapiens
ugugauuauuuauagacaguca

SEQ ID NO: 257930 - RNA, 22 nt, Homo sapiens
ugugcaaucagcuucauuacau

SEQ ID NO: 257931 - RNA, 22 nt, Homo sapiens
ugugcaguuuuagcguauuuua

SEQ ID NO: 257932 - RNA, 22 nt, Homo sapiens
ugugccaaucauagggcuuggu

SEQ ID NO: 257933 - RNA, 22 nt, Homo sapiens
ugugccacuccaaccuggguga

SEQ ID NO: 257934 - RNA, 22 nt, Homo sapiens
ugugccacugcacucuggccug

SEQ ID NO: 257935 - RNA, 22 nt, Homo sapiens
ugugccacuguucuguaaagug

SEQ ID NO: 257936 - RNA, 22 nt, Homo sapiens
uguggaaauggugcuacgaaca

SEQ ID NO: 257937 - RNA, 22 nt, Homo sapiens
uguggcacuguguccagagaaa

SEQ ID NO: 257938 - RNA, 22 nt, Homo sapiens
uguggcauugaauaaccuugga

SEQ ID NO: 257939 - RNA, 22 nt, Homo sapiens
ugugguuuuaguaaaacuaugu

SEQ ID NO: 257940 - RNA, 22 nt, Homo sapiens
uguguaaauaugauagaggaau

SEQ ID NO: 257941 - RNA, 22 nt, Homo sapiens
uguguaauaccuuugacuauau

SEQ ID NO: 257942 - RNA, 22 nt, Homo sapiens
uguguuuuuauguaaaauggaa

SEQ ID NO: 257943 - RNA, 22 nt, Homo sapiens
uguuacagugacuaauguuuua

SEQ ID NO: 257944 - RNA, 22 nt, Homo sapiens
uguuacaguguaggccuugggu

SEQ ID NO: 257945 - RNA, 22 nt, Homo sapiens
uguuauugagguuacuuauaag

SEQ ID NO: 257946 - RNA, 22 nt, Homo sapiens
uguuugguggucucuucacaug

SEQ ID NO: 257947 - RNA, 21 nt, Homo sapiens
uguuuuugcuguguaucucuc

SEQ ID NO: 257948 - RNA, 22 nt, Homo sapiens
uuaaaggcaugguuagacaugg

SEQ ID NO: 257949 - RNA, 22 nt, Homo sapiens
uuaaaguaauugaaauggccuu

SEQ ID NO: 257950 - RNA, 22 nt, Homo sapiens
uuaaagugaucauaaggauagu

SEQ ID NO: 257951 - RNA, 22 nt, Homo sapiens
uuaaagugcacacgggucaggc

SEQ ID NO: 257952 - RNA, 22 nt, Homo sapiens
uaguucauuuuucuugcuuaga

SEQ ID NO: 257953 - RNA, 22 nt, Homo sapiens
uauaacacccacauauagucuu

SEQ ID NO: 257954 - RNA, 22 nt, Homo sapiens
uauaaccauuucuucucucuuc

SEQ ID NO: 257955 - RNA, 22 nt, Homo sapiens
uauaaugcacauucccaaaucu

SEQ ID NO: 257956 - RNA, 22 nt, Homo sapiens
uauacaguaggcacucaguggc

SEQ ID NO: 257957 - RNA, 20 nt, Homo sapiens
uauagcaauuuuuuucuccu

SEQ ID NO: 257958 - RNA, 22 nt, Homo sapiens
uauaugcuaaacaagggguggg

SEQ ID NO: 257959 - RNA, 22 nt, Homo sapiens
uauauguucugugucccuuucg

SEQ ID NO: 257960 - RNA, 22 nt, Homo sapiens
uaucaaggccacucauuuuaug

SEQ ID NO: 257961 - RNA, 23 nt, Homo sapiens
uaucacacuuucucugugccaca

SEQ ID NO: 257962 - RNA, 20 nt, Homo sapiens
uaucacaggucagaaacccu

SEQ ID NO: 257963 - RNA, 22 nt, Homo sapiens
uaucaccauguccguuuuaaaa

SEQ ID NO: 257964 - RNA, 19 nt, Homo sapiens
uaucacuucccuggaaaca

SEQ ID NO: 257965 - RNA, 22 nt, Homo sapiens
uaucacuuugauaguuuaaaug

SEQ ID NO: 257966 - RNA, 22 nt, Homo sapiens
uaucccuuagagcggggugguu

SEQ ID NO: 257967 - RNA, 23 nt, Homo sapiens
uaucccuugccuuaugaugugag

SEQ ID NO: 257968 - RNA, 22 nt, Homo sapiens
uaucucagaguguacaagauua

SEQ ID NO: 257969 - RNA, 20 nt, Homo sapiens
uaugaaacaguguagagcaa

SEQ ID NO: 257970 - RNA, 22 nt, Homo sapiens
uaugaccuuggacaaguuacuu

SEQ ID NO: 257971 - RNA, 22 nt, Homo sapiens
uaugaccuuguccccucucgcc

SEQ ID NO: 257972 - RNA, 22 nt, Homo sapiens
uaugacuguuugcucauucagg

SEQ ID NO: 257973 - RNA, 20 nt, Homo sapiens
uaugagacugggagaaguuc

SEQ ID NO: 257974 - RNA, 22 nt, Homo sapiens
uaugagacugugagugagaaau

SEQ ID NO: 257975 - RNA, 22 nt, Homo sapiens
uaugaucacuacagcagggaug

SEQ ID NO: 257976 - RNA, 23 nt, Homo sapiens
uaugccuguuucaaacaaacuuu

SEQ ID NO: 257977 - RNA, 22 nt, Homo sapiens
uauggcugcuuucacacuacaa

SEQ ID NO: 257978 - RNA, 22 nt, Homo sapiens
uauggcuucuuauucuuucccg

SEQ ID NO: 257979 - RNA, 22 nt, Homo sapiens
uauggcuucuuuaaauugaggu

SEQ ID NO: 257980 - RNA, 19 nt, Homo sapiens
uauguaguuuucucaauau

SEQ ID NO: 257981 - RNA, 22 nt, Homo sapiens
uauuacauccauaggcucugcu

SEQ ID NO: 257982 - RNA, 22 nt, Homo sapiens
uauucacaggugugggacaaag

SEQ ID NO: 257983 - RNA, 20 nt, Homo sapiens
uauucacucuccagucuugc

SEQ ID NO: 257984 - RNA, 18 nt, Homo sapiens
uauuccucuuccucuauc

SEQ ID NO: 257985 - RNA, 22 nt, Homo sapiens
uauugcuuuuaacccaaucucu

SEQ ID NO: 257986 - RNA, 22 nt, Homo sapiens
uauuguuaaagauguuaaugau

SEQ ID NO: 257987 - RNA, 22 nt, Homo sapiens
uauuucaguugcguuucccgag

SEQ ID NO: 257988 - RNA, 22 nt, Homo sapiens
uauuuggugaaugaaugcaugu

SEQ ID NO: 257989 - RNA, 22 nt, Homo sapiens
uauuugguuacuugaauagcua

SEQ ID NO: 257990 - RNA, 22 nt, Homo sapiens
uauuugguuauaugaguaaguu

SEQ ID NO: 257991 - RNA, 22 nt, Homo sapiens
ucaaacauccccaccagggacu

SEQ ID NO: 257992 - RNA, 22 nt, Homo sapiens
ucaaaguagaaaaggggcaauu

SEQ ID NO: 257993 - RNA, 22 nt, Homo sapiens
ucaaagucuucucaaguaacau

SEQ ID NO: 257994 - RNA, 22 nt, Homo sapiens
ucaaauguuuguuuaaggcuua

SEQ ID NO: 257995 - RNA, 22 nt, Homo sapiens
ucaacagugggcacuguaaaug

SEQ ID NO: 257996 - RNA, 22 nt, Homo sapiens
ucaacguauuuauauagcagag

SEQ ID NO: 257997 - RNA, 22 nt, Homo sapiens
ucaaguacuuauuugauaauua

SEQ ID NO: 257998 - RNA, 22 nt, Homo sapiens
ucacaagcuccugccuuugcuu

SEQ ID NO: 257999 - RNA, 22 nt, Homo sapiens
ucacacugaaacuaggguguga

SEQ ID NO: 258000 - RNA, 22 nt, Homo sapiens
ucacacugcaucuguuggaauu

SEQ ID NO: 258001 - RNA, 22 nt, Homo sapiens
ucacacugucuugguuacucuu

SEQ ID NO: 258002 - RNA, 18 nt, Homo sapiens
ucacagguaauuaggauu

SEQ ID NO: 258003 - RNA, 22 nt, Homo sapiens
ucacaguaacuuuguugcuuuu

SEQ ID NO: 258004 - RNA, 20 nt, Homo sapiens
ucacagucacacauaauccu

SEQ ID NO: 258005 - RNA, 22 nt, Homo sapiens
ucacaguguuaaaccuuucuuu

SEQ ID NO: 258006 - RNA, 23 nt, Homo sapiens
ucacaguuacuuuugcaucaacc

SEQ ID NO: 258007 - RNA, 22 nt, Homo sapiens
ucacauagcugaguaaaaugga

SEQ ID NO: 258008 - RNA, 22 nt, Homo sapiens
ucacaugugacauauauauuug

SEQ ID NO: 258009 - RNA, 22 nt, Homo sapiens
ucacauucaauuguaauccccg

SEQ ID NO: 258010 - RNA, 22 nt, Homo sapiens
ucacauuguacaaacagguaag

SEQ ID NO: 258011 - RNA, 22 nt, Homo sapiens
ucacauuguuauguaaauguuu

SEQ ID NO: 258012 - RNA, 20 nt, Homo sapiens
ucacccugacaucugcccag

SEQ ID NO: 258013 - RNA, 22 nt, Homo sapiens
ucaccggcagacguggccugau

SEQ ID NO: 258014 - RNA, 22 nt, Homo sapiens
ucaccuggagaagauggaucau

SEQ ID NO: 258015 - RNA, 18 nt, Homo sapiens
ucaccuugaugcuggguc

SEQ ID NO: 258016 - RNA, 22 nt, Homo sapiens
ucacugaaaccacugccuccug

SEQ ID NO: 258017 - RNA, 22 nt, Homo sapiens
ucacugaaacuguccuggguua

SEQ ID NO: 258018 - RNA, 22 nt, Homo sapiens
ucacugcacuccagccuuuaug

SEQ ID NO: 258019 - RNA, 22 nt, Homo sapiens
ucacuggcaaauauauccguug

SEQ ID NO: 258020 - RNA, 22 nt, Homo sapiens
ucacuggucuaaguggaggggg

SEQ ID NO: 258021 - RNA, 22 nt, Homo sapiens
ucacugugguuggaaggcuuaa

SEQ ID NO: 258022 - RNA, 18 nt, Homo sapiens
ucacugugugucuugggu

SEQ ID NO: 258023 - RNA, 22 nt, Homo sapiens
ucacuguugaugggcaugcagg

SEQ ID NO: 258024 - RNA, 22 nt, Homo sapiens
ucagaguagaaacacuuccaua

SEQ ID NO: 258025 - RNA, 22 nt, Homo sapiens
ucagagucuagaucacucacug

SEQ ID NO: 258026 - RNA, 22 nt, Homo sapiens
ucagaguggagucugcagccuu

SEQ ID NO: 258027 - RNA, 22 nt, Homo sapiens
ucagaugauucuguuguugugu

SEQ ID NO: 258028 - RNA, 22 nt, Homo sapiens
ucagcaaugcugcacucuacug

SEQ ID NO: 258029 - RNA, 22 nt, Homo sapiens
ucaggcuuuucccagagugaug

SEQ ID NO: 258030 - RNA, 21 nt, Homo sapiens
ucagggaccugcuguacugau

SEQ ID NO: 258031 - RNA, 23 nt, Homo sapiens
ucagguaggccuagaguauucuu

SEQ ID NO: 258032 - RNA, 22 nt, Homo sapiens
ucagguagugccaugauugauu

SEQ ID NO: 258033 - RNA, 22 nt, Homo sapiens
ucagguaucuucauagcaaugc

SEQ ID NO: 258034 - RNA, 22 nt, Homo sapiens
ucaguaccugagagugggcaga

SEQ ID NO: 258035 - RNA, 22 nt, Homo sapiens
ucaguacuuuggagcucacaua

SEQ ID NO: 258036 - RNA, 22 nt, Homo sapiens
ucaguagagacaggauuucacc

SEQ ID NO: 258037 - RNA, 20 nt, Homo sapiens
ucaguauauuguuuccacag

SEQ ID NO: 258038 - RNA, 22 nt, Homo sapiens
ucagucauucacucacucggac

SEQ ID NO: 258039 - RNA, 22 nt, Homo sapiens
ucagugacuggguauuaaauca

SEQ ID NO: 258040 - RNA, 21 nt, Homo sapiens
ucagugcaauucuauggggaa

SEQ ID NO: 258041 - RNA, 22 nt, Homo sapiens
ucagugcaggaaucucuagcca

SEQ ID NO: 258042 - RNA, 23 nt, Homo sapiens
ucaucacagcauuuccugguauu

SEQ ID NO: 258043 - RNA, 22 nt, Homo sapiens
aaacuugucuaauuauaagcau

SEQ ID NO: 258044 - RNA, 22 nt, Homo sapiens
aaagaagucagccuguccuuug

SEQ ID NO: 258045 - RNA, 22 nt, Homo sapiens
aaagagcugagaccugguggag

SEQ ID NO: 258046 - RNA, 22 nt, Homo sapiens
aaagcugucaaggcaggaggcu

SEQ ID NO: 258047 - RNA, 22 nt, Homo sapiens
aaagggcacugugcuuuggcaa

SEQ ID NO: 258048 - RNA, 22 nt, Homo sapiens
aaagggcuuuguaaacuucaag

SEQ ID NO: 258049 - RNA, 22 nt, Homo sapiens
aaaguaauugcaguuuuugcaa

SEQ ID NO: 258050 - RNA, 22 nt, Homo sapiens
aaagugauguccaggcuuucag

SEQ ID NO: 258051 - RNA, 22 nt, Homo sapiens
aaagugcaguauuugggcagaa

SEQ ID NO: 258052 - RNA, 22 nt, Homo sapiens
aaagugcaguauuugggcagga

SEQ ID NO: 258053 - RNA, 22 nt, Homo sapiens
aaagugcuaggauuaccugggg

SEQ ID NO: 258054 - RNA, 22 nt, Homo sapiens
aaagugcuuccuuuuugagggu

SEQ ID NO: 258055 - RNA, 22 nt, Homo sapiens
aaaguguguuuccaaccugugg

SEQ ID NO: 258056 - RNA, 22 nt, Homo sapiens
aaauccauuuguucagcuaugc

SEQ ID NO: 258057 - RNA, 22 nt, Homo sapiens
aaaugacuuuuuaugcagagua

SEQ ID NO: 258058 - RNA, 22 nt, Homo sapiens
aaaugccucccauucuacugac

SEQ ID NO: 258059 - RNA, 22 nt, Homo sapiens
aaaugcuucuauguggcauguu

SEQ ID NO: 258060 - RNA, 22 nt, Homo sapiens
aaauggcaccggcucuucccuc

SEQ ID NO: 258061 - RNA, 19 nt, Homo sapiens
aaaugugcacuguuuucca

SEQ ID NO: 258062 - RNA, 22 nt, Homo sapiens
aaauuguccuauugguuuaagc

SEQ ID NO: 258063 - RNA, 22 nt, Homo sapiens
aacagcacacccgcugcuucca

SEQ ID NO: 258064 - RNA, 22 nt, Homo sapiens
aacaggguguuugcaguuucuu

SEQ ID NO: 258065 - RNA, 22 nt, Homo sapiens
aacuacaucucuuugaggcagg

SEQ ID NO: 258066 - RNA, 22 nt, Homo sapiens
aacugccucugacauaggcagg

SEQ ID NO: 258067 - RNA, 22 nt, Homo sapiens
aacuggcacuacaucaagagcu

SEQ ID NO: 258068 - RNA, 22 nt, Homo sapiens
aacuggccugagaugaaaagug

SEQ ID NO: 258069 - RNA, 21 nt, Homo sapiens
aagaaagcuggacuugccgcu

SEQ ID NO: 258070 - RNA, 22 nt, Homo sapiens
aagaggccuaggaaucuguauu

SEQ ID NO: 258071 - RNA, 22 nt, Homo sapiens
aagaggcuguaggauaaugccu

SEQ ID NO: 258072 - RNA, 22 nt, Homo sapiens
aagagguuauagaguguauacu

SEQ ID NO: 258073 - RNA, 22 nt, Homo sapiens
aagagguuuaacugacucacag

SEQ ID NO: 258074 - RNA, 22 nt, Homo sapiens
aagcacaauuucaccuucuugu

SEQ ID NO: 258075 - RNA, 22 nt, Homo sapiens
aagcacccagccucacgccugc

SEQ ID NO: 258076 - RNA, 22 nt, Homo sapiens
aagcugugucuugucagcuacc

SEQ ID NO: 258077 - RNA, 22 nt, Homo sapiens
aagcuguguguaagcucucaca

SEQ ID NO: 258078 - RNA, 22 nt, Homo sapiens
aaggaauucaaauuuucucugg

SEQ ID NO: 258079 - RNA, 22 nt, Homo sapiens
aaggagcagagagcccuguuuc

SEQ ID NO: 258080 - RNA, 22 nt, Homo sapiens
aaggagcaguggacggguccua

SEQ ID NO: 258081 - RNA, 22 nt, Homo sapiens
aaggaguauugaaugaccaagu

SEQ ID NO: 258082 - RNA, 22 nt, Homo sapiens
aaggcaagaaaauggauucucc

SEQ ID NO: 258083 - RNA, 22 nt, Homo sapiens
aaggcauucucaaacuaguucu

SEQ ID NO: 258084 - RNA, 22 nt, Homo sapiens
aagggaaugcuuccaguuugug

SEQ ID NO: 258085 - RNA, 18 nt, Homo sapiens
aaggugcuucuguucuga

SEQ ID NO: 258086 - RNA, 22 nt, Homo sapiens
aaguaaacauuuuguacaauaa

SEQ ID NO: 258087 - RNA, 19 nt, Homo sapiens
aaguaguugugacagaugc

SEQ ID NO: 258088 - RNA, 18 nt, Homo sapiens
aaguauagagagcccuua

SEQ ID NO: 258089 - RNA, 22 nt, Homo sapiens
aaguauagcuaugauaaacauu

SEQ ID NO: 258090 - RNA, 22 nt, Homo sapiens
aagucaugaagaggaaaggaca

SEQ ID NO: 258091 - RNA, 22 nt, Homo sapiens
aagucauggaggaguaugugag

SEQ ID NO: 258092 - RNA, 22 nt, Homo sapiens
aagugacuagacuaugaaaccu

SEQ ID NO: 258093 - RNA, 22 nt, Homo sapiens
aagugcuuuguacagggguuga

SEQ ID NO: 258094 - RNA, 22 nt, Homo sapiens
aaguugcuuuagguaagucaau

SEQ ID NO: 258095 - RNA, 22 nt, Homo sapiens
aauaaagucugaagugugcuua

SEQ ID NO: 258096 - RNA, 22 nt, Homo sapiens
aaucacauugaaucugcuaccu

SEQ ID NO: 258097 - RNA, 22 nt, Homo sapiens
aaucacuuuggcaccaaccuaa

SEQ ID NO: 258098 - RNA, 22 nt, Homo sapiens
aaucagagcccucugagcuuca

SEQ ID NO: 258099 - RNA, 22 nt, Homo sapiens
aaucuguagaaggugcacauuc

SEQ ID NO: 258100 - RNA, 22 nt, Homo sapiens
aaucugucaguuuuguguuaau

SEQ ID NO: 258101 - RNA, 22 nt, Homo sapiens
aaucugucuagacaaggagucu

SEQ ID NO: 258102 - RNA, 17 nt, Homo sapiens
aaugagacauuucugcu

SEQ ID NO: 258103 - RNA, 22 nt, Homo sapiens
aauggcacaagacaugaagaag

SEQ ID NO: 258104 - RNA, 22 nt, Homo sapiens
aauggcacuuuauaaauguuaa

SEQ ID NO: 258105 - RNA, 22 nt, Homo sapiens
aauggcuucuuauugugguuca

SEQ ID NO: 258106 - RNA, 18 nt, Homo sapiens
aaugggacuacaaagcca

SEQ ID NO: 258107 - RNA, 22 nt, Homo sapiens
aaugguuuuaucagcguccaaa

SEQ ID NO: 258108 - RNA, 22 nt, Homo sapiens
aaugucacugugguccuccagu

SEQ ID NO: 258109 - RNA, 22 nt, Homo sapiens
aaugugcacuuggagccuugcu

SEQ ID NO: 258110 - RNA, 22 nt, Homo sapiens
aaugugcuuucuuucacacagu

SEQ ID NO: 258111 - RNA, 22 nt, Homo sapiens
acaacaguuuuaucaccccaga

SEQ ID NO: 258112 - RNA, 22 nt, Homo sapiens
acaagcacaaaugcauagaugg

SEQ ID NO: 258113 - RNA, 22 nt, Homo sapiens
acaccauugcauuccagccugg

SEQ ID NO: 258114 - RNA, 22 nt, Homo sapiens
acacucuaguguucuuaaucag

SEQ ID NO: 258115 - RNA, 22 nt, Homo sapiens
acacuggguaacauaucuguua

SEQ ID NO: 258116 - RNA, 22 nt, Homo sapiens
acacuguugacauuuuguagug

SEQ ID NO: 258117 - RNA, 22 nt, Homo sapiens
acagaccuauuucaaucauuua

SEQ ID NO: 258118 - RNA, 22 nt, Homo sapiens
acagagcaaugagcuacggucu

SEQ ID NO: 258119 - RNA, 22 nt, Homo sapiens
acagaucagagauauuuagguu

SEQ ID NO: 258120 - RNA, 22 nt, Homo sapiens
acagccauuccagccaaauacu

SEQ ID NO: 258121 - RNA, 22 nt, Homo sapiens
acaggugaaguauuacacuaag

SEQ ID NO: 258122 - RNA, 22 nt, Homo sapiens
acagugacagaaagcugauuau

SEQ ID NO: 258123 - RNA, 18 nt, Homo sapiens
acagugcugucacugcuu

SEQ ID NO: 258124 - RNA, 22 nt, Homo sapiens
uugacuuuuauucacucugcua

SEQ ID NO: 258125 - RNA, 21 nt, Homo sapiens
uugagaagaauuagcucuucc

SEQ ID NO: 258126 - RNA, 22 nt, Homo sapiens
uugagauacauaauuaugaaug

SEQ ID NO: 258127 - RNA, 22 nt, Homo sapiens
uugagauagaauaggaauggga

SEQ ID NO: 258128 - RNA, 22 nt, Homo sapiens
uugagauggagccucacucugc

SEQ ID NO: 258129 - RNA, 22 nt, Homo sapiens
uugagauggagucucacucugc

SEQ ID NO: 258130 - RNA, 22 nt, Homo sapiens
uugagauggagucucacucugu

SEQ ID NO: 258131 - RNA, 22 nt, Homo sapiens
uugagauggagucuugcacugu

SEQ ID NO: 258132 - RNA, 22 nt, Homo sapiens
uugagauggagucuugcgcugu

SEQ ID NO: 258133 - RNA, 22 nt, Homo sapiens
uugagauggagucuugcucugu

SEQ ID NO: 258134 - RNA, 22 nt, Homo sapiens
uugagauggaguuucgcucuuu

SEQ ID NO: 258135 - RNA, 22 nt, Homo sapiens
uugagauggaguuuugcucuug

SEQ ID NO: 258136 - RNA, 22 nt, Homo sapiens
uugagauggugccacuguacuc

SEQ ID NO: 258137 - RNA, 22 nt, Homo sapiens
uugagauguggcaguuuaugag

SEQ ID NO: 258138 - RNA, 22 nt, Homo sapiens
uugagcaacauagugagacugu

SEQ ID NO: 258139 - RNA, 22 nt, Homo sapiens
uugagcucuucuagcaauucua

SEQ ID NO: 258140 - RNA, 22 nt, Homo sapiens
uugagcuuuuuacuuguccaau

SEQ ID NO: 258141 - RNA, 22 nt, Homo sapiens
uugaggaagugguuccccagag

SEQ ID NO: 258142 - RNA, 22 nt, Homo sapiens
uugaggaggcagucuucccauu

SEQ ID NO: 258143 - RNA, 22 nt, Homo sapiens
uugaggaguacugauuagguau

SEQ ID NO: 258144 - RNA, 22 nt, Homo sapiens
uugaggcuuuugaccucaugug

SEQ ID NO: 258145 - RNA, 22 nt, Homo sapiens
uugaguauuggacugguaucuu

SEQ ID NO: 258146 - RNA, 21 nt, Homo sapiens
uugaguugaagcaaggaggga

SEQ ID NO: 258147 - RNA, 22 nt, Homo sapiens
uugauagacaucugaguuguug

SEQ ID NO: 258148 - RNA, 22 nt, Homo sapiens
uugauuagauccaguugauuga

SEQ ID NO: 258149 - RNA, 22 nt, Homo sapiens
uugcaaagaccucuucacuucc

SEQ ID NO: 258150 - RNA, 22 nt, Homo sapiens
uugcaacauguauucuggugau

SEQ ID NO: 258151 - RNA, 22 nt, Homo sapiens
uugcaagaaaucagagccuucc

SEQ ID NO: 258152 - RNA, 22 nt, Homo sapiens
uugcagcauucugguuccuggu

SEQ ID NO: 258153 - RNA, 22 nt, Homo sapiens
uugcaggcaugagccaccgugc

SEQ ID NO: 258154 - RNA, 19 nt, Homo sapiens
uugcauagguugaaccagc

SEQ ID NO: 258155 - RNA, 22 nt, Homo sapiens
uugccuuuguuggaaacaagug

SEQ ID NO: 258156 - RNA, 20 nt, Homo sapiens
uugcugguguuagaggaggc

SEQ ID NO: 258157 - RNA, 22 nt, Homo sapiens
uugcugguuuucauaugagcag

SEQ ID NO: 258158 - RNA, 22 nt, Homo sapiens
uuggaaaguuguuguaguuauu

SEQ ID NO: 258159 - RNA, 22 nt, Homo sapiens
uuggaagacaaugcugauucuc

SEQ ID NO: 258160 - RNA, 22 nt, Homo sapiens
uuggaagcacauuguuuaauua

SEQ ID NO: 258161 - RNA, 22 nt, Homo sapiens
uuggaaguguguauguauagcu

SEQ ID NO: 258162 - RNA, 22 nt, Homo sapiens
uuggaauacucaaaagguuggg

SEQ ID NO: 258163 - RNA, 22 nt, Homo sapiens
uuggaauacuuguuaaagucca

SEQ ID NO: 258164 - RNA, 22 nt, Homo sapiens
uuggaauuaagagauauuuucu

SEQ ID NO: 258165 - RNA, 22 nt, Homo sapiens
uuggaauuuuaaaauaggcaac

SEQ ID NO: 258166 - RNA, 22 nt, Homo sapiens
uuggaauuuuacuucuguaaga

SEQ ID NO: 258167 - RNA, 22 nt, Homo sapiens
uuggacagaugguuacauuuuu

SEQ ID NO: 258168 - RNA, 22 nt, Homo sapiens
uuggagagucacuaguuagugc

SEQ ID NO: 258169 - RNA, 22 nt, Homo sapiens
uuggagugugagagcagccugg

SEQ ID NO: 258170 - RNA, 22 nt, Homo sapiens
uuggaugauaaagaagccuaag

SEQ ID NO: 258171 - RNA, 22 nt, Homo sapiens
uuggcagugguucugacggacc

SEQ ID NO: 258172 - RNA, 23 nt, Homo sapiens
uuggcaucugggacacaagcuga

SEQ ID NO: 258173 - RNA, 22 nt, Homo sapiens
uuggcauugaguuucaaaucau

SEQ ID NO: 258174 - RNA, 22 nt, Homo sapiens
uuggcauugccaaacugucaac

SEQ ID NO: 258175 - RNA, 22 nt, Homo sapiens
uuggcauuuauucuaaggucaa

SEQ ID NO: 258176 - RNA, 22 nt, Homo sapiens
uuggcauuuuggacacccagga

SEQ ID NO: 258177 - RNA, 22 nt, Homo sapiens
uuggccagugucuuuuuuuccu

SEQ ID NO: 258178 - RNA, 22 nt, Homo sapiens
uuggccccuccaaaucucaugu

SEQ ID NO: 258179 - RNA, 22 nt, Homo sapiens
uuggcucuggcugggcuccagc

SEQ ID NO: 258180 - RNA, 22 nt, Homo sapiens
uuggcuuuuaugcagcuuaggu

SEQ ID NO: 258181 - RNA, 17 nt, Homo sapiens
uugggcaagguagguga

SEQ ID NO: 258182 - RNA, 22 nt, Homo sapiens
uugggcaaguggcaugaccaug

SEQ ID NO: 258183 - RNA, 22 nt, Homo sapiens
uugggucaguuccuugacuccu

SEQ ID NO: 258184 - RNA, 22 nt, Homo sapiens
uugguaguuucugucuuuagau

SEQ ID NO: 258185 - RNA, 22 nt, Homo sapiens
uuggucaggcuagaguguggug

SEQ ID NO: 258186 - RNA, 23 nt, Homo sapiens
uuggucucccaaaguguugagau

SEQ ID NO: 258187 - RNA, 22 nt, Homo sapiens
uuggucuucuaauguaccuguu

SEQ ID NO: 258188 - RNA, 22 nt, Homo sapiens
uuguaaagucugucucagucag

SEQ ID NO: 258189 - RNA, 22 nt, Homo sapiens
uuguaauguuaccaaauggugu

SEQ ID NO: 258190 - RNA, 22 nt, Homo sapiens
uuguagcaaauguguaaacaaa

SEQ ID NO: 258191 - RNA, 22 nt, Homo sapiens
uuguaugucuucauuugaaaaa

SEQ ID NO: 258192 - RNA, 22 nt, Homo sapiens
uugucaaacucauucuccaucc

SEQ ID NO: 258193 - RNA, 22 nt, Homo sapiens
uugucacccucucuuggugucu

SEQ ID NO: 258194 - RNA, 19 nt, Homo sapiens
uuguccccucuaaaucuca

SEQ ID NO: 258195 - RNA, 22 nt, Homo sapiens
uugugaaaaaccucucguggaa

SEQ ID NO: 258196 - RNA, 22 nt, Homo sapiens
uugugaaaucuaggcagagguu

SEQ ID NO: 258197 - RNA, 22 nt, Homo sapiens
uugugaucauugucaaauagug

SEQ ID NO: 258198 - RNA, 22 nt, Homo sapiens
uugugaucuucagaaaguggcu

SEQ ID NO: 258199 - RNA, 22 nt, Homo sapiens
uugugcuugauuugccuagcug

SEQ ID NO: 258200 - RNA, 22 nt, Homo sapiens
uuguguaguaccucucacauug

SEQ ID NO: 258201 - RNA, 22 nt, Homo sapiens
uuguucaggagguuggggaugc

SEQ ID NO: 258202 - RNA, 22 nt, Homo sapiens
uuguugcacugcuuuccuggcc

SEQ ID NO: 258203 - RNA, 22 nt, Homo sapiens
uuguuuagagacuggaauuaaa

SEQ ID NO: 258204 - RNA, 22 nt, Homo sapiens
uuuaaagcaugacgagaagaag

SEQ ID NO: 258205 - RNA, 20 nt, Homo sapiens
uuuaagacaugcugaauuga

SEQ ID NO: 258206 - RNA, 22 nt, Homo sapiens
uuuaaugcaucccaaaauguag

SEQ ID NO: 258207 - RNA, 22 nt, Homo sapiens
uuuagcacugugauugacaaaa

SEQ ID NO: 258208 - RNA, 22 nt, Homo sapiens
uuuauagucaggaacuugagga

SEQ ID NO: 258209 - RNA, 22 nt, Homo sapiens
uuuauccagccucuagcaaggu

SEQ ID NO: 258210 - RNA, 20 nt, Homo sapiens
uuucaguacuuucuacuggc

SEQ ID NO: 258211 - RNA, 22 nt, Homo sapiens
uuucauagccuucuaaugaguu

SEQ ID NO: 258212 - RNA, 22 nt, Homo sapiens
uuucgguuaucuagcuuuauga

SEQ ID NO: 258213 - RNA, 17 nt, Homo sapiens
uuucucagcccucuucu

SEQ ID NO: 258214 - RNA, 22 nt, Homo sapiens
uuugaaaguaauuugguuggug

SEQ ID NO: 258215 - RNA, 22 nt, Homo sapiens
guguggaacucaauacaacgca

SEQ ID NO: 258216 - RNA, 22 nt, Homo sapiens
guguggcaggugggggcucaga

SEQ ID NO: 258217 - RNA, 22 nt, Homo sapiens
guuaugcagcaauugauaaucu

SEQ ID NO: 258218 - RNA, 22 nt, Homo sapiens
guucaagugauagcugggauua

SEQ ID NO: 258219 - RNA, 20 nt, Homo sapiens
guucacaggcuuccuuucag

SEQ ID NO: 258220 - RNA, 22 nt, Homo sapiens
guucuggagauaaagccaaggu

SEQ ID NO: 258221 - RNA, 22 nt, Homo sapiens
guugcucaggcuggagugcagu

SEQ ID NO: 258222 - RNA, 22 nt, Homo sapiens
guuuacagucgacuugggaaua

SEQ ID NO: 258223 - RNA, 22 nt, Homo sapiens
guuugcagaucaugaagaaccc

SEQ ID NO: 258224 - RNA, 15 nt, Homo sapiens
guuuuuggauacaau

SEQ ID NO: 258225 - RNA, 22 nt, Homo sapiens
uaaaagucaucacaacuggagu

SEQ ID NO: 258226 - RNA, 22 nt, Homo sapiens
uaaaccuagcauuuugcauaug

SEQ ID NO: 258227 - RNA, 22 nt, Homo sapiens
uaaacugcuugaggguaaguac

SEQ ID NO: 258228 - RNA, 22 nt, Homo sapiens
uaaacugucuugcaguuacaug

SEQ ID NO: 258229 - RNA, 22 nt, Homo sapiens
uaaagcacuuuuuucugcaugg

SEQ ID NO: 258230 - RNA, 22 nt, Homo sapiens
uaaagccagugauuaugucucu

SEQ ID NO: 258231 - RNA, 22 nt, Homo sapiens
uaaagccauugucaaguuugua

SEQ ID NO: 258232 - RNA, 22 nt, Homo sapiens
uaaagccuagaacuuucagccc

SEQ ID NO: 258233 - RNA, 18 nt, Homo sapiens
uaaaggcacuguguuguu

SEQ ID NO: 258234 - RNA, 22 nt, Homo sapiens
uaaaugcuuaauugaaugugga

SEQ ID NO: 258235 - RNA, 22 nt, Homo sapiens
uaaaugcuugagaugauggaua

SEQ ID NO: 258236 - RNA, 22 nt, Homo sapiens
uaaauggauauugccaucuccu

SEQ ID NO: 258237 - RNA, 22 nt, Homo sapiens
uaacaacauucuaacugacggc

SEQ ID NO: 258238 - RNA, 22 nt, Homo sapiens
uaacacagagcuccuaaucccu

SEQ ID NO: 258239 - RNA, 22 nt, Homo sapiens
uaacaccuugcucugucaauaa

SEQ ID NO: 258240 - RNA, 22 nt, Homo sapiens
uaacaccuuugauagcacuuuu

SEQ ID NO: 258241 - RNA, 22 nt, Homo sapiens
uaacagcucuacagcugcucuu

SEQ ID NO: 258242 - RNA, 22 nt, Homo sapiens
uaacaguauauuuaccaaaccu

SEQ ID NO: 258243 - RNA, 18 nt, Homo sapiens
uaacagucucucaggauc

SEQ ID NO: 258244 - RNA, 23 nt, Homo sapiens
uaacauguuuuuaagggaagcuu

SEQ ID NO: 258245 - RNA, 22 nt, Homo sapiens
uaacauucacaugcugcaaaaa

SEQ ID NO: 258246 - RNA, 22 nt, Homo sapiens
uaacccuuaguaucuguggguu

SEQ ID NO: 258247 - RNA, 22 nt, Homo sapiens
uaacugcaaccuccgccucccg

SEQ ID NO: 258248 - RNA, 22 nt, Homo sapiens
uaagaauucuguccgguauacu

SEQ ID NO: 258249 - RNA, 22 nt, Homo sapiens
uaagcagugcaagaauggaaua

SEQ ID NO: 258250 - RNA, 22 nt, Homo sapiens
uaagggcaugcugcaugagagu

SEQ ID NO: 258251 - RNA, 22 nt, Homo sapiens
uaagugaauuucacuacugagu

SEQ ID NO: 258252 - RNA, 22 nt, Homo sapiens
uaagugcaacauaaguguuaaa

SEQ ID NO: 258253 - RNA, 20 nt, Homo sapiens
uaagugcuuuauauugauua

SEQ ID NO: 258254 - RNA, 21 nt, Homo sapiens
uaauaaugucucagacaccua

SEQ ID NO: 258255 - RNA, 22 nt, Homo sapiens
uaauaguuucagaaguuguuuu

SEQ ID NO: 258256 - RNA, 22 nt, Homo sapiens
uaaucucagcuacucaggaggc

SEQ ID NO: 258257 - RNA, 22 nt, Homo sapiens
uaaugcuccauggguuauuaaa

SEQ ID NO: 258258 - RNA, 22 nt, Homo sapiens
uaaugcuguggucugguuuaaa

SEQ ID NO: 258259 - RNA, 21 nt, Homo sapiens
uaauggcaugaucucggcuca

SEQ ID NO: 258260 - RNA, 22 nt, Homo sapiens
uacaagcacaggcagcaggcug

SEQ ID NO: 258261 - RNA, 16 nt, Homo sapiens
uacaauguagaaaaca

SEQ ID NO: 258262 - RNA, 18 nt, Homo sapiens
uacagaacuggaguagaa

SEQ ID NO: 258263 - RNA, 22 nt, Homo sapiens
uacagaauucugucccuugagu

SEQ ID NO: 258264 - RNA, 22 nt, Homo sapiens
uacagcacugugcauagugguu

SEQ ID NO: 258265 - RNA, 22 nt, Homo sapiens
uacagccacauaauguaugauu

SEQ ID NO: 258266 - RNA, 22 nt, Homo sapiens
uacaggcagguguucccugguu

SEQ ID NO: 258267 - RNA, 22 nt, Homo sapiens
uacagucacauuccugaccaua

SEQ ID NO: 258268 - RNA, 22 nt, Homo sapiens
uacagucauaaugccuagugac

SEQ ID NO: 258269 - RNA, 22 nt, Homo sapiens
uacaguggugugaucucagcuc

SEQ ID NO: 258270 - RNA, 22 nt, Homo sapiens
uacauagucuucuuuugguuau

SEQ ID NO: 258271 - RNA, 22 nt, Homo sapiens
uacaugcaugggcaugugugca

SEQ ID NO: 258272 - RNA, 22 nt, Homo sapiens
uaccagcauuucucuuuaagua

SEQ ID NO: 258273 - RNA, 22 nt, Homo sapiens
uaccucaguucaauaacagaua

SEQ ID NO: 258274 - RNA, 22 nt, Homo sapiens
uacuagaggcgggguuucgcca

SEQ ID NO: 258275 - RNA, 22 nt, Homo sapiens
uacugcacuccaaccugagaga

SEQ ID NO: 258276 - RNA, 22 nt, Homo sapiens
uacugcugucagugccaaguag

SEQ ID NO: 258277 - RNA, 21 nt, Homo sapiens
uacuggagauacagucugcaa

SEQ ID NO: 258278 - RNA, 22 nt, Homo sapiens
uacuggccuugaacucuggugu

SEQ ID NO: 258279 - RNA, 22 nt, Homo sapiens
uacuuagagacaugcagcacug

SEQ ID NO: 258280 - RNA, 22 nt, Homo sapiens
uagacccauuguucagagagug

SEQ ID NO: 258281 - RNA, 22 nt, Homo sapiens
uagaugauucacuuuacuucca

SEQ ID NO: 258282 - RNA, 19 nt, Homo sapiens
uagaugucuuugcauagau

SEQ ID NO: 258283 - RNA, 22 nt, Homo sapiens
uagauuauuggcugauuugauc

SEQ ID NO: 258284 - RNA, 20 nt, Homo sapiens
uagcagcagacagagggagg

SEQ ID NO: 258285 - RNA, 22 nt, Homo sapiens
uagcagccaggaagggcuggcu

SEQ ID NO: 258286 - RNA, 22 nt, Homo sapiens
uagcaguaagaaacugacauug

SEQ ID NO: 258287 - RNA, 22 nt, Homo sapiens
uagcaguauaugagagcuauug

SEQ ID NO: 258288 - RNA, 22 nt, Homo sapiens
uagcauccuucucuaaacagga

SEQ ID NO: 258289 - RNA, 22 nt, Homo sapiens
uagcaugacacuuguugaaugc

SEQ ID NO: 258290 - RNA, 22 nt, Homo sapiens
uagcauggaggcggccauagug

SEQ ID NO: 258291 - RNA, 21 nt, Homo sapiens
uagcuacacugugauucaugg

SEQ ID NO: 258292 - RNA, 21 nt, Homo sapiens
uagcucagugguguugccaua

SEQ ID NO: 258293 - RNA, 22 nt, Homo sapiens
uaggacacaggacauauguaga

SEQ ID NO: 258294 - RNA, 22 nt, Homo sapiens
uaggauaguccuccugagaccu

SEQ ID NO: 258295 - RNA, 22 nt, Homo sapiens
uaggcuuuucugggaugugggc

SEQ ID NO: 258296 - RNA, 22 nt, Homo sapiens
uagggcaugugggaaguuauaa

SEQ ID NO: 258297 - RNA, 22 nt, Homo sapiens
uagggcauguguggaguguaug

SEQ ID NO: 258298 - RNA, 22 nt, Homo sapiens
uaggucuuuuaugaaauauauu

SEQ ID NO: 258299 - RNA, 22 nt, Homo sapiens
uaguaacacauugaacgaucgc

SEQ ID NO: 258300 - RNA, 22 nt, Homo sapiens
uaguaguuuuguguauaauaau

SEQ ID NO: 258301 - RNA, 22 nt, Homo sapiens
uaguaucacauggucuuaauua

SEQ ID NO: 258302 - RNA, 22 nt, Homo sapiens
uagucaaaucugaaggaaauuu

SEQ ID NO: 258303 - RNA, 22 nt, Homo sapiens
uagugaauguuggcuauuaaua

SEQ ID NO: 258304 - RNA, 22 nt, Homo sapiens
uagugcugugauauuuuuggcc

SEQ ID NO: 258305 - RNA, 22 nt, Homo sapiens
uagugguaguagcaguaauauu

SEQ ID NO: 258306 - RNA, 22 nt, Homo sapiens
ggcaagaacuucacucacuuuu

SEQ ID NO: 258307 - RNA, 22 nt, Homo sapiens
ggcaaguauguuuuaggaugcu

SEQ ID NO: 258308 - RNA, 22 nt, Homo sapiens
ggcacuguggcucaagccugua

SEQ ID NO: 258309 - RNA, 22 nt, Homo sapiens
ggcacuguugccggccugaauu

SEQ ID NO: 258310 - RNA, 22 nt, Homo sapiens
ggcagaguggacauuuaaaugu

SEQ ID NO: 258311 - RNA, 22 nt, Homo sapiens
ggcaugguggugugugccuaua

SEQ ID NO: 258312 - RNA, 22 nt, Homo sapiens
ggccggguggccauggcugccc

SEQ ID NO: 258313 - RNA, 22 nt, Homo sapiens
ggcucaguuuccuccgucugcu

SEQ ID NO: 258314 - RNA, 22 nt, Homo sapiens
ggcuuggaggaaugugagggcu

SEQ ID NO: 258315 - RNA, 20 nt, Homo sapiens
gggaugugagguacacucuu

SEQ ID NO: 258316 - RNA, 22 nt, Homo sapiens
gggauuauugugauuucauguu

SEQ ID NO: 258317 - RNA, 22 nt, Homo sapiens
gggggagugugguacccagcau

SEQ ID NO: 258318 - RNA, 22 nt, Homo sapiens
gggguaggcuacacugaguucc

SEQ ID NO: 258319 - RNA, 22 nt, Homo sapiens
gguagacaucgugcucugugau

SEQ ID NO: 258320 - RNA, 22 nt, Homo sapiens
ggucaacaucaucaugguaagu

SEQ ID NO: 258321 - RNA, 22 nt, Homo sapiens
ggucauggauaagauccagaag

SEQ ID NO: 258322 - RNA, 22 nt, Homo sapiens
ggucccccuccacucucgcaaa

SEQ ID NO: 258323 - RNA, 21 nt, Homo sapiens
ggugagaaaggagacauagac

SEQ ID NO: 258324 - RNA, 23 nt, Homo sapiens
ggugaggaguacagagucuucau

SEQ ID NO: 258325 - RNA, 22 nt, Homo sapiens
ggugagguaggaaaaguuagga

SEQ ID NO: 258326 - RNA, 22 nt, Homo sapiens
ggugagguaguaagguacaaua

SEQ ID NO: 258327 - RNA, 22 nt, Homo sapiens
guaagagcauguaguggcucua

SEQ ID NO: 258328 - RNA, 19 nt, Homo sapiens
guaaucucaguacuuuggu

SEQ ID NO: 258329 - RNA, 22 nt, Homo sapiens
guaaucuguaguaaagcaccau

SEQ ID NO: 258330 - RNA, 22 nt, Homo sapiens
guacaggugcaggaugggcagg

SEQ ID NO: 258331 - RNA, 22 nt, Homo sapiens
guagagguagacuuccuugucu

SEQ ID NO: 258332 - RNA, 22 nt, Homo sapiens
guagcaugcaauauuauagaga

SEQ ID NO: 258333 - RNA, 22 nt, Homo sapiens
guaggcacuggcucagcuuauc

SEQ ID NO: 258334 - RNA, 22 nt, Homo sapiens
guauacuucugaaaauagcuau

SEQ ID NO: 258335 - RNA, 22 nt, Homo sapiens
guaucauuggcauguaaccaga

SEQ ID NO: 258336 - RNA, 22 nt, Homo sapiens
guaugcacauauguguauguau

SEQ ID NO: 258337 - RNA, 22 nt, Homo sapiens
gucacauugaugcccauggugg

SEQ ID NO: 258338 - RNA, 22 nt, Homo sapiens
gucacggaauguaaguggaagu

SEQ ID NO: 258339 - RNA, 22 nt, Homo sapiens
gucacugacaagagagaagaac

SEQ ID NO: 258340 - RNA, 22 nt, Homo sapiens
gucaguggauacugucucuguc

SEQ ID NO: 258341 - RNA, 22 nt, Homo sapiens
gucauauaggguuuaccuguau

SEQ ID NO: 258342 - RNA, 22 nt, Homo sapiens
gucauggguuaaagguggauac

SEQ ID NO: 258343 - RNA, 22 nt, Homo sapiens
gucuagaacuucugaccuuagg

SEQ ID NO: 258344 - RNA, 22 nt, Homo sapiens
gucucccagccuacauauuucu

SEQ ID NO: 258345 - RNA, 22 nt, Homo sapiens
gucucuugguuuagagcauuua

SEQ ID NO: 258346 - RNA, 22 nt, Homo sapiens
gucugucuuuugucuuugaaau

SEQ ID NO: 258347 - RNA, 22 nt, Homo sapiens
gucuuccagccuccaucuuucu

SEQ ID NO: 258348 - RNA, 22 nt, Homo sapiens
gucuuugcuuuuaaccagaggu

SEQ ID NO: 258349 - RNA, 22 nt, Homo sapiens
gucuuuugcuagccagagagcu

SEQ ID NO: 258350 - RNA, 22 nt, Homo sapiens
gugaaagauuaaaccagugugu

SEQ ID NO: 258351 - RNA, 17 nt, Homo sapiens
gugaaaucaucauuuuu

SEQ ID NO: 258352 - RNA, 22 nt, Homo sapiens
gugaaucauaugccagucaugc

SEQ ID NO: 258353 - RNA, 22 nt, Homo sapiens
gugaaugaaugggugaauacau

SEQ ID NO: 258354 - RNA, 22 nt, Homo sapiens
gugacacagcaagacuccgucu

SEQ ID NO: 258355 - RNA, 22 nt, Homo sapiens
gugagaugguaucucauugugg

SEQ ID NO: 258356 - RNA, 19 nt, Homo sapiens
gugagcaaugcauugcacu

SEQ ID NO: 258357 - RNA, 22 nt, Homo sapiens
gugagcacugaaagaaggcaag

SEQ ID NO: 258358 - RNA, 22 nt, Homo sapiens
gugagcauuacucaugggauca

SEQ ID NO: 258359 - RNA, 22 nt, Homo sapiens
gugagcuaagcaaauaugagcc

SEQ ID NO: 258360 - RNA, 22 nt, Homo sapiens
gugagcuaguuucuuugcugug

SEQ ID NO: 258361 - RNA, 22 nt, Homo sapiens
gugagcuccucuucugcugcag

SEQ ID NO: 258362 - RNA, 21 nt, Homo sapiens
gugaggucauugggcuuucug

SEQ ID NO: 258363 - RNA, 22 nt, Homo sapiens
gugagguguuaaccaaccugug

SEQ ID NO: 258364 - RNA, 22 nt, Homo sapiens
gugaucuuucaggcuugaccau

SEQ ID NO: 258365 - RNA, 22 nt, Homo sapiens
gugcaaccaucaccacugacuc

SEQ ID NO: 258366 - RNA, 22 nt, Homo sapiens
gugcaauucacuguuaugucug

SEQ ID NO: 258367 - RNA, 22 nt, Homo sapiens
gugcacaacguguagguuuguu

SEQ ID NO: 258368 - RNA, 22 nt, Homo sapiens
gugcacaugguagguauugagu

SEQ ID NO: 258369 - RNA, 22 nt, Homo sapiens
gugcacuguagaacccuuuguu

SEQ ID NO: 258370 - RNA, 21 nt, Homo sapiens
gugcagaugccacagucacuc

SEQ ID NO: 258371 - RNA, 23 nt, Homo sapiens
gugcaugagucuuuauaguagca

SEQ ID NO: 258372 - RNA, 22 nt, Homo sapiens
gugcaugcaucuuuauaguagc

SEQ ID NO: 258373 - RNA, 22 nt, Homo sapiens
gugccacaguguuaagggauuc

SEQ ID NO: 258374 - RNA, 22 nt, Homo sapiens
guggaaaaguaguugcgguuuu

SEQ ID NO: 258375 - RNA, 20 nt, Homo sapiens
guggaagauaaguagccuga

SEQ ID NO: 258376 - RNA, 20 nt, Homo sapiens
guggaaguagaaacauaugu

SEQ ID NO: 258377 - RNA, 22 nt, Homo sapiens
guggaaugaaaacucucucaca

SEQ ID NO: 258378 - RNA, 22 nt, Homo sapiens
guggaaugcaguguugauucaa

SEQ ID NO: 258379 - RNA, 22 nt, Homo sapiens
guggaauuauagagacaucuug

SEQ ID NO: 258380 - RNA, 22 nt, Homo sapiens
guggacagagacuaaauguugu

SEQ ID NO: 258381 - RNA, 18 nt, Homo sapiens
guggagugucuuccugga

SEQ ID NO: 258382 - RNA, 22 nt, Homo sapiens
guggcaaagaugccuucuccaa

SEQ ID NO: 258383 - RNA, 22 nt, Homo sapiens
guggcaagaauguacaaaaggu

SEQ ID NO: 258384 - RNA, 22 nt, Homo sapiens
guggguaaaucucuguucgagg

SEQ ID NO: 258385 - RNA, 22 nt, Homo sapiens
gugguaaaauggcauagagcua

SEQ ID NO: 258386 - RNA, 22 nt, Homo sapiens
gugguuguuggaguggcaauuu

SEQ ID NO: 258387 - RNA, 22 nt, Homo sapiens
gugguuuuaauauucagucuag

SEQ ID NO: 258388 - RNA, 22 nt, Homo sapiens
gugguuuuaucccagaaauuaa

SEQ ID NO: 258389 - RNA, 22 nt, Homo sapiens
gugguuuuuaaaguaccugugg

SEQ ID NO: 258390 - RNA, 22 nt, Homo sapiens
guguaguuugagguaugggggc

SEQ ID NO: 258391 - RNA, 18 nt, Homo sapiens
guguauggauggaggcca

SEQ ID NO: 258392 - RNA, 22 nt, Homo sapiens
guguaugguaggaugacggagu

SEQ ID NO: 258393 - RNA, 22 nt, Homo sapiens
gugucaugggcauguccuuaac

SEQ ID NO: 258394 - RNA, 22 nt, Homo sapiens
guguccucgaguacacaucagg

SEQ ID NO: 258395 - RNA, 19 nt, Homo sapiens
gugugcauaucacagagca

SEQ ID NO: 258396 - RNA, 21 nt, Homo sapiens
gugugcuugaauucagcuguc

SEQ ID NO: 258397 - RNA, 22 nt, Homo sapiens
gacgauaucaaggaaaugaagu

SEQ ID NO: 258398 - RNA, 22 nt, Homo sapiens
gacuagaaauuauuuagugagc

SEQ ID NO: 258399 - RNA, 22 nt, Homo sapiens
gacuggauagauaaaguuaguu

SEQ ID NO: 258400 - RNA, 22 nt, Homo sapiens
gacuggccauugauacagaggu

SEQ ID NO: 258401 - RNA, 22 nt, Homo sapiens
gacuggguuaguuugaaagacu

SEQ ID NO: 258402 - RNA, 22 nt, Homo sapiens
gacuuagagauguuguauuugg

SEQ ID NO: 258403 - RNA, 22 nt, Homo sapiens
gagaacagaagcauuccuaauu

SEQ ID NO: 258404 - RNA, 22 nt, Homo sapiens
gagaacugagauaagugauauu

SEQ ID NO: 258405 - RNA, 21 nt, Homo sapiens
gagaaucaucauggcugcaua

SEQ ID NO: 258406 - RNA, 20 nt, Homo sapiens
gagaccugagauucacucaa

SEQ ID NO: 258407 - RNA, 22 nt, Homo sapiens
gagacugagucuugcucugucg

SEQ ID NO: 258408 - RNA, 22 nt, Homo sapiens
gagacugaguuuugcucuuguu

SEQ ID NO: 258409 - RNA, 22 nt, Homo sapiens
gagagugaaguuugcuaccugu

SEQ ID NO: 258410 - RNA, 22 nt, Homo sapiens
gagauaaauaggucacaguucu

SEQ ID NO: 258411 - RNA, 22 nt, Homo sapiens
gagauacuugguuucuguuucu

SEQ ID NO: 258412 - RNA, 22 nt, Homo sapiens
gagauauuauuucccuuucaca

SEQ ID NO: 258413 - RNA, 22 nt, Homo sapiens
gagauauuuagaaauguguucu

SEQ ID NO: 258414 - RNA, 22 nt, Homo sapiens
gagaucaaguauucuccacuaa

SEQ ID NO: 258415 - RNA, 22 nt, Homo sapiens
gagaucaguuaaugaagugagc

SEQ ID NO: 258416 - RNA, 22 nt, Homo sapiens
gagaucuuggccaaguuucuua

SEQ ID NO: 258417 - RNA, 22 nt, Homo sapiens
gagcacugaauacugugguggu

SEQ ID NO: 258418 - RNA, 22 nt, Homo sapiens
gagcuuggguuaaaguugccuu

SEQ ID NO: 258419 - RNA, 22 nt, Homo sapiens
gaggagauauucugcuggaugg

SEQ ID NO: 258420 - RNA, 22 nt, Homo sapiens
gaggaucucuugagcccagaag

SEQ ID NO: 258421 - RNA, 22 nt, Homo sapiens
gagggcacugcuuuccuuucaa

SEQ ID NO: 258422 - RNA, 22 nt, Homo sapiens
gagguagagacuauguauuaga

SEQ ID NO: 258423 - RNA, 22 nt, Homo sapiens
gagguaggaauaaacauuugaa

SEQ ID NO: 258424 - RNA, 22 nt, Homo sapiens
gagguagguuugguuacaaaag

SEQ ID NO: 258425 - RNA, 22 nt, Homo sapiens
gaggugguagguucacagcagc

SEQ ID NO: 258426 - RNA, 22 nt, Homo sapiens
gagugcaauggcaagaucuugg

SEQ ID NO: 258427 - RNA, 22 nt, Homo sapiens
gagugcaauggcaccgucucgg

SEQ ID NO: 258428 - RNA, 22 nt, Homo sapiens
gagugcaauggcagaucuccgc

SEQ ID NO: 258429 - RNA, 22 nt, Homo sapiens
gagugcaauggcaugaucuugg

SEQ ID NO: 258430 - RNA, 22 nt, Homo sapiens
gagugcaauggcgcgaucuggg

SEQ ID NO: 258431 - RNA, 22 nt, Homo sapiens
gauauguacagcucucuaggau

SEQ ID NO: 258432 - RNA, 22 nt, Homo sapiens
gauauguuagggggagaaguua

SEQ ID NO: 258433 - RNA, 22 nt, Homo sapiens
gauauguugaguagaguuuuug

SEQ ID NO: 258434 - RNA, 22 nt, Homo sapiens
gauauguuguuggauucgguua

SEQ ID NO: 258435 - RNA, 22 nt, Homo sapiens
gaucugucuuuccuuauagucu

SEQ ID NO: 258436 - RNA, 22 nt, Homo sapiens
gaucuguuuuccuauuguuugu

SEQ ID NO: 258437 - RNA, 22 nt, Homo sapiens
gaugagaugagcauuugaauug

SEQ ID NO: 258438 - RNA, 22 nt, Homo sapiens
gaugagcuaaguucucacagca

SEQ ID NO: 258439 - RNA, 22 nt, Homo sapiens
gauuccacuuacuuagcauucc

SEQ ID NO: 258440 - RNA, 22 nt, Homo sapiens
gauugguugaaaguagaauacu

SEQ ID NO: 258441 - RNA, 22 nt, Homo sapiens
gauuguguucauaggcauguua

SEQ ID NO: 258442 - RNA, 22 nt, Homo sapiens
gauuucacuuucuggaugugca

SEQ ID NO: 258443 - RNA, 22 nt, Homo sapiens
gauuucaucuuuagaggaagga

SEQ ID NO: 258444 - RNA, 22 nt, Homo sapiens
gauuuugguuagggaaggauac

SEQ ID NO: 258445 - RNA, 22 nt, Homo sapiens
gauuuuuggggaagccucuuau

SEQ ID NO: 258446 - RNA, 21 nt, Homo sapiens
gcaaacauccuuugaugccag

SEQ ID NO: 258447 - RNA, 21 nt, Homo sapiens
gcaaaggaauugccuaagcuu

SEQ ID NO: 258448 - RNA, 22 nt, Homo sapiens
gcacagaugaggagaggucuca

SEQ ID NO: 258449 - RNA, 22 nt, Homo sapiens
gcacaguguuacuugauauauu

SEQ ID NO: 258450 - RNA, 22 nt, Homo sapiens
gcacauggccccaucgugccga

SEQ ID NO: 258451 - RNA, 22 nt, Homo sapiens
gcaccacugcacucucagcuug

SEQ ID NO: 258452 - RNA, 22 nt, Homo sapiens
gcagaauugguuucuucuaagg

SEQ ID NO: 258453 - RNA, 22 nt, Homo sapiens
gcaggaaucuugagaaggauuc

SEQ ID NO: 258454 - RNA, 22 nt, Homo sapiens
gcagguaguuucugacuuuuac

SEQ ID NO: 258455 - RNA, 22 nt, Homo sapiens
gcagugugaucacagcuuacug

SEQ ID NO: 258456 - RNA, 22 nt, Homo sapiens
gcaguguggguagagggcaaga

SEQ ID NO: 258457 - RNA, 22 nt, Homo sapiens
gcaucacagcuccugugcuggc

SEQ ID NO: 258458 - RNA, 22 nt, Homo sapiens
gcaugaugaauaauaucacaag

SEQ ID NO: 258459 - RNA, 22 nt, Homo sapiens
gcauggccuuuaaaugucacag

SEQ ID NO: 258460 - RNA, 22 nt, Homo sapiens
gcauugcacuuggcauagacug

SEQ ID NO: 258461 - RNA, 22 nt, Homo sapiens
gccaguguuuuauugagaauuu

SEQ ID NO: 258462 - RNA, 22 nt, Homo sapiens
gccauugcacuccagccuaggc

SEQ ID NO: 258463 - RNA, 22 nt, Homo sapiens
gccauugcacucuagccuaggu

SEQ ID NO: 258464 - RNA, 22 nt, Homo sapiens
gccccgggugaugcagccguca

SEQ ID NO: 258465 - RNA, 22 nt, Homo sapiens
gccucaguuguggccagggauu

SEQ ID NO: 258466 - RNA, 22 nt, Homo sapiens
gcuacugucuaucugugcuucu

SEQ ID NO: 258467 - RNA, 23 nt, Homo sapiens
gcuaggagagaugaaacacaggu

SEQ ID NO: 258468 - RNA, 22 nt, Homo sapiens
gcucaguuuccucagcugcaaa

SEQ ID NO: 258469 - RNA, 22 nt, Homo sapiens
gcucaugagacaagcaggagua

SEQ ID NO: 258470 - RNA, 22 nt, Homo sapiens
gcugcuguuuaguuucuccugg

SEQ ID NO: 258471 - RNA, 22 nt, Homo sapiens
gcuggaauuaacauagaugugc

SEQ ID NO: 258472 - RNA, 22 nt, Homo sapiens
gcugguguagagugcagaaagg

SEQ ID NO: 258473 - RNA, 22 nt, Homo sapiens
gcugguguucaggcccucaguc

SEQ ID NO: 258474 - RNA, 22 nt, Homo sapiens
gcugucaugagcaacacaugaa

SEQ ID NO: 258475 - RNA, 21 nt, Homo sapiens
gcuuuuucggaagucuuuggc

SEQ ID NO: 258476 - RNA, 22 nt, Homo sapiens
ggaaagcuagguguggguguac

SEQ ID NO: 258477 - RNA, 19 nt, Homo sapiens
ggaaaugucuauuaagauc

SEQ ID NO: 258478 - RNA, 22 nt, Homo sapiens
ggagguaauaaguuccagugua

SEQ ID NO: 258479 - RNA, 20 nt, Homo sapiens
ggagguuguauaaguacauc

SEQ ID NO: 258480 - RNA, 22 nt, Homo sapiens
ggagucugacuuauaggaaccu

SEQ ID NO: 258481 - RNA, 22 nt, Homo sapiens
ggagucugauguucuaaggcag

SEQ ID NO: 258482 - RNA, 23 nt, Homo sapiens
ggaguguaaugacucgaucucgg

SEQ ID NO: 258483 - RNA, 22 nt, Homo sapiens
ggagugucagaaacaguguccu

SEQ ID NO: 258484 - RNA, 22 nt, Homo sapiens
ggaucacagccagcucccagaa

SEQ ID NO: 258485 - RNA, 21 nt, Homo sapiens
ggauucaucccucaugaauuu

SEQ ID NO: 258486 - RNA, 23 nt, Homo sapiens
ggauucaucuguuuguucgcugu

SEQ ID NO: 258487 - RNA, 22 nt, Homo sapiens
ggcaaaugaagauggagaggcu

SEQ ID NO: 258488 - RNA, 21 nt, Homo sapiens
cucaaaguacugauauuacag

SEQ ID NO: 258489 - RNA, 18 nt, Homo sapiens
cucacacccuaaucagga

SEQ ID NO: 258490 - RNA, 18 nt, Homo sapiens
cucacaguaacuuuuaag

SEQ ID NO: 258491 - RNA, 20 nt, Homo sapiens
cucaccagguguaggcugag

SEQ ID NO: 258492 - RNA, 22 nt, Homo sapiens
cucacuaggaaguaaaguuugu

SEQ ID NO: 258493 - RNA, 22 nt, Homo sapiens
cucacugggaccacucugaagu

SEQ ID NO: 258494 - RNA, 20 nt, Homo sapiens
cucagauuauucugaagcaa

SEQ ID NO: 258495 - RNA, 22 nt, Homo sapiens
cucaggguacuucuccuuugcu

SEQ ID NO: 258496 - RNA, 22 nt, Homo sapiens
cucaugcugucuucugggguaa

SEQ ID NO: 258497 - RNA, 19 nt, Homo sapiens
cucauggagaaggagaaua

SEQ ID NO: 258498 - RNA, 22 nt, Homo sapiens
cucauugcaaucuccaccuccc

SEQ ID NO: 258499 - RNA, 22 nt, Homo sapiens
cuccaggugucauccaccuccu

SEQ ID NO: 258500 - RNA, 22 nt, Homo sapiens
cucccacccucauuuuuaggca

SEQ ID NO: 258501 - RNA, 23 nt, Homo sapiens
cucccugaacaugacacaccaga

SEQ ID NO: 258502 - RNA, 22 nt, Homo sapiens
cucugguggaagcagggggcaa

SEQ ID NO: 258503 - RNA, 22 nt, Homo sapiens
cucuuuaguaagcaguugauga

SEQ ID NO: 258504 - RNA, 19 nt, Homo sapiens
cucuuuggugucucuucuu

SEQ ID NO: 258505 - RNA, 22 nt, Homo sapiens
cucuuuuguuccuaguuugauc

SEQ ID NO: 258506 - RNA, 22 nt, Homo sapiens
cugaaaagcaucugcauagcug

SEQ ID NO: 258507 - RNA, 22 nt, Homo sapiens
cugaaggcagguagaauagaga

SEQ ID NO: 258508 - RNA, 22 nt, Homo sapiens
cugacugugcaugcccagcccc

SEQ ID NO: 258509 - RNA, 22 nt, Homo sapiens
cugacuuuagaacccaaaaagu

SEQ ID NO: 258510 - RNA, 22 nt, Homo sapiens
cugagacuggguaauguauaaa

SEQ ID NO: 258511 - RNA, 22 nt, Homo sapiens
cugagauaauuucuagguguca

SEQ ID NO: 258512 - RNA, 22 nt, Homo sapiens
cugagauacacuaauagucucu

SEQ ID NO: 258513 - RNA, 22 nt, Homo sapiens
cugagauuaagauauugggagu

SEQ ID NO: 258514 - RNA, 22 nt, Homo sapiens
cugagcaaaaugaagacacgau

SEQ ID NO: 258515 - RNA, 22 nt, Homo sapiens
cugagcuaugccuggaaaggca

SEQ ID NO: 258516 - RNA, 22 nt, Homo sapiens
cugaggacaucagggaagcauc

SEQ ID NO: 258517 - RNA, 22 nt, Homo sapiens
cugaggauauucagccucugug

SEQ ID NO: 258518 - RNA, 22 nt, Homo sapiens
cugagguaggugaucagugcuu

SEQ ID NO: 258519 - RNA, 22 nt, Homo sapiens
cugaugaaguauuuguucugga

SEQ ID NO: 258520 - RNA, 22 nt, Homo sapiens
cugauguagguggucugugauc

SEQ ID NO: 258521 - RNA, 19 nt, Homo sapiens
cugcacugagaaaaggagg

SEQ ID NO: 258522 - RNA, 19 nt, Homo sapiens
cugcaugagacaguugguu

SEQ ID NO: 258523 - RNA, 22 nt, Homo sapiens
cugcccuuucuauaugauguaa

SEQ ID NO: 258524 - RNA, 22 nt, Homo sapiens
cugcuggucuuuaaggucuagg

SEQ ID NO: 258525 - RNA, 22 nt, Homo sapiens
cuggaaagcaaagggugcauug

SEQ ID NO: 258526 - RNA, 22 nt, Homo sapiens
cuggaauuacaggguugagcua

SEQ ID NO: 258527 - RNA, 22 nt, Homo sapiens
cuggagaucuugacauugaagu

SEQ ID NO: 258528 - RNA, 22 nt, Homo sapiens
cuggagcaaaggugacucuugu

SEQ ID NO: 258529 - RNA, 22 nt, Homo sapiens
cuggcaaaaagagggcaauaau

SEQ ID NO: 258530 - RNA, 22 nt, Homo sapiens
cuggcaaauaguagagccagga

SEQ ID NO: 258531 - RNA, 22 nt, Homo sapiens
cuggcaccauacacuguuguug

SEQ ID NO: 258532 - RNA, 22 nt, Homo sapiens
cuggcgagacagcuccaucacu

SEQ ID NO: 258533 - RNA, 22 nt, Homo sapiens
cugggaucaguucuagucagaa

SEQ ID NO: 258534 - RNA, 22 nt, Homo sapiens
cugguuguucuggaugggcagg

SEQ ID NO: 258535 - RNA, 19 nt, Homo sapiens
cugucacugaggaagacug

SEQ ID NO: 258536 - RNA, 22 nt, Homo sapiens
cuguccugcagagucagaauga

SEQ ID NO: 258537 - RNA, 22 nt, Homo sapiens
cugugauagguuagucaugaau

SEQ ID NO: 258538 - RNA, 22 nt, Homo sapiens
cugugauuauauaguuaaggua

SEQ ID NO: 258539 - RNA, 22 nt, Homo sapiens
cugugcaugcgcggagcugaaa

SEQ ID NO: 258540 - RNA, 22 nt, Homo sapiens
cugugcauggauuuuaagauug

SEQ ID NO: 258541 - RNA, 22 nt, Homo sapiens
cugugguuacguucuuugugcu

SEQ ID NO: 258542 - RNA, 19 nt, Homo sapiens
cuuaggugaccaguuccca

SEQ ID NO: 258543 - RNA, 22 nt, Homo sapiens
cuucaaguguggccaccugacc

SEQ ID NO: 258544 - RNA, 22 nt, Homo sapiens
cuucagcaauauauccccuggg

SEQ ID NO: 258545 - RNA, 18 nt, Homo sapiens
cuucauugcuguuuugcu

SEQ ID NO: 258546 - RNA, 22 nt, Homo sapiens
cuuccauaguuacacccaggga

SEQ ID NO: 258547 - RNA, 22 nt, Homo sapiens
cuucuguuaguucugauaacuu

SEQ ID NO: 258548 - RNA, 22 nt, Homo sapiens
cuucuugcuguguccucacaug

SEQ ID NO: 258549 - RNA, 21 nt, Homo sapiens
cuucuuggggcagggcagggu

SEQ ID NO: 258550 - RNA, 22 nt, Homo sapiens
cuugagcaaacaaaggugguag

SEQ ID NO: 258551 - RNA, 22 nt, Homo sapiens
cuuggcacgugauagguguuga

SEQ ID NO: 258552 - RNA, 22 nt, Homo sapiens
cuuggcauuguguugauagaag

SEQ ID NO: 258553 - RNA, 22 nt, Homo sapiens
cuuggguaagucauuaaaauua

SEQ ID NO: 258554 - RNA, 22 nt, Homo sapiens
cuuuacaguuggacucacgagg

SEQ ID NO: 258555 - RNA, 22 nt, Homo sapiens
cuuucacacuguuggugggaau

SEQ ID NO: 258556 - RNA, 21 nt, Homo sapiens
cuuugcacugcuccucagcuc

SEQ ID NO: 258557 - RNA, 20 nt, Homo sapiens
cuuuggcaaugagaacaggg

SEQ ID NO: 258558 - RNA, 22 nt, Homo sapiens
cuuuggguauucucccuugggg

SEQ ID NO: 258559 - RNA, 21 nt, Homo sapiens
cuuugguagaguuuuuagggu

SEQ ID NO: 258560 - RNA, 22 nt, Homo sapiens
cuuuggugagggauaaauuuca

SEQ ID NO: 258561 - RNA, 22 nt, Homo sapiens
cuuuuggcuuagaauugucuug

SEQ ID NO: 258562 - RNA, 21 nt, Homo sapiens
cuuuuuacucguucauaugca

SEQ ID NO: 258563 - RNA, 22 nt, Homo sapiens
cuuuuugcuagagucuaggguc

SEQ ID NO: 258564 - RNA, 22 nt, Homo sapiens
cuuuuugguagagcaggugugc

SEQ ID NO: 258565 - RNA, 22 nt, Homo sapiens
gaaagcugguauagauacauua

SEQ ID NO: 258566 - RNA, 22 nt, Homo sapiens
gaaagguaggaacagggugcag

SEQ ID NO: 258567 - RNA, 22 nt, Homo sapiens
gaaaucucuacuauuuugaucu

SEQ ID NO: 258568 - RNA, 22 nt, Homo sapiens
gaaaugcucagggguuuuccag

SEQ ID NO: 258569 - RNA, 23 nt, Homo sapiens
gaaaugucuuagugaaauugcuu

SEQ ID NO: 258570 - RNA, 22 nt, Homo sapiens
gaaauguugauagugggcauug

SEQ ID NO: 258571 - RNA, 22 nt, Homo sapiens
gaacccuggaggcggagguugc

SEQ ID NO: 258572 - RNA, 22 nt, Homo sapiens
gaacuggcuuagugaaacuucc

SEQ ID NO: 258573 - RNA, 22 nt, Homo sapiens
gaacuuguguugcuucacaugu

SEQ ID NO: 258574 - RNA, 22 nt, Homo sapiens
gaaguaguaaaauuuauugcag

SEQ ID NO: 258575 - RNA, 21 nt, Homo sapiens
gaauggcaccauuagcauaua

SEQ ID NO: 258576 - RNA, 22 nt, Homo sapiens
gacaagagaacacugcuauauu

SEQ ID NO: 258577 - RNA, 22 nt, Homo sapiens
gacauguuuucaagauuuauaa

SEQ ID NO: 258578 - RNA, 22 nt, Homo sapiens
gacauguuuucauguauuugga

SEQ ID NO: 258579 - RNA, 22 nt, Homo sapiens
acagugcuucugauaugaugcc

SEQ ID NO: 258580 - RNA, 22 nt, Homo sapiens
acaucacuguuugauugauuga

SEQ ID NO: 258581 - RNA, 21 nt, Homo sapiens
acaucagaguugugaagguag

SEQ ID NO: 258582 - RNA, 22 nt, Homo sapiens
acaugcauauguuggaagaaag

SEQ ID NO: 258583 - RNA, 22 nt, Homo sapiens
acauggcacugcgggcuucuug

SEQ ID NO: 258584 - RNA, 22 nt, Homo sapiens
acauguaauugauuuuguguua

SEQ ID NO: 258585 - RNA, 22 nt, Homo sapiens
acauucagcuguuguuucaaug

SEQ ID NO: 258586 - RNA, 18 nt, Homo sapiens
acauucagcuugaagaua

SEQ ID NO: 258587 - RNA, 22 nt, Homo sapiens
accacagugcuuccugcucacg

SEQ ID NO: 258588 - RNA, 22 nt, Homo sapiens
accaccacucccgcauucuaaa

SEQ ID NO: 258589 - RNA, 22 nt, Homo sapiens
accccuuacaucagcucuggua

SEQ ID NO: 258590 - RNA, 22 nt, Homo sapiens
acccuggaggucuacagugcag

SEQ ID NO: 258591 - RNA, 22 nt, Homo sapiens
acccuggaguaguaggaaucug

SEQ ID NO: 258592 - RNA, 22 nt, Homo sapiens
acgcagcacauucacagcuaug

SEQ ID NO: 258593 - RNA, 22 nt, Homo sapiens
acucacagcaaccuccgccucc

SEQ ID NO: 258594 - RNA, 22 nt, Homo sapiens
acugagacugagaauguuucuu

SEQ ID NO: 258595 - RNA, 22 nt, Homo sapiens
acugcacuccagccucgcaaca

SEQ ID NO: 258596 - RNA, 22 nt, Homo sapiens
acugcacuccagccuggacgac

SEQ ID NO: 258597 - RNA, 22 nt, Homo sapiens
acugcacuccagccuuggccac

SEQ ID NO: 258598 - RNA, 22 nt, Homo sapiens
acugcacugucaaccuccuggg

SEQ ID NO: 258599 - RNA, 22 nt, Homo sapiens
acugcacuucaaccucauugac

SEQ ID NO: 258600 - RNA, 18 nt, Homo sapiens
acuggauguaaagggucc

SEQ ID NO: 258601 - RNA, 22 nt, Homo sapiens
acuggcauagggcgggcacagu

SEQ ID NO: 258602 - RNA, 22 nt, Homo sapiens
acuggcucugcuuuacaaacag

SEQ ID NO: 258603 - RNA, 20 nt, Homo sapiens
acugggcuaccgaaguaagg

SEQ ID NO: 258604 - RNA, 17 nt, Homo sapiens
acuuuuugaggaggcau

SEQ ID NO: 258605 - RNA, 22 nt, Homo sapiens
acuuuuugaugaggucguuugu

SEQ ID NO: 258606 - RNA, 22 nt, Homo sapiens
acuuuuugauggggagaacauu

SEQ ID NO: 258607 - RNA, 22 nt, Homo sapiens
agaaacacagguggaauugcuu

SEQ ID NO: 258608 - RNA, 22 nt, Homo sapiens
agaaagcgcuucccuuugcugg

SEQ ID NO: 258609 - RNA, 23 nt, Homo sapiens
agaaaugucuauucagggucccu

SEQ ID NO: 258610 - RNA, 22 nt, Homo sapiens
agaaauguuuauucaaacccgu

SEQ ID NO: 258611 - RNA, 22 nt, Homo sapiens
agaauguaaacagaauagagga

SEQ ID NO: 258612 - RNA, 22 nt, Homo sapiens
agaauguaacucuaugaaggca

SEQ ID NO: 258613 - RNA, 22 nt, Homo sapiens
agaauucugucauguuuauauu

SEQ ID NO: 258614 - RNA, 22 nt, Homo sapiens
agacagcugguagcacuuccug

SEQ ID NO: 258615 - RNA, 22 nt, Homo sapiens
agacccuguauguguuuaguuu

SEQ ID NO: 258616 - RNA, 22 nt, Homo sapiens
agacuagacagaugaacagcac

SEQ ID NO: 258617 - RNA, 22 nt, Homo sapiens
agacucauuuuuaucgagcaug

SEQ ID NO: 258618 - RNA, 22 nt, Homo sapiens
agagauaauuagguuaaaugag

SEQ ID NO: 258619 - RNA, 20 nt, Homo sapiens
agagaucaguaauucaucaa

SEQ ID NO: 258620 - RNA, 22 nt, Homo sapiens
agagauuauccuggcuucucug

SEQ ID NO: 258621 - RNA, 22 nt, Homo sapiens
agagcauugaguuaaugguuca

SEQ ID NO: 258622 - RNA, 18 nt, Homo sapiens
agagcuaugaacauaugc

SEQ ID NO: 258623 - RNA, 22 nt, Homo sapiens
agagguauacauuugagagcca

SEQ ID NO: 258624 - RNA, 22 nt, Homo sapiens
agaguauacaugugagugagau

SEQ ID NO: 258625 - RNA, 19 nt, Homo sapiens
agaguauuguuacuucucu

SEQ ID NO: 258626 - RNA, 22 nt, Homo sapiens
agagucacaugaggcccuucau

SEQ ID NO: 258627 - RNA, 22 nt, Homo sapiens
agauacaucuaugugucugugu

SEQ ID NO: 258628 - RNA, 22 nt, Homo sapiens
agaucacagucuuugguuuuag

SEQ ID NO: 258629 - RNA, 22 nt, Homo sapiens
agcacagccuuguguuuucuug

SEQ ID NO: 258630 - RNA, 22 nt, Homo sapiens
agcaccaauaaucagaguucuu

SEQ ID NO: 258631 - RNA, 22 nt, Homo sapiens
agcagcaucgggaaguuggcca

SEQ ID NO: 258632 - RNA, 22 nt, Homo sapiens
agcagcaugcaaauggacuaau

SEQ ID NO: 258633 - RNA, 22 nt, Homo sapiens
agcagcucaugccuuugggagg

SEQ ID NO: 258634 - RNA, 22 nt, Homo sapiens
agcagguguccacaauguuugc

SEQ ID NO: 258635 - RNA, 22 nt, Homo sapiens
agcaucacaugggcugcuuggg

SEQ ID NO: 258636 - RNA, 22 nt, Homo sapiens
agcaugauugggguugggcaca

SEQ ID NO: 258637 - RNA, 22 nt, Homo sapiens
agccaagacucuguuccccuug

SEQ ID NO: 258638 - RNA, 22 nt, Homo sapiens
agccaguauuuccacagagugg

SEQ ID NO: 258639 - RNA, 22 nt, Homo sapiens
agcccagagacuguguaaauuu

SEQ ID NO: 258640 - RNA, 20 nt, Homo sapiens
agccccauguaaaccacaug

SEQ ID NO: 258641 - RNA, 22 nt, Homo sapiens
agccucauucuacauguuaaug

SEQ ID NO: 258642 - RNA, 22 nt, Homo sapiens
agccuguguugaauuauagaaa

SEQ ID NO: 258643 - RNA, 23 nt, Homo sapiens
agccuguugccuaggcagcucau

SEQ ID NO: 258644 - RNA, 22 nt, Homo sapiens
agcgccacugcacuccagccug

SEQ ID NO: 258645 - RNA, 22 nt, Homo sapiens
agcuaguguucaccagagguca

SEQ ID NO: 258646 - RNA, 22 nt, Homo sapiens
agcuccaugauaguaugucugu

SEQ ID NO: 258647 - RNA, 22 nt, Homo sapiens
agcuccauuguaaucaccuggu

SEQ ID NO: 258648 - RNA, 22 nt, Homo sapiens
agcugccagucuuguaaggccu

SEQ ID NO: 258649 - RNA, 21 nt, Homo sapiens
agcugguuuccacagugugcu

SEQ ID NO: 258650 - RNA, 22 nt, Homo sapiens
agcuguuguucucagaggcuuu

SEQ ID NO: 258651 - RNA, 22 nt, Homo sapiens
agcuugugauuuagagugagag

SEQ ID NO: 258652 - RNA, 22 nt, Homo sapiens
agcuugugcuguaugaagggcc

SEQ ID NO: 258653 - RNA, 21 nt, Homo sapiens
agcuuguguguaucacagugu

SEQ ID NO: 258654 - RNA, 22 nt, Homo sapiens
aggacacugauguaugcugugg

SEQ ID NO: 258655 - RNA, 22 nt, Homo sapiens
aggaccccucaucagcaccagu

SEQ ID NO: 258656 - RNA, 22 nt, Homo sapiens
aggagcacaauggucaugugga

SEQ ID NO: 258657 - RNA, 22 nt, Homo sapiens
aggagcacaggacuuugauuau

SEQ ID NO: 258658 - RNA, 22 nt, Homo sapiens
aggaggauugcuuucaucuuuu

SEQ ID NO: 258659 - RNA, 22 nt, Homo sapiens
aggagguagggugugaaacagc

SEQ ID NO: 258660 - RNA, 22 nt, Homo sapiens
aggcaagaaugcuuguuucacc

SEQ ID NO: 258661 - RNA, 16 nt, Homo sapiens
aggcaagaauugaggu

SEQ ID NO: 258662 - RNA, 22 nt, Homo sapiens
aggcaagugggagacagcauuu

SEQ ID NO: 258663 - RNA, 22 nt, Homo sapiens
aggcaaugugagaguuuauuca

SEQ ID NO: 258664 - RNA, 22 nt, Homo sapiens
aggcacgguggcucacaccugu

SEQ ID NO: 258665 - RNA, 22 nt, Homo sapiens
aggcaggugaaagauaguuuua

SEQ ID NO: 258666 - RNA, 22 nt, Homo sapiens
aggcaugaguucagaggguaug

SEQ ID NO: 258667 - RNA, 22 nt, Homo sapiens
aggcuuuauuacagggucucag

SEQ ID NO: 258668 - RNA, 22 nt, Homo sapiens
agggcuuguuuaacuaucauua

SEQ ID NO: 258669 - RNA, 22 nt, Homo sapiens
agguagcauagcgggaauauca

SEQ ID NO: 258670 - RNA, 22 nt, Homo sapiens
uuugaaguguggcacugaguuu

SEQ ID NO: 258671 - RNA, 22 nt, Homo sapiens
cacugcacucuucuucugggca

SEQ ID NO: 258672 - RNA, 22 nt, Homo sapiens
cacugcaguguaauuaagguug

SEQ ID NO: 258673 - RNA, 22 nt, Homo sapiens
cacugcauuacucaugagcaug

SEQ ID NO: 258674 - RNA, 17 nt, Homo sapiens
cacugggugcaagagga

SEQ ID NO: 258675 - RNA, 22 nt, Homo sapiens
cacugggugccauauguuugcu

SEQ ID NO: 258676 - RNA, 22 nt, Homo sapiens
cagaaguauugguaugcucugu

SEQ ID NO: 258677 - RNA, 22 nt, Homo sapiens
cagagaacugaguuauuuucuu

SEQ ID NO: 258678 - RNA, 20 nt, Homo sapiens
cagagcaaagcaguccuggc

SEQ ID NO: 258679 - RNA, 22 nt, Homo sapiens
cagcacauagcaguugcucagu

SEQ ID NO: 258680 - RNA, 22 nt, Homo sapiens
cagcccuacacagacugacuca

SEQ ID NO: 258681 - RNA, 22 nt, Homo sapiens
cagccgggugagguggcuuguu

SEQ ID NO: 258682 - RNA, 22 nt, Homo sapiens
caggcacgcuugggagacacac

SEQ ID NO: 258683 - RNA, 22 nt, Homo sapiens
cagggcaugugggucuauuggc

SEQ ID NO: 258684 - RNA, 22 nt, Homo sapiens
caguacaauguugauuagaagu

SEQ ID NO: 258685 - RNA, 22 nt, Homo sapiens
cagugcaaccuccaucucucgg

SEQ ID NO: 258686 - RNA, 22 nt, Homo sapiens
cagugcuuuaucaaguccucca

SEQ ID NO: 258687 - RNA, 22 nt, Homo sapiens
caguggaugaacaagaagugau

SEQ ID NO: 258688 - RNA, 22 nt, Homo sapiens
cagugguuuucaacccugguug

SEQ ID NO: 258689 - RNA, 22 nt, Homo sapiens
cauacaugugcuugucuuaugc

SEQ ID NO: 258690 - RNA, 22 nt, Homo sapiens
cauaguacuugcauaguacuau

SEQ ID NO: 258691 - RNA, 22 nt, Homo sapiens
caucaaaguggagggaaggacc

SEQ ID NO: 258692 - RNA, 22 nt, Homo sapiens
caucacuguugguacaaguaau

SEQ ID NO: 258693 - RNA, 22 nt, Homo sapiens
caucacuuugccuccgucucua

SEQ ID NO: 258694 - RNA, 22 nt, Homo sapiens
caucacuuuuccuuuuacagau

SEQ ID NO: 258695 - RNA, 22 nt, Homo sapiens
caucagauugagaucaucuaag

SEQ ID NO: 258696 - RNA, 22 nt, Homo sapiens
caucgcacuccagccugggcaa

SEQ ID NO: 258697 - RNA, 22 nt, Homo sapiens
caugaaagacugaggaauugga

SEQ ID NO: 258698 - RNA, 22 nt, Homo sapiens
caugaaagugagaaacuccugg

SEQ ID NO: 258699 - RNA, 22 nt, Homo sapiens
caugacacuggcauguuucuuu

SEQ ID NO: 258700 - RNA, 22 nt, Homo sapiens
caugccacugcacuccaaccug

SEQ ID NO: 258701 - RNA, 22 nt, Homo sapiens
cauggcauuugcagaguugaaa

SEQ ID NO: 258702 - RNA, 22 nt, Homo sapiens
cauggcccugggcugggcgaac

SEQ ID NO: 258703 - RNA, 23 nt, Homo sapiens
cauggcuguuaacacuguuugag

SEQ ID NO: 258704 - RNA, 21 nt, Homo sapiens
caugucacugcacucuagccu

SEQ ID NO: 258705 - RNA, 22 nt, Homo sapiens
cauuccacauguaggacaauuu

SEQ ID NO: 258706 - RNA, 20 nt, Homo sapiens
cauugcccuccagccugggc

SEQ ID NO: 258707 - RNA, 22 nt, Homo sapiens
cauuguacauaaguauggagua

SEQ ID NO: 258708 - RNA, 22 nt, Homo sapiens
cauuugguggcuacagaguaac

SEQ ID NO: 258709 - RNA, 22 nt, Homo sapiens
ccaaaguauuuucacugauauc

SEQ ID NO: 258710 - RNA, 23 nt, Homo sapiens
ccacaaugguugaacuagauuac

SEQ ID NO: 258711 - RNA, 22 nt, Homo sapiens
ccacacugucuuggugggaaac

SEQ ID NO: 258712 - RNA, 22 nt, Homo sapiens
ccacccuuccauucuuccucuu

SEQ ID NO: 258713 - RNA, 22 nt, Homo sapiens
ccacuguuuaaauggcugagga

SEQ ID NO: 258714 - RNA, 22 nt, Homo sapiens
ccagaguugccucagguuucug

SEQ ID NO: 258715 - RNA, 22 nt, Homo sapiens
ccagcaccauuuauuaaauagg

SEQ ID NO: 258716 - RNA, 22 nt, Homo sapiens
ccaggguuccacgccuggcugu

SEQ ID NO: 258717 - RNA, 18 nt, Homo sapiens
ccagugcaaggaaagccc

SEQ ID NO: 258718 - RNA, 22 nt, Homo sapiens
ccagugcauggaucccaggggg

SEQ ID NO: 258719 - RNA, 20 nt, Homo sapiens
ccaguguuauuuauguucua

SEQ ID NO: 258720 - RNA, 19 nt, Homo sapiens
ccaguguucugauugcacu

SEQ ID NO: 258721 - RNA, 22 nt, Homo sapiens
cccagugguuacauaaggagua

SEQ ID NO: 258722 - RNA, 22 nt, Homo sapiens
ccccagugguugcaacagcaga

SEQ ID NO: 258723 - RNA, 22 nt, Homo sapiens
ccccauguucucucugcagcuc

SEQ ID NO: 258724 - RNA, 17 nt, Homo sapiens
cccuaguagcugggacu

SEQ ID NO: 258725 - RNA, 22 nt, Homo sapiens
cccucauucauucauccuaugu

SEQ ID NO: 258726 - RNA, 22 nt, Homo sapiens
cccucgagaaaccaucugcuga

SEQ ID NO: 258727 - RNA, 22 nt, Homo sapiens
cccuggacauucaucauuaugu

SEQ ID NO: 258728 - RNA, 21 nt, Homo sapiens
cccugguguuuggaguuugag

SEQ ID NO: 258729 - RNA, 22 nt, Homo sapiens
cccuugcacuucagagcugcau

SEQ ID NO: 258730 - RNA, 22 nt, Homo sapiens
ccggguguuuuguucucucaga

SEQ ID NO: 258731 - RNA, 22 nt, Homo sapiens
ccuaggcacugggguccagccc

SEQ ID NO: 258732 - RNA, 21 nt, Homo sapiens
ccugaagaagugaccucugag

SEQ ID NO: 258733 - RNA, 22 nt, Homo sapiens
ccuguguuaugguuucuaaugu

SEQ ID NO: 258734 - RNA, 22 nt, Homo sapiens
ccuucauugcaucuuuaagaga

SEQ ID NO: 258735 - RNA, 22 nt, Homo sapiens
ccuuggcaauggcuggggcuga

SEQ ID NO: 258736 - RNA, 22 nt, Homo sapiens
ccuuuguggggcgguggguaau

SEQ ID NO: 258737 - RNA, 22 nt, Homo sapiens
ccuuuuugaguugccagaguuc

SEQ ID NO: 258738 - RNA, 22 nt, Homo sapiens
ccuuuuuguaguggaaguagga

SEQ ID NO: 258739 - RNA, 16 nt, Homo sapiens
cuaaaaugucuacuug

SEQ ID NO: 258740 - RNA, 22 nt, Homo sapiens
cuaaaguagccaggacugcagg

SEQ ID NO: 258741 - RNA, 22 nt, Homo sapiens
cuaaagugcuuaaaaucucauu

SEQ ID NO: 258742 - RNA, 22 nt, Homo sapiens
cuaaaguucuucugagagaaca

SEQ ID NO: 258743 - RNA, 22 nt, Homo sapiens
cuaacacagggcaagucaggcu

SEQ ID NO: 258744 - RNA, 22 nt, Homo sapiens
cuaaucugugcauagaagaggc

SEQ ID NO: 258745 - RNA, 22 nt, Homo sapiens
cuacagcagcccaguccccgaa

SEQ ID NO: 258746 - RNA, 23 nt, Homo sapiens
cuacagugccugucucuuuggcc

SEQ ID NO: 258747 - RNA, 22 nt, Homo sapiens
cuaccuggguggcucaugacuu

SEQ ID NO: 258748 - RNA, 22 nt, Homo sapiens
cuagauuguuuccauaaugaca

SEQ ID NO: 258749 - RNA, 22 nt, Homo sapiens
cuagcagaacaauacaauucgg

SEQ ID NO: 258750 - RNA, 22 nt, Homo sapiens
cuagccuggagugcaguggugc

SEQ ID NO: 258751 - RNA, 22 nt, Homo sapiens
cuaucucauugguuuuugaaag

SEQ ID NO: 258752 - RNA, 22 nt, Homo sapiens
cuaugcuucuuaaauuaguuau

SEQ ID NO: 258753 - RNA, 22 nt, Homo sapiens
cuauucacaggcaauauguaca

SEQ ID NO: 258754 - RNA, 19 nt, Homo sapiens
cuauugcacauagcugaag

SEQ ID NO: 258755 - RNA, 22 nt, Homo sapiens
uuaaaguguuuucaaaauguca

SEQ ID NO: 258756 - RNA, 22 nt, Homo sapiens
uuaaaugcacauacuugagaaa

SEQ ID NO: 258757 - RNA, 22 nt, Homo sapiens
uuaacacugccauugauacugu

SEQ ID NO: 258758 - RNA, 22 nt, Homo sapiens
uuaacagcacaugcugucccuu

SEQ ID NO: 258759 - RNA, 22 nt, Homo sapiens
uuaacaguuaauucuuuggcaa

SEQ ID NO: 258760 - RNA, 22 nt, Homo sapiens
uuaagcugaauuuaagcuucgg

SEQ ID NO: 258761 - RNA, 22 nt, Homo sapiens
uuaaggcagugucuaugccagu

SEQ ID NO: 258762 - RNA, 23 nt, Homo sapiens
uuaaggugaugucuuugugccuc

SEQ ID NO: 258763 - RNA, 22 nt, Homo sapiens
uuaaguagaugaaugugaaugu

SEQ ID NO: 258764 - RNA, 22 nt, Homo sapiens
uuaagugguagguggugcccaa

SEQ ID NO: 258765 - RNA, 22 nt, Homo sapiens
uuaaucugucuaugauuuuggu

SEQ ID NO: 258766 - RNA, 22 nt, Homo sapiens
uuaaucuguucucuguauucua

SEQ ID NO: 258767 - RNA, 22 nt, Homo sapiens
uuaaugaacuuuauuuuguaga

SEQ ID NO: 258768 - RNA, 22 nt, Homo sapiens
uuaauucugucugcccucaucc

SEQ ID NO: 258769 - RNA, 22 nt, Homo sapiens
uuaauuguccaaguucaucucu

SEQ ID NO: 258770 - RNA, 22 nt, Homo sapiens
uuacaacugucuuacugguuau

SEQ ID NO: 258771 - RNA, 22 nt, Homo sapiens
uuacaccuguaauccagcacuu

SEQ ID NO: 258772 - RNA, 21 nt, Homo sapiens
uuacaguugguugugaggugg

SEQ ID NO: 258773 - RNA, 22 nt, Homo sapiens
uuacauguggugugaagaagag

SEQ ID NO: 258774 - RNA, 22 nt, Homo sapiens
uuacuagaaacagggcuucgcc

SEQ ID NO: 258775 - RNA, 22 nt, Homo sapiens
uuacuguauagaaucaucuuga

SEQ ID NO: 258776 - RNA, 23 nt, Homo sapiens
uuagaucuuuaaggaaucuccac

SEQ ID NO: 258777 - RNA, 22 nt, Homo sapiens
uuagauuauugagcauccacug

SEQ ID NO: 258778 - RNA, 22 nt, Homo sapiens
uuagcacaucuuucuauguaag

SEQ ID NO: 258779 - RNA, 22 nt, Homo sapiens
uuagcagcacaaaagcagacua

SEQ ID NO: 258780 - RNA, 22 nt, Homo sapiens
uuagcagcaugaaaauggacug

SEQ ID NO: 258781 - RNA, 22 nt, Homo sapiens
uuagcagcucuggugacaaggu

SEQ ID NO: 258782 - RNA, 21 nt, Homo sapiens
uuaggcagugucagaggugag

SEQ ID NO: 258783 - RNA, 22 nt, Homo sapiens
uuagguauuaggaaauaugcuu

SEQ ID NO: 258784 - RNA, 22 nt, Homo sapiens
uuagguauuuuguuaugucagc

SEQ ID NO: 258785 - RNA, 22 nt, Homo sapiens
uuauacucgucugaaugauucu

SEQ ID NO: 258786 - RNA, 22 nt, Homo sapiens
uuauauguuacucccucuagca

SEQ ID NO: 258787 - RNA, 22 nt, Homo sapiens
uuaucauagugcaguuuucuga

SEQ ID NO: 258788 - RNA, 22 nt, Homo sapiens
uuaugcaucuuccacacucauu

SEQ ID NO: 258789 - RNA, 22 nt, Homo sapiens
uuauuagguuaaccuauagcua

SEQ ID NO: 258790 - RNA, 22 nt, Homo sapiens
uuauugcacuccagccugggua

SEQ ID NO: 258791 - RNA, 22 nt, Homo sapiens
uuauuguccaaguuucccuuug

SEQ ID NO: 258792 - RNA, 22 nt, Homo sapiens
uucaaaaccucugcuuaagccc

SEQ ID NO: 258793 - RNA, 22 nt, Homo sapiens
uucaaaggauagauuaagauca

SEQ ID NO: 258794 - RNA, 22 nt, Homo sapiens
uucaagauggccccagugagcc

SEQ ID NO: 258795 - RNA, 22 nt, Homo sapiens
uucaagcuacaguggcaggguu

SEQ ID NO: 258796 - RNA, 22 nt, Homo sapiens
uucaagcuauggugaucuuuuc

SEQ ID NO: 258797 - RNA, 22 nt, Homo sapiens
uucaagcugggcaaauaagggg

SEQ ID NO: 258798 - RNA, 22 nt, Homo sapiens
uucacaguacucccuggaauua

SEQ ID NO: 258799 - RNA, 22 nt, Homo sapiens
uucacugcacuccagccugagc

SEQ ID NO: 258800 - RNA, 22 nt, Homo sapiens
uucacugcacuccagccugggu

SEQ ID NO: 258801 - RNA, 21 nt, Homo sapiens
uucacuggucuauuucccuuu

SEQ ID NO: 258802 - RNA, 22 nt, Homo sapiens
uucagauugcauaccgaaagua

SEQ ID NO: 258803 - RNA, 22 nt, Homo sapiens
uucagcaaugacagccuauaua

SEQ ID NO: 258804 - RNA, 22 nt, Homo sapiens
uucagcacugaaaauaugucau

SEQ ID NO: 258805 - RNA, 22 nt, Homo sapiens
uucagcaggccaggcccugacu

SEQ ID NO: 258806 - RNA, 22 nt, Homo sapiens
uucagggagaaggcaaacguug

SEQ ID NO: 258807 - RNA, 22 nt, Homo sapiens
uucaguagucaaaagauaaggg

SEQ ID NO: 258808 - RNA, 22 nt, Homo sapiens
uucaguccauuuccuuggucac

SEQ ID NO: 258809 - RNA, 22 nt, Homo sapiens
uucauagucacauucgaugucu

SEQ ID NO: 258810 - RNA, 22 nt, Homo sapiens
uucauagucuaauuuuuuccac

SEQ ID NO: 258811 - RNA, 22 nt, Homo sapiens
uucauaguucuuuuagucauua

SEQ ID NO: 258812 - RNA, 22 nt, Homo sapiens
uucaugcaucuguagugguuaa

SEQ ID NO: 258813 - RNA, 22 nt, Homo sapiens
uucauggaauauugaccauuuu

SEQ ID NO: 258814 - RNA, 22 nt, Homo sapiens
uucauggacucaauaguuucgc

SEQ ID NO: 258815 - RNA, 22 nt, Homo sapiens
uucauguagucaucauccugcu

SEQ ID NO: 258816 - RNA, 22 nt, Homo sapiens
uuccagagucaccuuucugucg

SEQ ID NO: 258817 - RNA, 22 nt, Homo sapiens
uuccaguaauagcacagcauug

SEQ ID NO: 258818 - RNA, 22 nt, Homo sapiens
uuccaguauuugggcaagcgca

SEQ ID NO: 258819 - RNA, 22 nt, Homo sapiens
uuccaguguuugacucaccuuu

SEQ ID NO: 258820 - RNA, 22 nt, Homo sapiens
uuccaguuauuauaccucuuaa

SEQ ID NO: 258821 - RNA, 22 nt, Homo sapiens
uuccaguuuuauggguauagag

SEQ ID NO: 258822 - RNA, 22 nt, Homo sapiens
uuccaugagaugcaucaaagcu

SEQ ID NO: 258823 - RNA, 22 nt, Homo sapiens
uucccucagaaacacacagccc

SEQ ID NO: 258824 - RNA, 22 nt, Homo sapiens
uuccugagagggcugggugcag

SEQ ID NO: 258825 - RNA, 22 nt, Homo sapiens
uuccugagccuuguaucuagua

SEQ ID NO: 258826 - RNA, 22 nt, Homo sapiens
uuccuugaaacagucaagagaa

SEQ ID NO: 258827 - RNA, 22 nt, Homo sapiens
uuccuugguucagggaaggucc

SEQ ID NO: 258828 - RNA, 20 nt, Homo sapiens
uucuacagucacaggaagau

SEQ ID NO: 258829 - RNA, 22 nt, Homo sapiens
uucucaguucgguggcagugcu

SEQ ID NO: 258830 - RNA, 22 nt, Homo sapiens
uucucauggaacaucuguacug

SEQ ID NO: 258831 - RNA, 22 nt, Homo sapiens
uucugagguuauauucucucaa

SEQ ID NO: 258832 - RNA, 22 nt, Homo sapiens
uucugauggaguaguccacaga

SEQ ID NO: 258833 - RNA, 22 nt, Homo sapiens
uucugcuagucugucagaucuu

SEQ ID NO: 258834 - RNA, 22 nt, Homo sapiens
uucuggccuccauuuuucuccu

SEQ ID NO: 258835 - RNA, 22 nt, Homo sapiens
uucuucaggccacaaaaauggu

SEQ ID NO: 258836 - RNA, 21 nt, Homo sapiens
uucuuugcucaguguuagagu

SEQ ID NO: 258837 - RNA, 22 nt, Homo sapiens
uugaaagaugaacuggauugga

SEQ ID NO: 258838 - RNA, 22 nt, Homo sapiens
uugaaaucuuccacagcccaag

SEQ ID NO: 258839 - RNA, 22 nt, Homo sapiens
uugaagacuaauuuagauaaug

SEQ ID NO: 258840 - RNA, 22 nt, Homo sapiens
uugaagguaauugguuuuauga

SEQ ID NO: 258841 - RNA, 22 nt, Homo sapiens
uugaauaggcucaugcuuauca

SEQ ID NO: 258842 - RNA, 22 nt, Homo sapiens
uugaauagugacuuugauucug

SEQ ID NO: 258843 - RNA, 22 nt, Homo sapiens
uugaauaguggugaaaguuuga

SEQ ID NO: 258844 - RNA, 22 nt, Homo sapiens
uugacaguugggcagggaaguu

SEQ ID NO: 258845 - RNA, 22 nt, Homo sapiens
uugacauaaucauuucacagug

SEQ ID NO: 258846 - RNA, 22 nt, Homo sapiens
aaaagagcugagagguauucuu

SEQ ID NO: 258847 - RNA, 22 nt, Homo sapiens
aaacugucuggaugcuugugga

SEQ ID NO: 258848 - RNA, 22 nt, Homo sapiens
aaagcuagagaagcugcuguca

SEQ ID NO: 258849 - RNA, 22 nt, Homo sapiens
aaaggcacugugacuuuauagg

SEQ ID NO: 258850 - RNA, 19 nt, Homo sapiens
aaagguaguaaccucugau

SEQ ID NO: 258851 - RNA, 19 nt, Homo sapiens
aaaguacucugaugccucu

SEQ ID NO: 258852 - RNA, 22 nt, Homo sapiens
aaagugauugcgguuuuugcca

SEQ ID NO: 258853 - RNA, 22 nt, Homo sapiens
aaagugauuguaguuuuugcca

SEQ ID NO: 258854 - RNA, 22 nt, Homo sapiens
aaagugcaguacuucguauauu

SEQ ID NO: 258855 - RNA, 22 nt, Homo sapiens
aaagugcuuacuaaguugccaa

SEQ ID NO: 258856 - RNA, 22 nt, Homo sapiens
aaaguggugugaguauguaucu

SEQ ID NO: 258857 - RNA, 22 nt, Homo sapiens
aaagugguuuuucagacuuuga

SEQ ID NO: 258858 - RNA, 19 nt, Homo sapiens
aaaguguuuuaaagaggau

SEQ ID NO: 258859 - RNA, 22 nt, Homo sapiens
aaaugcagauucugcuuagguu

SEQ ID NO: 258860 - RNA, 22 nt, Homo sapiens
aaaugcagucuuuguucugggc

SEQ ID NO: 258861 - RNA, 22 nt, Homo sapiens
aaaugcaugaggugggaagaaa

SEQ ID NO: 258862 - RNA, 20 nt, Homo sapiens
aaaugcuguaauguuuggga

SEQ ID NO: 258863 - RNA, 22 nt, Homo sapiens
aaaugcugucaaauuguguucu

SEQ ID NO: 258864 - RNA, 22 nt, Homo sapiens
aaaugcuuucuuggaccauuug

SEQ ID NO: 258865 - RNA, 18 nt, Homo sapiens
aaauucugucccuucuuc

SEQ ID NO: 258866 - RNA, 23 nt, Homo sapiens
aaauuugccuauuauuccuaugg

SEQ ID NO: 258867 - RNA, 22 nt, Homo sapiens
aacaggcuccuaggggugcacc

SEQ ID NO: 258868 - RNA, 22 nt, Homo sapiens
aacagucaauugcugaugaccu

SEQ ID NO: 258869 - RNA, 21 nt, Homo sapiens
aacagugcugaacagacaccu

SEQ ID NO: 258870 - RNA, 22 nt, Homo sapiens
aacccugagucaugagucuaga

SEQ ID NO: 258871 - RNA, 22 nt, Homo sapiens
aaccuguggauuuugguaucug

SEQ ID NO: 258872 - RNA, 22 nt, Homo sapiens
aacucugucuccuucaaguuca

SEQ ID NO: 258873 - RNA, 22 nt, Homo sapiens
aacugcuguuuggguacuggug

SEQ ID NO: 258874 - RNA, 22 nt, Homo sapiens
aacuggcauguuuuaaggcuua

SEQ ID NO: 258875 - RNA, 22 nt, Homo sapiens
aacuugcacuugauugagagcu

SEQ ID NO: 258876 - RNA, 22 nt, Homo sapiens
aagaccuaugcaggaagaaaug

SEQ ID NO: 258877 - RNA, 22 nt, Homo sapiens
aagagcauuauuuaguaauuuc

SEQ ID NO: 258878 - RNA, 19 nt, Homo sapiens
aagaugauguuugggcuaa

SEQ ID NO: 258879 - RNA, 21 nt, Homo sapiens
aagcacauugaguguguguga

SEQ ID NO: 258880 - RNA, 22 nt, Homo sapiens
aagcagauguguugaaaguacu

SEQ ID NO: 258881 - RNA, 22 nt, Homo sapiens
aagcauccagcauggaacugaa

SEQ ID NO: 258882 - RNA, 23 nt, Homo sapiens
aagcaugcacagcuguuuguggu

SEQ ID NO: 258883 - RNA, 22 nt, Homo sapiens
aagcuccauuucugccaugaga

SEQ ID NO: 258884 - RNA, 22 nt, Homo sapiens
aagcuggagugcaguggugcaa

SEQ ID NO: 258885 - RNA, 22 nt, Homo sapiens
aagcuggagugcaguggugcga

SEQ ID NO: 258886 - RNA, 22 nt, Homo sapiens
aagcugguuuuauaucugugag

SEQ ID NO: 258887 - RNA, 22 nt, Homo sapiens
aagcuguugguggauguaccau

SEQ ID NO: 258888 - RNA, 22 nt, Homo sapiens
aaggaaguaauuugguuuauag

SEQ ID NO: 258889 - RNA, 23 nt, Homo sapiens
aaggacacugaacacuucccagc

SEQ ID NO: 258890 - RNA, 22 nt, Homo sapiens
aaggagcuuaagugacuuguac

SEQ ID NO: 258891 - RNA, 22 nt, Homo sapiens
aaggcuuuuugcugacguccuu

SEQ ID NO: 258892 - RNA, 22 nt, Homo sapiens
aagggaauguuguagcugguuu

SEQ ID NO: 258893 - RNA, 22 nt, Homo sapiens
aagggaauguuguggcugguug

SEQ ID NO: 258894 - RNA, 22 nt, Homo sapiens
aagguaguuagaaaauauaacu

SEQ ID NO: 258895 - RNA, 19 nt, Homo sapiens
aaguacuugucuuuugaag

SEQ ID NO: 258896 - RNA, 22 nt, Homo sapiens
aagucaaggagagaggcgucag

SEQ ID NO: 258897 - RNA, 23 nt, Homo sapiens
aagucauggaaucaaaugaggug

SEQ ID NO: 258898 - RNA, 22 nt, Homo sapiens
aagugaauguuugguagcagug

SEQ ID NO: 258899 - RNA, 20 nt, Homo sapiens
aagugaguguuaaacugaac

SEQ ID NO: 258900 - RNA, 22 nt, Homo sapiens
aagugcaaauucccaggcucug

SEQ ID NO: 258901 - RNA, 22 nt, Homo sapiens
aagugcucuugaaacugccuua

SEQ ID NO: 258902 - RNA, 22 nt, Homo sapiens
aagugcucuugaaacugucuua

SEQ ID NO: 258903 - RNA, 22 nt, Homo sapiens
aagugcuuuacacaugcaugau

SEQ ID NO: 258904 - RNA, 22 nt, Homo sapiens
aaguuguaguuagagaguugcu

SEQ ID NO: 258905 - RNA, 20 nt, Homo sapiens
aauaacagccccagggaggu

SEQ ID NO: 258906 - RNA, 22 nt, Homo sapiens
aauaagcugagagaauucuaca

SEQ ID NO: 258907 - RNA, 22 nt, Homo sapiens
aauaaguugagaugaggucaua

SEQ ID NO: 258908 - RNA, 22 nt, Homo sapiens
agcuucauucugaauagguuga

SEQ ID NO: 258909 - RNA, 22 nt, Homo sapiens
agcuucauuguuaugaauguca

SEQ ID NO: 258910 - RNA, 22 nt, Homo sapiens
agcuuguguuuuucuaaguauc

SEQ ID NO: 258911 - RNA, 22 nt, Homo sapiens
agcuuguuuucccauaacuaga

SEQ ID NO: 258912 - RNA, 22 nt, Homo sapiens
aggaagugucuucuuuuaggca

SEQ ID NO: 258913 - RNA, 22 nt, Homo sapiens
aggacacugauagucuuuggca

SEQ ID NO: 258914 - RNA, 22 nt, Homo sapiens
aggaccaugguauugcuuuggg

SEQ ID NO: 258915 - RNA, 22 nt, Homo sapiens
aggagcacuggccuuggaguca

SEQ ID NO: 258916 - RNA, 18 nt, Homo sapiens
aggagcauagugcuauga

SEQ ID NO: 258917 - RNA, 20 nt, Homo sapiens
aggagcauuuacauuggcuc

SEQ ID NO: 258918 - RNA, 22 nt, Homo sapiens
aggagguaggaauugugcuagg

SEQ ID NO: 258919 - RNA, 22 nt, Homo sapiens
aggaguguguauuaaugaaauu

SEQ ID NO: 258920 - RNA, 21 nt, Homo sapiens
aggcaagacuuuuagguuugu

SEQ ID NO: 258921 - RNA, 21 nt, Homo sapiens
aggcaagauuacuuacgagca

SEQ ID NO: 258922 - RNA, 22 nt, Homo sapiens
aggcacacaacccuggaccuga

SEQ ID NO: 258923 - RNA, 22 nt, Homo sapiens
aggcacggugucucaugccugu

SEQ ID NO: 258924 - RNA, 22 nt, Homo sapiens
aggcaugaaauacaugcauuga

SEQ ID NO: 258925 - RNA, 22 nt, Homo sapiens
agggcuuuugagcugagauggu

SEQ ID NO: 258926 - RNA, 22 nt, Homo sapiens
agguaauuuuaucauuauguga

SEQ ID NO: 258927 - RNA, 22 nt, Homo sapiens
agguagaguguuuuguucuucu

SEQ ID NO: 258928 - RNA, 22 nt, Homo sapiens
agguagugugaugcuccuguuu

SEQ ID NO: 258929 - RNA, 22 nt, Homo sapiens
aggugcuugaaucuaugagcuc

SEQ ID NO: 258930 - RNA, 22 nt, Homo sapiens
cagagaacauucagagcuguag

SEQ ID NO: 258931 - RNA, 22 nt, Homo sapiens
cagauggucuuaaggcagccuu

SEQ ID NO: 258932 - RNA, 22 nt, Homo sapiens
cagcuaaauuguuaaauccaag

SEQ ID NO: 258933 - RNA, 22 nt, Homo sapiens
caggcuuuuccacacauggguu

SEQ ID NO: 258934 - RNA, 22 nt, Homo sapiens
cagggcauuggcugguaccugg

SEQ ID NO: 258935 - RNA, 22 nt, Homo sapiens
caggguccccuaccuuuugaug

SEQ ID NO: 258936 - RNA, 19 nt, Homo sapiens
caguaucauugcacauagu

SEQ ID NO: 258937 - RNA, 22 nt, Homo sapiens
cagugauaggugguuguuggca

SEQ ID NO: 258938 - RNA, 18 nt, Homo sapiens
cagugcaauacaggagag

SEQ ID NO: 258939 - RNA, 22 nt, Homo sapiens
cagugcacugggauuauaagug

SEQ ID NO: 258940 - RNA, 22 nt, Homo sapiens
caguggaugauguuuucugugg

SEQ ID NO: 258941 - RNA, 22 nt, Homo sapiens
cauaaagauggaggaggccagg

SEQ ID NO: 258942 - RNA, 21 nt, Homo sapiens
cauaaugcuacuuauuuuaug

SEQ ID NO: 258943 - RNA, 22 nt, Homo sapiens
caucacacuuggauguaagaca

SEQ ID NO: 258944 - RNA, 22 nt, Homo sapiens
caucacaucugcaugguaagua

SEQ ID NO: 258945 - RNA, 22 nt, Homo sapiens
cauccccugcaccaaccuuuac

SEQ ID NO: 258946 - RNA, 22 nt, Homo sapiens
caucccugaaccccagaaaucu

SEQ ID NO: 258947 - RNA, 23 nt, Homo sapiens
caugaacuaguuugcagccauga

SEQ ID NO: 258948 - RNA, 22 nt, Homo sapiens
caugacacauguuuaccuaugu

SEQ ID NO: 258949 - RNA, 22 nt, Homo sapiens
cugacauggggauccaccuuag

SEQ ID NO: 258950 - RNA, 22 nt, Homo sapiens
cugaccauagacuacucugggc

SEQ ID NO: 258951 - RNA, 22 nt, Homo sapiens
cugacuaguuuuaaugcagauu

SEQ ID NO: 258952 - RNA, 22 nt, Homo sapiens
cugagaucaagucuugcucugu

SEQ ID NO: 258953 - RNA, 22 nt, Homo sapiens
cugagauggagucucgcauugu

SEQ ID NO: 258954 - RNA, 22 nt, Homo sapiens
cugagcaaagaagugauaauga

SEQ ID NO: 258955 - RNA, 22 nt, Homo sapiens
cugagcaugacaucaugugacu

SEQ ID NO: 258956 - RNA, 22 nt, Homo sapiens
cugagguacccacuucaucuca

SEQ ID NO: 258957 - RNA, 22 nt, Homo sapiens
cugagguagcucaggguauugc

SEQ ID NO: 258958 - RNA, 22 nt, Homo sapiens
cugaggucugaauccagguauc

SEQ ID NO: 258959 - RNA, 22 nt, Homo sapiens
cugauaguucucuuuagaguuu

SEQ ID NO: 258960 - RNA, 22 nt, Homo sapiens
cugauaugaugggugauuuuca

SEQ ID NO: 258961 - RNA, 22 nt, Homo sapiens
cugaucuguagcagccaccaca

SEQ ID NO: 258962 - RNA, 22 nt, Homo sapiens
cugcacugagacccucuuugcu

SEQ ID NO: 258963 - RNA, 22 nt, Homo sapiens
cugcaguaaccacuguaggugu

SEQ ID NO: 258964 - RNA, 22 nt, Homo sapiens
cugcauaaucaucucucugcau

SEQ ID NO: 258965 - RNA, 18 nt, Homo sapiens
cugccagugugcucuccg

SEQ ID NO: 258966 - RNA, 22 nt, Homo sapiens
cuggaagaaaaucacgccaucu

SEQ ID NO: 258967 - RNA, 22 nt, Homo sapiens
cuggacguugaggcugcaguga

SEQ ID NO: 258968 - RNA, 22 nt, Homo sapiens
cuggagauuaaccaauugccau

SEQ ID NO: 258969 - RNA, 18 nt, Homo sapiens
cuggaugucgaguguguu

SEQ ID NO: 258970 - RNA, 22 nt, Homo sapiens
cuggcaaauguuuucuguaaag

SEQ ID NO: 258971 - RNA, 22 nt, Homo sapiens
cuggcaagaggauaaaguccua

SEQ ID NO: 258972 - RNA, 22 nt, Homo sapiens
cuggcaucuaaauacuugaugu

SEQ ID NO: 258973 - RNA, 22 nt, Homo sapiens
cuggccagagacauucauuaaa

SEQ ID NO: 258974 - RNA, 22 nt, Homo sapiens
cuggcucugagguguuuagggc

SEQ ID NO: 258975 - RNA, 21 nt, Homo sapiens
cugguccccuuuauguaugug

SEQ ID NO: 258976 - RNA, 22 nt, Homo sapiens
cugucacuggggcacauguccc

SEQ ID NO: 258977 - RNA, 22 nt, Homo sapiens
cugucuaugagccaggaagcca

SEQ ID NO: 258978 - RNA, 22 nt, Homo sapiens
cugucuggaggccugcaaauaa

SEQ ID NO: 258979 - RNA, 22 nt, Homo sapiens
cugugacugcagggcauauuug

SEQ ID NO: 258980 - RNA, 22 nt, Homo sapiens
cugugaucuuuuuucauguggu

SEQ ID NO: 258981 - RNA, 22 nt, Homo sapiens
cuguguaguacuagauugagca

SEQ ID NO: 258982 - RNA, 22 nt, Homo sapiens
cuguugguuaaauuccaugcag

SEQ ID NO: 258983 - RNA, 22 nt, Homo sapiens
cuguuuguuuaggguacucaga

SEQ ID NO: 258984 - RNA, 22 nt, Homo sapiens
cuucaucugguuugugaacuuu

SEQ ID NO: 258985 - RNA, 19 nt, Homo sapiens
cuugccccauucauccucu

SEQ ID NO: 258986 - RNA, 22 nt, Homo sapiens
cuuguacuacuuaggaucugga

SEQ ID NO: 258987 - RNA, 22 nt, Homo sapiens
cuugugcaugaccccagguggg

SEQ ID NO: 258988 - RNA, 22 nt, Homo sapiens
cuuuaugagguuggauggaucu

SEQ ID NO: 258989 - RNA, 22 nt, Homo sapiens
cuuucugaggagaauagagaac

SEQ ID NO: 258990 - RNA, 22 nt, Homo sapiens
cuuugcacaucucugcuuuccc

SEQ ID NO: 258991 - RNA, 22 nt, Homo sapiens
cuuuggcaaugucauuuucaau

SEQ ID NO: 258992 - RNA, 22 nt, Homo sapiens
cuuuggcacuuccuaagugcca

SEQ ID NO: 258993 - RNA, 20 nt, Homo sapiens
cuuuggugagucaacuccuu

SEQ ID NO: 258994 - RNA, 19 nt, Homo sapiens
cuuugguugagcguguugg

SEQ ID NO: 258995 - RNA, 21 nt, Homo sapiens
cuuuugcacuccagccugggu

SEQ ID NO: 258996 - RNA, 22 nt, Homo sapiens
cuuuuugcugcagcaauacugg

SEQ ID NO: 258997 - RNA, 20 nt, Homo sapiens
cuuuuugcugugcugggagc

SEQ ID NO: 258998 - RNA, 22 nt, Homo sapiens
gaacugggguuggguugcgaua

SEQ ID NO: 258999 - RNA, 22 nt, Homo sapiens
gaagauucaaccaaaccagaac

SEQ ID NO: 259000 - RNA, 22 nt, Homo sapiens
gaaguaggugcuguuauuaucu

SEQ ID NO: 259001 - RNA, 22 nt, Homo sapiens
gaagugcaguggcacagucaug

SEQ ID NO: 259002 - RNA, 22 nt, Homo sapiens
gaaucaauugaucuaugugucu

SEQ ID NO: 259003 - RNA, 22 nt, Homo sapiens
gaaucccuugcauuaucccuuu

SEQ ID NO: 259004 - RNA, 22 nt, Homo sapiens
gacagacacaauugauccauga

SEQ ID NO: 259005 - RNA, 22 nt, Homo sapiens
gacauagagccuugacuucauu

SEQ ID NO: 259006 - RNA, 20 nt, Homo sapiens
gacaugacuaggagauagcc

SEQ ID NO: 259007 - RNA, 22 nt, Homo sapiens
gacauguuuuuuaagguuuaug

SEQ ID NO: 259008 - RNA, 22 nt, Homo sapiens
gaccugagagguacauguauuu

SEQ ID NO: 259009 - RNA, 22 nt, Homo sapiens
gacuagggaccaugagcaaucc

SEQ ID NO: 259010 - RNA, 18 nt, Homo sapiens
gacucaguuucuaaggca

SEQ ID NO: 259011 - RNA, 22 nt, Homo sapiens
gacucgugagguccccaggagg

SEQ ID NO: 259012 - RNA, 22 nt, Homo sapiens
gacuggcuguuuucuuuauuau

SEQ ID NO: 259013 - RNA, 22 nt, Homo sapiens
gacuuugguagaggaaaaaucu

SEQ ID NO: 259014 - RNA, 22 nt, Homo sapiens
gagaccauuuacugccuacuua

SEQ ID NO: 259015 - RNA, 22 nt, Homo sapiens
gagacugagucuugcccuguca

SEQ ID NO: 259016 - RNA, 22 nt, Homo sapiens
gagacugagucuugcuuuguca

SEQ ID NO: 259017 - RNA, 22 nt, Homo sapiens
gagaucuauuccucacccuucu

SEQ ID NO: 259018 - RNA, 22 nt, Homo sapiens
gagauggagacuuggccuuaaa

SEQ ID NO: 259019 - RNA, 18 nt, Homo sapiens
gagcaccuuuuuugcaga

SEQ ID NO: 259020 - RNA, 22 nt, Homo sapiens
gagcuccuccccuuggcuuuca

SEQ ID NO: 259021 - RNA, 22 nt, Homo sapiens
gagcugaucuuuucugauucca

SEQ ID NO: 259022 - RNA, 22 nt, Homo sapiens
gagcuggacuucuuaccuuuuc

SEQ ID NO: 259023 - RNA, 22 nt, Homo sapiens
gaggaaguaauuuuaggccugu

SEQ ID NO: 259024 - RNA, 22 nt, Homo sapiens
gaggaaguagcuacugucuuuc

SEQ ID NO: 259025 - RNA, 22 nt, Homo sapiens
gaggcaagaguaguuaaguuag

SEQ ID NO: 259026 - RNA, 22 nt, Homo sapiens
gaggcauuauucccaucuuaca

SEQ ID NO: 259027 - RNA, 22 nt, Homo sapiens
gagguaagaaagucaguccuuc

SEQ ID NO: 259028 - RNA, 22 nt, Homo sapiens
gagguagaauguuuuucagcug

SEQ ID NO: 259029 - RNA, 22 nt, Homo sapiens
gagguaggaggauugcuuaagg

SEQ ID NO: 259030 - RNA, 22 nt, Homo sapiens
gaggucauguggcaggcagcca

SEQ ID NO: 259031 - RNA, 22 nt, Homo sapiens
gaguaaaugucacuguugcugu

SEQ ID NO: 259032 - RNA, 23 nt, Homo sapiens
gaguacauuaaaagcccagacug

SEQ ID NO: 259033 - RNA, 22 nt, Homo sapiens
gaguauauuugcacuguuaugu

SEQ ID NO: 259034 - RNA, 22 nt, Homo sapiens
gagugcaauggcgcgaucucgg

SEQ ID NO: 259035 - RNA, 22 nt, Homo sapiens
gagugcaauggugccaucucgg

SEQ ID NO: 259036 - RNA, 23 nt, Homo sapiens
gaguggagacucauugauuuccu

SEQ ID NO: 259037 - RNA, 22 nt, Homo sapiens
gaguggugguucugaaacuuuu

SEQ ID NO: 259038 - RNA, 22 nt, Homo sapiens
gaguuagguugucaaugucuua

SEQ ID NO: 259039 - RNA, 22 nt, Homo sapiens
gaguucaauuuccagcuguucu

SEQ ID NO: 259040 - RNA, 22 nt, Homo sapiens
gauaaaguauuggguacuaugc

SEQ ID NO: 259041 - RNA, 22 nt, Homo sapiens
ugagaacuuugucuuuuacucu

SEQ ID NO: 259042 - RNA, 22 nt, Homo sapiens
ugagaagcauaccagugucugu

SEQ ID NO: 259043 - RNA, 22 nt, Homo sapiens
ugagaauguagggcucucccag

SEQ ID NO: 259044 - RNA, 21 nt, Homo sapiens
ugagacaauccuggucaauau

SEQ ID NO: 259045 - RNA, 22 nt, Homo sapiens
ugagacaaucucaucucaguga

SEQ ID NO: 259046 - RNA, 22 nt, Homo sapiens
ugagacauauuauacugcuuuu

SEQ ID NO: 259047 - RNA, 23 nt, Homo sapiens
ugagacauuggaaaguuaggcag

SEQ ID NO: 259048 - RNA, 22 nt, Homo sapiens
ugagacugagucuugcucuauu

SEQ ID NO: 259049 - RNA, 22 nt, Homo sapiens
ugagacugaguuucacuuuugu

SEQ ID NO: 259050 - RNA, 22 nt, Homo sapiens
ugagagcugguuguuuaaagga

SEQ ID NO: 259051 - RNA, 22 nt, Homo sapiens
ugagaggugaauggcaggcuca

SEQ ID NO: 259052 - RNA, 22 nt, Homo sapiens
ugagaguagggguugggauugg

SEQ ID NO: 259053 - RNA, 22 nt, Homo sapiens
ugagaucaacugagucagagca

SEQ ID NO: 259054 - RNA, 22 nt, Homo sapiens
ugagaucagaaggauuucucug

SEQ ID NO: 259055 - RNA, 22 nt, Homo sapiens
ugagaucugauaggccuggguu

SEQ ID NO: 259056 - RNA, 22 nt, Homo sapiens
ugagaucuucgcucuucacaga

SEQ ID NO: 259057 - RNA, 22 nt, Homo sapiens
ugagaucuuggaggcuuuguga

SEQ ID NO: 259058 - RNA, 19 nt, Homo sapiens
ugagaugaagacagggguu

SEQ ID NO: 259059 - RNA, 22 nt, Homo sapiens
ugagaugaugggauaagagggc

SEQ ID NO: 259060 - RNA, 22 nt, Homo sapiens
ugagauggaguuucgcccuugu

SEQ ID NO: 259061 - RNA, 22 nt, Homo sapiens
ugagauggaguuucgcucuugu

SEQ ID NO: 259062 - RNA, 21 nt, Homo sapiens
ugagauuauauuaacauggua

SEQ ID NO: 259063 - RNA, 22 nt, Homo sapiens
ugagcaucauucacaccuuggu

SEQ ID NO: 259064 - RNA, 22 nt, Homo sapiens
ugagcauuguuuggacuuggau

SEQ ID NO: 259065 - RNA, 20 nt, Homo sapiens
ugagcucaauuguugcaagu

SEQ ID NO: 259066 - RNA, 22 nt, Homo sapiens
ugagcugguacuaauauuauca

SEQ ID NO: 259067 - RNA, 22 nt, Homo sapiens
ugaggaauguguguuaaagaua

SEQ ID NO: 259068 - RNA, 22 nt, Homo sapiens
uuauguaaaucaaucuggaauc

SEQ ID NO: 259069 - RNA, 23 nt, Homo sapiens
uucaaaggaugcuuuauggaauu

SEQ ID NO: 259070 - RNA, 22 nt, Homo sapiens
uucaaaguaaagggauggagac

SEQ ID NO: 259071 - RNA, 22 nt, Homo sapiens
uucaaaucuuuggcucccacua

SEQ ID NO: 259072 - RNA, 23 nt, Homo sapiens
uucaaauguucucugguugucag

SEQ ID NO: 259073 - RNA, 23 nt, Homo sapiens
uucaacagguagacccucccugc

SEQ ID NO: 259074 - RNA, 22 nt, Homo sapiens
uucaagaauuaaaguggcuuuu

SEQ ID NO: 259075 - RNA, 22 nt, Homo sapiens
uucaagauggcaccagugagug

SEQ ID NO: 259076 - RNA, 22 nt, Homo sapiens
uucaaguaagaaagacaucagg

SEQ ID NO: 259077 - RNA, 22 nt, Homo sapiens
uucaaguagguaggaccacagg

SEQ ID NO: 259078 - RNA, 22 nt, Homo sapiens
uucaagucuuggcuuugccacc

SEQ ID NO: 259079 - RNA, 22 nt, Homo sapiens
uucaagugguucagaagucuga

SEQ ID NO: 259080 - RNA, 22 nt, Homo sapiens
uucacagaaaaaggcgaugagg

SEQ ID NO: 259081 - RNA, 22 nt, Homo sapiens
uucacagaguuauuuuuaugcu

SEQ ID NO: 259082 - RNA, 22 nt, Homo sapiens
uucaccuggaguucaggauaag

SEQ ID NO: 259083 - RNA, 22 nt, Homo sapiens
uucaccuggguuggccaucauu

SEQ ID NO: 259084 - RNA, 22 nt, Homo sapiens
uucaccuguagcaugcccuugg

SEQ ID NO: 259085 - RNA, 22 nt, Homo sapiens
uucacugagccagacuaagaca

SEQ ID NO: 259086 - RNA, 22 nt, Homo sapiens
uucacugugaacucauauucag

SEQ ID NO: 259087 - RNA, 22 nt, Homo sapiens
uucagaucaucccagcuccacu

SEQ ID NO: 259088 - RNA, 22 nt, Homo sapiens
uucagcacaguguggaucauuc

SEQ ID NO: 259089 - RNA, 22 nt, Homo sapiens
uucagcuacuuggaaacagcaa

SEQ ID NO: 259090 - RNA, 22 nt, Homo sapiens
uucaggcaccauggucauugau

SEQ ID NO: 259091 - RNA, 22 nt, Homo sapiens
uucagggcauuggaguuucuga

SEQ ID NO: 259092 - RNA, 22 nt, Homo sapiens
uucaguucugcucugaucuuag

SEQ ID NO: 259093 - RNA, 22 nt, Homo sapiens
uucauagaggacauuacuggag

SEQ ID NO: 259094 - RNA, 22 nt, Homo sapiens
uucauagugaaaaauucaaagu

SEQ ID NO: 259095 - RNA, 21 nt, Homo sapiens
uucaucagccagaaaucaagc

SEQ ID NO: 259096 - RNA, 22 nt, Homo sapiens
uucauggugguacaaaagcaau

SEQ ID NO: 259097 - RNA, 22 nt, Homo sapiens
uucauguaauuccauaagguaa

SEQ ID NO: 259098 - RNA, 22 nt, Homo sapiens
uuccacaaugguugaacuaauu

SEQ ID NO: 259099 - RNA, 22 nt, Homo sapiens
uuccacaaugguugaacuagcu

SEQ ID NO: 259100 - RNA, 22 nt, Homo sapiens
uuccacaaugguugaacuaguu

SEQ ID NO: 259101 - RNA, 22 nt, Homo sapiens
uggaugaagagaugguaguugc

SEQ ID NO: 259102 - RNA, 22 nt, Homo sapiens
uggcaagaaccacaauuacuuu

SEQ ID NO: 259103 - RNA, 22 nt, Homo sapiens
uggcaagaaggauuuauuccuu

SEQ ID NO: 259104 - RNA, 22 nt, Homo sapiens
uggcaagagcaaaauguacagu

SEQ ID NO: 259105 - RNA, 22 nt, Homo sapiens
uggcaagagggaugcaagguuu

SEQ ID NO: 259106 - RNA, 22 nt, Homo sapiens
uggcaagauuguuccgguuugg

SEQ ID NO: 259107 - RNA, 22 nt, Homo sapiens
uggcaauaauucagugugggcu

SEQ ID NO: 259108 - RNA, 22 nt, Homo sapiens
uggcaauguggaaugguccagg

SEQ ID NO: 259109 - RNA, 19 nt, Homo sapiens
uggcacuugacguccggau

SEQ ID NO: 259110 - RNA, 22 nt, Homo sapiens
uggcagauaggauacaggacua

SEQ ID NO: 259111 - RNA, 22 nt, Homo sapiens
uggcagaugagccgcgcuccaa

SEQ ID NO: 259112 - RNA, 22 nt, Homo sapiens
uggcagaugggugagcuggaga

SEQ ID NO: 259113 - RNA, 19 nt, Homo sapiens
uggcaugaaugugaacuaa

SEQ ID NO: 259114 - RNA, 22 nt, Homo sapiens
uggcaugcauuguggguaauua

SEQ ID NO: 259115 - RNA, 22 nt, Homo sapiens
uggcauggaaagcuuuucauac

SEQ ID NO: 259116 - RNA, 22 nt, Homo sapiens
uggcauggaguggauggcccca

SEQ ID NO: 259117 - RNA, 22 nt, Homo sapiens
uggcauuguccaauaaaauuuu

SEQ ID NO: 259118 - RNA, 23 nt, Homo sapiens
uggcauuuuaguuagcuucagug

SEQ ID NO: 259119 - RNA, 22 nt, Homo sapiens
uggccagugucggaggccagga

SEQ ID NO: 259120 - RNA, 22 nt, Homo sapiens
uggcgagaaaccauaugcuuuc

SEQ ID NO: 259121 - RNA, 22 nt, Homo sapiens
uggcuacugacugaugauuaua

SEQ ID NO: 259122 - RNA, 21 nt, Homo sapiens
uggcuauuucuguggcauaca

SEQ ID NO: 259123 - RNA, 22 nt, Homo sapiens
uggcuuucuggggcuucuguuc

SEQ ID NO: 259124 - RNA, 22 nt, Homo sapiens
ugggaauaugauacaggucuuu

SEQ ID NO: 259125 - RNA, 22 nt, Homo sapiens
ugggagugugcacaauuucagc

SEQ ID NO: 259126 - RNA, 22 nt, Homo sapiens
ugggaucagcugggcucucugu

SEQ ID NO: 259127 - RNA, 22 nt, Homo sapiens
uggguagagcacugggggcgag

SEQ ID NO: 259128 - RNA, 22 nt, Homo sapiens
ugguaucuaagaugcacguugu

SEQ ID NO: 259129 - RNA, 21 nt, Homo sapiens
uggucccauaagauuauaaug

SEQ ID NO: 259130 - RNA, 22 nt, Homo sapiens
uggucuuuucaacaaaugguau

SEQ ID NO: 259131 - RNA, 22 nt, Homo sapiens
agcuccuuucugcaggcagguc

SEQ ID NO: 259132 - RNA, 16 nt, Homo sapiens
agcuggaauuacaggc

SEQ ID NO: 259133 - RNA, 17 nt, Homo sapiens
agcuggaauuacgggag

SEQ ID NO: 259134 - RNA, 22 nt, Homo sapiens
agcugguuuaauaugcugucug

SEQ ID NO: 259135 - RNA, 22 nt, Homo sapiens
agcuguguugucugaagucaga

SEQ ID NO: 259136 - RNA, 22 nt, Homo sapiens
agcuguuguuaauuaacucauu

SEQ ID NO: 259137 - RNA, 22 nt, Homo sapiens
agcuuguuuuccugcaacuaga

SEQ ID NO: 259138 - RNA, 22 nt, Homo sapiens
aggaagguaaacuaacuugccu

SEQ ID NO: 259139 - RNA, 22 nt, Homo sapiens
aggaagugugcaauuaauuucu

SEQ ID NO: 259140 - RNA, 22 nt, Homo sapiens
aggacacugagcaugggagguu

SEQ ID NO: 259141 - RNA, 22 nt, Homo sapiens
aggagaauugguucuucuugau

SEQ ID NO: 259142 - RNA, 21 nt, Homo sapiens
aggagcauuguugugguggag

SEQ ID NO: 259143 - RNA, 23 nt, Homo sapiens
aggagcuuagaaguugccauugc

SEQ ID NO: 259144 - RNA, 22 nt, Homo sapiens
aggagcuuuggggaaaacagau

SEQ ID NO: 259145 - RNA, 22 nt, Homo sapiens
aggauaguaaugauagagaggc

SEQ ID NO: 259146 - RNA, 22 nt, Homo sapiens
aggcaagcaucuugcucccuuc

SEQ ID NO: 259147 - RNA, 22 nt, Homo sapiens
aggcagcuguuauauacugagu

SEQ ID NO: 259148 - RNA, 22 nt, Homo sapiens
aggcaugauggcuccagaucau

SEQ ID NO: 259149 - RNA, 22 nt, Homo sapiens
aggcauggagacuaaaauuaua

SEQ ID NO: 259150 - RNA, 22 nt, Homo sapiens
aggcuagaaucuuccaucuugg

SEQ ID NO: 259151 - RNA, 22 nt, Homo sapiens
aggcuagacuuugagaauuuuu

SEQ ID NO: 259152 - RNA, 22 nt, Homo sapiens
aggcugguauuuacaaaagcuc

SEQ ID NO: 259153 - RNA, 22 nt, Homo sapiens
aggcuguguggauaauauuggg

SEQ ID NO: 259154 - RNA, 22 nt, Homo sapiens
agggaauguaaguuuuaugaga

SEQ ID NO: 259155 - RNA, 22 nt, Homo sapiens
agggcacuguagguccugccuc

SEQ ID NO: 259156 - RNA, 22 nt, Homo sapiens
agggcuuaucuguguagaguuc

SEQ ID NO: 259157 - RNA, 22 nt, Homo sapiens
agguauauuggacagauguaaa

SEQ ID NO: 259158 - RNA, 22 nt, Homo sapiens
agguauguaugucuguacagcg

SEQ ID NO: 259159 - RNA, 22 nt, Homo sapiens
agguccacuuacuacuccuguu

SEQ ID NO: 259160 - RNA, 22 nt, Homo sapiens
agguuaugauuguagagcgagg

SEQ ID NO: 259161 - RNA, 22 nt, Homo sapiens
agguucccuuuuggccugggau

SEQ ID NO: 259162 - RNA, 22 nt, Homo sapiens
aguauguagugcaaucagucag

SEQ ID NO: 259163 - RNA, 20 nt, Homo sapiens
aguauucacuuuuuucaugg

SEQ ID NO: 259164 - RNA, 22 nt, Homo sapiens
agugcaauggcgugaucuuggc

SEQ ID NO: 259165 - RNA, 22 nt, Homo sapiens
agugcaguggcacaaucuuggc

SEQ ID NO: 259166 - RNA, 22 nt, Homo sapiens
agugcaguggcucaaaaugccu

SEQ ID NO: 259167 - RNA, 22 nt, Homo sapiens
agugcagugguuaggagccagg

SEQ ID NO: 259168 - RNA, 22 nt, Homo sapiens
agugcauuuguucugugucagg

SEQ ID NO: 259169 - RNA, 22 nt, Homo sapiens
agugccaaaucgagggcucuga

SEQ ID NO: 259170 - RNA, 22 nt, Homo sapiens
agugccacugcacucuagccug

SEQ ID NO: 259171 - RNA, 22 nt, Homo sapiens
aucucaguuaauuccaucuuuc

SEQ ID NO: 259172 - RNA, 22 nt, Homo sapiens
aucucugagauguucugauuuu

SEQ ID NO: 259173 - RNA, 22 nt, Homo sapiens
aucugauggagagcguguggcu

SEQ ID NO: 259174 - RNA, 22 nt, Homo sapiens
aucugguguauuggugcugggu

SEQ ID NO: 259175 - RNA, 22 nt, Homo sapiens
aucugguguuuccuucacauug

SEQ ID NO: 259176 - RNA, 22 nt, Homo sapiens
aucuuggauuaccugggugggu

SEQ ID NO: 259177 - RNA, 22 nt, Homo sapiens
augaaagguugucuuaagccau

SEQ ID NO: 259178 - RNA, 22 nt, Homo sapiens
augaacucaucauuuuuauggc

SEQ ID NO: 259179 - RNA, 22 nt, Homo sapiens
augaagcuagcugauugcugau

SEQ ID NO: 259180 - RNA, 22 nt, Homo sapiens
augacacugcagagauguccca

SEQ ID NO: 259181 - RNA, 23 nt, Homo sapiens
augacacuguccuugaccauuuc

SEQ ID NO: 259182 - RNA, 22 nt, Homo sapiens
augacauguauuuccaggauuu

SEQ ID NO: 259183 - RNA, 22 nt, Homo sapiens
augacugagacuaacuuacuuu

SEQ ID NO: 259184 - RNA, 22 nt, Homo sapiens
augacuuuucugaaaaccacca

SEQ ID NO: 259185 - RNA, 22 nt, Homo sapiens
augagaaucauuucagcuugua

SEQ ID NO: 259186 - RNA, 22 nt, Homo sapiens
augagaccagcagaaaaccugu

SEQ ID NO: 259187 - RNA, 22 nt, Homo sapiens
augagacuagaagagaauaaua

SEQ ID NO: 259188 - RNA, 22 nt, Homo sapiens
augagauaaaccaucucuuaag

SEQ ID NO: 259189 - RNA, 22 nt, Homo sapiens
augagauacuacaaaugaguuu

SEQ ID NO: 259190 - RNA, 22 nt, Homo sapiens
augagaugaggaauggcccucc

SEQ ID NO: 259191 - RNA, 22 nt, Homo sapiens
augagaugauaggcguucuaac

SEQ ID NO: 259192 - RNA, 22 nt, Homo sapiens
augagauucuuagagaagucug

SEQ ID NO: 259193 - RNA, 22 nt, Homo sapiens
augagcagaagagauacacugu

SEQ ID NO: 259194 - RNA, 22 nt, Homo sapiens
augagcuauggagcucccaccu

SEQ ID NO: 259195 - RNA, 22 nt, Homo sapiens
augagggagggguggugccgca

SEQ ID NO: 259196 - RNA, 22 nt, Homo sapiens
augagggcggacgcccuggaga

SEQ ID NO: 259197 - RNA, 22 nt, Homo sapiens
augaggugaguaaauaaaugaa

SEQ ID NO: 259198 - RNA, 22 nt, Homo sapiens
augagucacuuauuauuggggu

SEQ ID NO: 259199 - RNA, 19 nt, Homo sapiens
augagucugcaagaaccag

SEQ ID NO: 259200 - RNA, 22 nt, Homo sapiens
augauauuauucuagcccagag

SEQ ID NO: 259201 - RNA, 22 nt, Homo sapiens
augcaaaucuuaaguaugugug

SEQ ID NO: 259202 - RNA, 22 nt, Homo sapiens
augcaagaaauaucucuuuuuc

SEQ ID NO: 259203 - RNA, 22 nt, Homo sapiens
augcacuguuguuauuggauaa

SEQ ID NO: 259204 - RNA, 22 nt, Homo sapiens
augcauagcaucugcaaauguu

SEQ ID NO: 259205 - RNA, 22 nt, Homo sapiens
augcauauuuuaccuagaagag

SEQ ID NO: 259206 - RNA, 22 nt, Homo sapiens
augcuguuuuguagcucccucu

SEQ ID NO: 259207 - RNA, 22 nt, Homo sapiens
auggaagaaacgauuuucugga

SEQ ID NO: 259208 - RNA, 22 nt, Homo sapiens
auggaauguauagucauguagg

SEQ ID NO: 259209 - RNA, 22 nt, Homo sapiens
auggacagaaaaaaauagaugu

SEQ ID NO: 259210 - RNA, 22 nt, Homo sapiens
auggacagacacuggccuucug

SEQ ID NO: 259211 - RNA, 22 nt, Homo sapiens
auggagaugaacuuggguaaag

SEQ ID NO: 259212 - RNA, 22 nt, Homo sapiens
auggaguuuacuuaguguaaua

SEQ ID NO: 259213 - RNA, 22 nt, Homo sapiens
auggcacuccagccugggcaac

SEQ ID NO: 259214 - RNA, 22 nt, Homo sapiens
auggcacuguguccugggguca

SEQ ID NO: 259215 - RNA, 22 nt, Homo sapiens
auggcagagucagaaagucagg

SEQ ID NO: 259216 - RNA, 22 nt, Homo sapiens
auggcaucgucaccuuuucagu

SEQ ID NO: 259217 - RNA, 22 nt, Homo sapiens
auggcccaguuugcuaucccua

SEQ ID NO: 259218 - RNA, 22 nt, Homo sapiens
auggccugaugcaccuguccca

SEQ ID NO: 259219 - RNA, 22 nt, Homo sapiens
auggcuauucuucuuuugucag

SEQ ID NO: 259220 - RNA, 22 nt, Homo sapiens
auggcuuugggcugcucugccc

SEQ ID NO: 259221 - RNA, 22 nt, Homo sapiens
augguuuauuuguaagcagagu

SEQ ID NO: 259222 - RNA, 22 nt, Homo sapiens
augguuugugcuccuauaagaa

SEQ ID NO: 259223 - RNA, 22 nt, Homo sapiens
auguaguaugaagaagaugcuu

SEQ ID NO: 259224 - RNA, 22 nt, Homo sapiens
auguauacaugcaggucacagg

SEQ ID NO: 259225 - RNA, 22 nt, Homo sapiens
augucuguuugcugagcccggc

SEQ ID NO: 259226 - RNA, 22 nt, Homo sapiens
augugcacaacgugcagguuug

SEQ ID NO: 259227 - RNA, 22 nt, Homo sapiens
augugcacaugcuuacauguga

SEQ ID NO: 259228 - RNA, 22 nt, Homo sapiens
augugcagauguuacaaauugu

SEQ ID NO: 259229 - RNA, 22 nt, Homo sapiens
augugcauaugaagcacagaca

SEQ ID NO: 259230 - RNA, 22 nt, Homo sapiens
augugugaaucccagaaccugu

SEQ ID NO: 259231 - RNA, 22 nt, Homo sapiens
auguuagcaucaauauucauca

SEQ ID NO: 259232 - RNA, 22 nt, Homo sapiens
auguuugguaagaauauuguua

SEQ ID NO: 259233 - RNA, 22 nt, Homo sapiens
auguuugguagugaauauggua

SEQ ID NO: 259234 - RNA, 23 nt, Homo sapiens
auuaagguuacuacaguaugagg

SEQ ID NO: 259235 - RNA, 22 nt, Homo sapiens
auuaaguugugccugaaaacuu

SEQ ID NO: 259236 - RNA, 20 nt, Homo sapiens
auucaaguaugccuugagaa

SEQ ID NO: 259237 - RNA, 22 nt, Homo sapiens
auucacagggggagaaggguau

SEQ ID NO: 259238 - RNA, 22 nt, Homo sapiens
auucagaggggcagcugucuug

SEQ ID NO: 259239 - RNA, 22 nt, Homo sapiens
auucauagugcuaagguguauc

SEQ ID NO: 259240 - RNA, 22 nt, Homo sapiens
auuccaguuugugagaagcugu

SEQ ID NO: 259241 - RNA, 22 nt, Homo sapiens
auuccauaguacagugaugagu

SEQ ID NO: 259242 - RNA, 22 nt, Homo sapiens
auucccuuagcugccucagccu

SEQ ID NO: 259243 - RNA, 22 nt, Homo sapiens
auucuugcuugaacuuggugca

SEQ ID NO: 259244 - RNA, 22 nt, Homo sapiens
auugacaguuggccaguaagug

SEQ ID NO: 259245 - RNA, 22 nt, Homo sapiens
auugcacaucugcacuacagcc

SEQ ID NO: 259246 - RNA, 21 nt, Homo sapiens
auugcacuccagccugggcga

SEQ ID NO: 259247 - RNA, 22 nt, Homo sapiens
auugcuuuuacugggagcuuug

SEQ ID NO: 259248 - RNA, 22 nt, Homo sapiens
auuguaccccaauguacaauau

SEQ ID NO: 259249 - RNA, 22 nt, Homo sapiens
auuguguuugaaugaggcucca

SEQ ID NO: 259250 - RNA, 22 nt, Homo sapiens
auuuggcagugaagggaucaca

SEQ ID NO: 259251 - RNA, 20 nt, Homo sapiens
auuuggcauaguuuaagcaa

SEQ ID NO: 259252 - RNA, 22 nt, Homo sapiens
auuuuuggauauagggaaggau

SEQ ID NO: 259253 - RNA, 22 nt, Homo sapiens
caaaccuguaggggccaagagg

SEQ ID NO: 259254 - RNA, 22 nt, Homo sapiens
caaagugcugggaugggccagg

SEQ ID NO: 259255 - RNA, 22 nt, Homo sapiens
caaaugacaucauuucauucaa

SEQ ID NO: 259256 - RNA, 22 nt, Homo sapiens
caacacagugaaacccgucucu

SEQ ID NO: 259257 - RNA, 22 nt, Homo sapiens
caacaguaaagcauuuuuaagu

SEQ ID NO: 259258 - RNA, 22 nt, Homo sapiens
caacucuguaggauccaggugg

SEQ ID NO: 259259 - RNA, 21 nt, Homo sapiens
caaugacacuguagcugugcu

SEQ ID NO: 259260 - RNA, 22 nt, Homo sapiens
caauggcaaugaaauagugaga

SEQ ID NO: 259261 - RNA, 22 nt, Homo sapiens
cacaaaguagauuagucuucca

SEQ ID NO: 259262 - RNA, 22 nt, Homo sapiens
cacaccuacuagggccgugggc

SEQ ID NO: 259263 - RNA, 22 nt, Homo sapiens
cacagcacaggcaugaguguca

SEQ ID NO: 259264 - RNA, 22 nt, Homo sapiens
cacagcuagucaaugguagaca

SEQ ID NO: 259265 - RNA, 22 nt, Homo sapiens
agguauguauguaugggagaaa

SEQ ID NO: 259266 - RNA, 22 nt, Homo sapiens
aggugcugagcagagaauccug

SEQ ID NO: 259267 - RNA, 22 nt, Homo sapiens
agguuaugauuauagagcgagg

SEQ ID NO: 259268 - RNA, 23 nt, Homo sapiens
agguuaugauuauagagcgagga

SEQ ID NO: 259269 - RNA, 18 nt, Homo sapiens
agguuauuucccaagacu

SEQ ID NO: 259270 - RNA, 21 nt, Homo sapiens
agguuguguuuccucuuacuu

SEQ ID NO: 259271 - RNA, 22 nt, Homo sapiens
aguacacuguugaacagaagug

SEQ ID NO: 259272 - RNA, 22 nt, Homo sapiens
aguaucaagccacacaugguca

SEQ ID NO: 259273 - RNA, 22 nt, Homo sapiens
agucaagauggcaagguaaggc

SEQ ID NO: 259274 - RNA, 23 nt, Homo sapiens
agucaguaugcuccuuggauccc

SEQ ID NO: 259275 - RNA, 22 nt, Homo sapiens
agucaguguguauugauggcac

SEQ ID NO: 259276 - RNA, 22 nt, Homo sapiens
agucauggcagaaggcaccucu

SEQ ID NO: 259277 - RNA, 19 nt, Homo sapiens
agucaugugaggacccuug

SEQ ID NO: 259278 - RNA, 22 nt, Homo sapiens
agugaauguuggaaaguuauuu

SEQ ID NO: 259279 - RNA, 17 nt, Homo sapiens
agugagaucauggcuua

SEQ ID NO: 259280 - RNA, 22 nt, Homo sapiens
agugagcuggagaaaagaaacu

SEQ ID NO: 259281 - RNA, 22 nt, Homo sapiens
agugauuuuaacuuccagcaau

SEQ ID NO: 259282 - RNA, 22 nt, Homo sapiens
agugcauugagacuugugaguu

SEQ ID NO: 259283 - RNA, 22 nt, Homo sapiens
aguggauguuguggccugggag

SEQ ID NO: 259284 - RNA, 22 nt, Homo sapiens
agugggccccuagaggugaggu

SEQ ID NO: 259285 - RNA, 22 nt, Homo sapiens
auaaacagcuuauccucuauuc

SEQ ID NO: 259286 - RNA, 19 nt, Homo sapiens
auaaacuagaacugucccc

SEQ ID NO: 259287 - RNA, 22 nt, Homo sapiens
auaaagcaagucucuggccuca

SEQ ID NO: 259288 - RNA, 22 nt, Homo sapiens
auaaaugcuuccagucauuaaa

SEQ ID NO: 259289 - RNA, 20 nt, Homo sapiens
auaaauguauagguguacau

SEQ ID NO: 259290 - RNA, 22 nt, Homo sapiens
auaaauucauuuaagcuccuua

SEQ ID NO: 259291 - RNA, 22 nt, Homo sapiens
auaacucuguuuuuuucaugca

SEQ ID NO: 259292 - RNA, 22 nt, Homo sapiens
auaagaagugaaccagacgucu

SEQ ID NO: 259293 - RNA, 22 nt, Homo sapiens
auaagagcaggcuucuggccag

SEQ ID NO: 259294 - RNA, 22 nt, Homo sapiens
auacagguauacaaugcauaau

SEQ ID NO: 259295 - RNA, 22 nt, Homo sapiens
auacaugugcaggucagguuac

SEQ ID NO: 259296 - RNA, 22 nt, Homo sapiens
auacuggcuuuccaauugugau

SEQ ID NO: 259297 - RNA, 22 nt, Homo sapiens
auacuguuucugaacuuugauu

SEQ ID NO: 259298 - RNA, 22 nt, Homo sapiens
auacuguuuuacaucauugccu

SEQ ID NO: 259299 - RNA, 22 nt, Homo sapiens
auagaagcuauguauaggggcc

SEQ ID NO: 259300 - RNA, 22 nt, Homo sapiens
auagaagcugccaacguuucag

SEQ ID NO: 259301 - RNA, 22 nt, Homo sapiens
auagcagaacagugucucacug

SEQ ID NO: 259302 - RNA, 22 nt, Homo sapiens
auagcagcagcuaguagugaua

SEQ ID NO: 259303 - RNA, 22 nt, Homo sapiens
auagugcugcaaugaacauaca

SEQ ID NO: 259304 - RNA, 22 nt, Homo sapiens
auagugcuuuugaaucuuguug

SEQ ID NO: 259305 - RNA, 22 nt, Homo sapiens
auaucacaaacaagucuguacu

SEQ ID NO: 259306 - RNA, 22 nt, Homo sapiens
auaucacagguguuuaccugau

SEQ ID NO: 259307 - RNA, 22 nt, Homo sapiens
auauguaguuucagaaguggaa

SEQ ID NO: 259308 - RNA, 22 nt, Homo sapiens
auauuacagagaggaccuggga

SEQ ID NO: 259309 - RNA, 21 nt, Homo sapiens
auauuacuguuagaggacugc

SEQ ID NO: 259310 - RNA, 22 nt, Homo sapiens
auauuagcacuaaugucacgau

SEQ ID NO: 259311 - RNA, 22 nt, Homo sapiens
aucaaaguaucucaauauggua

SEQ ID NO: 259312 - RNA, 22 nt, Homo sapiens
aucaaaugcuggcagagugccu

SEQ ID NO: 259313 - RNA, 22 nt, Homo sapiens
aucaagcugcuuguuugaaucu

SEQ ID NO: 259314 - RNA, 22 nt, Homo sapiens
aucacagaacuuugagcagaga

SEQ ID NO: 259315 - RNA, 22 nt, Homo sapiens
aucacagaguuaaaacuuucuu

SEQ ID NO: 259316 - RNA, 22 nt, Homo sapiens
aucacagauauggguuuaaauc

SEQ ID NO: 259317 - RNA, 22 nt, Homo sapiens
aucacagcuacuccucugucuu

SEQ ID NO: 259318 - RNA, 22 nt, Homo sapiens
aucacagguacuauggcugaca

SEQ ID NO: 259319 - RNA, 22 nt, Homo sapiens
aucacaguuauaacauccuuuu

SEQ ID NO: 259320 - RNA, 22 nt, Homo sapiens
aucaccuggaggugaucacuug

SEQ ID NO: 259321 - RNA, 22 nt, Homo sapiens
aucacugggauggaacugcuga

SEQ ID NO: 259322 - RNA, 22 nt, Homo sapiens
aucacugggcaagauaucauga

SEQ ID NO: 259323 - RNA, 22 nt, Homo sapiens
aucacuggucaugagagaagua

SEQ ID NO: 259324 - RNA, 22 nt, Homo sapiens
aucacuguccacucaucuuucu

SEQ ID NO: 259325 - RNA, 20 nt, Homo sapiens
aucagagacuaggauugcca

SEQ ID NO: 259326 - RNA, 22 nt, Homo sapiens
aucagauaccuguugggaaaug

SEQ ID NO: 259327 - RNA, 22 nt, Homo sapiens
aucagauguuuguauaggagua

SEQ ID NO: 259328 - RNA, 19 nt, Homo sapiens
aucagcacaagugugcuuu

SEQ ID NO: 259329 - RNA, 22 nt, Homo sapiens
aucauagcucacugcagccucg

SEQ ID NO: 259330 - RNA, 22 nt, Homo sapiens
aucauggaguauuugcaagucu

SEQ ID NO: 259331 - RNA, 22 nt, Homo sapiens
auccaagagacugaugacuucc

SEQ ID NO: 259332 - RNA, 22 nt, Homo sapiens
auccacaugcaguuggaaacag

SEQ ID NO: 259333 - RNA, 22 nt, Homo sapiens
auccaucagacggcaggcguug

SEQ ID NO: 259334 - RNA, 22 nt, Homo sapiens
auccauugcucaagagaaguca

SEQ ID NO: 259335 - RNA, 22 nt, Homo sapiens
auccccugcacggggugucauu

SEQ ID NO: 259336 - RNA, 22 nt, Homo sapiens
auccccuugcagugaccggggc

SEQ ID NO: 259337 - RNA, 22 nt, Homo sapiens
aucccugagccugacucucaga

SEQ ID NO: 259338 - RNA, 22 nt, Homo sapiens
aucccuugacguggagucucug

SEQ ID NO: 259339 - RNA, 22 nt, Homo sapiens
auccugaagcuuuacugaauuc

SEQ ID NO: 259340 - RNA, 22 nt, Homo sapiens
auccuuuagacuguccaguuga

SEQ ID NO: 259341 - RNA, 22 nt, Homo sapiens
aucgcgccauuguacuccagcc

SEQ ID NO: 259342 - RNA, 22 nt, Homo sapiens
aucuaaaucucauaugggcaca

SEQ ID NO: 259343 - RNA, 21 nt, Homo sapiens
aucucacuugaauguaaaagc

SEQ ID NO: 259344 - RNA, 16 nt, Homo sapiens
aucucagaccugcuga

SEQ ID NO: 259345 - RNA, 22 nt, Homo sapiens
aucuccaggugccagcugcgcc

SEQ ID NO: 259346 - RNA, 22 nt, Homo sapiens
aucugcacaucuguguuuuugu

SEQ ID NO: 259347 - RNA, 19 nt, Homo sapiens
aucuggaguuccuggggcu

SEQ ID NO: 259348 - RNA, 22 nt, Homo sapiens
aucugguguccucgugggaguc

SEQ ID NO: 259349 - RNA, 22 nt, Homo sapiens
aucugugaaugaaguuauuuug

SEQ ID NO: 259350 - RNA, 22 nt, Homo sapiens
aucuucucuugaagggugggga

SEQ ID NO: 259351 - RNA, 22 nt, Homo sapiens
augaaagguauguuuucuguga

SEQ ID NO: 259352 - RNA, 22 nt, Homo sapiens
augaaagucaauccccaagugu

SEQ ID NO: 259353 - RNA, 22 nt, Homo sapiens
augaagagaaaguggaucuugg

SEQ ID NO: 259354 - RNA, 20 nt, Homo sapiens
augaagugaaguuagggaac

SEQ ID NO: 259355 - RNA, 22 nt, Homo sapiens
augacagagauaugugaauuuu

SEQ ID NO: 259356 - RNA, 22 nt, Homo sapiens
gcacacguagaagcaugcauca

SEQ ID NO: 259357 - RNA, 22 nt, Homo sapiens
gcacauggccacuaggaauaaa

SEQ ID NO: 259358 - RNA, 23 nt, Homo sapiens
gcagcaaugucacagggguccgg

SEQ ID NO: 259359 - RNA, 22 nt, Homo sapiens
gcagcaucaaaucacacaagau

SEQ ID NO: 259360 - RNA, 22 nt, Homo sapiens
gcaguagugugaucuuggcuca

SEQ ID NO: 259361 - RNA, 22 nt, Homo sapiens
gcagugacaugugccaguuuau

SEQ ID NO: 259362 - RNA, 22 nt, Homo sapiens
gcaguggugugugccagccuag

SEQ ID NO: 259363 - RNA, 22 nt, Homo sapiens
gcaugauuuuauaucuauguaa

SEQ ID NO: 259364 - RNA, 22 nt, Homo sapiens
gccaaaaugcugggauuacagg

SEQ ID NO: 259365 - RNA, 22 nt, Homo sapiens
gccauggaggauuuauagaggc

SEQ ID NO: 259366 - RNA, 22 nt, Homo sapiens
gccauugcacuacagccuaggc

SEQ ID NO: 259367 - RNA, 22 nt, Homo sapiens
gccccaguacaggcuccuuaga

SEQ ID NO: 259368 - RNA, 17 nt, Homo sapiens
gcccuuugugccucuuc

SEQ ID NO: 259369 - RNA, 22 nt, Homo sapiens
gccugagaggauaugauccccu

SEQ ID NO: 259370 - RNA, 22 nt, Homo sapiens
gcuccuuugaguagcuucugug

SEQ ID NO: 259371 - RNA, 22 nt, Homo sapiens
gcugaguaguauuucauuguau

SEQ ID NO: 259372 - RNA, 22 nt, Homo sapiens
gcugauggugcaguucuagccu

SEQ ID NO: 259373 - RNA, 22 nt, Homo sapiens
gcugauguuggccucugggcuu

SEQ ID NO: 259374 - RNA, 22 nt, Homo sapiens
gcugcacuuuaaggcauccccu

SEQ ID NO: 259375 - RNA, 22 nt, Homo sapiens
gcugcuguuauucaucagaacu

SEQ ID NO: 259376 - RNA, 19 nt, Homo sapiens
gcugguuguccacucucuc

SEQ ID NO: 259377 - RNA, 22 nt, Homo sapiens
gcugugauucuguguagauagu

SEQ ID NO: 259378 - RNA, 22 nt, Homo sapiens
gcuguugguaaaaaggacauga

SEQ ID NO: 259379 - RNA, 19 nt, Homo sapiens
gcuucuugaggacgaugac

SEQ ID NO: 259380 - RNA, 22 nt, Homo sapiens
gcuuuguuaaaacacagccaca

SEQ ID NO: 259381 - RNA, 22 nt, Homo sapiens
ggaaaguaacccauucucuuac

SEQ ID NO: 259382 - RNA, 23 nt, Homo sapiens
ggaaauguuuaagggguugggag

SEQ ID NO: 259383 - RNA, 23 nt, Homo sapiens
ggaaugaaaccugguuaugauau

SEQ ID NO: 259384 - RNA, 22 nt, Homo sapiens
ggaaugcagugagcauuagaua

SEQ ID NO: 259385 - RNA, 22 nt, Homo sapiens
ggaaugcuaaaauaggaugcug

SEQ ID NO: 259386 - RNA, 22 nt, Homo sapiens
ggaauguaguaauuugguuagu

SEQ ID NO: 259387 - RNA, 22 nt, Homo sapiens
ggacaagagacugggacacuga

SEQ ID NO: 259388 - RNA, 22 nt, Homo sapiens
ggacacaucaugugaccaaggu

SEQ ID NO: 259389 - RNA, 22 nt, Homo sapiens
ggagagcuaggcagagguuugu

SEQ ID NO: 259390 - RNA, 22 nt, Homo sapiens
ggagaugauuaugaaucacuua

SEQ ID NO: 259391 - RNA, 22 nt, Homo sapiens
ggagcugugauuugaguccaga

SEQ ID NO: 259392 - RNA, 22 nt, Homo sapiens
ggaguaggaaggaaauguuaaa

SEQ ID NO: 259393 - RNA, 22 nt, Homo sapiens
ggagucugaacuggacaaugac

SEQ ID NO: 259394 - RNA, 22 nt, Homo sapiens
ggagucugauuuuuauguugcu

SEQ ID NO: 259395 - RNA, 22 nt, Homo sapiens
ggagugcuguuguuacacaagg

SEQ ID NO: 259396 - RNA, 22 nt, Homo sapiens
ggaguguguaggagaaagguaa

SEQ ID NO: 259397 - RNA, 22 nt, Homo sapiens
ggaucacuugagaccaggaguu

SEQ ID NO: 259398 - RNA, 22 nt, Homo sapiens
ggaugugugcacgcgcacaugc

SEQ ID NO: 259399 - RNA, 22 nt, Homo sapiens
ggcaagaaccagggauuugcgu

SEQ ID NO: 259400 - RNA, 21 nt, Homo sapiens
ggcaagagaauacaacauaaa

SEQ ID NO: 259401 - RNA, 22 nt, Homo sapiens
ggcaagaucuuggcucacugaa

SEQ ID NO: 259402 - RNA, 22 nt, Homo sapiens
ggcagaauugcugaggaugcua

SEQ ID NO: 259403 - RNA, 17 nt, Homo sapiens
ggcaggaauuaauguca

SEQ ID NO: 259404 - RNA, 17 nt, Homo sapiens
ggcaggauccaggaucc

SEQ ID NO: 259405 - RNA, 22 nt, Homo sapiens
ggcaguguauuacuuaggguuc

SEQ ID NO: 259406 - RNA, 22 nt, Homo sapiens
ggcauguaauuauucaaagugg

SEQ ID NO: 259407 - RNA, 23 nt, Homo sapiens
ggcauuguggcucacaucuguaa

SEQ ID NO: 259408 - RNA, 22 nt, Homo sapiens
ggcccugauacaaguaaggucu

SEQ ID NO: 259409 - RNA, 21 nt, Homo sapiens
ggcucuguggucucagguuuc

SEQ ID NO: 259410 - RNA, 22 nt, Homo sapiens
gggaagugugcagaguucucuu

SEQ ID NO: 259411 - RNA, 22 nt, Homo sapiens
gggaggucauuguaaggucuua

SEQ ID NO: 259412 - RNA, 22 nt, Homo sapiens
gggagugucuaaccuguuaaca

SEQ ID NO: 259413 - RNA, 22 nt, Homo sapiens
gggagugugcacacaugguaua

SEQ ID NO: 259414 - RNA, 22 nt, Homo sapiens
gggaguguguaggacccagugu

SEQ ID NO: 259415 - RNA, 22 nt, Homo sapiens
gggaugaagaagaauaguucgu

SEQ ID NO: 259416 - RNA, 22 nt, Homo sapiens
gggaugaauuagguauguuuau

SEQ ID NO: 259417 - RNA, 22 nt, Homo sapiens
ggggcaaaaugccacgagucuc

SEQ ID NO: 259418 - RNA, 22 nt, Homo sapiens
gggugguuuuauuaucagugac

SEQ ID NO: 259419 - RNA, 22 nt, Homo sapiens
ggugagaaaaacauagucucag

SEQ ID NO: 259420 - RNA, 22 nt, Homo sapiens
gguggcaaaucugaguggcgcu

SEQ ID NO: 259421 - RNA, 22 nt, Homo sapiens
guaaacuuccccucaugaauga

SEQ ID NO: 259422 - RNA, 18 nt, Homo sapiens
guaaauguaucuauugcc

SEQ ID NO: 259423 - RNA, 22 nt, Homo sapiens
guaagauaguauguuuaaccca

SEQ ID NO: 259424 - RNA, 22 nt, Homo sapiens
guaaucucagcuacucaggagg

SEQ ID NO: 259425 - RNA, 22 nt, Homo sapiens
guacaugcauacaugcacaucu

SEQ ID NO: 259426 - RNA, 22 nt, Homo sapiens
guagagugcugggcacuggcuc

SEQ ID NO: 259427 - RNA, 22 nt, Homo sapiens
guagcagucacauagcagauug

SEQ ID NO: 259428 - RNA, 23 nt, Homo sapiens
guaguuugaugcaauccacuugu

SEQ ID NO: 259429 - RNA, 22 nt, Homo sapiens
guauacaugucaaaacucacau

SEQ ID NO: 259430 - RNA, 22 nt, Homo sapiens
guaucauugccuaaugcucuca

SEQ ID NO: 259431 - RNA, 22 nt, Homo sapiens
guaugacacaggaagcuuaacc

SEQ ID NO: 259432 - RNA, 22 nt, Homo sapiens
guauuuguugcagcagcacuau

SEQ ID NO: 259433 - RNA, 22 nt, Homo sapiens
gucaagauuuguaggacagaga

SEQ ID NO: 259434 - RNA, 22 nt, Homo sapiens
uuugacaaugugugcuuguauu

SEQ ID NO: 259435 - RNA, 22 nt, Homo sapiens
uuugacuaccaggaauguucuu

SEQ ID NO: 259436 - RNA, 22 nt, Homo sapiens
uuugacuagaguguuuuacaac

SEQ ID NO: 259437 - RNA, 22 nt, Homo sapiens
uuugagcauguaguuuaacccu

SEQ ID NO: 259438 - RNA, 22 nt, Homo sapiens
uuugaguaggcuuauauuuugg

SEQ ID NO: 259439 - RNA, 22 nt, Homo sapiens
uuugauuguacuaaaauuguac

SEQ ID NO: 259440 - RNA, 22 nt, Homo sapiens
uuugcaccuuccuaguggcuga

SEQ ID NO: 259441 - RNA, 22 nt, Homo sapiens
uuugcacuugaaaacacucuca

SEQ ID NO: 259442 - RNA, 22 nt, Homo sapiens
uuugcacuuuuguaauaugguu

SEQ ID NO: 259443 - RNA, 22 nt, Homo sapiens
uuugcaguguaguuggccagca

SEQ ID NO: 259444 - RNA, 22 nt, Homo sapiens
uuugccaauauuuuacugagga

SEQ ID NO: 259445 - RNA, 22 nt, Homo sapiens
uuugccaauauuuuauugagga

SEQ ID NO: 259446 - RNA, 19 nt, Homo sapiens
uuugccuaggcacauggcc

SEQ ID NO: 259447 - RNA, 22 nt, Homo sapiens
uuugcugagucugacuucaugg

SEQ ID NO: 259448 - RNA, 22 nt, Homo sapiens
uuuggaaugaaacagcagagcc

SEQ ID NO: 259449 - RNA, 22 nt, Homo sapiens
uuuggcaaagaucaacauguua

SEQ ID NO: 259450 - RNA, 22 nt, Homo sapiens
uuuggcaauuugacuguauagg

SEQ ID NO: 259451 - RNA, 22 nt, Homo sapiens
uuuggcauuuuacuacucaaau

SEQ ID NO: 259452 - RNA, 22 nt, Homo sapiens
uuuggcuuuuguaauaacugcc

SEQ ID NO: 259453 - RNA, 22 nt, Homo sapiens
uuugggccaugguuuguguaua

SEQ ID NO: 259454 - RNA, 22 nt, Homo sapiens
uuugggccucugauuucuuugg

SEQ ID NO: 259455 - RNA, 22 nt, Homo sapiens
uuuggucacugccgccgccagc

SEQ ID NO: 259456 - RNA, 22 nt, Homo sapiens
uuuggucuuuuauuuaaagcag

SEQ ID NO: 259457 - RNA, 22 nt, Homo sapiens
uuugguguauaaaaaugcuagu

SEQ ID NO: 259458 - RNA, 22 nt, Homo sapiens
uuuguaauccuauuccaaagga

SEQ ID NO: 259459 - RNA, 22 nt, Homo sapiens
uuugucacccugaauguaagau

SEQ ID NO: 259460 - RNA, 21 nt, Homo sapiens
uuugugguuacugugugagcu

SEQ ID NO: 259461 - RNA, 22 nt, Homo sapiens
uuuguguccccacccaaacauc

SEQ ID NO: 259462 - RNA, 23 nt, Homo sapiens
uuuugcaauaagucacuggaaua

SEQ ID NO: 259463 - RNA, 22 nt, Homo sapiens
uuuugcaauauguuccugaaua

SEQ ID NO: 259464 - RNA, 22 nt, Homo sapiens
uuuugcacuagaaccagagguu

SEQ ID NO: 259465 - RNA, 22 nt, Homo sapiens
uuuugcacuguuuuaucugaca

SEQ ID NO: 259466 - RNA, 22 nt, Homo sapiens
uuuugcaggcauuggaaguuua

SEQ ID NO: 259467 - RNA, 22 nt, Homo sapiens
uuuugcuccuggcaaacucaua

SEQ ID NO: 259468 - RNA, 22 nt, Homo sapiens
uuuuggcuagaaauauaccucc

SEQ ID NO: 259469 - RNA, 22 nt, Homo sapiens
uuuuggcuuaaagagaauguau

SEQ ID NO: 259470 - RNA, 21 nt, Homo sapiens
uuuugugcaugugcagccugc

SEQ ID NO: 259471 - RNA, 18 nt, Homo sapiens
uuuuugaggcacagggga

SEQ ID NO: 259472 - RNA, 22 nt, Homo sapiens
uuuuugugguauauugcaacaa

SEQ ID NO: 259473 - RNA, 22 nt, Homo sapiens
uugagcaaugucacugaggcuu

SEQ ID NO: 259474 - RNA, 22 nt, Homo sapiens
uugagcacaggaguuuugagac

SEQ ID NO: 259475 - RNA, 22 nt, Homo sapiens
uugagcaucauguuagcacuca

SEQ ID NO: 259476 - RNA, 22 nt, Homo sapiens
uugagcauugguauagguuuua

SEQ ID NO: 259477 - RNA, 22 nt, Homo sapiens
uugaggccugauaacacacuga

SEQ ID NO: 259478 - RNA, 22 nt, Homo sapiens
uugagguaauaaacagccauuc

SEQ ID NO: 259479 - RNA, 22 nt, Homo sapiens
uugagguauuuugucaacugua

SEQ ID NO: 259480 - RNA, 22 nt, Homo sapiens
ucaucagaguuuacaagcucag

SEQ ID NO: 259481 - RNA, 22 nt, Homo sapiens
ucaucagguaugucagcggagu

SEQ ID NO: 259482 - RNA, 22 nt, Homo sapiens
ucaucucaguuucuugccguac

SEQ ID NO: 259483 - RNA, 22 nt, Homo sapiens
ucauggguuuugguccaagcaa

SEQ ID NO: 259484 - RNA, 22 nt, Homo sapiens
ucauucuuucuguggaggggcu

SEQ ID NO: 259485 - RNA, 22 nt, Homo sapiens
uccacagugguggaauuguuca

SEQ ID NO: 259486 - RNA, 22 nt, Homo sapiens
uccacagugguugaacuaguuu

SEQ ID NO: 259487 - RNA, 18 nt, Homo sapiens
uccacgugcuuuccagau

SEQ ID NO: 259488 - RNA, 22 nt, Homo sapiens
uccacguggucuaucuguccuu

SEQ ID NO: 259489 - RNA, 22 nt, Homo sapiens
uccagaguggugaugcuggggc

SEQ ID NO: 259490 - RNA, 22 nt, Homo sapiens
uccauagacauuuuaagguagu

SEQ ID NO: 259491 - RNA, 22 nt, Homo sapiens
uccaugugaaaaggucgugaua

SEQ ID NO: 259492 - RNA, 22 nt, Homo sapiens
uccauuuguucagcuucaggaa

SEQ ID NO: 259493 - RNA, 19 nt, Homo sapiens
ucccaagaugcucauacau

SEQ ID NO: 259494 - RNA, 22 nt, Homo sapiens
ucccacugucuucucgugcucg

SEQ ID NO: 259495 - RNA, 22 nt, Homo sapiens
uccccaguaggcaauuaacacc

SEQ ID NO: 259496 - RNA, 22 nt, Homo sapiens
uccccuuuguaagauggaaacg

SEQ ID NO: 259497 - RNA, 22 nt, Homo sapiens
ucccugaaagcugagauuggaa

SEQ ID NO: 259498 - RNA, 22 nt, Homo sapiens
ucccugaagcugcagcaacaca

SEQ ID NO: 259499 - RNA, 22 nt, Homo sapiens
ucccugagguccuggauuauug

SEQ ID NO: 259500 - RNA, 22 nt, Homo sapiens
ucccugagugauugaaaauaaa

SEQ ID NO: 259501 - RNA, 22 nt, Homo sapiens
ucccuggagcaagagaagaagg

SEQ ID NO: 259502 - RNA, 22 nt, Homo sapiens
ucccugguguuaguuuguucuu

SEQ ID NO: 259503 - RNA, 22 nt, Homo sapiens
ucccuguguuccuuuugaauug

SEQ ID NO: 259504 - RNA, 17 nt, Homo sapiens
ucccuguuuuuucaguc

SEQ ID NO: 259505 - RNA, 22 nt, Homo sapiens
ucccuugguaauucuguuccuu

SEQ ID NO: 259506 - RNA, 22 nt, Homo sapiens
aaaacgcauccucacaggucug

SEQ ID NO: 259507 - RNA, 22 nt, Homo sapiens
aaaaggcuagcuaguaacagaa

SEQ ID NO: 259508 - RNA, 22 nt, Homo sapiens
aaaaugcugauauugggcccca

SEQ ID NO: 259509 - RNA, 22 nt, Homo sapiens
aaacaccacgcggucccucgga

SEQ ID NO: 259510 - RNA, 22 nt, Homo sapiens
aaaccaccauuacuuuugcacc

SEQ ID NO: 259511 - RNA, 22 nt, Homo sapiens
aaacugaucugaaggccaggcu

SEQ ID NO: 259512 - RNA, 22 nt, Homo sapiens
aaacugcuuuccaugguggcug

SEQ ID NO: 259513 - RNA, 22 nt, Homo sapiens
aaagcuacaggaccugcucauu

SEQ ID NO: 259514 - RNA, 22 nt, Homo sapiens
aaagcuaccagauucuguugga

SEQ ID NO: 259515 - RNA, 22 nt, Homo sapiens
aaaggauucuaauggaaaugcu

SEQ ID NO: 259516 - RNA, 22 nt, Homo sapiens
aaaggcacacacuccuuguuau

SEQ ID NO: 259517 - RNA, 22 nt, Homo sapiens
aaaggcuucggaucagaaggua

SEQ ID NO: 259518 - RNA, 22 nt, Homo sapiens
aaagggcuguuucuugacuugg

SEQ ID NO: 259519 - RNA, 22 nt, Homo sapiens
aaagguaguacuucuagaaggg

SEQ ID NO: 259520 - RNA, 22 nt, Homo sapiens
aaaguaguagcaguuucugcca

SEQ ID NO: 259521 - RNA, 22 nt, Homo sapiens
aaagucacuggagaaggaauau

SEQ ID NO: 259522 - RNA, 22 nt, Homo sapiens
aaagucuguuuugucagagacu

SEQ ID NO: 259523 - RNA, 22 nt, Homo sapiens
aaagugacuuagugccccauuu

SEQ ID NO: 259524 - RNA, 22 nt, Homo sapiens
aaagugcugggauuuuaggcau

SEQ ID NO: 259525 - RNA, 22 nt, Homo sapiens
aaagugucuguuccuagcauga

SEQ ID NO: 259526 - RNA, 22 nt, Homo sapiens
aaaguucuguugauagugcuga

SEQ ID NO: 259527 - RNA, 22 nt, Homo sapiens
aaaucccuugcucucucagacc

SEQ ID NO: 259528 - RNA, 22 nt, Homo sapiens
aaauggcacaguaagggcauuu

SEQ ID NO: 259529 - RNA, 22 nt, Homo sapiens
aaauggcuuugaggguaggaca

SEQ ID NO: 259530 - RNA, 22 nt, Homo sapiens
aaauucaucaaaugguuuguau

SEQ ID NO: 259531 - RNA, 22 nt, Homo sapiens
aaauucaugucaccucuaggua

SEQ ID NO: 259532 - RNA, 22 nt, Homo sapiens
aacaccauuuuucugcagccuu

SEQ ID NO: 259533 - RNA, 22 nt, Homo sapiens
aacaggguggugccugguccau

SEQ ID NO: 259534 - RNA, 22 nt, Homo sapiens
aacugcacuaggacagguuuuu

SEQ ID NO: 259535 - RNA, 22 nt, Homo sapiens
aacuggcauauucugguugcgg

SEQ ID NO: 259536 - RNA, 22 nt, Homo sapiens
aacuggccuccuugggaaauua

SEQ ID NO: 259537 - RNA, 19 nt, Homo sapiens
aacuggugugagaugguau

SEQ ID NO: 259538 - RNA, 20 nt, Homo sapiens
aagacacuguccccacugga

SEQ ID NO: 259539 - RNA, 18 nt, Homo sapiens
aagagcucagcacagguu

SEQ ID NO: 259540 - RNA, 22 nt, Homo sapiens
aagagcucucuguagcauguga

SEQ ID NO: 259541 - RNA, 22 nt, Homo sapiens
aagagguuguaccuaaaguguu

SEQ ID NO: 259542 - RNA, 22 nt, Homo sapiens
aagaugauguucuuuuucuuag

SEQ ID NO: 259543 - RNA, 22 nt, Homo sapiens
aagcaacacaucugccccgguu

SEQ ID NO: 259544 - RNA, 22 nt, Homo sapiens
aagcacccuuugucuggacaug

SEQ ID NO: 259545 - RNA, 22 nt, Homo sapiens
aagcaucacauaauggaucaug

SEQ ID NO: 259546 - RNA, 22 nt, Homo sapiens
aagcaucauuuggaauuugaga

SEQ ID NO: 259547 - RNA, 22 nt, Homo sapiens
aagcucuuguugaaucuuguca

SEQ ID NO: 259548 - RNA, 22 nt, Homo sapiens
aagcugccaggcaugguggcug

SEQ ID NO: 259549 - RNA, 22 nt, Homo sapiens
cugagcccauucuggggagaag

SEQ ID NO: 259550 - RNA, 22 nt, Homo sapiens
cugagcuagaccacuuggcucc

SEQ ID NO: 259551 - RNA, 22 nt, Homo sapiens
cugagguaauuuguugccagua

SEQ ID NO: 259552 - RNA, 22 nt, Homo sapiens
cugagguuguucuucucagugg

SEQ ID NO: 259553 - RNA, 22 nt, Homo sapiens
cugaucuaugaacacaggauau

SEQ ID NO: 259554 - RNA, 22 nt, Homo sapiens
cugaucuguuauacuuuucuau

SEQ ID NO: 259555 - RNA, 22 nt, Homo sapiens
cuggaaagaaucaggcuaaacu

SEQ ID NO: 259556 - RNA, 22 nt, Homo sapiens
cuggagauauuggaagaaagaa

SEQ ID NO: 259557 - RNA, 22 nt, Homo sapiens
cuggaggccugaacauaaaugg

SEQ ID NO: 259558 - RNA, 19 nt, Homo sapiens
cuggcaaaugcuuuggcca

SEQ ID NO: 259559 - RNA, 22 nt, Homo sapiens
cuggcagucugccucuucacug

SEQ ID NO: 259560 - RNA, 22 nt, Homo sapiens
cuggcagugcuuguuauccugg

SEQ ID NO: 259561 - RNA, 22 nt, Homo sapiens
cuggcccaguucugcguuuugc

SEQ ID NO: 259562 - RNA, 22 nt, Homo sapiens
cuggcucauuucauuuagcaua

SEQ ID NO: 259563 - RNA, 22 nt, Homo sapiens
cuggcucuguuagaagaaccag

SEQ ID NO: 259564 - RNA, 22 nt, Homo sapiens
cugggguaggacuggcuuuuga

SEQ ID NO: 259565 - RNA, 22 nt, Homo sapiens
cuggguacccuuuaaacaggaa

SEQ ID NO: 259566 - RNA, 22 nt, Homo sapiens
cuguaacagaauaaauuuguuu

SEQ ID NO: 259567 - RNA, 22 nt, Homo sapiens
cuguaauguaaugagacuacau

SEQ ID NO: 259568 - RNA, 22 nt, Homo sapiens
cugucacaguuuuggaggccag

SEQ ID NO: 259569 - RNA, 22 nt, Homo sapiens
cugucaucauuucuaugugcca

SEQ ID NO: 259570 - RNA, 22 nt, Homo sapiens
cugucucagccucuccaguagc

SEQ ID NO: 259571 - RNA, 22 nt, Homo sapiens
cugugcuugauuauaugagugu

SEQ ID NO: 259572 - RNA, 23 nt, Homo sapiens
cuguggauaugaguuguaaaugg

SEQ ID NO: 259573 - RNA, 22 nt, Homo sapiens
cuguugcaguuauggcugcagg

SEQ ID NO: 259574 - RNA, 22 nt, Homo sapiens
cuuaacagugguauugaugacc

SEQ ID NO: 259575 - RNA, 22 nt, Homo sapiens
cuuaagcauugacuuuggacag

SEQ ID NO: 259576 - RNA, 22 nt, Homo sapiens
cuuaaguaguuguggaaugaau

SEQ ID NO: 259577 - RNA, 22 nt, Homo sapiens
cuuacagucuaucagccacaac

SEQ ID NO: 259578 - RNA, 22 nt, Homo sapiens
cuucacuggagucccuggauuc

SEQ ID NO: 259579 - RNA, 22 nt, Homo sapiens
cuucaguucuguaaggacagca

SEQ ID NO: 259580 - RNA, 22 nt, Homo sapiens
cuuccagcuggguucagucagu

SEQ ID NO: 259581 - RNA, 22 nt, Homo sapiens
cuucucagugcucaucuuauuu

SEQ ID NO: 259582 - RNA, 23 nt, Homo sapiens
gugcaguggcgagauuucggcuc

SEQ ID NO: 259583 - RNA, 22 nt, Homo sapiens
gugccuuuucugagcaaugagc

SEQ ID NO: 259584 - RNA, 22 nt, Homo sapiens
guggaaaacauaugcuuguuga

SEQ ID NO: 259585 - RNA, 22 nt, Homo sapiens
guggaaaauuauugcuguuuuu

SEQ ID NO: 259586 - RNA, 22 nt, Homo sapiens
guggaaguguaaaagcucuugg

SEQ ID NO: 259587 - RNA, 22 nt, Homo sapiens
guggaaugauaucucauugugg

SEQ ID NO: 259588 - RNA, 22 nt, Homo sapiens
guggaauggaaugauuguguau

SEQ ID NO: 259589 - RNA, 17 nt, Homo sapiens
guggaaugucaugucaa

SEQ ID NO: 259590 - RNA, 22 nt, Homo sapiens
guggcagaaaagagaagcaaug

SEQ ID NO: 259591 - RNA, 22 nt, Homo sapiens
guggcagaacagguaggguucu

SEQ ID NO: 259592 - RNA, 22 nt, Homo sapiens
guggcuuuauuuagaagcaggg

SEQ ID NO: 259593 - RNA, 20 nt, Homo sapiens
gugggcaaauccuuuccucu

SEQ ID NO: 259594 - RNA, 22 nt, Homo sapiens
guggguaaaucucuguuugagg

SEQ ID NO: 259595 - RNA, 22 nt, Homo sapiens
gugguucuagaauugaguaucc

SEQ ID NO: 259596 - RNA, 22 nt, Homo sapiens
gugguuuuuuucugccuuauag

SEQ ID NO: 259597 - RNA, 22 nt, Homo sapiens
guguaaaugagugcugaaggag

SEQ ID NO: 259598 - RNA, 22 nt, Homo sapiens
guguaauaaucguggacuaugu

SEQ ID NO: 259599 - RNA, 22 nt, Homo sapiens
gugugauuauuucaauugaugc

SEQ ID NO: 259600 - RNA, 22 nt, Homo sapiens
gugugauuguuaauuuuaggug

SEQ ID NO: 259601 - RNA, 22 nt, Homo sapiens
gugugcacaaucuggcaugugc

SEQ ID NO: 259602 - RNA, 22 nt, Homo sapiens
guuauguuaaauuguuguaugc

SEQ ID NO: 259603 - RNA, 22 nt, Homo sapiens
guucaagcaauucugcugccuc

SEQ ID NO: 259604 - RNA, 22 nt, Homo sapiens
guucaagugauucuacugccuc

SEQ ID NO: 259605 - RNA, 22 nt, Homo sapiens
guucaaguuuucucuugugggu

SEQ ID NO: 259606 - RNA, 22 nt, Homo sapiens
guugcaaaguaauugugguuuu

SEQ ID NO: 259607 - RNA, 22 nt, Homo sapiens
guugggcccauagacugccagu

SEQ ID NO: 259608 - RNA, 22 nt, Homo sapiens
guuuaggaaugagaauauuuag

SEQ ID NO: 259609 - RNA, 22 nt, Homo sapiens
guuugcacuccuaugagaaucu

SEQ ID NO: 259610 - RNA, 22 nt, Homo sapiens
guuuugguuauauggaucaguu

SEQ ID NO: 259611 - RNA, 22 nt, Homo sapiens
uaaacugucuuuggagcuuugc

SEQ ID NO: 259612 - RNA, 20 nt, Homo sapiens
uaaaugccucaugcuuuauu

SEQ ID NO: 259613 - RNA, 22 nt, Homo sapiens
uaacacccuucuccagguacau

SEQ ID NO: 259614 - RNA, 22 nt, Homo sapiens
uaacccuuacaacuacacucgu

SEQ ID NO: 259615 - RNA, 22 nt, Homo sapiens
uaacgcuaguaucaccaggcua

SEQ ID NO: 259616 - RNA, 22 nt, Homo sapiens
uaacucugccuagugacauggu

SEQ ID NO: 259617 - RNA, 18 nt, Homo sapiens
uaacugugggaacuaacu

SEQ ID NO: 259618 - RNA, 16 nt, Homo sapiens
uaagccccacgugcau

SEQ ID NO: 259619 - RNA, 22 nt, Homo sapiens
uaagggacgcccccuucucucu

SEQ ID NO: 259620 - RNA, 22 nt, Homo sapiens
uaaguagaggaaucauuuugug

SEQ ID NO: 259621 - RNA, 22 nt, Homo sapiens
uaaguauagguaacagaagcaa

SEQ ID NO: 259622 - RNA, 22 nt, Homo sapiens
uaagugaauuugacagguaaug

SEQ ID NO: 259623 - RNA, 22 nt, Homo sapiens
uaagugcuugacuuugauguuu

SEQ ID NO: 259624 - RNA, 20 nt, Homo sapiens
uaagugcuugagacuucuga

SEQ ID NO: 259625 - RNA, 22 nt, Homo sapiens
uaauaguuggcacuggagaaag

SEQ ID NO: 259626 - RNA, 22 nt, Homo sapiens
uaauauguauacagacagauac

SEQ ID NO: 259627 - RNA, 22 nt, Homo sapiens
uaauaugugguugcuugggcac

SEQ ID NO: 259628 - RNA, 22 nt, Homo sapiens
uaauccuagcacuuuggaagac

SEQ ID NO: 259629 - RNA, 22 nt, Homo sapiens
uaauccugucuugaccaucagg

SEQ ID NO: 259630 - RNA, 22 nt, Homo sapiens
uacaaagcuuucugcaaaucau

SEQ ID NO: 259631 - RNA, 22 nt, Homo sapiens
uacaaguauuuuuauuagugcc

SEQ ID NO: 259632 - RNA, 20 nt, Homo sapiens
uacacguaugagcacaugug

SEQ ID NO: 259633 - RNA, 23 nt, Homo sapiens
uacagcugcagaaucaggcuaag

SEQ ID NO: 259634 - RNA, 19 nt, Homo sapiens
uacaggacugagcugaggu

SEQ ID NO: 259635 - RNA, 22 nt, Homo sapiens
uacaggauagacaauuuauuaa

SEQ ID NO: 259636 - RNA, 22 nt, Homo sapiens
uacaggcaccuggcuaauuuuu

SEQ ID NO: 259637 - RNA, 22 nt, Homo sapiens
uacaggugcuuauguggacaua

SEQ ID NO: 259638 - RNA, 22 nt, Homo sapiens
uacaguaguaucuucauuuguu

SEQ ID NO: 259639 - RNA, 22 nt, Homo sapiens
uacagucuggaggccuguguug

SEQ ID NO: 259640 - RNA, 22 nt, Homo sapiens
uacaguguuuugguauuccaca

SEQ ID NO: 259641 - RNA, 22 nt, Homo sapiens
uacauguauguguuuauggcug

SEQ ID NO: 259642 - RNA, 22 nt, Homo sapiens
uaccaccauuguaguuuggaaa

SEQ ID NO: 259643 - RNA, 22 nt, Homo sapiens
uacguguauuguuuucacaaga

SEQ ID NO: 259644 - RNA, 22 nt, Homo sapiens
uacuccccuuguucugugagcu

SEQ ID NO: 259645 - RNA, 22 nt, Homo sapiens
uacuguguaguuagaccucaga

SEQ ID NO: 259646 - RNA, 22 nt, Homo sapiens
uagaaaguagggaagguaggau

SEQ ID NO: 259647 - RNA, 18 nt, Homo sapiens
uagaauauaggucauucu

SEQ ID NO: 259648 - RNA, 22 nt, Homo sapiens
uagaaugucagcuucuugaggg

SEQ ID NO: 259649 - RNA, 22 nt, Homo sapiens
ucccauguagcuaggauuacag

SEQ ID NO: 259650 - RNA, 23 nt, Homo sapiens
uccccgggagcaccagcuuguug

SEQ ID NO: 259651 - RNA, 22 nt, Homo sapiens
ucccugaguaucuaauguguuu

SEQ ID NO: 259652 - RNA, 19 nt, Homo sapiens
ucccugagucuuagcuuga

SEQ ID NO: 259653 - RNA, 22 nt, Homo sapiens
ucccuuagccaaauccccagcc

SEQ ID NO: 259654 - RNA, 22 nt, Homo sapiens
ucccuugagccuggcuucucac

SEQ ID NO: 259655 - RNA, 19 nt, Homo sapiens
ucccuuuguagguaaccug

SEQ ID NO: 259656 - RNA, 22 nt, Homo sapiens
uccugcauucugaaauacaagu

SEQ ID NO: 259657 - RNA, 22 nt, Homo sapiens
uccuucaguccaguggguuuug

SEQ ID NO: 259658 - RNA, 22 nt, Homo sapiens
uccuugcacuaacuuaaggagg

SEQ ID NO: 259659 - RNA, 23 nt, Homo sapiens
uccuugguuggcgcccuaugugu

SEQ ID NO: 259660 - RNA, 22 nt, Homo sapiens
ucgugcugugucaucuuguggc

SEQ ID NO: 259661 - RNA, 22 nt, Homo sapiens
ucguggccugugaguccucccc

SEQ ID NO: 259662 - RNA, 17 nt, Homo sapiens
ucuaauaauaugcauuu

SEQ ID NO: 259663 - RNA, 22 nt, Homo sapiens
ucuauggaguuugaaugagaaa

SEQ ID NO: 259664 - RNA, 22 nt, Homo sapiens
ucuauguuuuugcuaguagugu

SEQ ID NO: 259665 - RNA, 22 nt, Homo sapiens
ucucaaguggucgcaguuagau

SEQ ID NO: 259666 - RNA, 22 nt, Homo sapiens
ucucacagaguugaacuuucuu

SEQ ID NO: 259667 - RNA, 18 nt, Homo sapiens
ucucacagcaaucuguca

SEQ ID NO: 259668 - RNA, 22 nt, Homo sapiens
ucucacaggguuauugaggggg

SEQ ID NO: 259669 - RNA, 22 nt, Homo sapiens
ucucagugaauugguuuugucu

SEQ ID NO: 259670 - RNA, 22 nt, Homo sapiens
ucucaguggcuuccucacuuuu

SEQ ID NO: 259671 - RNA, 22 nt, Homo sapiens
ucucaguguuaucuaucugccu

SEQ ID NO: 259672 - RNA, 22 nt, Homo sapiens
ucucaugaagauagagaauaga

SEQ ID NO: 259673 - RNA, 22 nt, Homo sapiens
ucucaugaagguggagaguagg

SEQ ID NO: 259674 - RNA, 22 nt, Homo sapiens
ucucauggagguagagaguaaa

SEQ ID NO: 259675 - RNA, 22 nt, Homo sapiens
ucucauggagucaggagcagaa

SEQ ID NO: 259676 - RNA, 22 nt, Homo sapiens
ucuccggguggcggcgaaggga

SEQ ID NO: 259677 - RNA, 22 nt, Homo sapiens
ucucugacacugaccccaaaaa

SEQ ID NO: 259678 - RNA, 22 nt, Homo sapiens
ucugagaucaugucugugcugu

SEQ ID NO: 259679 - RNA, 21 nt, Homo sapiens
ucugagucauucaguggccug

SEQ ID NO: 259680 - RNA, 22 nt, Homo sapiens
ucugcaagucuaaacuagccau

SEQ ID NO: 259681 - RNA, 22 nt, Homo sapiens
ucugccacugucauugugugau

SEQ ID NO: 259682 - RNA, 22 nt, Homo sapiens
ucuggcacugaugugggaugcu

SEQ ID NO: 259683 - RNA, 20 nt, Homo sapiens
ucuggccccuccaaaucuca

SEQ ID NO: 259684 - RNA, 21 nt, Homo sapiens
ucuggccccuccaaaucucau

SEQ ID NO: 259685 - RNA, 22 nt, Homo sapiens
ucuggccuagaacaauuaauua

SEQ ID NO: 259686 - RNA, 18 nt, Homo sapiens
ucuggcuucuuuguucca

SEQ ID NO: 259687 - RNA, 22 nt, Homo sapiens
ucuggcuugugaacugucuucu

SEQ ID NO: 259688 - RNA, 17 nt, Homo sapiens
ucuggcuuucacaccug

SEQ ID NO: 259689 - RNA, 21 nt, Homo sapiens
ucuggcuuucauuccccuucu

SEQ ID NO: 259690 - RNA, 22 nt, Homo sapiens
ucugguggugaugagagacagu

SEQ ID NO: 259691 - RNA, 22 nt, Homo sapiens
ucuguaguuaacagcuucagcu

SEQ ID NO: 259692 - RNA, 22 nt, Homo sapiens
ucugucaaaucuuauguuguag

SEQ ID NO: 259693 - RNA, 21 nt, Homo sapiens
ucuguguugaucucacuggga

SEQ ID NO: 259694 - RNA, 22 nt, Homo sapiens
ucuucaugcuugaaauaauagc

SEQ ID NO: 259695 - RNA, 22 nt, Homo sapiens
ucuucuagcggaacccucuugu

SEQ ID NO: 259696 - RNA, 17 nt, Homo sapiens
ucuucuguuacuguggc

SEQ ID NO: 259697 - RNA, 22 nt, Homo sapiens
ucuugcuuuugcagagcuucuc

SEQ ID NO: 259698 - RNA, 22 nt, Homo sapiens
ucuugggugaguuugugaauaa

SEQ ID NO: 259699 - RNA, 22 nt, Homo sapiens
ucuuggguuguuggcuucuccu

SEQ ID NO: 259700 - RNA, 22 nt, Homo sapiens
ucuuggguuugccuugcugcug

SEQ ID NO: 259701 - RNA, 22 nt, Homo sapiens
ucuuggguuuguccuucuccua

SEQ ID NO: 259702 - RNA, 22 nt, Homo sapiens
ucuuugauguucugaaagaugg

SEQ ID NO: 259703 - RNA, 22 nt, Homo sapiens
ucuuugguagaagcuauuuuau

SEQ ID NO: 259704 - RNA, 22 nt, Homo sapiens
ucuuuguguaggucaaucuggc

SEQ ID NO: 259705 - RNA, 22 nt, Homo sapiens
ucuuuguugcauaggcuuguuc

SEQ ID NO: 259706 - RNA, 22 nt, Homo sapiens
ugaaacacacauugcccuuuau

SEQ ID NO: 259707 - RNA, 22 nt, Homo sapiens
ugaaaucuuugaugguggcauu

SEQ ID NO: 259708 - RNA, 22 nt, Homo sapiens
ugaaaugccuugagauuuugac

SEQ ID NO: 259709 - RNA, 22 nt, Homo sapiens
ugaaggcaggagggagaaaagu

SEQ ID NO: 259710 - RNA, 22 nt, Homo sapiens
ugaaguaauguuuuauucuauu

SEQ ID NO: 259711 - RNA, 22 nt, Homo sapiens
ugaagugaagacucacagaagg

SEQ ID NO: 259712 - RNA, 22 nt, Homo sapiens
ugaagugaaugguaaguaugcc

SEQ ID NO: 259713 - RNA, 22 nt, Homo sapiens
ugacagcaucaggauuggagag

SEQ ID NO: 259714 - RNA, 22 nt, Homo sapiens
ugacaggagauuaugugauguu

SEQ ID NO: 259715 - RNA, 22 nt, Homo sapiens
ugacaggucuaauuuacugaca

SEQ ID NO: 259716 - RNA, 22 nt, Homo sapiens
ugacagguugauaggugcagca

SEQ ID NO: 259717 - RNA, 20 nt, Homo sapiens
ugacaguuaagggauagaag

SEQ ID NO: 259718 - RNA, 21 nt, Homo sapiens
ugacauuauuucaugucagua

SEQ ID NO: 259719 - RNA, 22 nt, Homo sapiens
ugaccuagaacucuaaugccug

SEQ ID NO: 259720 - RNA, 22 nt, Homo sapiens
ugacuagagggcuuuuguguag

SEQ ID NO: 259721 - RNA, 22 nt, Homo sapiens
ugacuauugauuuagacgugcu

SEQ ID NO: 259722 - RNA, 22 nt, Homo sapiens
ugacucaguuguuagucuucau

SEQ ID NO: 259723 - RNA, 22 nt, Homo sapiens
ugacuuuagaauuuuauccaga

SEQ ID NO: 259724 - RNA, 16 nt, Homo sapiens
ugagaacaugcagcau

SEQ ID NO: 259725 - RNA, 17 nt, Homo sapiens
ugagaacaugugguauu

SEQ ID NO: 259726 - RNA, 22 nt, Homo sapiens
ugagaacugccuguauuuaucu

SEQ ID NO: 259727 - RNA, 22 nt, Homo sapiens
ugagaagugauauagaaguuaa

SEQ ID NO: 259728 - RNA, 22 nt, Homo sapiens
ugagacaucugagauuuuaagc

SEQ ID NO: 259729 - RNA, 22 nt, Homo sapiens
ugagacaugugaauauuuguac

SEQ ID NO: 259730 - RNA, 22 nt, Homo sapiens
ugagacugagucucgcucuugu

SEQ ID NO: 259731 - RNA, 22 nt, Homo sapiens
ugagacugagucuugcucuugu

SEQ ID NO: 259732 - RNA, 22 nt, Homo sapiens
ugagacugaguuucucucuugu

SEQ ID NO: 259733 - RNA, 22 nt, Homo sapiens
ugagacugaguuuugccuuugu

SEQ ID NO: 259734 - RNA, 22 nt, Homo sapiens
ugagacugguaauguguagggc

SEQ ID NO: 259735 - RNA, 22 nt, Homo sapiens
ugagagaugauaaaauguuugu

SEQ ID NO: 259736 - RNA, 21 nt, Homo sapiens
ugagaguaguguauuauucuc

SEQ ID NO: 259737 - RNA, 22 nt, Homo sapiens
ugagauaguuguagauguacau

SEQ ID NO: 259738 - RNA, 22 nt, Homo sapiens
ugagaucaagguuaauauaauc

SEQ ID NO: 259739 - RNA, 22 nt, Homo sapiens
ugagaucucauuaugguuuuaa

SEQ ID NO: 259740 - RNA, 22 nt, Homo sapiens
ugagaucuguaaagucugacau

SEQ ID NO: 259741 - RNA, 22 nt, Homo sapiens
ugagaugaagcuagaagaaugg

SEQ ID NO: 259742 - RNA, 22 nt, Homo sapiens
ugagaugacgacacaccucagu

SEQ ID NO: 259743 - RNA, 22 nt, Homo sapiens
ugagauggcugaauucagaaua

SEQ ID NO: 259744 - RNA, 22 nt, Homo sapiens
ugagauggguaauuaaauggug

SEQ ID NO: 259745 - RNA, 22 nt, Homo sapiens
ugagaugguaaauuuuuguugu

SEQ ID NO: 259746 - RNA, 21 nt, Homo sapiens
ugagauuaaguuguuuagaag

SEQ ID NO: 259747 - RNA, 23 nt, Homo sapiens
ugagauuacccagaaagaguaua

SEQ ID NO: 259748 - RNA, 19 nt, Homo sapiens
ugagauuguaugaggagau

SEQ ID NO: 259749 - RNA, 22 nt, Homo sapiens
ugagcagaaguuuugauuggcg

SEQ ID NO: 259750 - RNA, 22 nt, Homo sapiens
ugagcagagggagaaguaaauu

SEQ ID NO: 259751 - RNA, 22 nt, Homo sapiens
ugagcagugagugugcugcagg

SEQ ID NO: 259752 - RNA, 22 nt, Homo sapiens
ugagcagugaguguggugcagg

SEQ ID NO: 259753 - RNA, 22 nt, Homo sapiens
ugagcaucucuaaaaggagcaa

SEQ ID NO: 259754 - RNA, 21 nt, Homo sapiens
ugagcauuaguacaguaggga

SEQ ID NO: 259755 - RNA, 22 nt, Homo sapiens
ugagcauuguguuugacuguga

SEQ ID NO: 259756 - RNA, 22 nt, Homo sapiens
ugagccaugguuagcuucucau

SEQ ID NO: 259757 - RNA, 22 nt, Homo sapiens
ugagcuauguucuucuuguuuu

SEQ ID NO: 259758 - RNA, 20 nt, Homo sapiens
ugagcucaugacauuuuucu

SEQ ID NO: 259759 - RNA, 22 nt, Homo sapiens
ugaggauaguguugaaggcagg

SEQ ID NO: 259760 - RNA, 22 nt, Homo sapiens
ugaggaucucuaggaauuuauc

SEQ ID NO: 259761 - RNA, 22 nt, Homo sapiens
ugaggcaaggcugaaugaaggc

SEQ ID NO: 259762 - RNA, 22 nt, Homo sapiens
ugagguaggugaagaaugcacg

SEQ ID NO: 259763 - RNA, 22 nt, Homo sapiens
ugagguguuauccagaguucuu

SEQ ID NO: 259764 - RNA, 22 nt, Homo sapiens
ugaguaauguugaucuuugaua

SEQ ID NO: 259765 - RNA, 22 nt, Homo sapiens
ugaguacugauuuaagauacac

SEQ ID NO: 259766 - RNA, 22 nt, Homo sapiens
ugaguagaacuccuggagaugu

SEQ ID NO: 259767 - RNA, 20 nt, Homo sapiens
ugaguagaggaguucuauca

SEQ ID NO: 259768 - RNA, 23 nt, Homo sapiens
ugaguagguccacguaugugagu

SEQ ID NO: 259769 - RNA, 22 nt, Homo sapiens
ugaguaugaguucaggaaaggc

SEQ ID NO: 259770 - RNA, 22 nt, Homo sapiens
ugaguauguuuaaugugacaau

SEQ ID NO: 259771 - RNA, 23 nt, Homo sapiens
ugagucacuuugcuggggucucu

SEQ ID NO: 259772 - RNA, 22 nt, Homo sapiens
ugagucauuuccuuaugcuacu

SEQ ID NO: 259773 - RNA, 22 nt, Homo sapiens
ugaguguccaaguaaggugaaa

SEQ ID NO: 259774 - RNA, 22 nt, Homo sapiens
ugaguguguaugugcauacaca

SEQ ID NO: 259775 - RNA, 22 nt, Homo sapiens
ugauaagaaauuguucauguag

SEQ ID NO: 259776 - RNA, 22 nt, Homo sapiens
ugauagaucugggcaaaguaaa

SEQ ID NO: 259777 - RNA, 20 nt, Homo sapiens
ugauauuucuggaaguggag

SEQ ID NO: 259778 - RNA, 17 nt, Homo sapiens
ugauauuuucccagaua

SEQ ID NO: 259779 - RNA, 22 nt, Homo sapiens
ugaucugucacuuaucacauuu

SEQ ID NO: 259780 - RNA, 22 nt, Homo sapiens
ugcaaagaaauuuuggugacca

SEQ ID NO: 259781 - RNA, 19 nt, Homo sapiens
ugcaaauucuaaaaacuga

SEQ ID NO: 259782 - RNA, 22 nt, Homo sapiens
ugcaagaaucuuucaggcuagc

SEQ ID NO: 259783 - RNA, 22 nt, Homo sapiens
ugcaaguggauuuuuccccaga

SEQ ID NO: 259784 - RNA, 17 nt, Homo sapiens
ugcaauuuaagcuagau

SEQ ID NO: 259785 - RNA, 18 nt, Homo sapiens
ugcaccaguuuacacuuc

SEQ ID NO: 259786 - RNA, 17 nt, Homo sapiens
ugcagcacacugauggg

SEQ ID NO: 259787 - RNA, 20 nt, Homo sapiens
ugcagcacugggaaugcagu

SEQ ID NO: 259788 - RNA, 22 nt, Homo sapiens
ugcagcauugcacuccagccug

SEQ ID NO: 259789 - RNA, 18 nt, Homo sapiens
ugcagcuuugugauuggc

SEQ ID NO: 259790 - RNA, 22 nt, Homo sapiens
ugcaguaggcccagcgggaggc

SEQ ID NO: 259791 - RNA, 22 nt, Homo sapiens
ugcagugugaaagagccugaca

SEQ ID NO: 259792 - RNA, 20 nt, Homo sapiens
ugcauguccucacuuacuug

SEQ ID NO: 259793 - RNA, 22 nt, Homo sapiens
ugcauugcacuugcaugagaua

SEQ ID NO: 259794 - RNA, 22 nt, Homo sapiens
ugccagaugugcccucuccacc

SEQ ID NO: 259795 - RNA, 22 nt, Homo sapiens
ugccaggaugaggucaauguuu

SEQ ID NO: 259796 - RNA, 22 nt, Homo sapiens
ugccaucauuaauauuaggcau

SEQ ID NO: 259797 - RNA, 22 nt, Homo sapiens
ugcccguaauuccagcacuuug

SEQ ID NO: 259798 - RNA, 22 nt, Homo sapiens
ugccuaggcuggaaugcagugg

SEQ ID NO: 259799 - RNA, 22 nt, Homo sapiens
ugccuaguggaaggagagcaaa

SEQ ID NO: 259800 - RNA, 22 nt, Homo sapiens
ugccugagccagguuuuaggag

SEQ ID NO: 259801 - RNA, 22 nt, Homo sapiens
ugcgccauugcacuccagccug

SEQ ID NO: 259802 - RNA, 22 nt, Homo sapiens
ugcuagaugcuguagggauuua

SEQ ID NO: 259803 - RNA, 21 nt, Homo sapiens
ugcuauguuguccaggcuggc

SEQ ID NO: 259804 - RNA, 22 nt, Homo sapiens
ugcugcaaacaggcaucugugg

SEQ ID NO: 259805 - RNA, 22 nt, Homo sapiens
ugcugcacuuauggcucugagg

SEQ ID NO: 259806 - RNA, 22 nt, Homo sapiens
ugcugguuuaaaaugcaaauuc

SEQ ID NO: 259807 - RNA, 22 nt, Homo sapiens
ugcugguuuucaucaucagugg

SEQ ID NO: 259808 - RNA, 18 nt, Homo sapiens
ugcuuagucauuuucaau

SEQ ID NO: 259809 - RNA, 20 nt, Homo sapiens
uggaaaguaagucaugauau

SEQ ID NO: 259810 - RNA, 22 nt, Homo sapiens
uggaaaguccaagccaaccggg

SEQ ID NO: 259811 - RNA, 22 nt, Homo sapiens
uggaaauaaaauagaguuugcc

SEQ ID NO: 259812 - RNA, 22 nt, Homo sapiens
uggaagcaugcaaucugugggg

SEQ ID NO: 259813 - RNA, 22 nt, Homo sapiens
uggaaguaaucaugagguagca

SEQ ID NO: 259814 - RNA, 23 nt, Homo sapiens
uggaaguauggaggaggcagaau

SEQ ID NO: 259815 - RNA, 21 nt, Homo sapiens
uggaaguguacaauuauaccc

SEQ ID NO: 259816 - RNA, 22 nt, Homo sapiens
uggaagugucugugcccagcuc

SEQ ID NO: 259817 - RNA, 20 nt, Homo sapiens
uggaaucugaagaucucagu

SEQ ID NO: 259818 - RNA, 22 nt, Homo sapiens
uggaauggagagagggugcacg

SEQ ID NO: 259819 - RNA, 22 nt, Homo sapiens
uggaaugguaucuuguuggggu

SEQ ID NO: 259820 - RNA, 22 nt, Homo sapiens
uggaaugucuauguuuuugauu

SEQ ID NO: 259821 - RNA, 22 nt, Homo sapiens
uggacaagugcccuccaccuca

SEQ ID NO: 259822 - RNA, 22 nt, Homo sapiens
uggacacuggagauucgucagu

SEQ ID NO: 259823 - RNA, 22 nt, Homo sapiens
uggacagagagaccggcauuuu

SEQ ID NO: 259824 - RNA, 18 nt, Homo sapiens
uggacagugauuauccau

SEQ ID NO: 259825 - RNA, 21 nt, Homo sapiens
uggaccccuacuucucaccau

SEQ ID NO: 259826 - RNA, 22 nt, Homo sapiens
uggaccccugcucgggagcccu

SEQ ID NO: 259827 - RNA, 21 nt, Homo sapiens
uggaccccuuccagucaucau

SEQ ID NO: 259828 - RNA, 19 nt, Homo sapiens
uggaccccuuccuuacacc

SEQ ID NO: 259829 - RNA, 22 nt, Homo sapiens
uggaccccuucuccuauuaaaa

SEQ ID NO: 259830 - RNA, 22 nt, Homo sapiens
uggacuagagggugggcgaggu

SEQ ID NO: 259831 - RNA, 22 nt, Homo sapiens
uggagacaaagauagaaaagca

SEQ ID NO: 259832 - RNA, 22 nt, Homo sapiens
uggagcccuaaacuucuaauau

SEQ ID NO: 259833 - RNA, 18 nt, Homo sapiens
ugacagcacaugugggga

SEQ ID NO: 259834 - RNA, 22 nt, Homo sapiens
ugacaguuuccagggcugucuc

SEQ ID NO: 259835 - RNA, 20 nt, Homo sapiens
ugacaucagcaauguaauaa

SEQ ID NO: 259836 - RNA, 22 nt, Homo sapiens
ugacaugauguuccuacacugu

SEQ ID NO: 259837 - RNA, 22 nt, Homo sapiens
ugacauggagguggaggaagau

SEQ ID NO: 259838 - RNA, 22 nt, Homo sapiens
ugacuagacuugcaagguugca

SEQ ID NO: 259839 - RNA, 22 nt, Homo sapiens
ugacuauaggauaacaugcauu

SEQ ID NO: 259840 - RNA, 22 nt, Homo sapiens
ugacugguguuuaaugagucaa

SEQ ID NO: 259841 - RNA, 22 nt, Homo sapiens
ugacuucagacugaaaugauuc

SEQ ID NO: 259842 - RNA, 22 nt, Homo sapiens
ugagaacagcagcuugggacac

SEQ ID NO: 259843 - RNA, 22 nt, Homo sapiens
ugagaacuagagaacaagguga

SEQ ID NO: 259844 - RNA, 22 nt, Homo sapiens
ugagaacuuauggugauuuuuu

SEQ ID NO: 259845 - RNA, 22 nt, Homo sapiens
ugagaauauuugaagauguuag

SEQ ID NO: 259846 - RNA, 22 nt, Homo sapiens
ugagaauauuuuccaugucuca

SEQ ID NO: 259847 - RNA, 22 nt, Homo sapiens
ugagacgucuucucuucuucaa

SEQ ID NO: 259848 - RNA, 22 nt, Homo sapiens
ugagacugagucucccucuguc

SEQ ID NO: 259849 - RNA, 22 nt, Homo sapiens
ugagacugaguuuccaucuugu

SEQ ID NO: 259850 - RNA, 22 nt, Homo sapiens
ugagacugaguuucgcucuugu

SEQ ID NO: 259851 - RNA, 22 nt, Homo sapiens
ugagacugaguuuugcucuugu

SEQ ID NO: 259852 - RNA, 22 nt, Homo sapiens
ugagacugauaggacauuuucu

SEQ ID NO: 259853 - RNA, 22 nt, Homo sapiens
ugagacugguuaauugauaaag

SEQ ID NO: 259854 - RNA, 22 nt, Homo sapiens
ugagagaugaacuauucuugaa

SEQ ID NO: 259855 - RNA, 22 nt, Homo sapiens
ugagaggugauaaagcaagggu

SEQ ID NO: 259856 - RNA, 22 nt, Homo sapiens
ugagauagggucucacucuguc

SEQ ID NO: 259857 - RNA, 22 nt, Homo sapiens
ugagaucacuaagagguaaugg

SEQ ID NO: 259858 - RNA, 18 nt, Homo sapiens
ugagaucagcaucaaggg

SEQ ID NO: 259859 - RNA, 22 nt, Homo sapiens
ugagaucagugaagaaguguuu

SEQ ID NO: 259860 - RNA, 23 nt, Homo sapiens
ugagaucuacagaucucagaucu

SEQ ID NO: 259861 - RNA, 22 nt, Homo sapiens
ugagaucuuuuguggcugagaa

SEQ ID NO: 259862 - RNA, 22 nt, Homo sapiens
ugagaugaagugauguaaaaca

SEQ ID NO: 259863 - RNA, 22 nt, Homo sapiens
ugagaugauaucuuauuguaau

SEQ ID NO: 259864 - RNA, 22 nt, Homo sapiens
ugagauggagucuugucgccua

SEQ ID NO: 259865 - RNA, 22 nt, Homo sapiens
ugagauggaguuucacuuuugu

SEQ ID NO: 259866 - RNA, 22 nt, Homo sapiens
ugagauggaguuucgcuuuugu

SEQ ID NO: 259867 - RNA, 22 nt, Homo sapiens
ugagauuaucguaauguaucuc

SEQ ID NO: 259868 - RNA, 22 nt, Homo sapiens
ugagauuaucuugaucuugaaa

SEQ ID NO: 259869 - RNA, 20 nt, Homo sapiens
ugagauuggugugguauaag

SEQ ID NO: 259870 - RNA, 22 nt, Homo sapiens
ugagauuguucuaugucugguu

SEQ ID NO: 259871 - RNA, 22 nt, Homo sapiens
ugagccauggcaccuugucuaa

SEQ ID NO: 259872 - RNA, 17 nt, Homo sapiens
ugagcuaugauccuguc

SEQ ID NO: 259873 - RNA, 22 nt, Homo sapiens
ugaggaguguauuucauucgcu

SEQ ID NO: 259874 - RNA, 22 nt, Homo sapiens
ugagguaucauugcccaggcug

SEQ ID NO: 259875 - RNA, 22 nt, Homo sapiens
ugaggugcagcaauccucaugu

SEQ ID NO: 259876 - RNA, 23 nt, Homo sapiens
ugagguguuaagcagacuugucu

SEQ ID NO: 259877 - RNA, 22 nt, Homo sapiens
ugaguagaacaucaagucauac

SEQ ID NO: 259878 - RNA, 22 nt, Homo sapiens
ugaguagauccaagacuguccu

SEQ ID NO: 259879 - RNA, 23 nt, Homo sapiens
ugaguaggugguuuuccccucac

SEQ ID NO: 259880 - RNA, 22 nt, Homo sapiens
ugagugugacuuagcagaagga

SEQ ID NO: 259881 - RNA, 22 nt, Homo sapiens
ugaguuccuugugugaccuugc

SEQ ID NO: 259882 - RNA, 22 nt, Homo sapiens
ugaguuccuuucccaguccagu

SEQ ID NO: 259883 - RNA, 22 nt, Homo sapiens
ugauagucauucaauuuagcca

SEQ ID NO: 259884 - RNA, 20 nt, Homo sapiens
ugauauuuucugagcaggaa

SEQ ID NO: 259885 - RNA, 22 nt, Homo sapiens
ugaucuuuuuaauguccauggg

SEQ ID NO: 259886 - RNA, 22 nt, Homo sapiens
ugaugacauugucacagucuga

SEQ ID NO: 259887 - RNA, 22 nt, Homo sapiens
ugaugcugaguggcuauuugaa

SEQ ID NO: 259888 - RNA, 22 nt, Homo sapiens
ugcaacacauugccccugcucu

SEQ ID NO: 259889 - RNA, 22 nt, Homo sapiens
ugcaauauccucuacuauaggu

SEQ ID NO: 259890 - RNA, 22 nt, Homo sapiens
ugcaaucauuuggaggagaaga

SEQ ID NO: 259891 - RNA, 22 nt, Homo sapiens
ugcaccacugcaccccagucug

SEQ ID NO: 259892 - RNA, 22 nt, Homo sapiens
ugcagagucuguccugccugcc

SEQ ID NO: 259893 - RNA, 20 nt, Homo sapiens
ugcagcacgggcccuuucca

SEQ ID NO: 259894 - RNA, 22 nt, Homo sapiens
ugcagcacugaacuucugggcu

SEQ ID NO: 259895 - RNA, 22 nt, Homo sapiens
ugcaguuuaggaacugguaaca

SEQ ID NO: 259896 - RNA, 22 nt, Homo sapiens
ugcauacugggagguugggugu

SEQ ID NO: 259897 - RNA, 21 nt, Homo sapiens
ugcauacuucucagaugauua

SEQ ID NO: 259898 - RNA, 22 nt, Homo sapiens
ugcaugcaucuuuuauaguagc

SEQ ID NO: 259899 - RNA, 22 nt, Homo sapiens
ugcauggagauauacaguuuuu

SEQ ID NO: 259900 - RNA, 22 nt, Homo sapiens
ugccaacaugccuggcuguuuu

SEQ ID NO: 259901 - RNA, 22 nt, Homo sapiens
ugccaagaacauuuucuguuuu

SEQ ID NO: 259902 - RNA, 20 nt, Homo sapiens
ugccaagaugacuauagcuc

SEQ ID NO: 259903 - RNA, 22 nt, Homo sapiens
ugccaaggagucagucccuaga

SEQ ID NO: 259904 - RNA, 22 nt, Homo sapiens
ugccagagacguagggaauauu

SEQ ID NO: 259905 - RNA, 19 nt, Homo sapiens
ugccauguagcacaugguc

SEQ ID NO: 259906 - RNA, 22 nt, Homo sapiens
ugccuaggcuggaaugcaaugg

SEQ ID NO: 259907 - RNA, 22 nt, Homo sapiens
ugccuaggcuggagugcagugg

SEQ ID NO: 259908 - RNA, 22 nt, Homo sapiens
ugccuucuguuaaacgaggaug

SEQ ID NO: 259909 - RNA, 22 nt, Homo sapiens
ugcgccauugcauuccagccug

SEQ ID NO: 259910 - RNA, 22 nt, Homo sapiens
ugcuaugucagccaggcugguc

SEQ ID NO: 259911 - RNA, 20 nt, Homo sapiens
ugcugcacuuaagcaugggc

SEQ ID NO: 259912 - RNA, 22 nt, Homo sapiens
ugcuggugauucagauucaaau

SEQ ID NO: 259913 - RNA, 22 nt, Homo sapiens
ugcuugagacacauaugaauuu

SEQ ID NO: 259914 - RNA, 22 nt, Homo sapiens
uggaagucaugcugcaagaaca

SEQ ID NO: 259915 - RNA, 22 nt, Homo sapiens
uggaaguuaaauuaguugauga

SEQ ID NO: 259916 - RNA, 22 nt, Homo sapiens
uggaaucuagagaaaugcaaac

SEQ ID NO: 259917 - RNA, 22 nt, Homo sapiens
uggaauguauaucguuuuuugu

SEQ ID NO: 259918 - RNA, 18 nt, Homo sapiens
uggaauguuuggguuaau

SEQ ID NO: 259919 - RNA, 22 nt, Homo sapiens
uggacacugguggauauggaau

SEQ ID NO: 259920 - RNA, 21 nt, Homo sapiens
uggaccccuuccuugcaccau

SEQ ID NO: 259921 - RNA, 21 nt, Homo sapiens
uggaccccuuucuuacaccgu

SEQ ID NO: 259922 - RNA, 22 nt, Homo sapiens
uggagacugaucccucuuuccu

SEQ ID NO: 259923 - RNA, 22 nt, Homo sapiens
uggagcccuaguuccucauaac

SEQ ID NO: 259924 - RNA, 22 nt, Homo sapiens
uuuuggugguuaugugucaaug

SEQ ID NO: 259925 - RNA, 22 nt, Homo sapiens
uuuugguguacaauucuaugga

SEQ ID NO: 259926 - RNA, 22 nt, Homo sapiens
uuuuucacuuaaguuaggcuca

SEQ ID NO: 259927 - RNA, 22 nt, Homo sapiens
uuuuuggauaaugguacaugua

SEQ ID NO: 259928 - RNA, 23 nt, Homo sapiens
uuuuuguguuucauggaaauagg

SEQ ID NO: 259929 - RNA, 23 nt, Homo sapiens
ucagguaguuucagaggaccuug

SEQ ID NO: 259930 - RNA, 22 nt, Homo sapiens
ucagguauuuuaucacaugaag

SEQ ID NO: 259931 - RNA, 22 nt, Homo sapiens
ucaguaaaugcuguucucuuuu

SEQ ID NO: 259932 - RNA, 23 nt, Homo sapiens
ucaguacuccacuuucaauagug

SEQ ID NO: 259933 - RNA, 22 nt, Homo sapiens
ucaguccccucgcugagucuac

SEQ ID NO: 259934 - RNA, 20 nt, Homo sapiens
ucagugauugguuuaguuau

SEQ ID NO: 259935 - RNA, 17 nt, Homo sapiens
ucagugcauuuaagaga

SEQ ID NO: 259936 - RNA, 22 nt, Homo sapiens
ucagugucugugauggagaggu

SEQ ID NO: 259937 - RNA, 22 nt, Homo sapiens
ucaguguuuggaaucucaauuu

SEQ ID NO: 259938 - RNA, 22 nt, Homo sapiens
ucauagaucaaguaauaagaca

SEQ ID NO: 259939 - RNA, 20 nt, Homo sapiens
ucaucaguuggugcucgcug

SEQ ID NO: 259940 - RNA, 22 nt, Homo sapiens
ucaucuggcgaaugugaagagu

SEQ ID NO: 259941 - RNA, 22 nt, Homo sapiens
ucaugacacagcauacugacuu

SEQ ID NO: 259942 - RNA, 22 nt, Homo sapiens
ucaugaccaugguauagaccac

SEQ ID NO: 259943 - RNA, 22 nt, Homo sapiens
ucauguaauuuugugucuauga

SEQ ID NO: 259944 - RNA, 22 nt, Homo sapiens
ucauugguagcucauggaaccg

SEQ ID NO: 259945 - RNA, 21 nt, Homo sapiens
ucauugguuggcugcccugua

SEQ ID NO: 259946 - RNA, 22 nt, Homo sapiens
uccaaaucucuggcacugggau

SEQ ID NO: 259947 - RNA, 22 nt, Homo sapiens
uccacagugguugaacuaguaa

SEQ ID NO: 259948 - RNA, 21 nt, Homo sapiens
uccagcuuugagaguuguggu

SEQ ID NO: 259949 - RNA, 22 nt, Homo sapiens
uccagcuuuuucuaauucugug

SEQ ID NO: 259950 - RNA, 22 nt, Homo sapiens
uccaguuuggaggcuugaugug

SEQ ID NO: 259951 - RNA, 22 nt, Homo sapiens
uccaugaguccauuagaaaaaa

SEQ ID NO: 259952 - RNA, 22 nt, Homo sapiens
uccaugugaaaucuaugaggac

SEQ ID NO: 259953 - RNA, 19 nt, Homo sapiens
ucccaauguuuccaggcag

SEQ ID NO: 259954 - RNA, 22 nt, Homo sapiens
uccccugagaccccucagcacu

SEQ ID NO: 259955 - RNA, 22 nt, Homo sapiens
uccccugauaccaaccaccaug

SEQ ID NO: 259956 - RNA, 20 nt, Homo sapiens
ucccuaagagccuuuccuuc

SEQ ID NO: 259957 - RNA, 22 nt, Homo sapiens
ucccugacagggucugagcuuu

SEQ ID NO: 259958 - RNA, 22 nt, Homo sapiens
ucccugacagucacagagcuac

SEQ ID NO: 259959 - RNA, 18 nt, Homo sapiens
ucccugacucaaauucuu

SEQ ID NO: 259960 - RNA, 22 nt, Homo sapiens
ucccuggacagccuugccuggg

SEQ ID NO: 259961 - RNA, 21 nt, Homo sapiens
uccugagagaggaguaacucu

SEQ ID NO: 259962 - RNA, 22 nt, Homo sapiens
uccuggcuccacuguuuauucc

SEQ ID NO: 259963 - RNA, 22 nt, Homo sapiens
uccuucacucuacaucuuuguu

SEQ ID NO: 259964 - RNA, 22 nt, Homo sapiens
uccuuggucaaaaagaaagugu

SEQ ID NO: 259965 - RNA, 22 nt, Homo sapiens
uccuuggucauggaagagacag

SEQ ID NO: 259966 - RNA, 22 nt, Homo sapiens
uccuuuguuacaguuggcucug

SEQ ID NO: 259967 - RNA, 22 nt, Homo sapiens
ucgcagcacgagcaugcaaggu

SEQ ID NO: 259968 - RNA, 22 nt, Homo sapiens
ucuaauguaaccugcaaauauu

SEQ ID NO: 259969 - RNA, 22 nt, Homo sapiens
ucuagccuaugaagcuugucca

SEQ ID NO: 259970 - RNA, 22 nt, Homo sapiens
ucucaauggguuguagacaaag

SEQ ID NO: 259971 - RNA, 22 nt, Homo sapiens
ucucacaccccucucauauacc

SEQ ID NO: 259972 - RNA, 22 nt, Homo sapiens
ucucacagaguugaauguuucu

SEQ ID NO: 259973 - RNA, 19 nt, Homo sapiens
ucucacagcucuacuaugu

SEQ ID NO: 259974 - RNA, 22 nt, Homo sapiens
ucucagagccuaggguuuuuca

SEQ ID NO: 259975 - RNA, 22 nt, Homo sapiens
ucucaguggugcuggcagggga

SEQ ID NO: 259976 - RNA, 20 nt, Homo sapiens
ucucauggagggaaagagca

SEQ ID NO: 259977 - RNA, 20 nt, Homo sapiens
ucucauggagguagagaaua

SEQ ID NO: 259978 - RNA, 22 nt, Homo sapiens
ucucauugauucuggggugaug

SEQ ID NO: 259979 - RNA, 22 nt, Homo sapiens
ucucugagaaaaguuucuccca

SEQ ID NO: 259980 - RNA, 22 nt, Homo sapiens
ucucuggauaucuacuuauguu

SEQ ID NO: 259981 - RNA, 22 nt, Homo sapiens
ucucuuggcggaaguugcagug

SEQ ID NO: 259982 - RNA, 22 nt, Homo sapiens
ucucuugguugaacaguuugga

SEQ ID NO: 259983 - RNA, 22 nt, Homo sapiens
ucugacaaugaacaaucuauag

SEQ ID NO: 259984 - RNA, 22 nt, Homo sapiens
ucugagguaggugcauggauac

SEQ ID NO: 259985 - RNA, 23 nt, Homo sapiens
ucugauguuauaaaauucuuugg

SEQ ID NO: 259986 - RNA, 22 nt, Homo sapiens
ucuggaauguaaaguuuauggg

SEQ ID NO: 259987 - RNA, 21 nt, Homo sapiens
ucuggcccccucaaaucucau

SEQ ID NO: 259988 - RNA, 22 nt, Homo sapiens
ucuggucccugcacauauuuuc

SEQ ID NO: 259989 - RNA, 22 nt, Homo sapiens
ucuggugugcucuggacuugca

SEQ ID NO: 259990 - RNA, 22 nt, Homo sapiens
ucugugaaaucauuuccuguaa

SEQ ID NO: 259991 - RNA, 22 nt, Homo sapiens
ucugugguuguugcauggaaug

SEQ ID NO: 259992 - RNA, 22 nt, Homo sapiens
ucuguguuuagacccaggguag

SEQ ID NO: 259993 - RNA, 22 nt, Homo sapiens
ucuuaguuuagauuagcaauuc

SEQ ID NO: 259994 - RNA, 22 nt, Homo sapiens
ucuucagucauauuggccugga

SEQ ID NO: 259995 - RNA, 22 nt, Homo sapiens
ucuugcauuuuuaaauagugcu

SEQ ID NO: 259996 - RNA, 22 nt, Homo sapiens
ucuugccacuucauccccuuuc

SEQ ID NO: 259997 - RNA, 21 nt, Homo sapiens
ucuuggguugaauucucccag

SEQ ID NO: 259998 - RNA, 22 nt, Homo sapiens
ucuugguaaugucacauuuccu

SEQ ID NO: 259999 - RNA, 22 nt, Homo sapiens
ucuuugaguguauacuuagauu

SEQ ID NO: 260000 - RNA, 22 nt, Homo sapiens
ucuuugaguuauugugcagacu

SEQ ID NO: 260001 - RNA, 19 nt, Homo sapiens
ucuuugcuuuucuaagagg

SEQ ID NO: 260002 - RNA, 22 nt, Homo sapiens
ucuuuggauggaaauuggaguc

SEQ ID NO: 260003 - RNA, 22 nt, Homo sapiens
ucuuugguugcacugcaggugu

SEQ ID NO: 260004 - RNA, 22 nt, Homo sapiens
ucuuuguguucaggagccacgu

SEQ ID NO: 260005 - RNA, 22 nt, Homo sapiens
ucuuuguuuucugauccugaag

SEQ ID NO: 260006 - RNA, 22 nt, Homo sapiens
ucuuuuguucuauucaggccuu

SEQ ID NO: 260007 - RNA, 22 nt, Homo sapiens
ugaaaaguuguugaaggcuuca

SEQ ID NO: 260008 - RNA, 22 nt, Homo sapiens
ugaaaucauguaguuauugcaa

SEQ ID NO: 260009 - RNA, 22 nt, Homo sapiens
ugaaauguaaguugucuagucu

SEQ ID NO: 260010 - RNA, 22 nt, Homo sapiens
ugaaauuauucuuaccaaggug

SEQ ID NO: 260011 - RNA, 22 nt, Homo sapiens
ugaacuguaagguauaggugau

SEQ ID NO: 260012 - RNA, 22 nt, Homo sapiens
ugaagaucuuaggagcugaggg

SEQ ID NO: 260013 - RNA, 22 nt, Homo sapiens
uagcagucaagauagucauuau

SEQ ID NO: 260014 - RNA, 22 nt, Homo sapiens
uagcagugucuagguaggccau

SEQ ID NO: 260015 - RNA, 22 nt, Homo sapiens
uagcauaauuuguagaaaauca

SEQ ID NO: 260016 - RNA, 21 nt, Homo sapiens
uagcauacauuuugcaucuua

SEQ ID NO: 260017 - RNA, 22 nt, Homo sapiens
uagcuggaauuacuugcaccug

SEQ ID NO: 260018 - RNA, 22 nt, Homo sapiens
uaggagcacaaaccccauugug

SEQ ID NO: 260019 - RNA, 22 nt, Homo sapiens
uaggagugugaacccuaugaac

SEQ ID NO: 260020 - RNA, 22 nt, Homo sapiens
uaggcuuuuggacccugucucu

SEQ ID NO: 260021 - RNA, 22 nt, Homo sapiens
uagggcauugaacugaauucuu

SEQ ID NO: 260022 - RNA, 23 nt, Homo sapiens
uagguuauuugguaaauauaugu

SEQ ID NO: 260023 - RNA, 20 nt, Homo sapiens
uagucaugagauucuccaag

SEQ ID NO: 260024 - RNA, 22 nt, Homo sapiens
uauaaaguaauuucuaggggcu

SEQ ID NO: 260025 - RNA, 22 nt, Homo sapiens
uauacugucuuuguaugccuag

SEQ ID NO: 260026 - RNA, 22 nt, Homo sapiens
uauagcauuuugauccuguaga

SEQ ID NO: 260027 - RNA, 21 nt, Homo sapiens
uauaugacuuacuauugccuc

SEQ ID NO: 260028 - RNA, 22 nt, Homo sapiens
uauaugcaacauaguguaugug

SEQ ID NO: 260029 - RNA, 22 nt, Homo sapiens
uaucacacaucaugguaaaucu

SEQ ID NO: 260030 - RNA, 22 nt, Homo sapiens
uaucacacgccuugcuucauuu

SEQ ID NO: 260031 - RNA, 22 nt, Homo sapiens
uaucacacuguuggauuugauu

SEQ ID NO: 260032 - RNA, 22 nt, Homo sapiens
uaucaccuugcaggagcuauga

SEQ ID NO: 260033 - RNA, 22 nt, Homo sapiens
uaucagcagagucauacuucaa

SEQ ID NO: 260034 - RNA, 22 nt, Homo sapiens
uaucagcagcaggggcugcaga

SEQ ID NO: 260035 - RNA, 22 nt, Homo sapiens
uaucauggaaugagguuggaca

SEQ ID NO: 260036 - RNA, 22 nt, Homo sapiens
uaucauugccucaaucuguauu

SEQ ID NO: 260037 - RNA, 20 nt, Homo sapiens
uaucuacuugcaaaugccau

SEQ ID NO: 260038 - RNA, 22 nt, Homo sapiens
uaucucauccuccuugauccca

SEQ ID NO: 260039 - RNA, 22 nt, Homo sapiens
uaugaaagcuacuucucacaau

SEQ ID NO: 260040 - RNA, 20 nt, Homo sapiens
uaugaccugucuuuucucuc

SEQ ID NO: 260041 - RNA, 22 nt, Homo sapiens
uauggcacuaguacuggaaagc

SEQ ID NO: 260042 - RNA, 22 nt, Homo sapiens
uauggccccuacaugugcaaaa

SEQ ID NO: 260043 - RNA, 22 nt, Homo sapiens
uauuacacuuuagugucuucca

SEQ ID NO: 260044 - RNA, 22 nt, Homo sapiens
uauuacugucaauaucacagaa

SEQ ID NO: 260045 - RNA, 22 nt, Homo sapiens
uauuaguuguaugauucccaag

SEQ ID NO: 260046 - RNA, 22 nt, Homo sapiens
uauugcagugagauccaucugg

SEQ ID NO: 260047 - RNA, 22 nt, Homo sapiens
uauugcauauuauucuaguggc

SEQ ID NO: 260048 - RNA, 22 nt, Homo sapiens
uauugcucaugcauuuaauuuc

SEQ ID NO: 260049 - RNA, 22 nt, Homo sapiens
uauuguacauguuauagauuuu

SEQ ID NO: 260050 - RNA, 22 nt, Homo sapiens
uauuucaguugugcagguaguu

SEQ ID NO: 260051 - RNA, 22 nt, Homo sapiens
ucaaaaucucuuagcugugucu

SEQ ID NO: 260052 - RNA, 22 nt, Homo sapiens
ucaaaguauucuucugagaacc

SEQ ID NO: 260053 - RNA, 22 nt, Homo sapiens
ucaaaugauucagaagccaccu

SEQ ID NO: 260054 - RNA, 22 nt, Homo sapiens
ucaaaugauucuccugccucag

SEQ ID NO: 260055 - RNA, 22 nt, Homo sapiens
ucaaaugcacguagagaaaaua

SEQ ID NO: 260056 - RNA, 17 nt, Homo sapiens
ucaaaugcucccaguga

SEQ ID NO: 260057 - RNA, 22 nt, Homo sapiens
ucaacauugcugucaggcaucu

SEQ ID NO: 260058 - RNA, 21 nt, Homo sapiens
ucaacccuugcgucaccaagc

SEQ ID NO: 260059 - RNA, 22 nt, Homo sapiens
ucaagaccucacauagaggaga

SEQ ID NO: 260060 - RNA, 18 nt, Homo sapiens
ucaagcaauugucaugcc

SEQ ID NO: 260061 - RNA, 20 nt, Homo sapiens
ucaaggcacgaauaaaaguu

SEQ ID NO: 260062 - RNA, 22 nt, Homo sapiens
ucaaggcacuagcugagcugca

SEQ ID NO: 260063 - RNA, 20 nt, Homo sapiens
ucaaggcaggaacuguacau

SEQ ID NO: 260064 - RNA, 22 nt, Homo sapiens
ucaaggcaguggccuuccuucu

SEQ ID NO: 260065 - RNA, 22 nt, Homo sapiens
ucaaguacugccuugcucuggc

SEQ ID NO: 260066 - RNA, 22 nt, Homo sapiens
ucaaguagugacucgaguuauu

SEQ ID NO: 260067 - RNA, 22 nt, Homo sapiens
ucaagugcauaugcuaacgguu

SEQ ID NO: 260068 - RNA, 22 nt, Homo sapiens
ucaaugcaugugacaaagagua

SEQ ID NO: 260069 - RNA, 16 nt, Homo sapiens
ucacaaacucuagcag

SEQ ID NO: 260070 - RNA, 22 nt, Homo sapiens
ucacaaagcuuggccugcuucu

SEQ ID NO: 260071 - RNA, 22 nt, Homo sapiens
ucacaaggcaggaaugaaaggg

SEQ ID NO: 260072 - RNA, 22 nt, Homo sapiens
ucacacgugaacucaucacaga

SEQ ID NO: 260073 - RNA, 22 nt, Homo sapiens
ucacacugaauuugaagcaaug

SEQ ID NO: 260074 - RNA, 22 nt, Homo sapiens
ucacagucugcgugaugagaca

SEQ ID NO: 260075 - RNA, 17 nt, Homo sapiens
ucacaguguuaggauga

SEQ ID NO: 260076 - RNA, 22 nt, Homo sapiens
ucacaugaagauuuuaguauac

SEQ ID NO: 260077 - RNA, 22 nt, Homo sapiens
ucacauguguaaauugguguaa

SEQ ID NO: 260078 - RNA, 22 nt, Homo sapiens
ucaccaccugcugauuguagag

SEQ ID NO: 260079 - RNA, 22 nt, Homo sapiens
ucaccuggagccuucacauucu

SEQ ID NO: 260080 - RNA, 22 nt, Homo sapiens
ucaccuggggaucuuguuuaca

SEQ ID NO: 260081 - RNA, 22 nt, Homo sapiens
ucaccuggggcacagcugaaga

SEQ ID NO: 260082 - RNA, 22 nt, Homo sapiens
ucacuagaucaagggagagaaa

SEQ ID NO: 260083 - RNA, 22 nt, Homo sapiens
ucacuauugacaacagugugga

SEQ ID NO: 260084 - RNA, 22 nt, Homo sapiens
ucacucagaccuggugauaugc

SEQ ID NO: 260085 - RNA, 21 nt, Homo sapiens
ucacugagguuaaauaggguu

SEQ ID NO: 260086 - RNA, 20 nt, Homo sapiens
ucacugagugguccacagua

SEQ ID NO: 260087 - RNA, 22 nt, Homo sapiens
ucacugcacuagguaaugccac

SEQ ID NO: 260088 - RNA, 22 nt, Homo sapiens
ucacugcacuucaggcuuucuc

SEQ ID NO: 260089 - RNA, 22 nt, Homo sapiens
ucacugcgaccuccaccucccg

SEQ ID NO: 260090 - RNA, 22 nt, Homo sapiens
ucacugcgaccucugccucccg

SEQ ID NO: 260091 - RNA, 22 nt, Homo sapiens
ucacuggagauagcaaucuggu

SEQ ID NO: 260092 - RNA, 22 nt, Homo sapiens
ucacugggagaccaaagccauc

SEQ ID NO: 260093 - RNA, 20 nt, Homo sapiens
ucacugugaacuucuugagg

SEQ ID NO: 260094 - RNA, 22 nt, Homo sapiens
ucacuguggaacucaaaaagcu

SEQ ID NO: 260095 - RNA, 22 nt, Homo sapiens
ucacugugugucucuguaucug

SEQ ID NO: 260096 - RNA, 21 nt, Homo sapiens
ucagaagcucccagggaggac

SEQ ID NO: 260097 - RNA, 22 nt, Homo sapiens
ucagacacugcccuccaccugu

SEQ ID NO: 260098 - RNA, 22 nt, Homo sapiens
ucagacacuguggccuuuggac

SEQ ID NO: 260099 - RNA, 19 nt, Homo sapiens
ucagaucagcccaagggau

SEQ ID NO: 260100 - RNA, 22 nt, Homo sapiens
ucagaugaucugguaagaacuu

SEQ ID NO: 260101 - RNA, 22 nt, Homo sapiens
ucagaugaugucccuguucuaa

SEQ ID NO: 260102 - RNA, 22 nt, Homo sapiens
ucagcaucacaggcagugagug

SEQ ID NO: 260103 - RNA, 20 nt, Homo sapiens
ucagguagggcuucaacauu

SEQ ID NO: 260104 - RNA, 22 nt, Homo sapiens
caugcacugagagggucucggc

SEQ ID NO: 260105 - RNA, 22 nt, Homo sapiens
caugcauuggucuauuauguga

SEQ ID NO: 260106 - RNA, 22 nt, Homo sapiens
cauggcacauauauaucuaggu

SEQ ID NO: 260107 - RNA, 22 nt, Homo sapiens
cauggcacugagcagguaugca

SEQ ID NO: 260108 - RNA, 19 nt, Homo sapiens
cauggcuuauaauuuuaau

SEQ ID NO: 260109 - RNA, 22 nt, Homo sapiens
cauggcuuuuauaacaagaaau

SEQ ID NO: 260110 - RNA, 22 nt, Homo sapiens
caugucacuuccucucugaugg

SEQ ID NO: 260111 - RNA, 22 nt, Homo sapiens
caugugcaugagcacauacgug

SEQ ID NO: 260112 - RNA, 22 nt, Homo sapiens
cauuaagcuacuuagaaggugc

SEQ ID NO: 260113 - RNA, 22 nt, Homo sapiens
cauugcaauccagccugggcaa

SEQ ID NO: 260114 - RNA, 22 nt, Homo sapiens
cauuuugcaguuucugucucca

SEQ ID NO: 260115 - RNA, 22 nt, Homo sapiens
ccacaaccuccauauccugggu

SEQ ID NO: 260116 - RNA, 22 nt, Homo sapiens
ccacccuggagaauuugagguc

SEQ ID NO: 260117 - RNA, 22 nt, Homo sapiens
ccacugcacuccagcccggcaa

SEQ ID NO: 260118 - RNA, 22 nt, Homo sapiens
ccagaguuucugauucagcagg

SEQ ID NO: 260119 - RNA, 23 nt, Homo sapiens
ccaguauuuauguaaggaagugu

SEQ ID NO: 260120 - RNA, 22 nt, Homo sapiens
ccaguguucuggaaggcugagu

SEQ ID NO: 260121 - RNA, 22 nt, Homo sapiens
ccaguucaaugauauggaaacu

SEQ ID NO: 260122 - RNA, 17 nt, Homo sapiens
ccaguuuucccucagug

SEQ ID NO: 260123 - RNA, 22 nt, Homo sapiens
ccaguuuuucauuuauacuagu

SEQ ID NO: 260124 - RNA, 22 nt, Homo sapiens
ccauugaacaugaaggaaugug

SEQ ID NO: 260125 - RNA, 20 nt, Homo sapiens
ccccaguuuuucuauuagcu

SEQ ID NO: 260126 - RNA, 22 nt, Homo sapiens
ccccugaaacucacucauuauc

SEQ ID NO: 260127 - RNA, 17 nt, Homo sapiens
ccccugagcgaugcagu

SEQ ID NO: 260128 - RNA, 22 nt, Homo sapiens
cccugagaaaacuuuguccuua

SEQ ID NO: 260129 - RNA, 22 nt, Homo sapiens
cccugagaugcuguuaaucugu

SEQ ID NO: 260130 - RNA, 22 nt, Homo sapiens
cccuguagcagcauucuuaaau

SEQ ID NO: 260131 - RNA, 22 nt, Homo sapiens
ccucccuuuguugcaagggaaa

SEQ ID NO: 260132 - RNA, 21 nt, Homo sapiens
ccugaugaccucugagaguua

SEQ ID NO: 260133 - RNA, 22 nt, Homo sapiens
ccuggaucauugucauucccaa

SEQ ID NO: 260134 - RNA, 22 nt, Homo sapiens
ccuggcacugagcaguguucua

SEQ ID NO: 260135 - RNA, 22 nt, Homo sapiens
ccuguagcauccaagaagcugc

SEQ ID NO: 260136 - RNA, 22 nt, Homo sapiens
ccugucuugaagagauccuccu

SEQ ID NO: 260137 - RNA, 22 nt, Homo sapiens
ccuucuuuuguaaggcugaaua

SEQ ID NO: 260138 - RNA, 22 nt, Homo sapiens
cgaggaguaucuuugugguguu

SEQ ID NO: 260139 - RNA, 22 nt, Homo sapiens
cuaaagauagugacaugauuug

SEQ ID NO: 260140 - RNA, 22 nt, Homo sapiens
cuaaaguauugagugguaaaga

SEQ ID NO: 260141 - RNA, 22 nt, Homo sapiens
cuaaagugcugagauuauaggu

SEQ ID NO: 260142 - RNA, 22 nt, Homo sapiens
cuaagugaacugucacugagaa

SEQ ID NO: 260143 - RNA, 22 nt, Homo sapiens
cuaauacaguuguccaagcugg

SEQ ID NO: 260144 - RNA, 22 nt, Homo sapiens
cuaauucuguaccuggcacaua

SEQ ID NO: 260145 - RNA, 22 nt, Homo sapiens
cuacagguaugaaagggaguau

SEQ ID NO: 260146 - RNA, 22 nt, Homo sapiens
cuacagugggucuguaguccuu

SEQ ID NO: 260147 - RNA, 22 nt, Homo sapiens
cuagcacauaguuauucacuca

SEQ ID NO: 260148 - RNA, 22 nt, Homo sapiens
cuagcagacaggcugggagcag

SEQ ID NO: 260149 - RNA, 22 nt, Homo sapiens
cuagcagacaugggcugaacca

SEQ ID NO: 260150 - RNA, 22 nt, Homo sapiens
cuagcagcaugagaauggacca

SEQ ID NO: 260151 - RNA, 22 nt, Homo sapiens
cuaggaaguauguguuauugcu

SEQ ID NO: 260152 - RNA, 22 nt, Homo sapiens
cuaggcacugauaguuguauuu

SEQ ID NO: 260153 - RNA, 22 nt, Homo sapiens
cuaggcuguagagaaguucagu

SEQ ID NO: 260154 - RNA, 22 nt, Homo sapiens
cuagucacaggaguugaaggau

SEQ ID NO: 260155 - RNA, 22 nt, Homo sapiens
cucacaaccuuaugaagcauga

SEQ ID NO: 260156 - RNA, 22 nt, Homo sapiens
cucacugucaacauguauuugg

SEQ ID NO: 260157 - RNA, 22 nt, Homo sapiens
cucacugugguguccuuaggua

SEQ ID NO: 260158 - RNA, 22 nt, Homo sapiens
cucagugaagggcaagaggcaa

SEQ ID NO: 260159 - RNA, 20 nt, Homo sapiens
cucagugcacccccauaaaa

SEQ ID NO: 260160 - RNA, 22 nt, Homo sapiens
cucauggaauacuucacagcca

SEQ ID NO: 260161 - RNA, 22 nt, Homo sapiens
cucauggagauagagaauagaa

SEQ ID NO: 260162 - RNA, 22 nt, Homo sapiens
cucauggauggucuggcagcca

SEQ ID NO: 260163 - RNA, 23 nt, Homo sapiens
cuccaugagccguccagggccug

SEQ ID NO: 260164 - RNA, 22 nt, Homo sapiens
cuccauuuaguccuuuuagaag

SEQ ID NO: 260165 - RNA, 22 nt, Homo sapiens
cucccagugacccaggaacagg

SEQ ID NO: 260166 - RNA, 22 nt, Homo sapiens
cucccugagccagggcuuugac

SEQ ID NO: 260167 - RNA, 22 nt, Homo sapiens
cuccgggugcgucggcgcccug

SEQ ID NO: 260168 - RNA, 22 nt, Homo sapiens
cucucaagaugcugggauuaca

SEQ ID NO: 260169 - RNA, 22 nt, Homo sapiens
cucucugagccccagacaccuu

SEQ ID NO: 260170 - RNA, 22 nt, Homo sapiens
cucugagguuauucguaauauu

SEQ ID NO: 260171 - RNA, 22 nt, Homo sapiens
cucuuugaugugaaccgugguu

SEQ ID NO: 260172 - RNA, 22 nt, Homo sapiens
cucuuugcuucuggcaucauug

SEQ ID NO: 260173 - RNA, 22 nt, Homo sapiens
cucuuuuguuuagcugagaggg

SEQ ID NO: 260174 - RNA, 22 nt, Homo sapiens
cugaaagguauacgcuuguuau

SEQ ID NO: 260175 - RNA, 22 nt, Homo sapiens
cugaaaguuauucaggggcaag

SEQ ID NO: 260176 - RNA, 22 nt, Homo sapiens
cugaagugcuugccacauaaaa

SEQ ID NO: 260177 - RNA, 22 nt, Homo sapiens
cugaauguccaggcagagguuu

SEQ ID NO: 260178 - RNA, 22 nt, Homo sapiens
augccagggagaauuguucaag

SEQ ID NO: 260179 - RNA, 19 nt, Homo sapiens
augccuggagaugguuaua

SEQ ID NO: 260180 - RNA, 22 nt, Homo sapiens
augcuacauucuacaauuaggc

SEQ ID NO: 260181 - RNA, 19 nt, Homo sapiens
augcugguguugcucaaac

SEQ ID NO: 260182 - RNA, 22 nt, Homo sapiens
auggaagaaaguuggguucuug

SEQ ID NO: 260183 - RNA, 22 nt, Homo sapiens
auggaagacuccucuuugggua

SEQ ID NO: 260184 - RNA, 22 nt, Homo sapiens
auggagagaauuauucucucag

SEQ ID NO: 260185 - RNA, 22 nt, Homo sapiens
auggagcaaaacagauuuggga

SEQ ID NO: 260186 - RNA, 22 nt, Homo sapiens
auggauuuuaggauacaguuga

SEQ ID NO: 260187 - RNA, 22 nt, Homo sapiens
auggauuuugaacuugagaguu

SEQ ID NO: 260188 - RNA, 22 nt, Homo sapiens
auggcacuacugggaaugucuu

SEQ ID NO: 260189 - RNA, 22 nt, Homo sapiens
auggcacucaaucaaguugaga

SEQ ID NO: 260190 - RNA, 22 nt, Homo sapiens
auggcacugaagcguauugaca

SEQ ID NO: 260191 - RNA, 22 nt, Homo sapiens
auggcacugccuggcuucaugg

SEQ ID NO: 260192 - RNA, 22 nt, Homo sapiens
auggcagaaucaagccgacagc

SEQ ID NO: 260193 - RNA, 22 nt, Homo sapiens
auggcaguuuggucucugugcu

SEQ ID NO: 260194 - RNA, 22 nt, Homo sapiens
auggcccugggaaaggaggcau

SEQ ID NO: 260195 - RNA, 22 nt, Homo sapiens
auggcuucuuacucuucugcau

SEQ ID NO: 260196 - RNA, 22 nt, Homo sapiens
auggcuugugacccaugcuuca

SEQ ID NO: 260197 - RNA, 22 nt, Homo sapiens
auggcuuuaagagugucugaau

SEQ ID NO: 260198 - RNA, 22 nt, Homo sapiens
auggcuuucaggacguggcgag

SEQ ID NO: 260199 - RNA, 22 nt, Homo sapiens
auggcuuuguguucagagcuga

SEQ ID NO: 260200 - RNA, 22 nt, Homo sapiens
auggcuuuuauuguguugaggu

SEQ ID NO: 260201 - RNA, 22 nt, Homo sapiens
auggcuuuuuaaaucauguugu

SEQ ID NO: 260202 - RNA, 22 nt, Homo sapiens
augguuuuacugcaaaauggga

SEQ ID NO: 260203 - RNA, 22 nt, Homo sapiens
auguaaacagaugugcagcuug

SEQ ID NO: 260204 - RNA, 22 nt, Homo sapiens
auguagauaucaagaggcauau

SEQ ID NO: 260205 - RNA, 22 nt, Homo sapiens
auguaguauuaaugagagauaa

SEQ ID NO: 260206 - RNA, 22 nt, Homo sapiens
auguaguugcucugccuguuuu

SEQ ID NO: 260207 - RNA, 22 nt, Homo sapiens
augugacugauggagaauaugu

SEQ ID NO: 260208 - RNA, 22 nt, Homo sapiens
augugcaugcuguucugccaga

SEQ ID NO: 260209 - RNA, 22 nt, Homo sapiens
auguggaaauguauaugugucu

SEQ ID NO: 260210 - RNA, 22 nt, Homo sapiens
auuaaauguuggacguauacau

SEQ ID NO: 260211 - RNA, 22 nt, Homo sapiens
auuaucacaguuuugcauaugg

SEQ ID NO: 260212 - RNA, 22 nt, Homo sapiens
auuauuaguuguugaaugaagu

SEQ ID NO: 260213 - RNA, 22 nt, Homo sapiens
auucaccauggcuaccaagggu

SEQ ID NO: 260214 - RNA, 22 nt, Homo sapiens
auugaacaugccauauguacca

SEQ ID NO: 260215 - RNA, 22 nt, Homo sapiens
auugagcaauuccuaugugcuu

SEQ ID NO: 260216 - RNA, 22 nt, Homo sapiens
auugcagaaaugacagagcgcc

SEQ ID NO: 260217 - RNA, 22 nt, Homo sapiens
auugcccaggcuggagugcagu

SEQ ID NO: 260218 - RNA, 22 nt, Homo sapiens
auugcucagucagggagcucgg

SEQ ID NO: 260219 - RNA, 22 nt, Homo sapiens
auugcugagacauugcuaaucu

SEQ ID NO: 260220 - RNA, 22 nt, Homo sapiens
auuggacagcauuucuagacuu

SEQ ID NO: 260221 - RNA, 22 nt, Homo sapiens
auuggcaauggcaaagcagagu

SEQ ID NO: 260222 - RNA, 22 nt, Homo sapiens
auuggggaaugguggcuuuagu

SEQ ID NO: 260223 - RNA, 22 nt, Homo sapiens
auuguaauuuuagagaaagugg

SEQ ID NO: 260224 - RNA, 22 nt, Homo sapiens
auuguacucuagccucugggca

SEQ ID NO: 260225 - RNA, 22 nt, Homo sapiens
auugucacuuaaaagugcaugu

SEQ ID NO: 260226 - RNA, 22 nt, Homo sapiens
auugucauuuucugagaaguaa

SEQ ID NO: 260227 - RNA, 22 nt, Homo sapiens
auuuagcaauggagguagugua

SEQ ID NO: 260228 - RNA, 22 nt, Homo sapiens
auuuggcauagaguaucauucu

SEQ ID NO: 260229 - RNA, 21 nt, Homo sapiens
auuugguggcugugugacacu

SEQ ID NO: 260230 - RNA, 22 nt, Homo sapiens
auuuugguuacauaguugagcu

SEQ ID NO: 260231 - RNA, 18 nt, Homo sapiens
auuuuugcaguccacaug

SEQ ID NO: 260232 - RNA, 22 nt, Homo sapiens
auuuuugguugguaggcuauua

SEQ ID NO: 260233 - RNA, 22 nt, Homo sapiens
caaagcuauagcaccagaggga

SEQ ID NO: 260234 - RNA, 21 nt, Homo sapiens
caauggcacaaucucugcuca

SEQ ID NO: 260235 - RNA, 22 nt, Homo sapiens
cacacuguuuuccauggggguu

SEQ ID NO: 260236 - RNA, 22 nt, Homo sapiens
cacagagugagacccugucucu

SEQ ID NO: 260237 - RNA, 22 nt, Homo sapiens
cacaggccugucucuuucuaac

SEQ ID NO: 260238 - RNA, 22 nt, Homo sapiens
cacagggcuaacauuuuugccc

SEQ ID NO: 260239 - RNA, 22 nt, Homo sapiens
caccacagccauuauugucccc

SEQ ID NO: 260240 - RNA, 22 nt, Homo sapiens
caccagguggcugaggccauga

SEQ ID NO: 260241 - RNA, 22 nt, Homo sapiens
caccgagguuggagugcagugg

SEQ ID NO: 260242 - RNA, 19 nt, Homo sapiens
caccgccugcccccugcug

SEQ ID NO: 260243 - RNA, 18 nt, Homo sapiens
cacugagcccuucacucu

SEQ ID NO: 260244 - RNA, 22 nt, Homo sapiens
cacugcaguaaauugcgucggu

SEQ ID NO: 260245 - RNA, 22 nt, Homo sapiens
cacugcaguggaagauuaagaa

SEQ ID NO: 260246 - RNA, 22 nt, Homo sapiens
cacugcauggccacccauguua

SEQ ID NO: 260247 - RNA, 22 nt, Homo sapiens
cacugcauucuccaccucccag

SEQ ID NO: 260248 - RNA, 22 nt, Homo sapiens
cacuggcacuguguuuagaugg

SEQ ID NO: 260249 - RNA, 21 nt, Homo sapiens
cacugguguugcuauaucaaa

SEQ ID NO: 260250 - RNA, 20 nt, Homo sapiens
acagcacugguuucaagcaa

SEQ ID NO: 260251 - RNA, 21 nt, Homo sapiens
acaguacuugagaucuuuuga

SEQ ID NO: 260252 - RNA, 22 nt, Homo sapiens
acagugcuuucaauguucagua

SEQ ID NO: 260253 - RNA, 22 nt, Homo sapiens
acauacacuagggauguggugu

SEQ ID NO: 260254 - RNA, 22 nt, Homo sapiens
acauccauuugcuuuauuugcu

SEQ ID NO: 260255 - RNA, 22 nt, Homo sapiens
acaucuguacaguggguguggu

SEQ ID NO: 260256 - RNA, 22 nt, Homo sapiens
acaugacauugggguggggaua

SEQ ID NO: 260257 - RNA, 22 nt, Homo sapiens
acauguagacaacggacaaagu

SEQ ID NO: 260258 - RNA, 22 nt, Homo sapiens
accacaggguaaaguuagauau

SEQ ID NO: 260259 - RNA, 22 nt, Homo sapiens
acccagaguuccuugucuuuca

SEQ ID NO: 260260 - RNA, 17 nt, Homo sapiens
acccagucuuuuugcac

SEQ ID NO: 260261 - RNA, 22 nt, Homo sapiens
acccucagaccaguuucccugg

SEQ ID NO: 260262 - RNA, 22 nt, Homo sapiens
accgggcugagcgcaggccccg

SEQ ID NO: 260263 - RNA, 23 nt, Homo sapiens
accugauguuucuguggggagcc

SEQ ID NO: 260264 - RNA, 22 nt, Homo sapiens
accuggacacuuugggcuccuc

SEQ ID NO: 260265 - RNA, 19 nt, Homo sapiens
accuguagaaaguacaaca

SEQ ID NO: 260266 - RNA, 22 nt, Homo sapiens
accuguagcagacuuaauauuu

SEQ ID NO: 260267 - RNA, 23 nt, Homo sapiens
accugugguuauuuuacucuucc

SEQ ID NO: 260268 - RNA, 22 nt, Homo sapiens
accuucauuguugccaugucca

SEQ ID NO: 260269 - RNA, 22 nt, Homo sapiens
accuugcacugagccgagauug

SEQ ID NO: 260270 - RNA, 22 nt, Homo sapiens
acuauacugaagcaaauuaaca

SEQ ID NO: 260271 - RNA, 22 nt, Homo sapiens
acugagccuuuaaaugacuuca

SEQ ID NO: 260272 - RNA, 22 nt, Homo sapiens
acugcacuccagccuggacgaa

SEQ ID NO: 260273 - RNA, 22 nt, Homo sapiens
acugcacuccagccugugagac

SEQ ID NO: 260274 - RNA, 20 nt, Homo sapiens
acugcacuccaggcugccca

SEQ ID NO: 260275 - RNA, 22 nt, Homo sapiens
acugcacuguccuagaguccuc

SEQ ID NO: 260276 - RNA, 22 nt, Homo sapiens
acuggcaauggcagaaauaguu

SEQ ID NO: 260277 - RNA, 22 nt, Homo sapiens
acugggauauuauugguaauau

SEQ ID NO: 260278 - RNA, 22 nt, Homo sapiens
acuguauagauggaguugauuu

SEQ ID NO: 260279 - RNA, 22 nt, Homo sapiens
acuguguguuugucuagcacag

SEQ ID NO: 260280 - RNA, 20 nt, Homo sapiens
acuuuuugaugaggucguuu

SEQ ID NO: 260281 - RNA, 22 nt, Homo sapiens
agacacugaaauguauugaaga

SEQ ID NO: 260282 - RNA, 20 nt, Homo sapiens
agacagcugcagcccacauc

SEQ ID NO: 260283 - RNA, 22 nt, Homo sapiens
agacaguguguguauauauggu

SEQ ID NO: 260284 - RNA, 19 nt, Homo sapiens
agacuggcccaggcgggug

SEQ ID NO: 260285 - RNA, 22 nt, Homo sapiens
agagaacugauucagggaaaau

SEQ ID NO: 260286 - RNA, 22 nt, Homo sapiens
agagagcuugggguguuaaauu

SEQ ID NO: 260287 - RNA, 22 nt, Homo sapiens
agagguuuugcccucgagauaa

SEQ ID NO: 260288 - RNA, 22 nt, Homo sapiens
agaguaguuuauuaugcuaagg

SEQ ID NO: 260289 - RNA, 22 nt, Homo sapiens
agaguauagcaacuuaguaaaa

SEQ ID NO: 260290 - RNA, 22 nt, Homo sapiens
agagugcaaagguuggggcugg

SEQ ID NO: 260291 - RNA, 22 nt, Homo sapiens
agagugcuauagauuagauuuc

SEQ ID NO: 260292 - RNA, 20 nt, Homo sapiens
agagugcugucuguccugag

SEQ ID NO: 260293 - RNA, 22 nt, Homo sapiens
agauauuuguuaggucugucag

SEQ ID NO: 260294 - RNA, 22 nt, Homo sapiens
agaucauaugcaguaaugaacu

SEQ ID NO: 260295 - RNA, 22 nt, Homo sapiens
agaugcuguuaucaacuguagc

SEQ ID NO: 260296 - RNA, 22 nt, Homo sapiens
agauggguuuucacauguuggc

SEQ ID NO: 260297 - RNA, 22 nt, Homo sapiens
agcaagaaugaacucucccaga

SEQ ID NO: 260298 - RNA, 22 nt, Homo sapiens
agcaagacauggcuuccaaaug

SEQ ID NO: 260299 - RNA, 22 nt, Homo sapiens
agcacacuggguggcuuaaaca

SEQ ID NO: 260300 - RNA, 22 nt, Homo sapiens
agcacaguuaaaugaggcuucu

SEQ ID NO: 260301 - RNA, 23 nt, Homo sapiens
agcaccaccccaggucacaagug

SEQ ID NO: 260302 - RNA, 22 nt, Homo sapiens
agcagauguuuagugagcgccu

SEQ ID NO: 260303 - RNA, 22 nt, Homo sapiens
agcagcauauuuuuauaaugua

SEQ ID NO: 260304 - RNA, 22 nt, Homo sapiens
agcaggauuguuacaauaguaa

SEQ ID NO: 260305 - RNA, 22 nt, Homo sapiens
agcaguagugaaaguagacuua

SEQ ID NO: 260306 - RNA, 22 nt, Homo sapiens
agcaucacacacuacagggaaa

SEQ ID NO: 260307 - RNA, 22 nt, Homo sapiens
agccaguauuuuauugaggauu

SEQ ID NO: 260308 - RNA, 22 nt, Homo sapiens
agcccauguggcugaggcuucu

SEQ ID NO: 260309 - RNA, 22 nt, Homo sapiens
agccccauuuguugaaaagacg

SEQ ID NO: 260310 - RNA, 22 nt, Homo sapiens
agcccuuagauggcuccuucca

SEQ ID NO: 260311 - RNA, 22 nt, Homo sapiens
agcucuuguuaguauuagcagu

SEQ ID NO: 260312 - RNA, 22 nt, Homo sapiens
agcugcaauguuuaguauaaua

SEQ ID NO: 260313 - RNA, 22 nt, Homo sapiens
agcuggcuguagcugcaagucu

SEQ ID NO: 260314 - RNA, 20 nt, Homo sapiens
agcuggguguguuggugcau

SEQ ID NO: 260315 - RNA, 22 nt, Homo sapiens
agcuggucucaggugcccugcu

SEQ ID NO: 260316 - RNA, 22 nt, Homo sapiens
agcuguaguuugguggauguaa

SEQ ID NO: 260317 - RNA, 19 nt, Homo sapiens
agcuguguugccugugaga

SEQ ID NO: 260318 - RNA, 20 nt, Homo sapiens
agcuguuguuaugagguuua

SEQ ID NO: 260319 - RNA, 22 nt, Homo sapiens
augaacacuccaauuguacucc

SEQ ID NO: 260320 - RNA, 22 nt, Homo sapiens
augaaguauuaggacacauuua

SEQ ID NO: 260321 - RNA, 22 nt, Homo sapiens
augaagugcaugauaguugguu

SEQ ID NO: 260322 - RNA, 19 nt, Homo sapiens
augaccauuuccauaguau

SEQ ID NO: 260323 - RNA, 22 nt, Homo sapiens
augaccuuguccucagugucau

SEQ ID NO: 260324 - RNA, 18 nt, Homo sapiens
augacucuggguguuccu

SEQ ID NO: 260325 - RNA, 22 nt, Homo sapiens
augagaacugucaaugagagcu

SEQ ID NO: 260326 - RNA, 22 nt, Homo sapiens
augagauauuuuauaagaucau

SEQ ID NO: 260327 - RNA, 22 nt, Homo sapiens
augagcaaagagaugagacccu

SEQ ID NO: 260328 - RNA, 22 nt, Homo sapiens
augagcaucaccagaaucaaua

SEQ ID NO: 260329 - RNA, 22 nt, Homo sapiens
augagcugauuuccuuaccaua

SEQ ID NO: 260330 - RNA, 22 nt, Homo sapiens
augaggcuauaauuuuuaugua

SEQ ID NO: 260331 - RNA, 22 nt, Homo sapiens
augagggaagcucacgugucca

SEQ ID NO: 260332 - RNA, 22 nt, Homo sapiens
augagguauccaagcccagaaa

SEQ ID NO: 260333 - RNA, 22 nt, Homo sapiens
augaggugaggucaguaaggua

SEQ ID NO: 260334 - RNA, 22 nt, Homo sapiens
augaggugggcggcuuggaaga

SEQ ID NO: 260335 - RNA, 22 nt, Homo sapiens
augcaacugcacuccagccugg

SEQ ID NO: 260336 - RNA, 22 nt, Homo sapiens
augcaauucuagauugauagua

SEQ ID NO: 260337 - RNA, 22 nt, Homo sapiens
augcacuuggcaggaugauucc

SEQ ID NO: 260338 - RNA, 22 nt, Homo sapiens
augcagacacaaguuauaguaa

SEQ ID NO: 260339 - RNA, 22 nt, Homo sapiens
aaaugcacaaagauuuugcacu

SEQ ID NO: 260340 - RNA, 20 nt, Homo sapiens
aacagcacugucugaagcuu

SEQ ID NO: 260341 - RNA, 22 nt, Homo sapiens
aacagucuccaguuguauccau

SEQ ID NO: 260342 - RNA, 22 nt, Homo sapiens
aacaucaaccaugaggguugga

SEQ ID NO: 260343 - RNA, 22 nt, Homo sapiens
aacuaggccuagaaguugagua

SEQ ID NO: 260344 - RNA, 22 nt, Homo sapiens
aacuggcauagccagacuucuc

SEQ ID NO: 260345 - RNA, 22 nt, Homo sapiens
aacuggcauaugaacuuguucu

SEQ ID NO: 260346 - RNA, 22 nt, Homo sapiens
aacuggccuggcgugcagaggg

SEQ ID NO: 260347 - RNA, 19 nt, Homo sapiens
aacuggugugagaugauau

SEQ ID NO: 260348 - RNA, 22 nt, Homo sapiens
aagagugcucgugggacucagc

SEQ ID NO: 260349 - RNA, 22 nt, Homo sapiens
aagaugcagaagcccagauguu

SEQ ID NO: 260350 - RNA, 22 nt, Homo sapiens
aagaugcagucauacuggagga

SEQ ID NO: 260351 - RNA, 22 nt, Homo sapiens
aagaugcagucauacuggagua

SEQ ID NO: 260352 - RNA, 20 nt, Homo sapiens
aagcagacauuuggaugaaa

SEQ ID NO: 260353 - RNA, 22 nt, Homo sapiens
aagccacuguaccugucucuua

SEQ ID NO: 260354 - RNA, 22 nt, Homo sapiens
aagcuagugagacagugguacu

SEQ ID NO: 260355 - RNA, 22 nt, Homo sapiens
aagcugccuugcugaggagaaa

SEQ ID NO: 260356 - RNA, 22 nt, Homo sapiens
aagcuggauuuaguguggagca

SEQ ID NO: 260357 - RNA, 22 nt, Homo sapiens
aagcuggauuucgcauccuguu

SEQ ID NO: 260358 - RNA, 22 nt, Homo sapiens
aagcuggcauucauucguucuu

SEQ ID NO: 260359 - RNA, 22 nt, Homo sapiens
aagcuguugguggaucuaccau

SEQ ID NO: 260360 - RNA, 22 nt, Homo sapiens
aaggcaagaagagaaccaucgg

SEQ ID NO: 260361 - RNA, 22 nt, Homo sapiens
aaggcaagaaugcgugcuuuca

SEQ ID NO: 260362 - RNA, 20 nt, Homo sapiens
aaggcuuucgaguuccaggg

SEQ ID NO: 260363 - RNA, 22 nt, Homo sapiens
aagggaaugcgcugccuguguu

SEQ ID NO: 260364 - RNA, 22 nt, Homo sapiens
aagggaauguuguggcugguuu

SEQ ID NO: 260365 - RNA, 22 nt, Homo sapiens
aagguacuggaaagaggaaugg

SEQ ID NO: 260366 - RNA, 22 nt, Homo sapiens
aaguaauggaguuauuuuauga

SEQ ID NO: 260367 - RNA, 22 nt, Homo sapiens
aaguaauugagguuuuugcugu

SEQ ID NO: 260368 - RNA, 22 nt, Homo sapiens
aaguacuguuuaaauugcagaa

SEQ ID NO: 260369 - RNA, 22 nt, Homo sapiens
aaguagcagaggcaagacuuga

SEQ ID NO: 260370 - RNA, 22 nt, Homo sapiens
aaguauuaugaguccuuguuuu

SEQ ID NO: 260371 - RNA, 19 nt, Homo sapiens
aagugaaugcuuuguucac

SEQ ID NO: 260372 - RNA, 22 nt, Homo sapiens
aagugcaaaucuguggcugaaa

SEQ ID NO: 260373 - RNA, 22 nt, Homo sapiens
aagugcuuuuuagauaugguuu

SEQ ID NO: 260374 - RNA, 22 nt, Homo sapiens
aagugguguuugggagcuggac

SEQ ID NO: 260375 - RNA, 22 nt, Homo sapiens
aauaaaguaggaggugaggaaa

SEQ ID NO: 260376 - RNA, 22 nt, Homo sapiens
aauacucaguccuggugaggcu

SEQ ID NO: 260377 - RNA, 22 nt, Homo sapiens
aauacugaaaguauuuucaaau

SEQ ID NO: 260378 - RNA, 22 nt, Homo sapiens
aauacuuccaaaucuagucauu

SEQ ID NO: 260379 - RNA, 22 nt, Homo sapiens
aauauguccaguguuuugggag

SEQ ID NO: 260380 - RNA, 22 nt, Homo sapiens
aauauguccuugaaauggugcu

SEQ ID NO: 260381 - RNA, 22 nt, Homo sapiens
aauaugucugcuaauuguuucu

SEQ ID NO: 260382 - RNA, 22 nt, Homo sapiens
aauaugucuugaaauuggguaa

SEQ ID NO: 260383 - RNA, 19 nt, Homo sapiens
aauauugacaguggugucu

SEQ ID NO: 260384 - RNA, 22 nt, Homo sapiens
aaucaacauuguuuuaagucaa

SEQ ID NO: 260385 - RNA, 22 nt, Homo sapiens
aaucacaggucuuggcugcaug

SEQ ID NO: 260386 - RNA, 22 nt, Homo sapiens
aaucacaguguucuugugaggg

SEQ ID NO: 260387 - RNA, 22 nt, Homo sapiens
aaucauggaguauuuguccuug

SEQ ID NO: 260388 - RNA, 22 nt, Homo sapiens
aaucccugagcuagacacaaag

SEQ ID NO: 260389 - RNA, 22 nt, Homo sapiens
aaucccuggacuuucggaggcu

SEQ ID NO: 260390 - RNA, 22 nt, Homo sapiens
aaucccuuuguccagucucuuu

SEQ ID NO: 260391 - RNA, 22 nt, Homo sapiens
aaucgcuuuugguaggcaagga

SEQ ID NO: 260392 - RNA, 22 nt, Homo sapiens
aaugacagugcuaaagaacccu

SEQ ID NO: 260393 - RNA, 22 nt, Homo sapiens
aaugacugugauauuuuucuuc

SEQ ID NO: 260394 - RNA, 22 nt, Homo sapiens
aaugcacuccagccugggcgac

SEQ ID NO: 260395 - RNA, 22 nt, Homo sapiens
aaugccacugugccugccaagg

SEQ ID NO: 260396 - RNA, 22 nt, Homo sapiens
aauggcaucuagaguggugaau

SEQ ID NO: 260397 - RNA, 22 nt, Homo sapiens
aauugcaccaucuagaucaaga

SEQ ID NO: 260398 - RNA, 22 nt, Homo sapiens
aauugcauaugcaguagaucua

SEQ ID NO: 260399 - RNA, 22 nt, Homo sapiens
aauuggcagugcucuugccaca

SEQ ID NO: 260400 - RNA, 22 nt, Homo sapiens
aauuugucaccucucucccuuu

SEQ ID NO: 260401 - RNA, 22 nt, Homo sapiens
acaaaguauggaauguuggugu

SEQ ID NO: 260402 - RNA, 22 nt, Homo sapiens
acacuauugagguuuguuugca

SEQ ID NO: 260403 - RNA, 22 nt, Homo sapiens
acacuguuggugggaguguaaa

SEQ ID NO: 260404 - RNA, 23 nt, Homo sapiens
acacuugcugaguaaaucaaaua

SEQ ID NO: 260405 - RNA, 22 nt, Homo sapiens
acagauugcugggccccagccc

SEQ ID NO: 260406 - RNA, 22 nt, Homo sapiens
acagcacugccaagugacccau

SEQ ID NO: 260407 - RNA, 22 nt, Homo sapiens
acagcagugccccacucuacug

SEQ ID NO: 260408 - RNA, 20 nt, Homo sapiens
acagcauagccuuuuaaagc

SEQ ID NO: 260409 - RNA, 22 nt, Homo sapiens
acagucacaauuuguaccuuuu

SEQ ID NO: 260410 - RNA, 22 nt, Homo sapiens
acagucuggagaaugggugcuc

SEQ ID NO: 260411 - RNA, 22 nt, Homo sapiens
acagugcuguuguguuuucacg

SEQ ID NO: 260412 - RNA, 18 nt, Homo sapiens
acagugucuuacaccugu

SEQ ID NO: 260413 - RNA, 22 nt, Homo sapiens
acaguguuacuugauaguguau

SEQ ID NO: 260414 - RNA, 22 nt, Homo sapiens
acaguguuccuuuguugugacu

SEQ ID NO: 260415 - RNA, 22 nt, Homo sapiens
acaucauugggggcuacaggug

SEQ ID NO: 260416 - RNA, 22 nt, Homo sapiens
acaugccucccugguccgcugu

SEQ ID NO: 260417 - RNA, 21 nt, Homo sapiens
acauguacacauguaugcaca

SEQ ID NO: 260418 - RNA, 22 nt, Homo sapiens
acauugcagauguguuuaaugu

SEQ ID NO: 260419 - RNA, 22 nt, Homo sapiens
acccagaauucagucuuaggcc

SEQ ID NO: 260420 - RNA, 22 nt, Homo sapiens
acccaguagccagauguagcug

SEQ ID NO: 260421 - RNA, 22 nt, Homo sapiens
acccaguagucauucaggagca

SEQ ID NO: 260422 - RNA, 22 nt, Homo sapiens
acccaguguucaacauucacau

SEQ ID NO: 260423 - RNA, 22 nt, Homo sapiens
acccaguguugggcagaacugu

SEQ ID NO: 260424 - RNA, 21 nt, Homo sapiens
acccccacaccuccuuaguuc

SEQ ID NO: 260425 - RNA, 22 nt, Homo sapiens
accccugagaucgaaucaugcu

SEQ ID NO: 260426 - RNA, 22 nt, Homo sapiens
acccgcccagguguggccggga

SEQ ID NO: 260427 - RNA, 22 nt, Homo sapiens
acccugaagccaugaguggaac

SEQ ID NO: 260428 - RNA, 22 nt, Homo sapiens
acccugcuaaacagcccccugc

SEQ ID NO: 260429 - RNA, 22 nt, Homo sapiens
acccuggagagugcuguaguaa

SEQ ID NO: 260430 - RNA, 22 nt, Homo sapiens
acccugucagcuggccugggca

SEQ ID NO: 260431 - RNA, 22 nt, Homo sapiens
cuugaacaaagagauuccauua

SEQ ID NO: 260432 - RNA, 22 nt, Homo sapiens
cuugagcuugagauccuuucug

SEQ ID NO: 260433 - RNA, 22 nt, Homo sapiens
cuuggacaccucaugcccaccu

SEQ ID NO: 260434 - RNA, 22 nt, Homo sapiens
cuuggcacucuguggaguuagg

SEQ ID NO: 260435 - RNA, 22 nt, Homo sapiens
cuuggcauugccccuggaauuu

SEQ ID NO: 260436 - RNA, 22 nt, Homo sapiens
cuuggcuucuuuauguggcuau

SEQ ID NO: 260437 - RNA, 22 nt, Homo sapiens
cuugggccccacccaaaucuua

SEQ ID NO: 260438 - RNA, 18 nt, Homo sapiens
cuugucaaaucuuuccuc

SEQ ID NO: 260439 - RNA, 22 nt, Homo sapiens
cuugucacuguuggcuuuagaa

SEQ ID NO: 260440 - RNA, 22 nt, Homo sapiens
cuuguggugcuuuuacgugggc

SEQ ID NO: 260441 - RNA, 22 nt, Homo sapiens
cuuguguuacauauuuaagaga

SEQ ID NO: 260442 - RNA, 21 nt, Homo sapiens
cuuuaugcuguguuagaaaag

SEQ ID NO: 260443 - RNA, 22 nt, Homo sapiens
cuuucucagugagacccgagau

SEQ ID NO: 260444 - RNA, 22 nt, Homo sapiens
cuuuggugauagauaccccaua

SEQ ID NO: 260445 - RNA, 21 nt, Homo sapiens
cuuugguuucugacuugcaua

SEQ ID NO: 260446 - RNA, 22 nt, Homo sapiens
cuuuguguaggugccucuggcu

SEQ ID NO: 260447 - RNA, 22 nt, Homo sapiens
cuuugugugggccaagggcugg

SEQ ID NO: 260448 - RNA, 22 nt, Homo sapiens
cuuuuggugguucugaugcagg

SEQ ID NO: 260449 - RNA, 22 nt, Homo sapiens
cuuuuugcaaauacaacucuga

SEQ ID NO: 260450 - RNA, 22 nt, Homo sapiens
gaaaauccauccccagggagua

SEQ ID NO: 260451 - RNA, 22 nt, Homo sapiens
gaaagugcugcaaggccaugca

SEQ ID NO: 260452 - RNA, 22 nt, Homo sapiens
gaaagugcugcuugacugggau

SEQ ID NO: 260453 - RNA, 22 nt, Homo sapiens
gaaauguuuuucaugugggcaa

SEQ ID NO: 260454 - RNA, 22 nt, Homo sapiens
gaacuguaaagaaauucuaagg

SEQ ID NO: 260455 - RNA, 22 nt, Homo sapiens
gaacuguuucuggugaaagagu

SEQ ID NO: 260456 - RNA, 22 nt, Homo sapiens
gaaggcacugugugccacccug

SEQ ID NO: 260457 - RNA, 17 nt, Homo sapiens
gaaguguuucagcagcu

SEQ ID NO: 260458 - RNA, 17 nt, Homo sapiens
gaaguguuucuucauga

SEQ ID NO: 260459 - RNA, 19 nt, Homo sapiens
gaaguguuuguucuccaug

SEQ ID NO: 260460 - RNA, 22 nt, Homo sapiens
gaaucauuggguugauucaaga

SEQ ID NO: 260461 - RNA, 22 nt, Homo sapiens
gaaugcaugaggggaucagaug

SEQ ID NO: 260462 - RNA, 22 nt, Homo sapiens
gaauucugucgcuuacuagaug

SEQ ID NO: 260463 - RNA, 22 nt, Homo sapiens
gacagugugauacuuagucuca

SEQ ID NO: 260464 - RNA, 21 nt, Homo sapiens
gaccacagcagggaaugucag

SEQ ID NO: 260465 - RNA, 22 nt, Homo sapiens
gaccacauuccacacaggcuuu

SEQ ID NO: 260466 - RNA, 22 nt, Homo sapiens
gacuauguuaccuuacacauca

SEQ ID NO: 260467 - RNA, 19 nt, Homo sapiens
gacuccagaguugugugcu

SEQ ID NO: 260468 - RNA, 22 nt, Homo sapiens
gacucuguagacaaucacaucu

SEQ ID NO: 260469 - RNA, 22 nt, Homo sapiens
gacuggccuauaauggcgaauu

SEQ ID NO: 260470 - RNA, 20 nt, Homo sapiens
gacuugagagugggagagua

SEQ ID NO: 260471 - RNA, 22 nt, Homo sapiens
gagaacaguguuguauuuuuuc

SEQ ID NO: 260472 - RNA, 22 nt, Homo sapiens
gagaaugaacagacugccucuu

SEQ ID NO: 260473 - RNA, 22 nt, Homo sapiens
gagacugagucuugcucuguca

SEQ ID NO: 260474 - RNA, 21 nt, Homo sapiens
gagaggauucgccagccucuu

SEQ ID NO: 260475 - RNA, 22 nt, Homo sapiens
gagaucuucguguggggagaca

SEQ ID NO: 260476 - RNA, 22 nt, Homo sapiens
gagaucuuuaagaacuacugcu

SEQ ID NO: 260477 - RNA, 22 nt, Homo sapiens
gagauggagucuuuuucuguca

SEQ ID NO: 260478 - RNA, 22 nt, Homo sapiens
gagauuaacauuugaggagcug

SEQ ID NO: 260479 - RNA, 22 nt, Homo sapiens
gagauugucaugauuacauugu

SEQ ID NO: 260480 - RNA, 22 nt, Homo sapiens
gagcaaugagcugccugcugag

SEQ ID NO: 260481 - RNA, 22 nt, Homo sapiens
gagcugaaguuuccauuuguac

SEQ ID NO: 260482 - RNA, 22 nt, Homo sapiens
gagcugaauugcugccauuugc

SEQ ID NO: 260483 - RNA, 22 nt, Homo sapiens
gagcugccuugccuaugcaaga

SEQ ID NO: 260484 - RNA, 22 nt, Homo sapiens
gagcugguccuuuaaggaugca

SEQ ID NO: 260485 - RNA, 20 nt, Homo sapiens
gagcugguguacugccgggc

SEQ ID NO: 260486 - RNA, 22 nt, Homo sapiens
gaggaaguuuacaaagcaucug

SEQ ID NO: 260487 - RNA, 22 nt, Homo sapiens
gagguaggggccuuaaagaugc

SEQ ID NO: 260488 - RNA, 22 nt, Homo sapiens
gagguagggucccacuauguug

SEQ ID NO: 260489 - RNA, 22 nt, Homo sapiens
gagguagguacaauugccacca

SEQ ID NO: 260490 - RNA, 22 nt, Homo sapiens
gaggucaggacauuuuugcuuu

SEQ ID NO: 260491 - RNA, 22 nt, Homo sapiens
gagguguagucaugccaagauc

SEQ ID NO: 260492 - RNA, 22 nt, Homo sapiens
gagguuauuggggugcuugugu

SEQ ID NO: 260493 - RNA, 22 nt, Homo sapiens
gagugcaaagguccugaggugg

SEQ ID NO: 260494 - RNA, 21 nt, Homo sapiens
gagugcaaauaaagagagggc

SEQ ID NO: 260495 - RNA, 22 nt, Homo sapiens
gagugcaagguuuuucugagug

SEQ ID NO: 260496 - RNA, 22 nt, Homo sapiens
gagugcaauggcaugaucuggg

SEQ ID NO: 260497 - RNA, 22 nt, Homo sapiens
gagugcaauggugcuaucucgg

SEQ ID NO: 260498 - RNA, 22 nt, Homo sapiens
gaguucaaaucucagcucuguu

SEQ ID NO: 260499 - RNA, 22 nt, Homo sapiens
gaguuuguacuaauuuguugua

SEQ ID NO: 260500 - RNA, 22 nt, Homo sapiens
gauaaauccagauucugaugua

SEQ ID NO: 260501 - RNA, 22 nt, Homo sapiens
gauacuguauccuaaaagcuuu

SEQ ID NO: 260502 - RNA, 22 nt, Homo sapiens
gauagguucuaagcagguguug

SEQ ID NO: 260503 - RNA, 22 nt, Homo sapiens
gauaguugugagaacucuuacu

SEQ ID NO: 260504 - RNA, 21 nt, Homo sapiens
gauaucuuuauucccaagagc

SEQ ID NO: 260505 - RNA, 21 nt, Homo sapiens
gauaugacauggguaaaacca

SEQ ID NO: 260506 - RNA, 22 nt, Homo sapiens
gaucacuuugaugccaggaacu

SEQ ID NO: 260507 - RNA, 22 nt, Homo sapiens
gaucuggagguuuuccucauga

SEQ ID NO: 260508 - RNA, 22 nt, Homo sapiens
gaucugugugauuggaugcauu

SEQ ID NO: 260509 - RNA, 22 nt, Homo sapiens
gaugaacugucuuacuacucac

SEQ ID NO: 260510 - RNA, 22 nt, Homo sapiens
gaugagaucauaaguguggagc

SEQ ID NO: 260511 - RNA, 22 nt, Homo sapiens
gaugagauguucucauggauug

SEQ ID NO: 260512 - RNA, 22 nt, Homo sapiens
gaugagguagaagacucagcaa

SEQ ID NO: 260513 - RNA, 22 nt, Homo sapiens
gauggaguugucgccugggcug

SEQ ID NO: 260514 - RNA, 22 nt, Homo sapiens
gauggauuuuuuaggcagagcu

SEQ ID NO: 260515 - RNA, 22 nt, Homo sapiens
gauggcacuuaagagcaagagc

SEQ ID NO: 260516 - RNA, 22 nt, Homo sapiens
gaugugaaaucauaguuucuag

SEQ ID NO: 260517 - RNA, 22 nt, Homo sapiens
gauuagaacagaagucagauua

SEQ ID NO: 260518 - RNA, 22 nt, Homo sapiens
gauuagcacuucaguuacagua

SEQ ID NO: 260519 - RNA, 22 nt, Homo sapiens
gauuuuccaguggcccugauca

SEQ ID NO: 260520 - RNA, 22 nt, Homo sapiens
gcaaaaaguagugcugguuagg

SEQ ID NO: 260521 - RNA, 22 nt, Homo sapiens
gcaaaauugagaagggaauaua

SEQ ID NO: 260522 - RNA, 22 nt, Homo sapiens
gcaaagaaugcagauuugccuc

SEQ ID NO: 260523 - RNA, 22 nt, Homo sapiens
uaaggcacuacuuuaggcuuuc

SEQ ID NO: 260524 - RNA, 22 nt, Homo sapiens
uaagggcacuaaucccauuuau

SEQ ID NO: 260525 - RNA, 22 nt, Homo sapiens
uaaguacaugcuagauggaaug

SEQ ID NO: 260526 - RNA, 22 nt, Homo sapiens
uaauauguuuugaaaucaggaa

SEQ ID NO: 260527 - RNA, 22 nt, Homo sapiens
uaaugcaucaugguuggcaaac

SEQ ID NO: 260528 - RNA, 22 nt, Homo sapiens
uaauucugacaacaguggcguu

SEQ ID NO: 260529 - RNA, 22 nt, Homo sapiens
uaauucuguauguaucagaguu

SEQ ID NO: 260530 - RNA, 22 nt, Homo sapiens
uacaaaguaacaguuccuguau

SEQ ID NO: 260531 - RNA, 16 nt, Homo sapiens
uacaacagugaguaug

SEQ ID NO: 260532 - RNA, 21 nt, Homo sapiens
uacaagcuguagcacaugcca

SEQ ID NO: 260533 - RNA, 22 nt, Homo sapiens
uacaccaauuuaaucaaaagca

SEQ ID NO: 260534 - RNA, 22 nt, Homo sapiens
uacagaguagaagauuugcaga

SEQ ID NO: 260535 - RNA, 22 nt, Homo sapiens
uacaguaauguuaaucuuugug

SEQ ID NO: 260536 - RNA, 22 nt, Homo sapiens
uacagucuagaggagaaucagg

SEQ ID NO: 260537 - RNA, 22 nt, Homo sapiens
uacauacuguaugguucuguuu

SEQ ID NO: 260538 - RNA, 22 nt, Homo sapiens
uacauccauccugcugggcagu

SEQ ID NO: 260539 - RNA, 19 nt, Homo sapiens
uacaugcagcaggcacgca

SEQ ID NO: 260540 - RNA, 22 nt, Homo sapiens
uacauguauacaggguuuacuu

SEQ ID NO: 260541 - RNA, 22 nt, Homo sapiens
uaccacaggcuggguaaucuau

SEQ ID NO: 260542 - RNA, 22 nt, Homo sapiens
uaccacagucauuacacuugua

SEQ ID NO: 260543 - RNA, 22 nt, Homo sapiens
uacgccuguaauaucagcauuu

SEQ ID NO: 260544 - RNA, 23 nt, Homo sapiens
uacuaguaagcguguucuuugca

SEQ ID NO: 260545 - RNA, 22 nt, Homo sapiens
uacucacauucuguuucuugcu

SEQ ID NO: 260546 - RNA, 19 nt, Homo sapiens
uacugcacuccagucuggg

SEQ ID NO: 260547 - RNA, 19 nt, Homo sapiens
uacuggcucgggaauuuuc

SEQ ID NO: 260548 - RNA, 22 nt, Homo sapiens
uagacccauuacguaguuucca

SEQ ID NO: 260549 - RNA, 22 nt, Homo sapiens
uagagaucuuauauuuuaugac

SEQ ID NO: 260550 - RNA, 22 nt, Homo sapiens
uagagcuugacacuuuccaugg

SEQ ID NO: 260551 - RNA, 22 nt, Homo sapiens
uagauaguaaagccauuagcuu

SEQ ID NO: 260552 - RNA, 22 nt, Homo sapiens
uagaucauauucagugcuuacu

SEQ ID NO: 260553 - RNA, 20 nt, Homo sapiens
uagaugcauuuagauucauu

SEQ ID NO: 260554 - RNA, 22 nt, Homo sapiens
uagcacaguucacccucgauuu

SEQ ID NO: 260555 - RNA, 22 nt, Homo sapiens
uagcaccacaaucaagauacag

SEQ ID NO: 260556 - RNA, 22 nt, Homo sapiens
uagcagaauaacuugccagccu

SEQ ID NO: 260557 - RNA, 22 nt, Homo sapiens
uagcagaauauaccucuuacuu

SEQ ID NO: 260558 - RNA, 22 nt, Homo sapiens
uagcagcaaagcaggaucugcu

SEQ ID NO: 260559 - RNA, 22 nt, Homo sapiens
uagcagcagugguguauuuaga

SEQ ID NO: 260560 - RNA, 22 nt, Homo sapiens
uagcagcuuuauugagguaaau

SEQ ID NO: 260561 - RNA, 22 nt, Homo sapiens
uagccuguggugaauguuucug

SEQ ID NO: 260562 - RNA, 22 nt, Homo sapiens
uagcuccagugggguuacugcu

SEQ ID NO: 260563 - RNA, 22 nt, Homo sapiens
uagcugaucuuuuaaagaauga

SEQ ID NO: 260564 - RNA, 22 nt, Homo sapiens
uagcugguucuccaggagcuag

SEQ ID NO: 260565 - RNA, 20 nt, Homo sapiens
uaggagcaaugagaguagaa

SEQ ID NO: 260566 - RNA, 22 nt, Homo sapiens
uaggaucauuuuauguugccca

SEQ ID NO: 260567 - RNA, 22 nt, Homo sapiens
uagggcauuuagaggcuauuaa

SEQ ID NO: 260568 - RNA, 19 nt, Homo sapiens
uagguacauucaagucucc

SEQ ID NO: 260569 - RNA, 22 nt, Homo sapiens
uagguaggauagucuuuauuuu

SEQ ID NO: 260570 - RNA, 22 nt, Homo sapiens
uagguaucuuuauagcaguagc

SEQ ID NO: 260571 - RNA, 22 nt, Homo sapiens
uaggucaguuuuggcuuggcuu

SEQ ID NO: 260572 - RNA, 22 nt, Homo sapiens
uaguauguuuauagcauugagu

SEQ ID NO: 260573 - RNA, 22 nt, Homo sapiens
uagugcccuuauaagagcagga

SEQ ID NO: 260574 - RNA, 20 nt, Homo sapiens
uaguggaaaucagguccucu

SEQ ID NO: 260575 - RNA, 22 nt, Homo sapiens
uaguuaguagacucugauuauu

SEQ ID NO: 260576 - RNA, 23 nt, Homo sapiens
uauaacuuuuaauuuacuggccu

SEQ ID NO: 260577 - RNA, 22 nt, Homo sapiens
uauagcacugagaauguaauuc

SEQ ID NO: 260578 - RNA, 22 nt, Homo sapiens
uauaugucugagacugggggau

SEQ ID NO: 260579 - RNA, 22 nt, Homo sapiens
uaucaaguuggaagagaaguaa

SEQ ID NO: 260580 - RNA, 22 nt, Homo sapiens
uaucacaaacuuagcaguuuaa

SEQ ID NO: 260581 - RNA, 22 nt, Homo sapiens
uaucacacuggaagaaguuaag

SEQ ID NO: 260582 - RNA, 22 nt, Homo sapiens
uaucacagguggacugcacacc

SEQ ID NO: 260583 - RNA, 21 nt, Homo sapiens
uaucacaguagaauaggaucu

SEQ ID NO: 260584 - RNA, 22 nt, Homo sapiens
uaucacaguaucuagcacagug

SEQ ID NO: 260585 - RNA, 20 nt, Homo sapiens
uaucacaguucaggaacucu

SEQ ID NO: 260586 - RNA, 22 nt, Homo sapiens
uaucacaguugcauauuuaagg

SEQ ID NO: 260587 - RNA, 22 nt, Homo sapiens
uaucacuauucauccuagcucc

SEQ ID NO: 260588 - RNA, 22 nt, Homo sapiens
uaucagagcugucagccuaccu

SEQ ID NO: 260589 - RNA, 22 nt, Homo sapiens
uaucauaguuuggacuuucauu

SEQ ID NO: 260590 - RNA, 22 nt, Homo sapiens
uaucaucauuggcaggugagaa

SEQ ID NO: 260591 - RNA, 22 nt, Homo sapiens
uaucauuguguuauuucuucca

SEQ ID NO: 260592 - RNA, 22 nt, Homo sapiens
uaucucaguguacaggaugaua

SEQ ID NO: 260593 - RNA, 20 nt, Homo sapiens
uaucucaguuuguccuaaac

SEQ ID NO: 260594 - RNA, 21 nt, Homo sapiens
uaucucaguuuuccuuugugg

SEQ ID NO: 260595 - RNA, 22 nt, Homo sapiens
uaugccucuucauaaaguauga

SEQ ID NO: 260596 - RNA, 19 nt, Homo sapiens
uaugcuagagagggaagcu

SEQ ID NO: 260597 - RNA, 22 nt, Homo sapiens
uauggauuugccuauucuguau

SEQ ID NO: 260598 - RNA, 22 nt, Homo sapiens
uauggcuuuguuaacauuuucu

SEQ ID NO: 260599 - RNA, 22 nt, Homo sapiens
uaugguuuuaagguuaaggacu

SEQ ID NO: 260600 - RNA, 17 nt, Homo sapiens
uauguaguacuuauaaa

SEQ ID NO: 260601 - RNA, 22 nt, Homo sapiens
uaugucuggaguuacugagcug

SEQ ID NO: 260602 - RNA, 22 nt, Homo sapiens
uaugucuucuuuagagaaaugu

SEQ ID NO: 260603 - RNA, 22 nt, Homo sapiens
uaugugcacaugcccuggugac

SEQ ID NO: 260604 - RNA, 22 nt, Homo sapiens
uauguuaucaaaaagcuaagga

SEQ ID NO: 260605 - RNA, 22 nt, Homo sapiens
uauucaagccaaauucaagcca

SEQ ID NO: 260606 - RNA, 22 nt, Homo sapiens
uauuccacuauuaguccagaug

SEQ ID NO: 260607 - RNA, 17 nt, Homo sapiens
uauugaccuuuguaugu

SEQ ID NO: 260608 - RNA, 22 nt, Homo sapiens
uauugcagauacccaggaaguu

SEQ ID NO: 260609 - RNA, 22 nt, Homo sapiens
uauugcuuuacucucuuauccu

SEQ ID NO: 260610 - RNA, 22 nt, Homo sapiens
uauugucacuaaaggaagcugg

SEQ ID NO: 260611 - RNA, 20 nt, Homo sapiens
uauuugguuauuuccauggu

SEQ ID NO: 260612 - RNA, 20 nt, Homo sapiens
ucaaagacauggcugucaga

SEQ ID NO: 260613 - RNA, 22 nt, Homo sapiens
ucaaaugcuguauuguaguaau

SEQ ID NO: 260614 - RNA, 22 nt, Homo sapiens
ucaacagugauggaaaguuaua

SEQ ID NO: 260615 - RNA, 22 nt, Homo sapiens
ucaagcaauucuccugccucag

SEQ ID NO: 260616 - RNA, 22 nt, Homo sapiens
ucaagcaauucugcugccucag

SEQ ID NO: 260617 - RNA, 19 nt, Homo sapiens
ucaagcuauucuccugccu

SEQ ID NO: 260618 - RNA, 18 nt, Homo sapiens
ucaagcuauugucaugcc

SEQ ID NO: 260619 - RNA, 19 nt, Homo sapiens
ucacacuguggcuucuuua

SEQ ID NO: 260620 - RNA, 22 nt, Homo sapiens
ucacagaggagaagaccuuuaa

SEQ ID NO: 260621 - RNA, 21 nt, Homo sapiens
ucacagccuaggaccugaaga

SEQ ID NO: 260622 - RNA, 22 nt, Homo sapiens
ucacagcuaaaaugaaaguagu

SEQ ID NO: 260623 - RNA, 22 nt, Homo sapiens
ucacaguagcaaauguuagaaa

SEQ ID NO: 260624 - RNA, 22 nt, Homo sapiens
ucacagucacugucacguugaa

SEQ ID NO: 260625 - RNA, 22 nt, Homo sapiens
ucacaguucagcauggcugagg

SEQ ID NO: 260626 - RNA, 22 nt, Homo sapiens
ucacaguugauugaaacacagc

SEQ ID NO: 260627 - RNA, 22 nt, Homo sapiens
ucacaugugcguuuuggcaugu

SEQ ID NO: 260628 - RNA, 22 nt, Homo sapiens
ucacauuguauauguaccuauc

SEQ ID NO: 260629 - RNA, 22 nt, Homo sapiens
ucacauuguguagccugcucac

SEQ ID NO: 260630 - RNA, 22 nt, Homo sapiens
ucaccuuacuugcuucugaacu

SEQ ID NO: 260631 - RNA, 22 nt, Homo sapiens
ucaccuugcacaguuguguggg

SEQ ID NO: 260632 - RNA, 22 nt, Homo sapiens
ucacuaaagaaaauggcaugga

SEQ ID NO: 260633 - RNA, 22 nt, Homo sapiens
ucacugagaaugauguuucuga

SEQ ID NO: 260634 - RNA, 21 nt, Homo sapiens
ucacugagcaucaugguuuca

SEQ ID NO: 260635 - RNA, 22 nt, Homo sapiens
ucacugagcuagaucacuugac

SEQ ID NO: 260636 - RNA, 20 nt, Homo sapiens
ucacugaguaucuacgauua

SEQ ID NO: 260637 - RNA, 22 nt, Homo sapiens
ucacugcacucuccgccuugcg

SEQ ID NO: 260638 - RNA, 22 nt, Homo sapiens
ucacugcgaccuccaccuccug

SEQ ID NO: 260639 - RNA, 22 nt, Homo sapiens
ucacugggagcauuugagccuu

SEQ ID NO: 260640 - RNA, 22 nt, Homo sapiens
ucacugugagaguuuauccugu

SEQ ID NO: 260641 - RNA, 22 nt, Homo sapiens
ucacugugguuuugaugugcau

SEQ ID NO: 260642 - RNA, 22 nt, Homo sapiens
ucagacacugagcaaacgacua

SEQ ID NO: 260643 - RNA, 18 nt, Homo sapiens
ucagagugcagacuauac

SEQ ID NO: 260644 - RNA, 22 nt, Homo sapiens
ucagaguggccucucuugaaga

SEQ ID NO: 260645 - RNA, 22 nt, Homo sapiens
ucagaucacuggcgcuggcgga

SEQ ID NO: 260646 - RNA, 22 nt, Homo sapiens
ucagaucauauucuucgcugcu

SEQ ID NO: 260647 - RNA, 22 nt, Homo sapiens
ucagaugauuccguugacgaga

SEQ ID NO: 260648 - RNA, 22 nt, Homo sapiens
ucagauuggugcaaaaguaauu

SEQ ID NO: 260649 - RNA, 22 nt, Homo sapiens
ucagcacauucaaggccugccu

SEQ ID NO: 260650 - RNA, 21 nt, Homo sapiens
ucagcucaucacugccuggag

SEQ ID NO: 260651 - RNA, 21 nt, Homo sapiens
ucaggcuuuuugagugccaau

SEQ ID NO: 260652 - RNA, 20 nt, Homo sapiens
ucagguagaucuuugagguc

SEQ ID NO: 260653 - RNA, 22 nt, Homo sapiens
ucagguagcauuuuggaaacag

SEQ ID NO: 260654 - RNA, 22 nt, Homo sapiens
ucagguaguuugugggagauga

SEQ ID NO: 260655 - RNA, 22 nt, Homo sapiens
ucagguaucucuauagcaaugu

SEQ ID NO: 260656 - RNA, 22 nt, Homo sapiens
ucagugauugguuauuuuaggc

SEQ ID NO: 260657 - RNA, 20 nt, Homo sapiens
ucagugcagauuguccaagu

SEQ ID NO: 260658 - RNA, 22 nt, Homo sapiens
ucaguggauuauuaaagucacc

SEQ ID NO: 260659 - RNA, 22 nt, Homo sapiens
ucaguucauggaggugucugcu

SEQ ID NO: 260660 - RNA, 22 nt, Homo sapiens
ucauacuguuaaaugguuuagu

SEQ ID NO: 260661 - RNA, 22 nt, Homo sapiens
ucauacuguugugaaacaaaac

SEQ ID NO: 260662 - RNA, 18 nt, Homo sapiens
ucauagaucaugacagug

SEQ ID NO: 260663 - RNA, 22 nt, Homo sapiens
ucauaguacuuuguuuugaaaa

SEQ ID NO: 260664 - RNA, 22 nt, Homo sapiens
ucauaguagucacuuaauaaau

SEQ ID NO: 260665 - RNA, 21 nt, Homo sapiens
ucaucaagcuguagacaugau

SEQ ID NO: 260666 - RNA, 23 nt, Homo sapiens
ucaugaggccauucaaauccauu

SEQ ID NO: 260667 - RNA, 22 nt, Homo sapiens
ucauggcacugaugagaguuuc

SEQ ID NO: 260668 - RNA, 22 nt, Homo sapiens
ucauggcuuuuauuauguugag

SEQ ID NO: 260669 - RNA, 19 nt, Homo sapiens
ucauggcuuuuucagcugu

SEQ ID NO: 260670 - RNA, 22 nt, Homo sapiens
ucaugucuuguuguauuuauuu

SEQ ID NO: 260671 - RNA, 22 nt, Homo sapiens
ucaugugagcacagagcaagau

SEQ ID NO: 260672 - RNA, 22 nt, Homo sapiens
ucauugcaaucucugccucccg

SEQ ID NO: 260673 - RNA, 22 nt, Homo sapiens
ucauuguccaacuucuuucagu

SEQ ID NO: 260674 - RNA, 22 nt, Homo sapiens
uccaagaugcuggcagcuacag

SEQ ID NO: 260675 - RNA, 22 nt, Homo sapiens
uccacaguaaggacccugccuu

SEQ ID NO: 260676 - RNA, 22 nt, Homo sapiens
uccagguuuugugaguuuaaau

SEQ ID NO: 260677 - RNA, 22 nt, Homo sapiens
uccaguacaggucucucauuuc

SEQ ID NO: 260678 - RNA, 20 nt, Homo sapiens
uccaguuuuggagacauucu

SEQ ID NO: 260679 - RNA, 22 nt, Homo sapiens
uccaugaggcuacaguaaucuc

SEQ ID NO: 260680 - RNA, 22 nt, Homo sapiens
uccauggagacacauuuuauau

SEQ ID NO: 260681 - RNA, 22 nt, Homo sapiens
uccauuuguuguaggguauagu

SEQ ID NO: 260682 - RNA, 19 nt, Homo sapiens
uccccaguuuuccguucag

SEQ ID NO: 260683 - RNA, 22 nt, Homo sapiens
uccccugagaacuugcuagaaa

SEQ ID NO: 260684 - RNA, 22 nt, Homo sapiens
uccccugagucaccugcuucuc

SEQ ID NO: 260685 - RNA, 18 nt, Homo sapiens
ucccucagaauuauagaa

SEQ ID NO: 260686 - RNA, 22 nt, Homo sapiens
ucccugagcaaaguuuucugua

SEQ ID NO: 260687 - RNA, 22 nt, Homo sapiens
uccucugaacuccagacccaua

SEQ ID NO: 260688 - RNA, 22 nt, Homo sapiens
uccugagagcagacccucuaua

SEQ ID NO: 260689 - RNA, 22 nt, Homo sapiens
uccuugguugauccugugcaga

SEQ ID NO: 260690 - RNA, 22 nt, Homo sapiens
ucuaagaauucauuuauaagcc

SEQ ID NO: 260691 - RNA, 22 nt, Homo sapiens
ucuaaguaguagcuggucagaa

SEQ ID NO: 260692 - RNA, 22 nt, Homo sapiens
ucuacccugugagggacacagu

SEQ ID NO: 260693 - RNA, 22 nt, Homo sapiens
ucucacacugaauguguguggg

SEQ ID NO: 260694 - RNA, 22 nt, Homo sapiens
ucucacauuucacagggauggg

SEQ ID NO: 260695 - RNA, 21 nt, Homo sapiens
ucucauagaguuucacuuucu

SEQ ID NO: 260696 - RNA, 22 nt, Homo sapiens
ucucccauccaugaacuucugu

SEQ ID NO: 260697 - RNA, 22 nt, Homo sapiens
ucugagaugagacuuugaauuu

SEQ ID NO: 260698 - RNA, 22 nt, Homo sapiens
ucugagucaucacaaaugaugc

SEQ ID NO: 260699 - RNA, 22 nt, Homo sapiens
ucugaguggcagaaugagcuga

SEQ ID NO: 260700 - RNA, 22 nt, Homo sapiens
ucugccuuuucaugugggaugg

SEQ ID NO: 260701 - RNA, 22 nt, Homo sapiens
ucuggccccucucaaaucucau

SEQ ID NO: 260702 - RNA, 22 nt, Homo sapiens
ucuggccuacaucauuuuuccg

SEQ ID NO: 260703 - RNA, 22 nt, Homo sapiens
ucuggcuuuagcaugugggaag

SEQ ID NO: 260704 - RNA, 23 nt, Homo sapiens
ucuggcuuugggaugcucaaggg

SEQ ID NO: 260705 - RNA, 22 nt, Homo sapiens
ucugggguuagucaaagguaug

SEQ ID NO: 260706 - RNA, 22 nt, Homo sapiens
ucugguguuacugagccuccca

SEQ ID NO: 260707 - RNA, 22 nt, Homo sapiens
ucugguuccuuggcuucggguc

SEQ ID NO: 260708 - RNA, 22 nt, Homo sapiens
ucugucacugaaucccugucac

SEQ ID NO: 260709 - RNA, 22 nt, Homo sapiens
ugcaaguaauuccagcuacuga

SEQ ID NO: 260710 - RNA, 22 nt, Homo sapiens
ugcaaugucuucugaggggagc

SEQ ID NO: 260711 - RNA, 22 nt, Homo sapiens
ugcaccacugcuagccugggua

SEQ ID NO: 260712 - RNA, 22 nt, Homo sapiens
ugcaccaucuugcuucuguggu

SEQ ID NO: 260713 - RNA, 22 nt, Homo sapiens
ugcagcacaguagguuugcaau

SEQ ID NO: 260714 - RNA, 22 nt, Homo sapiens
ugcagcucaaauuccuaacaag

SEQ ID NO: 260715 - RNA, 22 nt, Homo sapiens
ugcagugugauuuucuggcuga

SEQ ID NO: 260716 - RNA, 22 nt, Homo sapiens
ugcauacacaagcauacaugua

SEQ ID NO: 260717 - RNA, 22 nt, Homo sapiens
ugcauagaauguucuguaaaua

SEQ ID NO: 260718 - RNA, 22 nt, Homo sapiens
ugcauauucgaguuauuuuggg

SEQ ID NO: 260719 - RNA, 22 nt, Homo sapiens
ugccaagauuucaggaauuaag

SEQ ID NO: 260720 - RNA, 22 nt, Homo sapiens
ugcccuguaucccacuguuuca

SEQ ID NO: 260721 - RNA, 22 nt, Homo sapiens
ugccuaggcccaguccucagaa

SEQ ID NO: 260722 - RNA, 21 nt, Homo sapiens
ugccuuuguaguaggugucuu

SEQ ID NO: 260723 - RNA, 22 nt, Homo sapiens
ugccuuuguucuggaaugggaa

SEQ ID NO: 260724 - RNA, 22 nt, Homo sapiens
ugcgauuauuaugucacuuccu

SEQ ID NO: 260725 - RNA, 18 nt, Homo sapiens
ugcuccccugggugagca

SEQ ID NO: 260726 - RNA, 22 nt, Homo sapiens
uggaaaguaguucuaaucuaag

SEQ ID NO: 260727 - RNA, 22 nt, Homo sapiens
uggaaauuaagucuuuccugag

SEQ ID NO: 260728 - RNA, 22 nt, Homo sapiens
uggaagacucaagguggugaau

SEQ ID NO: 260729 - RNA, 20 nt, Homo sapiens
uggaaucuaggcggagguuu

SEQ ID NO: 260730 - RNA, 21 nt, Homo sapiens
uggaaucuauuauuccaguuu

SEQ ID NO: 260731 - RNA, 21 nt, Homo sapiens
uggaauguucugacuucaggg

SEQ ID NO: 260732 - RNA, 22 nt, Homo sapiens
uggaauuaauuaaaauauacug

SEQ ID NO: 260733 - RNA, 21 nt, Homo sapiens
uggaccccuuccuuacaucau

SEQ ID NO: 260734 - RNA, 22 nt, Homo sapiens
uggagguagagaugggaucucc

SEQ ID NO: 260735 - RNA, 22 nt, Homo sapiens
uggagugcaauggcaccaucuu

SEQ ID NO: 260736 - RNA, 22 nt, Homo sapiens
uggagugcaauggugagaucuu

SEQ ID NO: 260737 - RNA, 22 nt, Homo sapiens
uggagugucaguuuccagaguu

SEQ ID NO: 260738 - RNA, 22 nt, Homo sapiens
uggaguguguugcagaugaagg

SEQ ID NO: 260739 - RNA, 16 nt, Homo sapiens
uggaguguuuguuaga

SEQ ID NO: 260740 - RNA, 22 nt, Homo sapiens
uggaucuguucuauuuaucuga

SEQ ID NO: 260741 - RNA, 22 nt, Homo sapiens
uggauggagaggcuugugaugc

SEQ ID NO: 260742 - RNA, 22 nt, Homo sapiens
uggauggucagaggguuucugu

SEQ ID NO: 260743 - RNA, 22 nt, Homo sapiens
uggauguaauugauucauguug

SEQ ID NO: 260744 - RNA, 22 nt, Homo sapiens
uggcaaaauauuuugguuucug

SEQ ID NO: 260745 - RNA, 22 nt, Homo sapiens
uggcaacaucuggggacauguu

SEQ ID NO: 260746 - RNA, 22 nt, Homo sapiens
uggcaagaacaacaauuacuuu

SEQ ID NO: 260747 - RNA, 22 nt, Homo sapiens
uggcaagaacgaaauguagggu

SEQ ID NO: 260748 - RNA, 23 nt, Homo sapiens
uggcaagaauucuuaccgugugg

SEQ ID NO: 260749 - RNA, 22 nt, Homo sapiens
uggcaagaccccaucucuacaa

SEQ ID NO: 260750 - RNA, 22 nt, Homo sapiens
uggcaagagauaugugucuaua

SEQ ID NO: 260751 - RNA, 22 nt, Homo sapiens
uggcaagaucacaauuacuuuu

SEQ ID NO: 260752 - RNA, 20 nt, Homo sapiens
uggcaagauggcagaauaga

SEQ ID NO: 260753 - RNA, 20 nt, Homo sapiens
uggcaccugacagauagcca

SEQ ID NO: 260754 - RNA, 22 nt, Homo sapiens
uggcagcgugaauguggcugaa

SEQ ID NO: 260755 - RNA, 22 nt, Homo sapiens
uggcaggugcacuggcuuugaa

SEQ ID NO: 260756 - RNA, 22 nt, Homo sapiens
uggcaguuuacaaaugccauga

SEQ ID NO: 260757 - RNA, 22 nt, Homo sapiens
uggcaugggguaguagcgcugg

SEQ ID NO: 260758 - RNA, 22 nt, Homo sapiens
uggcauggucugcccaaguuuc

SEQ ID NO: 260759 - RNA, 22 nt, Homo sapiens
uggcaugucguuuuucauagga

SEQ ID NO: 260760 - RNA, 20 nt, Homo sapiens
uggcauguugguaugcaccc

SEQ ID NO: 260761 - RNA, 22 nt, Homo sapiens
uggcauuuucucuguucuuaga

SEQ ID NO: 260762 - RNA, 22 nt, Homo sapiens
uggcauuuuguuuuagaauuag

SEQ ID NO: 260763 - RNA, 22 nt, Homo sapiens
uggcuagauauccagaguucug

SEQ ID NO: 260764 - RNA, 22 nt, Homo sapiens
ugggcaagagagcaugacccug

SEQ ID NO: 260765 - RNA, 22 nt, Homo sapiens
uggguagagaaucaggaucuua

SEQ ID NO: 260766 - RNA, 22 nt, Homo sapiens
ugguaagaucugugagccaggc

SEQ ID NO: 260767 - RNA, 22 nt, Homo sapiens
ugguauguauacuagcgacacu

SEQ ID NO: 260768 - RNA, 22 nt, Homo sapiens
ugguauguguucuaaaauuaug

SEQ ID NO: 260769 - RNA, 22 nt, Homo sapiens
uggucaugaggugaggcuucuc

SEQ ID NO: 260770 - RNA, 22 nt, Homo sapiens
uggucauggggcagcugacacu

SEQ ID NO: 260771 - RNA, 21 nt, Homo sapiens
uggucccauaagauuacaaug

SEQ ID NO: 260772 - RNA, 22 nt, Homo sapiens
ugguccucugcuuccagaauuc

SEQ ID NO: 260773 - RNA, 22 nt, Homo sapiens
ugguguccugucucugcgcuug

SEQ ID NO: 260774 - RNA, 22 nt, Homo sapiens
uguaaacauguauguguuuaug

SEQ ID NO: 260775 - RNA, 22 nt, Homo sapiens
uguaaacuaugagcugauuauu

SEQ ID NO: 260776 - RNA, 22 nt, Homo sapiens
uguaagcauugggcaugcaguc

SEQ ID NO: 260777 - RNA, 22 nt, Homo sapiens
uguaauaguaggcucacauuug

SEQ ID NO: 260778 - RNA, 21 nt, Homo sapiens
uguagcagcaugauucauagu

SEQ ID NO: 260779 - RNA, 18 nt, Homo sapiens
ugucacuggauaaugguc

SEQ ID NO: 260780 - RNA, 22 nt, Homo sapiens
ugucagcacaacucagguuccu

SEQ ID NO: 260781 - RNA, 22 nt, Homo sapiens
ugucaggagcaaugauaaauuu

SEQ ID NO: 260782 - RNA, 22 nt, Homo sapiens
ugucaguggucuggaugcagcc

SEQ ID NO: 260783 - RNA, 22 nt, Homo sapiens
ugucauacaguaacaugguugg

SEQ ID NO: 260784 - RNA, 22 nt, Homo sapiens
ugucauagauugcuuggaaaaa

SEQ ID NO: 260785 - RNA, 22 nt, Homo sapiens
ugucaugagucuccuccaucuu

SEQ ID NO: 260786 - RNA, 22 nt, Homo sapiens
ugucauggugcucugggcccug

SEQ ID NO: 260787 - RNA, 22 nt, Homo sapiens
ugucauguuucuacugaccaaa

SEQ ID NO: 260788 - RNA, 16 nt, Homo sapiens
uguccaaauaaauaca

SEQ ID NO: 260789 - RNA, 20 nt, Homo sapiens
ugucccaaccccauggguuc

SEQ ID NO: 260790 - RNA, 22 nt, Homo sapiens
ugucucccuucccauuaggaag

SEQ ID NO: 260791 - RNA, 21 nt, Homo sapiens
ugucugagagaggagaucuac

SEQ ID NO: 260792 - RNA, 22 nt, Homo sapiens
ugucuggaguccauagaagugu

SEQ ID NO: 260793 - RNA, 22 nt, Homo sapiens
ugugaaaucagauagccuuuuu

SEQ ID NO: 260794 - RNA, 22 nt, Homo sapiens
ugugaacagcuccaaaugugga

SEQ ID NO: 260795 - RNA, 19 nt, Homo sapiens
ugugaacaucacagagugu

SEQ ID NO: 260796 - RNA, 19 nt, Homo sapiens
ugugaagaaaugcugcaag

SEQ ID NO: 260797 - RNA, 22 nt, Homo sapiens
ugugacaaauuuaguggacugu

SEQ ID NO: 260798 - RNA, 23 nt, Homo sapiens
ugugacacuuccgucaguucauu

SEQ ID NO: 260799 - RNA, 21 nt, Homo sapiens
ugugaccucugucucugaguc

SEQ ID NO: 260800 - RNA, 18 nt, Homo sapiens
ugugauggauauguuaau

SEQ ID NO: 260801 - RNA, 17 nt, Homo sapiens
ugugauugaagucaucc

SEQ ID NO: 260802 - RNA, 21 nt, Homo sapiens
cauccccugccauuguggucu

SEQ ID NO: 260803 - RNA, 22 nt, Homo sapiens
caucccugaaccccagaaaucu

SEQ ID NO: 260804 - RNA, 22 nt, Homo sapiens
caucgcacuccagccugggcaa

SEQ ID NO: 260805 - RNA, 22 nt, Homo sapiens
caugcagcacacaugucugugc

SEQ ID NO: 260806 - RNA, 22 nt, Homo sapiens
cauggauuuuuuugaauggcag

SEQ ID NO: 260807 - RNA, 22 nt, Homo sapiens
cauggcacaucuuuucugacua

SEQ ID NO: 260808 - RNA, 22 nt, Homo sapiens
cauggcacuguaugaaaugugc

SEQ ID NO: 260809 - RNA, 22 nt, Homo sapiens
cauggcauuucaagauuuacca

SEQ ID NO: 260810 - RNA, 22 nt, Homo sapiens
cauggcauuugcagaguugaaa

SEQ ID NO: 260811 - RNA, 22 nt, Homo sapiens
cauggcccugggcugggcgaac

SEQ ID NO: 260812 - RNA, 22 nt, Homo sapiens
cauggccuuuggaaugugucua

SEQ ID NO: 260813 - RNA, 22 nt, Homo sapiens
cauggcucuuugcugcuaaagu

SEQ ID NO: 260814 - RNA, 22 nt, Homo sapiens
cauggcuuuaagcaacaccaag

SEQ ID NO: 260815 - RNA, 22 nt, Homo sapiens
cauggcuuucacaguaaagccu

SEQ ID NO: 260816 - RNA, 22 nt, Homo sapiens
caugucuuuuaaacauucaacu

SEQ ID NO: 260817 - RNA, 22 nt, Homo sapiens
caugucuuuuauucugugugau

SEQ ID NO: 260818 - RNA, 22 nt, Homo sapiens
cauugcacuccagcucugggcg

SEQ ID NO: 260819 - RNA, 22 nt, Homo sapiens
cauugcacucuagucuggguga

SEQ ID NO: 260820 - RNA, 22 nt, Homo sapiens
cauugcacugcauucugggcaa

SEQ ID NO: 260821 - RNA, 20 nt, Homo sapiens
cauugcccuccagccugggc

SEQ ID NO: 260822 - RNA, 22 nt, Homo sapiens
cauugguuuuucaggaguauau

SEQ ID NO: 260823 - RNA, 22 nt, Homo sapiens
cauugucccucaaugacuauga

SEQ ID NO: 260824 - RNA, 22 nt, Homo sapiens
cauuugcacugagacucagcuu

SEQ ID NO: 260825 - RNA, 22 nt, Homo sapiens
cauuuugcaguuucugucucca

SEQ ID NO: 260826 - RNA, 22 nt, Homo sapiens
ccaaaucucauguugaaaugug

SEQ ID NO: 260827 - RNA, 22 nt, Homo sapiens
ccacaguggauuaaaguuacug

SEQ ID NO: 260828 - RNA, 22 nt, Homo sapiens
ccacugcacuccagcccggcaa

SEQ ID NO: 260829 - RNA, 22 nt, Homo sapiens
ccagaguuucugauucagcagg

SEQ ID NO: 260830 - RNA, 22 nt, Homo sapiens
ccagucuuggugucuguagcac

SEQ ID NO: 260831 - RNA, 22 nt, Homo sapiens
ccagugcauggaucccaggggg

SEQ ID NO: 260832 - RNA, 20 nt, Homo sapiens
ccaguguuauuuauguucua

SEQ ID NO: 260833 - RNA, 19 nt, Homo sapiens
ccaguguucugauugcacu

SEQ ID NO: 260834 - RNA, 19 nt, Homo sapiens
ccaguguugccagagcuga

SEQ ID NO: 260835 - RNA, 22 nt, Homo sapiens
ccaguuuucucacuguugcagu

SEQ ID NO: 260836 - RNA, 22 nt, Homo sapiens
ccaugaacuagaauagaacaug

SEQ ID NO: 260837 - RNA, 22 nt, Homo sapiens
ccauugcacuucagccuaggug

SEQ ID NO: 260838 - RNA, 22 nt, Homo sapiens
cccacaguggccucauauccuu

SEQ ID NO: 260839 - RNA, 22 nt, Homo sapiens
cccagaguucuuaaauacugag

SEQ ID NO: 260840 - RNA, 22 nt, Homo sapiens
cccagcguucggcauggcugag

SEQ ID NO: 260841 - RNA, 22 nt, Homo sapiens
cccagugguuacauaaggagua

SEQ ID NO: 260842 - RNA, 23 nt, Homo sapiens
cccaguuaauccuuaaucuccac

SEQ ID NO: 260843 - RNA, 22 nt, Homo sapiens
ccccagugguugcaacagcaga

SEQ ID NO: 260844 - RNA, 22 nt, Homo sapiens
cccugaagaaagccuaggacau

SEQ ID NO: 260845 - RNA, 22 nt, Homo sapiens
cccugaagacuccaccgucaug

SEQ ID NO: 260846 - RNA, 22 nt, Homo sapiens
cccugaagauacagaguuuggg

SEQ ID NO: 260847 - RNA, 22 nt, Homo sapiens
cccugagaugugaauuucagag

SEQ ID NO: 260848 - RNA, 22 nt, Homo sapiens
ccucauggagaaccucugcuag

SEQ ID NO: 260849 - RNA, 22 nt, Homo sapiens
ccucccuuuguugcaagggaaa

SEQ ID NO: 260850 - RNA, 21 nt, Homo sapiens
ccugaagaagugaccucugag

SEQ ID NO: 260851 - RNA, 22 nt, Homo sapiens
ccugagacugauugacucacaa

SEQ ID NO: 260852 - RNA, 21 nt, Homo sapiens
ccugaguacaacccacuccac

SEQ ID NO: 260853 - RNA, 22 nt, Homo sapiens
ccuggaagaaaggugcuaaaua

SEQ ID NO: 260854 - RNA, 22 nt, Homo sapiens
ccuggcaagagacugaagauag

SEQ ID NO: 260855 - RNA, 22 nt, Homo sapiens
ccugguguuuugauggucgggu

SEQ ID NO: 260856 - RNA, 22 nt, Homo sapiens
ccuucauugcaucuuuaagaga

SEQ ID NO: 260857 - RNA, 21 nt, Homo sapiens
ccuugagaacaucaauuugcu

SEQ ID NO: 260858 - RNA, 19 nt, Homo sapiens
ccuuugguuuccaugacau

SEQ ID NO: 260859 - RNA, 22 nt, Homo sapiens
ccuuuguuaguuugcugagaau

SEQ ID NO: 260860 - RNA, 22 nt, Homo sapiens
cgacuggccuagacuaguguuu

SEQ ID NO: 260861 - RNA, 22 nt, Homo sapiens
cgccugagcugaggaagcugca

SEQ ID NO: 260862 - RNA, 22 nt, Homo sapiens
cggucacagugauucaaggguc

SEQ ID NO: 260863 - RNA, 22 nt, Homo sapiens
cgugaggaguauuuuuaggugc

SEQ ID NO: 260864 - RNA, 22 nt, Homo sapiens
cuaaaugcacugucaaaggaag

SEQ ID NO: 260865 - RNA, 17 nt, Homo sapiens
cuaaggcaagagucugc

SEQ ID NO: 260866 - RNA, 18 nt, Homo sapiens
cuaauacuauucaacaag

SEQ ID NO: 260867 - RNA, 22 nt, Homo sapiens
cuaaucuagccuuauaaguauu

SEQ ID NO: 260868 - RNA, 22 nt, Homo sapiens
cuaaugcagucaggagaaggaa

SEQ ID NO: 260869 - RNA, 22 nt, Homo sapiens
cuacaguagagaggauguagaa

SEQ ID NO: 260870 - RNA, 22 nt, Homo sapiens
cuacaguucuuaauuaaguagu

SEQ ID NO: 260871 - RNA, 22 nt, Homo sapiens
cuacucuggagagugacaauca

SEQ ID NO: 260872 - RNA, 22 nt, Homo sapiens
cuagacuagacccaaauugaag

SEQ ID NO: 260873 - RNA, 22 nt, Homo sapiens
cuagaggcacagccuaggcacu

SEQ ID NO: 260874 - RNA, 22 nt, Homo sapiens
cuagcagaacaauacaauucgg

SEQ ID NO: 260875 - RNA, 22 nt, Homo sapiens
cuagcagacaugggcugaacca

SEQ ID NO: 260876 - RNA, 22 nt, Homo sapiens
cuagcccagugcuccuggauca

SEQ ID NO: 260877 - RNA, 22 nt, Homo sapiens
cuagcuccauauaaagcaggau

SEQ ID NO: 260878 - RNA, 22 nt, Homo sapiens
cuaggcacugauaguuguauuu

SEQ ID NO: 260879 - RNA, 22 nt, Homo sapiens
cuaggugauccacugcucucuu

SEQ ID NO: 260880 - RNA, 21 nt, Homo sapiens
cuaucucaguguuuacauuug

SEQ ID NO: 260881 - RNA, 22 nt, Homo sapiens
cuaucucauugguuuuugaaag

SEQ ID NO: 260882 - RNA, 22 nt, Homo sapiens
cuauggugauagaaaucagaau

SEQ ID NO: 260883 - RNA, 22 nt, Homo sapiens
cuauuagguuggggcgaaagua

SEQ ID NO: 260884 - RNA, 22 nt, Homo sapiens
cuauuugcauucagaggcaugu

SEQ ID NO: 260885 - RNA, 22 nt, Homo sapiens
cucaaguagugguuuucauuga

SEQ ID NO: 260886 - RNA, 18 nt, Homo sapiens
cucacacccuaaucagga

SEQ ID NO: 260887 - RNA, 20 nt, Homo sapiens
cucaccagguguaggcugag

SEQ ID NO: 260888 - RNA, 22 nt, Homo sapiens
cucaccuugugauccuccugcc

SEQ ID NO: 260889 - RNA, 22 nt, Homo sapiens
cucacggcccugcgcacuggca

SEQ ID NO: 260890 - RNA, 22 nt, Homo sapiens
cucacggugcaggcuucuggga

SEQ ID NO: 260891 - RNA, 22 nt, Homo sapiens
cucacugggaccacucugaagu

SEQ ID NO: 260892 - RNA, 22 nt, Homo sapiens
uugcauuagugugguacauuug

SEQ ID NO: 260893 - RNA, 22 nt, Homo sapiens
uugcauugacacaugaagcuca

SEQ ID NO: 260894 - RNA, 22 nt, Homo sapiens
uugccauagugcugccagauau

SEQ ID NO: 260895 - RNA, 22 nt, Homo sapiens
uugcccuuuagguaacuauaua

SEQ ID NO: 260896 - RNA, 22 nt, Homo sapiens
uugccuaggcuggagugcagua

SEQ ID NO: 260897 - RNA, 22 nt, Homo sapiens
uugccuaguuuaggucugugcu

SEQ ID NO: 260898 - RNA, 22 nt, Homo sapiens
uugcuagaugaaaaugguaccu

SEQ ID NO: 260899 - RNA, 22 nt, Homo sapiens
uugcucaggcuagaguucagcu

SEQ ID NO: 260900 - RNA, 22 nt, Homo sapiens
uugcugagucuuucuagguugc

SEQ ID NO: 260901 - RNA, 22 nt, Homo sapiens
uuggaaaccucugcagguguuu

SEQ ID NO: 260902 - RNA, 22 nt, Homo sapiens
uuggaaaguuguuguaguuauu

SEQ ID NO: 260903 - RNA, 22 nt, Homo sapiens
uuggaaaugguaaaggguuaau

SEQ ID NO: 260904 - RNA, 20 nt, Homo sapiens
uuggaaaugugaauugggag

SEQ ID NO: 260905 - RNA, 22 nt, Homo sapiens
uuggaaggcugaauggccucuc

SEQ ID NO: 260906 - RNA, 22 nt, Homo sapiens
uuggaagguaaucaaaaguucu

SEQ ID NO: 260907 - RNA, 22 nt, Homo sapiens
uuggaaugcacacugagccugc

SEQ ID NO: 260908 - RNA, 22 nt, Homo sapiens
uuggaaugugacugauaauauu

SEQ ID NO: 260909 - RNA, 19 nt, Homo sapiens
uuggaauuuuagaguuuga

SEQ ID NO: 260910 - RNA, 22 nt, Homo sapiens
uuggaccacuugauuucugguc

SEQ ID NO: 260911 - RNA, 22 nt, Homo sapiens
uuggacugagaguuccaccauu

SEQ ID NO: 260912 - RNA, 22 nt, Homo sapiens
uuggacugugagguuucguggg

SEQ ID NO: 260913 - RNA, 22 nt, Homo sapiens
uuggagugugcucauaacugcu

SEQ ID NO: 260914 - RNA, 22 nt, Homo sapiens
uuggagugugucuuauuccauu

SEQ ID NO: 260915 - RNA, 22 nt, Homo sapiens
uuggcaaauagguuuuauugca

SEQ ID NO: 260916 - RNA, 22 nt, Homo sapiens
uuggcaaaugucacaaaucagg

SEQ ID NO: 260917 - RNA, 22 nt, Homo sapiens
uuggcaacauagugagaccccc

SEQ ID NO: 260918 - RNA, 22 nt, Homo sapiens
uuggcaauugcuaugauuugaa

SEQ ID NO: 260919 - RNA, 22 nt, Homo sapiens
uuggcagaauguuagaaacuua

SEQ ID NO: 260920 - RNA, 20 nt, Homo sapiens
uuggcagagucuuuagggua

SEQ ID NO: 260921 - RNA, 19 nt, Homo sapiens
uuggcagaguugcccccua

SEQ ID NO: 260922 - RNA, 22 nt, Homo sapiens
uuggcagcuguggaaucugggc

SEQ ID NO: 260923 - RNA, 22 nt, Homo sapiens
uuggcaguaucuacuacagcua

SEQ ID NO: 260924 - RNA, 22 nt, Homo sapiens
uuggcagugcccgaugcugggg

SEQ ID NO: 260925 - RNA, 22 nt, Homo sapiens
uuggccccuccaaaucucaugu

SEQ ID NO: 260926 - RNA, 22 nt, Homo sapiens
uuggccccuuucauccacagcu

SEQ ID NO: 260927 - RNA, 22 nt, Homo sapiens
uuggcuauagauacauggauua

SEQ ID NO: 260928 - RNA, 22 nt, Homo sapiens
uuggcuguguuucccuacaaau

SEQ ID NO: 260929 - RNA, 22 nt, Homo sapiens
uuggcuuaguugaccacagucu

SEQ ID NO: 260930 - RNA, 22 nt, Homo sapiens
uugggacuggaaggaguaaggg

SEQ ID NO: 260931 - RNA, 22 nt, Homo sapiens
uugggcuugagggugcccaguc

SEQ ID NO: 260932 - RNA, 21 nt, Homo sapiens
uuggggaauggagagguuuuc

SEQ ID NO: 260933 - RNA, 22 nt, Homo sapiens
uuggucaggcuagaguguggug

SEQ ID NO: 260934 - RNA, 22 nt, Homo sapiens
uugguccucccaugcucaagag

SEQ ID NO: 260935 - RNA, 20 nt, Homo sapiens
uuggugaccuguuugguauu

SEQ ID NO: 260936 - RNA, 22 nt, Homo sapiens
uugguucucuuagccaucuuaa

SEQ ID NO: 260937 - RNA, 22 nt, Homo sapiens
uuguaaagaucauaugcuguuc

SEQ ID NO: 260938 - RNA, 22 nt, Homo sapiens
uuguaaagucugucucagucag

SEQ ID NO: 260939 - RNA, 22 nt, Homo sapiens
uuguaacaugcuuucacuucag

SEQ ID NO: 260940 - RNA, 22 nt, Homo sapiens
uuguaagaaucuagcucuuuau

SEQ ID NO: 260941 - RNA, 22 nt, Homo sapiens
uuguacuagucauauuuugaaa

SEQ ID NO: 260942 - RNA, 22 nt, Homo sapiens
uuguacuauuuuuaucagugau

SEQ ID NO: 260943 - RNA, 20 nt, Homo sapiens
uuguacuccugggcucaagc

SEQ ID NO: 260944 - RNA, 22 nt, Homo sapiens
uuguacuucagacaugccaaag

SEQ ID NO: 260945 - RNA, 22 nt, Homo sapiens
uuguagaucuucaguugcuaca

SEQ ID NO: 260946 - RNA, 22 nt, Homo sapiens
uuguauacucuauuuuagcagu

SEQ ID NO: 260947 - RNA, 22 nt, Homo sapiens
uuguauguuguuugucagagaa

SEQ ID NO: 260948 - RNA, 22 nt, Homo sapiens
uuguauguuucugugcacauga

SEQ ID NO: 260949 - RNA, 22 nt, Homo sapiens
uuguccaagucccauuuguuga

SEQ ID NO: 260950 - RNA, 22 nt, Homo sapiens
uuguccccaucugcugccagaa

SEQ ID NO: 260951 - RNA, 22 nt, Homo sapiens
uuguccccuuccaaaucucaug

SEQ ID NO: 260952 - RNA, 22 nt, Homo sapiens
uuguccuugagauaguuugcag

SEQ ID NO: 260953 - RNA, 21 nt, Homo sapiens
uugucuagagaaauauaucuc

SEQ ID NO: 260954 - RNA, 19 nt, Homo sapiens
uugucuuagaguugucauu

SEQ ID NO: 260955 - RNA, 22 nt, Homo sapiens
uugugaauggugccacaauaaa

SEQ ID NO: 260956 - RNA, 22 nt, Homo sapiens
uugugacacagcugggccuaua

SEQ ID NO: 260957 - RNA, 22 nt, Homo sapiens
uugugagggagcuaagaugagu

SEQ ID NO: 260958 - RNA, 22 nt, Homo sapiens
uugugauugagugauccuuguu

SEQ ID NO: 260959 - RNA, 22 nt, Homo sapiens
uugugcauaucagagguuugcu

SEQ ID NO: 260960 - RNA, 22 nt, Homo sapiens
uugugcuugauuugccuagcug

SEQ ID NO: 260961 - RNA, 22 nt, Homo sapiens
uugugcuuguaacuacauucag

SEQ ID NO: 260962 - RNA, 22 nt, Homo sapiens
uugugcuuuugagcugagauga

SEQ ID NO: 260963 - RNA, 22 nt, Homo sapiens
uugugggaggugauuagaucau

SEQ ID NO: 260964 - RNA, 22 nt, Homo sapiens
uugugguaaucugugacagcag

SEQ ID NO: 260965 - RNA, 22 nt, Homo sapiens
uugugguaggaguugccauguu

SEQ ID NO: 260966 - RNA, 22 nt, Homo sapiens
uugugguagugaaugagucuca

SEQ ID NO: 260967 - RNA, 22 nt, Homo sapiens
uugugguuuucagcuuauauau

SEQ ID NO: 260968 - RNA, 22 nt, Homo sapiens
uuguucaggagguuggggaugc

SEQ ID NO: 260969 - RNA, 22 nt, Homo sapiens
uuguugcacugcuuuccuggcc

SEQ ID NO: 260970 - RNA, 22 nt, Homo sapiens
uuuaaagcuaaaauauguuuau

SEQ ID NO: 260971 - RNA, 22 nt, Homo sapiens
uuuaauguuacaguauugguau

SEQ ID NO: 260972 - RNA, 22 nt, Homo sapiens
uuuagcagcaaagagcuguguu

SEQ ID NO: 260973 - RNA, 22 nt, Homo sapiens
uuuagguaauauuaaguagcug

SEQ ID NO: 260974 - RNA, 22 nt, Homo sapiens
uuuaguacugcuuuaugugugu

SEQ ID NO: 260975 - RNA, 22 nt, Homo sapiens
uuuauagucaggaacuugagga

SEQ ID NO: 260976 - RNA, 22 nt, Homo sapiens
uuuaugcuacauguguuggaaa

SEQ ID NO: 260977 - RNA, 21 nt, Homo sapiens
uagauacuguauuaaaccuag

SEQ ID NO: 260978 - RNA, 21 nt, Homo sapiens
uagauaguugguucugaaucu

SEQ ID NO: 260979 - RNA, 22 nt, Homo sapiens
uagauucauuuuagcaaaaguu

SEQ ID NO: 260980 - RNA, 22 nt, Homo sapiens
uagauuguaauaugcagaaugg

SEQ ID NO: 260981 - RNA, 22 nt, Homo sapiens
uagcaacauucagcucagguac

SEQ ID NO: 260982 - RNA, 17 nt, Homo sapiens
uagcacagugccuggua

SEQ ID NO: 260983 - RNA, 22 nt, Homo sapiens
uagcacaucccuaaaaugcugu

SEQ ID NO: 260984 - RNA, 22 nt, Homo sapiens
uagcaccacaaucaagauacag

SEQ ID NO: 260985 - RNA, 22 nt, Homo sapiens
uagcaccaggguugacugaccu

SEQ ID NO: 260986 - RNA, 22 nt, Homo sapiens
uagcacuauguuaucacauacu

SEQ ID NO: 260987 - RNA, 20 nt, Homo sapiens
uagcagcagacagagggagg

SEQ ID NO: 260988 - RNA, 22 nt, Homo sapiens
uagcagcagugguguauuuaga

SEQ ID NO: 260989 - RNA, 22 nt, Homo sapiens
uagcagcauuuuuguagaguau

SEQ ID NO: 260990 - RNA, 22 nt, Homo sapiens
uagcagcuuuauugagguaaau

SEQ ID NO: 260991 - RNA, 22 nt, Homo sapiens
uagcaguagacagacuuuggcu

SEQ ID NO: 260992 - RNA, 22 nt, Homo sapiens
uagcaguauggagcgaggccca

SEQ ID NO: 260993 - RNA, 21 nt, Homo sapiens
uagcauacauuuugcaucuua

SEQ ID NO: 260994 - RNA, 22 nt, Homo sapiens
uagcaucaauucauguuaugau

SEQ ID NO: 260995 - RNA, 22 nt, Homo sapiens
uagcaugacacuuguugaaugc

SEQ ID NO: 260996 - RNA, 18 nt, Homo sapiens
uagcaugaugcugagugc

SEQ ID NO: 260997 - RNA, 22 nt, Homo sapiens
uagcugcaaaauauagacuucu

SEQ ID NO: 260998 - RNA, 22 nt, Homo sapiens
uagcugcauccugugcacucaa

SEQ ID NO: 260999 - RNA, 22 nt, Homo sapiens
uagcugcccagcacgaaguugg

SEQ ID NO: 261000 - RNA, 22 nt, Homo sapiens
uagcuucuccauagcuccaugu

SEQ ID NO: 261001 - RNA, 22 nt, Homo sapiens
uaggagcacaaacccuacugug

SEQ ID NO: 261002 - RNA, 22 nt, Homo sapiens
uaggcaaaugcaagaguagaac

SEQ ID NO: 261003 - RNA, 22 nt, Homo sapiens
uaggcacuguguuuguaggagu

SEQ ID NO: 261004 - RNA, 22 nt, Homo sapiens
uaggcuuuuggacccugucucu

SEQ ID NO: 261005 - RNA, 22 nt, Homo sapiens
uagggcauguguggaguguaug

SEQ ID NO: 261006 - RNA, 22 nt, Homo sapiens
uagguaaguaauauacagauga

SEQ ID NO: 261007 - RNA, 19 nt, Homo sapiens
uagguacauucaagucucc

SEQ ID NO: 261008 - RNA, 22 nt, Homo sapiens
uagguacuuuacauguuaucuc

SEQ ID NO: 261009 - RNA, 22 nt, Homo sapiens
uaggucaguuuuggcuuggcuu

SEQ ID NO: 261010 - RNA, 22 nt, Homo sapiens
uaggucuuuuagcauaggagcu

SEQ ID NO: 261011 - RNA, 22 nt, Homo sapiens
uaggugauccauuuguauuuua

SEQ ID NO: 261012 - RNA, 22 nt, Homo sapiens
uaggugcacaguaaauauaugu

SEQ ID NO: 261013 - RNA, 22 nt, Homo sapiens
uagguucucaggaaugagcuuc

SEQ ID NO: 261014 - RNA, 22 nt, Homo sapiens
uaguagcauaccuaaguauacu

SEQ ID NO: 261015 - RNA, 22 nt, Homo sapiens
uaguauguuuauagcauugagu

SEQ ID NO: 261016 - RNA, 22 nt, Homo sapiens
uagucaaaucugaaggaaauuu

SEQ ID NO: 261017 - RNA, 22 nt, Homo sapiens
uagucagcaauguucauguucu

SEQ ID NO: 261018 - RNA, 22 nt, Homo sapiens
uagugaauguuggcuauuaaua

SEQ ID NO: 261019 - RNA, 22 nt, Homo sapiens
uagugcuagaugacuuugccau

SEQ ID NO: 261020 - RNA, 22 nt, Homo sapiens
uagugcugagauugagaagccc

SEQ ID NO: 261021 - RNA, 22 nt, Homo sapiens
aauaugucugcuaauuguuucu

SEQ ID NO: 261022 - RNA, 22 nt, Homo sapiens
aaucaacauuguuuuaagucaa

SEQ ID NO: 261023 - RNA, 22 nt, Homo sapiens
aaucacacuugauguugagcaa

SEQ ID NO: 261024 - RNA, 22 nt, Homo sapiens
aaucacauugaaucugcuaccu

SEQ ID NO: 261025 - RNA, 22 nt, Homo sapiens
aaucacuaugccaugaaguaca

SEQ ID NO: 261026 - RNA, 22 nt, Homo sapiens
aaucauauugucugccaagagg

SEQ ID NO: 261027 - RNA, 22 nt, Homo sapiens
aaucccugagcuagacacaaag

SEQ ID NO: 261028 - RNA, 22 nt, Homo sapiens
aaugacugugauauuuuucuuc

SEQ ID NO: 261029 - RNA, 22 nt, Homo sapiens
aaugauacuguguacaagggca

SEQ ID NO: 261030 - RNA, 22 nt, Homo sapiens
aauggcaaauguuuucuguuga

SEQ ID NO: 261031 - RNA, 22 nt, Homo sapiens
aauggcacaagacaugaagaag

SEQ ID NO: 261032 - RNA, 22 nt, Homo sapiens
aauggcacuuuauaaauguuaa

SEQ ID NO: 261033 - RNA, 22 nt, Homo sapiens
aauggcagaugaaauugucauu

SEQ ID NO: 261034 - RNA, 22 nt, Homo sapiens
aauggcauuugccagggcaaag

SEQ ID NO: 261035 - RNA, 22 nt, Homo sapiens
aauggcucuguuggcccaagac

SEQ ID NO: 261036 - RNA, 22 nt, Homo sapiens
aauggcucuuccuggaguugug

SEQ ID NO: 261037 - RNA, 22 nt, Homo sapiens
aauggcuuuuaauauccauaau

SEQ ID NO: 261038 - RNA, 22 nt, Homo sapiens
aaugugcacuuggagccuugcu

SEQ ID NO: 261039 - RNA, 22 nt, Homo sapiens
aaugugcuuucuuucacacagu

SEQ ID NO: 261040 - RNA, 22 nt, Homo sapiens
aauuaguugucgugagaguggu

SEQ ID NO: 261041 - RNA, 22 nt, Homo sapiens
aauugccucaagugaucauggc

SEQ ID NO: 261042 - RNA, 22 nt, Homo sapiens
aauuguacucccauaauucccu

SEQ ID NO: 261043 - RNA, 22 nt, Homo sapiens
aauugugcuuguaggccaggca

SEQ ID NO: 261044 - RNA, 21 nt, Homo sapiens
acaaagcuggagggagacugc

SEQ ID NO: 261045 - RNA, 22 nt, Homo sapiens
acaaaguauggaauguuggugu

SEQ ID NO: 261046 - RNA, 22 nt, Homo sapiens
acaaagugccuccuuuuagagu

SEQ ID NO: 261047 - RNA, 20 nt, Homo sapiens
acaaaugcauucugugacau

SEQ ID NO: 261048 - RNA, 22 nt, Homo sapiens
acaagacuucuuguauucuagu

SEQ ID NO: 261049 - RNA, 22 nt, Homo sapiens
acaagcacaaauuuaauccugu

SEQ ID NO: 261050 - RNA, 22 nt, Homo sapiens
acaagugaauacaggauucucu

SEQ ID NO: 261051 - RNA, 22 nt, Homo sapiens
acacaguaaauauugucuccuc

SEQ ID NO: 261052 - RNA, 22 nt, Homo sapiens
acacagugucuguguauuuaaa

SEQ ID NO: 261053 - RNA, 22 nt, Homo sapiens
acacaguguuuauugugguuag

SEQ ID NO: 261054 - RNA, 22 nt, Homo sapiens
acacauuagcaagugcuguuau

SEQ ID NO: 261055 - RNA, 22 nt, Homo sapiens
acaccaugucuguuucugguuu

SEQ ID NO: 261056 - RNA, 22 nt, Homo sapiens
acacuauugagguuuguuugca

SEQ ID NO: 261057 - RNA, 22 nt, Homo sapiens
acacucuaguguucuuaaucag

SEQ ID NO: 261058 - RNA, 20 nt, Homo sapiens
acacuggaguaucaaggccc

SEQ ID NO: 261059 - RNA, 22 nt, Homo sapiens
acacuguuggugggaguguaaa

SEQ ID NO: 261060 - RNA, 22 nt, Homo sapiens
acacuguuuuguggagaaugua

SEQ ID NO: 261061 - RNA, 22 nt, Homo sapiens
acagaacugggcuugcuuuugg

SEQ ID NO: 261062 - RNA, 22 nt, Homo sapiens
agcaccauugcacuccagccug

SEQ ID NO: 261063 - RNA, 22 nt, Homo sapiens
agcaccauuguacuccagccug

SEQ ID NO: 261064 - RNA, 22 nt, Homo sapiens
agcacuacugcacuccagccug

SEQ ID NO: 261065 - RNA, 22 nt, Homo sapiens
agcagauguuuagugagcgccu

SEQ ID NO: 261066 - RNA, 22 nt, Homo sapiens
agcagcauggguauaaaucucc

SEQ ID NO: 261067 - RNA, 22 nt, Homo sapiens
agcagguguggcuuauccugaa

SEQ ID NO: 261068 - RNA, 18 nt, Homo sapiens
agcaucacugaucauccu

SEQ ID NO: 261069 - RNA, 20 nt, Homo sapiens
agcaucagugguaguguugc

SEQ ID NO: 261070 - RNA, 22 nt, Homo sapiens
agcaucauaccaaucugguccu

SEQ ID NO: 261071 - RNA, 22 nt, Homo sapiens
agcaucaugcaguugcuauuca

SEQ ID NO: 261072 - RNA, 22 nt, Homo sapiens
agcaucauguuuucgagguuca

SEQ ID NO: 261073 - RNA, 22 nt, Homo sapiens
agccaguauuuugaguuggucu

SEQ ID NO: 261074 - RNA, 21 nt, Homo sapiens
agccaguguuccuuguggcuc

SEQ ID NO: 261075 - RNA, 22 nt, Homo sapiens
agccauacaacguaugcaugua

SEQ ID NO: 261076 - RNA, 22 nt, Homo sapiens
agcccuuagauggcuccuucca

SEQ ID NO: 261077 - RNA, 23 nt, Homo sapiens
agccugguuucccugcuucuccc

SEQ ID NO: 261078 - RNA, 22 nt, Homo sapiens
agccuucauucugacaguagga

SEQ ID NO: 261079 - RNA, 22 nt, Homo sapiens
agcggcuguuccccuggucuau

SEQ ID NO: 261080 - RNA, 18 nt, Homo sapiens
agcucaguguuugcuuac

SEQ ID NO: 261081 - RNA, 22 nt, Homo sapiens
agcucauugcaaccuccgccuc

SEQ ID NO: 261082 - RNA, 22 nt, Homo sapiens
agcuccuacuguuacaucauug

SEQ ID NO: 261083 - RNA, 22 nt, Homo sapiens
agcugcaauguuuaguauaaua

SEQ ID NO: 261084 - RNA, 16 nt, Homo sapiens
agcuggaauuacaggc

SEQ ID NO: 261085 - RNA, 23 nt, Homo sapiens
agcugguacuagaggcuugcgcc

SEQ ID NO: 261086 - RNA, 22 nt, Homo sapiens
agcugguauuuguuagggaguu

SEQ ID NO: 261087 - RNA, 22 nt, Homo sapiens
agcuggucucaggugcccugcu

SEQ ID NO: 261088 - RNA, 20 nt, Homo sapiens
agcugguuuuaugaaucuuu

SEQ ID NO: 261089 - RNA, 20 nt, Homo sapiens
agcuguuguuaugagguuua

SEQ ID NO: 261090 - RNA, 22 nt, Homo sapiens
agcuuaugcuuggaagagauga

SEQ ID NO: 261091 - RNA, 22 nt, Homo sapiens
agcuucauuccaacuuccuucu

SEQ ID NO: 261092 - RNA, 22 nt, Homo sapiens
agcuucauucugaauagguuga

SEQ ID NO: 261093 - RNA, 22 nt, Homo sapiens
agcuuguuuuauagaaagucaa

SEQ ID NO: 261094 - RNA, 22 nt, Homo sapiens
agcuuguuuuccugcaacuaga

SEQ ID NO: 261095 - RNA, 22 nt, Homo sapiens
agcuuuuugggcagcuauugac

SEQ ID NO: 261096 - RNA, 22 nt, Homo sapiens
aggaaaucuuagcugaggggau

SEQ ID NO: 261097 - RNA, 22 nt, Homo sapiens
aggaacuguaacuaugucucug

SEQ ID NO: 261098 - RNA, 21 nt, Homo sapiens
aggaagacuaugaucaauugg

SEQ ID NO: 261099 - RNA, 23 nt, Homo sapiens
aggaauggaaaaccaaguaucau

SEQ ID NO: 261100 - RNA, 18 nt, Homo sapiens
aggaaugguaauacuuca

SEQ ID NO: 261101 - RNA, 22 nt, Homo sapiens
aggagcacaggacuuugauuau

SEQ ID NO: 261102 - RNA, 21 nt, Homo sapiens
aggagcauucaugacgagguu

SEQ ID NO: 261103 - RNA, 22 nt, Homo sapiens
aggagcuuuggggaaaacagau

SEQ ID NO: 261104 - RNA, 22 nt, Homo sapiens
aggagguagaacauugccauuu

SEQ ID NO: 261105 - RNA, 22 nt, Homo sapiens
aggagguagucugucccuuagc

SEQ ID NO: 261106 - RNA, 22 nt, Homo sapiens
aggagguugguaccaucuguuu

SEQ ID NO: 261107 - RNA, 22 nt, Homo sapiens
ugucacugugaguuugacugcu

SEQ ID NO: 261108 - RNA, 22 nt, Homo sapiens
ugucacuuugccuucuggacuu

SEQ ID NO: 261109 - RNA, 22 nt, Homo sapiens
ugucaguggucuggaugcagcc

SEQ ID NO: 261110 - RNA, 22 nt, Homo sapiens
ugucaguguaugagccccggau

SEQ ID NO: 261111 - RNA, 22 nt, Homo sapiens
ugucaguuucaguguuagccuu

SEQ ID NO: 261112 - RNA, 22 nt, Homo sapiens
ugucaucauuggaaucugccuc

SEQ ID NO: 261113 - RNA, 22 nt, Homo sapiens
ugucaugaaauauguuuuucua

SEQ ID NO: 261114 - RNA, 21 nt, Homo sapiens
ugucaugcagagacccuggag

SEQ ID NO: 261115 - RNA, 22 nt, Homo sapiens
ugucauggauucugagucuggg

SEQ ID NO: 261116 - RNA, 22 nt, Homo sapiens
ugucauguauauaccacuucca

SEQ ID NO: 261117 - RNA, 22 nt, Homo sapiens
ugucaugucuuuguguaucaau

SEQ ID NO: 261118 - RNA, 22 nt, Homo sapiens
ugucauuguggugcagauauaa

SEQ ID NO: 261119 - RNA, 22 nt, Homo sapiens
uguccaguguuccucagaagaa

SEQ ID NO: 261120 - RNA, 18 nt, Homo sapiens
ugucccuuugcuguucau

SEQ ID NO: 261121 - RNA, 22 nt, Homo sapiens
ugucuacugaugauguaguuaa

SEQ ID NO: 261122 - RNA, 22 nt, Homo sapiens
ugucuagaucugaauguaauug

SEQ ID NO: 261123 - RNA, 22 nt, Homo sapiens
ugucugagacuguuuuacuuuc

SEQ ID NO: 261124 - RNA, 22 nt, Homo sapiens
ugucuguuugcgaaauugcuuc

SEQ ID NO: 261125 - RNA, 22 nt, Homo sapiens
ugucuugagagaggacaugacu

SEQ ID NO: 261126 - RNA, 21 nt, Homo sapiens
ugugaaaucuaggcagagguu

SEQ ID NO: 261127 - RNA, 22 nt, Homo sapiens
ugugaacauuuuguauauauua

SEQ ID NO: 261128 - RNA, 22 nt, Homo sapiens
ugugaagauggacuaauauagu

SEQ ID NO: 261129 - RNA, 22 nt, Homo sapiens
ugugacagcacgguucaacugc

SEQ ID NO: 261130 - RNA, 22 nt, Homo sapiens
ugugacagguauccuguguucu

SEQ ID NO: 261131 - RNA, 22 nt, Homo sapiens
ugugacaguuaguuugguguua

SEQ ID NO: 261132 - RNA, 19 nt, Homo sapiens
ugugacugguugucucgcu

SEQ ID NO: 261133 - RNA, 22 nt, Homo sapiens
ugugagacugacagggcagggu

SEQ ID NO: 261134 - RNA, 19 nt, Homo sapiens
ugugagcauuagcauuuag

SEQ ID NO: 261135 - RNA, 22 nt, Homo sapiens
ugugagcuauggaguuguagag

SEQ ID NO: 261136 - RNA, 19 nt, Homo sapiens
ugugauaguugaaccugcc

SEQ ID NO: 261137 - RNA, 22 nt, Homo sapiens
ugugaucaugguauuaaucugc

SEQ ID NO: 261138 - RNA, 22 nt, Homo sapiens
ugugaugauuugauaaacguau

SEQ ID NO: 261139 - RNA, 22 nt, Homo sapiens
ugugcaaggcucucaaccugug

SEQ ID NO: 261140 - RNA, 22 nt, Homo sapiens
ugugcaaucagcuucauuacau

SEQ ID NO: 261141 - RNA, 22 nt, Homo sapiens
ugugcacaaugugcagguuuga

SEQ ID NO: 261142 - RNA, 22 nt, Homo sapiens
ugugcaccucuucacacaggga

SEQ ID NO: 261143 - RNA, 22 nt, Homo sapiens
ugugcauaugucuuuauaguag

SEQ ID NO: 261144 - RNA, 22 nt, Homo sapiens
ugugcaugacagcauacaaacg

SEQ ID NO: 261145 - RNA, 22 nt, Homo sapiens
ugugccacuccagcucuagcuu

SEQ ID NO: 261146 - RNA, 22 nt, Homo sapiens
ugugccacuguucuguaaagug

SEQ ID NO: 261147 - RNA, 22 nt, Homo sapiens
ugugccuucuaagaaggagucu

SEQ ID NO: 261148 - RNA, 22 nt, Homo sapiens
ugugcgugugccuguaagaauu

SEQ ID NO: 261149 - RNA, 22 nt, Homo sapiens
ugugcuauguuauucacauggg

SEQ ID NO: 261150 - RNA, 22 nt, Homo sapiens
uguggcauuuucagaaaggaug

SEQ ID NO: 261151 - RNA, 22 nt, Homo sapiens
uguggcucuucuguucuccacu

SEQ ID NO: 261152 - RNA, 22 nt, Homo sapiens
uguggcuuuguaaccauggguc

SEQ ID NO: 261153 - RNA, 22 nt, Homo sapiens
uguggcuuuuucuuggcugagg

SEQ ID NO: 261154 - RNA, 22 nt, Homo sapiens
uguguauaucacugcaugagug

SEQ ID NO: 261155 - RNA, 22 nt, Homo sapiens
ugugucuugaauuuuguaugua

SEQ ID NO: 261156 - RNA, 22 nt, Homo sapiens
ugugucuugagagucucgagaa

SEQ ID NO: 261157 - RNA, 22 nt, Homo sapiens
ugugucuugcuggugccugcau

SEQ ID NO: 261158 - RNA, 22 nt, Homo sapiens
ugugucuuguuuuuucccaggc

SEQ ID NO: 261159 - RNA, 22 nt, Homo sapiens
ugugucuuuuaucacacaaugu

SEQ ID NO: 261160 - RNA, 22 nt, Homo sapiens
uguguuuuuauguaaaauggaa

SEQ ID NO: 261161 - RNA, 22 nt, Homo sapiens
uguuacagcagaauugaaagag

SEQ ID NO: 261162 - RNA, 22 nt, Homo sapiens
uguuaugaagaugccugguaca

SEQ ID NO: 261163 - RNA, 22 nt, Homo sapiens
uguuauguucuacuuuuaggug

SEQ ID NO: 261164 - RNA, 22 nt, Homo sapiens
uguuauguuguuugagaaaguc

SEQ ID NO: 261165 - RNA, 22 nt, Homo sapiens
uguuauuuuguguuagggcaca

SEQ ID NO: 261166 - RNA, 22 nt, Homo sapiens
uguucacaguguuucuuugaga

SEQ ID NO: 261167 - RNA, 22 nt, Homo sapiens
uguucuggagaguuuagucugg

SEQ ID NO: 261168 - RNA, 22 nt, Homo sapiens
uguucuggagccgguucaaaug

SEQ ID NO: 261169 - RNA, 19 nt, Homo sapiens
uguugcacuccagcuuggg

SEQ ID NO: 261170 - RNA, 22 nt, Homo sapiens
uguuugguggucucuucacaug

SEQ ID NO: 261171 - RNA, 22 nt, Homo sapiens
uguuuguuugauaugggauaaa

SEQ ID NO: 261172 - RNA, 22 nt, Homo sapiens
uguuuuguuagcacucugggaa

SEQ ID NO: 261173 - RNA, 22 nt, Homo sapiens
uuaaaguauaguuccucugguu

SEQ ID NO: 261174 - RNA, 22 nt, Homo sapiens
uuaaagugcacacgggucaggc

SEQ ID NO: 261175 - RNA, 22 nt, Homo sapiens
uuaaaugucuguagaugugcug

SEQ ID NO: 261176 - RNA, 21 nt, Homo sapiens
uuaacagacaagugucuuccc

SEQ ID NO: 261177 - RNA, 22 nt, Homo sapiens
uuaacagucacuuagcucauuu

SEQ ID NO: 261178 - RNA, 22 nt, Homo sapiens
uuaacagugucaaucuguagua

SEQ ID NO: 261179 - RNA, 22 nt, Homo sapiens
uuaagacaccaaucauuggauu

SEQ ID NO: 261180 - RNA, 22 nt, Homo sapiens
uuaagccacucaagagauagag

SEQ ID NO: 261181 - RNA, 22 nt, Homo sapiens
uuaaucucaggaguuugggacc

SEQ ID NO: 261182 - RNA, 22 nt, Homo sapiens
cugugcauggauuuuaagauug

SEQ ID NO: 261183 - RNA, 19 nt, Homo sapiens
cugugcauuucuguggaag

SEQ ID NO: 261184 - RNA, 22 nt, Homo sapiens
cuguggauguauugcacagucu

SEQ ID NO: 261185 - RNA, 22 nt, Homo sapiens
cuguggguuuuacuguuuuacu

SEQ ID NO: 261186 - RNA, 23 nt, Homo sapiens
cuguggugaggcccuagaaucug

SEQ ID NO: 261187 - RNA, 22 nt, Homo sapiens
cuguuauguucuagagggugca

SEQ ID NO: 261188 - RNA, 22 nt, Homo sapiens
cuguugguuaaauuccaugcag

SEQ ID NO: 261189 - RNA, 22 nt, Homo sapiens
cuguuugaggguuugcuuucag

SEQ ID NO: 261190 - RNA, 22 nt, Homo sapiens
cuguuugauuaagugguggaaa

SEQ ID NO: 261191 - RNA, 22 nt, Homo sapiens
cuuaaagcgaauauugguggua

SEQ ID NO: 261192 - RNA, 22 nt, Homo sapiens
cuuaaguaguuguggaaugaau

SEQ ID NO: 261193 - RNA, 19 nt, Homo sapiens
cuuaggugaccaguuccca

SEQ ID NO: 261194 - RNA, 17 nt, Homo sapiens
cuucaaauaauuucccc

SEQ ID NO: 261195 - RNA, 22 nt, Homo sapiens
cuucacggugccuacuuguguc

SEQ ID NO: 261196 - RNA, 22 nt, Homo sapiens
cuucaucugguuugugaacuuu

SEQ ID NO: 261197 - RNA, 22 nt, Homo sapiens
cuucaugggagaaccacaggua

SEQ ID NO: 261198 - RNA, 18 nt, Homo sapiens
cuucauugcuguuuugcu

SEQ ID NO: 261199 - RNA, 22 nt, Homo sapiens
cuuccugaguccugggcucaca

SEQ ID NO: 261200 - RNA, 22 nt, Homo sapiens
cuucucagugcucaucuuauuu

SEQ ID NO: 261201 - RNA, 22 nt, Homo sapiens
cuucuguuaguucugauaacuu

SEQ ID NO: 261202 - RNA, 22 nt, Homo sapiens
cuucuugagggccugcugggaa

SEQ ID NO: 261203 - RNA, 21 nt, Homo sapiens
cuucuuggggcagggcagggu

SEQ ID NO: 261204 - RNA, 20 nt, Homo sapiens
cuugaagacuaugcugcuga

SEQ ID NO: 261205 - RNA, 22 nt, Homo sapiens
cuugacacugucacucaggcca

SEQ ID NO: 261206 - RNA, 22 nt, Homo sapiens
cuugaccaauauggugaaaccc

SEQ ID NO: 261207 - RNA, 22 nt, Homo sapiens
cuugaccuauggaucuguuuuu

SEQ ID NO: 261208 - RNA, 22 nt, Homo sapiens
cuugagacauuguuuuccaagu

SEQ ID NO: 261209 - RNA, 22 nt, Homo sapiens
cuugagcaaacaaaggugguag

SEQ ID NO: 261210 - RNA, 22 nt, Homo sapiens
cuugaucaaugugguacuugau

SEQ ID NO: 261211 - RNA, 22 nt, Homo sapiens
cuugcacuagugcagaggcgcu

SEQ ID NO: 261212 - RNA, 22 nt, Homo sapiens
cuugcauagaguuauugcccuu

SEQ ID NO: 261213 - RNA, 19 nt, Homo sapiens
cuugccccauucauccucu

SEQ ID NO: 261214 - RNA, 22 nt, Homo sapiens
cuuggacaccucaugcccaccu

SEQ ID NO: 261215 - RNA, 22 nt, Homo sapiens
cuugugccugaucuuagggggc

SEQ ID NO: 261216 - RNA, 22 nt, Homo sapiens
cuuguguuacauauuuaagaga

SEQ ID NO: 261217 - RNA, 17 nt, Homo sapiens
cuuguugugguaguuug

SEQ ID NO: 261218 - RNA, 21 nt, Homo sapiens
cuuuaugcuguguuagaaaag

SEQ ID NO: 261219 - RNA, 22 nt, Homo sapiens
cuuugcaaauggccuuuccaag

SEQ ID NO: 261220 - RNA, 22 nt, Homo sapiens
cuuuggauggaaccucucuuuc

SEQ ID NO: 261221 - RNA, 21 nt, Homo sapiens
cuuugguagaguuuuuagggu

SEQ ID NO: 261222 - RNA, 22 nt, Homo sapiens
cuuuguggggucuuuccucaaa

SEQ ID NO: 261223 - RNA, 21 nt, Homo sapiens
cuuuugcacuccagccugggu

SEQ ID NO: 261224 - RNA, 22 nt, Homo sapiens
cuuuugugauucuucaguuacu

SEQ ID NO: 261225 - RNA, 22 nt, Homo sapiens
gaaaguguugagauuacaggca

SEQ ID NO: 261226 - RNA, 22 nt, Homo sapiens
gaaaucucuacuauuuugaucu

SEQ ID NO: 261227 - RNA, 22 nt, Homo sapiens
gaaaugcucauuuuggauccuu

SEQ ID NO: 261228 - RNA, 22 nt, Homo sapiens
gaaauggaucagagcaagcuuu

SEQ ID NO: 261229 - RNA, 22 nt, Homo sapiens
gaaauguauuaaugaguugaaa

SEQ ID NO: 261230 - RNA, 22 nt, Homo sapiens
gaacugggguuggguugcgaua

SEQ ID NO: 261231 - RNA, 22 nt, Homo sapiens
gaacuguaaagaaauucuaagg

SEQ ID NO: 261232 - RNA, 22 nt, Homo sapiens
gaacuuucuacauuaccucuuu

SEQ ID NO: 261233 - RNA, 22 nt, Homo sapiens
gaagacauuugcugcacguccu

SEQ ID NO: 261234 - RNA, 22 nt, Homo sapiens
gaaggagcuuaucugccauuuc

SEQ ID NO: 261235 - RNA, 17 nt, Homo sapiens
gaaguguuucuucauga

SEQ ID NO: 261236 - RNA, 19 nt, Homo sapiens
gaaguguuuguucuccaug

SEQ ID NO: 261237 - RNA, 22 nt, Homo sapiens
gaauaaacuagagaggacugag

SEQ ID NO: 261238 - RNA, 22 nt, Homo sapiens
gaaucacagauuaugaguaucu

SEQ ID NO: 261239 - RNA, 22 nt, Homo sapiens
gaaucacaguuauuagagcagc

SEQ ID NO: 261240 - RNA, 22 nt, Homo sapiens
gaaugcagcagugacagggcug

SEQ ID NO: 261241 - RNA, 22 nt, Homo sapiens
gaauggaacugacuauagcuga

SEQ ID NO: 261242 - RNA, 22 nt, Homo sapiens
gacaaguuugauuuauuccaag

SEQ ID NO: 261243 - RNA, 22 nt, Homo sapiens
gacagugugauacuuagucuca

SEQ ID NO: 261244 - RNA, 18 nt, Homo sapiens
gacaguguggcaauuccu

SEQ ID NO: 261245 - RNA, 22 nt, Homo sapiens
gacaguuuggugaggaagacga

SEQ ID NO: 261246 - RNA, 22 nt, Homo sapiens
gacauguuucucucuguuuacu

SEQ ID NO: 261247 - RNA, 20 nt, Homo sapiens
gacauguuuuguggccuaac

SEQ ID NO: 261248 - RNA, 22 nt, Homo sapiens
gacccuuagaaugugaucuuau

SEQ ID NO: 261249 - RNA, 22 nt, Homo sapiens
gaccugagagguacauguauuu

SEQ ID NO: 261250 - RNA, 22 nt, Homo sapiens
gacguagagaaaugugaaaugg

SEQ ID NO: 261251 - RNA, 22 nt, Homo sapiens
gacuagaaauuauuuagugagc

SEQ ID NO: 261252 - RNA, 22 nt, Homo sapiens
gacuagggaccaugagcaaucc

SEQ ID NO: 261253 - RNA, 19 nt, Homo sapiens
gacuccagaguugugugcu

SEQ ID NO: 261254 - RNA, 18 nt, Homo sapiens
gacuccauuucagccaga

SEQ ID NO: 261255 - RNA, 22 nt, Homo sapiens
gacuggagcuguaugugguuac

SEQ ID NO: 261256 - RNA, 18 nt, Homo sapiens
gacuuggaguuuacagug

SEQ ID NO: 261257 - RNA, 22 nt, Homo sapiens
gacuuugguaaacucgguggca

SEQ ID NO: 261258 - RNA, 22 nt, Homo sapiens
gacuuugguagaggaaaaaucu

SEQ ID NO: 261259 - RNA, 22 nt, Homo sapiens
gagaaccauuuggagaaaaagu

SEQ ID NO: 261260 - RNA, 22 nt, Homo sapiens
gagaacuaaugguuugauaagg

SEQ ID NO: 261261 - RNA, 22 nt, Homo sapiens
gagaaugaacagacugccucuu

SEQ ID NO: 261262 - RNA, 22 nt, Homo sapiens
gagaaugaugauuuccaauuuc

SEQ ID NO: 261263 - RNA, 22 nt, Homo sapiens
gagacugagucucacucuguca

SEQ ID NO: 261264 - RNA, 22 nt, Homo sapiens
gagacugagucuugcccuguca

SEQ ID NO: 261265 - RNA, 22 nt, Homo sapiens
gagacugagucuugcucugucg

SEQ ID NO: 261266 - RNA, 22 nt, Homo sapiens
gagagcaugugcuggcaucagu

SEQ ID NO: 261267 - RNA, 22 nt, Homo sapiens
gagagcauuaagccaucaucau

SEQ ID NO: 261268 - RNA, 22 nt, Homo sapiens
gagauauuuagaaauguguucu

SEQ ID NO: 261269 - RNA, 22 nt, Homo sapiens
gagaucaaguauucuccacuaa

SEQ ID NO: 261270 - RNA, 22 nt, Homo sapiens
gagaucuuggccaaguuucuua

SEQ ID NO: 261271 - RNA, 22 nt, Homo sapiens
cuggaaagaaacccuuaauucu

SEQ ID NO: 261272 - RNA, 22 nt, Homo sapiens
cuggaaaguagacaaucuaaaa

SEQ ID NO: 261273 - RNA, 22 nt, Homo sapiens
cuggaaggaaaaacaaccacag

SEQ ID NO: 261274 - RNA, 22 nt, Homo sapiens
cuggaauguuccuaaagauuca

SEQ ID NO: 261275 - RNA, 22 nt, Homo sapiens
cuggaauucaaaaucugaauuu

SEQ ID NO: 261276 - RNA, 22 nt, Homo sapiens
cuggacaaaucuggaaagaacc

SEQ ID NO: 261277 - RNA, 22 nt, Homo sapiens
cuggagauauuggaagaaagaa

SEQ ID NO: 261278 - RNA, 22 nt, Homo sapiens
cuggaguaugauguuagcguug

SEQ ID NO: 261279 - RNA, 22 nt, Homo sapiens
cuggaguuugaggcugcaguga

SEQ ID NO: 261280 - RNA, 22 nt, Homo sapiens
cuggcaucuaaauacuugaugu

SEQ ID NO: 261281 - RNA, 22 nt, Homo sapiens
cuggcucugggcuaaagaaaua

SEQ ID NO: 261282 - RNA, 22 nt, Homo sapiens
cugggauggaggagaauuagag

SEQ ID NO: 261283 - RNA, 22 nt, Homo sapiens
cugggguaggacuggcuuuuga

SEQ ID NO: 261284 - RNA, 22 nt, Homo sapiens
cugggucaguuucugauuauug

SEQ ID NO: 261285 - RNA, 22 nt, Homo sapiens
cuggugugugacuuuucauuau

SEQ ID NO: 261286 - RNA, 22 nt, Homo sapiens
cuguaguuagcagaugaugaau

SEQ ID NO: 261287 - RNA, 22 nt, Homo sapiens
cugucaucauuucuaugugcca

SEQ ID NO: 261288 - RNA, 22 nt, Homo sapiens
cugucuguuucaaaagugguua

SEQ ID NO: 261289 - RNA, 22 nt, Homo sapiens
cugugcacaucuggcggcccga

SEQ ID NO: 261290 - RNA, 20 nt, Homo sapiens
uggaccagagagguggggac

SEQ ID NO: 261291 - RNA, 22 nt, Homo sapiens
uggaccccuucuccuauuaaaa

SEQ ID NO: 261292 - RNA, 22 nt, Homo sapiens
uggacuagagggugggcgaggu

SEQ ID NO: 261293 - RNA, 22 nt, Homo sapiens
uggacuguaagugccuugagua

SEQ ID NO: 261294 - RNA, 22 nt, Homo sapiens
uggagagcaaagaauuuguuag

SEQ ID NO: 261295 - RNA, 22 nt, Homo sapiens
uggagagucauuuauaguauuu

SEQ ID NO: 261296 - RNA, 22 nt, Homo sapiens
uggagagugagggccuccuuaa

SEQ ID NO: 261297 - RNA, 22 nt, Homo sapiens
uggagcccuaguuccucauaac

SEQ ID NO: 261298 - RNA, 20 nt, Homo sapiens
uggaggucaucugucacuac

SEQ ID NO: 261299 - RNA, 22 nt, Homo sapiens
uggagugagaacuucaaugaug

SEQ ID NO: 261300 - RNA, 22 nt, Homo sapiens
uggaguguuggggcaggaucuc

SEQ ID NO: 261301 - RNA, 22 nt, Homo sapiens
uggaguuugacaugccuuuggg

SEQ ID NO: 261302 - RNA, 19 nt, Homo sapiens
uggauuguuagagcagugu

SEQ ID NO: 261303 - RNA, 22 nt, Homo sapiens
uggcaaaauggaauauguuggg

SEQ ID NO: 261304 - RNA, 22 nt, Homo sapiens
uggcaaagugugacgugggggu

SEQ ID NO: 261305 - RNA, 22 nt, Homo sapiens
uggcaaaugugagaugagaacu

SEQ ID NO: 261306 - RNA, 22 nt, Homo sapiens
uggcaagaaggauuuauuccuu

SEQ ID NO: 261307 - RNA, 22 nt, Homo sapiens
uggcaagagaacaacaucucuc

SEQ ID NO: 261308 - RNA, 22 nt, Homo sapiens
uggcaagagcugcauucaucug

SEQ ID NO: 261309 - RNA, 20 nt, Homo sapiens
uggcaccugacagauagcca

SEQ ID NO: 261310 - RNA, 22 nt, Homo sapiens
uggcacuggagauacauuaaua

SEQ ID NO: 261311 - RNA, 22 nt, Homo sapiens
uggcagauagaaaugugguuaa

SEQ ID NO: 261312 - RNA, 22 nt, Homo sapiens
uggcagauaggauacaggacua

SEQ ID NO: 261313 - RNA, 22 nt, Homo sapiens
uggcagaugggugagcuggaga

SEQ ID NO: 261314 - RNA, 22 nt, Homo sapiens
uggcaguuuacagcuuuaggag

SEQ ID NO: 261315 - RNA, 22 nt, Homo sapiens
uggcaguuucacauggcucaac

SEQ ID NO: 261316 - RNA, 20 nt, Homo sapiens
uggcaugaaauuuuccaagc

SEQ ID NO: 261317 - RNA, 22 nt, Homo sapiens
uggcauggucugcccaaguuuc

SEQ ID NO: 261318 - RNA, 22 nt, Homo sapiens
uggcauguuggguguugacucc

SEQ ID NO: 261319 - RNA, 23 nt, Homo sapiens
uggcauuuuaguuagcuucagug

SEQ ID NO: 261320 - RNA, 23 nt, Homo sapiens
uggccagaaacuucuuuucaucc

SEQ ID NO: 261321 - RNA, 22 nt, Homo sapiens
uggcuaagaugcacacuucacu

SEQ ID NO: 261322 - RNA, 22 nt, Homo sapiens
uggcuauuucgucaugcucccc

SEQ ID NO: 261323 - RNA, 20 nt, Homo sapiens
uggcucuuugcugcuaaagu

SEQ ID NO: 261324 - RNA, 22 nt, Homo sapiens
uggcuguuguuacuaacaguuc

SEQ ID NO: 261325 - RNA, 22 nt, Homo sapiens
uggcuuuuauuauguugaggua

SEQ ID NO: 261326 - RNA, 22 nt, Homo sapiens
uggcuuuuccaggcauuacgau

SEQ ID NO: 261327 - RNA, 22 nt, Homo sapiens
ugggaaauguagccuagcugug

SEQ ID NO: 261328 - RNA, 20 nt, Homo sapiens
ugggaacaugugguauaugg

SEQ ID NO: 261329 - RNA, 22 nt, Homo sapiens
ugggaacugaggugaaaagaca

SEQ ID NO: 261330 - RNA, 22 nt, Homo sapiens
ugggaagaagguuuacuugcca

SEQ ID NO: 261331 - RNA, 22 nt, Homo sapiens
ugggaagauucuguguuuuucc

SEQ ID NO: 261332 - RNA, 22 nt, Homo sapiens
ugggaucagcugggcucucugu

SEQ ID NO: 261333 - RNA, 22 nt, Homo sapiens
ugggaugaaaauagcuucuucc

SEQ ID NO: 261334 - RNA, 22 nt, Homo sapiens
ugggcaguauggucauuuucgu

SEQ ID NO: 261335 - RNA, 22 nt, Homo sapiens
uggggcaaugaacauuuuugca

SEQ ID NO: 261336 - RNA, 22 nt, Homo sapiens
uggggcuuuuucuuguauucuc

SEQ ID NO: 261337 - RNA, 22 nt, Homo sapiens
ugggguagaauagaauugauau

SEQ ID NO: 261338 - RNA, 22 nt, Homo sapiens
uggggucguaggugcccgccag

SEQ ID NO: 261339 - RNA, 22 nt, Homo sapiens
uggguagauaucauaguugccc

SEQ ID NO: 261340 - RNA, 22 nt, Homo sapiens
uggguaggcccucauuggacag

SEQ ID NO: 261341 - RNA, 23 nt, Homo sapiens
ugggucaguuuuucugacaucau

SEQ ID NO: 261342 - RNA, 22 nt, Homo sapiens
ugguaaaaugucauuuaccaga

SEQ ID NO: 261343 - RNA, 22 nt, Homo sapiens
ugguaagaucagaacuggaguc

SEQ ID NO: 261344 - RNA, 22 nt, Homo sapiens
ugguauguaugauuaacaugga

SEQ ID NO: 261345 - RNA, 22 nt, Homo sapiens
uggucaaaucugaugugagaaa

SEQ ID NO: 261346 - RNA, 20 nt, Homo sapiens
uggucaccuucaggagguuc

SEQ ID NO: 261347 - RNA, 19 nt, Homo sapiens
uggucaguucugggagcug

SEQ ID NO: 261348 - RNA, 22 nt, Homo sapiens
uggucaguugaguccuugccaa

SEQ ID NO: 261349 - RNA, 22 nt, Homo sapiens
uggucuccuuuguacccugggc

SEQ ID NO: 261350 - RNA, 22 nt, Homo sapiens
uggugagaaacuagauauuuuu

SEQ ID NO: 261351 - RNA, 22 nt, Homo sapiens
uggugcccuguccuucuguggc

SEQ ID NO: 261352 - RNA, 22 nt, Homo sapiens
ugguuccauauuaauuuuagga

SEQ ID NO: 261353 - RNA, 21 nt, Homo sapiens
ugguugauccuccuagugccu

SEQ ID NO: 261354 - RNA, 22 nt, Homo sapiens
ugguuguuuuaaaugucgucug

SEQ ID NO: 261355 - RNA, 18 nt, Homo sapiens
uguaaacuaccucaaccu

SEQ ID NO: 261356 - RNA, 22 nt, Homo sapiens
uguaaaucugguuaauuggaua

SEQ ID NO: 261357 - RNA, 22 nt, Homo sapiens
uguaacaguaguuacuauucuu

SEQ ID NO: 261358 - RNA, 20 nt, Homo sapiens
uguacacaguguacccacau

SEQ ID NO: 261359 - RNA, 22 nt, Homo sapiens
uguacacauaugugggguacau

SEQ ID NO: 261360 - RNA, 19 nt, Homo sapiens
uguacacuguaaaccugug

SEQ ID NO: 261361 - RNA, 22 nt, Homo sapiens
uguacccuuagagagugaucga

SEQ ID NO: 261362 - RNA, 22 nt, Homo sapiens
uguacuucaagauuaugguuua

SEQ ID NO: 261363 - RNA, 22 nt, Homo sapiens
uguagacagcacguaguugagu

SEQ ID NO: 261364 - RNA, 22 nt, Homo sapiens
uguagauaucauuagugcugug

SEQ ID NO: 261365 - RNA, 21 nt, Homo sapiens
uguagcagcauaauuuauaau

SEQ ID NO: 261366 - RNA, 21 nt, Homo sapiens
uguagcagcaugauucauagu

SEQ ID NO: 261367 - RNA, 21 nt, Homo sapiens
uguagcagcaugauuuauaau

SEQ ID NO: 261368 - RNA, 22 nt, Homo sapiens
uguagggagagggaguugcacc

SEQ ID NO: 261369 - RNA, 22 nt, Homo sapiens
uguagucauuuggaguccagcu

SEQ ID NO: 261370 - RNA, 22 nt, Homo sapiens
uguauacauauguauguuuugu

SEQ ID NO: 261371 - RNA, 21 nt, Homo sapiens
uguauacauggaagaaugguc

SEQ ID NO: 261372 - RNA, 22 nt, Homo sapiens
uguauaguugagucaaguuuca

SEQ ID NO: 261373 - RNA, 21 nt, Homo sapiens
uguauauguuuauacacacac

SEQ ID NO: 261374 - RNA, 22 nt, Homo sapiens
uguaugagagacauggcugcuu

SEQ ID NO: 261375 - RNA, 22 nt, Homo sapiens
uguauguaauugaaguuaaguu

SEQ ID NO: 261376 - RNA, 22 nt, Homo sapiens
uguaugucugcucuuuggaacu

SEQ ID NO: 261377 - RNA, 22 nt, Homo sapiens
ugucaaagagacaucugcacuc

SEQ ID NO: 261378 - RNA, 22 nt, Homo sapiens
ugucaccuugcucauccucgga

SEQ ID NO: 261379 - RNA, 22 nt, Homo sapiens
uccagguuuugugaguuuaaau

SEQ ID NO: 261380 - RNA, 22 nt, Homo sapiens
uccagugugcaggcaaguuuga

SEQ ID NO: 261381 - RNA, 22 nt, Homo sapiens
uccaguuuggaggcuugaugug

SEQ ID NO: 261382 - RNA, 18 nt, Homo sapiens
uccaguuuucccagcauc

SEQ ID NO: 261383 - RNA, 22 nt, Homo sapiens
uccauaguacuagaaacugacc

SEQ ID NO: 261384 - RNA, 19 nt, Homo sapiens
uccaugagcccacagugau

SEQ ID NO: 261385 - RNA, 22 nt, Homo sapiens
uccauggagacacauuuuauau

SEQ ID NO: 261386 - RNA, 16 nt, Homo sapiens
ucccaccauugcuugu

SEQ ID NO: 261387 - RNA, 22 nt, Homo sapiens
ucccagaaacgcauauguucau

SEQ ID NO: 261388 - RNA, 22 nt, Homo sapiens
ucccaguuuuucugaauaguca

SEQ ID NO: 261389 - RNA, 22 nt, Homo sapiens
ucccauguagcuaggauuacag

SEQ ID NO: 261390 - RNA, 23 nt, Homo sapiens
uccccgggagcaccagcuuguug

SEQ ID NO: 261391 - RNA, 22 nt, Homo sapiens
uccccugagucaccugcuucuc

SEQ ID NO: 261392 - RNA, 20 nt, Homo sapiens
ucccuaagagccuuuccuuc

SEQ ID NO: 261393 - RNA, 22 nt, Homo sapiens
ucccugaaaaauuggcuuaaca

SEQ ID NO: 261394 - RNA, 22 nt, Homo sapiens
ucccugaaagcugagauuggaa

SEQ ID NO: 261395 - RNA, 22 nt, Homo sapiens
ucccugacagggucugagcuuu

SEQ ID NO: 261396 - RNA, 22 nt, Homo sapiens
ucccugacagucacagagcuac

SEQ ID NO: 261397 - RNA, 18 nt, Homo sapiens
ucccugacucaaauucuu

SEQ ID NO: 261398 - RNA, 22 nt, Homo sapiens
ucccugaguaucuaauguguuu

SEQ ID NO: 261399 - RNA, 22 nt, Homo sapiens
ucccugguguuaguuuguucuu

SEQ ID NO: 261400 - RNA, 22 nt, Homo sapiens
uccgaguguuagagagcugugu

SEQ ID NO: 261401 - RNA, 22 nt, Homo sapiens
uccugagacucacaggcucccc

SEQ ID NO: 261402 - RNA, 21 nt, Homo sapiens
uccugagagaggaguaacucu

SEQ ID NO: 261403 - RNA, 22 nt, Homo sapiens
uccuugagucuuugcucagaug

SEQ ID NO: 261404 - RNA, 19 nt, Homo sapiens
uccuugauugcaccacugc

SEQ ID NO: 261405 - RNA, 18 nt, Homo sapiens
uccuuuugggguaggaga

SEQ ID NO: 261406 - RNA, 22 nt, Homo sapiens
ucuaaaguacuacuacuguugg

SEQ ID NO: 261407 - RNA, 22 nt, Homo sapiens
ucuaagaauucauuuauaagcc

SEQ ID NO: 261408 - RNA, 22 nt, Homo sapiens
ucuaaguaguagcuggucagaa

SEQ ID NO: 261409 - RNA, 22 nt, Homo sapiens
ucucacagaguugaauguuucu

SEQ ID NO: 261410 - RNA, 19 nt, Homo sapiens
ucucacagcucuacuaugu

SEQ ID NO: 261411 - RNA, 22 nt, Homo sapiens
ucucacauuucacagggauggg

SEQ ID NO: 261412 - RNA, 22 nt, Homo sapiens
ucucagcacaaacaaaauugcu

SEQ ID NO: 261413 - RNA, 22 nt, Homo sapiens
ucucagugaaauaaauuauuuu

SEQ ID NO: 261414 - RNA, 22 nt, Homo sapiens
ucucaguggcacccccaacacc

SEQ ID NO: 261415 - RNA, 22 nt, Homo sapiens
ucucaguguuaucuaucugccu

SEQ ID NO: 261416 - RNA, 22 nt, Homo sapiens
ucucaguuuucuggggaagaaa

SEQ ID NO: 261417 - RNA, 22 nt, Homo sapiens
ucucauggagguagagaguaaa

SEQ ID NO: 261418 - RNA, 21 nt, Homo sapiens
ucucauuacugaugagccaga

SEQ ID NO: 261419 - RNA, 22 nt, Homo sapiens
ucuccauuguccagaugaggaa

SEQ ID NO: 261420 - RNA, 20 nt, Homo sapiens
ucucccaaacagcaggcccu

SEQ ID NO: 261421 - RNA, 22 nt, Homo sapiens
ucucugacacugaccccaaaaa

SEQ ID NO: 261422 - RNA, 22 nt, Homo sapiens
ucucugauuaaacaagauagug

SEQ ID NO: 261423 - RNA, 22 nt, Homo sapiens
ucucuggauaucuacuuauguu

SEQ ID NO: 261424 - RNA, 19 nt, Homo sapiens
ucucugguguuggagggga

SEQ ID NO: 261425 - RNA, 22 nt, Homo sapiens
ucucuuggcggaaguugcagug

SEQ ID NO: 261426 - RNA, 20 nt, Homo sapiens
ucuggccccuccaaaucuca

SEQ ID NO: 261427 - RNA, 22 nt, Homo sapiens
ucuggccuacaaguaauuuuau

SEQ ID NO: 261428 - RNA, 22 nt, Homo sapiens
ucuggcuccaaagucuauuuuu

SEQ ID NO: 261429 - RNA, 22 nt, Homo sapiens
ucuggcuuugugaguugccaga

SEQ ID NO: 261430 - RNA, 22 nt, Homo sapiens
ucuggugugcucuggacuugca

SEQ ID NO: 261431 - RNA, 22 nt, Homo sapiens
ucugucaaaucuuauguuguag

SEQ ID NO: 261432 - RNA, 22 nt, Homo sapiens
ucugucuugugguuugagugcc

SEQ ID NO: 261433 - RNA, 22 nt, Homo sapiens
ucugugaaugaacacuugaaaa

SEQ ID NO: 261434 - RNA, 22 nt, Homo sapiens
ucugugcugagaguugaaaguu

SEQ ID NO: 261435 - RNA, 19 nt, Homo sapiens
ucugugcuugucccccugu

SEQ ID NO: 261436 - RNA, 22 nt, Homo sapiens
ucuguggucagaguccuuggcc

SEQ ID NO: 261437 - RNA, 22 nt, Homo sapiens
cccuguguuuagcugaagguuu

SEQ ID NO: 261438 - RNA, 22 nt, Homo sapiens
cccuugcacuucagagcugcau

SEQ ID NO: 261439 - RNA, 22 nt, Homo sapiens
ccggcuguguggagaggccccu

SEQ ID NO: 261440 - RNA, 22 nt, Homo sapiens
ccucauggagaacuucugcuag

SEQ ID NO: 261441 - RNA, 22 nt, Homo sapiens
ccucuguaguccugcaagagga

SEQ ID NO: 261442 - RNA, 22 nt, Homo sapiens
ccugagguagaguuuauauuga

SEQ ID NO: 261443 - RNA, 21 nt, Homo sapiens
ccugauguucacuuggccuuc

SEQ ID NO: 261444 - RNA, 19 nt, Homo sapiens
ccugcuguucuuuugcacc

SEQ ID NO: 261445 - RNA, 22 nt, Homo sapiens
ccuggcacugagcaguguucua

SEQ ID NO: 261446 - RNA, 22 nt, Homo sapiens
ccugucuugaagagauccuccu

SEQ ID NO: 261447 - RNA, 22 nt, Homo sapiens
ccugucuugauuaaauuacuua

SEQ ID NO: 261448 - RNA, 22 nt, Homo sapiens
ccugugguuaaccagcuagaug

SEQ ID NO: 261449 - RNA, 22 nt, Homo sapiens
ccuucauucauuaauuuagccc

SEQ ID NO: 261450 - RNA, 22 nt, Homo sapiens
ccuucuuuuguaaggcugaaua

SEQ ID NO: 261451 - RNA, 22 nt, Homo sapiens
ccuuggcacuuugccacagugc

SEQ ID NO: 261452 - RNA, 22 nt, Homo sapiens
ccuuuguuuaguugaauuguau

SEQ ID NO: 261453 - RNA, 22 nt, Homo sapiens
cgaguagcacaaugugugugau

SEQ ID NO: 261454 - RNA, 22 nt, Homo sapiens
cgcccuguagcuagcuagaggu

SEQ ID NO: 261455 - RNA, 22 nt, Homo sapiens
cgcuggugaucuagacccccaa

SEQ ID NO: 261456 - RNA, 22 nt, Homo sapiens
cggcaguggguaagccaagcuu

SEQ ID NO: 261457 - RNA, 22 nt, Homo sapiens
cuaaagauagugacaugauuug

SEQ ID NO: 261458 - RNA, 22 nt, Homo sapiens
cuaaagugcuuaaaaucucauu

SEQ ID NO: 261459 - RNA, 19 nt, Homo sapiens
cuaaaugggucccuagugg

SEQ ID NO: 261460 - RNA, 22 nt, Homo sapiens
cuaacacagagguuuauuucuc

SEQ ID NO: 261461 - RNA, 18 nt, Homo sapiens
cuaagacacuuggcagag

SEQ ID NO: 261462 - RNA, 22 nt, Homo sapiens
ucucaguuuucaagcugucgau

SEQ ID NO: 261463 - RNA, 20 nt, Homo sapiens
ucucauagagguagagaaua

SEQ ID NO: 261464 - RNA, 22 nt, Homo sapiens
ucucaugaagauagagaauaga

SEQ ID NO: 261465 - RNA, 20 nt, Homo sapiens
ucucauggagguagagaaua

SEQ ID NO: 261466 - RNA, 22 nt, Homo sapiens
ucuccauugaaauggacauaau

SEQ ID NO: 261467 - RNA, 22 nt, Homo sapiens
ucuccauuuguaaggguuucuc

SEQ ID NO: 261468 - RNA, 22 nt, Homo sapiens
ucucccauccaugaacuucugu

SEQ ID NO: 261469 - RNA, 22 nt, Homo sapiens
ucucccauccguacacggauug

SEQ ID NO: 261470 - RNA, 21 nt, Homo sapiens
ucucucaaccaggaagugggc

SEQ ID NO: 261471 - RNA, 22 nt, Homo sapiens
ucucugaaacucuugacauccu

SEQ ID NO: 261472 - RNA, 22 nt, Homo sapiens
ucucugguuuucaaagcaguau

SEQ ID NO: 261473 - RNA, 22 nt, Homo sapiens
ucucuguuuagagccagcaauu

SEQ ID NO: 261474 - RNA, 22 nt, Homo sapiens
ucucuguuuauuuuugguguau

SEQ ID NO: 261475 - RNA, 22 nt, Homo sapiens
ucugacacagugauuaguaaau

SEQ ID NO: 261476 - RNA, 22 nt, Homo sapiens
ucugagaucaugucugugcugu

SEQ ID NO: 261477 - RNA, 22 nt, Homo sapiens
ucugaguggcagaaugagcuga

SEQ ID NO: 261478 - RNA, 22 nt, Homo sapiens
ucuggccuagaacaauuaauua

SEQ ID NO: 261479 - RNA, 22 nt, Homo sapiens
ucuggccuccuaugagaaucga

SEQ ID NO: 261480 - RNA, 22 nt, Homo sapiens
ucuggcuccacacuuuauuaac

SEQ ID NO: 261481 - RNA, 18 nt, Homo sapiens
ucuggcuucuuuguucca

SEQ ID NO: 261482 - RNA, 22 nt, Homo sapiens
ucuggcuugugaacugucuucu

SEQ ID NO: 261483 - RNA, 22 nt, Homo sapiens
ucuggcuuuagcaugugggaag

SEQ ID NO: 261484 - RNA, 21 nt, Homo sapiens
ucuggcuuucauuccccuucu

SEQ ID NO: 261485 - RNA, 22 nt, Homo sapiens
ucugggguuuccacuuuuacuu

SEQ ID NO: 261486 - RNA, 22 nt, Homo sapiens
ucugguggugaugagagacagu

SEQ ID NO: 261487 - RNA, 22 nt, Homo sapiens
ucugguguuauucauguaguuu

SEQ ID NO: 261488 - RNA, 22 nt, Homo sapiens
ucuguacuccuugaguagugcu

SEQ ID NO: 261489 - RNA, 22 nt, Homo sapiens
ucugugaaugugaccuuauuug

SEQ ID NO: 261490 - RNA, 22 nt, Homo sapiens
ucuguggucagcauccgccacu

SEQ ID NO: 261491 - RNA, 22 nt, Homo sapiens
ucugugguucaaaccagcaacu

SEQ ID NO: 261492 - RNA, 22 nt, Homo sapiens
ucuguguuuagacccaggguag

SEQ ID NO: 261493 - RNA, 22 nt, Homo sapiens
ucuguguuugaucaagauugua

SEQ ID NO: 261494 - RNA, 22 nt, Homo sapiens
ucuguuguuaucauaauauuga

SEQ ID NO: 261495 - RNA, 17 nt, Homo sapiens
ucuucuguuacuguggc

SEQ ID NO: 261496 - RNA, 19 nt, Homo sapiens
ucuugcacaugugaacuca

SEQ ID NO: 261497 - RNA, 22 nt, Homo sapiens
ucuugcaccuacaugcuuuguc

SEQ ID NO: 261498 - RNA, 22 nt, Homo sapiens
ucuugcauuuuuaaauagugcu

SEQ ID NO: 261499 - RNA, 22 nt, Homo sapiens
ucuuggccaugaauggcaaggc

SEQ ID NO: 261500 - RNA, 21 nt, Homo sapiens
ucuuggguugaauucucccag

SEQ ID NO: 261501 - RNA, 22 nt, Homo sapiens
ucuuggguuuguccuucuccua

SEQ ID NO: 261502 - RNA, 22 nt, Homo sapiens
ucuugguaaugucacauuuccu

SEQ ID NO: 261503 - RNA, 22 nt, Homo sapiens
ucuugucacugcauccccagcu

SEQ ID NO: 261504 - RNA, 19 nt, Homo sapiens
ucuuuagucacauuuuuau

SEQ ID NO: 261505 - RNA, 22 nt, Homo sapiens
ucuuuagugacaguugugcaag

SEQ ID NO: 261506 - RNA, 22 nt, Homo sapiens
ucuuugauguucugaaagaugg

SEQ ID NO: 261507 - RNA, 22 nt, Homo sapiens
ucuuugauuuuguuacuaagac

SEQ ID NO: 261508 - RNA, 19 nt, Homo sapiens
ucuuugcuuuucuaagagg

SEQ ID NO: 261509 - RNA, 22 nt, Homo sapiens
ucuuuggaggcgaucuguuuga

SEQ ID NO: 261510 - RNA, 22 nt, Homo sapiens
ucuuugguaauggaugucugau

SEQ ID NO: 261511 - RNA, 22 nt, Homo sapiens
ucuuuggucuacuuucauaugu

SEQ ID NO: 261512 - RNA, 22 nt, Homo sapiens
ucuuugguuagguuuaguugau

SEQ ID NO: 261513 - RNA, 22 nt, Homo sapiens
ucuuuguguaggucaaucuggc

SEQ ID NO: 261514 - RNA, 22 nt, Homo sapiens
ucuuuuggguauggagccauca

SEQ ID NO: 261515 - RNA, 22 nt, Homo sapiens
ugaaaagucuaagauuaagguu

SEQ ID NO: 261516 - RNA, 20 nt, Homo sapiens
ugaaacacauggacuggggu

SEQ ID NO: 261517 - RNA, 22 nt, Homo sapiens
ugaaagacacagaaguugccca

SEQ ID NO: 261518 - RNA, 22 nt, Homo sapiens
ugaaagcuacaggaaaguauuu

SEQ ID NO: 261519 - RNA, 22 nt, Homo sapiens
ugaaagguauagguucuggagg

SEQ ID NO: 261520 - RNA, 22 nt, Homo sapiens
ugaaauacuuaauuucuccaug

SEQ ID NO: 261521 - RNA, 22 nt, Homo sapiens
ugaaaucauguaguuauugcaa

SEQ ID NO: 261522 - RNA, 22 nt, Homo sapiens
ugaaaugcuaauucguagcuaa

SEQ ID NO: 261523 - RNA, 22 nt, Homo sapiens
ugaaaugguuaugugaggagau

SEQ ID NO: 261524 - RNA, 22 nt, Homo sapiens
ugaaauguuaaacaaguggcuc

SEQ ID NO: 261525 - RNA, 22 nt, Homo sapiens
ugaaauguugggugauggaauc

SEQ ID NO: 261526 - RNA, 22 nt, Homo sapiens
ugaacucauccuuucuuauggc

SEQ ID NO: 261527 - RNA, 22 nt, Homo sapiens
ugaagacucaauuauuaugaac

SEQ ID NO: 261528 - RNA, 22 nt, Homo sapiens
ugaagagucuaaaucugucuuc

SEQ ID NO: 261529 - RNA, 22 nt, Homo sapiens
ugaaguaauguuuuauucuauu

SEQ ID NO: 261530 - RNA, 22 nt, Homo sapiens
ugaagugaagcaguaguguggg

SEQ ID NO: 261531 - RNA, 22 nt, Homo sapiens
ugaauauguuaaauaauguucu

SEQ ID NO: 261532 - RNA, 22 nt, Homo sapiens
ugaauauuugcuacucacucuu

SEQ ID NO: 261533 - RNA, 22 nt, Homo sapiens
ugaaucauuucuugucuucagu

SEQ ID NO: 261534 - RNA, 22 nt, Homo sapiens
ugaaugauuuuaaaagccucuc

SEQ ID NO: 261535 - RNA, 22 nt, Homo sapiens
ugaauguacacgcguacuuguu

SEQ ID NO: 261536 - RNA, 22 nt, Homo sapiens
ugaauguacuuaacacuggauu

SEQ ID NO: 261537 - RNA, 23 nt, Homo sapiens
ugaauguaucgaaugugggaaag

SEQ ID NO: 261538 - RNA, 22 nt, Homo sapiens
ugaauguuguugguugagauau

SEQ ID NO: 261539 - RNA, 22 nt, Homo sapiens
ugaauguuugcagcuuauacca

SEQ ID NO: 261540 - RNA, 22 nt, Homo sapiens
ugaauguuugcuuacuuccaua

SEQ ID NO: 261541 - RNA, 22 nt, Homo sapiens
ugaauucaucucacagaguuaa

SEQ ID NO: 261542 - RNA, 23 nt, Homo sapiens
ugacaaccucaugcuuugucaug

SEQ ID NO: 261543 - RNA, 22 nt, Homo sapiens
ugacaagugauuaaggcauauu

SEQ ID NO: 261544 - RNA, 18 nt, Homo sapiens
ugacaaugcuaguccugg

SEQ ID NO: 261545 - RNA, 22 nt, Homo sapiens
ugacacauguagacaucuggug

SEQ ID NO: 261546 - RNA, 19 nt, Homo sapiens
ugacacuguuggugggagg

SEQ ID NO: 261547 - RNA, 22 nt, Homo sapiens
ugacagagaagcauugaguuca

SEQ ID NO: 261548 - RNA, 22 nt, Homo sapiens
ugacaguaucuacagcuucuua

SEQ ID NO: 261549 - RNA, 22 nt, Homo sapiens
ugacaguguccuccuccugaga

SEQ ID NO: 261550 - RNA, 22 nt, Homo sapiens
ugacaugaagaaaaacagauuu

SEQ ID NO: 261551 - RNA, 22 nt, Homo sapiens
ugacauggagguggaggaagau

SEQ ID NO: 261552 - RNA, 23 nt, Homo sapiens
ugacauguaauucaguccagcag

SEQ ID NO: 261553 - RNA, 22 nt, Homo sapiens
ugacauguagagaacuucucau

SEQ ID NO: 261554 - RNA, 22 nt, Homo sapiens
gagcuggacuucuuaccuuuuc

SEQ ID NO: 261555 - RNA, 20 nt, Homo sapiens
gagcugguguacugccgggc

SEQ ID NO: 261556 - RNA, 22 nt, Homo sapiens
gaggagauauucugcuggaugg

SEQ ID NO: 261557 - RNA, 22 nt, Homo sapiens
gaggagucagacugugcaaggu

SEQ ID NO: 261558 - RNA, 22 nt, Homo sapiens
gaggaucucuugagcccagaag

SEQ ID NO: 261559 - RNA, 22 nt, Homo sapiens
gaggcagucugucccuuagcag

SEQ ID NO: 261560 - RNA, 22 nt, Homo sapiens
gaggcaguguguccguucucgg

SEQ ID NO: 261561 - RNA, 22 nt, Homo sapiens
gaggguguuguguugcuuaaua

SEQ ID NO: 261562 - RNA, 22 nt, Homo sapiens
gagguaagagaauaaacaguuu

SEQ ID NO: 261563 - RNA, 22 nt, Homo sapiens
gagguaggaauaaacauuugaa

SEQ ID NO: 261564 - RNA, 22 nt, Homo sapiens
gagguaggaggauugcuuaagg

SEQ ID NO: 261565 - RNA, 21 nt, Homo sapiens
gagguagggauuaaagaccuc

SEQ ID NO: 261566 - RNA, 22 nt, Homo sapiens
gagguaggggccuuaaagaugc

SEQ ID NO: 261567 - RNA, 22 nt, Homo sapiens
gaggucaugucgggccccagga

SEQ ID NO: 261568 - RNA, 22 nt, Homo sapiens
gagguggauacauuaaauaaug

SEQ ID NO: 261569 - RNA, 22 nt, Homo sapiens
gagguuuuagugagucccacug

SEQ ID NO: 261570 - RNA, 22 nt, Homo sapiens
gaguaucuuuaaggugguuugg

SEQ ID NO: 261571 - RNA, 22 nt, Homo sapiens
gaguauguauaugagugugucu

SEQ ID NO: 261572 - RNA, 22 nt, Homo sapiens
gagucagugucuugcucuguca

SEQ ID NO: 261573 - RNA, 22 nt, Homo sapiens
gagugcaaagguccugaggugg

SEQ ID NO: 261574 - RNA, 22 nt, Homo sapiens
gagugcaauggugccaucucgg

SEQ ID NO: 261575 - RNA, 22 nt, Homo sapiens
gaguucauaucuaugagugugc

SEQ ID NO: 261576 - RNA, 22 nt, Homo sapiens
gaguuuguacuaauuuguugua

SEQ ID NO: 261577 - RNA, 22 nt, Homo sapiens
gauaaagauagcaauagggaca

SEQ ID NO: 261578 - RNA, 18 nt, Homo sapiens
gauaacaguggacuaugc

SEQ ID NO: 261579 - RNA, 22 nt, Homo sapiens
gauagguagaagauguuuucau

SEQ ID NO: 261580 - RNA, 22 nt, Homo sapiens
gauauguaaaaauuauaucuga

SEQ ID NO: 261581 - RNA, 22 nt, Homo sapiens
gauauguucuuucacguuggug

SEQ ID NO: 261582 - RNA, 22 nt, Homo sapiens
gauauguuucuucaauaccuag

SEQ ID NO: 261583 - RNA, 22 nt, Homo sapiens
gaucccauuggcugccaugugg

SEQ ID NO: 261584 - RNA, 22 nt, Homo sapiens
gaucugucuuuccuuauagucu

SEQ ID NO: 261585 - RNA, 22 nt, Homo sapiens
gaugagaucauaaguguggagc

SEQ ID NO: 261586 - RNA, 22 nt, Homo sapiens
gaugagguagaagacucagcaa

SEQ ID NO: 261587 - RNA, 22 nt, Homo sapiens
gaugcaaauuaagcuugggaca

SEQ ID NO: 261588 - RNA, 22 nt, Homo sapiens
gaugcaguaagaaugcauagcg

SEQ ID NO: 261589 - RNA, 22 nt, Homo sapiens
gaugccuauugcuaguccuaaa

SEQ ID NO: 261590 - RNA, 22 nt, Homo sapiens
gaugccuuuuuguccucaguua

SEQ ID NO: 261591 - RNA, 22 nt, Homo sapiens
gauggaguaauguaaucuugag

SEQ ID NO: 261592 - RNA, 22 nt, Homo sapiens
gauggauuuuuuaggcagagcu

SEQ ID NO: 261593 - RNA, 22 nt, Homo sapiens
gauggcagugcagccccuggcu

SEQ ID NO: 261594 - RNA, 22 nt, Homo sapiens
gauggcauuucuggaucugaca

SEQ ID NO: 261595 - RNA, 22 nt, Homo sapiens
gauggcauuucuggaucugccc

SEQ ID NO: 261596 - RNA, 22 nt, Homo sapiens
gauggcucugcaggugagggua

SEQ ID NO: 261597 - RNA, 22 nt, Homo sapiens
gaugugaaaucauaguuucuag

SEQ ID NO: 261598 - RNA, 22 nt, Homo sapiens
gauguguuuguuucuggaggag

SEQ ID NO: 261599 - RNA, 22 nt, Homo sapiens
gauuccacuuacuuagcauucc

SEQ ID NO: 261600 - RNA, 22 nt, Homo sapiens
gauuuguuggccugugagcuag

SEQ ID NO: 261601 - RNA, 22 nt, Homo sapiens
gauuuuccaguggcccugauca

SEQ ID NO: 261602 - RNA, 22 nt, Homo sapiens
gcaaaauugagaagggaauaua

SEQ ID NO: 261603 - RNA, 21 nt, Homo sapiens
gcaaacauccuuugaugccag

SEQ ID NO: 261604 - RNA, 22 nt, Homo sapiens
gcaaaguguuuuuaggaagucu

SEQ ID NO: 261605 - RNA, 20 nt, Homo sapiens
gcaaaguuuagcucccacua

SEQ ID NO: 261606 - RNA, 22 nt, Homo sapiens
gcaaaugcuaugccauuuuaua

SEQ ID NO: 261607 - RNA, 22 nt, Homo sapiens
uuggaaauguguuugcauucag

SEQ ID NO: 261608 - RNA, 22 nt, Homo sapiens
uuggaagacaaugcugauucuc

SEQ ID NO: 261609 - RNA, 22 nt, Homo sapiens
uuggaagagaagggagauaaac

SEQ ID NO: 261610 - RNA, 22 nt, Homo sapiens
uuggaaggcuccuaaugaaugg

SEQ ID NO: 261611 - RNA, 22 nt, Homo sapiens
uuggaaugcaacagaaggauaa

SEQ ID NO: 261612 - RNA, 22 nt, Homo sapiens
uuggaauuaaccuggugcugga

SEQ ID NO: 261613 - RNA, 22 nt, Homo sapiens
uuggacuuuaagauagagaugu

SEQ ID NO: 261614 - RNA, 22 nt, Homo sapiens
uuggauauucaguuuuuccauc

SEQ ID NO: 261615 - RNA, 22 nt, Homo sapiens
uuggauuauaaacugagauuug

SEQ ID NO: 261616 - RNA, 22 nt, Homo sapiens
uuggcaaagugucuggcauuua

SEQ ID NO: 261617 - RNA, 22 nt, Homo sapiens
uuggcacuugauaauauucugg

SEQ ID NO: 261618 - RNA, 22 nt, Homo sapiens
uuggccagugucuuuuuuuccu

SEQ ID NO: 261619 - RNA, 23 nt, Homo sapiens
uuggccuccuugugucuagggcu

SEQ ID NO: 261620 - RNA, 22 nt, Homo sapiens
uuggcuguguuccucaaggagu

SEQ ID NO: 261621 - RNA, 22 nt, Homo sapiens
uuggcuguguuuauaugcugga

SEQ ID NO: 261622 - RNA, 22 nt, Homo sapiens
uuggcuucuggacuauugugca

SEQ ID NO: 261623 - RNA, 22 nt, Homo sapiens
uugggauggaaauuuguacccc

SEQ ID NO: 261624 - RNA, 22 nt, Homo sapiens
uugggauggaacuuuucaguga

SEQ ID NO: 261625 - RNA, 23 nt, Homo sapiens
uugggcaaaucacuaacgucucc

SEQ ID NO: 261626 - RNA, 23 nt, Homo sapiens
uugggcaaaucacugagggcaga

SEQ ID NO: 261627 - RNA, 22 nt, Homo sapiens
uugggcauugcuauaaauucuu

SEQ ID NO: 261628 - RNA, 22 nt, Homo sapiens
uuggguccucugguccuugguu

SEQ ID NO: 261629 - RNA, 22 nt, Homo sapiens
uuggucaggagccucccucuuu

SEQ ID NO: 261630 - RNA, 22 nt, Homo sapiens
uuggucaggcuaaucucgaacg

SEQ ID NO: 261631 - RNA, 21 nt, Homo sapiens
uugguccacaugucauaguua

SEQ ID NO: 261632 - RNA, 22 nt, Homo sapiens
uugguccccuucaaccagcugu

SEQ ID NO: 261633 - RNA, 22 nt, Homo sapiens
uugguuaccuucagaaaugagu

SEQ ID NO: 261634 - RNA, 22 nt, Homo sapiens
uugguuccauuuuaccagcucu

SEQ ID NO: 261635 - RNA, 22 nt, Homo sapiens
uugguuuccuuccugcuuaacu

SEQ ID NO: 261636 - RNA, 22 nt, Homo sapiens
uuguaaaguucucucccgaaaa

SEQ ID NO: 261637 - RNA, 22 nt, Homo sapiens
uuguaacaguucugcgagcagc

SEQ ID NO: 261638 - RNA, 22 nt, Homo sapiens
uuguaacaguuuauugacucga

SEQ ID NO: 261639 - RNA, 23 nt, Homo sapiens
uuguacacuaagaaucgcagaug

SEQ ID NO: 261640 - RNA, 22 nt, Homo sapiens
uuguacuagaaaauuauucuuu

SEQ ID NO: 261641 - RNA, 22 nt, Homo sapiens
uuguauaguucuauguguuuug

SEQ ID NO: 261642 - RNA, 22 nt, Homo sapiens
uugucaaacucauucuccaucc

SEQ ID NO: 261643 - RNA, 22 nt, Homo sapiens
uugucaaugggugagugcagag

SEQ ID NO: 261644 - RNA, 22 nt, Homo sapiens
gcugguauuacaggcaugagcc

SEQ ID NO: 261645 - RNA, 22 nt, Homo sapiens
gcuggugacuuuaaguugaagc

SEQ ID NO: 261646 - RNA, 22 nt, Homo sapiens
gcugguguagagugcagaaagg

SEQ ID NO: 261647 - RNA, 22 nt, Homo sapiens
gcuguuugccgccaucgcagac

SEQ ID NO: 261648 - RNA, 22 nt, Homo sapiens
gcuucauggaggcugggcgcag

SEQ ID NO: 261649 - RNA, 22 nt, Homo sapiens
gcuuggugugcaagugguacua

SEQ ID NO: 261650 - RNA, 23 nt, Homo sapiens
ggaaacauccagucuuucaccau

SEQ ID NO: 261651 - RNA, 22 nt, Homo sapiens
ggaaagacaccuuacuauguua

SEQ ID NO: 261652 - RNA, 22 nt, Homo sapiens
ggaaagauguaauauuaucuaa

SEQ ID NO: 261653 - RNA, 22 nt, Homo sapiens
ggaaagcuagguguggguguac

SEQ ID NO: 261654 - RNA, 22 nt, Homo sapiens
ggaaaucucugaggcucccuuc

SEQ ID NO: 261655 - RNA, 22 nt, Homo sapiens
ggaaauguuggugucaugaguu

SEQ ID NO: 261656 - RNA, 17 nt, Homo sapiens
ggaagccuuugguuuaa

SEQ ID NO: 261657 - RNA, 22 nt, Homo sapiens
ggaagguaauugucagcucaua

SEQ ID NO: 261658 - RNA, 22 nt, Homo sapiens
ggaauauaaaacuuuugacagg

SEQ ID NO: 261659 - RNA, 22 nt, Homo sapiens
ggaaucugaaccaugggaaugg

SEQ ID NO: 261660 - RNA, 23 nt, Homo sapiens
ggaaugaaaccugguuaugauau

SEQ ID NO: 261661 - RNA, 22 nt, Homo sapiens
ggaaugcagugagcauuagaua

SEQ ID NO: 261662 - RNA, 22 nt, Homo sapiens
ggaaugcuaaaauaggaugcug

SEQ ID NO: 261663 - RNA, 22 nt, Homo sapiens
ggacaaaguauuuucaaaugua

SEQ ID NO: 261664 - RNA, 22 nt, Homo sapiens
ggacaagagacugggacacuga

SEQ ID NO: 261665 - RNA, 22 nt, Homo sapiens
ggacaagaucuuccaccauuca

SEQ ID NO: 261666 - RNA, 22 nt, Homo sapiens
ggacaguagugcuuucuaucau

SEQ ID NO: 261667 - RNA, 22 nt, Homo sapiens
ggagaauugcuuggacccggga

SEQ ID NO: 261668 - RNA, 22 nt, Homo sapiens
ggagagcuaggcagagguuugu

SEQ ID NO: 261669 - RNA, 22 nt, Homo sapiens
ggagauccucugcgggcaaaga

SEQ ID NO: 261670 - RNA, 22 nt, Homo sapiens
ggagaucuuuguuaucuuuuga

SEQ ID NO: 261671 - RNA, 22 nt, Homo sapiens
ggagaugaaaugagcuacuuaa

SEQ ID NO: 261672 - RNA, 22 nt, Homo sapiens
ggagcucaucuagcauagaggu

SEQ ID NO: 261673 - RNA, 20 nt, Homo sapiens
ggagguguugauuuuucuuu

SEQ ID NO: 261674 - RNA, 22 nt, Homo sapiens
ggagucugaacuggacaaugac

SEQ ID NO: 261675 - RNA, 22 nt, Homo sapiens
ggagucugauguucuaaggcag

SEQ ID NO: 261676 - RNA, 22 nt, Homo sapiens
ggagucuugcuauguugccaag

SEQ ID NO: 261677 - RNA, 23 nt, Homo sapiens
ggaguguaaauuauuucaaccau

SEQ ID NO: 261678 - RNA, 22 nt, Homo sapiens
ggaguguaguggcuccaucucg

SEQ ID NO: 261679 - RNA, 23 nt, Homo sapiens
ggaguguauuggcacgaucucag

SEQ ID NO: 261680 - RNA, 22 nt, Homo sapiens
ggagugucagaaacaguguccu

SEQ ID NO: 261681 - RNA, 22 nt, Homo sapiens
ggaguguguaggagaaagguaa

SEQ ID NO: 261682 - RNA, 22 nt, Homo sapiens
ggaucacuugagaccaggaguu

SEQ ID NO: 261683 - RNA, 23 nt, Homo sapiens
ggauggaaaguuuugagggccac

SEQ ID NO: 261684 - RNA, 22 nt, Homo sapiens
ggcaaaaucgcaauuacuuuug

SEQ ID NO: 261685 - RNA, 22 nt, Homo sapiens
ggcaacaauuccuacuucuuuu

SEQ ID NO: 261686 - RNA, 22 nt, Homo sapiens
ggcaagaaccucaauuaccuuu

SEQ ID NO: 261687 - RNA, 19 nt, Homo sapiens
ggcaagaguuguucugugu

SEQ ID NO: 261688 - RNA, 23 nt, Homo sapiens
ggcaagaucucagcucacugcaa

SEQ ID NO: 261689 - RNA, 22 nt, Homo sapiens
ggcaaggauuagauucuccccu

SEQ ID NO: 261690 - RNA, 19 nt, Homo sapiens
ggcacugugugagugagga

SEQ ID NO: 261691 - RNA, 22 nt, Homo sapiens
ggcagaauugcugaggaugcua

SEQ ID NO: 261692 - RNA, 22 nt, Homo sapiens
ggcagacuguggaguucuuucu

SEQ ID NO: 261693 - RNA, 22 nt, Homo sapiens
ggcauguugauagguagaugua

SEQ ID NO: 261694 - RNA, 22 nt, Homo sapiens
ggcuagagaauagugccacuaa

SEQ ID NO: 261695 - RNA, 22 nt, Homo sapiens
uuucugguuaauuucuaagagc

SEQ ID NO: 261696 - RNA, 22 nt, Homo sapiens
uuugaagacuacugggagugaa

SEQ ID NO: 261697 - RNA, 22 nt, Homo sapiens
uuugacuaccaggaauguucuu

SEQ ID NO: 261698 - RNA, 22 nt, Homo sapiens
uuugacuagaguguuuuacaac

SEQ ID NO: 261699 - RNA, 22 nt, Homo sapiens
uuugacuuuuagaauaugaguu

SEQ ID NO: 261700 - RNA, 22 nt, Homo sapiens
uuugagcaagaggugacauuau

SEQ ID NO: 261701 - RNA, 22 nt, Homo sapiens
uuugagcaggcuaaucaauaua

SEQ ID NO: 261702 - RNA, 22 nt, Homo sapiens
uuugagcaugcagauugccagg

SEQ ID NO: 261703 - RNA, 22 nt, Homo sapiens
uuugagcauguaguuuaacccu

SEQ ID NO: 261704 - RNA, 21 nt, Homo sapiens
uuugaucauuaaaagugaauc

SEQ ID NO: 261705 - RNA, 22 nt, Homo sapiens
uuugcacucaguaagugggagc

SEQ ID NO: 261706 - RNA, 22 nt, Homo sapiens
uuugcacuggagauucaauggg

SEQ ID NO: 261707 - RNA, 21 nt, Homo sapiens
uuugcacuuugcaaaucccua

SEQ ID NO: 261708 - RNA, 20 nt, Homo sapiens
uuugcagaaucuaagaagag

SEQ ID NO: 261709 - RNA, 22 nt, Homo sapiens
uuugcagugucagcuucugugu

SEQ ID NO: 261710 - RNA, 22 nt, Homo sapiens
uuugcaucuuagaaaguucucc

SEQ ID NO: 261711 - RNA, 22 nt, Homo sapiens
uuugccaaugggaauuuuccua

SEQ ID NO: 261712 - RNA, 22 nt, Homo sapiens
uuugccuuugugauauggucua

SEQ ID NO: 261713 - RNA, 22 nt, Homo sapiens
uuugcugagucugacuucaugg

SEQ ID NO: 261714 - RNA, 22 nt, Homo sapiens
uuugcuuaaaucuuaaucagau

SEQ ID NO: 261715 - RNA, 22 nt, Homo sapiens
uuugcuuguguaaaaaucugga

SEQ ID NO: 261716 - RNA, 22 nt, Homo sapiens
uuuggcauauuuuaagcugguu

SEQ ID NO: 261717 - RNA, 22 nt, Homo sapiens
uuuggcauuaagaugcuguauc

SEQ ID NO: 261718 - RNA, 18 nt, Homo sapiens
uuuggcuguucaugacuc

SEQ ID NO: 261719 - RNA, 22 nt, Homo sapiens
uuuggcuguuucuggacuaaga

SEQ ID NO: 261720 - RNA, 22 nt, Homo sapiens
uuugggaaugaguuuaucauuu

SEQ ID NO: 261721 - RNA, 22 nt, Homo sapiens
uuugggccauggcuuuuccacg

SEQ ID NO: 261722 - RNA, 22 nt, Homo sapiens
uuugggccucugauuucuuugg

SEQ ID NO: 261723 - RNA, 22 nt, Homo sapiens
uuuggucagcugcgggucagcu

SEQ ID NO: 261724 - RNA, 22 nt, Homo sapiens
uuuguaauccuauuccaaagga

SEQ ID NO: 261725 - RNA, 22 nt, Homo sapiens
uuuguacacuguuggugguuau

SEQ ID NO: 261726 - RNA, 22 nt, Homo sapiens
uuuguacuugaaacccagggcc

SEQ ID NO: 261727 - RNA, 22 nt, Homo sapiens
uuuguagcuacaaagugagaug

SEQ ID NO: 261728 - RNA, 21 nt, Homo sapiens
uuuguaguagcaugauuuaua

SEQ ID NO: 261729 - RNA, 22 nt, Homo sapiens
uuuguauguuggagauuggaga

SEQ ID NO: 261730 - RNA, 19 nt, Homo sapiens
uuuguauguuuccaguaau

SEQ ID NO: 261731 - RNA, 22 nt, Homo sapiens
uuugugacacaaacacauauau

SEQ ID NO: 261732 - RNA, 22 nt, Homo sapiens
uuugugacucauggucuagugc

SEQ ID NO: 261733 - RNA, 22 nt, Homo sapiens
uuugugagguggauagauugca

SEQ ID NO: 261734 - RNA, 22 nt, Homo sapiens
ggcucagugaucuguuucugua

SEQ ID NO: 261735 - RNA, 22 nt, Homo sapiens
ggcuuuggucacacaggggcaa

SEQ ID NO: 261736 - RNA, 22 nt, Homo sapiens
gggaauggaagacauuaugaug

SEQ ID NO: 261737 - RNA, 22 nt, Homo sapiens
gggagcacaagaaauguuucau

SEQ ID NO: 261738 - RNA, 19 nt, Homo sapiens
gggaggaugcgucuucagg

SEQ ID NO: 261739 - RNA, 22 nt, Homo sapiens
gggaggucauuguaaggucuua

SEQ ID NO: 261740 - RNA, 22 nt, Homo sapiens
gggaggucauuguucaaugcug

SEQ ID NO: 261741 - RNA, 22 nt, Homo sapiens
gggaguagagaguuucucugac

SEQ ID NO: 261742 - RNA, 22 nt, Homo sapiens
gggagugugcacacaugguaua

SEQ ID NO: 261743 - RNA, 22 nt, Homo sapiens
gggauguaugauauauguuggu

SEQ ID NO: 261744 - RNA, 22 nt, Homo sapiens
gggcaaauuauguaucucucag

SEQ ID NO: 261745 - RNA, 22 nt, Homo sapiens
ggggaguguggacaucacccug

SEQ ID NO: 261746 - RNA, 22 nt, Homo sapiens
ggggcaaaaugccacgagucuc

SEQ ID NO: 261747 - RNA, 22 nt, Homo sapiens
gguaaacauacugcugucuucu

SEQ ID NO: 261748 - RNA, 22 nt, Homo sapiens
gguagacaucgugcucugugau

SEQ ID NO: 261749 - RNA, 22 nt, Homo sapiens
ggucacauuggacuaucaaguu

SEQ ID NO: 261750 - RNA, 22 nt, Homo sapiens
ggucauggagcuuuacuuuaug

SEQ ID NO: 261751 - RNA, 19 nt, Homo sapiens
ggucauggagguuguguga

SEQ ID NO: 261752 - RNA, 22 nt, Homo sapiens
ggucauggauugucuuuucuug

SEQ ID NO: 261753 - RNA, 22 nt, Homo sapiens
ggucauguguccaggagguagc

SEQ ID NO: 261754 - RNA, 22 nt, Homo sapiens
ggugagaaaaacauagucucag

SEQ ID NO: 261755 - RNA, 22 nt, Homo sapiens
ggugagauguucagacgaacug

SEQ ID NO: 261756 - RNA, 22 nt, Homo sapiens
ggugaguggugcuuaaguucag

SEQ ID NO: 261757 - RNA, 22 nt, Homo sapiens
ggugccuacugugugucaggca

SEQ ID NO: 261758 - RNA, 22 nt, Homo sapiens
gguggcaaaucugaguggcgcu

SEQ ID NO: 261759 - RNA, 22 nt, Homo sapiens
guaaaguaaagcacaucaaggu

SEQ ID NO: 261760 - RNA, 22 nt, Homo sapiens
guaaauaccaguuucuggaaca

SEQ ID NO: 261761 - RNA, 22 nt, Homo sapiens
guaacccuguaggccuaaagua

SEQ ID NO: 261762 - RNA, 22 nt, Homo sapiens
guaacucugucacuuacuaguu

SEQ ID NO: 261763 - RNA, 22 nt, Homo sapiens
guaaggaguaguguaacagugc

SEQ ID NO: 261764 - RNA, 22 nt, Homo sapiens
guaaguagcuuuagauauaaau

SEQ ID NO: 261765 - RNA, 22 nt, Homo sapiens
guaagucucaugagaucugaug

SEQ ID NO: 261766 - RNA, 22 nt, Homo sapiens
guaagugguagagcugggcuau

SEQ ID NO: 261767 - RNA, 23 nt, Homo sapiens
guaauacuagucauaguagcagg

SEQ ID NO: 261768 - RNA, 22 nt, Homo sapiens
guaauagucucaaacuccugga

SEQ ID NO: 261769 - RNA, 22 nt, Homo sapiens
guacaggugcaggaugggcagg

SEQ ID NO: 261770 - RNA, 22 nt, Homo sapiens
guacaguacugaaugaauguau

SEQ ID NO: 261771 - RNA, 22 nt, Homo sapiens
guacaguggguguagggaccag

SEQ ID NO: 261772 - RNA, 22 nt, Homo sapiens
guacaguuuucaguguucacug

SEQ ID NO: 261773 - RNA, 22 nt, Homo sapiens
guacauggaaugaaauucaaaa

SEQ ID NO: 261774 - RNA, 22 nt, Homo sapiens
agccuguguugaauuauagaaa

SEQ ID NO: 261775 - RNA, 22 nt, Homo sapiens
agcgccacugcacuccagccug

SEQ ID NO: 261776 - RNA, 21 nt, Homo sapiens
agcuaaauuggaaauuucugu

SEQ ID NO: 261777 - RNA, 23 nt, Homo sapiens
agcuagagaggcuggggauacag

SEQ ID NO: 261778 - RNA, 22 nt, Homo sapiens
agcugauuuuaaguccuugucc

SEQ ID NO: 261779 - RNA, 22 nt, Homo sapiens
agcugcacaaauggaugugagg

SEQ ID NO: 261780 - RNA, 22 nt, Homo sapiens
agcugcacgugguaaauguaaa

SEQ ID NO: 261781 - RNA, 22 nt, Homo sapiens
agcugccagucuuguaaggccu

SEQ ID NO: 261782 - RNA, 22 nt, Homo sapiens
agcuggcuguggagaaaccccu

SEQ ID NO: 261783 - RNA, 22 nt, Homo sapiens
agcugguaguuuucuaguguuu

SEQ ID NO: 261784 - RNA, 22 nt, Homo sapiens
ucugacucuggagucucagguu

SEQ ID NO: 261785 - RNA, 22 nt, Homo sapiens
ucugacucugugaugggcccaa

SEQ ID NO: 261786 - RNA, 22 nt, Homo sapiens
ucugagcaauagauguggauau

SEQ ID NO: 261787 - RNA, 22 nt, Homo sapiens
ucugagguaggugcauggauac

SEQ ID NO: 261788 - RNA, 22 nt, Homo sapiens
ucugagguuacugcuuuguaga

SEQ ID NO: 261789 - RNA, 22 nt, Homo sapiens
ucugcaagucuaaacuagccau

SEQ ID NO: 261790 - RNA, 22 nt, Homo sapiens
ucugcauaucaugcagaacuau

SEQ ID NO: 261791 - RNA, 22 nt, Homo sapiens
ucugccacugucauugugugau

SEQ ID NO: 261792 - RNA, 22 nt, Homo sapiens
ucuggagugugaaguggauaug

SEQ ID NO: 261793 - RNA, 23 nt, Homo sapiens
ucuggaucauucguagugccagc

SEQ ID NO: 261794 - RNA, 22 nt, Homo sapiens
ucuggauuuuugaggcaauaua

SEQ ID NO: 261795 - RNA, 22 nt, Homo sapiens
ucuggcaagagccgagggcagu

SEQ ID NO: 261796 - RNA, 22 nt, Homo sapiens
ucuggcaagauauccauugcuu

SEQ ID NO: 261797 - RNA, 17 nt, Homo sapiens
ucuggcuuucacaccug

SEQ ID NO: 261798 - RNA, 22 nt, Homo sapiens
ucugggguuagucaaagguaug

SEQ ID NO: 261799 - RNA, 22 nt, Homo sapiens
ucugguguuacugagccuccca

SEQ ID NO: 261800 - RNA, 23 nt, Homo sapiens
ucugguguugucaaaugcugguu

SEQ ID NO: 261801 - RNA, 19 nt, Homo sapiens
ucugucacuggggguauuc

SEQ ID NO: 261802 - RNA, 22 nt, Homo sapiens
ucugucacugguggacgaucac

SEQ ID NO: 261803 - RNA, 22 nt, Homo sapiens
ucugucuuugccuaaguuuguc

SEQ ID NO: 261804 - RNA, 22 nt, Homo sapiens
ucugucuuugucaggaccagag

SEQ ID NO: 261805 - RNA, 22 nt, Homo sapiens
ucugugaaaucauuuccuguaa

SEQ ID NO: 261806 - RNA, 22 nt, Homo sapiens
ucugugcauuacacuuuucuca

SEQ ID NO: 261807 - RNA, 22 nt, Homo sapiens
ucuguugguucuuugaggagga

SEQ ID NO: 261808 - RNA, 22 nt, Homo sapiens
ucuuaggugggccaucacccca

SEQ ID NO: 261809 - RNA, 22 nt, Homo sapiens
ucuucagucauauuggccugga

SEQ ID NO: 261810 - RNA, 22 nt, Homo sapiens
ucuucaugcuugaaauaauagc

SEQ ID NO: 261811 - RNA, 22 nt, Homo sapiens
ucuugcacacaguaaguguuuu

SEQ ID NO: 261812 - RNA, 22 nt, Homo sapiens
ucuugcuuuugcagagcuucuc

SEQ ID NO: 261813 - RNA, 20 nt, Homo sapiens
ucuugggaauguagccuagg

SEQ ID NO: 261814 - RNA, 22 nt, Homo sapiens
ucuuggguggauucauucuuuc

SEQ ID NO: 261815 - RNA, 22 nt, Homo sapiens
ucuugguugaaaauucauaaua

SEQ ID NO: 261816 - RNA, 22 nt, Homo sapiens
ucuuugaguggagcgaggcaga

SEQ ID NO: 261817 - RNA, 22 nt, Homo sapiens
ucuuugaguguauacuuagauu

SEQ ID NO: 261818 - RNA, 22 nt, Homo sapiens
ucuuugauaagauccagaagaa

SEQ ID NO: 261819 - RNA, 22 nt, Homo sapiens
ucuuugccuaacccaaggucau

SEQ ID NO: 261820 - RNA, 22 nt, Homo sapiens
ucuuugguagaagcuauuuuau

SEQ ID NO: 261821 - RNA, 22 nt, Homo sapiens
ucuuuggugaauggucauccag

SEQ ID NO: 261822 - RNA, 22 nt, Homo sapiens
ucuuuguguucaggagccacgu

SEQ ID NO: 261823 - RNA, 22 nt, Homo sapiens
ucuuuguuagaacccucuccuu

SEQ ID NO: 261824 - RNA, 22 nt, Homo sapiens
ucuuuguuuucugauccugaag

SEQ ID NO: 261825 - RNA, 22 nt, Homo sapiens
ucuuuugugagucagccucucc

SEQ ID NO: 261826 - RNA, 20 nt, Homo sapiens
ucuuuuuguggccccagagu

SEQ ID NO: 261827 - RNA, 22 nt, Homo sapiens
ugaaacacaccuccucuccauc

SEQ ID NO: 261828 - RNA, 18 nt, Homo sapiens
ugaaacacauuuuuuccu

SEQ ID NO: 261829 - RNA, 22 nt, Homo sapiens
ugaaagacugaaagcuuuucuu

SEQ ID NO: 261830 - RNA, 22 nt, Homo sapiens
ugaaagacugaagaauaggcau

SEQ ID NO: 261831 - RNA, 22 nt, Homo sapiens
ugaaaguaauugcaguuuuuac

SEQ ID NO: 261832 - RNA, 22 nt, Homo sapiens
ugaaauacuuuggcucuuuguu

SEQ ID NO: 261833 - RNA, 22 nt, Homo sapiens
ugaaaucuaaaauguuccaaga

SEQ ID NO: 261834 - RNA, 22 nt, Homo sapiens
ugaaaugauuauaugguguuug

SEQ ID NO: 261835 - RNA, 22 nt, Homo sapiens
ugaaaugccuuuaaugaauuua

SEQ ID NO: 261836 - RNA, 22 nt, Homo sapiens
ugaaauguaaguugucuagucu

SEQ ID NO: 261837 - RNA, 22 nt, Homo sapiens
ugaaauuguuugcaaggauagg

SEQ ID NO: 261838 - RNA, 22 nt, Homo sapiens
ugaaauuuuuuauucguuggcu

SEQ ID NO: 261839 - RNA, 22 nt, Homo sapiens
ugaacagcaccuccuagaguug

SEQ ID NO: 261840 - RNA, 22 nt, Homo sapiens
ugaacagucaucucucuuguau

SEQ ID NO: 261841 - RNA, 22 nt, Homo sapiens
ugaacuguaagguauaggugau

SEQ ID NO: 261842 - RNA, 22 nt, Homo sapiens
ugaagcuaacuugauugugaug

SEQ ID NO: 261843 - RNA, 22 nt, Homo sapiens
ugaagcuaggauuaauuuucau

SEQ ID NO: 261844 - RNA, 22 nt, Homo sapiens
ugaaggacauucuaugguagau

SEQ ID NO: 261845 - RNA, 20 nt, Homo sapiens
ugaaggaggucauuuauacc

SEQ ID NO: 261846 - RNA, 22 nt, Homo sapiens
ugaaggcaggagggagaaaagu

SEQ ID NO: 261847 - RNA, 22 nt, Homo sapiens
ugaaguaggcauaaguuaagcu

SEQ ID NO: 261848 - RNA, 21 nt, Homo sapiens
ugaaguguaaccgugcagggc

SEQ ID NO: 261849 - RNA, 22 nt, Homo sapiens
ugaaguguuuauuuuggccuuc

SEQ ID NO: 261850 - RNA, 22 nt, Homo sapiens
ugaauacugugcaaaggauuug

SEQ ID NO: 261851 - RNA, 22 nt, Homo sapiens
ugaauagagcugcaguggacau

SEQ ID NO: 261852 - RNA, 22 nt, Homo sapiens
ugaauauguuaauuagcaucau

SEQ ID NO: 261853 - RNA, 21 nt, Homo sapiens
ugaaugcuuuaaauauuagaa

SEQ ID NO: 261854 - RNA, 22 nt, Homo sapiens
ugaaugguuuuuagagaacaau

SEQ ID NO: 261855 - RNA, 22 nt, Homo sapiens
ugaauguaacuaaaccugugaa

SEQ ID NO: 261856 - RNA, 22 nt, Homo sapiens
ugaauguaacuaaaggacuuuu

SEQ ID NO: 261857 - RNA, 22 nt, Homo sapiens
ugaauguccauugauguuuuga

SEQ ID NO: 261858 - RNA, 22 nt, Homo sapiens
ugaauucuguccaaaauaacug

SEQ ID NO: 261859 - RNA, 22 nt, Homo sapiens
ugacaacugauuaacuccuuua

SEQ ID NO: 261860 - RNA, 22 nt, Homo sapiens
ugacaaguaaacagucagcacc

SEQ ID NO: 261861 - RNA, 23 nt, Homo sapiens
ugacagaccuucuggaagaaguc

SEQ ID NO: 261862 - RNA, 22 nt, Homo sapiens
ugacuagagggcuuuuguguag

SEQ ID NO: 261863 - RNA, 22 nt, Homo sapiens
ugacuaggaggcuggaggauga

SEQ ID NO: 261864 - RNA, 22 nt, Homo sapiens
ugacuaguuuugcuguuguuau

SEQ ID NO: 261865 - RNA, 22 nt, Homo sapiens
ugacuauaucucuguauaaacu

SEQ ID NO: 261866 - RNA, 23 nt, Homo sapiens
ugacugaguauauguuuggugcu

SEQ ID NO: 261867 - RNA, 22 nt, Homo sapiens
ugacuucagacugaaaugauuc

SEQ ID NO: 261868 - RNA, 22 nt, Homo sapiens
ugacuugauacauguuuuugaa

SEQ ID NO: 261869 - RNA, 22 nt, Homo sapiens
ugacuugauccauggggcucca

SEQ ID NO: 261870 - RNA, 22 nt, Homo sapiens
ugacuuuagaauuuuauccaga

SEQ ID NO: 261871 - RNA, 22 nt, Homo sapiens
ugagaacagauggcuuuauuau

SEQ ID NO: 261872 - RNA, 22 nt, Homo sapiens
ugagaacagcagcuugggacac

SEQ ID NO: 261873 - RNA, 17 nt, Homo sapiens
ugagaacaugugguauu

SEQ ID NO: 261874 - RNA, 22 nt, Homo sapiens
ugagaacggauacuaagggcug

SEQ ID NO: 261875 - RNA, 22 nt, Homo sapiens
ugagaagaugaacuccuugguc

SEQ ID NO: 261876 - RNA, 22 nt, Homo sapiens
ugagaagugacgcagcaggguu

SEQ ID NO: 261877 - RNA, 22 nt, Homo sapiens
ugagaagugauauagaaguuaa

SEQ ID NO: 261878 - RNA, 22 nt, Homo sapiens
ugagaaugacugggcaugcugc

SEQ ID NO: 261879 - RNA, 22 nt, Homo sapiens
ugagaaugcagaaucucgugca

SEQ ID NO: 261880 - RNA, 22 nt, Homo sapiens
ugagacaucucuccugagacag

SEQ ID NO: 261881 - RNA, 23 nt, Homo sapiens
ugagacauuggaaaguuaggcag

SEQ ID NO: 261882 - RNA, 22 nt, Homo sapiens
ugagaccuuucauuucucagug

SEQ ID NO: 261883 - RNA, 22 nt, Homo sapiens
ugagacggagucucacucuguu

SEQ ID NO: 261884 - RNA, 22 nt, Homo sapiens
ugagacggagucucgcucucua

SEQ ID NO: 261885 - RNA, 22 nt, Homo sapiens
ugagacggagucucgcucuguc

SEQ ID NO: 261886 - RNA, 22 nt, Homo sapiens
ugagacggaguuucacucuugu

SEQ ID NO: 261887 - RNA, 22 nt, Homo sapiens
ugagacggaguuuugcucuugu

SEQ ID NO: 261888 - RNA, 22 nt, Homo sapiens
ugagacugaaauuaggaaacug

SEQ ID NO: 261889 - RNA, 22 nt, Homo sapiens
ugagagaugaacuauucuugaa

SEQ ID NO: 261890 - RNA, 22 nt, Homo sapiens
ugagagcugcauucuugaaagc

SEQ ID NO: 261891 - RNA, 22 nt, Homo sapiens
ugagauauauauauuugagaca

SEQ ID NO: 261892 - RNA, 22 nt, Homo sapiens
ugagaucacgccacugcacucc

SEQ ID NO: 261893 - RNA, 22 nt, Homo sapiens
ugagaucugauaggccuggguu

SEQ ID NO: 261894 - RNA, 22 nt, Homo sapiens
ugagaucugucuuuauaguauu

SEQ ID NO: 261895 - RNA, 22 nt, Homo sapiens
ugagaucuucgcucuucacaga

SEQ ID NO: 261896 - RNA, 22 nt, Homo sapiens
ugagaucuuggaggcuuuguga

SEQ ID NO: 261897 - RNA, 22 nt, Homo sapiens
ugagaucuuuuguggcugagaa

SEQ ID NO: 261898 - RNA, 22 nt, Homo sapiens
ugagaugaaagcagaaagacuu

SEQ ID NO: 261899 - RNA, 22 nt, Homo sapiens
ugagaugaagcuagaagaaugg

SEQ ID NO: 261900 - RNA, 22 nt, Homo sapiens
ugagaugaagugauguaaaaca

SEQ ID NO: 261901 - RNA, 22 nt, Homo sapiens
ugagaugagucucgcucuguca

SEQ ID NO: 261902 - RNA, 22 nt, Homo sapiens
ugagaugaucaaaguauaggcu

SEQ ID NO: 261903 - RNA, 20 nt, Homo sapiens
ugagaugcauugggauguuu

SEQ ID NO: 261904 - RNA, 22 nt, Homo sapiens
ugagauggaguuucgcucuugu

SEQ ID NO: 261905 - RNA, 22 nt, Homo sapiens
ugagauggaguuucgcuuuugu

SEQ ID NO: 261906 - RNA, 22 nt, Homo sapiens
ugagauggcugaauucagaaua

SEQ ID NO: 261907 - RNA, 23 nt, Homo sapiens
ugagauuauaaucuuuuacuucu

SEQ ID NO: 261908 - RNA, 21 nt, Homo sapiens
ugagauuauauuaacauggua

SEQ ID NO: 261909 - RNA, 22 nt, Homo sapiens
ugagcaagaaauagaaacagau

SEQ ID NO: 261910 - RNA, 22 nt, Homo sapiens
ugagcacagagccugggguggc

SEQ ID NO: 261911 - RNA, 22 nt, Homo sapiens
ugagcacauuuacaucaguucc

SEQ ID NO: 261912 - RNA, 22 nt, Homo sapiens
ugagcagaaagcugcaaggucg

SEQ ID NO: 261913 - RNA, 22 nt, Homo sapiens
ugagcagagaagugcccugcgc

SEQ ID NO: 261914 - RNA, 22 nt, Homo sapiens
ugagcagaguuguuucuccuga

SEQ ID NO: 261915 - RNA, 22 nt, Homo sapiens
ugagccauggcaccuugucuaa

SEQ ID NO: 261916 - RNA, 17 nt, Homo sapiens
ugagcuaagauuacccc

SEQ ID NO: 261917 - RNA, 22 nt, Homo sapiens
ugagcuaggucuugcucuguca

SEQ ID NO: 261918 - RNA, 17 nt, Homo sapiens
ugagcuaugauccuguc

SEQ ID NO: 261919 - RNA, 22 nt, Homo sapiens
ugagcucagcuuucuuuuucac

SEQ ID NO: 261920 - RNA, 22 nt, Homo sapiens
ugagcugagaucgugccauugu

SEQ ID NO: 261921 - RNA, 22 nt, Homo sapiens
ugaggagugagaaauugguuuc

SEQ ID NO: 261922 - RNA, 22 nt, Homo sapiens
ugaggauaguguugaaggcagg

SEQ ID NO: 261923 - RNA, 22 nt, Homo sapiens
ugaggaucucuaggaauuuauc

SEQ ID NO: 261924 - RNA, 17 nt, Homo sapiens
ugaggcacuaguaucac

SEQ ID NO: 261925 - RNA, 22 nt, Homo sapiens
ugagguaauagauaauauuuuu

SEQ ID NO: 261926 - RNA, 22 nt, Homo sapiens
ugagguaaugcuguagcuguga

SEQ ID NO: 261927 - RNA, 22 nt, Homo sapiens
ugagguagaggugaacuugacc

SEQ ID NO: 261928 - RNA, 22 nt, Homo sapiens
ugaggucuuuauuuagugcuca

SEQ ID NO: 261929 - RNA, 22 nt, Homo sapiens
ugaggugaaguaauauucuaag

SEQ ID NO: 261930 - RNA, 22 nt, Homo sapiens
ugagguuggggucagggcuagc

SEQ ID NO: 261931 - RNA, 22 nt, Homo sapiens
ugagguugucagugucauucuu

SEQ ID NO: 261932 - RNA, 22 nt, Homo sapiens
ugagguuguccacuauaaucca

SEQ ID NO: 261933 - RNA, 22 nt, Homo sapiens
ugaguaauguugaucuuugaua

SEQ ID NO: 261934 - RNA, 22 nt, Homo sapiens
ugaguagaaauaaacgcaaacu

SEQ ID NO: 261935 - RNA, 22 nt, Homo sapiens
ugaguagaacaucaagucauac

SEQ ID NO: 261936 - RNA, 22 nt, Homo sapiens
cuaucacuguuuugaugcccgg

SEQ ID NO: 261937 - RNA, 22 nt, Homo sapiens
cuaugcuucuuaaauuaguuau

SEQ ID NO: 261938 - RNA, 22 nt, Homo sapiens
cuauggcucugucuuuuaaguu

SEQ ID NO: 261939 - RNA, 22 nt, Homo sapiens
cuauguaccuggaacuguauua

SEQ ID NO: 261940 - RNA, 22 nt, Homo sapiens
cuaugucuuucauauuuugggg

SEQ ID NO: 261941 - RNA, 22 nt, Homo sapiens
cucaaagucaagggaaagcagg

SEQ ID NO: 261942 - RNA, 22 nt, Homo sapiens
cucaaaguguggucuguggguu

SEQ ID NO: 261943 - RNA, 18 nt, Homo sapiens
cucaaccucaugcagggc

SEQ ID NO: 261944 - RNA, 22 nt, Homo sapiens
cucaaguacaugggauuacagg

SEQ ID NO: 261945 - RNA, 22 nt, Homo sapiens
cucacagucagaagggacuugc

SEQ ID NO: 261946 - RNA, 22 nt, Homo sapiens
cucaccuugugauccacccacc

SEQ ID NO: 261947 - RNA, 22 nt, Homo sapiens
cucacugcauuucaguuuuguu

SEQ ID NO: 261948 - RNA, 22 nt, Homo sapiens
cucacugucaacauguauuugg

SEQ ID NO: 261949 - RNA, 22 nt, Homo sapiens
cucagaguacuuuucccacuuc

SEQ ID NO: 261950 - RNA, 20 nt, Homo sapiens
cucagauuauucugaagcaa

SEQ ID NO: 261951 - RNA, 22 nt, Homo sapiens
cucagguaguuccuuauagcaa

SEQ ID NO: 261952 - RNA, 22 nt, Homo sapiens
cucagugucuggcacacagaaa

SEQ ID NO: 261953 - RNA, 22 nt, Homo sapiens
cucagugucuggggccccaggg

SEQ ID NO: 261954 - RNA, 22 nt, Homo sapiens
cucaguuuugccuuguuuaagg

SEQ ID NO: 261955 - RNA, 21 nt, Homo sapiens
cucauauugcuuuuccauggu

SEQ ID NO: 261956 - RNA, 22 nt, Homo sapiens
cucauggagauagagaauagaa

SEQ ID NO: 261957 - RNA, 22 nt, Homo sapiens
cuccaggugucauccaccuccu

SEQ ID NO: 261958 - RNA, 22 nt, Homo sapiens
cuccauuuaucugaaauuuuau

SEQ ID NO: 261959 - RNA, 22 nt, Homo sapiens
cucccacccucauuuuuaggca

SEQ ID NO: 261960 - RNA, 22 nt, Homo sapiens
cucccagugacccaggaacagg

SEQ ID NO: 261961 - RNA, 20 nt, Homo sapiens
cuccuucauuccuuuggacc

SEQ ID NO: 261962 - RNA, 22 nt, Homo sapiens
cuccuugauuagaguauagagu

SEQ ID NO: 261963 - RNA, 17 nt, Homo sapiens
cucucugguuuaaagca

SEQ ID NO: 261964 - RNA, 22 nt, Homo sapiens
cucugguucugcagugcacccu

SEQ ID NO: 261965 - RNA, 22 nt, Homo sapiens
cucugguuucgcaggaaauaga

SEQ ID NO: 261966 - RNA, 22 nt, Homo sapiens
cucuuagauuagccauccuaau

SEQ ID NO: 261967 - RNA, 22 nt, Homo sapiens
cucuuggguagauuuugcagag

SEQ ID NO: 261968 - RNA, 22 nt, Homo sapiens
cucuuuggaugccuuaggguua

SEQ ID NO: 261969 - RNA, 19 nt, Homo sapiens
cucuuuggugucucuucuu

SEQ ID NO: 261970 - RNA, 22 nt, Homo sapiens
cucuuuuguuccuaguuugauc

SEQ ID NO: 261971 - RNA, 22 nt, Homo sapiens
cugaaauggaaugugugcacag

SEQ ID NO: 261972 - RNA, 22 nt, Homo sapiens
cugaaauguccaucgacugaug

SEQ ID NO: 261973 - RNA, 22 nt, Homo sapiens
cugaaggcagguagaauagaga

SEQ ID NO: 261974 - RNA, 22 nt, Homo sapiens
cugaauguucuggauggaagag

SEQ ID NO: 261975 - RNA, 22 nt, Homo sapiens
cugacagucucauugauuugcu

SEQ ID NO: 261976 - RNA, 22 nt, Homo sapiens
cugaccauagacuacucugggc

SEQ ID NO: 261977 - RNA, 22 nt, Homo sapiens
cugacugugcaugcccagcccc

SEQ ID NO: 261978 - RNA, 22 nt, Homo sapiens
cugagagaugagaccucucacu

SEQ ID NO: 261979 - RNA, 22 nt, Homo sapiens
cugagauaauuucuagguguca

SEQ ID NO: 261980 - RNA, 22 nt, Homo sapiens
cugagauuaagauauugggagu

SEQ ID NO: 261981 - RNA, 22 nt, Homo sapiens
cugagcaaagaagugauaauga

SEQ ID NO: 261982 - RNA, 22 nt, Homo sapiens
cugagcaagucauuuuguuaaa

SEQ ID NO: 261983 - RNA, 22 nt, Homo sapiens
cugagcacugagauccucuagc

SEQ ID NO: 261984 - RNA, 18 nt, Homo sapiens
cugagcacugcuuuauga

SEQ ID NO: 261985 - RNA, 22 nt, Homo sapiens
cugagcuaugccuggaaaggca

SEQ ID NO: 261986 - RNA, 22 nt, Homo sapiens
cugaggguagaaggaucacuug

SEQ ID NO: 261987 - RNA, 22 nt, Homo sapiens
cugagguaauuuuccagauaau

SEQ ID NO: 261988 - RNA, 22 nt, Homo sapiens
cugaggugggagaaucacauaa

SEQ ID NO: 261989 - RNA, 20 nt, Homo sapiens
cugaggugggagaaucgcuu

SEQ ID NO: 261990 - RNA, 22 nt, Homo sapiens
cugaggugggaguuuuucucau

SEQ ID NO: 261991 - RNA, 22 nt, Homo sapiens
cugauaguucucuuuagaguuu

SEQ ID NO: 261992 - RNA, 22 nt, Homo sapiens
cugaucuggaggugucugggga

SEQ ID NO: 261993 - RNA, 22 nt, Homo sapiens
cugaugaaguauuuguucugga

SEQ ID NO: 261994 - RNA, 22 nt, Homo sapiens
cugauugucaucaauauuauua

SEQ ID NO: 261995 - RNA, 22 nt, Homo sapiens
cugauuguuugccucuaaaauc

SEQ ID NO: 261996 - RNA, 22 nt, Homo sapiens
uuagcagugugaaaaaagacua

SEQ ID NO: 261997 - RNA, 23 nt, Homo sapiens
uuaguaaacucaaugacaccaca

SEQ ID NO: 261998 - RNA, 22 nt, Homo sapiens
uuaguagagacgagcguuccac

SEQ ID NO: 261999 - RNA, 22 nt, Homo sapiens
uuaguagcacagaguaucagca

SEQ ID NO: 262000 - RNA, 22 nt, Homo sapiens
uuaguaucauccuucugcauuc

SEQ ID NO: 262001 - RNA, 22 nt, Homo sapiens
uuagugaaugcaccacuucuga

SEQ ID NO: 262002 - RNA, 22 nt, Homo sapiens
uuagugcuuacgaugagcuaag

SEQ ID NO: 262003 - RNA, 22 nt, Homo sapiens
uuaguggaugcugaauaaagaa

SEQ ID NO: 262004 - RNA, 22 nt, Homo sapiens
uuaguucauugugacuggacuc

SEQ ID NO: 262005 - RNA, 20 nt, Homo sapiens
uuaguucauuuagaagguuu

SEQ ID NO: 262006 - RNA, 22 nt, Homo sapiens
uuaguucccucauucuugacuu

SEQ ID NO: 262007 - RNA, 22 nt, Homo sapiens
uuaguuuaucagugguuucuga

SEQ ID NO: 262008 - RNA, 22 nt, Homo sapiens
uuauacacugugggaguguaaa

SEQ ID NO: 262009 - RNA, 22 nt, Homo sapiens
uuauacuacuauaaagagguag

SEQ ID NO: 262010 - RNA, 22 nt, Homo sapiens
uuauagcagugcaggaacagac

SEQ ID NO: 262011 - RNA, 22 nt, Homo sapiens
uuauauguuucuuagggacaga

SEQ ID NO: 262012 - RNA, 22 nt, Homo sapiens
uuaucagcagcaugaaacugga

SEQ ID NO: 262013 - RNA, 22 nt, Homo sapiens
uuaucucaguguuuguaaacaa

SEQ ID NO: 262014 - RNA, 22 nt, Homo sapiens
uuaugcaucuuccacacucauu

SEQ ID NO: 262015 - RNA, 22 nt, Homo sapiens
uuaugccagugauuauaagggc

SEQ ID NO: 262016 - RNA, 22 nt, Homo sapiens
uuaugcuugugugaauuuuccc

SEQ ID NO: 262017 - RNA, 22 nt, Homo sapiens
uuaugguacaugugcacaaugu

SEQ ID NO: 262018 - RNA, 22 nt, Homo sapiens
uuaugucuuuuguguucagcua

SEQ ID NO: 262019 - RNA, 22 nt, Homo sapiens
uuauucauuaauugcuaagguu

SEQ ID NO: 262020 - RNA, 16 nt, Homo sapiens
uuauugcauucuucuc

SEQ ID NO: 262021 - RNA, 22 nt, Homo sapiens
uuauuguccaaguuucccuuug

SEQ ID NO: 262022 - RNA, 22 nt, Homo sapiens
uucaaaguguugguuuugggcu

SEQ ID NO: 262023 - RNA, 22 nt, Homo sapiens
uucaaaguuggaggacaaacug

SEQ ID NO: 262024 - RNA, 22 nt, Homo sapiens
uucaagauggcaccagugagug

SEQ ID NO: 262025 - RNA, 22 nt, Homo sapiens
uucaaguaguucucaugccuca

SEQ ID NO: 262026 - RNA, 22 nt, Homo sapiens
uugagauggaguuucacucuug

SEQ ID NO: 262027 - RNA, 22 nt, Homo sapiens
uugagauggaguuucgcucuug

SEQ ID NO: 262028 - RNA, 22 nt, Homo sapiens
uugagauguaagauguuaauau

SEQ ID NO: 262029 - RNA, 22 nt, Homo sapiens
uugagauguaguuucacuccug

SEQ ID NO: 262030 - RNA, 22 nt, Homo sapiens
uugagcaaaacauuaauauuag

SEQ ID NO: 262031 - RNA, 22 nt, Homo sapiens
uugagcaacauagugagacugu

SEQ ID NO: 262032 - RNA, 21 nt, Homo sapiens
uugagcaacuaggguuauagg

SEQ ID NO: 262033 - RNA, 22 nt, Homo sapiens
uugagcacaggaguuugagacc

SEQ ID NO: 262034 - RNA, 22 nt, Homo sapiens
uugagcacauguguuaaggggu

SEQ ID NO: 262035 - RNA, 22 nt, Homo sapiens
uugagcaccaugccuggccaug

SEQ ID NO: 262036 - RNA, 22 nt, Homo sapiens
uugaggaaugucauuuguguuu

SEQ ID NO: 262037 - RNA, 22 nt, Homo sapiens
uugaggacugagacagaccaag

SEQ ID NO: 262038 - RNA, 22 nt, Homo sapiens
uugaggacuggaacacaggucu

SEQ ID NO: 262039 - RNA, 16 nt, Homo sapiens
uugaggcaugucucag

SEQ ID NO: 262040 - RNA, 22 nt, Homo sapiens
uugagggaaacauucacaucau

SEQ ID NO: 262041 - RNA, 22 nt, Homo sapiens
uugagggagcauuuguuuugag

SEQ ID NO: 262042 - RNA, 22 nt, Homo sapiens
uugagggaggcagggcuugucu

SEQ ID NO: 262043 - RNA, 22 nt, Homo sapiens
uugagguagcuuugauggaggu

SEQ ID NO: 262044 - RNA, 22 nt, Homo sapiens
uugagguauaaagguagguugu

SEQ ID NO: 262045 - RNA, 22 nt, Homo sapiens
uugagguuggaggccuugccug

SEQ ID NO: 262046 - RNA, 22 nt, Homo sapiens
uugaguagugugaugcaugucu

SEQ ID NO: 262047 - RNA, 22 nt, Homo sapiens
uugagugaaggcuguguucuug

SEQ ID NO: 262048 - RNA, 22 nt, Homo sapiens
uugauacuagagucuuucugac

SEQ ID NO: 262049 - RNA, 22 nt, Homo sapiens
uugauauguggaauauuuaucu

SEQ ID NO: 262050 - RNA, 22 nt, Homo sapiens
uugauauguguauagcaugugg

SEQ ID NO: 262051 - RNA, 22 nt, Homo sapiens
uugaucugugucccugcccaau

SEQ ID NO: 262052 - RNA, 22 nt, Homo sapiens
uugcaaagaccucuucacuucc

SEQ ID NO: 262053 - RNA, 23 nt, Homo sapiens
uugcaaagccugaaacucuucag

SEQ ID NO: 262054 - RNA, 22 nt, Homo sapiens
uugcaacauuguaaguuuauau

SEQ ID NO: 262055 - RNA, 22 nt, Homo sapiens
uugcaacuuagaaaaaucauuu

SEQ ID NO: 262056 - RNA, 22 nt, Homo sapiens
uugcacagucuagcuccaccuu

SEQ ID NO: 262057 - RNA, 22 nt, Homo sapiens
uugcacaguguguacagcacca

SEQ ID NO: 262058 - RNA, 22 nt, Homo sapiens
uugcacauggcaggugcucaau

SEQ ID NO: 262059 - RNA, 22 nt, Homo sapiens
uugcacauugauuuuguaucuu

SEQ ID NO: 262060 - RNA, 22 nt, Homo sapiens
uugcaccacugcguuccagccu

SEQ ID NO: 262061 - RNA, 22 nt, Homo sapiens
uugcaccccuacuauuugccaa

SEQ ID NO: 262062 - RNA, 22 nt, Homo sapiens
uugcacuccagcucuaggugac

SEQ ID NO: 262063 - RNA, 22 nt, Homo sapiens
uugcacugagauuuugcuuaca

SEQ ID NO: 262064 - RNA, 22 nt, Homo sapiens
uugcacuugcugaggagugauu

SEQ ID NO: 262065 - RNA, 22 nt, Homo sapiens
uugcagagucaguuauuuugcc

SEQ ID NO: 262066 - RNA, 22 nt, Homo sapiens
uugcagcauucugguuccuggu

SEQ ID NO: 262067 - RNA, 22 nt, Homo sapiens
uugcauaagugcauucugugau

SEQ ID NO: 262068 - RNA, 22 nt, Homo sapiens
uugcauaauaagauuggggggg

SEQ ID NO: 262069 - RNA, 22 nt, Homo sapiens
uugcauagaggugaguauagua

SEQ ID NO: 262070 - RNA, 19 nt, Homo sapiens
uugcauagguugaaccagc

SEQ ID NO: 262071 - RNA, 18 nt, Homo sapiens
uugcauaguguauccaaa

SEQ ID NO: 262072 - RNA, 22 nt, Homo sapiens
uugccaacauggugaacuccca

SEQ ID NO: 262073 - RNA, 22 nt, Homo sapiens
uugccacuucucuugccccauu

SEQ ID NO: 262074 - RNA, 22 nt, Homo sapiens
uugccugagaagccaagaauaa

SEQ ID NO: 262075 - RNA, 22 nt, Homo sapiens
uugcgaugaagacaaaacaugc

SEQ ID NO: 262076 - RNA, 22 nt, Homo sapiens
uugcuagagaugagggaugugu

SEQ ID NO: 262077 - RNA, 22 nt, Homo sapiens
uugcuagucucuguuucaggau

SEQ ID NO: 262078 - RNA, 22 nt, Homo sapiens
uugcuccccaggaaaggaagca

SEQ ID NO: 262079 - RNA, 22 nt, Homo sapiens
uugcuggugguucgagcaacac

SEQ ID NO: 262080 - RNA, 22 nt, Homo sapiens
uugcuuaggcuggagugcagug

SEQ ID NO: 262081 - RNA, 22 nt, Homo sapiens
uugcuuagucaugaaucacuga

SEQ ID NO: 262082 - RNA, 22 nt, Homo sapiens
ugagaucacuaagagguaaugg

SEQ ID NO: 262083 - RNA, 22 nt, Homo sapiens
ugagaucagaaggauuucucug

SEQ ID NO: 262084 - RNA, 22 nt, Homo sapiens
ugagaucagugaagaaguguuu

SEQ ID NO: 262085 - RNA, 22 nt, Homo sapiens
ugagauccaugcuauuugggcu

SEQ ID NO: 262086 - RNA, 22 nt, Homo sapiens
ugagaucgagucucgcucuguc

SEQ ID NO: 262087 - RNA, 19 nt, Homo sapiens
ugagaugaagacagggguu

SEQ ID NO: 262088 - RNA, 22 nt, Homo sapiens
ugagaugacgacacaccucagu

SEQ ID NO: 262089 - RNA, 22 nt, Homo sapiens
ugagaugagaaucaguucuaau

SEQ ID NO: 262090 - RNA, 22 nt, Homo sapiens
ugagaugauaucuuauuguaau

SEQ ID NO: 262091 - RNA, 21 nt, Homo sapiens
ugagaugauccugcaugcaug

SEQ ID NO: 262092 - RNA, 22 nt, Homo sapiens
ugagaugcaaaaugagaauugu

SEQ ID NO: 262093 - RNA, 21 nt, Homo sapiens
ugagaugcaaucaccagggag

SEQ ID NO: 262094 - RNA, 22 nt, Homo sapiens
ugagaugcauauucuggcuccu

SEQ ID NO: 262095 - RNA, 22 nt, Homo sapiens
ugagaugcuccucuugcaaagc

SEQ ID NO: 262096 - RNA, 22 nt, Homo sapiens
ugagaugcuuguaaauucauuu

SEQ ID NO: 262097 - RNA, 22 nt, Homo sapiens
ugagauggaguuucacuuuugu

SEQ ID NO: 262098 - RNA, 22 nt, Homo sapiens
ugagauggguaauuaaauggug

SEQ ID NO: 262099 - RNA, 22 nt, Homo sapiens
ugagauggguucugguccccug

SEQ ID NO: 262100 - RNA, 22 nt, Homo sapiens
ugagauguuccaaugacuauua

SEQ ID NO: 262101 - RNA, 22 nt, Homo sapiens
ugagauguugcucugaaacaag

SEQ ID NO: 262102 - RNA, 21 nt, Homo sapiens
ugagauuaaguuguuuagaag

SEQ ID NO: 262103 - RNA, 22 nt, Homo sapiens
ugagauuaaucuuuaaguaaga

SEQ ID NO: 262104 - RNA, 22 nt, Homo sapiens
ugagauuaucuguacauaggag

SEQ ID NO: 262105 - RNA, 22 nt, Homo sapiens
ugagauuguucuaugucugguu

SEQ ID NO: 262106 - RNA, 22 nt, Homo sapiens
ugagcaacauuucaaaacucca

SEQ ID NO: 262107 - RNA, 22 nt, Homo sapiens
ugagcaauaaaguuacacaguu

SEQ ID NO: 262108 - RNA, 23 nt, Homo sapiens
ugagcaauauucuacuauugagu

SEQ ID NO: 262109 - RNA, 22 nt, Homo sapiens
ugagcacagcgugugggagagc

SEQ ID NO: 262110 - RNA, 22 nt, Homo sapiens
ugagcacuguacuuuaucaggu

SEQ ID NO: 262111 - RNA, 22 nt, Homo sapiens
ugagcagagaucacggcauugu

SEQ ID NO: 262112 - RNA, 22 nt, Homo sapiens
ugagcagagggagaaguaaauu

SEQ ID NO: 262113 - RNA, 22 nt, Homo sapiens
ugagcaucucuaaaaggagcaa

SEQ ID NO: 262114 - RNA, 21 nt, Homo sapiens
ugagcauuaguacaguaggga

SEQ ID NO: 262115 - RNA, 22 nt, Homo sapiens
ugagccaaguucacaccauugc

SEQ ID NO: 262116 - RNA, 22 nt, Homo sapiens
ugagccaugguuagcuucucau

SEQ ID NO: 262117 - RNA, 20 nt, Homo sapiens
ugagcucaauuguugcaagu

SEQ ID NO: 262118 - RNA, 22 nt, Homo sapiens
ugagcucaugcauucuugagga

SEQ ID NO: 262119 - RNA, 22 nt, Homo sapiens
ugagcugagaucuuaccacugc

SEQ ID NO: 262120 - RNA, 22 nt, Homo sapiens
ugagcugagauuaagcugcugc

SEQ ID NO: 262121 - RNA, 18 nt, Homo sapiens
ugaggaaaggguuugcua

SEQ ID NO: 262122 - RNA, 22 nt, Homo sapiens
ugaggacugagaggcacugugg

SEQ ID NO: 262123 - RNA, 22 nt, Homo sapiens
ugaggcuaggauaggcugauuc

SEQ ID NO: 262124 - RNA, 17 nt, Homo sapiens
ugagggaugccugguuc

SEQ ID NO: 262125 - RNA, 22 nt, Homo sapiens
ugagguaucauugcccaggcug

SEQ ID NO: 262126 - RNA, 22 nt, Homo sapiens
ugaggucauucaugugggcgca

SEQ ID NO: 262127 - RNA, 22 nt, Homo sapiens
ugaggugagauggcuaccccaa

SEQ ID NO: 262128 - RNA, 22 nt, Homo sapiens
ugagguguuauccagaguucuu

SEQ ID NO: 262129 - RNA, 20 nt, Homo sapiens
ugaguagaggaguucuauca

SEQ ID NO: 262130 - RNA, 22 nt, Homo sapiens
ugaguagauccaagacuguccu

SEQ ID NO: 262131 - RNA, 21 nt, Homo sapiens
ugaguagcuagaacuaggggc

SEQ ID NO: 262132 - RNA, 22 nt, Homo sapiens
ugaguaggauugguauuucuuc

SEQ ID NO: 262133 - RNA, 22 nt, Homo sapiens
ugaguagugcugcaauaaacau

SEQ ID NO: 262134 - RNA, 22 nt, Homo sapiens
ugagucuguuccaaagaaauaa

SEQ ID NO: 262135 - RNA, 22 nt, Homo sapiens
ugagugugacuuagcagaagga

SEQ ID NO: 262136 - RNA, 22 nt, Homo sapiens
ugaguuagguguuuuaaauaua

SEQ ID NO: 262137 - RNA, 18 nt, Homo sapiens
ugaguucauuagacuucc

SEQ ID NO: 262138 - RNA, 22 nt, Homo sapiens
ugaguucuuccaccgggaccag

SEQ ID NO: 262139 - RNA, 22 nt, Homo sapiens
ugaguucuuuuagggauauugc

SEQ ID NO: 262140 - RNA, 23 nt, Homo sapiens
ugauaacagcauaugaagauucu

SEQ ID NO: 262141 - RNA, 22 nt, Homo sapiens
ugauaauguuaggcuuuauuca

SEQ ID NO: 262142 - RNA, 22 nt, Homo sapiens
uggagugcaauggcaccaucuu

SEQ ID NO: 262143 - RNA, 22 nt, Homo sapiens
uggaguguaauuagccaucagu

SEQ ID NO: 262144 - RNA, 22 nt, Homo sapiens
uggaguguagcggcaccuauua

SEQ ID NO: 262145 - RNA, 22 nt, Homo sapiens
uggauagaaauguacuguuuuc

SEQ ID NO: 262146 - RNA, 22 nt, Homo sapiens
uggauaguuuacugaagagugg

SEQ ID NO: 262147 - RNA, 22 nt, Homo sapiens
uggaucauucuuucuugcaggg

SEQ ID NO: 262148 - RNA, 21 nt, Homo sapiens
uggauugagaaccccaggagg

SEQ ID NO: 262149 - RNA, 22 nt, Homo sapiens
uggcaaaaaaacgcaauuacgu

SEQ ID NO: 262150 - RNA, 22 nt, Homo sapiens
uggcaaaaaucacaaguaccuu

SEQ ID NO: 262151 - RNA, 22 nt, Homo sapiens
uggcaaaucagaggcauggaca

SEQ ID NO: 262152 - RNA, 22 nt, Homo sapiens
uggcaacaucuggggacauguu

SEQ ID NO: 262153 - RNA, 22 nt, Homo sapiens
uggcaagaacgaaauguagggu

SEQ ID NO: 262154 - RNA, 23 nt, Homo sapiens
uggcaagaauucuuaccgugugg

SEQ ID NO: 262155 - RNA, 22 nt, Homo sapiens
uggcaagaccccaucucuacaa

SEQ ID NO: 262156 - RNA, 22 nt, Homo sapiens
uggcaccugacuccgagaugca

SEQ ID NO: 262157 - RNA, 22 nt, Homo sapiens
uggcacuaugugacaagguuuu

SEQ ID NO: 262158 - RNA, 22 nt, Homo sapiens
uggcaguuuacaaaugccauga

SEQ ID NO: 262159 - RNA, 22 nt, Homo sapiens
uggcauuuucucuguucuuaga

SEQ ID NO: 262160 - RNA, 22 nt, Homo sapiens
uggcauuuuguuuuagaauuag

SEQ ID NO: 262161 - RNA, 22 nt, Homo sapiens
uggccuguaacgcugucucagc

SEQ ID NO: 262162 - RNA, 22 nt, Homo sapiens
uggcgagaaaccauaugcuuuc

SEQ ID NO: 262163 - RNA, 22 nt, Homo sapiens
uggcgagaugcucgugugcaga

SEQ ID NO: 262164 - RNA, 22 nt, Homo sapiens
uggcgggaaaguugggagaaga

SEQ ID NO: 262165 - RNA, 22 nt, Homo sapiens
uggcuaaguuaaucaaggagau

SEQ ID NO: 262166 - RNA, 21 nt, Homo sapiens
uggcuauuucuguggcauaca

SEQ ID NO: 262167 - RNA, 22 nt, Homo sapiens
uggcuguuuauuucacaugggu

SEQ ID NO: 262168 - RNA, 22 nt, Homo sapiens
uuggccuccuggucauauccag

SEQ ID NO: 262169 - RNA, 22 nt, Homo sapiens
uuggcuacagauuaugaauuuc

SEQ ID NO: 262170 - RNA, 21 nt, Homo sapiens
uuggcuacugcuucagaggga

SEQ ID NO: 262171 - RNA, 22 nt, Homo sapiens
uuggcucugcgucucgcggacg

SEQ ID NO: 262172 - RNA, 22 nt, Homo sapiens
uuggcucuggcugggcuccagc

SEQ ID NO: 262173 - RNA, 22 nt, Homo sapiens
uuggcuuggagaguugaaaugu

SEQ ID NO: 262174 - RNA, 22 nt, Homo sapiens
uugggccacuuuaguuuccuua

SEQ ID NO: 262175 - RNA, 22 nt, Homo sapiens
uuggguagugaguuccuccagg

SEQ ID NO: 262176 - RNA, 22 nt, Homo sapiens
uuggucucaucaagagcagcuu

SEQ ID NO: 262177 - RNA, 20 nt, Homo sapiens
uuggugaccuacagaugugg

SEQ ID NO: 262178 - RNA, 23 nt, Homo sapiens
uuuguguccccacccaaaucuca

SEQ ID NO: 262179 - RNA, 22 nt, Homo sapiens
uuuguucaccucaaggauggga

SEQ ID NO: 262180 - RNA, 22 nt, Homo sapiens
uuuucaguggccauaguggaga

SEQ ID NO: 262181 - RNA, 22 nt, Homo sapiens
uuuugcacuguuuuaucugaca

SEQ ID NO: 262182 - RNA, 22 nt, Homo sapiens
uuuugcaguuacagagagugag

SEQ ID NO: 262183 - RNA, 22 nt, Homo sapiens
uuuugcauuggcugaggagugu

SEQ ID NO: 262184 - RNA, 22 nt, Homo sapiens
guauacaguugacccuugaacc

SEQ ID NO: 262185 - RNA, 22 nt, Homo sapiens
guauagcacauaauacuugaug

SEQ ID NO: 262186 - RNA, 22 nt, Homo sapiens
guauaguaguacaaaaguuuuu

SEQ ID NO: 262187 - RNA, 22 nt, Homo sapiens
guaucauuggcauguaaccaga

SEQ ID NO: 262188 - RNA, 22 nt, Homo sapiens
guauccugaaguucucagcacu

SEQ ID NO: 262189 - RNA, 22 nt, Homo sapiens
guaugauacuguaacagugggu

SEQ ID NO: 262190 - RNA, 22 nt, Homo sapiens
guauuagguuggugcaaaauug

SEQ ID NO: 262191 - RNA, 22 nt, Homo sapiens
guauugacauuuuuaaggaacu

SEQ ID NO: 262192 - RNA, 22 nt, Homo sapiens
guauuuuguuagggugugguau

SEQ ID NO: 262193 - RNA, 22 nt, Homo sapiens
gucacaggaaacuaauaugcgc

SEQ ID NO: 262194 - RNA, 22 nt, Homo sapiens
gucacugagcaauagaaaguuu

SEQ ID NO: 262195 - RNA, 22 nt, Homo sapiens
gucacugccugaggcugaugca

SEQ ID NO: 262196 - RNA, 22 nt, Homo sapiens
gucagaugcagauuccaguucu

SEQ ID NO: 262197 - RNA, 22 nt, Homo sapiens
gucagcaucaccaugucuauga

SEQ ID NO: 262198 - RNA, 22 nt, Homo sapiens
gucaggcaccgauacaguuuuu

SEQ ID NO: 262199 - RNA, 22 nt, Homo sapiens
gucagggagucucuaucagugg

SEQ ID NO: 262200 - RNA, 22 nt, Homo sapiens
gucagugugauaucugcagggg

SEQ ID NO: 262201 - RNA, 22 nt, Homo sapiens
gucauguuuaacuucuugagga

SEQ ID NO: 262202 - RNA, 22 nt, Homo sapiens
gucauugucaauugacaauugu

SEQ ID NO: 262203 - RNA, 22 nt, Homo sapiens
guccaguacucuuuccugaaaa

SEQ ID NO: 262204 - RNA, 22 nt, Homo sapiens
guccaguuguuuucugagguug

SEQ ID NO: 262205 - RNA, 20 nt, Homo sapiens
guccauuugcugccauugcu

SEQ ID NO: 262206 - RNA, 22 nt, Homo sapiens
gucccagagauauugugucuuu

SEQ ID NO: 262207 - RNA, 22 nt, Homo sapiens
guccuggagaagcguggaccgg

SEQ ID NO: 262208 - RNA, 22 nt, Homo sapiens
gucuagaacuucugaccuuagg

SEQ ID NO: 262209 - RNA, 22 nt, Homo sapiens
gucucuugguuuagagcauuua

SEQ ID NO: 262210 - RNA, 22 nt, Homo sapiens
gucugagcauggggccggcagg

SEQ ID NO: 262211 - RNA, 22 nt, Homo sapiens
gucuggcaauggcagacuggca

SEQ ID NO: 262212 - RNA, 22 nt, Homo sapiens
gucugguacuuguuuguaaggg

SEQ ID NO: 262213 - RNA, 22 nt, Homo sapiens
gucugguuggaguaguuuucag

SEQ ID NO: 262214 - RNA, 20 nt, Homo sapiens
gucugucuccgaguagaauu

SEQ ID NO: 262215 - RNA, 22 nt, Homo sapiens
gucugugcauuaauacgugcug

SEQ ID NO: 262216 - RNA, 22 nt, Homo sapiens
gucuuugcuuuuaaccagaggu

SEQ ID NO: 262217 - RNA, 17 nt, Homo sapiens
gucuuugguugaguuua

SEQ ID NO: 262218 - RNA, 22 nt, Homo sapiens
gugaaagacauauaugguuuga

SEQ ID NO: 262219 - RNA, 15 nt, Homo sapiens
gugaaauguuucaga

SEQ ID NO: 262220 - RNA, 22 nt, Homo sapiens
gugacagaguaagacccuguau

SEQ ID NO: 262221 - RNA, 22 nt, Homo sapiens
gugacaucagcuccagguauaa

SEQ ID NO: 262222 - RNA, 22 nt, Homo sapiens
gugaccaaagauagcucaaguu

SEQ ID NO: 262223 - RNA, 22 nt, Homo sapiens
gugacuggacucugaagaaaau

SEQ ID NO: 262224 - RNA, 22 nt, Homo sapiens
gugacugggaguggugaagaua

SEQ ID NO: 262225 - RNA, 22 nt, Homo sapiens
gugagaauugacacccuugucu

SEQ ID NO: 262226 - RNA, 22 nt, Homo sapiens
gugagaugguaucucauugugg

SEQ ID NO: 262227 - RNA, 22 nt, Homo sapiens
gugagcaauugauacuugaagu

SEQ ID NO: 262228 - RNA, 22 nt, Homo sapiens
gugagcagagaucgcgugauug

SEQ ID NO: 262229 - RNA, 22 nt, Homo sapiens
gugagcuauguccugguuuggg

SEQ ID NO: 262230 - RNA, 22 nt, Homo sapiens
gugaggaaggaaaccugcuagc

SEQ ID NO: 262231 - RNA, 21 nt, Homo sapiens
gugaggucauugggcuuucug

SEQ ID NO: 262232 - RNA, 22 nt, Homo sapiens
gugagucaugucccaucugauu

SEQ ID NO: 262233 - RNA, 22 nt, Homo sapiens
gugaguuauuauuuauguaaac

SEQ ID NO: 262234 - RNA, 22 nt, Homo sapiens
gugauagguugucacugucacu

SEQ ID NO: 262235 - RNA, 22 nt, Homo sapiens
gugaucaugauccugaagcauu

SEQ ID NO: 262236 - RNA, 22 nt, Homo sapiens
gugaucucauuuggaauuagag

SEQ ID NO: 262237 - RNA, 22 nt, Homo sapiens
gugaugcaguacguagaggaga

SEQ ID NO: 262238 - RNA, 22 nt, Homo sapiens
gugaugguaguuuguauuucug

SEQ ID NO: 262239 - RNA, 22 nt, Homo sapiens
gugauugcauuaugaauauuau

SEQ ID NO: 262240 - RNA, 22 nt, Homo sapiens
gugcaaauguuauugagguuuu

SEQ ID NO: 262241 - RNA, 22 nt, Homo sapiens
gugcaaauuccagcucaacucc

SEQ ID NO: 262242 - RNA, 22 nt, Homo sapiens
gugcacaacgugcaggcuuguu

SEQ ID NO: 262243 - RNA, 22 nt, Homo sapiens
gugcacaacgugcagguuuguu

SEQ ID NO: 262244 - RNA, 22 nt, Homo sapiens
gugcacaacguguagguuuguu

SEQ ID NO: 262245 - RNA, 22 nt, Homo sapiens
gugcacaaugugcagguuuguu

SEQ ID NO: 262246 - RNA, 22 nt, Homo sapiens
gugcacauauggugcauaagug

SEQ ID NO: 262247 - RNA, 23 nt, Homo sapiens
gugcaguggcgagauuucggcuc

SEQ ID NO: 262248 - RNA, 22 nt, Homo sapiens
gugcaguguuugcauggaauca

SEQ ID NO: 262249 - RNA, 22 nt, Homo sapiens
gugcaguuuacaguuacccagu

SEQ ID NO: 262250 - RNA, 22 nt, Homo sapiens
gugcaguuugaaaguagaaaca

SEQ ID NO: 262251 - RNA, 22 nt, Homo sapiens
gugcuaggugcuaggaagauag

SEQ ID NO: 262252 - RNA, 22 nt, Homo sapiens
gugcuuuguuguggcaguggca

SEQ ID NO: 262253 - RNA, 21 nt, Homo sapiens
guggaaauggaauuuacuaau

SEQ ID NO: 262254 - RNA, 22 nt, Homo sapiens
guggaagaaaucagguuauuug

SEQ ID NO: 262255 - RNA, 20 nt, Homo sapiens
guggaagauaaguagccuga

SEQ ID NO: 262256 - RNA, 22 nt, Homo sapiens
guggaagucuuugguauuggua

SEQ ID NO: 262257 - RNA, 22 nt, Homo sapiens
guggaagugucuggggccaggg

SEQ ID NO: 262258 - RNA, 22 nt, Homo sapiens
guggcaguuuuaaauaugaaaa

SEQ ID NO: 262259 - RNA, 22 nt, Homo sapiens
guggcaugaaagcaucugugau

SEQ ID NO: 262260 - RNA, 22 nt, Homo sapiens
guggcuaaagauuuggaaucug

SEQ ID NO: 262261 - RNA, 22 nt, Homo sapiens
guggcuauucaccuuuaugaaa

SEQ ID NO: 262262 - RNA, 22 nt, Homo sapiens
gugggauauaaucaguccugua

SEQ ID NO: 262263 - RNA, 22 nt, Homo sapiens
gugguucuagaauugaguaucc

SEQ ID NO: 262264 - RNA, 22 nt, Homo sapiens
gugguuuuaucccagaaauuaa

SEQ ID NO: 262265 - RNA, 22 nt, Homo sapiens
gugguuuuuagauuucuacagu

SEQ ID NO: 262266 - RNA, 22 nt, Homo sapiens
guguaaaacaauuagaggauuu

SEQ ID NO: 262267 - RNA, 22 nt, Homo sapiens
uggcaagauuguuccgguuugg

SEQ ID NO: 262268 - RNA, 23 nt, Homo sapiens
uggcaagauuuguauugccugga

SEQ ID NO: 262269 - RNA, 18 nt, Homo sapiens
uggcaaguuuaguagcac

SEQ ID NO: 262270 - RNA, 22 nt, Homo sapiens
uggcaauauccacaauuacuuu

SEQ ID NO: 262271 - RNA, 19 nt, Homo sapiens
uggcaaugucagcagagau

SEQ ID NO: 262272 - RNA, 22 nt, Homo sapiens
uggcacaaugacccuugugggc

SEQ ID NO: 262273 - RNA, 19 nt, Homo sapiens
uggcacauguauacauaug

SEQ ID NO: 262274 - RNA, 22 nt, Homo sapiens
uggcaccauccaggugucucua

SEQ ID NO: 262275 - RNA, 22 nt, Homo sapiens
uggcagcgugaauguggcugaa

SEQ ID NO: 262276 - RNA, 22 nt, Homo sapiens
uggcaggugcacuggcuuugaa

SEQ ID NO: 262277 - RNA, 22 nt, Homo sapiens
uggcaguuuuaugugguucaac

SEQ ID NO: 262278 - RNA, 22 nt, Homo sapiens
uggcaugaagaccccauccuuu

SEQ ID NO: 262279 - RNA, 17 nt, Homo sapiens
uggcaugaggguguggg

SEQ ID NO: 262280 - RNA, 22 nt, Homo sapiens
uggcaugauccuagauucaaca

SEQ ID NO: 262281 - RNA, 22 nt, Homo sapiens
uggcauggaaagcuuuucauac

SEQ ID NO: 262282 - RNA, 22 nt, Homo sapiens
uggcauggaguggauggcccca

SEQ ID NO: 262283 - RNA, 22 nt, Homo sapiens
uggcaugggguaguagcgcugg

SEQ ID NO: 262284 - RNA, 18 nt, Homo sapiens
uggccaauggcaaacaga

SEQ ID NO: 262285 - RNA, 22 nt, Homo sapiens
uggccagagggcaauuagcugu

SEQ ID NO: 262286 - RNA, 22 nt, Homo sapiens
uggccagugucggaggccagga

SEQ ID NO: 262287 - RNA, 22 nt, Homo sapiens
uggccaguguuuuuccugggcu

SEQ ID NO: 262288 - RNA, 22 nt, Homo sapiens
uggcccccucccaaaucucaua

SEQ ID NO: 262289 - RNA, 22 nt, Homo sapiens
uggcuagaccugcauaacagcu

SEQ ID NO: 262290 - RNA, 23 nt, Homo sapiens
uggcuagacguccuuuccugaug

SEQ ID NO: 262291 - RNA, 22 nt, Homo sapiens
uggcuagaugagauguacugca

SEQ ID NO: 262292 - RNA, 22 nt, Homo sapiens
uggcucauuucuaaacccagcu

SEQ ID NO: 262293 - RNA, 22 nt, Homo sapiens
uggcuguguccucucccaaauc

SEQ ID NO: 262294 - RNA, 20 nt, Homo sapiens
uggcuucuuaauugcaggca

SEQ ID NO: 262295 - RNA, 22 nt, Homo sapiens
uggcuugauggcacaagguuuc

SEQ ID NO: 262296 - RNA, 22 nt, Homo sapiens
uggcuuuuaucuacucucaacu

SEQ ID NO: 262297 - RNA, 22 nt, Homo sapiens
uggcuuuucauccugggacauu

SEQ ID NO: 262298 - RNA, 22 nt, Homo sapiens
ugggagugugcacaauuucagc

SEQ ID NO: 262299 - RNA, 22 nt, Homo sapiens
ugggaucgucaagugaggcucg

SEQ ID NO: 262300 - RNA, 22 nt, Homo sapiens
ugggcaaaacuaagagcugugg

SEQ ID NO: 262301 - RNA, 22 nt, Homo sapiens
uggguagagaaucaggaucuua

SEQ ID NO: 262302 - RNA, 22 nt, Homo sapiens
uggguagaugaauccauuccaa

SEQ ID NO: 262303 - RNA, 22 nt, Homo sapiens
ugguaagaaaaccauuauuagc

SEQ ID NO: 262304 - RNA, 22 nt, Homo sapiens
ugguaagaggcccugaguuugu

SEQ ID NO: 262305 - RNA, 22 nt, Homo sapiens
ugguauuuaauauaugagaguu

SEQ ID NO: 262306 - RNA, 22 nt, Homo sapiens
uggucaccugaauuaugcaugu

SEQ ID NO: 262307 - RNA, 22 nt, Homo sapiens
uggucauggggcagcugacacu

SEQ ID NO: 262308 - RNA, 22 nt, Homo sapiens
uggugcaaugaagugaucucaa

SEQ ID NO: 262309 - RNA, 20 nt, Homo sapiens
ugguguuugaacagugaaug

SEQ ID NO: 262310 - RNA, 23 nt, Homo sapiens
ugguuuguaagagauggacugga

SEQ ID NO: 262311 - RNA, 22 nt, Homo sapiens
uguaaaaagcccagccgcugag

SEQ ID NO: 262312 - RNA, 22 nt, Homo sapiens
uguaaacuuuugagauugacuu

SEQ ID NO: 262313 - RNA, 22 nt, Homo sapiens
uguaacacacacuguuuacucc

SEQ ID NO: 262314 - RNA, 20 nt, Homo sapiens
uguaacacauggagaacucu

SEQ ID NO: 262315 - RNA, 22 nt, Homo sapiens
uguaagcagcagagacuauccu

SEQ ID NO: 262316 - RNA, 19 nt, Homo sapiens
uguaccagcaagucuuuuc

SEQ ID NO: 262317 - RNA, 22 nt, Homo sapiens
uguagacaccaaagacagcaua

SEQ ID NO: 262318 - RNA, 22 nt, Homo sapiens
uguagauaucuaucaggucaau

SEQ ID NO: 262319 - RNA, 22 nt, Homo sapiens
uguagcaaaucgauacuauugg

SEQ ID NO: 262320 - RNA, 22 nt, Homo sapiens
uguagcacauuugaagagaagc

SEQ ID NO: 262321 - RNA, 21 nt, Homo sapiens
uguauacauauguuaggugca

SEQ ID NO: 262322 - RNA, 22 nt, Homo sapiens
uguauauguuuguacauauguc

SEQ ID NO: 262323 - RNA, 22 nt, Homo sapiens
uguaugagagugaaagcauuuc

SEQ ID NO: 262324 - RNA, 22 nt, Homo sapiens
uguaugaguuguuuauaaauuu

SEQ ID NO: 262325 - RNA, 22 nt, Homo sapiens
uguaugcuuuugagagauauuu

SEQ ID NO: 262326 - RNA, 22 nt, Homo sapiens
uguauguaaagacaggauaaca

SEQ ID NO: 262327 - RNA, 22 nt, Homo sapiens
uguaugucuucuuuagauaagu

SEQ ID NO: 262328 - RNA, 22 nt, Homo sapiens
uguauuuguuguuaaauggaga

SEQ ID NO: 262329 - RNA, 22 nt, Homo sapiens
ugucaaacauuaugaugcucua

SEQ ID NO: 262330 - RNA, 22 nt, Homo sapiens
ugucaaaugcagugauauuuga

SEQ ID NO: 262331 - RNA, 22 nt, Homo sapiens
ugucaagaugguuugauguugu

SEQ ID NO: 262332 - RNA, 21 nt, Homo sapiens
ugucaagugggaaaacaugua

SEQ ID NO: 262333 - RNA, 22 nt, Homo sapiens
gugacuacaggccacaguuugg

SEQ ID NO: 262334 - RNA, 22 nt, Homo sapiens
gugacugcauccauccaggcuu

SEQ ID NO: 262335 - RNA, 22 nt, Homo sapiens
gugagaagaaaaauauggcugu

SEQ ID NO: 262336 - RNA, 22 nt, Homo sapiens
gugagaccaauguacuaccuuc

SEQ ID NO: 262337 - RNA, 22 nt, Homo sapiens
gugagagaaugacuauguguuu

SEQ ID NO: 262338 - RNA, 22 nt, Homo sapiens
gugagauccucucuuauauggg

SEQ ID NO: 262339 - RNA, 22 nt, Homo sapiens
gugagaugaggucucacucugu

SEQ ID NO: 262340 - RNA, 22 nt, Homo sapiens
gugagauggaguuggugucuuu

SEQ ID NO: 262341 - RNA, 22 nt, Homo sapiens
gugagauuaguucuggaccugg

SEQ ID NO: 262342 - RNA, 22 nt, Homo sapiens
gugagcauuacucaugggauca

SEQ ID NO: 262343 - RNA, 22 nt, Homo sapiens
gugagcuccucuucugcugcag

SEQ ID NO: 262344 - RNA, 21 nt, Homo sapiens
gugaggaguuacuggcuuuga

SEQ ID NO: 262345 - RNA, 22 nt, Homo sapiens
gugagggaugugaaaaagguca

SEQ ID NO: 262346 - RNA, 22 nt, Homo sapiens
gugagguaagaguugcuuugcu

SEQ ID NO: 262347 - RNA, 22 nt, Homo sapiens
gugagguagagcaugugaaaga

SEQ ID NO: 262348 - RNA, 17 nt, Homo sapiens
gugagguauccucaaaa

SEQ ID NO: 262349 - RNA, 22 nt, Homo sapiens
gugaggucagggcuguggacag

SEQ ID NO: 262350 - RNA, 22 nt, Homo sapiens
gugagguugaaaauaauggaaa

SEQ ID NO: 262351 - RNA, 22 nt, Homo sapiens
gugauaucacuguaucacucca

SEQ ID NO: 262352 - RNA, 21 nt, Homo sapiens
gugaucaugucacugcacucc

SEQ ID NO: 262353 - RNA, 22 nt, Homo sapiens
gugauguguuucaacagcuccu

SEQ ID NO: 262354 - RNA, 22 nt, Homo sapiens
gugauguguuuguucuaucucu

SEQ ID NO: 262355 - RNA, 22 nt, Homo sapiens
gugauuauuaugcacugcaugc

SEQ ID NO: 262356 - RNA, 22 nt, Homo sapiens
gugauuuaguagaugcuaguua

SEQ ID NO: 262357 - RNA, 21 nt, Homo sapiens
gugcaaacaucauagaaugua

SEQ ID NO: 262358 - RNA, 21 nt, Homo sapiens
gugcaacucccucucccuaca

SEQ ID NO: 262359 - RNA, 22 nt, Homo sapiens
gugcaagcaucauggaguguac

SEQ ID NO: 262360 - RNA, 22 nt, Homo sapiens
gugcacaaaucuuaaauguaca

SEQ ID NO: 262361 - RNA, 22 nt, Homo sapiens
gugcacaacaugcagguuuguu

SEQ ID NO: 262362 - RNA, 22 nt, Homo sapiens
gugcacaucgugcagguuuguu

SEQ ID NO: 262363 - RNA, 22 nt, Homo sapiens
gugcacaucuguguuccagcua

SEQ ID NO: 262364 - RNA, 22 nt, Homo sapiens
gugcacauuguuuaugucuguu

SEQ ID NO: 262365 - RNA, 22 nt, Homo sapiens
gugcacuguagaacccuuuguu

SEQ ID NO: 262366 - RNA, 22 nt, Homo sapiens
gugcagugugauccuuccguau

SEQ ID NO: 262367 - RNA, 22 nt, Homo sapiens
gugcaguuuuaagugaguuucu

SEQ ID NO: 262368 - RNA, 22 nt, Homo sapiens
gugcauacgucuuuauaguagc

SEQ ID NO: 262369 - RNA, 22 nt, Homo sapiens
gugcauaucugugguuggcuga

SEQ ID NO: 262370 - RNA, 22 nt, Homo sapiens
gugcauaugcaugugcaugcac

SEQ ID NO: 262371 - RNA, 23 nt, Homo sapiens
gugcaugagucuuuauaguagca

SEQ ID NO: 262372 - RNA, 22 nt, Homo sapiens
gugcaugcaucuuuauaguagc

SEQ ID NO: 262373 - RNA, 22 nt, Homo sapiens
gugcaugucuaugcgagucuaa

SEQ ID NO: 262374 - RNA, 22 nt, Homo sapiens
gugccacaguguuaagggauuc

SEQ ID NO: 262375 - RNA, 22 nt, Homo sapiens
gugccacugcaccuggccuaag

SEQ ID NO: 262376 - RNA, 19 nt, Homo sapiens
uacaggacugagcugaggu

SEQ ID NO: 262377 - RNA, 22 nt, Homo sapiens
uacaggauagacaauuuauuaa

SEQ ID NO: 262378 - RNA, 22 nt, Homo sapiens
uacaggcaccuggcuaauuuuu

SEQ ID NO: 262379 - RNA, 22 nt, Homo sapiens
uacaggugcuuauguggacaua

SEQ ID NO: 262380 - RNA, 22 nt, Homo sapiens
uacaguaauguuaaucuuugug

SEQ ID NO: 262381 - RNA, 22 nt, Homo sapiens
uacaguacagugacaccauuau

SEQ ID NO: 262382 - RNA, 22 nt, Homo sapiens
uacaguaguaucuucauuuguu

SEQ ID NO: 262383 - RNA, 22 nt, Homo sapiens
uacagugcauagaggcaugaua

SEQ ID NO: 262384 - RNA, 22 nt, Homo sapiens
uacagugcuugguaucuaguaa

SEQ ID NO: 262385 - RNA, 22 nt, Homo sapiens
uacaguggugugaucucagcuc

SEQ ID NO: 262386 - RNA, 22 nt, Homo sapiens
uacaugcaugggcaugugugca

SEQ ID NO: 262387 - RNA, 22 nt, Homo sapiens
uacauguauguguuuauggcug

SEQ ID NO: 262388 - RNA, 22 nt, Homo sapiens
uaccacagucauuacacuugua

SEQ ID NO: 262389 - RNA, 22 nt, Homo sapiens
uaccauguauguuucuccauug

SEQ ID NO: 262390 - RNA, 22 nt, Homo sapiens
uacccaguaacaaguauuuugg

SEQ ID NO: 262391 - RNA, 20 nt, Homo sapiens
uacccgugaauguuuauucu

SEQ ID NO: 262392 - RNA, 22 nt, Homo sapiens
uaccugagaaagaaagcccucg

SEQ ID NO: 262393 - RNA, 22 nt, Homo sapiens
uacuauugcaucggugauuagg

SEQ ID NO: 262394 - RNA, 22 nt, Homo sapiens
uacucaauugcagucaccuggc

SEQ ID NO: 262395 - RNA, 22 nt, Homo sapiens
uacucugcagagaugcauaaca

SEQ ID NO: 262396 - RNA, 22 nt, Homo sapiens
uacucuuuagcuccuuaaggaa

SEQ ID NO: 262397 - RNA, 22 nt, Homo sapiens
uacugcacuccacccuggguga

SEQ ID NO: 262398 - RNA, 22 nt, Homo sapiens
uacugcacuggaggccucagau

SEQ ID NO: 262399 - RNA, 22 nt, Homo sapiens
uacugcaguugcagcuugagga

SEQ ID NO: 262400 - RNA, 23 nt, Homo sapiens
uacugcauccuccgccucuaggg

SEQ ID NO: 262401 - RNA, 21 nt, Homo sapiens
uacuugagacagggucuugcu

SEQ ID NO: 262402 - RNA, 22 nt, Homo sapiens
uagaauggaaggcauguuugcc

SEQ ID NO: 262403 - RNA, 22 nt, Homo sapiens
uagaauggaagguugagaagaa

SEQ ID NO: 262404 - RNA, 22 nt, Homo sapiens
uagacaacugaaacacugugca

SEQ ID NO: 262405 - RNA, 22 nt, Homo sapiens
uagacacuagauaugugacuga

SEQ ID NO: 262406 - RNA, 22 nt, Homo sapiens
uagaccaauuggcauauaguaa

SEQ ID NO: 262407 - RNA, 20 nt, Homo sapiens
uagagagauauggggguucc

SEQ ID NO: 262408 - RNA, 22 nt, Homo sapiens
uagaggaaugaauuuggccaga

SEQ ID NO: 262409 - RNA, 22 nt, Homo sapiens
uagagguucuaagauucucaga

SEQ ID NO: 262410 - RNA, 22 nt, Homo sapiens
uagaucauauacuugccaugac

SEQ ID NO: 262411 - RNA, 23 nt, Homo sapiens
uagaucaucaaguuuacugugcu

SEQ ID NO: 262412 - RNA, 22 nt, Homo sapiens
uagaucuuuaaaaggugcuaga

SEQ ID NO: 262413 - RNA, 21 nt, Homo sapiens
uagaugguguucuagagagaa

SEQ ID NO: 262414 - RNA, 19 nt, Homo sapiens
uagaugucuuugcauagau

SEQ ID NO: 262415 - RNA, 22 nt, Homo sapiens
uagcaaaucaauggaauugaag

SEQ ID NO: 262416 - RNA, 22 nt, Homo sapiens
uagcacagggaauugguucucu

SEQ ID NO: 262417 - RNA, 22 nt, Homo sapiens
uagcacaucuucuuggccugca

SEQ ID NO: 262418 - RNA, 22 nt, Homo sapiens
uagcagcaccccacucuacugg

SEQ ID NO: 262419 - RNA, 21 nt, Homo sapiens
uauaguaguaugauuuacaau

SEQ ID NO: 262420 - RNA, 22 nt, Homo sapiens
uauaucacaugcacucauuuuc

SEQ ID NO: 262421 - RNA, 22 nt, Homo sapiens
uauaucuguccauggcccugcu

SEQ ID NO: 262422 - RNA, 22 nt, Homo sapiens
uauaugcauugugggguacuga

SEQ ID NO: 262423 - RNA, 22 nt, Homo sapiens
uauaugucuuuguuauguugag

SEQ ID NO: 262424 - RNA, 22 nt, Homo sapiens
uauauguuuucauaaggcuaga

SEQ ID NO: 262425 - RNA, 22 nt, Homo sapiens
uaucacacuggaagaaguuaag

SEQ ID NO: 262426 - RNA, 22 nt, Homo sapiens
uaucacacuguuggauuugauu

SEQ ID NO: 262427 - RNA, 22 nt, Homo sapiens
uaucacagaggguauccuagag

SEQ ID NO: 262428 - RNA, 22 nt, Homo sapiens
uaucacagauauuaugggccaa

SEQ ID NO: 262429 - RNA, 20 nt, Homo sapiens
uaucacaguucaggaacucu

SEQ ID NO: 262430 - RNA, 22 nt, Homo sapiens
uaucauagacaaucaguuauug

SEQ ID NO: 262431 - RNA, 22 nt, Homo sapiens
uaucucaguguacaggaugaua

SEQ ID NO: 262432 - RNA, 21 nt, Homo sapiens
uaucucaguuuuccuuugugg

SEQ ID NO: 262433 - RNA, 22 nt, Homo sapiens
uaucugcaucccauuuuuauca

SEQ ID NO: 262434 - RNA, 20 nt, Homo sapiens
uaugaaacaguguagagcaa

SEQ ID NO: 262435 - RNA, 22 nt, Homo sapiens
uaugaccuuguccccucucgcc

SEQ ID NO: 262436 - RNA, 22 nt, Homo sapiens
uaugacuguuugcucauucagg

SEQ ID NO: 262437 - RNA, 22 nt, Homo sapiens
uaugcacacguguccaugugca

SEQ ID NO: 262438 - RNA, 22 nt, Homo sapiens
uaugcacuauggaaguagcuca

SEQ ID NO: 262439 - RNA, 19 nt, Homo sapiens
uaugcuauuuauuagaagu

SEQ ID NO: 262440 - RNA, 22 nt, Homo sapiens
uaugcuuauaaacauuugucag

SEQ ID NO: 262441 - RNA, 22 nt, Homo sapiens
uaugcuuguuuauuuaagaaac

SEQ ID NO: 262442 - RNA, 22 nt, Homo sapiens
uauggcaaugcauaggaaggaa

SEQ ID NO: 262443 - RNA, 22 nt, Homo sapiens
uauggcauguauguguggcgca

SEQ ID NO: 262444 - RNA, 22 nt, Homo sapiens
uauggcauuguuggugaugaua

SEQ ID NO: 262445 - RNA, 22 nt, Homo sapiens
uauggcuuuguucaacagccuc

SEQ ID NO: 262446 - RNA, 19 nt, Homo sapiens
uaugggauuuuuagggugu

SEQ ID NO: 262447 - RNA, 22 nt, Homo sapiens
uaugugcacaugcccuggugac

SEQ ID NO: 262448 - RNA, 22 nt, Homo sapiens
uauuacuugucugugucucaau

SEQ ID NO: 262449 - RNA, 22 nt, Homo sapiens
uauuauuguccuucuauaccca

SEQ ID NO: 262450 - RNA, 22 nt, Homo sapiens
uauuccacaauaugauuuuuaa

SEQ ID NO: 262451 - RNA, 22 nt, Homo sapiens
uauuccuuuugcauuuccacau

SEQ ID NO: 262452 - RNA, 22 nt, Homo sapiens
uauugacuugagaagggauuag

SEQ ID NO: 262453 - RNA, 22 nt, Homo sapiens
uauugacuuuuuuguuaggagg

SEQ ID NO: 262454 - RNA, 22 nt, Homo sapiens
uauugcaauuggcagagugcua

SEQ ID NO: 262455 - RNA, 22 nt, Homo sapiens
uauugcacaugaggagacauug

SEQ ID NO: 262456 - RNA, 22 nt, Homo sapiens
uauugcagugagauccaucugg

SEQ ID NO: 262457 - RNA, 22 nt, Homo sapiens
uauugcauguugagcaguaccu

SEQ ID NO: 262458 - RNA, 22 nt, Homo sapiens
uauugccugucuccaaaaauca

SEQ ID NO: 262459 - RNA, 22 nt, Homo sapiens
uugagacgaagucucacucuug

SEQ ID NO: 262460 - RNA, 22 nt, Homo sapiens
uugagacggagucuugcucuuu

SEQ ID NO: 262461 - RNA, 22 nt, Homo sapiens
uugagacugaacauuuguguac

SEQ ID NO: 262462 - RNA, 22 nt, Homo sapiens
uugagagaaaaggccaugccuu

SEQ ID NO: 262463 - RNA, 22 nt, Homo sapiens
uugagagagaacauuuguuaca

SEQ ID NO: 262464 - RNA, 22 nt, Homo sapiens
uugagauacauaauuaugaaug

SEQ ID NO: 262465 - RNA, 22 nt, Homo sapiens
uugagauagggucuaccucugu

SEQ ID NO: 262466 - RNA, 22 nt, Homo sapiens
uugagaugauggauaugcuaau

SEQ ID NO: 262467 - RNA, 22 nt, Homo sapiens
uugagauggagucucacucugc

SEQ ID NO: 262468 - RNA, 22 nt, Homo sapiens
uugagauggagucucacucugu

SEQ ID NO: 262469 - RNA, 22 nt, Homo sapiens
uugagauggagucucacucuug

SEQ ID NO: 262470 - RNA, 22 nt, Homo sapiens
uugagauggagucucacucuuu

SEQ ID NO: 262471 - RNA, 22 nt, Homo sapiens
uugagauggagucucgcucugu

SEQ ID NO: 262472 - RNA, 22 nt, Homo sapiens
uugagauggagucucgcucuuu

SEQ ID NO: 262473 - RNA, 22 nt, Homo sapiens
aaaacgcauccucacaggucug

SEQ ID NO: 262474 - RNA, 22 nt, Homo sapiens
aaacaccacgcggucccucgga

SEQ ID NO: 262475 - RNA, 22 nt, Homo sapiens
aaacugccuuccuuguaggugc

SEQ ID NO: 262476 - RNA, 22 nt, Homo sapiens
aaagcacugaauaaauuugcuu

SEQ ID NO: 262477 - RNA, 22 nt, Homo sapiens
aaagcaucacuuuuccuacuuu

SEQ ID NO: 262478 - RNA, 22 nt, Homo sapiens
aaaggcacuagaaguuaccuuu

SEQ ID NO: 262479 - RNA, 22 nt, Homo sapiens
aaaggcacugugacuuuauagg

SEQ ID NO: 262480 - RNA, 22 nt, Homo sapiens
aaaggcaucauuaguaccaagu

SEQ ID NO: 262481 - RNA, 22 nt, Homo sapiens
aaaggcuucggaucagaaggua

SEQ ID NO: 262482 - RNA, 22 nt, Homo sapiens
aaagggcuguuucuugacuugg

SEQ ID NO: 262483 - RNA, 22 nt, Homo sapiens
aaagggcuugaauacucuuuuu

SEQ ID NO: 262484 - RNA, 19 nt, Homo sapiens
aaagguaguaaccucugau

SEQ ID NO: 262485 - RNA, 22 nt, Homo sapiens
aaaguaauugcaguuuuugcaa

SEQ ID NO: 262486 - RNA, 19 nt, Homo sapiens
aaaguacucugaugccucu

SEQ ID NO: 262487 - RNA, 22 nt, Homo sapiens
aaagucuagaggaucaugugug

SEQ ID NO: 262488 - RNA, 22 nt, Homo sapiens
aaagucuguuuugucagagacu

SEQ ID NO: 262489 - RNA, 22 nt, Homo sapiens
aaagugaauguaucccguaagu

SEQ ID NO: 262490 - RNA, 22 nt, Homo sapiens
aaagugauguccaggcuuucag

SEQ ID NO: 262491 - RNA, 22 nt, Homo sapiens
aaagugcaguauuugggcagga

SEQ ID NO: 262492 - RNA, 22 nt, Homo sapiens
aaagugcugagucuaggcgggg

SEQ ID NO: 262493 - RNA, 22 nt, Homo sapiens
aaagugcugggaucacacugaa

SEQ ID NO: 262494 - RNA, 22 nt, Homo sapiens
aaaguggugggauuccaggcau

SEQ ID NO: 262495 - RNA, 22 nt, Homo sapiens
aaaguguguuuccaaccugugg

SEQ ID NO: 262496 - RNA, 22 nt, Homo sapiens
aaaguguuucugcaguagguuu

SEQ ID NO: 262497 - RNA, 22 nt, Homo sapiens
aaaugcacgcuacccagcuaga

SEQ ID NO: 262498 - RNA, 22 nt, Homo sapiens
aaaugcaugaggugggaagaaa

SEQ ID NO: 262499 - RNA, 22 nt, Homo sapiens
aaaugcauugagggaaaaggca

SEQ ID NO: 262500 - RNA, 23 nt, Homo sapiens
aaaugcucucaggugccaguaga

SEQ ID NO: 262501 - RNA, 22 nt, Homo sapiens
aaauggcuuugaggguaggaca

SEQ ID NO: 262502 - RNA, 22 nt, Homo sapiens
aaauucaucaaaugguuuguau

SEQ ID NO: 262503 - RNA, 22 nt, Homo sapiens
aaauucaugucaccucuaggua

SEQ ID NO: 262504 - RNA, 22 nt, Homo sapiens
aaauugcauugagcugcuuauu

SEQ ID NO: 262505 - RNA, 22 nt, Homo sapiens
aacaccaucccuuugaugcuuu

SEQ ID NO: 262506 - RNA, 22 nt, Homo sapiens
aacacuggcugcucgaguucuc

SEQ ID NO: 262507 - RNA, 22 nt, Homo sapiens
aacacuguuuccagucaugauc

SEQ ID NO: 262508 - RNA, 22 nt, Homo sapiens
aacagugcauuccuguccauau

SEQ ID NO: 262509 - RNA, 22 nt, Homo sapiens
aacaucaaccaugaggguugga

SEQ ID NO: 262510 - RNA, 22 nt, Homo sapiens
aaccuguggauuuugguaucug

SEQ ID NO: 262511 - RNA, 22 nt, Homo sapiens
aacuaugucaaauaaaaugagg

SEQ ID NO: 262512 - RNA, 22 nt, Homo sapiens
aacuccauuuuagacccuagau

SEQ ID NO: 262513 - RNA, 22 nt, Homo sapiens
aacugcacauauuuguaugggu

SEQ ID NO: 262514 - RNA, 22 nt, Homo sapiens
aacugcuguuuggguacuggug

SEQ ID NO: 262515 - RNA, 22 nt, Homo sapiens
aacuggcauagccagacuucuc

SEQ ID NO: 262516 - RNA, 22 nt, Homo sapiens
aacuggcauauucugguugcgg

SEQ ID NO: 262517 - RNA, 22 nt, Homo sapiens
aacugggcaagcauuacauggu

SEQ ID NO: 262518 - RNA, 22 nt, Homo sapiens
aacuugcacuugauugagagcu

SEQ ID NO: 262519 - RNA, 20 nt, Homo sapiens
aagacacuguccccacugga

SEQ ID NO: 262520 - RNA, 22 nt, Homo sapiens
aagagcauuauuuaguaauuuc

SEQ ID NO: 262521 - RNA, 22 nt, Homo sapiens
aagagcauuggauggggagauu

SEQ ID NO: 262522 - RNA, 22 nt, Homo sapiens
aagaugcagucauacuggagga

SEQ ID NO: 262523 - RNA, 22 nt, Homo sapiens
aagcaacacaucugccccgguu

SEQ ID NO: 262524 - RNA, 22 nt, Homo sapiens
aagcacaauuucaccuucuugu

SEQ ID NO: 262525 - RNA, 22 nt, Homo sapiens
aagcacccagccucacgccugc

SEQ ID NO: 262526 - RNA, 22 nt, Homo sapiens
acacauuggcaauucuggagca

SEQ ID NO: 262527 - RNA, 22 nt, Homo sapiens
acaccuguggucccaguaacuu

SEQ ID NO: 262528 - RNA, 22 nt, Homo sapiens
acacuggaggagagcuguugcu

SEQ ID NO: 262529 - RNA, 22 nt, Homo sapiens
acacuggaguuaaaggugauuu

SEQ ID NO: 262530 - RNA, 22 nt, Homo sapiens
acacugucugaugaaaguaguu

SEQ ID NO: 262531 - RNA, 22 nt, Homo sapiens
acacuuucuagacaagggaaua

SEQ ID NO: 262532 - RNA, 20 nt, Homo sapiens
acagcauagccuuuuaaagc

SEQ ID NO: 262533 - RNA, 19 nt, Homo sapiens
acagcugguuuugguuucu

SEQ ID NO: 262534 - RNA, 22 nt, Homo sapiens
acagguacaagggauuaggaug

SEQ ID NO: 262535 - RNA, 22 nt, Homo sapiens
acagguacacagaauauccaga

SEQ ID NO: 262536 - RNA, 22 nt, Homo sapiens
acaggugaaguauuacacuaag

SEQ ID NO: 262537 - RNA, 22 nt, Homo sapiens
acagugcuguuguguuuucacg

SEQ ID NO: 262538 - RNA, 22 nt, Homo sapiens
acagugcuuggcacacaguaau

SEQ ID NO: 262539 - RNA, 17 nt, Homo sapiens
acagugcuuugcuuucc

SEQ ID NO: 262540 - RNA, 22 nt, Homo sapiens
acaguggugcgaucucggcuca

SEQ ID NO: 262541 - RNA, 22 nt, Homo sapiens
acaguguguguguucaccuaga

SEQ ID NO: 262542 - RNA, 22 nt, Homo sapiens
acauagaguagcuaccuguaga

SEQ ID NO: 262543 - RNA, 22 nt, Homo sapiens
acauaguagacacugaaaauau

SEQ ID NO: 262544 - RNA, 22 nt, Homo sapiens
acaucacuguuugauugauuga

SEQ ID NO: 262545 - RNA, 22 nt, Homo sapiens
acaucaggcuugugaugauuac

SEQ ID NO: 262546 - RNA, 18 nt, Homo sapiens
acaucccaugcuggggug

SEQ ID NO: 262547 - RNA, 22 nt, Homo sapiens
acaugcauauguuggaagaaag

SEQ ID NO: 262548 - RNA, 22 nt, Homo sapiens
acaugcauccaugugaagagac

SEQ ID NO: 262549 - RNA, 23 nt, Homo sapiens
acauguauagacuuuuuuuccuu

SEQ ID NO: 262550 - RNA, 18 nt, Homo sapiens
acauucagcuugaagaua

SEQ ID NO: 262551 - RNA, 22 nt, Homo sapiens
acauugcauauggcacccucuu

SEQ ID NO: 262552 - RNA, 22 nt, Homo sapiens
accacagugcuuccugcucacg

SEQ ID NO: 262553 - RNA, 22 nt, Homo sapiens
accagucucagguaugucuuua

SEQ ID NO: 262554 - RNA, 22 nt, Homo sapiens
accaugcaguccaauaugcaca

SEQ ID NO: 262555 - RNA, 22 nt, Homo sapiens
acccagaagucauucaggaaca

SEQ ID NO: 262556 - RNA, 22 nt, Homo sapiens
acccugucacucccaucaauuu

SEQ ID NO: 262557 - RNA, 22 nt, Homo sapiens
accgggcugagcgcaggccccg

SEQ ID NO: 262558 - RNA, 22 nt, Homo sapiens
accugcacagccgaacauagac

SEQ ID NO: 262559 - RNA, 22 nt, Homo sapiens
accuggguguauguucaguuug

SEQ ID NO: 262560 - RNA, 19 nt, Homo sapiens
accuguagaaaguacaaca

SEQ ID NO: 262561 - RNA, 22 nt, Homo sapiens
accuguagcagacuuaauauuu

SEQ ID NO: 262562 - RNA, 23 nt, Homo sapiens
accuucauucauucagcugaagu

SEQ ID NO: 262563 - RNA, 22 nt, Homo sapiens
acgugcaugcacacacaugcgc

SEQ ID NO: 262564 - RNA, 22 nt, Homo sapiens
acucagagauuagcacauguuu

SEQ ID NO: 262565 - RNA, 22 nt, Homo sapiens
acucauugcucauaccuuaucu

SEQ ID NO: 262566 - RNA, 22 nt, Homo sapiens
acucuguaagcaagcuggggaa

SEQ ID NO: 262567 - RNA, 22 nt, Homo sapiens
acugacaugaucaggcauguuc

SEQ ID NO: 262568 - RNA, 21 nt, Homo sapiens
acugauguuugaaauucgcug

SEQ ID NO: 262569 - RNA, 22 nt, Homo sapiens
acugcacuccaaccuuggugac

SEQ ID NO: 262570 - RNA, 20 nt, Homo sapiens
acugcacuccaaccuuugug

SEQ ID NO: 262571 - RNA, 22 nt, Homo sapiens
acugcacuccagcccaggugac

SEQ ID NO: 262572 - RNA, 22 nt, Homo sapiens
acugcacuccagccucccgucu

SEQ ID NO: 262573 - RNA, 22 nt, Homo sapiens
acugcacuccagccuccugaca

SEQ ID NO: 262574 - RNA, 22 nt, Homo sapiens
acugcacuccagccucggugac

SEQ ID NO: 262575 - RNA, 22 nt, Homo sapiens
acugcacuccagccugccgaca

SEQ ID NO: 262576 - RNA, 22 nt, Homo sapiens
acugcacuccagccugcuggau

SEQ ID NO: 262577 - RNA, 22 nt, Homo sapiens
acugcacuccagccugcuggca

SEQ ID NO: 262578 - RNA, 22 nt, Homo sapiens
acugcacuccagccugcugggu

SEQ ID NO: 262579 - RNA, 22 nt, Homo sapiens
acugcacuccagccuggaccac

SEQ ID NO: 262580 - RNA, 22 nt, Homo sapiens
acugcacuccagccugugagac

SEQ ID NO: 262581 - RNA, 22 nt, Homo sapiens
acugcacuccagccuucaggac

SEQ ID NO: 262582 - RNA, 20 nt, Homo sapiens
acugcacuccagccuuccag

SEQ ID NO: 262583 - RNA, 22 nt, Homo sapiens
acugcacuccagccuugauggc

SEQ ID NO: 262584 - RNA, 22 nt, Homo sapiens
acugcacuccagcuccagggug

SEQ ID NO: 262585 - RNA, 22 nt, Homo sapiens
acugcacuccagcuugggugac

SEQ ID NO: 262586 - RNA, 22 nt, Homo sapiens
acugcacuccagcuuuggugac

SEQ ID NO: 262587 - RNA, 18 nt, Homo sapiens
acugcacuccauccuagg

SEQ ID NO: 262588 - RNA, 22 nt, Homo sapiens
acugcacuccuccuugggugac

SEQ ID NO: 262589 - RNA, 22 nt, Homo sapiens
acugcacucuagccuuggcaac

SEQ ID NO: 262590 - RNA, 22 nt, Homo sapiens
acugcacucuagcuugggugac

SEQ ID NO: 262591 - RNA, 22 nt, Homo sapiens
acugcacugucaaccuccuggg

SEQ ID NO: 262592 - RNA, 22 nt, Homo sapiens
acugcacuucagccuugggaaa

SEQ ID NO: 262593 - RNA, 22 nt, Homo sapiens
acugcauuugguaaagucaaga

SEQ ID NO: 262594 - RNA, 18 nt, Homo sapiens
acuggaauuaaacuuuuu

SEQ ID NO: 262595 - RNA, 22 nt, Homo sapiens
acuggacuuaaugaugaauugu

SEQ ID NO: 262596 - RNA, 22 nt, Homo sapiens
acuggaguuuguucaagaaaua

SEQ ID NO: 262597 - RNA, 20 nt, Homo sapiens
acuggcacugguaggugugg

SEQ ID NO: 262598 - RNA, 22 nt, Homo sapiens
acuggcuuaaggaugggccacu

SEQ ID NO: 262599 - RNA, 22 nt, Homo sapiens
acugggauauuauugguaauau

SEQ ID NO: 262600 - RNA, 22 nt, Homo sapiens
acugggucaaaguagaaaacua

SEQ ID NO: 262601 - RNA, 21 nt, Homo sapiens
acuuucuguggcaguccauuc

SEQ ID NO: 262602 - RNA, 22 nt, Homo sapiens
acuuuuguuauacagugugaua

SEQ ID NO: 262603 - RNA, 22 nt, Homo sapiens
acuuuuugaugaggucguuugu

SEQ ID NO: 262604 - RNA, 22 nt, Homo sapiens
acuuuuugauggggagaacauu

SEQ ID NO: 262605 - RNA, 22 nt, Homo sapiens
acuuuuugcaaccauuuggacc

SEQ ID NO: 262606 - RNA, 22 nt, Homo sapiens
agaaacauucucuugccuccuu

SEQ ID NO: 262607 - RNA, 20 nt, Homo sapiens
agaagcauugcucucuucag

SEQ ID NO: 262608 - RNA, 22 nt, Homo sapiens
agaauguauauucuguaguugu

SEQ ID NO: 262609 - RNA, 22 nt, Homo sapiens
cauagcacacguauaccuaugu

SEQ ID NO: 262610 - RNA, 22 nt, Homo sapiens
cauauucacuuuacagagcugu

SEQ ID NO: 262611 - RNA, 22 nt, Homo sapiens
caucacuguugguacaaguaau

SEQ ID NO: 262612 - RNA, 22 nt, Homo sapiens
caucccauucgaggggcacagc

SEQ ID NO: 262613 - RNA, 22 nt, Homo sapiens
cauccccugcaccaaccuuuac

SEQ ID NO: 262614 - RNA, 22 nt, Homo sapiens
caucucauugaauugcugagca

SEQ ID NO: 262615 - RNA, 22 nt, Homo sapiens
caugacacuggcauguuucuuu

SEQ ID NO: 262616 - RNA, 22 nt, Homo sapiens
caugaugcuagguauggaugaa

SEQ ID NO: 262617 - RNA, 22 nt, Homo sapiens
cauggagcuaggcuugaucccu

SEQ ID NO: 262618 - RNA, 22 nt, Homo sapiens
cauggcaucuguguggccucca

SEQ ID NO: 262619 - RNA, 22 nt, Homo sapiens
cauggcuuguauaagauucuca

SEQ ID NO: 262620 - RNA, 22 nt, Homo sapiens
caugggacugucuuggcuauac

SEQ ID NO: 262621 - RNA, 22 nt, Homo sapiens
cauggucaccuuccaaguuauu

SEQ ID NO: 262622 - RNA, 22 nt, Homo sapiens
cauguauagauuccauaguggu

SEQ ID NO: 262623 - RNA, 22 nt, Homo sapiens
cauugcaaugaggucuugcagu

SEQ ID NO: 262624 - RNA, 22 nt, Homo sapiens
cauugcacuccagccugcacga

SEQ ID NO: 262625 - RNA, 22 nt, Homo sapiens
cauugcacuccagccugcugac

SEQ ID NO: 262626 - RNA, 22 nt, Homo sapiens
cauugcacuccagccuuggcaa

SEQ ID NO: 262627 - RNA, 20 nt, Homo sapiens
cauugcacuccagcuugggc

SEQ ID NO: 262628 - RNA, 22 nt, Homo sapiens
cauugcacuccagcuugggcga

SEQ ID NO: 262629 - RNA, 22 nt, Homo sapiens
cauugcaguuuuugguguaucu

SEQ ID NO: 262630 - RNA, 22 nt, Homo sapiens
cauugcauuuucuuuguaccuu

SEQ ID NO: 262631 - RNA, 22 nt, Homo sapiens
cauugcccuccagccugggcaa

SEQ ID NO: 262632 - RNA, 22 nt, Homo sapiens
cauugcuaaaagucauauauaa

SEQ ID NO: 262633 - RNA, 22 nt, Homo sapiens
cauuggugauuagugaaugaac

SEQ ID NO: 262634 - RNA, 22 nt, Homo sapiens
cauuguacauaaguauggagua

SEQ ID NO: 262635 - RNA, 22 nt, Homo sapiens
cauuugguggcuacagaguaac

SEQ ID NO: 262636 - RNA, 22 nt, Homo sapiens
ccaaggcacugauucuguacuc

SEQ ID NO: 262637 - RNA, 22 nt, Homo sapiens
ccaagugcuuaaaauuucauuu

SEQ ID NO: 262638 - RNA, 22 nt, Homo sapiens
ccacaguagucuugggaugggc

SEQ ID NO: 262639 - RNA, 22 nt, Homo sapiens
ccacaguugaaauuuugacugu

SEQ ID NO: 262640 - RNA, 22 nt, Homo sapiens
ccaccgggucccagcucugcuc

SEQ ID NO: 262641 - RNA, 22 nt, Homo sapiens
ccagaguugccucagguuucug

SEQ ID NO: 262642 - RNA, 22 nt, Homo sapiens
ccagauguuuucauucagcaag

SEQ ID NO: 262643 - RNA, 20 nt, Homo sapiens
ccagcaucauuagauucugg

SEQ ID NO: 262644 - RNA, 22 nt, Homo sapiens
ccaggguugagacccacugacu

SEQ ID NO: 262645 - RNA, 21 nt, Homo sapiens
ccaguguaaugauagcaggca

SEQ ID NO: 262646 - RNA, 22 nt, Homo sapiens
ccaguuuuuggcaaugaugaau

SEQ ID NO: 262647 - RNA, 22 nt, Homo sapiens
ccaucccuuucugagcaguucc

SEQ ID NO: 262648 - RNA, 22 nt, Homo sapiens
ccauggcuucugcauucuguca

SEQ ID NO: 262649 - RNA, 22 nt, Homo sapiens
ccauugaacaugaaggaaugug

SEQ ID NO: 262650 - RNA, 22 nt, Homo sapiens
ccauugcacuccagccuaggca

SEQ ID NO: 262651 - RNA, 22 nt, Homo sapiens
ccauugcacucuggccuaggug

SEQ ID NO: 262652 - RNA, 22 nt, Homo sapiens
cccagagacagaaugauaaacu

SEQ ID NO: 262653 - RNA, 21 nt, Homo sapiens
cccagguucucugaggguaga

SEQ ID NO: 262654 - RNA, 22 nt, Homo sapiens
ccccugaaacucacucauuauc

SEQ ID NO: 262655 - RNA, 17 nt, Homo sapiens
ccccugagcgaugcagu

SEQ ID NO: 262656 - RNA, 22 nt, Homo sapiens
cccugacauucggagauguagu

SEQ ID NO: 262657 - RNA, 22 nt, Homo sapiens
cccugagcagccugaguuuccc

SEQ ID NO: 262658 - RNA, 22 nt, Homo sapiens
ccuaggcacugggguccagccc

SEQ ID NO: 262659 - RNA, 22 nt, Homo sapiens
ccucauggagaacaucugcuag

SEQ ID NO: 262660 - RNA, 22 nt, Homo sapiens
ccucuuuguugagacuucacca

SEQ ID NO: 262661 - RNA, 22 nt, Homo sapiens
ccugagaucauacuguuaguaa

SEQ ID NO: 262662 - RNA, 22 nt, Homo sapiens
ccuggaucauugucauucccaa

SEQ ID NO: 262663 - RNA, 22 nt, Homo sapiens
ccuggguuacaggugugagcca

SEQ ID NO: 262664 - RNA, 22 nt, Homo sapiens
ccuguagcauccaagaagcugc

SEQ ID NO: 262665 - RNA, 22 nt, Homo sapiens
ccuuggcacuacugacauugua

SEQ ID NO: 262666 - RNA, 22 nt, Homo sapiens
cgcuggugucuaagcgacagcu

SEQ ID NO: 262667 - RNA, 22 nt, Homo sapiens
cggugcaaauguaauugcaguu

SEQ ID NO: 262668 - RNA, 20 nt, Homo sapiens
cguugcacuccagccugggc

SEQ ID NO: 262669 - RNA, 22 nt, Homo sapiens
cuaaaacuuucugagugcagca

SEQ ID NO: 262670 - RNA, 16 nt, Homo sapiens
cuaaaaugucuacuug

SEQ ID NO: 262671 - RNA, 22 nt, Homo sapiens
cuaaaguucuucugagagaaca

SEQ ID NO: 262672 - RNA, 22 nt, Homo sapiens
cuaaaugucucuacuaaguuua

SEQ ID NO: 262673 - RNA, 22 nt, Homo sapiens
cuaagauugucuuaguguguug

SEQ ID NO: 262674 - RNA, 22 nt, Homo sapiens
guacacauacauauaugugugu

SEQ ID NO: 262675 - RNA, 22 nt, Homo sapiens
guacaguauaguaauaggauuu

SEQ ID NO: 262676 - RNA, 22 nt, Homo sapiens
guacaugcauaguuuauuucug

SEQ ID NO: 262677 - RNA, 22 nt, Homo sapiens
guacauguaugcaugcaugcau

SEQ ID NO: 262678 - RNA, 22 nt, Homo sapiens
guagaagcacaggugaguuggu

SEQ ID NO: 262679 - RNA, 22 nt, Homo sapiens
guagagguagacuuccuugucu

SEQ ID NO: 262680 - RNA, 22 nt, Homo sapiens
guagcagaauaucagauaauuu

SEQ ID NO: 262681 - RNA, 22 nt, Homo sapiens
guagcagccacacuugauaacu

SEQ ID NO: 262682 - RNA, 22 nt, Homo sapiens
guagugcaguuugagaaucagu

SEQ ID NO: 262683 - RNA, 22 nt, Homo sapiens
uuccugucuuccaagagagauu

SEQ ID NO: 262684 - RNA, 22 nt, Homo sapiens
uuccuugaaacagucaagagaa

SEQ ID NO: 262685 - RNA, 22 nt, Homo sapiens
uuccuuguagcaaaugcgauga

SEQ ID NO: 262686 - RNA, 22 nt, Homo sapiens
uuccuuguuuauuuacaggagg

SEQ ID NO: 262687 - RNA, 20 nt, Homo sapiens
uucuauggugaugaguccug

SEQ ID NO: 262688 - RNA, 22 nt, Homo sapiens
uucucaaggagccuucguaacu

SEQ ID NO: 262689 - RNA, 22 nt, Homo sapiens
uucucacaguacagggagcucu

SEQ ID NO: 262690 - RNA, 22 nt, Homo sapiens
uucucagugcuaucuuuuaugc

SEQ ID NO: 262691 - RNA, 22 nt, Homo sapiens
uucucaguucgguggcagugcu

SEQ ID NO: 262692 - RNA, 22 nt, Homo sapiens
uucucauggaacaucuguacug

SEQ ID NO: 262693 - RNA, 22 nt, Homo sapiens
uucuccugguggacccuaaacg

SEQ ID NO: 262694 - RNA, 22 nt, Homo sapiens
uucucgcuuuuuccaccuguau

SEQ ID NO: 262695 - RNA, 22 nt, Homo sapiens
uucucuggucagaggggagguu

SEQ ID NO: 262696 - RNA, 22 nt, Homo sapiens
uucucuguggauugggugagag

SEQ ID NO: 262697 - RNA, 22 nt, Homo sapiens
uucugugcugaaucaaagacug

SEQ ID NO: 262698 - RNA, 22 nt, Homo sapiens
uucuuagucaaguuguauuuca

SEQ ID NO: 262699 - RNA, 22 nt, Homo sapiens
uucuuagucauguaauagucca

SEQ ID NO: 262700 - RNA, 22 nt, Homo sapiens
uucuuaguggcaccacuuuuuu

SEQ ID NO: 262701 - RNA, 22 nt, Homo sapiens
uucuugcacuuggcccucauua

SEQ ID NO: 262702 - RNA, 22 nt, Homo sapiens
uucuugcugaauugugcccuuc

SEQ ID NO: 262703 - RNA, 22 nt, Homo sapiens
uucuuuaguucacuugcuccag

SEQ ID NO: 262704 - RNA, 22 nt, Homo sapiens
uucuuuggaaacaguacuaauu

SEQ ID NO: 262705 - RNA, 22 nt, Homo sapiens
uugaaagaaaggagacugaguu

SEQ ID NO: 262706 - RNA, 22 nt, Homo sapiens
uugaaaguaaacaucacaaaga

SEQ ID NO: 262707 - RNA, 22 nt, Homo sapiens
uugaaccauucuuuugauagag

SEQ ID NO: 262708 - RNA, 22 nt, Homo sapiens
uugaagguagaaguucucaauu

SEQ ID NO: 262709 - RNA, 22 nt, Homo sapiens
uugaaguaugaccgcugagaau

SEQ ID NO: 262710 - RNA, 22 nt, Homo sapiens
uugaauagacagccagcuuuaa

SEQ ID NO: 262711 - RNA, 22 nt, Homo sapiens
uugaauaggcucaugcuuauca

SEQ ID NO: 262712 - RNA, 22 nt, Homo sapiens
uugaauagugacuuugauucug

SEQ ID NO: 262713 - RNA, 22 nt, Homo sapiens
uugaaugaaaugaugucauuug

SEQ ID NO: 262714 - RNA, 22 nt, Homo sapiens
uugaauguguugggaagcccuu

SEQ ID NO: 262715 - RNA, 23 nt, Homo sapiens
uugaauguuuccccucccaaauu

SEQ ID NO: 262716 - RNA, 20 nt, Homo sapiens
uugacaguggguuguuaaag

SEQ ID NO: 262717 - RNA, 22 nt, Homo sapiens
uugacauugcuguaguguccag

SEQ ID NO: 262718 - RNA, 22 nt, Homo sapiens
uugaccccuucuaauagccuca

SEQ ID NO: 262719 - RNA, 22 nt, Homo sapiens
uugaccuggagaguacuuugac

SEQ ID NO: 262720 - RNA, 22 nt, Homo sapiens
uugacugggccagacagagauc

SEQ ID NO: 262721 - RNA, 22 nt, Homo sapiens
uugagacggagucucacucugu

SEQ ID NO: 262722 - RNA, 22 nt, Homo sapiens
uugagacugagucucgcccugu

SEQ ID NO: 262723 - RNA, 22 nt, Homo sapiens
uugagagaaaaaauuuauuggu

SEQ ID NO: 262724 - RNA, 22 nt, Homo sapiens
uugagagcugaugaaagauaaa

SEQ ID NO: 262725 - RNA, 22 nt, Homo sapiens
uugagauagaauaggaauggga

SEQ ID NO: 262726 - RNA, 22 nt, Homo sapiens
uugagauaggaacucacuaugc

SEQ ID NO: 262727 - RNA, 22 nt, Homo sapiens
uugagauauccauaaaugggaa

SEQ ID NO: 262728 - RNA, 22 nt, Homo sapiens
uugagaugaagucuugcucucu

SEQ ID NO: 262729 - RNA, 22 nt, Homo sapiens
uugagaugaaguuuugcucuuu

SEQ ID NO: 262730 - RNA, 22 nt, Homo sapiens
uugagauggagccucacucugc

SEQ ID NO: 262731 - RNA, 22 nt, Homo sapiens
uugagauggagcuucacucuug

SEQ ID NO: 262732 - RNA, 22 nt, Homo sapiens
uugagauggagucucacgcauu

SEQ ID NO: 262733 - RNA, 22 nt, Homo sapiens
uugagauggagucucacugugu

SEQ ID NO: 262734 - RNA, 22 nt, Homo sapiens
uugagauggagucucgcugugu

SEQ ID NO: 262735 - RNA, 22 nt, Homo sapiens
uugagauggagucucguucugu

SEQ ID NO: 262736 - RNA, 22 nt, Homo sapiens
uugagauggauagacauagcau

SEQ ID NO: 262737 - RNA, 22 nt, Homo sapiens
uugagauggugccacuguacuc

SEQ ID NO: 262738 - RNA, 22 nt, Homo sapiens
uugagauguauguauauaaugu

SEQ ID NO: 262739 - RNA, 22 nt, Homo sapiens
uugagauguggcaguuuaugag

SEQ ID NO: 262740 - RNA, 22 nt, Homo sapiens
uugagcaauccuccugccaugu

SEQ ID NO: 262741 - RNA, 22 nt, Homo sapiens
uugagcuauguacagaugcugu

SEQ ID NO: 262742 - RNA, 22 nt, Homo sapiens
uugagcuuuuuacuuguccaau

SEQ ID NO: 262743 - RNA, 22 nt, Homo sapiens
uugaggaggcagucugcccauu

SEQ ID NO: 262744 - RNA, 23 nt, Homo sapiens
uugaggcauguaccaucaauauc

SEQ ID NO: 262745 - RNA, 22 nt, Homo sapiens
uugaggucagagguucgagacc

SEQ ID NO: 262746 - RNA, 22 nt, Homo sapiens
uugaggugaagggcagagcagc

SEQ ID NO: 262747 - RNA, 22 nt, Homo sapiens
uugaguagauaccuaggaauag

SEQ ID NO: 262748 - RNA, 22 nt, Homo sapiens
uugaguauuggacugguaucuu

SEQ ID NO: 262749 - RNA, 22 nt, Homo sapiens
uugaguccccacacuggguccc

SEQ ID NO: 262750 - RNA, 21 nt, Homo sapiens
uugaguugaagcaaggaggga

SEQ ID NO: 262751 - RNA, 22 nt, Homo sapiens
uugaguuugaguauucuaaagc

SEQ ID NO: 262752 - RNA, 22 nt, Homo sapiens
uugauagacaucugaguuguug

SEQ ID NO: 262753 - RNA, 22 nt, Homo sapiens
uugauagguuuuauguauaguu

SEQ ID NO: 262754 - RNA, 22 nt, Homo sapiens
uugauaguccuguaucuauuuu

SEQ ID NO: 262755 - RNA, 22 nt, Homo sapiens
uugauaguuuuaaaauuaaucu

SEQ ID NO: 262756 - RNA, 22 nt, Homo sapiens
uugauaugcuugucaguccauu

SEQ ID NO: 262757 - RNA, 22 nt, Homo sapiens
uugauauguuguuagauucagu

SEQ ID NO: 262758 - RNA, 22 nt, Homo sapiens
uugaucaaaucugagugagaau

SEQ ID NO: 262759 - RNA, 22 nt, Homo sapiens
uugaucacuguacuaugacuau

SEQ ID NO: 262760 - RNA, 22 nt, Homo sapiens
uugauccucugagaaucuaucg

SEQ ID NO: 262761 - RNA, 22 nt, Homo sapiens
uugauguccaucucuagguaaa

SEQ ID NO: 262762 - RNA, 22 nt, Homo sapiens
uugcaacauguauucuggugau

SEQ ID NO: 262763 - RNA, 22 nt, Homo sapiens
uugcaaugugaugugauuugga

SEQ ID NO: 262764 - RNA, 22 nt, Homo sapiens
ucacauggaaaaguccaguaaa

SEQ ID NO: 262765 - RNA, 22 nt, Homo sapiens
ucacauggauuaacucauuuau

SEQ ID NO: 262766 - RNA, 22 nt, Homo sapiens
ucacaugugcguuuuggcaugu

SEQ ID NO: 262767 - RNA, 22 nt, Homo sapiens
ucacauguguaugagcuuugau

SEQ ID NO: 262768 - RNA, 22 nt, Homo sapiens
ucacauuaagcuguuauuucuu

SEQ ID NO: 262769 - RNA, 22 nt, Homo sapiens
ucaccaguaauaaagagccugc

SEQ ID NO: 262770 - RNA, 16 nt, Homo sapiens
ucaccccuagagaucc

SEQ ID NO: 262771 - RNA, 22 nt, Homo sapiens
ucaccuagacucgaucauguag

SEQ ID NO: 262772 - RNA, 22 nt, Homo sapiens
ucaccuggggaucuuguuuaca

SEQ ID NO: 262773 - RNA, 22 nt, Homo sapiens
ucaccuugcacaguuguguggg

SEQ ID NO: 262774 - RNA, 18 nt, Homo sapiens
ucacggggagcagcagcc

SEQ ID NO: 262775 - RNA, 19 nt, Homo sapiens
ucacgugcagcagccacac

SEQ ID NO: 262776 - RNA, 22 nt, Homo sapiens
ucacgugguucauaaggcagaa

SEQ ID NO: 262777 - RNA, 22 nt, Homo sapiens
ucacuagaucaagggagagaaa

SEQ ID NO: 262778 - RNA, 22 nt, Homo sapiens
ucacuaggcuggagugcagugg

SEQ ID NO: 262779 - RNA, 21 nt, Homo sapiens
ucacuaguaaaaggugaacug

SEQ ID NO: 262780 - RNA, 22 nt, Homo sapiens
ucacuauagaaaacagugugga

SEQ ID NO: 262781 - RNA, 22 nt, Homo sapiens
ucacugaaaccacugccuccug

SEQ ID NO: 262782 - RNA, 22 nt, Homo sapiens
ucacugaaaccgccuccaccuc

SEQ ID NO: 262783 - RNA, 22 nt, Homo sapiens
ucacugaaaccuccaccucucg

SEQ ID NO: 262784 - RNA, 21 nt, Homo sapiens
ucacugagcaucaugguuuca

SEQ ID NO: 262785 - RNA, 21 nt, Homo sapiens
ucacugagguuaaauaggguu

SEQ ID NO: 262786 - RNA, 22 nt, Homo sapiens
ucacugcacuccagccuuuaug

SEQ ID NO: 262787 - RNA, 22 nt, Homo sapiens
ucacugcacuucaggcuuucuc

SEQ ID NO: 262788 - RNA, 22 nt, Homo sapiens
ucacugcgaccuccaccucccg

SEQ ID NO: 262789 - RNA, 22 nt, Homo sapiens
ucacugcgaccuccaccuccug

SEQ ID NO: 262790 - RNA, 22 nt, Homo sapiens
ucacugcgaccuccgccucccg

SEQ ID NO: 262791 - RNA, 22 nt, Homo sapiens
ucacugcgaccucugccucccg

SEQ ID NO: 262792 - RNA, 22 nt, Homo sapiens
ucacuggagauagcaaucuggu

SEQ ID NO: 262793 - RNA, 22 nt, Homo sapiens
ucacuggagguuccugaaguuc

SEQ ID NO: 262794 - RNA, 22 nt, Homo sapiens
ucacuggcaaauauauccguug

SEQ ID NO: 262795 - RNA, 22 nt, Homo sapiens
ucacuggccaaauucuggguga

SEQ ID NO: 262796 - RNA, 20 nt, Homo sapiens
ucacuggguucuugaagucu

SEQ ID NO: 262797 - RNA, 22 nt, Homo sapiens
ucacuggucuaaguggaggggg

SEQ ID NO: 262798 - RNA, 22 nt, Homo sapiens
ucacuuggccgcagccuucucu

SEQ ID NO: 262799 - RNA, 22 nt, Homo sapiens
ucacuuugacggccaacuucua

SEQ ID NO: 262800 - RNA, 22 nt, Homo sapiens
ucacuuuguauagcgacuggcu

SEQ ID NO: 262801 - RNA, 22 nt, Homo sapiens
ucacuuuguuuuuggauaaguu

SEQ ID NO: 262802 - RNA, 21 nt, Homo sapiens
ucagaagcucccagggaggac

SEQ ID NO: 262803 - RNA, 22 nt, Homo sapiens
ucagaauguaacuuuaguugga

SEQ ID NO: 262804 - RNA, 22 nt, Homo sapiens
ucagaguagaaacacuuccaua

SEQ ID NO: 262805 - RNA, 22 nt, Homo sapiens
ucagagucuagaucacucacug

SEQ ID NO: 262806 - RNA, 18 nt, Homo sapiens
ucagagugcagacuauac

SEQ ID NO: 262807 - RNA, 22 nt, Homo sapiens
ucagaucauuaagguagguuua

SEQ ID NO: 262808 - RNA, 22 nt, Homo sapiens
ucagcaaugaccuaagcaaaua

SEQ ID NO: 262809 - RNA, 19 nt, Homo sapiens
ucagcaguaaucaacuuca

SEQ ID NO: 262810 - RNA, 22 nt, Homo sapiens
ucagcagucacuccuaugacaa

SEQ ID NO: 262811 - RNA, 20 nt, Homo sapiens
ucagcagucuggagcagagg

SEQ ID NO: 262812 - RNA, 22 nt, Homo sapiens
ucagcaguggacagaaugguag

SEQ ID NO: 262813 - RNA, 22 nt, Homo sapiens
ucagguaaucuauuugucuuuu

SEQ ID NO: 262814 - RNA, 22 nt, Homo sapiens
ucagguauuucuuuuagcugug

SEQ ID NO: 262815 - RNA, 22 nt, Homo sapiens
ucagguccuuacugugcucccu

SEQ ID NO: 262816 - RNA, 22 nt, Homo sapiens
ucaggugcaguggcucugaccu

SEQ ID NO: 262817 - RNA, 22 nt, Homo sapiens
ucaguacuuuggagcucacaua

SEQ ID NO: 262818 - RNA, 21 nt, Homo sapiens
augguacugucucuggagaua

SEQ ID NO: 262819 - RNA, 22 nt, Homo sapiens
augguauuuugugauaccuugu

SEQ ID NO: 262820 - RNA, 22 nt, Homo sapiens
augguuugugcuccuauaagaa

SEQ ID NO: 262821 - RNA, 22 nt, Homo sapiens
auguaaacagaugugcagcuug

SEQ ID NO: 262822 - RNA, 22 nt, Homo sapiens
auguaaacauuuggucuaaauu

SEQ ID NO: 262823 - RNA, 22 nt, Homo sapiens
auguaagugugcucaaauguua

SEQ ID NO: 262824 - RNA, 22 nt, Homo sapiens
auguaauguuaaauugcuaauu

SEQ ID NO: 262825 - RNA, 22 nt, Homo sapiens
auguaguagcagaaaauauuuu

SEQ ID NO: 262826 - RNA, 22 nt, Homo sapiens
auguaguaugaagaagaugcuu

SEQ ID NO: 262827 - RNA, 22 nt, Homo sapiens
auguaugagaguuccagcugau

SEQ ID NO: 262828 - RNA, 22 nt, Homo sapiens
augucaaagaggaaaacuggau

SEQ ID NO: 262829 - RNA, 22 nt, Homo sapiens
augucauagauaaggaagugga

SEQ ID NO: 262830 - RNA, 21 nt, Homo sapiens
augucauggaugacuaauuca

SEQ ID NO: 262831 - RNA, 22 nt, Homo sapiens
auguccaugagcacauguauca

SEQ ID NO: 262832 - RNA, 22 nt, Homo sapiens
augucuagagcaagagaugcug

SEQ ID NO: 262833 - RNA, 22 nt, Homo sapiens
augugaacugaauuaauucaca

SEQ ID NO: 262834 - RNA, 22 nt, Homo sapiens
augugacagcaacccccagccc

SEQ ID NO: 262835 - RNA, 22 nt, Homo sapiens
augugcaaaguuaagaucccag

SEQ ID NO: 262836 - RNA, 22 nt, Homo sapiens
augugcaaauuuccaaacucuu

SEQ ID NO: 262837 - RNA, 21 nt, Homo sapiens
augugcacuaugucauuuaau

SEQ ID NO: 262838 - RNA, 22 nt, Homo sapiens
augugcauaugaagcacagaca

SEQ ID NO: 262839 - RNA, 22 nt, Homo sapiens
augugcuaguaucaaacgagac

SEQ ID NO: 262840 - RNA, 22 nt, Homo sapiens
augugcuugagggaaaucaguu

SEQ ID NO: 262841 - RNA, 22 nt, Homo sapiens
auguggaaagcagcaugauaug

SEQ ID NO: 262842 - RNA, 22 nt, Homo sapiens
auguggcuuuucaacuguguga

SEQ ID NO: 262843 - RNA, 22 nt, Homo sapiens
augugguaguuauagugauaag

SEQ ID NO: 262844 - RNA, 19 nt, Homo sapiens
augugguuagcaugacugc

SEQ ID NO: 262845 - RNA, 22 nt, Homo sapiens
augugugcuugauguaaaaagu

SEQ ID NO: 262846 - RNA, 23 nt, Homo sapiens
augugugcuuggagagcaggaug

SEQ ID NO: 262847 - RNA, 22 nt, Homo sapiens
augugugcuugugacacagccu

SEQ ID NO: 262848 - RNA, 22 nt, Homo sapiens
auguguucaucacagcacaauu

SEQ ID NO: 262849 - RNA, 22 nt, Homo sapiens
auguugcuugaaggcauuuugu

SEQ ID NO: 262850 - RNA, 22 nt, Homo sapiens
auguuugguagugaauauggua

SEQ ID NO: 262851 - RNA, 22 nt, Homo sapiens
auuaacaucuagaguuuuggug

SEQ ID NO: 262852 - RNA, 22 nt, Homo sapiens
auaugcacaguggaguacuauu

SEQ ID NO: 262853 - RNA, 22 nt, Homo sapiens
auaugcacuauacacacguaua

SEQ ID NO: 262854 - RNA, 22 nt, Homo sapiens
auaugcauacauguaugcagga

SEQ ID NO: 262855 - RNA, 20 nt, Homo sapiens
auaugcauguguuuucacuu

SEQ ID NO: 262856 - RNA, 22 nt, Homo sapiens
auaugcuuauuagcaagaaaua

SEQ ID NO: 262857 - RNA, 21 nt, Homo sapiens
auauggaacuggugacguguu

SEQ ID NO: 262858 - RNA, 22 nt, Homo sapiens
auauggcuaugugagcauacca

SEQ ID NO: 262859 - RNA, 22 nt, Homo sapiens
auauggcuuuuauuauguugag

SEQ ID NO: 262860 - RNA, 22 nt, Homo sapiens
auauggucccuguucucaagga

SEQ ID NO: 262861 - RNA, 22 nt, Homo sapiens
auaugguguuugcuauucagcu

SEQ ID NO: 262862 - RNA, 22 nt, Homo sapiens
auaugguuuuuggaagcauauc

SEQ ID NO: 262863 - RNA, 22 nt, Homo sapiens
auauguucucauucauaugugg

SEQ ID NO: 262864 - RNA, 22 nt, Homo sapiens
auauuagcacuaaugucacgau

SEQ ID NO: 262865 - RNA, 22 nt, Homo sapiens
auauugacuuucucuuagauca

SEQ ID NO: 262866 - RNA, 22 nt, Homo sapiens
auauugcuccuaauaccacggu

SEQ ID NO: 262867 - RNA, 22 nt, Homo sapiens
auauuggucuucaagaccugug

SEQ ID NO: 262868 - RNA, 22 nt, Homo sapiens
aucaaagccaugcucaguuuuc

SEQ ID NO: 262869 - RNA, 22 nt, Homo sapiens
aucaaaguaggcauauguuuuu

SEQ ID NO: 262870 - RNA, 22 nt, Homo sapiens
aucaagccaaagaaaguccuug

SEQ ID NO: 262871 - RNA, 22 nt, Homo sapiens
aucaagcuacacccuuuggaaa

SEQ ID NO: 262872 - RNA, 22 nt, Homo sapiens
aucaaguaaucugaguaagagu

SEQ ID NO: 262873 - RNA, 22 nt, Homo sapiens
aucaaguaguuauacguaaagg

SEQ ID NO: 262874 - RNA, 22 nt, Homo sapiens
aucacaauuguacguaggagcc

SEQ ID NO: 262875 - RNA, 22 nt, Homo sapiens
aucacacuguuauuuuaguuaa

SEQ ID NO: 262876 - RNA, 22 nt, Homo sapiens
aucacagaguuaaaacuuucuu

SEQ ID NO: 262877 - RNA, 22 nt, Homo sapiens
aucacagauauggguuuaaauc

SEQ ID NO: 262878 - RNA, 22 nt, Homo sapiens
aucacagcuacuccucugucuu

SEQ ID NO: 262879 - RNA, 19 nt, Homo sapiens
aucaccauuauuuggaaca

SEQ ID NO: 262880 - RNA, 20 nt, Homo sapiens
aucacuggagaaggaaaccu

SEQ ID NO: 262881 - RNA, 22 nt, Homo sapiens
aucacugggauggaacugcuga

SEQ ID NO: 262882 - RNA, 20 nt, Homo sapiens
aucagagccggugaaagggc

SEQ ID NO: 262883 - RNA, 22 nt, Homo sapiens
aucagauuccacauuuuaucag

SEQ ID NO: 262884 - RNA, 22 nt, Homo sapiens
aucagauuccagaggcagcacc

SEQ ID NO: 262885 - RNA, 22 nt, Homo sapiens
aucagcagcaugaaaacaggcu

SEQ ID NO: 262886 - RNA, 22 nt, Homo sapiens
aucaggaaccuuuuuggugugu

SEQ ID NO: 262887 - RNA, 22 nt, Homo sapiens
aucagugauugauuuaaagacg

SEQ ID NO: 262888 - RNA, 22 nt, Homo sapiens
aucauacuguuuugauuacugu

SEQ ID NO: 262889 - RNA, 22 nt, Homo sapiens
aucauagcucacugcagccucg

SEQ ID NO: 262890 - RNA, 22 nt, Homo sapiens
aucauccugucaggagcuguga

SEQ ID NO: 262891 - RNA, 22 nt, Homo sapiens
aucauggaguauuugcaagucu

SEQ ID NO: 262892 - RNA, 22 nt, Homo sapiens
aucaugucuucccagugauucu

SEQ ID NO: 262893 - RNA, 22 nt, Homo sapiens
aucauguuuauguguaggauau

SEQ ID NO: 262894 - RNA, 22 nt, Homo sapiens
aucauuaguuguggaauucuug

SEQ ID NO: 262895 - RNA, 22 nt, Homo sapiens
auccauguggauaaauguguau

SEQ ID NO: 262896 - RNA, 22 nt, Homo sapiens
auccauugcucaagagaaguca

SEQ ID NO: 262897 - RNA, 22 nt, Homo sapiens
auccauugucuaaugcuaagau

SEQ ID NO: 262898 - RNA, 22 nt, Homo sapiens
aucccaguaaaaauggcuucua

SEQ ID NO: 262899 - RNA, 22 nt, Homo sapiens
aucccuguaacuagcagccccu

SEQ ID NO: 262900 - RNA, 22 nt, Homo sapiens
auccugagacuuuucugaaguu

SEQ ID NO: 262901 - RNA, 22 nt, Homo sapiens
auccuguagucucacagcccca

SEQ ID NO: 262902 - RNA, 22 nt, Homo sapiens
aucuaaaucucauaugggcaca

SEQ ID NO: 262903 - RNA, 22 nt, Homo sapiens
cuuuacaguuggacucacgagg

SEQ ID NO: 262904 - RNA, 22 nt, Homo sapiens
cuuuccauuguuggagcauaaa

SEQ ID NO: 262905 - RNA, 22 nt, Homo sapiens
cuuugcaaaacauugagaccuc

SEQ ID NO: 262906 - RNA, 22 nt, Homo sapiens
cuuugcacaucucugcuuuccc

SEQ ID NO: 262907 - RNA, 18 nt, Homo sapiens
cuuugcagcuuccagagg

SEQ ID NO: 262908 - RNA, 20 nt, Homo sapiens
cuuuggcaaugagaacaggg

SEQ ID NO: 262909 - RNA, 22 nt, Homo sapiens
cuuugggaccgcgguuuauacu

SEQ ID NO: 262910 - RNA, 21 nt, Homo sapiens
cuuugguuucugacuugcaua

SEQ ID NO: 262911 - RNA, 23 nt, Homo sapiens
cuuuguacagcuugacuacuggg

SEQ ID NO: 262912 - RNA, 22 nt, Homo sapiens
cuuuguaugucaugacaacugu

SEQ ID NO: 262913 - RNA, 22 nt, Homo sapiens
cuuuuacacuguuagugggaau

SEQ ID NO: 262914 - RNA, 22 nt, Homo sapiens
cuuuuacacuguuggcaggauu

SEQ ID NO: 262915 - RNA, 22 nt, Homo sapiens
cuuuugcugggucagcgguggu

SEQ ID NO: 262916 - RNA, 22 nt, Homo sapiens
cuuuuggcuuaagauugucuug

SEQ ID NO: 262917 - RNA, 22 nt, Homo sapiens
cuuuuggcuuagaauugucuug

SEQ ID NO: 262918 - RNA, 22 nt, Homo sapiens
cuuuuggugguucugaugcagg

SEQ ID NO: 262919 - RNA, 22 nt, Homo sapiens
cuuuuggugugaagaagcucuu

SEQ ID NO: 262920 - RNA, 22 nt, Homo sapiens
cuuuuugcaaauacaacucuga

SEQ ID NO: 262921 - RNA, 22 nt, Homo sapiens
cuuuuugcugcagcaauacugg

SEQ ID NO: 262922 - RNA, 20 nt, Homo sapiens
gaaacaucuauccucuccuu

SEQ ID NO: 262923 - RNA, 22 nt, Homo sapiens
gaaagauuuccugagcuagaaa

SEQ ID NO: 262924 - RNA, 22 nt, Homo sapiens
gaaaguaauuaacgauuguugc

SEQ ID NO: 262925 - RNA, 21 nt, Homo sapiens
gaaauacugccuuaggagcug

SEQ ID NO: 262926 - RNA, 18 nt, Homo sapiens
gaaaugccucuugcuuac

SEQ ID NO: 262927 - RNA, 23 nt, Homo sapiens
gaaaugucuuagugaaauugcuu

SEQ ID NO: 262928 - RNA, 22 nt, Homo sapiens
gaagacauuuacaugggagacc

SEQ ID NO: 262929 - RNA, 22 nt, Homo sapiens
gaaggcacugugugccacccug

SEQ ID NO: 262930 - RNA, 22 nt, Homo sapiens
gaaggugcuuggugaaugcauu

SEQ ID NO: 262931 - RNA, 22 nt, Homo sapiens
gaaguaauaaauggauucuuaa

SEQ ID NO: 262932 - RNA, 22 nt, Homo sapiens
gaauacuguccaagagugaugg

SEQ ID NO: 262933 - RNA, 22 nt, Homo sapiens
gaauagugcugcaagaaacaua

SEQ ID NO: 262934 - RNA, 22 nt, Homo sapiens
gaauagugcugcaguaaacaua

SEQ ID NO: 262935 - RNA, 22 nt, Homo sapiens
gaaucauuggguugauucaaga

SEQ ID NO: 262936 - RNA, 22 nt, Homo sapiens
gaaugauacuguuaacgaaaga

SEQ ID NO: 262937 - RNA, 22 nt, Homo sapiens
gaaugugcuguuggcugggcgu

SEQ ID NO: 262938 - RNA, 22 nt, Homo sapiens
gaauuguacugcaaucagggga

SEQ ID NO: 262939 - RNA, 22 nt, Homo sapiens
gacacagugaagucucuacuug

SEQ ID NO: 262940 - RNA, 22 nt, Homo sapiens
gacaccugguguggaacuggag

SEQ ID NO: 262941 - RNA, 22 nt, Homo sapiens
gacacuggguguuuguuggcgu

SEQ ID NO: 262942 - RNA, 22 nt, Homo sapiens
gacacugucuucugcucuuaaa

SEQ ID NO: 262943 - RNA, 22 nt, Homo sapiens
gacagacacaauugauccauga

SEQ ID NO: 262944 - RNA, 22 nt, Homo sapiens
gacagagcaagacccuauuuaa

SEQ ID NO: 262945 - RNA, 18 nt, Homo sapiens
gacaguguggugauuccu

SEQ ID NO: 262946 - RNA, 22 nt, Homo sapiens
gacaguuucucaggcuuccuua

SEQ ID NO: 262947 - RNA, 20 nt, Homo sapiens
gacauagagacucucaaaaa

SEQ ID NO: 262948 - RNA, 22 nt, Homo sapiens
gacaucauuaugagauuuaaac

SEQ ID NO: 262949 - RNA, 22 nt, Homo sapiens
gacauguuuucaagauuuauaa

SEQ ID NO: 262950 - RNA, 22 nt, Homo sapiens
gacauuaucagguuuguuuucu

SEQ ID NO: 262951 - RNA, 22 nt, Homo sapiens
gaccacauuccacacaggcuuu

SEQ ID NO: 262952 - RNA, 22 nt, Homo sapiens
gacucuguagacaaucacaucu

SEQ ID NO: 262953 - RNA, 22 nt, Homo sapiens
gacuggauagauaaaguuaguu

SEQ ID NO: 262954 - RNA, 22 nt, Homo sapiens
gacuucaucauacuaugugugg

SEQ ID NO: 262955 - RNA, 22 nt, Homo sapiens
gagaacagagauaauuuuacuu

SEQ ID NO: 262956 - RNA, 22 nt, Homo sapiens
gagaacugagauaagugauauu

SEQ ID NO: 262957 - RNA, 22 nt, Homo sapiens
gagacggagucacgcccuguca

SEQ ID NO: 262958 - RNA, 22 nt, Homo sapiens
gagacggagucucgcucuguca

SEQ ID NO: 262959 - RNA, 22 nt, Homo sapiens
gagacucuuagauuggaaaucu

SEQ ID NO: 262960 - RNA, 22 nt, Homo sapiens
gagacugagucuugcucuguca

SEQ ID NO: 262961 - RNA, 22 nt, Homo sapiens
auaaagccaugagcuugagaug

SEQ ID NO: 262962 - RNA, 22 nt, Homo sapiens
auaaaguucugcuggcauauau

SEQ ID NO: 262963 - RNA, 22 nt, Homo sapiens
auaaaugcaaugguauuuuuga

SEQ ID NO: 262964 - RNA, 22 nt, Homo sapiens
auaagaagugaaccagacgucu

SEQ ID NO: 262965 - RNA, 22 nt, Homo sapiens
auaagaguaguacauaugagac

SEQ ID NO: 262966 - RNA, 22 nt, Homo sapiens
auaagauaguggaagugggauu

SEQ ID NO: 262967 - RNA, 22 nt, Homo sapiens
auaagaugaaggaagccauauc

SEQ ID NO: 262968 - RNA, 22 nt, Homo sapiens
auaagcuaagaguuucugggcu

SEQ ID NO: 262969 - RNA, 18 nt, Homo sapiens
auacaagcagcagagauu

SEQ ID NO: 262970 - RNA, 22 nt, Homo sapiens
auacaaguuauuugaacugcgg

SEQ ID NO: 262971 - RNA, 22 nt, Homo sapiens
auacaguaaugucuuaggcugu

SEQ ID NO: 262972 - RNA, 22 nt, Homo sapiens
auacagugaauacuuacagugu

SEQ ID NO: 262973 - RNA, 22 nt, Homo sapiens
auacaucugccauguuggugug

SEQ ID NO: 262974 - RNA, 22 nt, Homo sapiens
auacaugugccauguugguaug

SEQ ID NO: 262975 - RNA, 20 nt, Homo sapiens
auacccaguagcacaacagc

SEQ ID NO: 262976 - RNA, 22 nt, Homo sapiens
auagaagcuauguauaggggcc

SEQ ID NO: 262977 - RNA, 22 nt, Homo sapiens
auagaauguauuaguaaauuug

SEQ ID NO: 262978 - RNA, 22 nt, Homo sapiens
auagcaaugcaagaauggcuua

SEQ ID NO: 262979 - RNA, 22 nt, Homo sapiens
auagcacaguguguguacacca

SEQ ID NO: 262980 - RNA, 22 nt, Homo sapiens
auagcacaugugcaaauggcug

SEQ ID NO: 262981 - RNA, 20 nt, Homo sapiens
auagcaccagacagcccuag

SEQ ID NO: 262982 - RNA, 22 nt, Homo sapiens
auagcagaauuuggucaagucu

SEQ ID NO: 262983 - RNA, 22 nt, Homo sapiens
auagcagaccaccucucccacu

SEQ ID NO: 262984 - RNA, 22 nt, Homo sapiens
auagcagcaccucacucuacug

SEQ ID NO: 262985 - RNA, 20 nt, Homo sapiens
auagcauugauggacucaaa

SEQ ID NO: 262986 - RNA, 21 nt, Homo sapiens
auagggcuuguugauaguuaa

SEQ ID NO: 262987 - RNA, 22 nt, Homo sapiens
auagguagcauagcaggaauau

SEQ ID NO: 262988 - RNA, 22 nt, Homo sapiens
auagguauuuuuaaaugacugu

SEQ ID NO: 262989 - RNA, 21 nt, Homo sapiens
auagugcuagagaguagcagg

SEQ ID NO: 262990 - RNA, 22 nt, Homo sapiens
auagugcuauggcagaccuuga

SEQ ID NO: 262991 - RNA, 22 nt, Homo sapiens
auagugcugcaagaaacauacg

SEQ ID NO: 262992 - RNA, 22 nt, Homo sapiens
auagugcugcacuaaacauaca

SEQ ID NO: 262993 - RNA, 22 nt, Homo sapiens
auagugcugcauuaaacauacg

SEQ ID NO: 262994 - RNA, 22 nt, Homo sapiens
auagugcugccauaaacauacg

SEQ ID NO: 262995 - RNA, 22 nt, Homo sapiens
auagugcuggaauaaauauacg

SEQ ID NO: 262996 - RNA, 22 nt, Homo sapiens
auaguggcaugaucauagcuca

SEQ ID NO: 262997 - RNA, 22 nt, Homo sapiens
auauagcaaugaaagagaugaa

SEQ ID NO: 262998 - RNA, 22 nt, Homo sapiens
auauaugcacacgugugcauau

SEQ ID NO: 262999 - RNA, 22 nt, Homo sapiens
auaucacaggaaaggaagauac

SEQ ID NO: 263000 - RNA, 22 nt, Homo sapiens
auauccaugccauagguuuuga

SEQ ID NO: 263001 - RNA, 22 nt, Homo sapiens
auaucccaguguguaaacacug

SEQ ID NO: 263002 - RNA, 22 nt, Homo sapiens
auaugcaaauccauagagacag

SEQ ID NO: 263003 - RNA, 22 nt, Homo sapiens
uagugguaguagcaguaauauu

SEQ ID NO: 263004 - RNA, 22 nt, Homo sapiens
uaguguuuuucauuggcagagg

SEQ ID NO: 263005 - RNA, 22 nt, Homo sapiens
uauaacacccacauauagucuu

SEQ ID NO: 263006 - RNA, 22 nt, Homo sapiens
uauacagcaaguuacugugcug

SEQ ID NO: 263007 - RNA, 22 nt, Homo sapiens
uauacugucuuuguaugccuag

SEQ ID NO: 263008 - RNA, 20 nt, Homo sapiens
uauagcaauuuuuuucuccu

SEQ ID NO: 263009 - RNA, 22 nt, Homo sapiens
uauauagcuaugucuguccauu

SEQ ID NO: 263010 - RNA, 22 nt, Homo sapiens
uauauguucugugucccuuucg

SEQ ID NO: 263011 - RNA, 22 nt, Homo sapiens
uauauguucuugcacuggaaag

SEQ ID NO: 263012 - RNA, 22 nt, Homo sapiens
uaucaacaggguggccagugua

SEQ ID NO: 263013 - RNA, 22 nt, Homo sapiens
uaucacagcgggguguacaccc

SEQ ID NO: 263014 - RNA, 22 nt, Homo sapiens
uaucacaggucaggaaccuugu

SEQ ID NO: 263015 - RNA, 22 nt, Homo sapiens
uaucacaggucaggaaucuugc

SEQ ID NO: 263016 - RNA, 22 nt, Homo sapiens
uaucacagguggacugcacacc

SEQ ID NO: 263017 - RNA, 22 nt, Homo sapiens
uaucacaguaucuagcacagug

SEQ ID NO: 263018 - RNA, 22 nt, Homo sapiens
uaucaccauguccguuuuaaaa

SEQ ID NO: 263019 - RNA, 22 nt, Homo sapiens
uaucaccuugguagucuugggg

SEQ ID NO: 263020 - RNA, 22 nt, Homo sapiens
uaucacuguuguuuguuuaagg

SEQ ID NO: 263021 - RNA, 21 nt, Homo sapiens
uaucauggugaaacccugucu

SEQ ID NO: 263022 - RNA, 21 nt, Homo sapiens
uaucccagucacaucuaccca

SEQ ID NO: 263023 - RNA, 22 nt, Homo sapiens
uaucccuguggacuucccaaca

SEQ ID NO: 263024 - RNA, 22 nt, Homo sapiens
uaucccuuagagcggggugguu

SEQ ID NO: 263025 - RNA, 20 nt, Homo sapiens
uaucuacuugcaaaugccau

SEQ ID NO: 263026 - RNA, 22 nt, Homo sapiens
uaucucauccuccuugauccca

SEQ ID NO: 263027 - RNA, 22 nt, Homo sapiens
uaugaauuuuauccaggauaua

SEQ ID NO: 263028 - RNA, 20 nt, Homo sapiens
uaugaccugucuuuucucuc

SEQ ID NO: 263029 - RNA, 22 nt, Homo sapiens
uaugaccuuggacaaguuacuu

SEQ ID NO: 263030 - RNA, 22 nt, Homo sapiens
uaugaucacuacagcagggaug

SEQ ID NO: 263031 - RNA, 22 nt, Homo sapiens
uaugaugcuguuuagaaucucu

SEQ ID NO: 263032 - RNA, 19 nt, Homo sapiens
uaugcaacuuauagugcug

SEQ ID NO: 263033 - RNA, 23 nt, Homo sapiens
uaugccuguuucaaacaaacuuu

SEQ ID NO: 263034 - RNA, 19 nt, Homo sapiens
uaugcuagagagggaagcu

SEQ ID NO: 263035 - RNA, 22 nt, Homo sapiens
uaugcuuauugucucauccacu

SEQ ID NO: 263036 - RNA, 22 nt, Homo sapiens
uauggcauuauuuugauagaca

SEQ ID NO: 263037 - RNA, 22 nt, Homo sapiens
uauggcccuuaaguauugguug

SEQ ID NO: 263038 - RNA, 22 nt, Homo sapiens
uauggcugcuuucacacuacaa

SEQ ID NO: 263039 - RNA, 22 nt, Homo sapiens
uauggcuucuuauucuuucccg

SEQ ID NO: 263040 - RNA, 22 nt, Homo sapiens
uauggcuuuguuaacauuuucu

SEQ ID NO: 263041 - RNA, 22 nt, Homo sapiens
uauggcuuuucacuuaaguccu

SEQ ID NO: 263042 - RNA, 22 nt, Homo sapiens
uaugggauuucauuaagugucu

SEQ ID NO: 263043 - RNA, 22 nt, Homo sapiens
uaugucuauuauguagcaggaa

SEQ ID NO: 263044 - RNA, 22 nt, Homo sapiens
uaugucuucuuuagagaaaugu

SEQ ID NO: 263045 - RNA, 22 nt, Homo sapiens
uaugucuuuugcuugcaaauag

SEQ ID NO: 263046 - RNA, 22 nt, Homo sapiens
uaugugcaaauuaauugcuaga

SEQ ID NO: 263047 - RNA, 22 nt, Homo sapiens
uaugugguuaauaggaauuugu

SEQ ID NO: 263048 - RNA, 22 nt, Homo sapiens
uauuaguuguaugauucccaag

SEQ ID NO: 263049 - RNA, 22 nt, Homo sapiens
uauucacuguaucauugauggg

SEQ ID NO: 263050 - RNA, 22 nt, Homo sapiens
uauuccacuuacaugagguauc

SEQ ID NO: 263051 - RNA, 22 nt, Homo sapiens
agaaugugaacaucuugaaagu

SEQ ID NO: 263052 - RNA, 22 nt, Homo sapiens
agaaugugaccuuauuuggaga

SEQ ID NO: 263053 - RNA, 22 nt, Homo sapiens
agacaguauuggcaaagugugu

SEQ ID NO: 263054 - RNA, 19 nt, Homo sapiens
agacuggcccaggcgggug

SEQ ID NO: 263055 - RNA, 19 nt, Homo sapiens
agagacucauuguagcauu

SEQ ID NO: 263056 - RNA, 22 nt, Homo sapiens
agagagcuuuugguugcccuaa

SEQ ID NO: 263057 - RNA, 22 nt, Homo sapiens
agagagguggguggagccccca

SEQ ID NO: 263058 - RNA, 22 nt, Homo sapiens
agagaucauuuuguuucaaauc

SEQ ID NO: 263059 - RNA, 22 nt, Homo sapiens
agagcacuguggguccaaauau

SEQ ID NO: 263060 - RNA, 22 nt, Homo sapiens
agagguaagcaguggcaagugc

SEQ ID NO: 263061 - RNA, 22 nt, Homo sapiens
agagguagaagauaggcuacag

SEQ ID NO: 263062 - RNA, 22 nt, Homo sapiens
agaggucuuaucaaacaugcuu

SEQ ID NO: 263063 - RNA, 22 nt, Homo sapiens
agaguacaggcaaguuagucau

SEQ ID NO: 263064 - RNA, 22 nt, Homo sapiens
agaguaguuuauuaugcuaagg

SEQ ID NO: 263065 - RNA, 18 nt, Homo sapiens
agaguaucauuuccccca

SEQ ID NO: 263066 - RNA, 22 nt, Homo sapiens
agagugcaaagguuggggcugg

SEQ ID NO: 263067 - RNA, 22 nt, Homo sapiens
agagugcaauggcaccaucucg

SEQ ID NO: 263068 - RNA, 23 nt, Homo sapiens
agagugcaauggugccaucucgg

SEQ ID NO: 263069 - RNA, 20 nt, Homo sapiens
agagugcuggacugaggagc

SEQ ID NO: 263070 - RNA, 22 nt, Homo sapiens
agauacaucuaugugucugugu

SEQ ID NO: 263071 - RNA, 22 nt, Homo sapiens
agauaugucugcuauuugcugu

SEQ ID NO: 263072 - RNA, 22 nt, Homo sapiens
agaucacaguaccguaaggcug

SEQ ID NO: 263073 - RNA, 22 nt, Homo sapiens
agaucacucagguuucucccug

SEQ ID NO: 263074 - RNA, 22 nt, Homo sapiens
agaugauguuucuggcacauga

SEQ ID NO: 263075 - RNA, 22 nt, Homo sapiens
agaugccucauguucuagguuc

SEQ ID NO: 263076 - RNA, 23 nt, Homo sapiens
agauggcauuucaguucuuuagg

SEQ ID NO: 263077 - RNA, 22 nt, Homo sapiens
agauggguuuucacauguuggc

SEQ ID NO: 263078 - RNA, 22 nt, Homo sapiens
agaugguauuauagguuucugu

SEQ ID NO: 263079 - RNA, 22 nt, Homo sapiens
agaugguguuuucucaccagau

SEQ ID NO: 263080 - RNA, 22 nt, Homo sapiens
agaugguuuuguucacagcucu

SEQ ID NO: 263081 - RNA, 22 nt, Homo sapiens
agauucauccaaguuguugcau

SEQ ID NO: 263082 - RNA, 22 nt, Homo sapiens
agcaacauuuuugaccuuucuu

SEQ ID NO: 263083 - RNA, 22 nt, Homo sapiens
agcaaccagaggagaugaggcu

SEQ ID NO: 263084 - RNA, 22 nt, Homo sapiens
agcaagacauggcuuccaaaug

SEQ ID NO: 263085 - RNA, 22 nt, Homo sapiens
agcaauaugacauugcuacauc

SEQ ID NO: 263086 - RNA, 22 nt, Homo sapiens
agcaccaccguugcucuauccc

SEQ ID NO: 263087 - RNA, 22 nt, Homo sapiens
agcagagcaguggauuuuguga

SEQ ID NO: 263088 - RNA, 22 nt, Homo sapiens
agcagcacaucccuuucuggcc

SEQ ID NO: 263089 - RNA, 22 nt, Homo sapiens
agcagcaucgggaaguuggcca

SEQ ID NO: 263090 - RNA, 22 nt, Homo sapiens
agcagcaugcaaauggacuaau

SEQ ID NO: 263091 - RNA, 21 nt, Homo sapiens
agcagcuuugguugaagcaga

SEQ ID NO: 263092 - RNA, 22 nt, Homo sapiens
agcagguguccacaauguuugc

SEQ ID NO: 263093 - RNA, 16 nt, Homo sapiens
agcagguguuagguga

SEQ ID NO: 263094 - RNA, 22 nt, Homo sapiens
agcagugugaaaauggacuaau

SEQ ID NO: 263095 - RNA, 22 nt, Homo sapiens
agcaucacaugggcugcuuggg

SEQ ID NO: 263096 - RNA, 22 nt, Homo sapiens
agcaucagugauuuuguugaag

SEQ ID NO: 263097 - RNA, 22 nt, Homo sapiens
agccaagacucuguuccccuug

SEQ ID NO: 263098 - RNA, 22 nt, Homo sapiens
agccaguauuuccacagagugg

SEQ ID NO: 263099 - RNA, 22 nt, Homo sapiens
agccaguauuuuauugaggauu

SEQ ID NO: 263100 - RNA, 22 nt, Homo sapiens
agccucauucuacauguuaaug

SEQ ID NO: 263101 - RNA, 22 nt, Homo sapiens
agcuaaaucucauguugaauug

SEQ ID NO: 263102 - RNA, 22 nt, Homo sapiens
agcuaacauuuuuccucuucca

SEQ ID NO: 263103 - RNA, 22 nt, Homo sapiens
agcuaguggucauucaauccuu

SEQ ID NO: 263104 - RNA, 22 nt, Homo sapiens
agcuaguguucaccagagguca

SEQ ID NO: 263105 - RNA, 21 nt, Homo sapiens
agcuccacucguucccaaagc

SEQ ID NO: 263106 - RNA, 20 nt, Homo sapiens
agcuccauuccugaaggcug

SEQ ID NO: 263107 - RNA, 22 nt, Homo sapiens
agcuccauuguaaucaccuggu

SEQ ID NO: 263108 - RNA, 22 nt, Homo sapiens
agcuccuuugcuuuuuccagga

SEQ ID NO: 263109 - RNA, 22 nt, Homo sapiens
agcugaguguuccaagagcgag

SEQ ID NO: 263110 - RNA, 22 nt, Homo sapiens
agcugcacugguauaggagaaa

SEQ ID NO: 263111 - RNA, 22 nt, Homo sapiens
agcugcauuuacuuuugcacaa

SEQ ID NO: 263112 - RNA, 17 nt, Homo sapiens
agcuggaauuacgggag

SEQ ID NO: 263113 - RNA, 22 nt, Homo sapiens
agcuggaauuuaagguagauag

SEQ ID NO: 263114 - RNA, 22 nt, Homo sapiens
agcuggcuguagcugcaagucu

SEQ ID NO: 263115 - RNA, 20 nt, Homo sapiens
agcuggguguguuggugcau

SEQ ID NO: 263116 - RNA, 22 nt, Homo sapiens
agcugguaugaaaaucucccca

SEQ ID NO: 263117 - RNA, 22 nt, Homo sapiens
agcugguauuuugucgaggacu

SEQ ID NO: 263118 - RNA, 22 nt, Homo sapiens
agcuggucugauacuuaccucc

SEQ ID NO: 263119 - RNA, 22 nt, Homo sapiens
agcuggucuuggggaagaguag

SEQ ID NO: 263120 - RNA, 22 nt, Homo sapiens
agcuguguugucugaagucaga

SEQ ID NO: 263121 - RNA, 22 nt, Homo sapiens
agcuguuguacacuuuaccuuu

SEQ ID NO: 263122 - RNA, 20 nt, Homo sapiens
agcuguuguuaaaaaggagg

SEQ ID NO: 263123 - RNA, 22 nt, Homo sapiens
agcuguuguuaauuaacucauu

SEQ ID NO: 263124 - RNA, 22 nt, Homo sapiens
agcuguuguuuuaagauacuaa

SEQ ID NO: 263125 - RNA, 20 nt, Homo sapiens
agcuugguuuggaugaucac

SEQ ID NO: 263126 - RNA, 22 nt, Homo sapiens
agcuugugauucuccaucaugu

SEQ ID NO: 263127 - RNA, 22 nt, Homo sapiens
agcuugugauuuagagugagag

SEQ ID NO: 263128 - RNA, 22 nt, Homo sapiens
agcuuguuuucccauaacuaga

SEQ ID NO: 263129 - RNA, 22 nt, Homo sapiens
agcuuuuugggaggccuuagga

SEQ ID NO: 263130 - RNA, 22 nt, Homo sapiens
aggaagacugaaauugcuguuc

SEQ ID NO: 263131 - RNA, 22 nt, Homo sapiens
aggaagugugcaauuaauuucu

SEQ ID NO: 263132 - RNA, 22 nt, Homo sapiens
aggaauuuaauguaugauaaua

SEQ ID NO: 263133 - RNA, 22 nt, Homo sapiens
aggacacugagcaugggagguu

SEQ ID NO: 263134 - RNA, 22 nt, Homo sapiens
aggacacugauagucuuuggca

SEQ ID NO: 263135 - RNA, 19 nt, Homo sapiens
aggacuaaagacuagaagu

SEQ ID NO: 263136 - RNA, 22 nt, Homo sapiens
aggagaucagccucccugcaac

SEQ ID NO: 263137 - RNA, 22 nt, Homo sapiens
aggagcacaauggucaugugga

SEQ ID NO: 263138 - RNA, 23 nt, Homo sapiens
aggagcuuagaaguugccauugc

SEQ ID NO: 263139 - RNA, 22 nt, Homo sapiens
aggaggauugcuuucaucuuuu

SEQ ID NO: 263140 - RNA, 22 nt, Homo sapiens
aggagguaggaauugugcuagg

SEQ ID NO: 263141 - RNA, 22 nt, Homo sapiens
aggagguagggugugaaacagc

SEQ ID NO: 263142 - RNA, 22 nt, Homo sapiens
aggcaaugugagaguuuauuca

SEQ ID NO: 263143 - RNA, 22 nt, Homo sapiens
aggcacacaacccuggaccuga

SEQ ID NO: 263144 - RNA, 22 nt, Homo sapiens
aggcacgguggcucacaccugu

SEQ ID NO: 263145 - RNA, 22 nt, Homo sapiens
aggcacggugucucaugccugu

SEQ ID NO: 263146 - RNA, 22 nt, Homo sapiens
aggcagaugagguccucagcug

SEQ ID NO: 263147 - RNA, 22 nt, Homo sapiens
aggcagucucugccggcugagg

SEQ ID NO: 263148 - RNA, 22 nt, Homo sapiens
aggcagucugaguuuugaaagg

SEQ ID NO: 263149 - RNA, 22 nt, Homo sapiens
aggcaugaaauacaugcauuga

SEQ ID NO: 263150 - RNA, 22 nt, Homo sapiens
aggcauugugcaucgaugauuu

SEQ ID NO: 263151 - RNA, 22 nt, Homo sapiens
aggcuuuuguuuuggucucagg

SEQ ID NO: 263152 - RNA, 22 nt, Homo sapiens
agggcacuguagguccugccuc

SEQ ID NO: 263153 - RNA, 22 nt, Homo sapiens
agggcuuuugagcugagauggu

SEQ ID NO: 263154 - RNA, 22 nt, Homo sapiens
agggguauuauguaaaucugac

SEQ ID NO: 263155 - RNA, 22 nt, Homo sapiens
aggguaguaggcuugggauugg

SEQ ID NO: 263156 - RNA, 22 nt, Homo sapiens
agguaaguauguuauuacuuuu

SEQ ID NO: 263157 - RNA, 22 nt, Homo sapiens
agguaagucucuaauuaugaau

SEQ ID NO: 263158 - RNA, 22 nt, Homo sapiens
agguaauuuucccagagggaaa

SEQ ID NO: 263159 - RNA, 22 nt, Homo sapiens
agguagaguguuuuguucuucu

SEQ ID NO: 263160 - RNA, 22 nt, Homo sapiens
agguagugugaugcuccuguuu

SEQ ID NO: 263161 - RNA, 22 nt, Homo sapiens
agguauguaugucuguacagcg

SEQ ID NO: 263162 - RNA, 22 nt, Homo sapiens
aggucccauguccucccugacc

SEQ ID NO: 263163 - RNA, 22 nt, Homo sapiens
aggugguuuuaggcagagacau

SEQ ID NO: 263164 - RNA, 22 nt, Homo sapiens
agguuaucccgcauuauuuggu

SEQ ID NO: 263165 - RNA, 22 nt, Homo sapiens
agguuguugcaugcuccuuagg

SEQ ID NO: 263166 - RNA, 22 nt, Homo sapiens
aguacaauguugaguagaagug

SEQ ID NO: 263167 - RNA, 22 nt, Homo sapiens
aguaccauuugacaugggaccc

SEQ ID NO: 263168 - RNA, 16 nt, Homo sapiens
aguaguuuuacagauu

SEQ ID NO: 263169 - RNA, 22 nt, Homo sapiens
aguaucaagccacacaugguca

SEQ ID NO: 263170 - RNA, 22 nt, Homo sapiens
aguauguagugcaaucagucag

SEQ ID NO: 263171 - RNA, 22 nt, Homo sapiens
agucaagaaucucagcaucuuu

SEQ ID NO: 263172 - RNA, 22 nt, Homo sapiens
agucaagauggcaagguaaggc

SEQ ID NO: 263173 - RNA, 22 nt, Homo sapiens
agucacaugcauuuucuucaau

SEQ ID NO: 263174 - RNA, 22 nt, Homo sapiens
agugagcugcagucuggggucc

SEQ ID NO: 263175 - RNA, 22 nt, Homo sapiens
agugagcuguuuuuacuuucug

SEQ ID NO: 263176 - RNA, 22 nt, Homo sapiens
agugcaguggcucaaaaugccu

SEQ ID NO: 263177 - RNA, 22 nt, Homo sapiens
agugccaaaucgagggcucuga

SEQ ID NO: 263178 - RNA, 22 nt, Homo sapiens
agugccacugcacucuagccug

SEQ ID NO: 263179 - RNA, 22 nt, Homo sapiens
aguggaauuaagaaacugaauu

SEQ ID NO: 263180 - RNA, 22 nt, Homo sapiens
aguggcacuauucucagaguca

SEQ ID NO: 263181 - RNA, 22 nt, Homo sapiens
agugggccccuagaggugaggu

SEQ ID NO: 263182 - RNA, 22 nt, Homo sapiens
agugguuuuggaauggaauuca

SEQ ID NO: 263183 - RNA, 18 nt, Homo sapiens
aguuguuuuauccugccc

SEQ ID NO: 263184 - RNA, 22 nt, Homo sapiens
aguuuuugcugauagcaugcuu

SEQ ID NO: 263185 - RNA, 17 nt, Homo sapiens
auaaacucaucauuuuu

SEQ ID NO: 263186 - RNA, 22 nt, Homo sapiens
auaaagguaagcacuauccuga

SEQ ID NO: 263187 - RNA, 22 nt, Homo sapiens
auaaauaguaguugugguggcc

SEQ ID NO: 263188 - RNA, 22 nt, Homo sapiens
auaaaugccuguuguuuuaagc

SEQ ID NO: 263189 - RNA, 22 nt, Homo sapiens
auaaaugcuuccagucauuaaa

SEQ ID NO: 263190 - RNA, 20 nt, Homo sapiens
auaaauguauagguguacau

SEQ ID NO: 263191 - RNA, 22 nt, Homo sapiens
auaacauggaguuugucauuua

SEQ ID NO: 263192 - RNA, 22 nt, Homo sapiens
auaacucuguuuuuuucaugca

SEQ ID NO: 263193 - RNA, 22 nt, Homo sapiens
auaaggcugguauagacauuca

SEQ ID NO: 263194 - RNA, 22 nt, Homo sapiens
auaaguagaaugauggucaaaa

SEQ ID NO: 263195 - RNA, 22 nt, Homo sapiens
auaauacugggaagaugagcau

SEQ ID NO: 263196 - RNA, 22 nt, Homo sapiens
auaaugacuuccaguuccacuc

SEQ ID NO: 263197 - RNA, 22 nt, Homo sapiens
auaauguuugauugagcagaua

SEQ ID NO: 263198 - RNA, 22 nt, Homo sapiens
auacaagcaguccaacuccaua

SEQ ID NO: 263199 - RNA, 22 nt, Homo sapiens
auacaguauggagggcccagcu

SEQ ID NO: 263200 - RNA, 22 nt, Homo sapiens
auacagugaauaucuggggcag

SEQ ID NO: 263201 - RNA, 22 nt, Homo sapiens
auacugguuuuugucaugugga

SEQ ID NO: 263202 - RNA, 20 nt, Homo sapiens
auagaagacuagugcagcag

SEQ ID NO: 263203 - RNA, 22 nt, Homo sapiens
auagaagcugccaacguuucag

SEQ ID NO: 263204 - RNA, 22 nt, Homo sapiens
auagaaucaucugugcacuagu

SEQ ID NO: 263205 - RNA, 23 nt, Homo sapiens
auagagcuaggaugcagacagau

SEQ ID NO: 263206 - RNA, 22 nt, Homo sapiens
auagaggacugaggugaucuuu

SEQ ID NO: 263207 - RNA, 22 nt, Homo sapiens
auagaguuagaaagaaauguuu

SEQ ID NO: 263208 - RNA, 22 nt, Homo sapiens
auagaucuauuuauguaucccu

SEQ ID NO: 263209 - RNA, 22 nt, Homo sapiens
auagcaauuugggaaucagacu

SEQ ID NO: 263210 - RNA, 22 nt, Homo sapiens
auagcacacuauagcuucaaac

SEQ ID NO: 263211 - RNA, 22 nt, Homo sapiens
auagcagcaccccacuaccuca

SEQ ID NO: 263212 - RNA, 22 nt, Homo sapiens
auagcagcuugucagggcagac

SEQ ID NO: 263213 - RNA, 22 nt, Homo sapiens
auagcagugugaaaauguacua

SEQ ID NO: 263214 - RNA, 22 nt, Homo sapiens
auagccaguagagagcuguuag

SEQ ID NO: 263215 - RNA, 22 nt, Homo sapiens
auagcucuugcuuacccacugu

SEQ ID NO: 263216 - RNA, 22 nt, Homo sapiens
auaguagagagggcaaaaugcu

SEQ ID NO: 263217 - RNA, 22 nt, Homo sapiens
auagugaacuuugugagaacaa

SEQ ID NO: 263218 - RNA, 22 nt, Homo sapiens
auagugcugcaauaaacauaca

SEQ ID NO: 263219 - RNA, 22 nt, Homo sapiens
auagugcugcaaucaacauaca

SEQ ID NO: 263220 - RNA, 22 nt, Homo sapiens
auagugcugcaauuaacauaca

SEQ ID NO: 263221 - RNA, 22 nt, Homo sapiens
auaucaacaucgugucauuagu

SEQ ID NO: 263222 - RNA, 22 nt, Homo sapiens
auaucaacaugguaggguuggu

SEQ ID NO: 263223 - RNA, 22 nt, Homo sapiens
auaucacaaacaagucuguacu

SEQ ID NO: 263224 - RNA, 22 nt, Homo sapiens
auaugcauguacccacacaggc

SEQ ID NO: 263225 - RNA, 22 nt, Homo sapiens
auauggguuuuauauuaggcuc

SEQ ID NO: 263226 - RNA, 22 nt, Homo sapiens
auauguaguuucagaaguggaa

SEQ ID NO: 263227 - RNA, 21 nt, Homo sapiens
auaugugcuguggaagucagc

SEQ ID NO: 263228 - RNA, 22 nt, Homo sapiens
auauuacagagaggaccuggga

SEQ ID NO: 263229 - RNA, 22 nt, Homo sapiens
auauucaagugaggauggcuaa

SEQ ID NO: 263230 - RNA, 22 nt, Homo sapiens
auauucacuauaugcagaacca

SEQ ID NO: 263231 - RNA, 22 nt, Homo sapiens
auauugcuuagugaugaagucu

SEQ ID NO: 263232 - RNA, 22 nt, Homo sapiens
auauuguacugcuacugguucu

SEQ ID NO: 263233 - RNA, 22 nt, Homo sapiens
aucaaagugaaauauuaguuau

SEQ ID NO: 263234 - RNA, 22 nt, Homo sapiens
aucaaagugaauuaaugagaau

SEQ ID NO: 263235 - RNA, 22 nt, Homo sapiens
aucaaaguuucccagaaguugu

SEQ ID NO: 263236 - RNA, 22 nt, Homo sapiens
aucaaauugucauuuuaaggau

SEQ ID NO: 263237 - RNA, 22 nt, Homo sapiens
aucaagcuggcauauguaguuc

SEQ ID NO: 263238 - RNA, 22 nt, Homo sapiens
aucaagcuugacuccuuaaagg

SEQ ID NO: 263239 - RNA, 22 nt, Homo sapiens
aucaaguacuguacugaaagug

SEQ ID NO: 263240 - RNA, 22 nt, Homo sapiens
aucacagguacuauggcugaca

SEQ ID NO: 263241 - RNA, 22 nt, Homo sapiens
aucacaguggcucacaagagcc

SEQ ID NO: 263242 - RNA, 22 nt, Homo sapiens
aucacauuuauaguggcacgca

SEQ ID NO: 263243 - RNA, 22 nt, Homo sapiens
aucaccauguguacauuagacc

SEQ ID NO: 263244 - RNA, 22 nt, Homo sapiens
aucaccuuucccuuucugaauc

SEQ ID NO: 263245 - RNA, 22 nt, Homo sapiens
aucacuaugcaggugucucggg

SEQ ID NO: 263246 - RNA, 22 nt, Homo sapiens
aucacuggucaugagagaagua

SEQ ID NO: 263247 - RNA, 23 nt, Homo sapiens
aucacuguuaacaauuucuuccu

SEQ ID NO: 263248 - RNA, 21 nt, Homo sapiens
aucagagacccaggcuuccuc

SEQ ID NO: 263249 - RNA, 22 nt, Homo sapiens
aucagagugaauaaugacaaaa

SEQ ID NO: 263250 - RNA, 22 nt, Homo sapiens
aucagauguuuguauaggagua

SEQ ID NO: 263251 - RNA, 22 nt, Homo sapiens
aucagugcauguuuguugagcu

SEQ ID NO: 263252 - RNA, 22 nt, Homo sapiens
aucauaucauuggugaacagug

SEQ ID NO: 263253 - RNA, 22 nt, Homo sapiens
aucauccagccccagaagggag

SEQ ID NO: 263254 - RNA, 22 nt, Homo sapiens
aucauguaguaagacacauuua

SEQ ID NO: 263255 - RNA, 22 nt, Homo sapiens
auccacagugucaauguuguga

SEQ ID NO: 263256 - RNA, 22 nt, Homo sapiens
auccacauucauggaccagucc

SEQ ID NO: 263257 - RNA, 22 nt, Homo sapiens
auccaguuuuaggagauuucua

SEQ ID NO: 263258 - RNA, 22 nt, Homo sapiens
auccaucagacggcaggcguug

SEQ ID NO: 263259 - RNA, 22 nt, Homo sapiens
aucccagaaacucggguuucuc

SEQ ID NO: 263260 - RNA, 22 nt, Homo sapiens
auccccugcacggggugucauu

SEQ ID NO: 263261 - RNA, 22 nt, Homo sapiens
auccccuugcagugaccggggc

SEQ ID NO: 263262 - RNA, 22 nt, Homo sapiens
aucccugagccugacucucaga

SEQ ID NO: 263263 - RNA, 22 nt, Homo sapiens
aucccuguaguaauauucuagc

SEQ ID NO: 263264 - RNA, 22 nt, Homo sapiens
aucccugugauccaaucacuuc

SEQ ID NO: 263265 - RNA, 22 nt, Homo sapiens
auccuagguuagagaacaaaac

SEQ ID NO: 263266 - RNA, 22 nt, Homo sapiens
auccucugagaucuaggcagag

SEQ ID NO: 263267 - RNA, 22 nt, Homo sapiens
auccugaagcuuuacugaauuc

SEQ ID NO: 263268 - RNA, 22 nt, Homo sapiens
auccuguacuaagguuuuccca

SEQ ID NO: 263269 - RNA, 22 nt, Homo sapiens
aucgcaccauugcacuccagca

SEQ ID NO: 263270 - RNA, 22 nt, Homo sapiens
aucgcgccauuguacuccagcc

SEQ ID NO: 263271 - RNA, 22 nt, Homo sapiens
aucuacagccagucugguuugu

SEQ ID NO: 263272 - RNA, 22 nt, Homo sapiens
aucuagagaggcagucuggccg

SEQ ID NO: 263273 - RNA, 22 nt, Homo sapiens
aucucaguucaggcuggccaca

SEQ ID NO: 263274 - RNA, 22 nt, Homo sapiens
aucucauggagguagagaguaa

SEQ ID NO: 263275 - RNA, 22 nt, Homo sapiens
aucucugagauguucugauuuu

SEQ ID NO: 263276 - RNA, 22 nt, Homo sapiens
aucugcaaauaaugaagauugg

SEQ ID NO: 263277 - RNA, 22 nt, Homo sapiens
aucugcauuagggugaagaccu

SEQ ID NO: 263278 - RNA, 22 nt, Homo sapiens
aucugcauucccauguuuauug

SEQ ID NO: 263279 - RNA, 22 nt, Homo sapiens
aucugguguggcugugauccuc

SEQ ID NO: 263280 - RNA, 22 nt, Homo sapiens
aucuucucuugaagggugggga

SEQ ID NO: 263281 - RNA, 22 nt, Homo sapiens
aucuuuggugcaugauacuuug

SEQ ID NO: 263282 - RNA, 22 nt, Homo sapiens
augaaagucaauccccaagugu

SEQ ID NO: 263283 - RNA, 22 nt, Homo sapiens
augaaagugauaaaugucucua

SEQ ID NO: 263284 - RNA, 22 nt, Homo sapiens
augaaaucuuuggcagaucuua

SEQ ID NO: 263285 - RNA, 22 nt, Homo sapiens
augaacuaugugggauguuuua

SEQ ID NO: 263286 - RNA, 22 nt, Homo sapiens
augaacucaucaucuagguuuu

SEQ ID NO: 263287 - RNA, 18 nt, Homo sapiens
augaagucaucacuuuua

SEQ ID NO: 263288 - RNA, 22 nt, Homo sapiens
augaagugcaugauaguugguu

SEQ ID NO: 263289 - RNA, 22 nt, Homo sapiens
augaaugucuuauuuugagaaa

SEQ ID NO: 263290 - RNA, 22 nt, Homo sapiens
augacacugcagagauguccca

SEQ ID NO: 263291 - RNA, 22 nt, Homo sapiens
augacauguauuuccaggauuu

SEQ ID NO: 263292 - RNA, 22 nt, Homo sapiens
augacauugaaaagcaagugga

SEQ ID NO: 263293 - RNA, 19 nt, Homo sapiens
augaccauggggugguuuu

SEQ ID NO: 263294 - RNA, 22 nt, Homo sapiens
augaccuuggggaaccaugucu

SEQ ID NO: 263295 - RNA, 22 nt, Homo sapiens
augacuggaacagcaauuuaca

SEQ ID NO: 263296 - RNA, 22 nt, Homo sapiens
augacuggauaauggacacaca

SEQ ID NO: 263297 - RNA, 22 nt, Homo sapiens
augacugucuugcagaggcuau

SEQ ID NO: 263298 - RNA, 17 nt, Homo sapiens
augacuucuucagugug

SEQ ID NO: 263299 - RNA, 22 nt, Homo sapiens
augagaacugucaaugagagcu

SEQ ID NO: 263300 - RNA, 22 nt, Homo sapiens
augagaaucauuucagcuugua

SEQ ID NO: 263301 - RNA, 22 nt, Homo sapiens
augagacauuaaaguguguuug

SEQ ID NO: 263302 - RNA, 22 nt, Homo sapiens
augagagcaacaccuucacuug

SEQ ID NO: 263303 - RNA, 22 nt, Homo sapiens
augagagcuaacuguggguaca

SEQ ID NO: 263304 - RNA, 22 nt, Homo sapiens
augagagugagagcagccccuu

SEQ ID NO: 263305 - RNA, 22 nt, Homo sapiens
augagauacuacaaaugaguuu

SEQ ID NO: 263306 - RNA, 22 nt, Homo sapiens
augagauauuuuauaagaucau

SEQ ID NO: 263307 - RNA, 22 nt, Homo sapiens
augagaugaauaccgacgaugu

SEQ ID NO: 263308 - RNA, 22 nt, Homo sapiens
augagaugauaggcguucuaac

SEQ ID NO: 263309 - RNA, 22 nt, Homo sapiens
augagcacuuguuuugggcaca

SEQ ID NO: 263310 - RNA, 22 nt, Homo sapiens
augagcuccucaaggucagaga

SEQ ID NO: 263311 - RNA, 22 nt, Homo sapiens
augaggaaggagccuuugucug

SEQ ID NO: 263312 - RNA, 22 nt, Homo sapiens
augaggagguaugauuuucuga

SEQ ID NO: 263313 - RNA, 22 nt, Homo sapiens
augaggcaggaaaggcguaucu

SEQ ID NO: 263314 - RNA, 22 nt, Homo sapiens
augagggcggacgcccuggaga

SEQ ID NO: 263315 - RNA, 22 nt, Homo sapiens
augaggugaguaaauaaaugaa

SEQ ID NO: 263316 - RNA, 22 nt, Homo sapiens
augaguugaagcuacaagaggc

SEQ ID NO: 263317 - RNA, 22 nt, Homo sapiens
augauacguuacuucacugggg

SEQ ID NO: 263318 - RNA, 22 nt, Homo sapiens
augauacuguucuaagauuuuu

SEQ ID NO: 263319 - RNA, 22 nt, Homo sapiens
augaugcugcaguuguugccaa

SEQ ID NO: 263320 - RNA, 22 nt, Homo sapiens
augcaaacaucauagaguguac

SEQ ID NO: 263321 - RNA, 22 nt, Homo sapiens
augcaagcacacaagaggaaau

SEQ ID NO: 263322 - RNA, 22 nt, Homo sapiens
augcaauucuagauugauagua

SEQ ID NO: 263323 - RNA, 22 nt, Homo sapiens
augcacauauguacugcccuau

SEQ ID NO: 263324 - RNA, 22 nt, Homo sapiens
augcacaugcgaaaacuugugu

SEQ ID NO: 263325 - RNA, 22 nt, Homo sapiens
augcacuguuguuauuggauaa

SEQ ID NO: 263326 - RNA, 22 nt, Homo sapiens
augcacuguuuucuugaugaga

SEQ ID NO: 263327 - RNA, 22 nt, Homo sapiens
augcagagucccagccccuagc

SEQ ID NO: 263328 - RNA, 18 nt, Homo sapiens
augcauauuuuaaguugu

SEQ ID NO: 263329 - RNA, 22 nt, Homo sapiens
augccagggagaauuguucaag

SEQ ID NO: 263330 - RNA, 22 nt, Homo sapiens
augcuacauucuacaauuaggc

SEQ ID NO: 263331 - RNA, 22 nt, Homo sapiens
augcuacugauaagcaaucauu

SEQ ID NO: 263332 - RNA, 22 nt, Homo sapiens
augcuguuuugaauucucuaga

SEQ ID NO: 263333 - RNA, 22 nt, Homo sapiens
augcuguuuuguagcucccucu

SEQ ID NO: 263334 - RNA, 22 nt, Homo sapiens
augcuuguugcagccugagccu

SEQ ID NO: 263335 - RNA, 22 nt, Homo sapiens
auggaaaugaagggcuggcccu

SEQ ID NO: 263336 - RNA, 19 nt, Homo sapiens
auggaacugcuggagccac

SEQ ID NO: 263337 - RNA, 22 nt, Homo sapiens
auggaagaaaguuggguucuug

SEQ ID NO: 263338 - RNA, 22 nt, Homo sapiens
auggaagacuccucuuugggua

SEQ ID NO: 263339 - RNA, 22 nt, Homo sapiens
auggaaggagaauggucuuuga

SEQ ID NO: 263340 - RNA, 22 nt, Homo sapiens
auggaaugccauuuauaaugga

SEQ ID NO: 263341 - RNA, 22 nt, Homo sapiens
auggacauuaaagcgauguaga

SEQ ID NO: 263342 - RNA, 22 nt, Homo sapiens
auggagaugugcgaacugagua

SEQ ID NO: 263343 - RNA, 19 nt, Homo sapiens
auggauacauuuucugcua

SEQ ID NO: 263344 - RNA, 22 nt, Homo sapiens
auggauuuuaggauacaguuga

SEQ ID NO: 263345 - RNA, 22 nt, Homo sapiens
auggauuuugaacuugagaguu

SEQ ID NO: 263346 - RNA, 22 nt, Homo sapiens
auggcacagaguagaugcucaa

SEQ ID NO: 263347 - RNA, 22 nt, Homo sapiens
auggcacuaaguucaacacuua

SEQ ID NO: 263348 - RNA, 18 nt, Homo sapiens
auggcagaacaauuuaca

SEQ ID NO: 263349 - RNA, 22 nt, Homo sapiens
auggcaguuuauucuaaaucaa

SEQ ID NO: 263350 - RNA, 22 nt, Homo sapiens
auggcaguuuggucucugugcu

SEQ ID NO: 263351 - RNA, 22 nt, Homo sapiens
auggcaucgucaccuuuucagu

SEQ ID NO: 263352 - RNA, 22 nt, Homo sapiens
auggcauuuuuagggcugggug

SEQ ID NO: 263353 - RNA, 22 nt, Homo sapiens
auggccauuacuaagaauguuu

SEQ ID NO: 263354 - RNA, 22 nt, Homo sapiens
auggcccccuguuugugaacau

SEQ ID NO: 263355 - RNA, 22 nt, Homo sapiens
auggcccugaguucaauauauu

SEQ ID NO: 263356 - RNA, 22 nt, Homo sapiens
auggcccugggaaaggaggcau

SEQ ID NO: 263357 - RNA, 22 nt, Homo sapiens
auggccugaugcaccuguccca

SEQ ID NO: 263358 - RNA, 22 nt, Homo sapiens
auggccuuuuuaucucaccaag

SEQ ID NO: 263359 - RNA, 22 nt, Homo sapiens
auggcuauuccauaggcagagc

SEQ ID NO: 263360 - RNA, 22 nt, Homo sapiens
auggcucaauucuuucccugaa

SEQ ID NO: 263361 - RNA, 22 nt, Homo sapiens
auggcucuuauuauuugaggua

SEQ ID NO: 263362 - RNA, 22 nt, Homo sapiens
auggcucuuauuauuuugaggu

SEQ ID NO: 263363 - RNA, 22 nt, Homo sapiens
auggcugagugauuucaaacag

SEQ ID NO: 263364 - RNA, 22 nt, Homo sapiens
auggcuucuucuaaaagugggg

SEQ ID NO: 263365 - RNA, 22 nt, Homo sapiens
auggcuuucaggacguggcgag

SEQ ID NO: 263366 - RNA, 22 nt, Homo sapiens
auggcuuuucacagaggguucu

SEQ ID NO: 263367 - RNA, 22 nt, Homo sapiens
auggcuuuugcccuaaauggau

SEQ ID NO: 263368 - RNA, 22 nt, Homo sapiens
augggaaaaucagaaggccugg

SEQ ID NO: 263369 - RNA, 22 nt, Homo sapiens
augggagugugguuagagaccu

SEQ ID NO: 263370 - RNA, 22 nt, Homo sapiens
augguaagcugaaaauaucgaa

SEQ ID NO: 263371 - RNA, 22 nt, Homo sapiens
augguacuagaguaagaauugu

SEQ ID NO: 263372 - RNA, 22 nt, Homo sapiens
augguacuccagagaagcagaa

SEQ ID NO: 263373 - RNA, 22 nt, Homo sapiens
augguaucauuacuguuuuauu

SEQ ID NO: 263374 - RNA, 22 nt, Homo sapiens
auggucuuuguuucuaauucug

SEQ ID NO: 263375 - RNA, 22 nt, Homo sapiens
augguuuuacugcaaaauggga

SEQ ID NO: 263376 - RNA, 22 nt, Homo sapiens
auguagauaucaagaggcauau

SEQ ID NO: 263377 - RNA, 22 nt, Homo sapiens
auguauacauagauacgugugu

SEQ ID NO: 263378 - RNA, 22 nt, Homo sapiens
augucaacauagacaguagagu

SEQ ID NO: 263379 - RNA, 22 nt, Homo sapiens
augucacagguccuagccaagu

SEQ ID NO: 263380 - RNA, 22 nt, Homo sapiens
auguccauggaaucuguagcaa

SEQ ID NO: 263381 - RNA, 22 nt, Homo sapiens
augugacugauggagaauaugu

SEQ ID NO: 263382 - RNA, 22 nt, Homo sapiens
augugacugauguaaucagaca

SEQ ID NO: 263383 - RNA, 22 nt, Homo sapiens
augugaugguuaauuuuaugug

SEQ ID NO: 263384 - RNA, 22 nt, Homo sapiens
augugcaaagcacuguucagca

SEQ ID NO: 263385 - RNA, 22 nt, Homo sapiens
augugcaacugcuggaacaguc

SEQ ID NO: 263386 - RNA, 22 nt, Homo sapiens
augugcaauggugucaccacau

SEQ ID NO: 263387 - RNA, 18 nt, Homo sapiens
augugcaauuuuguauuu

SEQ ID NO: 263388 - RNA, 22 nt, Homo sapiens
augugcacaacgugcagguuug

SEQ ID NO: 263389 - RNA, 22 nt, Homo sapiens
augugcaugcuguucugccaga

SEQ ID NO: 263390 - RNA, 22 nt, Homo sapiens
augugcuuaaaaaugcagagaa

SEQ ID NO: 263391 - RNA, 22 nt, Homo sapiens
augugcuuuuuaaacagaugcu

SEQ ID NO: 263392 - RNA, 18 nt, Homo sapiens
auguggcuuuugaaggcu

SEQ ID NO: 263393 - RNA, 22 nt, Homo sapiens
augugggaggacuuggcuguug

SEQ ID NO: 263394 - RNA, 22 nt, Homo sapiens
augugguaggcccaugagucau

SEQ ID NO: 263395 - RNA, 22 nt, Homo sapiens
auguguaaagcuuuucuuuguu

SEQ ID NO: 263396 - RNA, 22 nt, Homo sapiens
auguguauuaccucgauuguga

SEQ ID NO: 263397 - RNA, 22 nt, Homo sapiens
auguuacggaguuuuuauccag

SEQ ID NO: 263398 - RNA, 22 nt, Homo sapiens
auguuagcaucaauauucauca

SEQ ID NO: 263399 - RNA, 22 nt, Homo sapiens
auguuagcaucuggcacuaugg

SEQ ID NO: 263400 - RNA, 22 nt, Homo sapiens
auguuauguucuucucuguaua

SEQ ID NO: 263401 - RNA, 20 nt, Homo sapiens
auguucuggaggacagaagc

SEQ ID NO: 263402 - RNA, 22 nt, Homo sapiens
auguuuagagagggugucaaau

SEQ ID NO: 263403 - RNA, 22 nt, Homo sapiens
auguuugguaagaauauuguua

SEQ ID NO: 263404 - RNA, 22 nt, Homo sapiens
auuaagugcuugccagugcugg

SEQ ID NO: 263405 - RNA, 22 nt, Homo sapiens
auuacacuuucuauucaaugag

SEQ ID NO: 263406 - RNA, 22 nt, Homo sapiens
auuauaugucaucacagacacc

SEQ ID NO: 263407 - RNA, 22 nt, Homo sapiens
auucaaagugcauguucccacu

SEQ ID NO: 263408 - RNA, 23 nt, Homo sapiens
auucaaguagugagagugguuau

SEQ ID NO: 263409 - RNA, 22 nt, Homo sapiens
auucacagggggagaaggguau

SEQ ID NO: 263410 - RNA, 22 nt, Homo sapiens
auucauagugcuaagguguauc

SEQ ID NO: 263411 - RNA, 22 nt, Homo sapiens
auucaucagggauauuggucug

SEQ ID NO: 263412 - RNA, 22 nt, Homo sapiens
auuccacagccgauaccaugac

SEQ ID NO: 263413 - RNA, 22 nt, Homo sapiens
auuccacuuagugacucauuug

SEQ ID NO: 263414 - RNA, 20 nt, Homo sapiens
auuccacuuguuugagguac

SEQ ID NO: 263415 - RNA, 22 nt, Homo sapiens
auuccagauggaguugaggguu

SEQ ID NO: 263416 - RNA, 22 nt, Homo sapiens
auuccaguuugugagaagcugu

SEQ ID NO: 263417 - RNA, 22 nt, Homo sapiens
auuccuuaggcccuuugguuag

SEQ ID NO: 263418 - RNA, 22 nt, Homo sapiens
auucuauaguccuaggauuggg

SEQ ID NO: 263419 - RNA, 22 nt, Homo sapiens
auugaacaugccauauguacca

SEQ ID NO: 263420 - RNA, 20 nt, Homo sapiens
auugaacucaguauucugaa

SEQ ID NO: 263421 - RNA, 22 nt, Homo sapiens
auugcaacuuccgccuccuggg

SEQ ID NO: 263422 - RNA, 22 nt, Homo sapiens
auugcaaugggaaacuaugaaa

SEQ ID NO: 263423 - RNA, 21 nt, Homo sapiens
auugcacaauauacccaugua

SEQ ID NO: 263424 - RNA, 22 nt, Homo sapiens
auugcacaccagucugggcaaa

SEQ ID NO: 263425 - RNA, 22 nt, Homo sapiens
auugcacuccagccuagguaac

SEQ ID NO: 263426 - RNA, 22 nt, Homo sapiens
auugcacuccagccucggugac

SEQ ID NO: 263427 - RNA, 22 nt, Homo sapiens
auugcacuccagccuggcaaua

SEQ ID NO: 263428 - RNA, 22 nt, Homo sapiens
auugcacuccagccuggccgag

SEQ ID NO: 263429 - RNA, 22 nt, Homo sapiens
auugcacuccagccugggcaac

SEQ ID NO: 263430 - RNA, 22 nt, Homo sapiens
auugcacuccagccugggcagc

SEQ ID NO: 263431 - RNA, 22 nt, Homo sapiens
auugcacuccagccugggcgac

SEQ ID NO: 263432 - RNA, 22 nt, Homo sapiens
auugcacuccagccugggcuag

SEQ ID NO: 263433 - RNA, 22 nt, Homo sapiens
auugcacuccagccugggugag

SEQ ID NO: 263434 - RNA, 22 nt, Homo sapiens
auugcacuccagccuugggcaa

SEQ ID NO: 263435 - RNA, 22 nt, Homo sapiens
auugcacuccagccuuggggau

SEQ ID NO: 263436 - RNA, 22 nt, Homo sapiens
auugcacuccagcuugggugac

SEQ ID NO: 263437 - RNA, 22 nt, Homo sapiens
auugcacuccauccuaggugac

SEQ ID NO: 263438 - RNA, 22 nt, Homo sapiens
auugcacuccauccugggcaau

SEQ ID NO: 263439 - RNA, 22 nt, Homo sapiens
auugcacucuaaccuaggugac

SEQ ID NO: 263440 - RNA, 22 nt, Homo sapiens
auugcagaaaugacagagcgcc

SEQ ID NO: 263441 - RNA, 22 nt, Homo sapiens
auugcauaaacacauuucuuau

SEQ ID NO: 263442 - RNA, 22 nt, Homo sapiens
auugcauuuucagguuggucug

SEQ ID NO: 263443 - RNA, 22 nt, Homo sapiens
auugccucaauuccaagacugc

SEQ ID NO: 263444 - RNA, 22 nt, Homo sapiens
auugcuauuauuugaccauugu

SEQ ID NO: 263445 - RNA, 22 nt, Homo sapiens
auugcucuuagaaauauuucuu

SEQ ID NO: 263446 - RNA, 22 nt, Homo sapiens
auugcuuacuaaucaucuucag

SEQ ID NO: 263447 - RNA, 22 nt, Homo sapiens
auuggaguuguacgcacgcuca

SEQ ID NO: 263448 - RNA, 22 nt, Homo sapiens
auuggcaauguacauaucuugc

SEQ ID NO: 263449 - RNA, 22 nt, Homo sapiens
auuggccccguuuuaaauguca

SEQ ID NO: 263450 - RNA, 22 nt, Homo sapiens
auuggcuuuauacauaagaaua

SEQ ID NO: 263451 - RNA, 22 nt, Homo sapiens
auuguacuccagccuuggggac

SEQ ID NO: 263452 - RNA, 22 nt, Homo sapiens
auuugacacugagagccucagu

SEQ ID NO: 263453 - RNA, 22 nt, Homo sapiens
auuuggcaacguagggaggcau

SEQ ID NO: 263454 - RNA, 22 nt, Homo sapiens
caaagcacuuggcuuggaagau

SEQ ID NO: 263455 - RNA, 22 nt, Homo sapiens
caaaggugcuuuccagguccaa

SEQ ID NO: 263456 - RNA, 22 nt, Homo sapiens
caaagucuauucuacccuuacc

SEQ ID NO: 263457 - RNA, 22 nt, Homo sapiens
caaagucuucaguugauucuga

SEQ ID NO: 263458 - RNA, 22 nt, Homo sapiens
caacaguaaagcauuuuuaagu

SEQ ID NO: 263459 - RNA, 22 nt, Homo sapiens
caagacuguccaacauauuggg

SEQ ID NO: 263460 - RNA, 22 nt, Homo sapiens
caagaucauuuaugcuaaaauu

SEQ ID NO: 263461 - RNA, 22 nt, Homo sapiens
caaggaauucucaauagaguua

SEQ ID NO: 263462 - RNA, 22 nt, Homo sapiens
caagguacuuuuacaauuuccc

SEQ ID NO: 263463 - RNA, 21 nt, Homo sapiens
caaugacacuguagcugugcu

SEQ ID NO: 263464 - RNA, 22 nt, Homo sapiens
caaugcagcuuuuggagagaaa

SEQ ID NO: 263465 - RNA, 22 nt, Homo sapiens
cacaaccuccgccuccuggguu

SEQ ID NO: 263466 - RNA, 22 nt, Homo sapiens
cacacugucuucaauggguggu

SEQ ID NO: 263467 - RNA, 22 nt, Homo sapiens
cacacugucuucauuacuguag

SEQ ID NO: 263468 - RNA, 22 nt, Homo sapiens
cacagagugagacccugucucu

SEQ ID NO: 263469 - RNA, 23 nt, Homo sapiens
cacagggugaacaccccuaaucc

SEQ ID NO: 263470 - RNA, 22 nt, Homo sapiens
cacaggucauccuggaucaagg

SEQ ID NO: 263471 - RNA, 22 nt, Homo sapiens
cacaguugccuaucuccugaag

SEQ ID NO: 263472 - RNA, 22 nt, Homo sapiens
cacauugaauuucugaugacaa

SEQ ID NO: 263473 - RNA, 22 nt, Homo sapiens
caccaguuuuucagugauucaa

SEQ ID NO: 263474 - RNA, 22 nt, Homo sapiens
cacccaguaagcaugaggcccu

SEQ ID NO: 263475 - RNA, 22 nt, Homo sapiens
cacuaccucuacaggcagcugg

SEQ ID NO: 263476 - RNA, 22 nt, Homo sapiens
cacucaguuugugguacuuugu

SEQ ID NO: 263477 - RNA, 18 nt, Homo sapiens
cacugagcccuucacucu

SEQ ID NO: 263478 - RNA, 22 nt, Homo sapiens
cacugcacuccagccuaagagg

SEQ ID NO: 263479 - RNA, 22 nt, Homo sapiens
cacugcacuccagucugacgac

SEQ ID NO: 263480 - RNA, 21 nt, Homo sapiens
cacugcacuugccuucugggu

SEQ ID NO: 263481 - RNA, 22 nt, Homo sapiens
cacugcaguaaauugcgucggu

SEQ ID NO: 263482 - RNA, 22 nt, Homo sapiens
cacugcauccuugaccuucugg

SEQ ID NO: 263483 - RNA, 22 nt, Homo sapiens
cacugcauggucuagcuggguu

SEQ ID NO: 263484 - RNA, 22 nt, Homo sapiens
cacugcauucuccaccucccag

SEQ ID NO: 263485 - RNA, 17 nt, Homo sapiens
cacugggugcaagagga

SEQ ID NO: 263486 - RNA, 22 nt, Homo sapiens
cacuggguuagaacaugcuccu

SEQ ID NO: 263487 - RNA, 22 nt, Homo sapiens
cacuggucucauggcaugagag

SEQ ID NO: 263488 - RNA, 21 nt, Homo sapiens
cacugguguugcuauaucaaa

SEQ ID NO: 263489 - RNA, 18 nt, Homo sapiens
cacuuggcuuugccccuc

SEQ ID NO: 263490 - RNA, 22 nt, Homo sapiens
cagagaacauucagagcuguag

SEQ ID NO: 263491 - RNA, 21 nt, Homo sapiens
cagagaucaucucuguuuuaa

SEQ ID NO: 263492 - RNA, 22 nt, Homo sapiens
cagagugcauguuuagaugagu

SEQ ID NO: 263493 - RNA, 22 nt, Homo sapiens
cagaugguggucccacagccca

SEQ ID NO: 263494 - RNA, 22 nt, Homo sapiens
cagauguaguauuuuagugaaa

SEQ ID NO: 263495 - RNA, 22 nt, Homo sapiens
cagcaaaucauccuauuugagc

SEQ ID NO: 263496 - RNA, 22 nt, Homo sapiens
auaaauucauuuaagcuccuua

SEQ ID NO: 263497 - RNA, 22 nt, Homo sapiens
auaacauccuuucuuaucguug

SEQ ID NO: 263498 - RNA, 22 nt, Homo sapiens
auaagaucauuugcuaagaggg

SEQ ID NO: 263499 - RNA, 22 nt, Homo sapiens
auaagucaauggaacagauuaa

SEQ ID NO: 263500 - RNA, 19 nt, Homo sapiens
auaagugaaucacgggggc

SEQ ID NO: 263501 - RNA, 22 nt, Homo sapiens
auaauaccugccacauuugaau

SEQ ID NO: 263502 - RNA, 22 nt, Homo sapiens
auaauagcugaucauuuagaag

SEQ ID NO: 263503 - RNA, 22 nt, Homo sapiens
auaauaucagguugugaugaug

SEQ ID NO: 263504 - RNA, 22 nt, Homo sapiens
auaaucaugucugaaaccuuug

SEQ ID NO: 263505 - RNA, 22 nt, Homo sapiens
auacaagugccauguuggugug

SEQ ID NO: 263506 - RNA, 22 nt, Homo sapiens
auacaugcauuugcacgagagu

SEQ ID NO: 263507 - RNA, 22 nt, Homo sapiens
auacaugugcaggucagguuac

SEQ ID NO: 263508 - RNA, 22 nt, Homo sapiens
auacaugugugagcgaagaugu

SEQ ID NO: 263509 - RNA, 22 nt, Homo sapiens
auacauguucaagggcauauau

SEQ ID NO: 263510 - RNA, 22 nt, Homo sapiens
auacguacauaugcacauaugg

SEQ ID NO: 263511 - RNA, 22 nt, Homo sapiens
auacuaugagauaauaaagacu

SEQ ID NO: 263512 - RNA, 21 nt, Homo sapiens
auacuugcauccuuggagaga

SEQ ID NO: 263513 - RNA, 22 nt, Homo sapiens
auagagguagacagaggggaaa

SEQ ID NO: 263514 - RNA, 22 nt, Homo sapiens
auagcaaugccccaauccuugg

SEQ ID NO: 263515 - RNA, 22 nt, Homo sapiens
auagcagcagcuaguagugaua

SEQ ID NO: 263516 - RNA, 22 nt, Homo sapiens
auagcagugugaaaacagacug

SEQ ID NO: 263517 - RNA, 22 nt, Homo sapiens
auagcagugugaaaauggacua

SEQ ID NO: 263518 - RNA, 22 nt, Homo sapiens
auagcagugugaaaauugacug

SEQ ID NO: 263519 - RNA, 22 nt, Homo sapiens
auagcauagucagcuucgcuga

SEQ ID NO: 263520 - RNA, 22 nt, Homo sapiens
auagcugcucaggcuuuccuca

SEQ ID NO: 263521 - RNA, 22 nt, Homo sapiens
auaggacuauugugaggauuaa

SEQ ID NO: 263522 - RNA, 22 nt, Homo sapiens
auaggcacauuaggaacuuuug

SEQ ID NO: 263523 - RNA, 22 nt, Homo sapiens
auagugcugcaauaaacacacg

SEQ ID NO: 263524 - RNA, 22 nt, Homo sapiens
auagugcugcaauaaacauacg

SEQ ID NO: 263525 - RNA, 22 nt, Homo sapiens
auagugcugcaauaaccauggg

SEQ ID NO: 263526 - RNA, 22 nt, Homo sapiens
auagugcugcaaugaacauaca

SEQ ID NO: 263527 - RNA, 22 nt, Homo sapiens
auagugcugcagucaauguacg

SEQ ID NO: 263528 - RNA, 22 nt, Homo sapiens
auagugcuuuugaaucuuguug

SEQ ID NO: 263529 - RNA, 19 nt, Homo sapiens
auaguguaggaaaacagcu

SEQ ID NO: 263530 - RNA, 19 nt, Homo sapiens
auauaacauccaggagcag

SEQ ID NO: 263531 - RNA, 23 nt, Homo sapiens
auauaguagaugugcaguaacau

SEQ ID NO: 263532 - RNA, 22 nt, Homo sapiens
auaucaaggccauuuucuaaau

SEQ ID NO: 263533 - RNA, 22 nt, Homo sapiens
auaugcacgugcauacacacuu

SEQ ID NO: 263534 - RNA, 20 nt, Homo sapiens
auaugcagacacauacauac

SEQ ID NO: 263535 - RNA, 18 nt, Homo sapiens
auauugcauuggauggau

SEQ ID NO: 263536 - RNA, 22 nt, Homo sapiens
aucacagaacuuugagcagaga

SEQ ID NO: 263537 - RNA, 22 nt, Homo sapiens
aucacagcccuccucuuggaug

SEQ ID NO: 263538 - RNA, 22 nt, Homo sapiens
aucacagugaaaacagucaauu

SEQ ID NO: 263539 - RNA, 22 nt, Homo sapiens
aucaccagaugcuucaagcaga

SEQ ID NO: 263540 - RNA, 22 nt, Homo sapiens
aucaccugagcaguauacacug

SEQ ID NO: 263541 - RNA, 22 nt, Homo sapiens
aucacugggagcagccauuaau

SEQ ID NO: 263542 - RNA, 16 nt, Homo sapiens
aucacuugcuucuuuu

SEQ ID NO: 263543 - RNA, 22 nt, Homo sapiens
aucacuuucuauuucugugcca

SEQ ID NO: 263544 - RNA, 22 nt, Homo sapiens
aucagagccugugugcccugaa

SEQ ID NO: 263545 - RNA, 22 nt, Homo sapiens
aucagauaccuguugggaaaug

SEQ ID NO: 263546 - RNA, 19 nt, Homo sapiens
aucagcacaagugugcuuu

SEQ ID NO: 263547 - RNA, 22 nt, Homo sapiens
aucagcagcaugaaaacggacu

SEQ ID NO: 263548 - RNA, 22 nt, Homo sapiens
aucagcagcaugaaaagcaacu

SEQ ID NO: 263549 - RNA, 22 nt, Homo sapiens
aucaggcacacauuggaguuug

SEQ ID NO: 263550 - RNA, 18 nt, Homo sapiens
aucagggugaagagagga

SEQ ID NO: 263551 - RNA, 22 nt, Homo sapiens
aucagucuguuggaauaucgcu

SEQ ID NO: 263552 - RNA, 22 nt, Homo sapiens
aucagugagugguuagugaaug

SEQ ID NO: 263553 - RNA, 22 nt, Homo sapiens
aucaugcacaugcauagguaug

SEQ ID NO: 263554 - RNA, 22 nt, Homo sapiens
aucccaguucagccucugacac

SEQ ID NO: 263555 - RNA, 22 nt, Homo sapiens
aucccugagaacuuuuaauguu

SEQ ID NO: 263556 - RNA, 22 nt, Homo sapiens
aucccugaggaauuucugcacu

SEQ ID NO: 263557 - RNA, 22 nt, Homo sapiens
aucccuguguccagcaccugug

SEQ ID NO: 263558 - RNA, 22 nt, Homo sapiens
aucccuuucugauacuuucccu

SEQ ID NO: 263559 - RNA, 21 nt, Homo sapiens
auccuucuuuuucaaccugug

SEQ ID NO: 263560 - RNA, 22 nt, Homo sapiens
aucuacuugcugggucucugga

SEQ ID NO: 263561 - RNA, 21 nt, Homo sapiens
aucucacuugaauguaaaagc

SEQ ID NO: 263562 - RNA, 22 nt, Homo sapiens
aucugcaaagcugggcugagac

SEQ ID NO: 263563 - RNA, 22 nt, Homo sapiens
aucugcuccuggugaggguuuc

SEQ ID NO: 263564 - RNA, 22 nt, Homo sapiens
aucuggcuccuuuugacaaugc

SEQ ID NO: 263565 - RNA, 22 nt, Homo sapiens
aucuggguccguucugcuucuc

SEQ ID NO: 263566 - RNA, 22 nt, Homo sapiens
aucugguguccucgugggaguc

SEQ ID NO: 263567 - RNA, 22 nt, Homo sapiens
aucugugaaugaaguuauuuug

SEQ ID NO: 263568 - RNA, 22 nt, Homo sapiens
aucuuggauuaccugggugggu

SEQ ID NO: 263569 - RNA, 22 nt, Homo sapiens
aucuugggugggaacugagaau

SEQ ID NO: 263570 - RNA, 22 nt, Homo sapiens
aucuuugauuguagguacaaug

SEQ ID NO: 263571 - RNA, 22 nt, Homo sapiens
augaaaucuuuccugugaggau

SEQ ID NO: 263572 - RNA, 22 nt, Homo sapiens
augaaauguaugagucuggguu

SEQ ID NO: 263573 - RNA, 22 nt, Homo sapiens
augaaauugcuaucgcaguacu

SEQ ID NO: 263574 - RNA, 22 nt, Homo sapiens
augaacagagccuugagaaccu

SEQ ID NO: 263575 - RNA, 19 nt, Homo sapiens
augaacucaucauuucuca

SEQ ID NO: 263576 - RNA, 18 nt, Homo sapiens
augaacucaucauuuuuu

SEQ ID NO: 263577 - RNA, 20 nt, Homo sapiens
augaagugaaguuagggaac

SEQ ID NO: 263578 - RNA, 22 nt, Homo sapiens
augaauacagcuaugcgugcau

SEQ ID NO: 263579 - RNA, 22 nt, Homo sapiens
augacauugaugcucuggcugg

SEQ ID NO: 263580 - RNA, 19 nt, Homo sapiens
augaccauuuccauaguau

SEQ ID NO: 263581 - RNA, 22 nt, Homo sapiens
augacccugaccuaagccaauc

SEQ ID NO: 263582 - RNA, 21 nt, Homo sapiens
augacccuggguguccuuucc

SEQ ID NO: 263583 - RNA, 18 nt, Homo sapiens
augaccugcggguuauau

SEQ ID NO: 263584 - RNA, 22 nt, Homo sapiens
augacugucagggcagucauug

SEQ ID NO: 263585 - RNA, 22 nt, Homo sapiens
augagaccagcagaaaaccugu

SEQ ID NO: 263586 - RNA, 22 nt, Homo sapiens
cuuguacacuguuggugggaau

SEQ ID NO: 263587 - RNA, 21 nt, Homo sapiens
cuugucuugcuuagaauagac

SEQ ID NO: 263588 - RNA, 19 nt, Homo sapiens
cuugugccugaagcuuggg

SEQ ID NO: 263589 - RNA, 22 nt, Homo sapiens
cuuucacacuguuggugggaau

SEQ ID NO: 263590 - RNA, 22 nt, Homo sapiens
cuuucucagugagacccgagau

SEQ ID NO: 263591 - RNA, 22 nt, Homo sapiens
cuuucugaggagaauagagaac

SEQ ID NO: 263592 - RNA, 21 nt, Homo sapiens
cuuugcacugcuccucagcuc

SEQ ID NO: 263593 - RNA, 22 nt, Homo sapiens
cuuuggcaaugucauuuucaau

SEQ ID NO: 263594 - RNA, 22 nt, Homo sapiens
cuuugguuaauaggauauggca

SEQ ID NO: 263595 - RNA, 22 nt, Homo sapiens
cuuugguucuguuuauaugcug

SEQ ID NO: 263596 - RNA, 20 nt, Homo sapiens
cuuuguccuccugcugugcu

SEQ ID NO: 263597 - RNA, 22 nt, Homo sapiens
cuuugugcccuucugcccauca

SEQ ID NO: 263598 - RNA, 22 nt, Homo sapiens
cuuuguguggacauuucaggca

SEQ ID NO: 263599 - RNA, 22 nt, Homo sapiens
cuuugugugggccaagggcugg

SEQ ID NO: 263600 - RNA, 22 nt, Homo sapiens
cuuuuacacugguggugggaau

SEQ ID NO: 263601 - RNA, 22 nt, Homo sapiens
cuuuuguggaucuucuguugcu

SEQ ID NO: 263602 - RNA, 20 nt, Homo sapiens
cuuuuugcugugcugggagc

SEQ ID NO: 263603 - RNA, 22 nt, Homo sapiens
gaaaauccauccccagggagua

SEQ ID NO: 263604 - RNA, 22 nt, Homo sapiens
gaaagacuuucugcuguggaua

SEQ ID NO: 263605 - RNA, 23 nt, Homo sapiens
gaaauguaagugaugccccacag

SEQ ID NO: 263606 - RNA, 22 nt, Homo sapiens
gaagaacuaggugagaucuaga

SEQ ID NO: 263607 - RNA, 22 nt, Homo sapiens
gaagaaguacaagacaaauuuu

SEQ ID NO: 263608 - RNA, 18 nt, Homo sapiens
gaagaaguaggcauggca

SEQ ID NO: 263609 - RNA, 22 nt, Homo sapiens
gaagagacagguucccacaaaa

SEQ ID NO: 263610 - RNA, 22 nt, Homo sapiens
gaagauaucuaguaccauuguc

SEQ ID NO: 263611 - RNA, 22 nt, Homo sapiens
gaagcagcauucugguuuuugg

SEQ ID NO: 263612 - RNA, 22 nt, Homo sapiens
gaagcgaggugauuagcagaca

SEQ ID NO: 263613 - RNA, 23 nt, Homo sapiens
gaaguaauaaauggauucuuaac

SEQ ID NO: 263614 - RNA, 22 nt, Homo sapiens
gaaguaggugcuguuauuaucu

SEQ ID NO: 263615 - RNA, 23 nt, Homo sapiens
gaaguauagcaugcacauggaaa

SEQ ID NO: 263616 - RNA, 22 nt, Homo sapiens
gaagugcaguggcacagucaug

SEQ ID NO: 263617 - RNA, 22 nt, Homo sapiens
gaagugcuuuuggacuaacagu

SEQ ID NO: 263618 - RNA, 22 nt, Homo sapiens
gaauacugacuauuucaucugg

SEQ ID NO: 263619 - RNA, 22 nt, Homo sapiens
gaauagugcugcaauaaacaua

SEQ ID NO: 263620 - RNA, 22 nt, Homo sapiens
gaauagugcugcaaugaacaua

SEQ ID NO: 263621 - RNA, 22 nt, Homo sapiens
gaauagugcugcagcaaacaua

SEQ ID NO: 263622 - RNA, 22 nt, Homo sapiens
gaauagugcugcgauaaacaua

SEQ ID NO: 263623 - RNA, 22 nt, Homo sapiens
gaaucacugugguaucccaugc

SEQ ID NO: 263624 - RNA, 22 nt, Homo sapiens
gaaugcaugaggggaucagaug

SEQ ID NO: 263625 - RNA, 21 nt, Homo sapiens
gaauggcaccauuagcauaua

SEQ ID NO: 263626 - RNA, 22 nt, Homo sapiens
gaauguuuacuuuguuuaauac

SEQ ID NO: 263627 - RNA, 22 nt, Homo sapiens
gaauucugucgcuuacuagaug

SEQ ID NO: 263628 - RNA, 22 nt, Homo sapiens
gacaccauuucaguacuagguu

SEQ ID NO: 263629 - RNA, 22 nt, Homo sapiens
gacauguuuucauguauuugga

SEQ ID NO: 263630 - RNA, 21 nt, Homo sapiens
gaccuguaguaagcauucaca

SEQ ID NO: 263631 - RNA, 22 nt, Homo sapiens
gacuaguuaggucucucacaga

SEQ ID NO: 263632 - RNA, 22 nt, Homo sapiens
gacucagucuuggauuuuuaau

SEQ ID NO: 263633 - RNA, 22 nt, Homo sapiens
gacugaggaagcgcucucuccu

SEQ ID NO: 263634 - RNA, 16 nt, Homo sapiens
gacugggcugaggaau

SEQ ID NO: 263635 - RNA, 22 nt, Homo sapiens
gagaacauuaauaguuaauuuu

SEQ ID NO: 263636 - RNA, 22 nt, Homo sapiens
gagaacauuuaagccacucagg

SEQ ID NO: 263637 - RNA, 21 nt, Homo sapiens
gagaaucuuuucagggcaaac

SEQ ID NO: 263638 - RNA, 22 nt, Homo sapiens
gagaaugagaggggaaggccac

SEQ ID NO: 263639 - RNA, 22 nt, Homo sapiens
gagaaugagauuaugguuacau

SEQ ID NO: 263640 - RNA, 22 nt, Homo sapiens
gagacauguuugccaauaauuu

SEQ ID NO: 263641 - RNA, 22 nt, Homo sapiens
gagacggagucucgcucugucg

SEQ ID NO: 263642 - RNA, 22 nt, Homo sapiens
gagacggagucuugcucuguug

SEQ ID NO: 263643 - RNA, 22 nt, Homo sapiens
gagacugagucucgcucugccg

SEQ ID NO: 263644 - RNA, 22 nt, Homo sapiens
gagacugaguuuugcucuuguu

SEQ ID NO: 263645 - RNA, 22 nt, Homo sapiens
gagagugaaguuugcuaccugu

SEQ ID NO: 263646 - RNA, 22 nt, Homo sapiens
gagagugcuuuggguguaggcc

SEQ ID NO: 263647 - RNA, 22 nt, Homo sapiens
gagagugugucagaggcugcga

SEQ ID NO: 263648 - RNA, 22 nt, Homo sapiens
gagauaaauaggucacaguucu

SEQ ID NO: 263649 - RNA, 22 nt, Homo sapiens
gagauaauuugaaucauggggg

SEQ ID NO: 263650 - RNA, 22 nt, Homo sapiens
gagauacacccagugcagaggc

SEQ ID NO: 263651 - RNA, 22 nt, Homo sapiens
gagauaggauucacuuucaugu

SEQ ID NO: 263652 - RNA, 22 nt, Homo sapiens
gagaucaguuaaugaagugagc

SEQ ID NO: 263653 - RNA, 22 nt, Homo sapiens
gagaucauucugauccagaguc

SEQ ID NO: 263654 - RNA, 22 nt, Homo sapiens
gagauggagucuuuuucuguca

SEQ ID NO: 263655 - RNA, 22 nt, Homo sapiens
gagauuaauacacaucaaaugc

SEQ ID NO: 263656 - RNA, 22 nt, Homo sapiens
gagauuauugucucccucacca

SEQ ID NO: 263657 - RNA, 22 nt, Homo sapiens
gagauuuucagcuugacuggga

SEQ ID NO: 263658 - RNA, 22 nt, Homo sapiens
gagcaaugauugagccacugua

SEQ ID NO: 263659 - RNA, 22 nt, Homo sapiens
gagcacauguggagagucuggg

SEQ ID NO: 263660 - RNA, 22 nt, Homo sapiens
gagcaucauucaacaaaagucu

SEQ ID NO: 263661 - RNA, 22 nt, Homo sapiens
gagcuagugcuuaugcaccacu

SEQ ID NO: 263662 - RNA, 22 nt, Homo sapiens
gagcugaaguuuccauuuguac

SEQ ID NO: 263663 - RNA, 22 nt, Homo sapiens
gaggcggugugaugucacaugc

SEQ ID NO: 263664 - RNA, 22 nt, Homo sapiens
gagguaagaaagucaguccuuc

SEQ ID NO: 263665 - RNA, 22 nt, Homo sapiens
gagguaaguggauuaugagguc

SEQ ID NO: 263666 - RNA, 22 nt, Homo sapiens
gagguagagaguuuugauucug

SEQ ID NO: 263667 - RNA, 22 nt, Homo sapiens
gagguagggucccacuauguug

SEQ ID NO: 263668 - RNA, 22 nt, Homo sapiens
gagguagguuugguuacaaaag

SEQ ID NO: 263669 - RNA, 22 nt, Homo sapiens
gagguaguuaaugcauucacua

SEQ ID NO: 263670 - RNA, 22 nt, Homo sapiens
gagguaucauuauguugcccag

SEQ ID NO: 263671 - RNA, 22 nt, Homo sapiens
gaggucuuacauuuuaauauuu

SEQ ID NO: 263672 - RNA, 22 nt, Homo sapiens
gaggugaaggucucaauaaaua

SEQ ID NO: 263673 - RNA, 22 nt, Homo sapiens
gaggugguagguucacagcagc

SEQ ID NO: 263674 - RNA, 22 nt, Homo sapiens
gagguguagagauauaccugaa

SEQ ID NO: 263675 - RNA, 22 nt, Homo sapiens
gagguguagucaugccaagauc

SEQ ID NO: 263676 - RNA, 22 nt, Homo sapiens
cagcaagucucuaagaguucau

SEQ ID NO: 263677 - RNA, 22 nt, Homo sapiens
cagcacauagcaguugcucagu

SEQ ID NO: 263678 - RNA, 22 nt, Homo sapiens
cagcacauuacaaguacuuggu

SEQ ID NO: 263679 - RNA, 22 nt, Homo sapiens
cagcagguuuuuaucaguuaag

SEQ ID NO: 263680 - RNA, 22 nt, Homo sapiens
cagcaucauucaucugggguaa

SEQ ID NO: 263681 - RNA, 22 nt, Homo sapiens
cagccgggugagguggcuuguu

SEQ ID NO: 263682 - RNA, 22 nt, Homo sapiens
cagcgaggucugcgucacauug

SEQ ID NO: 263683 - RNA, 20 nt, Homo sapiens
cagcuagugguaggagucgg

SEQ ID NO: 263684 - RNA, 22 nt, Homo sapiens
cagcugaugucgaaugcacucu

SEQ ID NO: 263685 - RNA, 22 nt, Homo sapiens
cagcuguguuauaaacuaccau

SEQ ID NO: 263686 - RNA, 22 nt, Homo sapiens
caggaaugugaggguucccugc

SEQ ID NO: 263687 - RNA, 22 nt, Homo sapiens
caggcaaggugaaguguacugg

SEQ ID NO: 263688 - RNA, 22 nt, Homo sapiens
cagguaagaugcuuucucuuau

SEQ ID NO: 263689 - RNA, 22 nt, Homo sapiens
cagguaguauuugguuacauaa

SEQ ID NO: 263690 - RNA, 20 nt, Homo sapiens
cagucauagacaucagaguc

SEQ ID NO: 263691 - RNA, 20 nt, Homo sapiens
cagucaugaagaacugugag

SEQ ID NO: 263692 - RNA, 22 nt, Homo sapiens
cagugcaaccuccaucucucgg

SEQ ID NO: 263693 - RNA, 18 nt, Homo sapiens
cagugcaauacaggagag

SEQ ID NO: 263694 - RNA, 22 nt, Homo sapiens
cagugcauaggaucuaaaauuu

SEQ ID NO: 263695 - RNA, 22 nt, Homo sapiens
cagugcaugacuguauauuauc

SEQ ID NO: 263696 - RNA, 22 nt, Homo sapiens
cagugcuuuaucaaguccucca

SEQ ID NO: 263697 - RNA, 22 nt, Homo sapiens
cagugucugcauuuggaacuca

SEQ ID NO: 263698 - RNA, 22 nt, Homo sapiens
cauacaugugcuugucuuaugc

SEQ ID NO: 263699 - RNA, 22 nt, Homo sapiens
cauagcacacauuuaccuaugu

SEQ ID NO: 263700 - RNA, 22 nt, Homo sapiens
acuauacugaagcaaauuaaca

SEQ ID NO: 263701 - RNA, 22 nt, Homo sapiens
acucuguugucuggccuuccug

SEQ ID NO: 263702 - RNA, 21 nt, Homo sapiens
acugagagaucuggggcacau

SEQ ID NO: 263703 - RNA, 21 nt, Homo sapiens
acugcacuccaaccucaacag

SEQ ID NO: 263704 - RNA, 22 nt, Homo sapiens
acugcacuccacccuuggcagc

SEQ ID NO: 263705 - RNA, 18 nt, Homo sapiens
acugcacuccaccuuggg

SEQ ID NO: 263706 - RNA, 22 nt, Homo sapiens
acugcacuccaccuugggcaac

SEQ ID NO: 263707 - RNA, 22 nt, Homo sapiens
acugcacuccagccuaggcgac

SEQ ID NO: 263708 - RNA, 22 nt, Homo sapiens
acugcacuccagccucggcaau

SEQ ID NO: 263709 - RNA, 22 nt, Homo sapiens
acugcacuccagccucgugaca

SEQ ID NO: 263710 - RNA, 22 nt, Homo sapiens
acugcacuccagccucguggac

SEQ ID NO: 263711 - RNA, 22 nt, Homo sapiens
acugcacuccagccuggacgaa

SEQ ID NO: 263712 - RNA, 22 nt, Homo sapiens
acugcacuccagccuggcggac

SEQ ID NO: 263713 - RNA, 22 nt, Homo sapiens
acugcacuccagccugugcgua

SEQ ID NO: 263714 - RNA, 22 nt, Homo sapiens
acugcacuccagccuguugaca

SEQ ID NO: 263715 - RNA, 22 nt, Homo sapiens
acugcacuccagccuucggaca

SEQ ID NO: 263716 - RNA, 22 nt, Homo sapiens
acugcacuccagccuucgugac

SEQ ID NO: 263717 - RNA, 22 nt, Homo sapiens
acugcacuccagccuugagagc

SEQ ID NO: 263718 - RNA, 22 nt, Homo sapiens
acugcacuccagccuugcgaca

SEQ ID NO: 263719 - RNA, 22 nt, Homo sapiens
acugcacuccagccuuggagac

SEQ ID NO: 263720 - RNA, 22 nt, Homo sapiens
acugcacuccagccuuggcggc

SEQ ID NO: 263721 - RNA, 22 nt, Homo sapiens
acugcacuccagccuugugaca

SEQ ID NO: 263722 - RNA, 22 nt, Homo sapiens
acugcacuccagccuuugcgau

SEQ ID NO: 263723 - RNA, 20 nt, Homo sapiens
acugcacuccaggcugccca

SEQ ID NO: 263724 - RNA, 20 nt, Homo sapiens
acugcacuccagucucuggg

SEQ ID NO: 263725 - RNA, 22 nt, Homo sapiens
acugcacuccaguuccgggcaa

SEQ ID NO: 263726 - RNA, 22 nt, Homo sapiens
acugcacucccgcccgggugac

SEQ ID NO: 263727 - RNA, 22 nt, Homo sapiens
acugcacuccggccuggcaaca

SEQ ID NO: 263728 - RNA, 22 nt, Homo sapiens
acugcacuguccuagaguccuc

SEQ ID NO: 263729 - RNA, 22 nt, Homo sapiens
acugcacuuauccuccaauguu

SEQ ID NO: 263730 - RNA, 22 nt, Homo sapiens
acugcacuucaaccucauugac

SEQ ID NO: 263731 - RNA, 20 nt, Homo sapiens
acugcacuucagccugcugg

SEQ ID NO: 263732 - RNA, 22 nt, Homo sapiens
acugcauaaauauguguaauau

SEQ ID NO: 263733 - RNA, 20 nt, Homo sapiens
acugcauuuaguccucagga

SEQ ID NO: 263734 - RNA, 22 nt, Homo sapiens
acuggcucugcuuuacaaacag

SEQ ID NO: 263735 - RNA, 22 nt, Homo sapiens
acuggcuuauuucacuuagcau

SEQ ID NO: 263736 - RNA, 22 nt, Homo sapiens
acugguguaugggaggucccaa

SEQ ID NO: 263737 - RNA, 22 nt, Homo sapiens
acuguauagauggaguugauuu

SEQ ID NO: 263738 - RNA, 22 nt, Homo sapiens
acuuaguauggggcuuuugaga

SEQ ID NO: 263739 - RNA, 17 nt, Homo sapiens
acuuuuugaggaggcau

SEQ ID NO: 263740 - RNA, 22 nt, Homo sapiens
agaaacacagguggaauugcuu

SEQ ID NO: 263741 - RNA, 19 nt, Homo sapiens
agaaucuaaauuauuucug

SEQ ID NO: 263742 - RNA, 22 nt, Homo sapiens
agacacuguugaaaaggcccca

SEQ ID NO: 263743 - RNA, 22 nt, Homo sapiens
agacaguguguguauauauggu

SEQ ID NO: 263744 - RNA, 22 nt, Homo sapiens
agaccacuuuagagauuguuca

SEQ ID NO: 263745 - RNA, 22 nt, Homo sapiens
agacccuguauguguuuaguuu

SEQ ID NO: 263746 - RNA, 23 nt, Homo sapiens
agacugaaguaucugagacucag

SEQ ID NO: 263747 - RNA, 22 nt, Homo sapiens
agagauacauucugagaagugc

SEQ ID NO: 263748 - RNA, 22 nt, Homo sapiens
agagauaguuuccaacucauac

SEQ ID NO: 263749 - RNA, 22 nt, Homo sapiens
agagaucaacugaauuacugga

SEQ ID NO: 263750 - RNA, 22 nt, Homo sapiens
agagaucacugaaucacggggg

SEQ ID NO: 263751 - RNA, 20 nt, Homo sapiens
agagaucaguaauucaucaa

SEQ ID NO: 263752 - RNA, 22 nt, Homo sapiens
agagaugauuaacauuuuggua

SEQ ID NO: 263753 - RNA, 22 nt, Homo sapiens
agagcaauguuaucagucucug

SEQ ID NO: 263754 - RNA, 22 nt, Homo sapiens
agagcaccauuuagcaagguga

SEQ ID NO: 263755 - RNA, 22 nt, Homo sapiens
agagccacacucuccuaacuca

SEQ ID NO: 263756 - RNA, 21 nt, Homo sapiens
agaggacugaccacagcccua

SEQ ID NO: 263757 - RNA, 22 nt, Homo sapiens
agaguacugacguuugcaaauu

SEQ ID NO: 263758 - RNA, 22 nt, Homo sapiens
agaguaguuucuauauucuuca

SEQ ID NO: 263759 - RNA, 19 nt, Homo sapiens
agaguauugaauuugcccu

SEQ ID NO: 263760 - RNA, 19 nt, Homo sapiens
agaguauuguuacuucucu

SEQ ID NO: 263761 - RNA, 22 nt, Homo sapiens
agaucacagucuuugguuuuag

SEQ ID NO: 263762 - RNA, 20 nt, Homo sapiens
agaugcaugcacauaaacac

SEQ ID NO: 263763 - RNA, 22 nt, Homo sapiens
agaugcauugguggcauauuca

SEQ ID NO: 263764 - RNA, 22 nt, Homo sapiens
agaugcuguuaucaacuguagc

SEQ ID NO: 263765 - RNA, 18 nt, Homo sapiens
agaugguguugcuucugu

SEQ ID NO: 263766 - RNA, 22 nt, Homo sapiens
agcaccacauacuacagagaua

SEQ ID NO: 263767 - RNA, 22 nt, Homo sapiens
agcaccaugggcugaguaagug

SEQ ID NO: 263768 - RNA, 22 nt, Homo sapiens
agcaccauuucucuaaagcacu

SEQ ID NO: 263769 - RNA, 23 nt, Homo sapiens
agcaccuuuccuccacuaucugc

SEQ ID NO: 263770 - RNA, 19 nt, Homo sapiens
agcagaacaaauguguggg

SEQ ID NO: 263771 - RNA, 22 nt, Homo sapiens
agcagcaauuuuguaugguuua

SEQ ID NO: 263772 - RNA, 22 nt, Homo sapiens
agcagcauauuuuuauaaugua

SEQ ID NO: 263773 - RNA, 22 nt, Homo sapiens
agcagcauuaugauauaucuua

SEQ ID NO: 263774 - RNA, 22 nt, Homo sapiens
agcagcauuccaaaaaucugcu

SEQ ID NO: 263775 - RNA, 20 nt, Homo sapiens
agcagccacagauuccucag

SEQ ID NO: 263776 - RNA, 22 nt, Homo sapiens
agcagcucaagacuuaaauuug

SEQ ID NO: 263777 - RNA, 22 nt, Homo sapiens
agcagcuuugaucugaaugauu

SEQ ID NO: 263778 - RNA, 22 nt, Homo sapiens
agcaguacauaaaaagcauccu

SEQ ID NO: 263779 - RNA, 22 nt, Homo sapiens
agcagugucauuuucuggugag

SEQ ID NO: 263780 - RNA, 22 nt, Homo sapiens
agcagugugagaauggacuaau

SEQ ID NO: 263781 - RNA, 19 nt, Homo sapiens
agcaucauuauuguuuugg

SEQ ID NO: 263782 - RNA, 17 nt, Homo sapiens
agcauguguuugagauu

SEQ ID NO: 263783 - RNA, 22 nt, Homo sapiens
agccuagagagccacuuugaga

SEQ ID NO: 263784 - RNA, 22 nt, Homo sapiens
ucacugcacuagguaaugccac

SEQ ID NO: 263785 - RNA, 22 nt, Homo sapiens
ucacuggacagaaauaaaggug

SEQ ID NO: 263786 - RNA, 22 nt, Homo sapiens
ucacuggaggagaggaagugga

SEQ ID NO: 263787 - RNA, 22 nt, Homo sapiens
ucacugugcacauaugauaggu

SEQ ID NO: 263788 - RNA, 22 nt, Homo sapiens
ucacuguggaacucaaaaagcu

SEQ ID NO: 263789 - RNA, 22 nt, Homo sapiens
ucacugugugucucuguaucug

SEQ ID NO: 263790 - RNA, 22 nt, Homo sapiens
ucacuugguggcaaaguuuaug

SEQ ID NO: 263791 - RNA, 22 nt, Homo sapiens
agcugguauuuugucaaggaua

SEQ ID NO: 263792 - RNA, 22 nt, Homo sapiens
agcuguaguuugguggauguaa

SEQ ID NO: 263793 - RNA, 22 nt, Homo sapiens
agcuguuguucucagaggcuuu

SEQ ID NO: 263794 - RNA, 22 nt, Homo sapiens
agcuucacaaugcagagggcag

SEQ ID NO: 263795 - RNA, 22 nt, Homo sapiens
agcuugugcuguaugaagggcc

SEQ ID NO: 263796 - RNA, 21 nt, Homo sapiens
agcuuguguguaucacagugu

SEQ ID NO: 263797 - RNA, 22 nt, Homo sapiens
agcuuguguuuuucuaaguauc

SEQ ID NO: 263798 - RNA, 22 nt, Homo sapiens
aggaaugcuaaguuuuccuccu

SEQ ID NO: 263799 - RNA, 22 nt, Homo sapiens
aggaauggaaacuuuugauggu

SEQ ID NO: 263800 - RNA, 22 nt, Homo sapiens
aggaauguuaguacuucuuagu

SEQ ID NO: 263801 - RNA, 22 nt, Homo sapiens
aggaccccucaucagcaccagu

SEQ ID NO: 263802 - RNA, 22 nt, Homo sapiens
aggagaugaagcuuuaucuaaa

SEQ ID NO: 263803 - RNA, 21 nt, Homo sapiens
aggagcauuguugugguggag

SEQ ID NO: 263804 - RNA, 22 nt, Homo sapiens
aggauaguaaugauagagaggc

SEQ ID NO: 263805 - RNA, 22 nt, Homo sapiens
aggcaagaaugcuuguuucacc

SEQ ID NO: 263806 - RNA, 22 nt, Homo sapiens
aggcagcuguuauauacugagu

SEQ ID NO: 263807 - RNA, 22 nt, Homo sapiens
aggcaugaguucagaggguaug

SEQ ID NO: 263808 - RNA, 22 nt, Homo sapiens
aggcaugauggcuccagaucau

SEQ ID NO: 263809 - RNA, 22 nt, Homo sapiens
aggcaugguggcacauacaugu

SEQ ID NO: 263810 - RNA, 23 nt, Homo sapiens
aggcauuguacaguaauggaaaa

SEQ ID NO: 263811 - RNA, 22 nt, Homo sapiens
agguaauuuuaucauuauguga

SEQ ID NO: 263812 - RNA, 22 nt, Homo sapiens
agguagcauagcgggaauauca

SEQ ID NO: 263813 - RNA, 20 nt, Homo sapiens
agguaguuauacaaaugugu

SEQ ID NO: 263814 - RNA, 22 nt, Homo sapiens
agguauauuggacagauguaaa

SEQ ID NO: 263815 - RNA, 22 nt, Homo sapiens
agguauuuucaacuuagaaugg

SEQ ID NO: 263816 - RNA, 22 nt, Homo sapiens
agguccauugguauuauagcau

SEQ ID NO: 263817 - RNA, 22 nt, Homo sapiens
aggugacugguuuaucuggcag

SEQ ID NO: 263818 - RNA, 22 nt, Homo sapiens
aggugcacucagaaaacagaua

SEQ ID NO: 263819 - RNA, 22 nt, Homo sapiens
aggugcugagcagagaauccug

SEQ ID NO: 263820 - RNA, 22 nt, Homo sapiens
aggugguguuggguuccagccc

SEQ ID NO: 263821 - RNA, 21 nt, Homo sapiens
aggugucuuggguucccuggc

SEQ ID NO: 263822 - RNA, 22 nt, Homo sapiens
agguuaacaucuauuuuggaug

SEQ ID NO: 263823 - RNA, 22 nt, Homo sapiens
agguuaugauuauagagcgagg

SEQ ID NO: 263824 - RNA, 23 nt, Homo sapiens
agguuaugauuauagagcgagga

SEQ ID NO: 263825 - RNA, 22 nt, Homo sapiens
agguuaugauuguagagcgagg

SEQ ID NO: 263826 - RNA, 18 nt, Homo sapiens
agguuauuucccaagacu

SEQ ID NO: 263827 - RNA, 22 nt, Homo sapiens
aguacacuguugaacagaagug

SEQ ID NO: 263828 - RNA, 22 nt, Homo sapiens
aguaccauuagauuaggaugac

SEQ ID NO: 263829 - RNA, 20 nt, Homo sapiens
aguauucacuuuuuucaugg

SEQ ID NO: 263830 - RNA, 22 nt, Homo sapiens
aguauuuguuggaauaccuguu

SEQ ID NO: 263831 - RNA, 22 nt, Homo sapiens
agucaaaugcuuauguauaaag

SEQ ID NO: 263832 - RNA, 22 nt, Homo sapiens
agucaaguuuuuucagagaaua

SEQ ID NO: 263833 - RNA, 22 nt, Homo sapiens
agucacaugccagcacacccag

SEQ ID NO: 263834 - RNA, 22 nt, Homo sapiens
agucaguggaguaaauguaauu

SEQ ID NO: 263835 - RNA, 20 nt, Homo sapiens
agucaguuuauuuucucucu

SEQ ID NO: 263836 - RNA, 22 nt, Homo sapiens
agucauagaguuugcccuucuc

SEQ ID NO: 263837 - RNA, 22 nt, Homo sapiens
agucauaggagagauaucacug

SEQ ID NO: 263838 - RNA, 22 nt, Homo sapiens
agucauggcagaaggcaccucu

SEQ ID NO: 263839 - RNA, 22 nt, Homo sapiens
agucugguguucucacacuagu

SEQ ID NO: 263840 - RNA, 22 nt, Homo sapiens
agugaauuguucaacaggagga

SEQ ID NO: 263841 - RNA, 17 nt, Homo sapiens
agugagaucauggcuua

SEQ ID NO: 263842 - RNA, 19 nt, Homo sapiens
agugagccaagauccuacc

SEQ ID NO: 263843 - RNA, 22 nt, Homo sapiens
agugagcuggagaaaagaaacu

SEQ ID NO: 263844 - RNA, 22 nt, Homo sapiens
agugaucauuugaauugaugau

SEQ ID NO: 263845 - RNA, 22 nt, Homo sapiens
agugauggagccaggauuuaau

SEQ ID NO: 263846 - RNA, 22 nt, Homo sapiens
agugauguggaguuuggaugga

SEQ ID NO: 263847 - RNA, 22 nt, Homo sapiens
agugauuuuaacuuccagcaau

SEQ ID NO: 263848 - RNA, 22 nt, Homo sapiens
agugcacugcccgcuuccuguc

SEQ ID NO: 263849 - RNA, 22 nt, Homo sapiens
agugcaguggcauggucauaac

SEQ ID NO: 263850 - RNA, 22 nt, Homo sapiens
agugcauugagacuugugaguu

SEQ ID NO: 263851 - RNA, 22 nt, Homo sapiens
agugcauuuguucugugucagg

SEQ ID NO: 263852 - RNA, 22 nt, Homo sapiens
agugcuuaauagauguccagca

SEQ ID NO: 263853 - RNA, 22 nt, Homo sapiens
aguggcuuuuuaguggcagaug

SEQ ID NO: 263854 - RNA, 19 nt, Homo sapiens
agugggcuagaaaucaggg

SEQ ID NO: 263855 - RNA, 19 nt, Homo sapiens
aguggguguuuucuguuug

SEQ ID NO: 263856 - RNA, 23 nt, Homo sapiens
aguggucuccugggcccagcugu

SEQ ID NO: 263857 - RNA, 20 nt, Homo sapiens
agugguuuucaaauaugucu

SEQ ID NO: 263858 - RNA, 22 nt, Homo sapiens
aguucaaugcucuuucuacuau

SEQ ID NO: 263859 - RNA, 22 nt, Homo sapiens
aguuccauuuauucucgucucu

SEQ ID NO: 263860 - RNA, 22 nt, Homo sapiens
aguuggccccuacugggaggug

SEQ ID NO: 263861 - RNA, 22 nt, Homo sapiens
aguuuugguugaguuacuagca

SEQ ID NO: 263862 - RNA, 22 nt, Homo sapiens
auaaagacacuuggcaugauuu

SEQ ID NO: 263863 - RNA, 22 nt, Homo sapiens
auaaagcaagucucuggccuca

SEQ ID NO: 263864 - RNA, 22 nt, Homo sapiens
auaaagcuauuccucucuuuuu

SEQ ID NO: 263865 - RNA, 22 nt, Homo sapiens
auaaagguaauaauaguugcau

SEQ ID NO: 263866 - RNA, 22 nt, Homo sapiens
auaaaugcauugagaacugcug

SEQ ID NO: 263867 - RNA, 22 nt, Homo sapiens
auaaccuauggaucuacucggg

SEQ ID NO: 263868 - RNA, 22 nt, Homo sapiens
auaaguauuuggacuuuacugu

SEQ ID NO: 263869 - RNA, 22 nt, Homo sapiens
auaagugagugauucaguguua

SEQ ID NO: 263870 - RNA, 22 nt, Homo sapiens
ucuauugguaggggcugaggca

SEQ ID NO: 263871 - RNA, 22 nt, Homo sapiens
ucucaauggguuguagacaaag

SEQ ID NO: 263872 - RNA, 22 nt, Homo sapiens
ucucacagccauuucucccucu

SEQ ID NO: 263873 - RNA, 22 nt, Homo sapiens
ucucagugugguaaaaguuuuu

SEQ ID NO: 263874 - RNA, 22 nt, Homo sapiens
ucucauagaggcagagaguaaa

SEQ ID NO: 263875 - RNA, 17 nt, Homo sapiens
ucucccaucccuuucuc

SEQ ID NO: 263876 - RNA, 22 nt, Homo sapiens
ucucugagaaaaguuucuccca

SEQ ID NO: 263877 - RNA, 22 nt, Homo sapiens
ucucuuggugacuuaaaauguu

SEQ ID NO: 263878 - RNA, 22 nt, Homo sapiens
ucucuugguugaacaguuugga

SEQ ID NO: 263879 - RNA, 22 nt, Homo sapiens
ucugacaaugaacaaucuauag

SEQ ID NO: 263880 - RNA, 22 nt, Homo sapiens
ucugacagugagagaaaucuga

SEQ ID NO: 263881 - RNA, 22 nt, Homo sapiens
auaauacuuuuauuuugaggaa

SEQ ID NO: 263882 - RNA, 22 nt, Homo sapiens
auaauaguguuuagauuuggga

SEQ ID NO: 263883 - RNA, 23 nt, Homo sapiens
auaaugcaaguggugguaaucug

SEQ ID NO: 263884 - RNA, 22 nt, Homo sapiens
auacagguauacaaugcauaau

SEQ ID NO: 263885 - RNA, 22 nt, Homo sapiens
auacaguaucuucuggcaagca

SEQ ID NO: 263886 - RNA, 22 nt, Homo sapiens
auacaguguauguauaguacau

SEQ ID NO: 263887 - RNA, 22 nt, Homo sapiens
auacaguguucugggaagaagu

SEQ ID NO: 263888 - RNA, 22 nt, Homo sapiens
auacaguugccauuucuugugc

SEQ ID NO: 263889 - RNA, 22 nt, Homo sapiens
auacauguuucauguuggugug

SEQ ID NO: 263890 - RNA, 22 nt, Homo sapiens
auacccauacauauuggugacu

SEQ ID NO: 263891 - RNA, 22 nt, Homo sapiens
auagacugaguggcuuaaacca

SEQ ID NO: 263892 - RNA, 22 nt, Homo sapiens
auagcaaugccccauucccagu

SEQ ID NO: 263893 - RNA, 21 nt, Homo sapiens
auagcacaucagauuuuauua

SEQ ID NO: 263894 - RNA, 22 nt, Homo sapiens
auagcacauggcauccucucuu

SEQ ID NO: 263895 - RNA, 22 nt, Homo sapiens
cccugagaugcuguuaaucugu

SEQ ID NO: 263896 - RNA, 19 nt, Homo sapiens
cccuggcacauggaaaaug

SEQ ID NO: 263897 - RNA, 22 nt, Homo sapiens
cccuucauucaaggguugugag

SEQ ID NO: 263898 - RNA, 22 nt, Homo sapiens
ccucacaaccuuuauugaagag

SEQ ID NO: 263899 - RNA, 22 nt, Homo sapiens
ccucaguguuuaucauuauuuu

SEQ ID NO: 263900 - RNA, 22 nt, Homo sapiens
ccuccauuugugucaggaaguc

SEQ ID NO: 263901 - RNA, 21 nt, Homo sapiens
ccucuuugagggaagaaaggg

SEQ ID NO: 263902 - RNA, 22 nt, Homo sapiens
ccugagacgaauggagugaaca

SEQ ID NO: 263903 - RNA, 22 nt, Homo sapiens
ccuucacaggcacugguucaga

SEQ ID NO: 263904 - RNA, 22 nt, Homo sapiens
ccuucauccuccagcaggcuag

SEQ ID NO: 263905 - RNA, 22 nt, Homo sapiens
ccuugcacuucccaagugaggc

SEQ ID NO: 263906 - RNA, 22 nt, Homo sapiens
ccuugcacuucccaggugaggc

SEQ ID NO: 263907 - RNA, 22 nt, Homo sapiens
ccuuggcaauggcuggggcuga

SEQ ID NO: 263908 - RNA, 22 nt, Homo sapiens
ccuuuguggggcgguggguaau

SEQ ID NO: 263909 - RNA, 22 nt, Homo sapiens
ccuuuuuguaguggaaguagga

SEQ ID NO: 263910 - RNA, 22 nt, Homo sapiens
cguugcacuccagccugggcaa

SEQ ID NO: 263911 - RNA, 20 nt, Homo sapiens
cuaaucaucccagaagaaau

SEQ ID NO: 263912 - RNA, 22 nt, Homo sapiens
cuacagaguaucuaaagaggua

SEQ ID NO: 263913 - RNA, 22 nt, Homo sapiens
cuaccuggguggcucaugacuu

SEQ ID NO: 263914 - RNA, 22 nt, Homo sapiens
cuacucugugguguauuugcau

SEQ ID NO: 263915 - RNA, 22 nt, Homo sapiens
cuacugacacuacugcaaucau

SEQ ID NO: 263916 - RNA, 22 nt, Homo sapiens
cuagaagcauauucagaacaga

SEQ ID NO: 263917 - RNA, 22 nt, Homo sapiens
cuagaguguaguuuucuuagga

SEQ ID NO: 263918 - RNA, 22 nt, Homo sapiens
cuagcagacacuuccagagagu

SEQ ID NO: 263919 - RNA, 22 nt, Homo sapiens
cuagguuauacucugaaauggu

SEQ ID NO: 263920 - RNA, 22 nt, Homo sapiens
cuagguucucaaaccagcguca

SEQ ID NO: 263921 - RNA, 22 nt, Homo sapiens
cuagucacaggaguugaaggau

SEQ ID NO: 263922 - RNA, 22 nt, Homo sapiens
cuagucacauuuucaucaaaua

SEQ ID NO: 263923 - RNA, 22 nt, Homo sapiens
cuauaugucuguuuugguacca

SEQ ID NO: 263924 - RNA, 21 nt, Homo sapiens
cugcaaaugcugcugccugau

SEQ ID NO: 263925 - RNA, 19 nt, Homo sapiens
cugcaagguaauaggucag

SEQ ID NO: 263926 - RNA, 20 nt, Homo sapiens
cugcacauccacucuacuuc

SEQ ID NO: 263927 - RNA, 19 nt, Homo sapiens
cugcacugagaaaaggagg

SEQ ID NO: 263928 - RNA, 22 nt, Homo sapiens
cugcuaagagaaugagacuuag

SEQ ID NO: 263929 - RNA, 22 nt, Homo sapiens
cugcuguuguuaacuuuuggag

SEQ ID NO: 263930 - RNA, 22 nt, Homo sapiens
cuggaagaaaaucacgccaucu

SEQ ID NO: 263931 - RNA, 22 nt, Homo sapiens
cuggaauauuagcuggucuuaa

SEQ ID NO: 263932 - RNA, 22 nt, Homo sapiens
cuggaauuacaggguugagcua

SEQ ID NO: 263933 - RNA, 22 nt, Homo sapiens
cuggauagagauugaugaugcu

SEQ ID NO: 263934 - RNA, 22 nt, Homo sapiens
cuggauagucaggagauauaua

SEQ ID NO: 263935 - RNA, 20 nt, Homo sapiens
cuggaugucgaggcagaggu

SEQ ID NO: 263936 - RNA, 18 nt, Homo sapiens
cuggaugucgaguguguu

SEQ ID NO: 263937 - RNA, 22 nt, Homo sapiens
cuggcaaauaguagagccagga

SEQ ID NO: 263938 - RNA, 22 nt, Homo sapiens
cuggcaccauacacuguuguug

SEQ ID NO: 263939 - RNA, 22 nt, Homo sapiens
cuggcagugcuuguuauccugg

SEQ ID NO: 263940 - RNA, 22 nt, Homo sapiens
cuggcaguguuucuugugggcu

SEQ ID NO: 263941 - RNA, 22 nt, Homo sapiens
cugggaugauguaaauaggcua

SEQ ID NO: 263942 - RNA, 22 nt, Homo sapiens
cuggguacccuuuaaacaggaa

SEQ ID NO: 263943 - RNA, 22 nt, Homo sapiens
cuggugagaugucuuuccucuu

SEQ ID NO: 263944 - RNA, 22 nt, Homo sapiens
cuggugauugguuucauucagu

SEQ ID NO: 263945 - RNA, 21 nt, Homo sapiens
cugguguuagcacuucuuccc

SEQ ID NO: 263946 - RNA, 22 nt, Homo sapiens
cuguaaagaucacagagcuggu

SEQ ID NO: 263947 - RNA, 22 nt, Homo sapiens
cuguacucaucccauaugcacu

SEQ ID NO: 263948 - RNA, 22 nt, Homo sapiens
cuguaugugagaaauaauaagu

SEQ ID NO: 263949 - RNA, 22 nt, Homo sapiens
cuguccugcagagucagaauga

SEQ ID NO: 263950 - RNA, 22 nt, Homo sapiens
cugucucagccucuccaguagc

SEQ ID NO: 263951 - RNA, 22 nt, Homo sapiens
cugucucagugaauugguuuua

SEQ ID NO: 263952 - RNA, 22 nt, Homo sapiens
cugucuggaggccugcaaauaa

SEQ ID NO: 263953 - RNA, 22 nt, Homo sapiens
cugucuggaguccuucgugugc

SEQ ID NO: 263954 - RNA, 22 nt, Homo sapiens
cugugaagaaagucauugguag

SEQ ID NO: 263955 - RNA, 22 nt, Homo sapiens
cugugcauaucuuggacugugu

SEQ ID NO: 263956 - RNA, 22 nt, Homo sapiens
uauugcuccccauaucgcagug

SEQ ID NO: 263957 - RNA, 22 nt, Homo sapiens
uauugcuccuaauaucacggug

SEQ ID NO: 263958 - RNA, 22 nt, Homo sapiens
uauugcuggauguauuacaugu

SEQ ID NO: 263959 - RNA, 22 nt, Homo sapiens
uauuguacauguuauagauuuu

SEQ ID NO: 263960 - RNA, 22 nt, Homo sapiens
uauuguuuuucccaggagucua

SEQ ID NO: 263961 - RNA, 22 nt, Homo sapiens
uauuucaguugugcagguaguu

SEQ ID NO: 263962 - RNA, 22 nt, Homo sapiens
uauuucccuuaacuuuccugca

SEQ ID NO: 263963 - RNA, 22 nt, Homo sapiens
ucaaacugcuugaggccauuua

SEQ ID NO: 263964 - RNA, 22 nt, Homo sapiens
ucaaaugauucacccaccuuug

SEQ ID NO: 263965 - RNA, 22 nt, Homo sapiens
ucaaaugauucuccugccucag

SEQ ID NO: 263966 - RNA, 22 nt, Homo sapiens
ucaacaggucaauugcauagaa

SEQ ID NO: 263967 - RNA, 22 nt, Homo sapiens
ucaacagugauggaaaguuaua

SEQ ID NO: 263968 - RNA, 22 nt, Homo sapiens
ucaacagugggcacuguaaaug

SEQ ID NO: 263969 - RNA, 22 nt, Homo sapiens
ucaacauugcugucaggcaucu

SEQ ID NO: 263970 - RNA, 22 nt, Homo sapiens
ucaaccggugagagcuuccucc

SEQ ID NO: 263971 - RNA, 18 nt, Homo sapiens
ucaagcaauugucaugcc

SEQ ID NO: 263972 - RNA, 19 nt, Homo sapiens
ucaagcuauucuccugccu

SEQ ID NO: 263973 - RNA, 21 nt, Homo sapiens
ucaaggaguauacguaugcca

SEQ ID NO: 263974 - RNA, 22 nt, Homo sapiens
ucaaggcacuagcugagcugca

SEQ ID NO: 263975 - RNA, 22 nt, Homo sapiens
ucaaugcaaccuccaccucugg

SEQ ID NO: 263976 - RNA, 22 nt, Homo sapiens
ucacacgugaacucaucacaga

SEQ ID NO: 263977 - RNA, 22 nt, Homo sapiens
ucacacugaauuugaagcaaug

SEQ ID NO: 263978 - RNA, 22 nt, Homo sapiens
ucacacugucuugguuacucuu

SEQ ID NO: 263979 - RNA, 22 nt, Homo sapiens
ucacacuguuuugauuauuaua

SEQ ID NO: 263980 - RNA, 21 nt, Homo sapiens
ucacagccuaggaccugaaga

SEQ ID NO: 263981 - RNA, 19 nt, Homo sapiens
ucacaggguugacuugagg

SEQ ID NO: 263982 - RNA, 22 nt, Homo sapiens
ucacaguaacuuuguugcuuuu

SEQ ID NO: 263983 - RNA, 22 nt, Homo sapiens
ucacaguauggggggugguuau

SEQ ID NO: 263984 - RNA, 22 nt, Homo sapiens
ucacagucggugacuucuugcu

SEQ ID NO: 263985 - RNA, 22 nt, Homo sapiens
ucacagucugcgugaugagaca

SEQ ID NO: 263986 - RNA, 22 nt, Homo sapiens
ucacagugcaggaucaguuaau

SEQ ID NO: 263987 - RNA, 22 nt, Homo sapiens
ucacaguucagcauggcugagg

SEQ ID NO: 263988 - RNA, 22 nt, Homo sapiens
ucacaugaauugucuuguucca

SEQ ID NO: 263989 - RNA, 22 nt, Homo sapiens
ucacauggaggugauaguugaa

SEQ ID NO: 263990 - RNA, 22 nt, Homo sapiens
ucacauggggaagggacuagcu

SEQ ID NO: 263991 - RNA, 22 nt, Homo sapiens
ucacaugggugcaauauaauca

SEQ ID NO: 263992 - RNA, 22 nt, Homo sapiens
ucacauuguauauguaccuauc

SEQ ID NO: 263993 - RNA, 22 nt, Homo sapiens
ucaccaccugcugaucauagag

SEQ ID NO: 263994 - RNA, 22 nt, Homo sapiens
ucacccacacaggagacaggga

SEQ ID NO: 263995 - RNA, 20 nt, Homo sapiens
ucacuauggagcucuuucuu

SEQ ID NO: 263996 - RNA, 22 nt, Homo sapiens
ucacugaaaccuccgccuucug

SEQ ID NO: 263997 - RNA, 22 nt, Homo sapiens
ucacugagaaugauguuucuga

SEQ ID NO: 263998 - RNA, 22 nt, Homo sapiens
ucacugagcuagaucacuugac

SEQ ID NO: 263999 - RNA, 20 nt, Homo sapiens
ucacugagugguccacagua

SEQ ID NO: 264000 - RNA, 22 nt, Homo sapiens
ucacugcacucuccgccuugcg

SEQ ID NO: 264001 - RNA, 22 nt, Homo sapiens
ucacugggagaccaaagccauc

SEQ ID NO: 264002 - RNA, 22 nt, Homo sapiens
ucacuguugaugggcaugcagg

SEQ ID NO: 264003 - RNA, 22 nt, Homo sapiens
ucacuuuggguacuauggaaau

SEQ ID NO: 264004 - RNA, 22 nt, Homo sapiens
ucagacacugcccuccaccugu

SEQ ID NO: 264005 - RNA, 22 nt, Homo sapiens
ucagaccauuucauuacagacu

SEQ ID NO: 264006 - RNA, 22 nt, Homo sapiens
ucagaguagcugucugaggugc

SEQ ID NO: 264007 - RNA, 22 nt, Homo sapiens
ucagaguguuuuccaacuuggu

SEQ ID NO: 264008 - RNA, 19 nt, Homo sapiens
ucagaucagcccaagggau

SEQ ID NO: 264009 - RNA, 22 nt, Homo sapiens
ucagaugaucugguaagaacuu

SEQ ID NO: 264010 - RNA, 22 nt, Homo sapiens
ucagaugauuccguugacgaga

SEQ ID NO: 264011 - RNA, 22 nt, Homo sapiens
ucagauguuuuguuuaucugcu

SEQ ID NO: 264012 - RNA, 22 nt, Homo sapiens
ucagauugaugcauacuuaaau

SEQ ID NO: 264013 - RNA, 22 nt, Homo sapiens
ucagcaccauguaacaauugau

SEQ ID NO: 264014 - RNA, 20 nt, Homo sapiens
ucaggcuccgcauuaacuua

SEQ ID NO: 264015 - RNA, 23 nt, Homo sapiens
ucagguaguuucagaggaccuug

SEQ ID NO: 264016 - RNA, 22 nt, Homo sapiens
ucagguaucuucauagcaaugc

SEQ ID NO: 264017 - RNA, 22 nt, Homo sapiens
ucaggugcagagaagaaauggg

SEQ ID NO: 264018 - RNA, 22 nt, Homo sapiens
ucaggugcaguggcucaugcuu

SEQ ID NO: 264019 - RNA, 22 nt, Homo sapiens
ucagguugcuaaguauaauauu

SEQ ID NO: 264020 - RNA, 22 nt, Homo sapiens
ucaguaaauguuaggacauuuc

SEQ ID NO: 264021 - RNA, 22 nt, Homo sapiens
ucaguaaucuuagcugugcaga

SEQ ID NO: 264022 - RNA, 23 nt, Homo sapiens
ucaguacucuauaagugccagcu

SEQ ID NO: 264023 - RNA, 23 nt, Homo sapiens
ucaguagucauugggaaagugug

SEQ ID NO: 264024 - RNA, 22 nt, Homo sapiens
ucagucuuuuaccauuaaguau

SEQ ID NO: 264025 - RNA, 22 nt, Homo sapiens
ucagugaacgaggaggagggug

SEQ ID NO: 264026 - RNA, 22 nt, Homo sapiens
ucagugaauguuggccacuacu

SEQ ID NO: 264027 - RNA, 22 nt, Homo sapiens
ucagugccauugccauaugagu

SEQ ID NO: 264028 - RNA, 19 nt, Homo sapiens
ucagugcuauguaauguag

SEQ ID NO: 264029 - RNA, 22 nt, Homo sapiens
ucagugcuuggcacagagagcu

SEQ ID NO: 264030 - RNA, 22 nt, Homo sapiens
ucaguggagccucacucugugg

SEQ ID NO: 264031 - RNA, 22 nt, Homo sapiens
ucagugggcuauguaauuaacu

SEQ ID NO: 264032 - RNA, 22 nt, Homo sapiens
ucagugguuaaaagauucuaga

SEQ ID NO: 264033 - RNA, 22 nt, Homo sapiens
ucagugucaucuggguuguuug

SEQ ID NO: 264034 - RNA, 22 nt, Homo sapiens
ucauacaguaguccucacuugu

SEQ ID NO: 264035 - RNA, 22 nt, Homo sapiens
ucauaguacuuuguuuugaaaa

SEQ ID NO: 264036 - RNA, 22 nt, Homo sapiens
ucauaguagucacuuaauaaau

SEQ ID NO: 264037 - RNA, 22 nt, Homo sapiens
ucaucagguaugucagcggagu

SEQ ID NO: 264038 - RNA, 21 nt, Homo sapiens
ucaucagucaaagacaauggu

SEQ ID NO: 264039 - RNA, 20 nt, Homo sapiens
ucaucaguuggugcucgcug

SEQ ID NO: 264040 - RNA, 22 nt, Homo sapiens
ucaugacacuggcaggagcuaa

SEQ ID NO: 264041 - RNA, 22 nt, Homo sapiens
ucaugagacacacuggaaagga

SEQ ID NO: 264042 - RNA, 21 nt, Homo sapiens
ucaugccacugcacuuuagcc

SEQ ID NO: 264043 - RNA, 22 nt, Homo sapiens
ucauggguuuugguccaagcaa

SEQ ID NO: 264044 - RNA, 22 nt, Homo sapiens
ucaugguuuuauaacccucuug

SEQ ID NO: 264045 - RNA, 19 nt, Homo sapiens
gacaugagauuuggugggg

SEQ ID NO: 264046 - RNA, 20 nt, Homo sapiens
gacauggaggaggauuauua

SEQ ID NO: 264047 - RNA, 22 nt, Homo sapiens
gacauguaaggcucucucuguu

SEQ ID NO: 264048 - RNA, 22 nt, Homo sapiens
gacauguuuacaguguugagag

SEQ ID NO: 264049 - RNA, 22 nt, Homo sapiens
gaccaaagaggcaggcauuaga

SEQ ID NO: 264050 - RNA, 22 nt, Homo sapiens
gaccacagacuggaaagagggc

SEQ ID NO: 264051 - RNA, 21 nt, Homo sapiens
gaccacagcagggaaugucag

SEQ ID NO: 264052 - RNA, 22 nt, Homo sapiens
gacuuagagauguuguauuugg

SEQ ID NO: 264053 - RNA, 22 nt, Homo sapiens
gacuugaagaaucuaagggagg

SEQ ID NO: 264054 - RNA, 20 nt, Homo sapiens
gacuugagagugggagagua

SEQ ID NO: 264055 - RNA, 22 nt, Homo sapiens
gagaacaguguuguauuuuuuc

SEQ ID NO: 264056 - RNA, 22 nt, Homo sapiens
gagaaguaaauuuauuugcaaa

SEQ ID NO: 264057 - RNA, 21 nt, Homo sapiens
gagaaucaucauggcugcaua

SEQ ID NO: 264058 - RNA, 22 nt, Homo sapiens
gagacagugucagccauugaaa

SEQ ID NO: 264059 - RNA, 22 nt, Homo sapiens
gagacauguuugcuuaucugag

SEQ ID NO: 264060 - RNA, 22 nt, Homo sapiens
gagacauugacuuuguuccaga

SEQ ID NO: 264061 - RNA, 20 nt, Homo sapiens
gagaccugagauucacucaa

SEQ ID NO: 264062 - RNA, 22 nt, Homo sapiens
gagaucaaugggauggaauuga

SEQ ID NO: 264063 - RNA, 22 nt, Homo sapiens
gagaucaugcugguucucucau

SEQ ID NO: 264064 - RNA, 22 nt, Homo sapiens
gagaugaaguuaaggaucuuua

SEQ ID NO: 264065 - RNA, 22 nt, Homo sapiens
gagaugugguucaaggguguuu

SEQ ID NO: 264066 - RNA, 22 nt, Homo sapiens
gagauguuuuguuaucaaagga

SEQ ID NO: 264067 - RNA, 22 nt, Homo sapiens
gagauuaacauuugaggagcug

SEQ ID NO: 264068 - RNA, 22 nt, Homo sapiens
gagauucaucuagguccagaga

SEQ ID NO: 264069 - RNA, 22 nt, Homo sapiens
gagcaacaguggcagugguggg

SEQ ID NO: 264070 - RNA, 22 nt, Homo sapiens
gagcaccagucccugucagugc

SEQ ID NO: 264071 - RNA, 22 nt, Homo sapiens
gagcagacaugaggaccgcugg

SEQ ID NO: 264072 - RNA, 22 nt, Homo sapiens
gagcaucaguggccucaucuca

SEQ ID NO: 264073 - RNA, 22 nt, Homo sapiens
gagcgcauugauguuggaugcu

SEQ ID NO: 264074 - RNA, 22 nt, Homo sapiens
gagcuagggucaugcuacugca

SEQ ID NO: 264075 - RNA, 22 nt, Homo sapiens
gagcuagguuuugaauccagac

SEQ ID NO: 264076 - RNA, 22 nt, Homo sapiens
gagcuaguagagugcacccggc

SEQ ID NO: 264077 - RNA, 20 nt, Homo sapiens
gagcucaucuucuuuaccac

SEQ ID NO: 264078 - RNA, 22 nt, Homo sapiens
gagcucauuaaaaauguagaau

SEQ ID NO: 264079 - RNA, 22 nt, Homo sapiens
gagcucauuguugcuaaagaga

SEQ ID NO: 264080 - RNA, 22 nt, Homo sapiens
gagcuccuccccuuggcuuuca

SEQ ID NO: 264081 - RNA, 19 nt, Homo sapiens
ucaugugcauacauuuggg

SEQ ID NO: 264082 - RNA, 22 nt, Homo sapiens
ucauuagucaccuagccagcuu

SEQ ID NO: 264083 - RNA, 22 nt, Homo sapiens
ucauugcacuucuuuaguugca

SEQ ID NO: 264084 - RNA, 22 nt, Homo sapiens
ucauugcauguuaauuaaacag

SEQ ID NO: 264085 - RNA, 22 nt, Homo sapiens
ucauuggaugucugaaaugauu

SEQ ID NO: 264086 - RNA, 22 nt, Homo sapiens
ucauuggcuaagcuuguuacac

SEQ ID NO: 264087 - RNA, 22 nt, Homo sapiens
ucauugguugcguaauuugauu

SEQ ID NO: 264088 - RNA, 22 nt, Homo sapiens
uccacagugguugaacuaguuu

SEQ ID NO: 264089 - RNA, 20 nt, Homo sapiens
uccacugagcgucacggcag

SEQ ID NO: 264090 - RNA, 22 nt, Homo sapiens
uccaguacaggucucucauuuc

SEQ ID NO: 264091 - RNA, 22 nt, Homo sapiens
uccaguguuauaauaugcgucu

SEQ ID NO: 264092 - RNA, 22 nt, Homo sapiens
uccaguguuccucagucacccc

SEQ ID NO: 264093 - RNA, 22 nt, Homo sapiens
uccaguguuucuuccacuauuu

SEQ ID NO: 264094 - RNA, 22 nt, Homo sapiens
uccaguuuucuuuccuagggcu

SEQ ID NO: 264095 - RNA, 22 nt, Homo sapiens
uccaguuuuguuaacauauggu

SEQ ID NO: 264096 - RNA, 18 nt, Homo sapiens
uccauuuguaugggaugg

SEQ ID NO: 264097 - RNA, 22 nt, Homo sapiens
uccauuuguucagcuucaggaa

SEQ ID NO: 264098 - RNA, 22 nt, Homo sapiens
uccauuuguuguaggguauagu

SEQ ID NO: 264099 - RNA, 19 nt, Homo sapiens
ucccaauguuuccaggcag

SEQ ID NO: 264100 - RNA, 19 nt, Homo sapiens
uccccaguuuuccguucag

SEQ ID NO: 264101 - RNA, 22 nt, Homo sapiens
uccccugagaccccucagcacu

SEQ ID NO: 264102 - RNA, 20 nt, Homo sapiens
ucccucaaacuuuuccacug

SEQ ID NO: 264103 - RNA, 22 nt, Homo sapiens
ucccugaaaauuagcauuuuaa

SEQ ID NO: 264104 - RNA, 22 nt, Homo sapiens
ucccugagugauugaaaauaaa

SEQ ID NO: 264105 - RNA, 22 nt, Homo sapiens
ucccuguagugccuagaucaga

SEQ ID NO: 264106 - RNA, 22 nt, Homo sapiens
ucccuuucuggaguuucccaag

SEQ ID NO: 264107 - RNA, 22 nt, Homo sapiens
uccugagagcagacccucuaua

SEQ ID NO: 264108 - RNA, 20 nt, Homo sapiens
uccugagauucccaguucuc

SEQ ID NO: 264109 - RNA, 22 nt, Homo sapiens
uccugcauucauccugguguug

SEQ ID NO: 264110 - RNA, 22 nt, Homo sapiens
uccuggcuccacuguuuauucc

SEQ ID NO: 264111 - RNA, 22 nt, Homo sapiens
uccuucauuugucaacucuagu

SEQ ID NO: 264112 - RNA, 22 nt, Homo sapiens
uccuugagccugggaguuauag

SEQ ID NO: 264113 - RNA, 22 nt, Homo sapiens
uccuugagccuuaaauuauaaa

SEQ ID NO: 264114 - RNA, 22 nt, Homo sapiens
uccuuggucaaaaagaaagugu

SEQ ID NO: 264115 - RNA, 22 nt, Homo sapiens
uccuuggugacauuucuugucu

SEQ ID NO: 264116 - RNA, 21 nt, Homo sapiens
uccuuggugaugcccugcagu

SEQ ID NO: 264117 - RNA, 23 nt, Homo sapiens
uccuugguuggcgcccuaugugu

SEQ ID NO: 264118 - RNA, 22 nt, Homo sapiens
ucgcaccauugcacuccagcca

SEQ ID NO: 264119 - RNA, 22 nt, Homo sapiens
ucgcagcacgagcaugcaaggu

SEQ ID NO: 264120 - RNA, 19 nt, Homo sapiens
ucgcgccauucuccugccu

SEQ ID NO: 264121 - RNA, 22 nt, Homo sapiens
ucgcgccauucuccugccucag

SEQ ID NO: 264122 - RNA, 23 nt, Homo sapiens
ucgguccccuuggcugcccucgg

SEQ ID NO: 264123 - RNA, 22 nt, Homo sapiens
ucuaagacuaagggcuagcuuc

SEQ ID NO: 264124 - RNA, 17 nt, Homo sapiens
ucuaauaauaugcauuu

SEQ ID NO: 264125 - RNA, 22 nt, Homo sapiens
ucuaaugcucugagaacagugc

SEQ ID NO: 264126 - RNA, 22 nt, Homo sapiens
ucuauguuuuugcuaguagugu

SEQ ID NO: 264127 - RNA, 22 nt, Homo sapiens
ucucaaccucccaaguagcugg

SEQ ID NO: 264128 - RNA, 22 nt, Homo sapiens
ucucaaguaacugggacaauaa

SEQ ID NO: 264129 - RNA, 22 nt, Homo sapiens
ucucaaguggucgcaguuagau

SEQ ID NO: 264130 - RNA, 22 nt, Homo sapiens
ucucacacugaauguguguggg

SEQ ID NO: 264131 - RNA, 22 nt, Homo sapiens
ucucacaggguuauugaggggg

SEQ ID NO: 264132 - RNA, 22 nt, Homo sapiens
ucucagcacagucagggcgccu

SEQ ID NO: 264133 - RNA, 22 nt, Homo sapiens
ucucagugaauguggaaaaagc

SEQ ID NO: 264134 - RNA, 22 nt, Homo sapiens
ucucaguggugcuggcagggga

SEQ ID NO: 264135 - RNA, 22 nt, Homo sapiens
ugauacugugcauuagaggcua

SEQ ID NO: 264136 - RNA, 22 nt, Homo sapiens
ugauaugaaagggaaauaagug

SEQ ID NO: 264137 - RNA, 22 nt, Homo sapiens
ugauauguaugugaccuagaaa

SEQ ID NO: 264138 - RNA, 22 nt, Homo sapiens
ugauaugucacuugaucauggu

SEQ ID NO: 264139 - RNA, 21 nt, Homo sapiens
ugaucacaugaaaaccaugca

SEQ ID NO: 264140 - RNA, 22 nt, Homo sapiens
ugaugacccugcaguucucaag

SEQ ID NO: 264141 - RNA, 22 nt, Homo sapiens
ugauggcacagugaguuccagg

SEQ ID NO: 264142 - RNA, 22 nt, Homo sapiens
ugauguguuuuguaguucaacu

SEQ ID NO: 264143 - RNA, 22 nt, Homo sapiens
ugauuagagcccaagcuuugaa

SEQ ID NO: 264144 - RNA, 22 nt, Homo sapiens
ugauuggagaugaauuucguuu

SEQ ID NO: 264145 - RNA, 22 nt, Homo sapiens
ugcaaagucgaaacugcaguuu

SEQ ID NO: 264146 - RNA, 22 nt, Homo sapiens
ugcaaaucuuguguaguuguga

SEQ ID NO: 264147 - RNA, 22 nt, Homo sapiens
ugcaaaugcugcuauuucucuu

SEQ ID NO: 264148 - RNA, 22 nt, Homo sapiens
ugcaaaugucaaggguuagugu

SEQ ID NO: 264149 - RNA, 22 nt, Homo sapiens
ugcaacauguguaccacucugu

SEQ ID NO: 264150 - RNA, 22 nt, Homo sapiens
ugcaagacuaaaccuuccccuc

SEQ ID NO: 264151 - RNA, 22 nt, Homo sapiens
ugcaagaugauuucaauugaua

SEQ ID NO: 264152 - RNA, 22 nt, Homo sapiens
ugcaagucaucuguccuucaga

SEQ ID NO: 264153 - RNA, 22 nt, Homo sapiens
ugcacacucuguaugagaaucu

SEQ ID NO: 264154 - RNA, 22 nt, Homo sapiens
ugcaccaauucuaaacaguucu

SEQ ID NO: 264155 - RNA, 22 nt, Homo sapiens
ugcaccacacuccauccugggc

SEQ ID NO: 264156 - RNA, 23 nt, Homo sapiens
ugcaccacuacacacucuugggu

SEQ ID NO: 264157 - RNA, 22 nt, Homo sapiens
ugcaccacugcaccccagucug

SEQ ID NO: 264158 - RNA, 18 nt, Homo sapiens
ugcaccaguuuacacuuc

SEQ ID NO: 264159 - RNA, 22 nt, Homo sapiens
ugcagcacuguucacaauagcc

SEQ ID NO: 264160 - RNA, 18 nt, Homo sapiens
ugcagcaucaguacccag

SEQ ID NO: 264161 - RNA, 23 nt, Homo sapiens
ugcagcuacauguggccaugugc

SEQ ID NO: 264162 - RNA, 22 nt, Homo sapiens
ugcaguaggcccagcgggaggc

SEQ ID NO: 264163 - RNA, 22 nt, Homo sapiens
ugcagugcaugacuguguuaug

SEQ ID NO: 264164 - RNA, 22 nt, Homo sapiens
uugagauggagucuugcucugu

SEQ ID NO: 264165 - RNA, 22 nt, Homo sapiens
uugagauggagucuugcucuug

SEQ ID NO: 264166 - RNA, 22 nt, Homo sapiens
uugagauggaguucauuuuugu

SEQ ID NO: 264167 - RNA, 22 nt, Homo sapiens
uugagauggaguuucacucucg

SEQ ID NO: 264168 - RNA, 22 nt, Homo sapiens
uugagauggaguuucacucugu

SEQ ID NO: 264169 - RNA, 22 nt, Homo sapiens
uugagauggaguuucgcucuuu

SEQ ID NO: 264170 - RNA, 22 nt, Homo sapiens
uugagauggaguuuugcucuug

SEQ ID NO: 264171 - RNA, 19 nt, Homo sapiens
uugagaugugaacucacac

SEQ ID NO: 264172 - RNA, 22 nt, Homo sapiens
uugagauguggguuggugacuu

SEQ ID NO: 264173 - RNA, 22 nt, Homo sapiens
uugagauuuuccucaaauauuu

SEQ ID NO: 264174 - RNA, 22 nt, Homo sapiens
uugagcaaugaacgauucaggg

SEQ ID NO: 264175 - RNA, 22 nt, Homo sapiens
uugagcaaugucacugaggcuu

SEQ ID NO: 264176 - RNA, 22 nt, Homo sapiens
uugagcaucauguuagcacuca

SEQ ID NO: 264177 - RNA, 22 nt, Homo sapiens
uugagccaaggauugucuuucc

SEQ ID NO: 264178 - RNA, 22 nt, Homo sapiens
uugaggccugauaacacacuga

SEQ ID NO: 264179 - RNA, 22 nt, Homo sapiens
uugaggcuuuugaccucaugug

SEQ ID NO: 264180 - RNA, 22 nt, Homo sapiens
uugagggaagccagaggucugc

SEQ ID NO: 264181 - RNA, 22 nt, Homo sapiens
uugagggcugaauaccaaucag

SEQ ID NO: 264182 - RNA, 22 nt, Homo sapiens
uugaggguggcauauauugauu

SEQ ID NO: 264183 - RNA, 22 nt, Homo sapiens
uugagguaauaaacagccauuc

SEQ ID NO: 264184 - RNA, 22 nt, Homo sapiens
uugaggucuucaggaucaggcu

SEQ ID NO: 264185 - RNA, 22 nt, Homo sapiens
uugaggucuuugagcaaacgca

SEQ ID NO: 264186 - RNA, 22 nt, Homo sapiens
uugaggugggaggaucacuuga

SEQ ID NO: 264187 - RNA, 22 nt, Homo sapiens
uugagugaaugaaugauuaaau

SEQ ID NO: 264188 - RNA, 22 nt, Homo sapiens
uugauaauguuaacuuugguca

SEQ ID NO: 264189 - RNA, 22 nt, Homo sapiens
uugauagacacauauccaugug

SEQ ID NO: 264190 - RNA, 22 nt, Homo sapiens
uugauaugaauggcuguuugug

SEQ ID NO: 264191 - RNA, 22 nt, Homo sapiens
uugauauucugagaagcugaag

SEQ ID NO: 264192 - RNA, 22 nt, Homo sapiens
uugauguguuuccaggauuugu

SEQ ID NO: 264193 - RNA, 22 nt, Homo sapiens
uugauguugaggacauaaaccu

SEQ ID NO: 264194 - RNA, 22 nt, Homo sapiens
uugauuagauccaguugauuga

SEQ ID NO: 264195 - RNA, 22 nt, Homo sapiens
uugcaaaguugccaaggaagga

SEQ ID NO: 264196 - RNA, 22 nt, Homo sapiens
uugcaaggugcagcuuaugcaa

SEQ ID NO: 264197 - RNA, 22 nt, Homo sapiens
uugcaaguggagcuuccagggc

SEQ ID NO: 264198 - RNA, 22 nt, Homo sapiens
uugcacagugcuuucuuugccc

SEQ ID NO: 264199 - RNA, 22 nt, Homo sapiens
uugcacauguugaaccagcaaa

SEQ ID NO: 264200 - RNA, 22 nt, Homo sapiens
uugcacauugauuuuguauccu

SEQ ID NO: 264201 - RNA, 22 nt, Homo sapiens
uugcacauuuuuucuggcagaa

SEQ ID NO: 264202 - RNA, 22 nt, Homo sapiens
uugcacuauaggaaaauguguc

SEQ ID NO: 264203 - RNA, 22 nt, Homo sapiens
uugcacuccagccuuggggaga

SEQ ID NO: 264204 - RNA, 22 nt, Homo sapiens
uugcacuccagcucgggugaca

SEQ ID NO: 264205 - RNA, 22 nt, Homo sapiens
uugcacucugaagaccuacugu

SEQ ID NO: 264206 - RNA, 20 nt, Homo sapiens
uugcagagcccaacccugga

SEQ ID NO: 264207 - RNA, 22 nt, Homo sapiens
uugcagagccccugcaaggguc

SEQ ID NO: 264208 - RNA, 22 nt, Homo sapiens
uugcagaucccacacucacccu

SEQ ID NO: 264209 - RNA, 22 nt, Homo sapiens
uugcagcaacauggaugaaacu

SEQ ID NO: 264210 - RNA, 22 nt, Homo sapiens
uugcagugugacgacuauauuu

SEQ ID NO: 264211 - RNA, 22 nt, Homo sapiens
uugcauagacaauauuaaucuu

SEQ ID NO: 264212 - RNA, 22 nt, Homo sapiens
uugcauauucucugaggcagga

SEQ ID NO: 264213 - RNA, 22 nt, Homo sapiens
uugcaugcuccuuaugagaauc

SEQ ID NO: 264214 - RNA, 22 nt, Homo sapiens
uugcaugucugcuucuccuccu

SEQ ID NO: 264215 - RNA, 22 nt, Homo sapiens
uugccuaggcuggagugcagug

SEQ ID NO: 264216 - RNA, 21 nt, Homo sapiens
uugccugacacuggaagaaau

SEQ ID NO: 264217 - RNA, 22 nt, Homo sapiens
uugccuuuguuggaaacaagug

SEQ ID NO: 264218 - RNA, 22 nt, Homo sapiens
uugcucaggcuggaguacaaug

SEQ ID NO: 264219 - RNA, 20 nt, Homo sapiens
uugcugguguuagaggaggc

SEQ ID NO: 264220 - RNA, 22 nt, Homo sapiens
uuggaaacaccuggugagguua

SEQ ID NO: 264221 - RNA, 22 nt, Homo sapiens
uuggaaacauuuaugguaacag

SEQ ID NO: 264222 - RNA, 22 nt, Homo sapiens
uuggaacacauguuuuucuacc

SEQ ID NO: 264223 - RNA, 22 nt, Homo sapiens
uuggaauauaaccuguuucuaa

SEQ ID NO: 264224 - RNA, 22 nt, Homo sapiens
uuggaauuaagagauauuuucu

SEQ ID NO: 264225 - RNA, 22 nt, Homo sapiens
uuggacagaugguuacauuuuu

SEQ ID NO: 264226 - RNA, 22 nt, Homo sapiens
uuggacuacagauuacuucauc

SEQ ID NO: 264227 - RNA, 22 nt, Homo sapiens
uuggagagucacuaguuagugc

SEQ ID NO: 264228 - RNA, 22 nt, Homo sapiens
uuggagugugagagcagccugg

SEQ ID NO: 264229 - RNA, 22 nt, Homo sapiens
uuggcaaagaggaaugccacuu

SEQ ID NO: 264230 - RNA, 22 nt, Homo sapiens
uuggcaagaaccuucuuccaag

SEQ ID NO: 264231 - RNA, 22 nt, Homo sapiens
uuggcaaucaauucugacgucu

SEQ ID NO: 264232 - RNA, 22 nt, Homo sapiens
uuggcaauucagauucuuuuau

SEQ ID NO: 264233 - RNA, 22 nt, Homo sapiens
uuggcagaaaaggucggggguu

SEQ ID NO: 264234 - RNA, 22 nt, Homo sapiens
uuggcagaguuaauuuguugag

SEQ ID NO: 264235 - RNA, 22 nt, Homo sapiens
uuggcagucugaggcacagacu

SEQ ID NO: 264236 - RNA, 22 nt, Homo sapiens
uuggcauagaggcucucaagcu

SEQ ID NO: 264237 - RNA, 23 nt, Homo sapiens
uuggcaucugggacacaagcuga

SEQ ID NO: 264238 - RNA, 22 nt, Homo sapiens
uuggcauugaguuucaaaucau

SEQ ID NO: 264239 - RNA, 20 nt, Homo sapiens
uuggcauuuagacaagaguu

SEQ ID NO: 264240 - RNA, 22 nt, Homo sapiens
uuggcauuuuuagucaugggaa

SEQ ID NO: 264241 - RNA, 22 nt, Homo sapiens
uuggcccugcugaccauucccu

SEQ ID NO: 264242 - RNA, 19 nt, Homo sapiens
uuggcccugguucucuucu

SEQ ID NO: 264243 - RNA, 22 nt, Homo sapiens
uugguucaguuuaacgaguaau

SEQ ID NO: 264244 - RNA, 21 nt, Homo sapiens
uugguucccucugacaggucu

SEQ ID NO: 264245 - RNA, 22 nt, Homo sapiens
uuguaaacaucuguacauugcu

SEQ ID NO: 264246 - RNA, 22 nt, Homo sapiens
uuguacaggaguguaagcuuca

SEQ ID NO: 264247 - RNA, 22 nt, Homo sapiens
uuguacucucaccguaucccag

SEQ ID NO: 264248 - RNA, 22 nt, Homo sapiens
uuguacuuuuaguagagacggg

SEQ ID NO: 264249 - RNA, 21 nt, Homo sapiens
uuguagcagcauaaucccaga

SEQ ID NO: 264250 - RNA, 22 nt, Homo sapiens
uuguaguguuuauucugucaac

SEQ ID NO: 264251 - RNA, 22 nt, Homo sapiens
uuguauguaaccauuuggcaaa

SEQ ID NO: 264252 - RNA, 22 nt, Homo sapiens
uugucacucuuccuaggguagg

SEQ ID NO: 264253 - RNA, 22 nt, Homo sapiens
uugucacugcacuccagucugg

SEQ ID NO: 264254 - RNA, 22 nt, Homo sapiens
uugucaguguucacucaaagcu

SEQ ID NO: 264255 - RNA, 22 nt, Homo sapiens
uugucauuuucagaguguuacg

SEQ ID NO: 264256 - RNA, 22 nt, Homo sapiens
uuguccauggacagcaccacag

SEQ ID NO: 264257 - RNA, 23 nt, Homo sapiens
uuguccccuccaaagcucauguu

SEQ ID NO: 264258 - RNA, 19 nt, Homo sapiens
uuguccccucuaaaucuca

SEQ ID NO: 264259 - RNA, 16 nt, Homo sapiens
uugucccuucccaaau

SEQ ID NO: 264260 - RNA, 22 nt, Homo sapiens
uuguccuccacauuugaucagu

SEQ ID NO: 264261 - RNA, 22 nt, Homo sapiens
uuguccuggagguucuugcaag

SEQ ID NO: 264262 - RNA, 22 nt, Homo sapiens
uugucuugcagcuuaggcauca

SEQ ID NO: 264263 - RNA, 22 nt, Homo sapiens
uugugaaaaaccucucguggaa

SEQ ID NO: 264264 - RNA, 22 nt, Homo sapiens
uugugaagaaaccagaaaaguu

SEQ ID NO: 264265 - RNA, 22 nt, Homo sapiens
uugugaaugaugucgcaauaaa

SEQ ID NO: 264266 - RNA, 22 nt, Homo sapiens
uugugaaugaugucgcaguaaa

SEQ ID NO: 264267 - RNA, 22 nt, Homo sapiens
uugugaauggugccgcaauaaa

SEQ ID NO: 264268 - RNA, 22 nt, Homo sapiens
uugugaauggugccucaguaaa

SEQ ID NO: 264269 - RNA, 22 nt, Homo sapiens
uugugaucauugucaaauagug

SEQ ID NO: 264270 - RNA, 22 nt, Homo sapiens
uugugaucuucagaaaguggcu

SEQ ID NO: 264271 - RNA, 22 nt, Homo sapiens
uugugcaugaugcauacauggu

SEQ ID NO: 264272 - RNA, 22 nt, Homo sapiens
uugugccugguacauggagaaa

SEQ ID NO: 264273 - RNA, 22 nt, Homo sapiens
uugugcuuuuuaaauagcuucc

SEQ ID NO: 264274 - RNA, 18 nt, Homo sapiens
uuguggccccuacaaauu

SEQ ID NO: 264275 - RNA, 22 nt, Homo sapiens
uugugguaggaugaagagauga

SEQ ID NO: 264276 - RNA, 22 nt, Homo sapiens
uuguguaguaccucucacauug

SEQ ID NO: 264277 - RNA, 22 nt, Homo sapiens
uugugucaaauggcaauuagca

SEQ ID NO: 264278 - RNA, 19 nt, Homo sapiens
uuguguccccacaaaauuc

SEQ ID NO: 264279 - RNA, 22 nt, Homo sapiens
uuguuauguuaaacuacugaaa

SEQ ID NO: 264280 - RNA, 22 nt, Homo sapiens
uuuaaguguuuguuccugaaaa

SEQ ID NO: 264281 - RNA, 22 nt, Homo sapiens
uuuagguauuugguauagcagu

SEQ ID NO: 264282 - RNA, 22 nt, Homo sapiens
uuuauccagccucuagcaaggu

SEQ ID NO: 264283 - RNA, 22 nt, Homo sapiens
uuuaucuguuuaaaacuguuca

SEQ ID NO: 264284 - RNA, 22 nt, Homo sapiens
uuucaacuaauuuuuuggugag

SEQ ID NO: 264285 - RNA, 22 nt, Homo sapiens
uuucacuagccagcccuuuauu

SEQ ID NO: 264286 - RNA, 22 nt, Homo sapiens
uuucagagucaucugcccaagu

SEQ ID NO: 264287 - RNA, 22 nt, Homo sapiens
uuucauagccuuugucgucuga

SEQ ID NO: 264288 - RNA, 22 nt, Homo sapiens
uuucauggacgcaaugccuuuu

SEQ ID NO: 264289 - RNA, 22 nt, Homo sapiens
uuucauggaggcauuuuagauu

SEQ ID NO: 264290 - RNA, 19 nt, Homo sapiens
uuuccaguaaucuuaugug

SEQ ID NO: 264291 - RNA, 22 nt, Homo sapiens
uuuccaguuuggaggaugcauu

SEQ ID NO: 264292 - RNA, 22 nt, Homo sapiens
uuuccauguuggugaaaugagg

SEQ ID NO: 264293 - RNA, 22 nt, Homo sapiens
uuucccuuacuuaaacuuacuc

SEQ ID NO: 264294 - RNA, 22 nt, Homo sapiens
uuuccuguagggggcaaggccu

SEQ ID NO: 264295 - RNA, 22 nt, Homo sapiens
uuucgguuaucuagcuuuauga

SEQ ID NO: 264296 - RNA, 22 nt, Homo sapiens
uuucuacagggcuugccaggua

SEQ ID NO: 264297 - RNA, 22 nt, Homo sapiens
uuucugaggccucaccagaagc

SEQ ID NO: 264298 - RNA, 22 nt, Homo sapiens
uuugaaguguggcacugaguuu

SEQ ID NO: 264299 - RNA, 20 nt, Homo sapiens
uuugaauguaaagcauguca

SEQ ID NO: 264300 - RNA, 22 nt, Homo sapiens
uuugagcauggaaauggcauga

SEQ ID NO: 264301 - RNA, 22 nt, Homo sapiens
uuugcaauagguuguggggagg

SEQ ID NO: 264302 - RNA, 22 nt, Homo sapiens
uuugcacauauuugggcaaaag

SEQ ID NO: 264303 - RNA, 22 nt, Homo sapiens
uuugcaccuuccuaguggcuga

SEQ ID NO: 264304 - RNA, 22 nt, Homo sapiens
uuugcacuucugagugugacau

SEQ ID NO: 264305 - RNA, 22 nt, Homo sapiens
uuugcacuugaaaacacucuca

SEQ ID NO: 264306 - RNA, 23 nt, Homo sapiens
uuugcacuugcuccuucuauggc

SEQ ID NO: 264307 - RNA, 22 nt, Homo sapiens
uuugcaucuuuugcuuccugga

SEQ ID NO: 264308 - RNA, 22 nt, Homo sapiens
uuugccaaucagaggcaucuug

SEQ ID NO: 264309 - RNA, 22 nt, Homo sapiens
uuugccuguagacacuuacccu

SEQ ID NO: 264310 - RNA, 22 nt, Homo sapiens
uuugcuuaaaguccuuguggga

SEQ ID NO: 264311 - RNA, 22 nt, Homo sapiens
uuuggcauuuuacuacucaaau

SEQ ID NO: 264312 - RNA, 22 nt, Homo sapiens
uuuggcccugagggauggcaua

SEQ ID NO: 264313 - RNA, 22 nt, Homo sapiens
uuugggaaaugaaguugguaga

SEQ ID NO: 264314 - RNA, 22 nt, Homo sapiens
uuugggccaugguuuguguaua

SEQ ID NO: 264315 - RNA, 22 nt, Homo sapiens
uuuggucacugccgccgccagc

SEQ ID NO: 264316 - RNA, 22 nt, Homo sapiens
uuuguacacuguugguaggauu

SEQ ID NO: 264317 - RNA, 22 nt, Homo sapiens
uuuguacucccuuuagauaaaa

SEQ ID NO: 264318 - RNA, 20 nt, Homo sapiens
uuuguaucucuggguacugg

SEQ ID NO: 264319 - RNA, 22 nt, Homo sapiens
uuugucaauaacuaccaacagg

SEQ ID NO: 264320 - RNA, 22 nt, Homo sapiens
uuugucuccuaagacucugugg

SEQ ID NO: 264321 - RNA, 22 nt, Homo sapiens
uuugugauugcacacucaagau

SEQ ID NO: 264322 - RNA, 22 nt, Homo sapiens
uuugugcaaacuaggauugcga

SEQ ID NO: 264323 - RNA, 22 nt, Homo sapiens
uuugugcaugaagagggggugc

SEQ ID NO: 264324 - RNA, 18 nt, Homo sapiens
uuugugcuccacaaagga

SEQ ID NO: 264325 - RNA, 22 nt, Homo sapiens
uuugugcuccuguugagaaucu

SEQ ID NO: 264326 - RNA, 22 nt, Homo sapiens
uuuugcucuucauagguccugu

SEQ ID NO: 264327 - RNA, 22 nt, Homo sapiens
uuuugcuugugaauagccacau

SEQ ID NO: 264328 - RNA, 22 nt, Homo sapiens
uuuuggacuugcuccccugucc

SEQ ID NO: 264329 - RNA, 22 nt, Homo sapiens
uuuugguauacacaaggguccu

SEQ ID NO: 264330 - RNA, 22 nt, Homo sapiens
uuuugguauaugcaggggucuu

SEQ ID NO: 264331 - RNA, 22 nt, Homo sapiens
uuuugguguacaauucuaugga

SEQ ID NO: 264332 - RNA, 22 nt, Homo sapiens
uuuuugagaauuggugaaacac

SEQ ID NO: 264333 - RNA, 18 nt, Homo sapiens
uuuuugaggcacagggga

SEQ ID NO: 264334 - RNA, 22 nt, Homo sapiens
uuuuugagguauaguguggcua

SEQ ID NO: 264335 - RNA, 22 nt, Homo sapiens
uuuuugaguagcuggagagcag

SEQ ID NO: 264336 - RNA, 16 nt, Homo sapiens
uuuuugcagaaaugac

SEQ ID NO: 264337 - RNA, 21 nt, Homo sapiens
uuuuugguggucauggauaga

SEQ ID NO: 264338 - RNA, 22 nt, Homo sapiens
uuuuugguugguaggcuauuaa

SEQ ID NO: 264339 - RNA, 22 nt, Homo sapiens
uuuuuugguaauugaacaauga

SEQ ID NO: 264340 - RNA, 22 nt, Homo sapiens
uagcagcauaaauggacuaaga

SEQ ID NO: 264341 - RNA, 19 nt, Homo sapiens
uagcagcaugauuuauaau

SEQ ID NO: 264342 - RNA, 22 nt, Homo sapiens
uagcaguaaagaaugugauguu

SEQ ID NO: 264343 - RNA, 22 nt, Homo sapiens
uagcaguaagaaacugacauug

SEQ ID NO: 264344 - RNA, 22 nt, Homo sapiens
uagcaguaucccaccaucuggu

SEQ ID NO: 264345 - RNA, 22 nt, Homo sapiens
uagcaguauugaaagaugaggg

SEQ ID NO: 264346 - RNA, 22 nt, Homo sapiens
uagcaucagauuccauauucua

SEQ ID NO: 264347 - RNA, 21 nt, Homo sapiens
uagcuacacugugauucaugg

SEQ ID NO: 264348 - RNA, 22 nt, Homo sapiens
uagcucagcccagcuaagcuca

SEQ ID NO: 264349 - RNA, 22 nt, Homo sapiens
uagcugcacuuacaagugagaa

SEQ ID NO: 264350 - RNA, 22 nt, Homo sapiens
uagcugcugcuaggcuaaggau

SEQ ID NO: 264351 - RNA, 22 nt, Homo sapiens
uagcugguucuccaggagcuag

SEQ ID NO: 264352 - RNA, 23 nt, Homo sapiens
uagcuucucccagaccugcuccc

SEQ ID NO: 264353 - RNA, 18 nt, Homo sapiens
uaggaacauugauuggag

SEQ ID NO: 264354 - RNA, 22 nt, Homo sapiens
uaggacacagaccuggauggaa

SEQ ID NO: 264355 - RNA, 22 nt, Homo sapiens
uaggagugugaacccuaugaac

SEQ ID NO: 264356 - RNA, 22 nt, Homo sapiens
uaggaucauuuuauguugccca

SEQ ID NO: 264357 - RNA, 22 nt, Homo sapiens
uaggccuuuuucagauggguag

SEQ ID NO: 264358 - RNA, 22 nt, Homo sapiens
uagggcuuuaguuugcuugugu

SEQ ID NO: 264359 - RNA, 22 nt, Homo sapiens
uagguacuuaagaucucagcua

SEQ ID NO: 264360 - RNA, 22 nt, Homo sapiens
uagguaguuacacagcaaugua

SEQ ID NO: 264361 - RNA, 22 nt, Homo sapiens
uaggucuuuuaugaaauauauu

SEQ ID NO: 264362 - RNA, 22 nt, Homo sapiens
uaggugaauguaguaagguguu

SEQ ID NO: 264363 - RNA, 22 nt, Homo sapiens
uagguuaugauccaucuuggcu

SEQ ID NO: 264364 - RNA, 23 nt, Homo sapiens
uagguuauuugguaaauauaugu

SEQ ID NO: 264365 - RNA, 22 nt, Homo sapiens
uagguucuccacagguucucca

SEQ ID NO: 264366 - RNA, 22 nt, Homo sapiens
uagguugucuguucacucugau

SEQ ID NO: 264367 - RNA, 22 nt, Homo sapiens
uagguuguguucugagccucag

SEQ ID NO: 264368 - RNA, 22 nt, Homo sapiens
uagguuguucuauuaucuuaca

SEQ ID NO: 264369 - RNA, 20 nt, Homo sapiens
uagguuuucacagaauugcc

SEQ ID NO: 264370 - RNA, 22 nt, Homo sapiens
uaguaaacauaguucuuuugcu

SEQ ID NO: 264371 - RNA, 22 nt, Homo sapiens
uaguaaacauuuuucuaucauu

SEQ ID NO: 264372 - RNA, 22 nt, Homo sapiens
uaguaucacaagguguacaccc

SEQ ID NO: 264373 - RNA, 22 nt, Homo sapiens
uagucacacacucaacuuuuca

SEQ ID NO: 264374 - RNA, 20 nt, Homo sapiens
uagucaugagauucuccaag

SEQ ID NO: 264375 - RNA, 22 nt, Homo sapiens
uagucccauaugauuuagugaa

SEQ ID NO: 264376 - RNA, 22 nt, Homo sapiens
uagugacauugcugggaaugcu

SEQ ID NO: 264377 - RNA, 21 nt, Homo sapiens
uagugcagugggguaugacuu

SEQ ID NO: 264378 - RNA, 22 nt, Homo sapiens
uagugcugugauauuuuuggcc

SEQ ID NO: 264379 - RNA, 22 nt, Homo sapiens
uaguucauuuuucuugcuuaga

SEQ ID NO: 264380 - RNA, 22 nt, Homo sapiens
uaguugcaucuuaggucuguga

SEQ ID NO: 264381 - RNA, 22 nt, Homo sapiens
uaguuguugcagguaggaugua

SEQ ID NO: 264382 - RNA, 22 nt, Homo sapiens
uauaacaaugcaagaauggccu

SEQ ID NO: 264383 - RNA, 22 nt, Homo sapiens
uauacacgugugcauauauaca

SEQ ID NO: 264384 - RNA, 22 nt, Homo sapiens
uauacaguaggcacucaguggc

SEQ ID NO: 264385 - RNA, 22 nt, Homo sapiens
uauacaugugccauguuggugu

SEQ ID NO: 264386 - RNA, 22 nt, Homo sapiens
uauagcagccugaacaaaguaa

SEQ ID NO: 264387 - RNA, 22 nt, Homo sapiens
uauagcagugaguauugacuaa

SEQ ID NO: 264388 - RNA, 22 nt, Homo sapiens
uauagcauuuugauccuguaga

SEQ ID NO: 264389 - RNA, 22 nt, Homo sapiens
uucacugcacuccagccugagc

SEQ ID NO: 264390 - RNA, 22 nt, Homo sapiens
uucacugcacuccagccugggu

SEQ ID NO: 264391 - RNA, 22 nt, Homo sapiens
uucacuggagcccaggaguugg

SEQ ID NO: 264392 - RNA, 22 nt, Homo sapiens
uucacugggugugguggcucac

SEQ ID NO: 264393 - RNA, 21 nt, Homo sapiens
uucacuggucuauuucccuuu

SEQ ID NO: 264394 - RNA, 22 nt, Homo sapiens
uucacuguagccucagccucuu

SEQ ID NO: 264395 - RNA, 22 nt, Homo sapiens
uucacugugcuuaaauucugcu

SEQ ID NO: 264396 - RNA, 22 nt, Homo sapiens
uucagaguggacagaaauuaag

SEQ ID NO: 264397 - RNA, 22 nt, Homo sapiens
uucagagugguaugaagugaug

SEQ ID NO: 264398 - RNA, 22 nt, Homo sapiens
uucagaucaucccagcuccacu

SEQ ID NO: 264399 - RNA, 22 nt, Homo sapiens
uucagauugcauaccgaaagua

SEQ ID NO: 264400 - RNA, 22 nt, Homo sapiens
uucagcacaguguggaucauuc

SEQ ID NO: 264401 - RNA, 22 nt, Homo sapiens
uucagcacugaaaauaugucau

SEQ ID NO: 264402 - RNA, 22 nt, Homo sapiens
uucagcaggccaggcccugacu

SEQ ID NO: 264403 - RNA, 22 nt, Homo sapiens
uucagcuacuuggaaacagcaa

SEQ ID NO: 264404 - RNA, 22 nt, Homo sapiens
uucaggcaccauugucauugau

SEQ ID NO: 264405 - RNA, 22 nt, Homo sapiens
uucaggcuccgugccagcuccg

SEQ ID NO: 264406 - RNA, 22 nt, Homo sapiens
augaggugggagaaucacuuga

SEQ ID NO: 264407 - RNA, 19 nt, Homo sapiens
augaguuaggggaaauuuc

SEQ ID NO: 264408 - RNA, 22 nt, Homo sapiens
augaguuccuuccuugccuagg

SEQ ID NO: 264409 - RNA, 22 nt, Homo sapiens
augauaaguuauuagaagaaga

SEQ ID NO: 264410 - RNA, 22 nt, Homo sapiens
augauagucuugagaagcauuu

SEQ ID NO: 264411 - RNA, 22 nt, Homo sapiens
augaucacuguggaaauucagc

SEQ ID NO: 264412 - RNA, 22 nt, Homo sapiens
augaucaucugaaagcuuuuac

SEQ ID NO: 264413 - RNA, 22 nt, Homo sapiens
augaucuguagaacuaguccuu

SEQ ID NO: 264414 - RNA, 22 nt, Homo sapiens
augaucuguuuggugaucuugu

SEQ ID NO: 264415 - RNA, 22 nt, Homo sapiens
augauguaggccauggguuucu

SEQ ID NO: 264416 - RNA, 22 nt, Homo sapiens
augauugugaauaugugguuuu

SEQ ID NO: 264417 - RNA, 22 nt, Homo sapiens
augauuuuuguaucgccugaug

SEQ ID NO: 264418 - RNA, 22 nt, Homo sapiens
augcaaaucuuaaguaugugug

SEQ ID NO: 264419 - RNA, 22 nt, Homo sapiens
augcaagaaauaucucuuuuuc

SEQ ID NO: 264420 - RNA, 22 nt, Homo sapiens
augcaagacaccgauuagcuuu

SEQ ID NO: 264421 - RNA, 22 nt, Homo sapiens
augcaaggaugguuagauauau

SEQ ID NO: 264422 - RNA, 19 nt, Homo sapiens
augcaaugucacaggcugc

SEQ ID NO: 264423 - RNA, 22 nt, Homo sapiens
augcagaucacauuuuucuguc

SEQ ID NO: 264424 - RNA, 22 nt, Homo sapiens
augcagugugcaacagauuaag

SEQ ID NO: 264425 - RNA, 22 nt, Homo sapiens
augcauaugucuuuauaguggc

SEQ ID NO: 264426 - RNA, 19 nt, Homo sapiens
augccacagugaggucaga

SEQ ID NO: 264427 - RNA, 22 nt, Homo sapiens
augccacugcacuucagccugg

SEQ ID NO: 264428 - RNA, 22 nt, Homo sapiens
augccaguguccagaguggguu

SEQ ID NO: 264429 - RNA, 22 nt, Homo sapiens
augcuuguguuggggcagugga

SEQ ID NO: 264430 - RNA, 21 nt, Homo sapiens
auggaaagacugccucuucaa

SEQ ID NO: 264431 - RNA, 22 nt, Homo sapiens
auggaacauaacuauuugggga

SEQ ID NO: 264432 - RNA, 22 nt, Homo sapiens
auggaauguauagucauguagg

SEQ ID NO: 264433 - RNA, 21 nt, Homo sapiens
auggacaugguuaggcuuugu

SEQ ID NO: 264434 - RNA, 22 nt, Homo sapiens
auggagcaaaacagauuuggga

SEQ ID NO: 264435 - RNA, 22 nt, Homo sapiens
auggauauuuuuugaacauaga

SEQ ID NO: 264436 - RNA, 22 nt, Homo sapiens
auggcaaaauguuccuaguggu

SEQ ID NO: 264437 - RNA, 22 nt, Homo sapiens
auggcacuacugggaaugucuu

SEQ ID NO: 264438 - RNA, 22 nt, Homo sapiens
auggcacuccagccugggcaac

SEQ ID NO: 264439 - RNA, 22 nt, Homo sapiens
auggcacugccuggcuucaugg

SEQ ID NO: 264440 - RNA, 22 nt, Homo sapiens
auggcaguguaugauuauauua

SEQ ID NO: 264441 - RNA, 22 nt, Homo sapiens
auggcuguuuaagaguuucauu

SEQ ID NO: 264442 - RNA, 22 nt, Homo sapiens
auggcuuuaagagugucugaau

SEQ ID NO: 264443 - RNA, 22 nt, Homo sapiens
auggcuuuguguucagagcuga

SEQ ID NO: 264444 - RNA, 22 nt, Homo sapiens
auggcuuuuuaaaucauguugu

SEQ ID NO: 264445 - RNA, 21 nt, Homo sapiens
augggacuaacugaugggucu

SEQ ID NO: 264446 - RNA, 22 nt, Homo sapiens
augggguaggcuuugcugcagu

SEQ ID NO: 264447 - RNA, 22 nt, Homo sapiens
auggucccuguuccaugcuccu

SEQ ID NO: 264448 - RNA, 22 nt, Homo sapiens
auggugugugaauuaaauguua

SEQ ID NO: 264449 - RNA, 22 nt, Homo sapiens
augguugguuaaaucuguguau

SEQ ID NO: 264450 - RNA, 22 nt, Homo sapiens
auguaaacuacagauuuugggu

SEQ ID NO: 264451 - RNA, 21 nt, Homo sapiens
auguaacugggaaugugagag

SEQ ID NO: 264452 - RNA, 22 nt, Homo sapiens
auguaauugagguuuuugccau

SEQ ID NO: 264453 - RNA, 22 nt, Homo sapiens
auguaguauuaaugagagauaa

SEQ ID NO: 264454 - RNA, 22 nt, Homo sapiens
augucugguagccaccuggagg

SEQ ID NO: 264455 - RNA, 22 nt, Homo sapiens
augucuuucauagagacccaga

SEQ ID NO: 264456 - RNA, 22 nt, Homo sapiens
augugaaugugaucggauaguc

SEQ ID NO: 264457 - RNA, 17 nt, Homo sapiens
augugaauguucaaaua

SEQ ID NO: 264458 - RNA, 22 nt, Homo sapiens
augugacuugugaaaaguucag

SEQ ID NO: 264459 - RNA, 22 nt, Homo sapiens
augugacuuuuuccugugccuu

SEQ ID NO: 264460 - RNA, 22 nt, Homo sapiens
augugcagauguuacaaauugu

SEQ ID NO: 264461 - RNA, 22 nt, Homo sapiens
auguggcacuugacuuucucgc

SEQ ID NO: 264462 - RNA, 22 nt, Homo sapiens
auguggcauuucucauucauuu

SEQ ID NO: 264463 - RNA, 22 nt, Homo sapiens
auguggcuuuccuagaucuuag

SEQ ID NO: 264464 - RNA, 22 nt, Homo sapiens
auguggugguagccaggacagg

SEQ ID NO: 264465 - RNA, 23 nt, Homo sapiens
augugguuuuagguguugaacug

SEQ ID NO: 264466 - RNA, 22 nt, Homo sapiens
auguuaacaucuuaguuuucau

SEQ ID NO: 264467 - RNA, 18 nt, Homo sapiens
auguuauguuuguagaag

SEQ ID NO: 264468 - RNA, 22 nt, Homo sapiens
auguuguaguaugagucaaaau

SEQ ID NO: 264469 - RNA, 22 nt, Homo sapiens
auuaagagcacauguucugggu

SEQ ID NO: 264470 - RNA, 22 nt, Homo sapiens
auuaaguaaugguuccaauaau

SEQ ID NO: 264471 - RNA, 22 nt, Homo sapiens
auuaauguaauuaguaaaguug

SEQ ID NO: 264472 - RNA, 22 nt, Homo sapiens
auuacaugucuauccaugaaca

SEQ ID NO: 264473 - RNA, 22 nt, Homo sapiens
auuagaugguuauaggugugag

SEQ ID NO: 264474 - RNA, 22 nt, Homo sapiens
auuagugaaugugaugucuuga

SEQ ID NO: 264475 - RNA, 22 nt, Homo sapiens
auuauauguguaugugcauacc

SEQ ID NO: 264476 - RNA, 22 nt, Homo sapiens
auuauguuguauuuccuugcag

SEQ ID NO: 264477 - RNA, 22 nt, Homo sapiens
ugaguagaacuagucuagagcu

SEQ ID NO: 264478 - RNA, 22 nt, Homo sapiens
ugaguagaacuccuggagaugu

SEQ ID NO: 264479 - RNA, 19 nt, Homo sapiens
ugaguauauuguauucauu

SEQ ID NO: 264480 - RNA, 22 nt, Homo sapiens
ugaguaucuugaugaauuugaa

SEQ ID NO: 264481 - RNA, 22 nt, Homo sapiens
ugaguauguaggaugugucuua

SEQ ID NO: 264482 - RNA, 22 nt, Homo sapiens
ugaguauguuuagaaguaaagg

SEQ ID NO: 264483 - RNA, 23 nt, Homo sapiens
ugagucacuuugcuggggucucu

SEQ ID NO: 264484 - RNA, 22 nt, Homo sapiens
ugagucaugcuggagucauggc

SEQ ID NO: 264485 - RNA, 22 nt, Homo sapiens
ugagucgagauugcgccacugu

SEQ ID NO: 264486 - RNA, 22 nt, Homo sapiens
ugagugaggcugggcagucccu

SEQ ID NO: 264487 - RNA, 22 nt, Homo sapiens
ugaguguccaaguaaggugaaa

SEQ ID NO: 264488 - RNA, 22 nt, Homo sapiens
ugaguguguaugugcauacaca

SEQ ID NO: 264489 - RNA, 22 nt, Homo sapiens
ugaguucuuuguagauucugug

SEQ ID NO: 264490 - RNA, 22 nt, Homo sapiens
ugauaagugagauagcaaguga

SEQ ID NO: 264491 - RNA, 22 nt, Homo sapiens
ugauaggucagaugauauugaa

SEQ ID NO: 264492 - RNA, 22 nt, Homo sapiens
ugauagugccuuuuauaucucu

SEQ ID NO: 264493 - RNA, 22 nt, Homo sapiens
ugauaucugaauagauacacaa

SEQ ID NO: 264494 - RNA, 22 nt, Homo sapiens
ugauaugacagcucugcugcca

SEQ ID NO: 264495 - RNA, 22 nt, Homo sapiens
ugauaugcuuugaacucucugg

SEQ ID NO: 264496 - RNA, 22 nt, Homo sapiens
auugcacuccagccuggugaca

SEQ ID NO: 264497 - RNA, 22 nt, Homo sapiens
auugcacuccagccuugugaca

SEQ ID NO: 264498 - RNA, 22 nt, Homo sapiens
auugcacuccagcuuaggcgac

SEQ ID NO: 264499 - RNA, 22 nt, Homo sapiens
auugcacuccggccugggugac

SEQ ID NO: 264500 - RNA, 18 nt, Homo sapiens
auugcacuccugccuggg

SEQ ID NO: 264501 - RNA, 22 nt, Homo sapiens
auugcacucuagccuuggcgac

SEQ ID NO: 264502 - RNA, 22 nt, Homo sapiens
auugcacugcagccugggcaac

SEQ ID NO: 264503 - RNA, 22 nt, Homo sapiens
auugcaguuucaacuccagggc

SEQ ID NO: 264504 - RNA, 22 nt, Homo sapiens
auugcccaggcuggagugcagu

SEQ ID NO: 264505 - RNA, 22 nt, Homo sapiens
auugcccauaaggauauuguca

SEQ ID NO: 264506 - RNA, 22 nt, Homo sapiens
auugcuuacccuguauuagauc

SEQ ID NO: 264507 - RNA, 22 nt, Homo sapiens
auugcuucugauuuuaaaugag

SEQ ID NO: 264508 - RNA, 22 nt, Homo sapiens
auugcuuuuacugggagcuuug

SEQ ID NO: 264509 - RNA, 22 nt, Homo sapiens
auuggauagucuuuaucuguug

SEQ ID NO: 264510 - RNA, 22 nt, Homo sapiens
auuggccaaugggacgucagca

SEQ ID NO: 264511 - RNA, 18 nt, Homo sapiens
auuguaagauguauggga

SEQ ID NO: 264512 - RNA, 22 nt, Homo sapiens
auuguacuccagccuaggcaac

SEQ ID NO: 264513 - RNA, 21 nt, Homo sapiens
auuguauguaaaccaaaugag

SEQ ID NO: 264514 - RNA, 22 nt, Homo sapiens
auugucacuuaaaagugcaugu

SEQ ID NO: 264515 - RNA, 22 nt, Homo sapiens
auugucauuuucugagaaguaa

SEQ ID NO: 264516 - RNA, 22 nt, Homo sapiens
auuguguuugaaugaggcucca

SEQ ID NO: 264517 - RNA, 22 nt, Homo sapiens
auuuaugguuaauauaggaagu

SEQ ID NO: 264518 - RNA, 22 nt, Homo sapiens
auuuggcaauuuugaagaugcc

SEQ ID NO: 264519 - RNA, 22 nt, Homo sapiens
auuuggcagugaagggaucaca

SEQ ID NO: 264520 - RNA, 22 nt, Homo sapiens
auuuggccuuuguaugcaguau

SEQ ID NO: 264521 - RNA, 21 nt, Homo sapiens
auuugguguuagaaauaaauu

SEQ ID NO: 264522 - RNA, 22 nt, Homo sapiens
auuugucacuuaacagccauua

SEQ ID NO: 264523 - RNA, 22 nt, Homo sapiens
caaaagugauugcgguuuuugc

SEQ ID NO: 264524 - RNA, 22 nt, Homo sapiens
caaaccuguaggggccaagagg

SEQ ID NO: 264525 - RNA, 22 nt, Homo sapiens
caaaguaauugugguuuugcca

SEQ ID NO: 264526 - RNA, 22 nt, Homo sapiens
caaagucuucucauuaugucuu

SEQ ID NO: 264527 - RNA, 22 nt, Homo sapiens
caaagugguuuauacaugauug

SEQ ID NO: 264528 - RNA, 22 nt, Homo sapiens
caaauccucaccucaucaugaa

SEQ ID NO: 264529 - RNA, 22 nt, Homo sapiens
caaauugcuuguggaggauaau

SEQ ID NO: 264530 - RNA, 20 nt, Homo sapiens
caaauugcuuucuugguuuu

SEQ ID NO: 264531 - RNA, 21 nt, Homo sapiens
caagugaugcuucugcuuuaa

SEQ ID NO: 264532 - RNA, 22 nt, Homo sapiens
caagugcuugaugaaugaucaa

SEQ ID NO: 264533 - RNA, 19 nt, Homo sapiens
caauacuucuuggcauaca

SEQ ID NO: 264534 - RNA, 22 nt, Homo sapiens
caauggcaaugaaauagugaga

SEQ ID NO: 264535 - RNA, 21 nt, Homo sapiens
caauggcacgaucuuggcuca

SEQ ID NO: 264536 - RNA, 22 nt, Homo sapiens
caaugugcuuggggcacaugag

SEQ ID NO: 264537 - RNA, 22 nt, Homo sapiens
cacaaugucuaagauguuucua

SEQ ID NO: 264538 - RNA, 22 nt, Homo sapiens
cacaccuaccucauuauggaca

SEQ ID NO: 264539 - RNA, 22 nt, Homo sapiens
cacaccuacuagggccgugggc

SEQ ID NO: 264540 - RNA, 22 nt, Homo sapiens
cacacuguuuuccauggggguu

SEQ ID NO: 264541 - RNA, 22 nt, Homo sapiens
cacagaauucauuggauuaccu

SEQ ID NO: 264542 - RNA, 22 nt, Homo sapiens
cacagcacaggcaugaguguca

SEQ ID NO: 264543 - RNA, 22 nt, Homo sapiens
cacagcuagucaaugguagaca

SEQ ID NO: 264544 - RNA, 22 nt, Homo sapiens
cacaggccugucucuuucuaac

SEQ ID NO: 264545 - RNA, 22 nt, Homo sapiens
cacagugaacaauauccucugu

SEQ ID NO: 264546 - RNA, 22 nt, Homo sapiens
cacagugaaugucaucauugcc

SEQ ID NO: 264547 - RNA, 22 nt, Homo sapiens
cacaguguuacugguaugaagu

SEQ ID NO: 264548 - RNA, 22 nt, Homo sapiens
cacauagucccugcuaaucuuc

SEQ ID NO: 264549 - RNA, 21 nt, Homo sapiens
cacauggaggcagagagugua

SEQ ID NO: 264550 - RNA, 22 nt, Homo sapiens
cacauguuuuagcauggcuguu

SEQ ID NO: 264551 - RNA, 22 nt, Homo sapiens
caccaaccucaguagcaucugu

SEQ ID NO: 264552 - RNA, 22 nt, Homo sapiens
caccagguggcugaggccauga

SEQ ID NO: 264553 - RNA, 22 nt, Homo sapiens
caccagguuggagugcaguggu

SEQ ID NO: 264554 - RNA, 22 nt, Homo sapiens
cacccagucaucuuggguuuuu

SEQ ID NO: 264555 - RNA, 22 nt, Homo sapiens
cacccuugcagggacagcuuug

SEQ ID NO: 264556 - RNA, 22 nt, Homo sapiens
caccuagacuggagugcagugg

SEQ ID NO: 264557 - RNA, 22 nt, Homo sapiens
caccuguagucccagcugaggc

SEQ ID NO: 264558 - RNA, 22 nt, Homo sapiens
cacugcacuccagcuuugguga

SEQ ID NO: 264559 - RNA, 22 nt, Homo sapiens
cacugcacuccagucuggcgac

SEQ ID NO: 264560 - RNA, 22 nt, Homo sapiens
cacugcacuccaguuucgguaa

SEQ ID NO: 264561 - RNA, 22 nt, Homo sapiens
cacugcacucuucuucugggca

SEQ ID NO: 264562 - RNA, 22 nt, Homo sapiens
cacugcauccuccaccugccag

SEQ ID NO: 264563 - RNA, 22 nt, Homo sapiens
uggaauguagcguugacacgag

SEQ ID NO: 264564 - RNA, 22 nt, Homo sapiens
uggaaugucagcuacaagaggg

SEQ ID NO: 264565 - RNA, 22 nt, Homo sapiens
uggaaugucuuuuccccaaagc

SEQ ID NO: 264566 - RNA, 21 nt, Homo sapiens
uggaauguucugacuucaggg

SEQ ID NO: 264567 - RNA, 22 nt, Homo sapiens
uggacacuggagauucgucagu

SEQ ID NO: 264568 - RNA, 22 nt, Homo sapiens
uggacuguaauuuuauaggcau

SEQ ID NO: 264569 - RNA, 22 nt, Homo sapiens
uggagagugauaaguaaaugga

SEQ ID NO: 264570 - RNA, 23 nt, Homo sapiens
uggaggacaagcauggauaguga

SEQ ID NO: 264571 - RNA, 22 nt, Homo sapiens
uggagguagagaugggaucucc

SEQ ID NO: 264572 - RNA, 22 nt, Homo sapiens
uggagucuugaugauuuucaaa

SEQ ID NO: 264573 - RNA, 22 nt, Homo sapiens
uggagucuugcucuguugccca

SEQ ID NO: 264574 - RNA, 21 nt, Homo sapiens
uggagugaagaguuuauugac

SEQ ID NO: 264575 - RNA, 22 nt, Homo sapiens
uggaguguagaagccagccucc

SEQ ID NO: 264576 - RNA, 22 nt, Homo sapiens
uggagugucaguuuccagaguu

SEQ ID NO: 264577 - RNA, 22 nt, Homo sapiens
uggaguguguugcagaugaagg

SEQ ID NO: 264578 - RNA, 22 nt, Homo sapiens
uggauugaaagcuuuaauauug

SEQ ID NO: 264579 - RNA, 22 nt, Homo sapiens
uggauuuuaauuauucugucau

SEQ ID NO: 264580 - RNA, 22 nt, Homo sapiens
uggcaaaauauuuugguuucug

SEQ ID NO: 264581 - RNA, 21 nt, Homo sapiens
uggcaaaaugggcaguggguu

SEQ ID NO: 264582 - RNA, 22 nt, Homo sapiens
uggcaaaugaagucagcuguac

SEQ ID NO: 264583 - RNA, 21 nt, Homo sapiens
uggcaacauggauggauucug

SEQ ID NO: 264584 - RNA, 22 nt, Homo sapiens
uggcaagaaccacaguuacuuu

SEQ ID NO: 264585 - RNA, 22 nt, Homo sapiens
uggcaagagauaugugucuaua

SEQ ID NO: 264586 - RNA, 22 nt, Homo sapiens
caggcagugggagacaaaacug

SEQ ID NO: 264587 - RNA, 22 nt, Homo sapiens
caggcauuguauuguaaucccc

SEQ ID NO: 264588 - RNA, 22 nt, Homo sapiens
cagguacauuuuaaagggcuca

SEQ ID NO: 264589 - RNA, 22 nt, Homo sapiens
caggugcuuacuuaauagccau

SEQ ID NO: 264590 - RNA, 22 nt, Homo sapiens
caggugguauuugguuuucugu

SEQ ID NO: 264591 - RNA, 22 nt, Homo sapiens
caguacaauguugauuagaagu

SEQ ID NO: 264592 - RNA, 22 nt, Homo sapiens
caguaguagccccuuagaugga

SEQ ID NO: 264593 - RNA, 22 nt, Homo sapiens
cagugcaaagccucugcccaga

SEQ ID NO: 264594 - RNA, 20 nt, Homo sapiens
cagugcacuuucccacuggu

SEQ ID NO: 264595 - RNA, 22 nt, Homo sapiens
cagugcuuguuauuguucuauu

SEQ ID NO: 264596 - RNA, 22 nt, Homo sapiens
caguucaugguaggcaccauag

SEQ ID NO: 264597 - RNA, 22 nt, Homo sapiens
caguuguuuuaugacauaagau

SEQ ID NO: 264598 - RNA, 18 nt, Homo sapiens
cauagcacuucagcacau

SEQ ID NO: 264599 - RNA, 22 nt, Homo sapiens
cauaguacuugcauaguacuau

SEQ ID NO: 264600 - RNA, 22 nt, Homo sapiens
caucaaaguggagggaaggacc

SEQ ID NO: 264601 - RNA, 21 nt, Homo sapiens
caucaaauugucauggugggu

SEQ ID NO: 264602 - RNA, 22 nt, Homo sapiens
caucacaugcuuauuuuccuca

SEQ ID NO: 264603 - RNA, 22 nt, Homo sapiens
caucacuuugccuccgucucua

SEQ ID NO: 264604 - RNA, 22 nt, Homo sapiens
caucagauugagaucaucuaag

SEQ ID NO: 264605 - RNA, 22 nt, Homo sapiens
caucagcaauguaugaggguuc

SEQ ID NO: 264606 - RNA, 19 nt, Homo sapiens
caucccugagcugaagugg

SEQ ID NO: 264607 - RNA, 22 nt, Homo sapiens
caucgcacuccagcuugggcaa

SEQ ID NO: 264608 - RNA, 19 nt, Homo sapiens
caugccacugcacuugagu

SEQ ID NO: 264609 - RNA, 22 nt, Homo sapiens
cauggcucuuguuuacucccag

SEQ ID NO: 264610 - RNA, 23 nt, Homo sapiens
cauggcuguuaacacuguuugag

SEQ ID NO: 264611 - RNA, 21 nt, Homo sapiens
caugucacugcacucuagccu

SEQ ID NO: 264612 - RNA, 22 nt, Homo sapiens
caugugcaugagcacauacgug

SEQ ID NO: 264613 - RNA, 22 nt, Homo sapiens
caugugcaugcuuucuuaugug

SEQ ID NO: 264614 - RNA, 22 nt, Homo sapiens
cauuaguugaagugcagggaga

SEQ ID NO: 264615 - RNA, 22 nt, Homo sapiens
cauuccacuggauaaacaaggu

SEQ ID NO: 264616 - RNA, 22 nt, Homo sapiens
cauugcaacuucugccucccag

SEQ ID NO: 264617 - RNA, 22 nt, Homo sapiens
cauugcaauccagccugggcaa

SEQ ID NO: 264618 - RNA, 19 nt, Homo sapiens
cauugcacuccacccuggg

SEQ ID NO: 264619 - RNA, 22 nt, Homo sapiens
cauugcacuccagccugaggga

SEQ ID NO: 264620 - RNA, 22 nt, Homo sapiens
cauugcacuccagcuugggcaa

SEQ ID NO: 264621 - RNA, 22 nt, Homo sapiens
cauugcacuccaucuugggcaa

SEQ ID NO: 264622 - RNA, 22 nt, Homo sapiens
cauugcagauccuucaaaugac

SEQ ID NO: 264623 - RNA, 22 nt, Homo sapiens
cauugcauuccagucugggcaa

SEQ ID NO: 264624 - RNA, 22 nt, Homo sapiens
cauugucccucaaugucuauga

SEQ ID NO: 264625 - RNA, 22 nt, Homo sapiens
ccaaaguauuuucacugauauc

SEQ ID NO: 264626 - RNA, 22 nt, Homo sapiens
ccaagccucaguuucccucugu

SEQ ID NO: 264627 - RNA, 22 nt, Homo sapiens
ccaaguguucucauuguucaau

SEQ ID NO: 264628 - RNA, 19 nt, Homo sapiens
ccacaaugguugaacuaga

SEQ ID NO: 264629 - RNA, 22 nt, Homo sapiens
ccacccuggagaauuugagguc

SEQ ID NO: 264630 - RNA, 22 nt, Homo sapiens
ccacugggcuagguguuuugga

SEQ ID NO: 264631 - RNA, 22 nt, Homo sapiens
ccagcaccauuuguugaauagg

SEQ ID NO: 264632 - RNA, 22 nt, Homo sapiens
ccagccgggugcaguggcucac

SEQ ID NO: 264633 - RNA, 22 nt, Homo sapiens
ccagugcugugcaguguaugag

SEQ ID NO: 264634 - RNA, 22 nt, Homo sapiens
ccaguguucuggaaggcugagu

SEQ ID NO: 264635 - RNA, 22 nt, Homo sapiens
ccaguuuucaagauaaugguuu

SEQ ID NO: 264636 - RNA, 20 nt, Homo sapiens
ccaucaguccucucuuguuc

SEQ ID NO: 264637 - RNA, 19 nt, Homo sapiens
ccauggcaaugaucugaug

SEQ ID NO: 264638 - RNA, 21 nt, Homo sapiens
ccaugggacggaaugaauaca

SEQ ID NO: 264639 - RNA, 23 nt, Homo sapiens
ccauugcacuccagccucaguga

SEQ ID NO: 264640 - RNA, 18 nt, Homo sapiens
cccagugacuuauggccu

SEQ ID NO: 264641 - RNA, 22 nt, Homo sapiens
cccagugugcugggugacagcu

SEQ ID NO: 264642 - RNA, 22 nt, Homo sapiens
ccccaguguguaaaggccuugc

SEQ ID NO: 264643 - RNA, 20 nt, Homo sapiens
ccccaguuuuucuauuagcu

SEQ ID NO: 264644 - RNA, 17 nt, Homo sapiens
cccuaguagcugggacu

SEQ ID NO: 264645 - RNA, 23 nt, Homo sapiens
cccucagaagugcagggagagaa

SEQ ID NO: 264646 - RNA, 22 nt, Homo sapiens
cccucauucauucauccuaugu

SEQ ID NO: 264647 - RNA, 22 nt, Homo sapiens
cccugagaaaacuuuguccuua

SEQ ID NO: 264648 - RNA, 22 nt, Homo sapiens
cccugagagcagggucuuucuc

SEQ ID NO: 264649 - RNA, 22 nt, Homo sapiens
ugucacaguuuguacuuuauag

SEQ ID NO: 264650 - RNA, 22 nt, Homo sapiens
ugucacccuuuauccauuuccu

SEQ ID NO: 264651 - RNA, 22 nt, Homo sapiens
ugucagcacaacucagguuccu

SEQ ID NO: 264652 - RNA, 22 nt, Homo sapiens
ugucaguguacuguaagaauua

SEQ ID NO: 264653 - RNA, 22 nt, Homo sapiens
ugucauagauugcuuggaaaaa

SEQ ID NO: 264654 - RNA, 22 nt, Homo sapiens
ugucaugugagggaacuuguuc

SEQ ID NO: 264655 - RNA, 22 nt, Homo sapiens
ugucauguugguguacugcacc

SEQ ID NO: 264656 - RNA, 22 nt, Homo sapiens
ugucauguuucuacugaccaaa

SEQ ID NO: 264657 - RNA, 19 nt, Homo sapiens
ugucccagccauagaggca

SEQ ID NO: 264658 - RNA, 22 nt, Homo sapiens
uguccuagagggaugucacccc

SEQ ID NO: 264659 - RNA, 22 nt, Homo sapiens
uguccugaagcuuuguuaugua

SEQ ID NO: 264660 - RNA, 22 nt, Homo sapiens
ugucuaguuuugaaguauagca

SEQ ID NO: 264661 - RNA, 22 nt, Homo sapiens
ugucucaguucccuucucugga

SEQ ID NO: 264662 - RNA, 22 nt, Homo sapiens
ugucucaguuucuguggguuag

SEQ ID NO: 264663 - RNA, 22 nt, Homo sapiens
ugucuuuguuaguuguccuagu

SEQ ID NO: 264664 - RNA, 22 nt, Homo sapiens
ugugaaaucagauagccuuuuu

SEQ ID NO: 264665 - RNA, 22 nt, Homo sapiens
ugugaaauguuaucccgucgug

SEQ ID NO: 264666 - RNA, 22 nt, Homo sapiens
ugugaagaugagaugacgcccu

SEQ ID NO: 264667 - RNA, 22 nt, Homo sapiens
ugugacacugaauggcagaacu

SEQ ID NO: 264668 - RNA, 22 nt, Homo sapiens
ugugacugguugucccgcuuuc

SEQ ID NO: 264669 - RNA, 22 nt, Homo sapiens
ugugaguguguacuaguuauca

SEQ ID NO: 264670 - RNA, 22 nt, Homo sapiens
ugugaucauuucaggaauuuug

SEQ ID NO: 264671 - RNA, 22 nt, Homo sapiens
ugugaugaagaguccaagaaca

SEQ ID NO: 264672 - RNA, 22 nt, Homo sapiens
ugugauggaguuucauggacug

SEQ ID NO: 264673 - RNA, 22 nt, Homo sapiens
ugugaugugaugagaaguuccu

SEQ ID NO: 264674 - RNA, 22 nt, Homo sapiens
ugugauguggagggcagaucca

SEQ ID NO: 264675 - RNA, 22 nt, Homo sapiens
ugugauuauuuauagacaguca

SEQ ID NO: 264676 - RNA, 23 nt, Homo sapiens
gugccuucugagccuagucucca

SEQ ID NO: 264677 - RNA, 21 nt, Homo sapiens
gugcuuguagccucacuucug

SEQ ID NO: 264678 - RNA, 22 nt, Homo sapiens
guggaaaauuauugcuguuuuu

SEQ ID NO: 264679 - RNA, 22 nt, Homo sapiens
guggaaagaacacaaaauuagg

SEQ ID NO: 264680 - RNA, 22 nt, Homo sapiens
guggaaaucucugugugacuua

SEQ ID NO: 264681 - RNA, 22 nt, Homo sapiens
guggaagguaaugcagcuuacu

SEQ ID NO: 264682 - RNA, 20 nt, Homo sapiens
guggaaguagaaacauaugu

SEQ ID NO: 264683 - RNA, 22 nt, Homo sapiens
guggaaguguaaaagcucuugg

SEQ ID NO: 264684 - RNA, 22 nt, Homo sapiens
guggaaucuagagaggcaguag

SEQ ID NO: 264685 - RNA, 17 nt, Homo sapiens
guggaaugucaugucaa

SEQ ID NO: 264686 - RNA, 22 nt, Homo sapiens
gugggaugaucacaguucacug

SEQ ID NO: 264687 - RNA, 22 nt, Homo sapiens
gugggauggagagaagguauga

SEQ ID NO: 264688 - RNA, 22 nt, Homo sapiens
gugggcaaagcuaguguguaga

SEQ ID NO: 264689 - RNA, 22 nt, Homo sapiens
gugggcaagucacuucaguucu

SEQ ID NO: 264690 - RNA, 22 nt, Homo sapiens
gugggguagcaggcuccuaucu

SEQ ID NO: 264691 - RNA, 22 nt, Homo sapiens
guggguaaaucucuguuugagg

SEQ ID NO: 264692 - RNA, 22 nt, Homo sapiens
gugguaggaaagugcaaaugua

SEQ ID NO: 264693 - RNA, 22 nt, Homo sapiens
guguaaaucaaucuguugucuu

SEQ ID NO: 264694 - RNA, 20 nt, Homo sapiens
guguaagagcaagcuuccua

SEQ ID NO: 264695 - RNA, 22 nt, Homo sapiens
guguaauaaucguggacuaugu

SEQ ID NO: 264696 - RNA, 22 nt, Homo sapiens
guguauucaucuggcugaggua

SEQ ID NO: 264697 - RNA, 22 nt, Homo sapiens
gugucacagcuuccaucucggu

SEQ ID NO: 264698 - RNA, 22 nt, Homo sapiens
gugucaugggcauguccuuaac

SEQ ID NO: 264699 - RNA, 22 nt, Homo sapiens
gugucccagugugcauacaggu

SEQ ID NO: 264700 - RNA, 22 nt, Homo sapiens
guguccucgaguacacaucagg

SEQ ID NO: 264701 - RNA, 22 nt, Homo sapiens
gugugaacaucauagaguguau

SEQ ID NO: 264702 - RNA, 22 nt, Homo sapiens
gugugcaaauguguaccuacau

SEQ ID NO: 264703 - RNA, 22 nt, Homo sapiens
gugugcauggagggggcaguga

SEQ ID NO: 264704 - RNA, 22 nt, Homo sapiens
guguggcaggugggggcucaga

SEQ ID NO: 264705 - RNA, 22 nt, Homo sapiens
guguuauugagaaauagggugu

SEQ ID NO: 264706 - RNA, 22 nt, Homo sapiens
guguuauuuugcugggaaugau

SEQ ID NO: 264707 - RNA, 22 nt, Homo sapiens
guguucaaacccaggucugucu

SEQ ID NO: 264708 - RNA, 22 nt, Homo sapiens
guguucaaauucugacagagag

SEQ ID NO: 264709 - RNA, 22 nt, Homo sapiens
guuacugucuuccugauugcuu

SEQ ID NO: 264710 - RNA, 22 nt, Homo sapiens
guuauggaguauaugugaacug

SEQ ID NO: 264711 - RNA, 22 nt, Homo sapiens
guucaagcaauucugcugccuc

SEQ ID NO: 264712 - RNA, 22 nt, Homo sapiens
guucacacuugcaaccccagca

SEQ ID NO: 264713 - RNA, 22 nt, Homo sapiens
guucaucagggauacuggcuua

SEQ ID NO: 264714 - RNA, 20 nt, Homo sapiens
guucauguaauuaguucagg

SEQ ID NO: 264715 - RNA, 22 nt, Homo sapiens
guuccuuguagaugcuggauau

SEQ ID NO: 264716 - RNA, 20 nt, Homo sapiens
guucuugcucguguaucuuc

SEQ ID NO: 264717 - RNA, 17 nt, Homo sapiens
guugaguuugagucaag

SEQ ID NO: 264718 - RNA, 22 nt, Homo sapiens
guugcucaggcuggagugcagu

SEQ ID NO: 264719 - RNA, 22 nt, Homo sapiens
guugggcccauagacugccagu

SEQ ID NO: 264720 - RNA, 22 nt, Homo sapiens
guugguuuccuguaacuggaca

SEQ ID NO: 264721 - RNA, 22 nt, Homo sapiens
guuguauaggcauggggagaau

SEQ ID NO: 264722 - RNA, 16 nt, Homo sapiens
acaaagcuggcuaucu

SEQ ID NO: 264723 - RNA, 22 nt, Homo sapiens
acaaaguaggcagugggcugga

SEQ ID NO: 264724 - RNA, 22 nt, Homo sapiens
acaagcacaaaugcauagaugg

SEQ ID NO: 264725 - RNA, 22 nt, Homo sapiens
acacauacacauaugguguaua

SEQ ID NO: 264726 - RNA, 22 nt, Homo sapiens
acacaugugaaaaaaauguuac

SEQ ID NO: 264727 - RNA, 22 nt, Homo sapiens
acacaugugcguagacucuuua

SEQ ID NO: 264728 - RNA, 22 nt, Homo sapiens
aagcacccuuugucuggacaug

SEQ ID NO: 264729 - RNA, 22 nt, Homo sapiens
aagcagacauguucauuuugaa

SEQ ID NO: 264730 - RNA, 22 nt, Homo sapiens
aagcaucauuuggaauuugaga

SEQ ID NO: 264731 - RNA, 20 nt, Homo sapiens
aagcauggguuuuaggguca

SEQ ID NO: 264732 - RNA, 22 nt, Homo sapiens
aagcuacauuuuauuuauguca

SEQ ID NO: 264733 - RNA, 22 nt, Homo sapiens
aagcucuuguugaaucuuguca

SEQ ID NO: 264734 - RNA, 22 nt, Homo sapiens
aagcugccuugugaaggcauuc

SEQ ID NO: 264735 - RNA, 22 nt, Homo sapiens
aagcuggagugcaguggugcaa

SEQ ID NO: 264736 - RNA, 22 nt, Homo sapiens
aagcuggauuuaguguggagca

SEQ ID NO: 264737 - RNA, 22 nt, Homo sapiens
aagcuggauuucgcauccuguu

SEQ ID NO: 264738 - RNA, 22 nt, Homo sapiens
aagcugugucuugucagcuacc

SEQ ID NO: 264739 - RNA, 22 nt, Homo sapiens
aaggaguagacaacauggcgcc

SEQ ID NO: 264740 - RNA, 22 nt, Homo sapiens
aaggaguauugaaugaccaagu

SEQ ID NO: 264741 - RNA, 22 nt, Homo sapiens
aaggagugugauucuucaguuu

SEQ ID NO: 264742 - RNA, 22 nt, Homo sapiens
aaggcaacgugaguuguugauu

SEQ ID NO: 264743 - RNA, 22 nt, Homo sapiens
aaggcaagaaugcgugcuuuca

SEQ ID NO: 264744 - RNA, 22 nt, Homo sapiens
aaggcacugaacuuaaauucug

SEQ ID NO: 264745 - RNA, 22 nt, Homo sapiens
aaggcagucacuaaauagugag

SEQ ID NO: 264746 - RNA, 22 nt, Homo sapiens
aaggcaugcaaagaacauuuua

SEQ ID NO: 264747 - RNA, 22 nt, Homo sapiens
aaggcauucucaaacuaguucu

SEQ ID NO: 264748 - RNA, 22 nt, Homo sapiens
aaggcgguguggauccuacagc

SEQ ID NO: 264749 - RNA, 23 nt, Homo sapiens
aagguaagcuagaaagauguaga

SEQ ID NO: 264750 - RNA, 22 nt, Homo sapiens
aagguaguuagaaaauauaacu

SEQ ID NO: 264751 - RNA, 17 nt, Homo sapiens
aaggugcuucgaccucc

SEQ ID NO: 264752 - RNA, 18 nt, Homo sapiens
aaggugcuucuguucuga

SEQ ID NO: 264753 - RNA, 21 nt, Homo sapiens
aaggugguggugauugagaug

SEQ ID NO: 264754 - RNA, 22 nt, Homo sapiens
aagguguagucucuggauaagc

SEQ ID NO: 264755 - RNA, 22 nt, Homo sapiens
aaguaauggaguuauuuuauga

SEQ ID NO: 264756 - RNA, 22 nt, Homo sapiens
aaguagcagaggcaagacuuga

SEQ ID NO: 264757 - RNA, 22 nt, Homo sapiens
aaguagcuggaugcaguggcac

SEQ ID NO: 264758 - RNA, 22 nt, Homo sapiens
aaguauuaagacuaagaggcuu

SEQ ID NO: 264759 - RNA, 22 nt, Homo sapiens
aaguauuaugaguccuuguuuu

SEQ ID NO: 264760 - RNA, 22 nt, Homo sapiens
aagugacauugugcccauuuga

SEQ ID NO: 264761 - RNA, 22 nt, Homo sapiens
aagugacuagacuaugaaaccu

SEQ ID NO: 264762 - RNA, 22 nt, Homo sapiens
aagugccauguggaugggcccu

SEQ ID NO: 264763 - RNA, 22 nt, Homo sapiens
aagugcuggccuacucaaucga

SEQ ID NO: 264764 - RNA, 22 nt, Homo sapiens
aagugcuuacagggaacaugau

SEQ ID NO: 264765 - RNA, 22 nt, Homo sapiens
aagugcuuaggauagugugugg

SEQ ID NO: 264766 - RNA, 22 nt, Homo sapiens
aagugcuuuacacaugcaugau

SEQ ID NO: 264767 - RNA, 22 nt, Homo sapiens
aagugcuuuguacagggguuga

SEQ ID NO: 264768 - RNA, 23 nt, Homo sapiens
aaguucaugcucaucuguuacac

SEQ ID NO: 264769 - RNA, 22 nt, Homo sapiens
aaguugcuuuagguaagucaau

SEQ ID NO: 264770 - RNA, 22 nt, Homo sapiens
aaguugguguaugagacagaag

SEQ ID NO: 264771 - RNA, 21 nt, Homo sapiens
aauaaagcaaccuuaugccau

SEQ ID NO: 264772 - RNA, 22 nt, Homo sapiens
aauaaagcagcuuuuugggacu

SEQ ID NO: 264773 - RNA, 22 nt, Homo sapiens
aauaaagcaggguccuugcacu

SEQ ID NO: 264774 - RNA, 22 nt, Homo sapiens
aauaaagcauggcuacuccaua

SEQ ID NO: 264775 - RNA, 22 nt, Homo sapiens
aauaaagcuuugagcuuugcug

SEQ ID NO: 264776 - RNA, 20 nt, Homo sapiens
aauaacagccccagggaggu

SEQ ID NO: 264777 - RNA, 22 nt, Homo sapiens
aauaagcauaguaccugauagg

SEQ ID NO: 264778 - RNA, 22 nt, Homo sapiens
aauacagcacacagaugggucu

SEQ ID NO: 264779 - RNA, 22 nt, Homo sapiens
aauacugagaugugagguacua

SEQ ID NO: 264780 - RNA, 22 nt, Homo sapiens
aauacuggcacugaagaccaug

SEQ ID NO: 264781 - RNA, 22 nt, Homo sapiens
aauagugcugugcagugagugg

SEQ ID NO: 264782 - RNA, 22 nt, Homo sapiens
aauaucacaguggguguacacc

SEQ ID NO: 264783 - RNA, 22 nt, Homo sapiens
aauaugucuugaaauuggguaa

SEQ ID NO: 264784 - RNA, 22 nt, Homo sapiens
aauauugucaaaauggauucca

SEQ ID NO: 264785 - RNA, 22 nt, Homo sapiens
aaucaccaugcacuacagccuu

SEQ ID NO: 264786 - RNA, 22 nt, Homo sapiens
aaucagagcccucugagcuuca

SEQ ID NO: 264787 - RNA, 22 nt, Homo sapiens
aaucagcacacugugcuuucca

SEQ ID NO: 264788 - RNA, 22 nt, Homo sapiens
aaucucagagauaucugugucc

SEQ ID NO: 264789 - RNA, 22 nt, Homo sapiens
aaucuguagaaggugcacauuc

SEQ ID NO: 264790 - RNA, 22 nt, Homo sapiens
aaucugucaguuuuguguuaau

SEQ ID NO: 264791 - RNA, 22 nt, Homo sapiens
aaugacacugagcaucuuucau

SEQ ID NO: 264792 - RNA, 17 nt, Homo sapiens
aaugagacauuucugcu

SEQ ID NO: 264793 - RNA, 22 nt, Homo sapiens
aaugcauaauuuguaugaggua

SEQ ID NO: 264794 - RNA, 22 nt, Homo sapiens
aaugccaucagagaaaacucuu

SEQ ID NO: 264795 - RNA, 22 nt, Homo sapiens
aaugcuaucuggaacauuguug

SEQ ID NO: 264796 - RNA, 22 nt, Homo sapiens
aaugcuguucuuugcuuaaguu

SEQ ID NO: 264797 - RNA, 22 nt, Homo sapiens
aauggagcugaguggccuuggg

SEQ ID NO: 264798 - RNA, 22 nt, Homo sapiens
aauggcaagagccacagaggcg

SEQ ID NO: 264799 - RNA, 22 nt, Homo sapiens
aauggcaucuacguuaaauguc

SEQ ID NO: 264800 - RNA, 22 nt, Homo sapiens
aauggcuauuucaugugguagg

SEQ ID NO: 264801 - RNA, 22 nt, Homo sapiens
aaugguuuuaucagcguccaaa

SEQ ID NO: 264802 - RNA, 22 nt, Homo sapiens
aaugucacugugguccuccagu

SEQ ID NO: 264803 - RNA, 22 nt, Homo sapiens
aaugucaugaguccaaccagaa

SEQ ID NO: 264804 - RNA, 22 nt, Homo sapiens
aaugugcuuugaaaagagcuga

SEQ ID NO: 264805 - RNA, 22 nt, Homo sapiens
aauguguuuugaaaucaggaag

SEQ ID NO: 264806 - RNA, 22 nt, Homo sapiens
aauuaggcuagaauguuauuaa

SEQ ID NO: 264807 - RNA, 22 nt, Homo sapiens
aauuaguaaccuaauuccaucu

SEQ ID NO: 264808 - RNA, 22 nt, Homo sapiens
aauuaguugaaagucugcuuuu

SEQ ID NO: 264809 - RNA, 22 nt, Homo sapiens
aauuaguuggcugggugcggug

SEQ ID NO: 264810 - RNA, 22 nt, Homo sapiens
aauugcacuggaaguaacugag

SEQ ID NO: 264811 - RNA, 23 nt, Homo sapiens
aauugcuuuugaggacuuaguug

SEQ ID NO: 264812 - RNA, 22 nt, Homo sapiens
aauuguacucccaucauuccua

SEQ ID NO: 264813 - RNA, 22 nt, Homo sapiens
acaaagcuagggaauccaucuu

SEQ ID NO: 264814 - RNA, 22 nt, Homo sapiens
aggauacugguaugggcugaau

SEQ ID NO: 264815 - RNA, 21 nt, Homo sapiens
aggcaaaugaagcagccgcuc

SEQ ID NO: 264816 - RNA, 22 nt, Homo sapiens
aggcaaaugccagcaaucacac

SEQ ID NO: 264817 - RNA, 22 nt, Homo sapiens
aggcaagugggagacagcauuu

SEQ ID NO: 264818 - RNA, 22 nt, Homo sapiens
aggcaggugaaagauaguuuua

SEQ ID NO: 264819 - RNA, 22 nt, Homo sapiens
aggcauggagacuaaaauuaua

SEQ ID NO: 264820 - RNA, 22 nt, Homo sapiens
aggcaugugugcagacugucug

SEQ ID NO: 264821 - RNA, 20 nt, Homo sapiens
aggcauguugguuugcgugu

SEQ ID NO: 264822 - RNA, 22 nt, Homo sapiens
aggcuagacuuugagaauuuuu

SEQ ID NO: 264823 - RNA, 22 nt, Homo sapiens
aggcugguauuuacaaaagcuc

SEQ ID NO: 264824 - RNA, 22 nt, Homo sapiens
aggcuguguggauaauauuggg

SEQ ID NO: 264825 - RNA, 22 nt, Homo sapiens
aggcuuguuuuacuaacuggua

SEQ ID NO: 264826 - RNA, 22 nt, Homo sapiens
agggcaguguuaggacugucug

SEQ ID NO: 264827 - RNA, 22 nt, Homo sapiens
agguaaacauggggacugcuac

SEQ ID NO: 264828 - RNA, 22 nt, Homo sapiens
agguaagaugugacuugguguu

SEQ ID NO: 264829 - RNA, 20 nt, Homo sapiens
agguagauagaugauagaua

SEQ ID NO: 264830 - RNA, 22 nt, Homo sapiens
aggugaaugcucacauucuaau

SEQ ID NO: 264831 - RNA, 22 nt, Homo sapiens
aggugaauggauaaacuguggg

SEQ ID NO: 264832 - RNA, 22 nt, Homo sapiens
aggugcuugaaucuaugagcuc

SEQ ID NO: 264833 - RNA, 22 nt, Homo sapiens
agguuguguuugugauuagaua

SEQ ID NO: 264834 - RNA, 22 nt, Homo sapiens
aguaaagcaucagcuagaugug

SEQ ID NO: 264835 - RNA, 22 nt, Homo sapiens
aguaaagcuacucacugugggc

SEQ ID NO: 264836 - RNA, 22 nt, Homo sapiens
aguaaauuucugugcuuucaua

SEQ ID NO: 264837 - RNA, 22 nt, Homo sapiens
aguaacacaccugcauggugug

SEQ ID NO: 264838 - RNA, 22 nt, Homo sapiens
aguaacaggauccaaagaaugu

SEQ ID NO: 264839 - RNA, 22 nt, Homo sapiens
aguaccauuacucacuuauuuu

SEQ ID NO: 264840 - RNA, 22 nt, Homo sapiens
aguacugucugguuaccugaca

SEQ ID NO: 264841 - RNA, 22 nt, Homo sapiens
aguagcaauggcucugagcuau

SEQ ID NO: 264842 - RNA, 22 nt, Homo sapiens
aguagcacaugccacccugucu

SEQ ID NO: 264843 - RNA, 22 nt, Homo sapiens
agucaaggaggccuuucagaug

SEQ ID NO: 264844 - RNA, 22 nt, Homo sapiens
agucagugcauaagaaugaagu

SEQ ID NO: 264845 - RNA, 22 nt, Homo sapiens
agucagugucuguaaggagaac

SEQ ID NO: 264846 - RNA, 22 nt, Homo sapiens
agucaguguguauugauggcac

SEQ ID NO: 264847 - RNA, 22 nt, Homo sapiens
agucauggaucacaguagccuc

SEQ ID NO: 264848 - RNA, 22 nt, Homo sapiens
agucauuguugagaugguguca

SEQ ID NO: 264849 - RNA, 22 nt, Homo sapiens
aguccagguuuuguaauggcaa

SEQ ID NO: 264850 - RNA, 22 nt, Homo sapiens
aguccaguguuaugaucaguag

SEQ ID NO: 264851 - RNA, 22 nt, Homo sapiens
agugcaauggcgugaucuuggc

SEQ ID NO: 264852 - RNA, 22 nt, Homo sapiens
agugcaguggcacaaucuuggc

SEQ ID NO: 264853 - RNA, 22 nt, Homo sapiens
agugcagugguuaggagccagg

SEQ ID NO: 264854 - RNA, 22 nt, Homo sapiens
agugcaguugucacgugccuuc

SEQ ID NO: 264855 - RNA, 22 nt, Homo sapiens
agugccauggcugcuagauggc

SEQ ID NO: 264856 - RNA, 22 nt, Homo sapiens
agugucaggagacagguagcug

SEQ ID NO: 264857 - RNA, 22 nt, Homo sapiens
aguguuuuuaacaagaaagggu

SEQ ID NO: 264858 - RNA, 21 nt, Homo sapiens
aguucacauggcuccuguguu

SEQ ID NO: 264859 - RNA, 22 nt, Homo sapiens
aguugcaagucuugaguaaaga

SEQ ID NO: 264860 - RNA, 22 nt, Homo sapiens
auaaacagcuuauccucuauuc

SEQ ID NO: 264861 - RNA, 22 nt, Homo sapiens
uauuccauuugugaaaggaagu

SEQ ID NO: 264862 - RNA, 22 nt, Homo sapiens
uauugacauuacagugggucuu

SEQ ID NO: 264863 - RNA, 22 nt, Homo sapiens
uauugauuaauugugauuaggc

SEQ ID NO: 264864 - RNA, 22 nt, Homo sapiens
uauugcauauuauucuaguggc

SEQ ID NO: 264865 - RNA, 22 nt, Homo sapiens
uauugcccugcuuuguucuaaa

SEQ ID NO: 264866 - RNA, 22 nt, Homo sapiens
uauugccuugccuacuuuucca

SEQ ID NO: 264867 - RNA, 22 nt, Homo sapiens
uauugcuuuacucucuuauccu

SEQ ID NO: 264868 - RNA, 22 nt, Homo sapiens
uauugucacuaaaggaagcugg

SEQ ID NO: 264869 - RNA, 22 nt, Homo sapiens
uauuugauugacuuuagcagga

SEQ ID NO: 264870 - RNA, 22 nt, Homo sapiens
uauuugguuggugcaaaaguaa

SEQ ID NO: 264871 - RNA, 22 nt, Homo sapiens
ucaaaaccucagagaguagagc

SEQ ID NO: 264872 - RNA, 20 nt, Homo sapiens
ucaaagacauggcugucaga

SEQ ID NO: 264873 - RNA, 22 nt, Homo sapiens
ucaaaguaaagccucaggaugg

SEQ ID NO: 264874 - RNA, 18 nt, Homo sapiens
ucaaauacuuugggcagu

SEQ ID NO: 264875 - RNA, 22 nt, Homo sapiens
ucaaaugcucuuugcagagagg

SEQ ID NO: 264876 - RNA, 21 nt, Homo sapiens
ucaacccuugcgucaccaagc

SEQ ID NO: 264877 - RNA, 22 nt, Homo sapiens
ucaacguauuuauauagcagag

SEQ ID NO: 264878 - RNA, 22 nt, Homo sapiens
ucaagcaauucuccugccucag

SEQ ID NO: 264879 - RNA, 22 nt, Homo sapiens
ucaaggacucagagagggauua

SEQ ID NO: 264880 - RNA, 22 nt, Homo sapiens
ucaaggcaguggccuuccuucu

SEQ ID NO: 264881 - RNA, 22 nt, Homo sapiens
ucaaguacugccuugcucuggc

SEQ ID NO: 264882 - RNA, 22 nt, Homo sapiens
ucaagugauucuugugccuuag

SEQ ID NO: 264883 - RNA, 22 nt, Homo sapiens
ucacaagcuccugccuuugcuu

SEQ ID NO: 264884 - RNA, 22 nt, Homo sapiens
ucacaagugagaggaauuagau

SEQ ID NO: 264885 - RNA, 22 nt, Homo sapiens
ucacaaguguauagacaugucc

SEQ ID NO: 264886 - RNA, 22 nt, Homo sapiens
ucacaauggagacucgggcgga

SEQ ID NO: 264887 - RNA, 22 nt, Homo sapiens
ucacaccauucuucuacuucag

SEQ ID NO: 264888 - RNA, 22 nt, Homo sapiens
ucacacucucaccaacauuugg

SEQ ID NO: 264889 - RNA, 22 nt, Homo sapiens
ucacacugcaucuguuggaauu

SEQ ID NO: 264890 - RNA, 23 nt, Homo sapiens
ucacacuuaagagaaaugcagcu

SEQ ID NO: 264891 - RNA, 22 nt, Homo sapiens
ucacagaggagaagaccuuuaa

SEQ ID NO: 264892 - RNA, 22 nt, Homo sapiens
ucacagaugaggcgagaggcag

SEQ ID NO: 264893 - RNA, 22 nt, Homo sapiens
ucacagcuaaaaugaaaguagu

SEQ ID NO: 264894 - RNA, 22 nt, Homo sapiens
ucacaggguguuauuagaauua

SEQ ID NO: 264895 - RNA, 22 nt, Homo sapiens
ucacaguaaauccagaagaaau

SEQ ID NO: 264896 - RNA, 22 nt, Homo sapiens
ucacaguaucaugggggacaga

SEQ ID NO: 264897 - RNA, 22 nt, Homo sapiens
ucacaguauucaugaacaugga

SEQ ID NO: 264898 - RNA, 22 nt, Homo sapiens
ucacaguguuaaaccuuucuuu

SEQ ID NO: 264899 - RNA, 22 nt, Homo sapiens
ucacauagcauaaugucugcaa

SEQ ID NO: 264900 - RNA, 20 nt, Homo sapiens
ucacauccucucccaacaug

SEQ ID NO: 264901 - RNA, 22 nt, Homo sapiens
ucacaugcacaucucuggaacc

SEQ ID NO: 264902 - RNA, 22 nt, Homo sapiens
cuaauucuggccaaagggauaa

SEQ ID NO: 264903 - RNA, 22 nt, Homo sapiens
cuaauucuguaccuggcacaua

SEQ ID NO: 264904 - RNA, 22 nt, Homo sapiens
cuacagcagcccaguccccgaa

SEQ ID NO: 264905 - RNA, 22 nt, Homo sapiens
cuacagguaugaaagggaguau

SEQ ID NO: 264906 - RNA, 21 nt, Homo sapiens
cuacccuguauuagagaaaga

SEQ ID NO: 264907 - RNA, 22 nt, Homo sapiens
cuacccuuaaguuucugugggg

SEQ ID NO: 264908 - RNA, 23 nt, Homo sapiens
cuacuagucaagucuuuuccagu

SEQ ID NO: 264909 - RNA, 22 nt, Homo sapiens
cuacuauguagagauauugaau

SEQ ID NO: 264910 - RNA, 22 nt, Homo sapiens
cuacugcacaucaucugaguua

SEQ ID NO: 264911 - RNA, 22 nt, Homo sapiens
cuagacacugacguuccuccga

SEQ ID NO: 264912 - RNA, 22 nt, Homo sapiens
cuagcagacaggcugggagcag

SEQ ID NO: 264913 - RNA, 22 nt, Homo sapiens
cuagccuggagugcaguggugc

SEQ ID NO: 264914 - RNA, 22 nt, Homo sapiens
cuagcuuuugauguaaagugag

SEQ ID NO: 264915 - RNA, 22 nt, Homo sapiens
cuagcuuuuuaugacaaucuug

SEQ ID NO: 264916 - RNA, 22 nt, Homo sapiens
cuaggcacgccugggucuccag

SEQ ID NO: 264917 - RNA, 22 nt, Homo sapiens
cuauuagguuggugcaaaagua

SEQ ID NO: 264918 - RNA, 21 nt, Homo sapiens
cucaaaguacugauauuacag

SEQ ID NO: 264919 - RNA, 22 nt, Homo sapiens
cucaaguaauccucccgccuug

SEQ ID NO: 264920 - RNA, 18 nt, Homo sapiens
cucacaguaacuuuuaag

SEQ ID NO: 264921 - RNA, 22 nt, Homo sapiens
cucacaguucuaaaggcaagaa

SEQ ID NO: 264922 - RNA, 22 nt, Homo sapiens
cucagcuacuugggaagcugag

SEQ ID NO: 264923 - RNA, 22 nt, Homo sapiens
cucaggcacucugauuccagug

SEQ ID NO: 264924 - RNA, 20 nt, Homo sapiens
cucagguauuugaggcugca

SEQ ID NO: 264925 - RNA, 22 nt, Homo sapiens
cucaguagaaaauacauggacu

SEQ ID NO: 264926 - RNA, 22 nt, Homo sapiens
cucagucuaugauacuuugcua

SEQ ID NO: 264927 - RNA, 20 nt, Homo sapiens
cucagugcacccccauaaaa

SEQ ID NO: 264928 - RNA, 22 nt, Homo sapiens
cucaguguucccauucuaccuu

SEQ ID NO: 264929 - RNA, 19 nt, Homo sapiens
cucauggagaaggagaaua

SEQ ID NO: 264930 - RNA, 22 nt, Homo sapiens
cucauugcaaucuccaccuccc

SEQ ID NO: 264931 - RNA, 22 nt, Homo sapiens
cucauugcaaucucugccuccc

SEQ ID NO: 264932 - RNA, 22 nt, Homo sapiens
cuccacgugaaugccaaguauu

SEQ ID NO: 264933 - RNA, 22 nt, Homo sapiens
cuccaggugagguuaagggacu

SEQ ID NO: 264934 - RNA, 22 nt, Homo sapiens
cuccauguggcuaacuuuuaaa

SEQ ID NO: 264935 - RNA, 22 nt, Homo sapiens
cuccauuuggaacagauguccu

SEQ ID NO: 264936 - RNA, 22 nt, Homo sapiens
cucccagagccaguuauaggcu

SEQ ID NO: 264937 - RNA, 22 nt, Homo sapiens
cucccuuugcugaauguuuuuc

SEQ ID NO: 264938 - RNA, 22 nt, Homo sapiens
cuccuaaccagggcuguuaguc

SEQ ID NO: 264939 - RNA, 22 nt, Homo sapiens
cuccuggugauuggagugugaa

SEQ ID NO: 264940 - RNA, 22 nt, Homo sapiens
cucucaagaugcugggauuaca

SEQ ID NO: 264941 - RNA, 22 nt, Homo sapiens
cucucaguugucuaauuaguuu

SEQ ID NO: 264942 - RNA, 22 nt, Homo sapiens
cucucugagccauggcugcccu

SEQ ID NO: 264943 - RNA, 21 nt, Homo sapiens
cucucugcuuaugaauaguga

SEQ ID NO: 264944 - RNA, 22 nt, Homo sapiens
cucugacagugguuagcacugu

SEQ ID NO: 264945 - RNA, 22 nt, Homo sapiens
cucugagccugagguuccuacu

SEQ ID NO: 264946 - RNA, 22 nt, Homo sapiens
cucugagguuauucguaauauu

SEQ ID NO: 264947 - RNA, 15 nt, Homo sapiens
cucugguuuuucuuc

SEQ ID NO: 264948 - RNA, 22 nt, Homo sapiens
cugaaaagcaucugcauagcug

SEQ ID NO: 264949 - RNA, 19 nt, Homo sapiens
cugaaacacagagagggcu

SEQ ID NO: 264950 - RNA, 22 nt, Homo sapiens
cugaaagagcauguaacacagu

SEQ ID NO: 264951 - RNA, 22 nt, Homo sapiens
cugaaaguuauucaggggcaag

SEQ ID NO: 264952 - RNA, 22 nt, Homo sapiens
cugaaaucagccaguuaguuuc

SEQ ID NO: 264953 - RNA, 22 nt, Homo sapiens
cugaaaugaauuauuuucuuuc

SEQ ID NO: 264954 - RNA, 22 nt, Homo sapiens
cugaauagagcacacugauggg

SEQ ID NO: 264955 - RNA, 22 nt, Homo sapiens
cugaauguccaggcagagguuu

SEQ ID NO: 264956 - RNA, 22 nt, Homo sapiens
cugaauguuucacucugaaaug

SEQ ID NO: 264957 - RNA, 22 nt, Homo sapiens
cugacaagugaucacagcagca

SEQ ID NO: 264958 - RNA, 22 nt, Homo sapiens
cugacaugcagccacugcaccu

SEQ ID NO: 264959 - RNA, 17 nt, Homo sapiens
cugaccucauuguguac

SEQ ID NO: 264960 - RNA, 22 nt, Homo sapiens
cugacugaggaucaguucauca

SEQ ID NO: 264961 - RNA, 22 nt, Homo sapiens
cugagaacaucauucagauauu

SEQ ID NO: 264962 - RNA, 22 nt, Homo sapiens
cugagaagaaacagguaaggac

SEQ ID NO: 264963 - RNA, 22 nt, Homo sapiens
cugagaaugaugauuuccaguu

SEQ ID NO: 264964 - RNA, 22 nt, Homo sapiens
cugagacacucuuaucugcaua

SEQ ID NO: 264965 - RNA, 22 nt, Homo sapiens
cugagacuggugauuuaugaag

SEQ ID NO: 264966 - RNA, 22 nt, Homo sapiens
cugagaucaagucuugcucugu

SEQ ID NO: 264967 - RNA, 22 nt, Homo sapiens
cugagaucaugggucagguggu

SEQ ID NO: 264968 - RNA, 22 nt, Homo sapiens
cugagaucguggggcugcuguc

SEQ ID NO: 264969 - RNA, 22 nt, Homo sapiens
cugagauggagucucgcauugu

SEQ ID NO: 264970 - RNA, 22 nt, Homo sapiens
cugagcaaaaugaagacacgau

SEQ ID NO: 264971 - RNA, 22 nt, Homo sapiens
cugagcaaaguucuauuuaugg

SEQ ID NO: 264972 - RNA, 22 nt, Homo sapiens
cugagguacugggggccaggau

SEQ ID NO: 264973 - RNA, 22 nt, Homo sapiens
cugagguauaucccauuagaag

SEQ ID NO: 264974 - RNA, 22 nt, Homo sapiens
cugaggugauauauacauauuu

SEQ ID NO: 264975 - RNA, 22 nt, Homo sapiens
cugaggugggaggauuacuuga

SEQ ID NO: 264976 - RNA, 22 nt, Homo sapiens
cugauacugagaccuuggguua

SEQ ID NO: 264977 - RNA, 22 nt, Homo sapiens
cugauauuuuaaaauuggcugg

SEQ ID NO: 264978 - RNA, 22 nt, Homo sapiens
cugaucuguagcagccaccaca

SEQ ID NO: 264979 - RNA, 22 nt, Homo sapiens
cugaucuguuauacuuuucuau

SEQ ID NO: 264980 - RNA, 22 nt, Homo sapiens
cugcaagaaucguaguauuuga

SEQ ID NO: 264981 - RNA, 22 nt, Homo sapiens
cugcaauggagaaagugagacu

SEQ ID NO: 264982 - RNA, 22 nt, Homo sapiens
cugcccuuucuauaugauguaa

SEQ ID NO: 264983 - RNA, 22 nt, Homo sapiens
cugccuaaagaaaaagacguug

SEQ ID NO: 264984 - RNA, 20 nt, Homo sapiens
cugcuccccuacaaaucuca

SEQ ID NO: 264985 - RNA, 22 nt, Homo sapiens
cugcuggucuuuaaggucuagg

SEQ ID NO: 264986 - RNA, 22 nt, Homo sapiens
cuggacguugaggcugcaguga

SEQ ID NO: 264987 - RNA, 22 nt, Homo sapiens
cuggcaaaaagagggcaauaau

SEQ ID NO: 264988 - RNA, 22 nt, Homo sapiens
cuggcacagugucagaaacaca

SEQ ID NO: 264989 - RNA, 22 nt, Homo sapiens
cuggcagucugccucuucacug

SEQ ID NO: 264990 - RNA, 22 nt, Homo sapiens
cuggcccaguucugcguuuugc

SEQ ID NO: 264991 - RNA, 22 nt, Homo sapiens
uuaauucugucugcccucaucc

SEQ ID NO: 264992 - RNA, 22 nt, Homo sapiens
uuaauuguccaaguucaucucu

SEQ ID NO: 264993 - RNA, 22 nt, Homo sapiens
uuaauuguccauuauucuguuc

SEQ ID NO: 264994 - RNA, 22 nt, Homo sapiens
uuacaaguggcaucucucugga

SEQ ID NO: 264995 - RNA, 22 nt, Homo sapiens
uuacaccuguaauccagcacuu

SEQ ID NO: 264996 - RNA, 22 nt, Homo sapiens
uuacagucuuaggcagugcuuu

SEQ ID NO: 264997 - RNA, 22 nt, Homo sapiens
uuacaguguuuguucuguuacu

SEQ ID NO: 264998 - RNA, 22 nt, Homo sapiens
uuacaugagacugucgcuaguu

SEQ ID NO: 264999 - RNA, 22 nt, Homo sapiens
uuacaugucuugguaagguuag

SEQ ID NO: 265000 - RNA, 22 nt, Homo sapiens
uuacguaguuuuggagaucaua

SEQ ID NO: 265001 - RNA, 22 nt, Homo sapiens
uuacuugagauggggugucacu

SEQ ID NO: 265002 - RNA, 19 nt, Homo sapiens
uuagagaucaucugcuuca

SEQ ID NO: 265003 - RNA, 22 nt, Homo sapiens
uuagaguacaggggaaucaagg

SEQ ID NO: 265004 - RNA, 18 nt, Homo sapiens
uuagagugcauuacuuug

SEQ ID NO: 265005 - RNA, 22 nt, Homo sapiens
gagaugaaaucuugcucuguca

SEQ ID NO: 265006 - RNA, 22 nt, Homo sapiens
gagaugaucaugugguuuuguc

SEQ ID NO: 265007 - RNA, 22 nt, Homo sapiens
gagaugucuauuucagagaugu

SEQ ID NO: 265008 - RNA, 22 nt, Homo sapiens
gagauguuuguuucacugucac

SEQ ID NO: 265009 - RNA, 22 nt, Homo sapiens
gagauuauuuaaaaggugauuu

SEQ ID NO: 265010 - RNA, 22 nt, Homo sapiens
gagcacauaugacauuuucuuc

SEQ ID NO: 265011 - RNA, 18 nt, Homo sapiens
gagcaccuuuuuugcaga

SEQ ID NO: 265012 - RNA, 22 nt, Homo sapiens
gagcccauuucacuuguccagc

SEQ ID NO: 265013 - RNA, 21 nt, Homo sapiens
gagcuaggugaggcuguaaug

SEQ ID NO: 265014 - RNA, 22 nt, Homo sapiens
gagcuaguguaauauuuugggg

SEQ ID NO: 265015 - RNA, 22 nt, Homo sapiens
gagcucaccuuaccucuggagc

SEQ ID NO: 265016 - RNA, 22 nt, Homo sapiens
gagcugaauugcugccauuugc

SEQ ID NO: 265017 - RNA, 22 nt, Homo sapiens
gagcuuggguuaaaguugccuu

SEQ ID NO: 265018 - RNA, 22 nt, Homo sapiens
gaggaaguaauuuuaggccugu

SEQ ID NO: 265019 - RNA, 22 nt, Homo sapiens
gaggaaguagcuacugucuuuc

SEQ ID NO: 265020 - RNA, 22 nt, Homo sapiens
gaggaguagggcacaaagccuu

SEQ ID NO: 265021 - RNA, 22 nt, Homo sapiens
gaggaguauuuugucgaauguc

SEQ ID NO: 265022 - RNA, 22 nt, Homo sapiens
gaggcaauaugagggaggcuuc

SEQ ID NO: 265023 - RNA, 22 nt, Homo sapiens
gaggcagucugacccuuagcag

SEQ ID NO: 265024 - RNA, 22 nt, Homo sapiens
gaggcagucuguccauucucag

SEQ ID NO: 265025 - RNA, 22 nt, Homo sapiens
gaggcauugaaauauugcuuau

SEQ ID NO: 265026 - RNA, 22 nt, Homo sapiens
gagguagguacaauugccacca

SEQ ID NO: 265027 - RNA, 22 nt, Homo sapiens
gaguaacagcauaaauuuguga

SEQ ID NO: 265028 - RNA, 22 nt, Homo sapiens
gaguauauuugcacuguuaugu

SEQ ID NO: 265029 - RNA, 22 nt, Homo sapiens
gagugcaauggcaagaucuugg

SEQ ID NO: 265030 - RNA, 22 nt, Homo sapiens
gagugcaauggcaccgucucgg

SEQ ID NO: 265031 - RNA, 22 nt, Homo sapiens
gagugcaauggugcuaucucgg

SEQ ID NO: 265032 - RNA, 22 nt, Homo sapiens
gagugcauaugggccuguguca

SEQ ID NO: 265033 - RNA, 22 nt, Homo sapiens
gagugcuguuagcccuggguuu

SEQ ID NO: 265034 - RNA, 22 nt, Homo sapiens
gaguucauuuugaaaccuugau

SEQ ID NO: 265035 - RNA, 22 nt, Homo sapiens
gaguuguuuuaaggcacugacu

SEQ ID NO: 265036 - RNA, 22 nt, Homo sapiens
gauacaguaugcaugugguauu

SEQ ID NO: 265037 - RNA, 22 nt, Homo sapiens
gauacuguauccuaaaagcuuu

SEQ ID NO: 265038 - RNA, 19 nt, Homo sapiens
gauagacaucacagugcca

SEQ ID NO: 265039 - RNA, 22 nt, Homo sapiens
gauagcagccauucuuuuuauu

SEQ ID NO: 265040 - RNA, 22 nt, Homo sapiens
gauagcauucaauuaucuguug

SEQ ID NO: 265041 - RNA, 22 nt, Homo sapiens
gauagugaaccaagggguaauu

SEQ ID NO: 265042 - RNA, 22 nt, Homo sapiens
gauaugaguagucgcauugaug

SEQ ID NO: 265043 - RNA, 22 nt, Homo sapiens
gauauguucugagaaaugcauu

SEQ ID NO: 265044 - RNA, 22 nt, Homo sapiens
gauauugacuuauucuauguuu

SEQ ID NO: 265045 - RNA, 22 nt, Homo sapiens
gaucacaguuccucacgggcau

SEQ ID NO: 265046 - RNA, 22 nt, Homo sapiens
gaucacaugggagaaugagagu

SEQ ID NO: 265047 - RNA, 22 nt, Homo sapiens
gaucacauguguacucaaugug

SEQ ID NO: 265048 - RNA, 22 nt, Homo sapiens
gaucacuuugaugccaggaacu

SEQ ID NO: 265049 - RNA, 22 nt, Homo sapiens
gaucuggagguuuuccucauga

SEQ ID NO: 265050 - RNA, 22 nt, Homo sapiens
gaucuguuguuuggaaguauca

SEQ ID NO: 265051 - RNA, 22 nt, Homo sapiens
gaucuguuucaauugucuuagu

SEQ ID NO: 265052 - RNA, 22 nt, Homo sapiens
gaugacagcugacucccuugcu

SEQ ID NO: 265053 - RNA, 22 nt, Homo sapiens
gaugagcuaaguucucacagca

SEQ ID NO: 265054 - RNA, 22 nt, Homo sapiens
gaugaggcuagagacaugugua

SEQ ID NO: 265055 - RNA, 22 nt, Homo sapiens
gaugcagcuaggauuugugaca

SEQ ID NO: 265056 - RNA, 22 nt, Homo sapiens
gauggaguugacuaagacaaca

SEQ ID NO: 265057 - RNA, 22 nt, Homo sapiens
gauggcaucugagaguguuaga

SEQ ID NO: 265058 - RNA, 22 nt, Homo sapiens
gauuagagaaauacugcugcua

SEQ ID NO: 265059 - RNA, 22 nt, Homo sapiens
gauuagcacuucaguuacagua

SEQ ID NO: 265060 - RNA, 22 nt, Homo sapiens
gauuguguucauaggcauguua

SEQ ID NO: 265061 - RNA, 22 nt, Homo sapiens
gauuugagagaggguguuuaua

SEQ ID NO: 265062 - RNA, 22 nt, Homo sapiens
gauuuuuggggaagccucuuau

SEQ ID NO: 265063 - RNA, 22 nt, Homo sapiens
gcaaaucuuauguccucacauu

SEQ ID NO: 265064 - RNA, 22 nt, Homo sapiens
gcaagauguuaccauuagggaa

SEQ ID NO: 265065 - RNA, 21 nt, Homo sapiens
gcaaguacuaucaucauuauc

SEQ ID NO: 265066 - RNA, 22 nt, Homo sapiens
gcacacuuacacgaaccuagau

SEQ ID NO: 265067 - RNA, 22 nt, Homo sapiens
gcaccacugcacucucagcuug

SEQ ID NO: 265068 - RNA, 22 nt, Homo sapiens
gcacugggccacauuuauuuuc

SEQ ID NO: 265069 - RNA, 22 nt, Homo sapiens
gcagaguauagagggcugggcc

SEQ ID NO: 265070 - RNA, 22 nt, Homo sapiens
gcagaucuucgcgguaaguguu

SEQ ID NO: 265071 - RNA, 23 nt, Homo sapiens
gcagcaaugucacagggguccgg

SEQ ID NO: 265072 - RNA, 20 nt, Homo sapiens
gcagcaccauauuucuaaga

SEQ ID NO: 265073 - RNA, 22 nt, Homo sapiens
gcaggaaucuugagaaggauuc

SEQ ID NO: 265074 - RNA, 22 nt, Homo sapiens
gcagugacaugugccaguuuau

SEQ ID NO: 265075 - RNA, 22 nt, Homo sapiens
gcagugugaucacagcuuacug

SEQ ID NO: 265076 - RNA, 22 nt, Homo sapiens
gcaguguggguagagggcaaga

SEQ ID NO: 265077 - RNA, 22 nt, Homo sapiens
gcaguguuggggccggaggcug

SEQ ID NO: 265078 - RNA, 22 nt, Homo sapiens
gcauggagcauacauuucuguu

SEQ ID NO: 265079 - RNA, 22 nt, Homo sapiens
gcauggccuuuaaaugucacag

SEQ ID NO: 265080 - RNA, 22 nt, Homo sapiens
gcauguaguagauguugaauaa

SEQ ID NO: 265081 - RNA, 22 nt, Homo sapiens
uucccugaguaucuuaccaugg

SEQ ID NO: 265082 - RNA, 22 nt, Homo sapiens
uucccugugggaguaggaaagu

SEQ ID NO: 265083 - RNA, 22 nt, Homo sapiens
uucccugugggcuggugcucca

SEQ ID NO: 265084 - RNA, 22 nt, Homo sapiens
uucccugugguauagaagccgu

SEQ ID NO: 265085 - RNA, 22 nt, Homo sapiens
uucccuuucugaaaaucucauu

SEQ ID NO: 265086 - RNA, 22 nt, Homo sapiens
uucccuuucuuaaagaguuagg

SEQ ID NO: 265087 - RNA, 22 nt, Homo sapiens
uucccuuuguuaaauuggaaga

SEQ ID NO: 265088 - RNA, 22 nt, Homo sapiens
uuccuacugcccauuaaaaugg

SEQ ID NO: 265089 - RNA, 19 nt, Homo sapiens
uuccuagugguugggaagu

SEQ ID NO: 265090 - RNA, 22 nt, Homo sapiens
uuccugagaucagaauucaaau

SEQ ID NO: 265091 - RNA, 22 nt, Homo sapiens
uuccugcacuugcuugccuaug

SEQ ID NO: 265092 - RNA, 22 nt, Homo sapiens
uuccuggaggggaaguguccaa

SEQ ID NO: 265093 - RNA, 22 nt, Homo sapiens
aucucagcaacuaaagauccuu

SEQ ID NO: 265094 - RNA, 22 nt, Homo sapiens
aucucuugccagucagaauggu

SEQ ID NO: 265095 - RNA, 22 nt, Homo sapiens
aucuguguuuaaggucccagaa

SEQ ID NO: 265096 - RNA, 22 nt, Homo sapiens
aucuugcauuugcuaaaaugca

SEQ ID NO: 265097 - RNA, 22 nt, Homo sapiens
aucuuugcugagaugcauggca

SEQ ID NO: 265098 - RNA, 22 nt, Homo sapiens
aucuuuggauacuugauauagu

SEQ ID NO: 265099 - RNA, 22 nt, Homo sapiens
aucuuuggcgggaauaucacag

SEQ ID NO: 265100 - RNA, 22 nt, Homo sapiens
aucuuuggucaucacagcuaga

SEQ ID NO: 265101 - RNA, 22 nt, Homo sapiens
aucuuuggugaguucuuugguc

SEQ ID NO: 265102 - RNA, 22 nt, Homo sapiens
augaaaguguguggaaacuuga

SEQ ID NO: 265103 - RNA, 22 nt, Homo sapiens
augaaaugcauguuaaguccgu

SEQ ID NO: 265104 - RNA, 21 nt, Homo sapiens
augaacucaucauuuuuuaug

SEQ ID NO: 265105 - RNA, 22 nt, Homo sapiens
augaagcuagcugauugcugau

SEQ ID NO: 265106 - RNA, 17 nt, Homo sapiens
augaagucaucauuuuu

SEQ ID NO: 265107 - RNA, 22 nt, Homo sapiens
augaaguuagcucauuucuuuu

SEQ ID NO: 265108 - RNA, 22 nt, Homo sapiens
augaauagaguuaauugaguac

SEQ ID NO: 265109 - RNA, 23 nt, Homo sapiens
augaauguaaggaguguaagaaa

SEQ ID NO: 265110 - RNA, 22 nt, Homo sapiens
augacagagauaugugaauuuu

SEQ ID NO: 265111 - RNA, 22 nt, Homo sapiens
augacagugagugagcucucac

SEQ ID NO: 265112 - RNA, 22 nt, Homo sapiens
augaccaaugggcagagcuaga

SEQ ID NO: 265113 - RNA, 22 nt, Homo sapiens
augaccauuucaauugauaugg

SEQ ID NO: 265114 - RNA, 22 nt, Homo sapiens
augaccuuguccucagugucau

SEQ ID NO: 265115 - RNA, 18 nt, Homo sapiens
augacucuggguguuccu

SEQ ID NO: 265116 - RNA, 22 nt, Homo sapiens
augagacuguucuuccucauug

SEQ ID NO: 265117 - RNA, 22 nt, Homo sapiens
augagauaggaacaaacuuaca

SEQ ID NO: 265118 - RNA, 22 nt, Homo sapiens
augagauauguuaaaaguuaaa

SEQ ID NO: 265119 - RNA, 22 nt, Homo sapiens
augagaucugugaacaccuguc

SEQ ID NO: 265120 - RNA, 21 nt, Homo sapiens
augagauguuagacuuuagac

SEQ ID NO: 265121 - RNA, 22 nt, Homo sapiens
augagauuauguaaagagacca

SEQ ID NO: 265122 - RNA, 22 nt, Homo sapiens
augagcaucaccagaaucaaua

SEQ ID NO: 265123 - RNA, 22 nt, Homo sapiens
augagcuguuuggaagacacuu

SEQ ID NO: 265124 - RNA, 22 nt, Homo sapiens
augaggcacugcgcccuacuga

SEQ ID NO: 265125 - RNA, 21 nt, Homo sapiens
augagguguacuguggugaaa

SEQ ID NO: 265126 - RNA, 20 nt, Homo sapiens
augagguguaugacacugaa

SEQ ID NO: 265127 - RNA, 22 nt, Homo sapiens
augaguaugagaauacauuaag

SEQ ID NO: 265128 - RNA, 22 nt, Homo sapiens
augauacugaguugaguucuca

SEQ ID NO: 265129 - RNA, 22 nt, Homo sapiens
augaugcaguacuuugggaaca

SEQ ID NO: 265130 - RNA, 22 nt, Homo sapiens
augauucugaucuagagcuugg

SEQ ID NO: 265131 - RNA, 22 nt, Homo sapiens
cuggcucauuucauuuagcaua

SEQ ID NO: 265132 - RNA, 22 nt, Homo sapiens
cugggcaaugcggcuggauaga

SEQ ID NO: 265133 - RNA, 22 nt, Homo sapiens
cugguuuguaaaguuccugaga

SEQ ID NO: 265134 - RNA, 22 nt, Homo sapiens
cuguaaaguaagagguaaguua

SEQ ID NO: 265135 - RNA, 22 nt, Homo sapiens
cuguaaaguucucauuguagcc

SEQ ID NO: 265136 - RNA, 22 nt, Homo sapiens
cuguaauguaaugagacuacau

SEQ ID NO: 265137 - RNA, 23 nt, Homo sapiens
cuguacacauauacaucuaagua

SEQ ID NO: 265138 - RNA, 22 nt, Homo sapiens
cuguagcuuuuauaugcuuagc

SEQ ID NO: 265139 - RNA, 22 nt, Homo sapiens
cuguauguuucuaugaauguga

SEQ ID NO: 265140 - RNA, 22 nt, Homo sapiens
cugugacugcagggcauauuug

SEQ ID NO: 265141 - RNA, 22 nt, Homo sapiens
cugugaucuuuuuucauguggu

SEQ ID NO: 265142 - RNA, 22 nt, Homo sapiens
cugugcauaugacuuuauugga

SEQ ID NO: 265143 - RNA, 22 nt, Homo sapiens
cugugcauguaugcgugaguuc

SEQ ID NO: 265144 - RNA, 22 nt, Homo sapiens
cugugcauguuguccaauucuu

SEQ ID NO: 265145 - RNA, 22 nt, Homo sapiens
cugugccaagcuugcgaugugc

SEQ ID NO: 265146 - RNA, 23 nt, Homo sapiens
cuguggauaugaguuguaaaugg

SEQ ID NO: 265147 - RNA, 20 nt, Homo sapiens
cugugguagggaccaggaau

SEQ ID NO: 265148 - RNA, 22 nt, Homo sapiens
cugugguauuauuagaaauauc

SEQ ID NO: 265149 - RNA, 22 nt, Homo sapiens
cugugguuuaaggaauuuugac

SEQ ID NO: 265150 - RNA, 22 nt, Homo sapiens
cuguucaaauuguuugugaagu

SEQ ID NO: 265151 - RNA, 22 nt, Homo sapiens
cuguucaggaggcauuuggugg

SEQ ID NO: 265152 - RNA, 22 nt, Homo sapiens
cuuaagcauugacuuuggacag

SEQ ID NO: 265153 - RNA, 22 nt, Homo sapiens
cuucaaguguggccaccugacc

SEQ ID NO: 265154 - RNA, 20 nt, Homo sapiens
cuucacagaaguggaaucau

SEQ ID NO: 265155 - RNA, 20 nt, Homo sapiens
cuuccaguggccccaucuuu

SEQ ID NO: 265156 - RNA, 22 nt, Homo sapiens
cuuccauaguuacacccaggga

SEQ ID NO: 265157 - RNA, 22 nt, Homo sapiens
cuugcacuccacuguucuccug

SEQ ID NO: 265158 - RNA, 22 nt, Homo sapiens
cuugcagagcccauggauguca

SEQ ID NO: 265159 - RNA, 22 nt, Homo sapiens
cuugcauuuuggagaaugcuga

SEQ ID NO: 265160 - RNA, 22 nt, Homo sapiens
cuuggcauugccccuggaauuu

SEQ ID NO: 265161 - RNA, 22 nt, Homo sapiens
cuugugauugcacggcugccug

SEQ ID NO: 265162 - RNA, 22 nt, Homo sapiens
uucaggcuccugugagaaucua

SEQ ID NO: 265163 - RNA, 22 nt, Homo sapiens
uucagggcauuggaguuucuga

SEQ ID NO: 265164 - RNA, 22 nt, Homo sapiens
uucagguaucccuugucuauag

SEQ ID NO: 265165 - RNA, 22 nt, Homo sapiens
uucaguacacguguucucauuu

SEQ ID NO: 265166 - RNA, 22 nt, Homo sapiens
uucagugucauuaacacaguag

SEQ ID NO: 265167 - RNA, 22 nt, Homo sapiens
uucauacaguggcugcacucca

SEQ ID NO: 265168 - RNA, 22 nt, Homo sapiens
uucauagugaaaaauucaaagu

SEQ ID NO: 265169 - RNA, 21 nt, Homo sapiens
uucaucagccagaaaucaagc

SEQ ID NO: 265170 - RNA, 22 nt, Homo sapiens
uucaucagcuguagaugucaug

SEQ ID NO: 265171 - RNA, 18 nt, Homo sapiens
uucaucaguccucagcug

SEQ ID NO: 265172 - RNA, 22 nt, Homo sapiens
uucaucuggcaauucagagauu

SEQ ID NO: 265173 - RNA, 22 nt, Homo sapiens
uucauggacucaauaguuucgc

SEQ ID NO: 265174 - RNA, 22 nt, Homo sapiens
uucauggaguugagaaggcuaa

SEQ ID NO: 265175 - RNA, 22 nt, Homo sapiens
uucauggaguuuaaauuguagu

SEQ ID NO: 265176 - RNA, 22 nt, Homo sapiens
uucauugaaugauuuuuagaag

SEQ ID NO: 265177 - RNA, 22 nt, Homo sapiens
uucauugcugcuuaucuccaga

SEQ ID NO: 265178 - RNA, 22 nt, Homo sapiens
uuccacaaugguugaacuaguu

SEQ ID NO: 265179 - RNA, 22 nt, Homo sapiens
uuccagaugggaguucuauucu

SEQ ID NO: 265180 - RNA, 22 nt, Homo sapiens
uuccaggugggcgugggccugg

SEQ ID NO: 265181 - RNA, 22 nt, Homo sapiens
uuccaguauuugggcaagcgca

SEQ ID NO: 265182 - RNA, 21 nt, Homo sapiens
uuccagugagccuagaugccu

SEQ ID NO: 265183 - RNA, 22 nt, Homo sapiens
uuccaguguguucauccucaga

SEQ ID NO: 265184 - RNA, 22 nt, Homo sapiens
uuccaguguuugacucaccuuu

SEQ ID NO: 265185 - RNA, 22 nt, Homo sapiens
uuccaguuuuauggguauagag

SEQ ID NO: 265186 - RNA, 22 nt, Homo sapiens
uuccaugagaugcaucaaagcu

SEQ ID NO: 265187 - RNA, 22 nt, Homo sapiens
uuccauguaguugagcaguuuu

SEQ ID NO: 265188 - RNA, 22 nt, Homo sapiens
uuccaugugggcuugucaagua

SEQ ID NO: 265189 - RNA, 22 nt, Homo sapiens
uuccauuuguucggugucgcca

SEQ ID NO: 265190 - RNA, 22 nt, Homo sapiens
uucccagagccugggagugagg

SEQ ID NO: 265191 - RNA, 22 nt, Homo sapiens
uucccagucaaacgaaggacuu

SEQ ID NO: 265192 - RNA, 22 nt, Homo sapiens
uucccagugccaggcacuggga

SEQ ID NO: 265193 - RNA, 22 nt, Homo sapiens
uucccaguuggggaaagcgacc

SEQ ID NO: 265194 - RNA, 22 nt, Homo sapiens
uucccuugcaggaugaucugga

SEQ ID NO: 265195 - RNA, 22 nt, Homo sapiens
uucccuuuuuucuaguagguag

SEQ ID NO: 265196 - RNA, 22 nt, Homo sapiens
uuccuguagcgauuuuaguaau

SEQ ID NO: 265197 - RNA, 22 nt, Homo sapiens
uuccugugacccccaagcccac

SEQ ID NO: 265198 - RNA, 22 nt, Homo sapiens
uuccuuaguuauuugguccccu

SEQ ID NO: 265199 - RNA, 22 nt, Homo sapiens
uuccuugguucagggaaggucc

SEQ ID NO: 265200 - RNA, 22 nt, Homo sapiens
uucuaaacaucuuacaaugcau

SEQ ID NO: 265201 - RNA, 21 nt, Homo sapiens
uucuaaguaaauguuggacau

SEQ ID NO: 265202 - RNA, 22 nt, Homo sapiens
uucuaaguaauuuugcaugccu

SEQ ID NO: 265203 - RNA, 22 nt, Homo sapiens
uucuaugguuuaauaguuuggg

SEQ ID NO: 265204 - RNA, 22 nt, Homo sapiens
uucuauguuugaaaaugccaaa

SEQ ID NO: 265205 - RNA, 21 nt, Homo sapiens
uucucagaggcaggggauaaa

SEQ ID NO: 265206 - RNA, 22 nt, Homo sapiens
uucucagugaacuccagcuugu

SEQ ID NO: 265207 - RNA, 22 nt, Homo sapiens
uucucaguuccuacuuugguga

SEQ ID NO: 265208 - RNA, 19 nt, Homo sapiens
uucucugguuguacuaccc

SEQ ID NO: 265209 - RNA, 22 nt, Homo sapiens
uucugagguuauauucucucaa

SEQ ID NO: 265210 - RNA, 22 nt, Homo sapiens
uucugauggaguaguccacaga

SEQ ID NO: 265211 - RNA, 22 nt, Homo sapiens
uucugcacaucgaucacaagau

SEQ ID NO: 265212 - RNA, 23 nt, Homo sapiens
uucugccacugaaaaugccucag

SEQ ID NO: 265213 - RNA, 22 nt, Homo sapiens
uucugcuagucugucagaucuu

SEQ ID NO: 265214 - RNA, 22 nt, Homo sapiens
uucuggaaaucagcagagggug

SEQ ID NO: 265215 - RNA, 22 nt, Homo sapiens
uucuggccccucccaaucucau

SEQ ID NO: 265216 - RNA, 22 nt, Homo sapiens
uucuggcucgauucucugaccg

SEQ ID NO: 265217 - RNA, 22 nt, Homo sapiens
uucugugguugaaaggagagau

SEQ ID NO: 265218 - RNA, 22 nt, Homo sapiens
uucuguguuuaggucacggcua

SEQ ID NO: 265219 - RNA, 18 nt, Homo sapiens
uucuuguguugauauuuu

SEQ ID NO: 265220 - RNA, 22 nt, Homo sapiens
uucuuugcaugaucucaaaguc

SEQ ID NO: 265221 - RNA, 21 nt, Homo sapiens
uucuuugcucaguguuagagu

SEQ ID NO: 265222 - RNA, 22 nt, Homo sapiens
uugaaagaugaacuggauugga

SEQ ID NO: 265223 - RNA, 22 nt, Homo sapiens
uugaaagcuaucagagauucca

SEQ ID NO: 265224 - RNA, 22 nt, Homo sapiens
uugaaagucauuucuucuaagu

SEQ ID NO: 265225 - RNA, 22 nt, Homo sapiens
uugaagacuaaguuaucaggau

SEQ ID NO: 265226 - RNA, 22 nt, Homo sapiens
uugaaggaggugcucacucucg

SEQ ID NO: 265227 - RNA, 22 nt, Homo sapiens
uugaaguagaaagacgaaauuu

SEQ ID NO: 265228 - RNA, 22 nt, Homo sapiens
uugaaguagcauuucaugucua

SEQ ID NO: 265229 - RNA, 22 nt, Homo sapiens
uugaauaguggugaaaguuuga

SEQ ID NO: 265230 - RNA, 18 nt, Homo sapiens
uugaauaguguccaaucu

SEQ ID NO: 265231 - RNA, 22 nt, Homo sapiens
uugaauguacuuguucucacua

SEQ ID NO: 265232 - RNA, 22 nt, Homo sapiens
uugacaaggagugggguugaga

SEQ ID NO: 265233 - RNA, 22 nt, Homo sapiens
uugacauaaucauuucacagug

SEQ ID NO: 265234 - RNA, 23 nt, Homo sapiens
uugacuguggguacaaugugaua

SEQ ID NO: 265235 - RNA, 22 nt, Homo sapiens
uugacuuagacauucaguugga

SEQ ID NO: 265236 - RNA, 22 nt, Homo sapiens
uugagaaucuuucgaauguucu

SEQ ID NO: 265237 - RNA, 22 nt, Homo sapiens
aaaagagcugagagguauucuu

SEQ ID NO: 265238 - RNA, 22 nt, Homo sapiens
aaaagucuguagugaaagguga

SEQ ID NO: 265239 - RNA, 18 nt, Homo sapiens
aaacugcuuccuuggccu

SEQ ID NO: 265240 - RNA, 22 nt, Homo sapiens
aaagcagcaggugguuuucaau

SEQ ID NO: 265241 - RNA, 22 nt, Homo sapiens
aaaggcacacacuccuuguuau

SEQ ID NO: 265242 - RNA, 22 nt, Homo sapiens
aaagggcacugugcuuuggcaa

SEQ ID NO: 265243 - RNA, 22 nt, Homo sapiens
aaagguaguacuucuagaaggg

SEQ ID NO: 265244 - RNA, 17 nt, Homo sapiens
aaaguccuuugcuaucu

SEQ ID NO: 265245 - RNA, 22 nt, Homo sapiens
aaagugcacuuggaagagggcc

SEQ ID NO: 265246 - RNA, 22 nt, Homo sapiens
aaagugcaguacuucguauauu

SEQ ID NO: 265247 - RNA, 22 nt, Homo sapiens
aaagugccugacucauaguuag

SEQ ID NO: 265248 - RNA, 22 nt, Homo sapiens
aaagugcugggauuaggccagg

SEQ ID NO: 265249 - RNA, 22 nt, Homo sapiens
aaagugcugggauuggccgggc

SEQ ID NO: 265250 - RNA, 22 nt, Homo sapiens
aaaguggacuaagugaauauga

SEQ ID NO: 265251 - RNA, 19 nt, Homo sapiens
aaaguguuuuaaagaggau

SEQ ID NO: 265252 - RNA, 22 nt, Homo sapiens
aaauaacugucagguucuggaa

SEQ ID NO: 265253 - RNA, 22 nt, Homo sapiens
aaaugcagcacucaagugggaa

SEQ ID NO: 265254 - RNA, 22 nt, Homo sapiens
aaaugcuuucuuggaccauuug

SEQ ID NO: 265255 - RNA, 22 nt, Homo sapiens
aaaugguguuaguagaucuuua

SEQ ID NO: 265256 - RNA, 22 nt, Homo sapiens
aaaugucauggaguguuucccc

SEQ ID NO: 265257 - RNA, 19 nt, Homo sapiens
aaaugugcacuguuuucca

SEQ ID NO: 265258 - RNA, 22 nt, Homo sapiens
aaauugcacaaguggugauuug

SEQ ID NO: 265259 - RNA, 22 nt, Homo sapiens
aaauugcaguuaggaugauggu

SEQ ID NO: 265260 - RNA, 23 nt, Homo sapiens
aaauuugccuauuauuccuaugg

SEQ ID NO: 265261 - RNA, 20 nt, Homo sapiens
aacagcacugucugaagcuu

SEQ ID NO: 265262 - RNA, 22 nt, Homo sapiens
aacaggguguuugcaguuucuu

SEQ ID NO: 265263 - RNA, 21 nt, Homo sapiens
aacagugcugaacagacaccu

SEQ ID NO: 265264 - RNA, 20 nt, Homo sapiens
aacaguguguaaguuuccuu

SEQ ID NO: 265265 - RNA, 22 nt, Homo sapiens
aacauugaacuuggcacaccca

SEQ ID NO: 265266 - RNA, 22 nt, Homo sapiens
aacuacaucucuuugaggcagg

SEQ ID NO: 265267 - RNA, 22 nt, Homo sapiens
aacucugucuccuucaaguuca

SEQ ID NO: 265268 - RNA, 22 nt, Homo sapiens
aacuggcacuacaucaagagcu

SEQ ID NO: 265269 - RNA, 22 nt, Homo sapiens
aacuggccuccuugggaaauua

SEQ ID NO: 265270 - RNA, 21 nt, Homo sapiens
aacuggugugagaugguaugu

SEQ ID NO: 265271 - RNA, 21 nt, Homo sapiens
aagaaagcuggacuugccgcu

SEQ ID NO: 265272 - RNA, 18 nt, Homo sapiens
aagagcucagcacagguu

SEQ ID NO: 265273 - RNA, 22 nt, Homo sapiens
aagagcucucuguagcauguga

SEQ ID NO: 265274 - RNA, 22 nt, Homo sapiens
aagagguagcagucacaaaaga

SEQ ID NO: 265275 - RNA, 22 nt, Homo sapiens
aagagguaggaaauggucauuu

SEQ ID NO: 265276 - RNA, 22 nt, Homo sapiens
aagagguagucugucccuuagc

SEQ ID NO: 265277 - RNA, 22 nt, Homo sapiens
aagaucaucauagagggcauga

SEQ ID NO: 265278 - RNA, 22 nt, Homo sapiens
aagaucauucagggaaggcuga

SEQ ID NO: 265279 - RNA, 19 nt, Homo sapiens
aagaugauguuugggcuaa

SEQ ID NO: 265280 - RNA, 21 nt, Homo sapiens
aagcacauugaguguguguga

SEQ ID NO: 265281 - RNA, 22 nt, Homo sapiens
aagcaccaauaggagauuuguc

SEQ ID NO: 265282 - RNA, 20 nt, Homo sapiens
aagcagacauuuggaugaaa

SEQ ID NO: 265283 - RNA, 22 nt, Homo sapiens
aagcaggugaugagugggugug

SEQ ID NO: 265284 - RNA, 22 nt, Homo sapiens
aagcaggugucugugucuguaa

SEQ ID NO: 265285 - RNA, 22 nt, Homo sapiens
acauaaagaagcaggacauugu

SEQ ID NO: 265286 - RNA, 22 nt, Homo sapiens
acauacacuagggauguggugu

SEQ ID NO: 265287 - RNA, 22 nt, Homo sapiens
acaugagacuggguuuguaggg

SEQ ID NO: 265288 - RNA, 19 nt, Homo sapiens
acauggauuuugugcaaac

SEQ ID NO: 265289 - RNA, 22 nt, Homo sapiens
acauguaauugauuuuguguua

SEQ ID NO: 265290 - RNA, 22 nt, Homo sapiens
acauugcagauguguuuaaugu

SEQ ID NO: 265291 - RNA, 19 nt, Homo sapiens
accagauugcauucuugga

SEQ ID NO: 265292 - RNA, 17 nt, Homo sapiens
accagugcaugugcuuu

SEQ ID NO: 265293 - RNA, 22 nt, Homo sapiens
accauugcacuccagcccaggc

SEQ ID NO: 265294 - RNA, 22 nt, Homo sapiens
accauugcacuccagccugggc

SEQ ID NO: 265295 - RNA, 22 nt, Homo sapiens
acccagaauucagucuuaggcc

SEQ ID NO: 265296 - RNA, 17 nt, Homo sapiens
acccagucuuuuugcac

SEQ ID NO: 265297 - RNA, 22 nt, Homo sapiens
acccaguguugggcagaacugu

SEQ ID NO: 265298 - RNA, 22 nt, Homo sapiens
accccugagaucgaaucaugcu

SEQ ID NO: 265299 - RNA, 22 nt, Homo sapiens
acccugcuaaacagcccccugc

SEQ ID NO: 265300 - RNA, 22 nt, Homo sapiens
acccuggagagugcuguaguaa

SEQ ID NO: 265301 - RNA, 22 nt, Homo sapiens
acccugucagcuggccugggca

SEQ ID NO: 265302 - RNA, 19 nt, Homo sapiens
acccuguccccaccuuuac

SEQ ID NO: 265303 - RNA, 18 nt, Homo sapiens
acccuucagcacugggcc

SEQ ID NO: 265304 - RNA, 22 nt, Homo sapiens
acccuuugucaaucaguacuaa

SEQ ID NO: 265305 - RNA, 22 nt, Homo sapiens
accugagacuaggcauuuuaua

SEQ ID NO: 265306 - RNA, 22 nt, Homo sapiens
accugagauuacaggugcuggc

SEQ ID NO: 265307 - RNA, 23 nt, Homo sapiens
accugauguuucuguggggagcc

SEQ ID NO: 265308 - RNA, 22 nt, Homo sapiens
accuuuacaacuuguuagagua

SEQ ID NO: 265309 - RNA, 22 nt, Homo sapiens
acggcacugguggaaguguagc

SEQ ID NO: 265310 - RNA, 22 nt, Homo sapiens
acuagagaugcauuuguaguuu

SEQ ID NO: 265311 - RNA, 22 nt, Homo sapiens
acucagagaacauucccagucu

SEQ ID NO: 265312 - RNA, 22 nt, Homo sapiens
acuccauuucauuuuagcucuu

SEQ ID NO: 265313 - RNA, 22 nt, Homo sapiens
acugagaucuuuaaauaaauaa

SEQ ID NO: 265314 - RNA, 19 nt, Homo sapiens
acugagcuaccugggggca

SEQ ID NO: 265315 - RNA, 22 nt, Homo sapiens
acugcaaugucgaauagagaug

SEQ ID NO: 265316 - RNA, 19 nt, Homo sapiens
acugcacuccaaccuccug

SEQ ID NO: 265317 - RNA, 22 nt, Homo sapiens
acugcacuccagacucugucuc

SEQ ID NO: 265318 - RNA, 22 nt, Homo sapiens
acugcacuccagcccgggugac

SEQ ID NO: 265319 - RNA, 22 nt, Homo sapiens
acugcacuccagccuccugggu

SEQ ID NO: 265320 - RNA, 22 nt, Homo sapiens
acugcacuccagccugaugaaa

SEQ ID NO: 265321 - RNA, 22 nt, Homo sapiens
acugcacuccagccugcugaca

SEQ ID NO: 265322 - RNA, 22 nt, Homo sapiens
acugcacuccagccuggacgac

SEQ ID NO: 265323 - RNA, 22 nt, Homo sapiens
acugcacuccagccuuagugac

SEQ ID NO: 265324 - RNA, 22 nt, Homo sapiens
acugcacuccagccuuggccac

SEQ ID NO: 265325 - RNA, 22 nt, Homo sapiens
acugcacuccagcuuuggguga

SEQ ID NO: 265326 - RNA, 22 nt, Homo sapiens
acugcacuccaguuugggcagc

SEQ ID NO: 265327 - RNA, 19 nt, Homo sapiens
acugcacuccuccuugggu

SEQ ID NO: 265328 - RNA, 22 nt, Homo sapiens
acugcacuucagccuguugaca

SEQ ID NO: 265329 - RNA, 22 nt, Homo sapiens
acugcauuugucccuuuugaac

SEQ ID NO: 265330 - RNA, 22 nt, Homo sapiens
acugcauuugucugucucaauu

SEQ ID NO: 265331 - RNA, 22 nt, Homo sapiens
acugccuaaugacuuauguuuu

SEQ ID NO: 265332 - RNA, 22 nt, Homo sapiens
acuuauuguggcugacccaaac

SEQ ID NO: 265333 - RNA, 22 nt, Homo sapiens
acuucauucucuggaucagaau

SEQ ID NO: 265334 - RNA, 22 nt, Homo sapiens
acuugacacuuauauuacucac

SEQ ID NO: 265335 - RNA, 22 nt, Homo sapiens
acuuugguuaucauacuuucag

SEQ ID NO: 265336 - RNA, 22 nt, Homo sapiens
acuuuguguuacccagcaagga

SEQ ID NO: 265337 - RNA, 21 nt, Homo sapiens
agaaaaucuuaugggaaacau

SEQ ID NO: 265338 - RNA, 22 nt, Homo sapiens
agaaccaaucccacauggauac

SEQ ID NO: 265339 - RNA, 22 nt, Homo sapiens
agaacuguccauucagcaugaa

SEQ ID NO: 265340 - RNA, 22 nt, Homo sapiens
agaagaacauagggugacugaa

SEQ ID NO: 265341 - RNA, 22 nt, Homo sapiens
agaauacugucuauucauggua

SEQ ID NO: 265342 - RNA, 22 nt, Homo sapiens
agaauguaaacagaauagagga

SEQ ID NO: 265343 - RNA, 22 nt, Homo sapiens
agaauguuuuagaccaauacaa

SEQ ID NO: 265344 - RNA, 22 nt, Homo sapiens
agaauucugucauguuuauauu

SEQ ID NO: 265345 - RNA, 22 nt, Homo sapiens
agacuagagcagagcccucucu

SEQ ID NO: 265346 - RNA, 22 nt, Homo sapiens
agacucauuuuuaucgagcaug

SEQ ID NO: 265347 - RNA, 22 nt, Homo sapiens
agacuuagagagucuauucuau

SEQ ID NO: 265348 - RNA, 22 nt, Homo sapiens
agagaacugauucagggaaaau

SEQ ID NO: 265349 - RNA, 22 nt, Homo sapiens
agagacauugcuccaacucacc

SEQ ID NO: 265350 - RNA, 22 nt, Homo sapiens
agagauaaagauuuuaauuuug

SEQ ID NO: 265351 - RNA, 22 nt, Homo sapiens
agagaucaauaugaaggaaaug

SEQ ID NO: 265352 - RNA, 22 nt, Homo sapiens
agagaugaagauggggcucccg

SEQ ID NO: 265353 - RNA, 20 nt, Homo sapiens
agagcaaagccgcaccccua

SEQ ID NO: 265354 - RNA, 18 nt, Homo sapiens
agagcuaugaacauaugc

SEQ ID NO: 265355 - RNA, 22 nt, Homo sapiens
agaggaguacuacuccaagucu

SEQ ID NO: 265356 - RNA, 22 nt, Homo sapiens
agagguauuggaaggaguguca

SEQ ID NO: 265357 - RNA, 22 nt, Homo sapiens
agaguaguaggaugaauggacu

SEQ ID NO: 265358 - RNA, 21 nt, Homo sapiens
agagucaucucuaucuguacc

SEQ ID NO: 265359 - RNA, 22 nt, Homo sapiens
agagugaagcuuuuuauauucu

SEQ ID NO: 265360 - RNA, 22 nt, Homo sapiens
agauacauuggauaaugguggg

SEQ ID NO: 265361 - RNA, 22 nt, Homo sapiens
agauauguuauugauguuaaug

SEQ ID NO: 265362 - RNA, 22 nt, Homo sapiens
agaugauguuuacugagcauca

SEQ ID NO: 265363 - RNA, 22 nt, Homo sapiens
agaugccuaugaagagaaauua

SEQ ID NO: 265364 - RNA, 22 nt, Homo sapiens
agauggauuuuguagccccagc

SEQ ID NO: 265365 - RNA, 22 nt, Homo sapiens
agauggugauaaaugugguacc

SEQ ID NO: 265366 - RNA, 22 nt, Homo sapiens
agaugguguuggcugaguguau

SEQ ID NO: 265367 - RNA, 22 nt, Homo sapiens
agauguuguucaucugauuguu

SEQ ID NO: 265368 - RNA, 23 nt, Homo sapiens
agcaaaugcucuagcacuccaac

SEQ ID NO: 265369 - RNA, 22 nt, Homo sapiens
agcaacaucagcagcaggaaaa

SEQ ID NO: 265370 - RNA, 22 nt, Homo sapiens
agcaagaaugaacucucccaga

SEQ ID NO: 265371 - RNA, 22 nt, Homo sapiens
agcaagauccagucgcacagga

SEQ ID NO: 265372 - RNA, 22 nt, Homo sapiens
agcaagauugauggccugcagg

SEQ ID NO: 265373 - RNA, 22 nt, Homo sapiens
agcaagauuguucccauuuucu

SEQ ID NO: 265374 - RNA, 22 nt, Homo sapiens
agcacagccuuguguuuucuug

SEQ ID NO: 265375 - RNA, 22 nt, Homo sapiens
gucuguuugauccagaucaaaa

SEQ ID NO: 265376 - RNA, 20 nt, Homo sapiens
gucuugcuccguugcccagg

SEQ ID NO: 265377 - RNA, 22 nt, Homo sapiens
gucuuugagauaggguuauuuu

SEQ ID NO: 265378 - RNA, 22 nt, Homo sapiens
gucuuuugcuagccagagagcu

SEQ ID NO: 265379 - RNA, 22 nt, Homo sapiens
gugaaagauuaaaccagugugu

SEQ ID NO: 265380 - RNA, 22 nt, Homo sapiens
gugaaaugaaucuggaaauauu

SEQ ID NO: 265381 - RNA, 22 nt, Homo sapiens
gugaaauguguagaggaucugg

SEQ ID NO: 265382 - RNA, 22 nt, Homo sapiens
gugaacagaaccugggaucgaa

SEQ ID NO: 265383 - RNA, 22 nt, Homo sapiens
gugaagugugaccucagcaucu

SEQ ID NO: 265384 - RNA, 22 nt, Homo sapiens
gugaaguuuuuugcugagaguc

SEQ ID NO: 265385 - RNA, 22 nt, Homo sapiens
gugaaucauaugccagucaugc

SEQ ID NO: 265386 - RNA, 22 nt, Homo sapiens
gugaaucuguuuucuucuguuc

SEQ ID NO: 265387 - RNA, 22 nt, Homo sapiens
gugaauugagagaacuguguua

SEQ ID NO: 265388 - RNA, 20 nt, Homo sapiens
gugacacucguuaaccucug

SEQ ID NO: 265389 - RNA, 22 nt, Homo sapiens
gugaccagaugggcaggggugu

SEQ ID NO: 265390 - RNA, 22 nt, Homo sapiens
gugacugcauauaaguguaugu

SEQ ID NO: 265391 - RNA, 20 nt, Homo sapiens
gugagaacaugugguauuug

SEQ ID NO: 265392 - RNA, 16 nt, Homo sapiens
gugagagaugacaaac

SEQ ID NO: 265393 - RNA, 22 nt, Homo sapiens
gugagaggaggcagcuuuuaca

SEQ ID NO: 265394 - RNA, 22 nt, Homo sapiens
gugagaugauggguauguuaau

SEQ ID NO: 265395 - RNA, 19 nt, Homo sapiens
gugagcaaugcauugcacu

SEQ ID NO: 265396 - RNA, 19 nt, Homo sapiens
gugagcacagacaauacaa

SEQ ID NO: 265397 - RNA, 22 nt, Homo sapiens
gugagcauaacaacagaguuua

SEQ ID NO: 265398 - RNA, 22 nt, Homo sapiens
gugaggcacugcugcuuuccag

SEQ ID NO: 265399 - RNA, 22 nt, Homo sapiens
gugaggcugguccugccuccca

SEQ ID NO: 265400 - RNA, 20 nt, Homo sapiens
gugagguagaggguuaccug

SEQ ID NO: 265401 - RNA, 22 nt, Homo sapiens
gugaggucguagucauaggcaa

SEQ ID NO: 265402 - RNA, 22 nt, Homo sapiens
gugagguguuaaccaaccugug

SEQ ID NO: 265403 - RNA, 20 nt, Homo sapiens
gugagucauuaguaaccaaa

SEQ ID NO: 265404 - RNA, 22 nt, Homo sapiens
gugaguggacgugaccaauaaa

SEQ ID NO: 265405 - RNA, 22 nt, Homo sapiens
gugaucucagcucacuggaacc

SEQ ID NO: 265406 - RNA, 22 nt, Homo sapiens
gugaucuguccuucauagccug

SEQ ID NO: 265407 - RNA, 22 nt, Homo sapiens
gugaucuuucaggcuugaccau

SEQ ID NO: 265408 - RNA, 22 nt, Homo sapiens
gugaugacauucagagaugaag

SEQ ID NO: 265409 - RNA, 20 nt, Homo sapiens
gugauuggucacugguuguu

SEQ ID NO: 265410 - RNA, 22 nt, Homo sapiens
gugcaaaucucugaguaucuuu

SEQ ID NO: 265411 - RNA, 22 nt, Homo sapiens
gugcaacaugccuggcuaauuu

SEQ ID NO: 265412 - RNA, 22 nt, Homo sapiens
gugcaaguguaauacagcuagg

SEQ ID NO: 265413 - RNA, 22 nt, Homo sapiens
gugcacaacgugcaaguuuguu

SEQ ID NO: 265414 - RNA, 21 nt, Homo sapiens
gugcacaguaguguuuaauag

SEQ ID NO: 265415 - RNA, 22 nt, Homo sapiens
gugcacaugcgugcgcacauau

SEQ ID NO: 265416 - RNA, 21 nt, Homo sapiens
gugcagaugccacagucacuc

SEQ ID NO: 265417 - RNA, 22 nt, Homo sapiens
gugcagaugucuuuauaguagc

SEQ ID NO: 265418 - RNA, 22 nt, Homo sapiens
gugcaguuuugagugaguuucu

SEQ ID NO: 265419 - RNA, 22 nt, Homo sapiens
gugcauauaaguuguuucuagu

SEQ ID NO: 265420 - RNA, 22 nt, Homo sapiens
gugcccacugucuguccuguag

SEQ ID NO: 265421 - RNA, 22 nt, Homo sapiens
gugccuucuagcuaugguuggc

SEQ ID NO: 265422 - RNA, 22 nt, Homo sapiens
gugccuuuucugagcaaugagc

SEQ ID NO: 265423 - RNA, 22 nt, Homo sapiens
gugcuuguguuaauauguagcu

SEQ ID NO: 265424 - RNA, 22 nt, Homo sapiens
guggaaaacauaugcuuguuga

SEQ ID NO: 265425 - RNA, 22 nt, Homo sapiens
guggaagaccagacuuuccaac

SEQ ID NO: 265426 - RNA, 22 nt, Homo sapiens
guggaagcacaggccuccugga

SEQ ID NO: 265427 - RNA, 22 nt, Homo sapiens
guggaaggucaugaauguucuu

SEQ ID NO: 265428 - RNA, 22 nt, Homo sapiens
guggaauauaaagcaucgugua

SEQ ID NO: 265429 - RNA, 22 nt, Homo sapiens
guggagcuguguggccuugggc

SEQ ID NO: 265430 - RNA, 22 nt, Homo sapiens
guggcagagucagagggaaaug

SEQ ID NO: 265431 - RNA, 22 nt, Homo sapiens
guggcauuucccaaaguauucu

SEQ ID NO: 265432 - RNA, 22 nt, Homo sapiens
guggcuauuguucccugguugc

SEQ ID NO: 265433 - RNA, 22 nt, Homo sapiens
guggcuuuaaguacgauugagg

SEQ ID NO: 265434 - RNA, 22 nt, Homo sapiens
guggcuuuauuuagaagcaggg

SEQ ID NO: 265435 - RNA, 22 nt, Homo sapiens
gugggaagcuggaacucccucc

SEQ ID NO: 265436 - RNA, 22 nt, Homo sapiens
gugggaugcaaguaaaauuguc

SEQ ID NO: 265437 - RNA, 22 nt, Homo sapiens
gugggauggaaaugggcuucag

SEQ ID NO: 265438 - RNA, 22 nt, Homo sapiens
gugguagaaauguagaugcuag

SEQ ID NO: 265439 - RNA, 22 nt, Homo sapiens
guggucagaaaucucaguggca

SEQ ID NO: 265440 - RNA, 22 nt, Homo sapiens
gugguucuagagggacagaaug

SEQ ID NO: 265441 - RNA, 22 nt, Homo sapiens
gugguuuuaauauucagucuag

SEQ ID NO: 265442 - RNA, 22 nt, Homo sapiens
gugguuuucaacuccaccugca

SEQ ID NO: 265443 - RNA, 22 nt, Homo sapiens
gugguuuuuaaaguaccugugg

SEQ ID NO: 265444 - RNA, 22 nt, Homo sapiens
gugguuuuuuucugccuuauag

SEQ ID NO: 265445 - RNA, 22 nt, Homo sapiens
gugucaugaagguuuuaugcag

SEQ ID NO: 265446 - RNA, 22 nt, Homo sapiens
gugucuccuguggagcuaugua

SEQ ID NO: 265447 - RNA, 18 nt, Homo sapiens
gugucugguuaugggagu

SEQ ID NO: 265448 - RNA, 22 nt, Homo sapiens
gugugacuagucaugccugaau

SEQ ID NO: 265449 - RNA, 22 nt, Homo sapiens
gugugauuguuaauuuuaggug

SEQ ID NO: 265450 - RNA, 19 nt, Homo sapiens
gugugcauaucacagagca

SEQ ID NO: 265451 - RNA, 22 nt, Homo sapiens
gugugcauaugucuuuauagua

SEQ ID NO: 265452 - RNA, 22 nt, Homo sapiens
gugugguaggauugguuacuca

SEQ ID NO: 265453 - RNA, 23 nt, Homo sapiens
gugugguaggcuauaccaucuag

SEQ ID NO: 265454 - RNA, 22 nt, Homo sapiens
guguucaaagcugauugagauu

SEQ ID NO: 265455 - RNA, 22 nt, Homo sapiens
guguuugauugcaaauaaucua

SEQ ID NO: 265456 - RNA, 22 nt, Homo sapiens
guuaaagacauccacauaggag

SEQ ID NO: 265457 - RNA, 22 nt, Homo sapiens
guuaaugcuggaauaaguuaag

SEQ ID NO: 265458 - RNA, 22 nt, Homo sapiens
guuagguagaaguuuacuuuga

SEQ ID NO: 265459 - RNA, 22 nt, Homo sapiens
guuauauguuuggaaugaggaa

SEQ ID NO: 265460 - RNA, 22 nt, Homo sapiens
guuauguuaaauuguuguaugc

SEQ ID NO: 265461 - RNA, 22 nt, Homo sapiens
guucaagugauagcugggauua

SEQ ID NO: 265462 - RNA, 20 nt, Homo sapiens
guucacaggcuuccuuucag

SEQ ID NO: 265463 - RNA, 22 nt, Homo sapiens
guucacaguucagccuguaaca

SEQ ID NO: 265464 - RNA, 22 nt, Homo sapiens
guucaguaguucauucauuuau

SEQ ID NO: 265465 - RNA, 22 nt, Homo sapiens
uagaaugaaacaagcugugccu

SEQ ID NO: 265466 - RNA, 22 nt, Homo sapiens
uagacccauuguucagagagug

SEQ ID NO: 265467 - RNA, 22 nt, Homo sapiens
uagagcaugugccauacguaca

SEQ ID NO: 265468 - RNA, 22 nt, Homo sapiens
uagagguaggucuucgagucuc

SEQ ID NO: 265469 - RNA, 22 nt, Homo sapiens
uagaucaacuuugguaagagaa

SEQ ID NO: 265470 - RNA, 22 nt, Homo sapiens
uagauucaucuguuccuuuuga

SEQ ID NO: 265471 - RNA, 21 nt, Homo sapiens
uagcaaauugcuauuaaggca

SEQ ID NO: 265472 - RNA, 23 nt, Homo sapiens
uagcaacaguuggaggugaggua

SEQ ID NO: 265473 - RNA, 22 nt, Homo sapiens
uagcacaugucagguaauuugc

SEQ ID NO: 265474 - RNA, 22 nt, Homo sapiens
uagcaccaaacauauacucagu

SEQ ID NO: 265475 - RNA, 22 nt, Homo sapiens
uagcaccugugcacaccaggca

SEQ ID NO: 265476 - RNA, 22 nt, Homo sapiens
uagcaccuuagcauuucuagug

SEQ ID NO: 265477 - RNA, 22 nt, Homo sapiens
uagcagaauauaccucuuacuu

SEQ ID NO: 265478 - RNA, 22 nt, Homo sapiens
uagcaguauaugagagcuauug

SEQ ID NO: 265479 - RNA, 22 nt, Homo sapiens
uagcagucaagauagucauuau

SEQ ID NO: 265480 - RNA, 22 nt, Homo sapiens
uagcagugugaaaacagacuaa

SEQ ID NO: 265481 - RNA, 22 nt, Homo sapiens
uagcauggaggcggccauagug

SEQ ID NO: 265482 - RNA, 22 nt, Homo sapiens
uagcccagugagguugauuugg

SEQ ID NO: 265483 - RNA, 20 nt, Homo sapiens
uagccggguguugugucaug

SEQ ID NO: 265484 - RNA, 21 nt, Homo sapiens
uagcucagugguguugccaua

SEQ ID NO: 265485 - RNA, 17 nt, Homo sapiens
uagcucuauuucuagcc

SEQ ID NO: 265486 - RNA, 19 nt, Homo sapiens
uaggacccugguggccccc

SEQ ID NO: 265487 - RNA, 22 nt, Homo sapiens
uaggcaaguugcccaaucucuc

SEQ ID NO: 265488 - RNA, 22 nt, Homo sapiens
uaggcaauguggcgaaacucug

SEQ ID NO: 265489 - RNA, 22 nt, Homo sapiens
uaggcagccagcuguggauuga

SEQ ID NO: 265490 - RNA, 22 nt, Homo sapiens
uaggcaguggagaaauaaacag

SEQ ID NO: 265491 - RNA, 22 nt, Homo sapiens
uagggcuugugaucagguguag

SEQ ID NO: 265492 - RNA, 22 nt, Homo sapiens
uagggcuuuuccaagcugccac

SEQ ID NO: 265493 - RNA, 22 nt, Homo sapiens
uaggggcacacuucgguuagca

SEQ ID NO: 265494 - RNA, 22 nt, Homo sapiens
uagguaagauguuaacagcuga

SEQ ID NO: 265495 - RNA, 22 nt, Homo sapiens
uagguagcuuuggcguuucuug

SEQ ID NO: 265496 - RNA, 22 nt, Homo sapiens
uaggugguuugaaauacucaag

SEQ ID NO: 265497 - RNA, 22 nt, Homo sapiens
uagguugucaucagucuccacu

SEQ ID NO: 265498 - RNA, 22 nt, Homo sapiens
uagguuguccaucucuagaagc

SEQ ID NO: 265499 - RNA, 22 nt, Homo sapiens
uagguugucucuucacucugau

SEQ ID NO: 265500 - RNA, 22 nt, Homo sapiens
uagguugucuucccagaguuuu

SEQ ID NO: 265501 - RNA, 22 nt, Homo sapiens
uaguaguuuuguguauaauaau

SEQ ID NO: 265502 - RNA, 22 nt, Homo sapiens
uaguaucacauggucuuaauua

SEQ ID NO: 265503 - RNA, 22 nt, Homo sapiens
uagucccuuucuauuaaugaga

SEQ ID NO: 265504 - RNA, 21 nt, Homo sapiens
uagugcugaggcaguauggga

SEQ ID NO: 265505 - RNA, 22 nt, Homo sapiens
uagugcugugauaaacauauau

SEQ ID NO: 265506 - RNA, 20 nt, Homo sapiens
uaguggaaaucagguccucu

SEQ ID NO: 265507 - RNA, 22 nt, Homo sapiens
uaguuauggaguaauuuuaagc

SEQ ID NO: 265508 - RNA, 22 nt, Homo sapiens
uaguugcauucaggauaugacg

SEQ ID NO: 265509 - RNA, 22 nt, Homo sapiens
uaguugcauuggcugcuaugcu

SEQ ID NO: 265510 - RNA, 22 nt, Homo sapiens
uauaaugcacauucccaaaucu

SEQ ID NO: 265511 - RNA, 21 nt, Homo sapiens
uauagcagcacgauuuauaau

SEQ ID NO: 265512 - RNA, 22 nt, Homo sapiens
uauagcuaugggauguauuugc

SEQ ID NO: 265513 - RNA, 22 nt, Homo sapiens
uauaugauugguagacccugca

SEQ ID NO: 265514 - RNA, 22 nt, Homo sapiens
uaucaagaugacaaacuuugcu

SEQ ID NO: 265515 - RNA, 22 nt, Homo sapiens
uaucaagauggauaaggauaga

SEQ ID NO: 265516 - RNA, 22 nt, Homo sapiens
uaucaaggccacucauuuuaug

SEQ ID NO: 265517 - RNA, 23 nt, Homo sapiens
uaucacacuuucucugugccaca

SEQ ID NO: 265518 - RNA, 22 nt, Homo sapiens
uaucacagcaaggacccauuau

SEQ ID NO: 265519 - RNA, 22 nt, Homo sapiens
uaucacagcauugucuauaaua

SEQ ID NO: 265520 - RNA, 20 nt, Homo sapiens
uaucacaggucagaaacccu

SEQ ID NO: 265521 - RNA, 20 nt, Homo sapiens
uaucacauggggagaaaccu

SEQ ID NO: 265522 - RNA, 21 nt, Homo sapiens
uaucacauuggugauuaaguu

SEQ ID NO: 265523 - RNA, 19 nt, Homo sapiens
uaucacuucccuggaaaca

SEQ ID NO: 265524 - RNA, 21 nt, Homo sapiens
uaucagagacauugagaggca

SEQ ID NO: 265525 - RNA, 22 nt, Homo sapiens
uaucaucauguuuuugcugugu

SEQ ID NO: 265526 - RNA, 22 nt, Homo sapiens
uaucaucauuggcaggugagaa

SEQ ID NO: 265527 - RNA, 22 nt, Homo sapiens
uaucauugccucaaucuguauu

SEQ ID NO: 265528 - RNA, 22 nt, Homo sapiens
uauccugaagcuuuauuuaagu

SEQ ID NO: 265529 - RNA, 22 nt, Homo sapiens
uaucuacauguagguauguaug

SEQ ID NO: 265530 - RNA, 22 nt, Homo sapiens
uaucucagaugagacuuguaac

SEQ ID NO: 265531 - RNA, 22 nt, Homo sapiens
uaucugcacuucugucuagguc

SEQ ID NO: 265532 - RNA, 22 nt, Homo sapiens
uaugaaucuggcuacuccaggg

SEQ ID NO: 265533 - RNA, 20 nt, Homo sapiens
uaugacaaagccuagugagu

SEQ ID NO: 265534 - RNA, 22 nt, Homo sapiens
uaugacguuuuauuggcgcagu

SEQ ID NO: 265535 - RNA, 22 nt, Homo sapiens
uaugacuuuggaaaaauuacuu

SEQ ID NO: 265536 - RNA, 22 nt, Homo sapiens
uaugacuuuugaauacagaugg

SEQ ID NO: 265537 - RNA, 22 nt, Homo sapiens
uaugaugcugagguuuggagug

SEQ ID NO: 265538 - RNA, 22 nt, Homo sapiens
uaugauuuuugggagaggucaa

SEQ ID NO: 265539 - RNA, 22 nt, Homo sapiens
uaugcacaugcaugcuugaaua

SEQ ID NO: 265540 - RNA, 22 nt, Homo sapiens
uaugccucuucauaaaguauga

SEQ ID NO: 265541 - RNA, 22 nt, Homo sapiens
uaugcuuauuaaaacagugugu

SEQ ID NO: 265542 - RNA, 22 nt, Homo sapiens
uauggauuucauuagacuugag

SEQ ID NO: 265543 - RNA, 22 nt, Homo sapiens
uauggcauuuuguaagggcuug

SEQ ID NO: 265544 - RNA, 22 nt, Homo sapiens
uauggccccuacaugugcaaaa

SEQ ID NO: 265545 - RNA, 22 nt, Homo sapiens
uauggcucuauuuccuugucua

SEQ ID NO: 265546 - RNA, 21 nt, Homo sapiens
uauggcuuagucaguguuucc

SEQ ID NO: 265547 - RNA, 22 nt, Homo sapiens
uauuacauccauaggcucugcu

SEQ ID NO: 265548 - RNA, 22 nt, Homo sapiens
uauuacugucaauaucacagaa

SEQ ID NO: 265549 - RNA, 22 nt, Homo sapiens
uauuagguuggugcaacaguaa

SEQ ID NO: 265550 - RNA, 22 nt, Homo sapiens
uauuaguuuucuguggauuaca

SEQ ID NO: 265551 - RNA, 22 nt, Homo sapiens
uauucacaggugugggacaaag

SEQ ID NO: 265552 - RNA, 22 nt, Homo sapiens
uauuccagcccuggugagccag

SEQ ID NO: 265553 - RNA, 22 nt, Homo sapiens
uauugaauuugagcugucucuu

SEQ ID NO: 265554 - RNA, 23 nt, Homo sapiens
uauugcacuaugguaacccuuuu

SEQ ID NO: 265555 - RNA, 22 nt, Homo sapiens
ucaugaccaugguauagaccac

SEQ ID NO: 265556 - RNA, 22 nt, Homo sapiens
ucauggcauuguuaaggguuuu

SEQ ID NO: 265557 - RNA, 22 nt, Homo sapiens
ucauggcuuuuauuauguugag

SEQ ID NO: 265558 - RNA, 19 nt, Homo sapiens
ucauggcuuuuucagcugu

SEQ ID NO: 265559 - RNA, 22 nt, Homo sapiens
ucauuagagacagggugucacu

SEQ ID NO: 265560 - RNA, 22 nt, Homo sapiens
ucauuagagaucuuggggaaaa

SEQ ID NO: 265561 - RNA, 22 nt, Homo sapiens
ucauucauucuucaguggguac

SEQ ID NO: 265562 - RNA, 22 nt, Homo sapiens
ucauucuuucuguggaggggcu

SEQ ID NO: 265563 - RNA, 21 nt, Homo sapiens
ucauugggugcagcccacccu

SEQ ID NO: 265564 - RNA, 22 nt, Homo sapiens
ucauugguucuggguguuguug

SEQ ID NO: 265565 - RNA, 22 nt, Homo sapiens
uccacaguaaggacccugccuu

SEQ ID NO: 265566 - RNA, 22 nt, Homo sapiens
uccacaguggugaggugcagca

SEQ ID NO: 265567 - RNA, 19 nt, Homo sapiens
uccaccgcgugcaccucua

SEQ ID NO: 265568 - RNA, 22 nt, Homo sapiens
uccacguggucuaucuguccuu

SEQ ID NO: 265569 - RNA, 22 nt, Homo sapiens
uccacuuuugugcugaauugga

SEQ ID NO: 265570 - RNA, 22 nt, Homo sapiens
uccagaguggugaugcuggggc

SEQ ID NO: 265571 - RNA, 21 nt, Homo sapiens
uccagcuuugagaguuguggu

SEQ ID NO: 265572 - RNA, 22 nt, Homo sapiens
uccagguuuggcuuuauaacuu

SEQ ID NO: 265573 - RNA, 20 nt, Homo sapiens
uccaguuuuggagacauucu

SEQ ID NO: 265574 - RNA, 22 nt, Homo sapiens
uccauagacauuuuaagguagu

SEQ ID NO: 265575 - RNA, 22 nt, Homo sapiens
uccaugaggcuacaguaaucuc

SEQ ID NO: 265576 - RNA, 22 nt, Homo sapiens
uccaugaguccauuagaaaaaa

SEQ ID NO: 265577 - RNA, 22 nt, Homo sapiens
uccauguagaugcuauguuguc

SEQ ID NO: 265578 - RNA, 22 nt, Homo sapiens
uccaugugaaaucuaugaggac

SEQ ID NO: 265579 - RNA, 22 nt, Homo sapiens
uccauuugucuauguuucuguu

SEQ ID NO: 265580 - RNA, 22 nt, Homo sapiens
ucccaagaugagaugggggcug

SEQ ID NO: 265581 - RNA, 22 nt, Homo sapiens
ucccacugucuucucgugcucg

SEQ ID NO: 265582 - RNA, 22 nt, Homo sapiens
ucccagugcuaugcaaaagccu

SEQ ID NO: 265583 - RNA, 22 nt, Homo sapiens
ucccaguggucuugaaacaggg

SEQ ID NO: 265584 - RNA, 22 nt, Homo sapiens
ucccaguguguagcuugucucu

SEQ ID NO: 265585 - RNA, 17 nt, Homo sapiens
ucccauguuucuucuac

SEQ ID NO: 265586 - RNA, 22 nt, Homo sapiens
uccccgagcccaggcugugacu

SEQ ID NO: 265587 - RNA, 22 nt, Homo sapiens
uccccgucacacgcaggcuuac

SEQ ID NO: 265588 - RNA, 22 nt, Homo sapiens
uccccuuuguaagauggaaacg

SEQ ID NO: 265589 - RNA, 22 nt, Homo sapiens
ucccuacuggggcacugccuag

SEQ ID NO: 265590 - RNA, 18 nt, Homo sapiens
ucccucagaauuauagaa

SEQ ID NO: 265591 - RNA, 19 nt, Homo sapiens
ucccugagucuuagcuuga

SEQ ID NO: 265592 - RNA, 19 nt, Homo sapiens
ucccuguagaccacagugc

SEQ ID NO: 265593 - RNA, 22 nt, Homo sapiens
ucccuguguccugggggcaccu

SEQ ID NO: 265594 - RNA, 22 nt, Homo sapiens
ucccuguguuccuuuugaauug

SEQ ID NO: 265595 - RNA, 22 nt, Homo sapiens
ucccuguuaggcacagauuuau

SEQ ID NO: 265596 - RNA, 18 nt, Homo sapiens
ucccuuuguagaugaccc

SEQ ID NO: 265597 - RNA, 22 nt, Homo sapiens
ucccuuuguccaacggauccac

SEQ ID NO: 265598 - RNA, 22 nt, Homo sapiens
uccucaguggauuggauggugc

SEQ ID NO: 265599 - RNA, 22 nt, Homo sapiens
uccugagucagcauccguuugu

SEQ ID NO: 265600 - RNA, 22 nt, Homo sapiens
uccuucaguccaguggguuuug

SEQ ID NO: 265601 - RNA, 22 nt, Homo sapiens
uccuugagaggacagagccaua

SEQ ID NO: 265602 - RNA, 22 nt, Homo sapiens
uccuugagccucccagacucag

SEQ ID NO: 265603 - RNA, 22 nt, Homo sapiens
uccuugagucugaacuuuggau

SEQ ID NO: 265604 - RNA, 22 nt, Homo sapiens
uccuuggucauggaagagacag

SEQ ID NO: 265605 - RNA, 22 nt, Homo sapiens
uccuuuagacugaauccugaga

SEQ ID NO: 265606 - RNA, 22 nt, Homo sapiens
uccuuuaguuaauaaagacaag

SEQ ID NO: 265607 - RNA, 22 nt, Homo sapiens
ucuaauguaaccugcaaauauu

SEQ ID NO: 265608 - RNA, 21 nt, Homo sapiens
ucuaccuacugcucacaggcu

SEQ ID NO: 265609 - RNA, 22 nt, Homo sapiens
ucuagcacuuacuggcugugug

SEQ ID NO: 265610 - RNA, 22 nt, Homo sapiens
ucuauggaguuugaaugagaaa

SEQ ID NO: 265611 - RNA, 22 nt, Homo sapiens
ucuaugguuuauuuccaagugu

SEQ ID NO: 265612 - RNA, 22 nt, Homo sapiens
ucucaaccuccacacuacaaua

SEQ ID NO: 265613 - RNA, 22 nt, Homo sapiens
ucucaauuugauuacauucaua

SEQ ID NO: 265614 - RNA, 22 nt, Homo sapiens
ucucacaccccucucauauacc

SEQ ID NO: 265615 - RNA, 18 nt, Homo sapiens
ucucacagcaaucuguca

SEQ ID NO: 265616 - RNA, 22 nt, Homo sapiens
ucucagugacugcugggucccc

SEQ ID NO: 265617 - RNA, 22 nt, Homo sapiens
ucucaguggcuuccucacuuuu

SEQ ID NO: 265618 - RNA, 19 nt, Homo sapiens
ucucaguguuggucaggug

SEQ ID NO: 265619 - RNA, 21 nt, Homo sapiens
ucucauagaguuucacuuucu

SEQ ID NO: 265620 - RNA, 20 nt, Homo sapiens
ucucauggagggaaagagca

SEQ ID NO: 265621 - RNA, 22 nt, Homo sapiens
ucucauggagucaggagcagaa

SEQ ID NO: 265622 - RNA, 22 nt, Homo sapiens
ucucauggcucacccugcauag

SEQ ID NO: 265623 - RNA, 23 nt, Homo sapiens
ucucauuccuugaaaauaaugac

SEQ ID NO: 265624 - RNA, 22 nt, Homo sapiens
ucuccaguuuccuucgucuauc

SEQ ID NO: 265625 - RNA, 22 nt, Homo sapiens
ucucccuaccugagccgagcca

SEQ ID NO: 265626 - RNA, 22 nt, Homo sapiens
ucuccggguggcggcgaaggga

SEQ ID NO: 265627 - RNA, 22 nt, Homo sapiens
ucucuguuugucuguuacuggu

SEQ ID NO: 265628 - RNA, 22 nt, Homo sapiens
ucugacacuucugcagaauuga

SEQ ID NO: 265629 - RNA, 22 nt, Homo sapiens
ucugagacuguuucuaacaagc

SEQ ID NO: 265630 - RNA, 22 nt, Homo sapiens
ucugagguuaaauuuuauaguu

SEQ ID NO: 265631 - RNA, 22 nt, Homo sapiens
ucugagucaucacaaaugaugc

SEQ ID NO: 265632 - RNA, 22 nt, Homo sapiens
ucugauggaguugccagggaga

SEQ ID NO: 265633 - RNA, 20 nt, Homo sapiens
ucugauugcaacugcaugag

SEQ ID NO: 265634 - RNA, 22 nt, Homo sapiens
ucugccuacugguuggaggaac

SEQ ID NO: 265635 - RNA, 22 nt, Homo sapiens
ucugccuuuucaugugggaugg

SEQ ID NO: 265636 - RNA, 23 nt, Homo sapiens
ucugcggguguggacccuagugc

SEQ ID NO: 265637 - RNA, 22 nt, Homo sapiens
ucuggaauguaaaguuuauggg

SEQ ID NO: 265638 - RNA, 22 nt, Homo sapiens
ucuggcacucagaggccuugcu

SEQ ID NO: 265639 - RNA, 22 nt, Homo sapiens
ucuggccuacaucauuuuuccg

SEQ ID NO: 265640 - RNA, 23 nt, Homo sapiens
ucuggcuuugggaugcucaaggg

SEQ ID NO: 265641 - RNA, 22 nt, Homo sapiens
ucugucacugaaucccugucac

SEQ ID NO: 265642 - RNA, 22 nt, Homo sapiens
ucugucuuguccucacccuaga

SEQ ID NO: 265643 - RNA, 22 nt, Homo sapiens
ucugugcauggcagaggaauga

SEQ ID NO: 265644 - RNA, 22 nt, Homo sapiens
ucugugcauuguaacaacuaaa

SEQ ID NO: 265645 - RNA, 22 nt, Homo sapiens
ugagaguagggguugggauugg

SEQ ID NO: 265646 - RNA, 22 nt, Homo sapiens
ugagagucauacaaauaaaaau

SEQ ID NO: 265647 - RNA, 22 nt, Homo sapiens
ugagauagaaaacauaggagaa

SEQ ID NO: 265648 - RNA, 22 nt, Homo sapiens
ugagauagcauaagggacagaa

SEQ ID NO: 265649 - RNA, 22 nt, Homo sapiens
ugagauaguuguagauguacau

SEQ ID NO: 265650 - RNA, 22 nt, Homo sapiens
ugagaucaaggugggcccuggg

SEQ ID NO: 265651 - RNA, 22 nt, Homo sapiens
ugagaugaguugcgcucugucg

SEQ ID NO: 265652 - RNA, 22 nt, Homo sapiens
ugagaugauagauauguuaauu

SEQ ID NO: 265653 - RNA, 22 nt, Homo sapiens
ugagauggcuuuauugcugaau

SEQ ID NO: 265654 - RNA, 22 nt, Homo sapiens
ugagaugguaaauuuuuguugu

SEQ ID NO: 265655 - RNA, 22 nt, Homo sapiens
ugagaugugaucaccugaaggg

SEQ ID NO: 265656 - RNA, 22 nt, Homo sapiens
ugagauuaucuugaucuugaaa

SEQ ID NO: 265657 - RNA, 20 nt, Homo sapiens
ugagauuggugugguauaag

SEQ ID NO: 265658 - RNA, 22 nt, Homo sapiens
ugagauuguaucugcaaugugu

SEQ ID NO: 265659 - RNA, 19 nt, Homo sapiens
ugagauuguaugaggagau

SEQ ID NO: 265660 - RNA, 22 nt, Homo sapiens
ugagcagaaguuuugauuggcg

SEQ ID NO: 265661 - RNA, 22 nt, Homo sapiens
ugagcagugagugugcugcagg

SEQ ID NO: 265662 - RNA, 22 nt, Homo sapiens
ugagcccauuguccugguuuau

SEQ ID NO: 265663 - RNA, 20 nt, Homo sapiens
ugagccccuggacucaagcg

SEQ ID NO: 265664 - RNA, 20 nt, Homo sapiens
ugagcucaugacauuuuucu

SEQ ID NO: 265665 - RNA, 22 nt, Homo sapiens
ugagcugagaucaugcuauugu

SEQ ID NO: 265666 - RNA, 22 nt, Homo sapiens
ugagcugguacuaauauuauca

SEQ ID NO: 265667 - RNA, 22 nt, Homo sapiens
ugaggagugaacuauuucugau

SEQ ID NO: 265668 - RNA, 22 nt, Homo sapiens
ugaggaguguauuucauucgcu

SEQ ID NO: 265669 - RNA, 22 nt, Homo sapiens
ugaggcuagucagaucagauga

SEQ ID NO: 265670 - RNA, 22 nt, Homo sapiens
ugagguaacaaacuaugaguua

SEQ ID NO: 265671 - RNA, 20 nt, Homo sapiens
ugaggucaggaguuacagac

SEQ ID NO: 265672 - RNA, 21 nt, Homo sapiens
ugaggucaugaugcugcuucc

SEQ ID NO: 265673 - RNA, 22 nt, Homo sapiens
ugaggucauguucugucagguu

SEQ ID NO: 265674 - RNA, 20 nt, Homo sapiens
ugaggucugagaaagaauga

SEQ ID NO: 265675 - RNA, 22 nt, Homo sapiens
ugaggugaggguaucaaaugcu

SEQ ID NO: 265676 - RNA, 23 nt, Homo sapiens
ugagguguuaagcagacuugucu

SEQ ID NO: 265677 - RNA, 22 nt, Homo sapiens
ugagguugguauuacugucucu

SEQ ID NO: 265678 - RNA, 22 nt, Homo sapiens
ugaguacuacuaguuacugcua

SEQ ID NO: 265679 - RNA, 22 nt, Homo sapiens
ugaguagagaauucagcuaagg

SEQ ID NO: 265680 - RNA, 22 nt, Homo sapiens
ugaguagcuaagacgauaggca

SEQ ID NO: 265681 - RNA, 22 nt, Homo sapiens
ugagucagucucacucugcugc

SEQ ID NO: 265682 - RNA, 22 nt, Homo sapiens
ugagucuguucucacauugcua

SEQ ID NO: 265683 - RNA, 22 nt, Homo sapiens
ugagugaaugugaaggcuaggg

SEQ ID NO: 265684 - RNA, 22 nt, Homo sapiens
ugagugagguucuacucuguga

SEQ ID NO: 265685 - RNA, 22 nt, Homo sapiens
ugagugccuggagggcagggac

SEQ ID NO: 265686 - RNA, 17 nt, Homo sapiens
ugaguuaaucuuugugc

SEQ ID NO: 265687 - RNA, 22 nt, Homo sapiens
ugaguuaggagaguguggcucu

SEQ ID NO: 265688 - RNA, 22 nt, Homo sapiens
ugaguuauuaguagaggcuaug

SEQ ID NO: 265689 - RNA, 22 nt, Homo sapiens
ugaguucaugcuuguaguucua

SEQ ID NO: 265690 - RNA, 22 nt, Homo sapiens
ugaguucuuccuaucucugccu

SEQ ID NO: 265691 - RNA, 22 nt, Homo sapiens
ugaguucuuuuacauuuugaau

SEQ ID NO: 265692 - RNA, 22 nt, Homo sapiens
ugauacuggcuucauagaauga

SEQ ID NO: 265693 - RNA, 18 nt, Homo sapiens
ugauaucaaugauagcca

SEQ ID NO: 265694 - RNA, 18 nt, Homo sapiens
ugauaucaucacaauuga

SEQ ID NO: 265695 - RNA, 22 nt, Homo sapiens
ugauauguaacuacuccuuaua

SEQ ID NO: 265696 - RNA, 22 nt, Homo sapiens
ugauaugucccucgacaucagg

SEQ ID NO: 265697 - RNA, 22 nt, Homo sapiens
ugauaugugaguauaugguuau

SEQ ID NO: 265698 - RNA, 22 nt, Homo sapiens
ugauauguggauucagcucaaa

SEQ ID NO: 265699 - RNA, 22 nt, Homo sapiens
ugauauguguaaacaauguaua

SEQ ID NO: 265700 - RNA, 17 nt, Homo sapiens
ugauauuuucccagaua

SEQ ID NO: 265701 - RNA, 20 nt, Homo sapiens
ugauauuuucugagcaggaa

SEQ ID NO: 265702 - RNA, 22 nt, Homo sapiens
ugauauuuuugauccuuaaguu

SEQ ID NO: 265703 - RNA, 22 nt, Homo sapiens
ugaucucagcucacugguugaa

SEQ ID NO: 265704 - RNA, 22 nt, Homo sapiens
ugaucugucucggguuaucagu

SEQ ID NO: 265705 - RNA, 22 nt, Homo sapiens
ugaucuguguaacauaggaguc

SEQ ID NO: 265706 - RNA, 22 nt, Homo sapiens
ugaugaaguauaggaagggcuu

SEQ ID NO: 265707 - RNA, 22 nt, Homo sapiens
ugaugacacugauuucuucaau

SEQ ID NO: 265708 - RNA, 21 nt, Homo sapiens
ugaugcuuuucuuaaccuugc

SEQ ID NO: 265709 - RNA, 22 nt, Homo sapiens
ugauggcaauggcauucauuuu

SEQ ID NO: 265710 - RNA, 22 nt, Homo sapiens
ugauggcauuuggaguugggac

SEQ ID NO: 265711 - RNA, 22 nt, Homo sapiens
ugaugguuuuaaaaagaggagu

SEQ ID NO: 265712 - RNA, 20 nt, Homo sapiens
ugauguccaggcagagguuu

SEQ ID NO: 265713 - RNA, 22 nt, Homo sapiens
ugauguccaguucauagaaacu

SEQ ID NO: 265714 - RNA, 22 nt, Homo sapiens
ugaugucuugagauggagcuua

SEQ ID NO: 265715 - RNA, 22 nt, Homo sapiens
ugaugucuugcaggcacgagau

SEQ ID NO: 265716 - RNA, 22 nt, Homo sapiens
ugaugugucaucugagagagug

SEQ ID NO: 265717 - RNA, 22 nt, Homo sapiens
ugauugacauacauaggugugg

SEQ ID NO: 265718 - RNA, 22 nt, Homo sapiens
ugauugacauucuuuggaguau

SEQ ID NO: 265719 - RNA, 18 nt, Homo sapiens
ugauugacuuauuuaggu

SEQ ID NO: 265720 - RNA, 22 nt, Homo sapiens
ugauuggagaacaaacugcaua

SEQ ID NO: 265721 - RNA, 19 nt, Homo sapiens
ugcaaagucuuuuccuauu

SEQ ID NO: 265722 - RNA, 19 nt, Homo sapiens
ugcaaauucuaaaaacuga

SEQ ID NO: 265723 - RNA, 22 nt, Homo sapiens
ugcaacacauugccccugcucu

SEQ ID NO: 265724 - RNA, 22 nt, Homo sapiens
ugcaagaaucagccuaucauua

SEQ ID NO: 265725 - RNA, 22 nt, Homo sapiens
ugcaagaaucuuucaggcuagc

SEQ ID NO: 265726 - RNA, 22 nt, Homo sapiens
ugcaccacugcacuccagcuug

SEQ ID NO: 265727 - RNA, 22 nt, Homo sapiens
ugcaccaucuugcuucuguggu

SEQ ID NO: 265728 - RNA, 22 nt, Homo sapiens
ugcacuguggucugagagacag

SEQ ID NO: 265729 - RNA, 22 nt, Homo sapiens
ugcagagaaacauuuuguauuu

SEQ ID NO: 265730 - RNA, 19 nt, Homo sapiens
ugcagcaauguaaaagaca

SEQ ID NO: 265731 - RNA, 20 nt, Homo sapiens
ugcagcacgggcccuuucca

SEQ ID NO: 265732 - RNA, 20 nt, Homo sapiens
ugcagcacugggaaugcagu

SEQ ID NO: 265733 - RNA, 22 nt, Homo sapiens
ugcagcauugcacuccagccug

SEQ ID NO: 265734 - RNA, 21 nt, Homo sapiens
ugcagccauucagcccuaugc

SEQ ID NO: 265735 - RNA, 22 nt, Homo sapiens
ugcagugugaaagagccugaca

SEQ ID NO: 265736 - RNA, 22 nt, Homo sapiens
uggccuuuuccaagaacuacua

SEQ ID NO: 265737 - RNA, 22 nt, Homo sapiens
uggcggagacauggacuucaga

SEQ ID NO: 265738 - RNA, 22 nt, Homo sapiens
uggcuacagaaaguacuaguga

SEQ ID NO: 265739 - RNA, 22 nt, Homo sapiens
uggcuacugaccugcuaggggg

SEQ ID NO: 265740 - RNA, 21 nt, Homo sapiens
uggcuguuuucaugcuagaac

SEQ ID NO: 265741 - RNA, 22 nt, Homo sapiens
uggcuuuuccuugaaucugccu

SEQ ID NO: 265742 - RNA, 22 nt, Homo sapiens
uggcuuuuguuauuuggaagcu

SEQ ID NO: 265743 - RNA, 22 nt, Homo sapiens
ugggaagcugcauuuuaacaag

SEQ ID NO: 265744 - RNA, 22 nt, Homo sapiens
ugggaucaugagcaccgcuucc

SEQ ID NO: 265745 - RNA, 22 nt, Homo sapiens
ugggaucauuaugcauagugua

SEQ ID NO: 265746 - RNA, 22 nt, Homo sapiens
ugggaucauucaaugacgaaau

SEQ ID NO: 265747 - RNA, 22 nt, Homo sapiens
ugggauccaugugguuuaagca

SEQ ID NO: 265748 - RNA, 22 nt, Homo sapiens
ugggcaaauugugagggaggua

SEQ ID NO: 265749 - RNA, 21 nt, Homo sapiens
ugggccccuuccuuacaucau

SEQ ID NO: 265750 - RNA, 22 nt, Homo sapiens
ugggccgcugcaggaugguccc

SEQ ID NO: 265751 - RNA, 22 nt, Homo sapiens
ugggguaggccugguuaugugc

SEQ ID NO: 265752 - RNA, 22 nt, Homo sapiens
ugggguaggcuguauacucugu

SEQ ID NO: 265753 - RNA, 22 nt, Homo sapiens
uggguaaaucucuguucagggc

SEQ ID NO: 265754 - RNA, 22 nt, Homo sapiens
uggguaggaccagaaaugcacu

SEQ ID NO: 265755 - RNA, 23 nt, Homo sapiens
uggguucauucuugaagucagug

SEQ ID NO: 265756 - RNA, 22 nt, Homo sapiens
ugguaagaucugugagccaggc

SEQ ID NO: 265757 - RNA, 22 nt, Homo sapiens
ugguaucauuuuaucugcucua

SEQ ID NO: 265758 - RNA, 22 nt, Homo sapiens
ugguaugucuuucuuccuguag

SEQ ID NO: 265759 - RNA, 22 nt, Homo sapiens
uggucagaugcugaguggaucu

SEQ ID NO: 265760 - RNA, 22 nt, Homo sapiens
ugguccccaauacuucuauaga

SEQ ID NO: 265761 - RNA, 22 nt, Homo sapiens
uggucuggagagucccgcccag

SEQ ID NO: 265762 - RNA, 22 nt, Homo sapiens
uggucuucuggccuccagaacc

SEQ ID NO: 265763 - RNA, 22 nt, Homo sapiens
uggugagaaaagaugucuuugu

SEQ ID NO: 265764 - RNA, 22 nt, Homo sapiens
uggugagaaaugagaugcuuuu

SEQ ID NO: 265765 - RNA, 22 nt, Homo sapiens
ugguggcuuuucguagguucac

SEQ ID NO: 265766 - RNA, 15 nt, Homo sapiens
uggugguguugagac

SEQ ID NO: 265767 - RNA, 22 nt, Homo sapiens
ugguuaucacuuuccuuccauc

SEQ ID NO: 265768 - RNA, 22 nt, Homo sapiens
ugguucaguugcacaggcuguu

SEQ ID NO: 265769 - RNA, 22 nt, Homo sapiens
uguaaacauguauguguuuaug

SEQ ID NO: 265770 - RNA, 22 nt, Homo sapiens
uguaauaguaggcucacauuug

SEQ ID NO: 265771 - RNA, 22 nt, Homo sapiens
uguacaaauuucugugguggug

SEQ ID NO: 265772 - RNA, 22 nt, Homo sapiens
uguagauauucuuucaguuuuu

SEQ ID NO: 265773 - RNA, 23 nt, Homo sapiens
uguauacacccugugcaucuggg

SEQ ID NO: 265774 - RNA, 22 nt, Homo sapiens
uguauguugggucaaaguacau

SEQ ID NO: 265775 - RNA, 22 nt, Homo sapiens
uguauguuuaaggccaguggaa

SEQ ID NO: 265776 - RNA, 22 nt, Homo sapiens
ugucaacauuuaucaaguuauu

SEQ ID NO: 265777 - RNA, 22 nt, Homo sapiens
ugucaagaaaucaaggugugag

SEQ ID NO: 265778 - RNA, 22 nt, Homo sapiens
ugucaaggaaugucauugguuu

SEQ ID NO: 265779 - RNA, 22 nt, Homo sapiens
ugucacagagauuuugguaugu

SEQ ID NO: 265780 - RNA, 18 nt, Homo sapiens
ugucacuggauaaugguc

SEQ ID NO: 265781 - RNA, 22 nt, Homo sapiens
ugucagaaucuagaggcugcua

SEQ ID NO: 265782 - RNA, 22 nt, Homo sapiens
ugucagaaucugagacgacaac

SEQ ID NO: 265783 - RNA, 22 nt, Homo sapiens
ugucaggaguuuuagaaucuua

SEQ ID NO: 265784 - RNA, 22 nt, Homo sapiens
ugucaguggacugugaaaggca

SEQ ID NO: 265785 - RNA, 22 nt, Homo sapiens
ugucaguuucuugagauggaac

SEQ ID NO: 265786 - RNA, 22 nt, Homo sapiens
ugucaguuuuaacuagggaaua

SEQ ID NO: 265787 - RNA, 22 nt, Homo sapiens
ugucauauagaauguucuauga

SEQ ID NO: 265788 - RNA, 22 nt, Homo sapiens
ugucauggcauuuguaaacugc

SEQ ID NO: 265789 - RNA, 22 nt, Homo sapiens
ugucauguaaagaguaaauggu

SEQ ID NO: 265790 - RNA, 22 nt, Homo sapiens
ugucauguagaaauuguccauu

SEQ ID NO: 265791 - RNA, 22 nt, Homo sapiens
ugucauguugagaaacuuggau

SEQ ID NO: 265792 - RNA, 16 nt, Homo sapiens
uguccaaauaaauaca

SEQ ID NO: 265793 - RNA, 20 nt, Homo sapiens
ugucccaaccccauggguuc

SEQ ID NO: 265794 - RNA, 22 nt, Homo sapiens
ugucccaguuggguauugaauu

SEQ ID NO: 265795 - RNA, 22 nt, Homo sapiens
ugucccugagccuggauuccug

SEQ ID NO: 265796 - RNA, 22 nt, Homo sapiens
ugucuagaaaagccugccuucu

SEQ ID NO: 265797 - RNA, 22 nt, Homo sapiens
ugucucaguuacggcaauucca

SEQ ID NO: 265798 - RNA, 21 nt, Homo sapiens
ugucugagagaggagaucuac

SEQ ID NO: 265799 - RNA, 22 nt, Homo sapiens
ugucuuggagaauccuggguuu

SEQ ID NO: 265800 - RNA, 21 nt, Homo sapiens
ugucuuggagccagacgccag

SEQ ID NO: 265801 - RNA, 22 nt, Homo sapiens
ugucuuggaugaggauuaacag

SEQ ID NO: 265802 - RNA, 22 nt, Homo sapiens
ugugaacagaauuagucaccua

SEQ ID NO: 265803 - RNA, 22 nt, Homo sapiens
ugugaacagcuccaaaugugga

SEQ ID NO: 265804 - RNA, 22 nt, Homo sapiens
ugugaauguaagaaaauccaac

SEQ ID NO: 265805 - RNA, 23 nt, Homo sapiens
ugugacacuuccgucaguucauu

SEQ ID NO: 265806 - RNA, 18 nt, Homo sapiens
ugugacauugagcauguc

SEQ ID NO: 265807 - RNA, 22 nt, Homo sapiens
ugugaccaaaaucaacauaccu

SEQ ID NO: 265808 - RNA, 22 nt, Homo sapiens
ugugacuaguggugaaugacgc

SEQ ID NO: 265809 - RNA, 22 nt, Homo sapiens
ugugacucuggcacauggugag

SEQ ID NO: 265810 - RNA, 22 nt, Homo sapiens
ugugagacugguucugaaccca

SEQ ID NO: 265811 - RNA, 22 nt, Homo sapiens
ugugauaguuggcuaaagcagu

SEQ ID NO: 265812 - RNA, 22 nt, Homo sapiens
ugugaugguuuggaagcuucuu

SEQ ID NO: 265813 - RNA, 20 nt, Homo sapiens
ugugauuauuuaguugcaug

SEQ ID NO: 265814 - RNA, 22 nt, Homo sapiens
ugugauugauuaaugugugcua

SEQ ID NO: 265815 - RNA, 22 nt, Homo sapiens
ugugcacaacaugcagguuugu

SEQ ID NO: 265816 - RNA, 22 nt, Homo sapiens
ugugcacaaugugcagguuugu

SEQ ID NO: 265817 - RNA, 22 nt, Homo sapiens
ugugcacaugauauaucacaua

SEQ ID NO: 265818 - RNA, 22 nt, Homo sapiens
ugugccacuccaaccuggguga

SEQ ID NO: 265819 - RNA, 22 nt, Homo sapiens
ugugccacuccaggaggcuguu

SEQ ID NO: 265820 - RNA, 22 nt, Homo sapiens
ugugccacugcacucuggccug

SEQ ID NO: 265821 - RNA, 22 nt, Homo sapiens
ugugccacugcacucugggcaa

SEQ ID NO: 265822 - RNA, 22 nt, Homo sapiens
ugugccacugcacuucagccug

SEQ ID NO: 265823 - RNA, 22 nt, Homo sapiens
ugugccuaguaauguguccaga

SEQ ID NO: 265824 - RNA, 22 nt, Homo sapiens
ugugcguguaagagaucuaggu

SEQ ID NO: 265825 - RNA, 22 nt, Homo sapiens
ugugcuaaaaugggacuucuaa

SEQ ID NO: 265826 - RNA, 22 nt, Homo sapiens
uucacaugguugccuuuugauc

SEQ ID NO: 265827 - RNA, 22 nt, Homo sapiens
uucaccuugggucccacuugcu

SEQ ID NO: 265828 - RNA, 22 nt, Homo sapiens
uucacugagccagacuaagaca

SEQ ID NO: 265829 - RNA, 22 nt, Homo sapiens
uucacugcauuucagccugggc

SEQ ID NO: 265830 - RNA, 20 nt, Homo sapiens
uucacugggcucucuguugg

SEQ ID NO: 265831 - RNA, 22 nt, Homo sapiens
uucacuguaaaaugaagagggu

SEQ ID NO: 265832 - RNA, 22 nt, Homo sapiens
uucacugugaacucauauucag

SEQ ID NO: 265833 - RNA, 22 nt, Homo sapiens
uucagagagggagggauaccua

SEQ ID NO: 265834 - RNA, 22 nt, Homo sapiens
uucagaugcacacuguagucua

SEQ ID NO: 265835 - RNA, 22 nt, Homo sapiens
uucagcaaugacagccuauaua

SEQ ID NO: 265836 - RNA, 22 nt, Homo sapiens
uucagcaguggccaguggaaau

SEQ ID NO: 265837 - RNA, 22 nt, Homo sapiens
uucagcuaccugggaugcugaa

SEQ ID NO: 265838 - RNA, 22 nt, Homo sapiens
uucaggcaccauggucauugau

SEQ ID NO: 265839 - RNA, 22 nt, Homo sapiens
uucagguucauuugcugcuauu

SEQ ID NO: 265840 - RNA, 22 nt, Homo sapiens
uucaguaaauguucuuacuaua

SEQ ID NO: 265841 - RNA, 22 nt, Homo sapiens
uucaguaguaaguuggaacucu

SEQ ID NO: 265842 - RNA, 22 nt, Homo sapiens
uucaguccauuuccuuggucac

SEQ ID NO: 265843 - RNA, 22 nt, Homo sapiens
uucaguggguggaugaauauga

SEQ ID NO: 265844 - RNA, 22 nt, Homo sapiens
uucaguucugcucugaucuuag

SEQ ID NO: 265845 - RNA, 22 nt, Homo sapiens
uucauagaggacauuacuggag

SEQ ID NO: 265846 - RNA, 22 nt, Homo sapiens
uucauaguauuuuucuccaaau

SEQ ID NO: 265847 - RNA, 22 nt, Homo sapiens
uucauaguguuuccuuccagug

SEQ ID NO: 265848 - RNA, 22 nt, Homo sapiens
uucauaguucuuuuagucauua

SEQ ID NO: 265849 - RNA, 22 nt, Homo sapiens
uucaucacagucuccgaugccc

SEQ ID NO: 265850 - RNA, 20 nt, Homo sapiens
uucaucaggauauuggucua

SEQ ID NO: 265851 - RNA, 23 nt, Homo sapiens
uucaucagggauauuggccugaa

SEQ ID NO: 265852 - RNA, 22 nt, Homo sapiens
uucaucagggguauuggccaau

SEQ ID NO: 265853 - RNA, 22 nt, Homo sapiens
uucaucaguugagcugguugcu

SEQ ID NO: 265854 - RNA, 22 nt, Homo sapiens
uucauggaauauugaccauuuu

SEQ ID NO: 265855 - RNA, 22 nt, Homo sapiens
uucauggugguacaaaagcaau

SEQ ID NO: 265856 - RNA, 22 nt, Homo sapiens
uucauguaaucaaggcagcuaa

SEQ ID NO: 265857 - RNA, 22 nt, Homo sapiens
uuccaauguuccguguugcagu

SEQ ID NO: 265858 - RNA, 22 nt, Homo sapiens
uuccacaauggcugaacuaguu

SEQ ID NO: 265859 - RNA, 22 nt, Homo sapiens
uuccacaggguugaacuaguuu

SEQ ID NO: 265860 - RNA, 23 nt, Homo sapiens
uuccaccauugacuaguuacaua

SEQ ID NO: 265861 - RNA, 22 nt, Homo sapiens
uuccagagucaccuuucugucg

SEQ ID NO: 265862 - RNA, 20 nt, Homo sapiens
uuccagcacauuagggaagc

SEQ ID NO: 265863 - RNA, 22 nt, Homo sapiens
uuccaguaauagcacagcauug

SEQ ID NO: 265864 - RNA, 22 nt, Homo sapiens
uuccagugggacgagaugugga

SEQ ID NO: 265865 - RNA, 22 nt, Homo sapiens
uuccaguugugagcuauccggg

SEQ ID NO: 265866 - RNA, 22 nt, Homo sapiens
uucccagagaaaaggguuucuu

SEQ ID NO: 265867 - RNA, 22 nt, Homo sapiens
uucccgggguggaaugcaguga

SEQ ID NO: 265868 - RNA, 22 nt, Homo sapiens
uucccucagaaacacacagccc

SEQ ID NO: 265869 - RNA, 20 nt, Homo sapiens
uucccucagccuugagggua

SEQ ID NO: 265870 - RNA, 22 nt, Homo sapiens
uucccugagcaucuguugagcc

SEQ ID NO: 265871 - RNA, 22 nt, Homo sapiens
uucccugugugcagaugggugu

SEQ ID NO: 265872 - RNA, 22 nt, Homo sapiens
uucccuuugaaacuaaacuugc

SEQ ID NO: 265873 - RNA, 22 nt, Homo sapiens
uuccguguaguugagcaguuuu

SEQ ID NO: 265874 - RNA, 22 nt, Homo sapiens
uuccugagagggcugggugcag

SEQ ID NO: 265875 - RNA, 22 nt, Homo sapiens
uuccuugagaaaguacaaggcu

SEQ ID NO: 265876 - RNA, 22 nt, Homo sapiens
uuccuugagagcuugauaucac

SEQ ID NO: 265877 - RNA, 22 nt, Homo sapiens
uucgucaugagacagaugcuga

SEQ ID NO: 265878 - RNA, 22 nt, Homo sapiens
uucuacaugggucgucggugag

SEQ ID NO: 265879 - RNA, 22 nt, Homo sapiens
uucuagcaauggcagagugucu

SEQ ID NO: 265880 - RNA, 22 nt, Homo sapiens
uucuaugguuuuuaugguguua

SEQ ID NO: 265881 - RNA, 22 nt, Homo sapiens
uucucagcccccugacagucag

SEQ ID NO: 265882 - RNA, 17 nt, Homo sapiens
uucucaguucugaucuc

SEQ ID NO: 265883 - RNA, 22 nt, Homo sapiens
uucucugggacauaggucgggu

SEQ ID NO: 265884 - RNA, 22 nt, Homo sapiens
uucugacuggugugagauggua

SEQ ID NO: 265885 - RNA, 22 nt, Homo sapiens
uucugccaaucaacccacaucc

SEQ ID NO: 265886 - RNA, 22 nt, Homo sapiens
uucugugcuuguggaugaagug

SEQ ID NO: 265887 - RNA, 22 nt, Homo sapiens
uucugugguagaaaucucaaau

SEQ ID NO: 265888 - RNA, 22 nt, Homo sapiens
uucuucaguuacaacaaggggg

SEQ ID NO: 265889 - RNA, 22 nt, Homo sapiens
uucuugcuguauccucacaugg

SEQ ID NO: 265890 - RNA, 22 nt, Homo sapiens
uucuugguguaguaguugaaaa

SEQ ID NO: 265891 - RNA, 22 nt, Homo sapiens
uucuugguuggcaaccaacagu

SEQ ID NO: 265892 - RNA, 22 nt, Homo sapiens
uucuuuggauaaaguuuuaugc

SEQ ID NO: 265893 - RNA, 22 nt, Homo sapiens
uucuuugguacaagggccgacc

SEQ ID NO: 265894 - RNA, 22 nt, Homo sapiens
uugaaagucauggcacaggcaa

SEQ ID NO: 265895 - RNA, 22 nt, Homo sapiens
uugaaaguguucacaaugguau

SEQ ID NO: 265896 - RNA, 22 nt, Homo sapiens
uugaaaucuuccacagcccaag

SEQ ID NO: 265897 - RNA, 22 nt, Homo sapiens
uugaaauguguaagcuccgaaa

SEQ ID NO: 265898 - RNA, 22 nt, Homo sapiens
uugaagacuaauuuagauaaug

SEQ ID NO: 265899 - RNA, 22 nt, Homo sapiens
uugaagacuaccuaccauacuu

SEQ ID NO: 265900 - RNA, 22 nt, Homo sapiens
uugaagguaauugguuuuauga

SEQ ID NO: 265901 - RNA, 22 nt, Homo sapiens
uugaagguaggaugugcuauca

SEQ ID NO: 265902 - RNA, 22 nt, Homo sapiens
uugaagugaagaacaauaucac

SEQ ID NO: 265903 - RNA, 22 nt, Homo sapiens
uugacacuaauuauuauaggug

SEQ ID NO: 265904 - RNA, 22 nt, Homo sapiens
uugacauaguuucugaaauaga

SEQ ID NO: 265905 - RNA, 22 nt, Homo sapiens
uugaccacugggcacaguaagu

SEQ ID NO: 265906 - RNA, 22 nt, Homo sapiens
uugacuuuuaggaggaaaauga

SEQ ID NO: 265907 - RNA, 21 nt, Homo sapiens
uugagaagaauuagcucuucc

SEQ ID NO: 265908 - RNA, 21 nt, Homo sapiens
uugagacggagucucacucug

SEQ ID NO: 265909 - RNA, 22 nt, Homo sapiens
uugagaguggaggcuauaucuu

SEQ ID NO: 265910 - RNA, 22 nt, Homo sapiens
uugagauggagucucacucuuc

SEQ ID NO: 265911 - RNA, 22 nt, Homo sapiens
uugagauggagucuugcacugu

SEQ ID NO: 265912 - RNA, 22 nt, Homo sapiens
uugagauggagucuugcgcugu

SEQ ID NO: 265913 - RNA, 22 nt, Homo sapiens
uugagauggagucuugcucucu

SEQ ID NO: 265914 - RNA, 22 nt, Homo sapiens
uugagauggaguguugcucugu

SEQ ID NO: 265915 - RNA, 22 nt, Homo sapiens
uugagauggaguuucaauauug

SEQ ID NO: 265916 - RNA, 22 nt, Homo sapiens
uuguauguuuguucuuucagau

SEQ ID NO: 265917 - RNA, 22 nt, Homo sapiens
uugucacauggggcggcugccc

SEQ ID NO: 265918 - RNA, 22 nt, Homo sapiens
uuguccacugcuagccucugca

SEQ ID NO: 265919 - RNA, 21 nt, Homo sapiens
uuguccccacccaaaucucau

SEQ ID NO: 265920 - RNA, 22 nt, Homo sapiens
uuguccccacccaaaugucauc

SEQ ID NO: 265921 - RNA, 22 nt, Homo sapiens
uuguccuugagauaguuugcug

SEQ ID NO: 265922 - RNA, 22 nt, Homo sapiens
uugugaaugaugccgcaauaaa

SEQ ID NO: 265923 - RNA, 22 nt, Homo sapiens
uugugaauggugccgcaguaaa

SEQ ID NO: 265924 - RNA, 22 nt, Homo sapiens
uugugaauggugccgcgauaaa

SEQ ID NO: 265925 - RNA, 22 nt, Homo sapiens
uugugcacauguacccuagaac

SEQ ID NO: 265926 - RNA, 21 nt, Homo sapiens
uugugccaaacccuggaggga

SEQ ID NO: 265927 - RNA, 22 nt, Homo sapiens
uugugcuacugaguuggggugg

SEQ ID NO: 265928 - RNA, 22 nt, Homo sapiens
uugugcuugcuguguucuaugc

SEQ ID NO: 265929 - RNA, 22 nt, Homo sapiens
uugugcuuuacuuacuaccaga

SEQ ID NO: 265930 - RNA, 19 nt, Homo sapiens
uugugggaggacagagggg

SEQ ID NO: 265931 - RNA, 22 nt, Homo sapiens
uugugguaggcauguaagauga

SEQ ID NO: 265932 - RNA, 22 nt, Homo sapiens
uugugguugacuaaauuuguaa

SEQ ID NO: 265933 - RNA, 22 nt, Homo sapiens
uuguguuugaugcugacacgca

SEQ ID NO: 265934 - RNA, 22 nt, Homo sapiens
uuuaaagcuccaagcaugucug

SEQ ID NO: 265935 - RNA, 22 nt, Homo sapiens
uuuaaaguuagaaggaaagggc

SEQ ID NO: 265936 - RNA, 22 nt, Homo sapiens
uuuaacauuggaugagaucguc

SEQ ID NO: 265937 - RNA, 20 nt, Homo sapiens
uuuaagacaugcugaauuga

SEQ ID NO: 265938 - RNA, 22 nt, Homo sapiens
uuuaaggcaugccuguacaugc

SEQ ID NO: 265939 - RNA, 22 nt, Homo sapiens
uuuaagguauguggugaaaauu

SEQ ID NO: 265940 - RNA, 22 nt, Homo sapiens
uuuaaugcaucccaaaauguag

SEQ ID NO: 265941 - RNA, 22 nt, Homo sapiens
uuuacugugggguuucuuagag

SEQ ID NO: 265942 - RNA, 22 nt, Homo sapiens
uuuagcaaugcuguggggaagu

SEQ ID NO: 265943 - RNA, 22 nt, Homo sapiens
uuuagcaauggagggugacuuu

SEQ ID NO: 265944 - RNA, 22 nt, Homo sapiens
uuuagcaauucauuuugugucu

SEQ ID NO: 265945 - RNA, 22 nt, Homo sapiens
uuuagcagcaaagagccaugcu

SEQ ID NO: 265946 - RNA, 22 nt, Homo sapiens
uuuagcucauucaauuucaguc

SEQ ID NO: 265947 - RNA, 22 nt, Homo sapiens
uuuaggcaauauauucaugucu

SEQ ID NO: 265948 - RNA, 22 nt, Homo sapiens
uuuagguagucaaagguuaguc

SEQ ID NO: 265949 - RNA, 22 nt, Homo sapiens
uuuagguuacauauaauccaaa

SEQ ID NO: 265950 - RNA, 23 nt, Homo sapiens
uuuauacguugucauuuaucagg

SEQ ID NO: 265951 - RNA, 22 nt, Homo sapiens
uuuaucaggccuuuggaaaaau

SEQ ID NO: 265952 - RNA, 22 nt, Homo sapiens
uuuauguggagcacuugacaca

SEQ ID NO: 265953 - RNA, 19 nt, Homo sapiens
uuucacacucgccuacuuc

SEQ ID NO: 265954 - RNA, 23 nt, Homo sapiens
uuucacagaaggauuguagggcc

SEQ ID NO: 265955 - RNA, 22 nt, Homo sapiens
uuucacagcaauugccuauugu

SEQ ID NO: 265956 - RNA, 22 nt, Homo sapiens
uuucaggcagggagcuucagug

SEQ ID NO: 265957 - RNA, 20 nt, Homo sapiens
uuucaguacuuucuacuggc

SEQ ID NO: 265958 - RNA, 22 nt, Homo sapiens
uuucaguagagacacgguuuug

SEQ ID NO: 265959 - RNA, 22 nt, Homo sapiens
uuucaguguggcaggcauagcu

SEQ ID NO: 265960 - RNA, 22 nt, Homo sapiens
uuucauagaucaugcuuuugga

SEQ ID NO: 265961 - RNA, 16 nt, Homo sapiens
uuucaucaguuuuaau

SEQ ID NO: 265962 - RNA, 22 nt, Homo sapiens
uuucauggaauauagucauuuu

SEQ ID NO: 265963 - RNA, 22 nt, Homo sapiens
uuucauggaggauuugcuucuu

SEQ ID NO: 265964 - RNA, 18 nt, Homo sapiens
uuucauugagugugauau

SEQ ID NO: 265965 - RNA, 22 nt, Homo sapiens
uuuccaagaugcuuacuuucuc

SEQ ID NO: 265966 - RNA, 22 nt, Homo sapiens
uuuccaguuggaaagccuguuu

SEQ ID NO: 265967 - RNA, 22 nt, Homo sapiens
uuuccuggagaaucuuaacaaa

SEQ ID NO: 265968 - RNA, 22 nt, Homo sapiens
uuuccuguaggaaggaaauaga

SEQ ID NO: 265969 - RNA, 22 nt, Homo sapiens
uuucuacagugaacgauuucua

SEQ ID NO: 265970 - RNA, 17 nt, Homo sapiens
uuucucagcccucuucu

SEQ ID NO: 265971 - RNA, 20 nt, Homo sapiens
uuucuccccuauaaaucuca

SEQ ID NO: 265972 - RNA, 22 nt, Homo sapiens
uuucugagaccaaaacuuguaa

SEQ ID NO: 265973 - RNA, 22 nt, Homo sapiens
uuucugugguccucuugaaggu

SEQ ID NO: 265974 - RNA, 22 nt, Homo sapiens
uuugaaccauuugaagaaugau

SEQ ID NO: 265975 - RNA, 19 nt, Homo sapiens
uuugaauauaaugcagcua

SEQ ID NO: 265976 - RNA, 22 nt, Homo sapiens
uuugaauggaaguuuugugaaa

SEQ ID NO: 265977 - RNA, 22 nt, Homo sapiens
uuugaauguaaugagcaggaag

SEQ ID NO: 265978 - RNA, 22 nt, Homo sapiens
uuugagaaugcuaccagagaag

SEQ ID NO: 265979 - RNA, 22 nt, Homo sapiens
uuugagaucuuuagaaucaggc

SEQ ID NO: 265980 - RNA, 22 nt, Homo sapiens
uuugagcauuagggcaaaggca

SEQ ID NO: 265981 - RNA, 22 nt, Homo sapiens
uuugaggaaaggcauaaguagg

SEQ ID NO: 265982 - RNA, 22 nt, Homo sapiens
uuugaguuugaggugcugauga

SEQ ID NO: 265983 - RNA, 22 nt, Homo sapiens
uuugauguccaccucagcccac

SEQ ID NO: 265984 - RNA, 22 nt, Homo sapiens
uuugauguugagacuauaaagc

SEQ ID NO: 265985 - RNA, 22 nt, Homo sapiens
uuugauuguacuaaaauuguac

SEQ ID NO: 265986 - RNA, 22 nt, Homo sapiens
uuugcacuuuaauauaauguga

SEQ ID NO: 265987 - RNA, 22 nt, Homo sapiens
uuugcacuuuuguaauaugguu

SEQ ID NO: 265988 - RNA, 22 nt, Homo sapiens
uuugcagagucuuucgcugggc

SEQ ID NO: 265989 - RNA, 19 nt, Homo sapiens
uuugcauagugagaauaua

SEQ ID NO: 265990 - RNA, 22 nt, Homo sapiens
uuugccacugcaggcuguuuaa

SEQ ID NO: 265991 - RNA, 23 nt, Homo sapiens
uuugccacuuauuagcugggagg

SEQ ID NO: 265992 - RNA, 18 nt, Homo sapiens
uuugccacuucccagaaa

SEQ ID NO: 265993 - RNA, 22 nt, Homo sapiens
uuugcugagucauuccaugcug

SEQ ID NO: 265994 - RNA, 22 nt, Homo sapiens
uuugcuuaguaaauguagaaaa

SEQ ID NO: 265995 - RNA, 22 nt, Homo sapiens
uuuggaaugugcacucagauug

SEQ ID NO: 265996 - RNA, 22 nt, Homo sapiens
uuuggcaaagaucaacauguua

SEQ ID NO: 265997 - RNA, 21 nt, Homo sapiens
uuuggcauuaugucaccagag

SEQ ID NO: 265998 - RNA, 23 nt, Homo sapiens
uuuggcauuccagaaauuuucau

SEQ ID NO: 265999 - RNA, 22 nt, Homo sapiens
uuuggccauaauuuuaauuggc

SEQ ID NO: 266000 - RNA, 22 nt, Homo sapiens
uuuggcuauguuguaucuuucc

SEQ ID NO: 266001 - RNA, 22 nt, Homo sapiens
uuuggcuuugagaagcagugga

SEQ ID NO: 266002 - RNA, 22 nt, Homo sapiens
uuuggcuuuuguaauaacugcc

SEQ ID NO: 266003 - RNA, 22 nt, Homo sapiens
uuuggguuaguuuuccaaucuu

SEQ ID NO: 266004 - RNA, 22 nt, Homo sapiens
uuuggucuuuuauuuaaagcag

SEQ ID NO: 266005 - RNA, 22 nt, Homo sapiens
uuuggucuuuuguaaguuaucu

SEQ ID NO: 266006 - RNA, 22 nt, Homo sapiens
cuaaggcaguagccugaauaau

SEQ ID NO: 266007 - RNA, 22 nt, Homo sapiens
cuaagugaacugucacugagaa

SEQ ID NO: 266008 - RNA, 22 nt, Homo sapiens
cuaagugaguauaauuuuaaga

SEQ ID NO: 266009 - RNA, 22 nt, Homo sapiens
cuacagcacugagcugugugca

SEQ ID NO: 266010 - RNA, 23 nt, Homo sapiens
cuacagugccugucucuuuggcc

SEQ ID NO: 266011 - RNA, 22 nt, Homo sapiens
cuacagugggucuguaguccuu

SEQ ID NO: 266012 - RNA, 22 nt, Homo sapiens
cuacaguguauuuauggagggu

SEQ ID NO: 266013 - RNA, 22 nt, Homo sapiens
cuacauuguagguauucaaacu

SEQ ID NO: 266014 - RNA, 22 nt, Homo sapiens
cuagagagaagcugugugaccu

SEQ ID NO: 266015 - RNA, 22 nt, Homo sapiens
cuagcacauaguuauucacuca

SEQ ID NO: 266016 - RNA, 22 nt, Homo sapiens
cuagcacauuuaucuuuauaca

SEQ ID NO: 266017 - RNA, 22 nt, Homo sapiens
cuagcagcaugagaauggacca

SEQ ID NO: 266018 - RNA, 22 nt, Homo sapiens
cuaggcuguagagaaguucagu

SEQ ID NO: 266019 - RNA, 22 nt, Homo sapiens
cuauacuguacacugaaugagg

SEQ ID NO: 266020 - RNA, 22 nt, Homo sapiens
cuaucucaggcccaggcccuug

SEQ ID NO: 266021 - RNA, 22 nt, Homo sapiens
cuaugguuucuccauaucauca

SEQ ID NO: 266022 - RNA, 22 nt, Homo sapiens
cuauuagguuggugcaaaaguc

SEQ ID NO: 266023 - RNA, 22 nt, Homo sapiens
cuauucacaauagccaagauuu

SEQ ID NO: 266024 - RNA, 22 nt, Homo sapiens
cuauucacaauggugaagauau

SEQ ID NO: 266025 - RNA, 22 nt, Homo sapiens
cuauucacaggcaauauguaca

SEQ ID NO: 266026 - RNA, 19 nt, Homo sapiens
cuauugcacauagcugaag

SEQ ID NO: 266027 - RNA, 22 nt, Homo sapiens
cucaaagugcugggacuggcug

SEQ ID NO: 266028 - RNA, 20 nt, Homo sapiens
cucacagacagcuucuuucu

SEQ ID NO: 266029 - RNA, 22 nt, Homo sapiens
cucacuggguguaaaacaugua

SEQ ID NO: 266030 - RNA, 22 nt, Homo sapiens
cucacugugguguccuuaggua

SEQ ID NO: 266031 - RNA, 22 nt, Homo sapiens
cucagcaguggauuuaccacca

SEQ ID NO: 266032 - RNA, 22 nt, Homo sapiens
cucaguggauuagauaaugcac

SEQ ID NO: 266033 - RNA, 22 nt, Homo sapiens
cucagugguugauuuauuuauc

SEQ ID NO: 266034 - RNA, 22 nt, Homo sapiens
cucaguguuaaggccaccucug

SEQ ID NO: 266035 - RNA, 22 nt, Homo sapiens
cucaugcugucuucugggguaa

SEQ ID NO: 266036 - RNA, 22 nt, Homo sapiens
cucauggaauacuucacagcca

SEQ ID NO: 266037 - RNA, 22 nt, Homo sapiens
cucauggagaacaucugcuagg

SEQ ID NO: 266038 - RNA, 22 nt, Homo sapiens
cuccagugcaaagucaugauca

SEQ ID NO: 266039 - RNA, 23 nt, Homo sapiens
cuccaugagccguccagggccug

SEQ ID NO: 266040 - RNA, 23 nt, Homo sapiens
cucccugaacaugacacaccaga

SEQ ID NO: 266041 - RNA, 20 nt, Homo sapiens
cucccugacaaauguggaaa

SEQ ID NO: 266042 - RNA, 22 nt, Homo sapiens
cucccugagccagggcuuugac

SEQ ID NO: 266043 - RNA, 20 nt, Homo sapiens
cucuaguaauaaaguuuccc

SEQ ID NO: 266044 - RNA, 22 nt, Homo sapiens
cucugguggaagcagggggcaa

SEQ ID NO: 266045 - RNA, 20 nt, Homo sapiens
cucugguugugaauugucuu

SEQ ID NO: 266046 - RNA, 21 nt, Homo sapiens
cucugguuugcauuggauuau

SEQ ID NO: 266047 - RNA, 22 nt, Homo sapiens
cucugguuuuucuuccauuaag

SEQ ID NO: 266048 - RNA, 22 nt, Homo sapiens
cucuuuaguaagcaguugauga

SEQ ID NO: 266049 - RNA, 22 nt, Homo sapiens
cucuuuuguuuagcugagaggg

SEQ ID NO: 266050 - RNA, 22 nt, Homo sapiens
cugaauagucaacgauggacug

SEQ ID NO: 266051 - RNA, 22 nt, Homo sapiens
cugaaucauugcauuaucaagg

SEQ ID NO: 266052 - RNA, 22 nt, Homo sapiens
cugacauggggauccaccuuag

SEQ ID NO: 266053 - RNA, 22 nt, Homo sapiens
cugaccucugucaaagacaccc

SEQ ID NO: 266054 - RNA, 22 nt, Homo sapiens
cugagaauguaaaugaagcuuu

SEQ ID NO: 266055 - RNA, 22 nt, Homo sapiens
cugagagugguauguuuaagug

SEQ ID NO: 266056 - RNA, 22 nt, Homo sapiens
cugagaucugaaccaggagugu

SEQ ID NO: 266057 - RNA, 22 nt, Homo sapiens
cugagcaauauagugagaucuu

SEQ ID NO: 266058 - RNA, 22 nt, Homo sapiens
cugagcccauucuggggagaag

SEQ ID NO: 266059 - RNA, 22 nt, Homo sapiens
cugaggacaucagggaagcauc

SEQ ID NO: 266060 - RNA, 22 nt, Homo sapiens
cugaggcacggcgaccuuaagu

SEQ ID NO: 266061 - RNA, 22 nt, Homo sapiens
cugagguaauuuguugccagua

SEQ ID NO: 266062 - RNA, 22 nt, Homo sapiens
cugagguagcucaggguauugc

SEQ ID NO: 266063 - RNA, 22 nt, Homo sapiens
cugagguaggcccugagaauau

SEQ ID NO: 266064 - RNA, 22 nt, Homo sapiens
cugaggucugaauccagguauc

SEQ ID NO: 266065 - RNA, 22 nt, Homo sapiens
cugagguuaggaguuugagacc

SEQ ID NO: 266066 - RNA, 18 nt, Homo sapiens
cugagucauuccuggguc

SEQ ID NO: 266067 - RNA, 22 nt, Homo sapiens
cugauacucuccuuuuagagag

SEQ ID NO: 266068 - RNA, 21 nt, Homo sapiens
cugaucacaggugagcugccu

SEQ ID NO: 266069 - RNA, 22 nt, Homo sapiens
cugauguagguggucugugauc

SEQ ID NO: 266070 - RNA, 22 nt, Homo sapiens
cugcaagaugcauaggaauuuu

SEQ ID NO: 266071 - RNA, 22 nt, Homo sapiens
cugcacugagacccucuuugcu

SEQ ID NO: 266072 - RNA, 22 nt, Homo sapiens
cugcagaucuuggggcuugcca

SEQ ID NO: 266073 - RNA, 22 nt, Homo sapiens
cugcauuugaugacguauggug

SEQ ID NO: 266074 - RNA, 18 nt, Homo sapiens
cugccagugugcucuccg

SEQ ID NO: 266075 - RNA, 22 nt, Homo sapiens
cugccuagauguuguagggggu

SEQ ID NO: 266076 - RNA, 22 nt, Homo sapiens
uacccuuuaguauaaaaucaga

SEQ ID NO: 266077 - RNA, 22 nt, Homo sapiens
uaccugagacaacuuugaggaa

SEQ ID NO: 266078 - RNA, 22 nt, Homo sapiens
aaaagcuuagaugggcuuguau

SEQ ID NO: 266079 - RNA, 22 nt, Homo sapiens
aaaagugguguuguuucuaaau

SEQ ID NO: 266080 - RNA, 22 nt, Homo sapiens
aaacauugaccucauccuggca

SEQ ID NO: 266081 - RNA, 22 nt, Homo sapiens
aaacugcuuuccaugguggcug

SEQ ID NO: 266082 - RNA, 22 nt, Homo sapiens
aaagaagucagccuguccuuug

SEQ ID NO: 266083 - RNA, 22 nt, Homo sapiens
aaagaguucagguagauuucaa

SEQ ID NO: 266084 - RNA, 22 nt, Homo sapiens
aaagcacuggagucaucaucua

SEQ ID NO: 266085 - RNA, 22 nt, Homo sapiens
aaagcuaagguagcauuggaga

SEQ ID NO: 266086 - RNA, 22 nt, Homo sapiens
aaagcuacaggaccugcucauu

SEQ ID NO: 266087 - RNA, 22 nt, Homo sapiens
aaagcuagagaagcugcuguca

SEQ ID NO: 266088 - RNA, 22 nt, Homo sapiens
aaagcugucaaggcaggaggcu

SEQ ID NO: 266089 - RNA, 20 nt, Homo sapiens
aaaggcugugagaacgagau

SEQ ID NO: 266090 - RNA, 22 nt, Homo sapiens
aaagggcuuuguaaacuucaag

SEQ ID NO: 266091 - RNA, 22 nt, Homo sapiens
aaaguacucaguucaguuccgu

SEQ ID NO: 266092 - RNA, 20 nt, Homo sapiens
aaaguaggcuaauaccaaaa

SEQ ID NO: 266093 - RNA, 22 nt, Homo sapiens
aaagucuguuacagcuauuucu

SEQ ID NO: 266094 - RNA, 22 nt, Homo sapiens
aaagugauugcgguuuuugcca

SEQ ID NO: 266095 - RNA, 22 nt, Homo sapiens
aaagugcaguauuugggcagaa

SEQ ID NO: 266096 - RNA, 22 nt, Homo sapiens
aaaguggugugaguauguaucu

SEQ ID NO: 266097 - RNA, 22 nt, Homo sapiens
aaagugguuuuucagacuuuga

SEQ ID NO: 266098 - RNA, 22 nt, Homo sapiens
aaaguucugcguuagggcuaaa

SEQ ID NO: 266099 - RNA, 15 nt, Homo sapiens
aaauaugucaguucu

SEQ ID NO: 266100 - RNA, 22 nt, Homo sapiens
aaaugacuuuuuaugcagagua

SEQ ID NO: 266101 - RNA, 22 nt, Homo sapiens
aaaugcagauucugcuuagguu

SEQ ID NO: 266102 - RNA, 22 nt, Homo sapiens
aaaugcagucuuuguucugggc

SEQ ID NO: 266103 - RNA, 22 nt, Homo sapiens
aaaugcucuguggguaguaaug

SEQ ID NO: 266104 - RNA, 18 nt, Homo sapiens
aaaugcucuucuggaaua

SEQ ID NO: 266105 - RNA, 20 nt, Homo sapiens
aaaugcuguaauguuuggga

SEQ ID NO: 266106 - RNA, 22 nt, Homo sapiens
aaaugcugucugugagccucau

SEQ ID NO: 266107 - RNA, 22 nt, Homo sapiens
aaauggcacaguaagggcauuu

SEQ ID NO: 266108 - RNA, 22 nt, Homo sapiens
aaauggcaccggcucuucccuc

SEQ ID NO: 266109 - RNA, 22 nt, Homo sapiens
aaaugggacugggguccuuuga

SEQ ID NO: 266110 - RNA, 22 nt, Homo sapiens
aaauucauuucagcucugggua

SEQ ID NO: 266111 - RNA, 22 nt, Homo sapiens
aaauugcaaugcgaggcagagg

SEQ ID NO: 266112 - RNA, 22 nt, Homo sapiens
aacaccauucucuguaacaaga

SEQ ID NO: 266113 - RNA, 22 nt, Homo sapiens
aacacggcccgcagagcaagcu

SEQ ID NO: 266114 - RNA, 22 nt, Homo sapiens
aacacuaucugccuuacaggga

SEQ ID NO: 266115 - RNA, 22 nt, Homo sapiens
aacagagcuggugacuccaggu

SEQ ID NO: 266116 - RNA, 22 nt, Homo sapiens
aacagcuaguaccaauccacua

SEQ ID NO: 266117 - RNA, 22 nt, Homo sapiens
aacaggcuccuaggggugcacc

SEQ ID NO: 266118 - RNA, 22 nt, Homo sapiens
aacaggguggugccugguccau

SEQ ID NO: 266119 - RNA, 22 nt, Homo sapiens
aacagucaauugcugaugaccu

SEQ ID NO: 266120 - RNA, 22 nt, Homo sapiens
aacagugcuguuauaaauguac

SEQ ID NO: 266121 - RNA, 21 nt, Homo sapiens
aacagugcuuaguagauguuc

SEQ ID NO: 266122 - RNA, 22 nt, Homo sapiens
aacccugacacaagcagaauuu

SEQ ID NO: 266123 - RNA, 22 nt, Homo sapiens
aacccugagucaugagucuaga

SEQ ID NO: 266124 - RNA, 22 nt, Homo sapiens
aaccuacauucuuaacuguugc

SEQ ID NO: 266125 - RNA, 22 nt, Homo sapiens
aaccugaagaaaauauuugcug

SEQ ID NO: 266126 - RNA, 22 nt, Homo sapiens
aaccuucauuccuuucccugcc

SEQ ID NO: 266127 - RNA, 22 nt, Homo sapiens
aaccuuuagucagcucuuagga

SEQ ID NO: 266128 - RNA, 22 nt, Homo sapiens
aacuggcauaugaacuuguucu

SEQ ID NO: 266129 - RNA, 19 nt, Homo sapiens
aacuggugugagaugguau

SEQ ID NO: 266130 - RNA, 22 nt, Homo sapiens
aagaccuaugcaggaagaaaug

SEQ ID NO: 266131 - RNA, 22 nt, Homo sapiens
aagagaugaagguccugacugu

SEQ ID NO: 266132 - RNA, 22 nt, Homo sapiens
aagagguagaagcuugccuucu

SEQ ID NO: 266133 - RNA, 22 nt, Homo sapiens
aagagguuguaccuaaaguguu

SEQ ID NO: 266134 - RNA, 22 nt, Homo sapiens
aagagguuuaacugacucacag

SEQ ID NO: 266135 - RNA, 22 nt, Homo sapiens
aagagugucuuugugcuggccc

SEQ ID NO: 266136 - RNA, 22 nt, Homo sapiens
aagaguuaguaaaauuuccucu

SEQ ID NO: 266137 - RNA, 22 nt, Homo sapiens
aagcaugguuuccaggggucac

SEQ ID NO: 266138 - RNA, 20 nt, Homo sapiens
aagcugaguguuuuuuuaau

SEQ ID NO: 266139 - RNA, 22 nt, Homo sapiens
aagcugccaggcaugguggcug

SEQ ID NO: 266140 - RNA, 22 nt, Homo sapiens
aagcugccuugcugaggagaaa

SEQ ID NO: 266141 - RNA, 22 nt, Homo sapiens
aagcuggagugcaguggugcga

SEQ ID NO: 266142 - RNA, 22 nt, Homo sapiens
aagcugguguugcugcucuguu

SEQ ID NO: 266143 - RNA, 22 nt, Homo sapiens
aagcugguuuuauaucugugag

SEQ ID NO: 266144 - RNA, 22 nt, Homo sapiens
aagcuguugguggauguaccau

SEQ ID NO: 266145 - RNA, 22 nt, Homo sapiens
aaggagcagagagcccuguuuc

SEQ ID NO: 266146 - RNA, 22 nt, Homo sapiens
aaggagcaguggacggguccua

SEQ ID NO: 266147 - RNA, 22 nt, Homo sapiens
aaggagcuuaagugacuuguac

SEQ ID NO: 266148 - RNA, 22 nt, Homo sapiens
aaggaguaucuguuuucucacc

SEQ ID NO: 266149 - RNA, 22 nt, Homo sapiens
aaggaguguggugaucuugggc

SEQ ID NO: 266150 - RNA, 22 nt, Homo sapiens
aaggauuguaaaguugacaaau

SEQ ID NO: 266151 - RNA, 22 nt, Homo sapiens
aaggcaagaaaauggauucucc

SEQ ID NO: 266152 - RNA, 22 nt, Homo sapiens
aaggcaagagaaaauuucgagu

SEQ ID NO: 266153 - RNA, 22 nt, Homo sapiens
aaggcaauuuguugugaggauu

SEQ ID NO: 266154 - RNA, 22 nt, Homo sapiens
aaggcaguggcagaagauguca

SEQ ID NO: 266155 - RNA, 22 nt, Homo sapiens
aaggcuauuugagaaugugugu

SEQ ID NO: 266156 - RNA, 22 nt, Homo sapiens
aaggcucuuucaacguaaauua

SEQ ID NO: 266157 - RNA, 22 nt, Homo sapiens
aaggcuguuguguaauaggauu

SEQ ID NO: 266158 - RNA, 22 nt, Homo sapiens
aaggcuuuuugcugacguccuu

SEQ ID NO: 266159 - RNA, 22 nt, Homo sapiens
aagggaaugcuuccaguuugug

SEQ ID NO: 266160 - RNA, 22 nt, Homo sapiens
aagggaauguuguggcugguuu

SEQ ID NO: 266161 - RNA, 22 nt, Homo sapiens
aagggaauguugugguugguuu

SEQ ID NO: 266162 - RNA, 22 nt, Homo sapiens
aagggagcugcauaaucuugug

SEQ ID NO: 266163 - RNA, 22 nt, Homo sapiens
aaggugguuuucucuuggaguc

SEQ ID NO: 266164 - RNA, 21 nt, Homo sapiens
aagguuuuuagugcuugacuu

SEQ ID NO: 266165 - RNA, 22 nt, Homo sapiens
uuucacaguguucucccccaga

SEQ ID NO: 266166 - RNA, 22 nt, Homo sapiens
uuucaccguguuggccaggcug

SEQ ID NO: 266167 - RNA, 22 nt, Homo sapiens
uuucacguuggggaguugagug

SEQ ID NO: 266168 - RNA, 17 nt, Homo sapiens
uuucagaguggaagugu

SEQ ID NO: 266169 - RNA, 22 nt, Homo sapiens
uuucauaguuugcauagggcau

SEQ ID NO: 266170 - RNA, 22 nt, Homo sapiens
uuucauggcgaggcuucauggg

SEQ ID NO: 266171 - RNA, 22 nt, Homo sapiens
uuucauguuuuucugugaggca

SEQ ID NO: 266172 - RNA, 22 nt, Homo sapiens
uuuccaguuggaagaaggggga

SEQ ID NO: 266173 - RNA, 22 nt, Homo sapiens
uuucccagugguacaguuuaua

SEQ ID NO: 266174 - RNA, 22 nt, Homo sapiens
uuucccugaaggcucugaaguc

SEQ ID NO: 266175 - RNA, 15 nt, Homo sapiens
uuucuacugcacuuc

SEQ ID NO: 266176 - RNA, 22 nt, Homo sapiens
uuucucaguguuucaggguagg

SEQ ID NO: 266177 - RNA, 22 nt, Homo sapiens
uuucugcuugagagaauugcug

SEQ ID NO: 266178 - RNA, 21 nt, Homo sapiens
uuucugggggagcauggcagg

SEQ ID NO: 266179 - RNA, 22 nt, Homo sapiens
uuucugggggugcugauggaaa

SEQ ID NO: 266180 - RNA, 23 nt, Homo sapiens
uuucuugggcaugcuaugucagu

SEQ ID NO: 266181 - RNA, 22 nt, Homo sapiens
uuucuugguuguauuuagacuu

SEQ ID NO: 266182 - RNA, 22 nt, Homo sapiens
uuugaaaguaauuugguuggug

SEQ ID NO: 266183 - RNA, 22 nt, Homo sapiens
uuugaagugugaugccuugaug

SEQ ID NO: 266184 - RNA, 22 nt, Homo sapiens
uuugacaaugugugcuuguauu

SEQ ID NO: 266185 - RNA, 22 nt, Homo sapiens
uuugaguaggcuuauauuuugg

SEQ ID NO: 266186 - RNA, 23 nt, Homo sapiens
uuugagugugauaaacacuguca

SEQ ID NO: 266187 - RNA, 22 nt, Homo sapiens
uuugauguugauacuaccuuca

SEQ ID NO: 266188 - RNA, 22 nt, Homo sapiens
uuugauugguguaccugaaagu

SEQ ID NO: 266189 - RNA, 16 nt, Homo sapiens
uuugcaagaucagaag

SEQ ID NO: 266190 - RNA, 22 nt, Homo sapiens
uuugcaagaugaaaaaguucua

SEQ ID NO: 266191 - RNA, 22 nt, Homo sapiens
uuugcagagacuuguuaggaau

SEQ ID NO: 266192 - RNA, 22 nt, Homo sapiens
uuugccaauauuuuacugagga

SEQ ID NO: 266193 - RNA, 22 nt, Homo sapiens
uuugccaauauuuuauugagga

SEQ ID NO: 266194 - RNA, 22 nt, Homo sapiens
uuugcuauagugaauagugcug

SEQ ID NO: 266195 - RNA, 22 nt, Homo sapiens
uuugcuugaggucuagcuaccc

SEQ ID NO: 266196 - RNA, 22 nt, Homo sapiens
uuuggaagaugccacuguauca

SEQ ID NO: 266197 - RNA, 22 nt, Homo sapiens
uuuggaaugaaacagcagagcc

SEQ ID NO: 266198 - RNA, 22 nt, Homo sapiens
uuuggacuucuagccuccagag

SEQ ID NO: 266199 - RNA, 22 nt, Homo sapiens
uuuggauagugugguccuuuua

SEQ ID NO: 266200 - RNA, 22 nt, Homo sapiens
uuuggcagaaaacaagaaucug

SEQ ID NO: 266201 - RNA, 22 nt, Homo sapiens
uuuggccauguuggucaggcug

SEQ ID NO: 266202 - RNA, 22 nt, Homo sapiens
uuuggcuuaagauugacugcaa

SEQ ID NO: 266203 - RNA, 22 nt, Homo sapiens
uuugggaaugguuugucuccca

SEQ ID NO: 266204 - RNA, 22 nt, Homo sapiens
uuugggacuguauuaaaugccu

SEQ ID NO: 266205 - RNA, 22 nt, Homo sapiens
uuugggccaugcuucccgguca

SEQ ID NO: 266206 - RNA, 22 nt, Homo sapiens
uuugggcuuuuaaucuagagca

SEQ ID NO: 266207 - RNA, 22 nt, Homo sapiens
uuugguaauguuucauugcaga

SEQ ID NO: 266208 - RNA, 22 nt, Homo sapiens
uuugguuauauauauacacucu

SEQ ID NO: 266209 - RNA, 22 nt, Homo sapiens
uuugguuauuugaaacuagcau

SEQ ID NO: 266210 - RNA, 22 nt, Homo sapiens
uuugguugcauucacauauuuc

SEQ ID NO: 266211 - RNA, 22 nt, Homo sapiens
uuugguuuuuguuaucacucau

SEQ ID NO: 266212 - RNA, 22 nt, Homo sapiens
uuuguacuccuuggccagcuuc

SEQ ID NO: 266213 - RNA, 22 nt, Homo sapiens
uuuguacugagccaagauggua

SEQ ID NO: 266214 - RNA, 22 nt, Homo sapiens
uuuguacuugaagaaucuuuau

SEQ ID NO: 266215 - RNA, 23 nt, Homo sapiens
uuuguaguagcaugauuuauaau

SEQ ID NO: 266216 - RNA, 21 nt, Homo sapiens
uuuguccaccuguguucacca

SEQ ID NO: 266217 - RNA, 22 nt, Homo sapiens
uuugugacuugcuucucagaau

SEQ ID NO: 266218 - RNA, 22 nt, Homo sapiens
uuugugcugcaauuaauuuccc

SEQ ID NO: 266219 - RNA, 22 nt, Homo sapiens
uuuguguccccacccacaucuc

SEQ ID NO: 266220 - RNA, 22 nt, Homo sapiens
uuugugugugauuauaaaaggu

SEQ ID NO: 266221 - RNA, 22 nt, Homo sapiens
uuuuaacagccaggggacggcc

SEQ ID NO: 266222 - RNA, 22 nt, Homo sapiens
uuuuaagcuacaagagacauau

SEQ ID NO: 266223 - RNA, 22 nt, Homo sapiens
uuuuagcaaagagacugguggc

SEQ ID NO: 266224 - RNA, 22 nt, Homo sapiens
uuuuagcagccaugacaaagau

SEQ ID NO: 266225 - RNA, 22 nt, Homo sapiens
uuuuaugggcuauuugcauuag

SEQ ID NO: 266226 - RNA, 22 nt, Homo sapiens
uuuuauguuuguucccugccaa

SEQ ID NO: 266227 - RNA, 19 nt, Homo sapiens
uuuuccccuuucuuaagac

SEQ ID NO: 266228 - RNA, 22 nt, Homo sapiens
uuuugcaggcauuggaaguuua

SEQ ID NO: 266229 - RNA, 22 nt, Homo sapiens
uuuugcuccuggcaaacucaua

SEQ ID NO: 266230 - RNA, 22 nt, Homo sapiens
uuuugcucuugguaaugaaaga

SEQ ID NO: 266231 - RNA, 22 nt, Homo sapiens
uuuuggcucugucuguaucuuu

SEQ ID NO: 266232 - RNA, 22 nt, Homo sapiens
uuuuggcucuugguaggucaga

SEQ ID NO: 266233 - RNA, 22 nt, Homo sapiens
uuuuggcuuaaagagaauguau

SEQ ID NO: 266234 - RNA, 20 nt, Homo sapiens
uuuuggcuuaaagcagucug

SEQ ID NO: 266235 - RNA, 22 nt, Homo sapiens
uuuuggcuuuuccucagcaagc

SEQ ID NO: 266236 - RNA, 22 nt, Homo sapiens
uuuugggggugauucacacagu

SEQ ID NO: 266237 - RNA, 22 nt, Homo sapiens
uuuuguacgccuguguccauca

SEQ ID NO: 266238 - RNA, 19 nt, Homo sapiens
uuuuguacucugugacuug

SEQ ID NO: 266239 - RNA, 22 nt, Homo sapiens
uuuugugacuauuguaaauggg

SEQ ID NO: 266240 - RNA, 22 nt, Homo sapiens
uuuuucacuuaaguuaggcuca

SEQ ID NO: 266241 - RNA, 22 nt, Homo sapiens
uuuuugaguaaauauaaauugu

SEQ ID NO: 266242 - RNA, 22 nt, Homo sapiens
uuuuugauuaauggguagacca

SEQ ID NO: 266243 - RNA, 21 nt, Homo sapiens
uuuuugggcuuucauaguguu

SEQ ID NO: 266244 - RNA, 22 nt, Homo sapiens
gucauggguuaaagguggauac

SEQ ID NO: 266245 - RNA, 22 nt, Homo sapiens
gucauugaaguggaaucaucca

SEQ ID NO: 266246 - RNA, 22 nt, Homo sapiens
guccagagaagucauuacuuca

SEQ ID NO: 266247 - RNA, 22 nt, Homo sapiens
guccaugagaugaauccacaca

SEQ ID NO: 266248 - RNA, 22 nt, Homo sapiens
gucccugaggaacauccagggc

SEQ ID NO: 266249 - RNA, 22 nt, Homo sapiens
gucucccagccuacauauuucu

SEQ ID NO: 266250 - RNA, 22 nt, Homo sapiens
gucucccagccuacaucuuucu

SEQ ID NO: 266251 - RNA, 22 nt, Homo sapiens
gucugcaugucauaugauagua

SEQ ID NO: 266252 - RNA, 22 nt, Homo sapiens
gucuggagacuugggucaucaa

SEQ ID NO: 266253 - RNA, 22 nt, Homo sapiens
gucuggcacagggaaaguacaa

SEQ ID NO: 266254 - RNA, 22 nt, Homo sapiens
gucuggcuccugucuaaucacu

SEQ ID NO: 266255 - RNA, 21 nt, Homo sapiens
gucugguguuuuaaugaggac

SEQ ID NO: 266256 - RNA, 22 nt, Homo sapiens
gucuguuuggggaccuguggcc

SEQ ID NO: 266257 - RNA, 22 nt, Homo sapiens
gucuugaaggcugaguaccugu

SEQ ID NO: 266258 - RNA, 20 nt, Homo sapiens
gucuuguagcucaaguuauu

SEQ ID NO: 266259 - RNA, 22 nt, Homo sapiens
gucuuuggaaaaaaugucuguu

SEQ ID NO: 266260 - RNA, 22 nt, Homo sapiens
gucuuuggaaagacaaaguuca

SEQ ID NO: 266261 - RNA, 22 nt, Homo sapiens
gugaaagacagcauuaauggcu

SEQ ID NO: 266262 - RNA, 22 nt, Homo sapiens
gugaaauacauaaucccaagug

SEQ ID NO: 266263 - RNA, 22 nt, Homo sapiens
gugaaauauuuaacguccaggu

SEQ ID NO: 266264 - RNA, 17 nt, Homo sapiens
gugaaaucaucauuuuu

SEQ ID NO: 266265 - RNA, 22 nt, Homo sapiens
gugaaguuuuugugaggccuaa

SEQ ID NO: 266266 - RNA, 22 nt, Homo sapiens
gugaauguaaagucaugugacu

SEQ ID NO: 266267 - RNA, 22 nt, Homo sapiens
gugaauguuuucuuacauggua

SEQ ID NO: 266268 - RNA, 22 nt, Homo sapiens
gugacagucaaagacaugacuu

SEQ ID NO: 266269 - RNA, 22 nt, Homo sapiens
gugaccucuguugcugucacua

SEQ ID NO: 266270 - RNA, 22 nt, Homo sapiens
gugagauggagucuugcuuugu

SEQ ID NO: 266271 - RNA, 22 nt, Homo sapiens
gugagcacugaaagaaggcaag

SEQ ID NO: 266272 - RNA, 22 nt, Homo sapiens
gugagcaguguccuugggggca

SEQ ID NO: 266273 - RNA, 22 nt, Homo sapiens
gugaggcuuuuccuguuagacu

SEQ ID NO: 266274 - RNA, 22 nt, Homo sapiens
gugagggagcuggaauauuuau

SEQ ID NO: 266275 - RNA, 22 nt, Homo sapiens
gugagguaauuagcucccuuag

SEQ ID NO: 266276 - RNA, 22 nt, Homo sapiens
gugagguacgugucaagaacca

SEQ ID NO: 266277 - RNA, 17 nt, Homo sapiens
gugagguggguaguauc

SEQ ID NO: 266278 - RNA, 22 nt, Homo sapiens
gugauacugcuuauuaauuuaa

SEQ ID NO: 266279 - RNA, 22 nt, Homo sapiens
gugauaucuuacaauucucuuu

SEQ ID NO: 266280 - RNA, 22 nt, Homo sapiens
gugaucuucauggaaggugaaa

SEQ ID NO: 266281 - RNA, 22 nt, Homo sapiens
gugcaacaucccuccauaauuu

SEQ ID NO: 266282 - RNA, 22 nt, Homo sapiens
gugcaagagugacugcaguuuu

SEQ ID NO: 266283 - RNA, 22 nt, Homo sapiens
gugcaagagugauugcaguuuu

SEQ ID NO: 266284 - RNA, 22 nt, Homo sapiens
gugcacaacaugcaguuuuguu

SEQ ID NO: 266285 - RNA, 22 nt, Homo sapiens
gugcacaacgugcagguuaguu

SEQ ID NO: 266286 - RNA, 22 nt, Homo sapiens
gugcacaaucgugcauuccuug

SEQ ID NO: 266287 - RNA, 22 nt, Homo sapiens
gugcacaugguagguauugagu

SEQ ID NO: 266288 - RNA, 22 nt, Homo sapiens
gugcauguccacuaguccauau

SEQ ID NO: 266289 - RNA, 22 nt, Homo sapiens
gugcuauguuauccagcaagau

SEQ ID NO: 266290 - RNA, 22 nt, Homo sapiens
gugcucauuuagagagaagcac

SEQ ID NO: 266291 - RNA, 16 nt, Homo sapiens
gugcuguguuguuagg

SEQ ID NO: 266292 - RNA, 22 nt, Homo sapiens
gugcuuguauuuaaaucaugug

SEQ ID NO: 266293 - RNA, 22 nt, Homo sapiens
guggaaaaguaguugcgguuuu

SEQ ID NO: 266294 - RNA, 22 nt, Homo sapiens
acagcagugccccacucuacug

SEQ ID NO: 266295 - RNA, 22 nt, Homo sapiens
acaguacucugcucuuuugauu

SEQ ID NO: 266296 - RNA, 22 nt, Homo sapiens
acaguacuguuguuugcugcca

SEQ ID NO: 266297 - RNA, 18 nt, Homo sapiens
acagugcuggcaugagau

SEQ ID NO: 266298 - RNA, 22 nt, Homo sapiens
acagugcugucugcuuuggcua

SEQ ID NO: 266299 - RNA, 22 nt, Homo sapiens
acagugcuuucaauguucagua

SEQ ID NO: 266300 - RNA, 22 nt, Homo sapiens
acaguggaauguaggguuugag

SEQ ID NO: 266301 - RNA, 22 nt, Homo sapiens
acagugucaugucguguucccc

SEQ ID NO: 266302 - RNA, 22 nt, Homo sapiens
acagugucugacacguaggaag

SEQ ID NO: 266303 - RNA, 18 nt, Homo sapiens
acagugucuuacaccugu

SEQ ID NO: 266304 - RNA, 22 nt, Homo sapiens
acauaugaguacaugugccaug

SEQ ID NO: 266305 - RNA, 22 nt, Homo sapiens
acaugcaucauuaggugguuua

SEQ ID NO: 266306 - RNA, 22 nt, Homo sapiens
acaugccucccugguccgcugu

SEQ ID NO: 266307 - RNA, 22 nt, Homo sapiens
acauucagcuguuguuucaaug

SEQ ID NO: 266308 - RNA, 22 nt, Homo sapiens
accacaggguaaaguuagauau

SEQ ID NO: 266309 - RNA, 22 nt, Homo sapiens
accaucuagauuuguguaggua

SEQ ID NO: 266310 - RNA, 22 nt, Homo sapiens
acccagaguuccuugucuuuca

SEQ ID NO: 266311 - RNA, 22 nt, Homo sapiens
acccaguguucaacauucacau

SEQ ID NO: 266312 - RNA, 21 nt, Homo sapiens
acccccacaccuccuuaguuc

SEQ ID NO: 266313 - RNA, 22 nt, Homo sapiens
acccgggaggcaggagucauag

SEQ ID NO: 266314 - RNA, 22 nt, Homo sapiens
acccucagaccaguuucccugg

SEQ ID NO: 266315 - RNA, 21 nt, Homo sapiens
acccucuaguuuucaacaggc

SEQ ID NO: 266316 - RNA, 22 nt, Homo sapiens
accugggugcugaugggcuuua

SEQ ID NO: 266317 - RNA, 22 nt, Homo sapiens
accugguuuucucacaguggcu

SEQ ID NO: 266318 - RNA, 23 nt, Homo sapiens
accugugguuauuuuacucuucc

SEQ ID NO: 266319 - RNA, 18 nt, Homo sapiens
accuucauuccuuugccu

SEQ ID NO: 266320 - RNA, 22 nt, Homo sapiens
accuucauuguugccaugucca

SEQ ID NO: 266321 - RNA, 22 nt, Homo sapiens
accuugcacugagccgagauug

SEQ ID NO: 266322 - RNA, 22 nt, Homo sapiens
acguaguagguuuauaauauua

SEQ ID NO: 266323 - RNA, 22 nt, Homo sapiens
acuauacuguaacuguauucag

SEQ ID NO: 266324 - RNA, 22 nt, Homo sapiens
acucagagugggccccuagaua

SEQ ID NO: 266325 - RNA, 22 nt, Homo sapiens
acuccacuuucaccacagcgga

SEQ ID NO: 266326 - RNA, 22 nt, Homo sapiens
acucugucuaguuguaaaauuu

SEQ ID NO: 266327 - RNA, 23 nt, Homo sapiens
acugagcaauguuuacauacuug

SEQ ID NO: 266328 - RNA, 22 nt, Homo sapiens
acugagccuuuaaaugacuuca

SEQ ID NO: 266329 - RNA, 22 nt, Homo sapiens
acugaguguugauuuagauuaa

SEQ ID NO: 266330 - RNA, 22 nt, Homo sapiens
acugcacuccaaccuguugggc

SEQ ID NO: 266331 - RNA, 22 nt, Homo sapiens
acugcacuccagccucaugaca

SEQ ID NO: 266332 - RNA, 22 nt, Homo sapiens
acugcacuccagccucgcaaca

SEQ ID NO: 266333 - RNA, 22 nt, Homo sapiens
acugcacuccagccucggggac

SEQ ID NO: 266334 - RNA, 22 nt, Homo sapiens
acugcacuccagccugagccug

SEQ ID NO: 266335 - RNA, 22 nt, Homo sapiens
acugcacuccagccugcccaac

SEQ ID NO: 266336 - RNA, 22 nt, Homo sapiens
acugcacuccagccuuggcaac

SEQ ID NO: 266337 - RNA, 22 nt, Homo sapiens
acugcacuccaucuuagguggc

SEQ ID NO: 266338 - RNA, 22 nt, Homo sapiens
acugcacuccggccucgugaca

SEQ ID NO: 266339 - RNA, 22 nt, Homo sapiens
acugcacucuagcauggguaau

SEQ ID NO: 266340 - RNA, 22 nt, Homo sapiens
acugcacucuagccccugcgac

SEQ ID NO: 266341 - RNA, 22 nt, Homo sapiens
acugcacugcagccuggccaac

SEQ ID NO: 266342 - RNA, 22 nt, Homo sapiens
guggaagauaguguguuaaugu

SEQ ID NO: 266343 - RNA, 22 nt, Homo sapiens
guggaauacuaugaugguggau

SEQ ID NO: 266344 - RNA, 22 nt, Homo sapiens
guggacagagacuaaauguugu

SEQ ID NO: 266345 - RNA, 22 nt, Homo sapiens
guggacaugaauuuuggaggca

SEQ ID NO: 266346 - RNA, 22 nt, Homo sapiens
guggagacaaaggcugagugag

SEQ ID NO: 266347 - RNA, 18 nt, Homo sapiens
guggagugucuuccugga

SEQ ID NO: 266348 - RNA, 22 nt, Homo sapiens
guggaucacuugaggucaagag

SEQ ID NO: 266349 - RNA, 22 nt, Homo sapiens
guggcaaggaaaugcugcucac

SEQ ID NO: 266350 - RNA, 22 nt, Homo sapiens
guggcagaaaagagaagcaaug

SEQ ID NO: 266351 - RNA, 22 nt, Homo sapiens
guggcagaacagguaggguucu

SEQ ID NO: 266352 - RNA, 22 nt, Homo sapiens
guggcagugugaggauccugcu

SEQ ID NO: 266353 - RNA, 22 nt, Homo sapiens
gugggagugucccguuuuucca

SEQ ID NO: 266354 - RNA, 22 nt, Homo sapiens
gugggaugaucgcuugagccca

SEQ ID NO: 266355 - RNA, 20 nt, Homo sapiens
gugggcaaauccuuuccucu

SEQ ID NO: 266356 - RNA, 22 nt, Homo sapiens
guggguaaaucucuggggcucu

SEQ ID NO: 266357 - RNA, 22 nt, Homo sapiens
guggguaaaucucuguucgagg

SEQ ID NO: 266358 - RNA, 21 nt, Homo sapiens
gugguucuagagaaacagaau

SEQ ID NO: 266359 - RNA, 22 nt, Homo sapiens
gugguuguuggaguggcaauuu

SEQ ID NO: 266360 - RNA, 22 nt, Homo sapiens
gugguuuuacaaagagaaagau

SEQ ID NO: 266361 - RNA, 22 nt, Homo sapiens
guguaacaacagcacuccacug

SEQ ID NO: 266362 - RNA, 22 nt, Homo sapiens
guguaauacacacauauaugca

SEQ ID NO: 266363 - RNA, 22 nt, Homo sapiens
guguagagaaauagccugaagg

SEQ ID NO: 266364 - RNA, 22 nt, Homo sapiens
guguauauccuauuaguucugu

SEQ ID NO: 266365 - RNA, 22 nt, Homo sapiens
guguauguuguccauggaugcg

SEQ ID NO: 266366 - RNA, 22 nt, Homo sapiens
gugucaguggggagugaucuuc

SEQ ID NO: 266367 - RNA, 22 nt, Homo sapiens
gugugacagcuauagacaugau

SEQ ID NO: 266368 - RNA, 22 nt, Homo sapiens
gugugcaauuuugugggaggca

SEQ ID NO: 266369 - RNA, 22 nt, Homo sapiens
gugugcacaaucuggcaugugc

SEQ ID NO: 266370 - RNA, 22 nt, Homo sapiens
gugugcaugucuuuuuaguagg

SEQ ID NO: 266371 - RNA, 20 nt, Homo sapiens
gugugcauuucagauuuugg

SEQ ID NO: 266372 - RNA, 21 nt, Homo sapiens
gugugcuugagugaugggauu

SEQ ID NO: 266373 - RNA, 22 nt, Homo sapiens
gugugguauuauaacuagguau

SEQ ID NO: 266374 - RNA, 23 nt, Homo sapiens
guuaagugaauguguacucuauu

SEQ ID NO: 266375 - RNA, 22 nt, Homo sapiens
guuagcuaguagacaauuuucc

SEQ ID NO: 266376 - RNA, 22 nt, Homo sapiens
guuauccugucuuuacauacaa

SEQ ID NO: 266377 - RNA, 22 nt, Homo sapiens
guuaugcagcaauugauaaucu

SEQ ID NO: 266378 - RNA, 22 nt, Homo sapiens
guuauguuaguuacaaggcuag

SEQ ID NO: 266379 - RNA, 22 nt, Homo sapiens
guucaaguuuucucuugugggu

SEQ ID NO: 266380 - RNA, 22 nt, Homo sapiens
guucacaguuucuaaucccagc

SEQ ID NO: 266381 - RNA, 22 nt, Homo sapiens
guucaucaggaauauuggccua

SEQ ID NO: 266382 - RNA, 17 nt, Homo sapiens
guucccaguggcauuug

SEQ ID NO: 266383 - RNA, 22 nt, Homo sapiens
guugagcaagcuuuggagccua

SEQ ID NO: 266384 - RNA, 22 nt, Homo sapiens
ugagauggaguuucgcccuugu

SEQ ID NO: 266385 - RNA, 22 nt, Homo sapiens
ugagauggaucuuggauuugaa

SEQ ID NO: 266386 - RNA, 22 nt, Homo sapiens
ugagauguagauauggauuaga

SEQ ID NO: 266387 - RNA, 22 nt, Homo sapiens
ugagaugugugcauucaacuca

SEQ ID NO: 266388 - RNA, 23 nt, Homo sapiens
ugagauuacccagaaagaguaua

SEQ ID NO: 266389 - RNA, 22 nt, Homo sapiens
ugagauuauauuucuuaacaga

SEQ ID NO: 266390 - RNA, 22 nt, Homo sapiens
ugagauuaucguaauguaucuc

SEQ ID NO: 266391 - RNA, 22 nt, Homo sapiens
ugagcacaggugcgcgguuacu

SEQ ID NO: 266392 - RNA, 22 nt, Homo sapiens
ugagcaucauucacaccuuggu

SEQ ID NO: 266393 - RNA, 22 nt, Homo sapiens
ugagcauuguguuugacuguga

SEQ ID NO: 266394 - RNA, 22 nt, Homo sapiens
ugagcauuguuuggacuuggau

SEQ ID NO: 266395 - RNA, 22 nt, Homo sapiens
ugagcuagagaguuuaguguca

SEQ ID NO: 266396 - RNA, 22 nt, Homo sapiens
ugagcucaguauuucauaaaca

SEQ ID NO: 266397 - RNA, 22 nt, Homo sapiens
ugagcuccuucauaaaaaggca

SEQ ID NO: 266398 - RNA, 22 nt, Homo sapiens
ugagcugagaucacacuacugu

SEQ ID NO: 266399 - RNA, 22 nt, Homo sapiens
ugagcuguuugaagaagcauuu

SEQ ID NO: 266400 - RNA, 22 nt, Homo sapiens
ugaggaaugaccccgugugguc

SEQ ID NO: 266401 - RNA, 22 nt, Homo sapiens
ugaggcaagauacugauuucau

SEQ ID NO: 266402 - RNA, 22 nt, Homo sapiens
ugaggcaaggcugaaugaaggc

SEQ ID NO: 266403 - RNA, 22 nt, Homo sapiens
ugaggcacucccuagcggggug

SEQ ID NO: 266404 - RNA, 22 nt, Homo sapiens
ugagggaugccugguuuguuuu

SEQ ID NO: 266405 - RNA, 22 nt, Homo sapiens
ugagguaagauguucauuuuuc

SEQ ID NO: 266406 - RNA, 22 nt, Homo sapiens
ugagguaggugaagaaugcacg

SEQ ID NO: 266407 - RNA, 22 nt, Homo sapiens
ugaggucacuuguuuuaugcuu

SEQ ID NO: 266408 - RNA, 22 nt, Homo sapiens
ugaggugagggguuaggugcua

SEQ ID NO: 266409 - RNA, 22 nt, Homo sapiens
ugaggugcagcaauccucaugu

SEQ ID NO: 266410 - RNA, 22 nt, Homo sapiens
cagaugcaugaccugggcuugg

SEQ ID NO: 266411 - RNA, 20 nt, Homo sapiens
cagcaaccugcucucuuccu

SEQ ID NO: 266412 - RNA, 22 nt, Homo sapiens
cagcccuacacagacugacuca

SEQ ID NO: 266413 - RNA, 22 nt, Homo sapiens
cagcuaguuuuugguuuacagu

SEQ ID NO: 266414 - RNA, 22 nt, Homo sapiens
cagcucauugcagucucgaccu

SEQ ID NO: 266415 - RNA, 23 nt, Homo sapiens
cagcucauuuggguccccuuguc

SEQ ID NO: 266416 - RNA, 22 nt, Homo sapiens
cagcugcuuuggaaaauauuuu

SEQ ID NO: 266417 - RNA, 20 nt, Homo sapiens
cagggcaaugaggagguaaa

SEQ ID NO: 266418 - RNA, 22 nt, Homo sapiens
cagguacuucugggcugagcag

SEQ ID NO: 266419 - RNA, 22 nt, Homo sapiens
caggucaucugaguuuaguucu

SEQ ID NO: 266420 - RNA, 22 nt, Homo sapiens
caggugcauuggcugacaccug

SEQ ID NO: 266421 - RNA, 22 nt, Homo sapiens
caguagcaugccucagaaugag

SEQ ID NO: 266422 - RNA, 19 nt, Homo sapiens
caguaucauugcacauagu

SEQ ID NO: 266423 - RNA, 22 nt, Homo sapiens
cagugacacugaaaaguucggg

SEQ ID NO: 266424 - RNA, 22 nt, Homo sapiens
cagugguuuucucaguucagca

SEQ ID NO: 266425 - RNA, 22 nt, Homo sapiens
caguguuuuuaacaggugcccg

SEQ ID NO: 266426 - RNA, 21 nt, Homo sapiens
cauaaugcuacuuauuuuaug

SEQ ID NO: 266427 - RNA, 22 nt, Homo sapiens
caucacacuuggauguaagaca

SEQ ID NO: 266428 - RNA, 21 nt, Homo sapiens
caucacauuacucaaaguccu

SEQ ID NO: 266429 - RNA, 22 nt, Homo sapiens
caucacuuuuccuuuuacagau

SEQ ID NO: 266430 - RNA, 22 nt, Homo sapiens
caucagagugagauauaagauc

SEQ ID NO: 266431 - RNA, 22 nt, Homo sapiens
caucauugcacccuauagagaa

SEQ ID NO: 266432 - RNA, 22 nt, Homo sapiens
caucccugucgucaagucucug

SEQ ID NO: 266433 - RNA, 22 nt, Homo sapiens
caugaaagugagaaacuccugg

SEQ ID NO: 266434 - RNA, 22 nt, Homo sapiens
caugcacugaguccaccucugg

SEQ ID NO: 266435 - RNA, 22 nt, Homo sapiens
caugccacuguggacaaagaca

SEQ ID NO: 266436 - RNA, 22 nt, Homo sapiens
cauggcacagagaauguguucu

SEQ ID NO: 266437 - RNA, 22 nt, Homo sapiens
cauggcacauauauaucuaggu

SEQ ID NO: 266438 - RNA, 22 nt, Homo sapiens
cauggcacugagcagguaugca

SEQ ID NO: 266439 - RNA, 22 nt, Homo sapiens
cauggcacuggugggagugucu

SEQ ID NO: 266440 - RNA, 22 nt, Homo sapiens
cauggcccuggguccauaggaa

SEQ ID NO: 266441 - RNA, 19 nt, Homo sapiens
cauggcuuauaauuuuaau

SEQ ID NO: 266442 - RNA, 22 nt, Homo sapiens
cauggcuuuauuuucagcuucu

SEQ ID NO: 266443 - RNA, 22 nt, Homo sapiens
cauggcuuuuauaacaagaaau

SEQ ID NO: 266444 - RNA, 22 nt, Homo sapiens
cauggguuuucucaaguaguca

SEQ ID NO: 266445 - RNA, 19 nt, Homo sapiens
caugugcacuacuggcuuc

SEQ ID NO: 266446 - RNA, 22 nt, Homo sapiens
cauuccacauguaggacaauuu

SEQ ID NO: 266447 - RNA, 20 nt, Homo sapiens
cauuccacuuuccugucagu

SEQ ID NO: 266448 - RNA, 22 nt, Homo sapiens
cauugcacuccagcccuggcaa

SEQ ID NO: 266449 - RNA, 20 nt, Homo sapiens
cauugcacuccagccugcug

SEQ ID NO: 266450 - RNA, 22 nt, Homo sapiens
cauugcacuccagccuggcaac

SEQ ID NO: 266451 - RNA, 22 nt, Homo sapiens
cauugcacuccagucugggcaa

SEQ ID NO: 266452 - RNA, 22 nt, Homo sapiens
cauugcacuccauccuuggcaa

SEQ ID NO: 266453 - RNA, 22 nt, Homo sapiens
cauugcaguggaguggggaaga

SEQ ID NO: 266454 - RNA, 19 nt, Homo sapiens
cauuggacuugcuuuugcc

SEQ ID NO: 266455 - RNA, 22 nt, Homo sapiens
cauugguuuauagauggggaaa

SEQ ID NO: 266456 - RNA, 22 nt, Homo sapiens
ccaaggaauacccucccuuuuu

SEQ ID NO: 266457 - RNA, 22 nt, Homo sapiens
ccaaguguuuucauuguuccau

SEQ ID NO: 266458 - RNA, 22 nt, Homo sapiens
ccacacugucuuggugggaaac

SEQ ID NO: 266459 - RNA, 23 nt, Homo sapiens
ccacacuguuuagaauggcauca

SEQ ID NO: 266460 - RNA, 22 nt, Homo sapiens
ccacccuuccauucuuccucuu

SEQ ID NO: 266461 - RNA, 22 nt, Homo sapiens
ccagcaccauuuauuaaauagg

SEQ ID NO: 266462 - RNA, 23 nt, Homo sapiens
ccaguauuuauguaaggaagugu

SEQ ID NO: 266463 - RNA, 22 nt, Homo sapiens
ccaguucaaugauauggaaacu

SEQ ID NO: 266464 - RNA, 22 nt, Homo sapiens
ccaguuuuucauuuauacuagu

SEQ ID NO: 266465 - RNA, 22 nt, Homo sapiens
ccauacugucaaauagauuucc

SEQ ID NO: 266466 - RNA, 22 nt, Homo sapiens
ccaucacaggccucagugggaa

SEQ ID NO: 266467 - RNA, 22 nt, Homo sapiens
ccauggcaauggucagucuauu

SEQ ID NO: 266468 - RNA, 22 nt, Homo sapiens
ccauggcuauucuguaaggguu

SEQ ID NO: 266469 - RNA, 22 nt, Homo sapiens
ccauugcacuccauccugggca

SEQ ID NO: 266470 - RNA, 22 nt, Homo sapiens
ccauuucacucuuccugaagga

SEQ ID NO: 266471 - RNA, 22 nt, Homo sapiens
cccauuguuaaguugaguaucu

SEQ ID NO: 266472 - RNA, 22 nt, Homo sapiens
ccccauuguugugguuuuaucu

SEQ ID NO: 266473 - RNA, 22 nt, Homo sapiens
cccucgagaaaccaucugcuga

SEQ ID NO: 266474 - RNA, 22 nt, Homo sapiens
acugcacuucagccuuggcuac

SEQ ID NO: 266475 - RNA, 22 nt, Homo sapiens
acugcacuucagccuuggggac

SEQ ID NO: 266476 - RNA, 22 nt, Homo sapiens
acugcacuucagccuugugaca

SEQ ID NO: 266477 - RNA, 22 nt, Homo sapiens
acuggcauagggcgggcacagu

SEQ ID NO: 266478 - RNA, 20 nt, Homo sapiens
acugggcuaccgaaguaagg

SEQ ID NO: 266479 - RNA, 22 nt, Homo sapiens
acuguguguuugucuagcacag

SEQ ID NO: 266480 - RNA, 22 nt, Homo sapiens
acuuggcaaaguuuuaaacagc

SEQ ID NO: 266481 - RNA, 22 nt, Homo sapiens
agaaagcgcuucccuuugcugg

SEQ ID NO: 266482 - RNA, 22 nt, Homo sapiens
agaaagugcuucccuuugguga

SEQ ID NO: 266483 - RNA, 22 nt, Homo sapiens
agaauaauguccccccaaggga

SEQ ID NO: 266484 - RNA, 22 nt, Homo sapiens
agaaugauccuucucagaggca

SEQ ID NO: 266485 - RNA, 22 nt, Homo sapiens
agacacugaaauguauugaaga

SEQ ID NO: 266486 - RNA, 21 nt, Homo sapiens
agacacuuggaagguuuuaga

SEQ ID NO: 266487 - RNA, 20 nt, Homo sapiens
agacagcugcagcccacauc

SEQ ID NO: 266488 - RNA, 22 nt, Homo sapiens
agacagcuggaguaucauagcu

SEQ ID NO: 266489 - RNA, 22 nt, Homo sapiens
agacagcugggaaauggagugu

SEQ ID NO: 266490 - RNA, 22 nt, Homo sapiens
agacagcugguagcacuuccug

SEQ ID NO: 266491 - RNA, 22 nt, Homo sapiens
agacaucauuugauggugggag

SEQ ID NO: 266492 - RNA, 22 nt, Homo sapiens
agacuagagggaaaugaguugg

SEQ ID NO: 266493 - RNA, 20 nt, Homo sapiens
agacuagggagcagaaagcc

SEQ ID NO: 266494 - RNA, 22 nt, Homo sapiens
agacucauuuccauagucagcu

SEQ ID NO: 266495 - RNA, 22 nt, Homo sapiens
agagaacugauuggaguugggc

SEQ ID NO: 266496 - RNA, 22 nt, Homo sapiens
agagccacauuaaauaugggaa

SEQ ID NO: 266497 - RNA, 22 nt, Homo sapiens
agagcuaguauuuacggagcau

SEQ ID NO: 266498 - RNA, 22 nt, Homo sapiens
agagcuguguuuuaacuuuuua

SEQ ID NO: 266499 - RNA, 22 nt, Homo sapiens
agagguuuaauugauucacagu

SEQ ID NO: 266500 - RNA, 22 nt, Homo sapiens
agaguauagcaacuuaguaaaa

SEQ ID NO: 266501 - RNA, 22 nt, Homo sapiens
agagucacaugaggcccuucau

SEQ ID NO: 266502 - RNA, 22 nt, Homo sapiens
agagugcuauagauuagauuuc

SEQ ID NO: 266503 - RNA, 20 nt, Homo sapiens
agagugcugucuguccugag

SEQ ID NO: 266504 - RNA, 22 nt, Homo sapiens
agagugcuuuauuagauguagc

SEQ ID NO: 266505 - RNA, 22 nt, Homo sapiens
agauauuuguuaggucugucag

SEQ ID NO: 266506 - RNA, 22 nt, Homo sapiens
agaucauaugcaguaaugaacu

SEQ ID NO: 266507 - RNA, 23 nt, Homo sapiens
agaugcaucuggcugcgaggcaa

SEQ ID NO: 266508 - RNA, 22 nt, Homo sapiens
agaugcauuuuuauuggaauac

SEQ ID NO: 266509 - RNA, 22 nt, Homo sapiens
agcaaaucuaugaauguauauu

SEQ ID NO: 266510 - RNA, 22 nt, Homo sapiens
agcaacauugagacugcaguug

SEQ ID NO: 266511 - RNA, 22 nt, Homo sapiens
agcaacauuguucauaauagcu

SEQ ID NO: 266512 - RNA, 22 nt, Homo sapiens
agcaagaugaaguugagcuagg

SEQ ID NO: 266513 - RNA, 22 nt, Homo sapiens
agcacauauauuucccaaaaca

SEQ ID NO: 266514 - RNA, 22 nt, Homo sapiens
agcacauuaguaucuaagaaca

SEQ ID NO: 266515 - RNA, 22 nt, Homo sapiens
agcaccaauaacaguuucuagc

SEQ ID NO: 266516 - RNA, 22 nt, Homo sapiens
agcaccaauaaucagaguucuu

SEQ ID NO: 266517 - RNA, 22 nt, Homo sapiens
agcaccagaaucugaguuauuc

SEQ ID NO: 266518 - RNA, 18 nt, Homo sapiens
ucugugguguaaauacgu

SEQ ID NO: 266519 - RNA, 22 nt, Homo sapiens
ucugugguucuagcuacuuugg

SEQ ID NO: 266520 - RNA, 22 nt, Homo sapiens
ucuguguugaugcucauuaauu

SEQ ID NO: 266521 - RNA, 22 nt, Homo sapiens
ucuuaggugaugauugauguga

SEQ ID NO: 266522 - RNA, 22 nt, Homo sapiens
ucuuaguuuagauuagcaauuc

SEQ ID NO: 266523 - RNA, 22 nt, Homo sapiens
ucuugcuuguuguucccuucau

SEQ ID NO: 266524 - RNA, 22 nt, Homo sapiens
ucuugggugaguuugugaauaa

SEQ ID NO: 266525 - RNA, 22 nt, Homo sapiens
ucuuggguuguuggcuucuccu

SEQ ID NO: 266526 - RNA, 22 nt, Homo sapiens
ucuuggguuugccuugcugcug

SEQ ID NO: 266527 - RNA, 23 nt, Homo sapiens
ucuuguacuuugagugagcaugg

SEQ ID NO: 266528 - RNA, 22 nt, Homo sapiens
ucuuucacuuagcaugauguuu

SEQ ID NO: 266529 - RNA, 22 nt, Homo sapiens
ucuuugaguuauugugcagacu

SEQ ID NO: 266530 - RNA, 22 nt, Homo sapiens
ucuuugauuaugcagauggguu

SEQ ID NO: 266531 - RNA, 23 nt, Homo sapiens
ucuuuggcucuaauauaccuugu

SEQ ID NO: 266532 - RNA, 22 nt, Homo sapiens
ucuuuggucagaaagauuacac

SEQ ID NO: 266533 - RNA, 22 nt, Homo sapiens
ucuuugguucuguuuauguaau

SEQ ID NO: 266534 - RNA, 22 nt, Homo sapiens
ucuuuguuggaguccaaggaua

SEQ ID NO: 266535 - RNA, 22 nt, Homo sapiens
ucuuuugggccucuugucagac

SEQ ID NO: 266536 - RNA, 22 nt, Homo sapiens
ugaaacacacagagaagggaga

SEQ ID NO: 266537 - RNA, 22 nt, Homo sapiens
ugaaagcuacagucuccuagga

SEQ ID NO: 266538 - RNA, 22 nt, Homo sapiens
ugaaaugccuugagauuuugac

SEQ ID NO: 266539 - RNA, 22 nt, Homo sapiens
ugaaaugcugucuaggggaaau

SEQ ID NO: 266540 - RNA, 22 nt, Homo sapiens
ugaaauggaaagaguguagacu

SEQ ID NO: 266541 - RNA, 22 nt, Homo sapiens
ugaacacagccugccucugcca

SEQ ID NO: 266542 - RNA, 22 nt, Homo sapiens
ugaacacaucuccugguaccug

SEQ ID NO: 266543 - RNA, 22 nt, Homo sapiens
ugaagacucaguuugagggaca

SEQ ID NO: 266544 - RNA, 22 nt, Homo sapiens
ugaagaucuuaggagcugaggg

SEQ ID NO: 266545 - RNA, 22 nt, Homo sapiens
ugaagugaaugguaaguaugcc

SEQ ID NO: 266546 - RNA, 22 nt, Homo sapiens
ugaagugcugugggccaggcgu

SEQ ID NO: 266547 - RNA, 22 nt, Homo sapiens
ugaauacuucaaaaaaauagcu

SEQ ID NO: 266548 - RNA, 22 nt, Homo sapiens
ugaauagacacuaaagacugua

SEQ ID NO: 266549 - RNA, 22 nt, Homo sapiens
auuaaggaguggguucauggug

SEQ ID NO: 266550 - RNA, 22 nt, Homo sapiens
auuaagugaaugaaguuguucc

SEQ ID NO: 266551 - RNA, 22 nt, Homo sapiens
auuaaguuaggauuuugagaua

SEQ ID NO: 266552 - RNA, 22 nt, Homo sapiens
auuaaguugugccugaaaacuu

SEQ ID NO: 266553 - RNA, 22 nt, Homo sapiens
auuacauagucaaggugucuca

SEQ ID NO: 266554 - RNA, 22 nt, Homo sapiens
auuauaguguauacuugaaauu

SEQ ID NO: 266555 - RNA, 22 nt, Homo sapiens
auuaucacaguuuugcauaugg

SEQ ID NO: 266556 - RNA, 22 nt, Homo sapiens
auuauuaguuguugaaugaagu

SEQ ID NO: 266557 - RNA, 22 nt, Homo sapiens
auucaacuaauuauugaagaug

SEQ ID NO: 266558 - RNA, 22 nt, Homo sapiens
auucaagugaugugauucuucu

SEQ ID NO: 266559 - RNA, 22 nt, Homo sapiens
auucacagcuuuaaaaggcgug

SEQ ID NO: 266560 - RNA, 22 nt, Homo sapiens
auucaccauggaccaggggccu

SEQ ID NO: 266561 - RNA, 22 nt, Homo sapiens
auucaucagggauacuggccug

SEQ ID NO: 266562 - RNA, 22 nt, Homo sapiens
auuccacaguuaacacagaccg

SEQ ID NO: 266563 - RNA, 22 nt, Homo sapiens
auuccaguggguuuacauccca

SEQ ID NO: 266564 - RNA, 22 nt, Homo sapiens
auuccauagugucuguggcaga

SEQ ID NO: 266565 - RNA, 22 nt, Homo sapiens
auuccauuuguuaucacacccg

SEQ ID NO: 266566 - RNA, 22 nt, Homo sapiens
auugauagaucauaugguaggu

SEQ ID NO: 266567 - RNA, 22 nt, Homo sapiens
auugcacuccacccugggcaac

SEQ ID NO: 266568 - RNA, 22 nt, Homo sapiens
auugcacuccagccuaggcaac

SEQ ID NO: 266569 - RNA, 22 nt, Homo sapiens
auugcacuccagccugcggaac

SEQ ID NO: 266570 - RNA, 22 nt, Homo sapiens
auugcacuccagccuggcagca

SEQ ID NO: 266571 - RNA, 21 nt, Homo sapiens
auugcacuccagccugggcga

SEQ ID NO: 266572 - RNA, 22 nt, Homo sapiens
auugcacuccagccuugacaca

SEQ ID NO: 266573 - RNA, 22 nt, Homo sapiens
auugcacuccagucugggcaac

SEQ ID NO: 266574 - RNA, 22 nt, Homo sapiens
auugcacucugaucugcacucc

SEQ ID NO: 266575 - RNA, 22 nt, Homo sapiens
auugcaugucauguuuagugua

SEQ ID NO: 266576 - RNA, 22 nt, Homo sapiens
auugcauugugaucuucccaga

SEQ ID NO: 266577 - RNA, 22 nt, Homo sapiens
auugccacaucucagaggcaga

SEQ ID NO: 266578 - RNA, 23 nt, Homo sapiens
auugcccuugaaggcuaaacucu

SEQ ID NO: 266579 - RNA, 22 nt, Homo sapiens
auugcugagacauugcuaaucu

SEQ ID NO: 266580 - RNA, 22 nt, Homo sapiens
auuggacagcauuucuagacuu

SEQ ID NO: 266581 - RNA, 22 nt, Homo sapiens
auuggcaauccauauauuuucu

SEQ ID NO: 266582 - RNA, 22 nt, Homo sapiens
auuggcaaucgucuccauuuuu

SEQ ID NO: 266583 - RNA, 22 nt, Homo sapiens
auuguacauacaccggugugua

SEQ ID NO: 266584 - RNA, 22 nt, Homo sapiens
auuguacucuagccucugggca

SEQ ID NO: 266585 - RNA, 22 nt, Homo sapiens
auugucauuuauaacuguguag

SEQ ID NO: 266586 - RNA, 22 nt, Homo sapiens
auugugauggucaaaggaaaua

SEQ ID NO: 266587 - RNA, 22 nt, Homo sapiens
auuguuccccggucauuuuugu

SEQ ID NO: 266588 - RNA, 22 nt, Homo sapiens
auuguucuuacaugcugucauc

SEQ ID NO: 266589 - RNA, 22 nt, Homo sapiens
auuucuacuccuguguccagaa

SEQ ID NO: 266590 - RNA, 22 nt, Homo sapiens
auuuggcaguauaaugcuuugg

SEQ ID NO: 266591 - RNA, 20 nt, Homo sapiens
auuuggcauaguuuaagcaa

SEQ ID NO: 266592 - RNA, 22 nt, Homo sapiens
auuugggaaugugcauuauacu

SEQ ID NO: 266593 - RNA, 22 nt, Homo sapiens
auuugguaauauuuaaggacuu

SEQ ID NO: 266594 - RNA, 22 nt, Homo sapiens
auuugucacuauguggcuaaua

SEQ ID NO: 266595 - RNA, 22 nt, Homo sapiens
auuuugcauugcuguaaaggaa

SEQ ID NO: 266596 - RNA, 22 nt, Homo sapiens
auuuugguuacauaguugagcu

SEQ ID NO: 266597 - RNA, 22 nt, Homo sapiens
caaaagugguucuuauccuuuu

SEQ ID NO: 266598 - RNA, 22 nt, Homo sapiens
caaagcuauagcaccagaggga

SEQ ID NO: 266599 - RNA, 22 nt, Homo sapiens
caaaggcuuccacugcauccuu

SEQ ID NO: 266600 - RNA, 22 nt, Homo sapiens
caaaguaauugcuguuuugcca

SEQ ID NO: 266601 - RNA, 22 nt, Homo sapiens
caaagugcuggccgggcgcagu

SEQ ID NO: 266602 - RNA, 22 nt, Homo sapiens
caaaugaucugcuggccucagc

SEQ ID NO: 266603 - RNA, 22 nt, Homo sapiens
caaaugcuucuauggacugucu

SEQ ID NO: 266604 - RNA, 22 nt, Homo sapiens
caacacagugaaacccgucucu

SEQ ID NO: 266605 - RNA, 22 nt, Homo sapiens
caacacuguuuauuggauagcc

SEQ ID NO: 266606 - RNA, 22 nt, Homo sapiens
caacauccaccuccuggguuca

SEQ ID NO: 266607 - RNA, 22 nt, Homo sapiens
caacucuguaggauccaggugg

SEQ ID NO: 266608 - RNA, 22 nt, Homo sapiens
gagagcuaggccacuggggcuu

SEQ ID NO: 266609 - RNA, 22 nt, Homo sapiens
gagagguaguuuuuuggucguc

SEQ ID NO: 266610 - RNA, 21 nt, Homo sapiens
gagauagguaccgaagcuuag

SEQ ID NO: 266611 - RNA, 23 nt, Homo sapiens
gagaucauucuggaauuagagug

SEQ ID NO: 266612 - RNA, 22 nt, Homo sapiens
gagaugaagugucaauaaggau

SEQ ID NO: 266613 - RNA, 22 nt, Homo sapiens
gagaugcaccuugucacguuuc

SEQ ID NO: 266614 - RNA, 22 nt, Homo sapiens
gagauggaguuucacuucgcuc

SEQ ID NO: 266615 - RNA, 22 nt, Homo sapiens
gagaugguacacauacgauucu

SEQ ID NO: 266616 - RNA, 22 nt, Homo sapiens
gagauggugugcuguuggaagu

SEQ ID NO: 266617 - RNA, 22 nt, Homo sapiens
gagaugguguuccacugccagu

SEQ ID NO: 266618 - RNA, 22 nt, Homo sapiens
gagauguagucuugcccuguca

SEQ ID NO: 266619 - RNA, 22 nt, Homo sapiens
gagauuauuagauguucugcuu

SEQ ID NO: 266620 - RNA, 22 nt, Homo sapiens
gagcaaugagcugccugcugag

SEQ ID NO: 266621 - RNA, 21 nt, Homo sapiens
gagcacauuguccucuaacgc

SEQ ID NO: 266622 - RNA, 22 nt, Homo sapiens
gagcacugauuuauuuuugucu

SEQ ID NO: 266623 - RNA, 22 nt, Homo sapiens
gagccauggagaaaacagcuau

SEQ ID NO: 266624 - RNA, 22 nt, Homo sapiens
gagcugccuugccuaugcaaga

SEQ ID NO: 266625 - RNA, 22 nt, Homo sapiens
gagcuguuuuucacuagaccaa

SEQ ID NO: 266626 - RNA, 22 nt, Homo sapiens
gaggaaguuuacaaagcaucug

SEQ ID NO: 266627 - RNA, 22 nt, Homo sapiens
gaggcaaugugcccggcccaca

SEQ ID NO: 266628 - RNA, 22 nt, Homo sapiens
gaggcauuauucccaucuuaca

SEQ ID NO: 266629 - RNA, 22 nt, Homo sapiens
gagggcacugcuuuccuuucaa

SEQ ID NO: 266630 - RNA, 22 nt, Homo sapiens
gagguaaguaagaauggcaagc

SEQ ID NO: 266631 - RNA, 21 nt, Homo sapiens
gagguaccucauguaagugga

SEQ ID NO: 266632 - RNA, 22 nt, Homo sapiens
gagguagagacuauguauuaga

SEQ ID NO: 266633 - RNA, 22 nt, Homo sapiens
gaggucaggacauuuuugcuuu

SEQ ID NO: 266634 - RNA, 22 nt, Homo sapiens
gaggucauucugugguacccag

SEQ ID NO: 266635 - RNA, 22 nt, Homo sapiens
gaggugauaucucauugugguu

SEQ ID NO: 266636 - RNA, 22 nt, Homo sapiens
gagguggugguggaggcauagc

SEQ ID NO: 266637 - RNA, 22 nt, Homo sapiens
gaguaaaugucacuguugcugu

SEQ ID NO: 266638 - RNA, 22 nt, Homo sapiens
gaguaaauguccuagcuucuug

SEQ ID NO: 266639 - RNA, 22 nt, Homo sapiens
gaguagaacugguuaucuaaua

SEQ ID NO: 266640 - RNA, 22 nt, Homo sapiens
gagugcaagguuuuucugagug

SEQ ID NO: 266641 - RNA, 23 nt, Homo sapiens
gagugcaaugacaugaucucgga

SEQ ID NO: 266642 - RNA, 22 nt, Homo sapiens
gagugcaauggcagaucuccgc

SEQ ID NO: 266643 - RNA, 22 nt, Homo sapiens
gagugcaauggcgcgaucucgg

SEQ ID NO: 266644 - RNA, 22 nt, Homo sapiens
gagugcugagcccacuuccuug

SEQ ID NO: 266645 - RNA, 23 nt, Homo sapiens
gaguggagacucauugauuuccu

SEQ ID NO: 266646 - RNA, 21 nt, Homo sapiens
gaguggcuuuuguuucaccag

SEQ ID NO: 266647 - RNA, 22 nt, Homo sapiens
gauaaaucuuggcuagucuaag

SEQ ID NO: 266648 - RNA, 22 nt, Homo sapiens
gauaacagauaaugucaguuau

SEQ ID NO: 266649 - RNA, 22 nt, Homo sapiens
gauacaccauuuucuagcuauu

SEQ ID NO: 266650 - RNA, 22 nt, Homo sapiens
gauaguugugagaacucuuacu

SEQ ID NO: 266651 - RNA, 22 nt, Homo sapiens
gauauguaguaguugaaaaaga

SEQ ID NO: 266652 - RNA, 22 nt, Homo sapiens
gauauguuagggggagaaguua

SEQ ID NO: 266653 - RNA, 19 nt, Homo sapiens
gauauguugagcacccuuu

SEQ ID NO: 266654 - RNA, 22 nt, Homo sapiens
gauauguugaguagaguuuuug

SEQ ID NO: 266655 - RNA, 22 nt, Homo sapiens
gaucaauuggcugaagacacgu

SEQ ID NO: 266656 - RNA, 22 nt, Homo sapiens
gaucacauuguuucauacauau

SEQ ID NO: 266657 - RNA, 22 nt, Homo sapiens
gaucugagaaagugucauaaca

SEQ ID NO: 266658 - RNA, 22 nt, Homo sapiens
gaugaaacaucuuuggaaacug

SEQ ID NO: 266659 - RNA, 22 nt, Homo sapiens
gaugagguaguguaccuagucu

SEQ ID NO: 266660 - RNA, 22 nt, Homo sapiens
gaugauauuugagucauuagaa

SEQ ID NO: 266661 - RNA, 22 nt, Homo sapiens
gaugaugcuagguguuagggcu

SEQ ID NO: 266662 - RNA, 22 nt, Homo sapiens
gauggaguugucgccugggcug

SEQ ID NO: 266663 - RNA, 22 nt, Homo sapiens
gauggcaugugcugccaccaag

SEQ ID NO: 266664 - RNA, 22 nt, Homo sapiens
gauguaggugcauuugcacgug

SEQ ID NO: 266665 - RNA, 22 nt, Homo sapiens
gauuagugacguugagcacugu

SEQ ID NO: 266666 - RNA, 22 nt, Homo sapiens
gauuccauugcgaauuuucaga

SEQ ID NO: 266667 - RNA, 22 nt, Homo sapiens
gauuccauuuguggcuauuuac

SEQ ID NO: 266668 - RNA, 22 nt, Homo sapiens
gauuggcauugcugcaccugag

SEQ ID NO: 266669 - RNA, 22 nt, Homo sapiens
gcaaaaaguagugcugguuagg

SEQ ID NO: 266670 - RNA, 22 nt, Homo sapiens
gcaaagaaugcagauuugccuc

SEQ ID NO: 266671 - RNA, 21 nt, Homo sapiens
gcaaaguggcuaccuugcucc

SEQ ID NO: 266672 - RNA, 22 nt, Homo sapiens
gcaaaguguuuuccaacuuggu

SEQ ID NO: 266673 - RNA, 20 nt, Homo sapiens
gcaacauggccagagugaau

SEQ ID NO: 266674 - RNA, 22 nt, Homo sapiens
gcaagauuguguggcugaagua

SEQ ID NO: 266675 - RNA, 20 nt, Homo sapiens
gcaagcaugaagaguagaga

SEQ ID NO: 266676 - RNA, 22 nt, Homo sapiens
gcaaggacucccugggucauuc

SEQ ID NO: 266677 - RNA, 22 nt, Homo sapiens
gcaaugcugucugugcacagau

SEQ ID NO: 266678 - RNA, 22 nt, Homo sapiens
gcaauguuacugaauguguuuu

SEQ ID NO: 266679 - RNA, 22 nt, Homo sapiens
gcacacguagaagcaugcauca

SEQ ID NO: 266680 - RNA, 22 nt, Homo sapiens
gcacaguggcucccgucuauaa

SEQ ID NO: 266681 - RNA, 22 nt, Homo sapiens
gcacaguuaaagggucauguga

SEQ ID NO: 266682 - RNA, 17 nt, Homo sapiens
gcacuggcguaucccac

SEQ ID NO: 266683 - RNA, 22 nt, Homo sapiens
gcagcaucaaaucacacaagau

SEQ ID NO: 266684 - RNA, 22 nt, Homo sapiens
gcagcauuaccaagacauggca

SEQ ID NO: 266685 - RNA, 22 nt, Homo sapiens
gcagucacagggagauggugac

SEQ ID NO: 266686 - RNA, 22 nt, Homo sapiens
gcagugcaguggcgcgaucucg

SEQ ID NO: 266687 - RNA, 22 nt, Homo sapiens
gcagugugauguuuuaaucuau

SEQ ID NO: 266688 - RNA, 22 nt, Homo sapiens
gcaguguucugggcaggaagaa

SEQ ID NO: 266689 - RNA, 19 nt, Homo sapiens
gcaucauuaguugcuuuuc

SEQ ID NO: 266690 - RNA, 20 nt, Homo sapiens
gcaugagucuuuauaguaga

SEQ ID NO: 266691 - RNA, 22 nt, Homo sapiens
gcaugaugaauaauaucacaag

SEQ ID NO: 266692 - RNA, 22 nt, Homo sapiens
gcauggauguugauggcugcug

SEQ ID NO: 266693 - RNA, 22 nt, Homo sapiens
gcaugguacuggaugguaguau

SEQ ID NO: 266694 - RNA, 18 nt, Homo sapiens
gccaacauguaaacaggu

SEQ ID NO: 266695 - RNA, 22 nt, Homo sapiens
gccauggugucuuauuuuugug

SEQ ID NO: 266696 - RNA, 22 nt, Homo sapiens
gccccaguacaggcuccuuaga

SEQ ID NO: 266697 - RNA, 22 nt, Homo sapiens
gcccugagauucuuggauucug

SEQ ID NO: 266698 - RNA, 22 nt, Homo sapiens
gccuagagacuugguaucuugc

SEQ ID NO: 266699 - RNA, 22 nt, Homo sapiens
gccugagaggauaugauccccu

SEQ ID NO: 266700 - RNA, 22 nt, Homo sapiens
gcgcagugggcugugccaucca

SEQ ID NO: 266701 - RNA, 22 nt, Homo sapiens
gcuagcacauugucaccucuca

SEQ ID NO: 266702 - RNA, 22 nt, Homo sapiens
gcuauggccugaauguuugugu

SEQ ID NO: 266703 - RNA, 22 nt, Homo sapiens
gcuaugucuguugcucuugggc

SEQ ID NO: 266704 - RNA, 19 nt, Homo sapiens
gcucaccuugcugcuccag

SEQ ID NO: 266705 - RNA, 22 nt, Homo sapiens
gcucaugagacaagcaggagua

SEQ ID NO: 266706 - RNA, 22 nt, Homo sapiens
gcucguccccuccugacucugc

SEQ ID NO: 266707 - RNA, 22 nt, Homo sapiens
gcucugguuacaaaggcaaauu

SEQ ID NO: 266708 - RNA, 22 nt, Homo sapiens
gcugaaauguuuaauuugggag

SEQ ID NO: 266709 - RNA, 22 nt, Homo sapiens
gcugagaucucuugccugaacu

SEQ ID NO: 266710 - RNA, 17 nt, Homo sapiens
gcugcauucauguagaa

SEQ ID NO: 266711 - RNA, 22 nt, Homo sapiens
gcugcuuuugaugacaaaaaca

SEQ ID NO: 266712 - RNA, 22 nt, Homo sapiens
gcuggcuuucuccugaucucag

SEQ ID NO: 266713 - RNA, 22 nt, Homo sapiens
gcuggguucagagugggcugcg

SEQ ID NO: 266714 - RNA, 22 nt, Homo sapiens
gcugucaugagcaacacaugaa

SEQ ID NO: 266715 - RNA, 22 nt, Homo sapiens
gcugugauucuguguagauagu

SEQ ID NO: 266716 - RNA, 22 nt, Homo sapiens
gcugugguuuaguagaaagaag

SEQ ID NO: 266717 - RNA, 22 nt, Homo sapiens
gcuguguucucgaggcggggga

SEQ ID NO: 266718 - RNA, 22 nt, Homo sapiens
gcuguugcuauuauuccgagaa

SEQ ID NO: 266719 - RNA, 19 nt, Homo sapiens
gcuucuugaggacgaugac

SEQ ID NO: 266720 - RNA, 22 nt, Homo sapiens
ggaaagaucagcuaaauguaag

SEQ ID NO: 266721 - RNA, 21 nt, Homo sapiens
ggaaaguuaaggaaauacccc

SEQ ID NO: 266722 - RNA, 23 nt, Homo sapiens
ggaaauguuuaagggguugggag

SEQ ID NO: 266723 - RNA, 22 nt, Homo sapiens
ggaaauguuuagcauccacuuu

SEQ ID NO: 266724 - RNA, 22 nt, Homo sapiens
ggaagacaguguggugauuccu

SEQ ID NO: 266725 - RNA, 22 nt, Homo sapiens
ggaagccugcacucgggcaggg

SEQ ID NO: 266726 - RNA, 20 nt, Homo sapiens
ggaauagucuacacucugac

SEQ ID NO: 266727 - RNA, 17 nt, Homo sapiens
ggaaugaauuccagccc

SEQ ID NO: 266728 - RNA, 22 nt, Homo sapiens
ggaaugggauuugaagucuggc

SEQ ID NO: 266729 - RNA, 21 nt, Homo sapiens
ggaauuuagggaaugauuuag

SEQ ID NO: 266730 - RNA, 22 nt, Homo sapiens
ggacacaucaugugaccaaggu

SEQ ID NO: 266731 - RNA, 22 nt, Homo sapiens
ggacagugaaugccacuccucc

SEQ ID NO: 266732 - RNA, 22 nt, Homo sapiens
ggagagugacauauuucuaggc

SEQ ID NO: 266733 - RNA, 22 nt, Homo sapiens
ggagaugauuaugaaucacuua

SEQ ID NO: 266734 - RNA, 22 nt, Homo sapiens
ggaggcuaguaaaaagguagaa

SEQ ID NO: 266735 - RNA, 22 nt, Homo sapiens
ggagggugagaucaauuuggga

SEQ ID NO: 266736 - RNA, 22 nt, Homo sapiens
ggagguaauaaguuccagugua

SEQ ID NO: 266737 - RNA, 16 nt, Homo sapiens
ggaggucaucugggaa

SEQ ID NO: 266738 - RNA, 20 nt, Homo sapiens
ggagguuguauaaguacauc

SEQ ID NO: 266739 - RNA, 23 nt, Homo sapiens
ggaguguaaugacucgaucucgg

SEQ ID NO: 266740 - RNA, 22 nt, Homo sapiens
ggaguuuaagucuugugcaucu

SEQ ID NO: 266741 - RNA, 22 nt, Homo sapiens
ggcaaaugaagauggagaggcu

SEQ ID NO: 266742 - RNA, 22 nt, Homo sapiens
ggcaacaaagacauuucaacau

SEQ ID NO: 266743 - RNA, 22 nt, Homo sapiens
ggcaagaacuucacucacuuuu

SEQ ID NO: 266744 - RNA, 22 nt, Homo sapiens
ggcaagauagauaucaguguca

SEQ ID NO: 266745 - RNA, 22 nt, Homo sapiens
ggcaaggauguuuuucuggcaa

SEQ ID NO: 266746 - RNA, 22 nt, Homo sapiens
ggcaaggugcuacagacaguga

SEQ ID NO: 266747 - RNA, 22 nt, Homo sapiens
ggcaaugaggcggaccagcagg

SEQ ID NO: 266748 - RNA, 22 nt, Homo sapiens
ggcaaugucagcuaaugaugga

SEQ ID NO: 266749 - RNA, 22 nt, Homo sapiens
ggcacaaugucagcucacugca

SEQ ID NO: 266750 - RNA, 22 nt, Homo sapiens
ggcaccacagacgccaggcgug

SEQ ID NO: 266751 - RNA, 19 nt, Homo sapiens
ggcaccuuuuccaaaaaug

SEQ ID NO: 266752 - RNA, 22 nt, Homo sapiens
ggcagcauugccuuugcaguga

SEQ ID NO: 266753 - RNA, 22 nt, Homo sapiens
ggcagcuguguccuucguaagg

SEQ ID NO: 266754 - RNA, 17 nt, Homo sapiens
ggcaggaauuaauguca

SEQ ID NO: 266755 - RNA, 22 nt, Homo sapiens
ggcaguggaagugccaguuucu

SEQ ID NO: 266756 - RNA, 22 nt, Homo sapiens
ggccagaugcgguggcucacac

SEQ ID NO: 266757 - RNA, 22 nt, Homo sapiens
ggccggguggccauggcugccc

SEQ ID NO: 266758 - RNA, 22 nt, Homo sapiens
ggcgccauugcacuccagccug

SEQ ID NO: 266759 - RNA, 22 nt, Homo sapiens
ggcuguguguuaaaauaggcuu

SEQ ID NO: 266760 - RNA, 22 nt, Homo sapiens
gggaaauguaaagucauaagau

SEQ ID NO: 266761 - RNA, 22 nt, Homo sapiens
gggaagauauaggcugggcacc

SEQ ID NO: 266762 - RNA, 22 nt, Homo sapiens
gggaagugugcagaguucucuu

SEQ ID NO: 266763 - RNA, 22 nt, Homo sapiens
gggagguaggaguuauuauuuu

SEQ ID NO: 266764 - RNA, 22 nt, Homo sapiens
gggaugaagaagaauaguucgu

SEQ ID NO: 266765 - RNA, 22 nt, Homo sapiens
gggauguaaaagugggcacauu

SEQ ID NO: 266766 - RNA, 22 nt, Homo sapiens
gggauguuuuauacugagccug

SEQ ID NO: 266767 - RNA, 21 nt, Homo sapiens
gggcaaaucuuuauccuaagc

SEQ ID NO: 266768 - RNA, 22 nt, Homo sapiens
gggcagaugucuggacaccuca

SEQ ID NO: 266769 - RNA, 22 nt, Homo sapiens
gggggagugugguacccagcau

SEQ ID NO: 266770 - RNA, 22 nt, Homo sapiens
ggggucauuaaauuccgcuggu

SEQ ID NO: 266771 - RNA, 22 nt, Homo sapiens
ggguaggcaagcggaugucaga

SEQ ID NO: 266772 - RNA, 22 nt, Homo sapiens
gggugguuuuauuaucagugac

SEQ ID NO: 266773 - RNA, 22 nt, Homo sapiens
gguaaacauaagagagcugacu

SEQ ID NO: 266774 - RNA, 19 nt, Homo sapiens
ggucacagggguuacaagg

SEQ ID NO: 266775 - RNA, 22 nt, Homo sapiens
ggucagaaagacaggcauucag

SEQ ID NO: 266776 - RNA, 19 nt, Homo sapiens
ggucagcaaagucuagcug

SEQ ID NO: 266777 - RNA, 21 nt, Homo sapiens
ggugagaaaggagacauagac

SEQ ID NO: 266778 - RNA, 22 nt, Homo sapiens
ggugagaaagggauuccuguuc

SEQ ID NO: 266779 - RNA, 22 nt, Homo sapiens
ggugagcacagaaugcccugag

SEQ ID NO: 266780 - RNA, 19 nt, Homo sapiens
ggugcuugaauauuccucc

SEQ ID NO: 266781 - RNA, 22 nt, Homo sapiens
guaaacuuccccucaugaauga

SEQ ID NO: 266782 - RNA, 18 nt, Homo sapiens
guaaauguaucuauugcc

SEQ ID NO: 266783 - RNA, 22 nt, Homo sapiens
guaacagucucaacaguggucu

SEQ ID NO: 266784 - RNA, 22 nt, Homo sapiens
guaagagcauguaguggcucua

SEQ ID NO: 266785 - RNA, 22 nt, Homo sapiens
guaaucucagcuacucaggagg

SEQ ID NO: 266786 - RNA, 22 nt, Homo sapiens
aaaagcauucagagugcugggc

SEQ ID NO: 266787 - RNA, 22 nt, Homo sapiens
aaaaggcuagcuaguaacagaa

SEQ ID NO: 266788 - RNA, 15 nt, Homo sapiens
aaacccugucucaag

SEQ ID NO: 266789 - RNA, 20 nt, Homo sapiens
aaacucugucuucuuuauca

SEQ ID NO: 266790 - RNA, 22 nt, Homo sapiens
aaacugaucugaaggccaggcu

SEQ ID NO: 266791 - RNA, 23 nt, Homo sapiens
aaagacuagucaggugcaguggu

SEQ ID NO: 266792 - RNA, 22 nt, Homo sapiens
aaagagaucuaugggcacuaug

SEQ ID NO: 266793 - RNA, 22 nt, Homo sapiens
aaagagcugagaccugguggag

SEQ ID NO: 266794 - RNA, 22 nt, Homo sapiens
aaaggcacugaucuuauccagu

SEQ ID NO: 266795 - RNA, 22 nt, Homo sapiens
aaagugacuuagugccccauuu

SEQ ID NO: 266796 - RNA, 18 nt, Homo sapiens
aaagugaugucauucuuu

SEQ ID NO: 266797 - RNA, 22 nt, Homo sapiens
aaagugauuguaguuuuugcca

SEQ ID NO: 266798 - RNA, 22 nt, Homo sapiens
aaagugcuaggauuaccugggg

SEQ ID NO: 266799 - RNA, 22 nt, Homo sapiens
aaagugcugagacagacuggga

SEQ ID NO: 266800 - RNA, 22 nt, Homo sapiens
aaagugcugagauuguaggcau

SEQ ID NO: 266801 - RNA, 22 nt, Homo sapiens
aaagugcugggauuuuaggcau

SEQ ID NO: 266802 - RNA, 22 nt, Homo sapiens
aaagugcuguagacugggcgca

SEQ ID NO: 266803 - RNA, 22 nt, Homo sapiens
aaagugucuguuccuagcauga

SEQ ID NO: 266804 - RNA, 22 nt, Homo sapiens
aaaguucuguugauagugcuga

SEQ ID NO: 266805 - RNA, 22 nt, Homo sapiens
aaaguucuugcugaaggauuau

SEQ ID NO: 266806 - RNA, 22 nt, Homo sapiens
aaauccauuuguucagcuaugc

SEQ ID NO: 266807 - RNA, 22 nt, Homo sapiens
aaaugcacaaagauuuugcacu

SEQ ID NO: 266808 - RNA, 22 nt, Homo sapiens
aaaugcaguugguggggauaug

SEQ ID NO: 266809 - RNA, 22 nt, Homo sapiens
aaaugcccuaaaauggagcauc

SEQ ID NO: 266810 - RNA, 22 nt, Homo sapiens
aaaugccucccauucuacugac

SEQ ID NO: 266811 - RNA, 22 nt, Homo sapiens
aaaugcucuuuaugaaguugga

SEQ ID NO: 266812 - RNA, 22 nt, Homo sapiens
aaaugcugcuuuggccucuucu

SEQ ID NO: 266813 - RNA, 22 nt, Homo sapiens
aaaugcugucaaauuguguucu

SEQ ID NO: 266814 - RNA, 22 nt, Homo sapiens
aaaugcuucuauguggcauguu

SEQ ID NO: 266815 - RNA, 22 nt, Homo sapiens
aaauggauuaaguucacuugcu

SEQ ID NO: 266816 - RNA, 22 nt, Homo sapiens
aaauugcuuuugaagacuuagu

SEQ ID NO: 266817 - RNA, 22 nt, Homo sapiens
aacaccauuuuucugcagccuu

SEQ ID NO: 266818 - RNA, 22 nt, Homo sapiens
aacaccuugcagggauuaugac

SEQ ID NO: 266819 - RNA, 22 nt, Homo sapiens
aacagaauccucuuuuccuggg

SEQ ID NO: 266820 - RNA, 22 nt, Homo sapiens
aacagacugucacauaaaauug

SEQ ID NO: 266821 - RNA, 22 nt, Homo sapiens
aacagcacacccgcugcuucca

SEQ ID NO: 266822 - RNA, 22 nt, Homo sapiens
aacaguaucuaacgagugauga

SEQ ID NO: 266823 - RNA, 22 nt, Homo sapiens
aacagucuccaguuguauccau

SEQ ID NO: 266824 - RNA, 22 nt, Homo sapiens
aacagugcauucagggauauau

SEQ ID NO: 266825 - RNA, 22 nt, Homo sapiens
aacauagucaugggguaauguu

SEQ ID NO: 266826 - RNA, 22 nt, Homo sapiens
aacucacauucuuucuugguac

SEQ ID NO: 266827 - RNA, 22 nt, Homo sapiens
aacuggcauguuuuaaggcuua

SEQ ID NO: 266828 - RNA, 19 nt, Homo sapiens
aacuggugugagaugauau

SEQ ID NO: 266829 - RNA, 22 nt, Homo sapiens
aagacuguaauccaucuugagu

SEQ ID NO: 266830 - RNA, 22 nt, Homo sapiens
aagagagcuaugugcauaauua

SEQ ID NO: 266831 - RNA, 22 nt, Homo sapiens
aagagcucauccauaguuguca

SEQ ID NO: 266832 - RNA, 22 nt, Homo sapiens
aagaggccuaggaaucuguauu

SEQ ID NO: 266833 - RNA, 22 nt, Homo sapiens
aagaggcuguaggauaaugccu

SEQ ID NO: 266834 - RNA, 22 nt, Homo sapiens
aagagguaauaacaaagcuucu

SEQ ID NO: 266835 - RNA, 23 nt, Homo sapiens
aagagguaugacuaugaagugga

SEQ ID NO: 266836 - RNA, 22 nt, Homo sapiens
aagaugauguuguguuuucacu

SEQ ID NO: 266837 - RNA, 22 nt, Homo sapiens
aagaugcagaagcccagauguu

SEQ ID NO: 266838 - RNA, 22 nt, Homo sapiens
aagaugcagucauacuggagua

SEQ ID NO: 266839 - RNA, 22 nt, Homo sapiens
aagaugguauuucauuaguuuu

SEQ ID NO: 266840 - RNA, 22 nt, Homo sapiens
aagcagauguguugaaaguacu

SEQ ID NO: 266841 - RNA, 22 nt, Homo sapiens
aagcugguguguauuauucacu

SEQ ID NO: 266842 - RNA, 22 nt, Homo sapiens
aagcuguguguaagcucucaca

SEQ ID NO: 266843 - RNA, 22 nt, Homo sapiens
aaggaacuggaauauuuugaac

SEQ ID NO: 266844 - RNA, 22 nt, Homo sapiens
aaggcagugugcacauaacacu

SEQ ID NO: 266845 - RNA, 22 nt, Homo sapiens
aagggaaugcgcugccuguguu

SEQ ID NO: 266846 - RNA, 22 nt, Homo sapiens
aagggaauguuguagcugguuu

SEQ ID NO: 266847 - RNA, 22 nt, Homo sapiens
aagggaauguuguggcugguug

SEQ ID NO: 266848 - RNA, 22 nt, Homo sapiens
aagguacuggaaagaggaaugg

SEQ ID NO: 266849 - RNA, 22 nt, Homo sapiens
aagguggugucagagagcuuau

SEQ ID NO: 266850 - RNA, 22 nt, Homo sapiens
aagguucuugcuugcaugacug

SEQ ID NO: 266851 - RNA, 22 nt, Homo sapiens
aaguaauugagguuuuugcugu

SEQ ID NO: 266852 - RNA, 19 nt, Homo sapiens
aaguaguugugacagaugc

SEQ ID NO: 266853 - RNA, 18 nt, Homo sapiens
aaguauagagagcccuua

SEQ ID NO: 266854 - RNA, 22 nt, Homo sapiens
aaguauguaucaagucauacuu

SEQ ID NO: 266855 - RNA, 22 nt, Homo sapiens
aaguccaugaagucuugugggu

SEQ ID NO: 266856 - RNA, 19 nt, Homo sapiens
aagugaaugcuuuguucac

SEQ ID NO: 266857 - RNA, 22 nt, Homo sapiens
aagugagugacaaaaacugggc

SEQ ID NO: 266858 - RNA, 22 nt, Homo sapiens
aagugcacuguaagugcaggau

SEQ ID NO: 266859 - RNA, 22 nt, Homo sapiens
aagugcucuugaaacugucuua

SEQ ID NO: 266860 - RNA, 22 nt, Homo sapiens
aagugcuguccuaccuuuggga

SEQ ID NO: 266861 - RNA, 22 nt, Homo sapiens
aaguggcauugaggaaaaaaau

SEQ ID NO: 266862 - RNA, 17 nt, Homo sapiens
aaguggcuuguucacca

SEQ ID NO: 266863 - RNA, 22 nt, Homo sapiens
aagugguucuaugaguuugcaa

SEQ ID NO: 266864 - RNA, 22 nt, Homo sapiens
aaguguaugaaacaguccaugg

SEQ ID NO: 266865 - RNA, 22 nt, Homo sapiens
aaguuguuggaguuccauuguu

SEQ ID NO: 266866 - RNA, 22 nt, Homo sapiens
aauaagaaguggaagggaccgg

SEQ ID NO: 266867 - RNA, 22 nt, Homo sapiens
aauaaugucacaggggguuagc

SEQ ID NO: 266868 - RNA, 22 nt, Homo sapiens
aauacucaguccuggugaggcu

SEQ ID NO: 266869 - RNA, 21 nt, Homo sapiens
aauacucuagguuaagagagc

SEQ ID NO: 266870 - RNA, 22 nt, Homo sapiens
aauacugaaaguauuuucaaau

SEQ ID NO: 266871 - RNA, 22 nt, Homo sapiens
aauacugugauaucgagcgauu

SEQ ID NO: 266872 - RNA, 22 nt, Homo sapiens
aauagcauugaaucuaccaauu

SEQ ID NO: 266873 - RNA, 22 nt, Homo sapiens
aauagugcugcaaaaacauacg

SEQ ID NO: 266874 - RNA, 22 nt, Homo sapiens
aauaucuguguauagauggggg

SEQ ID NO: 266875 - RNA, 22 nt, Homo sapiens
uaccuuugucaguuacucaccu

SEQ ID NO: 266876 - RNA, 22 nt, Homo sapiens
uacuagaaccuuauucagagug

SEQ ID NO: 266877 - RNA, 22 nt, Homo sapiens
uacucugcaguaauuccagccc

SEQ ID NO: 266878 - RNA, 22 nt, Homo sapiens
uacugcacuccagccugggaga

SEQ ID NO: 266879 - RNA, 22 nt, Homo sapiens
uacugcacuccagccuggguga

SEQ ID NO: 266880 - RNA, 22 nt, Homo sapiens
uacugcuuaaaagucaauuacu

SEQ ID NO: 266881 - RNA, 22 nt, Homo sapiens
uacuuagagacaugcagcacug

SEQ ID NO: 266882 - RNA, 22 nt, Homo sapiens
uacuucauucuugaccuugcau

SEQ ID NO: 266883 - RNA, 22 nt, Homo sapiens
uacuuuguagagugugagaauu

SEQ ID NO: 266884 - RNA, 22 nt, Homo sapiens
uacuuuguagauuguuuccuuu

SEQ ID NO: 266885 - RNA, 22 nt, Homo sapiens
uagaaagcaugaccuucagaua

SEQ ID NO: 266886 - RNA, 22 nt, Homo sapiens
uagaacauuccaggugauguug

SEQ ID NO: 266887 - RNA, 22 nt, Homo sapiens
uagaaucuaacucgcaugaaaa

SEQ ID NO: 266888 - RNA, 22 nt, Homo sapiens
uagaauguaaauuccaagggca

SEQ ID NO: 266889 - RNA, 22 nt, Homo sapiens
uagaauguaacaguuaaaagca

SEQ ID NO: 266890 - RNA, 22 nt, Homo sapiens
uagaauguauaauauuuuacuu

SEQ ID NO: 266891 - RNA, 22 nt, Homo sapiens
uagaaugucagcuucuugaggg

SEQ ID NO: 266892 - RNA, 23 nt, Homo sapiens
uagaauguuuuuccauguuucuu

SEQ ID NO: 266893 - RNA, 22 nt, Homo sapiens
uagacacugcauauuuuuuuaa

SEQ ID NO: 266894 - RNA, 22 nt, Homo sapiens
uagacuguaagauccaggagag

SEQ ID NO: 266895 - RNA, 22 nt, Homo sapiens
uagagcaaugacucuggaaacc

SEQ ID NO: 266896 - RNA, 22 nt, Homo sapiens
uagagguagagugacuucccca

SEQ ID NO: 266897 - RNA, 22 nt, Homo sapiens
uagagguagguguaugaacuag

SEQ ID NO: 266898 - RNA, 22 nt, Homo sapiens
uagagguauguauaguauucuu

SEQ ID NO: 266899 - RNA, 22 nt, Homo sapiens
uagagugcugucaaagacuugu

SEQ ID NO: 266900 - RNA, 22 nt, Homo sapiens
uagaguguaaaccacauaguga

SEQ ID NO: 266901 - RNA, 22 nt, Homo sapiens
uagaucacucaggcaauaaaag

SEQ ID NO: 266902 - RNA, 22 nt, Homo sapiens
uagaucauauucagugcuuacu

SEQ ID NO: 266903 - RNA, 20 nt, Homo sapiens
uagaugcauuuagauucauu

SEQ ID NO: 266904 - RNA, 22 nt, Homo sapiens
uagauuaucauucauacaggga

SEQ ID NO: 266905 - RNA, 22 nt, Homo sapiens
uagauuaucccugauuugucca

SEQ ID NO: 266906 - RNA, 22 nt, Homo sapiens
uagauuaucucaccacucgagu

SEQ ID NO: 266907 - RNA, 22 nt, Homo sapiens
uagauuaucuguaugugcucuu

SEQ ID NO: 266908 - RNA, 22 nt, Homo sapiens
uagauuauuggcugauuugauc

SEQ ID NO: 266909 - RNA, 22 nt, Homo sapiens
uagcaagaugaauuugugcaaa

SEQ ID NO: 266910 - RNA, 20 nt, Homo sapiens
uagcacacauguagaauagu

SEQ ID NO: 266911 - RNA, 22 nt, Homo sapiens
uagcacaguucacccucgauuu

SEQ ID NO: 266912 - RNA, 20 nt, Homo sapiens
uagcacaucuggcuguagag

SEQ ID NO: 266913 - RNA, 22 nt, Homo sapiens
uagcaccucuuuggccuuucgu

SEQ ID NO: 266914 - RNA, 22 nt, Homo sapiens
uagcagaauaacuugccagccu

SEQ ID NO: 266915 - RNA, 22 nt, Homo sapiens
uagcagcaaagcaggaucugcu

SEQ ID NO: 266916 - RNA, 22 nt, Homo sapiens
uagcagcaucucuggcuucuac

SEQ ID NO: 266917 - RNA, 22 nt, Homo sapiens
uagcagccaggaagggcuggcu

SEQ ID NO: 266918 - RNA, 22 nt, Homo sapiens
uagcagguggugaccacauuuu

SEQ ID NO: 266919 - RNA, 22 nt, Homo sapiens
uagcagguguuccacaaauauu

SEQ ID NO: 266920 - RNA, 22 nt, Homo sapiens
uagcaguaccccaguauccugg

SEQ ID NO: 266921 - RNA, 22 nt, Homo sapiens
uagcaguauacguacugggucc

SEQ ID NO: 266922 - RNA, 22 nt, Homo sapiens
uagcauaauuuguagaaaauca

SEQ ID NO: 266923 - RNA, 22 nt, Homo sapiens
uagccgggugugguggaacucc

SEQ ID NO: 266924 - RNA, 22 nt, Homo sapiens
uagccucacaaagugcuuaaga

SEQ ID NO: 266925 - RNA, 22 nt, Homo sapiens
uagcugaucuuuuaaagaauga

SEQ ID NO: 266926 - RNA, 21 nt, Homo sapiens
uagcugcacccaggccuccuu

SEQ ID NO: 266927 - RNA, 22 nt, Homo sapiens
uagcugcuguauguacacggau

SEQ ID NO: 266928 - RNA, 17 nt, Homo sapiens
uagcuucacauuaggaa

SEQ ID NO: 266929 - RNA, 22 nt, Homo sapiens
uaggaaguuucuugauuacuua

SEQ ID NO: 266930 - RNA, 22 nt, Homo sapiens
uaggaaguuuucuugcugggcc

SEQ ID NO: 266931 - RNA, 22 nt, Homo sapiens
uaggacaaugguacagcagaaa

SEQ ID NO: 266932 - RNA, 20 nt, Homo sapiens
uaggagcaaugagaguagaa

SEQ ID NO: 266933 - RNA, 22 nt, Homo sapiens
uaggagugugaacccuguuuug

SEQ ID NO: 266934 - RNA, 22 nt, Homo sapiens
uaggcaauggagauagaggaug

SEQ ID NO: 266935 - RNA, 22 nt, Homo sapiens
uaggcacacaucuacuacaaau

SEQ ID NO: 266936 - RNA, 22 nt, Homo sapiens
uaggcuuuucugggaugugggc

SEQ ID NO: 266937 - RNA, 22 nt, Homo sapiens
uagggcaaggaacaguuaaaaa

SEQ ID NO: 266938 - RNA, 19 nt, Homo sapiens
uagggcacgaggcagaguc

SEQ ID NO: 266939 - RNA, 22 nt, Homo sapiens
uagggcaugugggaaguuauaa

SEQ ID NO: 266940 - RNA, 22 nt, Homo sapiens
uagggcuuuccggccugucaga

SEQ ID NO: 266941 - RNA, 22 nt, Homo sapiens
uaggucccguuucagacugaga

SEQ ID NO: 266942 - RNA, 22 nt, Homo sapiens
uaggugaaugcuggaagaaaug

SEQ ID NO: 266943 - RNA, 22 nt, Homo sapiens
uaggugauugaagguggaaugu

SEQ ID NO: 266944 - RNA, 19 nt, Homo sapiens
uaggugguuuuccccucac

SEQ ID NO: 266945 - RNA, 22 nt, Homo sapiens
uagguuauucauucaucauuua

SEQ ID NO: 266946 - RNA, 22 nt, Homo sapiens
uagugcaguggcuccaucucag

SEQ ID NO: 266947 - RNA, 22 nt, Homo sapiens
uagugcuguaauucuaaugaaa

SEQ ID NO: 266948 - RNA, 18 nt, Homo sapiens
uagugcuguucucaugau

SEQ ID NO: 266949 - RNA, 22 nt, Homo sapiens
uaguggauguucagagauuuga

SEQ ID NO: 266950 - RNA, 22 nt, Homo sapiens
uauacuguuuucuauaguggcu

SEQ ID NO: 266951 - RNA, 22 nt, Homo sapiens
uauagcaaugccccacuccuga

SEQ ID NO: 266952 - RNA, 21 nt, Homo sapiens
uauagcagcacgauuuauagu

SEQ ID NO: 266953 - RNA, 22 nt, Homo sapiens
uauagcagugugagaacagacu

SEQ ID NO: 266954 - RNA, 22 nt, Homo sapiens
uauaguguuuucaaaaguaugu

SEQ ID NO: 266955 - RNA, 22 nt, Homo sapiens
uauauaagcugaugagccacaa

SEQ ID NO: 266956 - RNA, 22 nt, Homo sapiens
uauaugcucugggauccugaaa

SEQ ID NO: 266957 - RNA, 19 nt, Homo sapiens
uaucaaguaugcacuguac

SEQ ID NO: 266958 - RNA, 22 nt, Homo sapiens
uaucaaguguuagggagaugug

SEQ ID NO: 266959 - RNA, 22 nt, Homo sapiens
uaucaaguuggaagagaaguaa

SEQ ID NO: 266960 - RNA, 22 nt, Homo sapiens
uaucacacaucaugguaaaucu

SEQ ID NO: 266961 - RNA, 22 nt, Homo sapiens
uaucacacgccuugcuucauuu

SEQ ID NO: 266962 - RNA, 22 nt, Homo sapiens
uaucacaguaaaucugggugca

SEQ ID NO: 266963 - RNA, 22 nt, Homo sapiens
uaucacaguagaacucuuucca

SEQ ID NO: 266964 - RNA, 22 nt, Homo sapiens
aaguacuguuuaaauugcagaa

SEQ ID NO: 266965 - RNA, 22 nt, Homo sapiens
uaucacaguugcauauuuaagg

SEQ ID NO: 266966 - RNA, 22 nt, Homo sapiens
uaucacuuugauaguuuaaaug

SEQ ID NO: 266967 - RNA, 22 nt, Homo sapiens
uaucagagcugucagccuaccu

SEQ ID NO: 266968 - RNA, 22 nt, Homo sapiens
uaucagaguuacacugaagacu

SEQ ID NO: 266969 - RNA, 22 nt, Homo sapiens
uaucagauugcugccaucugcu

SEQ ID NO: 266970 - RNA, 22 nt, Homo sapiens
uaucagcagagucauacuucaa

SEQ ID NO: 266971 - RNA, 22 nt, Homo sapiens
uaucaguauggauucauggauu

SEQ ID NO: 266972 - RNA, 22 nt, Homo sapiens
uaucauaguuuggacuuucauu

SEQ ID NO: 266973 - RNA, 22 nt, Homo sapiens
uaucaugucuguguguaccuag

SEQ ID NO: 266974 - RNA, 22 nt, Homo sapiens
uaucccaguggauguaccccau

SEQ ID NO: 266975 - RNA, 23 nt, Homo sapiens
uaucccuugccuuaugaugugag

SEQ ID NO: 266976 - RNA, 20 nt, Homo sapiens
uaucucaguuuguccuaaac

SEQ ID NO: 266977 - RNA, 18 nt, Homo sapiens
uaucucauuucuuagguc

SEQ ID NO: 266978 - RNA, 22 nt, Homo sapiens
uaucugcacauacacuuauagc

SEQ ID NO: 266979 - RNA, 22 nt, Homo sapiens
uaucugguuauugcugcugauu

SEQ ID NO: 266980 - RNA, 22 nt, Homo sapiens
uaucugguuuuguuacagguuc

SEQ ID NO: 266981 - RNA, 23 nt, Homo sapiens
uaugacagaggaagggggagcug

SEQ ID NO: 266982 - RNA, 22 nt, Homo sapiens
uaugcacacacguguuuaugug

SEQ ID NO: 266983 - RNA, 22 nt, Homo sapiens
uaugcacuauagcauauguggu

SEQ ID NO: 266984 - RNA, 22 nt, Homo sapiens
uauggaaaucuuaccuuauggu

SEQ ID NO: 266985 - RNA, 22 nt, Homo sapiens
uauggauuugccuauucuguau

SEQ ID NO: 266986 - RNA, 22 nt, Homo sapiens
uauggcuucuauaaggaagcuu

SEQ ID NO: 266987 - RNA, 22 nt, Homo sapiens
uauggcuucuuuaaauugaggu

SEQ ID NO: 266988 - RNA, 22 nt, Homo sapiens
uauggcuuucuacuugaguucu

SEQ ID NO: 266989 - RNA, 22 nt, Homo sapiens
uauggcuuuuaacugucguaug

SEQ ID NO: 266990 - RNA, 22 nt, Homo sapiens
uauggcuuuuauuauguuguag

SEQ ID NO: 266991 - RNA, 21 nt, Homo sapiens
uaugguuucuaauucugcagg

SEQ ID NO: 266992 - RNA, 20 nt, Homo sapiens
uaugguuuuagguauagcau

SEQ ID NO: 266993 - RNA, 22 nt, Homo sapiens
uaugguuuucucuuacguguug

SEQ ID NO: 266994 - RNA, 19 nt, Homo sapiens
uauguaguuuucucaauau

SEQ ID NO: 266995 - RNA, 22 nt, Homo sapiens
uaugucaugggguuuuugagau

SEQ ID NO: 266996 - RNA, 22 nt, Homo sapiens
uaugucauggguaaagugcccu

SEQ ID NO: 266997 - RNA, 22 nt, Homo sapiens
uaugucuggaguuacugagcug

SEQ ID NO: 266998 - RNA, 22 nt, Homo sapiens
uauguuaucaaaaagcuaagga

SEQ ID NO: 266999 - RNA, 22 nt, Homo sapiens
uauuagugucuuuugguuagaa

SEQ ID NO: 267000 - RNA, 20 nt, Homo sapiens
uauucacucuccagucuugc

SEQ ID NO: 267001 - RNA, 18 nt, Homo sapiens
uauuccucuuccucuauc

SEQ ID NO: 267002 - RNA, 17 nt, Homo sapiens
uauugaccuuuguaugu

SEQ ID NO: 267003 - RNA, 22 nt, Homo sapiens
uauugcaaauggugaucccagg

SEQ ID NO: 267004 - RNA, 22 nt, Homo sapiens
uauugcacuccucaugcauuug

SEQ ID NO: 267005 - RNA, 22 nt, Homo sapiens
uauugcagaaugugaguuggca

SEQ ID NO: 267006 - RNA, 22 nt, Homo sapiens
uauugcagauacccaggaaguu

SEQ ID NO: 267007 - RNA, 22 nt, Homo sapiens
uauugcauuugagguugguuga

SEQ ID NO: 267008 - RNA, 22 nt, Homo sapiens
uauugccucagugacuuugggg

SEQ ID NO: 267009 - RNA, 22 nt, Homo sapiens
uauugcuaaaacucaugguugc

SEQ ID NO: 267010 - RNA, 22 nt, Homo sapiens
uauugcuaaauucuuuuccuag

SEQ ID NO: 267011 - RNA, 22 nt, Homo sapiens
uauugcuggcucugucuucauu

SEQ ID NO: 267012 - RNA, 22 nt, Homo sapiens
uauuggcucuguuucucugaag

SEQ ID NO: 267013 - RNA, 22 nt, Homo sapiens
uauugucaccaucccuguuuua

SEQ ID NO: 267014 - RNA, 22 nt, Homo sapiens
uauuguccacuuugcacugugu

SEQ ID NO: 267015 - RNA, 22 nt, Homo sapiens
uauuugguagcuauuuugcagu

SEQ ID NO: 267016 - RNA, 22 nt, Homo sapiens
uauuugguuauaugaguaaguu

SEQ ID NO: 267017 - RNA, 20 nt, Homo sapiens
uauuugguuauuuccauggu

SEQ ID NO: 267018 - RNA, 22 nt, Homo sapiens
ucaaacauccccaccagggacu

SEQ ID NO: 267019 - RNA, 22 nt, Homo sapiens
ucaaagugacaaaguugcagca

SEQ ID NO: 267020 - RNA, 22 nt, Homo sapiens
ucaaaucaucuuuuccaaagcu

SEQ ID NO: 267021 - RNA, 22 nt, Homo sapiens
ucaaaugcuguauuguaguaau

SEQ ID NO: 267022 - RNA, 22 nt, Homo sapiens
ucaaaugguccacgugaacauu

SEQ ID NO: 267023 - RNA, 22 nt, Homo sapiens
ucaagaccucacauagaggaga

SEQ ID NO: 267024 - RNA, 22 nt, Homo sapiens
ucaagcaauucuccucucagcc

SEQ ID NO: 267025 - RNA, 22 nt, Homo sapiens
ucaagcaauucugcugccucag

SEQ ID NO: 267026 - RNA, 22 nt, Homo sapiens
ucaaggacuacauggggugaaa

SEQ ID NO: 267027 - RNA, 22 nt, Homo sapiens
ucaaguaguaacuaacugugac

SEQ ID NO: 267028 - RNA, 22 nt, Homo sapiens
ucaagugcauugauucaguauu

SEQ ID NO: 267029 - RNA, 22 nt, Homo sapiens
ucaauugcaucaacaguguaca

SEQ ID NO: 267030 - RNA, 22 nt, Homo sapiens
ucaauugcuuaugaagauacau

SEQ ID NO: 267031 - RNA, 22 nt, Homo sapiens
ucacaaagcuuggccugcuucu

SEQ ID NO: 267032 - RNA, 22 nt, Homo sapiens
ucacaauguaaaugaggguugg

SEQ ID NO: 267033 - RNA, 22 nt, Homo sapiens
ucacaauucucaauuugugaaa

SEQ ID NO: 267034 - RNA, 22 nt, Homo sapiens
ucacacugaaacuaggguguga

SEQ ID NO: 267035 - RNA, 22 nt, Homo sapiens
ucacagacugagccaaauagag

SEQ ID NO: 267036 - RNA, 22 nt, Homo sapiens
ucacaguagagcuucuuucaga

SEQ ID NO: 267037 - RNA, 22 nt, Homo sapiens
ucacagucacugucacguugaa

SEQ ID NO: 267038 - RNA, 22 nt, Homo sapiens
ucacagucuccucuagggaggg

SEQ ID NO: 267039 - RNA, 22 nt, Homo sapiens
ucacaguugauugaaacacagc

SEQ ID NO: 267040 - RNA, 22 nt, Homo sapiens
ucacaguuggccuggccuuuua

SEQ ID NO: 267041 - RNA, 22 nt, Homo sapiens
ucacaucucagguuucuugaca

SEQ ID NO: 267042 - RNA, 22 nt, Homo sapiens
ucacauggcagagaagaagcuc

SEQ ID NO: 267043 - RNA, 21 nt, Homo sapiens
ucacauggccagaguaggaac

SEQ ID NO: 267044 - RNA, 18 nt, Homo sapiens
ucacauggccgagagaga

SEQ ID NO: 267045 - RNA, 22 nt, Homo sapiens
ucacaugugacauauauauuug

SEQ ID NO: 267046 - RNA, 22 nt, Homo sapiens
ucacauuguguagccugcucac

SEQ ID NO: 267047 - RNA, 22 nt, Homo sapiens
ucaccuggagaagauggaucau

SEQ ID NO: 267048 - RNA, 22 nt, Homo sapiens
ucaccuggagccuucacauucu

SEQ ID NO: 267049 - RNA, 22 nt, Homo sapiens
ucacugaaacuguccuggguua

SEQ ID NO: 267050 - RNA, 22 nt, Homo sapiens
ucacugaggucugagcuuuaug

SEQ ID NO: 267051 - RNA, 20 nt, Homo sapiens
ucacugaguaucuacgauua

SEQ ID NO: 267052 - RNA, 19 nt, Homo sapiens
guaaucucaguacuuuggu

SEQ ID NO: 267053 - RNA, 22 nt, Homo sapiens
guaaucuguaguaaagcaccau

SEQ ID NO: 267054 - RNA, 22 nt, Homo sapiens
guacaggcagcaaacaccauaa

SEQ ID NO: 267055 - RNA, 22 nt, Homo sapiens
guacaguucucuuuguugucag

SEQ ID NO: 267056 - RNA, 22 nt, Homo sapiens
guacaugcauacaugcacaucu

SEQ ID NO: 267057 - RNA, 22 nt, Homo sapiens
guacaugcaugcaugggugugc

SEQ ID NO: 267058 - RNA, 22 nt, Homo sapiens
guagaagcacagggccuguauu

SEQ ID NO: 267059 - RNA, 22 nt, Homo sapiens
guagaauguauguauaacgcaa

SEQ ID NO: 267060 - RNA, 22 nt, Homo sapiens
guagagugcugggcacuggcuc

SEQ ID NO: 267061 - RNA, 22 nt, Homo sapiens
guagcagcuacuaaguugcugu

SEQ ID NO: 267062 - RNA, 22 nt, Homo sapiens
guagcaucauuugcaauuucau

SEQ ID NO: 267063 - RNA, 22 nt, Homo sapiens
guaguaccauuaggauauuucu

SEQ ID NO: 267064 - RNA, 22 nt, Homo sapiens
guaucaucauguuggccaggcu

SEQ ID NO: 267065 - RNA, 22 nt, Homo sapiens
guaucauugccuaaugcucuca

SEQ ID NO: 267066 - RNA, 22 nt, Homo sapiens
guaugcaagugauaugacauau

SEQ ID NO: 267067 - RNA, 22 nt, Homo sapiens
guauggcacuauccucucugau

SEQ ID NO: 267068 - RNA, 22 nt, Homo sapiens
guaugucuugucuauggcugcu

SEQ ID NO: 267069 - RNA, 22 nt, Homo sapiens
guaugucuuuauagcagugugg

SEQ ID NO: 267070 - RNA, 22 nt, Homo sapiens
guaugugacuggaacaguagga

SEQ ID NO: 267071 - RNA, 22 nt, Homo sapiens
guauugacuaucaaucaugugc

SEQ ID NO: 267072 - RNA, 22 nt, Homo sapiens
guauuugauuauagcaugcuua

SEQ ID NO: 267073 - RNA, 19 nt, Homo sapiens
guauuugguaaacucucca

SEQ ID NO: 267074 - RNA, 22 nt, Homo sapiens
guauuuguugcagcagcacuau

SEQ ID NO: 267075 - RNA, 22 nt, Homo sapiens
gucaaggaauuuauccauuucu

SEQ ID NO: 267076 - RNA, 22 nt, Homo sapiens
gucaagugaagcagugggagua

SEQ ID NO: 267077 - RNA, 22 nt, Homo sapiens
gucacaguggccagugauguuc

SEQ ID NO: 267078 - RNA, 22 nt, Homo sapiens
gucacaguguuuguucauccca

SEQ ID NO: 267079 - RNA, 22 nt, Homo sapiens
gucacauugaugcccauggugg

SEQ ID NO: 267080 - RNA, 22 nt, Homo sapiens
gucaccagcuguguuagccccu

SEQ ID NO: 267081 - RNA, 22 nt, Homo sapiens
gucagagcacugaguugugggc

SEQ ID NO: 267082 - RNA, 22 nt, Homo sapiens
gucagcaaaguucuccugcaga

SEQ ID NO: 267083 - RNA, 22 nt, Homo sapiens
gucagggagggauagaugauua

SEQ ID NO: 267084 - RNA, 22 nt, Homo sapiens
gucaggugcuuacgcggagauc

SEQ ID NO: 267085 - RNA, 22 nt, Homo sapiens
gucagugcauguaaacauaaaa

SEQ ID NO: 267086 - RNA, 22 nt, Homo sapiens
gucagugucuuaacagagauua

SEQ ID NO: 267087 - RNA, 22 nt, Homo sapiens
gucaguuucacucagcuggaac

SEQ ID NO: 267088 - RNA, 22 nt, Homo sapiens
gucaguuugguuaaucauucca

SEQ ID NO: 267089 - RNA, 18 nt, Homo sapiens
gucauagaaugaugguuc

SEQ ID NO: 267090 - RNA, 22 nt, Homo sapiens
gucaugggguacuacacauggg

SEQ ID NO: 267091 - RNA, 22 nt, Homo sapiens
agcacagugaaugguuuacuca

SEQ ID NO: 267092 - RNA, 22 nt, Homo sapiens
agcaccacaauuuccugccuaa

SEQ ID NO: 267093 - RNA, 22 nt, Homo sapiens
agcacgaaaccaaauucuguga

SEQ ID NO: 267094 - RNA, 22 nt, Homo sapiens
agcagagcauauucauucgggg

SEQ ID NO: 267095 - RNA, 22 nt, Homo sapiens
agcagcaccaaacagacuaaga

SEQ ID NO: 267096 - RNA, 22 nt, Homo sapiens
agcagcaugaggggacuucugc

SEQ ID NO: 267097 - RNA, 22 nt, Homo sapiens
agcagcauuaguggaaucuugu

SEQ ID NO: 267098 - RNA, 17 nt, Homo sapiens
agcagcccauaucccca

SEQ ID NO: 267099 - RNA, 22 nt, Homo sapiens
agcaggauuguuacaauaguaa

SEQ ID NO: 267100 - RNA, 22 nt, Homo sapiens
agcaguagaauuccugcaucac

SEQ ID NO: 267101 - RNA, 22 nt, Homo sapiens
agcaguagugaaaguagacuua

SEQ ID NO: 267102 - RNA, 22 nt, Homo sapiens
agcagugugaaaugauuuaagg

SEQ ID NO: 267103 - RNA, 20 nt, Homo sapiens
agcaucauugcaauuuguca

SEQ ID NO: 267104 - RNA, 22 nt, Homo sapiens
agcauuaguugugaagccuuua

SEQ ID NO: 267105 - RNA, 20 nt, Homo sapiens
agcauugguuagaacaguag

SEQ ID NO: 267106 - RNA, 22 nt, Homo sapiens
agcccauguggcugaggcuucu

SEQ ID NO: 267107 - RNA, 22 nt, Homo sapiens
agcuacuguuagucuaguuagg

SEQ ID NO: 267108 - RNA, 22 nt, Homo sapiens
agcucacagccuagcacuguga

SEQ ID NO: 267109 - RNA, 22 nt, Homo sapiens
agcuccuuucugcaggcagguc

SEQ ID NO: 267110 - RNA, 22 nt, Homo sapiens
agcugauggucuuguaugaugu

SEQ ID NO: 267111 - RNA, 20 nt, Homo sapiens
agcugcagauauaaauccgc

SEQ ID NO: 267112 - RNA, 22 nt, Homo sapiens
agcuggauuguuuaccuggggc

SEQ ID NO: 267113 - RNA, 22 nt, Homo sapiens
agcugguccugugacuugcuuc

SEQ ID NO: 267114 - RNA, 22 nt, Homo sapiens
agcuggucuacguguguaugag

SEQ ID NO: 267115 - RNA, 21 nt, Homo sapiens
agcugguuucuucuuacuccu

SEQ ID NO: 267116 - RNA, 22 nt, Homo sapiens
agcugugucuucuuaaagauuu

SEQ ID NO: 267117 - RNA, 19 nt, Homo sapiens
agcuguguugccugugaga

SEQ ID NO: 267118 - RNA, 22 nt, Homo sapiens
agcuucauuguuaugaauguca

SEQ ID NO: 267119 - RNA, 22 nt, Homo sapiens
agcuuuggauaccugcuguucc

SEQ ID NO: 267120 - RNA, 19 nt, Homo sapiens
agcuuuggcuaacuuucuc

SEQ ID NO: 267121 - RNA, 22 nt, Homo sapiens
aggaagcuagcauuuguucagu

SEQ ID NO: 267122 - RNA, 22 nt, Homo sapiens
aggaagguaaacuaacuugccu

SEQ ID NO: 267123 - RNA, 22 nt, Homo sapiens
aggaaucuaagguaucagguua

SEQ ID NO: 267124 - RNA, 22 nt, Homo sapiens
aggagaauugguucuucuugau

SEQ ID NO: 267125 - RNA, 21 nt, Homo sapiens
aggagauguuuguccuuuuag

SEQ ID NO: 267126 - RNA, 22 nt, Homo sapiens
aggagcacuggccuuggaguca

SEQ ID NO: 267127 - RNA, 18 nt, Homo sapiens
aggagcauagugcuauga

SEQ ID NO: 267128 - RNA, 20 nt, Homo sapiens
aggagcauuuacauuggcuc

SEQ ID NO: 267129 - RNA, 22 nt, Homo sapiens
aggcaacaugguaaaacccugu

SEQ ID NO: 267130 - RNA, 21 nt, Homo sapiens
aggcaagacuuuuagguuugu

SEQ ID NO: 267131 - RNA, 22 nt, Homo sapiens
aggcaagcaucuugcucccuuc

SEQ ID NO: 267132 - RNA, 21 nt, Homo sapiens
aggcaagguguuauuauugaa

SEQ ID NO: 267133 - RNA, 22 nt, Homo sapiens
aggcaguuucagugagagguga

SEQ ID NO: 267134 - RNA, 19 nt, Homo sapiens
aggcauugugcucaucugu

SEQ ID NO: 267135 - RNA, 23 nt, Homo sapiens
aggccaguuuuuccugcuugcug

SEQ ID NO: 267136 - RNA, 22 nt, Homo sapiens
aggcuagaaucuuccaucuugg

SEQ ID NO: 267137 - RNA, 21 nt, Homo sapiens
aggcuguuguuuugggaugga

SEQ ID NO: 267138 - RNA, 22 nt, Homo sapiens
aggcuuuauuacagggucucag

SEQ ID NO: 267139 - RNA, 22 nt, Homo sapiens
agggaagugugcuaugcauuua

SEQ ID NO: 267140 - RNA, 22 nt, Homo sapiens
agggagcaaaguggucuuucuc

SEQ ID NO: 267141 - RNA, 22 nt, Homo sapiens
agggcuuaucuguguagaguuc

SEQ ID NO: 267142 - RNA, 22 nt, Homo sapiens
aggucaccucaggaaauacuga

SEQ ID NO: 267143 - RNA, 22 nt, Homo sapiens
agguccacuuacuacuccuguu

SEQ ID NO: 267144 - RNA, 22 nt, Homo sapiens
aggugcugacaggauagguuuc

SEQ ID NO: 267145 - RNA, 20 nt, Homo sapiens
agguuauuauaauuagaaga

SEQ ID NO: 267146 - RNA, 22 nt, Homo sapiens
aguaaacuucagaguucuuccu

SEQ ID NO: 267147 - RNA, 22 nt, Homo sapiens
aguaaagccagaccuguuaauu

SEQ ID NO: 267148 - RNA, 22 nt, Homo sapiens
aguaacauuucuaguagagagu

SEQ ID NO: 267149 - RNA, 22 nt, Homo sapiens
aguacacuguuaaaaagaagug

SEQ ID NO: 267150 - RNA, 22 nt, Homo sapiens
aguaccauuccguuggagcugg

SEQ ID NO: 267151 - RNA, 22 nt, Homo sapiens
aguaucaucuuguuggccaggc

SEQ ID NO: 267152 - RNA, 22 nt, Homo sapiens
aguauuaggugaguguauuuca

SEQ ID NO: 267153 - RNA, 22 nt, Homo sapiens
agucacagccuuuuacuuuaga

SEQ ID NO: 267154 - RNA, 22 nt, Homo sapiens
agucagauuggcauuuguuggg

SEQ ID NO: 267155 - RNA, 21 nt, Homo sapiens
agucauaggaguacauaaugc

SEQ ID NO: 267156 - RNA, 19 nt, Homo sapiens
agucaugugaggacccuug

SEQ ID NO: 267157 - RNA, 22 nt, Homo sapiens
aguccauuugaugaugauucca

SEQ ID NO: 267158 - RNA, 22 nt, Homo sapiens
agucgguguuacugacagaaug

SEQ ID NO: 267159 - RNA, 23 nt, Homo sapiens
agucuguguuuacaggcucucug

SEQ ID NO: 267160 - RNA, 22 nt, Homo sapiens
agugaaaucugaagaaggucau

SEQ ID NO: 267161 - RNA, 22 nt, Homo sapiens
agugaaaugucaccuuuuagga

SEQ ID NO: 267162 - RNA, 22 nt, Homo sapiens
agugaacaaagaagugcagaua

SEQ ID NO: 267163 - RNA, 22 nt, Homo sapiens
agugaacacagcuucuuugguu

SEQ ID NO: 267164 - RNA, 22 nt, Homo sapiens
agugacaugggaucaaaucuga

SEQ ID NO: 267165 - RNA, 22 nt, Homo sapiens
agugcacuccagccugggcaac

SEQ ID NO: 267166 - RNA, 22 nt, Homo sapiens
agugcaguggugccaucauaac

SEQ ID NO: 267167 - RNA, 22 nt, Homo sapiens
aguggaaucuguuauacuaacu

SEQ ID NO: 267168 - RNA, 22 nt, Homo sapiens
aguggauuuuauuugacaacua

SEQ ID NO: 267169 - RNA, 22 nt, Homo sapiens
agugguuugaucacagcucacu

SEQ ID NO: 267170 - RNA, 22 nt, Homo sapiens
agugguuuuaaguagagcauac

SEQ ID NO: 267171 - RNA, 22 nt, Homo sapiens
aguguuuuuacaagcacucugg

SEQ ID NO: 267172 - RNA, 22 nt, Homo sapiens
aguucaauggguuuucacucau

SEQ ID NO: 267173 - RNA, 22 nt, Homo sapiens
aguuccuacuggcuguaaagaa

SEQ ID NO: 267174 - RNA, 22 nt, Homo sapiens
aguuggcacugagcugugauug

SEQ ID NO: 267175 - RNA, 22 nt, Homo sapiens
auaaaagcaggucuaggucagg

SEQ ID NO: 267176 - RNA, 22 nt, Homo sapiens
auaaacugucaguggagaguaa

SEQ ID NO: 267177 - RNA, 22 nt, Homo sapiens
auaaagcaaauaggacuauugc

SEQ ID NO: 267178 - RNA, 22 nt, Homo sapiens
auaaaguguuuaguauaggcaa

SEQ ID NO: 267179 - RNA, 19 nt, Homo sapiens
auaaaugccuacaagggug

SEQ ID NO: 267180 - RNA, 22 nt, Homo sapiens
auaaaugcuuagaucuguauau

SEQ ID NO: 267181 - RNA, 22 nt, Homo sapiens
auucccuuggucaacggaugca

SEQ ID NO: 267182 - RNA, 18 nt, Homo sapiens
auucuacaggccuuuuga

SEQ ID NO: 267183 - RNA, 22 nt, Homo sapiens
auucuugcuugaacuuggugca

SEQ ID NO: 267184 - RNA, 23 nt, Homo sapiens
auugaacacuuucauaugugagg

SEQ ID NO: 267185 - RNA, 22 nt, Homo sapiens
auugagacaaauuuguaugcag

SEQ ID NO: 267186 - RNA, 22 nt, Homo sapiens
auugagcaaggucuccuaguau

SEQ ID NO: 267187 - RNA, 22 nt, Homo sapiens
auugaggcaggaggaccaucua

SEQ ID NO: 267188 - RNA, 22 nt, Homo sapiens
auugagucauuucaaauccaag

SEQ ID NO: 267189 - RNA, 22 nt, Homo sapiens
auugauaguuuaauaggaauug

SEQ ID NO: 267190 - RNA, 22 nt, Homo sapiens
auugcacaaagagggaaacuga

SEQ ID NO: 267191 - RNA, 22 nt, Homo sapiens
auugcacacagaaucaggguaa

SEQ ID NO: 267192 - RNA, 18 nt, Homo sapiens
auugcacaccagccuggg

SEQ ID NO: 267193 - RNA, 22 nt, Homo sapiens
auugcacuccagccccggggac

SEQ ID NO: 267194 - RNA, 22 nt, Homo sapiens
auugcacuccagcccgggugac

SEQ ID NO: 267195 - RNA, 22 nt, Homo sapiens
auugcacuccagccuagucaac

SEQ ID NO: 267196 - RNA, 22 nt, Homo sapiens
auugcacuccagccugagcaaa

SEQ ID NO: 267197 - RNA, 22 nt, Homo sapiens
auugcacuccagccugggggac

SEQ ID NO: 267198 - RNA, 22 nt, Homo sapiens
auugcacuccagccugggugac

SEQ ID NO: 267199 - RNA, 22 nt, Homo sapiens
auugcacuccagucucaccagg

SEQ ID NO: 267200 - RNA, 22 nt, Homo sapiens
auugcacucuagccugggugac

SEQ ID NO: 267201 - RNA, 22 nt, Homo sapiens
auugcacuggggguuagaauuu

SEQ ID NO: 267202 - RNA, 23 nt, Homo sapiens
auugcagucuugaacuccugggc

SEQ ID NO: 267203 - RNA, 22 nt, Homo sapiens
auugcaguuagaacagaagucu

SEQ ID NO: 267204 - RNA, 18 nt, Homo sapiens
auugcccucauggggcuu

SEQ ID NO: 267205 - RNA, 22 nt, Homo sapiens
auugcuaacugaaauaagacca

SEQ ID NO: 267206 - RNA, 22 nt, Homo sapiens
auuggcaauggcaaagcagagu

SEQ ID NO: 267207 - RNA, 22 nt, Homo sapiens
auuggcagaaaucuuuauagua

SEQ ID NO: 267208 - RNA, 22 nt, Homo sapiens
auuggcuauuuggugagugauu

SEQ ID NO: 267209 - RNA, 22 nt, Homo sapiens
auuggggaaugguggcuuuagu

SEQ ID NO: 267210 - RNA, 22 nt, Homo sapiens
auuguaauuuuagagaaagugg

SEQ ID NO: 267211 - RNA, 22 nt, Homo sapiens
auuguucuuguguccuuuuccu

SEQ ID NO: 267212 - RNA, 22 nt, Homo sapiens
auuuagcaauggagguagugua

SEQ ID NO: 267213 - RNA, 19 nt, Homo sapiens
auuugaucaucaggcacag

SEQ ID NO: 267214 - RNA, 21 nt, Homo sapiens
auuugcacugagcuccugugc

SEQ ID NO: 267215 - RNA, 22 nt, Homo sapiens
auuuggcauagaguaucauucu

SEQ ID NO: 267216 - RNA, 22 nt, Homo sapiens
auuuggguuuuacaucaggcua

SEQ ID NO: 267217 - RNA, 22 nt, Homo sapiens
auuuguccugccuuuuccuccu

SEQ ID NO: 267218 - RNA, 21 nt, Homo sapiens
auuuuugcagagcugguagug

SEQ ID NO: 267219 - RNA, 22 nt, Homo sapiens
auuuuugguugucagcacuagg

SEQ ID NO: 267220 - RNA, 22 nt, Homo sapiens
auuuuugguuucaccugcacgc

SEQ ID NO: 267221 - RNA, 22 nt, Homo sapiens
caaaguaauuacgguuuuggcc

SEQ ID NO: 267222 - RNA, 22 nt, Homo sapiens
caaagugcugggaugggccagg

SEQ ID NO: 267223 - RNA, 19 nt, Homo sapiens
caaaguguucuucuuugcc

SEQ ID NO: 267224 - RNA, 22 nt, Homo sapiens
caaauacuuucauguugucuug

SEQ ID NO: 267225 - RNA, 22 nt, Homo sapiens
caaauugcuugucuguagugga

SEQ ID NO: 267226 - RNA, 22 nt, Homo sapiens
caagagaccugagugucauucu

SEQ ID NO: 267227 - RNA, 22 nt, Homo sapiens
caaggcacagccccuacuuccu

SEQ ID NO: 267228 - RNA, 22 nt, Homo sapiens
caagugcuacagagaaaucuuu

SEQ ID NO: 267229 - RNA, 22 nt, Homo sapiens
caagugcuuucuuggggauuua

SEQ ID NO: 267230 - RNA, 22 nt, Homo sapiens
caauacuguuaccugaaauagg

SEQ ID NO: 267231 - RNA, 22 nt, Homo sapiens
caaugcauuauucucccacuuc

SEQ ID NO: 267232 - RNA, 22 nt, Homo sapiens
caaugguuuuuuaguauaagua

SEQ ID NO: 267233 - RNA, 22 nt, Homo sapiens
cacacugucuuucagaaugguu

SEQ ID NO: 267234 - RNA, 22 nt, Homo sapiens
cacagucugggcuuguuuguac

SEQ ID NO: 267235 - RNA, 22 nt, Homo sapiens
cacagucuugcaauauugagau

SEQ ID NO: 267236 - RNA, 22 nt, Homo sapiens
cacagugaacugguggguuuuu

SEQ ID NO: 267237 - RNA, 22 nt, Homo sapiens
cacaguguucauagccaucagg

SEQ ID NO: 267238 - RNA, 22 nt, Homo sapiens
cacauguucaggagcacuuaga

SEQ ID NO: 267239 - RNA, 22 nt, Homo sapiens
caccacagccauuauugucccc

SEQ ID NO: 267240 - RNA, 19 nt, Homo sapiens
caccagugcaugcuacuau

SEQ ID NO: 267241 - RNA, 19 nt, Homo sapiens
caccgccugcccccugcug

SEQ ID NO: 267242 - RNA, 22 nt, Homo sapiens
cacgugcuuucuuuucauuuag

SEQ ID NO: 267243 - RNA, 22 nt, Homo sapiens
cacugcacuccagcuugugggc

SEQ ID NO: 267244 - RNA, 22 nt, Homo sapiens
cacugcacuccagucccgucuc

SEQ ID NO: 267245 - RNA, 22 nt, Homo sapiens
cacugcauccuccauauccugg

SEQ ID NO: 267246 - RNA, 20 nt, Homo sapiens
cagagcaaagcaguccuggc

SEQ ID NO: 267247 - RNA, 22 nt, Homo sapiens
cagagguaagcaagucagcauu

SEQ ID NO: 267248 - RNA, 22 nt, Homo sapiens
cagcuaaauuguuaaauccaag

SEQ ID NO: 267249 - RNA, 22 nt, Homo sapiens
cagcucuuguuaaaacuaacua

SEQ ID NO: 267250 - RNA, 23 nt, Homo sapiens
cagcuggugauuuuaaguugaag

SEQ ID NO: 267251 - RNA, 22 nt, Homo sapiens
caggcaacauggcgaaacucug

SEQ ID NO: 267252 - RNA, 22 nt, Homo sapiens
caggcagucuggcucccaagug

SEQ ID NO: 267253 - RNA, 22 nt, Homo sapiens
caggcagucuggggguguaucc

SEQ ID NO: 267254 - RNA, 22 nt, Homo sapiens
caggcuuuuccacacauggguu

SEQ ID NO: 267255 - RNA, 22 nt, Homo sapiens
cagggaauguuauuuaauagca

SEQ ID NO: 267256 - RNA, 22 nt, Homo sapiens
cagguacaugcaugugugugca

SEQ ID NO: 267257 - RNA, 22 nt, Homo sapiens
caggugaaugccucuccuucug

SEQ ID NO: 267258 - RNA, 22 nt, Homo sapiens
caguacaauguggaaaaggagu

SEQ ID NO: 267259 - RNA, 22 nt, Homo sapiens
cagucacagugacaggaugugg

SEQ ID NO: 267260 - RNA, 22 nt, Homo sapiens
cagugaauuucaggucaagagu

SEQ ID NO: 267261 - RNA, 20 nt, Homo sapiens
cagugcaccuggcguguuga

SEQ ID NO: 267262 - RNA, 23 nt, Homo sapiens
cagugcauuguggcauucagcau

SEQ ID NO: 267263 - RNA, 22 nt, Homo sapiens
caguggaugaacaagaagugau

SEQ ID NO: 267264 - RNA, 23 nt, Homo sapiens
cagugguguuagagaaaucuuuu

SEQ ID NO: 267265 - RNA, 22 nt, Homo sapiens
caguugcacuagccccguuuca

SEQ ID NO: 267266 - RNA, 22 nt, Homo sapiens
cauacaagcuacaaucacaaag

SEQ ID NO: 267267 - RNA, 22 nt, Homo sapiens
cauacagcuaguaaguguaaga

SEQ ID NO: 267268 - RNA, 22 nt, Homo sapiens
cauacaguaggcacuauuugua

SEQ ID NO: 267269 - RNA, 22 nt, Homo sapiens
caucacaucugcaugguaagua

SEQ ID NO: 267270 - RNA, 22 nt, Homo sapiens
caucaggugaggauucaaugca

SEQ ID NO: 267271 - RNA, 22 nt, Homo sapiens
cucagauacuugggagguugag

SEQ ID NO: 267272 - RNA, 22 nt, Homo sapiens
cucagugaagggcaagaggcaa

SEQ ID NO: 267273 - RNA, 22 nt, Homo sapiens
cucaguguuucagcugcucaga

SEQ ID NO: 267274 - RNA, 22 nt, Homo sapiens
cucauggagaaccucugcuagg

SEQ ID NO: 267275 - RNA, 22 nt, Homo sapiens
cucauuaguuguuuuaagauga

SEQ ID NO: 267276 - RNA, 22 nt, Homo sapiens
cuccaguacagagagguuccuc

SEQ ID NO: 267277 - RNA, 22 nt, Homo sapiens
cuccaguuucagaaucccaugu

SEQ ID NO: 267278 - RNA, 22 nt, Homo sapiens
cucccauugcaaacaacagaag

SEQ ID NO: 267279 - RNA, 22 nt, Homo sapiens
cucucaguguggaggccagaaa

SEQ ID NO: 267280 - RNA, 22 nt, Homo sapiens
cucucuguuugucuguuauugg

SEQ ID NO: 267281 - RNA, 22 nt, Homo sapiens
cucugauggagauauacaagga

SEQ ID NO: 267282 - RNA, 22 nt, Homo sapiens
cucuggauauuccugucuaaaa

SEQ ID NO: 267283 - RNA, 22 nt, Homo sapiens
cucugguuaaggcugaacuaua

SEQ ID NO: 267284 - RNA, 22 nt, Homo sapiens
cucuuacaguguguggugaaag

SEQ ID NO: 267285 - RNA, 22 nt, Homo sapiens
cugaaagagcauuugaaugggu

SEQ ID NO: 267286 - RNA, 22 nt, Homo sapiens
cugaagugcuugccacauaaaa

SEQ ID NO: 267287 - RNA, 22 nt, Homo sapiens
cugacauuguugaucacagcca

SEQ ID NO: 267288 - RNA, 22 nt, Homo sapiens
cugacguguuuuccagaccuuu

SEQ ID NO: 267289 - RNA, 22 nt, Homo sapiens
cugacucagacacauguauaug

SEQ ID NO: 267290 - RNA, 22 nt, Homo sapiens
cugacuuuagaacccaaaaagu

SEQ ID NO: 267291 - RNA, 22 nt, Homo sapiens
cugagacuggguaauguauaaa

SEQ ID NO: 267292 - RNA, 22 nt, Homo sapiens
cugagagaggagcuaaaacugc

SEQ ID NO: 267293 - RNA, 22 nt, Homo sapiens
cugagauacacuaauagucucu

SEQ ID NO: 267294 - RNA, 22 nt, Homo sapiens
cugagauaggacucugcuggcu

SEQ ID NO: 267295 - RNA, 22 nt, Homo sapiens
cugagauuuuuagauccuggcg

SEQ ID NO: 267296 - RNA, 22 nt, Homo sapiens
cugagcaucauggcagaaucuu

SEQ ID NO: 267297 - RNA, 22 nt, Homo sapiens
cugagcuagaccacuuggcucc

SEQ ID NO: 267298 - RNA, 22 nt, Homo sapiens
cugaggaaguucuuuaacaguu

SEQ ID NO: 267299 - RNA, 22 nt, Homo sapiens
cugaggauauucagccucugug

SEQ ID NO: 267300 - RNA, 22 nt, Homo sapiens
cugagguacccacuucaucuca

SEQ ID NO: 267301 - RNA, 22 nt, Homo sapiens
cugaggugggaggauuggcuug

SEQ ID NO: 267302 - RNA, 22 nt, Homo sapiens
cugagguuguucuucucagugg

SEQ ID NO: 267303 - RNA, 20 nt, Homo sapiens
cugauacagccugagcucuc

SEQ ID NO: 267304 - RNA, 22 nt, Homo sapiens
cugauuuguccccagccucaug

SEQ ID NO: 267305 - RNA, 22 nt, Homo sapiens
cuggaaacaucuuaggaaugca

SEQ ID NO: 267306 - RNA, 22 nt, Homo sapiens
cuggaaagaaucaggcuaaacu

SEQ ID NO: 267307 - RNA, 22 nt, Homo sapiens
cuggaaagcaaagggugcauug

SEQ ID NO: 267308 - RNA, 22 nt, Homo sapiens
cuggaaagcaaguccauugcuc

SEQ ID NO: 267309 - RNA, 22 nt, Homo sapiens
cuggaagcacaacgcauuuauu

SEQ ID NO: 267310 - RNA, 18 nt, Homo sapiens
cuggaaggcuacuacagu

SEQ ID NO: 267311 - RNA, 22 nt, Homo sapiens
cuggaaucuagaaaagguaagg

SEQ ID NO: 267312 - RNA, 22 nt, Homo sapiens
cuggaaucuauggauaacaucg

SEQ ID NO: 267313 - RNA, 22 nt, Homo sapiens
cuggaaugugagccccaaaaag

SEQ ID NO: 267314 - RNA, 22 nt, Homo sapiens
cuggagaucuugacauugaagu

SEQ ID NO: 267315 - RNA, 22 nt, Homo sapiens
cuggagcaaaggugacucuugu

SEQ ID NO: 267316 - RNA, 22 nt, Homo sapiens
cuggagcauugguggauuuguu

SEQ ID NO: 267317 - RNA, 22 nt, Homo sapiens
cuggaggccugaacauaaaugg

SEQ ID NO: 267318 - RNA, 22 nt, Homo sapiens
cuggaguaugaaccauguauca

SEQ ID NO: 267319 - RNA, 22 nt, Homo sapiens
cuggagucugacugacacaagg

SEQ ID NO: 267320 - RNA, 22 nt, Homo sapiens
cuggcaaauguuuucuguaaag

SEQ ID NO: 267321 - RNA, 22 nt, Homo sapiens
cuggcaagagugaaccagcugu

SEQ ID NO: 267322 - RNA, 22 nt, Homo sapiens
cuggccagagacauucauuaaa

SEQ ID NO: 267323 - RNA, 22 nt, Homo sapiens
cugggaucaguucuagucagaa

SEQ ID NO: 267324 - RNA, 22 nt, Homo sapiens
cugggaugugacuguugccccc

SEQ ID NO: 267325 - RNA, 22 nt, Homo sapiens
cugguaagaaggucuaagucaa

SEQ ID NO: 267326 - RNA, 22 nt, Homo sapiens
cuggucaagagcaaaggccagg

SEQ ID NO: 267327 - RNA, 22 nt, Homo sapiens
cuggucaugggggcacccucug

SEQ ID NO: 267328 - RNA, 22 nt, Homo sapiens
cugguuguucuggaugggcagg

SEQ ID NO: 267329 - RNA, 22 nt, Homo sapiens
cuguaacagaauaaauuuguuu

SEQ ID NO: 267330 - RNA, 19 nt, Homo sapiens
cugucacugaggaagacug

SEQ ID NO: 267331 - RNA, 22 nt, Homo sapiens
cugucacugggaggggcagcag

SEQ ID NO: 267332 - RNA, 22 nt, Homo sapiens
cugucagugggaguucaggcuu

SEQ ID NO: 267333 - RNA, 22 nt, Homo sapiens
cugucuagagggcacaugaugc

SEQ ID NO: 267334 - RNA, 22 nt, Homo sapiens
cugugauuauauaguuaaggua

SEQ ID NO: 267335 - RNA, 22 nt, Homo sapiens
cugugcauuggaugucucccug

SEQ ID NO: 267336 - RNA, 22 nt, Homo sapiens
cugugcuugauuauaugagugu

SEQ ID NO: 267337 - RNA, 22 nt, Homo sapiens
cugugguguaacucuuggggcg

SEQ ID NO: 267338 - RNA, 22 nt, Homo sapiens
cugugguugagcuuugccauga

SEQ ID NO: 267339 - RNA, 22 nt, Homo sapiens
cuguuagguuaaggaauggcaa

SEQ ID NO: 267340 - RNA, 22 nt, Homo sapiens
cuguugguguuuaaucacugca

SEQ ID NO: 267341 - RNA, 22 nt, Homo sapiens
cuguuuguuuaggguacucaga

SEQ ID NO: 267342 - RNA, 22 nt, Homo sapiens
cuuaaugcuacggcucuguguu

SEQ ID NO: 267343 - RNA, 22 nt, Homo sapiens
cuuagcaugucagcaccggguu

SEQ ID NO: 267344 - RNA, 22 nt, Homo sapiens
cuucaaaguuggcuaggagaca

SEQ ID NO: 267345 - RNA, 22 nt, Homo sapiens
cuucaagucuuuggauaauuag

SEQ ID NO: 267346 - RNA, 22 nt, Homo sapiens
cuucagcaauauauccccuggg

SEQ ID NO: 267347 - RNA, 22 nt, Homo sapiens
cuucaguucuguaaggacagca

SEQ ID NO: 267348 - RNA, 22 nt, Homo sapiens
cuucaugagacuuuuggaaggc

SEQ ID NO: 267349 - RNA, 22 nt, Homo sapiens
cuuccaaguggggcacgugcca

SEQ ID NO: 267350 - RNA, 22 nt, Homo sapiens
cuuccagcuggguucagucagu

SEQ ID NO: 267351 - RNA, 22 nt, Homo sapiens
cuugagcauauucuauauuaaa

SEQ ID NO: 267352 - RNA, 22 nt, Homo sapiens
cuugauagugguaaucauuuuu

SEQ ID NO: 267353 - RNA, 22 nt, Homo sapiens
cuugcacucagaagauucaguu

SEQ ID NO: 267354 - RNA, 22 nt, Homo sapiens
cuugcacuguuguaagggacuu

SEQ ID NO: 267355 - RNA, 18 nt, Homo sapiens
cuuggcgaugccaacaua

SEQ ID NO: 267356 - RNA, 22 nt, Homo sapiens
cuuggcuagucaaaccuccccg

SEQ ID NO: 267357 - RNA, 22 nt, Homo sapiens
cuuggcuuguuguccccugcuc

SEQ ID NO: 267358 - RNA, 20 nt, Homo sapiens
cuuggcuuucuugguguuaa

SEQ ID NO: 267359 - RNA, 22 nt, Homo sapiens
cuugggcagugugcauguguau

SEQ ID NO: 267360 - RNA, 22 nt, Homo sapiens
cuugggccccacccaaaucuua

SEQ ID NO: 267361 - RNA, 22 nt, Homo sapiens
ugugucacugcacuccagccug

SEQ ID NO: 267362 - RNA, 22 nt, Homo sapiens
ugugucuacugagaugaucaug

SEQ ID NO: 267363 - RNA, 22 nt, Homo sapiens
uguuaacauggucucagucugu

SEQ ID NO: 267364 - RNA, 22 nt, Homo sapiens
uguuacagcagcacaaaaugga

SEQ ID NO: 267365 - RNA, 22 nt, Homo sapiens
uguuaguuguucauguuaagag

SEQ ID NO: 267366 - RNA, 22 nt, Homo sapiens
uguuauguuuuagagguuucaa

SEQ ID NO: 267367 - RNA, 22 nt, Homo sapiens
uguucaugaguucucauuuuua

SEQ ID NO: 267368 - RNA, 22 nt, Homo sapiens
uguucuggagaggcaggccaca

SEQ ID NO: 267369 - RNA, 22 nt, Homo sapiens
uguugcauuugucaaggucaag

SEQ ID NO: 267370 - RNA, 18 nt, Homo sapiens
uguugguguucacucacu

SEQ ID NO: 267371 - RNA, 22 nt, Homo sapiens
uguuugcuguguggaguagcag

SEQ ID NO: 267372 - RNA, 22 nt, Homo sapiens
uguuuguuugagauggagucuc

SEQ ID NO: 267373 - RNA, 22 nt, Homo sapiens
uguuuuggaggccagaagucca

SEQ ID NO: 267374 - RNA, 22 nt, Homo sapiens
uguuuuggagguccucacuaga

SEQ ID NO: 267375 - RNA, 22 nt, Homo sapiens
uguuuuggaguggacuuugcau

SEQ ID NO: 267376 - RNA, 21 nt, Homo sapiens
uguuuuugcuguguaucucuc

SEQ ID NO: 267377 - RNA, 22 nt, Homo sapiens
uuaaaguaauugaaauggccuu

SEQ ID NO: 267378 - RNA, 22 nt, Homo sapiens
uuaaggcauucuuugucuucau

SEQ ID NO: 267379 - RNA, 19 nt, Homo sapiens
uuaaguaguuagagggucu

SEQ ID NO: 267380 - RNA, 22 nt, Homo sapiens
uuaagugaauuaucuaacaugu

SEQ ID NO: 267381 - RNA, 22 nt, Homo sapiens
uuaaucacagugucuuccuuca

SEQ ID NO: 267382 - RNA, 21 nt, Homo sapiens
uuaaugcuaugcagaaaaucu

SEQ ID NO: 267383 - RNA, 22 nt, Homo sapiens
uuaaugcuuggggaguaguucu

SEQ ID NO: 267384 - RNA, 22 nt, Homo sapiens
uuacaagaugucuguccaacac

SEQ ID NO: 267385 - RNA, 22 nt, Homo sapiens
uuacaggacuaagcagcuuugc

SEQ ID NO: 267386 - RNA, 17 nt, Homo sapiens
uuacaggugcugagagu

SEQ ID NO: 267387 - RNA, 22 nt, Homo sapiens
uuacagucaaguuacauuucuc

SEQ ID NO: 267388 - RNA, 22 nt, Homo sapiens
uuacagucucaagagugcugca

SEQ ID NO: 267389 - RNA, 22 nt, Homo sapiens
uuacaguggugaccuuguauug

SEQ ID NO: 267390 - RNA, 19 nt, Homo sapiens
uuacauccauugcauuuca

SEQ ID NO: 267391 - RNA, 22 nt, Homo sapiens
uuaccugagaaggugacauuug

SEQ ID NO: 267392 - RNA, 22 nt, Homo sapiens
uuacuacucucuaugaccaguu

SEQ ID NO: 267393 - RNA, 22 nt, Homo sapiens
uuacuagaacauuuagggaacu

SEQ ID NO: 267394 - RNA, 20 nt, Homo sapiens
uuacuauguaguauuggcuc

SEQ ID NO: 267395 - RNA, 22 nt, Homo sapiens
uuacuauguuucaaagugucuc

SEQ ID NO: 267396 - RNA, 22 nt, Homo sapiens
uuacugcucuuuugucaugagu

SEQ ID NO: 267397 - RNA, 22 nt, Homo sapiens
uuagaacagugcucaccacaaa

SEQ ID NO: 267398 - RNA, 22 nt, Homo sapiens
uuagagcacugaucugcucuuu

SEQ ID NO: 267399 - RNA, 17 nt, Homo sapiens
uuagagguagacucauu

SEQ ID NO: 267400 - RNA, 22 nt, Homo sapiens
uuagcacauuuccagcacaugg

SEQ ID NO: 267401 - RNA, 22 nt, Homo sapiens
uuagcaccacacacuuuagagg

SEQ ID NO: 267402 - RNA, 22 nt, Homo sapiens
uuagcacugagaauggcuugcu

SEQ ID NO: 267403 - RNA, 22 nt, Homo sapiens
uuagcagcacaaaagcagacua

SEQ ID NO: 267404 - RNA, 20 nt, Homo sapiens
uuagcagcaugauuuauaau

SEQ ID NO: 267405 - RNA, 22 nt, Homo sapiens
uuagccggguguguuggcgggc

SEQ ID NO: 267406 - RNA, 22 nt, Homo sapiens
uuaggcaggauaguuacauauu

SEQ ID NO: 267407 - RNA, 21 nt, Homo sapiens
uuaggcagugucagaggugag

SEQ ID NO: 267408 - RNA, 22 nt, Homo sapiens
uuaggcuaguuucuuaaacucu

SEQ ID NO: 267409 - RNA, 22 nt, Homo sapiens
uuagggaggcucaggacaagag

SEQ ID NO: 267410 - RNA, 22 nt, Homo sapiens
uuagguacuuuggagagauuca

SEQ ID NO: 267411 - RNA, 20 nt, Homo sapiens
uuagucuccucugcccuguc

SEQ ID NO: 267412 - RNA, 22 nt, Homo sapiens
uuauaacucugcagccugguau

SEQ ID NO: 267413 - RNA, 22 nt, Homo sapiens
uuauagacacguuguaacaaac

SEQ ID NO: 267414 - RNA, 22 nt, Homo sapiens
uuauauguuucuguuuggaggc

SEQ ID NO: 267415 - RNA, 22 nt, Homo sapiens
uuaucauagugcaguuuucuga

SEQ ID NO: 267416 - RNA, 17 nt, Homo sapiens
uuaugagacuucuuagc

SEQ ID NO: 267417 - RNA, 22 nt, Homo sapiens
uuaugcagcaaagugcuugaaa

SEQ ID NO: 267418 - RNA, 22 nt, Homo sapiens
uuauggauuuauauucuguagu

SEQ ID NO: 267419 - RNA, 22 nt, Homo sapiens
uuauggcuuugcgguguuagca

SEQ ID NO: 267420 - RNA, 23 nt, Homo sapiens
uuauggcuuuuauuauguugagg

SEQ ID NO: 267421 - RNA, 22 nt, Homo sapiens
uuaugucauuuuuggauguuaa

SEQ ID NO: 267422 - RNA, 22 nt, Homo sapiens
uuauuacuccuauuuuguagau

SEQ ID NO: 267423 - RNA, 17 nt, Homo sapiens
uuauugcuauaagcuga

SEQ ID NO: 267424 - RNA, 22 nt, Homo sapiens
uucaaaaccucugcuuaagccc

SEQ ID NO: 267425 - RNA, 22 nt, Homo sapiens
uucaaauguucuuucaccaccc

SEQ ID NO: 267426 - RNA, 22 nt, Homo sapiens
uucaagaauuaaaguggcuuuu

SEQ ID NO: 267427 - RNA, 22 nt, Homo sapiens
uucaagcuauggugaucuuuuc

SEQ ID NO: 267428 - RNA, 22 nt, Homo sapiens
uucaaggacuaaggauuuuugg

SEQ ID NO: 267429 - RNA, 22 nt, Homo sapiens
uucacaguacucccuggaauua

SEQ ID NO: 267430 - RNA, 22 nt, Homo sapiens
uucaccagggaagucucaacuc

SEQ ID NO: 267431 - RNA, 21 nt, Homo sapiens
uucaccauggcuccacacucu

SEQ ID NO: 267432 - RNA, 22 nt, Homo sapiens
uucaccuggaguucaggauaag

SEQ ID NO: 267433 - RNA, 20 nt, Homo sapiens
auucaaguaugccuugagaa

SEQ ID NO: 267434 - RNA, 22 nt, Homo sapiens
auucacugugcuuggccaaauu

SEQ ID NO: 267435 - RNA, 22 nt, Homo sapiens
auucacuguggcuuucucugau

SEQ ID NO: 267436 - RNA, 22 nt, Homo sapiens
auucacuuuuauagacaggucu

SEQ ID NO: 267437 - RNA, 22 nt, Homo sapiens
auucaucagggauauugguuga

SEQ ID NO: 267438 - RNA, 20 nt, Homo sapiens
auucauggaggagcaauugg

SEQ ID NO: 267439 - RNA, 22 nt, Homo sapiens
auuccacuuacaugaaguaccu

SEQ ID NO: 267440 - RNA, 22 nt, Homo sapiens
auuccacuuccacuaguuucuc

SEQ ID NO: 267441 - RNA, 22 nt, Homo sapiens
auucccuuagcugccucagccu

SEQ ID NO: 267442 - RNA, 20 nt, Homo sapiens
auugaagacuccggggcaga

SEQ ID NO: 267443 - RNA, 22 nt, Homo sapiens
auugaauuugguuugcuaagaa

SEQ ID NO: 267444 - RNA, 22 nt, Homo sapiens
auugacaguuggccaguaagug

SEQ ID NO: 267445 - RNA, 22 nt, Homo sapiens
auugagcaauuccuaugugcuu

SEQ ID NO: 267446 - RNA, 22 nt, Homo sapiens
auugaguaaaugaaaauugccu

SEQ ID NO: 267447 - RNA, 22 nt, Homo sapiens
auugcaaagcguagacucuaaa

SEQ ID NO: 267448 - RNA, 22 nt, Homo sapiens
auugcacaucugcacuacagcc

SEQ ID NO: 267449 - RNA, 19 nt, Homo sapiens
auugcacuccaaccugggu

SEQ ID NO: 267450 - RNA, 22 nt, Homo sapiens
auugcacuccagcccugcugac

SEQ ID NO: 267451 - RNA, 23 nt, Homo sapiens
auugcacuccagccuaccugggc

SEQ ID NO: 267452 - RNA, 22 nt, Homo sapiens
auugcacuccagccuggaugac

SEQ ID NO: 267453 - RNA, 22 nt, Homo sapiens
auugcacuccagccuggccaac

SEQ ID NO: 267454 - RNA, 22 nt, Homo sapiens
auugcacuccagccuggggaac

SEQ ID NO: 267455 - RNA, 22 nt, Homo sapiens
ugugcacaaccugcagguuugu

SEQ ID NO: 267456 - RNA, 22 nt, Homo sapiens
ugugcacaauguacagguuagu

SEQ ID NO: 267457 - RNA, 22 nt, Homo sapiens
ugugcacauaacauuuuuuuag

SEQ ID NO: 267458 - RNA, 22 nt, Homo sapiens
ugugcacauugugcagguugau

SEQ ID NO: 267459 - RNA, 22 nt, Homo sapiens
ugugcaugaaauuuaccuuuaa

SEQ ID NO: 267460 - RNA, 22 nt, Homo sapiens
ugugccuacugauagagccaag

SEQ ID NO: 267461 - RNA, 22 nt, Homo sapiens
ugugcuugaauuuaguagcuua

SEQ ID NO: 267462 - RNA, 22 nt, Homo sapiens
ugugcuuguaaaggccagagca

SEQ ID NO: 267463 - RNA, 22 nt, Homo sapiens
uguggaguguaugugacagaga

SEQ ID NO: 267464 - RNA, 22 nt, Homo sapiens
uguggcaaagucuugugaauau

SEQ ID NO: 267465 - RNA, 22 nt, Homo sapiens
uguggcaaauggucaggaagaa

SEQ ID NO: 267466 - RNA, 21 nt, Homo sapiens
uguggcaauggccucacagau

SEQ ID NO: 267467 - RNA, 20 nt, Homo sapiens
uguggcacuguaucucucag

SEQ ID NO: 267468 - RNA, 22 nt, Homo sapiens
uguggcagugcuuuaugaaacc

SEQ ID NO: 267469 - RNA, 17 nt, Homo sapiens
uguggcucuuaugcuga

SEQ ID NO: 267470 - RNA, 22 nt, Homo sapiens
uguggcuuuacagcaugguuca

SEQ ID NO: 267471 - RNA, 22 nt, Homo sapiens
ugugguuuuucacauuuagaga

SEQ ID NO: 267472 - RNA, 22 nt, Homo sapiens
ugugguuuuuuucuccaauagg

SEQ ID NO: 267473 - RNA, 22 nt, Homo sapiens
uguguaaauauauacacacgug

SEQ ID NO: 267474 - RNA, 22 nt, Homo sapiens
uguguacaucucuacacacaug

SEQ ID NO: 267475 - RNA, 22 nt, Homo sapiens
ugugucacugaggguuagugua

SEQ ID NO: 267476 - RNA, 22 nt, Homo sapiens
guguagagaaaaguaccauuuu

SEQ ID NO: 267477 - RNA, 22 nt, Homo sapiens
guguauacauagaauuguguau

SEQ ID NO: 267478 - RNA, 21 nt, Homo sapiens
gugucacagacaugacagaug

SEQ ID NO: 267479 - RNA, 22 nt, Homo sapiens
gugucaugagggggacaggaag

SEQ ID NO: 267480 - RNA, 22 nt, Homo sapiens
gugucucagcccagaccuauuu

SEQ ID NO: 267481 - RNA, 22 nt, Homo sapiens
gugugacugcucuauuagggcg

SEQ ID NO: 267482 - RNA, 22 nt, Homo sapiens
gcuguaguugaggauuuuaaga

SEQ ID NO: 267483 - RNA, 22 nt, Homo sapiens
gcuguauuguugaaggaaaugu

SEQ ID NO: 267484 - RNA, 22 nt, Homo sapiens
gcugucuggagucuguucaaug

SEQ ID NO: 267485 - RNA, 22 nt, Homo sapiens
gcuguguugugcccagcaucau

SEQ ID NO: 267486 - RNA, 18 nt, Homo sapiens
gcuguugucagagcacau

SEQ ID NO: 267487 - RNA, 22 nt, Homo sapiens
gcuguugugaacuauacaucua

SEQ ID NO: 267488 - RNA, 22 nt, Homo sapiens
gcuugguccccacccaaaucgc

SEQ ID NO: 267489 - RNA, 22 nt, Homo sapiens
gcuuguguucaaggaacaccua

SEQ ID NO: 267490 - RNA, 22 nt, Homo sapiens
gcuuguguuuacuguaguuacu

SEQ ID NO: 267491 - RNA, 22 nt, Homo sapiens
gcuuuggauaaaugucaguuua

SEQ ID NO: 267492 - RNA, 19 nt, Homo sapiens
gcuuuguggggaaggagcc

SEQ ID NO: 267493 - RNA, 21 nt, Homo sapiens
gcuuuuucggaagucuuuggc

SEQ ID NO: 267494 - RNA, 19 nt, Homo sapiens
ggaaaugucuauuaagauc

SEQ ID NO: 267495 - RNA, 22 nt, Homo sapiens
ggaagacuuagaguagcaucag

SEQ ID NO: 267496 - RNA, 18 nt, Homo sapiens
ggaagccuauuuaguaac

SEQ ID NO: 267497 - RNA, 22 nt, Homo sapiens
ggaagugcuguguggaagucug

SEQ ID NO: 267498 - RNA, 22 nt, Homo sapiens
ggaaugagaaauauuacacaau

SEQ ID NO: 267499 - RNA, 22 nt, Homo sapiens
ggaauggaacaaagucuugaaa

SEQ ID NO: 267500 - RNA, 22 nt, Homo sapiens
ggacauuaacugcaagauagau

SEQ ID NO: 267501 - RNA, 22 nt, Homo sapiens
ggacuagaggugaaaagaagac

SEQ ID NO: 267502 - RNA, 22 nt, Homo sapiens
ggagaucacucuuuguagcgug

SEQ ID NO: 267503 - RNA, 22 nt, Homo sapiens
ggagaucuuguuaaaguacaga

SEQ ID NO: 267504 - RNA, 22 nt, Homo sapiens
ggagaucuuuaggaguuggacu

SEQ ID NO: 267505 - RNA, 22 nt, Homo sapiens
ggagcugugauuugaguccaga

SEQ ID NO: 267506 - RNA, 22 nt, Homo sapiens
ggagguagucuuucccuuauca

SEQ ID NO: 267507 - RNA, 22 nt, Homo sapiens
ggaguaggaaggaaauguuaaa

SEQ ID NO: 267508 - RNA, 22 nt, Homo sapiens
ggaguaggcuguccggcaccca

SEQ ID NO: 267509 - RNA, 22 nt, Homo sapiens
ggagugcuguuguuacacaagg

SEQ ID NO: 267510 - RNA, 22 nt, Homo sapiens
ggagugugauuguucucuguua

SEQ ID NO: 267511 - RNA, 22 nt, Homo sapiens
ggaguguguuuuccaacuuggu

SEQ ID NO: 267512 - RNA, 22 nt, Homo sapiens
ggauaacagccaggucaaacaa

SEQ ID NO: 267513 - RNA, 22 nt, Homo sapiens
ggauugcuuaagaaguuucauu

SEQ ID NO: 267514 - RNA, 22 nt, Homo sapiens
ggcaaaauauugucugguauag

SEQ ID NO: 267515 - RNA, 22 nt, Homo sapiens
ggcaaagagacaugcaucgggg

SEQ ID NO: 267516 - RNA, 22 nt, Homo sapiens
ggcaagaaaaugcaauuacugu

SEQ ID NO: 267517 - RNA, 21 nt, Homo sapiens
ggcaagaaacacaaucaagua

SEQ ID NO: 267518 - RNA, 22 nt, Homo sapiens
ggcaagaaccagggauuugcgu

SEQ ID NO: 267519 - RNA, 21 nt, Homo sapiens
ggcaagagaauacaacauaaa

SEQ ID NO: 267520 - RNA, 22 nt, Homo sapiens
ggcaaggaggggcacuuucacu

SEQ ID NO: 267521 - RNA, 22 nt, Homo sapiens
ggcaagugucagcagcaacacc

SEQ ID NO: 267522 - RNA, 22 nt, Homo sapiens
ggcaaguucuaaugauuagaau

SEQ ID NO: 267523 - RNA, 22 nt, Homo sapiens
ggcaaguugcuauucuuuaaug

SEQ ID NO: 267524 - RNA, 22 nt, Homo sapiens
ggcacaauugcagcaauaaaca

SEQ ID NO: 267525 - RNA, 22 nt, Homo sapiens
ggcacugugaugugagggggua

SEQ ID NO: 267526 - RNA, 22 nt, Homo sapiens
ggcagcaugggugccuuuguga

SEQ ID NO: 267527 - RNA, 22 nt, Homo sapiens
ggcagcucaggccccgcgcuga

SEQ ID NO: 267528 - RNA, 17 nt, Homo sapiens
ggcaggauccaggaucc

SEQ ID NO: 267529 - RNA, 22 nt, Homo sapiens
ggcaguuuggcaguuucauaaa

SEQ ID NO: 267530 - RNA, 22 nt, Homo sapiens
ggcaguuuguucuugcuccuuu

SEQ ID NO: 267531 - RNA, 21 nt, Homo sapiens
ggcaugaauggaaaagugaga

SEQ ID NO: 267532 - RNA, 22 nt, Homo sapiens
ggcaugcauuguacuaguaugc

SEQ ID NO: 267533 - RNA, 22 nt, Homo sapiens
ggcauguuuaguagaauguggu

SEQ ID NO: 267534 - RNA, 22 nt, Homo sapiens
ggcccugagacaggaaaaagcu

SEQ ID NO: 267535 - RNA, 22 nt, Homo sapiens
ggcuagaauagggauagaccuu

SEQ ID NO: 267536 - RNA, 18 nt, Homo sapiens
ggcugguguuuuaguaua

SEQ ID NO: 267537 - RNA, 22 nt, Homo sapiens
gggaacauggaaauucugcucu

SEQ ID NO: 267538 - RNA, 18 nt, Homo sapiens
gggaauauggggaguuga

SEQ ID NO: 267539 - RNA, 22 nt, Homo sapiens
gggagguagguauuagcuuuuc

SEQ ID NO: 267540 - RNA, 22 nt, Homo sapiens
gggcaaaacuguacugccaagg

SEQ ID NO: 267541 - RNA, 22 nt, Homo sapiens
gggcaacauugaguacccugaa

SEQ ID NO: 267542 - RNA, 22 nt, Homo sapiens
gggcaugaugucuuaugccuau

SEQ ID NO: 267543 - RNA, 22 nt, Homo sapiens
gggcauugugggcagagggcag

SEQ ID NO: 267544 - RNA, 23 nt, Homo sapiens
gggcuagaugagagcuuccuggg

SEQ ID NO: 267545 - RNA, 22 nt, Homo sapiens
ggggaauguuaaagaauuugca

SEQ ID NO: 267546 - RNA, 22 nt, Homo sapiens
gggguaggcuacacugaguucc

SEQ ID NO: 267547 - RNA, 22 nt, Homo sapiens
gggguuuuaccuucguauucuu

SEQ ID NO: 267548 - RNA, 17 nt, Homo sapiens
gggucaccuugcaggua

SEQ ID NO: 267549 - RNA, 22 nt, Homo sapiens
gguaucuuggagagagaaguga

SEQ ID NO: 267550 - RNA, 22 nt, Homo sapiens
ggucacauugcuagcauggguu

SEQ ID NO: 267551 - RNA, 22 nt, Homo sapiens
ggucauggauaagauccagaag

SEQ ID NO: 267552 - RNA, 22 nt, Homo sapiens
ggucugguguugaaauucuuca

SEQ ID NO: 267553 - RNA, 23 nt, Homo sapiens
ggugaggaguacagagucuucau

SEQ ID NO: 267554 - RNA, 22 nt, Homo sapiens
ggugagguaggaaaaguuagga

SEQ ID NO: 267555 - RNA, 22 nt, Homo sapiens
ggugagguaguaagguacaaua

SEQ ID NO: 267556 - RNA, 22 nt, Homo sapiens
ggugcagcacaccaacauggca

SEQ ID NO: 267557 - RNA, 22 nt, Homo sapiens
gguggcuuuuugugauggcuga

SEQ ID NO: 267558 - RNA, 22 nt, Homo sapiens
gguggugguauuucagaaaaug

SEQ ID NO: 267559 - RNA, 22 nt, Homo sapiens
gguguguaaauuacuuaucucu

SEQ ID NO: 267560 - RNA, 22 nt, Homo sapiens
guaauaacuguggaaaaagguu

SEQ ID NO: 267561 - RNA, 22 nt, Homo sapiens
guacacaacaugcagguuuguu

SEQ ID NO: 267562 - RNA, 22 nt, Homo sapiens
uugcacauggcuggggaggccu

SEQ ID NO: 267563 - RNA, 22 nt, Homo sapiens
uugcacuccagccuggaugaca

SEQ ID NO: 267564 - RNA, 22 nt, Homo sapiens
uugcacuccggccuggguaaca

SEQ ID NO: 267565 - RNA, 22 nt, Homo sapiens
uugcacuguaauuuauuuaugu

SEQ ID NO: 267566 - RNA, 22 nt, Homo sapiens
uugcagagaaauuucugguuua

SEQ ID NO: 267567 - RNA, 22 nt, Homo sapiens
uugcagcaaauaggaaugagga

SEQ ID NO: 267568 - RNA, 19 nt, Homo sapiens
uugcauauguugaaccagg

SEQ ID NO: 267569 - RNA, 22 nt, Homo sapiens
uugcaugggagcugggugaagc

SEQ ID NO: 267570 - RNA, 22 nt, Homo sapiens
ucaguagagacaggauuucacc

SEQ ID NO: 267571 - RNA, 22 nt, Homo sapiens
ucagucauguuuaccagacgua

SEQ ID NO: 267572 - RNA, 22 nt, Homo sapiens
ucaguccccucgcugagucuac

SEQ ID NO: 267573 - RNA, 22 nt, Homo sapiens
ucagugaauauauaacagcgau

SEQ ID NO: 267574 - RNA, 20 nt, Homo sapiens
ucagugauugguuuaguuau

SEQ ID NO: 267575 - RNA, 20 nt, Homo sapiens
ucagugcagauuguccaagu

SEQ ID NO: 267576 - RNA, 22 nt, Homo sapiens
ucagugcaggaaucucuagcca

SEQ ID NO: 267577 - RNA, 17 nt, Homo sapiens
ucagugcauuuaagaga

SEQ ID NO: 267578 - RNA, 22 nt, Homo sapiens
ucagugucugcauucuuauugu

SEQ ID NO: 267579 - RNA, 22 nt, Homo sapiens
ucagugucugugauggagaggu

SEQ ID NO: 267580 - RNA, 22 nt, Homo sapiens
ucaguuuguauuucagguugca

SEQ ID NO: 267581 - RNA, 21 nt, Homo sapiens
ucauaagcucaacaucuguag

SEQ ID NO: 267582 - RNA, 22 nt, Homo sapiens
ucauacgucuccuugugccacc

SEQ ID NO: 267583 - RNA, 22 nt, Homo sapiens
ucauacuguccaauucuagugg

SEQ ID NO: 267584 - RNA, 18 nt, Homo sapiens
ucauagaucaugacagug

SEQ ID NO: 267585 - RNA, 22 nt, Homo sapiens
ucauaggucugagaagaaaaua

SEQ ID NO: 267586 - RNA, 16 nt, Homo sapiens
ucauaguaucucuucu

SEQ ID NO: 267587 - RNA, 16 nt, Homo sapiens
ucaucacagucucugg

SEQ ID NO: 267588 - RNA, 22 nt, Homo sapiens
ucaucagaguuuacaagcucag

SEQ ID NO: 267589 - RNA, 22 nt, Homo sapiens
ucaucagugcuugcaaauuauu

SEQ ID NO: 267590 - RNA, 22 nt, Homo sapiens
ucaucaguggggaugugguuga

SEQ ID NO: 267591 - RNA, 22 nt, Homo sapiens
ucaucaguuuuuuauaugugau

SEQ ID NO: 267592 - RNA, 22 nt, Homo sapiens
ucauggcacugaugagaguuuc

SEQ ID NO: 267593 - RNA, 22 nt, Homo sapiens
ucaugggagcccccaucaugag

SEQ ID NO: 267594 - RNA, 22 nt, Homo sapiens
ucauggggugagcuacaggcac

SEQ ID NO: 267595 - RNA, 22 nt, Homo sapiens
ucauguaauuuugugucuauga

SEQ ID NO: 267596 - RNA, 22 nt, Homo sapiens
ucaugugagcacagagcaagau

SEQ ID NO: 267597 - RNA, 22 nt, Homo sapiens
ucauguguugcacugaggaccu

SEQ ID NO: 267598 - RNA, 22 nt, Homo sapiens
ucauugcaaucucugccucccg

SEQ ID NO: 267599 - RNA, 22 nt, Homo sapiens
ucauuguccaacuucuuucagu

SEQ ID NO: 267600 - RNA, 22 nt, Homo sapiens
uccacagugguggaauuguuca

SEQ ID NO: 267601 - RNA, 22 nt, Homo sapiens
uccacagugguugaacuaguaa

SEQ ID NO: 267602 - RNA, 22 nt, Homo sapiens
uccagcuuuuucuaauucugug

SEQ ID NO: 267603 - RNA, 22 nt, Homo sapiens
uccagguacucagggggcugag

SEQ ID NO: 267604 - RNA, 22 nt, Homo sapiens
uccagguuucaugcucuuuauu

SEQ ID NO: 267605 - RNA, 22 nt, Homo sapiens
augcacaguccagcccaugugg

SEQ ID NO: 267606 - RNA, 22 nt, Homo sapiens
augcacaucagcuccagggacc

SEQ ID NO: 267607 - RNA, 22 nt, Homo sapiens
augcacauggcuaacuuuuuuc

SEQ ID NO: 267608 - RNA, 22 nt, Homo sapiens
augcacuguauaggaucuugcg

SEQ ID NO: 267609 - RNA, 22 nt, Homo sapiens
augcagagaaaucuaaaauaug

SEQ ID NO: 267610 - RNA, 22 nt, Homo sapiens
augcauauuccugggccucacu

SEQ ID NO: 267611 - RNA, 22 nt, Homo sapiens
augccacagaaauaaccaaaau

SEQ ID NO: 267612 - RNA, 22 nt, Homo sapiens
augccacugcacuucagccugc

SEQ ID NO: 267613 - RNA, 22 nt, Homo sapiens
augccacuguuuaugucacuua

SEQ ID NO: 267614 - RNA, 22 nt, Homo sapiens
augcccauuuguuuucugaaag

SEQ ID NO: 267615 - RNA, 19 nt, Homo sapiens
augccucaguuuuguacuu

SEQ ID NO: 267616 - RNA, 22 nt, Homo sapiens
augccucugacaauuggauucu

SEQ ID NO: 267617 - RNA, 22 nt, Homo sapiens
augcuacugaccccuacuuaca

SEQ ID NO: 267618 - RNA, 22 nt, Homo sapiens
augcuacuggacaauggugacu

SEQ ID NO: 267619 - RNA, 22 nt, Homo sapiens
augcuacuggauuuguauaaau

SEQ ID NO: 267620 - RNA, 22 nt, Homo sapiens
auggaagaauugucggggaugu

SEQ ID NO: 267621 - RNA, 22 nt, Homo sapiens
auggaaggagaggaaugaauga

SEQ ID NO: 267622 - RNA, 22 nt, Homo sapiens
auggaagucucuguuaaguuuc

SEQ ID NO: 267623 - RNA, 22 nt, Homo sapiens
auggaaucauccuccugggagc

SEQ ID NO: 267624 - RNA, 22 nt, Homo sapiens
auggaauggcacuuugaagauu

SEQ ID NO: 267625 - RNA, 22 nt, Homo sapiens
auggaaugguugggucauaagg

SEQ ID NO: 267626 - RNA, 22 nt, Homo sapiens
auggaauguaaguuauguuugc

SEQ ID NO: 267627 - RNA, 22 nt, Homo sapiens
auggaauguggaaugguaagua

SEQ ID NO: 267628 - RNA, 22 nt, Homo sapiens
auggacagaaaaaaauagaugu

SEQ ID NO: 267629 - RNA, 22 nt, Homo sapiens
auggagguguggggagugaguu

SEQ ID NO: 267630 - RNA, 22 nt, Homo sapiens
auggagugagaauggagguucc

SEQ ID NO: 267631 - RNA, 22 nt, Homo sapiens
auggaguguggaacugggaauc

SEQ ID NO: 267632 - RNA, 22 nt, Homo sapiens
auggaguguucugaauccuuug

SEQ ID NO: 267633 - RNA, 22 nt, Homo sapiens
auggaucauauucuugaggagg

SEQ ID NO: 267634 - RNA, 22 nt, Homo sapiens
auggauguucuagggaugugau

SEQ ID NO: 267635 - RNA, 22 nt, Homo sapiens
auggcaagaagagcaauuauuu

SEQ ID NO: 267636 - RNA, 22 nt, Homo sapiens
auggcaaugcgaugaugacuga

SEQ ID NO: 267637 - RNA, 22 nt, Homo sapiens
auggcaauguaagucagaaaaa

SEQ ID NO: 267638 - RNA, 22 nt, Homo sapiens
auggcacucaaucaaguugaga

SEQ ID NO: 267639 - RNA, 22 nt, Homo sapiens
auggcacuuuggacugcuagau

SEQ ID NO: 267640 - RNA, 22 nt, Homo sapiens
auggcagagucagaaagucagg

SEQ ID NO: 267641 - RNA, 22 nt, Homo sapiens
auggcagcugacacuuccgucu

SEQ ID NO: 267642 - RNA, 22 nt, Homo sapiens
auggcagcugguuuuacccuag

SEQ ID NO: 267643 - RNA, 22 nt, Homo sapiens
auggcaguuucagcuauaguuu

SEQ ID NO: 267644 - RNA, 22 nt, Homo sapiens
auggcccaguuugcuaucccua

SEQ ID NO: 267645 - RNA, 20 nt, Homo sapiens
auggcccugcugggaguguc

SEQ ID NO: 267646 - RNA, 22 nt, Homo sapiens
auggcccuguguggagcugcug

SEQ ID NO: 267647 - RNA, 22 nt, Homo sapiens
auggccgggugcgguggcucac

SEQ ID NO: 267648 - RNA, 22 nt, Homo sapiens
auggcucaguguguaucuauca

SEQ ID NO: 267649 - RNA, 22 nt, Homo sapiens
auggcucuguuuuuuaugcucu

SEQ ID NO: 267650 - RNA, 22 nt, Homo sapiens
auggcuguuccugggaguucua

SEQ ID NO: 267651 - RNA, 22 nt, Homo sapiens
auggcuguuucugcaaugucua

SEQ ID NO: 267652 - RNA, 22 nt, Homo sapiens
auggcuucuuacucuucugcau

SEQ ID NO: 267653 - RNA, 22 nt, Homo sapiens
auggcuuuugaccugguaggau

SEQ ID NO: 267654 - RNA, 22 nt, Homo sapiens
auggcuuuuuucuugggcacuc

SEQ ID NO: 267655 - RNA, 22 nt, Homo sapiens
augggacugggugccguggagc

SEQ ID NO: 267656 - RNA, 22 nt, Homo sapiens
augggauaguaucaguggaaua

SEQ ID NO: 267657 - RNA, 22 nt, Homo sapiens
augggucuccugaauacagcac

SEQ ID NO: 267658 - RNA, 22 nt, Homo sapiens
augggugaguaugaguugacuu

SEQ ID NO: 267659 - RNA, 22 nt, Homo sapiens
augguacuggguaaaagugggg

SEQ ID NO: 267660 - RNA, 22 nt, Homo sapiens
gccaacauggcgcuccauucuu

SEQ ID NO: 267661 - RNA, 22 nt, Homo sapiens
gccaagauuuaauucaucaguu

SEQ ID NO: 267662 - RNA, 19 nt, Homo sapiens
gccaccuggugcguguucu

SEQ ID NO: 267663 - RNA, 22 nt, Homo sapiens
gccccgggugaugcagccguca

SEQ ID NO: 267664 - RNA, 22 nt, Homo sapiens
gcccuguugcccaggcuggagu

SEQ ID NO: 267665 - RNA, 22 nt, Homo sapiens
gcccuuugugucuggcuggggu

SEQ ID NO: 267666 - RNA, 22 nt, Homo sapiens
gccucaguuguggccagggauu

SEQ ID NO: 267667 - RNA, 22 nt, Homo sapiens
gcgguagcauagacugcaggac

SEQ ID NO: 267668 - RNA, 22 nt, Homo sapiens
gcuccuuugaguagcuucugug

SEQ ID NO: 267669 - RNA, 22 nt, Homo sapiens
gcugauguuggccucugggcuu

SEQ ID NO: 267670 - RNA, 17 nt, Homo sapiens
gcugauguuugcauuuu

SEQ ID NO: 267671 - RNA, 22 nt, Homo sapiens
gcugcuguuuaguuucuccugg

SEQ ID NO: 267672 - RNA, 22 nt, Homo sapiens
gcuggucugccguaguaggugc

SEQ ID NO: 267673 - RNA, 18 nt, Homo sapiens
uuagaugguuuuaaaacu

SEQ ID NO: 267674 - RNA, 22 nt, Homo sapiens
uuagauguuuagaagugggcca

SEQ ID NO: 267675 - RNA, 22 nt, Homo sapiens
uuagauguuugacugggccuua

SEQ ID NO: 267676 - RNA, 22 nt, Homo sapiens
uuagcaauagccugcaucugca

SEQ ID NO: 267677 - RNA, 22 nt, Homo sapiens
uuagcaauugauucucauaagc

SEQ ID NO: 267678 - RNA, 22 nt, Homo sapiens
uuaggacacuguggguggguca

SEQ ID NO: 267679 - RNA, 22 nt, Homo sapiens
uuaggaucacagaaaauccucu

SEQ ID NO: 267680 - RNA, 22 nt, Homo sapiens
uuagggaguaaucuaaaaaugg

SEQ ID NO: 267681 - RNA, 22 nt, Homo sapiens
uuagguaauauauugcugcuuu

SEQ ID NO: 267682 - RNA, 22 nt, Homo sapiens
uuaggugguacacagccccagu

SEQ ID NO: 267683 - RNA, 22 nt, Homo sapiens
uuaguaguagcugcaugucagu

SEQ ID NO: 267684 - RNA, 22 nt, Homo sapiens
uuaguaguagugcuguaauuuu

SEQ ID NO: 267685 - RNA, 22 nt, Homo sapiens
uuagugcugaguggaauguucu

SEQ ID NO: 267686 - RNA, 22 nt, Homo sapiens
uuauaaacaugaagauuugggg

SEQ ID NO: 267687 - RNA, 22 nt, Homo sapiens
uuauaacagagacuccugugcu

SEQ ID NO: 267688 - RNA, 20 nt, Homo sapiens
uuauaacuuuuguucugggg

SEQ ID NO: 267689 - RNA, 22 nt, Homo sapiens
uuauacucgucugaaugauucu

SEQ ID NO: 267690 - RNA, 21 nt, Homo sapiens
uuauaguggcaugauuuauaa

SEQ ID NO: 267691 - RNA, 22 nt, Homo sapiens
uuaucaaacccuaggagguggu

SEQ ID NO: 267692 - RNA, 22 nt, Homo sapiens
uuaucacauugacugauuugca

SEQ ID NO: 267693 - RNA, 22 nt, Homo sapiens
uuaucagcagcaugaaaauaga

SEQ ID NO: 267694 - RNA, 22 nt, Homo sapiens
uuauggccauucuuguaggagu

SEQ ID NO: 267695 - RNA, 22 nt, Homo sapiens
uuauggcuauugaugacaauug

SEQ ID NO: 267696 - RNA, 22 nt, Homo sapiens
uuaugucacuguucagucuccc

SEQ ID NO: 267697 - RNA, 22 nt, Homo sapiens
uuauuagagauauuugguuagg

SEQ ID NO: 267698 - RNA, 22 nt, Homo sapiens
uuauucagcaccugcuguguuc

SEQ ID NO: 267699 - RNA, 22 nt, Homo sapiens
uuauugcacuccagccugggua

SEQ ID NO: 267700 - RNA, 22 nt, Homo sapiens
uucaaaguaaaaauguguucac

SEQ ID NO: 267701 - RNA, 22 nt, Homo sapiens
uucaaaucuucguuuugccaua

SEQ ID NO: 267702 - RNA, 22 nt, Homo sapiens
uucaaaucuuuggcucccacua

SEQ ID NO: 267703 - RNA, 22 nt, Homo sapiens
uucaagauggccccagugagcc

SEQ ID NO: 267704 - RNA, 22 nt, Homo sapiens
uucaaguaagaaagacaucagg

SEQ ID NO: 267705 - RNA, 22 nt, Homo sapiens
uucaagucaacaagcacuugag

SEQ ID NO: 267706 - RNA, 22 nt, Homo sapiens
uucaagucuuggcuuugccacc

SEQ ID NO: 267707 - RNA, 20 nt, Homo sapiens
uucaagugauucucaugccu

SEQ ID NO: 267708 - RNA, 22 nt, Homo sapiens
uucaauuaauauuauacucuca

SEQ ID NO: 267709 - RNA, 21 nt, Homo sapiens
uucacaagggaaguagggggc

SEQ ID NO: 267710 - RNA, 22 nt, Homo sapiens
uucacaaugccuuguugauggu

SEQ ID NO: 267711 - RNA, 22 nt, Homo sapiens
uucacacugggccuacucugug

SEQ ID NO: 267712 - RNA, 22 nt, Homo sapiens
uucacagccgcaccccaucacu

SEQ ID NO: 267713 - RNA, 20 nt, Homo sapiens
uucacaggcagcuucuuucu

SEQ ID NO: 267714 - RNA, 22 nt, Homo sapiens
uucacagucacccuucuccaug

SEQ ID NO: 267715 - RNA, 22 nt, Homo sapiens
uucacagugugaucuaugggca

SEQ ID NO: 267716 - RNA, 22 nt, Homo sapiens
uucacaguguguacaccagggg

SEQ ID NO: 267717 - RNA, 22 nt, Homo sapiens
uucaccaguuuugucacgaaug

SEQ ID NO: 267718 - RNA, 22 nt, Homo sapiens
uucaccuugcccacagcagucu

SEQ ID NO: 267719 - RNA, 22 nt, Homo sapiens
uucacgguguucacgggggucc

SEQ ID NO: 267720 - RNA, 22 nt, Homo sapiens
uucacuguagcuuggauguuua

SEQ ID NO: 267721 - RNA, 22 nt, Homo sapiens
uucagagugaggcucucggaac

SEQ ID NO: 267722 - RNA, 20 nt, Homo sapiens
uucagcaaaggaaugggagu

SEQ ID NO: 267723 - RNA, 19 nt, Homo sapiens
uucagcagugucugcucuu

SEQ ID NO: 267724 - RNA, 22 nt, Homo sapiens
uucagggacuuuagacaagaga

SEQ ID NO: 267725 - RNA, 22 nt, Homo sapiens
uucagggagaaggcaaacguug

SEQ ID NO: 267726 - RNA, 22 nt, Homo sapiens
uucaggguggagaguaugaggu

SEQ ID NO: 267727 - RNA, 22 nt, Homo sapiens
uucagguacuauaggcuguugg

SEQ ID NO: 267728 - RNA, 22 nt, Homo sapiens
uucaguagucuccauagaaccg

SEQ ID NO: 267729 - RNA, 22 nt, Homo sapiens
uucaguggacuuaguagugcuu

SEQ ID NO: 267730 - RNA, 22 nt, Homo sapiens
uucagugguuauuugugagauu

SEQ ID NO: 267731 - RNA, 22 nt, Homo sapiens
uucaguucugcacugaucuuag

SEQ ID NO: 267732 - RNA, 18 nt, Homo sapiens
uucaguuuguaucugggg

SEQ ID NO: 267733 - RNA, 22 nt, Homo sapiens
uucauaguaacaguaacuaugg

SEQ ID NO: 267734 - RNA, 22 nt, Homo sapiens
uucauagucuaauuuuuuccac

SEQ ID NO: 267735 - RNA, 22 nt, Homo sapiens
uucaucaggaauauugaccugu

SEQ ID NO: 267736 - RNA, 22 nt, Homo sapiens
uucauccccuccaaaucucaug

SEQ ID NO: 267737 - RNA, 22 nt, Homo sapiens
uucaugcaucuguagugguuaa

SEQ ID NO: 267738 - RNA, 22 nt, Homo sapiens
uucauggaugcauuugaggggu

SEQ ID NO: 267739 - RNA, 22 nt, Homo sapiens
uucauguaauauauuucaggcc

SEQ ID NO: 267740 - RNA, 22 nt, Homo sapiens
uucauguagucaucauccugcu

SEQ ID NO: 267741 - RNA, 22 nt, Homo sapiens
uucaugucuuggcuguuagagu

SEQ ID NO: 267742 - RNA, 22 nt, Homo sapiens
uuccacaaugguugaacuagcu

SEQ ID NO: 267743 - RNA, 22 nt, Homo sapiens
uuccacgugaaguauucuaaag

SEQ ID NO: 267744 - RNA, 22 nt, Homo sapiens
uuccagcugggggcaacucugc

SEQ ID NO: 267745 - RNA, 22 nt, Homo sapiens
uuccaguggacuacuucauccu

SEQ ID NO: 267746 - RNA, 22 nt, Homo sapiens
uuccaguggaguaaauggacaa

SEQ ID NO: 267747 - RNA, 22 nt, Homo sapiens
uuccauguaguugaacgguuuu

SEQ ID NO: 267748 - RNA, 22 nt, Homo sapiens
uucccuagaacacauggaggga

SEQ ID NO: 267749 - RNA, 22 nt, Homo sapiens
uucccugaaguguuacucuaga

SEQ ID NO: 267750 - RNA, 22 nt, Homo sapiens
augaauccauuccugccacaga

SEQ ID NO: 267751 - RNA, 22 nt, Homo sapiens
augaaugcuuuuggauguaucu

SEQ ID NO: 267752 - RNA, 22 nt, Homo sapiens
augacaagagccuucuuuccuu

SEQ ID NO: 267753 - RNA, 22 nt, Homo sapiens
augacaaugaaucccuguuuca

SEQ ID NO: 267754 - RNA, 22 nt, Homo sapiens
augacagcaucugugaaguugu

SEQ ID NO: 267755 - RNA, 22 nt, Homo sapiens
augacaguguggauuauuguaa

SEQ ID NO: 267756 - RNA, 22 nt, Homo sapiens
augaccaugauccuugccgacc

SEQ ID NO: 267757 - RNA, 22 nt, Homo sapiens
augagaacauaucaagugauug

SEQ ID NO: 267758 - RNA, 22 nt, Homo sapiens
augagaauguaaguuaaugaaa

SEQ ID NO: 267759 - RNA, 22 nt, Homo sapiens
augagacuagaagagaauaaua

SEQ ID NO: 267760 - RNA, 22 nt, Homo sapiens
augagauaaaccaucucuuaag

SEQ ID NO: 267761 - RNA, 22 nt, Homo sapiens
augagauuguuugugugaaaua

SEQ ID NO: 267762 - RNA, 22 nt, Homo sapiens
augagcuauggagacagggcca

SEQ ID NO: 267763 - RNA, 17 nt, Homo sapiens
augagcucaucauuuuu

SEQ ID NO: 267764 - RNA, 22 nt, Homo sapiens
augaggaagucaggcccagggg

SEQ ID NO: 267765 - RNA, 22 nt, Homo sapiens
augagguaauaaguccuuggaa

SEQ ID NO: 267766 - RNA, 22 nt, Homo sapiens
augagguaguagaaagucaggu

SEQ ID NO: 267767 - RNA, 22 nt, Homo sapiens
augagguauccaagcccagaaa

SEQ ID NO: 267768 - RNA, 22 nt, Homo sapiens
ugaucaaagugcuggaauuaca

SEQ ID NO: 267769 - RNA, 22 nt, Homo sapiens
ugaucacagcuugacuaaagga

SEQ ID NO: 267770 - RNA, 22 nt, Homo sapiens
ugaugacauugucacagucuga

SEQ ID NO: 267771 - RNA, 22 nt, Homo sapiens
ugauggcauuucauguuuguaa

SEQ ID NO: 267772 - RNA, 20 nt, Homo sapiens
ugauugaccagagcaguuuu

SEQ ID NO: 267773 - RNA, 22 nt, Homo sapiens
ugcaaauguuaguaacaccacu

SEQ ID NO: 267774 - RNA, 22 nt, Homo sapiens
ugcaagaaacauauuccacaag

SEQ ID NO: 267775 - RNA, 21 nt, Homo sapiens
ugcaagaaucaggaagcugcc

SEQ ID NO: 267776 - RNA, 22 nt, Homo sapiens
ugcaagcacacccagggauugu

SEQ ID NO: 267777 - RNA, 17 nt, Homo sapiens
ugcaauuuaagcuagau

SEQ ID NO: 267778 - RNA, 22 nt, Homo sapiens
ugcaccacugcacuccacccug

SEQ ID NO: 267779 - RNA, 22 nt, Homo sapiens
ugcaccacugcuagccugggua

SEQ ID NO: 267780 - RNA, 22 nt, Homo sapiens
ugcagagucuguccugccugcc

SEQ ID NO: 267781 - RNA, 23 nt, Homo sapiens
ugcagcacacugaugggucuuga

SEQ ID NO: 267782 - RNA, 22 nt, Homo sapiens
ugcagcacaguagguuugcaau

SEQ ID NO: 267783 - RNA, 22 nt, Homo sapiens
ugcagcucagcugcggaguuuu

SEQ ID NO: 267784 - RNA, 18 nt, Homo sapiens
ugcagcuuugugauuggc

SEQ ID NO: 267785 - RNA, 22 nt, Homo sapiens
ugcaguacauucagcauccucu

SEQ ID NO: 267786 - RNA, 22 nt, Homo sapiens
ugcaguacuuugaaauauacug

SEQ ID NO: 267787 - RNA, 20 nt, Homo sapiens
ugcaguguccucacuuguca

SEQ ID NO: 267788 - RNA, 22 nt, Homo sapiens
ugcaguuuaggaacugguaaca

SEQ ID NO: 267789 - RNA, 22 nt, Homo sapiens
ugcauacacaagcauacaugua

SEQ ID NO: 267790 - RNA, 22 nt, Homo sapiens
ugcauaucuucuuuugagaaau

SEQ ID NO: 267791 - RNA, 22 nt, Homo sapiens
ugcauauguauacaugugccau

SEQ ID NO: 267792 - RNA, 22 nt, Homo sapiens
ugcauaugucuuuauaguagca

SEQ ID NO: 267793 - RNA, 22 nt, Homo sapiens
ugcauauguugagaugcauauu

SEQ ID NO: 267794 - RNA, 22 nt, Homo sapiens
ugcauauuuuauaaagauggaa

SEQ ID NO: 267795 - RNA, 21 nt, Homo sapiens
ugcauggagaacacugagggu

SEQ ID NO: 267796 - RNA, 20 nt, Homo sapiens
ugcauguccucacuuacuug

SEQ ID NO: 267797 - RNA, 22 nt, Homo sapiens
ugcauuagucuguucucacacu

SEQ ID NO: 267798 - RNA, 21 nt, Homo sapiens
ugcauugucuugaguuuaaau

SEQ ID NO: 267799 - RNA, 21 nt, Homo sapiens
ugcauuguugcugagagcagg

SEQ ID NO: 267800 - RNA, 19 nt, Homo sapiens
ugccaagaaagucagcuua

SEQ ID NO: 267801 - RNA, 22 nt, Homo sapiens
ugccaagaacauuuucuguuuu

SEQ ID NO: 267802 - RNA, 20 nt, Homo sapiens
ugccaagaugacuauagcuc

SEQ ID NO: 267803 - RNA, 22 nt, Homo sapiens
ugccagagacguagggaauauu

SEQ ID NO: 267804 - RNA, 22 nt, Homo sapiens
ugccagaugcaguguucaacaa

SEQ ID NO: 267805 - RNA, 22 nt, Homo sapiens
ugccauagagauuuguggaacu

SEQ ID NO: 267806 - RNA, 22 nt, Homo sapiens
ugccaugucauagguuaagccu

SEQ ID NO: 267807 - RNA, 22 nt, Homo sapiens
ugccauugcacuccagccuggg

SEQ ID NO: 267808 - RNA, 22 nt, Homo sapiens
ugccuagaaacacuauuucucc

SEQ ID NO: 267809 - RNA, 22 nt, Homo sapiens
ugccuaggcuggagugcagugg

SEQ ID NO: 267810 - RNA, 22 nt, Homo sapiens
ugccuaggcuggaguguagugg

SEQ ID NO: 267811 - RNA, 21 nt, Homo sapiens
ugccuuuguaguaggugucuu

SEQ ID NO: 267812 - RNA, 22 nt, Homo sapiens
ugcucaguuuaaaacuuuugag

SEQ ID NO: 267813 - RNA, 21 nt, Homo sapiens
ugcucaugaguaaugcaguga

SEQ ID NO: 267814 - RNA, 23 nt, Homo sapiens
ugcuccccucauggaugaauaaa

SEQ ID NO: 267815 - RNA, 22 nt, Homo sapiens
ugcuggcguuacucuccaucag

SEQ ID NO: 267816 - RNA, 22 nt, Homo sapiens
ugcuggugauucagauucaaau

SEQ ID NO: 267817 - RNA, 22 nt, Homo sapiens
ugcuguguugcuggcuuaaaga

SEQ ID NO: 267818 - RNA, 21 nt, Homo sapiens
ugcuuacugaauguuaauuuc

SEQ ID NO: 267819 - RNA, 22 nt, Homo sapiens
ugcuuaguguugacccucugcc

SEQ ID NO: 267820 - RNA, 19 nt, Homo sapiens
ugcuuaguuuuauguguaa

SEQ ID NO: 267821 - RNA, 20 nt, Homo sapiens
uggaaaguaagucaugauau

SEQ ID NO: 267822 - RNA, 22 nt, Homo sapiens
uggaaaguacugagguccaccu

SEQ ID NO: 267823 - RNA, 22 nt, Homo sapiens
uggaaauaaaugugccaagauc

SEQ ID NO: 267824 - RNA, 22 nt, Homo sapiens
uggaaauuaagucuuuccugag

SEQ ID NO: 267825 - RNA, 22 nt, Homo sapiens
uggaacacaucuaaggaagcag

SEQ ID NO: 267826 - RNA, 22 nt, Homo sapiens
uggaacaccaggcuggcguggc

SEQ ID NO: 267827 - RNA, 22 nt, Homo sapiens
uggaagguaaguuuugagcauu

SEQ ID NO: 267828 - RNA, 22 nt, Homo sapiens
uggaaguaaccaugaauggaau

SEQ ID NO: 267829 - RNA, 22 nt, Homo sapiens
uggaaguaaucaugagguagca

SEQ ID NO: 267830 - RNA, 22 nt, Homo sapiens
uggaagugucugugcccagcuc

SEQ ID NO: 267831 - RNA, 22 nt, Homo sapiens
uggaaguuaaaugacucuuucu

SEQ ID NO: 267832 - RNA, 22 nt, Homo sapiens
uggaaguuaaauuaguugauga

SEQ ID NO: 267833 - RNA, 22 nt, Homo sapiens
uggaaucaucaacgaaugaaau

SEQ ID NO: 267834 - RNA, 20 nt, Homo sapiens
uggaaucuaggcggagguuu

SEQ ID NO: 267835 - RNA, 21 nt, Homo sapiens
uggaaucuauagaggcaguag

SEQ ID NO: 267836 - RNA, 22 nt, Homo sapiens
uggaaucuuaggugaaggcuuu

SEQ ID NO: 267837 - RNA, 19 nt, Homo sapiens
uggaauggauuuaaaugug

SEQ ID NO: 267838 - RNA, 22 nt, Homo sapiens
cacugcgaccuccaccucccgg

SEQ ID NO: 267839 - RNA, 22 nt, Homo sapiens
cacugcgaccucugccuaccgg

SEQ ID NO: 267840 - RNA, 22 nt, Homo sapiens
cacugcgacguccgccucccgg

SEQ ID NO: 267841 - RNA, 22 nt, Homo sapiens
cacugggugagauccauguuua

SEQ ID NO: 267842 - RNA, 22 nt, Homo sapiens
cacugggugccauauguuugcu

SEQ ID NO: 267843 - RNA, 22 nt, Homo sapiens
cacuggucagugaaacaguauu

SEQ ID NO: 267844 - RNA, 22 nt, Homo sapiens
cacuguggauggaacuauguga

SEQ ID NO: 267845 - RNA, 22 nt, Homo sapiens
cagaaguauugguaugcucugu

SEQ ID NO: 267846 - RNA, 22 nt, Homo sapiens
cagacaugucuuguggccgugg

SEQ ID NO: 267847 - RNA, 22 nt, Homo sapiens
cagagaaugucuuuuuuaacca

SEQ ID NO: 267848 - RNA, 22 nt, Homo sapiens
cagagagcuugcccuuguauau

SEQ ID NO: 267849 - RNA, 22 nt, Homo sapiens
cagagaucaugcaacugcucgc

SEQ ID NO: 267850 - RNA, 22 nt, Homo sapiens
cagagcaaugcuuuugcuuuga

SEQ ID NO: 267851 - RNA, 22 nt, Homo sapiens
cagagcacuaaagguaaaaggc

SEQ ID NO: 267852 - RNA, 22 nt, Homo sapiens
cagauacuccuggucucaggag

SEQ ID NO: 267853 - RNA, 22 nt, Homo sapiens
cagauacuggccuggagcugug

SEQ ID NO: 267854 - RNA, 22 nt, Homo sapiens
cagauaguuguagauaugcagc

SEQ ID NO: 267855 - RNA, 22 nt, Homo sapiens
cagauggucuuaaggcagccuu

SEQ ID NO: 267856 - RNA, 20 nt, Homo sapiens
cagcacgcacaugagacugu

SEQ ID NO: 267857 - RNA, 22 nt, Homo sapiens
cagcccguaaucccagcacuuu

SEQ ID NO: 267858 - RNA, 22 nt, Homo sapiens
cagccggguggcuccuagggua

SEQ ID NO: 267859 - RNA, 22 nt, Homo sapiens
cagcuggugcugcaccaguggg

SEQ ID NO: 267860 - RNA, 22 nt, Homo sapiens
cagcugguggcaagaagacaga

SEQ ID NO: 267861 - RNA, 22 nt, Homo sapiens
cagcuguuguuaugucugcagg

SEQ ID NO: 267862 - RNA, 22 nt, Homo sapiens
cagcuguuguugggguauagga

SEQ ID NO: 267863 - RNA, 23 nt, Homo sapiens
cagcuucauugaacauaacuccu

SEQ ID NO: 267864 - RNA, 22 nt, Homo sapiens
guuuaacugguacuucaagucu

SEQ ID NO: 267865 - RNA, 22 nt, Homo sapiens
guuuugguuauauggaucaguu

SEQ ID NO: 267866 - RNA, 21 nt, Homo sapiens
uaaaacuguaacuuuguccug

SEQ ID NO: 267867 - RNA, 22 nt, Homo sapiens
uaaagcacaaguaaagaauacu

SEQ ID NO: 267868 - RNA, 22 nt, Homo sapiens
uaaagcauguaauuagguuaga

SEQ ID NO: 267869 - RNA, 17 nt, Homo sapiens
uaaagccagucaaguca

SEQ ID NO: 267870 - RNA, 21 nt, Homo sapiens
uaaagcuagaaccuuagcuuu

SEQ ID NO: 267871 - RNA, 20 nt, Homo sapiens
uaaaugccucaugcuuuauu

SEQ ID NO: 267872 - RNA, 22 nt, Homo sapiens
uaaaugcuugagaugauggaua

SEQ ID NO: 267873 - RNA, 22 nt, Homo sapiens
uaacaaugucuuaugggcuuaa

SEQ ID NO: 267874 - RNA, 21 nt, Homo sapiens
uaacagcuccacuccauucuc

SEQ ID NO: 267875 - RNA, 22 nt, Homo sapiens
uaacaggcuacucuugcauugc

SEQ ID NO: 267876 - RNA, 22 nt, Homo sapiens
uaacaguauaugugguaucuau

SEQ ID NO: 267877 - RNA, 22 nt, Homo sapiens
uaacaguguauuuacuacuucc

SEQ ID NO: 267878 - RNA, 22 nt, Homo sapiens
uaacauugucuugcuuaguuuu

SEQ ID NO: 267879 - RNA, 22 nt, Homo sapiens
uaacuaaagagaagucaauguc

SEQ ID NO: 267880 - RNA, 22 nt, Homo sapiens
uaacuagaaaggagacaguugc

SEQ ID NO: 267881 - RNA, 18 nt, Homo sapiens
uaacuggugugagauggu

SEQ ID NO: 267882 - RNA, 22 nt, Homo sapiens
uaagcaguaaaugaagucuugc

SEQ ID NO: 267883 - RNA, 22 nt, Homo sapiens
uaagcagugcaagaauggaaua

SEQ ID NO: 267884 - RNA, 20 nt, Homo sapiens
uaagccacacagucuaaggu

SEQ ID NO: 267885 - RNA, 21 nt, Homo sapiens
uaagcuaaacauucaguuaac

SEQ ID NO: 267886 - RNA, 22 nt, Homo sapiens
uaagcuguguggacuaugccuc

SEQ ID NO: 267887 - RNA, 22 nt, Homo sapiens
uaaggaaggcugugugcuuuua

SEQ ID NO: 267888 - RNA, 22 nt, Homo sapiens
uaaggaguagaauaguaaggca

SEQ ID NO: 267889 - RNA, 20 nt, Homo sapiens
uaaggcacugugcuuuuagg

SEQ ID NO: 267890 - RNA, 22 nt, Homo sapiens
uaaggcuucuuggaauacugca

SEQ ID NO: 267891 - RNA, 22 nt, Homo sapiens
uaaggcuugaucuuggugagau

SEQ ID NO: 267892 - RNA, 22 nt, Homo sapiens
uaaggcuuugguagguuugguc

SEQ ID NO: 267893 - RNA, 22 nt, Homo sapiens
uaagguuacaaaggacuucaua

SEQ ID NO: 267894 - RNA, 22 nt, Homo sapiens
uaaguaaaugaaagguugauuu

SEQ ID NO: 267895 - RNA, 22 nt, Homo sapiens
uaagugaauauggacaguuagc

SEQ ID NO: 267896 - RNA, 22 nt, Homo sapiens
uaagugaauguuggcuacugaa

SEQ ID NO: 267897 - RNA, 22 nt, Homo sapiens
uaagugaauuucacuacugagu

SEQ ID NO: 267898 - RNA, 22 nt, Homo sapiens
uaagugcuguguuguuaccuaa

SEQ ID NO: 267899 - RNA, 22 nt, Homo sapiens
uaaguguaaugucugaaguuug

SEQ ID NO: 267900 - RNA, 22 nt, Homo sapiens
uaauaguuggcacuggagaaag

SEQ ID NO: 267901 - RNA, 22 nt, Homo sapiens
uaaucacagagguuuggccuca

SEQ ID NO: 267902 - RNA, 22 nt, Homo sapiens
uaaucucagcugagcugagauu

SEQ ID NO: 267903 - RNA, 22 nt, Homo sapiens
uaaugcacauuuauuuuaccuu

SEQ ID NO: 267904 - RNA, 22 nt, Homo sapiens
uaaugcauacagaagguguuuu

SEQ ID NO: 267905 - RNA, 22 nt, Homo sapiens
uaaugcaucagugguaguucuu

SEQ ID NO: 267906 - RNA, 22 nt, Homo sapiens
uaaugugaauagugcuguaaug

SEQ ID NO: 267907 - RNA, 22 nt, Homo sapiens
uacaaagcuuucugcaaaucau

SEQ ID NO: 267908 - RNA, 22 nt, Homo sapiens
uacagaguagaagauuugcaga

SEQ ID NO: 267909 - RNA, 23 nt, Homo sapiens
uacagcugcagaaucaggcuaag

SEQ ID NO: 267910 - RNA, 22 nt, Homo sapiens
uggcuguuuauuucacgugggu

SEQ ID NO: 267911 - RNA, 22 nt, Homo sapiens
uggcuuucuggggcuucuguuc

SEQ ID NO: 267912 - RNA, 22 nt, Homo sapiens
ugggaacaugaagguuaaagag

SEQ ID NO: 267913 - RNA, 22 nt, Homo sapiens
ugggaauaugauacaggucuuu

SEQ ID NO: 267914 - RNA, 22 nt, Homo sapiens
ugggaucagucuggaauauuga

SEQ ID NO: 267915 - RNA, 22 nt, Homo sapiens
ugggaugaauacaaugggauca

SEQ ID NO: 267916 - RNA, 22 nt, Homo sapiens
ugggaugaugaaaaggcuuucu

SEQ ID NO: 267917 - RNA, 22 nt, Homo sapiens
ugggaugaugcuugagaauauc

SEQ ID NO: 267918 - RNA, 22 nt, Homo sapiens
ugggaugauguuaaacguacuc

SEQ ID NO: 267919 - RNA, 22 nt, Homo sapiens
ugggcaaaugcuuuuuagucaa

SEQ ID NO: 267920 - RNA, 22 nt, Homo sapiens
ugggcaagagagcaugacccug

SEQ ID NO: 267921 - RNA, 22 nt, Homo sapiens
ugggcagugggacagcuuugug

SEQ ID NO: 267922 - RNA, 22 nt, Homo sapiens
ugggcauggaguggccuuaugu

SEQ ID NO: 267923 - RNA, 22 nt, Homo sapiens
uggggugugagggagaaagaaa

SEQ ID NO: 267924 - RNA, 22 nt, Homo sapiens
uggguaguguaaagcacuccag

SEQ ID NO: 267925 - RNA, 22 nt, Homo sapiens
ugggucaguagcauguaugucu

SEQ ID NO: 267926 - RNA, 23 nt, Homo sapiens
uggguucccuaagcgcaugcugc

SEQ ID NO: 267927 - RNA, 22 nt, Homo sapiens
ugguaaguuuaacaugcauccc

SEQ ID NO: 267928 - RNA, 22 nt, Homo sapiens
uggucaccuucuugcucugucu

SEQ ID NO: 267929 - RNA, 22 nt, Homo sapiens
uggucaugaggugaggcuucuc

SEQ ID NO: 267930 - RNA, 22 nt, Homo sapiens
ugguccacuaacccucaguauc

SEQ ID NO: 267931 - RNA, 22 nt, Homo sapiens
uggucguggagucccuggcuuc

SEQ ID NO: 267932 - RNA, 22 nt, Homo sapiens
uggugccgugguccuggggcca

SEQ ID NO: 267933 - RNA, 19 nt, Homo sapiens
uggugccuuguucuuggau

SEQ ID NO: 267934 - RNA, 22 nt, Homo sapiens
uggugcuuaaauaaggcuuuca

SEQ ID NO: 267935 - RNA, 22 nt, Homo sapiens
uguaaaucuauuuuuaguguuu

SEQ ID NO: 267936 - RNA, 22 nt, Homo sapiens
uguaagcauugggcaugcaguc

SEQ ID NO: 267937 - RNA, 22 nt, Homo sapiens
uguaauguuucaucauuauuaa

SEQ ID NO: 267938 - RNA, 22 nt, Homo sapiens
uguaauuuaaaugauccuugga

SEQ ID NO: 267939 - RNA, 22 nt, Homo sapiens
uguacaaaacaagaugggggua

SEQ ID NO: 267940 - RNA, 22 nt, Homo sapiens
uguacaugggacaggaggagag

SEQ ID NO: 267941 - RNA, 22 nt, Homo sapiens
uguagcaaauaaaagucuggau

SEQ ID NO: 267942 - RNA, 22 nt, Homo sapiens
uguagcagccauaaacacagug

SEQ ID NO: 267943 - RNA, 22 nt, Homo sapiens
uguauguugauguuauauucug

SEQ ID NO: 267944 - RNA, 22 nt, Homo sapiens
uguauguuguaagacuuagacc

SEQ ID NO: 267945 - RNA, 22 nt, Homo sapiens
ugucaauauguaauaacugaau

SEQ ID NO: 267946 - RNA, 22 nt, Homo sapiens
ugucacugugcagucaugcauu

SEQ ID NO: 267947 - RNA, 22 nt, Homo sapiens
ugucagggaggcucggccgcac

SEQ ID NO: 267948 - RNA, 22 nt, Homo sapiens
ugucaguuucccuccucuuccu

SEQ ID NO: 267949 - RNA, 22 nt, Homo sapiens
ugucauacaguaacaugguugg

SEQ ID NO: 267950 - RNA, 22 nt, Homo sapiens
ugucaugaacucacauucuggg

SEQ ID NO: 267951 - RNA, 22 nt, Homo sapiens
ugucauggggaaaauaacagac

SEQ ID NO: 267952 - RNA, 22 nt, Homo sapiens
ugucauggugcucugggcccug

SEQ ID NO: 267953 - RNA, 22 nt, Homo sapiens
ugucaugucaacuauggaauuu

SEQ ID NO: 267954 - RNA, 22 nt, Homo sapiens
ugucauguggcuaacgauucau

SEQ ID NO: 267955 - RNA, 20 nt, Homo sapiens
ugucauuaagcacugugcca

SEQ ID NO: 267956 - RNA, 22 nt, Homo sapiens
ugucauucaggaaauucuaagu

SEQ ID NO: 267957 - RNA, 22 nt, Homo sapiens
uguccaaaucagagguaccaaa

SEQ ID NO: 267958 - RNA, 22 nt, Homo sapiens
uguccaaauugaaucaucuggu

SEQ ID NO: 267959 - RNA, 22 nt, Homo sapiens
uguccuguaggaggcagaacaa

SEQ ID NO: 267960 - RNA, 20 nt, Homo sapiens
ugucuauggggguucucugc

SEQ ID NO: 267961 - RNA, 22 nt, Homo sapiens
ugucucccuucccauuaggaag

SEQ ID NO: 267962 - RNA, 22 nt, Homo sapiens
ugucuggaguccauagaagugu

SEQ ID NO: 267963 - RNA, 16 nt, Homo sapiens
ugucuguuugggcaca

SEQ ID NO: 267964 - RNA, 22 nt, Homo sapiens
ugucuuugguucaggcaaggag

SEQ ID NO: 267965 - RNA, 22 nt, Homo sapiens
ugugaaacauggauagaacugg

SEQ ID NO: 267966 - RNA, 22 nt, Homo sapiens
ugugaacaaaauuuguugcaua

SEQ ID NO: 267967 - RNA, 22 nt, Homo sapiens
ugugaagaaagucauugguagc

SEQ ID NO: 267968 - RNA, 19 nt, Homo sapiens
ugugaagaaaugcugcaag

SEQ ID NO: 267969 - RNA, 22 nt, Homo sapiens
ugugaauggugcugcaaugaac

SEQ ID NO: 267970 - RNA, 22 nt, Homo sapiens
ugugacagcacagcaucucuuu

SEQ ID NO: 267971 - RNA, 22 nt, Homo sapiens
ugugacaguguuacauuucaug

SEQ ID NO: 267972 - RNA, 22 nt, Homo sapiens
ugugagaaaugcagaaucucag

SEQ ID NO: 267973 - RNA, 20 nt, Homo sapiens
ugugagacugguuuugaacu

SEQ ID NO: 267974 - RNA, 22 nt, Homo sapiens
ugugaucaauuagugaugucug

SEQ ID NO: 267975 - RNA, 22 nt, Homo sapiens
ugugaugguuuagcauuuucuu

SEQ ID NO: 267976 - RNA, 22 nt, Homo sapiens
ugugauuggccuggcguggguc

SEQ ID NO: 267977 - RNA, 22 nt, Homo sapiens
ugugcaaauguuaaacuaacuu

SEQ ID NO: 267978 - RNA, 22 nt, Homo sapiens
augagaugcaagauuagauggg

SEQ ID NO: 267979 - RNA, 22 nt, Homo sapiens
augagauucuuagagaagucug

SEQ ID NO: 267980 - RNA, 22 nt, Homo sapiens
augagauuguuuguacuccaca

SEQ ID NO: 267981 - RNA, 22 nt, Homo sapiens
augagcugauuuccuuaccaua

SEQ ID NO: 267982 - RNA, 22 nt, Homo sapiens
augaggcuauaauuuuuaugua

SEQ ID NO: 267983 - RNA, 22 nt, Homo sapiens
augagggagggcaccugaccuu

SEQ ID NO: 267984 - RNA, 22 nt, Homo sapiens
augagguccuagccaacuuuuu

SEQ ID NO: 267985 - RNA, 22 nt, Homo sapiens
augaggugaggucaguaaggua

SEQ ID NO: 267986 - RNA, 22 nt, Homo sapiens
augaggugggcggcuuggaaga

SEQ ID NO: 267987 - RNA, 22 nt, Homo sapiens
augagugugaccugccaagaga

SEQ ID NO: 267988 - RNA, 22 nt, Homo sapiens
augauacuggcuucauagaaug

SEQ ID NO: 267989 - RNA, 22 nt, Homo sapiens
augauagguuuagguuuagaca

SEQ ID NO: 267990 - RNA, 22 nt, Homo sapiens
augauauuauucuagcccagag

SEQ ID NO: 267991 - RNA, 22 nt, Homo sapiens
augaucacugugccuccuguga

SEQ ID NO: 267992 - RNA, 22 nt, Homo sapiens
augaugaaguaagugcuuagga

SEQ ID NO: 267993 - RNA, 22 nt, Homo sapiens
augauggagguagauuguccau

SEQ ID NO: 267994 - RNA, 22 nt, Homo sapiens
augcauauuuuaccuagaagag

SEQ ID NO: 267995 - RNA, 22 nt, Homo sapiens
augccacugcacuucagcuugg

SEQ ID NO: 267996 - RNA, 22 nt, Homo sapiens
augccuaagacccuguggggga

SEQ ID NO: 267997 - RNA, 19 nt, Homo sapiens
augccuggagaugguuaua

SEQ ID NO: 267998 - RNA, 22 nt, Homo sapiens
augcuggugcuagaaacuggaa

SEQ ID NO: 267999 - RNA, 22 nt, Homo sapiens
augcuggugguucacaugcgca

SEQ ID NO: 268000 - RNA, 19 nt, Homo sapiens
augcugguguugcucaaac

SEQ ID NO: 268001 - RNA, 22 nt, Homo sapiens
auggaaagcuguuccuacacaa

SEQ ID NO: 268002 - RNA, 22 nt, Homo sapiens
auggaacauuauagauguaaaa

SEQ ID NO: 268003 - RNA, 20 nt, Homo sapiens
auggaacugugagccaauua

SEQ ID NO: 268004 - RNA, 22 nt, Homo sapiens
auggaagaaacgauuuucugga

SEQ ID NO: 268005 - RNA, 22 nt, Homo sapiens
auggaagcauaguauucuauug

SEQ ID NO: 268006 - RNA, 22 nt, Homo sapiens
auggacagacacuggccuucug

SEQ ID NO: 268007 - RNA, 22 nt, Homo sapiens
auggagagaauuauucucucag

SEQ ID NO: 268008 - RNA, 22 nt, Homo sapiens
auggagaugaacuuggguaaag

SEQ ID NO: 268009 - RNA, 22 nt, Homo sapiens
auggagaugaauaucaucuguu

SEQ ID NO: 268010 - RNA, 22 nt, Homo sapiens
auggagcuugacaguuguagag

SEQ ID NO: 268011 - RNA, 22 nt, Homo sapiens
auggaggacaaugucaccuuca

SEQ ID NO: 268012 - RNA, 22 nt, Homo sapiens
auggaggaggaagcugaaacaa

SEQ ID NO: 268013 - RNA, 22 nt, Homo sapiens
auggaguguaauauugagagcu

SEQ ID NO: 268014 - RNA, 22 nt, Homo sapiens
auggaguuuacuuaguguaaua

SEQ ID NO: 268015 - RNA, 22 nt, Homo sapiens
auggauuuguaguacaugguug

SEQ ID NO: 268016 - RNA, 22 nt, Homo sapiens
auggauuuuggggccagaggca

SEQ ID NO: 268017 - RNA, 22 nt, Homo sapiens
auggcacugaagcguauugaca

SEQ ID NO: 268018 - RNA, 22 nt, Homo sapiens
auggcacuguguauuuuucugu

SEQ ID NO: 268019 - RNA, 22 nt, Homo sapiens
auggcagaaucaagccgacagc

SEQ ID NO: 268020 - RNA, 22 nt, Homo sapiens
auggcagcaccccacucuacug

SEQ ID NO: 268021 - RNA, 22 nt, Homo sapiens
auggcagcccucuuuauccaug

SEQ ID NO: 268022 - RNA, 22 nt, Homo sapiens
auggcagugagucucuaguauu

SEQ ID NO: 268023 - RNA, 22 nt, Homo sapiens
auggcagugucuagggguguuu

SEQ ID NO: 268024 - RNA, 22 nt, Homo sapiens
auggcaguuucacucugggauu

SEQ ID NO: 268025 - RNA, 22 nt, Homo sapiens
auggcauggugaagucuuugga

SEQ ID NO: 268026 - RNA, 22 nt, Homo sapiens
auggcauugaagaguugucccu

SEQ ID NO: 268027 - RNA, 23 nt, Homo sapiens
auggcccuggugggagugucuuu

SEQ ID NO: 268028 - RNA, 22 nt, Homo sapiens
auggccuuguauaccuggcaaa

SEQ ID NO: 268029 - RNA, 22 nt, Homo sapiens
auggcucuggauagaaugcagg

SEQ ID NO: 268030 - RNA, 22 nt, Homo sapiens
auggcuuaagacaaccuuucau

SEQ ID NO: 268031 - RNA, 22 nt, Homo sapiens
auggcuuugggcugcucugccc

SEQ ID NO: 268032 - RNA, 22 nt, Homo sapiens
auggcuuuggucucccagugau

SEQ ID NO: 268033 - RNA, 22 nt, Homo sapiens
auggcuuuuauuguguugaggu

SEQ ID NO: 268034 - RNA, 22 nt, Homo sapiens
auggcuuuuccugucuugcaug

SEQ ID NO: 268035 - RNA, 22 nt, Homo sapiens
augggcaaauguuggaaauucc

SEQ ID NO: 268036 - RNA, 22 nt, Homo sapiens
augguuuauuuguaagcagagu

SEQ ID NO: 268037 - RNA, 22 nt, Homo sapiens
auguaacaguauuuggagaugu

SEQ ID NO: 268038 - RNA, 22 nt, Homo sapiens
auguaguagauauuuauggaaa

SEQ ID NO: 268039 - RNA, 22 nt, Homo sapiens
auguauggagauauuuuugguu

SEQ ID NO: 268040 - RNA, 20 nt, Homo sapiens
augucagaguguggguacgg

SEQ ID NO: 268041 - RNA, 22 nt, Homo sapiens
augucauagaagccugugaacc

SEQ ID NO: 268042 - RNA, 22 nt, Homo sapiens
augugaacaucauagaaugcac

SEQ ID NO: 268043 - RNA, 22 nt, Homo sapiens
augugacagugguuuuaagcgu

SEQ ID NO: 268044 - RNA, 22 nt, Homo sapiens
augugacuggaucauggggacg

SEQ ID NO: 268045 - RNA, 22 nt, Homo sapiens
augugcaagaucauuaaagcuc

SEQ ID NO: 268046 - RNA, 22 nt, Homo sapiens
augugcacaugcuuacauguga

SEQ ID NO: 268047 - RNA, 22 nt, Homo sapiens
augugcacauucugguaaauau

SEQ ID NO: 268048 - RNA, 22 nt, Homo sapiens
augugcuuauagguguauguuu

SEQ ID NO: 268049 - RNA, 22 nt, Homo sapiens
augugcuuuuggugagagauuu

SEQ ID NO: 268050 - RNA, 22 nt, Homo sapiens
auguggaaauguauaugugucu

SEQ ID NO: 268051 - RNA, 22 nt, Homo sapiens
augugggaggaauguguuucca

SEQ ID NO: 268052 - RNA, 22 nt, Homo sapiens
augugugaaucccagaaccugu

SEQ ID NO: 268053 - RNA, 22 nt, Homo sapiens
auuaaauguuggacguauacau

SEQ ID NO: 268054 - RNA, 22 nt, Homo sapiens
auuaagugcuugcagaagucca

SEQ ID NO: 268055 - RNA, 22 nt, Homo sapiens
auuacuuugcaccaaccuaaua

SEQ ID NO: 268056 - RNA, 20 nt, Homo sapiens
auuagagcuacauggcuaca

SEQ ID NO: 268057 - RNA, 22 nt, Homo sapiens
auuagguauuuguccuaaauau

SEQ ID NO: 268058 - RNA, 22 nt, Homo sapiens
auuagguauuuucuggacaggg

SEQ ID NO: 268059 - RNA, 22 nt, Homo sapiens
auuauuagucggccagcuguua

SEQ ID NO: 268060 - RNA, 22 nt, Homo sapiens
auucaagggauuucaggaggcu

SEQ ID NO: 268061 - RNA, 22 nt, Homo sapiens
auucaccauggcuaccaagggu

SEQ ID NO: 268062 - RNA, 22 nt, Homo sapiens
auucacuguggguccuuuggau

SEQ ID NO: 268063 - RNA, 22 nt, Homo sapiens
auucagaggggcagcugucuug

SEQ ID NO: 268064 - RNA, 23 nt, Homo sapiens
auuccaguggcaauuggagaaac

SEQ ID NO: 268065 - RNA, 22 nt, Homo sapiens
auuccaguuguaagguuuuuca

SEQ ID NO: 268066 - RNA, 22 nt, Homo sapiens
auuccauaguacagugaugagu

SEQ ID NO: 268067 - RNA, 22 nt, Homo sapiens
auucccuguagaauaaggaugg

SEQ ID NO: 268068 - RNA, 22 nt, Homo sapiens
gagguuauuggggugcuugugu

SEQ ID NO: 268069 - RNA, 22 nt, Homo sapiens
gagguugggaugagggauacag

SEQ ID NO: 268070 - RNA, 22 nt, Homo sapiens
gaguaaaugucaaguacuuagg

SEQ ID NO: 268071 - RNA, 22 nt, Homo sapiens
gagugcaauggcaugaucuggg

SEQ ID NO: 268072 - RNA, 22 nt, Homo sapiens
gagugcaauggcgcgaucuggg

SEQ ID NO: 268073 - RNA, 22 nt, Homo sapiens
gaguuagguugucaaugucuua

SEQ ID NO: 268074 - RNA, 22 nt, Homo sapiens
gaguuccuuugagccugagagg

SEQ ID NO: 268075 - RNA, 22 nt, Homo sapiens
gauaaaguauuggguacuaugc

SEQ ID NO: 268076 - RNA, 21 nt, Homo sapiens
gauaaguuggcagccagcacc

SEQ ID NO: 268077 - RNA, 22 nt, Homo sapiens
gauaauucuagcagauacaggc

SEQ ID NO: 268078 - RNA, 22 nt, Homo sapiens
gauauguuguuggauucgguua

SEQ ID NO: 268079 - RNA, 17 nt, Homo sapiens
gaucacagucgucuccu

SEQ ID NO: 268080 - RNA, 22 nt, Homo sapiens
gaucacauggccauuucuagcu

SEQ ID NO: 268081 - RNA, 22 nt, Homo sapiens
gaucucaguggauacugugaug

SEQ ID NO: 268082 - RNA, 22 nt, Homo sapiens
gaucugugugauuggaugcauu

SEQ ID NO: 268083 - RNA, 22 nt, Homo sapiens
gaucuguuuuccuauuguuugu

SEQ ID NO: 268084 - RNA, 22 nt, Homo sapiens
gaugagaugagcauuugaauug

SEQ ID NO: 268085 - RNA, 22 nt, Homo sapiens
gaugagauguucucauggauug

SEQ ID NO: 268086 - RNA, 22 nt, Homo sapiens
gaugauguuugauaaauaauaa

SEQ ID NO: 268087 - RNA, 22 nt, Homo sapiens
gauggaauuaaaaucagaauca

SEQ ID NO: 268088 - RNA, 22 nt, Homo sapiens
gauggcuacugauuaaauauag

SEQ ID NO: 268089 - RNA, 22 nt, Homo sapiens
gauggugucccaggcucaggcu

SEQ ID NO: 268090 - RNA, 22 nt, Homo sapiens
gauguguugggaagauuucaag

SEQ ID NO: 268091 - RNA, 22 nt, Homo sapiens
gauguuguuuagccuuugaugu

SEQ ID NO: 268092 - RNA, 20 nt, Homo sapiens
gauuagagagaggcugugca

SEQ ID NO: 268093 - RNA, 22 nt, Homo sapiens
gauuucaucuuuagaggaagga

SEQ ID NO: 268094 - RNA, 23 nt, Homo sapiens
gcaaauaucguagagugucccug

SEQ ID NO: 268095 - RNA, 22 nt, Homo sapiens
gcaaaugcuacaccauuuugua

SEQ ID NO: 268096 - RNA, 20 nt, Homo sapiens
gcaaauggaucccacaagcc

SEQ ID NO: 268097 - RNA, 22 nt, Homo sapiens
gcaacugguuucaguuuuucag

SEQ ID NO: 268098 - RNA, 22 nt, Homo sapiens
gcaagaaugagaaggauuaauu

SEQ ID NO: 268099 - RNA, 22 nt, Homo sapiens
gcaagaauggaacaggagagcc

SEQ ID NO: 268100 - RNA, 22 nt, Homo sapiens
gcaagaguauuucaaggaagau

SEQ ID NO: 268101 - RNA, 22 nt, Homo sapiens
gcaauacugacagcauuaguuu

SEQ ID NO: 268102 - RNA, 22 nt, Homo sapiens
gcacaguaggugguaggacuuu

SEQ ID NO: 268103 - RNA, 22 nt, Homo sapiens
gcacaguguuacuugauauauu

SEQ ID NO: 268104 - RNA, 22 nt, Homo sapiens
gcacauggccccaucgugccga

SEQ ID NO: 268105 - RNA, 22 nt, Homo sapiens
gcaccaugguagaauaauggua

SEQ ID NO: 268106 - RNA, 22 nt, Homo sapiens
gcagaucucuucauuucucuua

SEQ ID NO: 268107 - RNA, 22 nt, Homo sapiens
gcagcaguggcaguuaauauuu

SEQ ID NO: 268108 - RNA, 22 nt, Homo sapiens
gcaggcaugacauuucacucuu

SEQ ID NO: 268109 - RNA, 22 nt, Homo sapiens
gcaguagugugaucuuggcuca

SEQ ID NO: 268110 - RNA, 22 nt, Homo sapiens
gcaguggugugugccagccuag

SEQ ID NO: 268111 - RNA, 22 nt, Homo sapiens
gcaguguugugauccaggucuu

SEQ ID NO: 268112 - RNA, 22 nt, Homo sapiens
gcaguucuguaguugaaauuua

SEQ ID NO: 268113 - RNA, 22 nt, Homo sapiens
gcaugacaaugauugcucuuca

SEQ ID NO: 268114 - RNA, 22 nt, Homo sapiens
gcaugauuuuauaucuauguaa

SEQ ID NO: 268115 - RNA, 22 nt, Homo sapiens
gcaugcacuguauuuaaguauc

SEQ ID NO: 268116 - RNA, 20 nt, Homo sapiens
gccacaguuaagcuucugcc

SEQ ID NO: 268117 - RNA, 22 nt, Homo sapiens
gccaguguuuuauugagaauuu

SEQ ID NO: 268118 - RNA, 22 nt, Homo sapiens
gccauggaggauuuauagaggc

SEQ ID NO: 268119 - RNA, 17 nt, Homo sapiens
gcccuuugugccucuuc

SEQ ID NO: 268120 - RNA, 22 nt, Homo sapiens
gccuagagaaguaaauauuauc

SEQ ID NO: 268121 - RNA, 19 nt, Homo sapiens
gcggcacuggagacacagc

SEQ ID NO: 268122 - RNA, 22 nt, Homo sapiens
gcgugguguuagaaugagaagu

SEQ ID NO: 268123 - RNA, 22 nt, Homo sapiens
gcuaguguuugccagcguagcc

SEQ ID NO: 268124 - RNA, 22 nt, Homo sapiens
gcucaguuuccucagcugcaaa

SEQ ID NO: 268125 - RNA, 22 nt, Homo sapiens
gcucaugggcagugugauuguu

SEQ ID NO: 268126 - RNA, 16 nt, Homo sapiens
gcucauguuuguguag

SEQ ID NO: 268127 - RNA, 22 nt, Homo sapiens
gcucuuuugggguaauucugag

SEQ ID NO: 268128 - RNA, 22 nt, Homo sapiens
gcugacacugggcuauagaucu

SEQ ID NO: 268129 - RNA, 22 nt, Homo sapiens
gcugagcuaugccauauaugcc

SEQ ID NO: 268130 - RNA, 22 nt, Homo sapiens
gcugagguucaagaagguuaaa

SEQ ID NO: 268131 - RNA, 22 nt, Homo sapiens
gcugaguaguauuucauuguau

SEQ ID NO: 268132 - RNA, 22 nt, Homo sapiens
gcugauggugcaguucuagccu

SEQ ID NO: 268133 - RNA, 19 nt, Homo sapiens
gcugauguuacauucuugc

SEQ ID NO: 268134 - RNA, 22 nt, Homo sapiens
gcuggaauuaacauagaugugc

SEQ ID NO: 268135 - RNA, 22 nt, Homo sapiens
gcuggcaaguggccuacuuugu

SEQ ID NO: 268136 - RNA, 22 nt, Homo sapiens
gcugguguucaggcccucaguc

SEQ ID NO: 268137 - RNA, 19 nt, Homo sapiens
gcugguuguccacucucuc

SEQ ID NO: 268138 - RNA, 22 nt, Homo sapiens
gcuguauugacuuuguaucaua

SEQ ID NO: 268139 - RNA, 20 nt, Homo sapiens
gcugugcuuaauacacuuuc

SEQ ID NO: 268140 - RNA, 22 nt, Homo sapiens
gcuguguguuaucagaaauugc

SEQ ID NO: 268141 - RNA, 22 nt, Homo sapiens
gcuguugguaaaaaggacauga

SEQ ID NO: 268142 - RNA, 22 nt, Homo sapiens
gcuuuguuaaaacacagccaca

SEQ ID NO: 268143 - RNA, 22 nt, Homo sapiens
gcuuuguugauggugagucugu

SEQ ID NO: 268144 - RNA, 18 nt, Homo sapiens
ggaaaacuuuucuaagua

SEQ ID NO: 268145 - RNA, 22 nt, Homo sapiens
ggaaaguaacccauucucuuac

SEQ ID NO: 268146 - RNA, 22 nt, Homo sapiens
ggaaguuaauacagauagagua

SEQ ID NO: 268147 - RNA, 19 nt, Homo sapiens
ggaaugcaccaguccuugc

SEQ ID NO: 268148 - RNA, 22 nt, Homo sapiens
ggaaugugugucaugcuuuugc

SEQ ID NO: 268149 - RNA, 22 nt, Homo sapiens
ggacuagggacauggggagcug

SEQ ID NO: 268150 - RNA, 22 nt, Homo sapiens
ggacugagaggacuacagugua

SEQ ID NO: 268151 - RNA, 22 nt, Homo sapiens
ggacuggaagcauauuuauuuu

SEQ ID NO: 268152 - RNA, 22 nt, Homo sapiens
ggagaauguaauugguauuuug

SEQ ID NO: 268153 - RNA, 22 nt, Homo sapiens
ggagauuauuaguguuucaugc

SEQ ID NO: 268154 - RNA, 22 nt, Homo sapiens
ggagguagguuugugauuugua

SEQ ID NO: 268155 - RNA, 20 nt, Homo sapiens
ggagguguuggauuucuagu

SEQ ID NO: 268156 - RNA, 21 nt, Homo sapiens
ggaguauaaggcaaaggagug

SEQ ID NO: 268157 - RNA, 22 nt, Homo sapiens
ggagucugacuuauaggaaccu

SEQ ID NO: 268158 - RNA, 22 nt, Homo sapiens
ugagguguauugggggaaauuc

SEQ ID NO: 268159 - RNA, 22 nt, Homo sapiens
ugagguugaaggacauuuuuau

SEQ ID NO: 268160 - RNA, 22 nt, Homo sapiens
ugaguagaagugaagauagugg

SEQ ID NO: 268161 - RNA, 23 nt, Homo sapiens
ugaguagguccacguaugugagu

SEQ ID NO: 268162 - RNA, 22 nt, Homo sapiens
ugaguaugaguucaggaaaggc

SEQ ID NO: 268163 - RNA, 22 nt, Homo sapiens
ugaguauguuuaaugugacaau

SEQ ID NO: 268164 - RNA, 22 nt, Homo sapiens
ugagucaauucuaacaauggca

SEQ ID NO: 268165 - RNA, 22 nt, Homo sapiens
ugagugaaagaagcacuaagga

SEQ ID NO: 268166 - RNA, 22 nt, Homo sapiens
ugagugaacgcugagaccaaau

SEQ ID NO: 268167 - RNA, 22 nt, Homo sapiens
ugagugaaggggcucuguugug

SEQ ID NO: 268168 - RNA, 22 nt, Homo sapiens
ugaguuaauuuuuguaucaugu

SEQ ID NO: 268169 - RNA, 22 nt, Homo sapiens
ugaguuagguaauaauaaauau

SEQ ID NO: 268170 - RNA, 22 nt, Homo sapiens
ugaguucaauguuaaugaagca

SEQ ID NO: 268171 - RNA, 22 nt, Homo sapiens
ugaguucaauuguauuuuauua

SEQ ID NO: 268172 - RNA, 22 nt, Homo sapiens
ugaguugagauaagguuacauu

SEQ ID NO: 268173 - RNA, 22 nt, Homo sapiens
ugaguuguugcauucuuggugu

SEQ ID NO: 268174 - RNA, 22 nt, Homo sapiens
ugauaacauugggggaagcuga

SEQ ID NO: 268175 - RNA, 22 nt, Homo sapiens
ugauaacauuucuucugguaca

SEQ ID NO: 268176 - RNA, 22 nt, Homo sapiens
ugauaagaaauuguucauguag

SEQ ID NO: 268177 - RNA, 22 nt, Homo sapiens
ugauaauuuugucagguuuugg

SEQ ID NO: 268178 - RNA, 22 nt, Homo sapiens
ugauaggagauuuucaucugua

SEQ ID NO: 268179 - RNA, 22 nt, Homo sapiens
ugauagucuuugcuggugaccu

SEQ ID NO: 268180 - RNA, 22 nt, Homo sapiens
ugauaugaaguucaaaccaggu

SEQ ID NO: 268181 - RNA, 22 nt, Homo sapiens
ugauaugaucgcccuagcuuga

SEQ ID NO: 268182 - RNA, 23 nt, Homo sapiens
ugauaugccuaggaguauauuuu

SEQ ID NO: 268183 - RNA, 22 nt, Homo sapiens
ugauauguuagaaucuugcaag

SEQ ID NO: 268184 - RNA, 20 nt, Homo sapiens
ugauauuucuggaaguggag

SEQ ID NO: 268185 - RNA, 22 nt, Homo sapiens
ugaucucauuagcaccuuuagc

SEQ ID NO: 268186 - RNA, 22 nt, Homo sapiens
ugaucugucacuuaucacauuu

SEQ ID NO: 268187 - RNA, 22 nt, Homo sapiens
ugaucuguccaccucagcuucc

SEQ ID NO: 268188 - RNA, 22 nt, Homo sapiens
ugaucuguguauauugaaccag

SEQ ID NO: 268189 - RNA, 22 nt, Homo sapiens
ugaugcugaugccugccagaag

SEQ ID NO: 268190 - RNA, 22 nt, Homo sapiens
ugaugguaguucagucaaugua

SEQ ID NO: 268191 - RNA, 22 nt, Homo sapiens
ugauuuguuuagugccaaguuu

SEQ ID NO: 268192 - RNA, 19 nt, Homo sapiens
ugcaaagucagugaagggu

SEQ ID NO: 268193 - RNA, 22 nt, Homo sapiens
ugcaaaguccucauucuuaccc

SEQ ID NO: 268194 - RNA, 22 nt, Homo sapiens
ugcaaauguuaggugucauuau

SEQ ID NO: 268195 - RNA, 22 nt, Homo sapiens
ugcaaauguuauuuugguuucu

SEQ ID NO: 268196 - RNA, 22 nt, Homo sapiens
ugcaagacacuguccugggcau

SEQ ID NO: 268197 - RNA, 22 nt, Homo sapiens
ugcaaguaauuccagcuacuga

SEQ ID NO: 268198 - RNA, 22 nt, Homo sapiens
ugcaauauccucuacuauaggu

SEQ ID NO: 268199 - RNA, 22 nt, Homo sapiens
ugcaaucauuuggaggagaaga

SEQ ID NO: 268200 - RNA, 18 nt, Homo sapiens
ugcaauggagaugcagcc

SEQ ID NO: 268201 - RNA, 22 nt, Homo sapiens
ugcaccacugcacugccugggu

SEQ ID NO: 268202 - RNA, 17 nt, Homo sapiens
ugcagcacacugauggg

SEQ ID NO: 268203 - RNA, 22 nt, Homo sapiens
ugcagcacugaacuucugggcu

SEQ ID NO: 268204 - RNA, 22 nt, Homo sapiens
ugcagcauguaggcacguuauu

SEQ ID NO: 268205 - RNA, 22 nt, Homo sapiens
ugcagcucaaauuccuaacaag

SEQ ID NO: 268206 - RNA, 22 nt, Homo sapiens
ugcaggauguucaguaauuucc

SEQ ID NO: 268207 - RNA, 22 nt, Homo sapiens
ugcauaauuccuugcaccagaa

SEQ ID NO: 268208 - RNA, 21 nt, Homo sapiens
ugcauacuucucagaugauua

SEQ ID NO: 268209 - RNA, 22 nt, Homo sapiens
ugcauauguugaaccaggcuug

SEQ ID NO: 268210 - RNA, 22 nt, Homo sapiens
ugcauauucaaggcaggccauu

SEQ ID NO: 268211 - RNA, 22 nt, Homo sapiens
ugcauauucgaguuauuuuggg

SEQ ID NO: 268212 - RNA, 22 nt, Homo sapiens
ugcauauucuaggauuuuguau

SEQ ID NO: 268213 - RNA, 22 nt, Homo sapiens
ugcauuaucagauguuugcuuu

SEQ ID NO: 268214 - RNA, 22 nt, Homo sapiens
ugcauuguaggauguuuagcag

SEQ ID NO: 268215 - RNA, 22 nt, Homo sapiens
ugcauuguuccgaauguguccu

SEQ ID NO: 268216 - RNA, 22 nt, Homo sapiens
ugccaaggagucagucccuaga

SEQ ID NO: 268217 - RNA, 22 nt, Homo sapiens
ugccaucauuaauauuaggcau

SEQ ID NO: 268218 - RNA, 22 nt, Homo sapiens
ugcccuguaucccacuguuuca

SEQ ID NO: 268219 - RNA, 20 nt, Homo sapiens
ugccugacacucuuugcuuc

SEQ ID NO: 268220 - RNA, 22 nt, Homo sapiens
ugccugagcccagcccuguagu

SEQ ID NO: 268221 - RNA, 22 nt, Homo sapiens
ugccuggagagcuccuacauau

SEQ ID NO: 268222 - RNA, 22 nt, Homo sapiens
ugccuucuguuaaacgaggaug

SEQ ID NO: 268223 - RNA, 22 nt, Homo sapiens
ugcgccauugcacuccagucuu

SEQ ID NO: 268224 - RNA, 22 nt, Homo sapiens
ugcuauguccccacccaaaucu

SEQ ID NO: 268225 - RNA, 21 nt, Homo sapiens
ugcuauguuguccaggcuggc

SEQ ID NO: 268226 - RNA, 23 nt, Homo sapiens
ugcugagaccuagauccuaaaga

SEQ ID NO: 268227 - RNA, 22 nt, Homo sapiens
ugcugcaaacaugagaggaagu

SEQ ID NO: 268228 - RNA, 22 nt, Homo sapiens
ugcugcacaguucuuaagauua

SEQ ID NO: 268229 - RNA, 22 nt, Homo sapiens
ugcugguauuauguuauccaga

SEQ ID NO: 268230 - RNA, 22 nt, Homo sapiens
ugcugguauuuggaccagccug

SEQ ID NO: 268231 - RNA, 22 nt, Homo sapiens
ugcugguggucccauaugauua

SEQ ID NO: 268232 - RNA, 22 nt, Homo sapiens
ugcugguuuucaucaucagugg

SEQ ID NO: 268233 - RNA, 22 nt, Homo sapiens
ugcuuaggcuaacaaaaauagc

SEQ ID NO: 268234 - RNA, 22 nt, Homo sapiens
ugcuuuguugaaaaucauuugg

SEQ ID NO: 268235 - RNA, 22 nt, Homo sapiens
uggaagacaaguguuagcaugg

SEQ ID NO: 268236 - RNA, 22 nt, Homo sapiens
uggaagacucuagucucuugag

SEQ ID NO: 268237 - RNA, 22 nt, Homo sapiens
uggaagacuuuagaggcuuaua

SEQ ID NO: 268238 - RNA, 20 nt, Homo sapiens
uggaagccuggugcuaucuu

SEQ ID NO: 268239 - RNA, 20 nt, Homo sapiens
uggaaggcaucugcauuauu

SEQ ID NO: 268240 - RNA, 22 nt, Homo sapiens
uggaauacaugucgcugagcug

SEQ ID NO: 268241 - RNA, 22 nt, Homo sapiens
uggaauaugagacgggguuguc

SEQ ID NO: 268242 - RNA, 22 nt, Homo sapiens
uggaaugguaucuuguuggggu

SEQ ID NO: 268243 - RNA, 22 nt, Homo sapiens
uggaauguauaucguuuuuugu

SEQ ID NO: 268244 - RNA, 22 nt, Homo sapiens
uggaauuaauuaaaauauacug

SEQ ID NO: 268245 - RNA, 22 nt, Homo sapiens
uggacagagagaccggcauuuu

SEQ ID NO: 268246 - RNA, 18 nt, Homo sapiens
uggacagugauuauccau

SEQ ID NO: 268247 - RNA, 22 nt, Homo sapiens
caaggugcugagacaggagccc

SEQ ID NO: 268248 - RNA, 21 nt, Homo sapiens
caauggcacaaucucugcuca

SEQ ID NO: 268249 - RNA, 22 nt, Homo sapiens
caauggcacgaucucgucucac

SEQ ID NO: 268250 - RNA, 22 nt, Homo sapiens
caauggcacuauuggaaaaggu

SEQ ID NO: 268251 - RNA, 22 nt, Homo sapiens
caaugguccccauuggcaggaa

SEQ ID NO: 268252 - RNA, 22 nt, Homo sapiens
caauugcacucuuagguguaca

SEQ ID NO: 268253 - RNA, 22 nt, Homo sapiens
cacaaaguagauuagucuucca

SEQ ID NO: 268254 - RNA, 22 nt, Homo sapiens
cacaaugucugguaggccacuu

SEQ ID NO: 268255 - RNA, 22 nt, Homo sapiens
cacagcuaacaacuguuucuuc

SEQ ID NO: 268256 - RNA, 22 nt, Homo sapiens
cacaggaagaggcacggucccu

SEQ ID NO: 268257 - RNA, 22 nt, Homo sapiens
cacaguagaauagagcacuagg

SEQ ID NO: 268258 - RNA, 22 nt, Homo sapiens
cacaguguuccagcuauuugaa

SEQ ID NO: 268259 - RNA, 22 nt, Homo sapiens
cacauagcuagucaguagugaa

SEQ ID NO: 268260 - RNA, 22 nt, Homo sapiens
cacauguuugcuacauuuuucu

SEQ ID NO: 268261 - RNA, 22 nt, Homo sapiens
cacauugcaggaaaguucauua

SEQ ID NO: 268262 - RNA, 22 nt, Homo sapiens
caccacauuccauugaucaggc

SEQ ID NO: 268263 - RNA, 22 nt, Homo sapiens
caccagcuggcauugaauaccu

SEQ ID NO: 268264 - RNA, 22 nt, Homo sapiens
caccgagguuggagugcagugg

SEQ ID NO: 268265 - RNA, 22 nt, Homo sapiens
caccugagcgggaugcucgccu

SEQ ID NO: 268266 - RNA, 22 nt, Homo sapiens
caccuguacauggcaguguccu

SEQ ID NO: 268267 - RNA, 22 nt, Homo sapiens
cacuaggcuggagugcaguggc

SEQ ID NO: 268268 - RNA, 22 nt, Homo sapiens
cacugcaauuacuuuugcacca

SEQ ID NO: 268269 - RNA, 22 nt, Homo sapiens
cacugcacuccaguuuggauga

SEQ ID NO: 268270 - RNA, 22 nt, Homo sapiens
cacugcauccuccaccuccugg

SEQ ID NO: 268271 - RNA, 23 nt, Homo sapiens
cacugggcagcagguguucccag

SEQ ID NO: 268272 - RNA, 21 nt, Homo sapiens
cacuggguucaggcuugugga

SEQ ID NO: 268273 - RNA, 22 nt, Homo sapiens
cacuuugguucaccugaguuuc

SEQ ID NO: 268274 - RNA, 22 nt, Homo sapiens
cagacagugucccgagucccug

SEQ ID NO: 268275 - RNA, 22 nt, Homo sapiens
cagagguauugcaaaagccuag

SEQ ID NO: 268276 - RNA, 22 nt, Homo sapiens
cagaguuaguagccuuugacaa

SEQ ID NO: 268277 - RNA, 22 nt, Homo sapiens
uuuaugucuguacaucgggcgg

SEQ ID NO: 268278 - RNA, 22 nt, Homo sapiens
uuuauucggcuaggagcuucgg

SEQ ID NO: 268279 - RNA, 18 nt, Homo sapiens
uuucaagucuuaggugac

SEQ ID NO: 268280 - RNA, 22 nt, Homo sapiens
uuucacagagggcuucuuucua

SEQ ID NO: 268281 - RNA, 22 nt, Homo sapiens
gugugauuauuucaauugaugc

SEQ ID NO: 268282 - RNA, 22 nt, Homo sapiens
gugugcaacuuucauuaauauu

SEQ ID NO: 268283 - RNA, 21 nt, Homo sapiens
gugugcuugaauucagcuguc

SEQ ID NO: 268284 - RNA, 22 nt, Homo sapiens
guguguaaauggcagugagcuc

SEQ ID NO: 268285 - RNA, 22 nt, Homo sapiens
guuaagaaguguaacuuaaguu

SEQ ID NO: 268286 - RNA, 18 nt, Homo sapiens
guuagguaguaugaugcu

SEQ ID NO: 268287 - RNA, 22 nt, Homo sapiens
guuagugcuuauuaaauaguau

SEQ ID NO: 268288 - RNA, 22 nt, Homo sapiens
guuaugcagcuuagaaaaugaa

SEQ ID NO: 268289 - RNA, 22 nt, Homo sapiens
guuauguuauguuauguuaugu

SEQ ID NO: 268290 - RNA, 22 nt, Homo sapiens
guuauugcucucgaagacucuc

SEQ ID NO: 268291 - RNA, 22 nt, Homo sapiens
guuauuguccauuuauuuagca

SEQ ID NO: 268292 - RNA, 22 nt, Homo sapiens
guucaagugauucuacugccuc

SEQ ID NO: 268293 - RNA, 22 nt, Homo sapiens
guucagguauucuggaacagag

SEQ ID NO: 268294 - RNA, 22 nt, Homo sapiens
guucaucaggcuuucucuagag

SEQ ID NO: 268295 - RNA, 23 nt, Homo sapiens
guucaucagggauauuggccuga

SEQ ID NO: 268296 - RNA, 22 nt, Homo sapiens
guucaucagggauauuggcuua

SEQ ID NO: 268297 - RNA, 22 nt, Homo sapiens
guucccaguugaaaugauuagu

SEQ ID NO: 268298 - RNA, 22 nt, Homo sapiens
guugaaauccuaacccccuagu

SEQ ID NO: 268299 - RNA, 22 nt, Homo sapiens
guugaguuugaccugaacucug

SEQ ID NO: 268300 - RNA, 22 nt, Homo sapiens
guugcaugucugggaggccagc

SEQ ID NO: 268301 - RNA, 22 nt, Homo sapiens
guugccuaggcuggagugcagu

SEQ ID NO: 268302 - RNA, 22 nt, Homo sapiens
guuggaauguauugcuacuucu

SEQ ID NO: 268303 - RNA, 22 nt, Homo sapiens
guuggaauuaaaaggcaaguau

SEQ ID NO: 268304 - RNA, 22 nt, Homo sapiens
guuggcuguuucccccaaguga

SEQ ID NO: 268305 - RNA, 22 nt, Homo sapiens
guuuaggaaugagaauauuuag

SEQ ID NO: 268306 - RNA, 22 nt, Homo sapiens
guuugugcuccuaugagaaucu

SEQ ID NO: 268307 - RNA, 22 nt, Homo sapiens
guuuuuggggucacuauuaccg

SEQ ID NO: 268308 - RNA, 22 nt, Homo sapiens
uaaaccacguuuacauuugaga

SEQ ID NO: 268309 - RNA, 22 nt, Homo sapiens
uaaagagcuuuugaggugucau

SEQ ID NO: 268310 - RNA, 22 nt, Homo sapiens
uaaagcacuuuuuucugcaugg

SEQ ID NO: 268311 - RNA, 22 nt, Homo sapiens
uaaagccauugucaaguuugua

SEQ ID NO: 268312 - RNA, 16 nt, Homo sapiens
uaaagcuaaucacuuu

SEQ ID NO: 268313 - RNA, 22 nt, Homo sapiens
uaaagcuacaguauaugguauu

SEQ ID NO: 268314 - RNA, 22 nt, Homo sapiens
uaaagcuauuauaguuauguuu

SEQ ID NO: 268315 - RNA, 21 nt, Homo sapiens
uaaagcuuagcuauaguggcu

SEQ ID NO: 268316 - RNA, 22 nt, Homo sapiens
uaaauacguccauuugugguau

SEQ ID NO: 268317 - RNA, 21 nt, Homo sapiens
uaaaugucauacaaagcaaug

SEQ ID NO: 268318 - RNA, 22 nt, Homo sapiens
uaacaccuuugauagcacuuuu

SEQ ID NO: 268319 - RNA, 22 nt, Homo sapiens
uaacagcucuacagcugcucuu

SEQ ID NO: 268320 - RNA, 22 nt, Homo sapiens
uaacccagugucugugaugggu

SEQ ID NO: 268321 - RNA, 22 nt, Homo sapiens
uaacccuuaguaucuguggguu

SEQ ID NO: 268322 - RNA, 22 nt, Homo sapiens
uaacucugccuagugacauggu

SEQ ID NO: 268323 - RNA, 22 nt, Homo sapiens
uaacugucucccuugguccuga

SEQ ID NO: 268324 - RNA, 22 nt, Homo sapiens
uaagaauucuguccgguauacu

SEQ ID NO: 268325 - RNA, 22 nt, Homo sapiens
uaagacacuuaaaauguuacau

SEQ ID NO: 268326 - RNA, 20 nt, Homo sapiens
uaagacaugguccacaugcc

SEQ ID NO: 268327 - RNA, 22 nt, Homo sapiens
uaagacugccccagacagcaag

SEQ ID NO: 268328 - RNA, 19 nt, Homo sapiens
uaagaugaagcugucuggg

SEQ ID NO: 268329 - RNA, 22 nt, Homo sapiens
uaagaugaaggcucaccuagaa

SEQ ID NO: 268330 - RNA, 18 nt, Homo sapiens
uaagaugcagccuauucc

SEQ ID NO: 268331 - RNA, 22 nt, Homo sapiens
uaagccaccgugccuggccuaa

SEQ ID NO: 268332 - RNA, 22 nt, Homo sapiens
uaaggcaaucagucaugguguu

SEQ ID NO: 268333 - RNA, 18 nt, Homo sapiens
uaaggcacuauaggcauu

SEQ ID NO: 268334 - RNA, 22 nt, Homo sapiens
uaaggcuuaugguaaaguccug

SEQ ID NO: 268335 - RNA, 22 nt, Homo sapiens
uaaggcuuugcuggacucaguc

SEQ ID NO: 268336 - RNA, 22 nt, Homo sapiens
uaagggcacuaaucccauuuau

SEQ ID NO: 268337 - RNA, 22 nt, Homo sapiens
uaagguuuuugauaugcugcug

SEQ ID NO: 268338 - RNA, 22 nt, Homo sapiens
uaaguaauugugguuuuugcca

SEQ ID NO: 268339 - RNA, 22 nt, Homo sapiens
uaaguaauuguuaauagggaag

SEQ ID NO: 268340 - RNA, 19 nt, Homo sapiens
uaaguagaugacugaugcu

SEQ ID NO: 268341 - RNA, 20 nt, Homo sapiens
uaaguuguauuugucaugaa

SEQ ID NO: 268342 - RNA, 18 nt, Homo sapiens
uaauaacugugaccuuga

SEQ ID NO: 268343 - RNA, 21 nt, Homo sapiens
uaauaaugucucagacaccua

SEQ ID NO: 268344 - RNA, 22 nt, Homo sapiens
uaauaauguuaggcuuacucaa

SEQ ID NO: 268345 - RNA, 22 nt, Homo sapiens
uaauacauucaaggugguaguu

SEQ ID NO: 268346 - RNA, 22 nt, Homo sapiens
uaauacuugucauaaaggcauu

SEQ ID NO: 268347 - RNA, 22 nt, Homo sapiens
uaauagcucggauaaacaugau

SEQ ID NO: 268348 - RNA, 22 nt, Homo sapiens
uaaugcuguggucuaaugggga

SEQ ID NO: 268349 - RNA, 22 nt, Homo sapiens
uaaugcuguggucugguuuaaa

SEQ ID NO: 268350 - RNA, 22 nt, Homo sapiens
uacaaagcuuugaugugucuuu

SEQ ID NO: 268351 - RNA, 22 nt, Homo sapiens
uacaaaucuagguuuguuacug

SEQ ID NO: 268352 - RNA, 22 nt, Homo sapiens
uacaagcacaggcagcaggcug

SEQ ID NO: 268353 - RNA, 21 nt, Homo sapiens
uacaagcuguagcacaugcca

SEQ ID NO: 268354 - RNA, 22 nt, Homo sapiens
uacaaguaauaagggaagaauu

SEQ ID NO: 268355 - RNA, 22 nt, Homo sapiens
uacaaguggguuugugcaggag

SEQ ID NO: 268356 - RNA, 21 nt, Homo sapiens
uacaaugcacaggagagccuc

SEQ ID NO: 268357 - RNA, 18 nt, Homo sapiens
uacagaacuggaguagaa

SEQ ID NO: 268358 - RNA, 22 nt, Homo sapiens
uacagaauugcagguguggcag

SEQ ID NO: 268359 - RNA, 22 nt, Homo sapiens
uacagccacauaauguaugauu

SEQ ID NO: 268360 - RNA, 22 nt, Homo sapiens
uacagcuaugugcaugcaugcu

SEQ ID NO: 268361 - RNA, 22 nt, Homo sapiens
uacaggcagguguucccugguu

SEQ ID NO: 268362 - RNA, 22 nt, Homo sapiens
uacagucacauuccugaccaua

SEQ ID NO: 268363 - RNA, 22 nt, Homo sapiens
uacagucauaaugccuagugac

SEQ ID NO: 268364 - RNA, 19 nt, Homo sapiens
uacaugcagcaggcacgca

SEQ ID NO: 268365 - RNA, 22 nt, Homo sapiens
uacauugucauauucucucucu

SEQ ID NO: 268366 - RNA, 22 nt, Homo sapiens
uaccaugcagguguauguuugu

SEQ ID NO: 268367 - RNA, 22 nt, Homo sapiens
uacccuuauguaaucauuauac

SEQ ID NO: 268368 - RNA, 22 nt, Homo sapiens
aaguaguuaggaacauucucuc

SEQ ID NO: 268369 - RNA, 22 nt, Homo sapiens
aaguauagcuaugauaaacauu

SEQ ID NO: 268370 - RNA, 22 nt, Homo sapiens
aaguaucaggaauaguuauugg

SEQ ID NO: 268371 - RNA, 22 nt, Homo sapiens
aagucaaggagagaagcuucag

SEQ ID NO: 268372 - RNA, 22 nt, Homo sapiens
aagucacugagacuuguggcug

SEQ ID NO: 268373 - RNA, 22 nt, Homo sapiens
aagucaguuugggagaagcuau

SEQ ID NO: 268374 - RNA, 22 nt, Homo sapiens
aagucaugaagaggaaaggaca

SEQ ID NO: 268375 - RNA, 22 nt, Homo sapiens
aaguccccugacagaggggagg

SEQ ID NO: 268376 - RNA, 22 nt, Homo sapiens
aagugaaugaugugaaguguaa

SEQ ID NO: 268377 - RNA, 22 nt, Homo sapiens
aagugcuguaugggagccuagg

SEQ ID NO: 268378 - RNA, 19 nt, Homo sapiens
aagugguuuaaacuuguau

SEQ ID NO: 268379 - RNA, 22 nt, Homo sapiens
aagugguuuuuacaaagacaga

SEQ ID NO: 268380 - RNA, 22 nt, Homo sapiens
aaguguaaguuaauguuuaggu

SEQ ID NO: 268381 - RNA, 22 nt, Homo sapiens
aaguuaauguuuaagacuccua

SEQ ID NO: 268382 - RNA, 22 nt, Homo sapiens
aauaaagcugaauccuuccuga

SEQ ID NO: 268383 - RNA, 22 nt, Homo sapiens
aauaaagucugaagugugcuua

SEQ ID NO: 268384 - RNA, 22 nt, Homo sapiens
aauaaguugagaugaggucaua

SEQ ID NO: 268385 - RNA, 22 nt, Homo sapiens
aauacuuccaaaucuagucauu

SEQ ID NO: 268386 - RNA, 22 nt, Homo sapiens
aauagcacuguagauggaggaa

SEQ ID NO: 268387 - RNA, 21 nt, Homo sapiens
aaucacaguuguucugccuuc

SEQ ID NO: 268388 - RNA, 21 nt, Homo sapiens
aaucacugucuguuuccccuu

SEQ ID NO: 268389 - RNA, 22 nt, Homo sapiens
aaucccuggacuuucggaggcu

SEQ ID NO: 268390 - RNA, 22 nt, Homo sapiens
aaugacuaagaugguacauuuu

SEQ ID NO: 268391 - RNA, 22 nt, Homo sapiens
aaugauauguuauguuuagguu

SEQ ID NO: 268392 - RNA, 22 nt, Homo sapiens
aaugcaagauguuaauuauagg

SEQ ID NO: 268393 - RNA, 22 nt, Homo sapiens
aaugccuagugugugacaggug

SEQ ID NO: 268394 - RNA, 22 nt, Homo sapiens
aaugcuguguuauuucaugacc

SEQ ID NO: 268395 - RNA, 22 nt, Homo sapiens
aauggcaguagauggaugggua

SEQ ID NO: 268396 - RNA, 22 nt, Homo sapiens
aauggcaucuagaguggugaau

SEQ ID NO: 268397 - RNA, 22 nt, Homo sapiens
aauggccacugaccuguguuga

SEQ ID NO: 268398 - RNA, 19 nt, Homo sapiens
aauggcuuuuccuguuccc

SEQ ID NO: 268399 - RNA, 22 nt, Homo sapiens
aaugucaucuucaguuguacag

SEQ ID NO: 268400 - RNA, 22 nt, Homo sapiens
aauuacauggcaauugggaaau

SEQ ID NO: 268401 - RNA, 22 nt, Homo sapiens
aauuacuucuacaccaaccuaa

SEQ ID NO: 268402 - RNA, 22 nt, Homo sapiens
aauuaguuggcugccuaugauu

SEQ ID NO: 268403 - RNA, 22 nt, Homo sapiens
aauugcaccaucuagaucaaga

SEQ ID NO: 268404 - RNA, 22 nt, Homo sapiens
aauugcacuacugcacucccac

SEQ ID NO: 268405 - RNA, 22 nt, Homo sapiens
aauugcauaugcaguagaucua

SEQ ID NO: 268406 - RNA, 22 nt, Homo sapiens
aauuggugaccaagggaaggac

SEQ ID NO: 268407 - RNA, 22 nt, Homo sapiens
acaacaguuuuaucaccccaga

SEQ ID NO: 268408 - RNA, 22 nt, Homo sapiens
acacaaugguaaguguuugugu

SEQ ID NO: 268409 - RNA, 23 nt, Homo sapiens
acacaguaaacuaaaagcuagcu

SEQ ID NO: 268410 - RNA, 22 nt, Homo sapiens
acacguguugaaauuuaauugc

SEQ ID NO: 268411 - RNA, 22 nt, Homo sapiens
acacuacuggguauauguguuu

SEQ ID NO: 268412 - RNA, 22 nt, Homo sapiens
acacugcugaguaaauaauuuu

SEQ ID NO: 268413 - RNA, 20 nt, Homo sapiens
acacuggcuuugagauuuag

SEQ ID NO: 268414 - RNA, 22 nt, Homo sapiens
acacuguacuuauguuuugcag

SEQ ID NO: 268415 - RNA, 22 nt, Homo sapiens
acacuguugacauuuuguagug

SEQ ID NO: 268416 - RNA, 23 nt, Homo sapiens
acacuugcugaguaaaucaaaua

SEQ ID NO: 268417 - RNA, 22 nt, Homo sapiens
acacuugcuugcaauagccucc

SEQ ID NO: 268418 - RNA, 22 nt, Homo sapiens
acagaucagagauauuuagguu

SEQ ID NO: 268419 - RNA, 22 nt, Homo sapiens
acagauugcugggccccagccc

SEQ ID NO: 268420 - RNA, 22 nt, Homo sapiens
acaggagugggauuugaguccu

SEQ ID NO: 268421 - RNA, 22 nt, Homo sapiens
acaguaaugggccccuuuuccu

SEQ ID NO: 268422 - RNA, 22 nt, Homo sapiens
acaguacaugauaaauaaggua

SEQ ID NO: 268423 - RNA, 21 nt, Homo sapiens
acaguacuugagaucuuuuga

SEQ ID NO: 268424 - RNA, 22 nt, Homo sapiens
acaguagcgcaaucucggcuca

SEQ ID NO: 268425 - RNA, 22 nt, Homo sapiens
acaguauaaugcuguagggaga

SEQ ID NO: 268426 - RNA, 22 nt, Homo sapiens
acagucauagcagccuuuguua

SEQ ID NO: 268427 - RNA, 23 nt, Homo sapiens
acagucuaguuugaagucaggua

SEQ ID NO: 268428 - RNA, 22 nt, Homo sapiens
acagugacagaaagcugauuau

SEQ ID NO: 268429 - RNA, 19 nt, Homo sapiens
acagugcuuugucagaagc

SEQ ID NO: 268430 - RNA, 22 nt, Homo sapiens
acagugcuuuuguuccucuccu

SEQ ID NO: 268431 - RNA, 23 nt, Homo sapiens
acaguggugugaucuuggcucag

SEQ ID NO: 268432 - RNA, 22 nt, Homo sapiens
acaguguacaauagccuuuuaa

SEQ ID NO: 268433 - RNA, 18 nt, Homo sapiens
acagugucauggcucaau

SEQ ID NO: 268434 - RNA, 17 nt, Homo sapiens
acagugucuaugaaaug

SEQ ID NO: 268435 - RNA, 22 nt, Homo sapiens
acaguguuacuugauaguguau

SEQ ID NO: 268436 - RNA, 22 nt, Homo sapiens
acaguguuccuuuguugugacu

SEQ ID NO: 268437 - RNA, 22 nt, Homo sapiens
acauauaaggagacuagggcau

SEQ ID NO: 268438 - RNA, 22 nt, Homo sapiens
acaucauugggggcuacaggug

SEQ ID NO: 268439 - RNA, 22 nt, Homo sapiens
acaucccaugccuggguacucc

SEQ ID NO: 268440 - RNA, 22 nt, Homo sapiens
acaucccuugcucggggccccu

SEQ ID NO: 268441 - RNA, 22 nt, Homo sapiens
acaucccuuucccacccuucac

SEQ ID NO: 268442 - RNA, 22 nt, Homo sapiens
acaugacauugggguggggaua

SEQ ID NO: 268443 - RNA, 22 nt, Homo sapiens
acauggcacugcgggcuucuug

SEQ ID NO: 268444 - RNA, 22 nt, Homo sapiens
acaugguacugauuuacgaaau

SEQ ID NO: 268445 - RNA, 21 nt, Homo sapiens
acauguacacauguaugcaca

SEQ ID NO: 268446 - RNA, 22 nt, Homo sapiens
acauugcucuuaccaaguuugu

SEQ ID NO: 268447 - RNA, 22 nt, Homo sapiens
accaguuuuuuauacaucuucu

SEQ ID NO: 268448 - RNA, 22 nt, Homo sapiens
acccaguguucagacuaccugu

SEQ ID NO: 268449 - RNA, 22 nt, Homo sapiens
accccauuugcacugagcccuu

SEQ ID NO: 268450 - RNA, 22 nt, Homo sapiens
acccuacauaguagauccuaca

SEQ ID NO: 268451 - RNA, 20 nt, Homo sapiens
acccucuaggaugauuucuu

SEQ ID NO: 268452 - RNA, 22 nt, Homo sapiens
acccugacacgauucuucacuu

SEQ ID NO: 268453 - RNA, 22 nt, Homo sapiens
acccuggauucguggccuugaa

SEQ ID NO: 268454 - RNA, 22 nt, Homo sapiens
acccugucauccacauggugcu

SEQ ID NO: 268455 - RNA, 22 nt, Homo sapiens
acccuugaguguguuucaggca

SEQ ID NO: 268456 - RNA, 21 nt, Homo sapiens
uaucacaguagaauaggaucu

SEQ ID NO: 268457 - RNA, 22 nt, Homo sapiens
uaucacagugcuggaguauucc

SEQ ID NO: 268458 - RNA, 22 nt, Homo sapiens
auagcacuuauagauuuggucu

SEQ ID NO: 268459 - RNA, 22 nt, Homo sapiens
auagcagaagaagggacaauuc

SEQ ID NO: 268460 - RNA, 22 nt, Homo sapiens
auagcaggagaauggucauggg

SEQ ID NO: 268461 - RNA, 22 nt, Homo sapiens
auagcagugugaaaacagacua

SEQ ID NO: 268462 - RNA, 22 nt, Homo sapiens
auagcagugugagaaugaacua

SEQ ID NO: 268463 - RNA, 22 nt, Homo sapiens
auagcagugugaggacagacua

SEQ ID NO: 268464 - RNA, 22 nt, Homo sapiens
auagcauaucccacaugucaga

SEQ ID NO: 268465 - RNA, 22 nt, Homo sapiens
auagcaucauuucuugaaaaga

SEQ ID NO: 268466 - RNA, 22 nt, Homo sapiens
auaggagugugcacagaguagg

SEQ ID NO: 268467 - RNA, 22 nt, Homo sapiens
auaguacuauugcaguguuaua

SEQ ID NO: 268468 - RNA, 22 nt, Homo sapiens
auagugcugcaaaaaacauacg

SEQ ID NO: 268469 - RNA, 22 nt, Homo sapiens
auagugcugcaacaaauauacg

SEQ ID NO: 268470 - RNA, 22 nt, Homo sapiens
auagugcugcaauaaacauaug

SEQ ID NO: 268471 - RNA, 22 nt, Homo sapiens
auagugcuguauuaaacauacg

SEQ ID NO: 268472 - RNA, 22 nt, Homo sapiens
auagugcugugaugaacauaca

SEQ ID NO: 268473 - RNA, 22 nt, Homo sapiens
auauagcucuggcuggaugacu

SEQ ID NO: 268474 - RNA, 22 nt, Homo sapiens
auaucacagguguuuaccugau

SEQ ID NO: 268475 - RNA, 22 nt, Homo sapiens
auauccuggagcauuuuugcaa

SEQ ID NO: 268476 - RNA, 17 nt, Homo sapiens
auaugaauuuuggagau

SEQ ID NO: 268477 - RNA, 22 nt, Homo sapiens
auaugguacuuaugcucaaacu

SEQ ID NO: 268478 - RNA, 20 nt, Homo sapiens
auaugguugugagugauuuu

SEQ ID NO: 268479 - RNA, 22 nt, Homo sapiens
auauguaguauggaaacauugu

SEQ ID NO: 268480 - RNA, 22 nt, Homo sapiens
auaugucuguuuagucuguaau

SEQ ID NO: 268481 - RNA, 22 nt, Homo sapiens
auaugugacuucaugcaaggcu

SEQ ID NO: 268482 - RNA, 22 nt, Homo sapiens
auauucacagguaucagagauu

SEQ ID NO: 268483 - RNA, 22 nt, Homo sapiens
auauuggacugugcuaguuaga

SEQ ID NO: 268484 - RNA, 22 nt, Homo sapiens
auauugguuaaauauuauguga

SEQ ID NO: 268485 - RNA, 20 nt, Homo sapiens
aucaaagacuuagaggggga

SEQ ID NO: 268486 - RNA, 22 nt, Homo sapiens
aucaaaugcuggcagagugccu

SEQ ID NO: 268487 - RNA, 22 nt, Homo sapiens
aucaagcugcuuguuugaaucu

SEQ ID NO: 268488 - RNA, 22 nt, Homo sapiens
aucacaggcaaaauuccuucuc

SEQ ID NO: 268489 - RNA, 22 nt, Homo sapiens
aucacaggucaaaucauuauuu

SEQ ID NO: 268490 - RNA, 22 nt, Homo sapiens
aucacaguuauaacauccuuuu

SEQ ID NO: 268491 - RNA, 19 nt, Homo sapiens
aucaccagucuuuccacug

SEQ ID NO: 268492 - RNA, 22 nt, Homo sapiens
aucacuguaaguuuacacuuug

SEQ ID NO: 268493 - RNA, 22 nt, Homo sapiens
aucacuuugcucuccagugugg

SEQ ID NO: 268494 - RNA, 22 nt, Homo sapiens
aucagauggcuaaaacagaaga

SEQ ID NO: 268495 - RNA, 22 nt, Homo sapiens
aucagcaguguaaaaacggacu

SEQ ID NO: 268496 - RNA, 22 nt, Homo sapiens
aucauaucaucugcaaacaaag

SEQ ID NO: 268497 - RNA, 22 nt, Homo sapiens
aucaucacaguuguguguaaug

SEQ ID NO: 268498 - RNA, 22 nt, Homo sapiens
aucauugugcaucuucauucca

SEQ ID NO: 268499 - RNA, 22 nt, Homo sapiens
auccaagagacugaugacuucc

SEQ ID NO: 268500 - RNA, 22 nt, Homo sapiens
auccacaugcaguuggaaacag

SEQ ID NO: 268501 - RNA, 22 nt, Homo sapiens
aucccgagacuuugcugaaguu

SEQ ID NO: 268502 - RNA, 22 nt, Homo sapiens
aucccuuccuagcacuuggugu

SEQ ID NO: 268503 - RNA, 22 nt, Homo sapiens
auccucugagagaguuucauaa

SEQ ID NO: 268504 - RNA, 22 nt, Homo sapiens
auccugagacuuugcugaaguu

SEQ ID NO: 268505 - RNA, 21 nt, Homo sapiens
aucgcacaauauaccccugua

SEQ ID NO: 268506 - RNA, 22 nt, Homo sapiens
aucuagagacauaguaaagaau

SEQ ID NO: 268507 - RNA, 22 nt, Homo sapiens
aucucaguuaaugacccuaugc

SEQ ID NO: 268508 - RNA, 22 nt, Homo sapiens
aucucaguuaauuccaucuuuc

SEQ ID NO: 268509 - RNA, 22 nt, Homo sapiens
aucucauuccuucugggcugau

SEQ ID NO: 268510 - RNA, 22 nt, Homo sapiens
aucuccaggugccagcugcgcc

SEQ ID NO: 268511 - RNA, 20 nt, Homo sapiens
aucucugggcaaaggaaaau

SEQ ID NO: 268512 - RNA, 22 nt, Homo sapiens
aucugauggagagcguguggcu

SEQ ID NO: 268513 - RNA, 19 nt, Homo sapiens
aucuggaguuccuggggcu

SEQ ID NO: 268514 - RNA, 22 nt, Homo sapiens
aucugguguauuggugcugggu

SEQ ID NO: 268515 - RNA, 22 nt, Homo sapiens
aucuguagauucagcacaagcu

SEQ ID NO: 268516 - RNA, 21 nt, Homo sapiens
aucugugagaccuuggggguu

SEQ ID NO: 268517 - RNA, 22 nt, Homo sapiens
aucugugguuguaugcauauua

SEQ ID NO: 268518 - RNA, 22 nt, Homo sapiens
aucuuguguugaauggugcaga

SEQ ID NO: 268519 - RNA, 22 nt, Homo sapiens
aucuuuaguggcuguuuucaga

SEQ ID NO: 268520 - RNA, 22 nt, Homo sapiens
aucuuugauuagacugauggau

SEQ ID NO: 268521 - RNA, 22 nt, Homo sapiens
augaaaacaugauuugccuguu

SEQ ID NO: 268522 - RNA, 22 nt, Homo sapiens
augaaaagcauaaacgcugaag

SEQ ID NO: 268523 - RNA, 22 nt, Homo sapiens
augaaacuggcuaauuuuugua

SEQ ID NO: 268524 - RNA, 22 nt, Homo sapiens
augaaaucacugugaugcccua

SEQ ID NO: 268525 - RNA, 18 nt, Homo sapiens
augaacucaucauuuuua

SEQ ID NO: 268526 - RNA, 22 nt, Homo sapiens
augaacucaucauuuuuuaugg

SEQ ID NO: 268527 - RNA, 22 nt, Homo sapiens
augaacucaucauuuuuugugg

SEQ ID NO: 268528 - RNA, 19 nt, Homo sapiens
augaacucauucuuuuuau

SEQ ID NO: 268529 - RNA, 22 nt, Homo sapiens
augaagacaucgucugggauua

SEQ ID NO: 268530 - RNA, 22 nt, Homo sapiens
augaagauguugccuuuuuaau

SEQ ID NO: 268531 - RNA, 20 nt, Homo sapiens
augaaggcaggugugaguuu

SEQ ID NO: 268532 - RNA, 22 nt, Homo sapiens
augaaguauuaggacacauuua

SEQ ID NO: 268533 - RNA, 22 nt, Homo sapiens
ugacagaggucuuuuaauagcu

SEQ ID NO: 268534 - RNA, 22 nt, Homo sapiens
ugacagcuguugaggcauuuau

SEQ ID NO: 268535 - RNA, 22 nt, Homo sapiens
ugacaggagauuaugugauguu

SEQ ID NO: 268536 - RNA, 22 nt, Homo sapiens
ugacaggauggagaucgguauu

SEQ ID NO: 268537 - RNA, 22 nt, Homo sapiens
ugacagucaccaggacccacag

SEQ ID NO: 268538 - RNA, 22 nt, Homo sapiens
ugacauagcuauuaagugaugc

SEQ ID NO: 268539 - RNA, 22 nt, Homo sapiens
ugacaucaccaccuccgucauc

SEQ ID NO: 268540 - RNA, 22 nt, Homo sapiens
ugacauggugcucuuucaggca

SEQ ID NO: 268541 - RNA, 22 nt, Homo sapiens
ugaccacagaaagugagggagc

SEQ ID NO: 268542 - RNA, 22 nt, Homo sapiens
ugaccacugucuaagauaggug

SEQ ID NO: 268543 - RNA, 22 nt, Homo sapiens
ugaccagaaaacaaauuaguuu

SEQ ID NO: 268544 - RNA, 19 nt, Homo sapiens
ugaccagggacagaaacca

SEQ ID NO: 268545 - RNA, 22 nt, Homo sapiens
ugacggaggcauuggaagcuug

SEQ ID NO: 268546 - RNA, 22 nt, Homo sapiens
ugacuacacacaauuugucaag

SEQ ID NO: 268547 - RNA, 22 nt, Homo sapiens
ugacuacaggucaggaagcugu

SEQ ID NO: 268548 - RNA, 17 nt, Homo sapiens
ugugauugaagucaucc

SEQ ID NO: 268549 - RNA, 22 nt, Homo sapiens
ugugauugauauauuuacagaa

SEQ ID NO: 268550 - RNA, 22 nt, Homo sapiens
ugugcacaacgugcagguuugu

SEQ ID NO: 268551 - RNA, 23 nt, Homo sapiens
ugugcacauuuacauauauacac

SEQ ID NO: 268552 - RNA, 22 nt, Homo sapiens
ugugcauagugugugcggggcg

SEQ ID NO: 268553 - RNA, 22 nt, Homo sapiens
ugugcauauaaguguguauaua

SEQ ID NO: 268554 - RNA, 22 nt, Homo sapiens
ugugccacugcacucccgccug

SEQ ID NO: 268555 - RNA, 22 nt, Homo sapiens
ugugccacugcacuccugccug

SEQ ID NO: 268556 - RNA, 22 nt, Homo sapiens
ugugccacugcacuccugggug

SEQ ID NO: 268557 - RNA, 22 nt, Homo sapiens
ugugcuugaaauucaguuuuga

SEQ ID NO: 268558 - RNA, 22 nt, Homo sapiens
uguggcacuguguccagagaaa

SEQ ID NO: 268559 - RNA, 22 nt, Homo sapiens
uguggcauugaauaaccuugga

SEQ ID NO: 268560 - RNA, 22 nt, Homo sapiens
uguggccuuuguuucaguuggg

SEQ ID NO: 268561 - RNA, 22 nt, Homo sapiens
uguggcuucuuugguucaguau

SEQ ID NO: 268562 - RNA, 22 nt, Homo sapiens
ugugguauuagguguaguaucu

SEQ ID NO: 268563 - RNA, 22 nt, Homo sapiens
uguguaaauaugauagaggaau

SEQ ID NO: 268564 - RNA, 22 nt, Homo sapiens
uguguaauaccuuugacuauau

SEQ ID NO: 268565 - RNA, 22 nt, Homo sapiens
uguguacugcagaguauucugu

SEQ ID NO: 268566 - RNA, 22 nt, Homo sapiens
uguguagagaaauauuacuuau

SEQ ID NO: 268567 - RNA, 22 nt, Homo sapiens
uguguuugauaaguccauaguu

SEQ ID NO: 268568 - RNA, 21 nt, Homo sapiens
uguuaacaugcagauuacugg

SEQ ID NO: 268569 - RNA, 22 nt, Homo sapiens
uguuaacauuuuagagugggaa

SEQ ID NO: 268570 - RNA, 22 nt, Homo sapiens
uguuaagauguguuuuguggcu

SEQ ID NO: 268571 - RNA, 22 nt, Homo sapiens
uguuacacugugcacuaaauuu

SEQ ID NO: 268572 - RNA, 22 nt, Homo sapiens
uguuacagcagaauugauugca

SEQ ID NO: 268573 - RNA, 19 nt, Homo sapiens
uguugcacauaucaauaug

SEQ ID NO: 268574 - RNA, 22 nt, Homo sapiens
uuaaagcuggcguuacaguuug

SEQ ID NO: 268575 - RNA, 22 nt, Homo sapiens
uuaaagugaucauaaggauagu

SEQ ID NO: 268576 - RNA, 22 nt, Homo sapiens
uuaaaguguuugcagacaggug

SEQ ID NO: 268577 - RNA, 22 nt, Homo sapiens
uuaaauacagcaugguguuucu

SEQ ID NO: 268578 - RNA, 20 nt, Homo sapiens
uuaaaucuagugcagacuca

SEQ ID NO: 268579 - RNA, 22 nt, Homo sapiens
uuaaaugcuagaauuuucuuug

SEQ ID NO: 268580 - RNA, 22 nt, Homo sapiens
uuaaaugcucacauaaagguag

SEQ ID NO: 268581 - RNA, 22 nt, Homo sapiens
uuaagaagugauuuuccucauu

SEQ ID NO: 268582 - RNA, 22 nt, Homo sapiens
uuaagagcauggugccagguug

SEQ ID NO: 268583 - RNA, 23 nt, Homo sapiens
uuaagcaacggcugcuuuucaga

SEQ ID NO: 268584 - RNA, 22 nt, Homo sapiens
uuaaggaaagcauuuaauucag

SEQ ID NO: 268585 - RNA, 22 nt, Homo sapiens
uuaaggaaggagucuuaaaugg

SEQ ID NO: 268586 - RNA, 22 nt, Homo sapiens
uuaaggcagugcaucuggaguu

SEQ ID NO: 268587 - RNA, 22 nt, Homo sapiens
uuaaggguuuuagaauuuucca

SEQ ID NO: 268588 - RNA, 22 nt, Homo sapiens
uuaaguaaucagagaagagaac

SEQ ID NO: 268589 - RNA, 21 nt, Homo sapiens
uuaagugcuuuguaugcacua

SEQ ID NO: 268590 - RNA, 22 nt, Homo sapiens
uuaaguuguagcuacaaauaca

SEQ ID NO: 268591 - RNA, 22 nt, Homo sapiens
uuaauacugcuuaacuuuagga

SEQ ID NO: 268592 - RNA, 22 nt, Homo sapiens
uuaauagugacucauuuuccac

SEQ ID NO: 268593 - RNA, 22 nt, Homo sapiens
uuaaucacagcugaacucaaac

SEQ ID NO: 268594 - RNA, 22 nt, Homo sapiens
uuaauguaauugauugauugac

SEQ ID NO: 268595 - RNA, 22 nt, Homo sapiens
uuaauuguaucuauagauguca

SEQ ID NO: 268596 - RNA, 21 nt, Homo sapiens
uuacaauggcuccuugaaggu

SEQ ID NO: 268597 - RNA, 22 nt, Homo sapiens
uuacacaguugguaggggcaga

SEQ ID NO: 268598 - RNA, 22 nt, Homo sapiens
uuacagauggcacacucaaggg

SEQ ID NO: 268599 - RNA, 23 nt, Homo sapiens
uuacaguggcaugaucucugcuc

SEQ ID NO: 268600 - RNA, 22 nt, Homo sapiens
uuacagugguugcuauugugaa

SEQ ID NO: 268601 - RNA, 19 nt, Homo sapiens
uuacagugugcccuuuuag

SEQ ID NO: 268602 - RNA, 22 nt, Homo sapiens
uuacaguucugguggagaggua

SEQ ID NO: 268603 - RNA, 22 nt, Homo sapiens
uuacaguugugagccaccaugc

SEQ ID NO: 268604 - RNA, 22 nt, Homo sapiens
uuacaucaucacauuaguuugc

SEQ ID NO: 268605 - RNA, 22 nt, Homo sapiens
uuacauugcuucaaauucagug

SEQ ID NO: 268606 - RNA, 22 nt, Homo sapiens
uuacuugagaugaguuggacaa

SEQ ID NO: 268607 - RNA, 17 nt, Homo sapiens
uuagacagacauccugc

SEQ ID NO: 268608 - RNA, 22 nt, Homo sapiens
uuagacaguggugcacugcacu

SEQ ID NO: 268609 - RNA, 22 nt, Homo sapiens
uuagaguguagcaggaagaggc

SEQ ID NO: 268610 - RNA, 22 nt, Homo sapiens
ucagaacugauacuagaacuuu

SEQ ID NO: 268611 - RNA, 22 nt, Homo sapiens
ucagagugcagggaguagcagc

SEQ ID NO: 268612 - RNA, 22 nt, Homo sapiens
ucagaguggccucucuugaaga

SEQ ID NO: 268613 - RNA, 22 nt, Homo sapiens
ucagaucaguuccacaagaacu

SEQ ID NO: 268614 - RNA, 22 nt, Homo sapiens
ucagaucauauucuucgcugcu

SEQ ID NO: 268615 - RNA, 22 nt, Homo sapiens
ucagaucaugcuuaugauggga

SEQ ID NO: 268616 - RNA, 22 nt, Homo sapiens
ucagauguuugagaaguauacu

SEQ ID NO: 268617 - RNA, 22 nt, Homo sapiens
ucagcacauucaaggccugccu

SEQ ID NO: 268618 - RNA, 21 nt, Homo sapiens
ucagcucaucacugccuggag

SEQ ID NO: 268619 - RNA, 22 nt, Homo sapiens
ucaggcaccuuccucuuaucug

SEQ ID NO: 268620 - RNA, 20 nt, Homo sapiens
ucagguagaucuuugagguc

SEQ ID NO: 268621 - RNA, 22 nt, Homo sapiens
ucaguaaaugcuguucucuuuu

SEQ ID NO: 268622 - RNA, 22 nt, Homo sapiens
ucaguaccugagagugggcaga

SEQ ID NO: 268623 - RNA, 23 nt, Homo sapiens
ucaguacuccacuuucaauagug

SEQ ID NO: 268624 - RNA, 22 nt, Homo sapiens
ucaguagcauugcuuauacagu

SEQ ID NO: 268625 - RNA, 18 nt, Homo sapiens
ucagucacugccuggcuu

SEQ ID NO: 268626 - RNA, 22 nt, Homo sapiens
ucagucuuuuuuuggcaagcau

SEQ ID NO: 268627 - RNA, 22 nt, Homo sapiens
ucagugauugcuuucauggaaa

SEQ ID NO: 268628 - RNA, 22 nt, Homo sapiens
ucagugccucaguuuuuaaaga

SEQ ID NO: 268629 - RNA, 22 nt, Homo sapiens
ucagugcuuuuuguugucauca

SEQ ID NO: 268630 - RNA, 22 nt, Homo sapiens
ucaguggagcuacaauucuggg

SEQ ID NO: 268631 - RNA, 22 nt, Homo sapiens
ucaguggauuauuaaagucacc

SEQ ID NO: 268632 - RNA, 22 nt, Homo sapiens
ucaguuaaugcugccugcugga

SEQ ID NO: 268633 - RNA, 21 nt, Homo sapiens
ucaguuacugagagagaagug

SEQ ID NO: 268634 - RNA, 22 nt, Homo sapiens
ucaguucauggaggugucugcu

SEQ ID NO: 268635 - RNA, 20 nt, Homo sapiens
ucauacuguggaguaccagg

SEQ ID NO: 268636 - RNA, 22 nt, Homo sapiens
ucauacuguuaaaugguuuagu

SEQ ID NO: 268637 - RNA, 22 nt, Homo sapiens
ucauagucuaagguucuuuugc

SEQ ID NO: 268638 - RNA, 22 nt, Homo sapiens
ucauaucauuagaucuacugua

SEQ ID NO: 268639 - RNA, 21 nt, Homo sapiens
ucauauguaucuuugugccuc

SEQ ID NO: 268640 - RNA, 22 nt, Homo sapiens
ucauauguaugugcaauuuugu

SEQ ID NO: 268641 - RNA, 21 nt, Homo sapiens
ucaucaagcuguagacaugau

SEQ ID NO: 268642 - RNA, 23 nt, Homo sapiens
ucaucacagcauuuccugguauu

SEQ ID NO: 268643 - RNA, 22 nt, Homo sapiens
ucaucaggcucauucaagcuga

SEQ ID NO: 268644 - RNA, 22 nt, Homo sapiens
ucauccauacaguuagcaaagg

SEQ ID NO: 268645 - RNA, 22 nt, Homo sapiens
ucaucucaguuucuugccguac

SEQ ID NO: 268646 - RNA, 22 nt, Homo sapiens
ucaucuggcgaaugugaagagu

SEQ ID NO: 268647 - RNA, 22 nt, Homo sapiens
ucaugaaguaguuaacugguug

SEQ ID NO: 268648 - RNA, 23 nt, Homo sapiens
ucaugaggccauucaaauccauu

SEQ ID NO: 268649 - RNA, 22 nt, Homo sapiens
ucaugcaaugagucaggaggca

SEQ ID NO: 268650 - RNA, 22 nt, Homo sapiens
ucauggggugcuuugcuagauu

SEQ ID NO: 268651 - RNA, 23 nt, Homo sapiens
ucaugguagcaccaacaauaacu

SEQ ID NO: 268652 - RNA, 22 nt, Homo sapiens
ucaugucuuguuguauuuauuu

SEQ ID NO: 268653 - RNA, 22 nt, Homo sapiens
ucauucacucccuugaaguuag

SEQ ID NO: 268654 - RNA, 22 nt, Homo sapiens
ucauucauucauccagcuugag

SEQ ID NO: 268655 - RNA, 22 nt, Homo sapiens
ucauucauuugcucacuccaca

SEQ ID NO: 268656 - RNA, 22 nt, Homo sapiens
ucauugcauuccagcccaagca

SEQ ID NO: 268657 - RNA, 22 nt, Homo sapiens
uccaaaucucuggcacugggau

SEQ ID NO: 268658 - RNA, 22 nt, Homo sapiens
uccacaauggagaagaguauga

SEQ ID NO: 268659 - RNA, 19 nt, Homo sapiens
uccacagugguugaacuag

SEQ ID NO: 268660 - RNA, 18 nt, Homo sapiens
uccacgugcuuuccagau

SEQ ID NO: 268661 - RNA, 22 nt, Homo sapiens
uccacugagcuagaccacuugg

SEQ ID NO: 268662 - RNA, 22 nt, Homo sapiens
uccaguuguucucgaagcuccu

SEQ ID NO: 268663 - RNA, 22 nt, Homo sapiens
uccaugagaauaguuaggcucu

SEQ ID NO: 268664 - RNA, 22 nt, Homo sapiens
uccauguagaagacaggggaga

SEQ ID NO: 268665 - RNA, 22 nt, Homo sapiens
uccauguaguugagcggcuuug

SEQ ID NO: 268666 - RNA, 22 nt, Homo sapiens
uccauuuguagguagugagaca

SEQ ID NO: 268667 - RNA, 20 nt, Homo sapiens
ucccaguaggagaaggaagg

SEQ ID NO: 268668 - RNA, 22 nt, Homo sapiens
ucccagugaaaccccaccuuca

SEQ ID NO: 268669 - RNA, 22 nt, Homo sapiens
ucccauugucucugaccuugcc

SEQ ID NO: 268670 - RNA, 22 nt, Homo sapiens
uccccaguaggcaauuaacacc

SEQ ID NO: 268671 - RNA, 22 nt, Homo sapiens
uccccugagaacuugcuagaaa

SEQ ID NO: 268672 - RNA, 22 nt, Homo sapiens
uccccugauaccaaccaccaug

SEQ ID NO: 268673 - RNA, 22 nt, Homo sapiens
ucccuacugggguacugccuag

SEQ ID NO: 268674 - RNA, 22 nt, Homo sapiens
ucccugagcaaaguuuucugua

SEQ ID NO: 268675 - RNA, 22 nt, Homo sapiens
ucccugagguccuggauuauug

SEQ ID NO: 268676 - RNA, 22 nt, Homo sapiens
ucccuggagcaagagaagaagg

SEQ ID NO: 268677 - RNA, 22 nt, Homo sapiens
ucccuuagccaaauccccagcc

SEQ ID NO: 268678 - RNA, 22 nt, Homo sapiens
ucccuugagccuggcuucucac

SEQ ID NO: 268679 - RNA, 22 nt, Homo sapiens
ucccuugguaauucuguuccuu

SEQ ID NO: 268680 - RNA, 19 nt, Homo sapiens
ucccuuuguagguaaccug

SEQ ID NO: 268681 - RNA, 19 nt, Homo sapiens
ucccuuuguauggacauac

SEQ ID NO: 268682 - RNA, 22 nt, Homo sapiens
uccugagaauagaguugcaugu

SEQ ID NO: 268683 - RNA, 22 nt, Homo sapiens
uccugagacugaggagcuuugg

SEQ ID NO: 268684 - RNA, 22 nt, Homo sapiens
uccuucacucuacaucuuuguu

SEQ ID NO: 268685 - RNA, 22 nt, Homo sapiens
uccuucaugcaucaauguaucc

SEQ ID NO: 268686 - RNA, 22 nt, Homo sapiens
uccuugaaacaggaagaauuca

SEQ ID NO: 268687 - RNA, 22 nt, Homo sapiens
uccuugguugauccugugcaga

SEQ ID NO: 268688 - RNA, 22 nt, Homo sapiens
uccuuugguggagucuuuaggg

SEQ ID NO: 268689 - RNA, 23 nt, Homo sapiens
ucgcagcauucaauaccaggcag

SEQ ID NO: 268690 - RNA, 22 nt, Homo sapiens
ucggcucagugcaagcucugcc

SEQ ID NO: 268691 - RNA, 22 nt, Homo sapiens
ucuagccuaugaagcuugucca

SEQ ID NO: 268692 - RNA, 22 nt, Homo sapiens
uucacagacaacuggucccuua

SEQ ID NO: 268693 - RNA, 22 nt, Homo sapiens
uucacagaguuauuuuuaugcu

SEQ ID NO: 268694 - RNA, 23 nt, Homo sapiens
uucaccguguuggccaggcuggu

SEQ ID NO: 268695 - RNA, 22 nt, Homo sapiens
uucaccuguagcaugcccuugg

SEQ ID NO: 268696 - RNA, 22 nt, Homo sapiens
uucacugcaugaaaaggacagc

SEQ ID NO: 268697 - RNA, 22 nt, Homo sapiens
uucacuguuaagcaguuaaacu

SEQ ID NO: 268698 - RNA, 22 nt, Homo sapiens
uucaggcuuuuauuuacugaua

SEQ ID NO: 268699 - RNA, 22 nt, Homo sapiens
uucagguaauuaugguuugucu

SEQ ID NO: 268700 - RNA, 22 nt, Homo sapiens
uucaguagucaaaagauaaggg

SEQ ID NO: 268701 - RNA, 22 nt, Homo sapiens
uucaguauugcaccuggagucc

SEQ ID NO: 268702 - RNA, 22 nt, Homo sapiens
uucaguggagaggcugaguggu

SEQ ID NO: 268703 - RNA, 22 nt, Homo sapiens
uucaguugcaucaguugaccag

SEQ ID NO: 268704 - RNA, 19 nt, Homo sapiens
uucauacagugagagcagc

SEQ ID NO: 268705 - RNA, 22 nt, Homo sapiens
uucaucagggagaaauaauuuc

SEQ ID NO: 268706 - RNA, 22 nt, Homo sapiens
uucaucaguuauauuggccuga

SEQ ID NO: 268707 - RNA, 21 nt, Homo sapiens
uucaucuggccguauuccagg

SEQ ID NO: 268708 - RNA, 22 nt, Homo sapiens
uucauggagccauccuuugauc

SEQ ID NO: 268709 - RNA, 22 nt, Homo sapiens
uucauggauggaaaugauuuug

SEQ ID NO: 268710 - RNA, 20 nt, Homo sapiens
uucaugggagcaaagaggcc

SEQ ID NO: 268711 - RNA, 22 nt, Homo sapiens
uucauguaauauuucacagcuu

SEQ ID NO: 268712 - RNA, 22 nt, Homo sapiens
uucauguaauuccauaagguaa

SEQ ID NO: 268713 - RNA, 22 nt, Homo sapiens
uucaugugagucuguauuaacu

SEQ ID NO: 268714 - RNA, 22 nt, Homo sapiens
uuccacaaugguugaacuaauu

SEQ ID NO: 268715 - RNA, 22 nt, Homo sapiens
uuccacagggauuugcauugau

SEQ ID NO: 268716 - RNA, 22 nt, Homo sapiens
uuccacuuuuuccuugugcucc

SEQ ID NO: 268717 - RNA, 22 nt, Homo sapiens
uuccaguuauuauaccucuuaa

SEQ ID NO: 268718 - RNA, 22 nt, Homo sapiens
uuccauagucauagugcugaug

SEQ ID NO: 268719 - RNA, 22 nt, Homo sapiens
uuccauguugauacgugaaguu

SEQ ID NO: 268720 - RNA, 22 nt, Homo sapiens
uucccagagagggacuucuaau

SEQ ID NO: 268721 - RNA, 22 nt, Homo sapiens
uucccugaaauauucacuuuca

SEQ ID NO: 268722 - RNA, 22 nt, Homo sapiens
uucccuuugugcauaggauuug

SEQ ID NO: 268723 - RNA, 22 nt, Homo sapiens
uuccuacugugcaaaguugcaa

SEQ ID NO: 268724 - RNA, 19 nt, Homo sapiens
uuccugagaacaagggcuu

SEQ ID NO: 268725 - RNA, 22 nt, Homo sapiens
uuccugagccuuguaucuagua

SEQ ID NO: 268726 - RNA, 22 nt, Homo sapiens
uuccugaggccuccccagaagc

SEQ ID NO: 268727 - RNA, 20 nt, Homo sapiens
uuccuuaggcauuggaagaa

SEQ ID NO: 268728 - RNA, 22 nt, Homo sapiens
uuccuugagaaaggcacaaguu

SEQ ID NO: 268729 - RNA, 22 nt, Homo sapiens
uuccuugugacuaguagugacc

SEQ ID NO: 268730 - RNA, 22 nt, Homo sapiens
uucuacaggcuguucaagaagc

SEQ ID NO: 268731 - RNA, 22 nt, Homo sapiens
uucuacagugacugcagccaua

SEQ ID NO: 268732 - RNA, 21 nt, Homo sapiens
uucuacuccggcguuguuuuu

SEQ ID NO: 268733 - RNA, 22 nt, Homo sapiens
uucuacuucauuaggaggauug

SEQ ID NO: 268734 - RNA, 22 nt, Homo sapiens
uucuagcacuuugggagacuga

SEQ ID NO: 268735 - RNA, 22 nt, Homo sapiens
uucuauugguaauauuuucugu

SEQ ID NO: 268736 - RNA, 22 nt, Homo sapiens
uucucaauggcaacuuguugcu

SEQ ID NO: 268737 - RNA, 21 nt, Homo sapiens
uucucaggguguguccuaccc

SEQ ID NO: 268738 - RNA, 22 nt, Homo sapiens
uucucaguaauuccagauuuuu

SEQ ID NO: 268739 - RNA, 22 nt, Homo sapiens
uucucagugaaguuuagaacau

SEQ ID NO: 268740 - RNA, 22 nt, Homo sapiens
uucucauggugauggcaaaauc

SEQ ID NO: 268741 - RNA, 22 nt, Homo sapiens
uucugaguggcuuucaacacug

SEQ ID NO: 268742 - RNA, 22 nt, Homo sapiens
uucugcuugaucuaguguguug

SEQ ID NO: 268743 - RNA, 22 nt, Homo sapiens
uucuggcuaugggauacuaaau

SEQ ID NO: 268744 - RNA, 22 nt, Homo sapiens
uucuggcucaggucaacacuuc

SEQ ID NO: 268745 - RNA, 22 nt, Homo sapiens
uucugguuaauacuugcaaaaa

SEQ ID NO: 268746 - RNA, 22 nt, Homo sapiens
uucugugguuucauuuaccugu

SEQ ID NO: 268747 - RNA, 22 nt, Homo sapiens
uucuuagguuaaggcugagaga

SEQ ID NO: 268748 - RNA, 22 nt, Homo sapiens
uucuucaggcauucccagaagc

SEQ ID NO: 268749 - RNA, 22 nt, Homo sapiens
uucuuccagccuugaggggccc

SEQ ID NO: 268750 - RNA, 22 nt, Homo sapiens
uucuugaggcaugccgcuggga

SEQ ID NO: 268751 - RNA, 22 nt, Homo sapiens
cugugcaugcgcggagcugaaa

SEQ ID NO: 268752 - RNA, 22 nt, Homo sapiens
cugugcuaggcaaugugguaga

SEQ ID NO: 268753 - RNA, 22 nt, Homo sapiens
cugugcuugagagaugacacag

SEQ ID NO: 268754 - RNA, 22 nt, Homo sapiens
cuguguaguacuagauugagca

SEQ ID NO: 268755 - RNA, 22 nt, Homo sapiens
cuguuugguaaggaugccucag

SEQ ID NO: 268756 - RNA, 22 nt, Homo sapiens
cuuaggguacuuuggugcauca

SEQ ID NO: 268757 - RNA, 20 nt, Homo sapiens
cuuaucaguggcaaguauaa

SEQ ID NO: 268758 - RNA, 22 nt, Homo sapiens
cuucaccaguuuggcagucuca

SEQ ID NO: 268759 - RNA, 22 nt, Homo sapiens
cuucacuggagucccuggauuc

SEQ ID NO: 268760 - RNA, 22 nt, Homo sapiens
cuucacuuuguuaaacuccaau

SEQ ID NO: 268761 - RNA, 22 nt, Homo sapiens
cuuccaguggcagccgggcaug

SEQ ID NO: 268762 - RNA, 22 nt, Homo sapiens
cuuccauaguauuuuuacaaaa

SEQ ID NO: 268763 - RNA, 18 nt, Homo sapiens
cuuccuuagucugguuaa

SEQ ID NO: 268764 - RNA, 22 nt, Homo sapiens
cuucugauugaaaauggaguag

SEQ ID NO: 268765 - RNA, 22 nt, Homo sapiens
cuucuugagacuuaggcuuugg

SEQ ID NO: 268766 - RNA, 22 nt, Homo sapiens
cuucuugcuguguccucacaug

SEQ ID NO: 268767 - RNA, 22 nt, Homo sapiens
cuugaauguaaauaauguacag

SEQ ID NO: 268768 - RNA, 23 nt, Homo sapiens
cuugagacaaaugcgugugugca

SEQ ID NO: 268769 - RNA, 22 nt, Homo sapiens
cuugagcuugagauccuuucug

SEQ ID NO: 268770 - RNA, 22 nt, Homo sapiens
cuugcacauuacagaucugcau

SEQ ID NO: 268771 - RNA, 22 nt, Homo sapiens
cuugcacuugaaauuccaguuu

SEQ ID NO: 268772 - RNA, 22 nt, Homo sapiens
cuugccuaaucugcaugauuuu

SEQ ID NO: 268773 - RNA, 22 nt, Homo sapiens
cuugccuuugucuucaaaggcu

SEQ ID NO: 268774 - RNA, 22 nt, Homo sapiens
cuuggcacugcucacccuccuu

SEQ ID NO: 268775 - RNA, 22 nt, Homo sapiens
cuuggcaugaagaauaauuuuu

SEQ ID NO: 268776 - RNA, 22 nt, Homo sapiens
cuuggcauuguguugauagaag

SEQ ID NO: 268777 - RNA, 22 nt, Homo sapiens
cuugggauauguguuacucugu

SEQ ID NO: 268778 - RNA, 22 nt, Homo sapiens
cuugguacucugugucccagcu

SEQ ID NO: 268779 - RNA, 18 nt, Homo sapiens
cuugucaaaucuuuccuc

SEQ ID NO: 268780 - RNA, 22 nt, Homo sapiens
cuugucacuguuggcuuuagaa

SEQ ID NO: 268781 - RNA, 22 nt, Homo sapiens
cuugugcaugaccccagguggg

SEQ ID NO: 268782 - RNA, 22 nt, Homo sapiens
cuuguucuccuaagaugaaugc

SEQ ID NO: 268783 - RNA, 22 nt, Homo sapiens
cuuuaugagguuggauggaucu

SEQ ID NO: 268784 - RNA, 22 nt, Homo sapiens
cuuugauuauaaaaggguguuu

SEQ ID NO: 268785 - RNA, 22 nt, Homo sapiens
cuuuggagaaaaguucuugggc

SEQ ID NO: 268786 - RNA, 22 nt, Homo sapiens
cuuugguuuacuuggugcuagu

SEQ ID NO: 268787 - RNA, 23 nt, Homo sapiens
cuuuguccccacccaaaucucau

SEQ ID NO: 268788 - RNA, 22 nt, Homo sapiens
cuuuguccuucaagguguguca

SEQ ID NO: 268789 - RNA, 22 nt, Homo sapiens
cuuuuacacugcuggugggaau

SEQ ID NO: 268790 - RNA, 22 nt, Homo sapiens
cuuuuacacuguuggugggaau

SEQ ID NO: 268791 - RNA, 23 nt, Homo sapiens
cuuuugcaaugugaucuugccac

SEQ ID NO: 268792 - RNA, 22 nt, Homo sapiens
cuuuuggucuaucagagaagca

SEQ ID NO: 268793 - RNA, 22 nt, Homo sapiens
cuuuugugauuccucaguuacu

SEQ ID NO: 268794 - RNA, 21 nt, Homo sapiens
cuuuuuacucguucauaugca

SEQ ID NO: 268795 - RNA, 22 nt, Homo sapiens
cuuuuugcuagagucuaggguc

SEQ ID NO: 268796 - RNA, 22 nt, Homo sapiens
cuuuuugguagagcaggugugc

SEQ ID NO: 268797 - RNA, 22 nt, Homo sapiens
gaaaacugcuucucuggguuuc

SEQ ID NO: 268798 - RNA, 22 nt, Homo sapiens
gaaacugcauuucuaacaagcu

SEQ ID NO: 268799 - RNA, 22 nt, Homo sapiens
gaaagcuaaugacuuuggguga

SEQ ID NO: 268800 - RNA, 22 nt, Homo sapiens
gaaagcugguauagauacauua

SEQ ID NO: 268801 - RNA, 22 nt, Homo sapiens
gaacuguuucuggugaaagagu

SEQ ID NO: 268802 - RNA, 22 nt, Homo sapiens
gaagauguugcuuaccuuggag

SEQ ID NO: 268803 - RNA, 22 nt, Homo sapiens
gaaggcaugcugcauggccaga

SEQ ID NO: 268804 - RNA, 22 nt, Homo sapiens
gaagguaguuuauagauguggu

SEQ ID NO: 268805 - RNA, 22 nt, Homo sapiens
gaaguaguaaaauuuauugcag

SEQ ID NO: 268806 - RNA, 17 nt, Homo sapiens
gaaguguuucagcagcu

SEQ ID NO: 268807 - RNA, 22 nt, Homo sapiens
gacauagagccuugacuucauu

SEQ ID NO: 268808 - RNA, 20 nt, Homo sapiens
uucuugaguuaacaaguuac

SEQ ID NO: 268809 - RNA, 22 nt, Homo sapiens
uucuugcacuuaacugacauuc

SEQ ID NO: 268810 - RNA, 22 nt, Homo sapiens
uugaaagacagaggggcaaguu

SEQ ID NO: 268811 - RNA, 22 nt, Homo sapiens
uugaaagacaucaccuacugcu

SEQ ID NO: 268812 - RNA, 22 nt, Homo sapiens
uugaaagucuaggcuuacagua

SEQ ID NO: 268813 - RNA, 22 nt, Homo sapiens
uugaaauguuuagaaguuugga

SEQ ID NO: 268814 - RNA, 22 nt, Homo sapiens
uugaacuagaaccugcaaauuu

SEQ ID NO: 268815 - RNA, 22 nt, Homo sapiens
uugaacugguaguuggaaaucu

SEQ ID NO: 268816 - RNA, 22 nt, Homo sapiens
uugaagacuauaugauucuuca

SEQ ID NO: 268817 - RNA, 22 nt, Homo sapiens
uugaaggaacgcuguucccuug

SEQ ID NO: 268818 - RNA, 19 nt, Homo sapiens
uugaaggccgccuugcaga

SEQ ID NO: 268819 - RNA, 22 nt, Homo sapiens
uugaaguaguacuuuauuauag

SEQ ID NO: 268820 - RNA, 22 nt, Homo sapiens
uugaaguguguauacauugugg

SEQ ID NO: 268821 - RNA, 22 nt, Homo sapiens
uugaauagaagguuuuuuguuc

SEQ ID NO: 268822 - RNA, 17 nt, Homo sapiens
uugaaugcauuacuugg

SEQ ID NO: 268823 - RNA, 18 nt, Homo sapiens
uugaaugcgucccagaga

SEQ ID NO: 268824 - RNA, 22 nt, Homo sapiens
uugaauguaugcuggguuuacu

SEQ ID NO: 268825 - RNA, 22 nt, Homo sapiens
uugaaugucuauuaaguuguuu

SEQ ID NO: 268826 - RNA, 22 nt, Homo sapiens
uugacaaguuguccaguaugag

SEQ ID NO: 268827 - RNA, 22 nt, Homo sapiens
uugacaggaugcucagggccca

SEQ ID NO: 268828 - RNA, 22 nt, Homo sapiens
uugacaguggcuuaaauugguu

SEQ ID NO: 268829 - RNA, 22 nt, Homo sapiens
uugacuguaagauggcuauuac

SEQ ID NO: 268830 - RNA, 22 nt, Homo sapiens
uugacuucagagcugauucaag

SEQ ID NO: 268831 - RNA, 22 nt, Homo sapiens
uugacuuuuauucacucugcua

SEQ ID NO: 268832 - RNA, 22 nt, Homo sapiens
uugagaagugucuguucauguc

SEQ ID NO: 268833 - RNA, 22 nt, Homo sapiens
uugagacggaguuuugcucuug

SEQ ID NO: 268834 - RNA, 17 nt, Homo sapiens
uugagaguauaucuuac

SEQ ID NO: 268835 - RNA, 22 nt, Homo sapiens
uugagauaggagcuguuguucu

SEQ ID NO: 268836 - RNA, 22 nt, Homo sapiens
uugagauaucuuggccuuugca

SEQ ID NO: 268837 - RNA, 22 nt, Homo sapiens
uugagauggagucucacuccuu

SEQ ID NO: 268838 - RNA, 22 nt, Homo sapiens
uugagauggagucucgcacugu

SEQ ID NO: 268839 - RNA, 22 nt, Homo sapiens
uugagauggagucuuguucucu

SEQ ID NO: 268840 - RNA, 22 nt, Homo sapiens
uugagauggagucuuguucuuu

SEQ ID NO: 268841 - RNA, 22 nt, Homo sapiens
uugucacccuacauaacaggga

SEQ ID NO: 268842 - RNA, 22 nt, Homo sapiens
uugucacuauaaauaagcauuu

SEQ ID NO: 268843 - RNA, 22 nt, Homo sapiens
uugucccauggggucuuccuuu

SEQ ID NO: 268844 - RNA, 22 nt, Homo sapiens
uuguccucuccaaaucucaugu

SEQ ID NO: 268845 - RNA, 22 nt, Homo sapiens
uugucuagugaauacauuaaug

SEQ ID NO: 268846 - RNA, 22 nt, Homo sapiens
uugucucacuggaguuuaguaa

SEQ ID NO: 268847 - RNA, 22 nt, Homo sapiens
uugugaaaucuaggcagagguu

SEQ ID NO: 268848 - RNA, 22 nt, Homo sapiens
uugugaauggaguagcaggauc

SEQ ID NO: 268849 - RNA, 22 nt, Homo sapiens
uugugaauggugcugcaguaaa

SEQ ID NO: 268850 - RNA, 22 nt, Homo sapiens
uugugcauguauauuaguucac

SEQ ID NO: 268851 - RNA, 20 nt, Homo sapiens
uugugcauugggccauuggg

SEQ ID NO: 268852 - RNA, 22 nt, Homo sapiens
uugugcuuaaugaguguaaggu

SEQ ID NO: 268853 - RNA, 22 nt, Homo sapiens
uugugcuucaucaccuagcaga

SEQ ID NO: 268854 - RNA, 22 nt, Homo sapiens
uugugguugaugaagacugucu

SEQ ID NO: 268855 - RNA, 22 nt, Homo sapiens
uugugguuuuaucuaccuuugg

SEQ ID NO: 268856 - RNA, 22 nt, Homo sapiens
uuguguccccacucaaauuaca

SEQ ID NO: 268857 - RNA, 22 nt, Homo sapiens
uuguguuuuuaguagggaaggg

SEQ ID NO: 268858 - RNA, 22 nt, Homo sapiens
uuguuauguuggucaguaaugu

SEQ ID NO: 268859 - RNA, 23 nt, Homo sapiens
uuguucccuuccacucagucucc

SEQ ID NO: 268860 - RNA, 22 nt, Homo sapiens
uuguuuagagacuggaauuaaa

SEQ ID NO: 268861 - RNA, 22 nt, Homo sapiens
uuuaaagcacggaguuuguggc

SEQ ID NO: 268862 - RNA, 22 nt, Homo sapiens
uuuaaagcaugacgagaagaag

SEQ ID NO: 268863 - RNA, 22 nt, Homo sapiens
uuuaauacugcaucuuuacucu

SEQ ID NO: 268864 - RNA, 22 nt, Homo sapiens
uuuacccugaggaaucuauuuu

SEQ ID NO: 268865 - RNA, 21 nt, Homo sapiens
uuuacuguggacccauugcuu

SEQ ID NO: 268866 - RNA, 22 nt, Homo sapiens
uuuagcacugugauugacaaaa

SEQ ID NO: 268867 - RNA, 22 nt, Homo sapiens
uuuaggcaugcaguucuauuua

SEQ ID NO: 268868 - RNA, 22 nt, Homo sapiens
uuuagggcaggccuggugguga

SEQ ID NO: 268869 - RNA, 21 nt, Homo sapiens
uuuagguagcuuuucugggag

SEQ ID NO: 268870 - RNA, 22 nt, Homo sapiens
uuuauggagagauauuuauggu

SEQ ID NO: 268871 - RNA, 22 nt, Homo sapiens
uuuauugcucuaaaguugccau

SEQ ID NO: 268872 - RNA, 22 nt, Homo sapiens
uuucaacaggucuggggugguc

SEQ ID NO: 268873 - RNA, 22 nt, Homo sapiens
uuucaagugcugucuuagcugu

SEQ ID NO: 268874 - RNA, 21 nt, Homo sapiens
uuucacugugaguuuuucugu

SEQ ID NO: 268875 - RNA, 22 nt, Homo sapiens
uuucaggcaagggugacccuga

SEQ ID NO: 268876 - RNA, 23 nt, Homo sapiens
uuucaguaguuguauccuguugc

SEQ ID NO: 268877 - RNA, 22 nt, Homo sapiens
uuucauagccuucuaaugaguu

SEQ ID NO: 268878 - RNA, 22 nt, Homo sapiens
uuucaucaagcacagaguagau

SEQ ID NO: 268879 - RNA, 22 nt, Homo sapiens
uuucauggagaaucuucuuacu

SEQ ID NO: 268880 - RNA, 22 nt, Homo sapiens
uuucauggcaguuuggggccug

SEQ ID NO: 268881 - RNA, 19 nt, Homo sapiens
uuucauguuuuuggugaga

SEQ ID NO: 268882 - RNA, 22 nt, Homo sapiens
uuuccacauggacuuaccuucg

SEQ ID NO: 268883 - RNA, 22 nt, Homo sapiens
uuuccagguggccaacauuuua

SEQ ID NO: 268884 - RNA, 22 nt, Homo sapiens
uuuccaguuguucuagaaagcu

SEQ ID NO: 268885 - RNA, 22 nt, Homo sapiens
uuucccauuguucugcucugug

SEQ ID NO: 268886 - RNA, 19 nt, Homo sapiens
uuucccugcagaccuacua

SEQ ID NO: 268887 - RNA, 22 nt, Homo sapiens
uuucccuuuagcuuagugauuu

SEQ ID NO: 268888 - RNA, 22 nt, Homo sapiens
uuucccuuugcuuugucagcca

SEQ ID NO: 268889 - RNA, 16 nt, Homo sapiens
uuucccuuugguguuu

SEQ ID NO: 268890 - RNA, 21 nt, Homo sapiens
uuuccuggagcguauggcuuc

SEQ ID NO: 268891 - RNA, 22 nt, Homo sapiens
uuucuauguugaccagucuaga

SEQ ID NO: 268892 - RNA, 16 nt, Homo sapiens
uuucuauguuuuacua

SEQ ID NO: 268893 - RNA, 22 nt, Homo sapiens
gcaagacaugucuaagguuuaa

SEQ ID NO: 268894 - RNA, 22 nt, Homo sapiens
gcaauggaaucccuugaucaau

SEQ ID NO: 268895 - RNA, 22 nt, Homo sapiens
gcacauggccacuaggaauaaa

SEQ ID NO: 268896 - RNA, 22 nt, Homo sapiens
gcaccccuuaccgggcuggguu

SEQ ID NO: 268897 - RNA, 22 nt, Homo sapiens
gcacgugcacccacaugcacgu

SEQ ID NO: 268898 - RNA, 22 nt, Homo sapiens
gcacugagagaagccccaagua

SEQ ID NO: 268899 - RNA, 22 nt, Homo sapiens
gcagaauugacucuguuuuuuc

SEQ ID NO: 268900 - RNA, 19 nt, Homo sapiens
gcagagaugugguagcuug

SEQ ID NO: 268901 - RNA, 22 nt, Homo sapiens
gcagcacauggcagaacauauu

SEQ ID NO: 268902 - RNA, 22 nt, Homo sapiens
gcagcagugcccuggauggaaa

SEQ ID NO: 268903 - RNA, 22 nt, Homo sapiens
gcagcagugugggcugaaccua

SEQ ID NO: 268904 - RNA, 22 nt, Homo sapiens
gcaggaauuucucugcagaccc

SEQ ID NO: 268905 - RNA, 22 nt, Homo sapiens
gcaguagugcgaucucagcuca

SEQ ID NO: 268906 - RNA, 23 nt, Homo sapiens
gcagucauuuggaaaagguugaa

SEQ ID NO: 268907 - RNA, 20 nt, Homo sapiens
gcaguguucugaccugaauc

SEQ ID NO: 268908 - RNA, 22 nt, Homo sapiens
gcauaaagcuaauaagacgaag

SEQ ID NO: 268909 - RNA, 20 nt, Homo sapiens
gcauaugucuuuauagcaga

SEQ ID NO: 268910 - RNA, 22 nt, Homo sapiens
gcauauuuuaaaguguaaccug

SEQ ID NO: 268911 - RNA, 22 nt, Homo sapiens
gcaucacagcuccugugcuggc

SEQ ID NO: 268912 - RNA, 22 nt, Homo sapiens
gcaucacagggagacaggccuc

SEQ ID NO: 268913 - RNA, 22 nt, Homo sapiens
gcaugcacaugugaaaaaauga

SEQ ID NO: 268914 - RNA, 22 nt, Homo sapiens
gcauggagaaggggacugauuc

SEQ ID NO: 268915 - RNA, 22 nt, Homo sapiens
gcauggaguggaaauucuuggg

SEQ ID NO: 268916 - RNA, 22 nt, Homo sapiens
gcaugugaauguguaagaaaau

SEQ ID NO: 268917 - RNA, 22 nt, Homo sapiens
gcauugcacuuggcauagacug

SEQ ID NO: 268918 - RNA, 22 nt, Homo sapiens
gccaaaaugcugggauuacagg

SEQ ID NO: 268919 - RNA, 22 nt, Homo sapiens
gccagauuguccaguuuuuuau

SEQ ID NO: 268920 - RNA, 21 nt, Homo sapiens
gccaguguggcaauuuuucaa

SEQ ID NO: 268921 - RNA, 22 nt, Homo sapiens
gccauugcacuccagcuugggc

SEQ ID NO: 268922 - RNA, 22 nt, Homo sapiens
gcccuacuguuuauacauagga

SEQ ID NO: 268923 - RNA, 22 nt, Homo sapiens
gccuguagaagaguagaugacc

SEQ ID NO: 268924 - RNA, 22 nt, Homo sapiens
gcgagcauuguaggaaguucag

SEQ ID NO: 268925 - RNA, 22 nt, Homo sapiens
gcuacugucuaucugugcuucu

SEQ ID NO: 268926 - RNA, 22 nt, Homo sapiens
gcugagacauugguuuucuccu

SEQ ID NO: 268927 - RNA, 22 nt, Homo sapiens
gcugcacuuuaaggcauccccu

SEQ ID NO: 268928 - RNA, 22 nt, Homo sapiens
gcugcuguaccagaugugguua

SEQ ID NO: 268929 - RNA, 22 nt, Homo sapiens
gcugcuguuauucaucagaacu

SEQ ID NO: 268930 - RNA, 21 nt, Homo sapiens
gcugguaaucacuuugccaaa

SEQ ID NO: 268931 - RNA, 22 nt, Homo sapiens
uuugugcuauguuauauauucu

SEQ ID NO: 268932 - RNA, 22 nt, Homo sapiens
uuugugcuccucucaguaugug

SEQ ID NO: 268933 - RNA, 21 nt, Homo sapiens
uuugugguuacugugugagcu

SEQ ID NO: 268934 - RNA, 22 nt, Homo sapiens
uuuguguggccuuggccuggca

SEQ ID NO: 268935 - RNA, 22 nt, Homo sapiens
uuuguucuucguuccugagcca

SEQ ID NO: 268936 - RNA, 22 nt, Homo sapiens
uuuuacacaucaccgcucgugu

SEQ ID NO: 268937 - RNA, 20 nt, Homo sapiens
uuuuagcuuuuauugaaagc

SEQ ID NO: 268938 - RNA, 22 nt, Homo sapiens
uuuuaguggacaaagguauuua

SEQ ID NO: 268939 - RNA, 22 nt, Homo sapiens
uuuucaguuuuccagguagccg

SEQ ID NO: 268940 - RNA, 22 nt, Homo sapiens
uuuuccagugggacucccauua

SEQ ID NO: 268941 - RNA, 22 nt, Homo sapiens
uuuugcaaauuccaguggccau

SEQ ID NO: 268942 - RNA, 22 nt, Homo sapiens
uuuugcaauauguuccugaaua

SEQ ID NO: 268943 - RNA, 22 nt, Homo sapiens
uuuugcacuagaaccagagguu

SEQ ID NO: 268944 - RNA, 22 nt, Homo sapiens
uuuugcaggucaggggcagaga

SEQ ID NO: 268945 - RNA, 19 nt, Homo sapiens
uuuugcucuuuauaccuau

SEQ ID NO: 268946 - RNA, 18 nt, Homo sapiens
uuuugcuuaacugcgcca

SEQ ID NO: 268947 - RNA, 22 nt, Homo sapiens
uuuugcuuuuccucggucccac

SEQ ID NO: 268948 - RNA, 19 nt, Homo sapiens
uuuuggaaaugugaacagc

SEQ ID NO: 268949 - RNA, 22 nt, Homo sapiens
uuuuggugguuaugugucaaug

SEQ ID NO: 268950 - RNA, 22 nt, Homo sapiens
uuuugguguauuguauaaggua

SEQ ID NO: 268951 - RNA, 21 nt, Homo sapiens
uuuugugcaugugcagccugc

SEQ ID NO: 268952 - RNA, 22 nt, Homo sapiens
uuuuuggaggagguuagaucau

SEQ ID NO: 268953 - RNA, 22 nt, Homo sapiens
uuuuuggguaaugauuaucaau

SEQ ID NO: 268954 - RNA, 22 nt, Homo sapiens
uuuuuuaguuagcugggcauga

SEQ ID NO: 268955 - RNA, 22 nt, Homo sapiens
uuuuuugcuguaugcaaacauc

SEQ ID NO: 268956 - RNA, 22 nt, Homo sapiens
guagaucucaacacuggaagua

SEQ ID NO: 268957 - RNA, 18 nt, Homo sapiens
guaggucaguaccaagca

SEQ ID NO: 268958 - RNA, 22 nt, Homo sapiens
guaucucaguucucgugauuag

SEQ ID NO: 268959 - RNA, 22 nt, Homo sapiens
guaugacacaggaagcuuaacc

SEQ ID NO: 268960 - RNA, 22 nt, Homo sapiens
guaugaccucgcuuuauugcag

SEQ ID NO: 268961 - RNA, 22 nt, Homo sapiens
guaugcacauauguguauguau

SEQ ID NO: 268962 - RNA, 22 nt, Homo sapiens
guauggaauuugugaccuuaua

SEQ ID NO: 268963 - RNA, 18 nt, Homo sapiens
guauuccagccugaguga

SEQ ID NO: 268964 - RNA, 22 nt, Homo sapiens
guauugcuugagcccaggaguu

SEQ ID NO: 268965 - RNA, 22 nt, Homo sapiens
gucaaaugcacagaaccauuaa

SEQ ID NO: 268966 - RNA, 22 nt, Homo sapiens
gucaagagaacuuucuaucacu

SEQ ID NO: 268967 - RNA, 22 nt, Homo sapiens
gucacagcuggcauugucugca

SEQ ID NO: 268968 - RNA, 22 nt, Homo sapiens
gucaccauugagucauuuccuc

SEQ ID NO: 268969 - RNA, 22 nt, Homo sapiens
gucacuguuuccuauuauauuu

SEQ ID NO: 268970 - RNA, 22 nt, Homo sapiens
gucagcaaagaggaauaguuug

SEQ ID NO: 268971 - RNA, 22 nt, Homo sapiens
gucaguggauacugucucuguc

SEQ ID NO: 268972 - RNA, 22 nt, Homo sapiens
gucagugucuuugcagcucaga

SEQ ID NO: 268973 - RNA, 22 nt, Homo sapiens
gucauauaggguuuaccuguau

SEQ ID NO: 268974 - RNA, 22 nt, Homo sapiens
gucauaugcucggaaaauguua

SEQ ID NO: 268975 - RNA, 22 nt, Homo sapiens
gucaucaggacgggucaucugc

SEQ ID NO: 268976 - RNA, 22 nt, Homo sapiens
gucaucaucaguccucugugca

SEQ ID NO: 268977 - RNA, 22 nt, Homo sapiens
gucauccaggcuggagugaagc

SEQ ID NO: 268978 - RNA, 22 nt, Homo sapiens
gucauggaaaucuacauuguua

SEQ ID NO: 268979 - RNA, 22 nt, Homo sapiens
gucauggacaaggugugagcca

SEQ ID NO: 268980 - RNA, 22 nt, Homo sapiens
gucauggacaguuugcuaauug

SEQ ID NO: 268981 - RNA, 22 nt, Homo sapiens
gucauucauucagcaagcacug

SEQ ID NO: 268982 - RNA, 22 nt, Homo sapiens
gucauugguucuguuuauguga

SEQ ID NO: 268983 - RNA, 22 nt, Homo sapiens
guccaaauccaugggauguaca

SEQ ID NO: 268984 - RNA, 22 nt, Homo sapiens
guccaagacuaggaguuggcag

SEQ ID NO: 268985 - RNA, 18 nt, Homo sapiens
guccauuuguugguacac

SEQ ID NO: 268986 - RNA, 22 nt, Homo sapiens
gucucugguugcuuuuguacca

SEQ ID NO: 268987 - RNA, 22 nt, Homo sapiens
gucucuuguuaucauuucugag

SEQ ID NO: 268988 - RNA, 22 nt, Homo sapiens
gucugguuccugggagauuucu

SEQ ID NO: 268989 - RNA, 22 nt, Homo sapiens
gucugguugacagcauguggcc

SEQ ID NO: 268990 - RNA, 22 nt, Homo sapiens
gucugucuuuugucuuugaaau

SEQ ID NO: 268991 - RNA, 22 nt, Homo sapiens
gucugugguuccuaugucaccu

SEQ ID NO: 268992 - RNA, 21 nt, Homo sapiens
gucuuacagccagaugccucu

SEQ ID NO: 268993 - RNA, 22 nt, Homo sapiens
gucuuggagacauugccauuga

SEQ ID NO: 268994 - RNA, 22 nt, Homo sapiens
gucuuggcaugugcagcuggga

SEQ ID NO: 268995 - RNA, 22 nt, Homo sapiens
gucuuuaguugaaacauguggu

SEQ ID NO: 268996 - RNA, 22 nt, Homo sapiens
gucuuuguuauuaugaaucaac

SEQ ID NO: 268997 - RNA, 22 nt, Homo sapiens
gucuuuguuuggucuguaucag

SEQ ID NO: 268998 - RNA, 22 nt, Homo sapiens
gugaaaagaugagcaccauaca

SEQ ID NO: 268999 - RNA, 22 nt, Homo sapiens
gugaaagcaucugacugugcca

SEQ ID NO: 269000 - RNA, 22 nt, Homo sapiens
gugaaaugaaacgcuaugucuu

SEQ ID NO: 269001 - RNA, 22 nt, Homo sapiens
gugaacagcagaugagugagug

SEQ ID NO: 269002 - RNA, 22 nt, Homo sapiens
gugaaugcauuaagaaggggga

SEQ ID NO: 269003 - RNA, 22 nt, Homo sapiens
gugacacagcaagacuccgucu

SEQ ID NO: 269004 - RNA, 22 nt, Homo sapiens
gugacauuuuuacugaugagag

SEQ ID NO: 269005 - RNA, 22 nt, Homo sapiens
ugacauguauuagcucagugcu

SEQ ID NO: 269006 - RNA, 22 nt, Homo sapiens
ugacauuacagucacuugcugu

SEQ ID NO: 269007 - RNA, 21 nt, Homo sapiens
ugacauuauuucaugucagua

SEQ ID NO: 269008 - RNA, 22 nt, Homo sapiens
ugacccauagaaauguggauaa

SEQ ID NO: 269009 - RNA, 22 nt, Homo sapiens
ugaccucugauagcaguaggug

SEQ ID NO: 269010 - RNA, 22 nt, Homo sapiens
ugacuacaaccuccaccucccg

SEQ ID NO: 269011 - RNA, 22 nt, Homo sapiens
ugacuacagauuugcugccaga

SEQ ID NO: 269012 - RNA, 22 nt, Homo sapiens
ugacuagagcaauuggaaacaa

SEQ ID NO: 269013 - RNA, 22 nt, Homo sapiens
ugacuggaacuuuagugagucu

SEQ ID NO: 269014 - RNA, 22 nt, Homo sapiens
ugacuggagaccucaguagggu

SEQ ID NO: 269015 - RNA, 22 nt, Homo sapiens
ugacuucauuuuuggccaugag

SEQ ID NO: 269016 - RNA, 22 nt, Homo sapiens
ugacuugaguaacuggcucagg

SEQ ID NO: 269017 - RNA, 20 nt, Homo sapiens
ugagaacauguggcauuugg

SEQ ID NO: 269018 - RNA, 19 nt, Homo sapiens
ugagaacaugugguauuug

SEQ ID NO: 269019 - RNA, 22 nt, Homo sapiens
ugagaacuagagaacaagguga

SEQ ID NO: 269020 - RNA, 22 nt, Homo sapiens
ugagaagacaucagcuuucgga

SEQ ID NO: 269021 - RNA, 22 nt, Homo sapiens
ugagaagacaucuuugcuuugu

SEQ ID NO: 269022 - RNA, 22 nt, Homo sapiens
ugagaagcauaccagugucugu

SEQ ID NO: 269023 - RNA, 22 nt, Homo sapiens
ugagaaugaugauuuccaguuu

SEQ ID NO: 269024 - RNA, 22 nt, Homo sapiens
ugagacauauuauacugcuuuu

SEQ ID NO: 269025 - RNA, 22 nt, Homo sapiens
ugagacaucacaaaauccucaa

SEQ ID NO: 269026 - RNA, 22 nt, Homo sapiens
ugagacggagucuggcacuguc

SEQ ID NO: 269027 - RNA, 22 nt, Homo sapiens
ugagacugaguuuugcucguug

SEQ ID NO: 269028 - RNA, 22 nt, Homo sapiens
ugagacugguaauguguagggc

SEQ ID NO: 269029 - RNA, 22 nt, Homo sapiens
ugagaggugauaaagcaagggu

SEQ ID NO: 269030 - RNA, 21 nt, Homo sapiens
ugagaguaguguauuauucuc

SEQ ID NO: 269031 - RNA, 22 nt, Homo sapiens
ugagauaaucaugugauuucau

SEQ ID NO: 269032 - RNA, 22 nt, Homo sapiens
ugagauaaugcaugugaagauc

SEQ ID NO: 269033 - RNA, 22 nt, Homo sapiens
ugagauaauuuacuuguugagg

SEQ ID NO: 269034 - RNA, 18 nt, Homo sapiens
ugagauacuagaauaggu

SEQ ID NO: 269035 - RNA, 22 nt, Homo sapiens
ugagauaggaucuugcucuguu

SEQ ID NO: 269036 - RNA, 22 nt, Homo sapiens
ugagauagggucucacucuguc

SEQ ID NO: 269037 - RNA, 22 nt, Homo sapiens
guugaggcaggagaauuacuug

SEQ ID NO: 269038 - RNA, 22 nt, Homo sapiens
guugcacagucuuuccuggacu

SEQ ID NO: 269039 - RNA, 22 nt, Homo sapiens
guugcucaggcugaagugcagu

SEQ ID NO: 269040 - RNA, 22 nt, Homo sapiens
guugcugagucccaucaccaga

SEQ ID NO: 269041 - RNA, 22 nt, Homo sapiens
guuugccuuuuagauaggaaug

SEQ ID NO: 269042 - RNA, 22 nt, Homo sapiens
guuuggcucuuguuucugucaa

SEQ ID NO: 269043 - RNA, 17 nt, Homo sapiens
guuuggguacuggguaa

SEQ ID NO: 269044 - RNA, 15 nt, Homo sapiens
guuuuuggauacaau

SEQ ID NO: 269045 - RNA, 22 nt, Homo sapiens
uaaacacucacuucauagccau

SEQ ID NO: 269046 - RNA, 22 nt, Homo sapiens
uaaacugucuugcaguuacaug

SEQ ID NO: 269047 - RNA, 22 nt, Homo sapiens
uaaagccagugauuaugucucu

SEQ ID NO: 269048 - RNA, 22 nt, Homo sapiens
uaaagcuacagagcggaaaauu

SEQ ID NO: 269049 - RNA, 22 nt, Homo sapiens
uaaagcuagaauuguuccagca

SEQ ID NO: 269050 - RNA, 22 nt, Homo sapiens
uaaagcuaugagaacaccguag

SEQ ID NO: 269051 - RNA, 18 nt, Homo sapiens
uaaaggcacuguguuguu

SEQ ID NO: 269052 - RNA, 22 nt, Homo sapiens
uaaagugaggauggcaguaggu

SEQ ID NO: 269053 - RNA, 22 nt, Homo sapiens
uaaaguuauugccccucaguua

SEQ ID NO: 269054 - RNA, 22 nt, Homo sapiens
uaaaugcucuuuaaaagugcuu

SEQ ID NO: 269055 - RNA, 22 nt, Homo sapiens
uaaauugcauaaguacaaauga

SEQ ID NO: 269056 - RNA, 18 nt, Homo sapiens
uaaauugcuucaccugag

SEQ ID NO: 269057 - RNA, 22 nt, Homo sapiens
uaacaacauucuaacugacggc

SEQ ID NO: 269058 - RNA, 22 nt, Homo sapiens
uaacaagagagucagucagucc

SEQ ID NO: 269059 - RNA, 22 nt, Homo sapiens
uaacagcauuugugucuaguag

SEQ ID NO: 269060 - RNA, 22 nt, Homo sapiens
uaacaggcaaggucacaccuug

SEQ ID NO: 269061 - RNA, 22 nt, Homo sapiens
uaacagucaagguuugaccagg

SEQ ID NO: 269062 - RNA, 18 nt, Homo sapiens
uaacagucucucaggauc

SEQ ID NO: 269063 - RNA, 22 nt, Homo sapiens
uaacauucacaugcugcaaaaa

SEQ ID NO: 269064 - RNA, 22 nt, Homo sapiens
uaacauuguugauuauacuaag

SEQ ID NO: 269065 - RNA, 22 nt, Homo sapiens
uaacccacgcagaauggacaag

SEQ ID NO: 269066 - RNA, 22 nt, Homo sapiens
uaacccuuacaacuacacucgu

SEQ ID NO: 269067 - RNA, 22 nt, Homo sapiens
uaacugcaaccuccgccucccg

SEQ ID NO: 269068 - RNA, 22 nt, Homo sapiens
uaacuguggaaaugacuuuaaa

SEQ ID NO: 269069 - RNA, 22 nt, Homo sapiens
uaagacacauguguucccaggc

SEQ ID NO: 269070 - RNA, 16 nt, Homo sapiens
uaagccccacgugcau

SEQ ID NO: 269071 - RNA, 22 nt, Homo sapiens
uaagcucauuccagccaugucc

SEQ ID NO: 269072 - RNA, 22 nt, Homo sapiens
uaaggcucuuguuauuuugagg

SEQ ID NO: 269073 - RNA, 22 nt, Homo sapiens
uaaggcuugcuucagucuugaa

SEQ ID NO: 269074 - RNA, 22 nt, Homo sapiens
uaaggcuuugucuuaggacuuu

SEQ ID NO: 269075 - RNA, 22 nt, Homo sapiens
uaagggacauguguugccuaag

SEQ ID NO: 269076 - RNA, 22 nt, Homo sapiens
uaagggacgcccccuucucucu

SEQ ID NO: 269077 - RNA, 22 nt, Homo sapiens
uaagggcaugcugcaugagagu

SEQ ID NO: 269078 - RNA, 22 nt, Homo sapiens
uaaguaauuuguauuuuaccca

SEQ ID NO: 269079 - RNA, 22 nt, Homo sapiens
uaagucuuuuuggaguuuauaa

SEQ ID NO: 269080 - RNA, 22 nt, Homo sapiens
uaagugaaggaaguguguuuac

SEQ ID NO: 269081 - RNA, 22 nt, Homo sapiens
uaagugaauuugacagguaaug

SEQ ID NO: 269082 - RNA, 23 nt, Homo sapiens
uaaguucaucucuaauaggugga

SEQ ID NO: 269083 - RNA, 22 nt, Homo sapiens
uaaguucauucaugaaacuuag

SEQ ID NO: 269084 - RNA, 21 nt, Homo sapiens
ugaauauuuggguugugucca

SEQ ID NO: 269085 - RNA, 22 nt, Homo sapiens
ugaauggauccaauucuuagua

SEQ ID NO: 269086 - RNA, 22 nt, Homo sapiens
ugaauguaagaugucugcuggu

SEQ ID NO: 269087 - RNA, 22 nt, Homo sapiens
ugaauuguuuacgagaugugag

SEQ ID NO: 269088 - RNA, 22 nt, Homo sapiens
ugacaagaaagcgucuucuuuu

SEQ ID NO: 269089 - RNA, 22 nt, Homo sapiens
ugacacagugggggauccuuuu

SEQ ID NO: 269090 - RNA, 22 nt, Homo sapiens
ugacacuugcccuuagaaacau

SEQ ID NO: 269091 - RNA, 22 nt, Homo sapiens
ugacagcaucaggauuggagag

SEQ ID NO: 269092 - RNA, 20 nt, Homo sapiens
ugacaucagcaauguaauaa

SEQ ID NO: 269093 - RNA, 18 nt, Homo sapiens
ugacaucauuuagaaagg

SEQ ID NO: 269094 - RNA, 22 nt, Homo sapiens
ugacaugaugagcaauaauggc

SEQ ID NO: 269095 - RNA, 21 nt, Homo sapiens
ugacauguuggugugcugcac

SEQ ID NO: 269096 - RNA, 21 nt, Homo sapiens
ugacauguugguguucugcac

SEQ ID NO: 269097 - RNA, 22 nt, Homo sapiens
ugacauugggagugaagugaag

SEQ ID NO: 269098 - RNA, 22 nt, Homo sapiens
ugacuacauaaguaaucucaaa

SEQ ID NO: 269099 - RNA, 21 nt, Homo sapiens
ugacuagauuccagauuggcc

SEQ ID NO: 269100 - RNA, 22 nt, Homo sapiens
ugacucaguuucucagguagua

SEQ ID NO: 269101 - RNA, 22 nt, Homo sapiens
ugacugaguaguauuccacuau

SEQ ID NO: 269102 - RNA, 23 nt, Homo sapiens
ugacuggagacuguugauccuuu

SEQ ID NO: 269103 - RNA, 22 nt, Homo sapiens
ugacuggagucuugcucugucg

SEQ ID NO: 269104 - RNA, 22 nt, Homo sapiens
ugacugucuagauagagcuugg

SEQ ID NO: 269105 - RNA, 22 nt, Homo sapiens
ugacuugaacuucuaugucacc

SEQ ID NO: 269106 - RNA, 22 nt, Homo sapiens
ugacuugaucacccccuaaggg

SEQ ID NO: 269107 - RNA, 21 nt, Homo sapiens
ugagaacaacaggucaagcag

SEQ ID NO: 269108 - RNA, 22 nt, Homo sapiens
ugagaacaugcacuugagguug

SEQ ID NO: 269109 - RNA, 16 nt, Homo sapiens
ugagaacaugcagcau

SEQ ID NO: 269110 - RNA, 20 nt, Homo sapiens
ugagaacaugugguauuugg

SEQ ID NO: 269111 - RNA, 18 nt, Homo sapiens
ugagaacauguguacaca

SEQ ID NO: 269112 - RNA, 22 nt, Homo sapiens
ugagaacucaugggucugcugg

SEQ ID NO: 269113 - RNA, 22 nt, Homo sapiens
ugagaacuuugucuuuuacucu

SEQ ID NO: 269114 - RNA, 22 nt, Homo sapiens
ugagaauauuuuccaugucuca

SEQ ID NO: 269115 - RNA, 22 nt, Homo sapiens
ugagaauguagggcucucccag

SEQ ID NO: 269116 - RNA, 22 nt, Homo sapiens
ugagacacugaauccggccuga

SEQ ID NO: 269117 - RNA, 22 nt, Homo sapiens
ugagacauacuuacaggggaug

SEQ ID NO: 269118 - RNA, 22 nt, Homo sapiens
ugagacaugugaacuguaguuc

SEQ ID NO: 269119 - RNA, 22 nt, Homo sapiens
ugagacgaagucuugcucuguu

SEQ ID NO: 269120 - RNA, 22 nt, Homo sapiens
ugagacggagucuugcccuguc

SEQ ID NO: 269121 - RNA, 22 nt, Homo sapiens
ugagacggaguuauuuauaaua

SEQ ID NO: 269122 - RNA, 22 nt, Homo sapiens
ugagacugagucucccucuguc

SEQ ID NO: 269123 - RNA, 22 nt, Homo sapiens
ugagacugagucucgcucuauu

SEQ ID NO: 269124 - RNA, 22 nt, Homo sapiens
ugagacugagucuugcucuugu

SEQ ID NO: 269125 - RNA, 22 nt, Homo sapiens
ugagacugaguuuccaucuugu

SEQ ID NO: 269126 - RNA, 22 nt, Homo sapiens
ugagacugaguuucgcucuugu

SEQ ID NO: 269127 - RNA, 22 nt, Homo sapiens
ugagagacaguuucgucggagg

SEQ ID NO: 269128 - RNA, 22 nt, Homo sapiens
ugagagacaguuuguuaaaauu

SEQ ID NO: 269129 - RNA, 22 nt, Homo sapiens
ugagagacauuuguuguagagu

SEQ ID NO: 269130 - RNA, 22 nt, Homo sapiens
ugagaggugaauggcaggcuca

SEQ ID NO: 269131 - RNA, 22 nt, Homo sapiens
ugagauaacuaaaaacauuuug

SEQ ID NO: 269132 - RNA, 22 nt, Homo sapiens
ugagaucaacugagucagagca

SEQ ID NO: 269133 - RNA, 18 nt, Homo sapiens
ugagaucagcaucaaggg

SEQ ID NO: 269134 - RNA, 22 nt, Homo sapiens
ugagaucaugccacugcacuuc

SEQ ID NO: 269135 - RNA, 22 nt, Homo sapiens
ugagaucaugucauuugcacuc

SEQ ID NO: 269136 - RNA, 19 nt, Homo sapiens
ugagauccacugaagauuc

SEQ ID NO: 269137 - RNA, 19 nt, Homo sapiens
ugagaucuuuacuggguuu

SEQ ID NO: 269138 - RNA, 22 nt, Homo sapiens
ugagaugaacuugauuguuuua

SEQ ID NO: 269139 - RNA, 22 nt, Homo sapiens
ugagaugaagucuugcucuguu

SEQ ID NO: 269140 - RNA, 22 nt, Homo sapiens
ugagaugagagaaugcuugccu

SEQ ID NO: 269141 - RNA, 22 nt, Homo sapiens
ugagaugagggcugcacucaaa

SEQ ID NO: 269142 - RNA, 22 nt, Homo sapiens
ugagaugaguugcuggcucuga

SEQ ID NO: 269143 - RNA, 22 nt, Homo sapiens
ugagaugaugggauaagagggc

SEQ ID NO: 269144 - RNA, 22 nt, Homo sapiens
ugagaugauuuaauggagccca

SEQ ID NO: 269145 - RNA, 22 nt, Homo sapiens
ugagaugcucgccggccagcau

SEQ ID NO: 269146 - RNA, 22 nt, Homo sapiens
ugagauggagucuugucgccua

SEQ ID NO: 269147 - RNA, 22 nt, Homo sapiens
uaaguugcagguugugauucca

SEQ ID NO: 269148 - RNA, 22 nt, Homo sapiens
uaaguuguagaacguuuucuua

SEQ ID NO: 269149 - RNA, 22 nt, Homo sapiens
uaauagcaguguuacuaggacu

SEQ ID NO: 269150 - RNA, 22 nt, Homo sapiens
uaauaguuucagaaguuguuuu

SEQ ID NO: 269151 - RNA, 22 nt, Homo sapiens
uaauaugugguugcuugggcac

SEQ ID NO: 269152 - RNA, 22 nt, Homo sapiens
uaauauguuuugaaaucaggaa

SEQ ID NO: 269153 - RNA, 22 nt, Homo sapiens
uaaugguuuugcaccaucccuc

SEQ ID NO: 269154 - RNA, 22 nt, Homo sapiens
uaauuggaucucaaaaaagugu

SEQ ID NO: 269155 - RNA, 22 nt, Homo sapiens
uacaaaguaacaguuccuguau

SEQ ID NO: 269156 - RNA, 22 nt, Homo sapiens
uacaacacugguucgacaugug

SEQ ID NO: 269157 - RNA, 22 nt, Homo sapiens
uacacacguguguauauauaca

SEQ ID NO: 269158 - RNA, 22 nt, Homo sapiens
uacacagucaaaaauuuccagg

SEQ ID NO: 269159 - RNA, 22 nt, Homo sapiens
uacacaugugaguucuuuucua

SEQ ID NO: 269160 - RNA, 22 nt, Homo sapiens
uacagaauauuucugcccugag

SEQ ID NO: 269161 - RNA, 22 nt, Homo sapiens
uacaggaaugucagguugcugu

SEQ ID NO: 269162 - RNA, 22 nt, Homo sapiens
uacagguaugugucuauauaca

SEQ ID NO: 269163 - RNA, 22 nt, Homo sapiens
uacagucuggaggccuguguug

SEQ ID NO: 269164 - RNA, 22 nt, Homo sapiens
uacagugcuuuuugguggagaa

SEQ ID NO: 269165 - RNA, 22 nt, Homo sapiens
uacaguguuuugguauuccaca

SEQ ID NO: 269166 - RNA, 22 nt, Homo sapiens
uacauacuguaugguucuguuu

SEQ ID NO: 269167 - RNA, 22 nt, Homo sapiens
uacauacuucacagacuuuaaa

SEQ ID NO: 269168 - RNA, 22 nt, Homo sapiens
uaccaaaguuucggccucuguu

SEQ ID NO: 269169 - RNA, 22 nt, Homo sapiens
uaccagcauuucucuuuaagua

SEQ ID NO: 269170 - RNA, 22 nt, Homo sapiens
uaccucuguaaguaaagauuca

SEQ ID NO: 269171 - RNA, 22 nt, Homo sapiens
uacuacuuucugacaucuuuaa

SEQ ID NO: 269172 - RNA, 22 nt, Homo sapiens
uacuagaggaaaacuugaagac

SEQ ID NO: 269173 - RNA, 22 nt, Homo sapiens
uacuagaggcgggguuucgcca

SEQ ID NO: 269174 - RNA, 22 nt, Homo sapiens
uacuagaguagugcagagggga

SEQ ID NO: 269175 - RNA, 22 nt, Homo sapiens
uacucaguagacacucauaugu

SEQ ID NO: 269176 - RNA, 22 nt, Homo sapiens
uacucugcagccauaaaacaga

SEQ ID NO: 269177 - RNA, 22 nt, Homo sapiens
uacugagagaggaauauugaaa

SEQ ID NO: 269178 - RNA, 22 nt, Homo sapiens
uacugcagucagacuccugggc

SEQ ID NO: 269179 - RNA, 22 nt, Homo sapiens
uacugcaucuacuuagagccag

SEQ ID NO: 269180 - RNA, 19 nt, Homo sapiens
uacuggcucgggaauuuuc

SEQ ID NO: 269181 - RNA, 22 nt, Homo sapiens
uacuuuguuauagcagcaggaa

SEQ ID NO: 269182 - RNA, 22 nt, Homo sapiens
uagaagcuacucuucuuguggc

SEQ ID NO: 269183 - RNA, 22 nt, Homo sapiens
uagaaguaggcuacgugucugg

SEQ ID NO: 269184 - RNA, 18 nt, Homo sapiens
uagaauauaggucauucu

SEQ ID NO: 269185 - RNA, 22 nt, Homo sapiens
uagaauguaacuuccaugucau

SEQ ID NO: 269186 - RNA, 22 nt, Homo sapiens
uagacccauuacguaguuucca

SEQ ID NO: 269187 - RNA, 22 nt, Homo sapiens
uagagaucuuauauuuuaugac

SEQ ID NO: 269188 - RNA, 21 nt, Homo sapiens
uagagcaacacacgcccucuc

SEQ ID NO: 269189 - RNA, 21 nt, Homo sapiens
uagagcuuggcacagaguaga

SEQ ID NO: 269190 - RNA, 22 nt, Homo sapiens
uagagguauaccaaaaaggcau

SEQ ID NO: 269191 - RNA, 22 nt, Homo sapiens
uagagguauuaacaguagaaga

SEQ ID NO: 269192 - RNA, 22 nt, Homo sapiens
accucagcccggggaaguugag

SEQ ID NO: 269193 - RNA, 22 nt, Homo sapiens
acgcagcacauucacagcuaug

SEQ ID NO: 269194 - RNA, 22 nt, Homo sapiens
acuacaugugaugucaguauau

SEQ ID NO: 269195 - RNA, 22 nt, Homo sapiens
acuacuucuaaguuuuggaaga

SEQ ID NO: 269196 - RNA, 22 nt, Homo sapiens
acuagguaguaaucugcagaga

SEQ ID NO: 269197 - RNA, 22 nt, Homo sapiens
ugcagugugcuggggucuccau

SEQ ID NO: 269198 - RNA, 22 nt, Homo sapiens
ugcaguguucuuuagaggaaau

SEQ ID NO: 269199 - RNA, 19 nt, Homo sapiens
ugcauaggguuacauacuc

SEQ ID NO: 269200 - RNA, 22 nt, Homo sapiens
ugcauaugucuuuauagcagca

SEQ ID NO: 269201 - RNA, 21 nt, Homo sapiens
ugcauauuggaacuuucucuc

SEQ ID NO: 269202 - RNA, 22 nt, Homo sapiens
ugcauccauucuagacucaucu

SEQ ID NO: 269203 - RNA, 22 nt, Homo sapiens
ugcauggagauauacaguuuuu

SEQ ID NO: 269204 - RNA, 22 nt, Homo sapiens
ugcauggagcucucuuuggacu

SEQ ID NO: 269205 - RNA, 21 nt, Homo sapiens
ugcaugguagucacaugauuc

SEQ ID NO: 269206 - RNA, 22 nt, Homo sapiens
ugcauugcacuugcaugagaua

SEQ ID NO: 269207 - RNA, 22 nt, Homo sapiens
ugcauuguuuuugguucccagg

SEQ ID NO: 269208 - RNA, 22 nt, Homo sapiens
ugccaacaugccuggcuguuuu

SEQ ID NO: 269209 - RNA, 22 nt, Homo sapiens
ugccaguguugccuuucacuag

SEQ ID NO: 269210 - RNA, 22 nt, Homo sapiens
ugccaguguuuuguugaagauu

SEQ ID NO: 269211 - RNA, 19 nt, Homo sapiens
ugccauguagcacaugguc

SEQ ID NO: 269212 - RNA, 21 nt, Homo sapiens
ugcccaguggcuuggggucag

SEQ ID NO: 269213 - RNA, 22 nt, Homo sapiens
ugccuacagaaggggcucagca

SEQ ID NO: 269214 - RNA, 22 nt, Homo sapiens
ugccuaguagaaggugaacaug

SEQ ID NO: 269215 - RNA, 22 nt, Homo sapiens
ugccuaguggaaggagagcaaa

SEQ ID NO: 269216 - RNA, 22 nt, Homo sapiens
ugccuaguguguugagaguuuu

SEQ ID NO: 269217 - RNA, 22 nt, Homo sapiens
ugccugagccagguuuuaggag

SEQ ID NO: 269218 - RNA, 22 nt, Homo sapiens
ugccugcugucuaauauauucu

SEQ ID NO: 269219 - RNA, 16 nt, Homo sapiens
ugccuucuucuguauu

SEQ ID NO: 269220 - RNA, 22 nt, Homo sapiens
ugcuaugucagccaggcugguc

SEQ ID NO: 269221 - RNA, 22 nt, Homo sapiens
ugcucaccugcugcucaccucc

SEQ ID NO: 269222 - RNA, 22 nt, Homo sapiens
ugcugcaaacaggcaucugugg

SEQ ID NO: 269223 - RNA, 22 nt, Homo sapiens
ugcugcauuggggauuaaguuu

SEQ ID NO: 269224 - RNA, 22 nt, Homo sapiens
ugcugguaguuuaugacuaauu

SEQ ID NO: 269225 - RNA, 22 nt, Homo sapiens
ugcugguguuuaggaauaagaa

SEQ ID NO: 269226 - RNA, 22 nt, Homo sapiens
ugcuguuguuugaugaaguaau

SEQ ID NO: 269227 - RNA, 22 nt, Homo sapiens
ugcuuagucuugcuuuagcuau

SEQ ID NO: 269228 - RNA, 22 nt, Homo sapiens
ugcuuaguuguauguuccacau

SEQ ID NO: 269229 - RNA, 22 nt, Homo sapiens
ugcuuguguucagguaaccuuu

SEQ ID NO: 269230 - RNA, 22 nt, Homo sapiens
ugcuuugguagaaaucuuuggu

SEQ ID NO: 269231 - RNA, 22 nt, Homo sapiens
uggaaaauuaggggagguuaua

SEQ ID NO: 269232 - RNA, 22 nt, Homo sapiens
uggaaaguacuugaguuuguau

SEQ ID NO: 269233 - RNA, 22 nt, Homo sapiens
uggaaauaaaauagaguuugcc

SEQ ID NO: 269234 - RNA, 22 nt, Homo sapiens
uggaaauuaacagggauugucc

SEQ ID NO: 269235 - RNA, 23 nt, Homo sapiens
uggaacugaauuucuuagcauuu

SEQ ID NO: 269236 - RNA, 22 nt, Homo sapiens
uggaacugauauugauggaaaa

SEQ ID NO: 269237 - RNA, 19 nt, Homo sapiens
uggaacugauucaguucug

SEQ ID NO: 269238 - RNA, 22 nt, Homo sapiens
uggaagauggaguuuuaucauu

SEQ ID NO: 269239 - RNA, 22 nt, Homo sapiens
uggaagaugggaccucaguuuu

SEQ ID NO: 269240 - RNA, 22 nt, Homo sapiens
uggaagccuagauucuuuucuu

SEQ ID NO: 269241 - RNA, 22 nt, Homo sapiens
uggaagucaugcugcaagaaca

SEQ ID NO: 269242 - RNA, 22 nt, Homo sapiens
uggaauacuauucugugcugga

SEQ ID NO: 269243 - RNA, 22 nt, Homo sapiens
uggaauaucaugagaguuuguu

SEQ ID NO: 269244 - RNA, 19 nt, Homo sapiens
uggaaugaaauguuagggg

SEQ ID NO: 269245 - RNA, 22 nt, Homo sapiens
uggaaugcuaagcaugugggag

SEQ ID NO: 269246 - RNA, 22 nt, Homo sapiens
uggaaugggauuggaaauuuug

SEQ ID NO: 269247 - RNA, 22 nt, Homo sapiens
uggaaugguuggugugauuuua

SEQ ID NO: 269248 - RNA, 22 nt, Homo sapiens
uggaauguaacuugaaacuuuu

SEQ ID NO: 269249 - RNA, 17 nt, Homo sapiens
uggaaugucuaagccug

SEQ ID NO: 269250 - RNA, 22 nt, Homo sapiens
uggaaugugaauaacuuccuuc

SEQ ID NO: 269251 - RNA, 21 nt, Homo sapiens
uggaauuaauggagagguguu

SEQ ID NO: 269252 - RNA, 22 nt, Homo sapiens
uggaauuuagguugauaguaua

SEQ ID NO: 269253 - RNA, 22 nt, Homo sapiens
uggacaagauagguucuauauu

SEQ ID NO: 269254 - RNA, 22 nt, Homo sapiens
uggacaagugcccuccaccuca

SEQ ID NO: 269255 - RNA, 22 nt, Homo sapiens
uggacagaaacauguuuucagu

SEQ ID NO: 269256 - RNA, 22 nt, Homo sapiens
uggacuguaauagagaacagaa

SEQ ID NO: 269257 - RNA, 22 nt, Homo sapiens
uggaggacugcagaacugaggc

SEQ ID NO: 269258 - RNA, 22 nt, Homo sapiens
uggaguaggccuaagaaugaca

SEQ ID NO: 269259 - RNA, 19 nt, Homo sapiens
uggagucaucaugcugcua

SEQ ID NO: 269260 - RNA, 22 nt, Homo sapiens
aagcaucacauaauggaucaug

SEQ ID NO: 269261 - RNA, 21 nt, Homo sapiens
aagcaugguguaucuuuccau

SEQ ID NO: 269262 - RNA, 22 nt, Homo sapiens
aagccacuguaccugucucuua

SEQ ID NO: 269263 - RNA, 22 nt, Homo sapiens
aagcuagugagacagugguacu

SEQ ID NO: 269264 - RNA, 22 nt, Homo sapiens
aagcugcauuuucuagaugcuu

SEQ ID NO: 269265 - RNA, 22 nt, Homo sapiens
aagcuggcauucauucguucuu

SEQ ID NO: 269266 - RNA, 22 nt, Homo sapiens
aagcuguugguggaucuaccau

SEQ ID NO: 269267 - RNA, 22 nt, Homo sapiens
aaggaagcuagcaggaauuggu

SEQ ID NO: 269268 - RNA, 22 nt, Homo sapiens
aaggaaguaauuugguuuauag

SEQ ID NO: 269269 - RNA, 22 nt, Homo sapiens
aaggaauacuggugguugcuau

SEQ ID NO: 269270 - RNA, 22 nt, Homo sapiens
aaggaauucaaauuuucucugg

SEQ ID NO: 269271 - RNA, 23 nt, Homo sapiens
aaggacacugaacacuucccagc

SEQ ID NO: 269272 - RNA, 22 nt, Homo sapiens
aaggaguagaggaauagcaaug

SEQ ID NO: 269273 - RNA, 22 nt, Homo sapiens
aaggauuguaacaccaagguua

SEQ ID NO: 269274 - RNA, 22 nt, Homo sapiens
aaggcaagauacugguugcuga

SEQ ID NO: 269275 - RNA, 20 nt, Homo sapiens
aaggcuuucgaguuccaggg

SEQ ID NO: 269276 - RNA, 22 nt, Homo sapiens
aagggaaugugguagcugguuu

SEQ ID NO: 269277 - RNA, 22 nt, Homo sapiens
aaggucauugugguuuuugcca

SEQ ID NO: 269278 - RNA, 22 nt, Homo sapiens
aagguggaguugacaauuuuca

SEQ ID NO: 269279 - RNA, 22 nt, Homo sapiens
aagguuguauuuaauauacugu

SEQ ID NO: 269280 - RNA, 22 nt, Homo sapiens
aaguaaacauugagagacaaga

SEQ ID NO: 269281 - RNA, 22 nt, Homo sapiens
aaguaaacauuuuguacaauaa

SEQ ID NO: 269282 - RNA, 22 nt, Homo sapiens
aaguaaaucuuaugucagggag

SEQ ID NO: 269283 - RNA, 19 nt, Homo sapiens
aaguacuugucuuuugaag

SEQ ID NO: 269284 - RNA, 22 nt, Homo sapiens
aaguauuagcuaauugugcuua

SEQ ID NO: 269285 - RNA, 22 nt, Homo sapiens
aagucaaggagagaggcgucag

SEQ ID NO: 269286 - RNA, 22 nt, Homo sapiens
aagucauggaggaguaugugag

SEQ ID NO: 269287 - RNA, 22 nt, Homo sapiens
aagugaauucauuguguuauau

SEQ ID NO: 269288 - RNA, 20 nt, Homo sapiens
aagugcaucguugugucugc

SEQ ID NO: 269289 - RNA, 22 nt, Homo sapiens
aagugcccuauuuggcccuuga

SEQ ID NO: 269290 - RNA, 22 nt, Homo sapiens
aagugcuuuuuagauaugguuu

SEQ ID NO: 269291 - RNA, 22 nt, Homo sapiens
aagugguagggucaggauugga

SEQ ID NO: 269292 - RNA, 22 nt, Homo sapiens
aagugguguuugggagcuggac

SEQ ID NO: 269293 - RNA, 22 nt, Homo sapiens
aagugucuuaccgggagggagu

SEQ ID NO: 269294 - RNA, 22 nt, Homo sapiens
aaguuguaguuagagaguugcu

SEQ ID NO: 269295 - RNA, 22 nt, Homo sapiens
aauaaagccugucucuuuagag

SEQ ID NO: 269296 - RNA, 22 nt, Homo sapiens
aauaaaguaggaggugaggaaa

SEQ ID NO: 269297 - RNA, 22 nt, Homo sapiens
aauaagcugagagaauucuaca

SEQ ID NO: 269298 - RNA, 22 nt, Homo sapiens
aauaauggcaccaaagcacaag

SEQ ID NO: 269299 - RNA, 22 nt, Homo sapiens
aauagagucaggguuucaccau

SEQ ID NO: 269300 - RNA, 22 nt, Homo sapiens
aauaguggcuuggacuaaauau

SEQ ID NO: 269301 - RNA, 22 nt, Homo sapiens
aauaucacaguuggguguacac

SEQ ID NO: 269302 - RNA, 22 nt, Homo sapiens
aauaugguuuuaugaagcaauu

SEQ ID NO: 269303 - RNA, 19 nt, Homo sapiens
aauauugacaguggugucu

SEQ ID NO: 269304 - RNA, 22 nt, Homo sapiens
aaucacaggucuuggcugcaug

SEQ ID NO: 269305 - RNA, 22 nt, Homo sapiens
aaucacaguguucuugugaggg

SEQ ID NO: 269306 - RNA, 22 nt, Homo sapiens
aaucacuuugcuacaaggcagu

SEQ ID NO: 269307 - RNA, 22 nt, Homo sapiens
aaucacuuuggcaccaaccuaa

SEQ ID NO: 269308 - RNA, 22 nt, Homo sapiens
aauccaugugcuuuaccauuuu

SEQ ID NO: 269309 - RNA, 22 nt, Homo sapiens
aauccauuugccgucuauccau

SEQ ID NO: 269310 - RNA, 22 nt, Homo sapiens
aaucccuuuguccagucucuuu

SEQ ID NO: 269311 - RNA, 22 nt, Homo sapiens
aaucucaacacuuugggaggcu

SEQ ID NO: 269312 - RNA, 22 nt, Homo sapiens
aaucugauguuaucagcuuaag

SEQ ID NO: 269313 - RNA, 22 nt, Homo sapiens
aaugacagugcuaaagaacccu

SEQ ID NO: 269314 - RNA, 22 nt, Homo sapiens
aaugcacauauauuuccuuauu

SEQ ID NO: 269315 - RNA, 22 nt, Homo sapiens
aaugccacugugccugccaagg

SEQ ID NO: 269316 - RNA, 22 nt, Homo sapiens
aauggcacacaccuggucuaac

SEQ ID NO: 269317 - RNA, 20 nt, Homo sapiens
aauggcauguuggacaacug

SEQ ID NO: 269318 - RNA, 22 nt, Homo sapiens
aauggcauugguccuuuuggau

SEQ ID NO: 269319 - RNA, 18 nt, Homo sapiens
aauggcucuggguucuaa

SEQ ID NO: 269320 - RNA, 22 nt, Homo sapiens
aauggcuucuuauugugguuca

SEQ ID NO: 269321 - RNA, 22 nt, Homo sapiens
aauggcuuucagcuuuucccca

SEQ ID NO: 269322 - RNA, 22 nt, Homo sapiens
aaugugcuguucagaggagucc

SEQ ID NO: 269323 - RNA, 22 nt, Homo sapiens
aauucuguauuguuuagggacu

SEQ ID NO: 269324 - RNA, 22 nt, Homo sapiens
aauucugugagauggugcagau

SEQ ID NO: 269325 - RNA, 22 nt, Homo sapiens
aauugaccuaaucugauuacug

SEQ ID NO: 269326 - RNA, 22 nt, Homo sapiens
aauugcauugaauuuguagcuu

SEQ ID NO: 269327 - RNA, 22 nt, Homo sapiens
acaagugcuuuuccuggagaca

SEQ ID NO: 269328 - RNA, 22 nt, Homo sapiens
acaauguauauuuuacuguagg

SEQ ID NO: 269329 - RNA, 22 nt, Homo sapiens
acacacgugcauguaugcguau

SEQ ID NO: 269330 - RNA, 22 nt, Homo sapiens
acacaguaaauauguauugaau

SEQ ID NO: 269331 - RNA, 22 nt, Homo sapiens
acacaguaagcacaguguagau

SEQ ID NO: 269332 - RNA, 22 nt, Homo sapiens
acacaguauaugacaaugcuuu

SEQ ID NO: 269333 - RNA, 22 nt, Homo sapiens
acacagucaaauccacuuggcu

SEQ ID NO: 269334 - RNA, 22 nt, Homo sapiens
acacaugcuccacuguggccuc

SEQ ID NO: 269335 - RNA, 22 nt, Homo sapiens
acacucucucauuacuuguuug

SEQ ID NO: 269336 - RNA, 22 nt, Homo sapiens
acacuggguaacauaucuguua

SEQ ID NO: 269337 - RNA, 22 nt, Homo sapiens
acacuguauccuucuguccuuu

SEQ ID NO: 269338 - RNA, 22 nt, Homo sapiens
acacugucaugucucacaggca

SEQ ID NO: 269339 - RNA, 20 nt, Homo sapiens
acacugugcuaaggauuuuc

SEQ ID NO: 269340 - RNA, 22 nt, Homo sapiens
acacuguuuuaguuauuauagc

SEQ ID NO: 269341 - RNA, 22 nt, Homo sapiens
acacuuucuggagcugcacaua

SEQ ID NO: 269342 - RNA, 19 nt, Homo sapiens
acaguaccuggcaugaggu

SEQ ID NO: 269343 - RNA, 22 nt, Homo sapiens
acaguacuuuuggauuugugaa

SEQ ID NO: 269344 - RNA, 22 nt, Homo sapiens
acaguaugcuuuaaacuuuguu

SEQ ID NO: 269345 - RNA, 22 nt, Homo sapiens
acagucacaauuuguaccuuuu

SEQ ID NO: 269346 - RNA, 22 nt, Homo sapiens
acagucuggagaaugggugcuc

SEQ ID NO: 269347 - RNA, 18 nt, Homo sapiens
acagugcugucacugcuu

SEQ ID NO: 269348 - RNA, 22 nt, Homo sapiens
acagugcuguggucaugggucu

SEQ ID NO: 269349 - RNA, 22 nt, Homo sapiens
acagugcuucugauaugaugcc

SEQ ID NO: 269350 - RNA, 22 nt, Homo sapiens
ggaucacagccagcucccagaa

SEQ ID NO: 269351 - RNA, 22 nt, Homo sapiens
ggaugcauucaacuuccaguuc

SEQ ID NO: 269352 - RNA, 22 nt, Homo sapiens
ggaugcauuuuugguugucaca

SEQ ID NO: 269353 - RNA, 22 nt, Homo sapiens
ggaugugugcacgcgcacaugc

SEQ ID NO: 269354 - RNA, 21 nt, Homo sapiens
ggauucaucccucaugaauuu

SEQ ID NO: 269355 - RNA, 22 nt, Homo sapiens
ggcaaaauggccagugggucac

SEQ ID NO: 269356 - RNA, 22 nt, Homo sapiens
ggcaaagaugaccauuacuuuu

SEQ ID NO: 269357 - RNA, 22 nt, Homo sapiens
ggcaaaucugcaauuacuuuug

SEQ ID NO: 269358 - RNA, 22 nt, Homo sapiens
ggcaacauggugaaacucuguc

SEQ ID NO: 269359 - RNA, 22 nt, Homo sapiens
ggcaagaaagaaaucaucuguc

SEQ ID NO: 269360 - RNA, 17 nt, Homo sapiens
ggcaagaaguggaacuc

SEQ ID NO: 269361 - RNA, 22 nt, Homo sapiens
ggcaagaucuuggcucacugaa

SEQ ID NO: 269362 - RNA, 22 nt, Homo sapiens
ggcaaggugaugaaugucuaca

SEQ ID NO: 269363 - RNA, 23 nt, Homo sapiens
ggcacggaauucaaagaggcauu

SEQ ID NO: 269364 - RNA, 22 nt, Homo sapiens
ggcacgguggcucacgccugua

SEQ ID NO: 269365 - RNA, 22 nt, Homo sapiens
ggcagagucuugcaucuuuaga

SEQ ID NO: 269366 - RNA, 22 nt, Homo sapiens
ggcagcacaauuuucugaugga

SEQ ID NO: 269367 - RNA, 22 nt, Homo sapiens
ggcagguaaggagugggagccu

SEQ ID NO: 269368 - RNA, 22 nt, Homo sapiens
ggcaguguauuacuuaggguuc

SEQ ID NO: 269369 - RNA, 22 nt, Homo sapiens
ggcaguuucucaggcaggggua

SEQ ID NO: 269370 - RNA, 22 nt, Homo sapiens
ggcaguuuguuugugaggucca

SEQ ID NO: 269371 - RNA, 22 nt, Homo sapiens
ggccagaugcaguggcucacac

SEQ ID NO: 269372 - RNA, 22 nt, Homo sapiens
ggcccugauacaaguaaggucu

SEQ ID NO: 269373 - RNA, 22 nt, Homo sapiens
ggcuagagacaaguugcugaga

SEQ ID NO: 269374 - RNA, 22 nt, Homo sapiens
ggcuagagagcucagggauaug

SEQ ID NO: 269375 - RNA, 22 nt, Homo sapiens
ggcucguguuuucuguccaguu

SEQ ID NO: 269376 - RNA, 21 nt, Homo sapiens
ggcucuguggucucagguuuc

SEQ ID NO: 269377 - RNA, 22 nt, Homo sapiens
ggcuuggaggaaugugagggcu

SEQ ID NO: 269378 - RNA, 22 nt, Homo sapiens
gggaaaaugucuauugaaugaa

SEQ ID NO: 269379 - RNA, 22 nt, Homo sapiens
gggaagaaggagugguuuacuc

SEQ ID NO: 269380 - RNA, 22 nt, Homo sapiens
gggaagugugguuucuuuacag

SEQ ID NO: 269381 - RNA, 22 nt, Homo sapiens
gggagguuguauguaugcgggg

SEQ ID NO: 269382 - RNA, 22 nt, Homo sapiens
gggaugaagcccuaggguuggu

SEQ ID NO: 269383 - RNA, 22 nt, Homo sapiens
gggaugaaguugauguagaaag

SEQ ID NO: 269384 - RNA, 22 nt, Homo sapiens
gggcacgugugugcugugcuca

SEQ ID NO: 269385 - RNA, 22 nt, Homo sapiens
gggcaugauggugcacacaugu

SEQ ID NO: 269386 - RNA, 22 nt, Homo sapiens
ggguaaaucucuuuucauggcu

SEQ ID NO: 269387 - RNA, 22 nt, Homo sapiens
gguaacaguggggcuaugcuua

SEQ ID NO: 269388 - RNA, 22 nt, Homo sapiens
gguauguaggucuacgguacaa

SEQ ID NO: 269389 - RNA, 22 nt, Homo sapiens
gguauuauuugccuuuuacuga

SEQ ID NO: 269390 - RNA, 22 nt, Homo sapiens
ggucaacaucaucaugguaagu

SEQ ID NO: 269391 - RNA, 22 nt, Homo sapiens
ggucagauggcagcugggccug

SEQ ID NO: 269392 - RNA, 22 nt, Homo sapiens
ggucaggagaaugguaacugag

SEQ ID NO: 269393 - RNA, 22 nt, Homo sapiens
ggucaguguuaucaccgaagga

SEQ ID NO: 269394 - RNA, 22 nt, Homo sapiens
ggugacugguuuaucuggcagu

SEQ ID NO: 269395 - RNA, 19 nt, Homo sapiens
ggugagaaauuaugggucu

SEQ ID NO: 269396 - RNA, 22 nt, Homo sapiens
ggugaucauugucucuaguaug

SEQ ID NO: 269397 - RNA, 22 nt, Homo sapiens
guaaaugcagaugcaugaccuu

SEQ ID NO: 269398 - RNA, 22 nt, Homo sapiens
guaaauguccccugugauauug

SEQ ID NO: 269399 - RNA, 22 nt, Homo sapiens
guaacacaugcugcucucuggu

SEQ ID NO: 269400 - RNA, 22 nt, Homo sapiens
guacaguaguaaaagugaauga

SEQ ID NO: 269401 - RNA, 22 nt, Homo sapiens
guacagugcucacaaugagagc

SEQ ID NO: 269402 - RNA, 22 nt, Homo sapiens
guacuuagagauagggucuuua

SEQ ID NO: 269403 - RNA, 22 nt, Homo sapiens
guacuuuguuauaacccacagg

SEQ ID NO: 269404 - RNA, 22 nt, Homo sapiens
guagaaagcauuucagauuugc

SEQ ID NO: 269405 - RNA, 22 nt, Homo sapiens
guagaaaguuugcugucacaug

SEQ ID NO: 269406 - RNA, 22 nt, Homo sapiens
guagagagaaauacaaagcugu

SEQ ID NO: 269407 - RNA, 22 nt, Homo sapiens
guagcagaacauguuccuugua

SEQ ID NO: 269408 - RNA, 22 nt, Homo sapiens
guagcagucacauagcagauug

SEQ ID NO: 269409 - RNA, 22 nt, Homo sapiens
guagcaugcaauauuauagaga

SEQ ID NO: 269410 - RNA, 22 nt, Homo sapiens
guauacaugucaaaacucacau

SEQ ID NO: 269411 - RNA, 22 nt, Homo sapiens
guaucccuugcuaucugaaucu

SEQ ID NO: 269412 - RNA, 22 nt, Homo sapiens
guaugaaaaucggagauugggu

SEQ ID NO: 269413 - RNA, 18 nt, Homo sapiens
guaugcacaugccccugc

SEQ ID NO: 269414 - RNA, 22 nt, Homo sapiens
guauggaagucaguuuguuggc

SEQ ID NO: 269415 - RNA, 22 nt, Homo sapiens
guaugugcauuguaaauuuuga

SEQ ID NO: 269416 - RNA, 22 nt, Homo sapiens
guauuagguuggggcaaaagua

SEQ ID NO: 269417 - RNA, 22 nt, Homo sapiens
guauuagguuggugcaaaauaa

SEQ ID NO: 269418 - RNA, 19 nt, Homo sapiens
guauuugacuuucuuguuu

SEQ ID NO: 269419 - RNA, 22 nt, Homo sapiens
gucaacauauuaauuauguucu

SEQ ID NO: 269420 - RNA, 22 nt, Homo sapiens
gucacagaaaaagauaugccaa

SEQ ID NO: 269421 - RNA, 22 nt, Homo sapiens
gucacagcacuuuuaguaagug

SEQ ID NO: 269422 - RNA, 20 nt, Homo sapiens
gucacuggcccagggcuugu

SEQ ID NO: 269423 - RNA, 22 nt, Homo sapiens
gucacuggcugucuuguaugau

SEQ ID NO: 269424 - RNA, 21 nt, Homo sapiens
gucacuggggcuggauaauuc

SEQ ID NO: 269425 - RNA, 22 nt, Homo sapiens
gucacugggugcugcgccuguc

SEQ ID NO: 269426 - RNA, 22 nt, Homo sapiens
gucagauaauuugcauccaucu

SEQ ID NO: 269427 - RNA, 22 nt, Homo sapiens
gucaguggagaaaaggacaugu

SEQ ID NO: 269428 - RNA, 22 nt, Homo sapiens
gucaguucuugugguugcauuc

SEQ ID NO: 269429 - RNA, 21 nt, Homo sapiens
gucauaugucucugauuagug

SEQ ID NO: 269430 - RNA, 22 nt, Homo sapiens
gucauggaggaugaauggccaa

SEQ ID NO: 269431 - RNA, 22 nt, Homo sapiens
gucauggagggacauaacuaac

SEQ ID NO: 269432 - RNA, 22 nt, Homo sapiens
gucauugagucagggaguaucu

SEQ ID NO: 269433 - RNA, 22 nt, Homo sapiens
guccaaagugggagaggugggg

SEQ ID NO: 269434 - RNA, 22 nt, Homo sapiens
guccauuuguuuccagagcacu

SEQ ID NO: 269435 - RNA, 22 nt, Homo sapiens
gucccugcgauugugggauccu

SEQ ID NO: 269436 - RNA, 22 nt, Homo sapiens
guccugaagaccuuccucugga

SEQ ID NO: 269437 - RNA, 22 nt, Homo sapiens
gucucccaaccccugugcccag

SEQ ID NO: 269438 - RNA, 22 nt, Homo sapiens
gucuggcuuaucucacuuacca

SEQ ID NO: 269439 - RNA, 22 nt, Homo sapiens
gucugguuuuuuauauccucac

SEQ ID NO: 269440 - RNA, 22 nt, Homo sapiens
guucaguuuuaaagggaaauug

SEQ ID NO: 269441 - RNA, 22 nt, Homo sapiens
guucaucagggauauuggccug

SEQ ID NO: 269442 - RNA, 20 nt, Homo sapiens
guucccuguaggugugcgga

SEQ ID NO: 269443 - RNA, 22 nt, Homo sapiens
guucucacuggugcugguaagu

SEQ ID NO: 269444 - RNA, 22 nt, Homo sapiens
guucuggagauaaagccaaggu

SEQ ID NO: 269445 - RNA, 22 nt, Homo sapiens
guugaaaucaucacuuggcaug

SEQ ID NO: 269446 - RNA, 22 nt, Homo sapiens
guugaacaauagauucauauca

SEQ ID NO: 269447 - RNA, 22 nt, Homo sapiens
guugcagaguucuuccuccuga

SEQ ID NO: 269448 - RNA, 22 nt, Homo sapiens
guugcucaggccggagugcagu

SEQ ID NO: 269449 - RNA, 22 nt, Homo sapiens
guuggcaaguggcugagcuggg

SEQ ID NO: 269450 - RNA, 22 nt, Homo sapiens
guuggucaaugugauuaggcca

SEQ ID NO: 269451 - RNA, 22 nt, Homo sapiens
guuggugaccugaagagaguaa

SEQ ID NO: 269452 - RNA, 22 nt, Homo sapiens
guuguggagucuucuguucugg

SEQ ID NO: 269453 - RNA, 22 nt, Homo sapiens
guuuggcuuucucucuauccug

SEQ ID NO: 269454 - RNA, 22 nt, Homo sapiens
guuuguaacucuagugacuaga

SEQ ID NO: 269455 - RNA, 22 nt, Homo sapiens
guuugugcuccuaugagaaccu

SEQ ID NO: 269456 - RNA, 22 nt, Homo sapiens
uaaaagucaucacaacuggagu

SEQ ID NO: 269457 - RNA, 22 nt, Homo sapiens
uaaagaugcugggaaggcuagg

SEQ ID NO: 269458 - RNA, 22 nt, Homo sapiens
uaaagcuagagcuggaguggca

SEQ ID NO: 269459 - RNA, 22 nt, Homo sapiens
uaaagcuaucacauuggugauu

SEQ ID NO: 269460 - RNA, 22 nt, Homo sapiens
uaaagugcugagaugaggcugg

SEQ ID NO: 269461 - RNA, 22 nt, Homo sapiens
uaaaguguuuguuauuaaaggu

SEQ ID NO: 269462 - RNA, 22 nt, Homo sapiens
uaaaugacugucaguagaugaa

SEQ ID NO: 269463 - RNA, 22 nt, Homo sapiens
uaaaugcuuaauugaaugugga

SEQ ID NO: 269464 - RNA, 22 nt, Homo sapiens
uaaauggauaaaugaauaccua

SEQ ID NO: 269465 - RNA, 22 nt, Homo sapiens
uaaauggauauugccaucuccu

SEQ ID NO: 269466 - RNA, 22 nt, Homo sapiens
uaacagucuccucaagguguug

SEQ ID NO: 269467 - RNA, 22 nt, Homo sapiens
uaacuaguagauggcugacaua

SEQ ID NO: 269468 - RNA, 20 nt, Homo sapiens
uaacuguggcuucuuuuggc

SEQ ID NO: 269469 - RNA, 22 nt, Homo sapiens
uaacuucaucauaagucaagaa

SEQ ID NO: 269470 - RNA, 23 nt, Homo sapiens
uaagacacuaacuuuaugcuuug

SEQ ID NO: 269471 - RNA, 22 nt, Homo sapiens
uaagacucuggacucuaauguu

SEQ ID NO: 269472 - RNA, 22 nt, Homo sapiens
uaagacuguguaauuuaugaag

SEQ ID NO: 269473 - RNA, 22 nt, Homo sapiens
uaagacuguuggcaauuuuugc

SEQ ID NO: 269474 - RNA, 22 nt, Homo sapiens
uaagagagcuccaucuuuuccu

SEQ ID NO: 269475 - RNA, 22 nt, Homo sapiens
uaagcuaauguguuuucucuua

SEQ ID NO: 269476 - RNA, 22 nt, Homo sapiens
uaagcuauagugaauaaauugc

SEQ ID NO: 269477 - RNA, 22 nt, Homo sapiens
uaaggcacccuucugaguagag

SEQ ID NO: 269478 - RNA, 22 nt, Homo sapiens
uaaggcacuacuuuaggcuuuc

SEQ ID NO: 269479 - RNA, 22 nt, Homo sapiens
uaaggcuagcaagaugagaaua

SEQ ID NO: 269480 - RNA, 22 nt, Homo sapiens
uaaggcuuuuguucagcguggg

SEQ ID NO: 269481 - RNA, 22 nt, Homo sapiens
uaaguaauugcagcaauuugcc

SEQ ID NO: 269482 - RNA, 22 nt, Homo sapiens
uaaguauagguaacagaagcaa

SEQ ID NO: 269483 - RNA, 22 nt, Homo sapiens
uaaguauuaugugcugcauuuu

SEQ ID NO: 269484 - RNA, 22 nt, Homo sapiens
uaagugacuuugagauuccuca

SEQ ID NO: 269485 - RNA, 22 nt, Homo sapiens
uaagugcaacauaaguguuaaa

SEQ ID NO: 269486 - RNA, 20 nt, Homo sapiens
uaagugcauaggauauuucu

SEQ ID NO: 269487 - RNA, 22 nt, Homo sapiens
uaagugcaugauuacaugcaua

SEQ ID NO: 269488 - RNA, 22 nt, Homo sapiens
uaagugcuugacuuugauguuu

SEQ ID NO: 269489 - RNA, 20 nt, Homo sapiens
uaagugcuugagacuucuga

SEQ ID NO: 269490 - RNA, 20 nt, Homo sapiens
uaagugcuugaugaaugaac

SEQ ID NO: 269491 - RNA, 20 nt, Homo sapiens
uaagugcuuuauauugauua

SEQ ID NO: 269492 - RNA, 22 nt, Homo sapiens
uaaguuguugacauuaggggaa

SEQ ID NO: 269493 - RNA, 22 nt, Homo sapiens
uaauacuagugaauagcaggau

SEQ ID NO: 269494 - RNA, 22 nt, Homo sapiens
uaauauguauacagacagauac

SEQ ID NO: 269495 - RNA, 22 nt, Homo sapiens
uaaucucagcuacucaggaggc

SEQ ID NO: 269496 - RNA, 22 nt, Homo sapiens
uaaugcaucaugguuggcaaac

SEQ ID NO: 269497 - RNA, 22 nt, Homo sapiens
uaaugcauguaaugggcugaua

SEQ ID NO: 269498 - RNA, 21 nt, Homo sapiens
uaauggcaugaucucggcuca

SEQ ID NO: 269499 - RNA, 22 nt, Homo sapiens
uaauucacauaaagcacuuaga

SEQ ID NO: 269500 - RNA, 22 nt, Homo sapiens
uaauucuguauguaucagaguu

SEQ ID NO: 269501 - RNA, 22 nt, Homo sapiens
uaauugaaugcagacaccaggg

SEQ ID NO: 269502 - RNA, 22 nt, Homo sapiens
uacaaagcuacucgagggcagg

SEQ ID NO: 269503 - RNA, 22 nt, Homo sapiens
uacaaagugggaaacgaagguu

SEQ ID NO: 269504 - RNA, 22 nt, Homo sapiens
uacaauagugacaaaucagcau

SEQ ID NO: 269505 - RNA, 22 nt, Homo sapiens
uacaccaauuuaaucaaaagca

SEQ ID NO: 269506 - RNA, 22 nt, Homo sapiens
uacaccauuugauucuuuaagc

SEQ ID NO: 269507 - RNA, 22 nt, Homo sapiens
uacaccugaguuugugguuuuc

SEQ ID NO: 269508 - RNA, 22 nt, Homo sapiens
uacagaauucugucccuugagu

SEQ ID NO: 269509 - RNA, 22 nt, Homo sapiens
uacaggugcucuacagacagga

SEQ ID NO: 269510 - RNA, 22 nt, Homo sapiens
uacaguagagaucagcaaacua

SEQ ID NO: 269511 - RNA, 22 nt, Homo sapiens
uacagucuagaggagaaucagg

SEQ ID NO: 269512 - RNA, 22 nt, Homo sapiens
uacaguggaaguuaaccccauu

SEQ ID NO: 269513 - RNA, 22 nt, Homo sapiens
uacagugggcacuggcgcccug

SEQ ID NO: 269514 - RNA, 20 nt, Homo sapiens
uacauaguaaacugagagca

SEQ ID NO: 269515 - RNA, 22 nt, Homo sapiens
uacauagucuucuuuugguuau

SEQ ID NO: 269516 - RNA, 22 nt, Homo sapiens
uacaucagccugaaagagcucg

SEQ ID NO: 269517 - RNA, 22 nt, Homo sapiens
uaccacaggcuggguaaucuau

SEQ ID NO: 269518 - RNA, 22 nt, Homo sapiens
uaccaccauuguaguuuggaaa

SEQ ID NO: 269519 - RNA, 22 nt, Homo sapiens
uaccaguaaugguucuagagga

SEQ ID NO: 269520 - RNA, 22 nt, Homo sapiens
uaccaucauuauacguagaaau

SEQ ID NO: 269521 - RNA, 22 nt, Homo sapiens
uaccuguagacuacagcuucag

SEQ ID NO: 269522 - RNA, 22 nt, Homo sapiens
uacucacauucuguuucuugcu

SEQ ID NO: 269523 - RNA, 19 nt, Homo sapiens
uacugcacuccagucuggg

SEQ ID NO: 269524 - RNA, 22 nt, Homo sapiens
uacugcacucuagccuggguga

SEQ ID NO: 269525 - RNA, 22 nt, Homo sapiens
uacugcuuaagggcaugggccc

SEQ ID NO: 269526 - RNA, 21 nt, Homo sapiens
uacuggagauacagucugcaa

SEQ ID NO: 269527 - RNA, 22 nt, Homo sapiens
uacuggccuugaacucuggugu

SEQ ID NO: 269528 - RNA, 22 nt, Homo sapiens
uacuguguaguuagaccucaga

SEQ ID NO: 269529 - RNA, 22 nt, Homo sapiens
uagaagcacuaucccuccuagu

SEQ ID NO: 269530 - RNA, 22 nt, Homo sapiens
uauuguacauauccucccuuca

SEQ ID NO: 269531 - RNA, 22 nt, Homo sapiens
uauuuggauagucuggaaaaaa

SEQ ID NO: 269532 - RNA, 22 nt, Homo sapiens
ucaaagacacacaaggagaagg

SEQ ID NO: 269533 - RNA, 22 nt, Homo sapiens
ucaaaguagaaaaggggcaauu

SEQ ID NO: 269534 - RNA, 22 nt, Homo sapiens
ucaaagugagcuccuucucacu

SEQ ID NO: 269535 - RNA, 22 nt, Homo sapiens
ucaaaugcacguagagaaaaua

SEQ ID NO: 269536 - RNA, 17 nt, Homo sapiens
ucaaaugcucccaguga

SEQ ID NO: 269537 - RNA, 22 nt, Homo sapiens
ucaagcaauucgccugucucag

SEQ ID NO: 269538 - RNA, 18 nt, Homo sapiens
ucaagcuauugucaugcc

SEQ ID NO: 269539 - RNA, 20 nt, Homo sapiens
ucaaggcacgaauaaaaguu

SEQ ID NO: 269540 - RNA, 20 nt, Homo sapiens
ucaaggcaggaacuguacau

SEQ ID NO: 269541 - RNA, 23 nt, Homo sapiens
ucaagugaugguggccacaaggg

SEQ ID NO: 269542 - RNA, 22 nt, Homo sapiens
ucaaugaaugaugguugguaug

SEQ ID NO: 269543 - RNA, 22 nt, Homo sapiens
ucaauguaucuccaagaauuga

SEQ ID NO: 269544 - RNA, 22 nt, Homo sapiens
ucacaaggcaggaaugaaaggg

SEQ ID NO: 269545 - RNA, 19 nt, Homo sapiens
ucacacuguggcuucuuua

SEQ ID NO: 269546 - RNA, 22 nt, Homo sapiens
ucacagauaaauaaagaugauu

SEQ ID NO: 269547 - RNA, 22 nt, Homo sapiens
ucacagaugcuugacccauuuc

SEQ ID NO: 269548 - RNA, 22 nt, Homo sapiens
ucacagccuaguuuuauacauu

SEQ ID NO: 269549 - RNA, 18 nt, Homo sapiens
ucacagguaaaguugaca

SEQ ID NO: 269550 - RNA, 18 nt, Homo sapiens
ucacagguaauuaggauu

SEQ ID NO: 269551 - RNA, 22 nt, Homo sapiens
ucacaguagcaaauguuagaaa

SEQ ID NO: 269552 - RNA, 22 nt, Homo sapiens
ucacaguagccccucccaucau

SEQ ID NO: 269553 - RNA, 22 nt, Homo sapiens
ucacaguagggaacugacaaag

SEQ ID NO: 269554 - RNA, 22 nt, Homo sapiens
ucacagugaguggaguggggug

SEQ ID NO: 269555 - RNA, 23 nt, Homo sapiens
ucacaguggcugcuuaauuguga

SEQ ID NO: 269556 - RNA, 17 nt, Homo sapiens
ucacaguguuaggauga

SEQ ID NO: 269557 - RNA, 23 nt, Homo sapiens
ucacaguuacuuuugcaucaacc

SEQ ID NO: 269558 - RNA, 22 nt, Homo sapiens
ucacaugaagauuuuaguauac

SEQ ID NO: 269559 - RNA, 22 nt, Homo sapiens
ucacaugugaagauugggagua

SEQ ID NO: 269560 - RNA, 22 nt, Homo sapiens
ucacauuguacaaacagguaag

SEQ ID NO: 269561 - RNA, 22 nt, Homo sapiens
ucacauuguuauguaaauguuu

SEQ ID NO: 269562 - RNA, 19 nt, Homo sapiens
ucaccaguacacaauacaa

SEQ ID NO: 269563 - RNA, 20 nt, Homo sapiens
ucacccugacaucugcccag

SEQ ID NO: 269564 - RNA, 22 nt, Homo sapiens
ucaccucgugaucugcccacuu

SEQ ID NO: 269565 - RNA, 22 nt, Homo sapiens
ucaccuggagacaugaagacug

SEQ ID NO: 269566 - RNA, 22 nt, Homo sapiens
ucaccuggagagcuugcuaaua

SEQ ID NO: 269567 - RNA, 22 nt, Homo sapiens
ucaccuuacuugcuucugaacu

SEQ ID NO: 269568 - RNA, 22 nt, Homo sapiens
ucacuauugacaacagugugga

SEQ ID NO: 269569 - RNA, 22 nt, Homo sapiens
ucacugagcacaggagaugugc

SEQ ID NO: 269570 - RNA, 22 nt, Homo sapiens
ucacugggagcauuugagccuu

SEQ ID NO: 269571 - RNA, 20 nt, Homo sapiens
ucacugugaacuucuugagg

SEQ ID NO: 269572 - RNA, 22 nt, Homo sapiens
ucacugugagaguuuauccugu

SEQ ID NO: 269573 - RNA, 22 nt, Homo sapiens
ucacugugcaugaaggaugcug

SEQ ID NO: 269574 - RNA, 22 nt, Homo sapiens
ucacuguguauguauaugcagg

SEQ ID NO: 269575 - RNA, 22 nt, Homo sapiens
ucagaaccuccuagcaguguuc

SEQ ID NO: 269576 - RNA, 22 nt, Homo sapiens
ucagacacugagcaaacgacua

SEQ ID NO: 269577 - RNA, 22 nt, Homo sapiens
ucagagcaaagacacuuuauca

SEQ ID NO: 269578 - RNA, 22 nt, Homo sapiens
ucagaguagagcgacuucuccu

SEQ ID NO: 269579 - RNA, 22 nt, Homo sapiens
ucagaguaguuccuggcagaaa

SEQ ID NO: 269580 - RNA, 22 nt, Homo sapiens
ucagagugguuguaccauuuga

SEQ ID NO: 269581 - RNA, 22 nt, Homo sapiens
ucagauacuggugacaugaaug

SEQ ID NO: 269582 - RNA, 22 nt, Homo sapiens
ucagaucacuggcgcuggcgga

SEQ ID NO: 269583 - RNA, 22 nt, Homo sapiens
ucagaucuucagcaggggcccc

SEQ ID NO: 269584 - RNA, 22 nt, Homo sapiens
ucagauguuucuuuaacgcaug

SEQ ID NO: 269585 - RNA, 22 nt, Homo sapiens
ucagauuggugcaaaaguaauu

SEQ ID NO: 269586 - RNA, 22 nt, Homo sapiens
ucagcaaugcugcacucuacug

SEQ ID NO: 269587 - RNA, 22 nt, Homo sapiens
ucagcagugccccacucuacug

SEQ ID NO: 269588 - RNA, 22 nt, Homo sapiens
ucagcagugugaaaacaaacua

SEQ ID NO: 269589 - RNA, 22 nt, Homo sapiens
ucagcagugugaaaauggacua

SEQ ID NO: 269590 - RNA, 22 nt, Homo sapiens
ucagcaucacaggcagugagug

SEQ ID NO: 269591 - RNA, 22 nt, Homo sapiens
ucagcaucacgugggcucccgu

SEQ ID NO: 269592 - RNA, 22 nt, Homo sapiens
ucaggcacucagcuuagagucu

SEQ ID NO: 269593 - RNA, 22 nt, Homo sapiens
ucaggcuuuucccagagugaug

SEQ ID NO: 269594 - RNA, 22 nt, Homo sapiens
ucagguagugccaugauugauu

SEQ ID NO: 269595 - RNA, 22 nt, Homo sapiens
ucagguaguuugugggagauga

SEQ ID NO: 269596 - RNA, 22 nt, Homo sapiens
ucagguaucucuauagcaaugu

SEQ ID NO: 269597 - RNA, 22 nt, Homo sapiens
ucaggucauuccaggagggcca

SEQ ID NO: 269598 - RNA, 22 nt, Homo sapiens
ucaggugccuuggcuaauuguu

SEQ ID NO: 269599 - RNA, 22 nt, Homo sapiens
ucagucauugauggaguagguc

SEQ ID NO: 269600 - RNA, 23 nt, Homo sapiens
ucagugaaggaacaacuaaauag

SEQ ID NO: 269601 - RNA, 22 nt, Homo sapiens
ucagugaauacauguacucaug

SEQ ID NO: 269602 - RNA, 22 nt, Homo sapiens
ucagugacuggguauuaaauca

SEQ ID NO: 269603 - RNA, 22 nt, Homo sapiens
ucagugauugguuauuuuaggc

SEQ ID NO: 269604 - RNA, 22 nt, Homo sapiens
ucagugcuguaccaucuaagga

SEQ ID NO: 269605 - RNA, 21 nt, Homo sapiens
ucagugcugugggcaaggugc

SEQ ID NO: 269606 - RNA, 22 nt, Homo sapiens
ucagugcuguuugcccucguuu

SEQ ID NO: 269607 - RNA, 22 nt, Homo sapiens
ucaguggacuuagucuuucccc

SEQ ID NO: 269608 - RNA, 22 nt, Homo sapiens
ucaguggagagcuuccaggauu

SEQ ID NO: 269609 - RNA, 22 nt, Homo sapiens
ucaguggauuuaaccugaauca

SEQ ID NO: 269610 - RNA, 23 nt, Homo sapiens
ucagugucuggauccugcucagu

SEQ ID NO: 269611 - RNA, 22 nt, Homo sapiens
ucagugucugugcaccgcugga

SEQ ID NO: 269612 - RNA, 22 nt, Homo sapiens
ucaguguuuggaaucucaauuu

SEQ ID NO: 269613 - RNA, 22 nt, Homo sapiens
ucauaaaguuguuuuaauggga

SEQ ID NO: 269614 - RNA, 22 nt, Homo sapiens
ucauacuguugugaaacaaaac

SEQ ID NO: 269615 - RNA, 22 nt, Homo sapiens
ucauagaucaaguaauaagaca

SEQ ID NO: 269616 - RNA, 20 nt, Homo sapiens
ucauagggugguggcagugg

SEQ ID NO: 269617 - RNA, 22 nt, Homo sapiens
ucaucagaaucccuuagggaug

SEQ ID NO: 269618 - RNA, 22 nt, Homo sapiens
ucaucaggaaacuuaugcagug

SEQ ID NO: 269619 - RNA, 22 nt, Homo sapiens
ucaugacacagcauacugacuu

SEQ ID NO: 269620 - RNA, 22 nt, Homo sapiens
ucugugcuugucauaugcuuug

SEQ ID NO: 269621 - RNA, 22 nt, Homo sapiens
ucuguggugggcuccacccagu

SEQ ID NO: 269622 - RNA, 22 nt, Homo sapiens
ucugugguuguugcauggaaug

SEQ ID NO: 269623 - RNA, 21 nt, Homo sapiens
ucuguguugaucucacuggga

SEQ ID NO: 269624 - RNA, 22 nt, Homo sapiens
ucuuauuuggggaaaggguccu

SEQ ID NO: 269625 - RNA, 22 nt, Homo sapiens
ucuucuagcggaacccucuugu

SEQ ID NO: 269626 - RNA, 20 nt, Homo sapiens
ucuugaacuuagucaacagg

SEQ ID NO: 269627 - RNA, 22 nt, Homo sapiens
ucuugcaauuuccuuaguggug

SEQ ID NO: 269628 - RNA, 22 nt, Homo sapiens
ucuugcacaaauuauuuuaacu

SEQ ID NO: 269629 - RNA, 18 nt, Homo sapiens
ucuuuggcugaacuguag

SEQ ID NO: 269630 - RNA, 22 nt, Homo sapiens
ucuuuggcugugaagaauaaug

SEQ ID NO: 269631 - RNA, 22 nt, Homo sapiens
ucuuugggauauucugaaaggg

SEQ ID NO: 269632 - RNA, 22 nt, Homo sapiens
ucuuuggguagauauguagcug

SEQ ID NO: 269633 - RNA, 22 nt, Homo sapiens
ucuuuggguguauuucacagcc

SEQ ID NO: 269634 - RNA, 22 nt, Homo sapiens
ucuuugguauugugaauagugu

SEQ ID NO: 269635 - RNA, 21 nt, Homo sapiens
ucuuuggucaccaguuuucau

SEQ ID NO: 269636 - RNA, 22 nt, Homo sapiens
ucuuugucuacauccuguuaaa

SEQ ID NO: 269637 - RNA, 22 nt, Homo sapiens
ucuuuguucaggagccaacucc

SEQ ID NO: 269638 - RNA, 22 nt, Homo sapiens
ucuuuuugagucaguuucggua

SEQ ID NO: 269639 - RNA, 22 nt, Homo sapiens
ugaaaaguuguugaaggcuuca

SEQ ID NO: 269640 - RNA, 22 nt, Homo sapiens
ugaaacacacauugcccuuuau

SEQ ID NO: 269641 - RNA, 22 nt, Homo sapiens
ugaaacauacacucugaugggg

SEQ ID NO: 269642 - RNA, 22 nt, Homo sapiens
ugaaagguuuaauucugugaga

SEQ ID NO: 269643 - RNA, 22 nt, Homo sapiens
ugaaaucuuugaugguggcauu

SEQ ID NO: 269644 - RNA, 22 nt, Homo sapiens
ugaaaugaucaguuugguuacu

SEQ ID NO: 269645 - RNA, 21 nt, Homo sapiens
ugaaaugcaugugcacauuaa

SEQ ID NO: 269646 - RNA, 22 nt, Homo sapiens
ugaaauggugcggucugcagca

SEQ ID NO: 269647 - RNA, 22 nt, Homo sapiens
ugaaaugucuuuaggaggcuuc

SEQ ID NO: 269648 - RNA, 22 nt, Homo sapiens
ugaaauuauucuuaccaaggug

SEQ ID NO: 269649 - RNA, 22 nt, Homo sapiens
ugaacagcacguuuauucagaa

SEQ ID NO: 269650 - RNA, 22 nt, Homo sapiens
ugaagacauuuuugggugugua

SEQ ID NO: 269651 - RNA, 22 nt, Homo sapiens
ugaagcuuguuucuguaccuuu

SEQ ID NO: 269652 - RNA, 22 nt, Homo sapiens
ugaaggaguauggauaagucgu

SEQ ID NO: 269653 - RNA, 22 nt, Homo sapiens
ugaaggccgggcaugguggcuc

SEQ ID NO: 269654 - RNA, 22 nt, Homo sapiens
ugaagggcauuguuuugccaaa

SEQ ID NO: 269655 - RNA, 22 nt, Homo sapiens
ugaagugaagacucacagaagg

SEQ ID NO: 269656 - RNA, 22 nt, Homo sapiens
ugaaguguuuuuucaggcaugu

SEQ ID NO: 269657 - RNA, 22 nt, Homo sapiens
ugaauagaaguggcaggaguag

SEQ ID NO: 269658 - RNA, 22 nt, Homo sapiens
ugaauauguuucuaaaagugca

SEQ ID NO: 269659 - RNA, 19 nt, Homo sapiens
ugaaugacaucuaaagucc

SEQ ID NO: 269660 - RNA, 20 nt, Homo sapiens
ugaauguaauuacagaugua

SEQ ID NO: 269661 - RNA, 22 nt, Homo sapiens
ugaauguauuuauuaccauuca

SEQ ID NO: 269662 - RNA, 21 nt, Homo sapiens
ugaaugucuaggcagaaguuu

SEQ ID NO: 269663 - RNA, 22 nt, Homo sapiens
ugaaugugauggguuucaugug

SEQ ID NO: 269664 - RNA, 22 nt, Homo sapiens
ugacacagcaagauggaaccau

SEQ ID NO: 269665 - RNA, 21 nt, Homo sapiens
ugacagaaaauugaguuugcu

SEQ ID NO: 269666 - RNA, 17 nt, Homo sapiens
ugacagaaacuuguugu

SEQ ID NO: 269667 - RNA, 18 nt, Homo sapiens
ugacagcacaugugggga

SEQ ID NO: 269668 - RNA, 22 nt, Homo sapiens
ugacagcugaagauguugaacc

SEQ ID NO: 269669 - RNA, 22 nt, Homo sapiens
ugacagguugauaggugcagca

SEQ ID NO: 269670 - RNA, 23 nt, Homo sapiens
ugacagucucccgauggcuaggc

SEQ ID NO: 269671 - RNA, 22 nt, Homo sapiens
ugacagugaauaagucucuuaa

SEQ ID NO: 269672 - RNA, 23 nt, Homo sapiens
ugacagugcuugaaauugcucuu

SEQ ID NO: 269673 - RNA, 22 nt, Homo sapiens
ugacaguguccucauucccaac

SEQ ID NO: 269674 - RNA, 22 nt, Homo sapiens
ugacaugauguuccuacacugu

SEQ ID NO: 269675 - RNA, 17 nt, Homo sapiens
ugaccacugauucuacu

SEQ ID NO: 269676 - RNA, 22 nt, Homo sapiens
ugaccuguuugaaauugccaau

SEQ ID NO: 269677 - RNA, 22 nt, Homo sapiens
ugacuaaaacugaguuucauua

SEQ ID NO: 269678 - RNA, 22 nt, Homo sapiens
ugacuagacuugcaagguugca

SEQ ID NO: 269679 - RNA, 22 nt, Homo sapiens
ugacuagucauaggcauggggg

SEQ ID NO: 269680 - RNA, 22 nt, Homo sapiens
ugacuauugauuuagacgugcu

SEQ ID NO: 269681 - RNA, 22 nt, Homo sapiens
ugacucaagagccugacucauc

SEQ ID NO: 269682 - RNA, 22 nt, Homo sapiens
ugacucaguuguuagucuucau

SEQ ID NO: 269683 - RNA, 22 nt, Homo sapiens
ugacuggaaacaguguuauuug

SEQ ID NO: 269684 - RNA, 22 nt, Homo sapiens
ugacugugcagcuccaucaggg

SEQ ID NO: 269685 - RNA, 23 nt, Homo sapiens
ugacuuaggccucaacuaugacu

SEQ ID NO: 269686 - RNA, 22 nt, Homo sapiens
ugacuugaaacgugaacagauc

SEQ ID NO: 269687 - RNA, 22 nt, Homo sapiens
ugacuugaggcucgcacaaguu

SEQ ID NO: 269688 - RNA, 22 nt, Homo sapiens
ugagaacaugugauauuuggug

SEQ ID NO: 269689 - RNA, 22 nt, Homo sapiens
ugagaacauuccucuuccuggc

SEQ ID NO: 269690 - RNA, 22 nt, Homo sapiens
ugagaacucaugaaucuuucca

SEQ ID NO: 269691 - RNA, 22 nt, Homo sapiens
ugagaacugccuguauuuaucu

SEQ ID NO: 269692 - RNA, 22 nt, Homo sapiens
ugagaacuuauggugauuuuuu

SEQ ID NO: 269693 - RNA, 22 nt, Homo sapiens
ugagaaugaugauugguaaacc

SEQ ID NO: 269694 - RNA, 19 nt, Homo sapiens
ugagaauguuaccaggucc

SEQ ID NO: 269695 - RNA, 22 nt, Homo sapiens
ugagacaaaguuguuggauguu

SEQ ID NO: 269696 - RNA, 22 nt, Homo sapiens
ugagacaugugaauauuuguac

SEQ ID NO: 269697 - RNA, 22 nt, Homo sapiens
ugagacggagucucgcucuguu

SEQ ID NO: 269698 - RNA, 22 nt, Homo sapiens
ugagacggagucucgcuguguc

SEQ ID NO: 269699 - RNA, 22 nt, Homo sapiens
ugagacggagucuugcuaaguu

SEQ ID NO: 269700 - RNA, 22 nt, Homo sapiens
ugagacggagucuugcucuguc

SEQ ID NO: 269701 - RNA, 22 nt, Homo sapiens
ugagacggaguuucgcucuugu

SEQ ID NO: 269702 - RNA, 22 nt, Homo sapiens
ugagacugagucucgcucuugu

SEQ ID NO: 269703 - RNA, 22 nt, Homo sapiens
ugagacugagucuugcucuauu

SEQ ID NO: 269704 - RNA, 22 nt, Homo sapiens
ugagacugaguuucacuuuugu

SEQ ID NO: 269705 - RNA, 22 nt, Homo sapiens
ugagacugaguuucucucuugu

SEQ ID NO: 269706 - RNA, 22 nt, Homo sapiens
ugagacugaguuuugccuuugu

SEQ ID NO: 269707 - RNA, 22 nt, Homo sapiens
ugagacugaguuuugcucuugu

SEQ ID NO: 269708 - RNA, 22 nt, Homo sapiens
ugagagaugaacucugauaugu

SEQ ID NO: 269709 - RNA, 22 nt, Homo sapiens
ugagagaugauaaaauguuugu

SEQ ID NO: 269710 - RNA, 22 nt, Homo sapiens
ugcagugugauuuucuggcuga

SEQ ID NO: 269711 - RNA, 18 nt, Homo sapiens
ugcauacuaucugauuuu

SEQ ID NO: 269712 - RNA, 22 nt, Homo sapiens
ugcauacuguaugcgugcauac

SEQ ID NO: 269713 - RNA, 22 nt, Homo sapiens
ugcauagaauguucuguaaaua

SEQ ID NO: 269714 - RNA, 23 nt, Homo sapiens
ugcauaguacccaauacuuuauc

SEQ ID NO: 269715 - RNA, 22 nt, Homo sapiens
ugcauaugcagcauuuaugauu

SEQ ID NO: 269716 - RNA, 22 nt, Homo sapiens
ugcauauguucaaaguauucug

SEQ ID NO: 269717 - RNA, 22 nt, Homo sapiens
ugcaugaugcugagauuuggga

SEQ ID NO: 269718 - RNA, 22 nt, Homo sapiens
ugcaugcaucuuuuauaguagc

SEQ ID NO: 269719 - RNA, 22 nt, Homo sapiens
ugcauggauguuugaacacacu

SEQ ID NO: 269720 - RNA, 22 nt, Homo sapiens
ugcauguucuuacucauacaug

SEQ ID NO: 269721 - RNA, 22 nt, Homo sapiens
ugcauuaguaaguaauuuuaau

SEQ ID NO: 269722 - RNA, 22 nt, Homo sapiens
ugccaaaaugggcuuuauaccg

SEQ ID NO: 269723 - RNA, 22 nt, Homo sapiens
ugccaacugguuucuuuuaguu

SEQ ID NO: 269724 - RNA, 20 nt, Homo sapiens
ugccaagaaaugaggguauu

SEQ ID NO: 269725 - RNA, 22 nt, Homo sapiens
ugccagaugcuggugugagggg

SEQ ID NO: 269726 - RNA, 22 nt, Homo sapiens
ugccaggaugaggucaauguuu

SEQ ID NO: 269727 - RNA, 22 nt, Homo sapiens
ugccauagcaaugguaagcuga

SEQ ID NO: 269728 - RNA, 22 nt, Homo sapiens
ugcccguaauuccagcacuuug

SEQ ID NO: 269729 - RNA, 22 nt, Homo sapiens
ugccuacuuugcaucugucagg

SEQ ID NO: 269730 - RNA, 22 nt, Homo sapiens
ugccuaggcccaguccucagaa

SEQ ID NO: 269731 - RNA, 22 nt, Homo sapiens
ugccuaggcuggaaugcaaugg

SEQ ID NO: 269732 - RNA, 22 nt, Homo sapiens
ugccuaggcuggaaugcagugg

SEQ ID NO: 269733 - RNA, 22 nt, Homo sapiens
ugccuuuguucuggaaugggaa

SEQ ID NO: 269734 - RNA, 22 nt, Homo sapiens
ugcuacccuucgucucucuggu

SEQ ID NO: 269735 - RNA, 22 nt, Homo sapiens
ugcuagaagaucacacacauca

SEQ ID NO: 269736 - RNA, 22 nt, Homo sapiens
ugcuaugucuucucucacagag

SEQ ID NO: 269737 - RNA, 20 nt, Homo sapiens
ugcugcacuuaagcaugggc

SEQ ID NO: 269738 - RNA, 22 nt, Homo sapiens
ugcugcacuuauggcucugagg

SEQ ID NO: 269739 - RNA, 21 nt, Homo sapiens
ugcugcacuucuuuugcugug

SEQ ID NO: 269740 - RNA, 22 nt, Homo sapiens
ugcugcuguuaucauuuuacca

SEQ ID NO: 269741 - RNA, 22 nt, Homo sapiens
ugcugcuguuguuguuacuagc

SEQ ID NO: 269742 - RNA, 22 nt, Homo sapiens
ugcuggugauuaaauccugaag

SEQ ID NO: 269743 - RNA, 22 nt, Homo sapiens
ugcuggugucaucaaggcuuug

SEQ ID NO: 269744 - RNA, 22 nt, Homo sapiens
ugcugguguggucuagccgcuu

SEQ ID NO: 269745 - RNA, 22 nt, Homo sapiens
ugcuugagacacauaugaauuu

SEQ ID NO: 269746 - RNA, 21 nt, Homo sapiens
ugcuuuggucauacuucuucc

SEQ ID NO: 269747 - RNA, 22 nt, Homo sapiens
uggaaaguccaagccaaccggg

SEQ ID NO: 269748 - RNA, 20 nt, Homo sapiens
uggaaauuaaccuuucaggu

SEQ ID NO: 269749 - RNA, 22 nt, Homo sapiens
uggaagacacauaccugauaac

SEQ ID NO: 269750 - RNA, 22 nt, Homo sapiens
uggaagacauugggugaagggu

SEQ ID NO: 269751 - RNA, 23 nt, Homo sapiens
uggaagacuccucucuuggcugc

SEQ ID NO: 269752 - RNA, 22 nt, Homo sapiens
uggaagauuacuuuuuguugaa

SEQ ID NO: 269753 - RNA, 22 nt, Homo sapiens
uggaagauucuagaagauucca

SEQ ID NO: 269754 - RNA, 22 nt, Homo sapiens
uggaagcaugcaaucugugggg

SEQ ID NO: 269755 - RNA, 22 nt, Homo sapiens
uggaaggcuucauauguaaaga

SEQ ID NO: 269756 - RNA, 22 nt, Homo sapiens
uggaaguagauagauuguguca

SEQ ID NO: 269757 - RNA, 22 nt, Homo sapiens
uggaagucauugagguguguua

SEQ ID NO: 269758 - RNA, 22 nt, Homo sapiens
uggaagucuauggcauuugagu

SEQ ID NO: 269759 - RNA, 22 nt, Homo sapiens
uggaagugaacaaccaaggcag

SEQ ID NO: 269760 - RNA, 22 nt, Homo sapiens
uggaaucuacuaaagcaaaauc

SEQ ID NO: 269761 - RNA, 22 nt, Homo sapiens
uggaaucuagagaaaugcaaac

SEQ ID NO: 269762 - RNA, 21 nt, Homo sapiens
uggaaucuauuauuccaguuu

SEQ ID NO: 269763 - RNA, 20 nt, Homo sapiens
uggaaucugaagaucucagu

SEQ ID NO: 269764 - RNA, 22 nt, Homo sapiens
uggaauggagagagggugcacg

SEQ ID NO: 269765 - RNA, 22 nt, Homo sapiens
uggaaugucuauguuuuugauu

SEQ ID NO: 269766 - RNA, 22 nt, Homo sapiens
uggacagacaagguuauagauc

SEQ ID NO: 269767 - RNA, 22 nt, Homo sapiens
uggacaugaagggcacaggagg

SEQ ID NO: 269768 - RNA, 22 nt, Homo sapiens
uggacauguacauauguguaug

SEQ ID NO: 269769 - RNA, 22 nt, Homo sapiens
uggagacaaagauagaaaagca

SEQ ID NO: 269770 - RNA, 22 nt, Homo sapiens
uggagacugaucccucuuuccu

SEQ ID NO: 269771 - RNA, 22 nt, Homo sapiens
uggagagcaaaaucaauccaaa

SEQ ID NO: 269772 - RNA, 18 nt, Homo sapiens
uggagauaagaagaacuu

SEQ ID NO: 269773 - RNA, 22 nt, Homo sapiens
uggagauguuuaaaauccacug

SEQ ID NO: 269774 - RNA, 22 nt, Homo sapiens
uggagguagacauugggaagag

SEQ ID NO: 269775 - RNA, 22 nt, Homo sapiens
uggagugaaaacacacuaaucu

SEQ ID NO: 269776 - RNA, 20 nt, Homo sapiens
uggagugaagguucuggacc

SEQ ID NO: 269777 - RNA, 20 nt, Homo sapiens
uggagugcuguguugagaag

SEQ ID NO: 269778 - RNA, 22 nt, Homo sapiens
uggaguguaaauuaguucagcc

SEQ ID NO: 269779 - RNA, 20 nt, Homo sapiens
uggaguuugaguucuuggag

SEQ ID NO: 269780 - RNA, 22 nt, Homo sapiens
uggauggagaggcuugugaugc

SEQ ID NO: 269781 - RNA, 22 nt, Homo sapiens
uggauugagaagcuguggcuca

SEQ ID NO: 269782 - RNA, 22 nt, Homo sapiens
uggcaaaaaaccgcaguugccu

SEQ ID NO: 269783 - RNA, 22 nt, Homo sapiens
uggcaaaugaaagaaagccagu

SEQ ID NO: 269784 - RNA, 22 nt, Homo sapiens
uggcaaauuccaaaguuaauuc

SEQ ID NO: 269785 - RNA, 22 nt, Homo sapiens
uggcaagagcaaaauguacagu

SEQ ID NO: 269786 - RNA, 22 nt, Homo sapiens
uggcaagagggaugcaagguuu

SEQ ID NO: 269787 - RNA, 22 nt, Homo sapiens
uggcagacaaauuugagcauau

SEQ ID NO: 269788 - RNA, 22 nt, Homo sapiens
uggcagaugcucuuggugccca

SEQ ID NO: 269789 - RNA, 22 nt, Homo sapiens
uggcagcugcuucaugggaugc

SEQ ID NO: 269790 - RNA, 22 nt, Homo sapiens
uggcaguuucauaugguucaac

SEQ ID NO: 269791 - RNA, 22 nt, Homo sapiens
uggcauaugguauuugauaucu

SEQ ID NO: 269792 - RNA, 19 nt, Homo sapiens
uggcaugaaugugaacuaa

SEQ ID NO: 269793 - RNA, 22 nt, Homo sapiens
uggcaugauauauauucguuug

SEQ ID NO: 269794 - RNA, 22 nt, Homo sapiens
uggcaugcauuguggguaauua

SEQ ID NO: 269795 - RNA, 22 nt, Homo sapiens
uggcauggaacuacuuugaaac

SEQ ID NO: 269796 - RNA, 22 nt, Homo sapiens
uggcauggggcagaacauuaca

SEQ ID NO: 269797 - RNA, 22 nt, Homo sapiens
uggcauguguuugaaugaguau

SEQ ID NO: 269798 - RNA, 20 nt, Homo sapiens
uggcauguugguaugcaccc

SEQ ID NO: 269799 - RNA, 23 nt, Homo sapiens
uggccaagauaaucucaguuuuc

SEQ ID NO: 269800 - RNA, 22 nt, Homo sapiens
ugugcucaucucagucaacugu

SEQ ID NO: 269801 - RNA, 22 nt, Homo sapiens
uguggaaauaaaagaaagguua

SEQ ID NO: 269802 - RNA, 22 nt, Homo sapiens
uguggaaauggugcuacgaaca

SEQ ID NO: 269803 - RNA, 22 nt, Homo sapiens
uguggaaauuguuguauuuaau

SEQ ID NO: 269804 - RNA, 22 nt, Homo sapiens
ugugggaggugcuaauguaaau

SEQ ID NO: 269805 - RNA, 22 nt, Homo sapiens
uguggucaucacuugaagguaa

SEQ ID NO: 269806 - RNA, 22 nt, Homo sapiens
ugugguuuuaguaaaacuaugu

SEQ ID NO: 269807 - RNA, 22 nt, Homo sapiens
ugugguuuuauaaacgugaccu

SEQ ID NO: 269808 - RNA, 22 nt, Homo sapiens
ugugucacugcacuccagcgug

SEQ ID NO: 269809 - RNA, 22 nt, Homo sapiens
ugugucuuguuuauagcuuucu

SEQ ID NO: 269810 - RNA, 22 nt, Homo sapiens
uguuacagugacuaauguuuua

SEQ ID NO: 269811 - RNA, 22 nt, Homo sapiens
uguuauguauggagugauccca

SEQ ID NO: 269812 - RNA, 22 nt, Homo sapiens
uguucaauucccaccuaugagu

SEQ ID NO: 269813 - RNA, 22 nt, Homo sapiens
uguucuugagccuuuagaccua

SEQ ID NO: 269814 - RNA, 22 nt, Homo sapiens
uguucuugaguugggaguacaa

SEQ ID NO: 269815 - RNA, 22 nt, Homo sapiens
uguugccacuguuauuaaccua

SEQ ID NO: 269816 - RNA, 22 nt, Homo sapiens
uguuugcuguuuucuccaauga

SEQ ID NO: 269817 - RNA, 22 nt, Homo sapiens
uguuugcuuaacguggagccag

SEQ ID NO: 269818 - RNA, 22 nt, Homo sapiens
uuaaaaguauaggccuggcaua

SEQ ID NO: 269819 - RNA, 22 nt, Homo sapiens
uuaaaggcauguacacuagagu

SEQ ID NO: 269820 - RNA, 22 nt, Homo sapiens
uuaaaugcacauacuugagaaa

SEQ ID NO: 269821 - RNA, 22 nt, Homo sapiens
uuaaaugcauagaauguguagu

SEQ ID NO: 269822 - RNA, 22 nt, Homo sapiens
uuaagaucagugcaaacuggag

SEQ ID NO: 269823 - RNA, 22 nt, Homo sapiens
uuaagcaaagguaacaugagaa

SEQ ID NO: 269824 - RNA, 22 nt, Homo sapiens
uuaagcaguggauuagaauuuu

SEQ ID NO: 269825 - RNA, 22 nt, Homo sapiens
uuaaggaguagugucugguauu

SEQ ID NO: 269826 - RNA, 22 nt, Homo sapiens
uuaaggcagugucuaugccagu

SEQ ID NO: 269827 - RNA, 22 nt, Homo sapiens
uuaaggcuccuguuggcuuuua

SEQ ID NO: 269828 - RNA, 22 nt, Homo sapiens
uuaaggcuuguacuuguuuucu

SEQ ID NO: 269829 - RNA, 22 nt, Homo sapiens
uuaaggugaaguucucagaugc

SEQ ID NO: 269830 - RNA, 23 nt, Homo sapiens
uuaaggugaugucuuugugccuc

SEQ ID NO: 269831 - RNA, 21 nt, Homo sapiens
uuaaguaauuacccaacucuc

SEQ ID NO: 269832 - RNA, 22 nt, Homo sapiens
uuaaguacuucccuguuggaca

SEQ ID NO: 269833 - RNA, 22 nt, Homo sapiens
uuaaguagaugaaugugaaugu

SEQ ID NO: 269834 - RNA, 22 nt, Homo sapiens
uuaaguagcugggcaugguggu

SEQ ID NO: 269835 - RNA, 22 nt, Homo sapiens
uuaagucacacuagacaacuga

SEQ ID NO: 269836 - RNA, 22 nt, Homo sapiens
uuaaguuaggcuucagcagucu

SEQ ID NO: 269837 - RNA, 22 nt, Homo sapiens
uuaauacucuucuaaguagucc

SEQ ID NO: 269838 - RNA, 22 nt, Homo sapiens
uuaaucaggccguuuccuaaga

SEQ ID NO: 269839 - RNA, 22 nt, Homo sapiens
uuaauccugccuuauuucagua

SEQ ID NO: 269840 - RNA, 22 nt, Homo sapiens
uuaauguaucuaucacaucaca

SEQ ID NO: 269841 - RNA, 22 nt, Homo sapiens
uuaaugugaaucaggaugcauu

SEQ ID NO: 269842 - RNA, 22 nt, Homo sapiens
uuacagauggauggcagcuggc

SEQ ID NO: 269843 - RNA, 22 nt, Homo sapiens
uuacagcugcuccccaucacuc

SEQ ID NO: 269844 - RNA, 22 nt, Homo sapiens
uuacagcugggugugucuggua

SEQ ID NO: 269845 - RNA, 22 nt, Homo sapiens
uuacagguggagaaguaaggcu

SEQ ID NO: 269846 - RNA, 22 nt, Homo sapiens
uuacaguauugcaaggacuagg

SEQ ID NO: 269847 - RNA, 20 nt, Homo sapiens
uuacagugggaccuuccuga

SEQ ID NO: 269848 - RNA, 22 nt, Homo sapiens
uuaccagucuagggcucaguuu

SEQ ID NO: 269849 - RNA, 22 nt, Homo sapiens
uuaccagucugauaaacagaaa

SEQ ID NO: 269850 - RNA, 22 nt, Homo sapiens
uuacccauuagagaauuuaaga

SEQ ID NO: 269851 - RNA, 22 nt, Homo sapiens
uuacccuuuaacccuuuaaagu

SEQ ID NO: 269852 - RNA, 22 nt, Homo sapiens
uuaccuugcacugagucugaaa

SEQ ID NO: 269853 - RNA, 22 nt, Homo sapiens
uuagauuauugagcauccacug

SEQ ID NO: 269854 - RNA, 22 nt, Homo sapiens
uuagcacaguucauucauguua

SEQ ID NO: 269855 - RNA, 22 nt, Homo sapiens
uuagcacaucuuucuauguaag

SEQ ID NO: 269856 - RNA, 21 nt, Homo sapiens
uuagcauccauguucaucaac

SEQ ID NO: 269857 - RNA, 22 nt, Homo sapiens
uuagcaugucuacuaauuugcu

SEQ ID NO: 269858 - RNA, 22 nt, Homo sapiens
uuaggagacuggauaucucuuu

SEQ ID NO: 269859 - RNA, 22 nt, Homo sapiens
uuaggcaaugcucucaaauuug

SEQ ID NO: 269860 - RNA, 22 nt, Homo sapiens
uuaggcaguuuauugauuuuca

SEQ ID NO: 269861 - RNA, 22 nt, Homo sapiens
uuaggcuuuauugaaaacaaua

SEQ ID NO: 269862 - RNA, 18 nt, Homo sapiens
uuagguaggucuuugugu

SEQ ID NO: 269863 - RNA, 22 nt, Homo sapiens
uuagguagucucugucagaggg

SEQ ID NO: 269864 - RNA, 22 nt, Homo sapiens
uuagguauuuuguuaugucagc

SEQ ID NO: 269865 - RNA, 22 nt, Homo sapiens
uuagguuauuacugacaauaau

SEQ ID NO: 269866 - RNA, 20 nt, Homo sapiens
uuauagcuacaucuugacug

SEQ ID NO: 269867 - RNA, 18 nt, Homo sapiens
uuauaugcauguguagga

SEQ ID NO: 269868 - RNA, 21 nt, Homo sapiens
uuaucccagugucucugcagg

SEQ ID NO: 269869 - RNA, 22 nt, Homo sapiens
uuaucucagugaacugagugga

SEQ ID NO: 269870 - RNA, 22 nt, Homo sapiens
uuaugcuguuuucuggagauuu

SEQ ID NO: 269871 - RNA, 22 nt, Homo sapiens
uuauguaaaucaaucuggaauc

SEQ ID NO: 269872 - RNA, 22 nt, Homo sapiens
uuaugucuuugagcaaugcugu

SEQ ID NO: 269873 - RNA, 22 nt, Homo sapiens
uuauguguuuaauguuucugaa

SEQ ID NO: 269874 - RNA, 22 nt, Homo sapiens
uuauuagcacccuaccaugugg

SEQ ID NO: 269875 - RNA, 22 nt, Homo sapiens
uuauucauuaacagggaccaaa

SEQ ID NO: 269876 - RNA, 22 nt, Homo sapiens
uuauugcuaaaucaugaccaca

SEQ ID NO: 269877 - RNA, 22 nt, Homo sapiens
uuauugcucauuugggcauucu

SEQ ID NO: 269878 - RNA, 22 nt, Homo sapiens
uuauugcuccagaggcugauuu

SEQ ID NO: 269879 - RNA, 22 nt, Homo sapiens
uuauugcuuuugugcaggugag

SEQ ID NO: 269880 - RNA, 22 nt, Homo sapiens
uuauuugguuauuguaauuggg

SEQ ID NO: 269881 - RNA, 22 nt, Homo sapiens
uucaaaguaaagggauggagac

SEQ ID NO: 269882 - RNA, 22 nt, Homo sapiens
uucaacagugauggccuuugua

SEQ ID NO: 269883 - RNA, 22 nt, Homo sapiens
uucaagcugggcaaauaagggg

SEQ ID NO: 269884 - RNA, 22 nt, Homo sapiens
uucaagucaauuuuugaaugac

SEQ ID NO: 269885 - RNA, 22 nt, Homo sapiens
uucaagugaacaaaaugaggag

SEQ ID NO: 269886 - RNA, 22 nt, Homo sapiens
uucaagugguucagaagucuga

SEQ ID NO: 269887 - RNA, 22 nt, Homo sapiens
uucaauaugucauuggcaggca

SEQ ID NO: 269888 - RNA, 22 nt, Homo sapiens
uucacaauuaaaugugguuauu

SEQ ID NO: 269889 - RNA, 22 nt, Homo sapiens
uucacagcuuaauaaggcucag

SEQ ID NO: 269890 - RNA, 22 nt, Homo sapiens
uugagcacaggaguuuugagac

SEQ ID NO: 269891 - RNA, 22 nt, Homo sapiens
uugagcacugucugugugcagu

SEQ ID NO: 269892 - RNA, 22 nt, Homo sapiens
uugagcccuggagguggaggcu

SEQ ID NO: 269893 - RNA, 22 nt, Homo sapiens
uugagcucuucuagcaauucua

SEQ ID NO: 269894 - RNA, 22 nt, Homo sapiens
uugaggaaugugauuucaaaua

SEQ ID NO: 269895 - RNA, 22 nt, Homo sapiens
uugaggacugguugaaagcuuu

SEQ ID NO: 269896 - RNA, 22 nt, Homo sapiens
uugaggaggcagucuucccauu

SEQ ID NO: 269897 - RNA, 22 nt, Homo sapiens
uugaggaguacugauuagguau

SEQ ID NO: 269898 - RNA, 22 nt, Homo sapiens
uugaggaucauuguuuucggag

SEQ ID NO: 269899 - RNA, 22 nt, Homo sapiens
uugaggcaaugaggagaagcug

SEQ ID NO: 269900 - RNA, 22 nt, Homo sapiens
uugagggagcacagauucuuau

SEQ ID NO: 269901 - RNA, 22 nt, Homo sapiens
uugagggagccuguuagucccg

SEQ ID NO: 269902 - RNA, 22 nt, Homo sapiens
uugagggaggccucaguuuaca

SEQ ID NO: 269903 - RNA, 22 nt, Homo sapiens
uugagguaguacuuauuauugg

SEQ ID NO: 269904 - RNA, 22 nt, Homo sapiens
uugagguauugauaaaacauuu

SEQ ID NO: 269905 - RNA, 20 nt, Homo sapiens
uugaggucaggaguuuggga

SEQ ID NO: 269906 - RNA, 22 nt, Homo sapiens
uugaggugaauuugcaggaugc

SEQ ID NO: 269907 - RNA, 22 nt, Homo sapiens
uugaguaguaagaagaugauag

SEQ ID NO: 269908 - RNA, 22 nt, Homo sapiens
uugaguaguaagugguucaccg

SEQ ID NO: 269909 - RNA, 22 nt, Homo sapiens
uugaguccauucgaugcugauu

SEQ ID NO: 269910 - RNA, 22 nt, Homo sapiens
uugauaugacuaucuuuuaugu

SEQ ID NO: 269911 - RNA, 22 nt, Homo sapiens
uugauaugguauaagauuucau

SEQ ID NO: 269912 - RNA, 22 nt, Homo sapiens
uugaucaauagaauacaacaga

SEQ ID NO: 269913 - RNA, 22 nt, Homo sapiens
uugaucaucagcuuugucaucu

SEQ ID NO: 269914 - RNA, 22 nt, Homo sapiens
uugauuuguagaaugccccaac

SEQ ID NO: 269915 - RNA, 22 nt, Homo sapiens
uugcaaaucucuuguguuuggu

SEQ ID NO: 269916 - RNA, 22 nt, Homo sapiens
uugcaagauguuaacauuggag

SEQ ID NO: 269917 - RNA, 22 nt, Homo sapiens
uugcaaggugcucgaagggcuc

SEQ ID NO: 269918 - RNA, 20 nt, Homo sapiens
uugcacagagaaggaggcag

SEQ ID NO: 269919 - RNA, 22 nt, Homo sapiens
uugcacagugguuuagagccug

SEQ ID NO: 269920 - RNA, 22 nt, Homo sapiens
uugcacuauuaguauagauguc

SEQ ID NO: 269921 - RNA, 22 nt, Homo sapiens
uugcacuuccgccugggugaca

SEQ ID NO: 269922 - RNA, 22 nt, Homo sapiens
uugcagagccccacacugggcu

SEQ ID NO: 269923 - RNA, 22 nt, Homo sapiens
uugcagcaaagagggaggggca

SEQ ID NO: 269924 - RNA, 22 nt, Homo sapiens
uugcaggcaugagccaccgugc

SEQ ID NO: 269925 - RNA, 22 nt, Homo sapiens
uugcagugguuucacuggcaaa

SEQ ID NO: 269926 - RNA, 23 nt, Homo sapiens
uugcauagacauccucauagauu

SEQ ID NO: 269927 - RNA, 22 nt, Homo sapiens
uugcauauguugaaccaagcgu

SEQ ID NO: 269928 - RNA, 19 nt, Homo sapiens
uugcauauguugaaccagc

SEQ ID NO: 269929 - RNA, 22 nt, Homo sapiens
uugcauauguugaaccagccuu

SEQ ID NO: 269930 - RNA, 22 nt, Homo sapiens
uugcaugggagcugggugaggc

SEQ ID NO: 269931 - RNA, 22 nt, Homo sapiens
uugccaauauuuuacugagaag

SEQ ID NO: 269932 - RNA, 22 nt, Homo sapiens
uugcuauguugcccagucugga

SEQ ID NO: 269933 - RNA, 22 nt, Homo sapiens
uugcucaccugagaagaauaga

SEQ ID NO: 269934 - RNA, 22 nt, Homo sapiens
uugcugguuuucauaugagcag

SEQ ID NO: 269935 - RNA, 22 nt, Homo sapiens
uugcuucauucaacauugaggg

SEQ ID NO: 269936 - RNA, 22 nt, Homo sapiens
uugcuuuguuacugcaguuucc

SEQ ID NO: 269937 - RNA, 22 nt, Homo sapiens
uuggaaaaauccaccuugaucu

SEQ ID NO: 269938 - RNA, 22 nt, Homo sapiens
uuggaaacgucaccuuuuccuu

SEQ ID NO: 269939 - RNA, 22 nt, Homo sapiens
uuggaaauauguuaagugucau

SEQ ID NO: 269940 - RNA, 22 nt, Homo sapiens
uuggaagacauucugucugcua

SEQ ID NO: 269941 - RNA, 22 nt, Homo sapiens
uuggaagauuacuuaguuuucu

SEQ ID NO: 269942 - RNA, 22 nt, Homo sapiens
uuggaaguguguauguauagcu

SEQ ID NO: 269943 - RNA, 23 nt, Homo sapiens
uuggaaugagaccuaagaguuuu

SEQ ID NO: 269944 - RNA, 22 nt, Homo sapiens
uuggaauuuuaaaauaggcaac

SEQ ID NO: 269945 - RNA, 22 nt, Homo sapiens
uuggacuucuaacugacaugga

SEQ ID NO: 269946 - RNA, 22 nt, Homo sapiens
uuggacuuuuauucugcaggca

SEQ ID NO: 269947 - RNA, 22 nt, Homo sapiens
uuggagagaaaggcaguuccug

SEQ ID NO: 269948 - RNA, 22 nt, Homo sapiens
uuggagagagaggacucccggc

SEQ ID NO: 269949 - RNA, 22 nt, Homo sapiens
uuggagagugauauucagaugc

SEQ ID NO: 269950 - RNA, 22 nt, Homo sapiens
uuggcaaguuucugucagcaaa

SEQ ID NO: 269951 - RNA, 21 nt, Homo sapiens
uuggcacucuucucuccuuau

SEQ ID NO: 269952 - RNA, 22 nt, Homo sapiens
uuggcagugguucugacggacc

SEQ ID NO: 269953 - RNA, 22 nt, Homo sapiens
uuggcauuguggauggaaucau

SEQ ID NO: 269954 - RNA, 22 nt, Homo sapiens
uuggccccucccaaauuucaug

SEQ ID NO: 269955 - RNA, 21 nt, Homo sapiens
uuggccuggaggccugaaugu

SEQ ID NO: 269956 - RNA, 22 nt, Homo sapiens
uugggagugucucuggacugca

SEQ ID NO: 269957 - RNA, 17 nt, Homo sapiens
uugggcaagguagguga

SEQ ID NO: 269958 - RNA, 22 nt, Homo sapiens
uugggcaaguggcaugaccaug

SEQ ID NO: 269959 - RNA, 22 nt, Homo sapiens
uugggcaauaggaagcaggugg

SEQ ID NO: 269960 - RNA, 22 nt, Homo sapiens
uuggggcacggccucuguugcc

SEQ ID NO: 269961 - RNA, 22 nt, Homo sapiens
uugguaagguggaugaugaaua

SEQ ID NO: 269962 - RNA, 22 nt, Homo sapiens
uugguaaugggcugguauaacc

SEQ ID NO: 269963 - RNA, 22 nt, Homo sapiens
uuggucacugacauguuugaaa

SEQ ID NO: 269964 - RNA, 22 nt, Homo sapiens
uuggucagcuagauuauucccu

SEQ ID NO: 269965 - RNA, 22 nt, Homo sapiens
uuggucagcucaauggagaggg

SEQ ID NO: 269966 - RNA, 22 nt, Homo sapiens
uuggucaucucccuccuuuuag

SEQ ID NO: 269967 - RNA, 23 nt, Homo sapiens
uuggucucccaaaguguugagau

SEQ ID NO: 269968 - RNA, 22 nt, Homo sapiens
uuggucucuuaaucacacuuuu

SEQ ID NO: 269969 - RNA, 19 nt, Homo sapiens
uugguugguuauuucuuac

SEQ ID NO: 269970 - RNA, 22 nt, Homo sapiens
uuguaaaguucuuaggaagcuc

SEQ ID NO: 269971 - RNA, 23 nt, Homo sapiens
uuguaacuggagaguaacauucc

SEQ ID NO: 269972 - RNA, 22 nt, Homo sapiens
uuguaauguuaccaaauggugu

SEQ ID NO: 269973 - RNA, 22 nt, Homo sapiens
uuguacuccagccugggugaca

SEQ ID NO: 269974 - RNA, 22 nt, Homo sapiens
uuguacuggguuuucuggaauu

SEQ ID NO: 269975 - RNA, 22 nt, Homo sapiens
uuguaguagcauuauuuauaau

SEQ ID NO: 269976 - RNA, 22 nt, Homo sapiens
uuguauaggcucaguaagaauc

SEQ ID NO: 269977 - RNA, 21 nt, Homo sapiens
uuguaugguugaacuugauac

SEQ ID NO: 269978 - RNA, 22 nt, Homo sapiens
uuguaugucuucauuugaaaaa

SEQ ID NO: 269979 - RNA, 22 nt, Homo sapiens
uuguauguugaaugaugguaua

SEQ ID NO: 269980 - RNA, 22 nt, Homo sapiens
uuuguaagaugcauagauugca

SEQ ID NO: 269981 - RNA, 22 nt, Homo sapiens
uuuguacacgugggugaauugu

SEQ ID NO: 269982 - RNA, 22 nt, Homo sapiens
uuuguacuaugguuuuucacua

SEQ ID NO: 269983 - RNA, 22 nt, Homo sapiens
uuuguacuugguguucuggaaa

SEQ ID NO: 269984 - RNA, 22 nt, Homo sapiens
uuugucauagcagcaggaaugg

SEQ ID NO: 269985 - RNA, 22 nt, Homo sapiens
uuugucccccguaguucauaua

SEQ ID NO: 269986 - RNA, 22 nt, Homo sapiens
uuugugaaugucauaagcucca

SEQ ID NO: 269987 - RNA, 23 nt, Homo sapiens
uuugugacacucuccaucuccag

SEQ ID NO: 269988 - RNA, 22 nt, Homo sapiens
uuugugcuaacuuuaacucuua

SEQ ID NO: 269989 - RNA, 22 nt, Homo sapiens
uuugugcuaaugcuagauuacu

SEQ ID NO: 269990 - RNA, 22 nt, Homo sapiens
uuugugucccucuaaaauuuau

SEQ ID NO: 269991 - RNA, 22 nt, Homo sapiens
uuuuacagaggagguugcugau

SEQ ID NO: 269992 - RNA, 20 nt, Homo sapiens
uuuuagcacuuguuauggug

SEQ ID NO: 269993 - RNA, 22 nt, Homo sapiens
uuuuagcuuuucccaggacucc

SEQ ID NO: 269994 - RNA, 22 nt, Homo sapiens
uuuuaguggaauauuuacaguu

SEQ ID NO: 269995 - RNA, 20 nt, Homo sapiens
uuuugaacuuggcaaccugu

SEQ ID NO: 269996 - RNA, 23 nt, Homo sapiens
uuuugcaauaagucacuggaaua

SEQ ID NO: 269997 - RNA, 21 nt, Homo sapiens
uuuugcacacuaugcagcuuu

SEQ ID NO: 269998 - RNA, 22 nt, Homo sapiens
uuuugcaccauccuaauaguau

SEQ ID NO: 269999 - RNA, 20 nt, Homo sapiens
uuuugcacuccuacuaaggu

SEQ ID NO: 270000 - RNA, 22 nt, Homo sapiens
uuuuggcuagaaauauaccucc

SEQ ID NO: 270001 - RNA, 22 nt, Homo sapiens
uuuuggucuccaguuucugcug

SEQ ID NO: 270002 - RNA, 22 nt, Homo sapiens
uuuuguacaacagcucugggga

SEQ ID NO: 270003 - RNA, 22 nt, Homo sapiens
uuuugugcauggcccaguggua

SEQ ID NO: 270004 - RNA, 22 nt, Homo sapiens
uuuuuauggccaauccucagaa

SEQ ID NO: 270005 - RNA, 22 nt, Homo sapiens
uuuuuggauaaugguacaugua

SEQ ID NO: 270006 - RNA, 23 nt, Homo sapiens
uuuuuguguuucauggaaauagg

SEQ ID NO: 270007 - RNA, 20 nt, Homo sapiens
aauaacagccccagggaggu

SEQ ID NO: 270008 - RNA, 22 nt, Homo sapiens
auagcagaagaagggacaauuc

SEQ ID NO: 270009 - RNA, 22 nt, Homo sapiens
auauucacagguaucagagauu

SEQ ID NO: 270010 - RNA, 22 nt, Homo sapiens
aucaaaguuucccagaaguugu

SEQ ID NO: 270011 - RNA, 22 nt, Homo sapiens
caagugaauaguugcucucaga

SEQ ID NO: 270012 - RNA, 22 nt, Homo sapiens
cuaaaacuuucugagugcagca

SEQ ID NO: 270013 - RNA, 22 nt, Homo sapiens
cuaaagugcuuaaaaucucauu

SEQ ID NO: 270014 - RNA, 22 nt, Homo sapiens
cuagcagacacuuccagagagu

SEQ ID NO: 270015 - RNA, 22 nt, Homo sapiens
cuagcuuuugauguaaagugag

SEQ ID NO: 270016 - RNA, 22 nt, Homo sapiens
gaaugcuaagcaugugggaauu

SEQ ID NO: 270017 - RNA, 22 nt, Homo sapiens
gaaugcuaccagcaucuagugg

SEQ ID NO: 270018 - RNA, 22 nt, Homo sapiens
gaauucugucgcuuacuagaug

SEQ ID NO: 270019 - RNA, 22 nt, Homo sapiens
gauaaaguauuggguacuaugc

SEQ ID NO: 270020 - RNA, 22 nt, Homo sapiens
gugaggaaggaaaccugcuagc

SEQ ID NO: 270021 - RNA, 22 nt, Homo sapiens
uaaagugaggauggcaguaggu

SEQ ID NO: 270022 - RNA, 22 nt, Homo sapiens
uaagugaaggaaguguguuuac

SEQ ID NO: 270023 - RNA, 22 nt, Homo sapiens
uaauagcaguguuacuaggacu

SEQ ID NO: 270024 - RNA, 22 nt, Homo sapiens
uauugccuugccuacuuuucca

SEQ ID NO: 270025 - RNA, 22 nt, Homo sapiens
ugugaaaucagauagccuuuuu

SEQ ID NO: 270026 - RNA, 22 nt, Homo sapiens
uucaaaguaaagggauggagac

SEQ ID NO: 270027 - RNA, 22 nt, Homo sapiens
uucaguagucaaaagauaaggg

SEQ ID NO: 270028 - RNA, 23 nt, Homo sapiens
uuucuugggcaugcuaugucagu

SEQ ID NO: 270029 - RNA, 22 nt, Homo sapiens
aaauaguagcugaaugagggaa

SEQ ID NO: 270030 - RNA, 22 nt, Homo sapiens
aaggaauucaaauuuucucugg

SEQ ID NO: 270031 - RNA, 22 nt, Homo sapiens
aaguaaauauccgguaguccca

SEQ ID NO: 270032 - RNA, 23 nt, Homo sapiens
accuucauucauucagcugaagu

SEQ ID NO: 270033 - RNA, 22 nt, Homo sapiens
aggaauguuaguacuucuuagu

SEQ ID NO: 270034 - RNA, 22 nt, Homo sapiens
auaauagcugaucauuuagaag

SEQ ID NO: 270035 - RNA, 22 nt, Homo sapiens
auagcagaauuuggucaagucu

SEQ ID NO: 270036 - RNA, 22 nt, Homo sapiens
auagcagugugaggacagacua

SEQ ID NO: 270037 - RNA, 22 nt, Homo sapiens
auagcauagucagcuucgcuga

SEQ ID NO: 270038 - RNA, 22 nt, Homo sapiens
augucaaggugaagaaagauca

SEQ ID NO: 270039 - RNA, 22 nt, Homo sapiens
auucuauaguccuaggauuggg

SEQ ID NO: 270040 - RNA, 19 nt, Homo sapiens
caauacuucuuggcauaca

SEQ ID NO: 270041 - RNA, 22 nt, Homo sapiens
cuaaagauagugacaugauuug

SEQ ID NO: 270042 - RNA, 21 nt, Homo sapiens
cuaaggaaagcuaugaacccu

SEQ ID NO: 270043 - RNA, 22 nt, Homo sapiens
cuagcagacaugggcugaacca

SEQ ID NO: 270044 - RNA, 21 nt, Homo sapiens
cucaaaguacugauauuacag

SEQ ID NO: 270045 - RNA, 22 nt, Homo sapiens
cucaaagucaagggaaagcagg

SEQ ID NO: 270046 - RNA, 22 nt, Homo sapiens
gauaacagauaaugucaguuau

SEQ ID NO: 270047 - RNA, 22 nt, Homo sapiens
gcaagacaugucuaagguuuaa

SEQ ID NO: 270048 - RNA, 22 nt, Homo sapiens
guaaacuuccccucaugaauga

SEQ ID NO: 270049 - RNA, 22 nt, Homo sapiens
guacaagugcaguuucguuaca

SEQ ID NO: 270050 - RNA, 22 nt, Homo sapiens
guuugccuuuuagauaggaaug

SEQ ID NO: 270051 - RNA, 22 nt, Homo sapiens
uaacuaaagagaagucaauguc

SEQ ID NO: 270052 - RNA, 22 nt, Homo sapiens
uacaauagugacaaaucagcau

SEQ ID NO: 270053 - RNA, 21 nt, Homo sapiens
uauagcagcacgauuuauaau

SEQ ID NO: 270054 - RNA, 22 nt, Homo sapiens
uauagcagugaguauugacuaa

SEQ ID NO: 270055 - RNA, 22 nt, Homo sapiens
uauagcaguguaagaaucgagu

SEQ ID NO: 270056 - RNA, 22 nt, Homo sapiens
ucaacagugggcacuguaaaug

SEQ ID NO: 270057 - RNA, 22 nt, Homo sapiens
guagcagaacauguuccuugua

SEQ ID NO: 270058 - RNA, 22 nt, Homo sapiens
gugaaagacauauaugguuuga

SEQ ID NO: 270059 - RNA, 22 nt, Homo sapiens
gugaaagauuaaaccagugugu

SEQ ID NO: 270060 - RNA, 21 nt, Homo sapiens
uaagcuaaacauucaguuaac

SEQ ID NO: 270061 - RNA, 22 nt, Homo sapiens
uaagugaauguuggcuacugaa

SEQ ID NO: 270062 - RNA, 22 nt, Homo sapiens
uaagugaauuucacuacugagu

SEQ ID NO: 270063 - RNA, 22 nt, Homo sapiens
uacacagucaaaaauuuccagg

SEQ ID NO: 270064 - RNA, 22 nt, Homo sapiens
ugaaguaauguuuuauucuauu

SEQ ID NO: 270065 - RNA, 22 nt, Homo sapiens
uuaaaaguauaggccuggcaua

SEQ ID NO: 270066 - RNA, 22 nt, Homo sapiens
uuaaagugaucauaaggauagu

SEQ ID NO: 270067 - RNA, 22 nt, Homo sapiens
uuaacagcacaugcugucccuu

SEQ ID NO: 270068 - RNA, 22 nt, Homo sapiens
uuaacagcacuacguggggauc

SEQ ID NO: 270069 - RNA, 22 nt, Homo sapiens
uuaaggaaggagucuuaaaugg

SEQ ID NO: 270070 - RNA, 22 nt, Homo sapiens
gauagcagccauucuuuuuauu

SEQ ID NO: 270071 - RNA, 22 nt, Homo sapiens
gaugagguagaagacucagcaa

SEQ ID NO: 270072 - RNA, 22 nt, Homo sapiens
gcagaauugguuucuucuaagg

SEQ ID NO: 270073 - RNA, 22 nt, Homo sapiens
ggaaagcuagguguggguguac

SEQ ID NO: 270074 - RNA, 20 nt, Homo sapiens
aacaguguguaaguuuccuu

SEQ ID NO: 270075 - RNA, 22 nt, Homo sapiens
agagauuauccuggcuucucug

SEQ ID NO: 270076 - RNA, 22 nt, Homo sapiens
aggaauuuaauguaugauaaua

SEQ ID NO: 270077 - RNA, 22 nt, Homo sapiens
auagcagugugaaaacagacug

SEQ ID NO: 270078 - RNA, 22 nt, Homo sapiens
auagcagugugagaaugaacua

SEQ ID NO: 270079 - RNA, 22 nt, Homo sapiens
auagcauaucccacaugucaga

SEQ ID NO: 270080 - RNA, 18 nt, Homo sapiens
auauugccuucagacuag

SEQ ID NO: 270081 - RNA, 22 nt, Homo sapiens
aucaaagugaauuaaugagaau

SEQ ID NO: 270082 - RNA, 22 nt, Homo sapiens
ccucacaaccuuuauugaagag

SEQ ID NO: 270083 - RNA, 22 nt, Homo sapiens
cuagcagaacaauacaauucgg

SEQ ID NO: 270084 - RNA, 22 nt, Homo sapiens
cuucucagugcucaucuuauuu

SEQ ID NO: 270085 - RNA, 22 nt, Homo sapiens
aaagugaauguaucccguaagu

SEQ ID NO: 270086 - RNA, 22 nt, Homo sapiens
aaaguucuugcugaaggauuau

SEQ ID NO: 270087 - RNA, 22 nt, Homo sapiens
aacagaauccucuuuuccuggg

SEQ ID NO: 270088 - RNA, 22 nt, Homo sapiens
aagugaaugaugugaaguguaa

SEQ ID NO: 270089 - RNA, 19 nt, Homo sapiens
aagugaaugcuuuguucac

SEQ ID NO: 270090 - RNA, 22 nt, Homo sapiens
aauagcauugaaucuaccaauu

SEQ ID NO: 270091 - RNA, 22 nt, Homo sapiens
agaaacauucucuugccuccuu

SEQ ID NO: 270092 - RNA, 22 nt, Homo sapiens
auaacagcauuauugcauacgu

SEQ ID NO: 270093 - RNA, 22 nt, Homo sapiens
auaacagcugcaaggcaaaagc

SEQ ID NO: 270094 - RNA, 22 nt, Homo sapiens
auagcagaccaccucucccacu

SEQ ID NO: 270095 - RNA, 22 nt, Homo sapiens
auagcagugugaaaacagacua

SEQ ID NO: 270096 - RNA, 22 nt, Homo sapiens
aucagaguggguuuuaaaagug

SEQ ID NO: 270097 - RNA, 22 nt, Homo sapiens
cuaaggaaggacugaaaggaca

SEQ ID NO: 270098 - RNA, 22 nt, Homo sapiens
cuucaaaguuggcuaggagaca

SEQ ID NO: 270099 - RNA, 22 nt, Homo sapiens
gaaagacuuucugcuguggaua

SEQ ID NO: 270100 - RNA, 21 nt, Homo sapiens
gaaauacugccuuaggagcug

SEQ ID NO: 270101 - RNA, 23 nt, Homo sapiens
ggaaacauccagucuuucaccau

SEQ ID NO: 270102 - RNA, 22 nt, Homo sapiens
ggaaagauguaauauuaucuaa

SEQ ID NO: 270103 - RNA, 20 nt, Homo sapiens
guaacagcacuuucccaaag

SEQ ID NO: 270104 - RNA, 22 nt, Homo sapiens
guagcagaauaucagauaauuu

SEQ ID NO: 270105 - RNA, 22 nt, Homo sapiens
uaagugaauauggacaguuagc

SEQ ID NO: 270106 - RNA, 21 nt, Homo sapiens
uagcaaauugcuauuaaggca

SEQ ID NO: 270107 - RNA, 21 nt, Homo sapiens
uauagcagcacgauuuauagu

SEQ ID NO: 270108 - RNA, 22 nt, Homo sapiens
uauagcagccugaacaaaguaa

SEQ ID NO: 270109 - RNA, 22 nt, Homo sapiens
ucagaguagagcgacuucuccu

SEQ ID NO: 270110 - RNA, 22 nt, Homo sapiens
ugaaagacugaaagcuuuucuu

SEQ ID NO: 270111 - RNA, 22 nt, Homo sapiens
ugaaagcuacaggaaaguauuu

SEQ ID NO: 270112 - RNA, 22 nt, Homo sapiens
uucaaaguuggaggacaaacug

SEQ ID NO: 270113 - RNA, 22 nt, Homo sapiens
uuuccaagaugcuuacuuucuc

SEQ ID NO: 270114 - RNA, 17 nt, Homo sapiens
ucuaauaauaugcauuu

SEQ ID NO: 270115 - RNA, 22 nt, Homo sapiens
ucucacaccccucucauauacc

SEQ ID NO: 270116 - RNA, 22 nt, Homo sapiens
ugaaacauacacucugaugggg

SEQ ID NO: 270117 - RNA, 22 nt, Homo sapiens
ugaaagcuacagucuccuagga

SEQ ID NO: 270118 - RNA, 22 nt, Homo sapiens
ugaaauacuuaauuucuccaug

SEQ ID NO: 270119 - RNA, 22 nt, Homo sapiens
ugaauaguuugacagaacucuu

SEQ ID NO: 270120 - RNA, 22 nt, Homo sapiens
ugagcagagggagaaguaaauu

SEQ ID NO: 270121 - RNA, 22 nt, Homo sapiens
uggcaguuuacaaaugccauga

SEQ ID NO: 270122 - RNA, 22 nt, Homo sapiens
uuaaaguguuugcagacaggug

SEQ ID NO: 270123 - RNA, 22 nt, Homo sapiens
uuaaggaaagcauuuaauucag

SEQ ID NO: 270124 - RNA, 22 nt, Homo sapiens
uucaaaguaaaaauguguucac

SEQ ID NO: 270125 - RNA, 22 nt, Homo sapiens
uucagagugaggcucucggaac

SEQ ID NO: 270126 - RNA, 22 nt, Homo sapiens
uucuuagucauguaauagucca

SEQ ID NO: 270127 - RNA, 22 nt, Homo sapiens
uuucuauguugaccagucuaga

SEQ ID NO: 270128 - RNA, 18 nt, Homo sapiens
aaaaagugcucaggccua

SEQ ID NO: 270129 - RNA, 22 nt, Homo sapiens
aaacuugucuaauuauaagcau

SEQ ID NO: 270130 - RNA, 22 nt, Homo sapiens
aaagugccugacucauaguuag

SEQ ID NO: 270131 - RNA, 21 nt, Homo sapiens
aaaugcacauuacugcuggug

SEQ ID NO: 270132 - RNA, 22 nt, Homo sapiens
aaaugcucuuuaugaaguugga

SEQ ID NO: 270133 - RNA, 22 nt, Homo sapiens
aaauucaucaaaugguuuguau

SEQ ID NO: 270134 - RNA, 22 nt, Homo sapiens
aaauugcauugagcugcuuauu

SEQ ID NO: 270135 - RNA, 22 nt, Homo sapiens
aacagaccuagauaguauaguc

SEQ ID NO: 270136 - RNA, 22 nt, Homo sapiens
aacagcacacccgcugcuucca

SEQ ID NO: 270137 - RNA, 22 nt, Homo sapiens
aacaggcuccuaggggugcacc

SEQ ID NO: 270138 - RNA, 22 nt, Homo sapiens
aaccuuuagucagcucuuagga

SEQ ID NO: 270139 - RNA, 21 nt, Homo sapiens
aacuggugugagaugguaugu

SEQ ID NO: 270140 - RNA, 22 nt, Homo sapiens
aagagguaggaaauggucauuu

SEQ ID NO: 270141 - RNA, 22 nt, Homo sapiens
aagauagcuaagcuucuucuaa

SEQ ID NO: 270142 - RNA, 22 nt, Homo sapiens
aagaucaucauagagggcauga

SEQ ID NO: 270143 - RNA, 20 nt, Homo sapiens
aagcagacauuuggaugaaa

SEQ ID NO: 270144 - RNA, 22 nt, Homo sapiens
aagcagauguguugaaaguacu

SEQ ID NO: 270145 - RNA, 20 nt, Homo sapiens
aagcugaguguuuuuuuaau

SEQ ID NO: 270146 - RNA, 22 nt, Homo sapiens
aagcuggagugcaguggugcaa

SEQ ID NO: 270147 - RNA, 22 nt, Homo sapiens
aagcuggagugcaguggugcga

SEQ ID NO: 270148 - RNA, 22 nt, Homo sapiens
aaggcaagguggauaaugaagc

SEQ ID NO: 270149 - RNA, 22 nt, Homo sapiens
aaggcucuuucaacguaaauua

SEQ ID NO: 270150 - RNA, 22 nt, Homo sapiens
aaguaauugagguuuuugcugu

SEQ ID NO: 270151 - RNA, 22 nt, Homo sapiens
aaguaucaggaauaguuauugg

SEQ ID NO: 270152 - RNA, 22 nt, Homo sapiens
aagugccauguggaugggcccu

SEQ ID NO: 270153 - RNA, 22 nt, Homo sapiens
aagugucagaguugcuaaugac

SEQ ID NO: 270154 - RNA, 22 nt, Homo sapiens
aauaaagccugucucuuuagag

SEQ ID NO: 270155 - RNA, 19 nt, Homo sapiens
aauaaugccagaugucugu

SEQ ID NO: 270156 - RNA, 21 nt, Homo sapiens
ccuugagaacaucaauuugcu

SEQ ID NO: 270157 - RNA, 23 nt, Homo sapiens
cuaaagucugucacugaggacuu

SEQ ID NO: 270158 - RNA, 22 nt, Homo sapiens
cuaagauugucuuaguguguug

SEQ ID NO: 270159 - RNA, 22 nt, Homo sapiens
cuagcagaacaauacaauucgg

SEQ ID NO: 270160 - RNA, 22 nt, Homo sapiens
cuagucacauuuucaucaaaua

SEQ ID NO: 270161 - RNA, 22 nt, Homo sapiens
cuauggcagccacggccuggag

SEQ ID NO: 270162 - RNA, 22 nt, Homo sapiens
cuauucacaauagccaagauuu

SEQ ID NO: 270163 - RNA, 18 nt, Homo sapiens
cucaaccucaugcagggc

SEQ ID NO: 270164 - RNA, 22 nt, Homo sapiens
cucaaguacaugggauuacagg

SEQ ID NO: 270165 - RNA, 22 nt, Homo sapiens
cucaccuugugauccacccacc

SEQ ID NO: 270166 - RNA, 22 nt, Homo sapiens
cucagcuacuugggaagcugag

SEQ ID NO: 270167 - RNA, 20 nt, Homo sapiens
cucagguauuugaggcugca

SEQ ID NO: 270168 - RNA, 22 nt, Homo sapiens
cucauugcaaucucugccuccc

SEQ ID NO: 270169 - RNA, 22 nt, Homo sapiens
cuccauuuaucugaaauuuuau

SEQ ID NO: 270170 - RNA, 22 nt, Homo sapiens
cucucaguguggaggccagaaa

SEQ ID NO: 270171 - RNA, 22 nt, Homo sapiens
cucugacagugguuagcacugu

SEQ ID NO: 270172 - RNA, 19 nt, Homo sapiens
cucuuuggugucucuucuu

SEQ ID NO: 270173 - RNA, 22 nt, Homo sapiens
cugaccucugucaaagacaccc

SEQ ID NO: 270174 - RNA, 22 nt, Homo sapiens
cugagagaggagcuaaaacugc

SEQ ID NO: 270175 - RNA, 22 nt, Homo sapiens
cugagauaauuucuagguguca

SEQ ID NO: 270176 - RNA, 22 nt, Homo sapiens
cugagauaggacucugcuggcu

SEQ ID NO: 270177 - RNA, 22 nt, Homo sapiens
cugagcuaguagcauuguguca

SEQ ID NO: 270178 - RNA, 22 nt, Homo sapiens
cugaugaaguauuuguucugga

SEQ ID NO: 270179 - RNA, 21 nt, Homo sapiens
cugcauccauuucugagugau

SEQ ID NO: 270180 - RNA, 22 nt, Homo sapiens
cuggaauauuagcuggucuuaa

SEQ ID NO: 270181 - RNA, 22 nt, Homo sapiens
cuggaguuugaggcugcaguga

SEQ ID NO: 270182 - RNA, 22 nt, Homo sapiens
cuggcgagacagcuccaucacu

SEQ ID NO: 270183 - RNA, 22 nt, Homo sapiens
cugggaugauguaaauaggcua

SEQ ID NO: 270184 - RNA, 22 nt, Homo sapiens
cugggaugugacuguugccccc

SEQ ID NO: 270185 - RNA, 22 nt, Homo sapiens
cugguaugugugacugcauuga

SEQ ID NO: 270186 - RNA, 22 nt, Homo sapiens
cuguaauguaaugagacuacau

SEQ ID NO: 270187 - RNA, 22 nt, Homo sapiens
cuguauguuucuaugaauguga

SEQ ID NO: 270188 - RNA, 22 nt, Homo sapiens
cugucacugggaggggcagcag

SEQ ID NO: 270189 - RNA, 22 nt, Homo sapiens
cugucacuggggcacauguccc

SEQ ID NO: 270190 - RNA, 22 nt, Homo sapiens
cugugcauguaugcgugaguuc

SEQ ID NO: 270191 - RNA, 22 nt, Homo sapiens
cugugcauuggaugucucccug

SEQ ID NO: 270192 - RNA, 22 nt, Homo sapiens
cuucaugagacuuuuggaaggc

SEQ ID NO: 270193 - RNA, 22 nt, Homo sapiens
cuucaugggagaaccacaggua

SEQ ID NO: 270194 - RNA, 22 nt, Homo sapiens
cuuccagcuggguucagucagu

SEQ ID NO: 270195 - RNA, 20 nt, Homo sapiens
cuugaagacuaugcugcuga

SEQ ID NO: 270196 - RNA, 22 nt, Homo sapiens
cuuggcacugcucacccuccuu

SEQ ID NO: 270197 - RNA, 22 nt, Homo sapiens
cuuggcaugaagaauaauuuuu

SEQ ID NO: 270198 - RNA, 21 nt, Homo sapiens
cuugucuugcuuagaauagac

SEQ ID NO: 270199 - RNA, 19 nt, Homo sapiens
cuugugccugaagcuuggg

SEQ ID NO: 270200 - RNA, 22 nt, Homo sapiens
cuuucacacuguuggugggaau

SEQ ID NO: 270201 - RNA, 22 nt, Homo sapiens
cuuugcacaucucugcuuuccc

SEQ ID NO: 270202 - RNA, 22 nt, Homo sapiens
cuuuggcaaugucauuuucaau

SEQ ID NO: 270203 - RNA, 22 nt, Homo sapiens
cuuuuugcaaauacaacucuga

SEQ ID NO: 270204 - RNA, 22 nt, Homo sapiens
gaaaugcucauuuuggauccuu

SEQ ID NO: 270205 - RNA, 22 nt, Homo sapiens
uugagauuuuccucaaauauuu

SEQ ID NO: 270206 - RNA, 22 nt, Homo sapiens
uugaggaaugucauuuguguuu

SEQ ID NO: 270207 - RNA, 22 nt, Homo sapiens
uugaggacugagacagaccaag

SEQ ID NO: 270208 - RNA, 22 nt, Homo sapiens
uugaggacugcuaagcauuuga

SEQ ID NO: 270209 - RNA, 22 nt, Homo sapiens
uugaggaguacugauuagguau

SEQ ID NO: 270210 - RNA, 22 nt, Homo sapiens
uugagggagccuguuagucccg

SEQ ID NO: 270211 - RNA, 22 nt, Homo sapiens
uugagggaggccucaguuuaca

SEQ ID NO: 270212 - RNA, 22 nt, Homo sapiens
uugaguaguaagaagaugauag

SEQ ID NO: 270213 - RNA, 22 nt, Homo sapiens
uugaguauuggacugguaucuu

SEQ ID NO: 270214 - RNA, 22 nt, Homo sapiens
uugcauauguugaaccagccuu

SEQ ID NO: 270215 - RNA, 22 nt, Homo sapiens
uugcaugggagcugggugaggc

SEQ ID NO: 270216 - RNA, 22 nt, Homo sapiens
uugccacuucucuugccccauu

SEQ ID NO: 270217 - RNA, 22 nt, Homo sapiens
uugcgaugaagacaaaacaugc

SEQ ID NO: 270218 - RNA, 22 nt, Homo sapiens
uugcuagaugaaaaugguaccu

SEQ ID NO: 270219 - RNA, 22 nt, Homo sapiens
uugcuucauucaacauugaggg

SEQ ID NO: 270220 - RNA, 22 nt, Homo sapiens
uuggaaaccucugcagguguuu

SEQ ID NO: 270221 - RNA, 22 nt, Homo sapiens
uuggaagacauucugucugcua

SEQ ID NO: 270222 - RNA, 22 nt, Homo sapiens
uuggaaggcuccuaaugaaugg

SEQ ID NO: 270223 - RNA, 22 nt, Homo sapiens
uuggaaguguguauguauagcu

SEQ ID NO: 270224 - RNA, 22 nt, Homo sapiens
uuggacagaugguuacauuuuu

SEQ ID NO: 270225 - RNA, 22 nt, Homo sapiens
uuggcaaagaggaaugccacuu

SEQ ID NO: 270226 - RNA, 22 nt, Homo sapiens
uuggcaauucagauucuuuuau

SEQ ID NO: 270227 - RNA, 22 nt, Homo sapiens
uuggcauagaggcucucaagcu

SEQ ID NO: 270228 - RNA, 22 nt, Homo sapiens
uugguaaaaugaccacagacau

SEQ ID NO: 270229 - RNA, 22 nt, Homo sapiens
uugguaggcuggccucucucag

SEQ ID NO: 270230 - RNA, 22 nt, Homo sapiens
uuggucagcucaauggagaggg

SEQ ID NO: 270231 - RNA, 22 nt, Homo sapiens
uuggucaggagccucccucuuu

SEQ ID NO: 270232 - RNA, 22 nt, Homo sapiens
uugguuaucaucauuucagcaa

SEQ ID NO: 270233 - RNA, 19 nt, Homo sapiens
uuguccccucuaaaucuca

SEQ ID NO: 270234 - RNA, 22 nt, Homo sapiens
uugucuccuagacgaccaggcg

SEQ ID NO: 270235 - RNA, 22 nt, Homo sapiens
uugugcauaucagagguuugcu

SEQ ID NO: 270236 - RNA, 22 nt, Homo sapiens
uugugcauguauauuaguucac

SEQ ID NO: 270237 - RNA, 20 nt, Homo sapiens
uugugcauugggccauuggg

SEQ ID NO: 270238 - RNA, 22 nt, Homo sapiens
cuugcauuuuggagaaugcuga

SEQ ID NO: 270239 - RNA, 22 nt, Homo sapiens
cuuggcuucuuuauguggcuau

SEQ ID NO: 270240 - RNA, 22 nt, Homo sapiens
cuugggcagugugcauguguau

SEQ ID NO: 270241 - RNA, 22 nt, Homo sapiens
cuugugauugcacggcugccug

SEQ ID NO: 270242 - RNA, 21 nt, Homo sapiens
cuuuaugcuguguuagaaaag

SEQ ID NO: 270243 - RNA, 22 nt, Homo sapiens
cuuuggauggaaccucucuuuc

SEQ ID NO: 270244 - RNA, 22 nt, Homo sapiens
cuuugggaccgcgguuuauacu

SEQ ID NO: 270245 - RNA, 20 nt, Homo sapiens
cuuuuagcagcagcaagaga

SEQ ID NO: 270246 - RNA, 22 nt, Homo sapiens
cuuuuggugguucugaugcagg

SEQ ID NO: 270247 - RNA, 22 nt, Homo sapiens
cuuuugugauucuucaguuacu

SEQ ID NO: 270248 - RNA, 22 nt, Homo sapiens
gaagauucaaccaaaccagaac

SEQ ID NO: 270249 - RNA, 23 nt, Homo sapiens
gaaguaauaaauggauucuuaac

SEQ ID NO: 270250 - RNA, 22 nt, Homo sapiens
gacugaggaagcgcucucuccu

SEQ ID NO: 270251 - RNA, 22 nt, Homo sapiens
gacugcagugcagcuguuaggc

SEQ ID NO: 270252 - RNA, 22 nt, Homo sapiens
gacuggagcuguaugugguuac

SEQ ID NO: 270253 - RNA, 22 nt, Homo sapiens
gacuuugguaaacucgguggca

SEQ ID NO: 270254 - RNA, 22 nt, Homo sapiens
augugcuuuuuaaacagaugcu

SEQ ID NO: 270255 - RNA, 22 nt, Homo sapiens
augugugcuugugacacagccu

SEQ ID NO: 270256 - RNA, 22 nt, Homo sapiens
auuagaugguuauaggugugag

SEQ ID NO: 270257 - RNA, 22 nt, Homo sapiens
auuagguuagugcaaaaguaau

SEQ ID NO: 270258 - RNA, 22 nt, Homo sapiens
auuagguuguugcaaaaguaau

SEQ ID NO: 270259 - RNA, 22 nt, Homo sapiens
auuauguuguauuuccuugcag

SEQ ID NO: 270260 - RNA, 20 nt, Homo sapiens
auuccacuuguuugagguac

SEQ ID NO: 270261 - RNA, 22 nt, Homo sapiens
auugagcaaggucuccuaguau

SEQ ID NO: 270262 - RNA, 22 nt, Homo sapiens
auugaguaaaaaauagugaugu

SEQ ID NO: 270263 - RNA, 21 nt, Homo sapiens
auugcacuccagccugggcga

SEQ ID NO: 270264 - RNA, 22 nt, Homo sapiens
auugcacugcagccugggcaac

SEQ ID NO: 270265 - RNA, 19 nt, Homo sapiens
auuuccuggagcuggucuc

SEQ ID NO: 270266 - RNA, 22 nt, Homo sapiens
agcuucauuccaacuuccuucu

SEQ ID NO: 270267 - RNA, 21 nt, Homo sapiens
aggaagacuaugaucaauugg

SEQ ID NO: 270268 - RNA, 22 nt, Homo sapiens
aggaagcuagcauuuguucagu

SEQ ID NO: 270269 - RNA, 22 nt, Homo sapiens
aggaauuuaauguaugauaaua

SEQ ID NO: 270270 - RNA, 22 nt, Homo sapiens
aggagaugaagcuuuaucuaaa

SEQ ID NO: 270271 - RNA, 22 nt, Homo sapiens
aggagguagggugugaaacagc

SEQ ID NO: 270272 - RNA, 22 nt, Homo sapiens
aggcaaaugccagcaaucacac

SEQ ID NO: 270273 - RNA, 22 nt, Homo sapiens
aggcaaugugagaguuuauuca

SEQ ID NO: 270274 - RNA, 22 nt, Homo sapiens
aggcuagacuuugagaauuuuu

SEQ ID NO: 270275 - RNA, 22 nt, Homo sapiens
agguccauugguauuauagcau

SEQ ID NO: 270276 - RNA, 22 nt, Homo sapiens
aggugcaauggugguuuugugg

SEQ ID NO: 270277 - RNA, 22 nt, Homo sapiens
aggugcugagcagagaauccug

SEQ ID NO: 270278 - RNA, 20 nt, Homo sapiens
agguuauuauaauuagaaga

SEQ ID NO: 270279 - RNA, 22 nt, Homo sapiens
aguaucaucuuguuggccaggc

SEQ ID NO: 270280 - RNA, 22 nt, Homo sapiens
agucacaugccagcacacccag

SEQ ID NO: 270281 - RNA, 22 nt, Homo sapiens
agucauggaucacaguagccuc

SEQ ID NO: 270282 - RNA, 17 nt, Homo sapiens
agugagaucauggcuua

SEQ ID NO: 270283 - RNA, 22 nt, Homo sapiens
agugcauaugucuuuuuggaag

SEQ ID NO: 270284 - RNA, 22 nt, Homo sapiens
aguggcacaauuuugacucccc

SEQ ID NO: 270285 - RNA, 22 nt, Homo sapiens
agugguguugccuguugaccua

SEQ ID NO: 270286 - RNA, 22 nt, Homo sapiens
aguucaaugcucuuucuacuau

SEQ ID NO: 270287 - RNA, 22 nt, Homo sapiens
aguugcaagucuugaguaaaga

SEQ ID NO: 270288 - RNA, 22 nt, Homo sapiens
auaauguuugauugagcagaua

SEQ ID NO: 270289 - RNA, 19 nt, Homo sapiens
auaguguaggaaaacagcu

SEQ ID NO: 270290 - RNA, 22 nt, Homo sapiens
auaugcauacauguaugcagga

SEQ ID NO: 270291 - RNA, 22 nt, Homo sapiens
auauggcuaugugagcauacca

SEQ ID NO: 270292 - RNA, 22 nt, Homo sapiens
auauucacuauaugcagaacca

SEQ ID NO: 270293 - RNA, 22 nt, Homo sapiens
aucacauggccagguaguaauc

SEQ ID NO: 270294 - RNA, 22 nt, Homo sapiens
aucacauuuauaguggcacgca

SEQ ID NO: 270295 - RNA, 22 nt, Homo sapiens
auccaguguuuucuuuugucac

SEQ ID NO: 270296 - RNA, 22 nt, Homo sapiens
aucccaguaaaaauggcuucua

SEQ ID NO: 270297 - RNA, 22 nt, Homo sapiens
aucccaguucagccucugacac

SEQ ID NO: 270298 - RNA, 22 nt, Homo sapiens
auccccugcacggggugucauu

SEQ ID NO: 270299 - RNA, 22 nt, Homo sapiens
aucccuguguccagcaccugug

SEQ ID NO: 270300 - RNA, 22 nt, Homo sapiens
auccuacaguccauucuuugug

SEQ ID NO: 270301 - RNA, 22 nt, Homo sapiens
auccucugagaucuaggcagag

SEQ ID NO: 270302 - RNA, 22 nt, Homo sapiens
auccugaugacacagugcugca

SEQ ID NO: 270303 - RNA, 22 nt, Homo sapiens
aucucagcaacuaaagauccuu

SEQ ID NO: 270304 - RNA, 22 nt, Homo sapiens
aucucaguucaggcuggccaca

SEQ ID NO: 270305 - RNA, 22 nt, Homo sapiens
aucugauggagagcguguggcu

SEQ ID NO: 270306 - RNA, 22 nt, Homo sapiens
aucugguguccucgugggaguc

SEQ ID NO: 270307 - RNA, 23 nt, Homo sapiens
augaaagcccuugcaaaugcugg

SEQ ID NO: 270308 - RNA, 22 nt, Homo sapiens
augaagugcaugauaguugguu

SEQ ID NO: 270309 - RNA, 22 nt, Homo sapiens
augaaugcuuuuggauguaucu

SEQ ID NO: 270310 - RNA, 22 nt, Homo sapiens
augacuauugcacuuuccuggu

SEQ ID NO: 270311 - RNA, 19 nt, Homo sapiens
augagaacagacuccauuu

SEQ ID NO: 270312 - RNA, 22 nt, Homo sapiens
augagagcaacaccuucacuug

SEQ ID NO: 270313 - RNA, 22 nt, Homo sapiens
augagagugagagcagccccuu

SEQ ID NO: 270314 - RNA, 22 nt, Homo sapiens
augagauaggaacaaacuuaca

SEQ ID NO: 270315 - RNA, 22 nt, Homo sapiens
augagaugaggaauggcccucc

SEQ ID NO: 270316 - RNA, 21 nt, Homo sapiens
augagauguuagacuuuagac

SEQ ID NO: 270317 - RNA, 22 nt, Homo sapiens
augagcagaugcuccugccucu

SEQ ID NO: 270318 - RNA, 17 nt, Homo sapiens
augagcucaucauuuuu

SEQ ID NO: 270319 - RNA, 22 nt, Homo sapiens
augauagucuugagaagcauuu

SEQ ID NO: 270320 - RNA, 22 nt, Homo sapiens
augcacaguccagcccaugugg

SEQ ID NO: 270321 - RNA, 22 nt, Homo sapiens
augcacaugcgaaaacuugugu

SEQ ID NO: 270322 - RNA, 22 nt, Homo sapiens
augcagagucccagccccuagc

SEQ ID NO: 270323 - RNA, 18 nt, Homo sapiens
augcauauuuuaaguugu

SEQ ID NO: 270324 - RNA, 22 nt, Homo sapiens
augccaagagacaaagggaauc

SEQ ID NO: 270325 - RNA, 22 nt, Homo sapiens
augccacugcacuucagccugg

SEQ ID NO: 270326 - RNA, 22 nt, Homo sapiens
augccacuucucuaagucaugu

SEQ ID NO: 270327 - RNA, 22 nt, Homo sapiens
auggaagucucuguuaaguuuc

SEQ ID NO: 270328 - RNA, 22 nt, Homo sapiens
auggagagaauuauucucucag

SEQ ID NO: 270329 - RNA, 22 nt, Homo sapiens
auggccauuacuaagaauguuu

SEQ ID NO: 270330 - RNA, 23 nt, Homo sapiens
auggcccuggugggagugucuuu

SEQ ID NO: 270331 - RNA, 22 nt, Homo sapiens
auggcccuguguggagcugcug

SEQ ID NO: 270332 - RNA, 22 nt, Homo sapiens
auggcuagaaccuguauauuca

SEQ ID NO: 270333 - RNA, 22 nt, Homo sapiens
auggcuguuucugcaaugucua

SEQ ID NO: 270334 - RNA, 22 nt, Homo sapiens
auggcuuuuuucuugggcacuc

SEQ ID NO: 270335 - RNA, 22 nt, Homo sapiens
auggucccauucauucacguau

SEQ ID NO: 270336 - RNA, 22 nt, Homo sapiens
auguaugagaguuccagcugau

SEQ ID NO: 270337 - RNA, 22 nt, Homo sapiens
augucacagguccuagccaagu

SEQ ID NO: 270338 - RNA, 20 nt, Homo sapiens
augucagaguguggguacgg

SEQ ID NO: 270339 - RNA, 22 nt, Homo sapiens
auguccaugagcacauguauca

SEQ ID NO: 270340 - RNA, 22 nt, Homo sapiens
augugcaugcuguucugccaga

SEQ ID NO: 270341 - RNA, 20 nt, Homo sapiens
augugcuaauauuaauaugu

SEQ ID NO: 270342 - RNA, 22 nt, Homo sapiens
augugcuaguaucaaacgagac

SEQ ID NO: 270343 - RNA, 22 nt, Homo sapiens
augugcuuuuggugagagauuu

SEQ ID NO: 270344 - RNA, 22 nt, Homo sapiens
acaucauugggggcuacaggug

SEQ ID NO: 270345 - RNA, 22 nt, Homo sapiens
acaugcauauguuggaagaaag

SEQ ID NO: 270346 - RNA, 22 nt, Homo sapiens
acauguaauugauuuuguguua

SEQ ID NO: 270347 - RNA, 22 nt, Homo sapiens
acccugucagcuggccugggca

SEQ ID NO: 270348 - RNA, 22 nt, Homo sapiens
accucagcccggggaaguugag

SEQ ID NO: 270349 - RNA, 22 nt, Homo sapiens
accuucauuguugccaugucca

SEQ ID NO: 270350 - RNA, 22 nt, Homo sapiens
acuauacugaagcaaauuaaca

SEQ ID NO: 270351 - RNA, 22 nt, Homo sapiens
acuaugcuuuucuuagaauuaa

SEQ ID NO: 270352 - RNA, 21 nt, Homo sapiens
acugagagaucuggggcacau

SEQ ID NO: 270353 - RNA, 21 nt, Homo sapiens
acugcacuccaaccucaacag

SEQ ID NO: 270354 - RNA, 22 nt, Homo sapiens
acugcacuccacccuuggcagc

SEQ ID NO: 270355 - RNA, 22 nt, Homo sapiens
acugcacuccagccucgugaca

SEQ ID NO: 270356 - RNA, 22 nt, Homo sapiens
acugcacuccagccugagccug

SEQ ID NO: 270357 - RNA, 22 nt, Homo sapiens
acugcacuccagccugcccaac

SEQ ID NO: 270358 - RNA, 22 nt, Homo sapiens
acugcacuccagccuggacgaa

SEQ ID NO: 270359 - RNA, 22 nt, Homo sapiens
acugcacuccagccugugcgua

SEQ ID NO: 270360 - RNA, 22 nt, Homo sapiens
acugcacuccagccuguugaca

SEQ ID NO: 270361 - RNA, 22 nt, Homo sapiens
acugcacuccagccuugagagc

SEQ ID NO: 270362 - RNA, 22 nt, Homo sapiens
acugcacuccagccuugauggc

SEQ ID NO: 270363 - RNA, 22 nt, Homo sapiens
acugcacuccagccuuggcaac

SEQ ID NO: 270364 - RNA, 22 nt, Homo sapiens
acugcacuccagcuccagggug

SEQ ID NO: 270365 - RNA, 22 nt, Homo sapiens
acugcacuccaguuccgggcaa

SEQ ID NO: 270366 - RNA, 22 nt, Homo sapiens
acugcacuccaguuugggcagc

SEQ ID NO: 270367 - RNA, 22 nt, Homo sapiens
acugcacugcagccuggccaac

SEQ ID NO: 270368 - RNA, 22 nt, Homo sapiens
acuggaguuuguucaagaaaua

SEQ ID NO: 270369 - RNA, 22 nt, Homo sapiens
acuggcuuaaggaugggccacu

SEQ ID NO: 270370 - RNA, 22 nt, Homo sapiens
acuguacuccagccugggcaac

SEQ ID NO: 270371 - RNA, 22 nt, Homo sapiens
acuguacucuacccugggcaac

SEQ ID NO: 270372 - RNA, 22 nt, Homo sapiens
acuguguguuugucuagcacag

SEQ ID NO: 270373 - RNA, 22 nt, Homo sapiens
acuuugcuuaucccaggcacug

SEQ ID NO: 270374 - RNA, 22 nt, Homo sapiens
agaaacacagguggaauugcuu

SEQ ID NO: 270375 - RNA, 22 nt, Homo sapiens
agaagaacauagggugacugaa

SEQ ID NO: 270376 - RNA, 21 nt, Homo sapiens
agacacuuggaagguuuuaga

SEQ ID NO: 270377 - RNA, 20 nt, Homo sapiens
agacagcugcagcccacauc

SEQ ID NO: 270378 - RNA, 22 nt, Homo sapiens
agacaguguguguauauauggu

SEQ ID NO: 270379 - RNA, 23 nt, Homo sapiens
agacugaaguaucugagacucag

SEQ ID NO: 270380 - RNA, 22 nt, Homo sapiens
agagcacuguggguccaaauau

SEQ ID NO: 270381 - RNA, 22 nt, Homo sapiens
agagcuguguuuuaacuuuuua

SEQ ID NO: 270382 - RNA, 22 nt, Homo sapiens
agagguaagcaguggcaagugc

SEQ ID NO: 270383 - RNA, 22 nt, Homo sapiens
agagguagaagauaggcuacag

SEQ ID NO: 270384 - RNA, 22 nt, Homo sapiens
agaguaguuuauuaugcuaagg

SEQ ID NO: 270385 - RNA, 22 nt, Homo sapiens
agaucacagucuuugguuuuag

SEQ ID NO: 270386 - RNA, 22 nt, Homo sapiens
agauucauccaaguuguugcau

SEQ ID NO: 270387 - RNA, 22 nt, Homo sapiens
agcaacauuuuugaccuuucuu

SEQ ID NO: 270388 - RNA, 22 nt, Homo sapiens
agcaccacauacuacagagaua

SEQ ID NO: 270389 - RNA, 22 nt, Homo sapiens
agcacgaaaccaaauucuguga

SEQ ID NO: 270390 - RNA, 22 nt, Homo sapiens
agcagagcauauucauucgggg

SEQ ID NO: 270391 - RNA, 21 nt, Homo sapiens
agcagaguggcagcucuuuug

SEQ ID NO: 270392 - RNA, 22 nt, Homo sapiens
agcagcaucgggaaguuggcca

SEQ ID NO: 270393 - RNA, 22 nt, Homo sapiens
agcagcauuccaaaaaucugcu

SEQ ID NO: 270394 - RNA, 22 nt, Homo sapiens
agcagcucaugccuuugggagg

SEQ ID NO: 270395 - RNA, 22 nt, Homo sapiens
agcagcuuugcauggccuguga

SEQ ID NO: 270396 - RNA, 22 nt, Homo sapiens
agcaucagugauuuuguugaag

SEQ ID NO: 270397 - RNA, 20 nt, Homo sapiens
agccccauguaaaccacaug

SEQ ID NO: 270398 - RNA, 22 nt, Homo sapiens
agccgguguccacgaagaagag

SEQ ID NO: 270399 - RNA, 23 nt, Homo sapiens
agccuguugccuaggcagcucau

SEQ ID NO: 270400 - RNA, 22 nt, Homo sapiens
agcugccagucuuguaaggccu

SEQ ID NO: 270401 - RNA, 22 nt, Homo sapiens
agcuggaauuuaagguagauag

SEQ ID NO: 270402 - RNA, 22 nt, Homo sapiens
agcuugugauuuagagugagag

SEQ ID NO: 270403 - RNA, 21 nt, Homo sapiens
aggagauguuuguccuuuuag

SEQ ID NO: 270404 - RNA, 22 nt, Homo sapiens
aggagguagaacauugccauuu

SEQ ID NO: 270405 - RNA, 21 nt, Homo sapiens
aggcaaaugaagcagccgcuc

SEQ ID NO: 270406 - RNA, 21 nt, Homo sapiens
aggcaagguguuauuauugaa

SEQ ID NO: 270407 - RNA, 22 nt, Homo sapiens
aggcagaugagguccucagcug

SEQ ID NO: 270408 - RNA, 22 nt, Homo sapiens
aggcuguguggauaauauuggg

SEQ ID NO: 270409 - RNA, 22 nt, Homo sapiens
agggagcaaaguggucuuucuc

SEQ ID NO: 270410 - RNA, 22 nt, Homo sapiens
agggcuuuugagcugagauggu

SEQ ID NO: 270411 - RNA, 21 nt, Homo sapiens
aggucaugaagauguucuaau

SEQ ID NO: 270412 - RNA, 22 nt, Homo sapiens
agguguuguugaggagauuuca

SEQ ID NO: 270413 - RNA, 22 nt, Homo sapiens
agguuguguuugugauuagaua

SEQ ID NO: 270414 - RNA, 22 nt, Homo sapiens
agucacagccuuuuacuuuaga

SEQ ID NO: 270415 - RNA, 22 nt, Homo sapiens
agucacaugcauuuucuucaau

SEQ ID NO: 270416 - RNA, 21 nt, Homo sapiens
agucauaggaguacauaaugc

SEQ ID NO: 270417 - RNA, 22 nt, Homo sapiens
agucaugggagagaugugaucg

SEQ ID NO: 270418 - RNA, 22 nt, Homo sapiens
agugcagugguuaggagccagg

SEQ ID NO: 270419 - RNA, 19 nt, Homo sapiens
aguggguguuuucuguuug

SEQ ID NO: 270420 - RNA, 22 nt, Homo sapiens
aguguuuuuaucaugaaagggu

SEQ ID NO: 270421 - RNA, 22 nt, Homo sapiens
auaaagcaagucucuggccuca

SEQ ID NO: 270422 - RNA, 22 nt, Homo sapiens
auaaaugcuuccagucauuaaa

SEQ ID NO: 270423 - RNA, 22 nt, Homo sapiens
auacaagcaguccaacuccaua

SEQ ID NO: 270424 - RNA, 22 nt, Homo sapiens
auacaguaucuucuggcaagca

SEQ ID NO: 270425 - RNA, 22 nt, Homo sapiens
auacagugaauacuuacagugu

SEQ ID NO: 270426 - RNA, 22 nt, Homo sapiens
auagcagaacagugucucacug

SEQ ID NO: 270427 - RNA, 22 nt, Homo sapiens
auagucaaaucucauuaccccc

SEQ ID NO: 270428 - RNA, 22 nt, Homo sapiens
auauagcaaugaaagagaugaa

SEQ ID NO: 270429 - RNA, 22 nt, Homo sapiens
auauauguuuucugggaagaaa

SEQ ID NO: 270430 - RNA, 22 nt, Homo sapiens
uccauuuguagguagugagaca

SEQ ID NO: 270431 - RNA, 22 nt, Homo sapiens
uccauuuguucagcuucaggaa

SEQ ID NO: 270432 - RNA, 22 nt, Homo sapiens
ucccagugaaaccccaccuuca

SEQ ID NO: 270433 - RNA, 22 nt, Homo sapiens
uccccugagucaccugcuucuc

SEQ ID NO: 270434 - RNA, 22 nt, Homo sapiens
ucccuguguccugggggcaccu

SEQ ID NO: 270435 - RNA, 22 nt, Homo sapiens
ucccuguguuccuuuugaauug

SEQ ID NO: 270436 - RNA, 21 nt, Homo sapiens
uccugagagaggaguaacucu

SEQ ID NO: 270437 - RNA, 23 nt, Homo sapiens
uccuugguuggcgcccuaugugu

SEQ ID NO: 270438 - RNA, 22 nt, Homo sapiens
ucucaauuugauuacauucaua

SEQ ID NO: 270439 - RNA, 22 nt, Homo sapiens
ucucaugaagauagagaauaga

SEQ ID NO: 270440 - RNA, 22 nt, Homo sapiens
ucucaugaagguggagaguagg

SEQ ID NO: 270441 - RNA, 20 nt, Homo sapiens
ucucauggagguagagaaua

SEQ ID NO: 270442 - RNA, 22 nt, Homo sapiens
ucucuguuuagagccagcaauu

SEQ ID NO: 270443 - RNA, 22 nt, Homo sapiens
ucugacacuucugcagaauuga

SEQ ID NO: 270444 - RNA, 22 nt, Homo sapiens
ucuggagugugaaguggauaug

SEQ ID NO: 270445 - RNA, 22 nt, Homo sapiens
ucuggcaagagccgagggcagu

SEQ ID NO: 270446 - RNA, 22 nt, Homo sapiens
ucugguggugaugagagacagu

SEQ ID NO: 270447 - RNA, 22 nt, Homo sapiens
ucugugcauuguaacaacuaaa

SEQ ID NO: 270448 - RNA, 22 nt, Homo sapiens
ucugugcauuguaggauguuua

SEQ ID NO: 270449 - RNA, 22 nt, Homo sapiens
ucugugcggucuguguuaugaa

SEQ ID NO: 270450 - RNA, 22 nt, Homo sapiens
ucuguugguucuuugaggagga

SEQ ID NO: 270451 - RNA, 22 nt, Homo sapiens
ucuuggguuuguccuucuccua

SEQ ID NO: 270452 - RNA, 22 nt, Homo sapiens
ucuugguugaaaauucauaaua

SEQ ID NO: 270453 - RNA, 22 nt, Homo sapiens
ucuuuggagacaaccccagucu

SEQ ID NO: 270454 - RNA, 22 nt, Homo sapiens
ugaaauacuuaauuucuccaug

SEQ ID NO: 270455 - RNA, 22 nt, Homo sapiens
ugaaauggugcggucugcagca

SEQ ID NO: 270456 - RNA, 22 nt, Homo sapiens
ugaacagcaccuccuagaguug

SEQ ID NO: 270457 - RNA, 22 nt, Homo sapiens
ugaaggacauaaggcagaguga

SEQ ID NO: 270458 - RNA, 20 nt, Homo sapiens
ugaaggaggucauuuauacc

SEQ ID NO: 270459 - RNA, 22 nt, Homo sapiens
ugaauacagcacacccaugggu

SEQ ID NO: 270460 - RNA, 22 nt, Homo sapiens
ugaauagaaguggcaggaguag

SEQ ID NO: 270461 - RNA, 22 nt, Homo sapiens
ugacaaguaaacagucagcacc

SEQ ID NO: 270462 - RNA, 22 nt, Homo sapiens
uugaaagucauuucuucuaagu

SEQ ID NO: 270463 - RNA, 22 nt, Homo sapiens
uugaaauguguaagcuccgaaa

SEQ ID NO: 270464 - RNA, 22 nt, Homo sapiens
uugagacggagucuugcucuuu

SEQ ID NO: 270465 - RNA, 22 nt, Homo sapiens
uugagacggaguuuugcucuug

SEQ ID NO: 270466 - RNA, 22 nt, Homo sapiens
uugagauggagucucacucuuu

SEQ ID NO: 270467 - RNA, 22 nt, Homo sapiens
uugagauggagucucgcucuuu

SEQ ID NO: 270468 - RNA, 22 nt, Homo sapiens
uugagauggagucucgcugugu

SEQ ID NO: 270469 - RNA, 22 nt, Homo sapiens
uugagauggaguucauuuuugu

SEQ ID NO: 270470 - RNA, 22 nt, Homo sapiens
uugagauggaguuucaauauug

SEQ ID NO: 270471 - RNA, 22 nt, Homo sapiens
uugagauggaguuucacucugu

SEQ ID NO: 270472 - RNA, 22 nt, Homo sapiens
uugagauggaguuucgcucuug

SEQ ID NO: 270473 - RNA, 22 nt, Homo sapiens
uugagauguaguuucacuccug

SEQ ID NO: 270474 - RNA, 22 nt, Homo sapiens
uugagauguggcaguuuaugag

SEQ ID NO: 270475 - RNA, 22 nt, Homo sapiens
uugaggaggcagucucuccauu

SEQ ID NO: 270476 - RNA, 22 nt, Homo sapiens
uugaggaggcagucuguccguu

SEQ ID NO: 270477 - RNA, 22 nt, Homo sapiens
uugagggaagccagaggucugc

SEQ ID NO: 270478 - RNA, 22 nt, Homo sapiens
uugagguuggaggccuugccug

SEQ ID NO: 270479 - RNA, 22 nt, Homo sapiens
uugauauguuguuagauucagu

SEQ ID NO: 270480 - RNA, 22 nt, Homo sapiens
uugcaacauguauucuggugau

SEQ ID NO: 270481 - RNA, 22 nt, Homo sapiens
uugcacagugcuuucuuugccc

SEQ ID NO: 270482 - RNA, 22 nt, Homo sapiens
uugcacuccagucuggggggca

SEQ ID NO: 270483 - RNA, 22 nt, Homo sapiens
uugcacuccauccuggguugac

SEQ ID NO: 270484 - RNA, 22 nt, Homo sapiens
uugcacuccggccuggguaaca

SEQ ID NO: 270485 - RNA, 22 nt, Homo sapiens
uugcacucuagccugggugaca

SEQ ID NO: 270486 - RNA, 22 nt, Homo sapiens
uugcagagaaauuucugguuua

SEQ ID NO: 270487 - RNA, 22 nt, Homo sapiens
uugcauauguugaaccaagcgu

SEQ ID NO: 270488 - RNA, 22 nt, Homo sapiens
uugcauuuucuaggagggcaaa

SEQ ID NO: 270489 - RNA, 22 nt, Homo sapiens
uugccuaguuuaggucugugcu

SEQ ID NO: 270490 - RNA, 22 nt, Homo sapiens
uuggaaacauuuaugguaacag

SEQ ID NO: 270491 - RNA, 22 nt, Homo sapiens
uuggaaacgucaccuuuuccuu

SEQ ID NO: 270492 - RNA, 22 nt, Homo sapiens
uuggaagacaaugcugauucuc

SEQ ID NO: 270493 - RNA, 22 nt, Homo sapiens
uuggaagauuacuuaguuuucu

SEQ ID NO: 270494 - RNA, 22 nt, Homo sapiens
uuggaauguauggcaucuugcg

SEQ ID NO: 270495 - RNA, 22 nt, Homo sapiens
uuggacugagaguuccaccauu

SEQ ID NO: 270496 - RNA, 22 nt, Homo sapiens
uuggacuggaacuauaccauug

SEQ ID NO: 270497 - RNA, 22 nt, Homo sapiens
uuggacugggauggccgaggcu

SEQ ID NO: 270498 - RNA, 22 nt, Homo sapiens
uuggagagucacuaguuagugc

SEQ ID NO: 270499 - RNA, 22 nt, Homo sapiens
uuggagagugauauucagaugc

SEQ ID NO: 270500 - RNA, 22 nt, Homo sapiens
uuggagucaucucuguacugua

SEQ ID NO: 270501 - RNA, 21 nt, Homo sapiens
uuggcacucuucucuccuuau

SEQ ID NO: 270502 - RNA, 20 nt, Homo sapiens
uuggcagagucuuuagggua

SEQ ID NO: 270503 - RNA, 22 nt, Homo sapiens
uuggggcacggccucuguugcc

SEQ ID NO: 270504 - RNA, 22 nt, Homo sapiens
uuggucaggcuagaguguggug

SEQ ID NO: 270505 - RNA, 19 nt, Homo sapiens
uuggucccuuuggguucuu

SEQ ID NO: 270506 - RNA, 22 nt, Homo sapiens
uugguuauccugucgguaauuc

SEQ ID NO: 270507 - RNA, 22 nt, Homo sapiens
uuguaaucaacacaucauuggg

SEQ ID NO: 270508 - RNA, 22 nt, Homo sapiens
uuguaauguuaggguguccaug

SEQ ID NO: 270509 - RNA, 22 nt, Homo sapiens
uuguacuggguuuucuggaauu

SEQ ID NO: 270510 - RNA, 22 nt, Homo sapiens
uuguagaucuucaguugcuaca

SEQ ID NO: 270511 - RNA, 22 nt, Homo sapiens
uuguccucuccaaaucucaugu

SEQ ID NO: 270512 - RNA, 22 nt, Homo sapiens
uugugaucauugucaaauagug

SEQ ID NO: 270513 - RNA, 22 nt, Homo sapiens
uugugccugguacauggagaaa

SEQ ID NO: 270514 - RNA, 22 nt, Homo sapiens
uugugcuucaucaccuagcaga

SEQ ID NO: 270515 - RNA, 22 nt, Homo sapiens
uugugcuuguaacuacauucag

SEQ ID NO: 270516 - RNA, 18 nt, Homo sapiens
uuguggccccuacaaauu

SEQ ID NO: 270517 - RNA, 22 nt, Homo sapiens
uuuagcaauucauuuugugucu

SEQ ID NO: 270518 - RNA, 21 nt, Homo sapiens
uuucacugugaguuuuucugu

SEQ ID NO: 270519 - RNA, 22 nt, Homo sapiens
uuucagguauuuaagggccguu

SEQ ID NO: 270520 - RNA, 22 nt, Homo sapiens
uuuccacauggacuuaccuucg

SEQ ID NO: 270521 - RNA, 22 nt, Homo sapiens
uuuccagguggccaacauuuua

SEQ ID NO: 270522 - RNA, 22 nt, Homo sapiens
uuucccauuguucugcucugug

SEQ ID NO: 270523 - RNA, 22 nt, Homo sapiens
uuugagaucuuuagaaucaggc

SEQ ID NO: 270524 - RNA, 22 nt, Homo sapiens
ugccugagcccagcccuguagu

SEQ ID NO: 270525 - RNA, 22 nt, Homo sapiens
ugccuggagagcuccuacauau

SEQ ID NO: 270526 - RNA, 22 nt, Homo sapiens
ugcugguguuuaggaauaagaa

SEQ ID NO: 270527 - RNA, 22 nt, Homo sapiens
ugcugguuuucaucaucagugg

SEQ ID NO: 270528 - RNA, 22 nt, Homo sapiens
ugcuuagucuugcuuuagcuau

SEQ ID NO: 270529 - RNA, 22 nt, Homo sapiens
ugcuucauuggccaccaggaag

SEQ ID NO: 270530 - RNA, 22 nt, Homo sapiens
uggaagacaggcuguauuuuaa

SEQ ID NO: 270531 - RNA, 22 nt, Homo sapiens
uggaagacauugggugaagggu

SEQ ID NO: 270532 - RNA, 23 nt, Homo sapiens
uggaagacuccucucuuggcugc

SEQ ID NO: 270533 - RNA, 22 nt, Homo sapiens
uggaaguauagauaauugaaag

SEQ ID NO: 270534 - RNA, 23 nt, Homo sapiens
uggaaguauggaggaggcagaau

SEQ ID NO: 270535 - RNA, 22 nt, Homo sapiens
uggaagucauugagguguguua

SEQ ID NO: 270536 - RNA, 22 nt, Homo sapiens
uggaagucuauggcauuugagu

SEQ ID NO: 270537 - RNA, 21 nt, Homo sapiens
uggaauguucugacuucaggg

SEQ ID NO: 270538 - RNA, 22 nt, Homo sapiens
uggacaagugcccuccaccuca

SEQ ID NO: 270539 - RNA, 22 nt, Homo sapiens
uggacugagauuucagcugcca

SEQ ID NO: 270540 - RNA, 22 nt, Homo sapiens
uggagguagacauugggaagag

SEQ ID NO: 270541 - RNA, 20 nt, Homo sapiens
uggaggucaucugucacuac

SEQ ID NO: 270542 - RNA, 22 nt, Homo sapiens
uggaguguaauuagccaucagu

SEQ ID NO: 270543 - RNA, 22 nt, Homo sapiens
uggauagauacuauccaggacu

SEQ ID NO: 270544 - RNA, 21 nt, Homo sapiens
uggauugagaaccccaggagg

SEQ ID NO: 270545 - RNA, 22 nt, Homo sapiens
uggcaagagcaaaauguacagu

SEQ ID NO: 270546 - RNA, 22 nt, Homo sapiens
uggcaagugggaccuaguuaaa

SEQ ID NO: 270547 - RNA, 23 nt, Homo sapiens
uggcauuuuaguuagcuucagug

SEQ ID NO: 270548 - RNA, 23 nt, Homo sapiens
uggcauuuuuggcaaugccuucu

SEQ ID NO: 270549 - RNA, 22 nt, Homo sapiens
uggccagagggcaauuagcugu

SEQ ID NO: 270550 - RNA, 22 nt, Homo sapiens
uggccagugucggaggccagga

SEQ ID NO: 270551 - RNA, 22 nt, Homo sapiens
uggccuguaacgcugucucagc

SEQ ID NO: 270552 - RNA, 22 nt, Homo sapiens
uggcuuuuauuauguugaggua

SEQ ID NO: 270553 - RNA, 22 nt, Homo sapiens
cauggccuuuggaaugugucua

SEQ ID NO: 270554 - RNA, 22 nt, Homo sapiens
cauggcuuuauuuucagcuucu

SEQ ID NO: 270555 - RNA, 20 nt, Homo sapiens
cauuccacuuuccugucagu

SEQ ID NO: 270556 - RNA, 22 nt, Homo sapiens
cauuuugcaguuucugucucca

SEQ ID NO: 270557 - RNA, 22 nt, Homo sapiens
ccaagccucaguuucccucugu

SEQ ID NO: 270558 - RNA, 22 nt, Homo sapiens
ccaaggcacugauucuguacuc

SEQ ID NO: 270559 - RNA, 22 nt, Homo sapiens
ccacccuuccacacccugggua

SEQ ID NO: 270560 - RNA, 22 nt, Homo sapiens
ccacuguuuaaauggcugagga

SEQ ID NO: 270561 - RNA, 22 nt, Homo sapiens
auacugucucuugcuccugccc

SEQ ID NO: 270562 - RNA, 20 nt, Homo sapiens
auagaagacuagugcagcag

SEQ ID NO: 270563 - RNA, 22 nt, Homo sapiens
auagaagcugccaacguuucag

SEQ ID NO: 270564 - RNA, 22 nt, Homo sapiens
auagcaauuugggaaucagacu

SEQ ID NO: 270565 - RNA, 22 nt, Homo sapiens
auauaccuaggcuacaugguuu

SEQ ID NO: 270566 - RNA, 22 nt, Homo sapiens
auaucacaggaaaggaagauac

SEQ ID NO: 270567 - RNA, 22 nt, Homo sapiens
aucaaauugucauuuuaaggau

SEQ ID NO: 270568 - RNA, 22 nt, Homo sapiens
aucacaggcaaaauuccuucuc

SEQ ID NO: 270569 - RNA, 22 nt, Homo sapiens
aucacuuucuauuucugugcca

SEQ ID NO: 270570 - RNA, 22 nt, Homo sapiens
aucaggaaccuuuuuggugugu

SEQ ID NO: 270571 - RNA, 22 nt, Homo sapiens
aucauauccuagauauaacuuc

SEQ ID NO: 270572 - RNA, 22 nt, Homo sapiens
aucccagaaacucggguuucuc

SEQ ID NO: 270573 - RNA, 22 nt, Homo sapiens
aucgcaccauugcacuccagca

SEQ ID NO: 270574 - RNA, 22 nt, Homo sapiens
aucucugagauguucugauuuu

SEQ ID NO: 270575 - RNA, 22 nt, Homo sapiens
aucucuugccagucagaauggu

SEQ ID NO: 270576 - RNA, 22 nt, Homo sapiens
aucuuguguugaauggugcaga

SEQ ID NO: 270577 - RNA, 22 nt, Homo sapiens
augaaaucuuuccugugaggau

SEQ ID NO: 270578 - RNA, 18 nt, Homo sapiens
augaagucaucacuuuua

SEQ ID NO: 270579 - RNA, 22 nt, Homo sapiens
augaccagagguaugauguuug

SEQ ID NO: 270580 - RNA, 22 nt, Homo sapiens
augacguugugggcucucaagc

SEQ ID NO: 270581 - RNA, 22 nt, Homo sapiens
augagaugaauaccgacgaugu

SEQ ID NO: 270582 - RNA, 22 nt, Homo sapiens
augagaugcaagauuagauggg

SEQ ID NO: 270583 - RNA, 22 nt, Homo sapiens
augagggcggacgcccuggaga

SEQ ID NO: 270584 - RNA, 20 nt, Homo sapiens
augagguguaugacacugaa

SEQ ID NO: 270585 - RNA, 22 nt, Homo sapiens
augauggaggccgugauggacg

SEQ ID NO: 270586 - RNA, 22 nt, Homo sapiens
augcaaacaucauagaguguac

SEQ ID NO: 270587 - RNA, 22 nt, Homo sapiens
augcauauuuuaccuagaagag

SEQ ID NO: 270588 - RNA, 22 nt, Homo sapiens
augccacugcacucuagccugg

SEQ ID NO: 270589 - RNA, 22 nt, Homo sapiens
augccacugcacuucagcuugg

SEQ ID NO: 270590 - RNA, 22 nt, Homo sapiens
augccacugcauaagguuuuca

SEQ ID NO: 270591 - RNA, 22 nt, Homo sapiens
augccacugcgcucuagccugg

SEQ ID NO: 270592 - RNA, 22 nt, Homo sapiens
auggaacauaacuauuugggga

SEQ ID NO: 270593 - RNA, 22 nt, Homo sapiens
auggauguucuagggaugugau

SEQ ID NO: 270594 - RNA, 22 nt, Homo sapiens
auggcacugaagcguauugaca

SEQ ID NO: 270595 - RNA, 22 nt, Homo sapiens
auggcacuuuggacugcuagau

SEQ ID NO: 270596 - RNA, 22 nt, Homo sapiens
auggcagagucagaaagucagg

SEQ ID NO: 270597 - RNA, 22 nt, Homo sapiens
auggcaguuuauucuaaaucaa

SEQ ID NO: 270598 - RNA, 22 nt, Homo sapiens
auggcauggugcaggguuuaag

SEQ ID NO: 270599 - RNA, 22 nt, Homo sapiens
auggcccugaguucaauauauu

SEQ ID NO: 270600 - RNA, 22 nt, Homo sapiens
auggccugaugcaccuguccca

SEQ ID NO: 270601 - RNA, 22 nt, Homo sapiens
auggccuuguauaccuggcaaa

SEQ ID NO: 270602 - RNA, 22 nt, Homo sapiens
auggccuuuuuaucucaccaag

SEQ ID NO: 270603 - RNA, 22 nt, Homo sapiens
auggcuagauuguaugguaguu

SEQ ID NO: 270604 - RNA, 22 nt, Homo sapiens
auggcucuggauagaaugcagg

SEQ ID NO: 270605 - RNA, 22 nt, Homo sapiens
auguaacaguauuuggagaugu

SEQ ID NO: 270606 - RNA, 22 nt, Homo sapiens
augucuagagugauacugaagc

SEQ ID NO: 270607 - RNA, 22 nt, Homo sapiens
augugggaggaauguguuucca

SEQ ID NO: 270608 - RNA, 22 nt, Homo sapiens
auguggugguagccaggacagg

SEQ ID NO: 270609 - RNA, 22 nt, Homo sapiens
augugugcuugauguaaaaagu

SEQ ID NO: 270610 - RNA, 22 nt, Homo sapiens
auguugcuugaaggcauuuugu

SEQ ID NO: 270611 - RNA, 22 nt, Homo sapiens
auuaauguaauuaguaaaguug

SEQ ID NO: 270612 - RNA, 22 nt, Homo sapiens
auugcacuccacccugggcaac

SEQ ID NO: 270613 - RNA, 22 nt, Homo sapiens
auugcacuccagccuggcaaua

SEQ ID NO: 270614 - RNA, 22 nt, Homo sapiens
auugcacuccagccuugugaca

SEQ ID NO: 270615 - RNA, 22 nt, Homo sapiens
auugcagaaaugacagagcgcc

SEQ ID NO: 270616 - RNA, 18 nt, Homo sapiens
auugcccucauggggcuu

SEQ ID NO: 270617 - RNA, 22 nt, Homo sapiens
auugcugagacauugcuaaucu

SEQ ID NO: 270618 - RNA, 22 nt, Homo sapiens
auuguaauuuuagagaaagugg

SEQ ID NO: 270619 - RNA, 22 nt, Homo sapiens
auuguucuuacaugcugucauc

SEQ ID NO: 270620 - RNA, 22 nt, Homo sapiens
auuugguuauggucauggacac

SEQ ID NO: 270621 - RNA, 22 nt, Homo sapiens
caaagugcugggaugggccagg

SEQ ID NO: 270622 - RNA, 22 nt, Homo sapiens
caaauugcuuguggaggauaau

SEQ ID NO: 270623 - RNA, 22 nt, Homo sapiens
caacugguuuuauacaguuuag

SEQ ID NO: 270624 - RNA, 22 nt, Homo sapiens
caagaucauuuaugcuaaaauu

SEQ ID NO: 270625 - RNA, 22 nt, Homo sapiens
caagggguggaaaugguagugu

SEQ ID NO: 270626 - RNA, 22 nt, Homo sapiens
cacaggccugucucuuucuaac

SEQ ID NO: 270627 - RNA, 22 nt, Homo sapiens
cacagugaacaauauccucugu

SEQ ID NO: 270628 - RNA, 22 nt, Homo sapiens
cacauugcaggaaaguucauua

SEQ ID NO: 270629 - RNA, 22 nt, Homo sapiens
caccgagguuggagugcagugg

SEQ ID NO: 270630 - RNA, 22 nt, Homo sapiens
cacugcaguggaagauuaagaa

SEQ ID NO: 270631 - RNA, 22 nt, Homo sapiens
cacugcauccuccaccuccugg

SEQ ID NO: 270632 - RNA, 22 nt, Homo sapiens
cagagcaaugcuuuugcuuuga

SEQ ID NO: 270633 - RNA, 22 nt, Homo sapiens
cagccgggugagguggcuuguu

SEQ ID NO: 270634 - RNA, 22 nt, Homo sapiens
cagcugaugucgaaugcacucu

SEQ ID NO: 270635 - RNA, 23 nt, Homo sapiens
cagcuucauugaacauaacuccu

SEQ ID NO: 270636 - RNA, 22 nt, Homo sapiens
caggcagucuggcucccaagug

SEQ ID NO: 270637 - RNA, 22 nt, Homo sapiens
caggcauuguauuguaaucccc

SEQ ID NO: 270638 - RNA, 18 nt, Homo sapiens
cagugcaauacaggagag

SEQ ID NO: 270639 - RNA, 22 nt, Homo sapiens
cagugcuuguuauuguucuauu

SEQ ID NO: 270640 - RNA, 22 nt, Homo sapiens
cagugucugcauuuggaacuca

SEQ ID NO: 270641 - RNA, 22 nt, Homo sapiens
caucacaugcuuauuuuccuca

SEQ ID NO: 270642 - RNA, 22 nt, Homo sapiens
cauggagcuaggcuugaucccu

SEQ ID NO: 270643 - RNA, 22 nt, Homo sapiens
cauggcccugggcugggcgaac

SEQ ID NO: 270644 - RNA, 20 nt, Homo sapiens
cauugcccuccagccugggc

SEQ ID NO: 270645 - RNA, 22 nt, Homo sapiens
cauugcuuuuggugguuuagac

SEQ ID NO: 270646 - RNA, 22 nt, Homo sapiens
ccaaguguuuucauuguuccau

SEQ ID NO: 270647 - RNA, 22 nt, Homo sapiens
ccacccuggagaauuugagguc

SEQ ID NO: 270648 - RNA, 22 nt, Homo sapiens
gcaagaauggaacaggagagcc

SEQ ID NO: 270649 - RNA, 22 nt, Homo sapiens
gcacaggguuacauucuaaggu

SEQ ID NO: 270650 - RNA, 22 nt, Homo sapiens
gcacaguguuacuugauauauu

SEQ ID NO: 270651 - RNA, 22 nt, Homo sapiens
gcaccauugacaagaaauaggu

SEQ ID NO: 270652 - RNA, 23 nt, Homo sapiens
gcagcaaugucacagggguccgg

SEQ ID NO: 270653 - RNA, 22 nt, Homo sapiens
gcagcagugugggcugaaccua

SEQ ID NO: 270654 - RNA, 22 nt, Homo sapiens
gcagcaucaaaucacacaagau

SEQ ID NO: 270655 - RNA, 20 nt, Homo sapiens
gcaguacuuuuaguucuaag

SEQ ID NO: 270656 - RNA, 22 nt, Homo sapiens
gcaguagugugaucuuggcuca

SEQ ID NO: 270657 - RNA, 22 nt, Homo sapiens
gcagugcaugacgguauauaua

SEQ ID NO: 270658 - RNA, 22 nt, Homo sapiens
gcaguguucugggcaggaagaa

SEQ ID NO: 270659 - RNA, 22 nt, Homo sapiens
gcaguguugugauccaggucuu

SEQ ID NO: 270660 - RNA, 20 nt, Homo sapiens
gcauaugucuuuauagcaga

SEQ ID NO: 270661 - RNA, 22 nt, Homo sapiens
gccaagaugcugcccacagaca

SEQ ID NO: 270662 - RNA, 22 nt, Homo sapiens
gccaagauuuaauucaucaguu

SEQ ID NO: 270663 - RNA, 22 nt, Homo sapiens
gccucaguuguggccagggauu

SEQ ID NO: 270664 - RNA, 19 nt, Homo sapiens
gcugauguuacauucuugc

SEQ ID NO: 270665 - RNA, 22 nt, Homo sapiens
gcugcacuuuaaggcauccccu

SEQ ID NO: 270666 - RNA, 22 nt, Homo sapiens
gcuguauugacuuuguaucaua

SEQ ID NO: 270667 - RNA, 22 nt, Homo sapiens
gcuguguguuaucagaaauugc

SEQ ID NO: 270668 - RNA, 22 nt, Homo sapiens
gcuguguucucgaggcggggga

SEQ ID NO: 270669 - RNA, 22 nt, Homo sapiens
gcuucauggaggcugggcgcag

SEQ ID NO: 270670 - RNA, 22 nt, Homo sapiens
gcuuuggauaaaugucaguuua

SEQ ID NO: 270671 - RNA, 22 nt, Homo sapiens
gcuuuguuguugaugggaaauc

SEQ ID NO: 270672 - RNA, 22 nt, Homo sapiens
ggaaaguaacccauucucuuac

SEQ ID NO: 270673 - RNA, 22 nt, Homo sapiens
ggaagaauauuaggggauuucg

SEQ ID NO: 270674 - RNA, 22 nt, Homo sapiens
ggaaugagaaauauuacacaau

SEQ ID NO: 270675 - RNA, 21 nt, Homo sapiens
ggaauguugccagcagccaga

SEQ ID NO: 270676 - RNA, 22 nt, Homo sapiens
ggacaagagacugggacacuga

SEQ ID NO: 270677 - RNA, 22 nt, Homo sapiens
ggacaguagugcuuucuaucau

SEQ ID NO: 270678 - RNA, 22 nt, Homo sapiens
ggagagugacauauuucuaggc

SEQ ID NO: 270679 - RNA, 22 nt, Homo sapiens
ggagggugagaucaauuuggga

SEQ ID NO: 270680 - RNA, 20 nt, Homo sapiens
ggagguguugauuuuucuuu

SEQ ID NO: 270681 - RNA, 20 nt, Homo sapiens
ggagguuguauaaguacauc

SEQ ID NO: 270682 - RNA, 23 nt, Homo sapiens
ggaguguaaauuauuucaaccau

SEQ ID NO: 270683 - RNA, 22 nt, Homo sapiens
ggcaaggauguuuuucuggcaa

SEQ ID NO: 270684 - RNA, 22 nt, Homo sapiens
ggcauugugauccaccagccuu

SEQ ID NO: 270685 - RNA, 22 nt, Homo sapiens
ggccagaugaucuaugaaggaa

SEQ ID NO: 270686 - RNA, 22 nt, Homo sapiens
ggcuagagacaaguugcugaga

SEQ ID NO: 270687 - RNA, 22 nt, Homo sapiens
ggcuguguguuaaaauaggcuu

SEQ ID NO: 270688 - RNA, 22 nt, Homo sapiens
gggauguaugauauauguuggu

SEQ ID NO: 270689 - RNA, 22 nt, Homo sapiens
gggcacgugugugcugugcuca

SEQ ID NO: 270690 - RNA, 22 nt, Homo sapiens
gggcagaugucuggacaccuca

SEQ ID NO: 270691 - RNA, 22 nt, Homo sapiens
ggguucccuucuggcucagggu

SEQ ID NO: 270692 - RNA, 22 nt, Homo sapiens
gguguguaaauuacuuaucucu

SEQ ID NO: 270693 - RNA, 22 nt, Homo sapiens
guaaauaccaguuucuggaaca

SEQ ID NO: 270694 - RNA, 22 nt, Homo sapiens
guaaucucagcuacuugggagg

SEQ ID NO: 270695 - RNA, 22 nt, Homo sapiens
guaaucucagcuucuugggagg

SEQ ID NO: 270696 - RNA, 19 nt, Homo sapiens
guaaucucaguacuuuggu

SEQ ID NO: 270697 - RNA, 22 nt, Homo sapiens
guagcagcuacuaaguugcugu

SEQ ID NO: 270698 - RNA, 22 nt, Homo sapiens
guauacuucugaaaauagcuau

SEQ ID NO: 270699 - RNA, 22 nt, Homo sapiens
guauaguaguacaaaaguuuuu

SEQ ID NO: 270700 - RNA, 22 nt, Homo sapiens
guaucaugaaguuucuucauuu

SEQ ID NO: 270701 - RNA, 22 nt, Homo sapiens
guauggcacuauccucucugau

SEQ ID NO: 270702 - RNA, 21 nt, Homo sapiens
guauggcauugauuaguuacu

SEQ ID NO: 270703 - RNA, 22 nt, Homo sapiens
guauggcauuuguggauuggcc

SEQ ID NO: 270704 - RNA, 22 nt, Homo sapiens
gucagggagucucuaucagugg

SEQ ID NO: 270705 - RNA, 22 nt, Homo sapiens
gucauuguguggacauggagaa

SEQ ID NO: 270706 - RNA, 22 nt, Homo sapiens
guccauuuguuuccagagcacu

SEQ ID NO: 270707 - RNA, 22 nt, Homo sapiens
guccuugaggcuuugacugugg

SEQ ID NO: 270708 - RNA, 22 nt, Homo sapiens
gucgguguuuccugagaacgaa

SEQ ID NO: 270709 - RNA, 22 nt, Homo sapiens
gucucuugguuuagagcauuua

SEQ ID NO: 270710 - RNA, 21 nt, Homo sapiens
gucugguguuuuaaugaggac

SEQ ID NO: 270711 - RNA, 22 nt, Homo sapiens
gucugguugacagcauguggcc

SEQ ID NO: 270712 - RNA, 22 nt, Homo sapiens
gucugguuuuuuauauccucac

SEQ ID NO: 270713 - RNA, 21 nt, Homo sapiens
gucuuacagccagaugccucu

SEQ ID NO: 270714 - RNA, 22 nt, Homo sapiens
gugaaaugaaacgcuaugucuu

SEQ ID NO: 270715 - RNA, 22 nt, Homo sapiens
gugaaugaaugggugaauacau

SEQ ID NO: 270716 - RNA, 22 nt, Homo sapiens
gugagcagagaucgcgugauug

SEQ ID NO: 270717 - RNA, 22 nt, Homo sapiens
gugaggaaggaaaccugcuagc

SEQ ID NO: 270718 - RNA, 22 nt, Homo sapiens
gugaggcacugcugcuuuccag

SEQ ID NO: 270719 - RNA, 22 nt, Homo sapiens
gugagggaugugaaaaagguca

SEQ ID NO: 270720 - RNA, 21 nt, Homo sapiens
gugaggucauugggcuuucug

SEQ ID NO: 270721 - RNA, 22 nt, Homo sapiens
gugagguguuaaccaaccugug

SEQ ID NO: 270722 - RNA, 22 nt, Homo sapiens
gugauguguuucaacagcuccu

SEQ ID NO: 270723 - RNA, 22 nt, Homo sapiens
gugauguguuuguucuaucucu

SEQ ID NO: 270724 - RNA, 22 nt, Homo sapiens
gugcacaacgugcagguuuguu

SEQ ID NO: 270725 - RNA, 23 nt, Homo sapiens
gugcaguggcgagauuucggcuc

SEQ ID NO: 270726 - RNA, 22 nt, Homo sapiens
gugcauaugcaugugcaugcac

SEQ ID NO: 270727 - RNA, 22 nt, Homo sapiens
guggagcuguguggccuugggc

SEQ ID NO: 270728 - RNA, 22 nt, Homo sapiens
guggcagaaaagagaagcaaug

SEQ ID NO: 270729 - RNA, 22 nt, Homo sapiens
guggcagagucagagggaaaug

SEQ ID NO: 270730 - RNA, 22 nt, Homo sapiens
guggucagaaaucucaguggca

SEQ ID NO: 270731 - RNA, 18 nt, Homo sapiens
gugucugguuaugggagu

SEQ ID NO: 270732 - RNA, 22 nt, Homo sapiens
gugugcacaaucuggcaugugc

SEQ ID NO: 270733 - RNA, 19 nt, Homo sapiens
gugugcauaucacagagca

SEQ ID NO: 270734 - RNA, 22 nt, Homo sapiens
gugugcauggagggggcaguga

SEQ ID NO: 270735 - RNA, 22 nt, Homo sapiens
uuaguaguuugauaggaauagc

SEQ ID NO: 270736 - RNA, 22 nt, Homo sapiens
uuaguuuaucagugguuucuga

SEQ ID NO: 270737 - RNA, 18 nt, Homo sapiens
uuauacuccccaggcaau

SEQ ID NO: 270738 - RNA, 22 nt, Homo sapiens
uuauacucgucugaaugauucu

SEQ ID NO: 270739 - RNA, 22 nt, Homo sapiens
uuauauguuacucccucuagca

SEQ ID NO: 270740 - RNA, 22 nt, Homo sapiens
uuauauguuuguacuuaggccu

SEQ ID NO: 270741 - RNA, 22 nt, Homo sapiens
uuauggauuuauauucuguagu

SEQ ID NO: 270742 - RNA, 22 nt, Homo sapiens
uuaugucuuugagcaaugcugu

SEQ ID NO: 270743 - RNA, 22 nt, Homo sapiens
uuauguguuuaauguuucugaa

SEQ ID NO: 270744 - RNA, 22 nt, Homo sapiens
uuauuacuccuauuuuguagau

SEQ ID NO: 270745 - RNA, 23 nt, Homo sapiens
uucaaauguucucugguugucag

SEQ ID NO: 270746 - RNA, 20 nt, Homo sapiens
uucagcaaaggaaugggagu

SEQ ID NO: 270747 - RNA, 22 nt, Homo sapiens
uucagcaaugacagccuauaua

SEQ ID NO: 270748 - RNA, 22 nt, Homo sapiens
uucagcaggccaggcccugacu

SEQ ID NO: 270749 - RNA, 19 nt, Homo sapiens
uucagcagugucugcucuu

SEQ ID NO: 270750 - RNA, 22 nt, Homo sapiens
uucagcuacuuggaaacagcaa

SEQ ID NO: 270751 - RNA, 22 nt, Homo sapiens
uucaggcuccugugagaaucua

SEQ ID NO: 270752 - RNA, 22 nt, Homo sapiens
uucagguucauuugcugcuauu

SEQ ID NO: 270753 - RNA, 22 nt, Homo sapiens
uucagugguuauuugugagauu

SEQ ID NO: 270754 - RNA, 22 nt, Homo sapiens
uucaguucugcucugaucuuag

SEQ ID NO: 270755 - RNA, 18 nt, Homo sapiens
uucauaguagcaugauuu

SEQ ID NO: 270756 - RNA, 22 nt, Homo sapiens
uucaucuggcaauucagagauu

SEQ ID NO: 270757 - RNA, 22 nt, Homo sapiens
uucauggaugcauuugaggggu

SEQ ID NO: 270758 - RNA, 22 nt, Homo sapiens
uuccaauguuccguguugcagu

SEQ ID NO: 270759 - RNA, 22 nt, Homo sapiens
uuccacaauggcugaacuaguu

SEQ ID NO: 270760 - RNA, 22 nt, Homo sapiens
uuccacaaugguugaacuagcu

SEQ ID NO: 270761 - RNA, 22 nt, Homo sapiens
uuccacaggguugaacuaguuu

SEQ ID NO: 270762 - RNA, 23 nt, Homo sapiens
uuccaccauugacuaguuacaua

SEQ ID NO: 270763 - RNA, 22 nt, Homo sapiens
uuccaguguguucauccucaga

SEQ ID NO: 270764 - RNA, 22 nt, Homo sapiens
uuccauguaguugagcaguuuu

SEQ ID NO: 270765 - RNA, 22 nt, Homo sapiens
uuccauguugauacgugaaguu

SEQ ID NO: 270766 - RNA, 22 nt, Homo sapiens
uuccguguaguugagcaguuuu

SEQ ID NO: 270767 - RNA, 22 nt, Homo sapiens
uuccugagaucagaauucaaau

SEQ ID NO: 270768 - RNA, 20 nt, Homo sapiens
uuccuuaggcauuggaagaa

SEQ ID NO: 270769 - RNA, 22 nt, Homo sapiens
uucuaaacaucuuacaaugcau

SEQ ID NO: 270770 - RNA, 22 nt, Homo sapiens
uucuagagagaagacuuaagcu

SEQ ID NO: 270771 - RNA, 22 nt, Homo sapiens
uucuaugguuuuuaugguguua

SEQ ID NO: 270772 - RNA, 22 nt, Homo sapiens
uucucaaggagccuucguaacu

SEQ ID NO: 270773 - RNA, 22 nt, Homo sapiens
uucucaauggaugugggaccag

SEQ ID NO: 270774 - RNA, 22 nt, Homo sapiens
uucucugggacauaggucgggu

SEQ ID NO: 270775 - RNA, 22 nt, Homo sapiens
uucugagguuauauucucucaa

SEQ ID NO: 270776 - RNA, 22 nt, Homo sapiens
uucuggaaaucagcagagggug

SEQ ID NO: 270777 - RNA, 22 nt, Homo sapiens
uucugugguugaaaggagagau

SEQ ID NO: 270778 - RNA, 22 nt, Homo sapiens
uucuuagucauguaauagucca

SEQ ID NO: 270779 - RNA, 22 nt, Homo sapiens
uucuucaguuacaacaaggggg

SEQ ID NO: 270780 - RNA, 18 nt, Homo sapiens
uucuuguguugauauuuu

SEQ ID NO: 270781 - RNA, 22 nt, Homo sapiens
uucuuuggauaaaguuuuaugc

SEQ ID NO: 270782 - RNA, 22 nt, Homo sapiens
uucuuugguacaagggccgacc

SEQ ID NO: 270783 - RNA, 19 nt, Homo sapiens
uucuuuguugugggggcug

SEQ ID NO: 270784 - RNA, 22 nt, Homo sapiens
uugaaaguaaacaucacaaaga

SEQ ID NO: 270785 - RNA, 22 nt, Homo sapiens
uugaaaucuuccacagcccaag

SEQ ID NO: 270786 - RNA, 22 nt, Homo sapiens
uugaagacuaaguuaucaggau

SEQ ID NO: 270787 - RNA, 22 nt, Homo sapiens
uugagaaucuuugcuaaaggaa

SEQ ID NO: 270788 - RNA, 22 nt, Homo sapiens
uugagagaaaaggccaugccuu

SEQ ID NO: 270789 - RNA, 22 nt, Homo sapiens
uugagagagaacauuuguuaca

SEQ ID NO: 270790 - RNA, 22 nt, Homo sapiens
uugagaguggaggcuauaucuu

SEQ ID NO: 270791 - RNA, 22 nt, Homo sapiens
uugagaugauggauaugcuaau

SEQ ID NO: 270792 - RNA, 22 nt, Homo sapiens
uugagauggaaucucgcuuugu

SEQ ID NO: 270793 - RNA, 22 nt, Homo sapiens
uugagauggagucucacucuuc

SEQ ID NO: 270794 - RNA, 22 nt, Homo sapiens
uugagauggagucuugcucugu

SEQ ID NO: 270795 - RNA, 22 nt, Homo sapiens
uugagauggauagacauagcau

SEQ ID NO: 270796 - RNA, 22 nt, Homo sapiens
uugagauggugccacuguacuc

SEQ ID NO: 270797 - RNA, 22 nt, Homo sapiens
uugaggacuggaacacaggucu

SEQ ID NO: 270798 - RNA, 22 nt, Homo sapiens
uugaggaggcagucuucccauu

SEQ ID NO: 270799 - RNA, 22 nt, Homo sapiens
uugauaugcuugucaguccauu

SEQ ID NO: 270800 - RNA, 22 nt, Homo sapiens
uugauauuaaguacugaagugg

SEQ ID NO: 270801 - RNA, 22 nt, Homo sapiens
uugcaccuugaagccaauagca

SEQ ID NO: 270802 - RNA, 22 nt, Homo sapiens
uugcacuccagccugggugaca

SEQ ID NO: 270803 - RNA, 22 nt, Homo sapiens
uugcacuccagccuuggggaga

SEQ ID NO: 270804 - RNA, 22 nt, Homo sapiens
uugcacuccagcucuaggugac

SEQ ID NO: 270805 - RNA, 22 nt, Homo sapiens
uugcagagccccacacugggcu

SEQ ID NO: 270806 - RNA, 22 nt, Homo sapiens
uugcagugugacgacuauauuu

SEQ ID NO: 270807 - RNA, 19 nt, Homo sapiens
uugcauauguugaaccagc

SEQ ID NO: 270808 - RNA, 22 nt, Homo sapiens
uugcauauucucugaggcagga

SEQ ID NO: 270809 - RNA, 22 nt, Homo sapiens
uugcaugcacaguucucaauag

SEQ ID NO: 270810 - RNA, 23 nt, Homo sapiens
uugcauugcccuccauaguacuc

SEQ ID NO: 270811 - RNA, 22 nt, Homo sapiens
uugcuauguugcccagucugga

SEQ ID NO: 270812 - RNA, 22 nt, Homo sapiens
uugcucaggcuggaguacaaug

SEQ ID NO: 270813 - RNA, 22 nt, Homo sapiens
uugcugagucuuucuagguugc

SEQ ID NO: 270814 - RNA, 22 nt, Homo sapiens
uuggaagagaagggagauaaac

SEQ ID NO: 270815 - RNA, 22 nt, Homo sapiens
uuggaauauaaccuguuucuaa

SEQ ID NO: 270816 - RNA, 23 nt, Homo sapiens
uuggaaugagaccuaagaguuuu

SEQ ID NO: 270817 - RNA, 22 nt, Homo sapiens
uuggaugauaaagaagccuaag

SEQ ID NO: 270818 - RNA, 22 nt, Homo sapiens
uuggcaaguuucugucagcaaa

SEQ ID NO: 270819 - RNA, 22 nt, Homo sapiens
uuggcagaaaaggucggggguu

SEQ ID NO: 270820 - RNA, 22 nt, Homo sapiens
uuggccagugucuuuuuuuccu

SEQ ID NO: 270821 - RNA, 22 nt, Homo sapiens
uugguaagguggaugaugaaua

SEQ ID NO: 270822 - RNA, 22 nt, Homo sapiens
ccaguguuuuugaauuccagga

SEQ ID NO: 270823 - RNA, 22 nt, Homo sapiens
ccaguuuuuggcaaugaugaau

SEQ ID NO: 270824 - RNA, 22 nt, Homo sapiens
ccaucacacugugauuauuauc

SEQ ID NO: 270825 - RNA, 22 nt, Homo sapiens
ccauggcaauggucagucuauu

SEQ ID NO: 270826 - RNA, 22 nt, Homo sapiens
cccagaguucuuaaauacugag

SEQ ID NO: 270827 - RNA, 19 nt, Homo sapiens
cccagugucagagaagggu

SEQ ID NO: 270828 - RNA, 22 nt, Homo sapiens
ccccugaaacucacucauuauc

SEQ ID NO: 270829 - RNA, 22 nt, Homo sapiens
cccugugaauauuaccuuauuu

SEQ ID NO: 270830 - RNA, 22 nt, Homo sapiens
ccucaguguuuaucauuauuuu

SEQ ID NO: 270831 - RNA, 22 nt, Homo sapiens
ccugagaucauacuguuaguaa

SEQ ID NO: 270832 - RNA, 22 nt, Homo sapiens
ccuggaucauugucauucccaa

SEQ ID NO: 270833 - RNA, 22 nt, Homo sapiens
ccuggcaagagacugaagauag

SEQ ID NO: 270834 - RNA, 22 nt, Homo sapiens
cgccugagcugaggaagcugca

SEQ ID NO: 270835 - RNA, 22 nt, Homo sapiens
cggcaguggguaagccaagcuu

SEQ ID NO: 270836 - RNA, 22 nt, Homo sapiens
cuaaugcagucaggagaaggaa

SEQ ID NO: 270837 - RNA, 22 nt, Homo sapiens
cuagcagacaugggcugaacca

SEQ ID NO: 270838 - RNA, 22 nt, Homo sapiens
cuagcccagugcuccuggauca

SEQ ID NO: 270839 - RNA, 22 nt, Homo sapiens
cuagccuggagugcaguggugc

SEQ ID NO: 270840 - RNA, 22 nt, Homo sapiens
cuaggugauccacugcucucuu

SEQ ID NO: 270841 - RNA, 22 nt, Homo sapiens
cuauaugucuguuuugguacca

SEQ ID NO: 270842 - RNA, 22 nt, Homo sapiens
cuauggcuguaaggauaguaac

SEQ ID NO: 270843 - RNA, 22 nt, Homo sapiens
cuauucacaggcaauauguaca

SEQ ID NO: 270844 - RNA, 22 nt, Homo sapiens
cucaaaguguggucuguggguu

SEQ ID NO: 270845 - RNA, 22 nt, Homo sapiens
cucaaguaauccucccgccuug

SEQ ID NO: 270846 - RNA, 22 nt, Homo sapiens
cucacugggaccacucugaagu

SEQ ID NO: 270847 - RNA, 22 nt, Homo sapiens
cucacugugguguccuuaggua

SEQ ID NO: 270848 - RNA, 22 nt, Homo sapiens
cucagugaagggcaagaggcaa

SEQ ID NO: 270849 - RNA, 19 nt, Homo sapiens
cucauggagaaggagaaua

SEQ ID NO: 270850 - RNA, 22 nt, Homo sapiens
cuccagugcaaagucaugauca

SEQ ID NO: 270851 - RNA, 22 nt, Homo sapiens
cuccauuuaguccuuuuagaag

SEQ ID NO: 270852 - RNA, 22 nt, Homo sapiens
cucccacccucauuuuuaggca

SEQ ID NO: 270853 - RNA, 22 nt, Homo sapiens
cucccagugacccaggaacagg

SEQ ID NO: 270854 - RNA, 22 nt, Homo sapiens
cuccuaaccagggcuguuaguc

SEQ ID NO: 270855 - RNA, 22 nt, Homo sapiens
cucuuacaguguguggugaaag

SEQ ID NO: 270856 - RNA, 22 nt, Homo sapiens
cucuuggguagauuuugcagag

SEQ ID NO: 270857 - RNA, 22 nt, Homo sapiens
cugaaucauugcauuaucaagg

SEQ ID NO: 270858 - RNA, 22 nt, Homo sapiens
cugacacuucaaaacugccaau

SEQ ID NO: 270859 - RNA, 22 nt, Homo sapiens
cugacauuguugaucacagcca

SEQ ID NO: 270860 - RNA, 17 nt, Homo sapiens
cugaccucauuguguac

SEQ ID NO: 270861 - RNA, 22 nt, Homo sapiens
cugagagaugagaccucucacu

SEQ ID NO: 270862 - RNA, 22 nt, Homo sapiens
cugagauacacuaauagucucu

SEQ ID NO: 270863 - RNA, 22 nt, Homo sapiens
cugagauggagucucgcauugu

SEQ ID NO: 270864 - RNA, 22 nt, Homo sapiens
cugagcaaagaagugauaauga

SEQ ID NO: 270865 - RNA, 22 nt, Homo sapiens
cugagcaauauagugagaucuu

SEQ ID NO: 270866 - RNA, 22 nt, Homo sapiens
cugagcucauuucuuuugcuac

SEQ ID NO: 270867 - RNA, 22 nt, Homo sapiens
cugaggguagaaggaucacuug

SEQ ID NO: 270868 - RNA, 22 nt, Homo sapiens
cugccacugacaccucaaggac

SEQ ID NO: 270869 - RNA, 18 nt, Homo sapiens
cugccagugugcucuccg

SEQ ID NO: 270870 - RNA, 22 nt, Homo sapiens
cuggaaugugagccccaaaaag

SEQ ID NO: 270871 - RNA, 22 nt, Homo sapiens
cuggaauguuccuaaagauuca

SEQ ID NO: 270872 - RNA, 22 nt, Homo sapiens
cugggaucaguucuagucagaa

SEQ ID NO: 270873 - RNA, 21 nt, Homo sapiens
cugguccccuuuauguaugug

SEQ ID NO: 270874 - RNA, 21 nt, Homo sapiens
cugguguuagcacuucuuccc

SEQ ID NO: 270875 - RNA, 22 nt, Homo sapiens
cuguaaggcacuaagcauaugu

SEQ ID NO: 270876 - RNA, 17 nt, Homo sapiens
cugugaugaucuugucu

SEQ ID NO: 270877 - RNA, 22 nt, Homo sapiens
cugugcauaucuuggacugugu

SEQ ID NO: 270878 - RNA, 22 nt, Homo sapiens
cugugguguaacucuuggggcg

SEQ ID NO: 270879 - RNA, 19 nt, Homo sapiens
cuuaggugaccaguuccca

SEQ ID NO: 270880 - RNA, 22 nt, Homo sapiens
cuugaauguaaauaauguacag

SEQ ID NO: 270881 - RNA, 22 nt, Homo sapiens
cuugccuaaucugcaugauuuu

SEQ ID NO: 270882 - RNA, 20 nt, Homo sapiens
cuugcuccccuuguucuaga

SEQ ID NO: 270883 - RNA, 22 nt, Homo sapiens
cuuggcauuguguugauagaag

SEQ ID NO: 270884 - RNA, 22 nt, Homo sapiens
cuugucacuguuggcuuuagaa

SEQ ID NO: 270885 - RNA, 18 nt, Homo sapiens
cuuugcagcuuccagagg

SEQ ID NO: 270886 - RNA, 19 nt, Homo sapiens
cuuugguugagcguguugg

SEQ ID NO: 270887 - RNA, 22 nt, Homo sapiens
cuuuguguaggugccucuggcu

SEQ ID NO: 270888 - RNA, 22 nt, Homo sapiens
cuuuuggugugaagaagcucuu

SEQ ID NO: 270889 - RNA, 22 nt, Homo sapiens
gaaagguaggaacagggugcag

SEQ ID NO: 270890 - RNA, 22 nt, Homo sapiens
gaacuguuucuggugaaagagu

SEQ ID NO: 270891 - RNA, 18 nt, Homo sapiens
gaagaaguaggcauggca

SEQ ID NO: 270892 - RNA, 22 nt, Homo sapiens
gaagcgaggugauuagcagaca

SEQ ID NO: 270893 - RNA, 22 nt, Homo sapiens
gaagguaguuuauagauguggu

SEQ ID NO: 270894 - RNA, 23 nt, Homo sapiens
gaaguauagcaugcacauggaaa

SEQ ID NO: 270895 - RNA, 22 nt, Homo sapiens
gacuggccuauaauggcgaauu

SEQ ID NO: 270896 - RNA, 22 nt, Homo sapiens
gacuucaucauacuaugugugg

SEQ ID NO: 270897 - RNA, 22 nt, Homo sapiens
gagaacagaagcauuccuaauu

SEQ ID NO: 270898 - RNA, 22 nt, Homo sapiens
gagacggagucucgcucugucg

SEQ ID NO: 270899 - RNA, 22 nt, Homo sapiens
gagacggagucuugcucuguug

SEQ ID NO: 270900 - RNA, 22 nt, Homo sapiens
gagacugagucuugcccuguca

SEQ ID NO: 270901 - RNA, 22 nt, Homo sapiens
gagacugagucuugcuuuguca

SEQ ID NO: 270902 - RNA, 22 nt, Homo sapiens
gagagcaugugcuggcaucagu

SEQ ID NO: 270903 - RNA, 22 nt, Homo sapiens
gagagugcuuuggguguaggcc

SEQ ID NO: 270904 - RNA, 22 nt, Homo sapiens
gagauggagucuuuuucuguca

SEQ ID NO: 270905 - RNA, 22 nt, Homo sapiens
gagauggaguuucacuucgcuc

SEQ ID NO: 270906 - RNA, 22 nt, Homo sapiens
gagaugucuauuucagagaugu

SEQ ID NO: 270907 - RNA, 22 nt, Homo sapiens
gagcaacaguggcagugguggg

SEQ ID NO: 270908 - RNA, 22 nt, Homo sapiens
gagcacccuuuguugauugcaa

SEQ ID NO: 270909 - RNA, 22 nt, Homo sapiens
gagcagacaugaggaccgcugg

SEQ ID NO: 270910 - RNA, 22 nt, Homo sapiens
gagcuguuuuucacuagaccaa

SEQ ID NO: 270911 - RNA, 22 nt, Homo sapiens
gaggcuagauggggaugugucc

SEQ ID NO: 270912 - RNA, 22 nt, Homo sapiens
gagguaugauugacauauaaaa

SEQ ID NO: 270913 - RNA, 22 nt, Homo sapiens
guguaugugagaaugcucaugu

SEQ ID NO: 270914 - RNA, 22 nt, Homo sapiens
guguucauggaauuugcaauug

SEQ ID NO: 270915 - RNA, 22 nt, Homo sapiens
guguuugguugauagagccacu

SEQ ID NO: 270916 - RNA, 22 nt, Homo sapiens
guucagcaggggcuucaauggu

SEQ ID NO: 270917 - RNA, 22 nt, Homo sapiens
guucccaguugaaaugauuagu

SEQ ID NO: 270918 - RNA, 22 nt, Homo sapiens
guugagcaagcuuuggagccua

SEQ ID NO: 270919 - RNA, 17 nt, Homo sapiens
uaaagccagucaaguca

SEQ ID NO: 270920 - RNA, 22 nt, Homo sapiens
uaaagccauugucaaguuugua

SEQ ID NO: 270921 - RNA, 22 nt, Homo sapiens
uaacuaguggaauuugauuuca

SEQ ID NO: 270922 - RNA, 22 nt, Homo sapiens
uaagacacuuaaaauguuacau

SEQ ID NO: 270923 - RNA, 22 nt, Homo sapiens
uaagcucauuccagccaugucc

SEQ ID NO: 270924 - RNA, 20 nt, Homo sapiens
uaaggcacugugcuuuuagg

SEQ ID NO: 270925 - RNA, 22 nt, Homo sapiens
uaaguacugucagaauuggacu

SEQ ID NO: 270926 - RNA, 22 nt, Homo sapiens
uaaugcaucaugguuggcaaac

SEQ ID NO: 270927 - RNA, 19 nt, Homo sapiens
uacaggacugagcugaggu

SEQ ID NO: 270928 - RNA, 22 nt, Homo sapiens
uacaggacuucucagaguuauu

SEQ ID NO: 270929 - RNA, 22 nt, Homo sapiens
uacagucauaaugccuagugac

SEQ ID NO: 270930 - RNA, 22 nt, Homo sapiens
uaccugagacaacuuugaggaa

SEQ ID NO: 270931 - RNA, 22 nt, Homo sapiens
uagaaagcaugaccuucagaua

SEQ ID NO: 270932 - RNA, 23 nt, Homo sapiens
uagaauguuuuuccauguuucuu

SEQ ID NO: 270933 - RNA, 22 nt, Homo sapiens
uagagaucuuauauuuuaugac

SEQ ID NO: 270934 - RNA, 22 nt, Homo sapiens
uagagguagguguaugaacuag

SEQ ID NO: 270935 - RNA, 23 nt, Homo sapiens
uagcaacaguuggaggugaggua

SEQ ID NO: 270936 - RNA, 17 nt, Homo sapiens
uagcacagugccuggua

SEQ ID NO: 270937 - RNA, 22 nt, Homo sapiens
uagcagaauauaccucuuacuu

SEQ ID NO: 270938 - RNA, 20 nt, Homo sapiens
uagcagcagacagagggagg

SEQ ID NO: 270939 - RNA, 22 nt, Homo sapiens
uagcccagugagguugauuugg

SEQ ID NO: 270940 - RNA, 22 nt, Homo sapiens
uagcugagacuacaguaggugc

SEQ ID NO: 270941 - RNA, 22 nt, Homo sapiens
uaggcuuuucugggaugugggc

SEQ ID NO: 270942 - RNA, 22 nt, Homo sapiens
uaggucuuuuagcauaggagcu

SEQ ID NO: 270943 - RNA, 22 nt, Homo sapiens
uagucaaaucugaaggaaauuu

SEQ ID NO: 270944 - RNA, 22 nt, Homo sapiens
uagugcugagauugagaagccc

SEQ ID NO: 270945 - RNA, 22 nt, Homo sapiens
uagugcuguaauucuaaugaaa

SEQ ID NO: 270946 - RNA, 22 nt, Homo sapiens
uagugguaguagcaguaauauu

SEQ ID NO: 270947 - RNA, 23 nt, Homo sapiens
uaucacacuuucucugugccaca

SEQ ID NO: 270948 - RNA, 21 nt, Homo sapiens
uaucacauuggugauuaaguu

SEQ ID NO: 270949 - RNA, 22 nt, Homo sapiens
uaucagcagcaggggcugcaga

SEQ ID NO: 270950 - RNA, 22 nt, Homo sapiens
uaucaucauguuuuugcugugu

SEQ ID NO: 270951 - RNA, 21 nt, Homo sapiens
uauccacuugcaacagagaag

SEQ ID NO: 270952 - RNA, 21 nt, Homo sapiens
uaucucaguuuuccuuugugg

SEQ ID NO: 270953 - RNA, 22 nt, Homo sapiens
uaugagagcugguagguagaga

SEQ ID NO: 270954 - RNA, 19 nt, Homo sapiens
uaugcuauuuauuagaagu

SEQ ID NO: 270955 - RNA, 22 nt, Homo sapiens
uauggauguuaagguucacagc

SEQ ID NO: 270956 - RNA, 22 nt, Homo sapiens
uauggauuugccuauucuguau

SEQ ID NO: 270957 - RNA, 22 nt, Homo sapiens
uauggcauuauuuugauagaca

SEQ ID NO: 270958 - RNA, 22 nt, Homo sapiens
uauggccccuacaugugcaaaa

SEQ ID NO: 270959 - RNA, 22 nt, Homo sapiens
uauggcuacuacgaauaaugcu

SEQ ID NO: 270960 - RNA, 22 nt, Homo sapiens
uauggguuuuucauaaauaggu

SEQ ID NO: 270961 - RNA, 22 nt, Homo sapiens
uauuacugucaauaucacagaa

SEQ ID NO: 270962 - RNA, 22 nt, Homo sapiens
uauucacuguaucauugauggg

SEQ ID NO: 270963 - RNA, 22 nt, Homo sapiens
uauugacuugagaagggauuag

SEQ ID NO: 270964 - RNA, 22 nt, Homo sapiens
ucaaaugauucuccugccucag

SEQ ID NO: 270965 - RNA, 22 nt, Homo sapiens
ucaaauuccaagucuagguagg

SEQ ID NO: 270966 - RNA, 22 nt, Homo sapiens
ucaaggcacuagcugagcugca

SEQ ID NO: 270967 - RNA, 22 nt, Homo sapiens
ucacagacugagccaaauagag

SEQ ID NO: 270968 - RNA, 22 nt, Homo sapiens
ucacagaggagaagaccuuuaa

SEQ ID NO: 270969 - RNA, 18 nt, Homo sapiens
ucacagguaauuaggauu

SEQ ID NO: 270970 - RNA, 22 nt, Homo sapiens
ucacagugcaggaucaguuaau

SEQ ID NO: 270971 - RNA, 22 nt, Homo sapiens
ucacaguguuaaaccuuucuuu

SEQ ID NO: 270972 - RNA, 22 nt, Homo sapiens
ucacauguguaugagcuuugau

SEQ ID NO: 270973 - RNA, 22 nt, Homo sapiens
ucacauuguguagccugcucac

SEQ ID NO: 270974 - RNA, 22 nt, Homo sapiens
ucaccaguaauaaagagccugc

SEQ ID NO: 270975 - RNA, 22 nt, Homo sapiens
ucacccugacaugcggccgaac

SEQ ID NO: 270976 - RNA, 22 nt, Homo sapiens
ucacugcacuccagccuuuaug

SEQ ID NO: 270977 - RNA, 22 nt, Homo sapiens
ucacugcacucuccgccuugcg

SEQ ID NO: 270978 - RNA, 22 nt, Homo sapiens
ucagcaaugaccuaagcaaaua

SEQ ID NO: 270979 - RNA, 21 nt, Homo sapiens
ucagcucaucacugccuggag

SEQ ID NO: 270980 - RNA, 22 nt, Homo sapiens
ucagucauugauggaguagguc

SEQ ID NO: 270981 - RNA, 22 nt, Homo sapiens
ucagugccauugccauaugagu

SEQ ID NO: 270982 - RNA, 22 nt, Homo sapiens
ucagugccucaguuuuuaaaga

SEQ ID NO: 270983 - RNA, 21 nt, Homo sapiens
ucauauguaucuuugugccuc

SEQ ID NO: 270984 - RNA, 22 nt, Homo sapiens
ucagagcaaagacacuuuauca

SEQ ID NO: 270985 - RNA, 22 nt, Homo sapiens
ucagagucuagaucacucacug

SEQ ID NO: 270986 - RNA, 21 nt, Homo sapiens
ucagugcugugggcaaggugc

SEQ ID NO: 270987 - RNA, 22 nt, Homo sapiens
ucagugcuuggcacagagagcu

SEQ ID NO: 270988 - RNA, 22 nt, Homo sapiens
ucagugguuaaaagauucuaga

SEQ ID NO: 270989 - RNA, 22 nt, Homo sapiens
ucaugagacacacuggaaagga

SEQ ID NO: 270990 - RNA, 23 nt, Homo sapiens
ucaugaggccauucaaauccauu

SEQ ID NO: 270991 - RNA, 22 nt, Homo sapiens
ucaugggagcccccaucaugag

SEQ ID NO: 270992 - RNA, 22 nt, Homo sapiens
uccagugcauucagacacuugg

SEQ ID NO: 270993 - RNA, 22 nt, Homo sapiens
uccaguguuauaauaugcgucu

SEQ ID NO: 270994 - RNA, 22 nt, Homo sapiens
uccaguguuccucagucacccc

SEQ ID NO: 270995 - RNA, 22 nt, Homo sapiens
uccaguguuucuuccacuauuu

SEQ ID NO: 270996 - RNA, 22 nt, Homo sapiens
uccaugagaauaguuaggcucu

SEQ ID NO: 270997 - RNA, 19 nt, Homo sapiens
uccaugagcccacagugau

SEQ ID NO: 270998 - RNA, 22 nt, Homo sapiens
uccaugugaaaucuaugaggac

SEQ ID NO: 270999 - RNA, 17 nt, Homo sapiens
ucccauguuucuucuac

SEQ ID NO: 271000 - RNA, 22 nt, Homo sapiens
uccccugagaccccucagcacu

SEQ ID NO: 271001 - RNA, 22 nt, Homo sapiens
ucccugacagggucugagcuuu

SEQ ID NO: 271002 - RNA, 22 nt, Homo sapiens
uccucauggagaaccucugcua

SEQ ID NO: 271003 - RNA, 22 nt, Homo sapiens
uccugcauucauccugguguug

SEQ ID NO: 271004 - RNA, 22 nt, Homo sapiens
uccuucaugcaucaauguaucc

SEQ ID NO: 271005 - RNA, 22 nt, Homo sapiens
uccuucauuugucaacucuagu

SEQ ID NO: 271006 - RNA, 22 nt, Homo sapiens
uccuuuaguuaauaaagacaag

SEQ ID NO: 271007 - RNA, 20 nt, Homo sapiens
ucgcaccacuauacuccagc

SEQ ID NO: 271008 - RNA, 22 nt, Homo sapiens
aaucacacuugauguugagcaa

SEQ ID NO: 271009 - RNA, 22 nt, Homo sapiens
aaucacaguguucuugugaggg

SEQ ID NO: 271010 - RNA, 22 nt, Homo sapiens
aaucagcacacugugcuuucca

SEQ ID NO: 271011 - RNA, 22 nt, Homo sapiens
aaucucagagauaucugugucc

SEQ ID NO: 271012 - RNA, 22 nt, Homo sapiens
aaucucagcauuuugggcugag

SEQ ID NO: 271013 - RNA, 22 nt, Homo sapiens
aauucacuuguggcagauccuu

SEQ ID NO: 271014 - RNA, 22 nt, Homo sapiens
aauugcauaugcaguagaucua

SEQ ID NO: 271015 - RNA, 22 nt, Homo sapiens
aauugguuaagauaagaucaua

SEQ ID NO: 271016 - RNA, 22 nt, Homo sapiens
acacaaugguaaguguuugugu

SEQ ID NO: 271017 - RNA, 22 nt, Homo sapiens
acacagugucuguguauuuaaa

SEQ ID NO: 271018 - RNA, 22 nt, Homo sapiens
acacaguguuuauugugguuag

SEQ ID NO: 271019 - RNA, 22 nt, Homo sapiens
acacaugugaaaaaaauguuac

SEQ ID NO: 271020 - RNA, 20 nt, Homo sapiens
acacugugcuaaggauuuuc

SEQ ID NO: 271021 - RNA, 22 nt, Homo sapiens
acagagcaaugagcuacggucu

SEQ ID NO: 271022 - RNA, 22 nt, Homo sapiens
acagcagugccccacucuacug

SEQ ID NO: 271023 - RNA, 22 nt, Homo sapiens
acagugcuucugauaugaugcc

SEQ ID NO: 271024 - RNA, 22 nt, Homo sapiens
accauugcacuccagccugggc

SEQ ID NO: 271025 - RNA, 22 nt, Homo sapiens
acccugcuaaacagcccccugc

SEQ ID NO: 271026 - RNA, 22 nt, Homo sapiens
acccugguagcuaugaagucuu

SEQ ID NO: 271027 - RNA, 22 nt, Homo sapiens
acucagagauuagcacauguuu

SEQ ID NO: 271028 - RNA, 22 nt, Homo sapiens
acugaauguaaacacggagugu

SEQ ID NO: 271029 - RNA, 22 nt, Homo sapiens
acugagccuuuaaaugacuuca

SEQ ID NO: 271030 - RNA, 22 nt, Homo sapiens
acugcacuccaaccuguugggc

SEQ ID NO: 271031 - RNA, 22 nt, Homo sapiens
acugcacuccagccucgcaaca

SEQ ID NO: 271032 - RNA, 22 nt, Homo sapiens
acugcacuccagccucggcaau

SEQ ID NO: 271033 - RNA, 22 nt, Homo sapiens
acugcacuccagccucguggac

SEQ ID NO: 271034 - RNA, 22 nt, Homo sapiens
acugcacuccagccugaugaaa

SEQ ID NO: 271035 - RNA, 22 nt, Homo sapiens
acugcacuccagccugcugggu

SEQ ID NO: 271036 - RNA, 22 nt, Homo sapiens
acugcacuccagccuggacgac

SEQ ID NO: 271037 - RNA, 22 nt, Homo sapiens
acugcacuccagccugugagac

SEQ ID NO: 271038 - RNA, 22 nt, Homo sapiens
acugcacuccagccuuagugac

SEQ ID NO: 271039 - RNA, 22 nt, Homo sapiens
acugcacucccgcccgggugac

SEQ ID NO: 271040 - RNA, 22 nt, Homo sapiens
acugcacucuagccuuggcaac

SEQ ID NO: 271041 - RNA, 22 nt, Homo sapiens
acugcacuuauccuccaauguu

SEQ ID NO: 271042 - RNA, 22 nt, Homo sapiens
acugcacuucaaccucauugac

SEQ ID NO: 271043 - RNA, 22 nt, Homo sapiens
acuggcaauggcagaaauaguu

SEQ ID NO: 271044 - RNA, 23 nt, Homo sapiens
agaaaugucuauucagggucccu

SEQ ID NO: 271045 - RNA, 22 nt, Homo sapiens
agaaccauuagagggagauauu

SEQ ID NO: 271046 - RNA, 22 nt, Homo sapiens
agaaugugaacaucuugaaagu

SEQ ID NO: 271047 - RNA, 22 nt, Homo sapiens
agacuagacagaugaacagcac

SEQ ID NO: 271048 - RNA, 19 nt, Homo sapiens
agagacucauuguagcauu

SEQ ID NO: 271049 - RNA, 22 nt, Homo sapiens
agagagguggguggagccccca

SEQ ID NO: 271050 - RNA, 22 nt, Homo sapiens
agagcaaugggugaauauuaaa

SEQ ID NO: 271051 - RNA, 22 nt, Homo sapiens
agagcaauguuaucagucucug

SEQ ID NO: 271052 - RNA, 22 nt, Homo sapiens
agaggaguacuacuccaagucu

SEQ ID NO: 271053 - RNA, 19 nt, Homo sapiens
agaguauuguuacuucucu

SEQ ID NO: 271054 - RNA, 22 nt, Homo sapiens
aaacaccacgcggucccucgga

SEQ ID NO: 271055 - RNA, 18 nt, Homo sapiens
aaacagugucucuuucug

SEQ ID NO: 271056 - RNA, 22 nt, Homo sapiens
aaacauugaccucauccuggca

SEQ ID NO: 271057 - RNA, 22 nt, Homo sapiens
aaacucuguagcagagacagau

SEQ ID NO: 271058 - RNA, 22 nt, Homo sapiens
aaacugaucugaaggccaggcu

SEQ ID NO: 271059 - RNA, 22 nt, Homo sapiens
aaagagcugagaccugguggag

SEQ ID NO: 271060 - RNA, 19 nt, Homo sapiens
aaagguaguaaccucugau

SEQ ID NO: 271061 - RNA, 22 nt, Homo sapiens
aaaguaguagcaguuucugcca

SEQ ID NO: 271062 - RNA, 22 nt, Homo sapiens
aaagugccuucuauuuuaguga

SEQ ID NO: 271063 - RNA, 22 nt, Homo sapiens
aaagugguuuuucagacuuuga

SEQ ID NO: 271064 - RNA, 22 nt, Homo sapiens
aaaugcaccacucuggugcagg

SEQ ID NO: 271065 - RNA, 22 nt, Homo sapiens
aaaugcugcuuuggccucuucu

SEQ ID NO: 271066 - RNA, 22 nt, Homo sapiens
aaauggcaccggcucuucccuc

SEQ ID NO: 271067 - RNA, 22 nt, Homo sapiens
aaaugguguuaguagaucuuua

SEQ ID NO: 271068 - RNA, 22 nt, Homo sapiens
aacaggguguuugcaguuucuu

SEQ ID NO: 271069 - RNA, 22 nt, Homo sapiens
aacuugcacuugauugagagcu

SEQ ID NO: 271070 - RNA, 22 nt, Homo sapiens
aagagaacugacaguaccuggg

SEQ ID NO: 271071 - RNA, 22 nt, Homo sapiens
aagagguaauaacaaagcuucu

SEQ ID NO: 271072 - RNA, 22 nt, Homo sapiens
aagaguuaguaaaauuuccucu

SEQ ID NO: 271073 - RNA, 22 nt, Homo sapiens
aagcaaacaucagcuugguuaa

SEQ ID NO: 271074 - RNA, 21 nt, Homo sapiens
aagcacauugaguguguguga

SEQ ID NO: 271075 - RNA, 22 nt, Homo sapiens
aagcuggauuuaguguggagca

SEQ ID NO: 271076 - RNA, 22 nt, Homo sapiens
aaggaguaucuguuuucucacc

SEQ ID NO: 271077 - RNA, 22 nt, Homo sapiens
aaggcaacgugaguuguugauu

SEQ ID NO: 271078 - RNA, 22 nt, Homo sapiens
aaggcauggugacuauuuaggc

SEQ ID NO: 271079 - RNA, 22 nt, Homo sapiens
aaguagcagaggcaagacuuga

SEQ ID NO: 271080 - RNA, 23 nt, Homo sapiens
aagucauggaaucaaaugaggug

SEQ ID NO: 271081 - RNA, 22 nt, Homo sapiens
aaguggaauguuuguggcacaa

SEQ ID NO: 271082 - RNA, 17 nt, Homo sapiens
aaguggcuuguucacca

SEQ ID NO: 271083 - RNA, 23 nt, Homo sapiens
aaguucaugcucaucuguuacac

SEQ ID NO: 271084 - RNA, 22 nt, Homo sapiens
aaguugcuuuagguaagucaau

SEQ ID NO: 271085 - RNA, 22 nt, Homo sapiens
aauaaaguaggaggugaggaaa

SEQ ID NO: 271086 - RNA, 22 nt, Homo sapiens
aauaaagucugaagugugcuua

SEQ ID NO: 271087 - RNA, 22 nt, Homo sapiens
aauaagaaguggaagggaccgg

SEQ ID NO: 271088 - RNA, 22 nt, Homo sapiens
aauacucaguccuggugaggcu

SEQ ID NO: 271089 - RNA, 21 nt, Homo sapiens
aauacucuagguuaagagagc

SEQ ID NO: 271090 - RNA, 22 nt, Homo sapiens
aauacugugauaucgagcgauu

SEQ ID NO: 271091 - RNA, 22 nt, Homo sapiens
aaucugguguguggccgggcac

SEQ ID NO: 271092 - RNA, 22 nt, Homo sapiens
aaugacccugauuggcaaguug

SEQ ID NO: 271093 - RNA, 22 nt, Homo sapiens
aauggcacaagacaugaagaag

SEQ ID NO: 271094 - RNA, 22 nt, Homo sapiens
aauugcacuacugcacucccac

SEQ ID NO: 271095 - RNA, 22 nt, Homo sapiens
aauugcauaaaauucaacucug

SEQ ID NO: 271096 - RNA, 21 nt, Homo sapiens
acaaagcuggagggagacugc

SEQ ID NO: 271097 - RNA, 22 nt, Homo sapiens
acacauacacauaugguguaua

SEQ ID NO: 271098 - RNA, 22 nt, Homo sapiens
acacuugcuugcaauagccucc

SEQ ID NO: 271099 - RNA, 21 nt, Homo sapiens
auaugugcuguggaagucagc

SEQ ID NO: 271100 - RNA, 22 nt, Homo sapiens
aucccgagacuuugcugaaguu

SEQ ID NO: 271101 - RNA, 22 nt, Homo sapiens
auccugagacuuugcugaaguu

SEQ ID NO: 271102 - RNA, 22 nt, Homo sapiens
aucgcgccauuguacuccagcc

SEQ ID NO: 271103 - RNA, 22 nt, Homo sapiens
aucuacuugcugggucucugga

SEQ ID NO: 271104 - RNA, 22 nt, Homo sapiens
aucugcacaucuguguuuuugu

SEQ ID NO: 271105 - RNA, 22 nt, Homo sapiens
aucugguguuuccuucacauug

SEQ ID NO: 271106 - RNA, 22 nt, Homo sapiens
aucugugguuguaugcauauua

SEQ ID NO: 271107 - RNA, 22 nt, Homo sapiens
aucuguguuuaaggucccagaa

SEQ ID NO: 271108 - RNA, 22 nt, Homo sapiens
augaaaucuuuggcagaucuua

SEQ ID NO: 271109 - RNA, 22 nt, Homo sapiens
augaauuuucugauguugggua

SEQ ID NO: 271110 - RNA, 22 nt, Homo sapiens
augacaagaguguucagggaga

SEQ ID NO: 271111 - RNA, 22 nt, Homo sapiens
augacagugagugagcucucac

SEQ ID NO: 271112 - RNA, 22 nt, Homo sapiens
augagaacugucaaugagagcu

SEQ ID NO: 271113 - RNA, 22 nt, Homo sapiens
augagauauuuuauaagaucau

SEQ ID NO: 271114 - RNA, 22 nt, Homo sapiens
augagaugauaggcguucuaac

SEQ ID NO: 271115 - RNA, 22 nt, Homo sapiens
augagcugauuuccuuaccaua

SEQ ID NO: 271116 - RNA, 22 nt, Homo sapiens
augaggaaggagccuuugucug

SEQ ID NO: 271117 - RNA, 22 nt, Homo sapiens
augaggaagucaggcccagggg

SEQ ID NO: 271118 - RNA, 22 nt, Homo sapiens
augagggagggcaccugaccuu

SEQ ID NO: 271119 - RNA, 22 nt, Homo sapiens
augagggagggguggugccgca

SEQ ID NO: 271120 - RNA, 22 nt, Homo sapiens
augauauggucacccuuaugaa

SEQ ID NO: 271121 - RNA, 20 nt, Homo sapiens
augcaaacccugcuuugugg

SEQ ID NO: 271122 - RNA, 22 nt, Homo sapiens
augcagaucacauuuuucuguc

SEQ ID NO: 271123 - RNA, 22 nt, Homo sapiens
augcauaugucuuuauaguggc

SEQ ID NO: 271124 - RNA, 22 nt, Homo sapiens
augcauauuccugggccucacu

SEQ ID NO: 271125 - RNA, 19 nt, Homo sapiens
augccacagugaggucaga

SEQ ID NO: 271126 - RNA, 20 nt, Homo sapiens
augccacugagcagugguga

SEQ ID NO: 271127 - RNA, 22 nt, Homo sapiens
augccacuguacucuagccuag

SEQ ID NO: 271128 - RNA, 22 nt, Homo sapiens
augccacuguuuaugucacuua

SEQ ID NO: 271129 - RNA, 22 nt, Homo sapiens
augccucugacaauuggauucu

SEQ ID NO: 271130 - RNA, 19 nt, Homo sapiens
auggaacugcuggagccac

SEQ ID NO: 271131 - RNA, 21 nt, Homo sapiens
auggacugugugacccugcac

SEQ ID NO: 271132 - RNA, 22 nt, Homo sapiens
auggaucuuucugcuuuugaau

SEQ ID NO: 271133 - RNA, 22 nt, Homo sapiens
auggcaagaagagcaauuauuu

SEQ ID NO: 271134 - RNA, 22 nt, Homo sapiens
auggcauugaagaguugucccu

SEQ ID NO: 271135 - RNA, 22 nt, Homo sapiens
auggcccaguuugcuaucccua

SEQ ID NO: 271136 - RNA, 22 nt, Homo sapiens
augguauggaaggucuggagga

SEQ ID NO: 271137 - RNA, 22 nt, Homo sapiens
auggucccuguuccaugcuccu

SEQ ID NO: 271138 - RNA, 22 nt, Homo sapiens
auguaauugagguuuuugccau

SEQ ID NO: 271139 - RNA, 22 nt, Homo sapiens
augugacagugguuuuaagcgu

SEQ ID NO: 271140 - RNA, 22 nt, Homo sapiens
augugcaauggugucaccacau

SEQ ID NO: 271141 - RNA, 22 nt, Homo sapiens
augugcauaugaagcacagaca

SEQ ID NO: 271142 - RNA, 22 nt, Homo sapiens
augugucaaaucuaggccaaag

SEQ ID NO: 271143 - RNA, 22 nt, Homo sapiens
auguguucaucacagcacaauu

SEQ ID NO: 271144 - RNA, 22 nt, Homo sapiens
auuccacuuauaugagguaucu

SEQ ID NO: 271145 - RNA, 22 nt, Homo sapiens
auuccagauggaguugaggguu

SEQ ID NO: 271146 - RNA, 22 nt, Homo sapiens
auugaacuguuggagagguuuu

SEQ ID NO: 271147 - RNA, 22 nt, Homo sapiens
auugaguaaaugaaaauugccu

SEQ ID NO: 271148 - RNA, 22 nt, Homo sapiens
auugcacuccagccugggcaac

SEQ ID NO: 271149 - RNA, 22 nt, Homo sapiens
auugcacuccauccugggcaau

SEQ ID NO: 271150 - RNA, 23 nt, Homo sapiens
auugcagaaucacagagguagug

SEQ ID NO: 271151 - RNA, 22 nt, Homo sapiens
auuguucuuguguccuuuuccu

SEQ ID NO: 271152 - RNA, 22 nt, Homo sapiens
auuuggcaauuuugaagaugcc

SEQ ID NO: 271153 - RNA, 22 nt, Homo sapiens
caaauugcuugucuguagugga

SEQ ID NO: 271154 - RNA, 22 nt, Homo sapiens
caacacuguuuauuggauagcc

SEQ ID NO: 271155 - RNA, 21 nt, Homo sapiens
caagugaugcuucugcuuuaa

SEQ ID NO: 271156 - RNA, 21 nt, Homo sapiens
caauggcacaaucucugcuca

SEQ ID NO: 271157 - RNA, 21 nt, Homo sapiens
caauggcacgaucuuggcuca

SEQ ID NO: 271158 - RNA, 22 nt, Homo sapiens
cacaccuaccucauuauggaca

SEQ ID NO: 271159 - RNA, 22 nt, Homo sapiens
cacucaguuugugguacuuugu

SEQ ID NO: 271160 - RNA, 22 nt, Homo sapiens
cacugcaguaaauugcgucggu

SEQ ID NO: 271161 - RNA, 22 nt, Homo sapiens
cacugcaguguaauuaagguug

SEQ ID NO: 271162 - RNA, 22 nt, Homo sapiens
cacugcauccuccaccugccag

SEQ ID NO: 271163 - RNA, 22 nt, Homo sapiens
cacuggacauguugaagcuuuu

SEQ ID NO: 271164 - RNA, 21 nt, Homo sapiens
cagagaucaucucuguuuuaa

SEQ ID NO: 271165 - RNA, 22 nt, Homo sapiens
cagagaucaugcaacugcucgc

SEQ ID NO: 271166 - RNA, 20 nt, Homo sapiens
cagagcaaagcaguccuggc

SEQ ID NO: 271167 - RNA, 22 nt, Homo sapiens
cagagugcauguuuagaugagu

SEQ ID NO: 271168 - RNA, 22 nt, Homo sapiens
cagaugcaugaccugggcuugg

SEQ ID NO: 271169 - RNA, 22 nt, Homo sapiens
cagccggguggcuccuagggua

SEQ ID NO: 271170 - RNA, 22 nt, Homo sapiens
cagcugguggcaagaagacaga

SEQ ID NO: 271171 - RNA, 22 nt, Homo sapiens
caggcauuguccaugcugaagg

SEQ ID NO: 271172 - RNA, 22 nt, Homo sapiens
cagguaagaugcuuucucuuau

SEQ ID NO: 271173 - RNA, 19 nt, Homo sapiens
cagguagugugcugacaug

SEQ ID NO: 271174 - RNA, 22 nt, Homo sapiens
caggugaaugccucuccuucug

SEQ ID NO: 271175 - RNA, 22 nt, Homo sapiens
cauagcacugcacuucagccug

SEQ ID NO: 271176 - RNA, 22 nt, Homo sapiens
caucaaaguggagggaaggacc

SEQ ID NO: 271177 - RNA, 21 nt, Homo sapiens
caucacauuacucaaaguccu

SEQ ID NO: 271178 - RNA, 22 nt, Homo sapiens
caucacauucugagauacugag

SEQ ID NO: 271179 - RNA, 22 nt, Homo sapiens
caugcagcacacaugucugugc

SEQ ID NO: 271180 - RNA, 19 nt, Homo sapiens
caugccacugcacuugagu

SEQ ID NO: 271181 - RNA, 22 nt, Homo sapiens
cauggcacugagcagguaugca

SEQ ID NO: 271182 - RNA, 22 nt, Homo sapiens
cauggcccuggguccauaggaa

SEQ ID NO: 271183 - RNA, 22 nt, Homo sapiens
uuugagcauggaaauggcauga

SEQ ID NO: 271184 - RNA, 22 nt, Homo sapiens
uuugaguaggcuuauauuuugg

SEQ ID NO: 271185 - RNA, 22 nt, Homo sapiens
uuugcaagaugaaaaaguucua

SEQ ID NO: 271186 - RNA, 22 nt, Homo sapiens
uuugcugagucugacuucaugg

SEQ ID NO: 271187 - RNA, 22 nt, Homo sapiens
uuuggaaugugcacucagauug

SEQ ID NO: 271188 - RNA, 22 nt, Homo sapiens
uuuggcagaugacccucaaguu

SEQ ID NO: 271189 - RNA, 22 nt, Homo sapiens
uuuggcaugggcuauuugcuuu

SEQ ID NO: 271190 - RNA, 22 nt, Homo sapiens
uuuggcuuuuguaauaacugcc

SEQ ID NO: 271191 - RNA, 22 nt, Homo sapiens
uuugggacuguauuaaaugccu

SEQ ID NO: 271192 - RNA, 22 nt, Homo sapiens
uuuggucuuuuguaaguuaucu

SEQ ID NO: 271193 - RNA, 22 nt, Homo sapiens
uuugguguauaaaaaugcuagu

SEQ ID NO: 271194 - RNA, 22 nt, Homo sapiens
uuuguguggccuuggccuggca

SEQ ID NO: 271195 - RNA, 22 nt, Homo sapiens
uuuugggggugauucacacagu

SEQ ID NO: 271196 - RNA, 22 nt, Homo sapiens
uuuugguguacaauucuaugga

SEQ ID NO: 271197 - RNA, 22 nt, Homo sapiens
uuuuugaguaaauauaaauugu

SEQ ID NO: 271198 - RNA, 22 nt, Homo sapiens
uuuuuuaguuagcugggcauga

SEQ ID NO: 271199 - RNA, 22 nt, Homo sapiens
ugacaagugauuaaggcauauu

SEQ ID NO: 271200 - RNA, 23 nt, Homo sapiens
ugacagaccuucuggaagaaguc

SEQ ID NO: 271201 - RNA, 22 nt, Homo sapiens
ugacauugggagugaagugaag

SEQ ID NO: 271202 - RNA, 22 nt, Homo sapiens
ugacuugaacuucuaugucacc

SEQ ID NO: 271203 - RNA, 22 nt, Homo sapiens
ugacuugaguaacuggcucagg

SEQ ID NO: 271204 - RNA, 22 nt, Homo sapiens
ugagaacauggagaacccccca

SEQ ID NO: 271205 - RNA, 16 nt, Homo sapiens
ugagaacaugggguau

SEQ ID NO: 271206 - RNA, 16 nt, Homo sapiens
ugagaacaugugacau

SEQ ID NO: 271207 - RNA, 22 nt, Homo sapiens
ugagaacaugugauauuuggug

SEQ ID NO: 271208 - RNA, 22 nt, Homo sapiens
ugagaacucaugaaucuuucca

SEQ ID NO: 271209 - RNA, 22 nt, Homo sapiens
ugagaacuuauggugauuuuuu

SEQ ID NO: 271210 - RNA, 22 nt, Homo sapiens
ugagaagacaucuuugcuuugu

SEQ ID NO: 271211 - RNA, 22 nt, Homo sapiens
ugagaagaugaacuccuugguc

SEQ ID NO: 271212 - RNA, 22 nt, Homo sapiens
ugagaaugcagaaucucgugca

SEQ ID NO: 271213 - RNA, 22 nt, Homo sapiens
ugagacggagucucgcucuguc

SEQ ID NO: 271214 - RNA, 22 nt, Homo sapiens
ugagacugagucuugcucuugu

SEQ ID NO: 271215 - RNA, 22 nt, Homo sapiens
ugagacugaguuuugcucuugu

SEQ ID NO: 271216 - RNA, 22 nt, Homo sapiens
ugagagacaguuuguuaaaauu

SEQ ID NO: 271217 - RNA, 22 nt, Homo sapiens
ugagauagggucucacucuguc

SEQ ID NO: 271218 - RNA, 22 nt, Homo sapiens
ugagaucacgccacugcacucc

SEQ ID NO: 271219 - RNA, 22 nt, Homo sapiens
ugagaugaggucucgcucuguc

SEQ ID NO: 271220 - RNA, 22 nt, Homo sapiens
ugagauggaguuucgcuuuugu

SEQ ID NO: 271221 - RNA, 22 nt, Homo sapiens
ugagauggguucugguccccug

SEQ ID NO: 271222 - RNA, 22 nt, Homo sapiens
ugagauguuuagauuguugucu

SEQ ID NO: 271223 - RNA, 22 nt, Homo sapiens
ugagcacagcgugugggagagc

SEQ ID NO: 271224 - RNA, 22 nt, Homo sapiens
ugagcagaaagcugcaaggucg

SEQ ID NO: 271225 - RNA, 22 nt, Homo sapiens
ugagcagagaagugcccugcgc

SEQ ID NO: 271226 - RNA, 22 nt, Homo sapiens
ugagcagugaguguggugcagg

SEQ ID NO: 271227 - RNA, 20 nt, Homo sapiens
ugagcucaauuguugcaagu

SEQ ID NO: 271228 - RNA, 22 nt, Homo sapiens
ugagcugagaucuuaccacugc

SEQ ID NO: 271229 - RNA, 22 nt, Homo sapiens
ugaggaaugaccccgugugguc

SEQ ID NO: 271230 - RNA, 22 nt, Homo sapiens
ugaggaauguguguuaaagaua

SEQ ID NO: 271231 - RNA, 22 nt, Homo sapiens
ugaggaucucuaggaauuuauc

SEQ ID NO: 271232 - RNA, 22 nt, Homo sapiens
ugagguaacaaacuaugaguua

SEQ ID NO: 271233 - RNA, 22 nt, Homo sapiens
ugagguaggugaagaaugcacg

SEQ ID NO: 271234 - RNA, 22 nt, Homo sapiens
ugagguguuaacuuuacuuuua

SEQ ID NO: 271235 - RNA, 23 nt, Homo sapiens
ugagguguuaagcagacuugucu

SEQ ID NO: 271236 - RNA, 22 nt, Homo sapiens
ugaguagagaauucagcuaagg

SEQ ID NO: 271237 - RNA, 22 nt, Homo sapiens
ugagucuguucucacauugcua

SEQ ID NO: 271238 - RNA, 22 nt, Homo sapiens
ugagugagguucuacucuguga

SEQ ID NO: 271239 - RNA, 22 nt, Homo sapiens
ugauaagugaaagugcucuauc

SEQ ID NO: 271240 - RNA, 22 nt, Homo sapiens
ugauaagugagauagcaaguga

SEQ ID NO: 271241 - RNA, 20 nt, Homo sapiens
ugauaaguugcacuuuccuu

SEQ ID NO: 271242 - RNA, 22 nt, Homo sapiens
ugauaauuuugucagguuuugg

SEQ ID NO: 271243 - RNA, 22 nt, Homo sapiens
ugauaugaaguucaaaccaggu

SEQ ID NO: 271244 - RNA, 22 nt, Homo sapiens
ugaucucauuagcaccuuuagc

SEQ ID NO: 271245 - RNA, 23 nt, Homo sapiens
ugauguccacuuagggucuaggu

SEQ ID NO: 271246 - RNA, 22 nt, Homo sapiens
ugcaaacuuccuugggcagcau

SEQ ID NO: 271247 - RNA, 17 nt, Homo sapiens
ugcaauuuaagcuagau

SEQ ID NO: 271248 - RNA, 22 nt, Homo sapiens
ugcagcucagcugcggaguuuu

SEQ ID NO: 271249 - RNA, 18 nt, Homo sapiens
ugcagcuuugugauuggc

SEQ ID NO: 271250 - RNA, 22 nt, Homo sapiens
ugcauaucuucagccgggcacg

SEQ ID NO: 271251 - RNA, 22 nt, Homo sapiens
ugcauaucuucuuuugagaaau

SEQ ID NO: 271252 - RNA, 22 nt, Homo sapiens
ugcauggaagggagggaaagag

SEQ ID NO: 271253 - RNA, 19 nt, Homo sapiens
ugccaagaaagucagcuua

SEQ ID NO: 271254 - RNA, 22 nt, Homo sapiens
ugcccuguaucccacuguuuca

SEQ ID NO: 271255 - RNA, 22 nt, Homo sapiens
ugccuaggcccaguccucagaa

SEQ ID NO: 271256 - RNA, 22 nt, Homo sapiens
uacugcaguugcagcuugagga

SEQ ID NO: 271257 - RNA, 22 nt, Homo sapiens
uacugcaucuacuuagagccag

SEQ ID NO: 271258 - RNA, 21 nt, Homo sapiens
uagagcaacacacgcccucuc

SEQ ID NO: 271259 - RNA, 22 nt, Homo sapiens
uagaguacucugguaaguucuu

SEQ ID NO: 271260 - RNA, 22 nt, Homo sapiens
uagaucauauucagugcuuacu

SEQ ID NO: 271261 - RNA, 21 nt, Homo sapiens
uagcaaauugcuauuaaggca

SEQ ID NO: 271262 - RNA, 22 nt, Homo sapiens
uagcacuauguuaucacauacu

SEQ ID NO: 271263 - RNA, 22 nt, Homo sapiens
uagcagaauaacuugccagccu

SEQ ID NO: 271264 - RNA, 22 nt, Homo sapiens
uagcagcauaaauggacuaaga

SEQ ID NO: 271265 - RNA, 22 nt, Homo sapiens
uagcagcuuuauugagguaaau

SEQ ID NO: 271266 - RNA, 22 nt, Homo sapiens
uaggugcacaguaaauauaugu

SEQ ID NO: 271267 - RNA, 22 nt, Homo sapiens
uauagcacugcaauauuucccu

SEQ ID NO: 271268 - RNA, 22 nt, Homo sapiens
uauagcagugugagaacagacu

SEQ ID NO: 271269 - RNA, 22 nt, Homo sapiens
uauaguguuuucaaaaguaugu

SEQ ID NO: 271270 - RNA, 23 nt, Homo sapiens
uauaugugucuaggagcuauggu

SEQ ID NO: 271271 - RNA, 22 nt, Homo sapiens
uaucacaggucaggaaccuugu

SEQ ID NO: 271272 - RNA, 22 nt, Homo sapiens
uaucacuuugauaguuuaaaug

SEQ ID NO: 271273 - RNA, 22 nt, Homo sapiens
uaucucagaugagacuuguaac

SEQ ID NO: 271274 - RNA, 22 nt, Homo sapiens
uaucucaguguacaggaugaua

SEQ ID NO: 271275 - RNA, 22 nt, Homo sapiens
uauggcaaugcauaggaaggaa

SEQ ID NO: 271276 - RNA, 22 nt, Homo sapiens
uauggcuaugggaacugggagu

SEQ ID NO: 271277 - RNA, 17 nt, Homo sapiens
uauggcuauguuuagau

SEQ ID NO: 271278 - RNA, 22 nt, Homo sapiens
uauggcucuauuuccuugucua

SEQ ID NO: 271279 - RNA, 17 nt, Homo sapiens
uauguaguacuuauaaa

SEQ ID NO: 271280 - RNA, 22 nt, Homo sapiens
uauuacuguuauuccuaucaaa

SEQ ID NO: 271281 - RNA, 22 nt, Homo sapiens
uauugaauuugagcugucucuu

SEQ ID NO: 271282 - RNA, 22 nt, Homo sapiens
uauugcaauuggggaaacuggg

SEQ ID NO: 271283 - RNA, 22 nt, Homo sapiens
ucaaggcacauuugacauuuuc

SEQ ID NO: 271284 - RNA, 22 nt, Homo sapiens
ucaaggcaguggccuuccuucu

SEQ ID NO: 271285 - RNA, 22 nt, Homo sapiens
ucaauguaucuccaagaauuga

SEQ ID NO: 271286 - RNA, 22 nt, Homo sapiens
ucacagugaguggaguggggug

SEQ ID NO: 271287 - RNA, 22 nt, Homo sapiens
ucacaugaagauuuuaguauac

SEQ ID NO: 271288 - RNA, 22 nt, Homo sapiens
ucacaugaauugucuuguucca

SEQ ID NO: 271289 - RNA, 22 nt, Homo sapiens
ucacauuguauauguaccuauc

SEQ ID NO: 271290 - RNA, 22 nt, Homo sapiens
ucacccuguguuuugcguuugc

SEQ ID NO: 271291 - RNA, 22 nt, Homo sapiens
ucacuggacagaaauaaaggug

SEQ ID NO: 271292 - RNA, 22 nt, Homo sapiens
ucacuggagguuccugaaguuc

SEQ ID NO: 271293 - RNA, 22 nt, Homo sapiens
ucacuuggccgcagccuucucu

SEQ ID NO: 271294 - RNA, 22 nt, Homo sapiens
ucagagugcagggaguagcagc

SEQ ID NO: 271295 - RNA, 22 nt, Homo sapiens
ucagcaaugcugcacucuacug

SEQ ID NO: 271296 - RNA, 22 nt, Homo sapiens
ucagcaccauguaacaauugau

SEQ ID NO: 271297 - RNA, 22 nt, Homo sapiens
ucagcagugugaaaacaaacua

SEQ ID NO: 271298 - RNA, 22 nt, Homo sapiens
ucagcaucacgugggcucccgu

SEQ ID NO: 271299 - RNA, 22 nt, Homo sapiens
ucagggacuuacaaaccagaag

SEQ ID NO: 271300 - RNA, 22 nt, Homo sapiens
ucaggguacuuguggccaaagu

SEQ ID NO: 271301 - RNA, 20 nt, Homo sapiens
ucagguagaucuuugagguc

SEQ ID NO: 271302 - RNA, 22 nt, Homo sapiens
ucagguaguuugugggagauga

SEQ ID NO: 271303 - RNA, 22 nt, Homo sapiens
ucagguaucuuuauagcgaugc

SEQ ID NO: 271304 - RNA, 22 nt, Homo sapiens
ucaguguuuggaaucucaauuu

SEQ ID NO: 271305 - RNA, 22 nt, Homo sapiens
ucauauguaugugcaauuuugu

SEQ ID NO: 271306 - RNA, 22 nt, Homo sapiens
ucaucaggcucauucaagcuga

SEQ ID NO: 271307 - RNA, 22 nt, Homo sapiens
ucauggggugcuuugcuagauu

SEQ ID NO: 271308 - RNA, 22 nt, Homo sapiens
uccacaauggcugaacuagauu

SEQ ID NO: 271309 - RNA, 22 nt, Homo sapiens
uccaugugaaaaggucgugaua

SEQ ID NO: 271310 - RNA, 22 nt, Homo sapiens
gaacuguaaagaaauucuaagg

SEQ ID NO: 271311 - RNA, 22 nt, Homo sapiens
gaaguaggugcuguuauuaucu

SEQ ID NO: 271312 - RNA, 22 nt, Homo sapiens
gaaucacagauuaugaguaucu

SEQ ID NO: 271313 - RNA, 22 nt, Homo sapiens
gacagacacaauugauccauga

SEQ ID NO: 271314 - RNA, 18 nt, Homo sapiens
gacuccauuucagccaga

SEQ ID NO: 271315 - RNA, 22 nt, Homo sapiens
gacuggccauugauacagaggu

SEQ ID NO: 271316 - RNA, 22 nt, Homo sapiens
gagaacaguguuguauuuuuuc

SEQ ID NO: 271317 - RNA, 22 nt, Homo sapiens
gagacucuuagauuggaaaucu

SEQ ID NO: 271318 - RNA, 22 nt, Homo sapiens
gagaugguguuccacugccagu

SEQ ID NO: 271319 - RNA, 22 nt, Homo sapiens
gagauugucaugauuacauugu

SEQ ID NO: 271320 - RNA, 22 nt, Homo sapiens
gagcaucaauggcaugugggaa

SEQ ID NO: 271321 - RNA, 22 nt, Homo sapiens
gagccuguaggaggagaggugg

SEQ ID NO: 271322 - RNA, 22 nt, Homo sapiens
gagcucaccuuaccucuggagc

SEQ ID NO: 271323 - RNA, 22 nt, Homo sapiens
gagcugaauugcugccauuugc

SEQ ID NO: 271324 - RNA, 22 nt, Homo sapiens
gaggcggugugaugucacaugc

SEQ ID NO: 271325 - RNA, 22 nt, Homo sapiens
gagguaggaauaaacauuugaa

SEQ ID NO: 271326 - RNA, 22 nt, Homo sapiens
gagguaggggccuuaaagaugc

SEQ ID NO: 271327 - RNA, 22 nt, Homo sapiens
gagguaugugggcagacauuua

SEQ ID NO: 271328 - RNA, 22 nt, Homo sapiens
gagguggugguggaggcauagc

SEQ ID NO: 271329 - RNA, 22 nt, Homo sapiens
gaguaacauugacaacuucaug

SEQ ID NO: 271330 - RNA, 22 nt, Homo sapiens
gagugcaauggcgcgaucuggg

SEQ ID NO: 271331 - RNA, 22 nt, Homo sapiens
gagugcauaugggccuguguca

SEQ ID NO: 271332 - RNA, 22 nt, Homo sapiens
gagugcugagcccacuuccuug

SEQ ID NO: 271333 - RNA, 22 nt, Homo sapiens
gagugcuguuagcccuggguuu

SEQ ID NO: 271334 - RNA, 22 nt, Homo sapiens
gaguuccuuugagccugagagg

SEQ ID NO: 271335 - RNA, 22 nt, Homo sapiens
gaguuuguacuaauuuguugua

SEQ ID NO: 271336 - RNA, 22 nt, Homo sapiens
gauagguagaagauguuuucau

SEQ ID NO: 271337 - RNA, 22 nt, Homo sapiens
gaugccuauugcuaguccuaaa

SEQ ID NO: 271338 - RNA, 22 nt, Homo sapiens
gauggcuacugauuaaauauag

SEQ ID NO: 271339 - RNA, 22 nt, Homo sapiens
gcacaguggcucccgucuauaa

SEQ ID NO: 271340 - RNA, 22 nt, Homo sapiens
gcagaauugguuucuucuaagg

SEQ ID NO: 271341 - RNA, 22 nt, Homo sapiens
gcagaucucuucauuucucuua

SEQ ID NO: 271342 - RNA, 22 nt, Homo sapiens
gcagcacauggcagaacauauu

SEQ ID NO: 271343 - RNA, 20 nt, Homo sapiens
gcagcaccauauuucuaaga

SEQ ID NO: 271344 - RNA, 22 nt, Homo sapiens
gcaguggugugugccagccuag

SEQ ID NO: 271345 - RNA, 22 nt, Homo sapiens
gcaguguuggggccggaggcug

SEQ ID NO: 271346 - RNA, 22 nt, Homo sapiens
gcauauguuuggguguguauau

SEQ ID NO: 271347 - RNA, 22 nt, Homo sapiens
gccaguguuuuauugagaauuu

SEQ ID NO: 271348 - RNA, 22 nt, Homo sapiens
gcccuuugugucuggcuggggu

SEQ ID NO: 271349 - RNA, 22 nt, Homo sapiens
gcuuuguugauggugagucugu

SEQ ID NO: 271350 - RNA, 18 nt, Homo sapiens
ggaagccuauuuaguaac

SEQ ID NO: 271351 - RNA, 17 nt, Homo sapiens
ggaagccuuugguuuaa

SEQ ID NO: 271352 - RNA, 19 nt, Homo sapiens
ggaaugcaccaguccuugc

SEQ ID NO: 271353 - RNA, 20 nt, Homo sapiens
ggaauguuaaucuccaugau

SEQ ID NO: 271354 - RNA, 21 nt, Homo sapiens
ggaauuuagggaaugauuuag

SEQ ID NO: 271355 - RNA, 22 nt, Homo sapiens
ggacauguauauauaugugugu

SEQ ID NO: 271356 - RNA, 22 nt, Homo sapiens
ggacuagggacauggggagcug

SEQ ID NO: 271357 - RNA, 22 nt, Homo sapiens
ggagaugugccugcucugcucu

SEQ ID NO: 271358 - RNA, 22 nt, Homo sapiens
ggagcugugauuugaguccaga

SEQ ID NO: 271359 - RNA, 22 nt, Homo sapiens
ggagguaauaaguuccagugua

SEQ ID NO: 271360 - RNA, 22 nt, Homo sapiens
ggagugucccaaucucagcuca

SEQ ID NO: 271361 - RNA, 21 nt, Homo sapiens
ggauucaucccucaugaauuu

SEQ ID NO: 271362 - RNA, 22 nt, Homo sapiens
ggcaaaauauugucugguauag

SEQ ID NO: 271363 - RNA, 22 nt, Homo sapiens
ggcaaagagacaugcaucgggg

SEQ ID NO: 271364 - RNA, 22 nt, Homo sapiens
ggcaacaaagacauuucaacau

SEQ ID NO: 271365 - RNA, 21 nt, Homo sapiens
ggcaagagaauacaacauaaa

SEQ ID NO: 271366 - RNA, 22 nt, Homo sapiens
ggcagacuguggaguucuuucu

SEQ ID NO: 271367 - RNA, 22 nt, Homo sapiens
ggcaguggaagugccaguuucu

SEQ ID NO: 271368 - RNA, 22 nt, Homo sapiens
ggccuguaaacuagagacccug

SEQ ID NO: 271369 - RNA, 22 nt, Homo sapiens
ggcucagugggguccugguucu

SEQ ID NO: 271370 - RNA, 21 nt, Homo sapiens
ggcucuguggucucagguuuc

SEQ ID NO: 271371 - RNA, 22 nt, Homo sapiens
gggaagauauaggcugggcacc

SEQ ID NO: 271372 - RNA, 18 nt, Homo sapiens
gggaauauggggaguuga

SEQ ID NO: 271373 - RNA, 22 nt, Homo sapiens
gggaaugaagagaaccuuccca

SEQ ID NO: 271374 - RNA, 22 nt, Homo sapiens
gggauguuuuauacugagccug

SEQ ID NO: 271375 - RNA, 22 nt, Homo sapiens
ggggaauguuaaagaauuugca

SEQ ID NO: 271376 - RNA, 22 nt, Homo sapiens
gguaaacauacugcugucuucu

SEQ ID NO: 271377 - RNA, 22 nt, Homo sapiens
ggucaggagaaugguaacugag

SEQ ID NO: 271378 - RNA, 22 nt, Homo sapiens
ggucauagagaauucaccagga

SEQ ID NO: 271379 - RNA, 22 nt, Homo sapiens
ggucugguguugaaauucuuca

SEQ ID NO: 271380 - RNA, 23 nt, Homo sapiens
ggugaggaguacagagucuucau

SEQ ID NO: 271381 - RNA, 22 nt, Homo sapiens
guaauaacuguggaaaaagguu

SEQ ID NO: 271382 - RNA, 22 nt, Homo sapiens
guaaucucaccuacuugggagg

SEQ ID NO: 271383 - RNA, 22 nt, Homo sapiens
guagaagcacagggccuguauu

SEQ ID NO: 271384 - RNA, 22 nt, Homo sapiens
guagcagaacauguuccuugua

SEQ ID NO: 271385 - RNA, 22 nt, Homo sapiens
guauacaguugacccuugaacc

SEQ ID NO: 271386 - RNA, 22 nt, Homo sapiens
gucacauugaugcccauggugg

SEQ ID NO: 271387 - RNA, 22 nt, Homo sapiens
gucagcaucaccaugucuauga

SEQ ID NO: 271388 - RNA, 22 nt, Homo sapiens
gucaguuugguuaaucauucca

SEQ ID NO: 271389 - RNA, 22 nt, Homo sapiens
guccaaagugggagaggugggg

SEQ ID NO: 271390 - RNA, 22 nt, Homo sapiens
gucucuuguuaucauuucugag

SEQ ID NO: 271391 - RNA, 22 nt, Homo sapiens
gucugguuccugggagauuucu

SEQ ID NO: 271392 - RNA, 22 nt, Homo sapiens
gucugugguuccuaugucaccu

SEQ ID NO: 271393 - RNA, 20 nt, Homo sapiens
gucuugcuccguugcccagg

SEQ ID NO: 271394 - RNA, 22 nt, Homo sapiens
gucuuuguuauuaugaaucaac

SEQ ID NO: 271395 - RNA, 22 nt, Homo sapiens
gugaacaagcaaaggcaggagg

SEQ ID NO: 271396 - RNA, 22 nt, Homo sapiens
gugaagaucccuguccuguucc

SEQ ID NO: 271397 - RNA, 22 nt, Homo sapiens
gugacaucagcuccagguauaa

SEQ ID NO: 271398 - RNA, 22 nt, Homo sapiens
gugagacugaguuucgcucuug

SEQ ID NO: 271399 - RNA, 22 nt, Homo sapiens
gugagauggagucuugcuuugu

SEQ ID NO: 271400 - RNA, 22 nt, Homo sapiens
gugagcauaggaggcuucuguu

SEQ ID NO: 271401 - RNA, 21 nt, Homo sapiens
gugaggaguuacuggcuuuga

SEQ ID NO: 271402 - RNA, 22 nt, Homo sapiens
gugcacaacaugcagguuuguu

SEQ ID NO: 271403 - RNA, 22 nt, Homo sapiens
gugcacauuguuuaugucuguu

SEQ ID NO: 271404 - RNA, 22 nt, Homo sapiens
gugcacuguagaacccuuuguu

SEQ ID NO: 271405 - RNA, 22 nt, Homo sapiens
gugcauauaaguuguuucuagu

SEQ ID NO: 271406 - RNA, 22 nt, Homo sapiens
gugcauaucugugguuggcuga

SEQ ID NO: 271407 - RNA, 23 nt, Homo sapiens
gugccuucugagccuagucucca

SEQ ID NO: 271408 - RNA, 22 nt, Homo sapiens
guggaaaucucugugugacuua

SEQ ID NO: 271409 - RNA, 20 nt, Homo sapiens
guggaaguagaaacauaugu

SEQ ID NO: 271410 - RNA, 22 nt, Homo sapiens
guggaagugucuggggccaggg

SEQ ID NO: 271411 - RNA, 22 nt, Homo sapiens
guggaaugauaucucauugugg

SEQ ID NO: 271412 - RNA, 22 nt, Homo sapiens
guggcaaguguuccaagaggcg

SEQ ID NO: 271413 - RNA, 22 nt, Homo sapiens
guggcuuuaaguacgauugagg

SEQ ID NO: 271414 - RNA, 22 nt, Homo sapiens
gugguuuuaauauucagucuag

SEQ ID NO: 271415 - RNA, 22 nt, Homo sapiens
gugguuuuacaaagagaaagau

SEQ ID NO: 271416 - RNA, 22 nt, Homo sapiens
gugguuuuuagauuucuacagu

SEQ ID NO: 271417 - RNA, 22 nt, Homo sapiens
gugugacagcuauagacaugau

SEQ ID NO: 271418 - RNA, 22 nt, Homo sapiens
gugugacugcucuauuagggcg

SEQ ID NO: 271419 - RNA, 20 nt, Homo sapiens
gugugcauuucagauuuugg

SEQ ID NO: 271420 - RNA, 22 nt, Homo sapiens
guugcugagucccaucaccaga

SEQ ID NO: 271421 - RNA, 22 nt, Homo sapiens
guuuggauauuaggcaagagua

SEQ ID NO: 271422 - RNA, 22 nt, Homo sapiens
uaacaacauucuaacugacggc

SEQ ID NO: 271423 - RNA, 18 nt, Homo sapiens
uaacagucucucaggauc

SEQ ID NO: 271424 - RNA, 22 nt, Homo sapiens
uaagacacauguguucccaggc

SEQ ID NO: 271425 - RNA, 22 nt, Homo sapiens
uaaggcacuacuuuaggcuuuc

SEQ ID NO: 271426 - RNA, 22 nt, Homo sapiens
uaaguagugugcauguauguau

SEQ ID NO: 271427 - RNA, 22 nt, Homo sapiens
uaauagcaguguuacuaggacu

SEQ ID NO: 271428 - RNA, 22 nt, Homo sapiens
uaaucucagcuacucaggaggc

SEQ ID NO: 271429 - RNA, 22 nt, Homo sapiens
uaauucacauaaagcacuuaga

SEQ ID NO: 271430 - RNA, 22 nt, Homo sapiens
uacaggcaccuggcuaauuuuu

SEQ ID NO: 271431 - RNA, 22 nt, Homo sapiens
uacuacuuucugacaucuuuaa

SEQ ID NO: 271432 - RNA, 22 nt, Homo sapiens
uacugcagucagacuccugggc

SEQ ID NO: 271433 - RNA, 18 nt, Homo sapiens
uugugccugagaaggugg

SEQ ID NO: 271434 - RNA, 20 nt, Homo sapiens
uuuaagacaugcugaauuga

SEQ ID NO: 271435 - RNA, 22 nt, Homo sapiens
uuuagcaaugcuguggggaagu

SEQ ID NO: 271436 - RNA, 22 nt, Homo sapiens
uuucaggcagggagcuucagug

SEQ ID NO: 271437 - RNA, 23 nt, Homo sapiens
uuucaggcaggugaaagaccagc

SEQ ID NO: 271438 - RNA, 23 nt, Homo sapiens
uuucaguaguuguauccuguugc

SEQ ID NO: 271439 - RNA, 22 nt, Homo sapiens
uuucaguguggcaggcauagcu

SEQ ID NO: 271440 - RNA, 22 nt, Homo sapiens
uuuccaguuggaaagccuguuu

SEQ ID NO: 271441 - RNA, 22 nt, Homo sapiens
uuucuauguugaccagucuaga

SEQ ID NO: 271442 - RNA, 16 nt, Homo sapiens
uuucuauguuuuacua

SEQ ID NO: 271443 - RNA, 20 nt, Homo sapiens
uuucuccccuauaaaucuca

SEQ ID NO: 271444 - RNA, 22 nt, Homo sapiens
uuucugggggugcugauggaaa

SEQ ID NO: 271445 - RNA, 22 nt, Homo sapiens
uuucugugguccucuugaaggu

SEQ ID NO: 271446 - RNA, 23 nt, Homo sapiens
uuucuugggcaugcuaugucagu

SEQ ID NO: 271447 - RNA, 22 nt, Homo sapiens
uuucuugguuguauuuagacuu

SEQ ID NO: 271448 - RNA, 22 nt, Homo sapiens
uuugacaaugugugcuuguauu

SEQ ID NO: 271449 - RNA, 22 nt, Homo sapiens
uuugaggaaaggcauaaguagg

SEQ ID NO: 271450 - RNA, 22 nt, Homo sapiens
uuugcugagucauuccaugcug

SEQ ID NO: 271451 - RNA, 22 nt, Homo sapiens
uuugcuuguguaaaaaucugga

SEQ ID NO: 271452 - RNA, 20 nt, Homo sapiens
uuuggcacugagugguauaa

SEQ ID NO: 271453 - RNA, 22 nt, Homo sapiens
uuuggcaguuauuuacucagug

SEQ ID NO: 271454 - RNA, 22 nt, Homo sapiens
uuuguagcuacaaagugagaug

SEQ ID NO: 271455 - RNA, 22 nt, Homo sapiens
uuuuaagcuacaagagacauau

SEQ ID NO: 271456 - RNA, 22 nt, Homo sapiens
uuuuaguggacaaagguauuua

SEQ ID NO: 271457 - RNA, 22 nt, Homo sapiens
uuuugcucuucggaagagcuug

SEQ ID NO: 271458 - RNA, 22 nt, Homo sapiens
uuuugcucuugguaaugaaaga

SEQ ID NO: 271459 - RNA, 22 nt, Homo sapiens
uuuuguacgccuguguccauca

SEQ ID NO: 271460 - RNA, 22 nt, Homo sapiens
uuaagcaguaguuaaggagagg

SEQ ID NO: 271461 - RNA, 22 nt, Homo sapiens
uuaaggaguagugucugguauu

SEQ ID NO: 271462 - RNA, 22 nt, Homo sapiens
uuaccuuuuuaagacagguuag

SEQ ID NO: 271463 - RNA, 22 nt, Homo sapiens
uuagaugguucaccaugaguag

SEQ ID NO: 271464 - RNA, 22 nt, Homo sapiens
uuaggcaggauaguuacauauu

SEQ ID NO: 271465 - RNA, 16 nt, Homo sapiens
uuaggcagugugauac

SEQ ID NO: 271466 - RNA, 22 nt, Homo sapiens
uuaggcuuuuuaaccaguuguu

SEQ ID NO: 271467 - RNA, 22 nt, Homo sapiens
uuauaacagagacuccugugcu

SEQ ID NO: 271468 - RNA, 22 nt, Homo sapiens
uuauggcaaugccccacuccua

SEQ ID NO: 271469 - RNA, 22 nt, Homo sapiens
uuauuagguuaaccuauagcua

SEQ ID NO: 271470 - RNA, 22 nt, Homo sapiens
uucacaaugccuuguugauggu

SEQ ID NO: 271471 - RNA, 22 nt, Homo sapiens
uucacugcacuccagccugagc

SEQ ID NO: 271472 - RNA, 22 nt, Homo sapiens
uucagaugcacacuguagucua

SEQ ID NO: 271473 - RNA, 22 nt, Homo sapiens
uucaggcaccauggucauugau

SEQ ID NO: 271474 - RNA, 22 nt, Homo sapiens
uucaggcaccauugucauugau

SEQ ID NO: 271475 - RNA, 22 nt, Homo sapiens
uucaggcuuuuauuuacugaua

SEQ ID NO: 271476 - RNA, 22 nt, Homo sapiens
uucagggagaaggcaaacguug

SEQ ID NO: 271477 - RNA, 22 nt, Homo sapiens
uucaguucugcacugaucuuag

SEQ ID NO: 271478 - RNA, 18 nt, Homo sapiens
uucaguuuguaucugggg

SEQ ID NO: 271479 - RNA, 21 nt, Homo sapiens
uucaucagccagaaaucaagc

SEQ ID NO: 271480 - RNA, 22 nt, Homo sapiens
uucaugcaucuguagugguuaa

SEQ ID NO: 271481 - RNA, 22 nt, Homo sapiens
uucauggugguacaaaagcaau

SEQ ID NO: 271482 - RNA, 22 nt, Homo sapiens
uucauguaauauauuucaggcc

SEQ ID NO: 271483 - RNA, 22 nt, Homo sapiens
uucauguaauauuucacagcuu

SEQ ID NO: 271484 - RNA, 22 nt, Homo sapiens
uuccacagggauuugcauugau

SEQ ID NO: 271485 - RNA, 22 nt, Homo sapiens
uuccaggugggcgugggccugg

SEQ ID NO: 271486 - RNA, 22 nt, Homo sapiens
uuccaguggacuacuucauccu

SEQ ID NO: 271487 - RNA, 22 nt, Homo sapiens
uucccgggguggaaugcaguga

SEQ ID NO: 271488 - RNA, 22 nt, Homo sapiens
uucccuagaacacauggaggga

SEQ ID NO: 271489 - RNA, 22 nt, Homo sapiens
uuccuguagcgauuuuaguaau

SEQ ID NO: 271490 - RNA, 22 nt, Homo sapiens
uuccuuguuuauuuacaggagg

SEQ ID NO: 271491 - RNA, 22 nt, Homo sapiens
uucucaauggcaacuuguugcu

SEQ ID NO: 271492 - RNA, 22 nt, Homo sapiens
uucucaguuccuacuuugguga

SEQ ID NO: 271493 - RNA, 22 nt, Homo sapiens
uucucuguggauugggugagag

SEQ ID NO: 271494 - RNA, 22 nt, Homo sapiens
uucugguuaauacuugcaaaaa

SEQ ID NO: 271495 - RNA, 22 nt, Homo sapiens
uugaaagucuaggcuuacagua

SEQ ID NO: 271496 - RNA, 22 nt, Homo sapiens
uugaaguagaaagacgaaauuu

SEQ ID NO: 271497 - RNA, 22 nt, Homo sapiens
uugaaugaaaugaugucauuug

SEQ ID NO: 271498 - RNA, 22 nt, Homo sapiens
uugaaugaaauuggugugggga

SEQ ID NO: 271499 - RNA, 22 nt, Homo sapiens
uugacuuuuauucacucugcua

SEQ ID NO: 271500 - RNA, 21 nt, Homo sapiens
uugagacggagucucacucug

SEQ ID NO: 271501 - RNA, 22 nt, Homo sapiens
uugagauccuuuugcucaucag

SEQ ID NO: 271502 - RNA, 22 nt, Homo sapiens
uugagauggagucucacucugc

SEQ ID NO: 271503 - RNA, 22 nt, Homo sapiens
uugagauggagucucacucugu

SEQ ID NO: 271504 - RNA, 22 nt, Homo sapiens
uugagauggagucucacucuug

SEQ ID NO: 271505 - RNA, 22 nt, Homo sapiens
uugagauggagucucgcucugu

SEQ ID NO: 271506 - RNA, 22 nt, Homo sapiens
uugagauggagucuugcacugu

SEQ ID NO: 271507 - RNA, 22 nt, Homo sapiens
uugagauggagucuugcgcugu

SEQ ID NO: 271508 - RNA, 22 nt, Homo sapiens
uugagauggagucuugcucuug

SEQ ID NO: 271509 - RNA, 22 nt, Homo sapiens
uugagauggagucuuguucucu

SEQ ID NO: 271510 - RNA, 22 nt, Homo sapiens
uugagauggagucuuguucuuu

SEQ ID NO: 271511 - RNA, 22 nt, Homo sapiens
uugagauggaguuucacucucg

SEQ ID NO: 271512 - RNA, 22 nt, Homo sapiens
uugagauggaguuucacucuug

SEQ ID NO: 271513 - RNA, 22 nt, Homo sapiens
uugagauggaguuucgcucuuu

SEQ ID NO: 271514 - RNA, 22 nt, Homo sapiens
uugagauggaguuuugcucuug

SEQ ID NO: 271515 - RNA, 19 nt, Homo sapiens
uugagaugugaacucacac

SEQ ID NO: 271516 - RNA, 21 nt, Homo sapiens
ugcagccauucagcccuaugc

SEQ ID NO: 271517 - RNA, 22 nt, Homo sapiens
ugcagguacuugacaacuuggg

SEQ ID NO: 271518 - RNA, 22 nt, Homo sapiens
ugcauagcaaaauaggauuaga

SEQ ID NO: 271519 - RNA, 21 nt, Homo sapiens
ugcauaucucuaaugaccagu

SEQ ID NO: 271520 - RNA, 22 nt, Homo sapiens
ugcauauguauacaugugccau

SEQ ID NO: 271521 - RNA, 22 nt, Homo sapiens
ugcauauguugagaugcauauu

SEQ ID NO: 271522 - RNA, 21 nt, Homo sapiens
ugcauggagaacacugagggu

SEQ ID NO: 271523 - RNA, 21 nt, Homo sapiens
ugcauuggagaauguuucuca

SEQ ID NO: 271524 - RNA, 22 nt, Homo sapiens
ugcauuguuccgaauguguccu

SEQ ID NO: 271525 - RNA, 22 nt, Homo sapiens
ugccaaaaugggcuuuauaccg

SEQ ID NO: 271526 - RNA, 19 nt, Homo sapiens
ugccauguagcacaugguc

SEQ ID NO: 271527 - RNA, 22 nt, Homo sapiens
ugccaugucauagguuaagccu

SEQ ID NO: 271528 - RNA, 22 nt, Homo sapiens
ugccuaguagaaggugaacaug

SEQ ID NO: 271529 - RNA, 22 nt, Homo sapiens
ugcuaugucagccaggcugguc

SEQ ID NO: 271530 - RNA, 23 nt, Homo sapiens
ugcugagaccuagauccuaaaga

SEQ ID NO: 271531 - RNA, 22 nt, Homo sapiens
uggaagacucaagguggugaau

SEQ ID NO: 271532 - RNA, 22 nt, Homo sapiens
uggaagacucuagucucuugag

SEQ ID NO: 271533 - RNA, 22 nt, Homo sapiens
uggaagacuuuagaggcuuaua

SEQ ID NO: 271534 - RNA, 22 nt, Homo sapiens
uggaagauucuagaagauucca

SEQ ID NO: 271535 - RNA, 22 nt, Homo sapiens
uggaagcaugcaaucugugggg

SEQ ID NO: 271536 - RNA, 22 nt, Homo sapiens
uggaagguaaguuuugagcauu

SEQ ID NO: 271537 - RNA, 20 nt, Homo sapiens
uggaaguaagaauauaggug

SEQ ID NO: 271538 - RNA, 22 nt, Homo sapiens
uggaagucuucauuauguauag

SEQ ID NO: 271539 - RNA, 19 nt, Homo sapiens
uggaauggauuuaaaugug

SEQ ID NO: 271540 - RNA, 22 nt, Homo sapiens
uggacauguacauauguguaug

SEQ ID NO: 271541 - RNA, 22 nt, Homo sapiens
uggagacaaagauagaaaagca

SEQ ID NO: 271542 - RNA, 22 nt, Homo sapiens
uggagagucauuuauaguauuu

SEQ ID NO: 271543 - RNA, 22 nt, Homo sapiens
uggagguaggacgaagaacucu

SEQ ID NO: 271544 - RNA, 22 nt, Homo sapiens
uggaguaggccuaagaaugaca

SEQ ID NO: 271545 - RNA, 20 nt, Homo sapiens
uggagugcuguguugagaag

SEQ ID NO: 271546 - RNA, 22 nt, Homo sapiens
uggauaguuuacugaagagugg

SEQ ID NO: 271547 - RNA, 22 nt, Homo sapiens
uggauuguuucucuugguauga

SEQ ID NO: 271548 - RNA, 22 nt, Homo sapiens
uggcaaagugugacgugggggu

SEQ ID NO: 271549 - RNA, 22 nt, Homo sapiens
uggcaaaugugagaugagaacu

SEQ ID NO: 271550 - RNA, 22 nt, Homo sapiens
uggcaagaaccacaguuacuuu

SEQ ID NO: 271551 - RNA, 22 nt, Homo sapiens
uggcaagaacugcaauugcuuu

SEQ ID NO: 271552 - RNA, 22 nt, Homo sapiens
uggcaagaagagcaugagacca

SEQ ID NO: 271553 - RNA, 22 nt, Homo sapiens
uggcaagaucacaauuacuuuu

SEQ ID NO: 271554 - RNA, 21 nt, Homo sapiens
uggcacuauucacaauagcaa

SEQ ID NO: 271555 - RNA, 22 nt, Homo sapiens
uggcagugggagauauuuuauu

SEQ ID NO: 271556 - RNA, 22 nt, Homo sapiens
uggcauauaaagauguguucaa

SEQ ID NO: 271557 - RNA, 22 nt, Homo sapiens
uggccaguuuuuaauugggucu

SEQ ID NO: 271558 - RNA, 22 nt, Homo sapiens
uggccuguaacccucucauagg

SEQ ID NO: 271559 - RNA, 20 nt, Homo sapiens
uggcuaaaugaaugauagca

SEQ ID NO: 271560 - RNA, 22 nt, Homo sapiens
uggcuagaccugcauaacagcu

SEQ ID NO: 271561 - RNA, 22 nt, Homo sapiens
uggcucauuucuaaacccagcu

SEQ ID NO: 271562 - RNA, 22 nt, Homo sapiens
uggcuuuuccuugaaucugccu

SEQ ID NO: 271563 - RNA, 22 nt, Homo sapiens
ugggaaauguagccuagcugug

SEQ ID NO: 271564 - RNA, 22 nt, Homo sapiens
ugggaagaagguuuacuugcca

SEQ ID NO: 271565 - RNA, 22 nt, Homo sapiens
ugggaagcugcugaacuacagu

SEQ ID NO: 271566 - RNA, 22 nt, Homo sapiens
ugggaauaugauacaggucuuu

SEQ ID NO: 271567 - RNA, 22 nt, Homo sapiens
ugggcaagugacuuggcuucuc

SEQ ID NO: 271568 - RNA, 22 nt, Homo sapiens
ugggcggagacgugcagccgcc

SEQ ID NO: 271569 - RNA, 22 nt, Homo sapiens
uggguaguuucuuacaacucug

SEQ ID NO: 271570 - RNA, 22 nt, Homo sapiens
ugguaagaucagaacuggaguc

SEQ ID NO: 271571 - RNA, 22 nt, Homo sapiens
ugguauggaguaauuaguaagc

SEQ ID NO: 271572 - RNA, 22 nt, Homo sapiens
uggucaaaucugaugugagaaa

SEQ ID NO: 271573 - RNA, 22 nt, Homo sapiens
uggugagaaaagaugucuuugu

SEQ ID NO: 271574 - RNA, 23 nt, Homo sapiens
ugguuuguaagagauggacugga

SEQ ID NO: 271575 - RNA, 22 nt, Homo sapiens
auuuggcaguauaaugcuuugg

SEQ ID NO: 271576 - RNA, 22 nt, Homo sapiens
caaaggcuuccacugcauccuu

SEQ ID NO: 271577 - RNA, 22 nt, Homo sapiens
caacaguaaagcauuuuuaagu

SEQ ID NO: 271578 - RNA, 22 nt, Homo sapiens
cacauguuuuagcauggcuguu

SEQ ID NO: 271579 - RNA, 22 nt, Homo sapiens
caccagguuggagugcaguggu

SEQ ID NO: 271580 - RNA, 22 nt, Homo sapiens
cacugcacuccagucugacgac

SEQ ID NO: 271581 - RNA, 22 nt, Homo sapiens
cacugcauucuccaccucccag

SEQ ID NO: 271582 - RNA, 22 nt, Homo sapiens
cacuguggauggaacuauguga

SEQ ID NO: 271583 - RNA, 22 nt, Homo sapiens
cacuuugguucaccugaguuuc

SEQ ID NO: 271584 - RNA, 22 nt, Homo sapiens
cagagguaagcaagucagcauu

SEQ ID NO: 271585 - RNA, 23 nt, Homo sapiens
cagguaguucuuuauaguagugu

SEQ ID NO: 271586 - RNA, 22 nt, Homo sapiens
cagugcuuuaucaaguccucca

SEQ ID NO: 271587 - RNA, 23 nt, Homo sapiens
cagugguguuagagaaaucuuuu

SEQ ID NO: 271588 - RNA, 22 nt, Homo sapiens
cauauucacuuuacagagcugu

SEQ ID NO: 271589 - RNA, 22 nt, Homo sapiens
caugccauugcucuccugggug

SEQ ID NO: 271590 - RNA, 22 nt, Homo sapiens
cauggcuacugcagauguaggg

SEQ ID NO: 271591 - RNA, 23 nt, Homo sapiens
cauggcuguuaacacuguuugag

SEQ ID NO: 271592 - RNA, 19 nt, Homo sapiens
cauggcuuauaauuuuaau

SEQ ID NO: 271593 - RNA, 22 nt, Homo sapiens
cauugcauuccagucugggcaa

SEQ ID NO: 271594 - RNA, 22 nt, Homo sapiens
cauuuuacuuuccagacgugga

SEQ ID NO: 271595 - RNA, 20 nt, Homo sapiens
ccagcaucauuagauucugg

SEQ ID NO: 271596 - RNA, 21 nt, Homo sapiens
ccaguguaaugauagcaggca

SEQ ID NO: 271597 - RNA, 22 nt, Homo sapiens
ccaucacaggccucagugggaa

SEQ ID NO: 271598 - RNA, 19 nt, Homo sapiens
ccauggcaaugaucugaug

SEQ ID NO: 271599 - RNA, 21 nt, Homo sapiens
ccaugggacggaaugaauaca

SEQ ID NO: 271600 - RNA, 22 nt, Homo sapiens
cccagugugaacuuggcauuuu

SEQ ID NO: 271601 - RNA, 22 nt, Homo sapiens
cccaguguguuguggauauuua

SEQ ID NO: 271602 - RNA, 22 nt, Homo sapiens
cccaguguuuauuuugagccaa

SEQ ID NO: 271603 - RNA, 22 nt, Homo sapiens
cccugaagauacagaguuuggg

SEQ ID NO: 271604 - RNA, 22 nt, Homo sapiens
cccugagaaaacuuuguccuua

SEQ ID NO: 271605 - RNA, 22 nt, Homo sapiens
cccugagaugugaauuucagag

SEQ ID NO: 271606 - RNA, 19 nt, Homo sapiens
ccucaaguacuaauauguu

SEQ ID NO: 271607 - RNA, 21 nt, Homo sapiens
ccucuuugagggaagaaaggg

SEQ ID NO: 271608 - RNA, 22 nt, Homo sapiens
ccuucauccuccagcaggcuag

SEQ ID NO: 271609 - RNA, 22 nt, Homo sapiens
ccuucauucauuaauuuagccc

SEQ ID NO: 271610 - RNA, 22 nt, Homo sapiens
ccuugguaauguguuuuauucu

SEQ ID NO: 271611 - RNA, 22 nt, Homo sapiens
ccuuuuugaguugccagaguuc

SEQ ID NO: 271612 - RNA, 22 nt, Homo sapiens
ccuuuuuguaguggaaguagga

SEQ ID NO: 271613 - RNA, 22 nt, Homo sapiens
cgcuggugucuaagcgacagcu

SEQ ID NO: 271614 - RNA, 17 nt, Homo sapiens
cuaaggcaagagucugc

SEQ ID NO: 271615 - RNA, 22 nt, Homo sapiens
cuacacaugcaggcucccugcc

SEQ ID NO: 271616 - RNA, 22 nt, Homo sapiens
cuacugcacaucaucugaguua

SEQ ID NO: 271617 - RNA, 18 nt, Homo sapiens
cucacacccuaaucagga

SEQ ID NO: 271618 - RNA, 17 nt, Homo sapiens
cucacugagaacagcua

SEQ ID NO: 271619 - RNA, 22 nt, Homo sapiens
cucaguguuaaggccaccucug

SEQ ID NO: 271620 - RNA, 22 nt, Homo sapiens
cucaugcugucuucugggguaa

SEQ ID NO: 271621 - RNA, 22 nt, Homo sapiens
cucauggaauacuucacagcca

SEQ ID NO: 271622 - RNA, 22 nt, Homo sapiens
cucauggauggucuggcagcca

SEQ ID NO: 271623 - RNA, 22 nt, Homo sapiens
cuccuggugauuggagugugaa

SEQ ID NO: 271624 - RNA, 20 nt, Homo sapiens
cuccuucauuccuuuggacc

SEQ ID NO: 271625 - RNA, 22 nt, Homo sapiens
cucugguggaagcagggggcaa

SEQ ID NO: 271626 - RNA, 22 nt, Homo sapiens
cucuuugaguuccuccuggugu

SEQ ID NO: 271627 - RNA, 22 nt, Homo sapiens
cucuuugaugugaaccgugguu

SEQ ID NO: 271628 - RNA, 22 nt, Homo sapiens
cucuuuuguuuagcugagaggg

SEQ ID NO: 271629 - RNA, 22 nt, Homo sapiens
cugaaaucagccaguuaguuuc

SEQ ID NO: 271630 - RNA, 22 nt, Homo sapiens
cugaauagucaacgauggacug

SEQ ID NO: 271631 - RNA, 22 nt, Homo sapiens
cugagguacugggggccaggau

SEQ ID NO: 271632 - RNA, 19 nt, Homo sapiens
cugcaugagacaguugguu

SEQ ID NO: 271633 - RNA, 22 nt, Homo sapiens
cugcauuagucuguuuaguguu

SEQ ID NO: 271634 - RNA, 22 nt, Homo sapiens
cuggaaacaucuuaggaaugca

SEQ ID NO: 271635 - RNA, 22 nt, Homo sapiens
cuggaaagcaaguccauugcuc

SEQ ID NO: 271636 - RNA, 22 nt, Homo sapiens
cuggcaccauuuugaucaaagg

SEQ ID NO: 271637 - RNA, 22 nt, Homo sapiens
cuggcagucugccucuucacug

SEQ ID NO: 271638 - RNA, 22 nt, Homo sapiens
cuggcccaguucugcguuuugc

SEQ ID NO: 271639 - RNA, 22 nt, Homo sapiens
cugguaugcuucauaugcaaac

SEQ ID NO: 271640 - RNA, 19 nt, Homo sapiens
cugucacugaggaagacug

SEQ ID NO: 271641 - RNA, 22 nt, Homo sapiens
cugugcauaugacuuuauugga

SEQ ID NO: 271642 - RNA, 22 nt, Homo sapiens
cugugcaugcgcggagcugaaa

SEQ ID NO: 271643 - RNA, 18 nt, Homo sapiens
cuucauugcuguuuugcu

SEQ ID NO: 271644 - RNA, 20 nt, Homo sapiens
cuuccaguggccccaucuuu

SEQ ID NO: 271645 - RNA, 22 nt, Homo sapiens
cuugagcaaacaaaggugguag

SEQ ID NO: 271646 - RNA, 22 nt, Homo sapiens
cuugaucaaugugguacuugau

SEQ ID NO: 271647 - RNA, 22 nt, Homo sapiens
cuugcagagcccauggauguca

SEQ ID NO: 271648 - RNA, 22 nt, Homo sapiens
cuugcagaggcccuggggagag

SEQ ID NO: 271649 - RNA, 22 nt, Homo sapiens
uucaucaggaauauugaccugu

SEQ ID NO: 271650 - RNA, 20 nt, Homo sapiens
uucaugggagcaaagaggcc

SEQ ID NO: 271651 - RNA, 22 nt, Homo sapiens
uucauugaaugauuuuuagaag

SEQ ID NO: 271652 - RNA, 22 nt, Homo sapiens
uucauuggacuuguguucuuga

SEQ ID NO: 271653 - RNA, 22 nt, Homo sapiens
uuccaugugggcuugucaagua

SEQ ID NO: 271654 - RNA, 22 nt, Homo sapiens
uucccagucaaacgaaggacuu

SEQ ID NO: 271655 - RNA, 22 nt, Homo sapiens
uuccuaguccugagucucugcg

SEQ ID NO: 271656 - RNA, 19 nt, Homo sapiens
uuccuagugguugggaagu

SEQ ID NO: 271657 - RNA, 22 nt, Homo sapiens
uuccuucaugcuugaaggguau

SEQ ID NO: 271658 - RNA, 23 nt, Homo sapiens
uucuaucaggcccaggagcccug

SEQ ID NO: 271659 - RNA, 22 nt, Homo sapiens
uucucagcccccugacagucag

SEQ ID NO: 271660 - RNA, 22 nt, Homo sapiens
uucucauggugauggcaaaauc

SEQ ID NO: 271661 - RNA, 22 nt, Homo sapiens
uucugugcuuguggaugaagug

SEQ ID NO: 271662 - RNA, 22 nt, Homo sapiens
uucuguguuuaggucacggcua

SEQ ID NO: 271663 - RNA, 22 nt, Homo sapiens
uucuuccagccuugaggggccc

SEQ ID NO: 271664 - RNA, 22 nt, Homo sapiens
uucuuuggaaacaguacuaauu

SEQ ID NO: 271665 - RNA, 22 nt, Homo sapiens
uugaaagaaaggagacugaguu

SEQ ID NO: 271666 - RNA, 22 nt, Homo sapiens
uugaagacuaccuaccauacuu

SEQ ID NO: 271667 - RNA, 22 nt, Homo sapiens
uugagauaggaacucacuaugc

SEQ ID NO: 271668 - RNA, 22 nt, Homo sapiens
uugagaugaagucuugcucucu

SEQ ID NO: 271669 - RNA, 22 nt, Homo sapiens
uugagaugaaguuuugcucuuu

SEQ ID NO: 271670 - RNA, 22 nt, Homo sapiens
uugagauggagccucacucugc

SEQ ID NO: 271671 - RNA, 22 nt, Homo sapiens
uugagauggagcuucacucuug

SEQ ID NO: 271672 - RNA, 22 nt, Homo sapiens
uugagauggagucucacgcauu

SEQ ID NO: 271673 - RNA, 22 nt, Homo sapiens
uugagauggagucucacuccuu

SEQ ID NO: 271674 - RNA, 22 nt, Homo sapiens
uugagauggagucucacugugu

SEQ ID NO: 271675 - RNA, 22 nt, Homo sapiens
uugagauggagucucgcacugu

SEQ ID NO: 271676 - RNA, 22 nt, Homo sapiens
uugagauggagucucguucugu

SEQ ID NO: 271677 - RNA, 22 nt, Homo sapiens
uugagauggagucuugcucucu

SEQ ID NO: 271678 - RNA, 22 nt, Homo sapiens
uugagauggaguguugcucugu

SEQ ID NO: 271679 - RNA, 22 nt, Homo sapiens
uugagauguaagauguuaauau

SEQ ID NO: 271680 - RNA, 22 nt, Homo sapiens
uugagauguauguauauaaugu

SEQ ID NO: 271681 - RNA, 22 nt, Homo sapiens
ugagguguuauccagaguucuu

SEQ ID NO: 271682 - RNA, 22 nt, Homo sapiens
ugagucaauggaggcucagagc

SEQ ID NO: 271683 - RNA, 22 nt, Homo sapiens
ugaguggagacuguguguagag

SEQ ID NO: 271684 - RNA, 22 nt, Homo sapiens
ugagugugacuuagcagaagga

SEQ ID NO: 271685 - RNA, 22 nt, Homo sapiens
ugauaauguuaggcuuuauuca

SEQ ID NO: 271686 - RNA, 22 nt, Homo sapiens
ugauaugaaguuagcuggcugu

SEQ ID NO: 271687 - RNA, 22 nt, Homo sapiens
ugaucucagcucacugguugaa

SEQ ID NO: 271688 - RNA, 22 nt, Homo sapiens
ugauggcauuuggaguugggac

SEQ ID NO: 271689 - RNA, 20 nt, Homo sapiens
ugauguccaggcagagguuu

SEQ ID NO: 271690 - RNA, 22 nt, Homo sapiens
ugauguccaguucauagaaacu

SEQ ID NO: 271691 - RNA, 19 nt, Homo sapiens
ugcaaauucuaaaaacuga

SEQ ID NO: 271692 - RNA, 22 nt, Homo sapiens
ugcaagaggagacuguacucag

SEQ ID NO: 271693 - RNA, 22 nt, Homo sapiens
ugcagguaggcaguaucauuua

SEQ ID NO: 271694 - RNA, 22 nt, Homo sapiens
ugcauacugggagguugggugu

SEQ ID NO: 271695 - RNA, 22 nt, Homo sapiens
ugcauaucuuguggaauaucuc

SEQ ID NO: 271696 - RNA, 22 nt, Homo sapiens
ugcauauucaaggcaggccauu

SEQ ID NO: 271697 - RNA, 22 nt, Homo sapiens
ugcauccauucuagacucaucu

SEQ ID NO: 271698 - RNA, 22 nt, Homo sapiens
ugcauggagcucucuuuggacu

SEQ ID NO: 271699 - RNA, 21 nt, Homo sapiens
ugcauuguugcugagagcagg

SEQ ID NO: 271700 - RNA, 22 nt, Homo sapiens
ugccaagaacauuuucuguuuu

SEQ ID NO: 271701 - RNA, 22 nt, Homo sapiens
ugccaaggagucagucccuaga

SEQ ID NO: 271702 - RNA, 22 nt, Homo sapiens
ugccauagagauuuguggaacu

SEQ ID NO: 271703 - RNA, 22 nt, Homo sapiens
ugccuaggcuggaaugcagugg

SEQ ID NO: 271704 - RNA, 22 nt, Homo sapiens
ugccuucuguuaaacgaggaug

SEQ ID NO: 271705 - RNA, 22 nt, Homo sapiens
ugcuagaagaucacacacauca

SEQ ID NO: 271706 - RNA, 22 nt, Homo sapiens
ugcugguguggucuagccgcuu

SEQ ID NO: 271707 - RNA, 18 nt, Homo sapiens
ugcuuagucauuuucaau

SEQ ID NO: 271708 - RNA, 22 nt, Homo sapiens
ugcuugagacacauaugaauuu

SEQ ID NO: 271709 - RNA, 22 nt, Homo sapiens
gugugcaugucuuuuuaguagg

SEQ ID NO: 271710 - RNA, 21 nt, Homo sapiens
gugugcuugaauucagcuguc

SEQ ID NO: 271711 - RNA, 21 nt, Homo sapiens
gugugcuugagugaugggauu

SEQ ID NO: 271712 - RNA, 22 nt, Homo sapiens
guguugcacauucuguggaugu

SEQ ID NO: 271713 - RNA, 22 nt, Homo sapiens
guuaagaaguguaacuuaaguu

SEQ ID NO: 271714 - RNA, 22 nt, Homo sapiens
guucagguauucuggaacagag

SEQ ID NO: 271715 - RNA, 22 nt, Homo sapiens
guuuguaacucuagugacuaga

SEQ ID NO: 271716 - RNA, 21 nt, Homo sapiens
uaaaacuguaacuuuguccug

SEQ ID NO: 271717 - RNA, 22 nt, Homo sapiens
uaaagccagugauuaugucucu

SEQ ID NO: 271718 - RNA, 22 nt, Homo sapiens
uaaagugaggauggcaguaggu

SEQ ID NO: 271719 - RNA, 22 nt, Homo sapiens
uaacaguguauuccuuuggaca

SEQ ID NO: 271720 - RNA, 22 nt, Homo sapiens
uaacaguguauuuacuacuucc

SEQ ID NO: 271721 - RNA, 22 nt, Homo sapiens
uaacuacuucugcuucagagua

SEQ ID NO: 271722 - RNA, 22 nt, Homo sapiens
uaagacucuggacucuaauguu

SEQ ID NO: 271723 - RNA, 22 nt, Homo sapiens
uaaggaguagaauaguaaggca

SEQ ID NO: 271724 - RNA, 22 nt, Homo sapiens
uaaggcacauaggccuggaaac

SEQ ID NO: 271725 - RNA, 22 nt, Homo sapiens
uaaggcacccuucugaguagag

SEQ ID NO: 271726 - RNA, 22 nt, Homo sapiens
uaagguccuuaaauguguaacc

SEQ ID NO: 271727 - RNA, 22 nt, Homo sapiens
uaaguacuuuacagacauuauc

SEQ ID NO: 271728 - RNA, 20 nt, Homo sapiens
uaagugcuuuauauugauua

SEQ ID NO: 271729 - RNA, 22 nt, Homo sapiens
uaauugcaguucuguguuauau

SEQ ID NO: 271730 - RNA, 22 nt, Homo sapiens
uacaaaucuagguuuguuacug

SEQ ID NO: 271731 - RNA, 22 nt, Homo sapiens
uacaacacugguucgacaugug

SEQ ID NO: 271732 - RNA, 22 nt, Homo sapiens
uacaagcaggaaaugguauaug

SEQ ID NO: 271733 - RNA, 23 nt, Homo sapiens
uacagcugcagaaucaggcuaag

SEQ ID NO: 271734 - RNA, 22 nt, Homo sapiens
uacaggacuauagaacuuuccc

SEQ ID NO: 271735 - RNA, 22 nt, Homo sapiens
uacagugcuuuuugguggagaa

SEQ ID NO: 271736 - RNA, 22 nt, Homo sapiens
uacauugucauauucucucucu

SEQ ID NO: 271737 - RNA, 22 nt, Homo sapiens
uacuagaguagugcagagggga

SEQ ID NO: 271738 - RNA, 22 nt, Homo sapiens
uacuguacugcaguucugcaaa

SEQ ID NO: 271739 - RNA, 22 nt, Homo sapiens
uagaaugaaacaagcugugccu

SEQ ID NO: 271740 - RNA, 22 nt, Homo sapiens
uagaaugucagcuucuugaggg

SEQ ID NO: 271741 - RNA, 22 nt, Homo sapiens
uagagguauuaacaguagaaga

SEQ ID NO: 271742 - RNA, 21 nt, Homo sapiens
uagauacuguauuaaaccuag

SEQ ID NO: 271743 - RNA, 20 nt, Homo sapiens
uagaugcauuuagauucauu

SEQ ID NO: 271744 - RNA, 19 nt, Homo sapiens
uagaugucuuugcauagau

SEQ ID NO: 271745 - RNA, 22 nt, Homo sapiens
uagcaaaucaauggaauugaag

SEQ ID NO: 271746 - RNA, 22 nt, Homo sapiens
uagcaacauucagcucagguac

SEQ ID NO: 271747 - RNA, 22 nt, Homo sapiens
uagcaagaugaauuugugcaaa

SEQ ID NO: 271748 - RNA, 22 nt, Homo sapiens
uagcacaucccuaaaaugcugu

SEQ ID NO: 271749 - RNA, 22 nt, Homo sapiens
uagcaccucuuuggccuuucgu

SEQ ID NO: 271750 - RNA, 22 nt, Homo sapiens
uagcagcaaagcaggaucugcu

SEQ ID NO: 271751 - RNA, 22 nt, Homo sapiens
uagcagcaucucuggcuucuac

SEQ ID NO: 271752 - RNA, 22 nt, Homo sapiens
uagcagccaggaagggcuggcu

SEQ ID NO: 271753 - RNA, 22 nt, Homo sapiens
uagcugcacuuacaagugagaa

SEQ ID NO: 271754 - RNA, 19 nt, Homo sapiens
uaggacccugguggccccc

SEQ ID NO: 271755 - RNA, 22 nt, Homo sapiens
uaggcaaguugcccaaucucuc

SEQ ID NO: 271756 - RNA, 22 nt, Homo sapiens
uaggcagccagcuguggauuga

SEQ ID NO: 271757 - RNA, 22 nt, Homo sapiens
uaggccuuuuucagauggguag

SEQ ID NO: 271758 - RNA, 22 nt, Homo sapiens
uaggucuuuuaugaaauauauu

SEQ ID NO: 271759 - RNA, 22 nt, Homo sapiens
uaguuuaucuucuggauggaca

SEQ ID NO: 271760 - RNA, 22 nt, Homo sapiens
uauaagacuagcagcugaauug

SEQ ID NO: 271761 - RNA, 22 nt, Homo sapiens
uaucacacgccuugcuucauuu

SEQ ID NO: 271762 - RNA, 22 nt, Homo sapiens
uaucacaggucaggaaucuugc

SEQ ID NO: 271763 - RNA, 22 nt, Homo sapiens
uaucacaguaucuagcacagug

SEQ ID NO: 271764 - RNA, 22 nt, Homo sapiens
uaucacagugcuggaguauucc

SEQ ID NO: 271765 - RNA, 22 nt, Homo sapiens
uaucucuguggguagugcugaa

SEQ ID NO: 271766 - RNA, 22 nt, Homo sapiens
uaugaugcuguuuagaaucucu

SEQ ID NO: 271767 - RNA, 22 nt, Homo sapiens
uauggcauuguuggugaugaua

SEQ ID NO: 271768 - RNA, 22 nt, Homo sapiens
uauggcccuuaaguauugguug

SEQ ID NO: 271769 - RNA, 22 nt, Homo sapiens
uauggcuauggcuguggcuaug

SEQ ID NO: 271770 - RNA, 22 nt, Homo sapiens
uauggcugcuuucacacuacaa

SEQ ID NO: 271771 - RNA, 22 nt, Homo sapiens
uaugguuuuaagguuaaggacu

SEQ ID NO: 271772 - RNA, 22 nt, Homo sapiens
uaugugcacaugcccuggugac

SEQ ID NO: 271773 - RNA, 20 nt, Homo sapiens
uauucacucuccagucuugc

SEQ ID NO: 271774 - RNA, 22 nt, Homo sapiens
ucaaaguaaagccucaggaugg

SEQ ID NO: 271775 - RNA, 22 nt, Homo sapiens
ucaaagugcuauggcucagguu

SEQ ID NO: 271776 - RNA, 20 nt, Homo sapiens
ucaaggcaggaacuguacau

SEQ ID NO: 271777 - RNA, 18 nt, Homo sapiens
ucaauguggauguucuuu

SEQ ID NO: 271778 - RNA, 22 nt, Homo sapiens
ucacaaagcuuggccugcuucu

SEQ ID NO: 271779 - RNA, 22 nt, Homo sapiens
ucacaauucacuacaggcuuga

SEQ ID NO: 271780 - RNA, 22 nt, Homo sapiens
ucacaccauucuucuacuucag

SEQ ID NO: 271781 - RNA, 22 nt, Homo sapiens
ucacagacauugaggggaccuu

SEQ ID NO: 271782 - RNA, 22 nt, Homo sapiens
ucacagauaaauaaagaugauu

SEQ ID NO: 271783 - RNA, 17 nt, Homo sapiens
ucacaguguuaggauga

SEQ ID NO: 271784 - RNA, 22 nt, Homo sapiens
ucacaguucagcauggcugagg

SEQ ID NO: 271785 - RNA, 21 nt, Homo sapiens
ucacaucguuuagcugugccu

SEQ ID NO: 271786 - RNA, 22 nt, Homo sapiens
ucacauguguaaauugguguaa

SEQ ID NO: 271787 - RNA, 20 nt, Homo sapiens
ucacccugacaucugcccag

SEQ ID NO: 271788 - RNA, 22 nt, Homo sapiens
ucacugaaacuguccuggguua

SEQ ID NO: 271789 - RNA, 22 nt, Homo sapiens
ucacugagcacaggagaugugc

SEQ ID NO: 271790 - RNA, 19 nt, Homo sapiens
ucacuggacagcacacuca

SEQ ID NO: 271791 - RNA, 22 nt, Homo sapiens
ucacuggaggagaggaagugga

SEQ ID NO: 271792 - RNA, 22 nt, Homo sapiens
ucacugugguuuugaugugcau

SEQ ID NO: 271793 - RNA, 22 nt, Homo sapiens
ucagaguagcugucugaggugc

SEQ ID NO: 271794 - RNA, 22 nt, Homo sapiens
ucagaguaguuccuggcagaaa

SEQ ID NO: 271795 - RNA, 22 nt, Homo sapiens
ucagggacgcuugacacaagcc

SEQ ID NO: 271796 - RNA, 22 nt, Homo sapiens
caauggcacgaucucgucucac

SEQ ID NO: 271797 - RNA, 22 nt, Homo sapiens
cacagcuagucaaugguagaca

SEQ ID NO: 271798 - RNA, 22 nt, Homo sapiens
caccaaccucaguagcaucugu

SEQ ID NO: 271799 - RNA, 23 nt, Homo sapiens
caccaguagaaugugugggaggg

SEQ ID NO: 271800 - RNA, 22 nt, Homo sapiens
cacugcacuccagccuaagagg

SEQ ID NO: 271801 - RNA, 22 nt, Homo sapiens
cacugcacuccagcuugugggc

SEQ ID NO: 271802 - RNA, 22 nt, Homo sapiens
cacugcgaccuccaccucccgg

SEQ ID NO: 271803 - RNA, 22 nt, Homo sapiens
cagagaacauucagagcuguag

SEQ ID NO: 271804 - RNA, 22 nt, Homo sapiens
cagagguauugcaaaagccuag

SEQ ID NO: 271805 - RNA, 22 nt, Homo sapiens
cagcaaaucauccuauuugagc

SEQ ID NO: 271806 - RNA, 22 nt, Homo sapiens
cagguaguauuugguuacauaa

SEQ ID NO: 271807 - RNA, 19 nt, Homo sapiens
caguaucauugcacauagu

SEQ ID NO: 271808 - RNA, 20 nt, Homo sapiens
cagugcacuuucccacuggu

SEQ ID NO: 271809 - RNA, 22 nt, Homo sapiens
cauacaugugcuugucuuaugc

SEQ ID NO: 271810 - RNA, 22 nt, Homo sapiens
cauagcacugagcucuacccuc

SEQ ID NO: 271811 - RNA, 18 nt, Homo sapiens
cauagcacuucagcacau

SEQ ID NO: 271812 - RNA, 22 nt, Homo sapiens
caucccauucgaggggcacagc

SEQ ID NO: 271813 - RNA, 22 nt, Homo sapiens
caugaaagacugaggaauugga

SEQ ID NO: 271814 - RNA, 22 nt, Homo sapiens
caugaaagugagaaacuccugg

SEQ ID NO: 271815 - RNA, 22 nt, Homo sapiens
caugcacugaguccaccucugg

SEQ ID NO: 271816 - RNA, 22 nt, Homo sapiens
cauggcacuguaugaaaugugc

SEQ ID NO: 271817 - RNA, 22 nt, Homo sapiens
cauggcucuuguuuacucccag

SEQ ID NO: 271818 - RNA, 22 nt, Homo sapiens
cauggcucuuugcugcuaaagu

SEQ ID NO: 271819 - RNA, 22 nt, Homo sapiens
caugggacugucuuggcuauac

SEQ ID NO: 271820 - RNA, 22 nt, Homo sapiens
caugucuuuuaaacauucaacu

SEQ ID NO: 271821 - RNA, 22 nt, Homo sapiens
ccaagugcuuaaaauuucauuu

SEQ ID NO: 271822 - RNA, 22 nt, Homo sapiens
ccacagucuaugcaacaagguc

SEQ ID NO: 271823 - RNA, 22 nt, Homo sapiens
ccacaguggauuaaaguuacug

SEQ ID NO: 271824 - RNA, 22 nt, Homo sapiens
ccacccuuccauucuuccucuu

SEQ ID NO: 271825 - RNA, 22 nt, Homo sapiens
ccacugcacuccagcccggcaa

SEQ ID NO: 271826 - RNA, 18 nt, Homo sapiens
ccagugcaaggaaagccc

SEQ ID NO: 271827 - RNA, 22 nt, Homo sapiens
ccagugcugugcaguguaugag

SEQ ID NO: 271828 - RNA, 22 nt, Homo sapiens
ccagugguucccuguggccuga

SEQ ID NO: 271829 - RNA, 17 nt, Homo sapiens
ccccugagcgaugcagu

SEQ ID NO: 271830 - RNA, 22 nt, Homo sapiens
cccucgagaaaccaucugcuga

SEQ ID NO: 271831 - RNA, 22 nt, Homo sapiens
cccugagagcagggucuuucuc

SEQ ID NO: 271832 - RNA, 22 nt, Homo sapiens
cccugagcagccugaguuuccc

SEQ ID NO: 271833 - RNA, 21 nt, Homo sapiens
cccugguguuuggaguuugag

SEQ ID NO: 271834 - RNA, 22 nt, Homo sapiens
ccucccuuuguugcaagggaaa

SEQ ID NO: 271835 - RNA, 22 nt, Homo sapiens
ccugucuugauuaaauuacuua

SEQ ID NO: 271836 - RNA, 22 nt, Homo sapiens
acagugcugucugcuuuggcua

SEQ ID NO: 271837 - RNA, 22 nt, Homo sapiens
acaucaggcuugugaugauuac

SEQ ID NO: 271838 - RNA, 22 nt, Homo sapiens
auaucacagguguuuaccugau

SEQ ID NO: 271839 - RNA, 22 nt, Homo sapiens
auauggcauucagaacuguaua

SEQ ID NO: 271840 - RNA, 20 nt, Homo sapiens
ucucccaaacagcaggcccu

SEQ ID NO: 271841 - RNA, 22 nt, Homo sapiens
ucucugagaccacuccaaacuc

SEQ ID NO: 271842 - RNA, 22 nt, Homo sapiens
ucucuguuuauuuuugguguau

SEQ ID NO: 271843 - RNA, 22 nt, Homo sapiens
ucucuuggcggaaguugcagug

SEQ ID NO: 271844 - RNA, 22 nt, Homo sapiens
ucucuugguugaacaguuugga

SEQ ID NO: 271845 - RNA, 22 nt, Homo sapiens
ucugacacagugauuaguaaau

SEQ ID NO: 271846 - RNA, 22 nt, Homo sapiens
ucugacucuggagucucagguu

SEQ ID NO: 271847 - RNA, 22 nt, Homo sapiens
ucugguguuauucauguaguuu

SEQ ID NO: 271848 - RNA, 22 nt, Homo sapiens
ucugucacugguggacgaucac

SEQ ID NO: 271849 - RNA, 22 nt, Homo sapiens
ucuguggucagcauccgccacu

SEQ ID NO: 271850 - RNA, 22 nt, Homo sapiens
ucugugguucaggcuggagugc

SEQ ID NO: 271851 - RNA, 22 nt, Homo sapiens
ucuguguugaucacacugggag

SEQ ID NO: 271852 - RNA, 22 nt, Homo sapiens
ucuguguuugaucaagauugua

SEQ ID NO: 271853 - RNA, 22 nt, Homo sapiens
ucuuaguuuagauuagcaauuc

SEQ ID NO: 271854 - RNA, 22 nt, Homo sapiens
ucuucagucauauuggccugga

SEQ ID NO: 271855 - RNA, 22 nt, Homo sapiens
ucuugcaguucccaaauucaca

SEQ ID NO: 271856 - RNA, 22 nt, Homo sapiens
ucuugucacugcauccccagcu

SEQ ID NO: 271857 - RNA, 22 nt, Homo sapiens
ucuuuagugacaguugugcaag

SEQ ID NO: 271858 - RNA, 22 nt, Homo sapiens
ucuuugauguucugaaagaugg

SEQ ID NO: 271859 - RNA, 22 nt, Homo sapiens
ucuuugggauauucugaaaggg

SEQ ID NO: 271860 - RNA, 22 nt, Homo sapiens
ucuuuguguaggucaaucuggc

SEQ ID NO: 271861 - RNA, 22 nt, Homo sapiens
ugaaauacuuuggcucuuuguu

SEQ ID NO: 271862 - RNA, 22 nt, Homo sapiens
ugaaaugguuaugugaggagau

SEQ ID NO: 271863 - RNA, 22 nt, Homo sapiens
ugaacagucaucucucuuguau

SEQ ID NO: 271864 - RNA, 22 nt, Homo sapiens
ugaauauagacagggguagaga

SEQ ID NO: 271865 - RNA, 22 nt, Homo sapiens
ugacacuugcccuuagaaacau

SEQ ID NO: 271866 - RNA, 22 nt, Homo sapiens
ugacaggagauuaugugauguu

SEQ ID NO: 271867 - RNA, 22 nt, Homo sapiens
ugacaguaucuacagcuucuua

SEQ ID NO: 271868 - RNA, 22 nt, Homo sapiens
ugacagucaccaggacccacag

SEQ ID NO: 271869 - RNA, 22 nt, Homo sapiens
ugacuaguuggauaaccuagga

SEQ ID NO: 271870 - RNA, 21 nt, Homo sapiens
ugagaacaacaggucaagcag

SEQ ID NO: 271871 - RNA, 17 nt, Homo sapiens
ugagaacaugugguauu

SEQ ID NO: 271872 - RNA, 19 nt, Homo sapiens
ugagaacaugugguauuug

SEQ ID NO: 271873 - RNA, 20 nt, Homo sapiens
ugagaacaugugguauuugg

SEQ ID NO: 271874 - RNA, 18 nt, Homo sapiens
ugagaacauguguacaca

SEQ ID NO: 271875 - RNA, 22 nt, Homo sapiens
ugagaauauuuuccaugucuca

SEQ ID NO: 271876 - RNA, 19 nt, Homo sapiens
ugagaauguuaccaggucc

SEQ ID NO: 271877 - RNA, 22 nt, Homo sapiens
ugagacugagucucgcucuugu

SEQ ID NO: 271878 - RNA, 22 nt, Homo sapiens
ugagacugaguuucgcucuugu

SEQ ID NO: 271879 - RNA, 22 nt, Homo sapiens
ugagacugguaauguguagggc

SEQ ID NO: 271880 - RNA, 22 nt, Homo sapiens
ugagagacaguuucgucggagg

SEQ ID NO: 271881 - RNA, 22 nt, Homo sapiens
ugagagacauuuguuguagagu

SEQ ID NO: 271882 - RNA, 22 nt, Homo sapiens
ugagaguagggguugggauugg

SEQ ID NO: 271883 - RNA, 22 nt, Homo sapiens
ugagaucaugccacugcacuuc

SEQ ID NO: 271884 - RNA, 22 nt, Homo sapiens
ugagaugagggcugcacucaaa

SEQ ID NO: 271885 - RNA, 22 nt, Homo sapiens
ugagaugcauauucuggcuccu

SEQ ID NO: 271886 - RNA, 22 nt, Homo sapiens
ugagauggaguuucacuuuugu

SEQ ID NO: 271887 - RNA, 22 nt, Homo sapiens
ugagauggaucuuggauuugaa

SEQ ID NO: 271888 - RNA, 22 nt, Homo sapiens
ugagauggcuuuauugcugaau

SEQ ID NO: 271889 - RNA, 22 nt, Homo sapiens
ugagauggguaauuaaauggug

SEQ ID NO: 271890 - RNA, 22 nt, Homo sapiens
ugagaugguaaauuuuuguugu

SEQ ID NO: 271891 - RNA, 22 nt, Homo sapiens
ugagauguuccaaugacuauua

SEQ ID NO: 271892 - RNA, 22 nt, Homo sapiens
ugagauuguuagaucaaauggu

SEQ ID NO: 271893 - RNA, 22 nt, Homo sapiens
ugagcagaaguuuugauuggcg

SEQ ID NO: 271894 - RNA, 22 nt, Homo sapiens
ugagcagagaucacggcauugu

SEQ ID NO: 271895 - RNA, 22 nt, Homo sapiens
ugagcagaguuguuucuccuga

SEQ ID NO: 271896 - RNA, 22 nt, Homo sapiens
ugagccaaguucacaccauugc

SEQ ID NO: 271897 - RNA, 20 nt, Homo sapiens
ugagccccuggacucaagcg

SEQ ID NO: 271898 - RNA, 22 nt, Homo sapiens
ugagcugagauuaagcugcugc

SEQ ID NO: 271899 - RNA, 22 nt, Homo sapiens
ugaggaguauguucuguagacc

SEQ ID NO: 271900 - RNA, 22 nt, Homo sapiens
ugaggcaaggcugaaugaaggc

SEQ ID NO: 271901 - RNA, 22 nt, Homo sapiens
ugagguaaugcuguagcuguga

SEQ ID NO: 271902 - RNA, 22 nt, Homo sapiens
ugaggugagauggcuaccccaa

SEQ ID NO: 271903 - RNA, 22 nt, Homo sapiens
uggaaaauuaggggagguuaua

SEQ ID NO: 271904 - RNA, 22 nt, Homo sapiens
uggaaaguaguucuaaucuaag

SEQ ID NO: 271905 - RNA, 22 nt, Homo sapiens
uggaagacaaguguuagcaugg

SEQ ID NO: 271906 - RNA, 22 nt, Homo sapiens
uggaagacauuuuggaccuugg

SEQ ID NO: 271907 - RNA, 20 nt, Homo sapiens
uggaagccuggugcuaucuu

SEQ ID NO: 271908 - RNA, 22 nt, Homo sapiens
uggaaguaaucaugagguagca

SEQ ID NO: 271909 - RNA, 22 nt, Homo sapiens
uggaaguagauagauuguguca

SEQ ID NO: 271910 - RNA, 21 nt, Homo sapiens
uggaaucuauagaggcaguag

SEQ ID NO: 271911 - RNA, 22 nt, Homo sapiens
uggacaugaagggcacaggagg

SEQ ID NO: 271912 - RNA, 22 nt, Homo sapiens
uggagguaggugauauguagca

SEQ ID NO: 271913 - RNA, 22 nt, Homo sapiens
uggagugcaauggugagaucuu

SEQ ID NO: 271914 - RNA, 22 nt, Homo sapiens
uggaguguuggggcaggaucuc

SEQ ID NO: 271915 - RNA, 22 nt, Homo sapiens
uggauuuuaauuauucugucau

SEQ ID NO: 271916 - RNA, 22 nt, Homo sapiens
uggcaaaugaaagaaagccagu

SEQ ID NO: 271917 - RNA, 22 nt, Homo sapiens
uggcaaauguaguacccaauag

SEQ ID NO: 271918 - RNA, 22 nt, Homo sapiens
uggcaacaucuggggacauguu

SEQ ID NO: 271919 - RNA, 18 nt, Homo sapiens
uggcaagugccauacggu

SEQ ID NO: 271920 - RNA, 22 nt, Homo sapiens
uggcaauauccacaauuacuuu

SEQ ID NO: 271921 - RNA, 22 nt, Homo sapiens
uggcaggugcacuggcuuugaa

SEQ ID NO: 271922 - RNA, 22 nt, Homo sapiens
uggcaugcauuguggguaauua

SEQ ID NO: 271923 - RNA, 22 nt, Homo sapiens
uggcauuuugugugaauuagaa

SEQ ID NO: 271924 - RNA, 22 nt, Homo sapiens
uggccaguguuuuuccugggcu

SEQ ID NO: 271925 - RNA, 21 nt, Homo sapiens
uggcuauuucuguggcauaca

SEQ ID NO: 271926 - RNA, 20 nt, Homo sapiens
ugggaacaugugguauaugg

SEQ ID NO: 271927 - RNA, 20 nt, Homo sapiens
uggucaccuucaggagguuc

SEQ ID NO: 271928 - RNA, 22 nt, Homo sapiens
uguaaacucaguauguuuuacu

SEQ ID NO: 271929 - RNA, 22 nt, Homo sapiens
uguagacagcacguaguugagu

SEQ ID NO: 271930 - RNA, 22 nt, Homo sapiens
ugucagcacaacucagguuccu

SEQ ID NO: 271931 - RNA, 22 nt, Homo sapiens
ugucauggugcucugggcccug

SEQ ID NO: 271932 - RNA, 22 nt, Homo sapiens
uguccuagagggaugucacccc

SEQ ID NO: 271933 - RNA, 22 nt, Homo sapiens
ugugaacagaauuagucaccua

SEQ ID NO: 271934 - RNA, 18 nt, Homo sapiens
ugugacauugagcauguc

SEQ ID NO: 271935 - RNA, 22 nt, Homo sapiens
ugugcuauguuauucacauggg

SEQ ID NO: 271936 - RNA, 22 nt, Homo sapiens
ugugcuugaaauucaguuuuga

SEQ ID NO: 271937 - RNA, 22 nt, Homo sapiens
ugugcuuguaaaggccagagca

SEQ ID NO: 271938 - RNA, 22 nt, Homo sapiens
ugugucacugcacuccagcgug

SEQ ID NO: 271939 - RNA, 22 nt, Homo sapiens
uguucauggauccaguggcuuc

SEQ ID NO: 271940 - RNA, 22 nt, Homo sapiens
uguuuguuugugauacgguaca

SEQ ID NO: 271941 - RNA, 22 nt, Homo sapiens
uuaacaguuaauucuuuggcaa

SEQ ID NO: 271942 - RNA, 22 nt, Homo sapiens
uuaaggcuuucccuauguaaaa

SEQ ID NO: 271943 - RNA, 22 nt, Homo sapiens
uuaaggugaaguucucagaugc

SEQ ID NO: 271944 - RNA, 22 nt, Homo sapiens
uuaauguaauugauugauugac

SEQ ID NO: 271945 - RNA, 22 nt, Homo sapiens
uuaauguaucuaucacaucaca

SEQ ID NO: 271946 - RNA, 22 nt, Homo sapiens
uuacagcagugccccacuccca

SEQ ID NO: 271947 - RNA, 22 nt, Homo sapiens
uuacagcugcuccccaucacuc

SEQ ID NO: 271948 - RNA, 22 nt, Homo sapiens
uuagaacagugcucaccacaaa

SEQ ID NO: 271949 - RNA, 18 nt, Homo sapiens
uuagaugguuuuaaaacu

SEQ ID NO: 271950 - RNA, 22 nt, Homo sapiens
uuagcacaucuuucuauguaag

SEQ ID NO: 271951 - RNA, 22 nt, Homo sapiens
uuaugccagugauuauaagggc

SEQ ID NO: 271952 - RNA, 22 nt, Homo sapiens
uucaagcugggcaaauaagggg

SEQ ID NO: 271953 - RNA, 22 nt, Homo sapiens
uucaaggacuaaggauuuuugg

SEQ ID NO: 271954 - RNA, 22 nt, Homo sapiens
uucagcacaguguggaucauuc

SEQ ID NO: 271955 - RNA, 22 nt, Homo sapiens
uucagggacuuuagacaagaga

SEQ ID NO: 271956 - RNA, 23 nt, Homo sapiens
uucaguauugaaugauggcgcug

SEQ ID NO: 271957 - RNA, 22 nt, Homo sapiens
uucaguggacuuaguagugcuu

SEQ ID NO: 271958 - RNA, 22 nt, Homo sapiens
uucauagaggacauuacuggag

SEQ ID NO: 271959 - RNA, 22 nt, Homo sapiens
uucauaguauuuuucuccaaau

SEQ ID NO: 271960 - RNA, 22 nt, Homo sapiens
uucauagucuaugcaaguaaga

SEQ ID NO: 271961 - RNA, 22 nt, Homo sapiens
uugagauguggguuggugacuu

SEQ ID NO: 271962 - RNA, 22 nt, Homo sapiens
uugagcaaugucacugaggcuu

SEQ ID NO: 271963 - RNA, 22 nt, Homo sapiens
uugaggcaaugaggagaagcug

SEQ ID NO: 271964 - RNA, 22 nt, Homo sapiens
uugagggaggcagggcuugucu

SEQ ID NO: 271965 - RNA, 22 nt, Homo sapiens
uugaguauuugcagucugaaca

SEQ ID NO: 271966 - RNA, 18 nt, Homo sapiens
uugcacuccugccugggu

SEQ ID NO: 271967 - RNA, 19 nt, Homo sapiens
uugcauauguugaaccagg

SEQ ID NO: 271968 - RNA, 22 nt, Homo sapiens
uugcauugacacaugaagcuca

SEQ ID NO: 271969 - RNA, 22 nt, Homo sapiens
uugcuccucugccaggaccugu

SEQ ID NO: 271970 - RNA, 22 nt, Homo sapiens
uugcuuaggcuggagugcagug

SEQ ID NO: 271971 - RNA, 22 nt, Homo sapiens
uuggaaacaccuggugagguua

SEQ ID NO: 271972 - RNA, 22 nt, Homo sapiens
uuggaaauguguuugcauucag

SEQ ID NO: 271973 - RNA, 22 nt, Homo sapiens
uuggaaugcacacugagccugc

SEQ ID NO: 271974 - RNA, 22 nt, Homo sapiens
uuggagagaaaggcaguuccug

SEQ ID NO: 271975 - RNA, 22 nt, Homo sapiens
uuggagugugcucauaacugcu

SEQ ID NO: 271976 - RNA, 22 nt, Homo sapiens
uuggcauugaguuucaaaucau

SEQ ID NO: 271977 - RNA, 23 nt, Homo sapiens
uuggccuccuugugucuagggcu

SEQ ID NO: 271978 - RNA, 22 nt, Homo sapiens
uuggcuuuuaugcagcuuaggu

SEQ ID NO: 271979 - RNA, 23 nt, Homo sapiens
uugggcaaaucacugagggcaga

SEQ ID NO: 271980 - RNA, 22 nt, Homo sapiens
uuggucagcuagauuauucccu

SEQ ID NO: 271981 - RNA, 22 nt, Homo sapiens
uuggucaggcuaaucucgaacg

SEQ ID NO: 271982 - RNA, 22 nt, Homo sapiens
uuguagcaaauauauuuuggaa

SEQ ID NO: 271983 - RNA, 22 nt, Homo sapiens
uuguagcaaauguguaaacaaa

SEQ ID NO: 271984 - RNA, 21 nt, Homo sapiens
uuguagcagcauaaucccaga

SEQ ID NO: 271985 - RNA, 22 nt, Homo sapiens
uugucauuuucagaguguuacg

SEQ ID NO: 271986 - RNA, 22 nt, Homo sapiens
uuguccuggagguucuugcaag

SEQ ID NO: 271987 - RNA, 22 nt, Homo sapiens
uugugcaugaugcauacauggu

SEQ ID NO: 271988 - RNA, 19 nt, Homo sapiens
uugugggaggacagagggg

SEQ ID NO: 271989 - RNA, 22 nt, Homo sapiens
uuuaaugcaucccaaaauguag

SEQ ID NO: 271990 - RNA, 22 nt, Homo sapiens
uuuaaugcugcccagucauggg

SEQ ID NO: 271991 - RNA, 22 nt, Homo sapiens
uuuaauguuacaguauugguau

SEQ ID NO: 271992 - RNA, 22 nt, Homo sapiens
uuucagagucaucugcccaagu

SEQ ID NO: 271993 - RNA, 22 nt, Homo sapiens
uuucaguagagacacgguuuug

SEQ ID NO: 271994 - RNA, 22 nt, Homo sapiens
uuucauguuuuucugugaggca

SEQ ID NO: 271995 - RNA, 19 nt, Homo sapiens
uuucauguuuuuggugaga

SEQ ID NO: 271996 - RNA, 17 nt, Homo sapiens
uuucucagcccucuucu

SEQ ID NO: 271997 - RNA, 22 nt, Homo sapiens
uuugaaugcaacaaaugcggga

SEQ ID NO: 271998 - RNA, 22 nt, Homo sapiens
uuugaauggaaguuuugugaaa

SEQ ID NO: 271999 - RNA, 20 nt, Homo sapiens
uuugaauguaaagcauguca

SEQ ID NO: 272000 - RNA, 22 nt, Homo sapiens
uuugagauaucuuccaucagua

SEQ ID NO: 272001 - RNA, 22 nt, Homo sapiens
uuugauguugauacuaccuuca

SEQ ID NO: 272002 - RNA, 19 nt, Homo sapiens
uuugccuaggcacauggcc

SEQ ID NO: 272003 - RNA, 22 nt, Homo sapiens
uuugcuucacuguuuggcaaaa

SEQ ID NO: 272004 - RNA, 22 nt, Homo sapiens
uuuggcagaaaacaagaaucug

SEQ ID NO: 272005 - RNA, 22 nt, Homo sapiens
uuuggcagaaaacuaaaaggua

SEQ ID NO: 272006 - RNA, 22 nt, Homo sapiens
uuugggcuuuuaaucuagagca

SEQ ID NO: 272007 - RNA, 22 nt, Homo sapiens
uuugguuauauauauacacucu

SEQ ID NO: 272008 - RNA, 22 nt, Homo sapiens
uuugucacccugaauguaagau

SEQ ID NO: 272009 - RNA, 22 nt, Homo sapiens
uuugugagguggauagauugca

SEQ ID NO: 272010 - RNA, 22 nt, Homo sapiens
uuugugucccucuaaaauuuau

SEQ ID NO: 272011 - RNA, 22 nt, Homo sapiens
uuuguucuucguuccugagcca

SEQ ID NO: 272012 - RNA, 22 nt, Homo sapiens
uuuugcaguuacagagagugag

SEQ ID NO: 272013 - RNA, 22 nt, Homo sapiens
uuuuggacuucaauuugacacu

SEQ ID NO: 272014 - RNA, 22 nt, Homo sapiens
uuuugugcauggcccaguggua

SEQ ID NO: 272015 - RNA, 22 nt, Homo sapiens
ccagccgggugcaguggcucac

SEQ ID NO: 272016 - RNA, 22 nt, Homo sapiens
ccauggcuauucuguaaggguu

SEQ ID NO: 272017 - RNA, 21 nt, Homo sapiens
cccagguucucugaggguaga

SEQ ID NO: 272018 - RNA, 22 nt, Homo sapiens
cccagugugcugggugacagcu

SEQ ID NO: 272019 - RNA, 22 nt, Homo sapiens
cccaguguuacgugacagccug

SEQ ID NO: 272020 - RNA, 23 nt, Homo sapiens
cccucagaagugcagggagagaa

SEQ ID NO: 272021 - RNA, 22 nt, Homo sapiens
cccugaagaaagccuaggacau

SEQ ID NO: 272022 - RNA, 22 nt, Homo sapiens
cccugaagacuccaccgucaug

SEQ ID NO: 272023 - RNA, 22 nt, Homo sapiens
cccugagaugcuguuaaucugu

SEQ ID NO: 272024 - RNA, 19 nt, Homo sapiens
cccuggcacauggaaaaug

SEQ ID NO: 272025 - RNA, 22 nt, Homo sapiens
ccuaggcacugggguccagccc

SEQ ID NO: 272026 - RNA, 22 nt, Homo sapiens
ccugcauugucaaggccaagcc

SEQ ID NO: 272027 - RNA, 22 nt, Homo sapiens
ccuucuuuuguaaggcugaaua

SEQ ID NO: 272028 - RNA, 22 nt, Homo sapiens
ccuuuguuaguuugcugagaau

SEQ ID NO: 272029 - RNA, 22 nt, Homo sapiens
cgcuggugaucuagacccccaa

SEQ ID NO: 272030 - RNA, 22 nt, Homo sapiens
cuaaaguauugagugguaaaga

SEQ ID NO: 272031 - RNA, 22 nt, Homo sapiens
cuacagcagcccaguccccgaa

SEQ ID NO: 272032 - RNA, 23 nt, Homo sapiens
cuacagugccugucucuuuggcc

SEQ ID NO: 272033 - RNA, 22 nt, Homo sapiens
cuacaguguauuuauggagggu

SEQ ID NO: 272034 - RNA, 22 nt, Homo sapiens
cuagaggcacagccuaggcacu

SEQ ID NO: 272035 - RNA, 22 nt, Homo sapiens
cuaggaaguauguguuauugcu

SEQ ID NO: 272036 - RNA, 22 nt, Homo sapiens
cuauauacugccugcugauuag

SEQ ID NO: 272037 - RNA, 22 nt, Homo sapiens
cucagcaguggauuuaccacca

SEQ ID NO: 272038 - RNA, 22 nt, Homo sapiens
cucaggcacucugauuccagug

SEQ ID NO: 272039 - RNA, 22 nt, Homo sapiens
cucagucuaugauacuuugcua

SEQ ID NO: 272040 - RNA, 22 nt, Homo sapiens
cucagugucuggggccccaggg

SEQ ID NO: 272041 - RNA, 22 nt, Homo sapiens
cucauugcaaucuccaccuccc

SEQ ID NO: 272042 - RNA, 22 nt, Homo sapiens
cuccauagucuucgaagaauga

SEQ ID NO: 272043 - RNA, 22 nt, Homo sapiens
cuccauguggcuaacuuuuaaa

SEQ ID NO: 272044 - RNA, 21 nt, Homo sapiens
cucucugcuuaugaauaguga

SEQ ID NO: 272045 - RNA, 22 nt, Homo sapiens
cucucuguuugucuguuauugg

SEQ ID NO: 272046 - RNA, 22 nt, Homo sapiens
cugaauguccaggcagagguuu

SEQ ID NO: 272047 - RNA, 22 nt, Homo sapiens
cugacagaugacugccacugua

SEQ ID NO: 272048 - RNA, 22 nt, Homo sapiens
cugagacacucuuaucugcaua

SEQ ID NO: 272049 - RNA, 22 nt, Homo sapiens
cugagcccauucuggggagaag

SEQ ID NO: 272050 - RNA, 22 nt, Homo sapiens
cugaggacaucagggaagcauc

SEQ ID NO: 272051 - RNA, 22 nt, Homo sapiens
cugagguauuuaggugaaagaa

SEQ ID NO: 272052 - RNA, 22 nt, Homo sapiens
cugcauuugaugacguauggug

SEQ ID NO: 272053 - RNA, 22 nt, Homo sapiens
cuggagcaaaggugacucuugu

SEQ ID NO: 272054 - RNA, 22 nt, Homo sapiens
cuggccagagacauucauuaaa

SEQ ID NO: 272055 - RNA, 22 nt, Homo sapiens
cugucucagccucuccaguagc

SEQ ID NO: 272056 - RNA, 22 nt, Homo sapiens
cugugcauggauuuuaagauug

SEQ ID NO: 272057 - RNA, 22 nt, Homo sapiens
cugugcauguuguccaauucuu

SEQ ID NO: 272058 - RNA, 22 nt, Homo sapiens
cugugcauucuuaaaucaggaa

SEQ ID NO: 272059 - RNA, 19 nt, Homo sapiens
cugugcauuucuguggaag

SEQ ID NO: 272060 - RNA, 22 nt, Homo sapiens
cugugcuuggagucccccuagg

SEQ ID NO: 272061 - RNA, 22 nt, Homo sapiens
cuguguaguacuagauugagca

SEQ ID NO: 272062 - RNA, 22 nt, Homo sapiens
cuuccaaguggggcacgugcca

SEQ ID NO: 272063 - RNA, 22 nt, Homo sapiens
cuuccaguggcagccgggcaug

SEQ ID NO: 272064 - RNA, 22 nt, Homo sapiens
cuuccauaguuacacccaggga

SEQ ID NO: 272065 - RNA, 22 nt, Homo sapiens
cuucuugcuguguccucacaug

SEQ ID NO: 272066 - RNA, 22 nt, Homo sapiens
cuuggcacgugauagguguuga

SEQ ID NO: 272067 - RNA, 22 nt, Homo sapiens
cuugggauauguguuacucugu

SEQ ID NO: 272068 - RNA, 22 nt, Homo sapiens
cuuugcaaaacauugagaccuc

SEQ ID NO: 272069 - RNA, 20 nt, Homo sapiens
cuuuggcaaugagaacaggg

SEQ ID NO: 272070 - RNA, 22 nt, Homo sapiens
cuuuuggucuaucagagaagca

SEQ ID NO: 272071 - RNA, 22 nt, Homo sapiens
cuuuugugauuccucaguuacu

SEQ ID NO: 272072 - RNA, 22 nt, Homo sapiens
cuuuugugauucuucaguugcu

SEQ ID NO: 272073 - RNA, 22 nt, Homo sapiens
cuuuuguggaucuucuguugcu

SEQ ID NO: 272074 - RNA, 22 nt, Homo sapiens
gaaagacuuucugcuguggaua

SEQ ID NO: 272075 - RNA, 22 nt, Homo sapiens
gaacacaucuuugguuagagga

SEQ ID NO: 272076 - RNA, 22 nt, Homo sapiens
gaagaaguacaagacaaauuuu

SEQ ID NO: 272077 - RNA, 22 nt, Homo sapiens
gaaguaguaaaauuuauugcag

SEQ ID NO: 272078 - RNA, 22 nt, Homo sapiens
gaaucauuggguugauucaaga

SEQ ID NO: 272079 - RNA, 22 nt, Homo sapiens
gaaugcaugaggggaucagaug

SEQ ID NO: 272080 - RNA, 22 nt, Homo sapiens
gaccaaagaggcaggcauuaga

SEQ ID NO: 272081 - RNA, 18 nt, Homo sapiens
gacucaguuucuaaggca

SEQ ID NO: 272082 - RNA, 22 nt, Homo sapiens
gagaacagagauaauuuuacuu

SEQ ID NO: 272083 - RNA, 22 nt, Homo sapiens
gagaaugagaggggaaggccac

SEQ ID NO: 272084 - RNA, 22 nt, Homo sapiens
gagagguaguuuuuuggucguc

SEQ ID NO: 272085 - RNA, 22 nt, Homo sapiens
gagcaaaaguauguauugguua

SEQ ID NO: 272086 - RNA, 22 nt, Homo sapiens
gagcacauaugacauuuucuuc

SEQ ID NO: 272087 - RNA, 22 nt, Homo sapiens
gagcuaguguaauauuuugggg

SEQ ID NO: 272088 - RNA, 22 nt, Homo sapiens
gaggaaguagcuacugucuuuc

SEQ ID NO: 272089 - RNA, 22 nt, Homo sapiens
gaggucuuacauuuuaauauuu

SEQ ID NO: 272090 - RNA, 22 nt, Homo sapiens
gagugcaauggcaagaucuugg

SEQ ID NO: 272091 - RNA, 22 nt, Homo sapiens
gauaaaucuuggcuagucuaag

SEQ ID NO: 272092 - RNA, 22 nt, Homo sapiens
gauagcagccauucuuuuuauu

SEQ ID NO: 272093 - RNA, 22 nt, Homo sapiens
gauaugugauaagaguuaucuu

SEQ ID NO: 272094 - RNA, 22 nt, Homo sapiens
gauauguguaucuauguacaug

SEQ ID NO: 272095 - RNA, 22 nt, Homo sapiens
gauauguguuuuagucaggguu

SEQ ID NO: 272096 - RNA, 22 nt, Homo sapiens
gaucacaguuccucacgggcau

SEQ ID NO: 272097 - RNA, 22 nt, Homo sapiens
gaucucaguggauacugugaug

SEQ ID NO: 272098 - RNA, 22 nt, Homo sapiens
gaucugugugauuggaugcauu

SEQ ID NO: 272099 - RNA, 22 nt, Homo sapiens
gauggcuauucuuaccauuucu

SEQ ID NO: 272100 - RNA, 22 nt, Homo sapiens
gauguuguuuagccuuugaugu

SEQ ID NO: 272101 - RNA, 22 nt, Homo sapiens
gcaaaugcuaugccauuuuaua

SEQ ID NO: 272102 - RNA, 22 nt, Homo sapiens
ugagugaggcugggcagucccu

SEQ ID NO: 272103 - RNA, 17 nt, Homo sapiens
ugauaagugugagguga

SEQ ID NO: 272104 - RNA, 18 nt, Homo sapiens
ugauaucaucacaauuga

SEQ ID NO: 272105 - RNA, 22 nt, Homo sapiens
ugauaugaaagggaaauaagug

SEQ ID NO: 272106 - RNA, 22 nt, Homo sapiens
ugauauggcuuggcuaugucac

SEQ ID NO: 272107 - RNA, 22 nt, Homo sapiens
ugaucaaagugcuggaauuaca

SEQ ID NO: 272108 - RNA, 18 nt, Homo sapiens
ugauugacuuauuuaggu

SEQ ID NO: 272109 - RNA, 22 nt, Homo sapiens
ugcaaagaaauuuuggugacca

SEQ ID NO: 272110 - RNA, 18 nt, Homo sapiens
ugcaauggagaugcagcc

SEQ ID NO: 272111 - RNA, 22 nt, Homo sapiens
ugcagagucuguccugccugcc

SEQ ID NO: 272112 - RNA, 22 nt, Homo sapiens
ugcagcacuguucacaauagcc

SEQ ID NO: 272113 - RNA, 22 nt, Homo sapiens
ugcaguaggcccagcgggaggc

SEQ ID NO: 272114 - RNA, 22 nt, Homo sapiens
ugcaguagugugaucuuggcuc

SEQ ID NO: 272115 - RNA, 22 nt, Homo sapiens
ugcauacuguaugcgugcauac

SEQ ID NO: 272116 - RNA, 22 nt, Homo sapiens
ugccauagcaaugguaagcuga

SEQ ID NO: 272117 - RNA, 19 nt, Homo sapiens
ugccauguaacaggaaaau

SEQ ID NO: 272118 - RNA, 22 nt, Homo sapiens
ugccuacuuugcaucugucagg

SEQ ID NO: 272119 - RNA, 22 nt, Homo sapiens
ugccuaggcuggagugcagugg

SEQ ID NO: 272120 - RNA, 22 nt, Homo sapiens
ugccuaggcuggaguguagugg

SEQ ID NO: 272121 - RNA, 22 nt, Homo sapiens
ugccugagccagguuuuaggag

SEQ ID NO: 272122 - RNA, 21 nt, Homo sapiens
ugcuauguuguccaggcuggc

SEQ ID NO: 272123 - RNA, 22 nt, Homo sapiens
ugcugcaaacaggcaucugugg

SEQ ID NO: 272124 - RNA, 22 nt, Homo sapiens
ugcuggugauuaaauccugaag

SEQ ID NO: 272125 - RNA, 22 nt, Homo sapiens
ugcuuaguuguauguuccacau

SEQ ID NO: 272126 - RNA, 22 nt, Homo sapiens
ugcuuugguagaaaucuuuggu

SEQ ID NO: 272127 - RNA, 22 nt, Homo sapiens
uggaagacacauaccugauaac

SEQ ID NO: 272128 - RNA, 22 nt, Homo sapiens
uggaaguaaccaugaauggaau

SEQ ID NO: 272129 - RNA, 22 nt, Homo sapiens
uggaaucaucaacgaaugaaau

SEQ ID NO: 272130 - RNA, 20 nt, Homo sapiens
uggaaucuaggcggagguuu

SEQ ID NO: 272131 - RNA, 22 nt, Homo sapiens
uggaauggagagagggugcacg

SEQ ID NO: 272132 - RNA, 21 nt, Homo sapiens
uggaauuaauggagagguguu

SEQ ID NO: 272133 - RNA, 22 nt, Homo sapiens
uggagauguuuaaaauccacug

SEQ ID NO: 272134 - RNA, 18 nt, Homo sapiens
uggauuguacuguguucu

SEQ ID NO: 272135 - RNA, 22 nt, Homo sapiens
uggcaaaugaagucagcuguac

SEQ ID NO: 272136 - RNA, 21 nt, Homo sapiens
uggcaacauggauggauucug

SEQ ID NO: 272137 - RNA, 22 nt, Homo sapiens
uggcaagaacgaaauguagggu

SEQ ID NO: 272138 - RNA, 22 nt, Homo sapiens
uggcaguuuuugccuucaauac

SEQ ID NO: 272139 - RNA, 22 nt, Homo sapiens
uggccagugucuauugguuucc

SEQ ID NO: 272140 - RNA, 22 nt, Homo sapiens
uggccaguugaagacaaugcuc

SEQ ID NO: 272141 - RNA, 22 nt, Homo sapiens
uggcuaagaugcacacuucacu

SEQ ID NO: 272142 - RNA, 18 nt, Homo sapiens
uggcuacugaacuagaug

SEQ ID NO: 272143 - RNA, 22 nt, Homo sapiens
uggcucuguuuguuaacuagac

SEQ ID NO: 272144 - RNA, 22 nt, Homo sapiens
uggcuuuucauccugggacauu

SEQ ID NO: 272145 - RNA, 20 nt, Homo sapiens
ugggaaauguccaggacaua

SEQ ID NO: 272146 - RNA, 22 nt, Homo sapiens
ugggaagauucuguguuuuucc

SEQ ID NO: 272147 - RNA, 22 nt, Homo sapiens
ugggaagcugcauuuuaacaag

SEQ ID NO: 272148 - RNA, 22 nt, Homo sapiens
uggguaggaccagaaaugcacu

SEQ ID NO: 272149 - RNA, 22 nt, Homo sapiens
uggguaggcccucauuggacag

SEQ ID NO: 272150 - RNA, 20 nt, Homo sapiens
ugguaauguaagagaggaga

SEQ ID NO: 272151 - RNA, 22 nt, Homo sapiens
uggucaccugaauuaugcaugu

SEQ ID NO: 272152 - RNA, 21 nt, Homo sapiens
uggucccauaagauuacaaug

SEQ ID NO: 272153 - RNA, 21 nt, Homo sapiens
uggucccauaagauuauaaug

SEQ ID NO: 272154 - RNA, 22 nt, Homo sapiens
uggucccaugaacuuuagguca

SEQ ID NO: 272155 - RNA, 22 nt, Homo sapiens
uggugcccuguccuucuguggc

SEQ ID NO: 272156 - RNA, 22 nt, Homo sapiens
ugguguccugucucugcgcuug

SEQ ID NO: 272157 - RNA, 16 nt, Homo sapiens
uguaaauguuuugcau

SEQ ID NO: 272158 - RNA, 22 nt, Homo sapiens
uguaaugaucaaaucagaguaa

SEQ ID NO: 272159 - RNA, 22 nt, Homo sapiens
uguagguguacauacaugguua

SEQ ID NO: 272160 - RNA, 22 nt, Homo sapiens
ugucaugucuuuguguaucaau

SEQ ID NO: 272161 - RNA, 22 nt, Homo sapiens
ugucauguggcuaacgauucau

SEQ ID NO: 272162 - RNA, 22 nt, Homo sapiens
ugucauucaggaaauucuaagu

SEQ ID NO: 272163 - RNA, 22 nt, Homo sapiens
uguccaaauugaaucaucuggu

SEQ ID NO: 272164 - RNA, 18 nt, Homo sapiens
ugucccuuugcuguucau

SEQ ID NO: 272165 - RNA, 22 nt, Homo sapiens
uguccuggugaugcccaaauuc

SEQ ID NO: 272166 - RNA, 22 nt, Homo sapiens
ugucuggaaggguggccuccug

SEQ ID NO: 272167 - RNA, 22 nt, Homo sapiens
ugugaagaugagaugacgcccu

SEQ ID NO: 272168 - RNA, 22 nt, Homo sapiens
ugugacagcacgguucaacugc

SEQ ID NO: 272169 - RNA, 18 nt, Homo sapiens
ugugauggauauguuaau

SEQ ID NO: 272170 - RNA, 23 nt, Homo sapiens
ugugcacauuuacauauauacac

SEQ ID NO: 272171 - RNA, 22 nt, Homo sapiens
ugugcaguuuugagugaauuuc

SEQ ID NO: 272172 - RNA, 22 nt, Homo sapiens
ugugcauaugucuuuauaguag

SEQ ID NO: 272173 - RNA, 22 nt, Homo sapiens
ugugccacugcacucuggccug

SEQ ID NO: 272174 - RNA, 22 nt, Homo sapiens
ugugggugguaaaauacaauga

SEQ ID NO: 272175 - RNA, 22 nt, Homo sapiens
uguguagagaaauauuacuuau

SEQ ID NO: 272176 - RNA, 22 nt, Homo sapiens
ugugucuugaauuuuguaugua

SEQ ID NO: 272177 - RNA, 22 nt, Homo sapiens
uguguuuuuauguaaaauggaa

SEQ ID NO: 272178 - RNA, 22 nt, Homo sapiens
uguucuugaguugggaguacaa

SEQ ID NO: 272179 - RNA, 22 nt, Homo sapiens
uguuugcuguguggaguagcag

SEQ ID NO: 272180 - RNA, 22 nt, Homo sapiens
uguuugcuuaacguggagccag

SEQ ID NO: 272181 - RNA, 21 nt, Homo sapiens
uguuuuugcuguguaucucuc

SEQ ID NO: 272182 - RNA, 22 nt, Homo sapiens
uuaaaggcaugguuagacaugg

SEQ ID NO: 272183 - RNA, 22 nt, Homo sapiens
uuaaauacagcaugguguuucu

SEQ ID NO: 272184 - RNA, 22 nt, Homo sapiens
uuaaggcuccuguuggcuuuua

SEQ ID NO: 272185 - RNA, 22 nt, Homo sapiens
uuaaugaacuuuauuuuguaga

SEQ ID NO: 272186 - RNA, 22 nt, Homo sapiens
uuacuugagaugaguuggacaa

SEQ ID NO: 272187 - RNA, 17 nt, Homo sapiens
uuagagguagacucauu

SEQ ID NO: 272188 - RNA, 22 nt, Homo sapiens
uuagauguuugacugggccuua

SEQ ID NO: 272189 - RNA, 22 nt, Homo sapiens
uuagcacaguucauucauguua

SEQ ID NO: 272190 - RNA, 23 nt, Homo sapiens
uuggucucccaaaguguugagau

SEQ ID NO: 272191 - RNA, 22 nt, Homo sapiens
uugucuugcagcuuaggcauca

SEQ ID NO: 272192 - RNA, 22 nt, Homo sapiens
uugugaagaugugaagcaagca

SEQ ID NO: 272193 - RNA, 22 nt, Homo sapiens
uugugacacagcugggccuaua

SEQ ID NO: 272194 - RNA, 22 nt, Homo sapiens
uugugaucuucagaaaguggcu

SEQ ID NO: 272195 - RNA, 22 nt, Homo sapiens
uugugcuugauuugccuagcug

SEQ ID NO: 272196 - RNA, 22 nt, Homo sapiens
uugugcuugcuguguucuaugc

SEQ ID NO: 272197 - RNA, 22 nt, Homo sapiens
uugugcuuuugagcugagauga

SEQ ID NO: 272198 - RNA, 22 nt, Homo sapiens
uugugggaggugauuagaucau

SEQ ID NO: 272199 - RNA, 22 nt, Homo sapiens
uugugguaggaguugccauguu

SEQ ID NO: 272200 - RNA, 22 nt, Homo sapiens
uuuaaagcuaaaauauguuuau

SEQ ID NO: 272201 - RNA, 22 nt, Homo sapiens
uuuagcaaagcaauuuacacca

SEQ ID NO: 272202 - RNA, 22 nt, Homo sapiens
uuuauagucaggaacuugagga

SEQ ID NO: 272203 - RNA, 22 nt, Homo sapiens
uuucacaguguucucccccaga

SEQ ID NO: 272204 - RNA, 22 nt, Homo sapiens
uuucacuagccagcccuuuauu

SEQ ID NO: 272205 - RNA, 17 nt, Homo sapiens
uuucagaguggaagugu

SEQ ID NO: 272206 - RNA, 22 nt, Homo sapiens
uuucaggcaagggugacccuga

SEQ ID NO: 272207 - RNA, 20 nt, Homo sapiens
uuucaguacuuucuacuggc

SEQ ID NO: 272208 - RNA, 22 nt, Homo sapiens
uuuccaguuuggaggaugcauu

SEQ ID NO: 272209 - RNA, 22 nt, Homo sapiens
uuugagcaagaggugacauuau

SEQ ID NO: 272210 - RNA, 22 nt, Homo sapiens
uuugcacuuuaauauaauguga

SEQ ID NO: 272211 - RNA, 22 nt, Homo sapiens
uuugcuugaggucuagcuaccc

SEQ ID NO: 272212 - RNA, 22 nt, Homo sapiens
uuuggcauuagauaauugugua

SEQ ID NO: 272213 - RNA, 22 nt, Homo sapiens
uuuggguuuuauguaacagcua

SEQ ID NO: 272214 - RNA, 22 nt, Homo sapiens
uuugguuuuuguuaucacucau

SEQ ID NO: 272215 - RNA, 22 nt, Homo sapiens
uuugugcuccucucaguaugug

SEQ ID NO: 272216 - RNA, 22 nt, Homo sapiens
uuuuacagaggagguugcugau

SEQ ID NO: 272217 - RNA, 22 nt, Homo sapiens
uuuucaguggccauaguggaga

SEQ ID NO: 272218 - RNA, 19 nt, Homo sapiens
uuuuccccuuucuuaagac

SEQ ID NO: 272219 - RNA, 23 nt, Homo sapiens
uuuugcaauaagucacuggaaua

SEQ ID NO: 272220 - RNA, 22 nt, Homo sapiens
uuuugcuugugaauagccacau

SEQ ID NO: 272221 - RNA, 19 nt, Homo sapiens
uuuuggaaaugugaacagc

SEQ ID NO: 272222 - RNA, 22 nt, Homo sapiens
uuuugguaaugaacuuaggaag

SEQ ID NO: 272223 - RNA, 19 nt, Homo sapiens
uuuuguacucugugacuug

SEQ ID NO: 272224 - RNA, 18 nt, Homo sapiens
uuuuugaggcacagggga

SEQ ID NO: 272225 - RNA, 23 nt, Homo sapiens
agagugcaauggugccaucucgg

SEQ ID NO: 272226 - RNA, 22 nt, Homo sapiens
agaugauguuuacugagcauca

SEQ ID NO: 272227 - RNA, 22 nt, Homo sapiens
agaugccucauguucuagguuc

SEQ ID NO: 272228 - RNA, 22 nt, Homo sapiens
agaugguguuuucucaccagau

SEQ ID NO: 272229 - RNA, 22 nt, Homo sapiens
agcaagauuguucccauuuucu

SEQ ID NO: 272230 - RNA, 22 nt, Homo sapiens
agcaccaauaaucagaguucuu

SEQ ID NO: 272231 - RNA, 22 nt, Homo sapiens
agcagcaugaggggacuucugc

SEQ ID NO: 272232 - RNA, 22 nt, Homo sapiens
agcagcuuugaucugaaugauu

SEQ ID NO: 272233 - RNA, 22 nt, Homo sapiens
agcaggacaauaugggaucagg

SEQ ID NO: 272234 - RNA, 22 nt, Homo sapiens
agcagugugagaauggacuaau

SEQ ID NO: 272235 - RNA, 22 nt, Homo sapiens
agcaucauuugauguucccgag

SEQ ID NO: 272236 - RNA, 22 nt, Homo sapiens
agcaugauugggguugggcaca

SEQ ID NO: 272237 - RNA, 22 nt, Homo sapiens
agccaagacucuguuccccuug

SEQ ID NO: 272238 - RNA, 21 nt, Homo sapiens
agccaguguuccuuguggcuc

SEQ ID NO: 272239 - RNA, 21 nt, Homo sapiens
agccugugggucauaguugcc

SEQ ID NO: 272240 - RNA, 22 nt, Homo sapiens
agcuaguguucaccagagguca

SEQ ID NO: 272241 - RNA, 20 nt, Homo sapiens
agcugcagauauaaauccgc

SEQ ID NO: 272242 - RNA, 20 nt, Homo sapiens
agcuguuguuaaaaaggagg

SEQ ID NO: 272243 - RNA, 22 nt, Homo sapiens
agcuguuuuugugggcauguga

SEQ ID NO: 272244 - RNA, 22 nt, Homo sapiens
agcuucauucugaauagguuga

SEQ ID NO: 272245 - RNA, 22 nt, Homo sapiens
aggaacuguaacuaugucucug

SEQ ID NO: 272246 - RNA, 23 nt, Homo sapiens
aggaauggaaaaccaaguaucau

SEQ ID NO: 272247 - RNA, 18 nt, Homo sapiens
aggaaugguaauacuuca

SEQ ID NO: 272248 - RNA, 22 nt, Homo sapiens
aggaccauuguguagcagacau

SEQ ID NO: 272249 - RNA, 22 nt, Homo sapiens
aggcaacaugguaaaacccugu

SEQ ID NO: 272250 - RNA, 22 nt, Homo sapiens
aggcaagagugacuacgugaaa

SEQ ID NO: 272251 - RNA, 22 nt, Homo sapiens
aggcaggugaaagauaguuuua

SEQ ID NO: 272252 - RNA, 22 nt, Homo sapiens
aggcaugaaauacaugcauuga

SEQ ID NO: 272253 - RNA, 22 nt, Homo sapiens
aggcauguggcucuguucugac

SEQ ID NO: 272254 - RNA, 22 nt, Homo sapiens
agguagaguguuuuguucuucu

SEQ ID NO: 272255 - RNA, 22 nt, Homo sapiens
agguagcauagcgggaauauca

SEQ ID NO: 272256 - RNA, 22 nt, Homo sapiens
agguagugugaugcuccuguuu

SEQ ID NO: 272257 - RNA, 22 nt, Homo sapiens
agguauguauguaugggagaaa

SEQ ID NO: 272258 - RNA, 22 nt, Homo sapiens
aguaacaggauccaaagaaugu

SEQ ID NO: 272259 - RNA, 20 nt, Homo sapiens
aguauucacuuuuuucaugg

SEQ ID NO: 272260 - RNA, 22 nt, Homo sapiens
agucaagugggguuagauaguu

SEQ ID NO: 272261 - RNA, 22 nt, Homo sapiens
agucacagguucuugggauuag

SEQ ID NO: 272262 - RNA, 22 nt, Homo sapiens
agucgguguuacugacagaaug

SEQ ID NO: 272263 - RNA, 22 nt, Homo sapiens
agucugguguucucacacuagu

SEQ ID NO: 272264 - RNA, 22 nt, Homo sapiens
agugcaaugauccggugcuggg

SEQ ID NO: 272265 - RNA, 22 nt, Homo sapiens
agugcacuccagccugggcaac

SEQ ID NO: 272266 - RNA, 22 nt, Homo sapiens
agugcaguggcacaaucuuggc

SEQ ID NO: 272267 - RNA, 22 nt, Homo sapiens
agugccacugcacucuagccug

SEQ ID NO: 272268 - RNA, 22 nt, Homo sapiens
gugugcucaucacaugcaauag

SEQ ID NO: 272269 - RNA, 22 nt, Homo sapiens
guuagaugaagaccaagggcaa

SEQ ID NO: 272270 - RNA, 17 nt, Homo sapiens
guucccaguggcauuug

SEQ ID NO: 272271 - RNA, 22 nt, Homo sapiens
guugaaaucaucacuuggcaug

SEQ ID NO: 272272 - RNA, 22 nt, Homo sapiens
guugaaauccuaacccccuagu

SEQ ID NO: 272273 - RNA, 22 nt, Homo sapiens
guuggugaccugaagagaguaa

SEQ ID NO: 272274 - RNA, 22 nt, Homo sapiens
uaaauggauaaaugaauaccua

SEQ ID NO: 272275 - RNA, 22 nt, Homo sapiens
uaacaagagagucagucagucc

SEQ ID NO: 272276 - RNA, 18 nt, Homo sapiens
uaacuggugugagauggu

SEQ ID NO: 272277 - RNA, 23 nt, Homo sapiens
uaagacacuaacuuuaugcuuug

SEQ ID NO: 272278 - RNA, 19 nt, Homo sapiens
uaagaugaagcugucuggg

SEQ ID NO: 272279 - RNA, 22 nt, Homo sapiens
uaaggcaaaccuuggcugcagu

SEQ ID NO: 272280 - RNA, 22 nt, Homo sapiens
uaaggcacucuucugugugccu

SEQ ID NO: 272281 - RNA, 22 nt, Homo sapiens
uaaggcucuuguuauuuugagg

SEQ ID NO: 272282 - RNA, 22 nt, Homo sapiens
uaaguaauugugguuuuugcca

SEQ ID NO: 272283 - RNA, 22 nt, Homo sapiens
uaagugcuugacuuugauguuu

SEQ ID NO: 272284 - RNA, 23 nt, Homo sapiens
uaaguucaucucuaauaggugga

SEQ ID NO: 272285 - RNA, 22 nt, Homo sapiens
uaaguucauucaugaaacuuag

SEQ ID NO: 272286 - RNA, 22 nt, Homo sapiens
uaaugcaucagugguaguucuu

SEQ ID NO: 272287 - RNA, 21 nt, Homo sapiens
uaauggcaugaucucggcuca

SEQ ID NO: 272288 - RNA, 22 nt, Homo sapiens
uacaaguggguuugugcaggag

SEQ ID NO: 272289 - RNA, 22 nt, Homo sapiens
uacaggaaugucagguugcugu

SEQ ID NO: 272290 - RNA, 22 nt, Homo sapiens
uacaguaauguuaaucuuugug

SEQ ID NO: 272291 - RNA, 22 nt, Homo sapiens
uaccaaaguuucggccucuguu

SEQ ID NO: 272292 - RNA, 21 nt, Homo sapiens
uacuugagacagggucuugcu

SEQ ID NO: 272293 - RNA, 22 nt, Homo sapiens
uacuuuguuauagcagcaggaa

SEQ ID NO: 272294 - RNA, 22 nt, Homo sapiens
uagaagcacuaucccuccuagu

SEQ ID NO: 272295 - RNA, 22 nt, Homo sapiens
uagaauggaagguugagaagaa

SEQ ID NO: 272296 - RNA, 22 nt, Homo sapiens
uagagcaaugacucuggaaacc

SEQ ID NO: 272297 - RNA, 22 nt, Homo sapiens
uagaucaacuuugguaagagaa

SEQ ID NO: 272298 - RNA, 22 nt, Homo sapiens
uagcacaugucagguaauuugc

SEQ ID NO: 272299 - RNA, 22 nt, Homo sapiens
uagcaccaggguugacugaccu

SEQ ID NO: 272300 - RNA, 22 nt, Homo sapiens
uagcacuauuuauugaaaagga

SEQ ID NO: 272301 - RNA, 22 nt, Homo sapiens
uagcauaauuuguagaaaauca

SEQ ID NO: 272302 - RNA, 22 nt, Homo sapiens
uagcuccagugggguuacugcu

SEQ ID NO: 272303 - RNA, 19 nt, Homo sapiens
uaggugguuuuccccucac

SEQ ID NO: 272304 - RNA, 22 nt, Homo sapiens
uauaacaaugcaagaauggccu

SEQ ID NO: 272305 - RNA, 22 nt, Homo sapiens
uauagcacugagaauguaauuc

SEQ ID NO: 272306 - RNA, 22 nt, Homo sapiens
uauagcuuaaaguuuagauccu

SEQ ID NO: 272307 - RNA, 22 nt, Homo sapiens
uauagcuugaaggaauggucau

SEQ ID NO: 272308 - RNA, 22 nt, Homo sapiens
uaucacacuggaagaaguuaag

SEQ ID NO: 272309 - RNA, 20 nt, Homo sapiens
uaucacauggggagaaaccu

SEQ ID NO: 272310 - RNA, 22 nt, Homo sapiens
uaucauaguuuggacuuucauu

SEQ ID NO: 272311 - RNA, 20 nt, Homo sapiens
uaugaaacaguguagagcaa

SEQ ID NO: 272312 - RNA, 19 nt, Homo sapiens
uaugcaacuuauagugcug

SEQ ID NO: 272313 - RNA, 22 nt, Homo sapiens
uaugguuuucucuuacguguug

SEQ ID NO: 272314 - RNA, 22 nt, Homo sapiens
uauuacuugucugugucucaau

SEQ ID NO: 272315 - RNA, 18 nt, Homo sapiens
uauuccucuuccucuauc

SEQ ID NO: 272316 - RNA, 22 nt, Homo sapiens
uauugaauuuuuaagcccuuug

SEQ ID NO: 272317 - RNA, 22 nt, Homo sapiens
uauugacuuuuuuguuaggagg

SEQ ID NO: 272318 - RNA, 22 nt, Homo sapiens
ucaaaugguccacgugaacauu

SEQ ID NO: 272319 - RNA, 20 nt, Homo sapiens
ucaaauucuuggccuccagc

SEQ ID NO: 272320 - RNA, 20 nt, Homo sapiens
ucaaggcacgaauaaaaguu

SEQ ID NO: 272321 - RNA, 22 nt, Homo sapiens
ucacaaguguauagacaugucc

SEQ ID NO: 272322 - RNA, 23 nt, Homo sapiens
ucacaguggcugcuuaauuguga

SEQ ID NO: 272323 - RNA, 22 nt, Homo sapiens
ucacaugugcguuuuggcaugu

SEQ ID NO: 272324 - RNA, 22 nt, Homo sapiens
ucacauuguacaaacagguaag

SEQ ID NO: 272325 - RNA, 22 nt, Homo sapiens
ucacauuguuauguaaauguuu

SEQ ID NO: 272326 - RNA, 22 nt, Homo sapiens
ucacucagaccuggugauaugc

SEQ ID NO: 272327 - RNA, 22 nt, Homo sapiens
ucacugagaaugauguuucuga

SEQ ID NO: 272328 - RNA, 20 nt, Homo sapiens
ucacugagugguccacagua

SEQ ID NO: 272329 - RNA, 22 nt, Homo sapiens
ucacugcacuucaggcuuucuc

SEQ ID NO: 272330 - RNA, 22 nt, Homo sapiens
ucacugugugucucuguaucug

SEQ ID NO: 272331 - RNA, 21 nt, Homo sapiens
ucagaagcucccagggaggac

SEQ ID NO: 272332 - RNA, 22 nt, Homo sapiens
ucagaauguaacuuuaguugga

SEQ ID NO: 272333 - RNA, 22 nt, Homo sapiens
ucagaccauuucauuacagacu

SEQ ID NO: 272334 - RNA, 22 nt, Homo sapiens
ucaucaggaaacuuaugcagug

SEQ ID NO: 272335 - RNA, 22 nt, Homo sapiens
ucaucagguaugucagcggagu

SEQ ID NO: 272336 - RNA, 21 nt, Homo sapiens
ucaucagucaaagacaauggu

SEQ ID NO: 272337 - RNA, 22 nt, Homo sapiens
ucaucuggcgaaugugaagagu

SEQ ID NO: 272338 - RNA, 22 nt, Homo sapiens
ucauggcacugaugagaguuuc

SEQ ID NO: 272339 - RNA, 22 nt, Homo sapiens
ucaugguuuuauaacccucuug

SEQ ID NO: 272340 - RNA, 22 nt, Homo sapiens
ucauguguugcacugaggaccu

SEQ ID NO: 272341 - RNA, 21 nt, Homo sapiens
uccagcuuugagaguuguggu

SEQ ID NO: 272342 - RNA, 22 nt, Homo sapiens
uccagguacucagggggcugag

SEQ ID NO: 272343 - RNA, 22 nt, Homo sapiens
uccagguuuugugaguuuaaau

SEQ ID NO: 272344 - RNA, 22 nt, Homo sapiens
ucccaguggucuugaaacaggg

SEQ ID NO: 272345 - RNA, 18 nt, Homo sapiens
ucccucagaauuauagaa

SEQ ID NO: 272346 - RNA, 22 nt, Homo sapiens
uccugagacucacaggcucccc

SEQ ID NO: 272347 - RNA, 22 nt, Homo sapiens
uccugagagcagacccucuaua

SEQ ID NO: 272348 - RNA, 22 nt, Homo sapiens
uccuugagucugaacuuuggau

SEQ ID NO: 272349 - RNA, 22 nt, Homo sapiens
uccuuggugacauuucuugucu

SEQ ID NO: 272350 - RNA, 22 nt, Homo sapiens
ucgcaccauugcacuccagcca

SEQ ID NO: 272351 - RNA, 22 nt, Homo sapiens
ucucaaccuccacacuacaaua

SEQ ID NO: 272352 - RNA, 22 nt, Homo sapiens
ucucagcacaaacaaaauugcu

SEQ ID NO: 272353 - RNA, 22 nt, Homo sapiens
ucucaguuuucuggggaagaaa

SEQ ID NO: 272354 - RNA, 20 nt, Homo sapiens
ucucauggagggaaagagca

SEQ ID NO: 272355 - RNA, 22 nt, Homo sapiens
ucucauggagguagagaguaaa

SEQ ID NO: 272356 - RNA, 22 nt, Homo sapiens
ucucauggagucaggagcagaa

SEQ ID NO: 272357 - RNA, 19 nt, Homo sapiens
augcugguguugcucaaac

SEQ ID NO: 272358 - RNA, 22 nt, Homo sapiens
augcuguuuugaauucucuaga

SEQ ID NO: 272359 - RNA, 22 nt, Homo sapiens
auggaaacauaagaguauagau

SEQ ID NO: 272360 - RNA, 22 nt, Homo sapiens
auggaacauuauagauguaaaa

SEQ ID NO: 272361 - RNA, 22 nt, Homo sapiens
auggaagaaaguuggguucuug

SEQ ID NO: 272362 - RNA, 22 nt, Homo sapiens
auggauuuuggggccagaggca

SEQ ID NO: 272363 - RNA, 22 nt, Homo sapiens
auggcaguuucagcuauaguuu

SEQ ID NO: 272364 - RNA, 22 nt, Homo sapiens
auggcauggugaagucuuugga

SEQ ID NO: 272365 - RNA, 20 nt, Homo sapiens
auggcccugcugggaguguc

SEQ ID NO: 272366 - RNA, 22 nt, Homo sapiens
auggcccugggaaaggaggcau

SEQ ID NO: 272367 - RNA, 22 nt, Homo sapiens
auggcugagugauuucaaacag

SEQ ID NO: 272368 - RNA, 22 nt, Homo sapiens
auggcuuuuauuguguugaggu

SEQ ID NO: 272369 - RNA, 22 nt, Homo sapiens
auggcuuuugaccugguaggau

SEQ ID NO: 272370 - RNA, 22 nt, Homo sapiens
augggcuaguaaagacaaacuu

SEQ ID NO: 272371 - RNA, 22 nt, Homo sapiens
augguacuccagagaagcagaa

SEQ ID NO: 272372 - RNA, 22 nt, Homo sapiens
augguuuauuuguaagcagagu

SEQ ID NO: 272373 - RNA, 22 nt, Homo sapiens
augguuuuacugcaaaauggga

SEQ ID NO: 272374 - RNA, 17 nt, Homo sapiens
auguaauccucaucucu

SEQ ID NO: 272375 - RNA, 21 nt, Homo sapiens
auguaaugaagaagccacugg

SEQ ID NO: 272376 - RNA, 22 nt, Homo sapiens
augucaacauagacaguagagu

SEQ ID NO: 272377 - RNA, 22 nt, Homo sapiens
augucaaggugggugauaguuu

SEQ ID NO: 272378 - RNA, 22 nt, Homo sapiens
augugcaauguguacguagccc

SEQ ID NO: 272379 - RNA, 22 nt, Homo sapiens
augugggaggacuuggcuguug

SEQ ID NO: 272380 - RNA, 22 nt, Homo sapiens
auguguauuaccucgauuguga

SEQ ID NO: 272381 - RNA, 23 nt, Homo sapiens
augugugcuuggagagcaggaug

SEQ ID NO: 272382 - RNA, 20 nt, Homo sapiens
auguucuggaggacagaagc

SEQ ID NO: 272383 - RNA, 22 nt, Homo sapiens
auuagguuggugcaaaaguaau

SEQ ID NO: 272384 - RNA, 22 nt, Homo sapiens
auuaucacaguuuugcauaugg

SEQ ID NO: 272385 - RNA, 22 nt, Homo sapiens
auucacuuuuauagacaggucu

SEQ ID NO: 272386 - RNA, 22 nt, Homo sapiens
auuccacaguuaacacagaccg

SEQ ID NO: 272387 - RNA, 22 nt, Homo sapiens
auuccacuuagugacucauuug

SEQ ID NO: 272388 - RNA, 22 nt, Homo sapiens
auucuauaguccuaggauuggg

SEQ ID NO: 272389 - RNA, 22 nt, Homo sapiens
auucuugcuugaacuuggugca

SEQ ID NO: 272390 - RNA, 22 nt, Homo sapiens
auugaauuugguuugcuaagaa

SEQ ID NO: 272391 - RNA, 22 nt, Homo sapiens
auugcacuccagccugggcagc

SEQ ID NO: 272392 - RNA, 22 nt, Homo sapiens
auugcacuccagucugggcaac

SEQ ID NO: 272393 - RNA, 22 nt, Homo sapiens
auugcuauuauuugaccauugu

SEQ ID NO: 272394 - RNA, 22 nt, Homo sapiens
auuggcagaaaucuuuauagua

SEQ ID NO: 272395 - RNA, 22 nt, Homo sapiens
auuggcuuuauacauaagaaua

SEQ ID NO: 272396 - RNA, 22 nt, Homo sapiens
auuuccuguaggggcuugcgaa

SEQ ID NO: 272397 - RNA, 19 nt, Homo sapiens
auuugaucaucaggcacag

SEQ ID NO: 272398 - RNA, 22 nt, Homo sapiens
auuuggcaacguagggaggcau

SEQ ID NO: 272399 - RNA, 22 nt, Homo sapiens
caaaagugauugcgguuuuugc

SEQ ID NO: 272400 - RNA, 22 nt, Homo sapiens
caaagcacuuggcuuggaagau

SEQ ID NO: 272401 - RNA, 22 nt, Homo sapiens
caaugcagcuuuuggagagaaa

SEQ ID NO: 272402 - RNA, 22 nt, Homo sapiens
caauggcaaugaaauagugaga

SEQ ID NO: 272403 - RNA, 22 nt, Homo sapiens
acaguggugcgaucucggcuca

SEQ ID NO: 272404 - RNA, 23 nt, Homo sapiens
acaguggugugaucuuggcucag

SEQ ID NO: 272405 - RNA, 22 nt, Homo sapiens
acaucacuguuugauugauuga

SEQ ID NO: 272406 - RNA, 22 nt, Homo sapiens
acaugacauugggguggggaua

SEQ ID NO: 272407 - RNA, 22 nt, Homo sapiens
acaugagacuggguuuguaggg

SEQ ID NO: 272408 - RNA, 22 nt, Homo sapiens
accauugcacuccagcccaggc

SEQ ID NO: 272409 - RNA, 22 nt, Homo sapiens
acccugucauccacauggugcu

SEQ ID NO: 272410 - RNA, 21 nt, Homo sapiens
accugauguuucaguuggagu

SEQ ID NO: 272411 - RNA, 18 nt, Homo sapiens
accuucauuccuuugccu

SEQ ID NO: 272412 - RNA, 22 nt, Homo sapiens
acuauacuguaacuguauucag

SEQ ID NO: 272413 - RNA, 22 nt, Homo sapiens
acucagagagaacugucauuug

SEQ ID NO: 272414 - RNA, 22 nt, Homo sapiens
acucugucuaguuguaaaauuu

SEQ ID NO: 272415 - RNA, 22 nt, Homo sapiens
acugcacuccaccuugggcaac

SEQ ID NO: 272416 - RNA, 22 nt, Homo sapiens
acugcacuccagcccaggugac

SEQ ID NO: 272417 - RNA, 22 nt, Homo sapiens
acugcacuccagccucaugaca

SEQ ID NO: 272418 - RNA, 22 nt, Homo sapiens
acugcacuccagccuccugaca

SEQ ID NO: 272419 - RNA, 22 nt, Homo sapiens
acugcacuccagccucggugac

SEQ ID NO: 272420 - RNA, 22 nt, Homo sapiens
acugcacuccagccuuggagac

SEQ ID NO: 272421 - RNA, 22 nt, Homo sapiens
acugcacuccggccucgugaca

SEQ ID NO: 272422 - RNA, 22 nt, Homo sapiens
acugcacuccggccuggcaaca

SEQ ID NO: 272423 - RNA, 22 nt, Homo sapiens
acugcacugucaaccuccuggg

SEQ ID NO: 272424 - RNA, 22 nt, Homo sapiens
acuggcucugcuuuacaaacag

SEQ ID NO: 272425 - RNA, 20 nt, Homo sapiens
acugggcuaccgaaguaagg

SEQ ID NO: 272426 - RNA, 22 nt, Homo sapiens
acuuuuguuauacagugugaua

SEQ ID NO: 272427 - RNA, 22 nt, Homo sapiens
acuuuuugauggggagaacauu

SEQ ID NO: 272428 - RNA, 22 nt, Homo sapiens
agaacccuuugaaauguguuug

SEQ ID NO: 272429 - RNA, 22 nt, Homo sapiens
agaauacugucuauucauggua

SEQ ID NO: 272430 - RNA, 22 nt, Homo sapiens
agaauguaacucuaugaaggca

SEQ ID NO: 272431 - RNA, 22 nt, Homo sapiens
agacacuguugaaaaggcccca

SEQ ID NO: 272432 - RNA, 22 nt, Homo sapiens
agacaguauuggcaaagugugu

SEQ ID NO: 272433 - RNA, 22 nt, Homo sapiens
agacuagagggaaaugaguugg

SEQ ID NO: 272434 - RNA, 22 nt, Homo sapiens
agacuguaaugcauaauuuacu

SEQ ID NO: 272435 - RNA, 22 nt, Homo sapiens
agagaacuggcuucaccauucu

SEQ ID NO: 272436 - RNA, 22 nt, Homo sapiens
agagaucauuuuguuucaaauc

SEQ ID NO: 272437 - RNA, 20 nt, Homo sapiens
agagcaaagccgcaccccua

SEQ ID NO: 272438 - RNA, 19 nt, Homo sapiens
agaguauugaauuugcccu

SEQ ID NO: 272439 - RNA, 22 nt, Homo sapiens
agagugcaauggcaccaucucg

SEQ ID NO: 272440 - RNA, 22 nt, Homo sapiens
agaugauguuucuggcacauga

SEQ ID NO: 272441 - RNA, 22 nt, Homo sapiens
agaugccuaugaagagaaauua

SEQ ID NO: 272442 - RNA, 22 nt, Homo sapiens
agcaaaucuaugaauguauauu

SEQ ID NO: 272443 - RNA, 22 nt, Homo sapiens
agcaccacaauuuccugccuaa

SEQ ID NO: 272444 - RNA, 22 nt, Homo sapiens
agcaccaugggcugaguaagug

SEQ ID NO: 272445 - RNA, 22 nt, Homo sapiens
agcaccauuucucuaaagcacu

SEQ ID NO: 272446 - RNA, 22 nt, Homo sapiens
agcagauguuuagugagcgccu

SEQ ID NO: 272447 - RNA, 21 nt, Homo sapiens
agcagcuuugguugaagcaga

SEQ ID NO: 272448 - RNA, 22 nt, Homo sapiens
agcagugucauuuucuggugag

SEQ ID NO: 272449 - RNA, 22 nt, Homo sapiens
agcagugugaaaauggacuaau

SEQ ID NO: 272450 - RNA, 22 nt, Homo sapiens
agcagugugaaaugauuuaagg

SEQ ID NO: 272451 - RNA, 20 nt, Homo sapiens
agcaucagugguaguguugc

SEQ ID NO: 272452 - RNA, 20 nt, Homo sapiens
agcauugguuagaacaguag

SEQ ID NO: 272453 - RNA, 22 nt, Homo sapiens
agccaguauuuccacagagugg

SEQ ID NO: 272454 - RNA, 22 nt, Homo sapiens
agccuguguugaauuauagaaa

SEQ ID NO: 272455 - RNA, 18 nt, Homo sapiens
agcucaguguuugcuuac

SEQ ID NO: 272456 - RNA, 22 nt, Homo sapiens
agcuccaugauaguaugucugu

SEQ ID NO: 272457 - RNA, 22 nt, Homo sapiens
agcuccuuugcuuuuuccagga

SEQ ID NO: 272458 - RNA, 20 nt, Homo sapiens
agcuggguguguuggugcau

SEQ ID NO: 272459 - RNA, 22 nt, Homo sapiens
agcuguuguuuuaagauacuaa

SEQ ID NO: 272460 - RNA, 22 nt, Homo sapiens
agcuucauuguuaugaauguca

SEQ ID NO: 272461 - RNA, 22 nt, Homo sapiens
agcuugugcuguaugaagggcc

SEQ ID NO: 272462 - RNA, 21 nt, Homo sapiens
agcuuguguguaucacagugu

SEQ ID NO: 272463 - RNA, 23 nt, Homo sapiens
aggaaguaacuaucuuuucuguc

SEQ ID NO: 272464 - RNA, 22 nt, Homo sapiens
aggaagugugcaauuaauuucu

SEQ ID NO: 272465 - RNA, 22 nt, Homo sapiens
aggaauggaaacuuuugauggu

SEQ ID NO: 272466 - RNA, 19 nt, Homo sapiens
aggacuaaagacuagaagu

SEQ ID NO: 272467 - RNA, 22 nt, Homo sapiens
aggagaauugguucuucuugau

SEQ ID NO: 272468 - RNA, 22 nt, Homo sapiens
aggagcacaauggucaugugga

SEQ ID NO: 272469 - RNA, 22 nt, Homo sapiens
aggagcacuggccuuggaguca

SEQ ID NO: 272470 - RNA, 21 nt, Homo sapiens
aggagcauucaugacgagguu

SEQ ID NO: 272471 - RNA, 22 nt, Homo sapiens
aggauacugguaugggcugaau

SEQ ID NO: 272472 - RNA, 22 nt, Homo sapiens
aggcauggagacuaaaauuaua

SEQ ID NO: 272473 - RNA, 22 nt, Homo sapiens
aggcuagaaucuuccaucuugg

SEQ ID NO: 272474 - RNA, 22 nt, Homo sapiens
aggcuuauuaagauucccuuau

SEQ ID NO: 272475 - RNA, 22 nt, Homo sapiens
agguccacuuacuacuccuguu

SEQ ID NO: 272476 - RNA, 22 nt, Homo sapiens
agguucccuuuuggccugggau

SEQ ID NO: 272477 - RNA, 22 nt, Homo sapiens
agguuuucagccccagccuagg

SEQ ID NO: 272478 - RNA, 22 nt, Homo sapiens
agugauuuuaacuuccagcaau

SEQ ID NO: 272479 - RNA, 22 nt, Homo sapiens
agugcaauggcgugaucuuggc

SEQ ID NO: 272480 - RNA, 23 nt, Homo sapiens
aguggucuccugggcccagcugu

SEQ ID NO: 272481 - RNA, 22 nt, Homo sapiens
aguguuuuucaugggauacuuu

SEQ ID NO: 272482 - RNA, 22 nt, Homo sapiens
aguuggccccuacugggaggug

SEQ ID NO: 272483 - RNA, 18 nt, Homo sapiens
auaaacucaucauuuuua

SEQ ID NO: 272484 - RNA, 22 nt, Homo sapiens
auaaaguguuuaguauaggcaa

SEQ ID NO: 272485 - RNA, 22 nt, Homo sapiens
auaaguauuuggacuuuacugu

SEQ ID NO: 272486 - RNA, 22 nt, Homo sapiens
auaauacuuuuauuuugaggaa

SEQ ID NO: 272487 - RNA, 22 nt, Homo sapiens
auacaugugccauguucgugug

SEQ ID NO: 272488 - RNA, 22 nt, Homo sapiens
auacaugugugagcgaagaugu

SEQ ID NO: 272489 - RNA, 22 nt, Homo sapiens
auacauguuucauguuggugug

SEQ ID NO: 272490 - RNA, 20 nt, Homo sapiens
aaacucugucuucuuuauca

SEQ ID NO: 272491 - RNA, 22 nt, Homo sapiens
aaacugcuuuccaugguggcug

SEQ ID NO: 272492 - RNA, 22 nt, Homo sapiens
aaagagaucuaugggcacuaug

SEQ ID NO: 272493 - RNA, 22 nt, Homo sapiens
aaagguaguacuucuagaaggg

SEQ ID NO: 272494 - RNA, 20 nt, Homo sapiens
aaaugcuguaauguuuggga

SEQ ID NO: 272495 - RNA, 22 nt, Homo sapiens
aacacuguuuccagucaugauc

SEQ ID NO: 272496 - RNA, 22 nt, Homo sapiens
aacuccauuuuagacccuagau

SEQ ID NO: 272497 - RNA, 22 nt, Homo sapiens
aagagccgcaagggugaagggu

SEQ ID NO: 272498 - RNA, 22 nt, Homo sapiens
aagaggcuguaggauaaugccu

SEQ ID NO: 272499 - RNA, 22 nt, Homo sapiens
aagagguuguaccuaaaguguu

SEQ ID NO: 272500 - RNA, 22 nt, Homo sapiens
aagaucauucagggaaggcuga

SEQ ID NO: 272501 - RNA, 22 nt, Homo sapiens
aagcaacacaucugccccgguu

SEQ ID NO: 272502 - RNA, 22 nt, Homo sapiens
aagcaucauuuggaauuugaga

SEQ ID NO: 272503 - RNA, 22 nt, Homo sapiens
aagcuccauuucugccaugaga

SEQ ID NO: 272504 - RNA, 22 nt, Homo sapiens
aagcuggauuucgcauccuguu

SEQ ID NO: 272505 - RNA, 22 nt, Homo sapiens
aaggcaagaaaauggauucucc

SEQ ID NO: 272506 - RNA, 22 nt, Homo sapiens
aaggucauugugguuuuugcca

SEQ ID NO: 272507 - RNA, 19 nt, Homo sapiens
aaguacuugucuuuugaag

SEQ ID NO: 272508 - RNA, 22 nt, Homo sapiens
aaguagcuggaugcaguggcac

SEQ ID NO: 272509 - RNA, 22 nt, Homo sapiens
aagugauguuauugggugacuc

SEQ ID NO: 272510 - RNA, 20 nt, Homo sapiens
aagugcaucguugugucugc

SEQ ID NO: 272511 - RNA, 22 nt, Homo sapiens
aaucacaguuaguaagggagaa

SEQ ID NO: 272512 - RNA, 22 nt, Homo sapiens
aauccaugugcuuuaccauuuu

SEQ ID NO: 272513 - RNA, 22 nt, Homo sapiens
aaugacuaagaugguacauuuu

SEQ ID NO: 272514 - RNA, 22 nt, Homo sapiens
aaugaucaauguuugaggugau

SEQ ID NO: 272515 - RNA, 22 nt, Homo sapiens
aaugcacauauauuuccuuauu

SEQ ID NO: 272516 - RNA, 22 nt, Homo sapiens
aaugccuagugugugacaggug

SEQ ID NO: 272517 - RNA, 22 nt, Homo sapiens
aaugcuaucuggaacauuguug

SEQ ID NO: 272518 - RNA, 22 nt, Homo sapiens
aauggcuauuucaugugguagg

SEQ ID NO: 272519 - RNA, 22 nt, Homo sapiens
aaugucacugugguccuccagu

SEQ ID NO: 272520 - RNA, 22 nt, Homo sapiens
aaugugcacuuggagccuugcu

SEQ ID NO: 272521 - RNA, 23 nt, Homo sapiens
aauugcacauuccuugcuggcag

SEQ ID NO: 272522 - RNA, 23 nt, Homo sapiens
aauugcuuuugaggacuuaguug

SEQ ID NO: 272523 - RNA, 23 nt, Homo sapiens
acacaguaaacuaaaagcuagcu

SEQ ID NO: 272524 - RNA, 22 nt, Homo sapiens
acacucuaguguucuuaaucag

SEQ ID NO: 272525 - RNA, 22 nt, Homo sapiens
acacuguuuuaguuauuauagc

SEQ ID NO: 272526 - RNA, 22 nt, Homo sapiens
acagaaccauucacuccccugg

SEQ ID NO: 272527 - RNA, 22 nt, Homo sapiens
acauccauuugcuuuauuugcu

SEQ ID NO: 272528 - RNA, 22 nt, Homo sapiens
acaucuguacaguggguguggu

SEQ ID NO: 272529 - RNA, 17 nt, Homo sapiens
acaugagacuggauucu

SEQ ID NO: 272530 - RNA, 22 nt, Homo sapiens
acccaguagccagauguagcug

SEQ ID NO: 272531 - RNA, 22 nt, Homo sapiens
accccauuugcacugagcccuu

SEQ ID NO: 272532 - RNA, 21 nt, Homo sapiens
acccccacaccuccuuaguuc

SEQ ID NO: 272533 - RNA, 17 nt, Homo sapiens
accccuaccucagaagc

SEQ ID NO: 272534 - RNA, 23 nt, Homo sapiens
accugauguuucuguggggagcc

SEQ ID NO: 272535 - RNA, 22 nt, Homo sapiens
acugcacuccaaccuuggugac

SEQ ID NO: 272536 - RNA, 18 nt, Homo sapiens
acugcacuccaccuuggg

SEQ ID NO: 272537 - RNA, 22 nt, Homo sapiens
acugcacuccagcccgggugac

SEQ ID NO: 272538 - RNA, 22 nt, Homo sapiens
acugcacuccagccucggggac

SEQ ID NO: 272539 - RNA, 22 nt, Homo sapiens
acugcacuccagccugcugaca

SEQ ID NO: 272540 - RNA, 22 nt, Homo sapiens
acugcacuccagccugcuggau

SEQ ID NO: 272541 - RNA, 22 nt, Homo sapiens
acugcacuccagccugcuggca

SEQ ID NO: 272542 - RNA, 18 nt, Homo sapiens
acugcacuccauccuagg

SEQ ID NO: 272543 - RNA, 22 nt, Homo sapiens
acugcacucuagccccugcgac

SEQ ID NO: 272544 - RNA, 22 nt, Homo sapiens
acugcacuguccuagaguccuc

SEQ ID NO: 272545 - RNA, 22 nt, Homo sapiens
acugcacuucagccuguugaca

SEQ ID NO: 272546 - RNA, 22 nt, Homo sapiens
acuuugcuuagagggcauuaaa

SEQ ID NO: 272547 - RNA, 21 nt, Homo sapiens
agaaaaucuuaugggaaacau

SEQ ID NO: 272548 - RNA, 22 nt, Homo sapiens
agaauaauguccccccaaggga

SEQ ID NO: 272549 - RNA, 22 nt, Homo sapiens
agaaugauccuucucagaggca

SEQ ID NO: 272550 - RNA, 22 nt, Homo sapiens
agacaucauuugauggugggag

SEQ ID NO: 272551 - RNA, 21 nt, Homo sapiens
agagaacugaaacaugugacu

SEQ ID NO: 272552 - RNA, 22 nt, Homo sapiens
agagacauugcuccaacucacc

SEQ ID NO: 272553 - RNA, 22 nt, Homo sapiens
agagauaguuuccaacucauac

SEQ ID NO: 272554 - RNA, 22 nt, Homo sapiens
agagcaaugacaugcuaugugg

SEQ ID NO: 272555 - RNA, 22 nt, Homo sapiens
agaguaguaggaugaauggacu

SEQ ID NO: 272556 - RNA, 22 nt, Homo sapiens
agaugcuguuaucaacuguagc

SEQ ID NO: 272557 - RNA, 22 nt, Homo sapiens
agcaacauugagacugcaguug

SEQ ID NO: 272558 - RNA, 22 nt, Homo sapiens
agcaagauccagucgcacagga

SEQ ID NO: 272559 - RNA, 22 nt, Homo sapiens
agcacagugguuaaguuucuua

SEQ ID NO: 272560 - RNA, 17 nt, Homo sapiens
agcaccacacucucuug

SEQ ID NO: 272561 - RNA, 20 nt, Homo sapiens
uguaaucuaaguuuuaagcc

SEQ ID NO: 272562 - RNA, 22 nt, Homo sapiens
uguauacugucuaauauguugu

SEQ ID NO: 272563 - RNA, 22 nt, Homo sapiens
ugucaaacauuaugaugcucua

SEQ ID NO: 272564 - RNA, 22 nt, Homo sapiens
ugucaaaugcagugauauuuga

SEQ ID NO: 272565 - RNA, 22 nt, Homo sapiens
ugucagaaucuagaggcugcua

SEQ ID NO: 272566 - RNA, 19 nt, Homo sapiens
ugucccagccauagaggca

SEQ ID NO: 272567 - RNA, 22 nt, Homo sapiens
ugucucaguucccuucucugga

SEQ ID NO: 272568 - RNA, 22 nt, Homo sapiens
ugucuguuugcgaaauugcuuc

SEQ ID NO: 272569 - RNA, 22 nt, Homo sapiens
ugucuugagagaggacaugacu

SEQ ID NO: 272570 - RNA, 22 nt, Homo sapiens
ugucuuggagaauccuggguuu

SEQ ID NO: 272571 - RNA, 22 nt, Homo sapiens
ugugaacauuuuguauauauua

SEQ ID NO: 272572 - RNA, 21 nt, Homo sapiens
ugugaccucugucucugaguc

SEQ ID NO: 272573 - RNA, 22 nt, Homo sapiens
ugugaguguguacuaguuauca

SEQ ID NO: 272574 - RNA, 22 nt, Homo sapiens
ugugauguggagggcagaucca

SEQ ID NO: 272575 - RNA, 22 nt, Homo sapiens
ugugcaguuuuagcguauuuua

SEQ ID NO: 272576 - RNA, 22 nt, Homo sapiens
ugugccacugcacuccugccug

SEQ ID NO: 272577 - RNA, 22 nt, Homo sapiens
ugugccuucuaagaaggagucu

SEQ ID NO: 272578 - RNA, 22 nt, Homo sapiens
ugugcgcaucggggccugcuuc

SEQ ID NO: 272579 - RNA, 22 nt, Homo sapiens
uguggaaauggugcuacgaaca

SEQ ID NO: 272580 - RNA, 22 nt, Homo sapiens
uguggaaauuguuguauuuaau

SEQ ID NO: 272581 - RNA, 20 nt, Homo sapiens
uguggcacuguaucucucag

SEQ ID NO: 272582 - RNA, 22 nt, Homo sapiens
ugugguuuuuuucuccaauagg

SEQ ID NO: 272583 - RNA, 22 nt, Homo sapiens
ugugucuuguuuuuucccaggc

SEQ ID NO: 272584 - RNA, 22 nt, Homo sapiens
ugugucuuuuaucacacaaugu

SEQ ID NO: 272585 - RNA, 22 nt, Homo sapiens
uguucaugaguucucauuuuua

SEQ ID NO: 272586 - RNA, 22 nt, Homo sapiens
uguugcauuugucaaggucaag

SEQ ID NO: 272587 - RNA, 22 nt, Homo sapiens
uguuuguuugagauggagucuc

SEQ ID NO: 272588 - RNA, 22 nt, Homo sapiens
uguuuguuugauaugggauaaa

SEQ ID NO: 272589 - RNA, 22 nt, Homo sapiens
uuaagaagugauuuuccucauu

SEQ ID NO: 272590 - RNA, 22 nt, Homo sapiens
uuaagcaaagguaacaugagaa

SEQ ID NO: 272591 - RNA, 22 nt, Homo sapiens
agcagagcaguggauuuuguga

SEQ ID NO: 272592 - RNA, 22 nt, Homo sapiens
agcagcuuugcauggccugugg

SEQ ID NO: 272593 - RNA, 22 nt, Homo sapiens
agcaggucuuaacuugugaggu

SEQ ID NO: 272594 - RNA, 22 nt, Homo sapiens
agcagguguccacaauguuugc

SEQ ID NO: 272595 - RNA, 17 nt, Homo sapiens
agcauguguuugagauu

SEQ ID NO: 272596 - RNA, 22 nt, Homo sapiens
agcccauguggcugaggcuucu

SEQ ID NO: 272597 - RNA, 22 nt, Homo sapiens
agcuccuacuguuacaucauug

SEQ ID NO: 272598 - RNA, 20 nt, Homo sapiens
agcuguuguuaugagguuua

SEQ ID NO: 272599 - RNA, 22 nt, Homo sapiens
ugagauggaguuucgcccuugu

SEQ ID NO: 272600 - RNA, 22 nt, Homo sapiens
ugagauggcugaauucagaaua

SEQ ID NO: 272601 - RNA, 22 nt, Homo sapiens
ugagauguaaucucgcucuguc

SEQ ID NO: 272602 - RNA, 22 nt, Homo sapiens
ugagaugugaucaccugaaggg

SEQ ID NO: 272603 - RNA, 22 nt, Homo sapiens
ugagauguugcucugaaacaag

SEQ ID NO: 272604 - RNA, 22 nt, Homo sapiens
ugagauguuuguuucagugccu

SEQ ID NO: 272605 - RNA, 22 nt, Homo sapiens
ugagcacagagccugggguggc

SEQ ID NO: 272606 - RNA, 22 nt, Homo sapiens
ugagcccauuguccugguuuau

SEQ ID NO: 272607 - RNA, 22 nt, Homo sapiens
ugagcugagaaaugcagcagcu

SEQ ID NO: 272608 - RNA, 22 nt, Homo sapiens
ugagcugagacaauaaguuuuu

SEQ ID NO: 272609 - RNA, 22 nt, Homo sapiens
ugagcugagaucacacuacugu

SEQ ID NO: 272610 - RNA, 22 nt, Homo sapiens
ugaggagugagaaauugguuuc

SEQ ID NO: 272611 - RNA, 17 nt, Homo sapiens
ugagggaugccugguuc

SEQ ID NO: 272612 - RNA, 22 nt, Homo sapiens
ugagguaugacuuauuauucuu

SEQ ID NO: 272613 - RNA, 20 nt, Homo sapiens
ugaggucugagaaagaauga

SEQ ID NO: 272614 - RNA, 22 nt, Homo sapiens
ugagguguauugggggaaauuc

SEQ ID NO: 272615 - RNA, 22 nt, Homo sapiens
ugaguaugaguucaggaaaggc

SEQ ID NO: 272616 - RNA, 22 nt, Homo sapiens
ugaguauguuuagaaguaaagg

SEQ ID NO: 272617 - RNA, 22 nt, Homo sapiens
ugaguguccaccccuuucacag

SEQ ID NO: 272618 - RNA, 22 nt, Homo sapiens
ugagugugaggaagaauuagaa

SEQ ID NO: 272619 - RNA, 22 nt, Homo sapiens
ugaguuaauuuuuguaucaugu

SEQ ID NO: 272620 - RNA, 22 nt, Homo sapiens
ugauagugccuuuuauaucucu

SEQ ID NO: 272621 - RNA, 22 nt, Homo sapiens
ugaucacagcuugacuaaagga

SEQ ID NO: 272622 - RNA, 22 nt, Homo sapiens
ugaugcugaugccugccagaag

SEQ ID NO: 272623 - RNA, 22 nt, Homo sapiens
ugauggcauuucauguuuguaa

SEQ ID NO: 272624 - RNA, 16 nt, Homo sapiens
ugcagaguaggugaau

SEQ ID NO: 272625 - RNA, 22 nt, Homo sapiens
ugcagcauugcacuccagccug

SEQ ID NO: 272626 - RNA, 22 nt, Homo sapiens
uggcuuuuccaggcauuacgau

SEQ ID NO: 272627 - RNA, 22 nt, Homo sapiens
uggcuuuuguuauuuggaagcu

SEQ ID NO: 272628 - RNA, 22 nt, Homo sapiens
ugggaaugaaauuacauagcuu

SEQ ID NO: 272629 - RNA, 22 nt, Homo sapiens
ugggagcauugcauuagaagcc

SEQ ID NO: 272630 - RNA, 22 nt, Homo sapiens
ugggguaggcuguauacucugu

SEQ ID NO: 272631 - RNA, 22 nt, Homo sapiens
ugguaagaggcccugaguuugu

SEQ ID NO: 272632 - RNA, 22 nt, Homo sapiens
ugguauuuaauauaugagaguu

SEQ ID NO: 272633 - RNA, 22 nt, Homo sapiens
uggugagaaaugagaugcuuuu

SEQ ID NO: 272634 - RNA, 19 nt, Homo sapiens
uggugccuuguucuuggau

SEQ ID NO: 272635 - RNA, 22 nt, Homo sapiens
ugguuccauauuaauuuuagga

SEQ ID NO: 272636 - RNA, 22 nt, Homo sapiens
uguaagcauugggcaugcaguc

SEQ ID NO: 272637 - RNA, 22 nt, Homo sapiens
uguagcaaauaaaagucuggau

SEQ ID NO: 272638 - RNA, 22 nt, Homo sapiens
uguagcaaaucgauacuauugg

SEQ ID NO: 272639 - RNA, 22 nt, Homo sapiens
ugucaccauuuguaggugagga

SEQ ID NO: 272640 - RNA, 22 nt, Homo sapiens
ugucauauagaauguucuauga

SEQ ID NO: 272641 - RNA, 22 nt, Homo sapiens
ugucauggauucugagucuggg

SEQ ID NO: 272642 - RNA, 21 nt, Homo sapiens
ugucgugcaggaucuguggga

SEQ ID NO: 272643 - RNA, 22 nt, Homo sapiens
ugucuaaagaauggcagacuca

SEQ ID NO: 272644 - RNA, 22 nt, Homo sapiens
ugugaacagcuccaaaugugga

SEQ ID NO: 272645 - RNA, 19 nt, Homo sapiens
ugugaagaaaugcugcaag

SEQ ID NO: 272646 - RNA, 22 nt, Homo sapiens
ugugacagcacagcaucucuuu

SEQ ID NO: 272647 - RNA, 22 nt, Homo sapiens
ugugaugguuuggaagcuucuu

SEQ ID NO: 272648 - RNA, 22 nt, Homo sapiens
ugugcauagugugugcggggcg

SEQ ID NO: 272649 - RNA, 22 nt, Homo sapiens
ugugcauauaaguguguauaua

SEQ ID NO: 272650 - RNA, 22 nt, Homo sapiens
ugugccacugcacucccgccug

SEQ ID NO: 272651 - RNA, 22 nt, Homo sapiens
ugugccacugcacucugggcaa

SEQ ID NO: 272652 - RNA, 22 nt, Homo sapiens
ugugcguguaagagaucuaggu

SEQ ID NO: 272653 - RNA, 22 nt, Homo sapiens
ugugcgugugccuguaagaauu

SEQ ID NO: 272654 - RNA, 22 nt, Homo sapiens
ugugcuugaauuuaguagcuua

SEQ ID NO: 272655 - RNA, 22 nt, Homo sapiens
uguggaaauaaaagaaagguua

SEQ ID NO: 272656 - RNA, 22 nt, Homo sapiens
ugugguccucugaaggcuuuuc

SEQ ID NO: 272657 - RNA, 22 nt, Homo sapiens
ugugguuuuaguaaaacuaugu

SEQ ID NO: 272658 - RNA, 22 nt, Homo sapiens
ugugucacugaggguuagugua

SEQ ID NO: 272659 - RNA, 22 nt, Homo sapiens
ugugucacugcacuccagccug

SEQ ID NO: 272660 - RNA, 22 nt, Homo sapiens
ugugucuugagagucucgagaa

SEQ ID NO: 272661 - RNA, 22 nt, Homo sapiens
uguguuugauaaguccauaguu

SEQ ID NO: 272662 - RNA, 22 nt, Homo sapiens
uguuaacauggucucagucugu

SEQ ID NO: 272663 - RNA, 22 nt, Homo sapiens
uguucacaguguuucuuugaga

SEQ ID NO: 272664 - RNA, 22 nt, Homo sapiens
uguucuugagccuuuagaccua

SEQ ID NO: 272665 - RNA, 22 nt, Homo sapiens
uguuucuacugucucuguagua

SEQ ID NO: 272666 - RNA, 22 nt, Homo sapiens
uguuugcuguuuucuccaauga

SEQ ID NO: 272667 - RNA, 22 nt, Homo sapiens
uuaaaggcauguacacuagagu

SEQ ID NO: 272668 - RNA, 22 nt, Homo sapiens
uuaagacaccaaucauuggauu

SEQ ID NO: 272669 - RNA, 22 nt, Homo sapiens
uuaaggcuuguacuuguuuucu

SEQ ID NO: 272670 - RNA, 22 nt, Homo sapiens
uuaaggcuuuaaguaaacacag

SEQ ID NO: 272671 - RNA, 22 nt, Homo sapiens
uuaauagcaaagaguuuagacu

SEQ ID NO: 272672 - RNA, 22 nt, Homo sapiens
uuacagauggauggcagcuggc

SEQ ID NO: 272673 - RNA, 22 nt, Homo sapiens
uuacagucaaguuacauuucuc

SEQ ID NO: 272674 - RNA, 22 nt, Homo sapiens
uuacuugagauggggugucacu

SEQ ID NO: 272675 - RNA, 22 nt, Homo sapiens
uuagauguuuagaagugggcca

SEQ ID NO: 272676 - RNA, 22 nt, Homo sapiens
uuagcacuaauucguuggggca

SEQ ID NO: 272677 - RNA, 21 nt, Homo sapiens
uuaggcagugucagaggugag

SEQ ID NO: 272678 - RNA, 22 nt, Homo sapiens
uuaggcaguuuauugauuuuca

SEQ ID NO: 272679 - RNA, 22 nt, Homo sapiens
uuaguaguugugauagguaccu

SEQ ID NO: 272680 - RNA, 22 nt, Homo sapiens
uuagucaaguguacugugaaug

SEQ ID NO: 272681 - RNA, 22 nt, Homo sapiens
uuauauguuagacauggugggu

SEQ ID NO: 272682 - RNA, 22 nt, Homo sapiens
uuauauguuucuguuuggaggc

SEQ ID NO: 272683 - RNA, 22 nt, Homo sapiens
uuauauguuucuuagggacaga

SEQ ID NO: 272684 - RNA, 22 nt, Homo sapiens
uuauuagguuagugcaaaaguu

SEQ ID NO: 272685 - RNA, 22 nt, Homo sapiens
uuauuagguugguggaaaagua

SEQ ID NO: 272686 - RNA, 22 nt, Homo sapiens
uucaagaauuaaaguggcuuuu

SEQ ID NO: 272687 - RNA, 22 nt, Homo sapiens
uucacaguacucccuggaauua

SEQ ID NO: 272688 - RNA, 19 nt, Homo sapiens
uucacguaggagaaagaag

SEQ ID NO: 272689 - RNA, 22 nt, Homo sapiens
uucaggguggagaguaugaggu

SEQ ID NO: 272690 - RNA, 22 nt, Homo sapiens
uucaguggguggaugaauauga

SEQ ID NO: 272691 - RNA, 22 nt, Homo sapiens
uucauagucacauucgaugucu

SEQ ID NO: 272692 - RNA, 22 nt, Homo sapiens
uucaucagggagaaauaauuuc

SEQ ID NO: 272693 - RNA, 22 nt, Homo sapiens
uucauguaaucaaggcagcuaa

SEQ ID NO: 272694 - RNA, 22 nt, Homo sapiens
uucauguaauuccauaagguaa

SEQ ID NO: 272695 - RNA, 22 nt, Homo sapiens
uucauguagucaucauccugcu

SEQ ID NO: 272696 - RNA, 22 nt, Homo sapiens
uuccacaaugguugaacuaguu

SEQ ID NO: 272697 - RNA, 22 nt, Homo sapiens
uuccagcugggggcaacucugc

SEQ ID NO: 272698 - RNA, 21 nt, Homo sapiens
uuccagugagccuagaugccu

SEQ ID NO: 272699 - RNA, 22 nt, Homo sapiens
uuccaguggaguaaauggacaa

SEQ ID NO: 272700 - RNA, 22 nt, Homo sapiens
uuccagugggacgagaugugga

SEQ ID NO: 272701 - RNA, 22 nt, Homo sapiens
uuccaguguuugacucaccuuu

SEQ ID NO: 272702 - RNA, 22 nt, Homo sapiens
uuccauguaguugaacgguuuu

SEQ ID NO: 272703 - RNA, 22 nt, Homo sapiens
uuccuugaaacagucaagagaa

SEQ ID NO: 272704 - RNA, 22 nt, Homo sapiens
uucuacagugacugcagccaua

SEQ ID NO: 272705 - RNA, 17 nt, Homo sapiens
uucucaguucugaucuc

SEQ ID NO: 272706 - RNA, 22 nt, Homo sapiens
uucuucaggccacaaaaauggu

SEQ ID NO: 272707 - RNA, 22 nt, Homo sapiens
uucuugcacuuaacugacauuc

SEQ ID NO: 272708 - RNA, 22 nt, Homo sapiens
uucuugcugaauugugcccuuc

SEQ ID NO: 272709 - RNA, 22 nt, Homo sapiens
uucuugcuguauccucacaugg

SEQ ID NO: 272710 - RNA, 22 nt, Homo sapiens
uucuuuaguucacuugcuccag

SEQ ID NO: 272711 - RNA, 22 nt, Homo sapiens
uugaaagacaucaccuacugcu

SEQ ID NO: 272712 - RNA, 23 nt, Homo sapiens
ucagguaguuucagaggaccuug

SEQ ID NO: 272713 - RNA, 22 nt, Homo sapiens
ucaggugcagagaagaaauggg

SEQ ID NO: 272714 - RNA, 22 nt, Homo sapiens
ucauaugucauaguaugaucuu

SEQ ID NO: 272715 - RNA, 22 nt, Homo sapiens
ucaucagaaucccuuagggaug

SEQ ID NO: 272716 - RNA, 22 nt, Homo sapiens
ucaucaguuuuuuauaugugau

SEQ ID NO: 272717 - RNA, 22 nt, Homo sapiens
ucauccauacaguuagcaaagg

SEQ ID NO: 272718 - RNA, 22 nt, Homo sapiens
ucaugaaguaguuaacugguug

SEQ ID NO: 272719 - RNA, 22 nt, Homo sapiens
ucaugucuuguuguauuuauuu

SEQ ID NO: 272720 - RNA, 22 nt, Homo sapiens
uccagcuuuuucuaauucugug

SEQ ID NO: 272721 - RNA, 18 nt, Homo sapiens
uccaguuuucccagcauc

SEQ ID NO: 272722 - RNA, 22 nt, Homo sapiens
uccauuugucuauguuucuguu

SEQ ID NO: 272723 - RNA, 19 nt, Homo sapiens
ucccaagaugcucauacau

SEQ ID NO: 272724 - RNA, 22 nt, Homo sapiens
ucccacugucuucucgugcucg

SEQ ID NO: 272725 - RNA, 22 nt, Homo sapiens
ucccaguuuuucugaauaguca

SEQ ID NO: 272726 - RNA, 22 nt, Homo sapiens
uccccugagaacuugcuagaaa

SEQ ID NO: 272727 - RNA, 22 nt, Homo sapiens
ucccugguguuaguuuguucuu

SEQ ID NO: 272728 - RNA, 22 nt, Homo sapiens
uccuucaguccaguggguuuug

SEQ ID NO: 272729 - RNA, 22 nt, Homo sapiens
uccuugagucuuugcucagaug

SEQ ID NO: 272730 - RNA, 18 nt, Homo sapiens
uccuuuugggguaggaga

SEQ ID NO: 272731 - RNA, 22 nt, Homo sapiens
ucucaaguaacugggacaauaa

SEQ ID NO: 272732 - RNA, 22 nt, Homo sapiens
ucucaguguuaucuaucugccu

SEQ ID NO: 272733 - RNA, 22 nt, Homo sapiens
ucucccauccaugaacuucugu

SEQ ID NO: 272734 - RNA, 22 nt, Homo sapiens
ucuccggguggcggcgaaggga

SEQ ID NO: 272735 - RNA, 23 nt, Homo sapiens
ucugauguuauaaaauucuuugg

SEQ ID NO: 272736 - RNA, 21 nt, Homo sapiens
ucuggcuuucauuccccuucu

SEQ ID NO: 272737 - RNA, 23 nt, Homo sapiens
ucuggcuuugggaugcucaaggg

SEQ ID NO: 272738 - RNA, 22 nt, Homo sapiens
ucugugcuugucauaugcuuug

SEQ ID NO: 272739 - RNA, 17 nt, Homo sapiens
ucuucuguuacuguggc

SEQ ID NO: 272740 - RNA, 20 nt, Homo sapiens
ucuugaacuuagucaacagg

SEQ ID NO: 272741 - RNA, 22 nt, Homo sapiens
ucuugcuuguuguucccuucau

SEQ ID NO: 272742 - RNA, 22 nt, Homo sapiens
ucuugguuaggggaaauaggca

SEQ ID NO: 272743 - RNA, 23 nt, Homo sapiens
ucuugguuauagaaaaauaguug

SEQ ID NO: 272744 - RNA, 22 nt, Homo sapiens
ucuuuggaggcgaucuguuuga

SEQ ID NO: 272745 - RNA, 22 nt, Homo sapiens
ucuuuugugagucagccucucc

SEQ ID NO: 272746 - RNA, 22 nt, Homo sapiens
ugaaaagucuaagauuaagguu

SEQ ID NO: 272747 - RNA, 22 nt, Homo sapiens
ugaaaaguuguugaaggcuuca

SEQ ID NO: 272748 - RNA, 22 nt, Homo sapiens
ugaaacauacacucugaugggg

SEQ ID NO: 272749 - RNA, 22 nt, Homo sapiens
ugaaagcuacagucuccuagga

SEQ ID NO: 272750 - RNA, 22 nt, Homo sapiens
ugaaaugauuauaugguguuug

SEQ ID NO: 272751 - RNA, 22 nt, Homo sapiens
ugaacagcacguuuauucagaa

SEQ ID NO: 272752 - RNA, 22 nt, Homo sapiens
ugaaggaguauggauaagucgu

SEQ ID NO: 272753 - RNA, 19 nt, Homo sapiens
ugaaugacaucuaaagucc

SEQ ID NO: 272754 - RNA, 23 nt, Homo sapiens
ugaauguaucgaaugugggaaag

SEQ ID NO: 272755 - RNA, 22 nt, Homo sapiens
ugacagcugaagauguugaacc

SEQ ID NO: 272756 - RNA, 22 nt, Homo sapiens
ugacaguaaacagucuugauua

SEQ ID NO: 272757 - RNA, 23 nt, Homo sapiens
ugacagucucccgauggcuaggc

SEQ ID NO: 272758 - RNA, 22 nt, Homo sapiens
ugacaugaugagcaauaauggc

SEQ ID NO: 272759 - RNA, 22 nt, Homo sapiens
ugagaacagauggcuuuauuau

SEQ ID NO: 272760 - RNA, 22 nt, Homo sapiens
ugagaacaugcacuugagguug

SEQ ID NO: 272761 - RNA, 16 nt, Homo sapiens
ugagaacaugugauau

SEQ ID NO: 272762 - RNA, 22 nt, Homo sapiens
ugagaacauuccucuuccuggc

SEQ ID NO: 272763 - RNA, 22 nt, Homo sapiens
ugagaacuuugucuuuuacucu

SEQ ID NO: 272764 - RNA, 22 nt, Homo sapiens
ugagaaugaugauugguaaacc

SEQ ID NO: 272765 - RNA, 22 nt, Homo sapiens
ugagacggagucucgcucuguu

SEQ ID NO: 272766 - RNA, 22 nt, Homo sapiens
ugagacggagucucgcuguguc

SEQ ID NO: 272767 - RNA, 22 nt, Homo sapiens
ugagacggagucuugcucuguc

SEQ ID NO: 272768 - RNA, 22 nt, Homo sapiens
ugagacugaguuucacuuuugu

SEQ ID NO: 272769 - RNA, 22 nt, Homo sapiens
ugagacugaguuuugccuuugu

SEQ ID NO: 272770 - RNA, 22 nt, Homo sapiens
ugagacugaguuuugcucguug

SEQ ID NO: 272771 - RNA, 22 nt, Homo sapiens
ugagaggugauaaagcaagggu

SEQ ID NO: 272772 - RNA, 21 nt, Homo sapiens
ugagaguaguguauuauucuc

SEQ ID NO: 272773 - RNA, 22 nt, Homo sapiens
ugagaucagugaagaaguguuu

SEQ ID NO: 272774 - RNA, 19 nt, Homo sapiens
ugagaucuuuacuggguuu

SEQ ID NO: 272775 - RNA, 22 nt, Homo sapiens
ugagaucuuugcuguccucacc

SEQ ID NO: 272776 - RNA, 22 nt, Homo sapiens
ugagaugaacuugauuguuuua

SEQ ID NO: 272777 - RNA, 22 nt, Homo sapiens
ugagaugacgacacaccucagu

SEQ ID NO: 272778 - RNA, 22 nt, Homo sapiens
ugagaugaguucucgcucuguc

SEQ ID NO: 272779 - RNA, 22 nt, Homo sapiens
ugagaugaugggauaagagggc

SEQ ID NO: 272780 - RNA, 22 nt, Homo sapiens
ugagauggagucuugucgccua

SEQ ID NO: 272781 - RNA, 22 nt, Homo sapiens
ugagauggaguuucgcucuugu

SEQ ID NO: 272782 - RNA, 22 nt, Homo sapiens
ugagaugugaagaucacaugaa

SEQ ID NO: 272783 - RNA, 19 nt, Homo sapiens
ugagauuguaugaggagau

SEQ ID NO: 272784 - RNA, 22 nt, Homo sapiens
ugagcagagggagaaguaaauu

SEQ ID NO: 272785 - RNA, 22 nt, Homo sapiens
ugagcaucucuaaaaggagcaa

SEQ ID NO: 272786 - RNA, 22 nt, Homo sapiens
ugagcugagaucaugcuauugu

SEQ ID NO: 272787 - RNA, 22 nt, Homo sapiens
ugagcugagaucgugccauugu

SEQ ID NO: 272788 - RNA, 18 nt, Homo sapiens
ugaggaaaggguuugcua

SEQ ID NO: 272789 - RNA, 22 nt, Homo sapiens
ugaggagugaacuauuucugau

SEQ ID NO: 272790 - RNA, 22 nt, Homo sapiens
ugaggaguguauuucauucgcu

SEQ ID NO: 272791 - RNA, 22 nt, Homo sapiens
ugagguaaaacaaggauuggau

SEQ ID NO: 272792 - RNA, 22 nt, Homo sapiens
ugagguaagauguucauuuuuc

SEQ ID NO: 272793 - RNA, 22 nt, Homo sapiens
ugagguaauagauaauauuuuu

SEQ ID NO: 272794 - RNA, 22 nt, Homo sapiens
ugagguaucauugcccaggcug

SEQ ID NO: 272795 - RNA, 22 nt, Homo sapiens
ugagguuauuuguucaagaagu

SEQ ID NO: 272796 - RNA, 22 nt, Homo sapiens
ugagguuggggucagggcuagc

SEQ ID NO: 272797 - RNA, 23 nt, Homo sapiens
ugaguagguccacguaugugagu

SEQ ID NO: 272798 - RNA, 22 nt, Homo sapiens
ugaguauuugggggaccagaga

SEQ ID NO: 272799 - RNA, 22 nt, Homo sapiens
aguggguguuccauuggauaaa

SEQ ID NO: 272800 - RNA, 22 nt, Homo sapiens
aguggugucugaguggccaggg

SEQ ID NO: 272801 - RNA, 20 nt, Homo sapiens
agugguuuucaaauaugucu

SEQ ID NO: 272802 - RNA, 22 nt, Homo sapiens
aguuggcacugagcugugauug

SEQ ID NO: 272803 - RNA, 22 nt, Homo sapiens
auaaaugcauugagaacugcug

SEQ ID NO: 272804 - RNA, 22 nt, Homo sapiens
auaacaggaaauacagggcuuu

SEQ ID NO: 272805 - RNA, 23 nt, Homo sapiens
auaaugcaaguggugguaaucug

SEQ ID NO: 272806 - RNA, 22 nt, Homo sapiens
auacuguacugaaguacccauu

SEQ ID NO: 272807 - RNA, 21 nt, Homo sapiens
auacuugcauccuuggagaga

SEQ ID NO: 272808 - RNA, 22 nt, Homo sapiens
auagaguuagaaagaaauguuu

SEQ ID NO: 272809 - RNA, 22 nt, Homo sapiens
auagcaaugcaagaauggcuua

SEQ ID NO: 272810 - RNA, 22 nt, Homo sapiens
auagcagcaccccacuaccuca

SEQ ID NO: 272811 - RNA, 22 nt, Homo sapiens
auaucacaaacaagucuguacu

SEQ ID NO: 272812 - RNA, 20 nt, Homo sapiens
auaugguugugagugauuuu

SEQ ID NO: 272813 - RNA, 22 nt, Homo sapiens
auauguauuuuaacguguaagg

SEQ ID NO: 272814 - RNA, 22 nt, Homo sapiens
aucacagaguuaaaacuuucuu

SEQ ID NO: 272815 - RNA, 22 nt, Homo sapiens
aucacagauauggguuuaaauc

SEQ ID NO: 272816 - RNA, 22 nt, Homo sapiens
aucacagcccuccucuuggaug

SEQ ID NO: 272817 - RNA, 22 nt, Homo sapiens
aucacuuugcucuccagugugg

SEQ ID NO: 272818 - RNA, 22 nt, Homo sapiens
aucaggcacacauuggaguuug

SEQ ID NO: 272819 - RNA, 22 nt, Homo sapiens
auccacaugcaguuggaaacag

SEQ ID NO: 272820 - RNA, 22 nt, Homo sapiens
auccaucagacggcaggcguug

SEQ ID NO: 272821 - RNA, 22 nt, Homo sapiens
auccauguggauaaauguguau

SEQ ID NO: 272822 - RNA, 22 nt, Homo sapiens
aucccuguaguaauauucuagc

SEQ ID NO: 272823 - RNA, 22 nt, Homo sapiens
aucccugugacgagcaucccua

SEQ ID NO: 272824 - RNA, 22 nt, Homo sapiens
auccucugagagaguuucauaa

SEQ ID NO: 272825 - RNA, 22 nt, Homo sapiens
aucuccaggugccagcugcgcc

SEQ ID NO: 272826 - RNA, 22 nt, Homo sapiens
aucugguguauuggugcugggu

SEQ ID NO: 272827 - RNA, 22 nt, Homo sapiens
aucugguguggcugugauccuc

SEQ ID NO: 272828 - RNA, 22 nt, Homo sapiens
augaaaucacugugaugcccua

SEQ ID NO: 272829 - RNA, 23 nt, Homo sapiens
augacacuguccuugaccauuuc

SEQ ID NO: 272830 - RNA, 22 nt, Homo sapiens
augacaguguggauuauuguaa

SEQ ID NO: 272831 - RNA, 22 nt, Homo sapiens
augagaacauaucaagugauug

SEQ ID NO: 272832 - RNA, 22 nt, Homo sapiens
augagauuguuuguacuccaca

SEQ ID NO: 272833 - RNA, 22 nt, Homo sapiens
augagcuaggacagaaugucag

SEQ ID NO: 272834 - RNA, 22 nt, Homo sapiens
augagcucauaaagagugauuu

SEQ ID NO: 272835 - RNA, 22 nt, Homo sapiens
augagguauccaagcccagaaa

SEQ ID NO: 272836 - RNA, 23 nt, Homo sapiens
augagguaucugagcccagaaau

SEQ ID NO: 272837 - RNA, 22 nt, Homo sapiens
augaggugaggucaguaaggua

SEQ ID NO: 272838 - RNA, 22 nt, Homo sapiens
augauggagguagauuguccau

SEQ ID NO: 272839 - RNA, 22 nt, Homo sapiens
augcaaacagcuaucuggcugg

SEQ ID NO: 272840 - RNA, 22 nt, Homo sapiens
augccaagaugagcacgcgucu

SEQ ID NO: 272841 - RNA, 22 nt, Homo sapiens
augccacugcacuucagccugc

SEQ ID NO: 272842 - RNA, 22 nt, Homo sapiens
gugagguugaaaauaauggaaa

SEQ ID NO: 272843 - RNA, 22 nt, Homo sapiens
gugaugguaguuuguauuucug

SEQ ID NO: 272844 - RNA, 22 nt, Homo sapiens
gugcaaauguuauugagguuuu

SEQ ID NO: 272845 - RNA, 22 nt, Homo sapiens
gugccacaguguuaagggauuc

SEQ ID NO: 272846 - RNA, 22 nt, Homo sapiens
guggaaguuaagugacuuucug

SEQ ID NO: 272847 - RNA, 22 nt, Homo sapiens
guggaguaugaaaacugacuuu

SEQ ID NO: 272848 - RNA, 22 nt, Homo sapiens
guggcuagaaugaagguagcug

SEQ ID NO: 272849 - RNA, 22 nt, Homo sapiens
gugggauauaaucaguccugua

SEQ ID NO: 272850 - RNA, 22 nt, Homo sapiens
gugguuuuaucccagaaauuaa

SEQ ID NO: 272851 - RNA, 22 nt, Homo sapiens
gugguuuuuuucugccuuauag

SEQ ID NO: 272852 - RNA, 22 nt, Homo sapiens
guguaaguccugaguuuggaua

SEQ ID NO: 272853 - RNA, 22 nt, Homo sapiens
guguagagaaaaguaccauuuu

SEQ ID NO: 272854 - RNA, 22 nt, Homo sapiens
guguaugguuguuguagagaga

SEQ ID NO: 272855 - RNA, 22 nt, Homo sapiens
guguauguuguccauggaugcg

SEQ ID NO: 272856 - RNA, 21 nt, Homo sapiens
gugucacagacaugacagaug

SEQ ID NO: 272857 - RNA, 22 nt, Homo sapiens
gugucacuguauaauauuuauu

SEQ ID NO: 272858 - RNA, 22 nt, Homo sapiens
gugucccagugugcauacaggu

SEQ ID NO: 272859 - RNA, 22 nt, Homo sapiens
guguccucgaguacacaucagg

SEQ ID NO: 272860 - RNA, 22 nt, Homo sapiens
gugucuccuguggagcuaugua

SEQ ID NO: 272861 - RNA, 22 nt, Homo sapiens
gugugcauaugucuuuauagua

SEQ ID NO: 272862 - RNA, 19 nt, Homo sapiens
ucuaaaucucuugauagac

SEQ ID NO: 272863 - RNA, 22 nt, Homo sapiens
ucuaaugcucugagaacagugc

SEQ ID NO: 272864 - RNA, 22 nt, Homo sapiens
ucucagagccuaggguuuuuca

SEQ ID NO: 272865 - RNA, 22 nt, Homo sapiens
ucucagcacagucagggcgccu

SEQ ID NO: 272866 - RNA, 22 nt, Homo sapiens
ucucaguuuucaagcugucgau

SEQ ID NO: 272867 - RNA, 21 nt, Homo sapiens
ucucauagaguuucacuuucu

SEQ ID NO: 272868 - RNA, 17 nt, Homo sapiens
ucucccaucccuuucuc

SEQ ID NO: 272869 - RNA, 22 nt, Homo sapiens
ucucuuggugacuuaaaauguu

SEQ ID NO: 272870 - RNA, 22 nt, Homo sapiens
ucugacagugugaauauugacu

SEQ ID NO: 272871 - RNA, 22 nt, Homo sapiens
ucugaguggcagaaugagcuga

SEQ ID NO: 272872 - RNA, 22 nt, Homo sapiens
ucugccuuuucaugugggaugg

SEQ ID NO: 272873 - RNA, 22 nt, Homo sapiens
ucuggcaagauauccauugcuu

SEQ ID NO: 272874 - RNA, 22 nt, Homo sapiens
ucuggccuagaacaauuaauua

SEQ ID NO: 272875 - RNA, 23 nt, Homo sapiens
ucugguguugucaaaugcugguu

SEQ ID NO: 272876 - RNA, 22 nt, Homo sapiens
ucugucaaaucuuauguuguag

SEQ ID NO: 272877 - RNA, 22 nt, Homo sapiens
ucugucuuguccucacccuaga

SEQ ID NO: 272878 - RNA, 22 nt, Homo sapiens
ucugucuugugguuugagugcc

SEQ ID NO: 272879 - RNA, 22 nt, Homo sapiens
ucugugcauggcagaggaauga

SEQ ID NO: 272880 - RNA, 22 nt, Homo sapiens
ucugugcauuacacuuuucuca

SEQ ID NO: 272881 - RNA, 22 nt, Homo sapiens
ucugugcauuuucuuuuagacu

SEQ ID NO: 272882 - RNA, 19 nt, Homo sapiens
ucugugcuugucccccugu

SEQ ID NO: 272883 - RNA, 22 nt, Homo sapiens
ucuugcuuuugcagagcuucuc

SEQ ID NO: 272884 - RNA, 22 nt, Homo sapiens
ucuuggccaugaauggcaaggc

SEQ ID NO: 272885 - RNA, 20 nt, Homo sapiens
ucuugggaauguagccuagg

SEQ ID NO: 272886 - RNA, 22 nt, Homo sapiens
ucuuggguuugccuugcugcug

SEQ ID NO: 272887 - RNA, 20 nt, Homo sapiens
ucuuucgguuaccaggcagu

SEQ ID NO: 272888 - RNA, 22 nt, Homo sapiens
ucuuuggauggaaauuggaguc

SEQ ID NO: 272889 - RNA, 22 nt, Homo sapiens
ucuuuggguagauauguagcug

SEQ ID NO: 272890 - RNA, 22 nt, Homo sapiens
ucuuuggguguauuucacagcc

SEQ ID NO: 272891 - RNA, 22 nt, Homo sapiens
ugaaaugccuuuaaugaauuua

SEQ ID NO: 272892 - RNA, 22 nt, Homo sapiens
ugaaauggaaagaguguagacu

SEQ ID NO: 272893 - RNA, 22 nt, Homo sapiens
ugaagcuaggauuaauuuucau

SEQ ID NO: 272894 - RNA, 22 nt, Homo sapiens
ugaagugaagacucacagaagg

SEQ ID NO: 272895 - RNA, 22 nt, Homo sapiens
ugaagugggaaaugaguauuaa

SEQ ID NO: 272896 - RNA, 22 nt, Homo sapiens
ugaauauuugcuacucacucuu

SEQ ID NO: 272897 - RNA, 21 nt, Homo sapiens
ugaauauuuggguugugucca

SEQ ID NO: 272898 - RNA, 22 nt, Homo sapiens
ugaaucauuucuugucuucagu

SEQ ID NO: 272899 - RNA, 22 nt, Homo sapiens
ugacagaggucuuuuaauagcu

SEQ ID NO: 272900 - RNA, 22 nt, Homo sapiens
ugacagguugauaggugcagca

SEQ ID NO: 272901 - RNA, 19 nt, Homo sapiens
ugacaugaaacccaagauc

SEQ ID NO: 272902 - RNA, 22 nt, Homo sapiens
ugacauggagguggaggaagau

SEQ ID NO: 272903 - RNA, 22 nt, Homo sapiens
ugacuagagcaauuggaaacaa

SEQ ID NO: 272904 - RNA, 22 nt, Homo sapiens
ugacuagugugauguaguaaau

SEQ ID NO: 272905 - RNA, 22 nt, Homo sapiens
ugacuauugauuuagacgugcu

SEQ ID NO: 272906 - RNA, 22 nt, Homo sapiens
ugacuugauacauguuuuugaa

SEQ ID NO: 272907 - RNA, 22 nt, Homo sapiens
ugacuugauccauggggcucca

SEQ ID NO: 272908 - RNA, 22 nt, Homo sapiens
ugagaacagcagcuugggacac

SEQ ID NO: 272909 - RNA, 16 nt, Homo sapiens
ugagaacaugcagcau

SEQ ID NO: 272910 - RNA, 20 nt, Homo sapiens
ugagaacauguggcauuugg

SEQ ID NO: 272911 - RNA, 22 nt, Homo sapiens
ugagaacugccuguauuuaucu

SEQ ID NO: 272912 - RNA, 22 nt, Homo sapiens
ugagaagacaucagcuuucgga

SEQ ID NO: 272913 - RNA, 22 nt, Homo sapiens
ugagacugaaauuaggaaacug

SEQ ID NO: 272914 - RNA, 22 nt, Homo sapiens
ugagagaugaacucugauaugu

SEQ ID NO: 272915 - RNA, 22 nt, Homo sapiens
ugagaggugaauggcaggcuca

SEQ ID NO: 272916 - RNA, 22 nt, Homo sapiens
ugagauaaucaugugauuucau

SEQ ID NO: 272917 - RNA, 22 nt, Homo sapiens
ugagaucagaaggauuucucug

SEQ ID NO: 272918 - RNA, 22 nt, Homo sapiens
ugagaucgagucucgcucuguc

SEQ ID NO: 272919 - RNA, 22 nt, Homo sapiens
ugagaugaagugauguaaaaca

SEQ ID NO: 272920 - RNA, 22 nt, Homo sapiens
ugagaugagaaucaguucuaau

SEQ ID NO: 272921 - RNA, 22 nt, Homo sapiens
ugagaugauagauauguuaauu

SEQ ID NO: 272922 - RNA, 21 nt, Homo sapiens
ugagaugcaaucaccagggag

SEQ ID NO: 272923 - RNA, 22 nt, Homo sapiens
ugagaugcuccucuugcaaagc

SEQ ID NO: 272924 - RNA, 22 nt, Homo sapiens
gacuuugguagaggaaaaaucu

SEQ ID NO: 272925 - RNA, 22 nt, Homo sapiens
gagaaccauuuggagaaaaagu

SEQ ID NO: 272926 - RNA, 22 nt, Homo sapiens
gagacggagucucgcucuguca

SEQ ID NO: 272927 - RNA, 22 nt, Homo sapiens
gagaugguacacauacgauucu

SEQ ID NO: 272928 - RNA, 22 nt, Homo sapiens
gagauggugugcuguuggaagu

SEQ ID NO: 272929 - RNA, 22 nt, Homo sapiens
gagauucuucaauauuuauucu

SEQ ID NO: 272930 - RNA, 22 nt, Homo sapiens
gagccauggagaaaacagcuau

SEQ ID NO: 272931 - RNA, 22 nt, Homo sapiens
gagcugaaguuuccauuuguac

SEQ ID NO: 272932 - RNA, 22 nt, Homo sapiens
gagcuguugguuugaaagaauu

SEQ ID NO: 272933 - RNA, 22 nt, Homo sapiens
gaggugguagguucacagcagc

SEQ ID NO: 272934 - RNA, 23 nt, Homo sapiens
gaguacauuaaaagcccagacug

SEQ ID NO: 272935 - RNA, 22 nt, Homo sapiens
gaguauauuugcacuguuaugu

SEQ ID NO: 272936 - RNA, 18 nt, Homo sapiens
gaguggugcuucccuugu

SEQ ID NO: 272937 - RNA, 22 nt, Homo sapiens
gaucacauuguuucauacauau

SEQ ID NO: 272938 - RNA, 22 nt, Homo sapiens
gaucuguguuuguaugcauaag

SEQ ID NO: 272939 - RNA, 22 nt, Homo sapiens
gaugcaguaagaaugcauagcg

SEQ ID NO: 272940 - RNA, 21 nt, Homo sapiens
gcaaacauccuuugaugccag

SEQ ID NO: 272941 - RNA, 22 nt, Homo sapiens
gcacugggccacauuuauuuuc

SEQ ID NO: 272942 - RNA, 19 nt, Homo sapiens
gcagagaugugguagcuug

SEQ ID NO: 272943 - RNA, 22 nt, Homo sapiens
gcagaucuucgcgguaaguguu

SEQ ID NO: 272944 - RNA, 22 nt, Homo sapiens
gcagguaguuucugacuuuuac

SEQ ID NO: 272945 - RNA, 22 nt, Homo sapiens
gcagugcaguggcgcgaucucg

SEQ ID NO: 272946 - RNA, 22 nt, Homo sapiens
gcauaugucuuuauagcagcau

SEQ ID NO: 272947 - RNA, 20 nt, Homo sapiens
gcauaugucuuuauggcagc

SEQ ID NO: 272948 - RNA, 22 nt, Homo sapiens
gcauauuuuaaaguguaaccug

SEQ ID NO: 272949 - RNA, 22 nt, Homo sapiens
gcauggaguggaaauucuuggg

SEQ ID NO: 272950 - RNA, 22 nt, Homo sapiens
gccaagaucugaauaauuaaga

SEQ ID NO: 272951 - RNA, 22 nt, Homo sapiens
gccaagauugguuuaauauucc

SEQ ID NO: 272952 - RNA, 22 nt, Homo sapiens
gccauugcacuccgcccugggc

SEQ ID NO: 272953 - RNA, 22 nt, Homo sapiens
gcccagcguucagggaggggcu

SEQ ID NO: 272954 - RNA, 22 nt, Homo sapiens
gcccuguugcccaggcuggagu

SEQ ID NO: 272955 - RNA, 22 nt, Homo sapiens
gccuuuggugacaggcaugugu

SEQ ID NO: 272956 - RNA, 22 nt, Homo sapiens
gcuaaggcaggagcauugcuug

SEQ ID NO: 272957 - RNA, 22 nt, Homo sapiens
gcuaaggcagggcaaucauuug

SEQ ID NO: 272958 - RNA, 22 nt, Homo sapiens
gcugauggugcaguucuagccu

SEQ ID NO: 272959 - RNA, 22 nt, Homo sapiens
gcuguauuguugaaggaaaugu

SEQ ID NO: 272960 - RNA, 17 nt, Homo sapiens
ggaaugaauuccagccc

SEQ ID NO: 272961 - RNA, 22 nt, Homo sapiens
ggagaauguaauugguauuuug

SEQ ID NO: 272962 - RNA, 22 nt, Homo sapiens
ggagaugauuaugaaucacuua

SEQ ID NO: 272963 - RNA, 22 nt, Homo sapiens
ggagguagguuugugauuugua

SEQ ID NO: 272964 - RNA, 22 nt, Homo sapiens
ggagucugacuuauaggaaccu

SEQ ID NO: 272965 - RNA, 22 nt, Homo sapiens
ggaguguguaggagaaagguaa

SEQ ID NO: 272966 - RNA, 23 nt, Homo sapiens
ggauucaucuguuuguucgcugu

SEQ ID NO: 272967 - RNA, 22 nt, Homo sapiens
ggcaacaauuccuacuucuuuu

SEQ ID NO: 272968 - RNA, 22 nt, Homo sapiens
ggcaccauggaaggacgggagc

SEQ ID NO: 272969 - RNA, 17 nt, Homo sapiens
ggcaggauccaggaucc

SEQ ID NO: 272970 - RNA, 22 nt, Homo sapiens
ggcaguguaauaauuuauuaau

SEQ ID NO: 272971 - RNA, 22 nt, Homo sapiens
ggcaugaggccauaaaaguaag

SEQ ID NO: 272972 - RNA, 22 nt, Homo sapiens
ggccuguaggguauugguaggg

SEQ ID NO: 272973 - RNA, 22 nt, Homo sapiens
ggcucagugaucuguuucugua

SEQ ID NO: 272974 - RNA, 22 nt, Homo sapiens
ggcucaguugcaaaucaguuca

SEQ ID NO: 272975 - RNA, 22 nt, Homo sapiens
ggcucaguuuccuccgucugcu

SEQ ID NO: 272976 - RNA, 22 nt, Homo sapiens
gggaaauguaaagucauaagau

SEQ ID NO: 272977 - RNA, 19 nt, Homo sapiens
ggucauggagguuguguga

SEQ ID NO: 272978 - RNA, 22 nt, Homo sapiens
guaaacuuccccucaugaauga

SEQ ID NO: 272979 - RNA, 22 nt, Homo sapiens
guaaucucagcuacuugggagc

SEQ ID NO: 272980 - RNA, 22 nt, Homo sapiens
guaaucucagcuacuugggagu

SEQ ID NO: 272981 - RNA, 22 nt, Homo sapiens
guaaugcacucccaaagaucca

SEQ ID NO: 272982 - RNA, 22 nt, Homo sapiens
gucugguuggaguaguuuucag

SEQ ID NO: 272983 - RNA, 22 nt, Homo sapiens
gucugugcauuaauacgugcug

SEQ ID NO: 272984 - RNA, 22 nt, Homo sapiens
gucuuccagccuccaucuuucu

SEQ ID NO: 272985 - RNA, 22 nt, Homo sapiens
gucuuggcaugugcagcuggga

SEQ ID NO: 272986 - RNA, 22 nt, Homo sapiens
gucuuuggaaagacaaaguuca

SEQ ID NO: 272987 - RNA, 22 nt, Homo sapiens
gucuuuguuuggucuguaucag

SEQ ID NO: 272988 - RNA, 22 nt, Homo sapiens
gugagaagaaaaauauggcugu

SEQ ID NO: 272989 - RNA, 22 nt, Homo sapiens
gugagaugaggucucacucugu

SEQ ID NO: 272990 - RNA, 22 nt, Homo sapiens
gugagauggaguuggugucuuu

SEQ ID NO: 272991 - RNA, 22 nt, Homo sapiens
gugagaugguaucucauugugg

SEQ ID NO: 272992 - RNA, 22 nt, Homo sapiens
gugagaugugacuucugccucu

SEQ ID NO: 272993 - RNA, 22 nt, Homo sapiens
gugagcauauuaguauugcacu

SEQ ID NO: 272994 - RNA, 22 nt, Homo sapiens
gagguugggaugagggauacag

SEQ ID NO: 272995 - RNA, 23 nt, Homo sapiens
gagugcaaugacaugaucucgga

SEQ ID NO: 272996 - RNA, 22 nt, Homo sapiens
gagugcaauggcaugaucuugg

SEQ ID NO: 272997 - RNA, 22 nt, Homo sapiens
gagugcaauggcgcgaucucgg

SEQ ID NO: 272998 - RNA, 22 nt, Homo sapiens
gaucacauggccauuucuagcu

SEQ ID NO: 272999 - RNA, 22 nt, Homo sapiens
gaugaugcuagguguuagggcu

SEQ ID NO: 273000 - RNA, 22 nt, Homo sapiens
gaugccuuuuuguccucaguua

SEQ ID NO: 273001 - RNA, 22 nt, Homo sapiens
gauggcauuucuggaucugaca

SEQ ID NO: 273002 - RNA, 22 nt, Homo sapiens
gaugguguuuugauaggaauug

SEQ ID NO: 273003 - RNA, 22 nt, Homo sapiens
gauuagaacagaagucagauua

SEQ ID NO: 273004 - RNA, 22 nt, Homo sapiens
gauuuguuggccugugagcuag

SEQ ID NO: 273005 - RNA, 22 nt, Homo sapiens
gcaaaguguuuuuaggaagucu

SEQ ID NO: 273006 - RNA, 22 nt, Homo sapiens
gcagcacaugacuguauguaua

SEQ ID NO: 273007 - RNA, 22 nt, Homo sapiens
gcagguguuaugcaaacaacug

SEQ ID NO: 273008 - RNA, 22 nt, Homo sapiens
gcagugcuggagcccccgugug

SEQ ID NO: 273009 - RNA, 22 nt, Homo sapiens
gcagugugauguuuuaaucuau

SEQ ID NO: 273010 - RNA, 22 nt, Homo sapiens
gcaguguucaaaucaugcccau

SEQ ID NO: 273011 - RNA, 22 nt, Homo sapiens
gcaucaaugucuauaguguuug

SEQ ID NO: 273012 - RNA, 22 nt, Homo sapiens
gcauggccuuuaaaugucacag

SEQ ID NO: 273013 - RNA, 22 nt, Homo sapiens
gccaaaaugcugggauuacagg

SEQ ID NO: 273014 - RNA, 22 nt, Homo sapiens
gccauugcacuccagcuugggc

SEQ ID NO: 273015 - RNA, 17 nt, Homo sapiens
gcugcauucauguagaa

SEQ ID NO: 273016 - RNA, 22 nt, Homo sapiens
gcuggaauuaacauagaugugc

SEQ ID NO: 273017 - RNA, 22 nt, Homo sapiens
gcuggcaagaugcugaugcaac

SEQ ID NO: 273018 - RNA, 22 nt, Homo sapiens
gcuguguugugcccagcaucau

SEQ ID NO: 273019 - RNA, 21 nt, Homo sapiens
gcuuuuucggaagucuuuggc

SEQ ID NO: 273020 - RNA, 22 nt, Homo sapiens
ggaaagaucagcuaaauguaag

SEQ ID NO: 273021 - RNA, 22 nt, Homo sapiens
ggaagacaguguggugauuccu

SEQ ID NO: 273022 - RNA, 22 nt, Homo sapiens
ggaguaaaagaguaggaggaau

SEQ ID NO: 273023 - RNA, 22 nt, Homo sapiens
ggagucugauguucuaaggcag

SEQ ID NO: 273024 - RNA, 22 nt, Homo sapiens
ggagugugauuguucucuguua

SEQ ID NO: 273025 - RNA, 22 nt, Homo sapiens
ggcaaaugaagauggagaggcu

SEQ ID NO: 273026 - RNA, 22 nt, Homo sapiens
ggcaagugucagcagcaacacc

SEQ ID NO: 273027 - RNA, 22 nt, Homo sapiens
ggcaguuuguucuugcuccuuu

SEQ ID NO: 273028 - RNA, 21 nt, Homo sapiens
ggcaugaauggaaaagugaga

SEQ ID NO: 273029 - RNA, 22 nt, Homo sapiens
ggcuagagagcucagggauaug

SEQ ID NO: 273030 - RNA, 22 nt, Homo sapiens
ggcuagauauucacauauggcu

SEQ ID NO: 273031 - RNA, 22 nt, Homo sapiens
ggcuagaugcuagagauaucau

SEQ ID NO: 273032 - RNA, 19 nt, Homo sapiens
ggcucagucaacugacugu

SEQ ID NO: 273033 - RNA, 22 nt, Homo sapiens
gggaagaaggagugguuuacuc

SEQ ID NO: 273034 - RNA, 19 nt, Homo sapiens
gggcaaaucuggaaauuua

SEQ ID NO: 273035 - RNA, 23 nt, Homo sapiens
gggcuagaugagagcuuccuggg

SEQ ID NO: 273036 - RNA, 22 nt, Homo sapiens
ggucauggauaagauccagaag

SEQ ID NO: 273037 - RNA, 22 nt, Homo sapiens
ggugaggaaaguugaguuucua

SEQ ID NO: 273038 - RNA, 22 nt, Homo sapiens
ggugcuugaggaacggaggcug

SEQ ID NO: 273039 - RNA, 22 nt, Homo sapiens
gguggucuuccccuggaguucg

SEQ ID NO: 273040 - RNA, 22 nt, Homo sapiens
ggugucaguuggccccuacugg

SEQ ID NO: 273041 - RNA, 22 nt, Homo sapiens
gguguuccccuuaccucuuggc

SEQ ID NO: 273042 - RNA, 22 nt, Homo sapiens
guacacauacauauaugugugu

SEQ ID NO: 273043 - RNA, 22 nt, Homo sapiens
guauacacccugugauauuauu

SEQ ID NO: 273044 - RNA, 22 nt, Homo sapiens
guauggcaugcaugagaauuuc

SEQ ID NO: 273045 - RNA, 22 nt, Homo sapiens
guauuuuguuagggugugguau

SEQ ID NO: 273046 - RNA, 22 nt, Homo sapiens
gucaggcaccgauacaguuuuu

SEQ ID NO: 273047 - RNA, 22 nt, Homo sapiens
gucagggagggauagaugauua

SEQ ID NO: 273048 - RNA, 22 nt, Homo sapiens
gucauaugcucggaaaauguua

SEQ ID NO: 273049 - RNA, 22 nt, Homo sapiens
gucccugcgauugugggauccu

SEQ ID NO: 273050 - RNA, 22 nt, Homo sapiens
gucucagugcgaaucucaaaga

SEQ ID NO: 273051 - RNA, 22 nt, Homo sapiens
gucuggcaauggcagacuggca

SEQ ID NO: 273052 - RNA, 22 nt, Homo sapiens
gucuguuuggggaccuguggcc

SEQ ID NO: 273053 - RNA, 22 nt, Homo sapiens
gucuugaaggcugaguaccugu

SEQ ID NO: 273054 - RNA, 22 nt, Homo sapiens
gucuuuguuuugauuuaccaga

SEQ ID NO: 273055 - RNA, 22 nt, Homo sapiens
gucuuuugcuagccagagagcu

SEQ ID NO: 273056 - RNA, 17 nt, Homo sapiens
gugaaaucaucauuuuu

SEQ ID NO: 273057 - RNA, 22 nt, Homo sapiens
gugaccagaugggcaggggugu

SEQ ID NO: 273058 - RNA, 22 nt, Homo sapiens
gugagaugauggguauguuaau

SEQ ID NO: 273059 - RNA, 22 nt, Homo sapiens
gugagcuccucuucugcugcag

SEQ ID NO: 273060 - RNA, 22 nt, Homo sapiens
gugaguggacgugaccaauaaa

SEQ ID NO: 273061 - RNA, 22 nt, Homo sapiens
gugaucuucauggaaggugaaa

SEQ ID NO: 273062 - RNA, 22 nt, Homo sapiens
gugcacaacgugcaggcuuguu

SEQ ID NO: 273063 - RNA, 22 nt, Homo sapiens
gugcacaacgugcagguuaguu

SEQ ID NO: 273064 - RNA, 22 nt, Homo sapiens
gugcacaacguguagguuuguu

SEQ ID NO: 273065 - RNA, 22 nt, Homo sapiens
gugcacaaugugcagguuuguu

SEQ ID NO: 273066 - RNA, 22 nt, Homo sapiens
gugcacaucgugcagguuuguu

SEQ ID NO: 273067 - RNA, 22 nt, Homo sapiens
gugcauguccacuaguccauau

SEQ ID NO: 273068 - RNA, 22 nt, Homo sapiens
gugccuucuagcuaugguuggc

SEQ ID NO: 273069 - RNA, 22 nt, Homo sapiens
guggaagaccagacuuuccaac

SEQ ID NO: 273070 - RNA, 22 nt, Homo sapiens
guggaagucuuugguauuggua

SEQ ID NO: 273071 - RNA, 22 nt, Homo sapiens
guggaaguguaaaagcucuugg

SEQ ID NO: 273072 - RNA, 22 nt, Homo sapiens
guggacguguguccccauggcu

SEQ ID NO: 273073 - RNA, 22 nt, Homo sapiens
guggacugggagagauaguucc

SEQ ID NO: 273074 - RNA, 18 nt, Homo sapiens
guggagugucuuccugga

SEQ ID NO: 273075 - RNA, 22 nt, Homo sapiens
guggcaagaugacuacucacug

SEQ ID NO: 273076 - RNA, 22 nt, Homo sapiens
guggcuaaagauuuggaaucug

SEQ ID NO: 273077 - RNA, 22 nt, Homo sapiens
guggguaaaucucuggggcucu

SEQ ID NO: 273078 - RNA, 22 nt, Homo sapiens
guggguaaaucucuguucgagg

SEQ ID NO: 273079 - RNA, 22 nt, Homo sapiens
guggguaaaucucuguuugagg

SEQ ID NO: 273080 - RNA, 22 nt, Homo sapiens
gugguuuucaacuccaccugca

SEQ ID NO: 273081 - RNA, 22 nt, Homo sapiens
gugguuuuuaaaguaccugugg

SEQ ID NO: 273082 - RNA, 22 nt, Homo sapiens
aaaagugguguuguuucuaaau

SEQ ID NO: 273083 - RNA, 22 nt, Homo sapiens
aaaguaauugcaguuuuugcaa

SEQ ID NO: 273084 - RNA, 22 nt, Homo sapiens
aaagugcaguacuucguauauu

SEQ ID NO: 273085 - RNA, 22 nt, Homo sapiens
aaaguggugggauuccaggcau

SEQ ID NO: 273086 - RNA, 22 nt, Homo sapiens
aaaugcaugaggugggaagaaa

SEQ ID NO: 273087 - RNA, 22 nt, Homo sapiens
aaauucauuucagcucugggua

SEQ ID NO: 273088 - RNA, 22 nt, Homo sapiens
aaauugcuuuugaagacuuagu

SEQ ID NO: 273089 - RNA, 22 nt, Homo sapiens
aacauguuuagcagauaccugu

SEQ ID NO: 273090 - RNA, 22 nt, Homo sapiens
aacuggccuggcgugcagaggg

SEQ ID NO: 273091 - RNA, 21 nt, Homo sapiens
aagaaagcuggacuugccgcu

SEQ ID NO: 273092 - RNA, 20 nt, Homo sapiens
aagacacuguccccacugga

SEQ ID NO: 273093 - RNA, 18 nt, Homo sapiens
aagagcucagcacagguu

SEQ ID NO: 273094 - RNA, 23 nt, Homo sapiens
aagagguaugacuaugaagugga

SEQ ID NO: 273095 - RNA, 22 nt, Homo sapiens
aagaguaguaguggcacucucu

SEQ ID NO: 273096 - RNA, 22 nt, Homo sapiens
aagaugauguucuuuuucuuag

SEQ ID NO: 273097 - RNA, 22 nt, Homo sapiens
aagcaggugucugugucuguaa

SEQ ID NO: 273098 - RNA, 22 nt, Homo sapiens
aagcaggugugggaggaaaugg

SEQ ID NO: 273099 - RNA, 21 nt, Homo sapiens
aagcaugguguaucuuuccau

SEQ ID NO: 273100 - RNA, 22 nt, Homo sapiens
aagccacuguaccugucucuua

SEQ ID NO: 273101 - RNA, 22 nt, Homo sapiens
aagcugccuugugaaggcauuc

SEQ ID NO: 273102 - RNA, 23 nt, Homo sapiens
aaggacacugaacacuucccagc

SEQ ID NO: 273103 - RNA, 22 nt, Homo sapiens
aaguaauggaguuauuuuauga

SEQ ID NO: 273104 - RNA, 22 nt, Homo sapiens
aaguacuguuuaaauugcagaa

SEQ ID NO: 273105 - RNA, 22 nt, Homo sapiens
aaguauuaugaguccuuguuuu

SEQ ID NO: 273106 - RNA, 22 nt, Homo sapiens
aagucaugaagaggaaaggaca

SEQ ID NO: 273107 - RNA, 22 nt, Homo sapiens
aauaaugucacaggggguuagc

SEQ ID NO: 273108 - RNA, 22 nt, Homo sapiens
aauagcauugaaucuaccaauu

SEQ ID NO: 273109 - RNA, 22 nt, Homo sapiens
aauaucacaguggguguacacc

SEQ ID NO: 273110 - RNA, 19 nt, Homo sapiens
aauauugacaguggugucu

SEQ ID NO: 273111 - RNA, 22 nt, Homo sapiens
aaugcacuccagccugggcgac

SEQ ID NO: 273112 - RNA, 22 nt, Homo sapiens
aauggcauuugccagggcaaag

SEQ ID NO: 273113 - RNA, 22 nt, Homo sapiens
aauggcucuuccuggaguugug

SEQ ID NO: 273114 - RNA, 22 nt, Homo sapiens
aauggcuuucagcuuuucccca

SEQ ID NO: 273115 - RNA, 22 nt, Homo sapiens
aaugucaucuucaguuguacag

SEQ ID NO: 273116 - RNA, 22 nt, Homo sapiens
aauuacuucuacaccaaccuaa

SEQ ID NO: 273117 - RNA, 22 nt, Homo sapiens
aauuaguaaccuaauuccaucu

SEQ ID NO: 273118 - RNA, 22 nt, Homo sapiens
aauucacuucuuuuaggcaggg

SEQ ID NO: 273119 - RNA, 22 nt, Homo sapiens
aauugcauugaauuuguagcuu

SEQ ID NO: 273120 - RNA, 22 nt, Homo sapiens
acaaagugccuccuuuuagagu

SEQ ID NO: 273121 - RNA, 22 nt, Homo sapiens
acacugucaugucucacaggca

SEQ ID NO: 273122 - RNA, 22 nt, Homo sapiens
acagugacagaaagcugauuau

SEQ ID NO: 273123 - RNA, 22 nt, Homo sapiens
acagugcuguggucaugggucu

SEQ ID NO: 273124 - RNA, 22 nt, Homo sapiens
acacuguccaguuaggcuacau

SEQ ID NO: 273125 - RNA, 22 nt, Homo sapiens
acagaccuauuucaaucauuua

SEQ ID NO: 273126 - RNA, 22 nt, Homo sapiens
acaggguuauuguaauaaugua

SEQ ID NO: 273127 - RNA, 22 nt, Homo sapiens
acaggugaaguauuacacuaag

SEQ ID NO: 273128 - RNA, 22 nt, Homo sapiens
acagugcuucugauaugaugcc

SEQ ID NO: 273129 - RNA, 17 nt, Homo sapiens
acagugucuaugaaaug

SEQ ID NO: 273130 - RNA, 22 nt, Homo sapiens
acaguguuccuuuguugugacu

SEQ ID NO: 273131 - RNA, 17 nt, Homo sapiens
acaugagacuggauucu

SEQ ID NO: 273132 - RNA, 22 nt, Homo sapiens
acaugcauccaugugaagagac

SEQ ID NO: 273133 - RNA, 19 nt, Homo sapiens
acauggauuuugugcaaac

SEQ ID NO: 273134 - RNA, 22 nt, Homo sapiens
acauguagacaacggacaaagu

SEQ ID NO: 273135 - RNA, 22 nt, Homo sapiens
acauguauauaaugcauagcga

SEQ ID NO: 273136 - RNA, 22 nt, Homo sapiens
accacaggguaaaguuagauau

SEQ ID NO: 273137 - RNA, 21 nt, Homo sapiens
acccucuaguuuucaacaggc

SEQ ID NO: 273138 - RNA, 22 nt, Homo sapiens
acccuguaggacuauucuaauc

SEQ ID NO: 273139 - RNA, 22 nt, Homo sapiens
accuguagcagacuuaauauuu

SEQ ID NO: 273140 - RNA, 22 nt, Homo sapiens
acucagagagaacugucauuug

SEQ ID NO: 273141 - RNA, 22 nt, Homo sapiens
acucagagauuagcacauguuu

SEQ ID NO: 273142 - RNA, 19 nt, Homo sapiens
acugcacuccaaccuccug

SEQ ID NO: 273143 - RNA, 22 nt, Homo sapiens
acugcacuccagccucggggac

SEQ ID NO: 273144 - RNA, 22 nt, Homo sapiens
acugcacucuagccccugcgac

SEQ ID NO: 273145 - RNA, 22 nt, Homo sapiens
acugcauuugucugucucaauu

SEQ ID NO: 273146 - RNA, 22 nt, Homo sapiens
acuggcuuuugagaaaaacacu

SEQ ID NO: 273147 - RNA, 22 nt, Homo sapiens
acugggucaaaguagaaaacua

SEQ ID NO: 273148 - RNA, 22 nt, Homo sapiens
acuguauagauggaguugauuu

SEQ ID NO: 273149 - RNA, 22 nt, Homo sapiens
acuuuuugaugaggucguuugu

SEQ ID NO: 273150 - RNA, 22 nt, Homo sapiens
agaaugugaccuuauuuggaga

SEQ ID NO: 273151 - RNA, 22 nt, Homo sapiens
agacaagauggcuugagguuca

SEQ ID NO: 273152 - RNA, 22 nt, Homo sapiens
agacuguaaugcauaauuuacu

SEQ ID NO: 273153 - RNA, 22 nt, Homo sapiens
agagaacugauucagggaaaau

SEQ ID NO: 273154 - RNA, 22 nt, Homo sapiens
agagaacuggcuucaccauucu

SEQ ID NO: 273155 - RNA, 22 nt, Homo sapiens
agagaacuguuuacacguuaau

SEQ ID NO: 273156 - RNA, 22 nt, Homo sapiens
agagauaaagauuuuaauuuug

SEQ ID NO: 273157 - RNA, 22 nt, Homo sapiens
agagaucaacugaauuacugga

SEQ ID NO: 273158 - RNA, 22 nt, Homo sapiens
agagaugaagauggggcucccg

SEQ ID NO: 273159 - RNA, 23 nt, Homo sapiens
agagguuuaaucaggcaguugcu

SEQ ID NO: 273160 - RNA, 22 nt, Homo sapiens
agaguaguuuauuaugcuaagg

SEQ ID NO: 273161 - RNA, 22 nt, Homo sapiens
agauggauuuuguagccccagc

SEQ ID NO: 273162 - RNA, 22 nt, Homo sapiens
agauguuguucaucugauuguu

SEQ ID NO: 273163 - RNA, 22 nt, Homo sapiens
agcaacaucagcagcaggaaaa

SEQ ID NO: 273164 - RNA, 22 nt, Homo sapiens
agcaauaugacauugcuacauc

SEQ ID NO: 273165 - RNA, 22 nt, Homo sapiens
agcacagugguuaaguuucuua

SEQ ID NO: 273166 - RNA, 22 nt, Homo sapiens
agcagauguuuagugagcgccu

SEQ ID NO: 273167 - RNA, 17 nt, Homo sapiens
agcagcccauaucccca

SEQ ID NO: 273168 - RNA, 22 nt, Homo sapiens
agcagcuuugcauggccugugg

SEQ ID NO: 273169 - RNA, 21 nt, Homo sapiens
agcagcuuugguugaagcaga

SEQ ID NO: 273170 - RNA, 16 nt, Homo sapiens
agcagguguuagguga

SEQ ID NO: 273171 - RNA, 22 nt, Homo sapiens
agcagugugaaaugauuuaagg

SEQ ID NO: 273172 - RNA, 21 nt, Homo sapiens
agccaguguuccuuguggcuc

SEQ ID NO: 273173 - RNA, 22 nt, Homo sapiens
agcgccauugcacuccagccuu

SEQ ID NO: 273174 - RNA, 22 nt, Homo sapiens
agcuaguauuuucuuaaggauu

SEQ ID NO: 273175 - RNA, 20 nt, Homo sapiens
agcugcagauauaaauccgc

SEQ ID NO: 273176 - RNA, 22 nt, Homo sapiens
agcugccagucuuguaaggccu

SEQ ID NO: 273177 - RNA, 22 nt, Homo sapiens
agcuggaauuuaagguagauag

SEQ ID NO: 273178 - RNA, 22 nt, Homo sapiens
agcuggcuguggagaaaccccu

SEQ ID NO: 273179 - RNA, 22 nt, Homo sapiens
agcugguauuuguuagggaguu

SEQ ID NO: 273180 - RNA, 22 nt, Homo sapiens
agcuggucuuggggaagaguag

SEQ ID NO: 273181 - RNA, 22 nt, Homo sapiens
agcuuuuugggcagcuauugac

SEQ ID NO: 273182 - RNA, 22 nt, Homo sapiens
aggaagugugcaauuaauuucu

SEQ ID NO: 273183 - RNA, 22 nt, Homo sapiens
aggaccauuguguagcagacau

SEQ ID NO: 273184 - RNA, 22 nt, Homo sapiens
aggagaucagccucccugcaac

SEQ ID NO: 273185 - RNA, 21 nt, Homo sapiens
aggagcauuguugugguggag

SEQ ID NO: 273186 - RNA, 21 nt, Homo sapiens
aggcaagguguuauuauugaa

SEQ ID NO: 273187 - RNA, 22 nt, Homo sapiens
aggcacacaacccuggaccuga

SEQ ID NO: 273188 - RNA, 22 nt, Homo sapiens
aggcacggugucucaugccugu

SEQ ID NO: 273189 - RNA, 22 nt, Homo sapiens
aggcagaugagguccucagcug

SEQ ID NO: 273190 - RNA, 22 nt, Homo sapiens
aggcaugaguucagaggguaug

SEQ ID NO: 273191 - RNA, 22 nt, Homo sapiens
aggcaugauuguauuuugcucu

SEQ ID NO: 273192 - RNA, 23 nt, Homo sapiens
aggcauuguacaguaauggaaaa

SEQ ID NO: 273193 - RNA, 21 nt, Homo sapiens
aggcuguuguuuugggaugga

SEQ ID NO: 273194 - RNA, 22 nt, Homo sapiens
aggcuuuauuacagggucucag

SEQ ID NO: 273195 - RNA, 23 nt, Homo sapiens
agggcacuauagauguuauucua

SEQ ID NO: 273196 - RNA, 22 nt, Homo sapiens
agguagguugagaugggcauca

SEQ ID NO: 273197 - RNA, 22 nt, Homo sapiens
aggucaccucaggaaauacuga

SEQ ID NO: 273198 - RNA, 22 nt, Homo sapiens
aggugaaugcucacauucuaau

SEQ ID NO: 273199 - RNA, 22 nt, Homo sapiens
aggugcaugcuucacuggauau

SEQ ID NO: 273200 - RNA, 22 nt, Homo sapiens
aggugcugacaggauagguuuc

SEQ ID NO: 273201 - RNA, 20 nt, Homo sapiens
agguuauuauaauuagaaga

SEQ ID NO: 273202 - RNA, 22 nt, Homo sapiens
aguacaauguugaguagaagug

SEQ ID NO: 273203 - RNA, 22 nt, Homo sapiens
aguagcaauggcucugagcuau

SEQ ID NO: 273204 - RNA, 21 nt, Homo sapiens
aguagcacugugucuuacaaa

SEQ ID NO: 273205 - RNA, 22 nt, Homo sapiens
agucauggcagaaggcaccucu

SEQ ID NO: 273206 - RNA, 22 nt, Homo sapiens
agugacaugggaucaaaucuga

SEQ ID NO: 273207 - RNA, 22 nt, Homo sapiens
agugauauguuugccuugaggg

SEQ ID NO: 273208 - RNA, 22 nt, Homo sapiens
agugccaaaucgagggcucuga

SEQ ID NO: 273209 - RNA, 22 nt, Homo sapiens
aguggaauuaagaaacugaauu

SEQ ID NO: 273210 - RNA, 22 nt, Homo sapiens
agugguuuuaaguagagcauac

SEQ ID NO: 273211 - RNA, 22 nt, Homo sapiens
aguucaaugcucuuucuacuau

SEQ ID NO: 273212 - RNA, 22 nt, Homo sapiens
aguuuuugcugauagcaugcuu

SEQ ID NO: 273213 - RNA, 22 nt, Homo sapiens
auaaaccuacauuuucacuucu

SEQ ID NO: 273214 - RNA, 22 nt, Homo sapiens
auaauguuuauccagaggaguu

SEQ ID NO: 273215 - RNA, 22 nt, Homo sapiens
auacaaggaaugaagagauuug

SEQ ID NO: 273216 - RNA, 22 nt, Homo sapiens
auacaguaaugucuuaggcugu

SEQ ID NO: 273217 - RNA, 22 nt, Homo sapiens
auagaauguuugcgccagguga

SEQ ID NO: 273218 - RNA, 22 nt, Homo sapiens
auagacugaguggcuuaaacca

SEQ ID NO: 273219 - RNA, 22 nt, Homo sapiens
auagaucauugucauuuuagau

SEQ ID NO: 273220 - RNA, 22 nt, Homo sapiens
auagcaaugccccacuccuugg

SEQ ID NO: 273221 - RNA, 22 nt, Homo sapiens
auaucaagugacuggaguucca

SEQ ID NO: 273222 - RNA, 22 nt, Homo sapiens
auauccaugccauagguuuuga

SEQ ID NO: 273223 - RNA, 21 nt, Homo sapiens
auauggaacuggugacguguu

SEQ ID NO: 273224 - RNA, 22 nt, Homo sapiens
auauggcuaugugagcauacca

SEQ ID NO: 273225 - RNA, 19 nt, Homo sapiens
auaugggguuugaacugug

SEQ ID NO: 273226 - RNA, 22 nt, Homo sapiens
cauuugguggcuacagaguaac

SEQ ID NO: 273227 - RNA, 22 nt, Homo sapiens
cauuuugguuaaauagguagcu

SEQ ID NO: 273228 - RNA, 23 nt, Homo sapiens
ccacaaugguugaacuagauuac

SEQ ID NO: 273229 - RNA, 22 nt, Homo sapiens
ccacaguggauuaaaguuacug

SEQ ID NO: 273230 - RNA, 22 nt, Homo sapiens
ccacccuuccacacccugggua

SEQ ID NO: 273231 - RNA, 22 nt, Homo sapiens
ccaguuuucccagcaccauuaa

SEQ ID NO: 273232 - RNA, 22 nt, Homo sapiens
ccauggcaauggucagucuauu

SEQ ID NO: 273233 - RNA, 21 nt, Homo sapiens
ccaugggacggaaugaauaca

SEQ ID NO: 273234 - RNA, 22 nt, Homo sapiens
cccaguguuuauuuugagccaa

SEQ ID NO: 273235 - RNA, 22 nt, Homo sapiens
cccaguuuugcuucucaugagg

SEQ ID NO: 273236 - RNA, 22 nt, Homo sapiens
ccccagguuucaauaaagccca

SEQ ID NO: 273237 - RNA, 20 nt, Homo sapiens
ccccaguuuuucuauuagcu

SEQ ID NO: 273238 - RNA, 22 nt, Homo sapiens
ccccauuugaacuccuucaacu

SEQ ID NO: 273239 - RNA, 22 nt, Homo sapiens
ccccuguaucucagcgucuuca

SEQ ID NO: 273240 - RNA, 17 nt, Homo sapiens
cccuaguagcugggacu

SEQ ID NO: 273241 - RNA, 22 nt, Homo sapiens
cccugugaauauuaccuuauuu

SEQ ID NO: 273242 - RNA, 21 nt, Homo sapiens
ccugaagaagugaccucugag

SEQ ID NO: 273243 - RNA, 21 nt, Homo sapiens
ccugaguacaacccacuccac

SEQ ID NO: 273244 - RNA, 22 nt, Homo sapiens
ccugucuugauuaaauuacuua

SEQ ID NO: 273245 - RNA, 22 nt, Homo sapiens
ccuucuuuuguaaggcugaaua

SEQ ID NO: 273246 - RNA, 22 nt, Homo sapiens
cgccugagcugaggaagcugca

SEQ ID NO: 273247 - RNA, 21 nt, Homo sapiens
cgucauggagauguguuguac

SEQ ID NO: 273248 - RNA, 22 nt, Homo sapiens
cgugaggaguauuuuuaggugc

SEQ ID NO: 273249 - RNA, 22 nt, Homo sapiens
cuaaagugcuuaaaaucucauu

SEQ ID NO: 273250 - RNA, 22 nt, Homo sapiens
cuaagggaggaagcugugcagg

SEQ ID NO: 273251 - RNA, 22 nt, Homo sapiens
cuagcuuuuuaugacaaucuug

SEQ ID NO: 273252 - RNA, 22 nt, Homo sapiens
cuauuugguuggugaaaaaagu

SEQ ID NO: 273253 - RNA, 22 nt, Homo sapiens
cucaaguaauccucccgccuug

SEQ ID NO: 273254 - RNA, 22 nt, Homo sapiens
cucaauuuggaauugucaguaa

SEQ ID NO: 273255 - RNA, 20 nt, Homo sapiens
cucaccagguguaggcugag

SEQ ID NO: 273256 - RNA, 22 nt, Homo sapiens
cucaccuugugauccuccugcc

SEQ ID NO: 273257 - RNA, 22 nt, Homo sapiens
cucacggcccugcgcacuggca

SEQ ID NO: 273258 - RNA, 22 nt, Homo sapiens
cucaggcacucugauuccagug

SEQ ID NO: 273259 - RNA, 22 nt, Homo sapiens
cucaggguacuucuccuuugcu

SEQ ID NO: 273260 - RNA, 21 nt, Homo sapiens
cucauauugcuuuuccauggu

SEQ ID NO: 273261 - RNA, 22 nt, Homo sapiens
cuccacugagcaggugggaggc

SEQ ID NO: 273262 - RNA, 22 nt, Homo sapiens
cuccagugcaaagucaugauca

SEQ ID NO: 273263 - RNA, 23 nt, Homo sapiens
cuccaugagccguccagggccug

SEQ ID NO: 273264 - RNA, 22 nt, Homo sapiens
cucccacccucauuuuuaggca

SEQ ID NO: 273265 - RNA, 22 nt, Homo sapiens
cucucaagaugcugggauuaca

SEQ ID NO: 273266 - RNA, 17 nt, Homo sapiens
cucucugguuuaaagca

SEQ ID NO: 273267 - RNA, 22 nt, Homo sapiens
cugaaagagcauuugaaugggu

SEQ ID NO: 273268 - RNA, 22 nt, Homo sapiens
cugaaaucagccaguuaguuuc

SEQ ID NO: 273269 - RNA, 22 nt, Homo sapiens
cugaaauguccaucgacugaug

SEQ ID NO: 273270 - RNA, 22 nt, Homo sapiens
cugacaugcagccacugcaccu

SEQ ID NO: 273271 - RNA, 22 nt, Homo sapiens
cugagaagaaacagguaaggac

SEQ ID NO: 273272 - RNA, 22 nt, Homo sapiens
cugagaauguaaaugaagcuuu

SEQ ID NO: 273273 - RNA, 22 nt, Homo sapiens
cugagacuggugauuuaugaag

SEQ ID NO: 273274 - RNA, 22 nt, Homo sapiens
cugagauaauuucuagguguca

SEQ ID NO: 273275 - RNA, 22 nt, Homo sapiens
cugagauaggacucugcuggcu

SEQ ID NO: 273276 - RNA, 22 nt, Homo sapiens
cugagaucaugggucagguggu

SEQ ID NO: 273277 - RNA, 22 nt, Homo sapiens
cugagaucuuauuagaaaugca

SEQ ID NO: 273278 - RNA, 22 nt, Homo sapiens
cugagcaaaaugaagacacgau

SEQ ID NO: 273279 - RNA, 21 nt, Homo sapiens
cugaucacaggugagcugccu

SEQ ID NO: 273280 - RNA, 22 nt, Homo sapiens
cugauuuguccccagccucaug

SEQ ID NO: 273281 - RNA, 22 nt, Homo sapiens
cugcauaaucaucucucugcau

SEQ ID NO: 273282 - RNA, 18 nt, Homo sapiens
cugccagugugcucuccg

SEQ ID NO: 273283 - RNA, 22 nt, Homo sapiens
cugcuggucuuuaaggucuagg

SEQ ID NO: 273284 - RNA, 22 nt, Homo sapiens
cuggaaggaaaaacaaccacag

SEQ ID NO: 273285 - RNA, 22 nt, Homo sapiens
cuggacaaaucuggaaagaacc

SEQ ID NO: 273286 - RNA, 22 nt, Homo sapiens
cuggagucugacugacacaagg

SEQ ID NO: 273287 - RNA, 22 nt, Homo sapiens
cuggaguuugaggcugcaguga

SEQ ID NO: 273288 - RNA, 22 nt, Homo sapiens
cuggcaccauuuugaucaaagg

SEQ ID NO: 273289 - RNA, 22 nt, Homo sapiens
cuggcagucugccucuucacug

SEQ ID NO: 273290 - RNA, 22 nt, Homo sapiens
cuggcucuguuagaagaaccag

SEQ ID NO: 273291 - RNA, 22 nt, Homo sapiens
cuggugagaugucuuuccucuu

SEQ ID NO: 273292 - RNA, 22 nt, Homo sapiens
cuguaauguaaugagacuacau

SEQ ID NO: 273293 - RNA, 22 nt, Homo sapiens
cugugaucuuuuuucauguggu

SEQ ID NO: 273294 - RNA, 22 nt, Homo sapiens
cuguuugguaaggaugccucag

SEQ ID NO: 273295 - RNA, 22 nt, Homo sapiens
cuucaaaguuggcuaggagaca

SEQ ID NO: 273296 - RNA, 17 nt, Homo sapiens
cuucaaauaauuucccc

SEQ ID NO: 273297 - RNA, 22 nt, Homo sapiens
cuucaaguaauucugauggcua

SEQ ID NO: 273298 - RNA, 22 nt, Homo sapiens
cuuccagcuggguucagucagu

SEQ ID NO: 273299 - RNA, 22 nt, Homo sapiens
cuucuugcuguguccucacaug

SEQ ID NO: 273300 - RNA, 21 nt, Homo sapiens
cuucuuggggcagggcagggu

SEQ ID NO: 273301 - RNA, 22 nt, Homo sapiens
cuugaccaauauggugaaaccc

SEQ ID NO: 273302 - RNA, 22 nt, Homo sapiens
cuugaccuauggaucuguuuuu

SEQ ID NO: 273303 - RNA, 22 nt, Homo sapiens
cuuggcacucuguggaguuagg

SEQ ID NO: 273304 - RNA, 20 nt, Homo sapiens
cuuggcuuucuugguguuaa

SEQ ID NO: 273305 - RNA, 22 nt, Homo sapiens
cuuuaguugucuccucaagggu

SEQ ID NO: 273306 - RNA, 22 nt, Homo sapiens
cuuucugaggagaauagagaac

SEQ ID NO: 273307 - RNA, 22 nt, Homo sapiens
cuuugcaaauggccuuuccaag

SEQ ID NO: 273308 - RNA, 22 nt, Homo sapiens
cuuuggcaaugucauuuucaau

SEQ ID NO: 273309 - RNA, 22 nt, Homo sapiens
cuuuugcugggucagcgguggu

SEQ ID NO: 273310 - RNA, 22 nt, Homo sapiens
cuuuugugauuccucaguuacu

SEQ ID NO: 273311 - RNA, 22 nt, Homo sapiens
cuuuuugcugcagcaauacugg

SEQ ID NO: 273312 - RNA, 22 nt, Homo sapiens
gaaaauccauccccagggagua

SEQ ID NO: 273313 - RNA, 22 nt, Homo sapiens
gaaaguguugagauuacaggca

SEQ ID NO: 273314 - RNA, 22 nt, Homo sapiens
gaaaugcucagggguuuuccag

SEQ ID NO: 273315 - RNA, 22 nt, Homo sapiens
gaaaugcucauuuuggauccuu

SEQ ID NO: 273316 - RNA, 22 nt, Homo sapiens
gaaauggaucagagcaagcuuu

SEQ ID NO: 273317 - RNA, 22 nt, Homo sapiens
gaaauguuuuucaugugggcaa

SEQ ID NO: 273318 - RNA, 22 nt, Homo sapiens
gaacugggguuggguugcgaua

SEQ ID NO: 273319 - RNA, 22 nt, Homo sapiens
gaacuguuucuggugaaagagu

SEQ ID NO: 273320 - RNA, 22 nt, Homo sapiens
gaagcagcauucugguuuuugg

SEQ ID NO: 273321 - RNA, 22 nt, Homo sapiens
gaagguauauucuguuaaugcu

SEQ ID NO: 273322 - RNA, 22 nt, Homo sapiens
gaaugauacuguuaacgaaaga

SEQ ID NO: 273323 - RNA, 22 nt, Homo sapiens
gaaugcagcagugacagggcug

SEQ ID NO: 273324 - RNA, 22 nt, Homo sapiens
gacacuggguguuuguuggcgu

SEQ ID NO: 273325 - RNA, 22 nt, Homo sapiens
gacagugugauacuuagucuca

SEQ ID NO: 273326 - RNA, 18 nt, Homo sapiens
gacaguguggcgauuccu

SEQ ID NO: 273327 - RNA, 22 nt, Homo sapiens
gacaguguggcgauuccucaag

SEQ ID NO: 273328 - RNA, 22 nt, Homo sapiens
guaaucucagcuacuugggagg

SEQ ID NO: 273329 - RNA, 17 nt, Homo sapiens
guacacuucuucuguga

SEQ ID NO: 273330 - RNA, 22 nt, Homo sapiens
guacaggugcaggaugggcagg

SEQ ID NO: 273331 - RNA, 22 nt, Homo sapiens
guacaugcauacaugcacaucu

SEQ ID NO: 273332 - RNA, 22 nt, Homo sapiens
guagaagcacagggccuguauu

SEQ ID NO: 273333 - RNA, 22 nt, Homo sapiens
guagaauguauguauaacgcaa

SEQ ID NO: 273334 - RNA, 22 nt, Homo sapiens
guagagugcugggcacuggcuc

SEQ ID NO: 273335 - RNA, 22 nt, Homo sapiens
guauagaucguagaccaauaaa

SEQ ID NO: 273336 - RNA, 22 nt, Homo sapiens
guaucauugccuaaugcucuca

SEQ ID NO: 273337 - RNA, 22 nt, Homo sapiens
guauggcaugcaugagaauuuc

SEQ ID NO: 273338 - RNA, 21 nt, Homo sapiens
guauggcauugauuaguuacu

SEQ ID NO: 273339 - RNA, 22 nt, Homo sapiens
guauuuggugaugccuccaaac

SEQ ID NO: 273340 - RNA, 19 nt, Homo sapiens
gucaaagucgguauucaaa

SEQ ID NO: 273341 - RNA, 22 nt, Homo sapiens
gucacuguuuccuauuauauuu

SEQ ID NO: 273342 - RNA, 22 nt, Homo sapiens
gucagcaaaguucuccugcaga

SEQ ID NO: 273343 - RNA, 22 nt, Homo sapiens
gucagcuuuuccuuacuuuagg

SEQ ID NO: 273344 - RNA, 22 nt, Homo sapiens
gucaguuucacucagcuggaac

SEQ ID NO: 273345 - RNA, 22 nt, Homo sapiens
gucauggguuaaagguggauac

SEQ ID NO: 273346 - RNA, 22 nt, Homo sapiens
gucccugaggaacauccagggc

SEQ ID NO: 273347 - RNA, 22 nt, Homo sapiens
gucucacagcuagcugcuuuau

SEQ ID NO: 273348 - RNA, 22 nt, Homo sapiens
gucucccagccuacauauuucu

SEQ ID NO: 273349 - RNA, 22 nt, Homo sapiens
gucuggcuccugucuaaucacu

SEQ ID NO: 273350 - RNA, 22 nt, Homo sapiens
gucuguuugauccagaucaaaa

SEQ ID NO: 273351 - RNA, 22 nt, Homo sapiens
gucuuuggaaaaaaugucuguu

SEQ ID NO: 273352 - RNA, 22 nt, Homo sapiens
gugaaaugaaucuggaaauauu

SEQ ID NO: 273353 - RNA, 22 nt, Homo sapiens
gugaauguaaagucaugugacu

SEQ ID NO: 273354 - RNA, 22 nt, Homo sapiens
gugaauguuuucuuacauggua

SEQ ID NO: 273355 - RNA, 18 nt, Homo sapiens
gugagaaugacuguucug

SEQ ID NO: 273356 - RNA, 22 nt, Homo sapiens
gugagauccucucuuauauggg

SEQ ID NO: 273357 - RNA, 22 nt, Homo sapiens
gugcauaucugugguuggcuga

SEQ ID NO: 273358 - RNA, 22 nt, Homo sapiens
guggaagcacaggccuccugga

SEQ ID NO: 273359 - RNA, 22 nt, Homo sapiens
guggaaggucaugaauguucuu

SEQ ID NO: 273360 - RNA, 22 nt, Homo sapiens
guggcaagaauguacaaaaggu

SEQ ID NO: 273361 - RNA, 22 nt, Homo sapiens
guggcaagaugacuacucacug

SEQ ID NO: 273362 - RNA, 22 nt, Homo sapiens
guggcauuucccaaaguauucu

SEQ ID NO: 273363 - RNA, 23 nt, Homo sapiens
guggccuuuggccaguccgaguc

SEQ ID NO: 273364 - RNA, 22 nt, Homo sapiens
gugggcaagucacuucaguucu

SEQ ID NO: 273365 - RNA, 22 nt, Homo sapiens
gugguagaaauguagaugcuag

SEQ ID NO: 273366 - RNA, 21 nt, Homo sapiens
gugucacagacaugacagaug

SEQ ID NO: 273367 - RNA, 22 nt, Homo sapiens
gugugauggcgcacacagggug

SEQ ID NO: 273368 - RNA, 17 nt, Homo sapiens
guucccaguggcauuug

SEQ ID NO: 273369 - RNA, 22 nt, Homo sapiens
guucuggagauaaagccaaggu

SEQ ID NO: 273370 - RNA, 22 nt, Homo sapiens
guugaaauccuaacccccuagu

SEQ ID NO: 273371 - RNA, 22 nt, Homo sapiens
guugcaauugauguaugucuga

SEQ ID NO: 273372 - RNA, 22 nt, Homo sapiens
guuuggcuuucucucuauccug

SEQ ID NO: 273373 - RNA, 15 nt, Homo sapiens
guuuuuggauacaau

SEQ ID NO: 273374 - RNA, 22 nt, Homo sapiens
uaaaccacguuuacauuugaga

SEQ ID NO: 273375 - RNA, 22 nt, Homo sapiens
uaaagcuaucacauuggugauu

SEQ ID NO: 273376 - RNA, 22 nt, Homo sapiens
uaacaguggucugugguaucug

SEQ ID NO: 273377 - RNA, 22 nt, Homo sapiens
uaacaguguauuuacuacuucc

SEQ ID NO: 273378 - RNA, 22 nt, Homo sapiens
uaaggcaaaccuuggcugcagu

SEQ ID NO: 273379 - RNA, 22 nt, Homo sapiens
uaaggcacuacuuuaggcuuuc

SEQ ID NO: 273380 - RNA, 18 nt, Homo sapiens
uaaggcacuauaggcauu

SEQ ID NO: 273381 - RNA, 22 nt, Homo sapiens
uaaggcacucuucugugugccu

SEQ ID NO: 273382 - RNA, 20 nt, Homo sapiens
uaaggcacugugcuuuuagg

SEQ ID NO: 273383 - RNA, 22 nt, Homo sapiens
uaagggacauguguugccuaag

SEQ ID NO: 273384 - RNA, 22 nt, Homo sapiens
uaagggcaugcugcaugagagu

SEQ ID NO: 273385 - RNA, 22 nt, Homo sapiens
uaagguccuuaaauguguaacc

SEQ ID NO: 273386 - RNA, 22 nt, Homo sapiens
uaaguacaugcuagauggaaug

SEQ ID NO: 273387 - RNA, 22 nt, Homo sapiens
uaaugcuguggucugguuuaaa

SEQ ID NO: 273388 - RNA, 22 nt, Homo sapiens
uacaaagcuuugaugugucuuu

SEQ ID NO: 273389 - RNA, 22 nt, Homo sapiens
uacaaagugggaaacgaagguu

SEQ ID NO: 273390 - RNA, 22 nt, Homo sapiens
uacaacacugguucgacaugug

SEQ ID NO: 273391 - RNA, 22 nt, Homo sapiens
uacaaguggguuugugcaggag

SEQ ID NO: 273392 - RNA, 22 nt, Homo sapiens
uacaauagugacaaaucagcau

SEQ ID NO: 273393 - RNA, 22 nt, Homo sapiens
uacaguggaaguuaaccccauu

SEQ ID NO: 273394 - RNA, 22 nt, Homo sapiens
uacaucagccugaaagagcucg

SEQ ID NO: 273395 - RNA, 19 nt, Homo sapiens
uaccagcacaguguuugag

SEQ ID NO: 273396 - RNA, 22 nt, Homo sapiens
uaccagcauuucucuuuaagua

SEQ ID NO: 273397 - RNA, 22 nt, Homo sapiens
uaccugagaaagaaagcccucg

SEQ ID NO: 273398 - RNA, 22 nt, Homo sapiens
uaccugagcccucugcugaguu

SEQ ID NO: 273399 - RNA, 22 nt, Homo sapiens
uaccugagucuagagucuagaa

SEQ ID NO: 273400 - RNA, 22 nt, Homo sapiens
uaccuguagacuacagcuucag

SEQ ID NO: 273401 - RNA, 22 nt, Homo sapiens
uacugcuuaagggcaugggccc

SEQ ID NO: 273402 - RNA, 22 nt, Homo sapiens
uagaaguaggcuacgugucugg

SEQ ID NO: 273403 - RNA, 22 nt, Homo sapiens
uagagcuugacacuuuccaugg

SEQ ID NO: 273404 - RNA, 21 nt, Homo sapiens
uagagcuuggcacagaguaga

SEQ ID NO: 273405 - RNA, 22 nt, Homo sapiens
uagagguauguauaguauucuu

SEQ ID NO: 273406 - RNA, 22 nt, Homo sapiens
uagcacccucuccuaguccugc

SEQ ID NO: 273407 - RNA, 22 nt, Homo sapiens
uagcagcaaagcaggaucugcu

SEQ ID NO: 273408 - RNA, 22 nt, Homo sapiens
uagcagcuuuauugagguaaau

SEQ ID NO: 273409 - RNA, 22 nt, Homo sapiens
uagcaucaauucauguuaugau

SEQ ID NO: 273410 - RNA, 22 nt, Homo sapiens
uagcucagcccagcuaagcuca

SEQ ID NO: 273411 - RNA, 22 nt, Homo sapiens
uaggacacagauggagaaaagc

SEQ ID NO: 273412 - RNA, 22 nt, Homo sapiens
uaggacacaggacauauguaga

SEQ ID NO: 273413 - RNA, 22 nt, Homo sapiens
uaggcaaguugcccaaucucuc

SEQ ID NO: 273414 - RNA, 22 nt, Homo sapiens
uaggcacacaucuacuacaaau

SEQ ID NO: 273415 - RNA, 22 nt, Homo sapiens
uaggcagccagcuguggauuga

SEQ ID NO: 273416 - RNA, 22 nt, Homo sapiens
uaggccuuuuuaugucaauauc

SEQ ID NO: 273417 - RNA, 22 nt, Homo sapiens
uagggcuuuccggccugucaga

SEQ ID NO: 273418 - RNA, 22 nt, Homo sapiens
uagguaaguaauauacagauga

SEQ ID NO: 273419 - RNA, 22 nt, Homo sapiens
uaggucaguuuuggcuuggcuu

SEQ ID NO: 273420 - RNA, 22 nt, Homo sapiens
uaguagcauaccuaaguauacu

SEQ ID NO: 273421 - RNA, 22 nt, Homo sapiens
uaguauguuuauagcauugagu

SEQ ID NO: 273422 - RNA, 22 nt, Homo sapiens
uagucacacacucaacuuuuca

SEQ ID NO: 273423 - RNA, 22 nt, Homo sapiens
uauagcaaugccccacuccuga

SEQ ID NO: 273424 - RNA, 22 nt, Homo sapiens
uauagcauuuugauccuguaga

SEQ ID NO: 273425 - RNA, 22 nt, Homo sapiens
uaucacacgccuugcuucauuu

SEQ ID NO: 273426 - RNA, 22 nt, Homo sapiens
uaucacagauucuccaggguuu

SEQ ID NO: 273427 - RNA, 22 nt, Homo sapiens
uaucacaguaaaucugggugca

SEQ ID NO: 273428 - RNA, 22 nt, Homo sapiens
uaucacaguaucuagcacagug

SEQ ID NO: 273429 - RNA, 22 nt, Homo sapiens
uaucaucauguuuuugcugugu

SEQ ID NO: 273430 - RNA, 22 nt, Homo sapiens
ucugugcauuacacuuuucuca

SEQ ID NO: 273431 - RNA, 22 nt, Homo sapiens
ucuuauuuggggaaaggguccu

SEQ ID NO: 273432 - RNA, 22 nt, Homo sapiens
ucuugccacuucauccccuuuc

SEQ ID NO: 273433 - RNA, 22 nt, Homo sapiens
ucuuuaguaauuucuguaaggc

SEQ ID NO: 273434 - RNA, 19 nt, Homo sapiens
ucuuuagucacauuuuuau

SEQ ID NO: 273435 - RNA, 22 nt, Homo sapiens
ucuuucacuuagcaugauguuu

SEQ ID NO: 273436 - RNA, 22 nt, Homo sapiens
ucuuugccuaacccaaggucau

SEQ ID NO: 273437 - RNA, 19 nt, Homo sapiens
ucuuugguacgugcuuuga

SEQ ID NO: 273438 - RNA, 22 nt, Homo sapiens
ucuuugguauugugaauagugu

SEQ ID NO: 273439 - RNA, 22 nt, Homo sapiens
ucuuuggucagaaagauuacac

SEQ ID NO: 273440 - RNA, 22 nt, Homo sapiens
ucuuugguucuguuuauguaau

SEQ ID NO: 273441 - RNA, 22 nt, Homo sapiens
ucuuugguuucugucucuguaa

SEQ ID NO: 273442 - RNA, 22 nt, Homo sapiens
ugaaauaguuaaguugccuagu

SEQ ID NO: 273443 - RNA, 22 nt, Homo sapiens
ugaaaucuaaaauguuccaaga

SEQ ID NO: 273444 - RNA, 22 nt, Homo sapiens
ugaacuaguaguuuacuugaug

SEQ ID NO: 273445 - RNA, 22 nt, Homo sapiens
ugaagcuaggauuaauuuucau

SEQ ID NO: 273446 - RNA, 22 nt, Homo sapiens
ugaagcuuguuucuguaccuuu

SEQ ID NO: 273447 - RNA, 22 nt, Homo sapiens
ugaaggaguauggauaagucgu

SEQ ID NO: 273448 - RNA, 22 nt, Homo sapiens
ugaauauguuaauuagcaucau

SEQ ID NO: 273449 - RNA, 22 nt, Homo sapiens
ugaaucauuucuugucuucagu

SEQ ID NO: 273450 - RNA, 22 nt, Homo sapiens
ugaauuguuuacgagaugugag

SEQ ID NO: 273451 - RNA, 22 nt, Homo sapiens
ugacaacugauuaacuccuuua

SEQ ID NO: 273452 - RNA, 22 nt, Homo sapiens
ugacacagugggggauccuuuu

SEQ ID NO: 273453 - RNA, 22 nt, Homo sapiens
ugacaggucuaauuuacugaca

SEQ ID NO: 273454 - RNA, 22 nt, Homo sapiens
ugacaugaugagcaauaauggc

SEQ ID NO: 273455 - RNA, 23 nt, Homo sapiens
ugacauguaauucaguccagcag

SEQ ID NO: 273456 - RNA, 21 nt, Homo sapiens
ugacauguuggugugcugcac

SEQ ID NO: 273457 - RNA, 21 nt, Homo sapiens
ugacauguugguuugcugcac

SEQ ID NO: 273458 - RNA, 22 nt, Homo sapiens
ugaccagaaaacaaauuaguuu

SEQ ID NO: 273459 - RNA, 22 nt, Homo sapiens
ugaccucugauagcaguaggug

SEQ ID NO: 273460 - RNA, 22 nt, Homo sapiens
ugacuagacuugcaagguugca

SEQ ID NO: 273461 - RNA, 19 nt, Homo sapiens
ugacuauagccugaucagu

SEQ ID NO: 273462 - RNA, 22 nt, Homo sapiens
ugacuauaggauaacaugcauu

SEQ ID NO: 273463 - RNA, 22 nt, Homo sapiens
ugacuuuagaauuuuauccaga

SEQ ID NO: 273464 - RNA, 22 nt, Homo sapiens
ugagaacuaaaaugugguauau

SEQ ID NO: 273465 - RNA, 22 nt, Homo sapiens
ugagaacuguuuugguuugggu

SEQ ID NO: 273466 - RNA, 22 nt, Homo sapiens
ugagaagacaucuuugcuuugu

SEQ ID NO: 273467 - RNA, 22 nt, Homo sapiens
ugagaagaugaacuccuugguc

SEQ ID NO: 273468 - RNA, 22 nt, Homo sapiens
ugagaauauuugaagauguuag

SEQ ID NO: 273469 - RNA, 19 nt, Homo sapiens
ugagaauguuaccaggucc

SEQ ID NO: 273470 - RNA, 22 nt, Homo sapiens
ugagacaaaguuguuggauguu

SEQ ID NO: 273471 - RNA, 22 nt, Homo sapiens
ugagacauauuauacugcuuuu

SEQ ID NO: 273472 - RNA, 22 nt, Homo sapiens
ugagauaacuaaaaacauuuug

SEQ ID NO: 273473 - RNA, 22 nt, Homo sapiens
ugagauaaggaaauugaggcuc

SEQ ID NO: 273474 - RNA, 21 nt, Homo sapiens
ugagauaauauguuucugaug

SEQ ID NO: 273475 - RNA, 22 nt, Homo sapiens
ugagaucacgccacugcacucc

SEQ ID NO: 273476 - RNA, 22 nt, Homo sapiens
ugagaucagaaggauuucucug

SEQ ID NO: 273477 - RNA, 22 nt, Homo sapiens
ugagaucauguguggaccccag

SEQ ID NO: 273478 - RNA, 22 nt, Homo sapiens
ugagaugauuuaauggagccca

SEQ ID NO: 273479 - RNA, 22 nt, Homo sapiens
ugagauggagucuugucgccua

SEQ ID NO: 273480 - RNA, 22 nt, Homo sapiens
ugagauggcugaauucagaaua

SEQ ID NO: 273481 - RNA, 22 nt, Homo sapiens
ugagaugugugcauucaacuca

SEQ ID NO: 273482 - RNA, 22 nt, Homo sapiens
ugagauguugcucugaaacaag

SEQ ID NO: 273483 - RNA, 22 nt, Homo sapiens
ugagauuaucuugaucuugaaa

SEQ ID NO: 273484 - RNA, 22 nt, Homo sapiens
ugagcaagaucuuuauaauuag

SEQ ID NO: 273485 - RNA, 22 nt, Homo sapiens
ugagcacuguacuuuaucaggu

SEQ ID NO: 273486 - RNA, 22 nt, Homo sapiens
ugagcagagaagugcccugcgc

SEQ ID NO: 273487 - RNA, 22 nt, Homo sapiens
ugagcagagggagaaguaaauu

SEQ ID NO: 273488 - RNA, 22 nt, Homo sapiens
ugagcagaguuguuucuccuga

SEQ ID NO: 273489 - RNA, 22 nt, Homo sapiens
ugagcauauuuaagguaugcua

SEQ ID NO: 273490 - RNA, 22 nt, Homo sapiens
ugagcuaagugccaauauuaau

SEQ ID NO: 273491 - RNA, 22 nt, Homo sapiens
ugagcuccuucauaaaaaggca

SEQ ID NO: 273492 - RNA, 22 nt, Homo sapiens
ugagcugagaucgugccauugu

SEQ ID NO: 273493 - RNA, 22 nt, Homo sapiens
ugagcugguacuaauauuauca

SEQ ID NO: 273494 - RNA, 22 nt, Homo sapiens
ugaggaguauguucuguagacc

SEQ ID NO: 273495 - RNA, 22 nt, Homo sapiens
ugaggagugaacuauuucugau

SEQ ID NO: 273496 - RNA, 22 nt, Homo sapiens
ugaggcuaggauaggcugauuc

SEQ ID NO: 273497 - RNA, 17 nt, Homo sapiens
ugagggaugccugguuc

SEQ ID NO: 273498 - RNA, 22 nt, Homo sapiens
ugagguagaggugaacuugacc

SEQ ID NO: 273499 - RNA, 21 nt, Homo sapiens
ugaggucaugaugcugcuucc

SEQ ID NO: 273500 - RNA, 22 nt, Homo sapiens
ugaggucauguucugucagguu

SEQ ID NO: 273501 - RNA, 22 nt, Homo sapiens
ugaggucauucaugugggcgca

SEQ ID NO: 273502 - RNA, 22 nt, Homo sapiens
ugaggugagauggcuaccccaa

SEQ ID NO: 273503 - RNA, 22 nt, Homo sapiens
ugaguagaaauaaacgcaaacu

SEQ ID NO: 273504 - RNA, 22 nt, Homo sapiens
ugaguagagaauucagcuaagg

SEQ ID NO: 273505 - RNA, 22 nt, Homo sapiens
ugaguagucuagaguggaaugu

SEQ ID NO: 273506 - RNA, 22 nt, Homo sapiens
ugagucauuuccuuaugcuacu

SEQ ID NO: 273507 - RNA, 22 nt, Homo sapiens
ugagugaaagaagcacuaagga

SEQ ID NO: 273508 - RNA, 22 nt, Homo sapiens
ugagugaaugugaaggcuaggg

SEQ ID NO: 273509 - RNA, 22 nt, Homo sapiens
ugagugagguucuacucuguga

SEQ ID NO: 273510 - RNA, 22 nt, Homo sapiens
ugaguggagacuguguguagag

SEQ ID NO: 273511 - RNA, 22 nt, Homo sapiens
ugaguucaauuguauuuuauua

SEQ ID NO: 273512 - RNA, 22 nt, Homo sapiens
ugauaagugagauagcaaguga

SEQ ID NO: 273513 - RNA, 22 nt, Homo sapiens
ugauaucugaauagauacacaa

SEQ ID NO: 273514 - RNA, 22 nt, Homo sapiens
ugauaugucacuugaucauggu

SEQ ID NO: 273515 - RNA, 20 nt, Homo sapiens
ugauauuuucugagcaggaa

SEQ ID NO: 273516 - RNA, 22 nt, Homo sapiens
ugaucuguguaacauaggaguc

SEQ ID NO: 273517 - RNA, 22 nt, Homo sapiens
ugauuagagcccaagcuuugaa

SEQ ID NO: 273518 - RNA, 19 nt, Homo sapiens
ugcaaauucuaaaaacuga

SEQ ID NO: 273519 - RNA, 22 nt, Homo sapiens
ugcaaccauuguuaagugugca

SEQ ID NO: 273520 - RNA, 22 nt, Homo sapiens
ugcaagcacacccagggauugu

SEQ ID NO: 273521 - RNA, 22 nt, Homo sapiens
ugcaaugugaaauaagcacauc

SEQ ID NO: 273522 - RNA, 20 nt, Homo sapiens
ugcagcacugggaaugcagu

SEQ ID NO: 273523 - RNA, 17 nt, Homo sapiens
ugcauaggcaggcucag

SEQ ID NO: 273524 - RNA, 23 nt, Homo sapiens
ugcauaguacccaauacuuuauc

SEQ ID NO: 273525 - RNA, 22 nt, Homo sapiens
ugcauauuuuauaaagauggaa

SEQ ID NO: 273526 - RNA, 22 nt, Homo sapiens
ugcauggauguuugaacacacu

SEQ ID NO: 273527 - RNA, 19 nt, Homo sapiens
ugccaagaaagucagcuua

SEQ ID NO: 273528 - RNA, 22 nt, Homo sapiens
ugccagaugugcccucuccacc

SEQ ID NO: 273529 - RNA, 22 nt, Homo sapiens
ugccaucauuaauauuaggcau

SEQ ID NO: 273530 - RNA, 22 nt, Homo sapiens
ugcccuguaucccacuguuuca

SEQ ID NO: 273531 - RNA, 22 nt, Homo sapiens
ugccugagccagguuuuaggag

SEQ ID NO: 273532 - RNA, 22 nt, Homo sapiens
augagcagaagagauacacugu

SEQ ID NO: 273533 - RNA, 22 nt, Homo sapiens
augaggagauauuaaauaccau

SEQ ID NO: 273534 - RNA, 22 nt, Homo sapiens
augaguaugagaauacauuaag

SEQ ID NO: 273535 - RNA, 18 nt, Homo sapiens
augagucauuguggaaau

SEQ ID NO: 273536 - RNA, 22 nt, Homo sapiens
augaugcaguacuuugggaaca

SEQ ID NO: 273537 - RNA, 22 nt, Homo sapiens
augauuguucucacucaagaga

SEQ ID NO: 273538 - RNA, 22 nt, Homo sapiens
augcacauauguacugcccuau

SEQ ID NO: 273539 - RNA, 22 nt, Homo sapiens
augccacugcacucuagccugg

SEQ ID NO: 273540 - RNA, 22 nt, Homo sapiens
augccacugcacuucagccugc

SEQ ID NO: 273541 - RNA, 22 nt, Homo sapiens
augccacugcacuucagccugg

SEQ ID NO: 273542 - RNA, 22 nt, Homo sapiens
augccacuguacucuagccuag

SEQ ID NO: 273543 - RNA, 22 nt, Homo sapiens
augccauugcacuccagccugg

SEQ ID NO: 273544 - RNA, 22 nt, Homo sapiens
augccucugacaauuggauucu

SEQ ID NO: 273545 - RNA, 22 nt, Homo sapiens
augcuggugguucacaugcgca

SEQ ID NO: 273546 - RNA, 22 nt, Homo sapiens
auggaagucucuguuaaguuuc

SEQ ID NO: 273547 - RNA, 22 nt, Homo sapiens
auggagguguggggagugaguu

SEQ ID NO: 273548 - RNA, 22 nt, Homo sapiens
auggcaaaaaaugcaauuacuu

SEQ ID NO: 273549 - RNA, 22 nt, Homo sapiens
auggcaagaagagcaauuauuu

SEQ ID NO: 273550 - RNA, 22 nt, Homo sapiens
auggcacagacucuuggucaag

SEQ ID NO: 273551 - RNA, 22 nt, Homo sapiens
uuuccaguuguucuagaaagcu

SEQ ID NO: 273552 - RNA, 22 nt, Homo sapiens
uuucuacagggcuugccaggua

SEQ ID NO: 273553 - RNA, 22 nt, Homo sapiens
uuucugaggccucaccagaagc

SEQ ID NO: 273554 - RNA, 22 nt, Homo sapiens
uuugaggaaaggcauaaguagg

SEQ ID NO: 273555 - RNA, 23 nt, Homo sapiens
uuugccacuuauuagcugggagg

SEQ ID NO: 273556 - RNA, 22 nt, Homo sapiens
uuugcugagucauuccaugcug

SEQ ID NO: 273557 - RNA, 22 nt, Homo sapiens
uuugcuugaggucuagcuaccc

SEQ ID NO: 273558 - RNA, 22 nt, Homo sapiens
uuugcuuguguaaaaaucugga

SEQ ID NO: 273559 - RNA, 22 nt, Homo sapiens
uuuggcaauuugacuguauagg

SEQ ID NO: 273560 - RNA, 22 nt, Homo sapiens
uuuggcacuguaaauuucucuu

SEQ ID NO: 273561 - RNA, 22 nt, Homo sapiens
uuuggcauuagauaauugugua

SEQ ID NO: 273562 - RNA, 22 nt, Homo sapiens
uuuggcuauguuguaucuuucc

SEQ ID NO: 273563 - RNA, 18 nt, Homo sapiens
uuuggcuguucaugacuc

SEQ ID NO: 273564 - RNA, 21 nt, Homo sapiens
uuuggcuucucugcugcagcc

SEQ ID NO: 273565 - RNA, 22 nt, Homo sapiens
uuuggcuuugagaagcagugga

SEQ ID NO: 273566 - RNA, 22 nt, Homo sapiens
uuuggcuuuuguaauaacugcc

SEQ ID NO: 273567 - RNA, 22 nt, Homo sapiens
uuuggcuuuugugauacguaau

SEQ ID NO: 273568 - RNA, 22 nt, Homo sapiens
uuugggccauggcuuuuccacg

SEQ ID NO: 273569 - RNA, 22 nt, Homo sapiens
uuuguacacuguuggugguuau

SEQ ID NO: 273570 - RNA, 22 nt, Homo sapiens
uuuguacuucauacaauaacuc

SEQ ID NO: 273571 - RNA, 22 nt, Homo sapiens
uuugugcuccuaugagaaucua

SEQ ID NO: 273572 - RNA, 22 nt, Homo sapiens
uuugugcuccugugagaaucua

SEQ ID NO: 273573 - RNA, 22 nt, Homo sapiens
uuugugcuccuguugagaaucu

SEQ ID NO: 273574 - RNA, 22 nt, Homo sapiens
uuuuacacaucaccgcucgugu

SEQ ID NO: 273575 - RNA, 22 nt, Homo sapiens
uuuuacacuucgguugugugca

SEQ ID NO: 273576 - RNA, 22 nt, Homo sapiens
uuuuagcaaagagacugguggc

SEQ ID NO: 273577 - RNA, 22 nt, Homo sapiens
uuuuagcagccaugacaaagau

SEQ ID NO: 273578 - RNA, 22 nt, Homo sapiens
uuuuaguggaauauuuacaguu

SEQ ID NO: 273579 - RNA, 22 nt, Homo sapiens
uuuuccagugggacucccauua

SEQ ID NO: 273580 - RNA, 22 nt, Homo sapiens
uuuugcaaauuccaguggccau

SEQ ID NO: 273581 - RNA, 22 nt, Homo sapiens
uuuugcuugugaauagccacau

SEQ ID NO: 273582 - RNA, 22 nt, Homo sapiens
uuuuggcuagaaauauaccucc

SEQ ID NO: 273583 - RNA, 22 nt, Homo sapiens
uuuuggcucuugguaggucaga

SEQ ID NO: 273584 - RNA, 22 nt, Homo sapiens
uuuugguauaugcaggggucuu

SEQ ID NO: 273585 - RNA, 22 nt, Homo sapiens
uuuugugcauggcccaguggua

SEQ ID NO: 273586 - RNA, 22 nt, Homo sapiens
uuuuugagaauuggugaaacac

SEQ ID NO: 273587 - RNA, 22 nt, Homo sapiens
uuuuugaguaaauauaaauugu

SEQ ID NO: 273588 - RNA, 22 nt, Homo sapiens
uuuuugaguagcuggagagcag

SEQ ID NO: 273589 - RNA, 22 nt, Homo sapiens
agcagcaucgggaaguuggcca

SEQ ID NO: 273590 - RNA, 22 nt, Homo sapiens
agcagcauggguauaaaucucc

SEQ ID NO: 273591 - RNA, 22 nt, Homo sapiens
agcagcauuccaaaaaucugcu

SEQ ID NO: 273592 - RNA, 22 nt, Homo sapiens
agcagcuuugaucugaaugauu

SEQ ID NO: 273593 - RNA, 22 nt, Homo sapiens
agcagcuuugcauggccuguga

SEQ ID NO: 273594 - RNA, 22 nt, Homo sapiens
agcagguguccacaauguuugc

SEQ ID NO: 273595 - RNA, 16 nt, Homo sapiens
agccaccauuuacuug

SEQ ID NO: 273596 - RNA, 20 nt, Homo sapiens
agcuaguauuuccaugguua

SEQ ID NO: 273597 - RNA, 22 nt, Homo sapiens
agcuaguguucaccagagguca

SEQ ID NO: 273598 - RNA, 22 nt, Homo sapiens
agcuguaguuugguggauguaa

SEQ ID NO: 273599 - RNA, 22 nt, Homo sapiens
agcuugugauucuccaucaugu

SEQ ID NO: 273600 - RNA, 22 nt, Homo sapiens
aggaaaucuuagcugaggggau

SEQ ID NO: 273601 - RNA, 21 nt, Homo sapiens
aggaagacuaugaucaauugg

SEQ ID NO: 273602 - RNA, 18 nt, Homo sapiens
aggaaugguaauacuuca

SEQ ID NO: 273603 - RNA, 22 nt, Homo sapiens
aggagcacuggccuuggaguca

SEQ ID NO: 273604 - RNA, 20 nt, Homo sapiens
aggagcauuuacauuggcuc

SEQ ID NO: 273605 - RNA, 23 nt, Homo sapiens
aggagcuuagaaguugccauugc

SEQ ID NO: 273606 - RNA, 22 nt, Homo sapiens
aggagguagggugugaaacagc

SEQ ID NO: 273607 - RNA, 22 nt, Homo sapiens
aggcaagaaugcuuguuucacc

SEQ ID NO: 273608 - RNA, 21 nt, Homo sapiens
aggcaagacuuuuagguuugu

SEQ ID NO: 273609 - RNA, 22 nt, Homo sapiens
aggcaagagugacuacgugaaa

SEQ ID NO: 273610 - RNA, 21 nt, Homo sapiens
aggcaagauuacuuacgagca

SEQ ID NO: 273611 - RNA, 22 nt, Homo sapiens
aggcagcuguuauauacugagu

SEQ ID NO: 273612 - RNA, 22 nt, Homo sapiens
aggcugguauuuacaaaagcuc

SEQ ID NO: 273613 - RNA, 22 nt, Homo sapiens
cuuuuggucuaucagagaagca

SEQ ID NO: 273614 - RNA, 22 nt, Homo sapiens
gaaagauuuccugagcuagaaa

SEQ ID NO: 273615 - RNA, 22 nt, Homo sapiens
gaacuuucuacauuaccucuuu

SEQ ID NO: 273616 - RNA, 19 nt, Homo sapiens
gaaguguuguccuccagua

SEQ ID NO: 273617 - RNA, 17 nt, Homo sapiens
gaaguguuucagcagcu

SEQ ID NO: 273618 - RNA, 19 nt, Homo sapiens
gaaguguuuguucuccaug

SEQ ID NO: 273619 - RNA, 22 nt, Homo sapiens
gacaccugguguggaacuggag

SEQ ID NO: 273620 - RNA, 22 nt, Homo sapiens
gacagguuuucuguuucugaaa

SEQ ID NO: 273621 - RNA, 18 nt, Homo sapiens
gacagugugaagauuccu

SEQ ID NO: 273622 - RNA, 19 nt, Homo sapiens
gacaugagauuuggugggg

SEQ ID NO: 273623 - RNA, 22 nt, Homo sapiens
gacuagaaauuauuuagugagc

SEQ ID NO: 273624 - RNA, 22 nt, Homo sapiens
gacuagauauuguucuauguca

SEQ ID NO: 273625 - RNA, 22 nt, Homo sapiens
gacugcagugcagcuguuaggc

SEQ ID NO: 273626 - RNA, 23 nt, Homo sapiens
gagaccagcuucagaaagcacga

SEQ ID NO: 273627 - RNA, 22 nt, Homo sapiens
gagaccauuuacugccuacuua

SEQ ID NO: 273628 - RNA, 22 nt, Homo sapiens
gagacugagucucgcucugccg

SEQ ID NO: 273629 - RNA, 22 nt, Homo sapiens
gagagaguacuugauauaauuu

SEQ ID NO: 273630 - RNA, 22 nt, Homo sapiens
gagaucauguacuagaacaccu

SEQ ID NO: 273631 - RNA, 22 nt, Homo sapiens
gagaugugguucaaggguguuu

SEQ ID NO: 273632 - RNA, 22 nt, Homo sapiens
gagauucaucuagguccagaga

SEQ ID NO: 273633 - RNA, 22 nt, Homo sapiens
gagauucuucaauauuuauucu

SEQ ID NO: 273634 - RNA, 22 nt, Homo sapiens
gagcaucaauggcaugugggaa

SEQ ID NO: 273635 - RNA, 22 nt, Homo sapiens
gagcaucaguggccucaucuca

SEQ ID NO: 273636 - RNA, 22 nt, Homo sapiens
gagcuguuuuucacuagaccaa

SEQ ID NO: 273637 - RNA, 22 nt, Homo sapiens
gaggacauuaugcuaaguggaa

SEQ ID NO: 273638 - RNA, 22 nt, Homo sapiens
gaggcaguguguccguucucgg

SEQ ID NO: 273639 - RNA, 22 nt, Homo sapiens
gaggugaaggucucaauaaaua

SEQ ID NO: 273640 - RNA, 22 nt, Homo sapiens
gaguaacagcauaaauuuguga

SEQ ID NO: 273641 - RNA, 22 nt, Homo sapiens
gaguaacauugacaacuucaug

SEQ ID NO: 273642 - RNA, 22 nt, Homo sapiens
gauauguucugagaaaugcauu

SEQ ID NO: 273643 - RNA, 22 nt, Homo sapiens
gauauguucuuucacguuggug

SEQ ID NO: 273644 - RNA, 22 nt, Homo sapiens
gauauuacuuccaauauugcaa

SEQ ID NO: 273645 - RNA, 22 nt, Homo sapiens
gaucuguguuuguaugcauaag

SEQ ID NO: 273646 - RNA, 22 nt, Homo sapiens
gaugagaugagcauuugaauug

SEQ ID NO: 273647 - RNA, 22 nt, Homo sapiens
gaugagguaggccugcuuugaa

SEQ ID NO: 273648 - RNA, 22 nt, Homo sapiens
gaugguguuuugauaggaauug

SEQ ID NO: 273649 - RNA, 22 nt, Homo sapiens
gauuucaucuuuagaggaagga

SEQ ID NO: 273650 - RNA, 22 nt, Homo sapiens
gcacccguagugcuuucaauua

SEQ ID NO: 273651 - RNA, 22 nt, Homo sapiens
gcacccugucaaaauggaccaa

SEQ ID NO: 273652 - RNA, 22 nt, Homo sapiens
gcagaucucuucauuucucuua

SEQ ID NO: 273653 - RNA, 20 nt, Homo sapiens
gcaguacuuuuaguucuaag

SEQ ID NO: 273654 - RNA, 22 nt, Homo sapiens
gcaguagugcgaucucagcuca

SEQ ID NO: 273655 - RNA, 22 nt, Homo sapiens
gcaguguggguagagggcaaga

SEQ ID NO: 273656 - RNA, 22 nt, Homo sapiens
ugucauucaggaaauucuaagu

SEQ ID NO: 273657 - RNA, 22 nt, Homo sapiens
ugucccugagccuggauuccug

SEQ ID NO: 273658 - RNA, 19 nt, Homo sapiens
uguccuagaggaguucaca

SEQ ID NO: 273659 - RNA, 22 nt, Homo sapiens
uguccuggugaugcccaaauuc

SEQ ID NO: 273660 - RNA, 22 nt, Homo sapiens
ugucugagacuguuuuacuuuc

SEQ ID NO: 273661 - RNA, 21 nt, Homo sapiens
ugugaaaucuaggcagagguu

SEQ ID NO: 273662 - RNA, 22 nt, Homo sapiens
ugugaacaaaauuuguugcaua

SEQ ID NO: 273663 - RNA, 22 nt, Homo sapiens
ugugaacauuuuguauauauua

SEQ ID NO: 273664 - RNA, 22 nt, Homo sapiens
ugugaagauggacuaauauagu

SEQ ID NO: 273665 - RNA, 22 nt, Homo sapiens
ugugaaugauggagugucgaau

SEQ ID NO: 273666 - RNA, 22 nt, Homo sapiens
ugugacagcacgguucaacugc

SEQ ID NO: 273667 - RNA, 22 nt, Homo sapiens
ugugauaguugcuguucugggc

SEQ ID NO: 273668 - RNA, 22 nt, Homo sapiens
ugugaucaaccugcagggcugg

SEQ ID NO: 273669 - RNA, 22 nt, Homo sapiens
ugugauuauuuauagacaguca

SEQ ID NO: 273670 - RNA, 22 nt, Homo sapiens
ugugcacaacgugcagguuugu

SEQ ID NO: 273671 - RNA, 22 nt, Homo sapiens
ugugcacaaugugcagguuugu

SEQ ID NO: 273672 - RNA, 22 nt, Homo sapiens
ugugcacauugugcagguugau

SEQ ID NO: 273673 - RNA, 22 nt, Homo sapiens
ugugccacuccaggaggcuguu

SEQ ID NO: 273674 - RNA, 22 nt, Homo sapiens
ugugccacugcacucugggcaa

SEQ ID NO: 273675 - RNA, 22 nt, Homo sapiens
ugugcguguaagagaucuaggu

SEQ ID NO: 273676 - RNA, 22 nt, Homo sapiens
uguggaguguaugugacagaga

SEQ ID NO: 273677 - RNA, 22 nt, Homo sapiens
uguggcagugcuuuaugaaacc

SEQ ID NO: 273678 - RNA, 22 nt, Homo sapiens
aggcaugguggcacauacaugu

SEQ ID NO: 273679 - RNA, 22 nt, Homo sapiens
agguagcauagcgggaauauca

SEQ ID NO: 273680 - RNA, 22 nt, Homo sapiens
aguaaagcaucagcuagaugug

SEQ ID NO: 273681 - RNA, 22 nt, Homo sapiens
aguacacuguugaacagaagug

SEQ ID NO: 273682 - RNA, 22 nt, Homo sapiens
aguaucaucuuguuggccaggc

SEQ ID NO: 273683 - RNA, 22 nt, Homo sapiens
agucaugggagagaugugaucg

SEQ ID NO: 273684 - RNA, 22 nt, Homo sapiens
agucaugguaguaaauuuggac

SEQ ID NO: 273685 - RNA, 23 nt, Homo sapiens
agucuguguuuacaggcucucug

SEQ ID NO: 273686 - RNA, 17 nt, Homo sapiens
agugagaucauggcuua

SEQ ID NO: 273687 - RNA, 22 nt, Homo sapiens
agugccacugcacucuagccug

SEQ ID NO: 273688 - RNA, 22 nt, Homo sapiens
aguggaaucuguuauacuaacu

SEQ ID NO: 273689 - RNA, 22 nt, Homo sapiens
aguggcuuuuuaguggcagaug

SEQ ID NO: 273690 - RNA, 22 nt, Homo sapiens
agugggccccuagaggugaggu

SEQ ID NO: 273691 - RNA, 19 nt, Homo sapiens
aguggguguuuucuguuug

SEQ ID NO: 273692 - RNA, 22 nt, Homo sapiens
agugguuugaucacagcucacu

SEQ ID NO: 273693 - RNA, 20 nt, Homo sapiens
agugguuuucaaauaugucu

SEQ ID NO: 273694 - RNA, 22 nt, Homo sapiens
aguucaauggguuuucacucau

SEQ ID NO: 273695 - RNA, 22 nt, Homo sapiens
aguuggcacugagcugugauug

SEQ ID NO: 273696 - RNA, 22 nt, Homo sapiens
auaaaugcauugagaacugcug

SEQ ID NO: 273697 - RNA, 19 nt, Homo sapiens
auaaaugccuacaagggug

SEQ ID NO: 273698 - RNA, 22 nt, Homo sapiens
auaacauggaguuugucauuua

SEQ ID NO: 273699 - RNA, 22 nt, Homo sapiens
auaagaagugaaccagacgucu

SEQ ID NO: 273700 - RNA, 22 nt, Homo sapiens
auaaugcuuuucuagguugcau

SEQ ID NO: 273701 - RNA, 22 nt, Homo sapiens
auacaagcaguccaacuccaua

SEQ ID NO: 273702 - RNA, 22 nt, Homo sapiens
auacagcuaaaauauuaaguua

SEQ ID NO: 273703 - RNA, 22 nt, Homo sapiens
auacuccugucucagcugagau

SEQ ID NO: 273704 - RNA, 22 nt, Homo sapiens
auacuguuuuacaucauugccu

SEQ ID NO: 273705 - RNA, 22 nt, Homo sapiens
auagaauguaauguaccuccuu

SEQ ID NO: 273706 - RNA, 21 nt, Homo sapiens
auagcacaucagauuuuauua

SEQ ID NO: 273707 - RNA, 22 nt, Homo sapiens
auaguagcaugaaacagccauu

SEQ ID NO: 273708 - RNA, 22 nt, Homo sapiens
auaucagugucuuacuguuuuu

SEQ ID NO: 273709 - RNA, 22 nt, Homo sapiens
auaugcaaauccauagagacag

SEQ ID NO: 273710 - RNA, 22 nt, Homo sapiens
auaugucuguuuagucuguaau

SEQ ID NO: 273711 - RNA, 22 nt, Homo sapiens
auauugguuaaauauuauguga

SEQ ID NO: 273712 - RNA, 22 nt, Homo sapiens
auauuugguuaccugugggucu

SEQ ID NO: 273713 - RNA, 22 nt, Homo sapiens
aucaaagccaugcucaguuuuc

SEQ ID NO: 273714 - RNA, 22 nt, Homo sapiens
aucaaagugaauuaaugagaau

SEQ ID NO: 273715 - RNA, 22 nt, Homo sapiens
aucaagcugcuuguuugaaucu

SEQ ID NO: 273716 - RNA, 22 nt, Homo sapiens
aucacagaacuuugagcagaga

SEQ ID NO: 273717 - RNA, 22 nt, Homo sapiens
aucacagguacuauggcugaca

SEQ ID NO: 273718 - RNA, 22 nt, Homo sapiens
aucaccauguguacauuagacc

SEQ ID NO: 273719 - RNA, 22 nt, Homo sapiens
aucaccugagcaguauacacug

SEQ ID NO: 273720 - RNA, 22 nt, Homo sapiens
aucagcagcaugaaaacaggcu

SEQ ID NO: 273721 - RNA, 18 nt, Homo sapiens
aucagggugaagagagga

SEQ ID NO: 273722 - RNA, 22 nt, Homo sapiens
aucauacuguuuugauuacugu

SEQ ID NO: 273723 - RNA, 22 nt, Homo sapiens
aaggcaugcugaguccuaaaag

SEQ ID NO: 273724 - RNA, 22 nt, Homo sapiens
aaggcauggugacuauuuaggc

SEQ ID NO: 273725 - RNA, 22 nt, Homo sapiens
aagggaaugugguagcugguuu

SEQ ID NO: 273726 - RNA, 22 nt, Homo sapiens
aaggugcucucuuauguagaaa

SEQ ID NO: 273727 - RNA, 17 nt, Homo sapiens
aaggugcuucgaccucc

SEQ ID NO: 273728 - RNA, 22 nt, Homo sapiens
aagguucuugcuugcaugacug

SEQ ID NO: 273729 - RNA, 22 nt, Homo sapiens
aagugagaugcaguggaguucc

SEQ ID NO: 273730 - RNA, 23 nt, Homo sapiens
aagugagcuccaauugggugaga

SEQ ID NO: 273731 - RNA, 22 nt, Homo sapiens
aagugguguuugggagcuggac

SEQ ID NO: 273732 - RNA, 22 nt, Homo sapiens
aaguugcuuuagguaagucaau

SEQ ID NO: 273733 - RNA, 22 nt, Homo sapiens
aauaauggcaccaaagcacaag

SEQ ID NO: 273734 - RNA, 22 nt, Homo sapiens
aauacugaaaguauuuucaaau

SEQ ID NO: 273735 - RNA, 17 nt, Homo sapiens
aaucagauuucugagga

SEQ ID NO: 273736 - RNA, 22 nt, Homo sapiens
aauccaugugcuuuaccauuuu

SEQ ID NO: 273737 - RNA, 22 nt, Homo sapiens
aaucccugagcuagacacaaag

SEQ ID NO: 273738 - RNA, 22 nt, Homo sapiens
aaucucagcauuuugggcugag

SEQ ID NO: 273739 - RNA, 22 nt, Homo sapiens
aaugacagugcuaaagaacccu

SEQ ID NO: 273740 - RNA, 22 nt, Homo sapiens
aaugcacauauauuuccuuauu

SEQ ID NO: 273741 - RNA, 22 nt, Homo sapiens
aaugcacuccagccugggcgac

SEQ ID NO: 273742 - RNA, 22 nt, Homo sapiens
aaugcuguucuuugcuuaaguu

SEQ ID NO: 273743 - RNA, 22 nt, Homo sapiens
aauggcacaagacaugaagaag

SEQ ID NO: 273744 - RNA, 22 nt, Homo sapiens
aauggcacacaccuggucuaac

SEQ ID NO: 273745 - RNA, 22 nt, Homo sapiens
aaugguguuuccguuaagcuga

SEQ ID NO: 273746 - RNA, 22 nt, Homo sapiens
aauugcuucuguauuuuggaca

SEQ ID NO: 273747 - RNA, 21 nt, Homo sapiens
acaaagcuggagggagacugc

SEQ ID NO: 273748 - RNA, 22 nt, Homo sapiens
acacaguaaauauguauugaau

SEQ ID NO: 273749 - RNA, 22 nt, Homo sapiens
acacagugucuguguauuuaaa

SEQ ID NO: 273750 - RNA, 22 nt, Homo sapiens
acacauuagcaagugcuguuau

SEQ ID NO: 273751 - RNA, 22 nt, Homo sapiens
acacugucucuugcugaccaug

SEQ ID NO: 273752 - RNA, 23 nt, Homo sapiens
acacuugcugaguaaaucaaaua

SEQ ID NO: 273753 - RNA, 22 nt, Homo sapiens
acaguaugcuuuaaacuuuguu

SEQ ID NO: 273754 - RNA, 19 nt, Homo sapiens
acagugucucuauaaugau

SEQ ID NO: 273755 - RNA, 22 nt, Homo sapiens
acaguguuacuugauaguguau

SEQ ID NO: 273756 - RNA, 22 nt, Homo sapiens
acaucccuuucccacccuucac

SEQ ID NO: 273757 - RNA, 22 nt, Homo sapiens
acaugacauugggguggggaua

SEQ ID NO: 273758 - RNA, 22 nt, Homo sapiens
acauggcuuaugaauuuggaga

SEQ ID NO: 273759 - RNA, 22 nt, Homo sapiens
acauugcagauguguuuaaugu

SEQ ID NO: 273760 - RNA, 17 nt, Homo sapiens
accagugcaugugcuuu

SEQ ID NO: 273761 - RNA, 22 nt, Homo sapiens
acccuggagagugcuguaguaa

SEQ ID NO: 273762 - RNA, 22 nt, Homo sapiens
acccuguaacauacaagugguu

SEQ ID NO: 273763 - RNA, 22 nt, Homo sapiens
accugagacuaggcauuuuaua

SEQ ID NO: 273764 - RNA, 19 nt, Homo sapiens
accuguagaaaguacaaca

SEQ ID NO: 273765 - RNA, 23 nt, Homo sapiens
accugugguuauuuuacucuucc

SEQ ID NO: 273766 - RNA, 22 nt, Homo sapiens
acuacauaugacaucuucuuua

SEQ ID NO: 273767 - RNA, 22 nt, Homo sapiens
acugcacuccagccugagccug

SEQ ID NO: 273768 - RNA, 22 nt, Homo sapiens
acugcacuccagccugaugaaa

SEQ ID NO: 273769 - RNA, 22 nt, Homo sapiens
acugcacuccagccugcugaca

SEQ ID NO: 273770 - RNA, 22 nt, Homo sapiens
acugcacuccagccuggcggac

SEQ ID NO: 273771 - RNA, 22 nt, Homo sapiens
acugcacuccagccuugauggc

SEQ ID NO: 273772 - RNA, 22 nt, Homo sapiens
acugcacuucaaccucauugac

SEQ ID NO: 273773 - RNA, 22 nt, Homo sapiens
acuggcuuaaggaugggccacu

SEQ ID NO: 273774 - RNA, 22 nt, Homo sapiens
acugggauauuauugguaauau

SEQ ID NO: 273775 - RNA, 20 nt, Homo sapiens
acugggcuaccgaaguaagg

SEQ ID NO: 273776 - RNA, 22 nt, Homo sapiens
acugguguaugggaggucccaa

SEQ ID NO: 273777 - RNA, 22 nt, Homo sapiens
acuuggcaaaguuuuaaacagc

SEQ ID NO: 273778 - RNA, 21 nt, Homo sapiens
acuuucuguggcaguccauuc

SEQ ID NO: 273779 - RNA, 22 nt, Homo sapiens
acuuugguuaucauacuuucag

SEQ ID NO: 273780 - RNA, 22 nt, Homo sapiens
acuuuuugcaaccauuuggacc

SEQ ID NO: 273781 - RNA, 23 nt, Homo sapiens
agaaaugucuauucagggucccu

SEQ ID NO: 273782 - RNA, 22 nt, Homo sapiens
agaaugauccuucucagaggca

SEQ ID NO: 273783 - RNA, 22 nt, Homo sapiens
agaauguauauucuguaguugu

SEQ ID NO: 273784 - RNA, 22 nt, Homo sapiens
agaaugugaacaucuugaaagu

SEQ ID NO: 273785 - RNA, 22 nt, Homo sapiens
agacacugaaauguauugaaga

SEQ ID NO: 273786 - RNA, 22 nt, Homo sapiens
agacagcugguagcacuuccug

SEQ ID NO: 273787 - RNA, 22 nt, Homo sapiens
agacaguauuggcaaagugugu

SEQ ID NO: 273788 - RNA, 22 nt, Homo sapiens
agagaacugauuggaguugggc

SEQ ID NO: 273789 - RNA, 22 nt, Homo sapiens
agagaacugauuggaugugggc

SEQ ID NO: 273790 - RNA, 20 nt, Homo sapiens
agagaucaguaauucaucaa

SEQ ID NO: 273791 - RNA, 22 nt, Homo sapiens
agaggaguacuacuccaagucu

SEQ ID NO: 273792 - RNA, 22 nt, Homo sapiens
agagguaugccugggcuggagc

SEQ ID NO: 273793 - RNA, 22 nt, Homo sapiens
agaggucuuaucaaacaugcuu

SEQ ID NO: 273794 - RNA, 22 nt, Homo sapiens
agagguuuugcacugguucuuu

SEQ ID NO: 273795 - RNA, 22 nt, Homo sapiens
agaguacugacguuugcaaauu

SEQ ID NO: 273796 - RNA, 22 nt, Homo sapiens
agagugaagcuuuuuauauucu

SEQ ID NO: 273797 - RNA, 22 nt, Homo sapiens
agauaugucugcuauuugcugu

SEQ ID NO: 273798 - RNA, 22 nt, Homo sapiens
agauauguuauugauguuaaug

SEQ ID NO: 273799 - RNA, 22 nt, Homo sapiens
agaucacaguaccguaaggcug

SEQ ID NO: 273800 - RNA, 22 nt, Homo sapiens
agaugauguuucuggcacauga

SEQ ID NO: 273801 - RNA, 22 nt, Homo sapiens
agcacagugaaugguuuacuca

SEQ ID NO: 273802 - RNA, 22 nt, Homo sapiens
agcagcaugaggggacuucugc

SEQ ID NO: 273803 - RNA, 20 nt, Homo sapiens
agcagccacagauuccucag

SEQ ID NO: 273804 - RNA, 22 nt, Homo sapiens
agcagcucaugccuuugggagg

SEQ ID NO: 273805 - RNA, 22 nt, Homo sapiens
agcagugugaaaauggacuaau

SEQ ID NO: 273806 - RNA, 22 nt, Homo sapiens
agcagugugagaauggacuaau

SEQ ID NO: 273807 - RNA, 23 nt, Homo sapiens
agcccugugacucgaacgaggag

SEQ ID NO: 273808 - RNA, 22 nt, Homo sapiens
agcuaguauuuuguuaaggauu

SEQ ID NO: 273809 - RNA, 22 nt, Homo sapiens
agcucuuguuaguauuagcagu

SEQ ID NO: 273810 - RNA, 20 nt, Homo sapiens
agcuggguguguuggugcau

SEQ ID NO: 273811 - RNA, 22 nt, Homo sapiens
agcuucauucugaauagguuga

SEQ ID NO: 273812 - RNA, 22 nt, Homo sapiens
agcuuuuugggaggccuuagga

SEQ ID NO: 273813 - RNA, 22 nt, Homo sapiens
aggaagacauauagaacuaaaa

SEQ ID NO: 273814 - RNA, 22 nt, Homo sapiens
aggaagguaaacuaacuugccu

SEQ ID NO: 273815 - RNA, 22 nt, Homo sapiens
aggacacugagcaugggagguu

SEQ ID NO: 273816 - RNA, 21 nt, Homo sapiens
aggagcauucaugacgagguu

SEQ ID NO: 273817 - RNA, 22 nt, Homo sapiens
aggagguugguaccaucuguuu

SEQ ID NO: 273818 - RNA, 22 nt, Homo sapiens
aggaucauugacuauuauaagg

SEQ ID NO: 273819 - RNA, 16 nt, Homo sapiens
aggcaagaauugaggu

SEQ ID NO: 273820 - RNA, 22 nt, Homo sapiens
aggcaagcaucuugcucccuuc

SEQ ID NO: 273821 - RNA, 22 nt, Homo sapiens
aggcacgguggcucacaccugu

SEQ ID NO: 273822 - RNA, 22 nt, Homo sapiens
aggcaggugaaagauaguuuua

SEQ ID NO: 273823 - RNA, 22 nt, Homo sapiens
aggcaguuucagugagagguga

SEQ ID NO: 273824 - RNA, 22 nt, Homo sapiens
aggcaugauggcuccagaucau

SEQ ID NO: 273825 - RNA, 22 nt, Homo sapiens
uuaagcaguaguuaaggagagg

SEQ ID NO: 273826 - RNA, 22 nt, Homo sapiens
uuaagccaggugugguggcaca

SEQ ID NO: 273827 - RNA, 22 nt, Homo sapiens
uuaagcugaauuuaagcuucgg

SEQ ID NO: 273828 - RNA, 22 nt, Homo sapiens
uuaaggcuccuguuggcuuuua

SEQ ID NO: 273829 - RNA, 22 nt, Homo sapiens
uuaaucucaggaguuugggacc

SEQ ID NO: 273830 - RNA, 22 nt, Homo sapiens
uuaaugcuuuugggauauuucu

SEQ ID NO: 273831 - RNA, 22 nt, Homo sapiens
uuacaagaugucuguccaacac

SEQ ID NO: 273832 - RNA, 22 nt, Homo sapiens
uuacaaguggcaucucucugga

SEQ ID NO: 273833 - RNA, 22 nt, Homo sapiens
uuacagauggauggcagcuggc

SEQ ID NO: 273834 - RNA, 22 nt, Homo sapiens
uuacagguggagaaguaaggcu

SEQ ID NO: 273835 - RNA, 22 nt, Homo sapiens
uuacaguucugguggagaggua

SEQ ID NO: 273836 - RNA, 22 nt, Homo sapiens
uuacaugucuugguaagguuag

SEQ ID NO: 273837 - RNA, 22 nt, Homo sapiens
uuacugcuuaagugauucaaca

SEQ ID NO: 273838 - RNA, 22 nt, Homo sapiens
uuacuguagugucauaucguau

SEQ ID NO: 273839 - RNA, 22 nt, Homo sapiens
uuacuguauagaaucaucuuga

SEQ ID NO: 273840 - RNA, 22 nt, Homo sapiens
uuagaauggaaaugcgagguua

SEQ ID NO: 273841 - RNA, 22 nt, Homo sapiens
uuagaugaagucacagaaccca

SEQ ID NO: 273842 - RNA, 22 nt, Homo sapiens
uuagcacugucuacucuggauu

SEQ ID NO: 273843 - RNA, 21 nt, Homo sapiens
uuagccuguaagcacuuugca

SEQ ID NO: 273844 - RNA, 22 nt, Homo sapiens
uuaggcaaugcucucaaauuug

SEQ ID NO: 273845 - RNA, 22 nt, Homo sapiens
uuagguaggugcuuuuuucaca

SEQ ID NO: 273846 - RNA, 20 nt, Homo sapiens
uuaguucauuuagaagguuu

SEQ ID NO: 273847 - RNA, 20 nt, Homo sapiens
uuauaacuuuuguucugggg

SEQ ID NO: 273848 - RNA, 21 nt, Homo sapiens
uuaucccagugucucugcagg

SEQ ID NO: 273849 - RNA, 22 nt, Homo sapiens
uuaugcuugugugaauuuuccc

SEQ ID NO: 273850 - RNA, 22 nt, Homo sapiens
uuauguccuuuaacuucaucac

SEQ ID NO: 273851 - RNA, 22 nt, Homo sapiens
uuaugucuuugagcaaugcugu

SEQ ID NO: 273852 - RNA, 22 nt, Homo sapiens
uuauuacuccuauuuuguagau

SEQ ID NO: 273853 - RNA, 22 nt, Homo sapiens
uuauuagagauauuugguuagg

SEQ ID NO: 273854 - RNA, 22 nt, Homo sapiens
uuauugcuaaaucaugaccaca

SEQ ID NO: 273855 - RNA, 22 nt, Homo sapiens
uuauugcucauuugggcauucu

SEQ ID NO: 273856 - RNA, 22 nt, Homo sapiens
uuauuugguuauuguaauuggg

SEQ ID NO: 273857 - RNA, 22 nt, Homo sapiens
uucaaaguaaaaauguguucac

SEQ ID NO: 273858 - RNA, 22 nt, Homo sapiens
uucaaauguucuuucaccaccc

SEQ ID NO: 273859 - RNA, 22 nt, Homo sapiens
uucacaaugccuuguugauggu

SEQ ID NO: 273860 - RNA, 22 nt, Homo sapiens
uucacaauuaaaugugguuauu

SEQ ID NO: 273861 - RNA, 22 nt, Homo sapiens
uucacacuagccacucugguag

SEQ ID NO: 273862 - RNA, 22 nt, Homo sapiens
uucaccaguuuugucacgaaug

SEQ ID NO: 273863 - RNA, 22 nt, Homo sapiens
uucaccuggguuggccaucauu

SEQ ID NO: 273864 - RNA, 23 nt, Homo sapiens
uucaccugguuauuaauagccuc

SEQ ID NO: 273865 - RNA, 22 nt, Homo sapiens
uucacuggagcccaggaguugg

SEQ ID NO: 273866 - RNA, 20 nt, Homo sapiens
uucacugggcucucuguugg

SEQ ID NO: 273867 - RNA, 22 nt, Homo sapiens
uucacuguaaaaugaagagggu

SEQ ID NO: 273868 - RNA, 22 nt, Homo sapiens
uucacuguagccucagccucuu

SEQ ID NO: 273869 - RNA, 22 nt, Homo sapiens
uucacugugcuuaaauucugcu

SEQ ID NO: 273870 - RNA, 22 nt, Homo sapiens
uucacugugugacccugggcca

SEQ ID NO: 273871 - RNA, 22 nt, Homo sapiens
uucagcacugaaaauaugucau

SEQ ID NO: 273872 - RNA, 22 nt, Homo sapiens
uucaguagucuccauagaaccg

SEQ ID NO: 273873 - RNA, 22 nt, Homo sapiens
uucaguggguggaugaauauga

SEQ ID NO: 273874 - RNA, 19 nt, Homo sapiens
uucauacagugagagcagc

SEQ ID NO: 273875 - RNA, 18 nt, Homo sapiens
uucauaguagcaugauuu

SEQ ID NO: 273876 - RNA, 22 nt, Homo sapiens
uucauaguuuauacugauauuu

SEQ ID NO: 273877 - RNA, 22 nt, Homo sapiens
uucauugcugcuuaucuccaga

SEQ ID NO: 273878 - RNA, 16 nt, Homo sapiens
uuccacagucgaggug

SEQ ID NO: 273879 - RNA, 20 nt, Homo sapiens
uuccagcacauuagggaagc

SEQ ID NO: 273880 - RNA, 21 nt, Homo sapiens
uuccagugagccuagaugccu

SEQ ID NO: 273881 - RNA, 22 nt, Homo sapiens
uuccaguggacuacuucauccu

SEQ ID NO: 273882 - RNA, 22 nt, Homo sapiens
uuccaguggaguaaauggacaa

SEQ ID NO: 273883 - RNA, 22 nt, Homo sapiens
uuccaguguuugacucaccuuu

SEQ ID NO: 273884 - RNA, 22 nt, Homo sapiens
uuccauaggcuagaucaaccag

SEQ ID NO: 273885 - RNA, 22 nt, Homo sapiens
uucccuguaucuucugccaugu

SEQ ID NO: 273886 - RNA, 22 nt, Homo sapiens
uucccugugguauagaagccgu

SEQ ID NO: 273887 - RNA, 22 nt, Homo sapiens
uuccugugacuguguggcaccc

SEQ ID NO: 273888 - RNA, 22 nt, Homo sapiens
uucuacaggcuguucaagaagc

SEQ ID NO: 273889 - RNA, 21 nt, Homo sapiens
uucucaggguguguccuaccc

SEQ ID NO: 273890 - RNA, 22 nt, Homo sapiens
uucucauggaacaucuguacug

SEQ ID NO: 273891 - RNA, 22 nt, Homo sapiens
uuuucaguggccauaguggaga

SEQ ID NO: 273892 - RNA, 22 nt, Homo sapiens
uuuuggcacuuugucugauucu

SEQ ID NO: 273893 - RNA, 20 nt, Homo sapiens
uuuuggcuuaaagcagucug

SEQ ID NO: 273894 - RNA, 22 nt, Homo sapiens
uuuugguaaugaacuuaggaag

SEQ ID NO: 273895 - RNA, 22 nt, Homo sapiens
uuuugguauacacaaggguccu

SEQ ID NO: 273896 - RNA, 19 nt, Homo sapiens
uuuuguacucugugacuug

SEQ ID NO: 273897 - RNA, 18 nt, Homo sapiens
uuuuugaggcacagggga

SEQ ID NO: 273898 - RNA, 22 nt, Homo sapiens
uuuuuggaggagguuagaucau

SEQ ID NO: 273899 - RNA, 22 nt, Homo sapiens
auucacuguggcuuucucugau

SEQ ID NO: 273900 - RNA, 22 nt, Homo sapiens
auucacuguggguccuuuggau

SEQ ID NO: 273901 - RNA, 22 nt, Homo sapiens
auuccagauggaguugaggguu

SEQ ID NO: 273902 - RNA, 22 nt, Homo sapiens
auugaacuguuggagagguuuu

SEQ ID NO: 273903 - RNA, 22 nt, Homo sapiens
auugcaaagcguagacucuaaa

SEQ ID NO: 273904 - RNA, 22 nt, Homo sapiens
auugcacuccagccuggggaac

SEQ ID NO: 273905 - RNA, 22 nt, Homo sapiens
auuggcuuuauacauaagaaua

SEQ ID NO: 273906 - RNA, 22 nt, Homo sapiens
auuguacuccagccuaggcaac

SEQ ID NO: 273907 - RNA, 22 nt, Homo sapiens
auuguacuccagccugggcaaa

SEQ ID NO: 273908 - RNA, 22 nt, Homo sapiens
auuguacuuauugccagaauuu

SEQ ID NO: 273909 - RNA, 22 nt, Homo sapiens
auuguucuuacaugcugucauc

SEQ ID NO: 273910 - RNA, 22 nt, Homo sapiens
auuucacuucgcaugguguccg

SEQ ID NO: 273911 - RNA, 22 nt, Homo sapiens
auuugacacugagagccucagu

SEQ ID NO: 273912 - RNA, 20 nt, Homo sapiens
auuugcauuauggagcaccc

SEQ ID NO: 273913 - RNA, 20 nt, Homo sapiens
auuuggcauaguuuaagcaa

SEQ ID NO: 273914 - RNA, 22 nt, Homo sapiens
auuuggguaaugagugcaaggg

SEQ ID NO: 273915 - RNA, 22 nt, Homo sapiens
auuugguagaguucgauaccug

SEQ ID NO: 273916 - RNA, 21 nt, Homo sapiens
auuugguggcugugugacacu

SEQ ID NO: 273917 - RNA, 22 nt, Homo sapiens
auuuuugguuucaccugcacgc

SEQ ID NO: 273918 - RNA, 22 nt, Homo sapiens
caaaguaauugugguuuugcca

SEQ ID NO: 273919 - RNA, 22 nt, Homo sapiens
caaauccucaccucaucaugaa

SEQ ID NO: 273920 - RNA, 22 nt, Homo sapiens
caagugacugagccgccucggc

SEQ ID NO: 273921 - RNA, 22 nt, Homo sapiens
caaguguuuccuuaaauacuug

SEQ ID NO: 273922 - RNA, 21 nt, Homo sapiens
caaugacacuguagcugugcu

SEQ ID NO: 273923 - RNA, 22 nt, Homo sapiens
cacaaugucuaagauguuucua

SEQ ID NO: 273924 - RNA, 22 nt, Homo sapiens
cacagaauucauuggauuaccu

SEQ ID NO: 273925 - RNA, 22 nt, Homo sapiens
cacagagugagacccugucucu

SEQ ID NO: 273926 - RNA, 22 nt, Homo sapiens
cacaggccugucucuuucuaac

SEQ ID NO: 273927 - RNA, 22 nt, Homo sapiens
cacaguguuacugguaugaagu

SEQ ID NO: 273928 - RNA, 22 nt, Homo sapiens
cacauugaauuucugaugacaa

SEQ ID NO: 273929 - RNA, 22 nt, Homo sapiens
caccauguguucagaaggauug

SEQ ID NO: 273930 - RNA, 22 nt, Homo sapiens
caccugagcgggaugcucgccu

SEQ ID NO: 273931 - RNA, 22 nt, Homo sapiens
caccuguagucccagcugaggc

SEQ ID NO: 273932 - RNA, 22 nt, Homo sapiens
cacugcauccuccaccuccugg

SEQ ID NO: 273933 - RNA, 22 nt, Homo sapiens
cacugugcaaccuccaccuccc

SEQ ID NO: 273934 - RNA, 20 nt, Homo sapiens
cagagcaaagcaguccuggc

SEQ ID NO: 273935 - RNA, 22 nt, Homo sapiens
cagagcaaugcuuuugcuuuga

SEQ ID NO: 273936 - RNA, 22 nt, Homo sapiens
cagagugcauguuuagaugagu

SEQ ID NO: 273937 - RNA, 22 nt, Homo sapiens
cagcagguuuuuaucaguuaag

SEQ ID NO: 273938 - RNA, 22 nt, Homo sapiens
cagcgaggucugcgucacauug

SEQ ID NO: 273939 - RNA, 22 nt, Homo sapiens
caggcuuuuccacacauggguu

SEQ ID NO: 273940 - RNA, 22 nt, Homo sapiens
cagggaauguuauuuaauagca

SEQ ID NO: 273941 - RNA, 20 nt, Homo sapiens
cagggcaaugaggagguaaa

SEQ ID NO: 273942 - RNA, 20 nt, Homo sapiens
cagucauagacaucagaguc

SEQ ID NO: 273943 - RNA, 20 nt, Homo sapiens
cagugcacuuucccacuggu

SEQ ID NO: 273944 - RNA, 22 nt, Homo sapiens
cauagcacugcacuucagccug

SEQ ID NO: 273945 - RNA, 22 nt, Homo sapiens
cauauucacuuuacagagcugu

SEQ ID NO: 273946 - RNA, 22 nt, Homo sapiens
auaugucuuaguuaccuugggc

SEQ ID NO: 273947 - RNA, 22 nt, Homo sapiens
aucaagcuugacuccuuaaagg

SEQ ID NO: 273948 - RNA, 22 nt, Homo sapiens
aucacaggcaaaauuccuucuc

SEQ ID NO: 273949 - RNA, 22 nt, Homo sapiens
aucacagugaaaacagucaauu

SEQ ID NO: 273950 - RNA, 22 nt, Homo sapiens
aucacauggccagguaguaauc

SEQ ID NO: 273951 - RNA, 22 nt, Homo sapiens
aucacauggccuagccuaaccu

SEQ ID NO: 273952 - RNA, 20 nt, Homo sapiens
aucacuggagaaggaaaccu

SEQ ID NO: 273953 - RNA, 20 nt, Homo sapiens
aucagagccggugaaagggc

SEQ ID NO: 273954 - RNA, 22 nt, Homo sapiens
aucagcagcaugaaaacggacu

SEQ ID NO: 273955 - RNA, 22 nt, Homo sapiens
aucagugcauaguauuuaauga

SEQ ID NO: 273956 - RNA, 22 nt, Homo sapiens
auccacagugucaauguuguga

SEQ ID NO: 273957 - RNA, 22 nt, Homo sapiens
auccacaugcaguuggaaacag

SEQ ID NO: 273958 - RNA, 22 nt, Homo sapiens
aucccgagacuuugcugaaguu

SEQ ID NO: 273959 - RNA, 22 nt, Homo sapiens
aucccuuccuagcacuuggugu

SEQ ID NO: 273960 - RNA, 22 nt, Homo sapiens
auccugagacuuuucugaaguu

SEQ ID NO: 273961 - RNA, 21 nt, Homo sapiens
auccuucuuuuucaaccugug

SEQ ID NO: 273962 - RNA, 22 nt, Homo sapiens
aucgcugagaaagggacuuuca

SEQ ID NO: 273963 - RNA, 22 nt, Homo sapiens
aucucugagauguucugauuuu

SEQ ID NO: 273964 - RNA, 22 nt, Homo sapiens
aucuuuggcgggaauaucacag

SEQ ID NO: 273965 - RNA, 22 nt, Homo sapiens
augaagacaucgucugggauua

SEQ ID NO: 273966 - RNA, 22 nt, Homo sapiens
augaauagaguuaauugaguac

SEQ ID NO: 273967 - RNA, 23 nt, Homo sapiens
augaauguaaggaguguaagaaa

SEQ ID NO: 273968 - RNA, 22 nt, Homo sapiens
augacaaugaaucccuguuuca

SEQ ID NO: 273969 - RNA, 22 nt, Homo sapiens
augacaguguggauuauuguaa

SEQ ID NO: 273970 - RNA, 22 nt, Homo sapiens
augacauguauuuccaggauuu

SEQ ID NO: 273971 - RNA, 22 nt, Homo sapiens
augaccaaagaaaugcuauagg

SEQ ID NO: 273972 - RNA, 22 nt, Homo sapiens
augaccauuucaauugauaugg

SEQ ID NO: 273973 - RNA, 22 nt, Homo sapiens
augagaaucauuucagcuugua

SEQ ID NO: 273974 - RNA, 22 nt, Homo sapiens
augagauaggaacaaacuuaca

SEQ ID NO: 273975 - RNA, 22 nt, Homo sapiens
augagauauguuaaaaguuaaa

SEQ ID NO: 273976 - RNA, 22 nt, Homo sapiens
augagauauuuuauaagaucau

SEQ ID NO: 273977 - RNA, 22 nt, Homo sapiens
augagaugaauaccgacgaugu

SEQ ID NO: 273978 - RNA, 22 nt, Homo sapiens
augagaugauaggcguucuaac

SEQ ID NO: 273979 - RNA, 22 nt, Homo sapiens
augaggaagucaggcccagggg

SEQ ID NO: 273980 - RNA, 21 nt, Homo sapiens
augagguguacuguggugaaa

SEQ ID NO: 273981 - RNA, 22 nt, Homo sapiens
augaguauguucuguauuuuca

SEQ ID NO: 273982 - RNA, 22 nt, Homo sapiens
augagucacuuauuauuggggu

SEQ ID NO: 273983 - RNA, 22 nt, Homo sapiens
augcaaacaucauagaguguac

SEQ ID NO: 273984 - RNA, 22 nt, Homo sapiens
augcaauucuagauugauagua

SEQ ID NO: 273985 - RNA, 20 nt, Homo sapiens
augccacugagcagugguga

SEQ ID NO: 273986 - RNA, 22 nt, Homo sapiens
augccacuguuuaugucacuua

SEQ ID NO: 273987 - RNA, 22 nt, Homo sapiens
augccacuucucuaagucaugu

SEQ ID NO: 273988 - RNA, 22 nt, Homo sapiens
augccauugcacuccagccuag

SEQ ID NO: 273989 - RNA, 19 nt, Homo sapiens
augccuggagaugguuaua

SEQ ID NO: 273990 - RNA, 22 nt, Homo sapiens
auggaggccuacagaauuuugg

SEQ ID NO: 273991 - RNA, 22 nt, Homo sapiens
auggcacuccagccugggcaac

SEQ ID NO: 273992 - RNA, 18 nt, Homo sapiens
auggcagaacaauuuaca

SEQ ID NO: 273993 - RNA, 22 nt, Homo sapiens
auggcagaaucaagccgacagc

SEQ ID NO: 273994 - RNA, 22 nt, Homo sapiens
auggcagcccucuuuauccaug

SEQ ID NO: 273995 - RNA, 20 nt, Homo sapiens
auggcccugcugggaguguc

SEQ ID NO: 273996 - RNA, 22 nt, Homo sapiens
auggcggugugaucuuggcuca

SEQ ID NO: 273997 - RNA, 22 nt, Homo sapiens
auggcucuguuuuuuaugcucu

SEQ ID NO: 273998 - RNA, 22 nt, Homo sapiens
auguaguugcucugccuguuuu

SEQ ID NO: 273999 - RNA, 22 nt, Homo sapiens
auguauacauagauacgugugu

SEQ ID NO: 274000 - RNA, 22 nt, Homo sapiens
augugacugauggagaauaugu

SEQ ID NO: 274001 - RNA, 22 nt, Homo sapiens
auuacacuuucuauucaaugag

SEQ ID NO: 274002 - RNA, 22 nt, Homo sapiens
auuacaugucuauccaugaaca

SEQ ID NO: 274003 - RNA, 22 nt, Homo sapiens
auuagguuguugcaaaaguaau

SEQ ID NO: 274004 - RNA, 22 nt, Homo sapiens
auugacuugauauauagcugau

SEQ ID NO: 274005 - RNA, 21 nt, Homo sapiens
auugagcacaugaaacauggc

SEQ ID NO: 274006 - RNA, 22 nt, Homo sapiens
auugcacuccagccugggcaac

SEQ ID NO: 274007 - RNA, 21 nt, Homo sapiens
auugcacuccagccugggcga

SEQ ID NO: 274008 - RNA, 22 nt, Homo sapiens
auugccacaucucagaggcaga

SEQ ID NO: 274009 - RNA, 22 nt, Homo sapiens
auugcuuacccuguauuagauc

SEQ ID NO: 274010 - RNA, 16 nt, Homo sapiens
auuggcaagaugccuu

SEQ ID NO: 274011 - RNA, 22 nt, Homo sapiens
auuggcaauagcuuucuuacua

SEQ ID NO: 274012 - RNA, 22 nt, Homo sapiens
auuggcaauggcaaagcagagu

SEQ ID NO: 274013 - RNA, 22 nt, Homo sapiens
auuguacuccagccugggcaag

SEQ ID NO: 274014 - RNA, 22 nt, Homo sapiens
auuuagcaauggagguagugua

SEQ ID NO: 274015 - RNA, 22 nt, Homo sapiens
auuuggcauagaguaucauucu

SEQ ID NO: 274016 - RNA, 22 nt, Homo sapiens
auuugguugggugcgguggcuu

SEQ ID NO: 274017 - RNA, 18 nt, Homo sapiens
auuuuugcaguccacaug

SEQ ID NO: 274018 - RNA, 22 nt, Homo sapiens
caaaggauucauuuccaggagu

SEQ ID NO: 274019 - RNA, 22 nt, Homo sapiens
caaaggcuguuauaggccagga

SEQ ID NO: 274020 - RNA, 19 nt, Homo sapiens
caaaguguucuucuuugcc

SEQ ID NO: 274021 - RNA, 22 nt, Homo sapiens
caacacuguuuauuggauagcc

SEQ ID NO: 274022 - RNA, 22 nt, Homo sapiens
caacauccaccuccuggguuca

SEQ ID NO: 274023 - RNA, 21 nt, Homo sapiens
caagugaugcuucugcuuuaa

SEQ ID NO: 274024 - RNA, 22 nt, Homo sapiens
cacaggaagaggcacggucccu

SEQ ID NO: 274025 - RNA, 22 nt, Homo sapiens
cacaguagaauagagcacuagg

SEQ ID NO: 274026 - RNA, 22 nt, Homo sapiens
cacaguguucauagccaucagg

SEQ ID NO: 274027 - RNA, 22 nt, Homo sapiens
cacaguugccuaucuccugaag

SEQ ID NO: 274028 - RNA, 21 nt, Homo sapiens
cacauggaggcagagagugua

SEQ ID NO: 274029 - RNA, 22 nt, Homo sapiens
cacauguuugcuacauuuuucu

SEQ ID NO: 274030 - RNA, 22 nt, Homo sapiens
caccacagccauuauugucccc

SEQ ID NO: 274031 - RNA, 19 nt, Homo sapiens
caccgccugcccccugcug

SEQ ID NO: 274032 - RNA, 22 nt, Homo sapiens
cagagcacuaaagguaaaaggc

SEQ ID NO: 274033 - RNA, 20 nt, Homo sapiens
cagcaaccugcucucuuccu

SEQ ID NO: 274034 - RNA, 22 nt, Homo sapiens
cagcaguuguuucggauuggga

SEQ ID NO: 274035 - RNA, 22 nt, Homo sapiens
cagcccguaaucccagcacuuu

SEQ ID NO: 274036 - RNA, 22 nt, Homo sapiens
cagcucauugcagucucgaccu

SEQ ID NO: 274037 - RNA, 22 nt, Homo sapiens
cagguaggccaauguuuuccaa

SEQ ID NO: 274038 - RNA, 22 nt, Homo sapiens
caguagcaugccucagaaugag

SEQ ID NO: 274039 - RNA, 20 nt, Homo sapiens
cagugcaccuggcguguuga

SEQ ID NO: 274040 - RNA, 22 nt, Homo sapiens
cauacaguaggcacuauuugua

SEQ ID NO: 274041 - RNA, 22 nt, Homo sapiens
caucagagugagauauaagauc

SEQ ID NO: 274042 - RNA, 19 nt, Homo sapiens
caucccugagcugaagugg

SEQ ID NO: 274043 - RNA, 22 nt, Homo sapiens
caucucauugaauugcugagca

SEQ ID NO: 274044 - RNA, 22 nt, Homo sapiens
caugaaagacugaggaauugga

SEQ ID NO: 274045 - RNA, 22 nt, Homo sapiens
caugccacuguggacaaagaca

SEQ ID NO: 274046 - RNA, 22 nt, Homo sapiens
cauggcacaucuuuucugacua

SEQ ID NO: 274047 - RNA, 22 nt, Homo sapiens
cauggcucuuguuuacucccag

SEQ ID NO: 274048 - RNA, 18 nt, Homo sapiens
gacaguguggugauuccu

SEQ ID NO: 274049 - RNA, 21 nt, Homo sapiens
gacauggcgauacuccgucuc

SEQ ID NO: 274050 - RNA, 22 nt, Homo sapiens
gaccaaagaggcaggcauuaga

SEQ ID NO: 274051 - RNA, 22 nt, Homo sapiens
gaccacagacuggaaagagggc

SEQ ID NO: 274052 - RNA, 22 nt, Homo sapiens
gacuggcuguuuucuuuauuau

SEQ ID NO: 274053 - RNA, 21 nt, Homo sapiens
gagaaucuuuucagggcaaac

SEQ ID NO: 274054 - RNA, 22 nt, Homo sapiens
gagaaugaacagacugccucuu

SEQ ID NO: 274055 - RNA, 22 nt, Homo sapiens
gagaaugagaggggaaggccac

SEQ ID NO: 274056 - RNA, 22 nt, Homo sapiens
gagaaugagauuaugguuacau

SEQ ID NO: 274057 - RNA, 22 nt, Homo sapiens
gagauacacccagugcagaggc

SEQ ID NO: 274058 - RNA, 20 nt, Homo sapiens
gagcaucacaggccucugcu

SEQ ID NO: 274059 - RNA, 22 nt, Homo sapiens
gagcuccuccccuuggcuuuca

SEQ ID NO: 274060 - RNA, 22 nt, Homo sapiens
gaggagauauucugcuggaugg

SEQ ID NO: 274061 - RNA, 22 nt, Homo sapiens
gaggaguagggcacaaagccuu

SEQ ID NO: 274062 - RNA, 22 nt, Homo sapiens
gaggaguauuuugucgaauguc

SEQ ID NO: 274063 - RNA, 22 nt, Homo sapiens
gaggcaaguggccaccgagucu

SEQ ID NO: 274064 - RNA, 22 nt, Homo sapiens
gaggcuagauggggaugugucc

SEQ ID NO: 274065 - RNA, 22 nt, Homo sapiens
gaggguguuguguugcuuaaua

SEQ ID NO: 274066 - RNA, 22 nt, Homo sapiens
gaggucuuacauuuuaauauuu

SEQ ID NO: 274067 - RNA, 22 nt, Homo sapiens
gaggugauaucucauugugguu

SEQ ID NO: 274068 - RNA, 22 nt, Homo sapiens
gagucagugucuugcucuguca

SEQ ID NO: 274069 - RNA, 22 nt, Homo sapiens
gagugcugagcccacuuccuug

SEQ ID NO: 274070 - RNA, 23 nt, Homo sapiens
gaguggagacucauugauuuccu

SEQ ID NO: 274071 - RNA, 22 nt, Homo sapiens
gaguugagagaguuguuauuuc

SEQ ID NO: 274072 - RNA, 22 nt, Homo sapiens
gauacaguaugcaugugguauu

SEQ ID NO: 274073 - RNA, 19 nt, Homo sapiens
gauagacaucacagugcca

SEQ ID NO: 274074 - RNA, 20 nt, Homo sapiens
gaucaguuuggaguaagugc

SEQ ID NO: 274075 - RNA, 22 nt, Homo sapiens
gaucucaguggauacugugaug

SEQ ID NO: 274076 - RNA, 22 nt, Homo sapiens
gaugcaaauuaagcuugggaca

SEQ ID NO: 274077 - RNA, 22 nt, Homo sapiens
gauuucacuuucuggaugugca

SEQ ID NO: 274078 - RNA, 22 nt, Homo sapiens
gcaaaugcuacaccauuuugua

SEQ ID NO: 274079 - RNA, 22 nt, Homo sapiens
gcaagaaucugggaguaaaauu

SEQ ID NO: 274080 - RNA, 22 nt, Homo sapiens
gcaagaaugagaaggauuaauu

SEQ ID NO: 274081 - RNA, 22 nt, Homo sapiens
gcaagaauggaacaggagagcc

SEQ ID NO: 274082 - RNA, 22 nt, Homo sapiens
gcacacuuacacgaaccuagau

SEQ ID NO: 274083 - RNA, 22 nt, Homo sapiens
gcacaguggcucccgucuauaa

SEQ ID NO: 274084 - RNA, 22 nt, Homo sapiens
gcaccaugguagaauaauggua

SEQ ID NO: 274085 - RNA, 20 nt, Homo sapiens
gcagcaccauauuucuaaga

SEQ ID NO: 274086 - RNA, 22 nt, Homo sapiens
gcagcaucaaaucacacaagau

SEQ ID NO: 274087 - RNA, 22 nt, Homo sapiens
gcaggaaucuugagaaggauuc

SEQ ID NO: 274088 - RNA, 22 nt, Homo sapiens
gcaggaauuucucugcagaccc

SEQ ID NO: 274089 - RNA, 22 nt, Homo sapiens
gcaggcaugacauuucacucuu

SEQ ID NO: 274090 - RNA, 22 nt, Homo sapiens
gcaguagugugaucuuggcuca

SEQ ID NO: 274091 - RNA, 22 nt, Homo sapiens
gcagugacaugugccaguuuau

SEQ ID NO: 274092 - RNA, 22 nt, Homo sapiens
gccaagaagugucuaagcagga

SEQ ID NO: 274093 - RNA, 22 nt, Homo sapiens
gccauugcacuacagccuaggc

SEQ ID NO: 274094 - RNA, 22 nt, Homo sapiens
gcccugagauucuuggauucug

SEQ ID NO: 274095 - RNA, 22 nt, Homo sapiens
gcggguguuuuacccuugcaga

SEQ ID NO: 274096 - RNA, 22 nt, Homo sapiens
gcuaugucuguugcucuugggc

SEQ ID NO: 274097 - RNA, 22 nt, Homo sapiens
gcucaaguaauggcaguuuugc

SEQ ID NO: 274098 - RNA, 22 nt, Homo sapiens
gcucaugagacaagcaggagua

SEQ ID NO: 274099 - RNA, 22 nt, Homo sapiens
gcugcuguuuaguuucuccugg

SEQ ID NO: 274100 - RNA, 22 nt, Homo sapiens
gcuggcaaaugguuauaaggcc

SEQ ID NO: 274101 - RNA, 22 nt, Homo sapiens
gcuggcaagaugcugaugcaac

SEQ ID NO: 274102 - RNA, 22 nt, Homo sapiens
gcuguuugccgccaucgcagac

SEQ ID NO: 274103 - RNA, 22 nt, Homo sapiens
gcuuggugugcaagugguacua

SEQ ID NO: 274104 - RNA, 21 nt, Homo sapiens
ggaaaguuaaggaaauacccc

SEQ ID NO: 274105 - RNA, 19 nt, Homo sapiens
ggaaaugucuauuaagauc

SEQ ID NO: 274106 - RNA, 22 nt, Homo sapiens
ggaagccugcacucgggcaggg

SEQ ID NO: 274107 - RNA, 17 nt, Homo sapiens
ggaagccuuugguuuaa

SEQ ID NO: 274108 - RNA, 22 nt, Homo sapiens
ggaauguuaaggcgcuguuggu

SEQ ID NO: 274109 - RNA, 22 nt, Homo sapiens
ggacuagaggugaaaagaagac

SEQ ID NO: 274110 - RNA, 20 nt, Homo sapiens
ggagagugacauaauucugg

SEQ ID NO: 274111 - RNA, 22 nt, Homo sapiens
ggagaucauuuccuauuugaag

SEQ ID NO: 274112 - RNA, 22 nt, Homo sapiens
ggagaucuuuaggaguuggacu

SEQ ID NO: 274113 - RNA, 22 nt, Homo sapiens
ggagaugaaaugagcuacuuaa

SEQ ID NO: 274114 - RNA, 22 nt, Homo sapiens
ggagaugugccugcucugcucu

SEQ ID NO: 274115 - RNA, 22 nt, Homo sapiens
ggagguagucuuucccuuauca

SEQ ID NO: 274116 - RNA, 22 nt, Homo sapiens
ggagucugaacuggacaaugac

SEQ ID NO: 274117 - RNA, 22 nt, Homo sapiens
ggagucugacuuauaggaaccu

SEQ ID NO: 274118 - RNA, 22 nt, Homo sapiens
ggagugucccaaucucagcuca

SEQ ID NO: 274119 - RNA, 22 nt, Homo sapiens
ggaguguguaggagaaagguaa

SEQ ID NO: 274120 - RNA, 22 nt, Homo sapiens
ggaguuuaagucuugugcaucu

SEQ ID NO: 274121 - RNA, 22 nt, Homo sapiens
ggcaagaaccacaauuacuuuu

SEQ ID NO: 274122 - RNA, 22 nt, Homo sapiens
ggcaagaagaacuauaacuuuu

SEQ ID NO: 274123 - RNA, 17 nt, Homo sapiens
ggcaagaaguggaacuc

SEQ ID NO: 274124 - RNA, 22 nt, Homo sapiens
ggcaagauagauaucaguguca

SEQ ID NO: 274125 - RNA, 23 nt, Homo sapiens
ggcaagaucucagcucacugcaa

SEQ ID NO: 274126 - RNA, 22 nt, Homo sapiens
ggcaaggaggggcacuuucacu

SEQ ID NO: 274127 - RNA, 22 nt, Homo sapiens
ggcaccacagacgccaggcgug

SEQ ID NO: 274128 - RNA, 22 nt, Homo sapiens
ggcccugauacaaguaaggucu

SEQ ID NO: 274129 - RNA, 18 nt, Homo sapiens
ggcggguguuuuauucac

SEQ ID NO: 274130 - RNA, 22 nt, Homo sapiens
ggcuagagaauagugccacuaa

SEQ ID NO: 274131 - RNA, 22 nt, Homo sapiens
ggcucagugggguccugguucu

SEQ ID NO: 274132 - RNA, 22 nt, Homo sapiens
ggcuuggaggaaugugagggcu

SEQ ID NO: 274133 - RNA, 18 nt, Homo sapiens
gggaauauggggaguuga

SEQ ID NO: 274134 - RNA, 22 nt, Homo sapiens
gggagguaggaguuauuauuuu

SEQ ID NO: 274135 - RNA, 22 nt, Homo sapiens
gggaggucauuguucaaugcug

SEQ ID NO: 274136 - RNA, 22 nt, Homo sapiens
gggagugugcacacaugguaua

SEQ ID NO: 274137 - RNA, 22 nt, Homo sapiens
gggcagaugucuggacaccuca

SEQ ID NO: 274138 - RNA, 22 nt, Homo sapiens
gggcauugugggcagagggcag

SEQ ID NO: 274139 - RNA, 22 nt, Homo sapiens
gggccagaugcauuuguuauuu

SEQ ID NO: 274140 - RNA, 22 nt, Homo sapiens
ggggaguguggacaucacccug

SEQ ID NO: 274141 - RNA, 22 nt, Homo sapiens
gggguaggcuacacugaguucc

SEQ ID NO: 274142 - RNA, 22 nt, Homo sapiens
gguauguuuagaccauuuacau

SEQ ID NO: 274143 - RNA, 19 nt, Homo sapiens
ggucagcaaagucuagcug

SEQ ID NO: 274144 - RNA, 22 nt, Homo sapiens
ggucaguguuaucaccgaagga

SEQ ID NO: 274145 - RNA, 22 nt, Homo sapiens
ggucauggauugucuuuucuug

SEQ ID NO: 274146 - RNA, 22 nt, Homo sapiens
ggucugguguugaaauucuuca

SEQ ID NO: 274147 - RNA, 22 nt, Homo sapiens
ggugagauaucugcugauguuu

SEQ ID NO: 274148 - RNA, 22 nt, Homo sapiens
ggugagguaggaaaaguuagga

SEQ ID NO: 274149 - RNA, 22 nt, Homo sapiens
guaagagcauguaguggcucua

SEQ ID NO: 274150 - RNA, 22 nt, Homo sapiens
uaucccaguggauguaccccau

SEQ ID NO: 274151 - RNA, 20 nt, Homo sapiens
uaucuacuugcaaaugccau

SEQ ID NO: 274152 - RNA, 22 nt, Homo sapiens
uaugaaacucuaagauucacau

SEQ ID NO: 274153 - RNA, 22 nt, Homo sapiens
uauggcuuuguucaacagccuc

SEQ ID NO: 274154 - RNA, 19 nt, Homo sapiens
uauguaguuuucucaauau

SEQ ID NO: 274155 - RNA, 22 nt, Homo sapiens
uaugucacagguuuuggugaaa

SEQ ID NO: 274156 - RNA, 22 nt, Homo sapiens
uauguuaucaaaaagcuaagga

SEQ ID NO: 274157 - RNA, 22 nt, Homo sapiens
uauuacuguuauuccuaucaaa

SEQ ID NO: 274158 - RNA, 22 nt, Homo sapiens
uauuagguuggugcaaaaguaa

SEQ ID NO: 274159 - RNA, 22 nt, Homo sapiens
uauucacaggugugggacaaag

SEQ ID NO: 274160 - RNA, 22 nt, Homo sapiens
uauuccacuggcacugcauuug

SEQ ID NO: 274161 - RNA, 18 nt, Homo sapiens
uauuccucuuccucuauc

SEQ ID NO: 274162 - RNA, 22 nt, Homo sapiens
uauugcagauacccaggaaguu

SEQ ID NO: 274163 - RNA, 22 nt, Homo sapiens
uauugcauauuauucuaguggc

SEQ ID NO: 274164 - RNA, 22 nt, Homo sapiens
uauugcauguugagcaguaccu

SEQ ID NO: 274165 - RNA, 22 nt, Homo sapiens
uauugcuugaggaaaugguaau

SEQ ID NO: 274166 - RNA, 22 nt, Homo sapiens
uauugucacuaaaggaagcugg

SEQ ID NO: 274167 - RNA, 22 nt, Homo sapiens
uauuugcacucccaucauggug

SEQ ID NO: 274168 - RNA, 22 nt, Homo sapiens
uauuugguuacuugaauagcua

SEQ ID NO: 274169 - RNA, 22 nt, Homo sapiens
ucaaacacuccauaucgcgauu

SEQ ID NO: 274170 - RNA, 19 nt, Homo sapiens
ucaagcuauucuccugccu

SEQ ID NO: 274171 - RNA, 18 nt, Homo sapiens
ucaagcuauugucaugcc

SEQ ID NO: 274172 - RNA, 22 nt, Homo sapiens
ucaaggcacuagcugagcugca

SEQ ID NO: 274173 - RNA, 22 nt, Homo sapiens
ucaaguacugccuugcucuggc

SEQ ID NO: 274174 - RNA, 22 nt, Homo sapiens
ucaauugcuuaugaagauacau

SEQ ID NO: 274175 - RNA, 22 nt, Homo sapiens
ucacagaggagaagaccuuuaa

SEQ ID NO: 274176 - RNA, 22 nt, Homo sapiens
ucacagugaguggaguggggug

SEQ ID NO: 274177 - RNA, 23 nt, Homo sapiens
ucacaguggcugcuuaauuguga

SEQ ID NO: 274178 - RNA, 22 nt, Homo sapiens
ucacaugugcguuuuggcaugu

SEQ ID NO: 274179 - RNA, 22 nt, Homo sapiens
ucaccucgugaucugcccacuu

SEQ ID NO: 274180 - RNA, 22 nt, Homo sapiens
ucaccuggggcacagcugaaga

SEQ ID NO: 274181 - RNA, 23 nt, Homo sapiens
ucacggagaccugcaagaccaau

SEQ ID NO: 274182 - RNA, 22 nt, Homo sapiens
ucacugggagcauuugagccuu

SEQ ID NO: 274183 - RNA, 22 nt, Homo sapiens
ucagacacuguggccuuuggac

SEQ ID NO: 274184 - RNA, 22 nt, Homo sapiens
ucagaccauuucauuacagacu

SEQ ID NO: 274185 - RNA, 22 nt, Homo sapiens
ucagaguagaaacacuuccaua

SEQ ID NO: 274186 - RNA, 22 nt, Homo sapiens
ucagaguguuuuccaacuuggu

SEQ ID NO: 274187 - RNA, 22 nt, Homo sapiens
ucagauguuuuguuuaucugcu

SEQ ID NO: 274188 - RNA, 22 nt, Homo sapiens
ucagcacauucaaggccugccu

SEQ ID NO: 274189 - RNA, 22 nt, Homo sapiens
ucagcagucacuccuaugacaa

SEQ ID NO: 274190 - RNA, 22 nt, Homo sapiens
ucagcaguggacagaaugguag

SEQ ID NO: 274191 - RNA, 22 nt, Homo sapiens
ucagcgcauggucgugcggcau

SEQ ID NO: 274192 - RNA, 22 nt, Homo sapiens
ucaggcacucagcuuagagucu

SEQ ID NO: 274193 - RNA, 22 nt, Homo sapiens
ucaguagagacaggauuucacc

SEQ ID NO: 274194 - RNA, 22 nt, Homo sapiens
ucaguccccucgcugagucuac

SEQ ID NO: 274195 - RNA, 22 nt, Homo sapiens
ucagugacugcugcuuguauac

SEQ ID NO: 274196 - RNA, 22 nt, Homo sapiens
ucagugacuggguauuaaauca

SEQ ID NO: 274197 - RNA, 20 nt, Homo sapiens
ucagugauugguuuaguuau

SEQ ID NO: 274198 - RNA, 17 nt, Homo sapiens
ucagugcauuuaagaga

SEQ ID NO: 274199 - RNA, 22 nt, Homo sapiens
ucauauugcgguucauugacuu

SEQ ID NO: 274200 - RNA, 21 nt, Homo sapiens
ucaucagucaaagacaauggu

SEQ ID NO: 274201 - RNA, 22 nt, Homo sapiens
ucaucaguggggaugugguuga

SEQ ID NO: 274202 - RNA, 20 nt, Homo sapiens
ucaucaguuggugcucgcug

SEQ ID NO: 274203 - RNA, 22 nt, Homo sapiens
ucauccauacaguuagcaaagg

SEQ ID NO: 274204 - RNA, 22 nt, Homo sapiens
ucaugacacagcauacugacuu

SEQ ID NO: 274205 - RNA, 22 nt, Homo sapiens
ucauggcacugaugagaguuuc

SEQ ID NO: 274206 - RNA, 22 nt, Homo sapiens
ucauggcauuguuaaggguuuu

SEQ ID NO: 274207 - RNA, 22 nt, Homo sapiens
ucaugggagcccccaucaugag

SEQ ID NO: 274208 - RNA, 22 nt, Homo sapiens
ucauggggugagcuacaggcac

SEQ ID NO: 274209 - RNA, 22 nt, Homo sapiens
ucauggguuuugguccaagcaa

SEQ ID NO: 274210 - RNA, 22 nt, Homo sapiens
ucauuagagacagggugucacu

SEQ ID NO: 274211 - RNA, 22 nt, Homo sapiens
ucauucuuucuguggaggggcu

SEQ ID NO: 274212 - RNA, 22 nt, Homo sapiens
ucauugcacucccagacacccu

SEQ ID NO: 274213 - RNA, 22 nt, Homo sapiens
ucauugcacuucuuuaguugca

SEQ ID NO: 274214 - RNA, 22 nt, Homo sapiens
ucauugcauguuaauuaaacag

SEQ ID NO: 274215 - RNA, 22 nt, Homo sapiens
ucauugcauuccagcccaagca

SEQ ID NO: 274216 - RNA, 22 nt, Homo sapiens
uccacaauggcugaacuagauu

SEQ ID NO: 274217 - RNA, 19 nt, Homo sapiens
uccacagugguugaacuag

SEQ ID NO: 274218 - RNA, 22 nt, Homo sapiens
uccagguuuugugaguuuaaau

SEQ ID NO: 274219 - RNA, 18 nt, Homo sapiens
uccaguuuucccagcauc

SEQ ID NO: 274220 - RNA, 22 nt, Homo sapiens
uccaguuuucuuuccuagggcu

SEQ ID NO: 274221 - RNA, 20 nt, Homo sapiens
uccaguuuuggagacauucu

SEQ ID NO: 274222 - RNA, 22 nt, Homo sapiens
ucccaguguguagcuugucucu

SEQ ID NO: 274223 - RNA, 23 nt, Homo sapiens
uccccgggagcaccagcuuguug

SEQ ID NO: 274224 - RNA, 22 nt, Homo sapiens
uccccugagaccccucagcacu

SEQ ID NO: 274225 - RNA, 22 nt, Homo sapiens
ucccuacugggguacugccuag

SEQ ID NO: 274226 - RNA, 22 nt, Homo sapiens
ucccuggacagccuugccuggg

SEQ ID NO: 274227 - RNA, 22 nt, Homo sapiens
ucccuuucuggaguuucccaag

SEQ ID NO: 274228 - RNA, 22 nt, Homo sapiens
uccugcauucugacuugcuuuc

SEQ ID NO: 274229 - RNA, 22 nt, Homo sapiens
uccuucaguccaguggguuuug

SEQ ID NO: 274230 - RNA, 22 nt, Homo sapiens
uccuucauuugucaacucuagu

SEQ ID NO: 274231 - RNA, 19 nt, Homo sapiens
uccuugauugcaccacugc

SEQ ID NO: 274232 - RNA, 22 nt, Homo sapiens
uccuuuaguuaauaaagacaag

SEQ ID NO: 274233 - RNA, 22 nt, Homo sapiens
uccuuuggcuaacuuucuaagu

SEQ ID NO: 274234 - RNA, 22 nt, Homo sapiens
ucgcagcacgagcaugcaaggu

SEQ ID NO: 274235 - RNA, 22 nt, Homo sapiens
ucuagccuaugaagcuugucca

SEQ ID NO: 274236 - RNA, 21 nt, Homo sapiens
ucucauagaguuucacuuucu

SEQ ID NO: 274237 - RNA, 20 nt, Homo sapiens
ucucccaaacagcaggcccu

SEQ ID NO: 274238 - RNA, 22 nt, Homo sapiens
ucuccggguggcggcgaaggga

SEQ ID NO: 274239 - RNA, 19 nt, Homo sapiens
ucucugguguuggagggga

SEQ ID NO: 274240 - RNA, 22 nt, Homo sapiens
ucucugguuuucaaagcaguau

SEQ ID NO: 274241 - RNA, 22 nt, Homo sapiens
ucucuuggcggaaguugcagug

SEQ ID NO: 274242 - RNA, 22 nt, Homo sapiens
ucugcauauucuagggcaccaa

SEQ ID NO: 274243 - RNA, 22 nt, Homo sapiens
ucuggcaagagccgagggcagu

SEQ ID NO: 274244 - RNA, 22 nt, Homo sapiens
ucuggcacucagaggccuugcu

SEQ ID NO: 274245 - RNA, 22 nt, Homo sapiens
ucuggcuuauuucacuuagcau

SEQ ID NO: 274246 - RNA, 22 nt, Homo sapiens
ucuggcuucugacuuaggggac

SEQ ID NO: 274247 - RNA, 22 nt, Homo sapiens
ucuggcuugugaacugucuucu

SEQ ID NO: 274248 - RNA, 22 nt, Homo sapiens
ucuggcuuuagcaugugggaag

SEQ ID NO: 274249 - RNA, 17 nt, Homo sapiens
ucuggcuuucacaccug

SEQ ID NO: 274250 - RNA, 22 nt, Homo sapiens
ucuggguuuuuacaauguuuac

SEQ ID NO: 274251 - RNA, 22 nt, Homo sapiens
ucugugaaaucauuuccuguaa

SEQ ID NO: 274252 - RNA, 21 nt, Homo sapiens
ugccuuuguaguaggugucuu

SEQ ID NO: 274253 - RNA, 18 nt, Homo sapiens
ugcuccccugggugagca

SEQ ID NO: 274254 - RNA, 23 nt, Homo sapiens
ugcugagaccuagauccuaaaga

SEQ ID NO: 274255 - RNA, 22 nt, Homo sapiens
ugcugaguguuaccggacaccg

SEQ ID NO: 274256 - RNA, 22 nt, Homo sapiens
ugcugguauuuggaccagccug

SEQ ID NO: 274257 - RNA, 22 nt, Homo sapiens
ugcugguguuuaggaauaagaa

SEQ ID NO: 274258 - RNA, 22 nt, Homo sapiens
ugcuguguugcuggcuuaaaga

SEQ ID NO: 274259 - RNA, 22 nt, Homo sapiens
uggaaauaaaugugccaagauc

SEQ ID NO: 274260 - RNA, 22 nt, Homo sapiens
uggaaggucauuguucauuuga

SEQ ID NO: 274261 - RNA, 21 nt, Homo sapiens
uggaaguguacaauuauaccc

SEQ ID NO: 274262 - RNA, 21 nt, Homo sapiens
uggaaucuauagaggcaguag

SEQ ID NO: 274263 - RNA, 21 nt, Homo sapiens
uggaaugaauggccaacaugg

SEQ ID NO: 274264 - RNA, 22 nt, Homo sapiens
uggagcccuaaacuucuaauau

SEQ ID NO: 274265 - RNA, 22 nt, Homo sapiens
uggaggacugcagaacugaggc

SEQ ID NO: 274266 - RNA, 19 nt, Homo sapiens
uggagucaucaugcugcua

SEQ ID NO: 274267 - RNA, 18 nt, Homo sapiens
uggauuggaaaaguuccu

SEQ ID NO: 274268 - RNA, 22 nt, Homo sapiens
uggcaaaaaucacaaguaccuu

SEQ ID NO: 274269 - RNA, 22 nt, Homo sapiens
uggcaaaauauuuugguuucug

SEQ ID NO: 274270 - RNA, 22 nt, Homo sapiens
uggcaagaacugcaauugcuuu

SEQ ID NO: 274271 - RNA, 22 nt, Homo sapiens
uggcaagaucacaauuacuuuu

SEQ ID NO: 274272 - RNA, 18 nt, Homo sapiens
uggcaauaugguucuacc

SEQ ID NO: 274273 - RNA, 19 nt, Homo sapiens
uggcacauguauacuuaug

SEQ ID NO: 274274 - RNA, 20 nt, Homo sapiens
uggcaccugacagauagcca

SEQ ID NO: 274275 - RNA, 22 nt, Homo sapiens
uggcaccugacuccgagaugca

SEQ ID NO: 274276 - RNA, 22 nt, Homo sapiens
uggcacuaugugacaagguuuu

SEQ ID NO: 274277 - RNA, 22 nt, Homo sapiens
uggcaguuucauaugguucaac

SEQ ID NO: 274278 - RNA, 22 nt, Homo sapiens
uggcauaugguauuugauaucu

SEQ ID NO: 274279 - RNA, 22 nt, Homo sapiens
uggcauggaguggauggcccca

SEQ ID NO: 274280 - RNA, 22 nt, Homo sapiens
uggcauuuuguuuuagaauuag

SEQ ID NO: 274281 - RNA, 23 nt, Homo sapiens
uggccagaaacuucuuuucaucc

SEQ ID NO: 274282 - RNA, 22 nt, Homo sapiens
uggcgggaaaguugggagaaga

SEQ ID NO: 274283 - RNA, 19 nt, Homo sapiens
uggcuagagcagauauccu

SEQ ID NO: 274284 - RNA, 22 nt, Homo sapiens
uggcuuucuggggcuucuguuc

SEQ ID NO: 274285 - RNA, 22 nt, Homo sapiens
uggcuuuuaucuacucucaacu

SEQ ID NO: 274286 - RNA, 22 nt, Homo sapiens
uggcuuuuccaggcauuacgau

SEQ ID NO: 274287 - RNA, 22 nt, Homo sapiens
ugggaaacauccagcacauacu

SEQ ID NO: 274288 - RNA, 22 nt, Homo sapiens
ugggagcauugcauuagaagcc

SEQ ID NO: 274289 - RNA, 22 nt, Homo sapiens
ugggaugauguuaaacguacuc

SEQ ID NO: 274290 - RNA, 22 nt, Homo sapiens
ugggcggagacgugcagccgcc

SEQ ID NO: 274291 - RNA, 22 nt, Homo sapiens
ugguaagaggcccugaguuugu

SEQ ID NO: 274292 - RNA, 22 nt, Homo sapiens
ugguaagaucugugagccaggc

SEQ ID NO: 274293 - RNA, 22 nt, Homo sapiens
ugguauguaugauuaacaugga

SEQ ID NO: 274294 - RNA, 20 nt, Homo sapiens
ugguccccugagucuggcuu

SEQ ID NO: 274295 - RNA, 22 nt, Homo sapiens
uggucucuuugcuuuagucauc

SEQ ID NO: 274296 - RNA, 22 nt, Homo sapiens
uggucuggagagucccgcccag

SEQ ID NO: 274297 - RNA, 20 nt, Homo sapiens
ugguguuugaacagugaaug

SEQ ID NO: 274298 - RNA, 22 nt, Homo sapiens
ugguguuugagaagcugauguc

SEQ ID NO: 274299 - RNA, 20 nt, Homo sapiens
uguaaaggagauugcagcug

SEQ ID NO: 274300 - RNA, 22 nt, Homo sapiens
uguaaggcaguuagagcaaauu

SEQ ID NO: 274301 - RNA, 22 nt, Homo sapiens
uguaaugaucaaaucagaguaa

SEQ ID NO: 274302 - RNA, 19 nt, Homo sapiens
uguacacuguaaaccugug

SEQ ID NO: 274303 - RNA, 22 nt, Homo sapiens
uguauguugauguuauauucug

SEQ ID NO: 274304 - RNA, 22 nt, Homo sapiens
ugucaagaaaucaaggugugag

SEQ ID NO: 274305 - RNA, 18 nt, Homo sapiens
ugucacuggauaaugguc

SEQ ID NO: 274306 - RNA, 22 nt, Homo sapiens
ugucacugugcagucaugcauu

SEQ ID NO: 274307 - RNA, 22 nt, Homo sapiens
ugucauggggaaaauaacagac

SEQ ID NO: 274308 - RNA, 22 nt, Homo sapiens
ugucaugguagcaaggacgagg

SEQ ID NO: 274309 - RNA, 22 nt, Homo sapiens
ugucaugguguuaauuuuccug

SEQ ID NO: 274310 - RNA, 22 nt, Homo sapiens
ugucaugucaacuauggaauuu

SEQ ID NO: 274311 - RNA, 20 nt, Homo sapiens
ugucccaaccccauggguuc

SEQ ID NO: 274312 - RNA, 22 nt, Homo sapiens
uguccuagagggaugucacccc

SEQ ID NO: 274313 - RNA, 22 nt, Homo sapiens
ugucuaaagaauggcagacuca

SEQ ID NO: 274314 - RNA, 21 nt, Homo sapiens
ugucugagagaggagaucuac

SEQ ID NO: 274315 - RNA, 22 nt, Homo sapiens
ugucuggaaggguggccuccug

SEQ ID NO: 274316 - RNA, 22 nt, Homo sapiens
ugugaaaucagauagccuuuuu

SEQ ID NO: 274317 - RNA, 19 nt, Homo sapiens
ugugaagaaaugcugcaag

SEQ ID NO: 274318 - RNA, 22 nt, Homo sapiens
ugugaauguaagaaaauccaac

SEQ ID NO: 274319 - RNA, 22 nt, Homo sapiens
ugugacacugaauggcagaacu

SEQ ID NO: 274320 - RNA, 23 nt, Homo sapiens
ugugacacuuccgucaguucauu

SEQ ID NO: 274321 - RNA, 19 nt, Homo sapiens
ugugacugggccagccuag

SEQ ID NO: 274322 - RNA, 22 nt, Homo sapiens
ugugagaaaugcagaaucucag

SEQ ID NO: 274323 - RNA, 22 nt, Homo sapiens
ugugaguguguacuaguuauca

SEQ ID NO: 274324 - RNA, 16 nt, Homo sapiens
ugugaucuuuuuucuu

SEQ ID NO: 274325 - RNA, 22 nt, Homo sapiens
ugugauguggagggcagaucca

SEQ ID NO: 274326 - RNA, 22 nt, Homo sapiens
ugugcaaucagcuucauuacau

SEQ ID NO: 274327 - RNA, 22 nt, Homo sapiens
ugugcacaugauauaucacaua

SEQ ID NO: 274328 - RNA, 22 nt, Homo sapiens
ugugcacuggaccuugucuucu

SEQ ID NO: 274329 - RNA, 22 nt, Homo sapiens
ugugccacugcacucccgccug

SEQ ID NO: 274330 - RNA, 22 nt, Homo sapiens
ugugccacugcacuucagccug

SEQ ID NO: 274331 - RNA, 22 nt, Homo sapiens
ugugccuucuaagaaggagucu

SEQ ID NO: 274332 - RNA, 22 nt, Homo sapiens
uguggaaauuguuguauuuaau

SEQ ID NO: 274333 - RNA, 21 nt, Homo sapiens
uguggcaauggccucacagau

SEQ ID NO: 274334 - RNA, 22 nt, Homo sapiens
uguggcacuguguccagagaaa

SEQ ID NO: 274335 - RNA, 22 nt, Homo sapiens
uguggccccuagcuacuagaga

SEQ ID NO: 274336 - RNA, 22 nt, Homo sapiens
uguggcuuuacagcaugguuca

SEQ ID NO: 274337 - RNA, 22 nt, Homo sapiens
uguguaauacucuaaugaugca

SEQ ID NO: 274338 - RNA, 22 nt, Homo sapiens
ugugucacugaggguuagugua

SEQ ID NO: 274339 - RNA, 22 nt, Homo sapiens
ugugucacugcacuccagcgug

SEQ ID NO: 274340 - RNA, 22 nt, Homo sapiens
uguuacaguguaggccuugggu

SEQ ID NO: 274341 - RNA, 22 nt, Homo sapiens
uguuuaguuaagacauagaauu

SEQ ID NO: 274342 - RNA, 22 nt, Homo sapiens
uuaaaaguauaggccuggcaua

SEQ ID NO: 274343 - RNA, 22 nt, Homo sapiens
uuaaaccugucuucucacuaau

SEQ ID NO: 274344 - RNA, 22 nt, Homo sapiens
uuaaagcuggcguuacaguuug

SEQ ID NO: 274345 - RNA, 22 nt, Homo sapiens
uuaaagugcacacgggucaggc

SEQ ID NO: 274346 - RNA, 22 nt, Homo sapiens
uuaaaguguuuucaaaauguca

SEQ ID NO: 274347 - RNA, 22 nt, Homo sapiens
uuaagccacucaagagauagag

SEQ ID NO: 274348 - RNA, 22 nt, Homo sapiens
uuaaggcagugcaucuggaguu

SEQ ID NO: 274349 - RNA, 22 nt, Homo sapiens
uuaagucacacuagacaacuga

SEQ ID NO: 274350 - RNA, 22 nt, Homo sapiens
uuaauacucuucuaaguagucc

SEQ ID NO: 274351 - RNA, 22 nt, Homo sapiens
uuaaugaacuuuauuuuguaga

SEQ ID NO: 274352 - RNA, 22 nt, Homo sapiens
uuacaacugucuuacugguuau

SEQ ID NO: 274353 - RNA, 22 nt, Homo sapiens
uuacagauggcacacucaaggg

SEQ ID NO: 274354 - RNA, 22 nt, Homo sapiens
uuguacuuuuaguagagacggg

SEQ ID NO: 274355 - RNA, 22 nt, Homo sapiens
uuguccccaucugcugccagaa

SEQ ID NO: 274356 - RNA, 22 nt, Homo sapiens
uugugaagaugugaagcaagca

SEQ ID NO: 274357 - RNA, 22 nt, Homo sapiens
uuguggcuuaucucauuuagcg

SEQ ID NO: 274358 - RNA, 19 nt, Homo sapiens
uugugggaggacagagggg

SEQ ID NO: 274359 - RNA, 22 nt, Homo sapiens
uugugguaggaugaagagauga

SEQ ID NO: 274360 - RNA, 22 nt, Homo sapiens
uuuacugugggguuucuuagag

SEQ ID NO: 274361 - RNA, 22 nt, Homo sapiens
uuuagugcaucagacacccucu

SEQ ID NO: 274362 - RNA, 22 nt, Homo sapiens
uuuauggcaugcucccucucaa

SEQ ID NO: 274363 - RNA, 23 nt, Homo sapiens
uuucacaguagcuggaucagccu

SEQ ID NO: 274364 - RNA, 18 nt, Homo sapiens
uuucauugagugugauau

SEQ ID NO: 274365 - RNA, 16 nt, Homo sapiens
uuucuauguuuuacua

SEQ ID NO: 274366 - RNA, 17 nt, Homo sapiens
uuucucagcccucuucu

SEQ ID NO: 274367 - RNA, 22 nt, Homo sapiens
uuugaauguaaugagcaggaag

SEQ ID NO: 274368 - RNA, 22 nt, Homo sapiens
uuugagcaggcuaaucaauaua

SEQ ID NO: 274369 - RNA, 22 nt, Homo sapiens
uuugagugugauaucgauugga

SEQ ID NO: 274370 - RNA, 22 nt, Homo sapiens
uuugcuuaguaaauguagaaaa

SEQ ID NO: 274371 - RNA, 22 nt, Homo sapiens
uuuggaaugaaacagcagagcc

SEQ ID NO: 274372 - RNA, 22 nt, Homo sapiens
uuuggaaugugcacucagauug

SEQ ID NO: 274373 - RNA, 20 nt, Homo sapiens
uuuggcaauaggguuuuugu

SEQ ID NO: 274374 - RNA, 22 nt, Homo sapiens
uuuggcagaaaacaagaaucug

SEQ ID NO: 274375 - RNA, 22 nt, Homo sapiens
uuuggcauauuuuaagcugguu

SEQ ID NO: 274376 - RNA, 23 nt, Homo sapiens
uuuggcauuccagaaauuuucau

SEQ ID NO: 274377 - RNA, 22 nt, Homo sapiens
uuuggcuuaagauugacugcaa

SEQ ID NO: 274378 - RNA, 22 nt, Homo sapiens
uuugggaaugaguuuaucauuu

SEQ ID NO: 274379 - RNA, 22 nt, Homo sapiens
uuugggccaugcuucccgguca

SEQ ID NO: 274380 - RNA, 22 nt, Homo sapiens
uuugggccucugauuucuuugg

SEQ ID NO: 274381 - RNA, 22 nt, Homo sapiens
uuuggguuuuauguaacagcua

SEQ ID NO: 274382 - RNA, 22 nt, Homo sapiens
uuugguuauauauauacacucu

SEQ ID NO: 274383 - RNA, 22 nt, Homo sapiens
uuugguuauuugaaacuagcau

SEQ ID NO: 274384 - RNA, 22 nt, Homo sapiens
uuugguugcauucacauauuuc

SEQ ID NO: 274385 - RNA, 21 nt, Homo sapiens
uuuguccaccuguguucacca

SEQ ID NO: 274386 - RNA, 22 nt, Homo sapiens
uuuguucuucguuccugagcca

SEQ ID NO: 274387 - RNA, 22 nt, Homo sapiens
uuuugcaauauguuccugaaua

SEQ ID NO: 274388 - RNA, 22 nt, Homo sapiens
uuuugcuccuggcaaacucaua

SEQ ID NO: 274389 - RNA, 22 nt, Homo sapiens
uuuugcuuuuccucggucccac

SEQ ID NO: 274390 - RNA, 22 nt, Homo sapiens
uuuuggcucugucuguaucuuu

SEQ ID NO: 274391 - RNA, 22 nt, Homo sapiens
uuuugguauauacggggguccu

SEQ ID NO: 274392 - RNA, 22 nt, Homo sapiens
uuuuggucuccaguuucugcug

SEQ ID NO: 274393 - RNA, 22 nt, Homo sapiens
uuuuuauggccaauccucagaa

SEQ ID NO: 274394 - RNA, 22 nt, Homo sapiens
uuuuugguugguaggcuauuaa

SEQ ID NO: 274395 - RNA, 22 nt, Homo sapiens
guauuugguuauugcagccuga

SEQ ID NO: 274396 - RNA, 22 nt, Homo sapiens
gucaagugaagcagugggagua

SEQ ID NO: 274397 - RNA, 22 nt, Homo sapiens
gucacauugaugcccauggugg

SEQ ID NO: 274398 - RNA, 20 nt, Homo sapiens
gucacuggcccagggcuugu

SEQ ID NO: 274399 - RNA, 22 nt, Homo sapiens
gucaucaggacgggucaucugc

SEQ ID NO: 274400 - RNA, 22 nt, Homo sapiens
gucauccaggcuggagugaagc

SEQ ID NO: 274401 - RNA, 22 nt, Homo sapiens
gucauggaacaacuuaaaguca

SEQ ID NO: 274402 - RNA, 21 nt, Homo sapiens
guccaaaacaguguccaaugc

SEQ ID NO: 274403 - RNA, 22 nt, Homo sapiens
guccaguguuggagguuuuacc

SEQ ID NO: 274404 - RNA, 22 nt, Homo sapiens
gugaaaagaugagcaccauaca

SEQ ID NO: 274405 - RNA, 22 nt, Homo sapiens
gugacacuggagcuggcacaau

SEQ ID NO: 274406 - RNA, 22 nt, Homo sapiens
gugagaacugugucuuauaaac

SEQ ID NO: 274407 - RNA, 22 nt, Homo sapiens
gugagaauugacacccuugucu

SEQ ID NO: 274408 - RNA, 22 nt, Homo sapiens
gugagaggaggcagcuuuuaca

SEQ ID NO: 274409 - RNA, 22 nt, Homo sapiens
gugagauaaugucucauugugg

SEQ ID NO: 274410 - RNA, 22 nt, Homo sapiens
gugagaugaggucucacucugu

SEQ ID NO: 274411 - RNA, 22 nt, Homo sapiens
gugagaugguaucucauugugg

SEQ ID NO: 274412 - RNA, 22 nt, Homo sapiens
gugagaugugacuucugccucu

SEQ ID NO: 274413 - RNA, 22 nt, Homo sapiens
gugagauuuucuccagguucag

SEQ ID NO: 274414 - RNA, 22 nt, Homo sapiens
gugagcgaggaaacgacggcgc

SEQ ID NO: 274415 - RNA, 22 nt, Homo sapiens
gugagcuaguuucuuugcugug

SEQ ID NO: 274416 - RNA, 22 nt, Homo sapiens
gugaggaaggaaaccugcuagc

SEQ ID NO: 274417 - RNA, 22 nt, Homo sapiens
gugaggcacugcugcuuuccag

SEQ ID NO: 274418 - RNA, 22 nt, Homo sapiens
gugaggcugguccugccuccca

SEQ ID NO: 274419 - RNA, 22 nt, Homo sapiens
gugagguauacugggaucacua

SEQ ID NO: 274420 - RNA, 21 nt, Homo sapiens
gugaggucauugggcuuucug

SEQ ID NO: 274421 - RNA, 22 nt, Homo sapiens
gugagucaugucccaucugauu

SEQ ID NO: 274422 - RNA, 22 nt, Homo sapiens
gugauagguugucacugucacu

SEQ ID NO: 274423 - RNA, 22 nt, Homo sapiens
gugaucucagcucacuggaacc

SEQ ID NO: 274424 - RNA, 22 nt, Homo sapiens
gugcaaacuccaggucucuuca

SEQ ID NO: 274425 - RNA, 22 nt, Homo sapiens
gugcagaugucuuuauaguagc

SEQ ID NO: 274426 - RNA, 22 nt, Homo sapiens
gugccacaguguuaagggauuc

SEQ ID NO: 274427 - RNA, 22 nt, Homo sapiens
gugccacugcaccuggccuaag

SEQ ID NO: 274428 - RNA, 21 nt, Homo sapiens
guggaaauggaauuuacuaau

SEQ ID NO: 274429 - RNA, 20 nt, Homo sapiens
guggaagauaaguagccuga

SEQ ID NO: 274430 - RNA, 22 nt, Homo sapiens
guggagcuguguggccuugggc

SEQ ID NO: 274431 - RNA, 22 nt, Homo sapiens
guggcaaggaaaugcugcucac

SEQ ID NO: 274432 - RNA, 22 nt, Homo sapiens
guggcaaguguuccaagaggcg

SEQ ID NO: 274433 - RNA, 22 nt, Homo sapiens
gagcugguccuuuaaggaugca

SEQ ID NO: 274434 - RNA, 22 nt, Homo sapiens
gagcuuggguuaaaguugccuu

SEQ ID NO: 274435 - RNA, 22 nt, Homo sapiens
gagguaggggccuuaaagaugc

SEQ ID NO: 274436 - RNA, 22 nt, Homo sapiens
gagguaguuuaguuuuggggaa

SEQ ID NO: 274437 - RNA, 22 nt, Homo sapiens
gaggucaggacauuuuugcuuu

SEQ ID NO: 274438 - RNA, 22 nt, Homo sapiens
gagguugggaugagggauacag

SEQ ID NO: 274439 - RNA, 22 nt, Homo sapiens
gagugcuguuagcccuggguuu

SEQ ID NO: 274440 - RNA, 22 nt, Homo sapiens
gaguggugguucugaaacuuuu

SEQ ID NO: 274441 - RNA, 21 nt, Homo sapiens
gauaaguuggcagccagcacc

SEQ ID NO: 274442 - RNA, 22 nt, Homo sapiens
gauauguaaaaauuauaucuga

SEQ ID NO: 274443 - RNA, 22 nt, Homo sapiens
gaucaauuggcugaagacacgu

SEQ ID NO: 274444 - RNA, 22 nt, Homo sapiens
gaugagaucauaaguguggagc

SEQ ID NO: 274445 - RNA, 22 nt, Homo sapiens
gaugauauuugagucauuagaa

SEQ ID NO: 274446 - RNA, 22 nt, Homo sapiens
gauggcagugcagccccuggcu

SEQ ID NO: 274447 - RNA, 22 nt, Homo sapiens
gauggcuacugauuaaauauag

SEQ ID NO: 274448 - RNA, 22 nt, Homo sapiens
gauggugucccaggcucaggcu

SEQ ID NO: 274449 - RNA, 22 nt, Homo sapiens
gauuagaacagaagucagauua

SEQ ID NO: 274450 - RNA, 22 nt, Homo sapiens
gauuagagaaauacugcugcua

SEQ ID NO: 274451 - RNA, 22 nt, Homo sapiens
gauuccacuuacuuagcauucc

SEQ ID NO: 274452 - RNA, 22 nt, Homo sapiens
gauuugguguucuggcucaaga

SEQ ID NO: 274453 - RNA, 22 nt, Homo sapiens
gauuuuuggggaagccucuuau

SEQ ID NO: 274454 - RNA, 22 nt, Homo sapiens
gcaaaguguuuuuaggaagucu

SEQ ID NO: 274455 - RNA, 20 nt, Homo sapiens
gcaacauggccagagugaau

SEQ ID NO: 274456 - RNA, 22 nt, Homo sapiens
gcaaggacucccugggucauuc

SEQ ID NO: 274457 - RNA, 22 nt, Homo sapiens
gcacaguguuacuugauauauu

SEQ ID NO: 274458 - RNA, 22 nt, Homo sapiens
gcacauuacaaguauuagcuca

SEQ ID NO: 274459 - RNA, 22 nt, Homo sapiens
gcaccccuuaccgggcuggguu

SEQ ID NO: 274460 - RNA, 22 nt, Homo sapiens
gcagaucuucgcgguaaguguu

SEQ ID NO: 274461 - RNA, 22 nt, Homo sapiens
gcauauuuuaaaguguaaccug

SEQ ID NO: 274462 - RNA, 22 nt, Homo sapiens
gcaucacagcuccugugcuggc

SEQ ID NO: 274463 - RNA, 22 nt, Homo sapiens
gcauggaguggaaauucuuggg

SEQ ID NO: 274464 - RNA, 21 nt, Homo sapiens
gccaguguggcaauuuuucaa

SEQ ID NO: 274465 - RNA, 22 nt, Homo sapiens
gccauugcacuccagccucggc

SEQ ID NO: 274466 - RNA, 22 nt, Homo sapiens
gcccugauacauucuucugccu

SEQ ID NO: 274467 - RNA, 22 nt, Homo sapiens
gcccuguugcccaggcuggagu

SEQ ID NO: 274468 - RNA, 22 nt, Homo sapiens
gccuagagacuugguaucuugc

SEQ ID NO: 274469 - RNA, 23 nt, Homo sapiens
gcuaggagagaugaaacacaggu

SEQ ID NO: 274470 - RNA, 22 nt, Homo sapiens
gcuaggagaucugcugcucucu

SEQ ID NO: 274471 - RNA, 19 nt, Homo sapiens
gcucaccuugcugcuccag

SEQ ID NO: 274472 - RNA, 22 nt, Homo sapiens
gcuccuuugaguagcuucugug

SEQ ID NO: 274473 - RNA, 22 nt, Homo sapiens
gcucguccccuccugacucugc

SEQ ID NO: 274474 - RNA, 22 nt, Homo sapiens
gcugcuguaccagaugugguua

SEQ ID NO: 274475 - RNA, 22 nt, Homo sapiens
gcugcuguuauucaucagaacu

SEQ ID NO: 274476 - RNA, 22 nt, Homo sapiens
gcugcuguuucucuuucagcau

SEQ ID NO: 274477 - RNA, 22 nt, Homo sapiens
gcuguauugacuuuguaucaua

SEQ ID NO: 274478 - RNA, 20 nt, Homo sapiens
gcugugcuuaauacacuuuc

SEQ ID NO: 274479 - RNA, 22 nt, Homo sapiens
ggaagacuuagaguagcaucag

SEQ ID NO: 274480 - RNA, 22 nt, Homo sapiens
ggaagguaauuggguaaugaga

SEQ ID NO: 274481 - RNA, 22 nt, Homo sapiens
ggaagguaauugucagcucaua

SEQ ID NO: 274482 - RNA, 22 nt, Homo sapiens
ggacagaugggcucccgggucu

SEQ ID NO: 274483 - RNA, 22 nt, Homo sapiens
ggacuguaauaccaugaggaca

SEQ ID NO: 274484 - RNA, 22 nt, Homo sapiens
ggaggcuaguaaaaagguagaa

SEQ ID NO: 274485 - RNA, 22 nt, Homo sapiens
gugaggucagggcuguggacag

SEQ ID NO: 274486 - RNA, 17 nt, Homo sapiens
gugagguggguaguauc

SEQ ID NO: 274487 - RNA, 22 nt, Homo sapiens
gugauacugcuuauuaauuuaa

SEQ ID NO: 274488 - RNA, 22 nt, Homo sapiens
gugcaagagugacugcaguuuu

SEQ ID NO: 274489 - RNA, 22 nt, Homo sapiens
gugcaauucacuguuaugucug

SEQ ID NO: 274490 - RNA, 22 nt, Homo sapiens
gugcacaacgugcaggcuuguu

SEQ ID NO: 274491 - RNA, 21 nt, Homo sapiens
gugcagacacacauauaggcu

SEQ ID NO: 274492 - RNA, 22 nt, Homo sapiens
gugccacugcacuccggccugg

SEQ ID NO: 274493 - RNA, 22 nt, Homo sapiens
guggaaguguaaaagcucuugg

SEQ ID NO: 274494 - RNA, 22 nt, Homo sapiens
guggaauacuaugaugguggau

SEQ ID NO: 274495 - RNA, 18 nt, Homo sapiens
guggagugucuuccugga

SEQ ID NO: 274496 - RNA, 22 nt, Homo sapiens
guggcacgaugaucugggcuca

SEQ ID NO: 274497 - RNA, 22 nt, Homo sapiens
guggcuaaagauuuggaaucug

SEQ ID NO: 274498 - RNA, 22 nt, Homo sapiens
guggcuuuaaguacgauugagg

SEQ ID NO: 274499 - RNA, 22 nt, Homo sapiens
gugggaagcuggaacucccucc

SEQ ID NO: 274500 - RNA, 22 nt, Homo sapiens
gugggauauaaucaguccugua

SEQ ID NO: 274501 - RNA, 20 nt, Homo sapiens
gugggcaaauccuuuccucu

SEQ ID NO: 274502 - RNA, 22 nt, Homo sapiens
gugguucuaaaccuuuuuuggu

SEQ ID NO: 274503 - RNA, 22 nt, Homo sapiens
gugugacagcuauagacaugau

SEQ ID NO: 274504 - RNA, 22 nt, Homo sapiens
gugugcucaucacaugcaauag

SEQ ID NO: 274505 - RNA, 22 nt, Homo sapiens
guguucauggaauuugcaauug

SEQ ID NO: 274506 - RNA, 22 nt, Homo sapiens
guuauugcucucgaagacucuc

SEQ ID NO: 274507 - RNA, 22 nt, Homo sapiens
guucaagcaauucugcugccuc

SEQ ID NO: 274508 - RNA, 22 nt, Homo sapiens
guucacaguuaggacaacugcu

SEQ ID NO: 274509 - RNA, 22 nt, Homo sapiens
guuggcuuuuuaaggaaauugc

SEQ ID NO: 274510 - RNA, 22 nt, Homo sapiens
guuugcauagugcugggagggg

SEQ ID NO: 274511 - RNA, 22 nt, Homo sapiens
guuugccuuuuagauaggaaug

SEQ ID NO: 274512 - RNA, 22 nt, Homo sapiens
guuuguaacucuagugacuaga

SEQ ID NO: 274513 - RNA, 22 nt, Homo sapiens
guuuuuggggucacuauuaccg

SEQ ID NO: 274514 - RNA, 16 nt, Homo sapiens
uaaagcuaaucacuuu

SEQ ID NO: 274515 - RNA, 22 nt, Homo sapiens
uaaagugaggauggcaguaggu

SEQ ID NO: 274516 - RNA, 22 nt, Homo sapiens
uaaaguguuuguuauuaaaggu

SEQ ID NO: 274517 - RNA, 22 nt, Homo sapiens
uaaaugcuuaauugaaugugga

SEQ ID NO: 274518 - RNA, 21 nt, Homo sapiens
uaaaugucauacaaagcaaug

SEQ ID NO: 274519 - RNA, 22 nt, Homo sapiens
uaacauucacaugcugcaaaaa

SEQ ID NO: 274520 - RNA, 22 nt, Homo sapiens
uaacauuguugauuauacuaag

SEQ ID NO: 274521 - RNA, 22 nt, Homo sapiens
uaacccagugucugugaugggu

SEQ ID NO: 274522 - RNA, 22 nt, Homo sapiens
uaagacuguguaauuuaugaag

SEQ ID NO: 274523 - RNA, 22 nt, Homo sapiens
uaagcuaauguguuuucucuua

SEQ ID NO: 274524 - RNA, 22 nt, Homo sapiens
uaaggcaaguuuuuaguggaca

SEQ ID NO: 274525 - RNA, 22 nt, Homo sapiens
uaagggacgcccccuucucucu

SEQ ID NO: 274526 - RNA, 22 nt, Homo sapiens
uaaguagaggaaucauuuugug

SEQ ID NO: 274527 - RNA, 22 nt, Homo sapiens
uaagugaugucuuuuugugugc

SEQ ID NO: 274528 - RNA, 22 nt, Homo sapiens
uaauacuugucauaaaggcauu

SEQ ID NO: 274529 - RNA, 22 nt, Homo sapiens
uaauagcaguguuacuaggacu

SEQ ID NO: 274530 - RNA, 22 nt, Homo sapiens
uaauccuggcacuuugggaggc

SEQ ID NO: 274531 - RNA, 22 nt, Homo sapiens
uaaugcauacagaagguguuuu

SEQ ID NO: 274532 - RNA, 22 nt, Homo sapiens
uacaaagcuacucgagggcagg

SEQ ID NO: 274533 - RNA, 22 nt, Homo sapiens
aacaggcuccuaggggugcacc

SEQ ID NO: 274534 - RNA, 22 nt, Homo sapiens
aacagugccugucauuuaguag

SEQ ID NO: 274535 - RNA, 22 nt, Homo sapiens
aacagugcuguuauaaauguac

SEQ ID NO: 274536 - RNA, 20 nt, Homo sapiens
aacaguguguaaguuuccuu

SEQ ID NO: 274537 - RNA, 22 nt, Homo sapiens
aacaucaaccaugaggguugga

SEQ ID NO: 274538 - RNA, 22 nt, Homo sapiens
aacauugaacuuggcacaccca

SEQ ID NO: 274539 - RNA, 22 nt, Homo sapiens
aacccugacacaagcagaauuu

SEQ ID NO: 274540 - RNA, 22 nt, Homo sapiens
aagagaugaagguccugacugu

SEQ ID NO: 274541 - RNA, 22 nt, Homo sapiens
aagagcucucuguagcauguga

SEQ ID NO: 274542 - RNA, 22 nt, Homo sapiens
aagcugccaggcaugguggcug

SEQ ID NO: 274543 - RNA, 22 nt, Homo sapiens
aagcuggcauucaugagauuac

SEQ ID NO: 274544 - RNA, 22 nt, Homo sapiens
aaggaagcuagcaggaauuggu

SEQ ID NO: 274545 - RNA, 22 nt, Homo sapiens
aaggaguaucuguuuucucacc

SEQ ID NO: 274546 - RNA, 22 nt, Homo sapiens
aagggaaugcuuccaguuugug

SEQ ID NO: 274547 - RNA, 22 nt, Homo sapiens
aagggaauguuguggcugguug

SEQ ID NO: 274548 - RNA, 22 nt, Homo sapiens
aagggaauguuguggcugguuu

SEQ ID NO: 274549 - RNA, 22 nt, Homo sapiens
aagguggaguugacaauuuuca

SEQ ID NO: 274550 - RNA, 22 nt, Homo sapiens
aagucaugaagaggaaaggaca

SEQ ID NO: 274551 - RNA, 20 nt, Homo sapiens
aagugaguguuaaacugaac

SEQ ID NO: 274552 - RNA, 22 nt, Homo sapiens
aauaagcugagagaauucuaca

SEQ ID NO: 274553 - RNA, 22 nt, Homo sapiens
aauaucacaggguguacacuca

SEQ ID NO: 274554 - RNA, 22 nt, Homo sapiens
aauaucacaguggguguacacc

SEQ ID NO: 274555 - RNA, 23 nt, Homo sapiens
aauaucacaguggguguacaccc

SEQ ID NO: 274556 - RNA, 22 nt, Homo sapiens
aaucacagccagcuuccgcuau

SEQ ID NO: 274557 - RNA, 22 nt, Homo sapiens
aaucacuuugcuacaaggcagu

SEQ ID NO: 274558 - RNA, 22 nt, Homo sapiens
aaucauauugucugccaagagg

SEQ ID NO: 274559 - RNA, 22 nt, Homo sapiens
aaucucagagauaucugugucc

SEQ ID NO: 274560 - RNA, 22 nt, Homo sapiens
aaucuguagaaggugcacauuc

SEQ ID NO: 274561 - RNA, 22 nt, Homo sapiens
aaugaaguuagauguugagaag

SEQ ID NO: 274562 - RNA, 22 nt, Homo sapiens
aaugcacauaaaauccuccagg

SEQ ID NO: 274563 - RNA, 22 nt, Homo sapiens
aauggcaguagauggaugggua

SEQ ID NO: 274564 - RNA, 21 nt, Homo sapiens
aaugguguugccaacaaggug

SEQ ID NO: 274565 - RNA, 23 nt, Homo sapiens
aauugcuuuugaggacuuaguug

SEQ ID NO: 274566 - RNA, 22 nt, Homo sapiens
acaacaguuuuaucaccccaga

SEQ ID NO: 274567 - RNA, 22 nt, Homo sapiens
acaaccauuguaagggcuuugg

SEQ ID NO: 274568 - RNA, 22 nt, Homo sapiens
acacagucaaauccacuuggcu

SEQ ID NO: 274569 - RNA, 22 nt, Homo sapiens
acacaguguuuauugugguuag

SEQ ID NO: 274570 - RNA, 22 nt, Homo sapiens
acacugucaugucucacaggca

SEQ ID NO: 274571 - RNA, 20 nt, Homo sapiens
acacugugcuaaggauuuuc

SEQ ID NO: 274572 - RNA, 22 nt, Homo sapiens
acagauagcacuaagggaucug

SEQ ID NO: 274573 - RNA, 22 nt, Homo sapiens
acagcacugccaagugacccau

SEQ ID NO: 274574 - RNA, 20 nt, Homo sapiens
acaguauguuuggaugcaua

SEQ ID NO: 274575 - RNA, 22 nt, Homo sapiens
acagucuggagaaugggugcuc

SEQ ID NO: 274576 - RNA, 23 nt, Homo sapiens
acaguggugugaucuuggcucag

SEQ ID NO: 274577 - RNA, 18 nt, Homo sapiens
acagugucauggcucaau

SEQ ID NO: 274578 - RNA, 22 nt, Homo sapiens
acagugucugacacguaggaag

SEQ ID NO: 274579 - RNA, 22 nt, Homo sapiens
acauaaagaagcaggacauugu

SEQ ID NO: 274580 - RNA, 22 nt, Homo sapiens
acaugagacuggguuuguaggg

SEQ ID NO: 274581 - RNA, 22 nt, Homo sapiens
acauguaauugauuuuguguua

SEQ ID NO: 274582 - RNA, 22 nt, Homo sapiens
accacguagaugagagaguuaa

SEQ ID NO: 274583 - RNA, 22 nt, Homo sapiens
accaguuuuuuauacaucuucu

SEQ ID NO: 274584 - RNA, 22 nt, Homo sapiens
accaugcaguccaauaugcaca

SEQ ID NO: 274585 - RNA, 22 nt, Homo sapiens
acccagaagucauucaggaaca

SEQ ID NO: 274586 - RNA, 22 nt, Homo sapiens
acccuguaggugcuggcagaga

SEQ ID NO: 274587 - RNA, 22 nt, Homo sapiens
acccuuugucaaucaguacuaa

SEQ ID NO: 274588 - RNA, 22 nt, Homo sapiens
acgugccuuguuguucauauga

SEQ ID NO: 274589 - RNA, 22 nt, Homo sapiens
acucagagaacauucccagucu

SEQ ID NO: 274590 - RNA, 22 nt, Homo sapiens
acuccauuuggacucugggagg

SEQ ID NO: 274591 - RNA, 22 nt, Homo sapiens
acugagccuuuaaaugacuuca

SEQ ID NO: 274592 - RNA, 21 nt, Homo sapiens
acugcacuccaaccucaacag

SEQ ID NO: 274593 - RNA, 22 nt, Homo sapiens
acugcacuccagccuggaccac

SEQ ID NO: 274594 - RNA, 22 nt, Homo sapiens
acuggcuuauuucacuuagcau

SEQ ID NO: 274595 - RNA, 22 nt, Homo sapiens
acuguacuccagccugggcaac

SEQ ID NO: 274596 - RNA, 22 nt, Homo sapiens
acuguacucuacccugggcaac

SEQ ID NO: 274597 - RNA, 22 nt, Homo sapiens
agaaccauuagagggagauauu

SEQ ID NO: 274598 - RNA, 22 nt, Homo sapiens
agacagcugggaaauggagugu

SEQ ID NO: 274599 - RNA, 22 nt, Homo sapiens
agacaucauuugauggugggag

SEQ ID NO: 274600 - RNA, 21 nt, Homo sapiens
agagaacugaaacaugugacu

SEQ ID NO: 274601 - RNA, 22 nt, Homo sapiens
agagagcuuuugguugcccuaa

SEQ ID NO: 274602 - RNA, 22 nt, Homo sapiens
agagaucaauaugaaggaaaug

SEQ ID NO: 274603 - RNA, 22 nt, Homo sapiens
agagaugauuaacauuuuggua

SEQ ID NO: 274604 - RNA, 22 nt, Homo sapiens
agagcacugcugcaggguucug

SEQ ID NO: 274605 - RNA, 21 nt, Homo sapiens
agaggacugaccacagcccua

SEQ ID NO: 274606 - RNA, 22 nt, Homo sapiens
agauauguuuaguuucaaaaug

SEQ ID NO: 274607 - RNA, 22 nt, Homo sapiens
agcaacauagaaauuugggugg

SEQ ID NO: 274608 - RNA, 22 nt, Homo sapiens
agcaaccagaggagaugaggcu

SEQ ID NO: 274609 - RNA, 22 nt, Homo sapiens
agcaagaaugaacucucccaga

SEQ ID NO: 274610 - RNA, 22 nt, Homo sapiens
agcagcaauuuuguaugguuua

SEQ ID NO: 274611 - RNA, 22 nt, Homo sapiens
guggcagcacauauagguuguu

SEQ ID NO: 274612 - RNA, 22 nt, Homo sapiens
guggcuuuauuuagaagcaggg

SEQ ID NO: 274613 - RNA, 22 nt, Homo sapiens
guguaauacacacauauaugca

SEQ ID NO: 274614 - RNA, 22 nt, Homo sapiens
guguaugugagaaugcucaugu

SEQ ID NO: 274615 - RNA, 22 nt, Homo sapiens
guguggaacucaauacaacgca

SEQ ID NO: 274616 - RNA, 22 nt, Homo sapiens
guuauuaguugauauuaaguuc

SEQ ID NO: 274617 - RNA, 22 nt, Homo sapiens
guugcugagucccaucaccaga

SEQ ID NO: 274618 - RNA, 22 nt, Homo sapiens
guuggcaaguggcugagcuggg

SEQ ID NO: 274619 - RNA, 22 nt, Homo sapiens
guugguauuacagaaauuaguu

SEQ ID NO: 274620 - RNA, 22 nt, Homo sapiens
guuguggagucuucuguucugg

SEQ ID NO: 274621 - RNA, 22 nt, Homo sapiens
guuuacagucgacuugggaaua

SEQ ID NO: 274622 - RNA, 22 nt, Homo sapiens
guuuggcucuuguuucugucaa

SEQ ID NO: 274623 - RNA, 22 nt, Homo sapiens
uaaagccagugauuaugucucu

SEQ ID NO: 274624 - RNA, 21 nt, Homo sapiens
uaaagcuagaaccuuagcuuu

SEQ ID NO: 274625 - RNA, 22 nt, Homo sapiens
uaaagcuuagauccaugguggc

SEQ ID NO: 274626 - RNA, 22 nt, Homo sapiens
uaacaccuuugauagcacuuuu

SEQ ID NO: 274627 - RNA, 22 nt, Homo sapiens
uaacagcucuacagcugcucuu

SEQ ID NO: 274628 - RNA, 22 nt, Homo sapiens
uaagcuagcauagggguaaauu

SEQ ID NO: 274629 - RNA, 22 nt, Homo sapiens
uaaggaaggcugugugcuuuua

SEQ ID NO: 274630 - RNA, 22 nt, Homo sapiens
uaaggcacccuucugaguagag

SEQ ID NO: 274631 - RNA, 22 nt, Homo sapiens
uaaggcauuuuuuugaguugca

SEQ ID NO: 274632 - RNA, 22 nt, Homo sapiens
uaagguauuuacauuucuguuu

SEQ ID NO: 274633 - RNA, 22 nt, Homo sapiens
uaauaguuucagaaguuguuuu

SEQ ID NO: 274634 - RNA, 22 nt, Homo sapiens
uaauauguauacagacagauac

SEQ ID NO: 274635 - RNA, 22 nt, Homo sapiens
uaaucacagagguuuggccuca

SEQ ID NO: 274636 - RNA, 22 nt, Homo sapiens
uaaucucagcuacucaggaggc

SEQ ID NO: 274637 - RNA, 22 nt, Homo sapiens
uaaugcuguggucuaaugggga

SEQ ID NO: 274638 - RNA, 22 nt, Homo sapiens
uaauucuguauguaucagaguu

SEQ ID NO: 274639 - RNA, 22 nt, Homo sapiens
uacaaaucuagguuuguuacug

SEQ ID NO: 274640 - RNA, 22 nt, Homo sapiens
uacaagcaggaaaugguauaug

SEQ ID NO: 274641 - RNA, 22 nt, Homo sapiens
uacaagguaucagugaccguaa

SEQ ID NO: 274642 - RNA, 22 nt, Homo sapiens
uacaaguauuuuuauuagugcc

SEQ ID NO: 274643 - RNA, 22 nt, Homo sapiens
uacacacguguguauauauaca

SEQ ID NO: 274644 - RNA, 22 nt, Homo sapiens
uacaguggugugaucucagcuc

SEQ ID NO: 274645 - RNA, 22 nt, Homo sapiens
uacauaguuacuuccauuucca

SEQ ID NO: 274646 - RNA, 22 nt, Homo sapiens
uacccuuuaguauaaaaucaga

SEQ ID NO: 274647 - RNA, 22 nt, Homo sapiens
uaccucagccaaugcccagaag

SEQ ID NO: 274648 - RNA, 22 nt, Homo sapiens
uaccuguagcucuucuaggcug

SEQ ID NO: 274649 - RNA, 22 nt, Homo sapiens
uacugguuuuauauauuucucc

SEQ ID NO: 274650 - RNA, 22 nt, Homo sapiens
uacugguuuuggugggcaggug

SEQ ID NO: 274651 - RNA, 22 nt, Homo sapiens
uacuuuguagauuguuuccuuu

SEQ ID NO: 274652 - RNA, 22 nt, Homo sapiens
uagaaagcaugaccuucagaua

SEQ ID NO: 274653 - RNA, 22 nt, Homo sapiens
uagaagcuacucuucuuguggc

SEQ ID NO: 274654 - RNA, 22 nt, Homo sapiens
uagaaugaaacaagcugugccu

SEQ ID NO: 274655 - RNA, 20 nt, Homo sapiens
uagagagauauggggguucc

SEQ ID NO: 274656 - RNA, 22 nt, Homo sapiens
uagauuaucuaugaggcuucca

SEQ ID NO: 274657 - RNA, 22 nt, Homo sapiens
uagauucaucuguuccuuuuga

SEQ ID NO: 274658 - RNA, 17 nt, Homo sapiens
uagcacagugccuggua

SEQ ID NO: 274659 - RNA, 22 nt, Homo sapiens
uagcaccucuuuggccuuucgu

SEQ ID NO: 274660 - RNA, 22 nt, Homo sapiens
uagcacuauguuaucacauacu

SEQ ID NO: 274661 - RNA, 19 nt, Homo sapiens
uagcagcaugauuuauaau

SEQ ID NO: 274662 - RNA, 22 nt, Homo sapiens
uagcaguauacguacugggucc

SEQ ID NO: 274663 - RNA, 22 nt, Homo sapiens
uagcugagacuacaguaggugc

SEQ ID NO: 274664 - RNA, 22 nt, Homo sapiens
uaggacacucucuccaccagua

SEQ ID NO: 274665 - RNA, 22 nt, Homo sapiens
uaggcacugagaauaugaggau

SEQ ID NO: 274666 - RNA, 22 nt, Homo sapiens
uaguaacacauugaacgaucgc

SEQ ID NO: 274667 - RNA, 22 nt, Homo sapiens
uaguagcaccucucaugagcuu

SEQ ID NO: 274668 - RNA, 22 nt, Homo sapiens
uaguuuaucuucuggauggaca

SEQ ID NO: 274669 - RNA, 22 nt, Homo sapiens
uauaaccauuucuucucucuuc

SEQ ID NO: 274670 - RNA, 22 nt, Homo sapiens
uauagcuaugggauguauuugc

SEQ ID NO: 274671 - RNA, 23 nt, Homo sapiens
uauaugugucuaggagcuauggu

SEQ ID NO: 274672 - RNA, 22 nt, Homo sapiens
uauauguucuugcacuggaaag

SEQ ID NO: 274673 - RNA, 22 nt, Homo sapiens
uauauguuuucauaaggcuaga

SEQ ID NO: 274674 - RNA, 22 nt, Homo sapiens
uaucaaucuagggaaacuccaa

SEQ ID NO: 274675 - RNA, 22 nt, Homo sapiens
uaucaccacccugggaaacaua

SEQ ID NO: 274676 - RNA, 22 nt, Homo sapiens
uaucugcacauacacuuauagc

SEQ ID NO: 274677 - RNA, 22 nt, Homo sapiens
uaugacuuuggaaaaauuacuu

SEQ ID NO: 274678 - RNA, 22 nt, Homo sapiens
uaugcacaugcaugcuugaaua

SEQ ID NO: 274679 - RNA, 22 nt, Homo sapiens
uauggcaaugcauaggaaggaa

SEQ ID NO: 274680 - RNA, 22 nt, Homo sapiens
uaugucuggaguuacugagcug

SEQ ID NO: 274681 - RNA, 22 nt, Homo sapiens
uauuacugucaauaucacagaa

SEQ ID NO: 274682 - RNA, 22 nt, Homo sapiens
uauuagguuggugcaacaguaa

SEQ ID NO: 274683 - RNA, 22 nt, Homo sapiens
aaacauugaccucauccuggca

SEQ ID NO: 274684 - RNA, 22 nt, Homo sapiens
aaacugaucugaaggccaggcu

SEQ ID NO: 274685 - RNA, 22 nt, Homo sapiens
aaagcagcaggugguuuucaau

SEQ ID NO: 274686 - RNA, 22 nt, Homo sapiens
aaagcuaagguagcauuggaga

SEQ ID NO: 274687 - RNA, 22 nt, Homo sapiens
aaagcuagagaagcugcuguca

SEQ ID NO: 274688 - RNA, 22 nt, Homo sapiens
aaagcugucaaggcaggaggcu

SEQ ID NO: 274689 - RNA, 22 nt, Homo sapiens
aaaggauucuaauggaaaugcu

SEQ ID NO: 274690 - RNA, 22 nt, Homo sapiens
aaagggcuguuucuugacuugg

SEQ ID NO: 274691 - RNA, 22 nt, Homo sapiens
aaagggcuugaauacucuuuuu

SEQ ID NO: 274692 - RNA, 22 nt, Homo sapiens
aaagugcugagacagacuggga

SEQ ID NO: 274693 - RNA, 22 nt, Homo sapiens
aaagugcugagucuaggcgggg

SEQ ID NO: 274694 - RNA, 22 nt, Homo sapiens
aaagugcugggauuaggccagg

SEQ ID NO: 274695 - RNA, 22 nt, Homo sapiens
aaagugcugggauuggcugggc

SEQ ID NO: 274696 - RNA, 22 nt, Homo sapiens
aaagugguuuuucagacuuuga

SEQ ID NO: 274697 - RNA, 22 nt, Homo sapiens
aaaguucuguugauagugcuga

SEQ ID NO: 274698 - RNA, 22 nt, Homo sapiens
aaaugcacagaaaggaugugga

SEQ ID NO: 274699 - RNA, 22 nt, Homo sapiens
aaaugcagucuuuguucugggc

SEQ ID NO: 274700 - RNA, 22 nt, Homo sapiens
aaaugcaugaauaagcucgugu

SEQ ID NO: 274701 - RNA, 22 nt, Homo sapiens
aaaugcauggacagcuggucuu

SEQ ID NO: 274702 - RNA, 22 nt, Homo sapiens
aaaugucauggaguguuucccc

SEQ ID NO: 274703 - RNA, 22 nt, Homo sapiens
aaauugcuuuugaagacuuagu

SEQ ID NO: 274704 - RNA, 22 nt, Homo sapiens
aacaccaucccuuugaugcuuu

SEQ ID NO: 274705 - RNA, 22 nt, Homo sapiens
aacaggguggugccugguccau

SEQ ID NO: 274706 - RNA, 22 nt, Homo sapiens
aacaggguguuugcaguuucuu

SEQ ID NO: 274707 - RNA, 21 nt, Homo sapiens
aacagugcuuaguagauguuc

SEQ ID NO: 274708 - RNA, 22 nt, Homo sapiens
aacaguguuuuggguuuucugg

SEQ ID NO: 274709 - RNA, 22 nt, Homo sapiens
aagagguuuaacugacucacag

SEQ ID NO: 274710 - RNA, 22 nt, Homo sapiens
aagauauguuaguuauaaacuc

SEQ ID NO: 274711 - RNA, 20 nt, Homo sapiens
aagcagacauuuggaugaaa

SEQ ID NO: 274712 - RNA, 22 nt, Homo sapiens
aagcaugguuuccaggggucac

SEQ ID NO: 274713 - RNA, 22 nt, Homo sapiens
aagcuggagugcaguggugcaa

SEQ ID NO: 274714 - RNA, 22 nt, Homo sapiens
aagcuggagugcaguggugcga

SEQ ID NO: 274715 - RNA, 22 nt, Homo sapiens
aagcuguugguggaucuaccau

SEQ ID NO: 274716 - RNA, 22 nt, Homo sapiens
aaggagcuaagagaucauacau

SEQ ID NO: 274717 - RNA, 22 nt, Homo sapiens
aaggaguagaggaauagcaaug

SEQ ID NO: 274718 - RNA, 22 nt, Homo sapiens
aaggcaagauacugguugcuga

SEQ ID NO: 274719 - RNA, 22 nt, Homo sapiens
aaggcuagagaagaagggcauc

SEQ ID NO: 274720 - RNA, 22 nt, Homo sapiens
aagggaauguuguagcugguuu

SEQ ID NO: 274721 - RNA, 22 nt, Homo sapiens
aagggaauguugugguugguuu

SEQ ID NO: 274722 - RNA, 22 nt, Homo sapiens
aaguaauugagguuuuugcugu

SEQ ID NO: 274723 - RNA, 22 nt, Homo sapiens
aaguauuagcuaauugugcuua

SEQ ID NO: 274724 - RNA, 22 nt, Homo sapiens
aaguguaugaaacaguccaugg

SEQ ID NO: 274725 - RNA, 19 nt, Homo sapiens
aauaaugccagaugucugu

SEQ ID NO: 274726 - RNA, 22 nt, Homo sapiens
aauacugagaugugagguacua

SEQ ID NO: 274727 - RNA, 22 nt, Homo sapiens
aaucacacuugauguugagcaa

SEQ ID NO: 274728 - RNA, 21 nt, Homo sapiens
aaucacaguuguucugccuuc

SEQ ID NO: 274729 - RNA, 22 nt, Homo sapiens
aaugauacuguguacaagggca

SEQ ID NO: 274730 - RNA, 22 nt, Homo sapiens
aaugauauguuauguuuagguu

SEQ ID NO: 274731 - RNA, 18 nt, Homo sapiens
aaugggacuacaaagcca

SEQ ID NO: 274732 - RNA, 22 nt, Homo sapiens
aaugggacugacgccucccaga

SEQ ID NO: 274733 - RNA, 22 nt, Homo sapiens
aauuaguugucgugagaguggu

SEQ ID NO: 274734 - RNA, 22 nt, Homo sapiens
aauugaaucaugugggcagacu

SEQ ID NO: 274735 - RNA, 22 nt, Homo sapiens
aauugcuuuuauuuagggccag

SEQ ID NO: 274736 - RNA, 20 nt, Homo sapiens
acaaaugcauucugugacau

SEQ ID NO: 274737 - RNA, 22 nt, Homo sapiens
acaagugaauacaggauucucu

SEQ ID NO: 274738 - RNA, 22 nt, Homo sapiens
acaauguauauuuuacuguagg

SEQ ID NO: 274739 - RNA, 22 nt, Homo sapiens
acacauuggcaauucuggagca

SEQ ID NO: 274740 - RNA, 22 nt, Homo sapiens
acaccaucuccuuauuucucuu

SEQ ID NO: 274741 - RNA, 22 nt, Homo sapiens
acaccauugcauuccagccugg

SEQ ID NO: 274742 - RNA, 22 nt, Homo sapiens
acacucuaguguucuuaaucag

SEQ ID NO: 274743 - RNA, 22 nt, Homo sapiens
acacuguagcugagggcaugcg

SEQ ID NO: 274744 - RNA, 22 nt, Homo sapiens
aaaagucuguagugaaagguga

SEQ ID NO: 274745 - RNA, 22 nt, Homo sapiens
aaaaugcugauauugggcccca

SEQ ID NO: 274746 - RNA, 22 nt, Homo sapiens
aaagugauuguaguuuuugcca

SEQ ID NO: 274747 - RNA, 22 nt, Homo sapiens
aaaguguuucugcaguagguuu

SEQ ID NO: 274748 - RNA, 19 nt, Homo sapiens
aaaguguuuuaaagaggau

SEQ ID NO: 274749 - RNA, 22 nt, Homo sapiens
aaauccauuuguucagcuaugc

SEQ ID NO: 274750 - RNA, 22 nt, Homo sapiens
aaaugcagauucugcuuagguu

SEQ ID NO: 274751 - RNA, 22 nt, Homo sapiens
aaaugcugucaaauuguguucu

SEQ ID NO: 274752 - RNA, 22 nt, Homo sapiens
aaauucaucaaaugguuuguau

SEQ ID NO: 274753 - RNA, 22 nt, Homo sapiens
aaauucauuucagcucugggua

SEQ ID NO: 274754 - RNA, 22 nt, Homo sapiens
aacaccuugcagggauuaugac

SEQ ID NO: 274755 - RNA, 21 nt, Homo sapiens
aacacggugaaaucccgucuc

SEQ ID NO: 274756 - RNA, 22 nt, Homo sapiens
aacacuaucugccuuacaggga

SEQ ID NO: 274757 - RNA, 22 nt, Homo sapiens
aacagaccuagauaguauaguc

SEQ ID NO: 274758 - RNA, 22 nt, Homo sapiens
aaccugaagaaaauauuugcug

SEQ ID NO: 274759 - RNA, 22 nt, Homo sapiens
aaccuuuagucagcucuuagga

SEQ ID NO: 274760 - RNA, 22 nt, Homo sapiens
aagaggcuguaggauaaugccu

SEQ ID NO: 274761 - RNA, 22 nt, Homo sapiens
aagagguaauaacaaagcuucu

SEQ ID NO: 274762 - RNA, 22 nt, Homo sapiens
aagcaccaauaggagauuuguc

SEQ ID NO: 274763 - RNA, 22 nt, Homo sapiens
aagcacccagccucacgccugc

SEQ ID NO: 274764 - RNA, 22 nt, Homo sapiens
aagccacuguaccugucucuua

SEQ ID NO: 274765 - RNA, 22 nt, Homo sapiens
aagcuaccauuuguauauaaag

SEQ ID NO: 274766 - RNA, 22 nt, Homo sapiens
aagcuccauuucugccaugaga

SEQ ID NO: 274767 - RNA, 22 nt, Homo sapiens
aagcugccuugcugaggagaaa

SEQ ID NO: 274768 - RNA, 22 nt, Homo sapiens
aagcugguguugcugcucuguu

SEQ ID NO: 274769 - RNA, 22 nt, Homo sapiens
aagcuguugguggauguaccau

SEQ ID NO: 274770 - RNA, 22 nt, Homo sapiens
aaggagcuuaagugacuuguac

SEQ ID NO: 274771 - RNA, 22 nt, Homo sapiens
aaggaguagaauagaugcaccu

SEQ ID NO: 274772 - RNA, 22 nt, Homo sapiens
aaggaguauugaaugaccaagu

SEQ ID NO: 274773 - RNA, 22 nt, Homo sapiens
aagggaaugcgcugccuguguu

SEQ ID NO: 274774 - RNA, 22 nt, Homo sapiens
aagggagcugcauaaucuugug

SEQ ID NO: 274775 - RNA, 22 nt, Homo sapiens
aagguauuuuugucuauaucuu

SEQ ID NO: 274776 - RNA, 22 nt, Homo sapiens
aaggucauugugguuuuugcca

SEQ ID NO: 274777 - RNA, 22 nt, Homo sapiens
aaggugcuguaagcauccaugu

SEQ ID NO: 274778 - RNA, 19 nt, Homo sapiens
aaguaguugugacagaugc

SEQ ID NO: 274779 - RNA, 22 nt, Homo sapiens
aagucaaggagagaagcuucag

SEQ ID NO: 274780 - RNA, 22 nt, Homo sapiens
aagucauggaggaguaugugag

SEQ ID NO: 274781 - RNA, 22 nt, Homo sapiens
aaguccaugaagucuugugggu

SEQ ID NO: 274782 - RNA, 22 nt, Homo sapiens
aaguccccugacagaggggagg

SEQ ID NO: 274783 - RNA, 17 nt, Homo sapiens
aaguggcuuguucacca

SEQ ID NO: 274784 - RNA, 22 nt, Homo sapiens
aauaagaaguggaagggaccgg

SEQ ID NO: 274785 - RNA, 22 nt, Homo sapiens
aauagcauugaaucuaccaauu

SEQ ID NO: 274786 - RNA, 22 nt, Homo sapiens
aaucagagcccucugagcuuca

SEQ ID NO: 274787 - RNA, 22 nt, Homo sapiens
aaucagauuccagugguuggaa

SEQ ID NO: 274788 - RNA, 22 nt, Homo sapiens
aauccugucuugccauccaaua

SEQ ID NO: 274789 - RNA, 22 nt, Homo sapiens
aauggcacaagaguaaacuguu

SEQ ID NO: 274790 - RNA, 22 nt, Homo sapiens
aauuaguugaaagucugcuuuu

SEQ ID NO: 274791 - RNA, 22 nt, Homo sapiens
aauuaguuggcugccuaugauu

SEQ ID NO: 274792 - RNA, 22 nt, Homo sapiens
aauuaguuggcugggugcggug

SEQ ID NO: 274793 - RNA, 22 nt, Homo sapiens
acaagacuucuuguauucuagu

SEQ ID NO: 274794 - RNA, 22 nt, Homo sapiens
acaccaugucuguuucugguuu

SEQ ID NO: 274795 - RNA, 22 nt, Homo sapiens
acacgggugccggcaucagcac

SEQ ID NO: 274796 - RNA, 22 nt, Homo sapiens
acacguguugaaauuuaauugc

SEQ ID NO: 274797 - RNA, 22 nt, Homo sapiens
acacugucugaugaaaguaguu

SEQ ID NO: 274798 - RNA, 22 nt, Homo sapiens
acagagcaaugagcuacggucu

SEQ ID NO: 274799 - RNA, 20 nt, Homo sapiens
acagcacugguuucaagcaa

SEQ ID NO: 274800 - RNA, 22 nt, Homo sapiens
acaggagugggauuugaguccu

SEQ ID NO: 274801 - RNA, 22 nt, Homo sapiens
acagguauagaaagcuaaaggg

SEQ ID NO: 274802 - RNA, 23 nt, Homo sapiens
acaguauguggauguggcuaagu

SEQ ID NO: 274803 - RNA, 22 nt, Homo sapiens
acagugacagaaagcugauuau

SEQ ID NO: 274804 - RNA, 22 nt, Homo sapiens
acagugcugucugcuuuggcua

SEQ ID NO: 274805 - RNA, 21 nt, Homo sapiens
acaucagaguugugaagguag

SEQ ID NO: 274806 - RNA, 22 nt, Homo sapiens
acaucaggcuugugaugauuac

SEQ ID NO: 274807 - RNA, 22 nt, Homo sapiens
acaucccaugccuggguacucc

SEQ ID NO: 274808 - RNA, 22 nt, Homo sapiens
acaucccuugcucggggccccu

SEQ ID NO: 274809 - RNA, 22 nt, Homo sapiens
acaucuguacaguggguguggu

SEQ ID NO: 274810 - RNA, 22 nt, Homo sapiens
acauugcauauggcacccucuu

SEQ ID NO: 274811 - RNA, 22 nt, Homo sapiens
accacuguuucaagaagcuugu

SEQ ID NO: 274812 - RNA, 22 nt, Homo sapiens
acccagaguuccuugucuuuca

SEQ ID NO: 274813 - RNA, 22 nt, Homo sapiens
acccugcuaaacagcccccugc

SEQ ID NO: 274814 - RNA, 22 nt, Homo sapiens
acccuguaguuagaaacuuuca

SEQ ID NO: 274815 - RNA, 22 nt, Homo sapiens
acccugucauccacauggugcu

SEQ ID NO: 274816 - RNA, 22 nt, Homo sapiens
acggcacugguggaaguguagc

SEQ ID NO: 274817 - RNA, 22 nt, Homo sapiens
acucagagugggccccuagaua

SEQ ID NO: 274818 - RNA, 22 nt, Homo sapiens
acugcacuccagccucccgucu

SEQ ID NO: 274819 - RNA, 22 nt, Homo sapiens
acugcacuccagccugcccaac

SEQ ID NO: 274820 - RNA, 22 nt, Homo sapiens
acugcacuguccuagaguccuc

SEQ ID NO: 274821 - RNA, 20 nt, Homo sapiens
acugcacuucagccugcugg

SEQ ID NO: 274822 - RNA, 22 nt, Homo sapiens
acugcacuucagccuuggggac

SEQ ID NO: 274823 - RNA, 22 nt, Homo sapiens
acuggcuguuaggaauuaccuc

SEQ ID NO: 274824 - RNA, 19 nt, Homo sapiens
acuguacuccagucugggc

SEQ ID NO: 274825 - RNA, 17 nt, Homo sapiens
acuuuuugaggaggcau

SEQ ID NO: 274826 - RNA, 22 nt, Homo sapiens
agaacuguccauucagcaugaa

SEQ ID NO: 274827 - RNA, 20 nt, Homo sapiens
agaagcauugcucucuucag

SEQ ID NO: 274828 - RNA, 19 nt, Homo sapiens
agaaucuaaauuauuucug

SEQ ID NO: 274829 - RNA, 22 nt, Homo sapiens
agacuagacagaugaacagcac

SEQ ID NO: 274830 - RNA, 23 nt, Homo sapiens
agacugaaguaucugagacucag

SEQ ID NO: 274831 - RNA, 22 nt, Homo sapiens
agagauaguuuccaacucauac

SEQ ID NO: 274832 - RNA, 22 nt, Homo sapiens
agagcaaugggugaauauuaaa

SEQ ID NO: 274833 - RNA, 22 nt, Homo sapiens
agaguaguuucuauauucuuca

SEQ ID NO: 274834 - RNA, 19 nt, Homo sapiens
agaguauuguuacuucucu

SEQ ID NO: 274835 - RNA, 22 nt, Homo sapiens
agaugauguuuacugagcauca

SEQ ID NO: 274836 - RNA, 22 nt, Homo sapiens
agauggguuuucacauguuggc

SEQ ID NO: 274837 - RNA, 22 nt, Homo sapiens
agcaagauugauggccugcagg

SEQ ID NO: 274838 - RNA, 22 nt, Homo sapiens
agcacauauauuucccaaaaca

SEQ ID NO: 274839 - RNA, 19 nt, Homo sapiens
agcagaacaaauguguggg

SEQ ID NO: 274840 - RNA, 22 nt, Homo sapiens
agcagcauauuuuuauaaugua

SEQ ID NO: 274841 - RNA, 22 nt, Homo sapiens
agcagcauuaguggaaucuugu

SEQ ID NO: 274842 - RNA, 22 nt, Homo sapiens
agcagcauuaugauauaucuua

SEQ ID NO: 274843 - RNA, 22 nt, Homo sapiens
agcagguguggcuuauccugaa

SEQ ID NO: 274844 - RNA, 19 nt, Homo sapiens
agcaucauuauuguuuugg

SEQ ID NO: 274845 - RNA, 22 nt, Homo sapiens
agcauuaguugugaagccuuua

SEQ ID NO: 274846 - RNA, 22 nt, Homo sapiens
ucaacauugcugucaggcaucu

SEQ ID NO: 274847 - RNA, 22 nt, Homo sapiens
ucaagcaauucugcugccucag

SEQ ID NO: 274848 - RNA, 23 nt, Homo sapiens
ucaagugaugguggccacaaggg

SEQ ID NO: 274849 - RNA, 22 nt, Homo sapiens
ucacaauguaaaugaggguugg

SEQ ID NO: 274850 - RNA, 22 nt, Homo sapiens
ucacacugcaucuguuggaauu

SEQ ID NO: 274851 - RNA, 17 nt, Homo sapiens
ucacaguguuaggauga

SEQ ID NO: 274852 - RNA, 22 nt, Homo sapiens
ucaccaguggcacuccagccug

SEQ ID NO: 274853 - RNA, 22 nt, Homo sapiens
ucaccagugucagggaacugcu

SEQ ID NO: 274854 - RNA, 22 nt, Homo sapiens
ucacccugacaugcggccgaac

SEQ ID NO: 274855 - RNA, 22 nt, Homo sapiens
ucaccuggagacaugaagacug

SEQ ID NO: 274856 - RNA, 22 nt, Homo sapiens
ucacuauugacaacagugugga

SEQ ID NO: 274857 - RNA, 22 nt, Homo sapiens
ucacugaaaccgccuccaccuc

SEQ ID NO: 274858 - RNA, 22 nt, Homo sapiens
ucacuggaggagaggaagugga

SEQ ID NO: 274859 - RNA, 22 nt, Homo sapiens
ucacuggucuaaguggaggggg

SEQ ID NO: 274860 - RNA, 22 nt, Homo sapiens
ucagaacugauacuagaacuuu

SEQ ID NO: 274861 - RNA, 22 nt, Homo sapiens
ucagacacugagcaaacgacua

SEQ ID NO: 274862 - RNA, 18 nt, Homo sapiens
ucagagugcagacuauac

SEQ ID NO: 274863 - RNA, 22 nt, Homo sapiens
ucagagugcagggaguagcagc

SEQ ID NO: 274864 - RNA, 22 nt, Homo sapiens
ucagaucaguuccacaagaacu

SEQ ID NO: 274865 - RNA, 22 nt, Homo sapiens
ucagauguuucuuuaacgcaug

SEQ ID NO: 274866 - RNA, 19 nt, Homo sapiens
ucagcaguaaucaacuuca

SEQ ID NO: 274867 - RNA, 22 nt, Homo sapiens
ucagcagugagagaccucaccc

SEQ ID NO: 274868 - RNA, 22 nt, Homo sapiens
ucagcagugccccacucuacug

SEQ ID NO: 274869 - RNA, 22 nt, Homo sapiens
ucagcagugugaaaauggacua

SEQ ID NO: 274870 - RNA, 21 nt, Homo sapiens
ucagggaccugcuguacugau

SEQ ID NO: 274871 - RNA, 22 nt, Homo sapiens
ucaggucauuccaggagggcca

SEQ ID NO: 274872 - RNA, 22 nt, Homo sapiens
ucagguccuuacugugcucccu

SEQ ID NO: 274873 - RNA, 22 nt, Homo sapiens
ucaggugccuuggcuaauuguu

SEQ ID NO: 274874 - RNA, 22 nt, Homo sapiens
ucagucauguuuaccagacgua

SEQ ID NO: 274875 - RNA, 22 nt, Homo sapiens
ucagugcaggaauuuccuuaga

SEQ ID NO: 274876 - RNA, 22 nt, Homo sapiens
ucauacaggccaccagggaagu

SEQ ID NO: 274877 - RNA, 19 nt, Homo sapiens
ucauagucuaagaugagaa

SEQ ID NO: 274878 - RNA, 22 nt, Homo sapiens
ucauagucuaagguucuuuugc

SEQ ID NO: 274879 - RNA, 22 nt, Homo sapiens
ucauaucauuagaucuacugua

SEQ ID NO: 274880 - RNA, 22 nt, Homo sapiens
ucaugacacuggcaggagcuaa

SEQ ID NO: 274881 - RNA, 22 nt, Homo sapiens
ucaugagacacacuggaaagga

SEQ ID NO: 274882 - RNA, 22 nt, Homo sapiens
ucauggggugcuuugcuagauu

SEQ ID NO: 274883 - RNA, 22 nt, Homo sapiens
ucauugcacuccagccugggug

SEQ ID NO: 274884 - RNA, 22 nt, Homo sapiens
uccacaauggagaagaguauga

SEQ ID NO: 274885 - RNA, 22 nt, Homo sapiens
uccacagugguugaacuaguaa

SEQ ID NO: 274886 - RNA, 19 nt, Homo sapiens
uccaccgcgugcaccucua

SEQ ID NO: 274887 - RNA, 22 nt, Homo sapiens
uccagaguggugaugcuggggc

SEQ ID NO: 274888 - RNA, 22 nt, Homo sapiens
uccaguguuccucagucacccc

SEQ ID NO: 274889 - RNA, 22 nt, Homo sapiens
uccauagugagcagucaaugua

SEQ ID NO: 274890 - RNA, 22 nt, Homo sapiens
uccaugaguccauuagaaaaaa

SEQ ID NO: 274891 - RNA, 22 nt, Homo sapiens
ucccaagaugagaugggggcug

SEQ ID NO: 274892 - RNA, 22 nt, Homo sapiens
uccccaguaggcaauuaacacc

SEQ ID NO: 274893 - RNA, 19 nt, Homo sapiens
uccccaguuuuccguucag

SEQ ID NO: 274894 - RNA, 22 nt, Homo sapiens
uccccugagaacuugcuagaaa

SEQ ID NO: 274895 - RNA, 19 nt, Homo sapiens
ucccuguagaccacagugc

SEQ ID NO: 274896 - RNA, 22 nt, Homo sapiens
uccugagucagcauccguuugu

SEQ ID NO: 274897 - RNA, 22 nt, Homo sapiens
ucucacagccauuucucccucu

SEQ ID NO: 274898 - RNA, 22 nt, Homo sapiens
ucucagagccuaggguuuuuca

SEQ ID NO: 274899 - RNA, 22 nt, Homo sapiens
ucuccaguuuccuucgucuauc

SEQ ID NO: 274900 - RNA, 22 nt, Homo sapiens
ucucugauuauugcauuucauu

SEQ ID NO: 274901 - RNA, 22 nt, Homo sapiens
ucucuuggugacuuaaaauguu

SEQ ID NO: 274902 - RNA, 22 nt, Homo sapiens
ucugagucaucacaaaugaugc

SEQ ID NO: 274903 - RNA, 22 nt, Homo sapiens
ucugaguggcagaaugagcuga

SEQ ID NO: 274904 - RNA, 22 nt, Homo sapiens
ucugccuacugagcacacagug

SEQ ID NO: 274905 - RNA, 22 nt, Homo sapiens
ucugccuuuucaugugggaugg

SEQ ID NO: 274906 - RNA, 22 nt, Homo sapiens
ucuggcacugaugugggaugcu

SEQ ID NO: 274907 - RNA, 22 nt, Homo sapiens
ucuggcauuuucucugcuugca

SEQ ID NO: 274908 - RNA, 18 nt, Homo sapiens
ucuggcuucuuuguucca

SEQ ID NO: 274909 - RNA, 22 nt, Homo sapiens
ucugugcauggcagaggaauga

SEQ ID NO: 274910 - RNA, 22 nt, Homo sapiens
ucugugcugagaguugaaaguu

SEQ ID NO: 274911 - RNA, 22 nt, Homo sapiens
ucugugcuugucauaugcuuug

SEQ ID NO: 274912 - RNA, 19 nt, Homo sapiens
ucugugcuugucccccugu

SEQ ID NO: 274913 - RNA, 22 nt, Homo sapiens
ucuuagguaagaaauuuuaaca

SEQ ID NO: 274914 - RNA, 22 nt, Homo sapiens
ucuucuagcggaacccucuugu

SEQ ID NO: 274915 - RNA, 22 nt, Homo sapiens
ucuuugaguggagcgaggcaga

SEQ ID NO: 274916 - RNA, 22 nt, Homo sapiens
ucuuugaguuauugugcagacu

SEQ ID NO: 274917 - RNA, 22 nt, Homo sapiens
ucuuugauguucugaaagaugg

SEQ ID NO: 274918 - RNA, 19 nt, Homo sapiens
ucuuugcuuuucuaagagg

SEQ ID NO: 274919 - RNA, 22 nt, Homo sapiens
ucuuuggucuacuuucauaugu

SEQ ID NO: 274920 - RNA, 22 nt, Homo sapiens
ucuuugguuagguuuaguugau

SEQ ID NO: 274921 - RNA, 22 nt, Homo sapiens
ucuuugguucugugcagccuau

SEQ ID NO: 274922 - RNA, 22 nt, Homo sapiens
ugaaacauacacucugaugggg

SEQ ID NO: 274923 - RNA, 22 nt, Homo sapiens
ugaaauacuuaauuucuccaug

SEQ ID NO: 274924 - RNA, 20 nt, Homo sapiens
ugaaaucuucacuaagucuc

SEQ ID NO: 274925 - RNA, 22 nt, Homo sapiens
ugaacucagcauccagggccaa

SEQ ID NO: 274926 - RNA, 21 nt, Homo sapiens
ugaaguagcauaggaugucaa

SEQ ID NO: 274927 - RNA, 22 nt, Homo sapiens
ugaaguaggcauaaguuaagcu

SEQ ID NO: 274928 - RNA, 22 nt, Homo sapiens
ugaagugaagcaguaguguggg

SEQ ID NO: 274929 - RNA, 22 nt, Homo sapiens
ugaaugauuuuaaaagccucuc

SEQ ID NO: 274930 - RNA, 22 nt, Homo sapiens
ugacaagagaccccuccgcagg

SEQ ID NO: 274931 - RNA, 22 nt, Homo sapiens
ugacacauguagacaucuggug

SEQ ID NO: 274932 - RNA, 19 nt, Homo sapiens
ugacacuguuggugggagg

SEQ ID NO: 274933 - RNA, 22 nt, Homo sapiens
ugacagguuggaauuaugggag

SEQ ID NO: 274934 - RNA, 20 nt, Homo sapiens
ugacaucagcaauguaauaa

SEQ ID NO: 274935 - RNA, 18 nt, Homo sapiens
ugacaucauuuagaaagg

SEQ ID NO: 274936 - RNA, 22 nt, Homo sapiens
ugacaugauguuccuacacugu

SEQ ID NO: 274937 - RNA, 22 nt, Homo sapiens
ugacauguauuagcucagugcu

SEQ ID NO: 274938 - RNA, 22 nt, Homo sapiens
ugacauguugcauuauauuucc

SEQ ID NO: 274939 - RNA, 21 nt, Homo sapiens
ugacauguugguguucugcac

SEQ ID NO: 274940 - RNA, 22 nt, Homo sapiens
ugacuaagaugaggucuggaua

SEQ ID NO: 274941 - RNA, 22 nt, Homo sapiens
ugacuagagggcuuuuguguag

SEQ ID NO: 274942 - RNA, 22 nt, Homo sapiens
ugacuauaguaaucacuucaca

SEQ ID NO: 274943 - RNA, 22 nt, Homo sapiens
ugacuugaaacgugaacagauc

SEQ ID NO: 274944 - RNA, 20 nt, Homo sapiens
ugacuuguccgagguccccc

SEQ ID NO: 274945 - RNA, 22 nt, Homo sapiens
ugagaacaugcacuugagguug

SEQ ID NO: 274946 - RNA, 22 nt, Homo sapiens
ugagacaugugaacuguaguuc

SEQ ID NO: 274947 - RNA, 22 nt, Homo sapiens
ugagacggagucuggcacuguc

SEQ ID NO: 274948 - RNA, 22 nt, Homo sapiens
ugagagacaguuucgucggagg

SEQ ID NO: 274949 - RNA, 22 nt, Homo sapiens
ugagagcuuuuuugccugguga

SEQ ID NO: 274950 - RNA, 22 nt, Homo sapiens
ugagagucacugaccugguaua

SEQ ID NO: 274951 - RNA, 22 nt, Homo sapiens
ugagauaaucaugugauuucau

SEQ ID NO: 274952 - RNA, 22 nt, Homo sapiens
ugagauauauauauuugagaca

SEQ ID NO: 274953 - RNA, 22 nt, Homo sapiens
ugagaucaagauguuagggacu

SEQ ID NO: 274954 - RNA, 22 nt, Homo sapiens
ugagaucaagguuaauauaauc

SEQ ID NO: 274955 - RNA, 22 nt, Homo sapiens
ugagaucagugaagaaguguuu

SEQ ID NO: 274956 - RNA, 23 nt, Homo sapiens
ugagaucuacagaucucagaucu

SEQ ID NO: 274957 - RNA, 22 nt, Homo sapiens
ugagaugagaaucaguucuaau

SEQ ID NO: 274958 - RNA, 22 nt, Homo sapiens
ugagaugaggucucacucuguu

SEQ ID NO: 274959 - RNA, 22 nt, Homo sapiens
ugagaugauaucuuauuguaau

SEQ ID NO: 274960 - RNA, 22 nt, Homo sapiens
ugagaugaucaaaguauaggcu

SEQ ID NO: 274961 - RNA, 22 nt, Homo sapiens
ugagauuaaucuuuaaguaaga

SEQ ID NO: 274962 - RNA, 22 nt, Homo sapiens
ugagauuauauuucuuaacaga

SEQ ID NO: 274963 - RNA, 22 nt, Homo sapiens
ugagcagaaagcugcaaggucg

SEQ ID NO: 274964 - RNA, 22 nt, Homo sapiens
ugagcagagaucacggcauugu

SEQ ID NO: 274965 - RNA, 22 nt, Homo sapiens
ugagcauuguuuggacuuggau

SEQ ID NO: 274966 - RNA, 22 nt, Homo sapiens
ugagcucagcuaguugaggugu

SEQ ID NO: 274967 - RNA, 22 nt, Homo sapiens
ugagcugagaucacacuacugu

SEQ ID NO: 274968 - RNA, 22 nt, Homo sapiens
ugaggaaugaccccgugugguc

SEQ ID NO: 274969 - RNA, 22 nt, Homo sapiens
ugaggacugagaggcacugugg

SEQ ID NO: 274970 - RNA, 22 nt, Homo sapiens
ugaggcaagauacugauuucau

SEQ ID NO: 274971 - RNA, 22 nt, Homo sapiens
ugaggcuagucagaucagauga

SEQ ID NO: 274972 - RNA, 22 nt, Homo sapiens
ugagguaaaacaaggauuggau

SEQ ID NO: 274973 - RNA, 22 nt, Homo sapiens
ugagguaacaaacuaugaguua

SEQ ID NO: 274974 - RNA, 22 nt, Homo sapiens
ugaggucacuuguuuuaugcuu

SEQ ID NO: 274975 - RNA, 22 nt, Homo sapiens
ugaggugaggguaucaaaugcu

SEQ ID NO: 274976 - RNA, 19 nt, Homo sapiens
ugaguauauuguauucauu

SEQ ID NO: 274977 - RNA, 22 nt, Homo sapiens
ugagucagucucacucugcugc

SEQ ID NO: 274978 - RNA, 22 nt, Homo sapiens
ugagucaugcuggagucauggc

SEQ ID NO: 274979 - RNA, 22 nt, Homo sapiens
ugagucauguaauaaugcugcu

SEQ ID NO: 274980 - RNA, 22 nt, Homo sapiens
ugagugccuggagggcagggac

SEQ ID NO: 274981 - RNA, 23 nt, Homo sapiens
ugauaacagcauaugaagauucu

SEQ ID NO: 274982 - RNA, 22 nt, Homo sapiens
ugauaauuuugucagguuuugg

SEQ ID NO: 274983 - RNA, 22 nt, Homo sapiens
ugauaugaaagggaaauaagug

SEQ ID NO: 274984 - RNA, 22 nt, Homo sapiens
ugauaugcuuugaacucucugg

SEQ ID NO: 274985 - RNA, 22 nt, Homo sapiens
ugauauggcuuggcuaugucac

SEQ ID NO: 274986 - RNA, 17 nt, Homo sapiens
ugauauuuucccagaua

SEQ ID NO: 274987 - RNA, 22 nt, Homo sapiens
ugaugacacugauuucuucaau

SEQ ID NO: 274988 - RNA, 22 nt, Homo sapiens
ugaugacauugucacagucuga

SEQ ID NO: 274989 - RNA, 20 nt, Homo sapiens
ugauguccaggcagagguuu

SEQ ID NO: 274990 - RNA, 22 nt, Homo sapiens
ugaugugucaucugagagagug

SEQ ID NO: 274991 - RNA, 22 nt, Homo sapiens
ugauuugucucucagcccuacu

SEQ ID NO: 274992 - RNA, 22 nt, Homo sapiens
ugcaauauccucuacuauaggu

SEQ ID NO: 274993 - RNA, 22 nt, Homo sapiens
ugcacaguccagugcccacuga

SEQ ID NO: 274994 - RNA, 19 nt, Homo sapiens
ugcagcaauguaaaagaca

SEQ ID NO: 274995 - RNA, 22 nt, Homo sapiens
ugcagcacugaacuucugggcu

SEQ ID NO: 274996 - RNA, 22 nt, Homo sapiens
ugcauagaauguucuguaaaua

SEQ ID NO: 274997 - RNA, 19 nt, Homo sapiens
ugcauaggguuacauacuc

SEQ ID NO: 274998 - RNA, 18 nt, Homo sapiens
ugcauauguugaaccagc

SEQ ID NO: 274999 - RNA, 22 nt, Homo sapiens
ugcauauucgaguuauuuuggg

SEQ ID NO: 275000 - RNA, 22 nt, Homo sapiens
ugcauauucuaggauuuuguau

SEQ ID NO: 275001 - RNA, 22 nt, Homo sapiens
ugcauggagcucucuuuggacu

SEQ ID NO: 275002 - RNA, 20 nt, Homo sapiens
ugccagugugucaauuuaua

SEQ ID NO: 275003 - RNA, 21 nt, Homo sapiens
ugcccaguggcuuggggucag

SEQ ID NO: 275004 - RNA, 22 nt, Homo sapiens
ugccuaguagaaggugaacaug

SEQ ID NO: 275005 - RNA, 22 nt, Homo sapiens
ugccuuauuccaacugagcucu

SEQ ID NO: 275006 - RNA, 22 nt, Homo sapiens
ugcugcaaacaggcaucugugg

SEQ ID NO: 275007 - RNA, 22 nt, Homo sapiens
ugcugcaaacaugagaggaagu

SEQ ID NO: 275008 - RNA, 22 nt, Homo sapiens
ugcugcauuggggauuaaguuu

SEQ ID NO: 275009 - RNA, 22 nt, Homo sapiens
ugcugcuguuaucauuuuacca

SEQ ID NO: 275010 - RNA, 22 nt, Homo sapiens
ugcuggcguuacucuccaucag

SEQ ID NO: 275011 - RNA, 22 nt, Homo sapiens
uggaagacaggcuguauuuuaa

SEQ ID NO: 275012 - RNA, 22 nt, Homo sapiens
uggaagauucuagaagauucca

SEQ ID NO: 275013 - RNA, 22 nt, Homo sapiens
uggaagccuagauucuuuucuu

SEQ ID NO: 275014 - RNA, 21 nt, Homo sapiens
uggaaucuauuauuccaguuu

SEQ ID NO: 275015 - RNA, 19 nt, Homo sapiens
uggaaugaaauguuagggg

SEQ ID NO: 275016 - RNA, 22 nt, Homo sapiens
uggaaugugaauaacuuccuuc

SEQ ID NO: 275017 - RNA, 21 nt, Homo sapiens
uggaauguucugacuucaggg

SEQ ID NO: 275018 - RNA, 22 nt, Homo sapiens
uggaauuaauccuccugguuuc

SEQ ID NO: 275019 - RNA, 22 nt, Homo sapiens
uggacagaaacauguuuucagu

SEQ ID NO: 275020 - RNA, 22 nt, Homo sapiens
uggaccccugcucgggagcccu

SEQ ID NO: 275021 - RNA, 22 nt, Homo sapiens
uggagaacugaugucuccaaga

SEQ ID NO: 275022 - RNA, 22 nt, Homo sapiens
uggagauccuucauuuuggugu

SEQ ID NO: 275023 - RNA, 22 nt, Homo sapiens
uggagcccuaguuccucauaac

SEQ ID NO: 275024 - RNA, 22 nt, Homo sapiens
uggaguauuauguaauuucaau

SEQ ID NO: 275025 - RNA, 21 nt, Homo sapiens
uggcaacauggauggauucug

SEQ ID NO: 275026 - RNA, 21 nt, Homo sapiens
uggcaacgaggugugcauuau

SEQ ID NO: 275027 - RNA, 22 nt, Homo sapiens
uggcaacuugcaaccucauucu

SEQ ID NO: 275028 - RNA, 22 nt, Homo sapiens
uggcaagaacaacaauuacuuu

SEQ ID NO: 275029 - RNA, 22 nt, Homo sapiens
uggcaagaaccacaauuacuuu

SEQ ID NO: 275030 - RNA, 22 nt, Homo sapiens
uggcaagaacgaaauguagggu

SEQ ID NO: 275031 - RNA, 23 nt, Homo sapiens
uggcaagaauucuuaccgugugg

SEQ ID NO: 275032 - RNA, 22 nt, Homo sapiens
uggcaagagaacaacaucucuc

SEQ ID NO: 275033 - RNA, 22 nt, Homo sapiens
uggcaagagcugcauucaucug

SEQ ID NO: 275034 - RNA, 20 nt, Homo sapiens
uggcaagauggcagaauaga

SEQ ID NO: 275035 - RNA, 22 nt, Homo sapiens
uggcaagauuguuccgguuugg

SEQ ID NO: 275036 - RNA, 22 nt, Homo sapiens
uggcaaguuucaauccgaggga

SEQ ID NO: 275037 - RNA, 19 nt, Homo sapiens
uggcaaugucagcagagau

SEQ ID NO: 275038 - RNA, 22 nt, Homo sapiens
uggcagcgugaauguggcugaa

SEQ ID NO: 275039 - RNA, 22 nt, Homo sapiens
uggcaggugcacuggcuuugaa

SEQ ID NO: 275040 - RNA, 22 nt, Homo sapiens
uggcaguuuugauguggagaga

SEQ ID NO: 275041 - RNA, 22 nt, Homo sapiens
uggcauauaaagauguguucaa

SEQ ID NO: 275042 - RNA, 22 nt, Homo sapiens
uggcaucuguucuacacauaaa

SEQ ID NO: 275043 - RNA, 23 nt, Homo sapiens
uggccaagauaaucucaguuuuc

SEQ ID NO: 275044 - RNA, 22 nt, Homo sapiens
uggccagagggcaauuagcugu

SEQ ID NO: 275045 - RNA, 22 nt, Homo sapiens
uggcucuguuuguuaacuagac

SEQ ID NO: 275046 - RNA, 22 nt, Homo sapiens
gagaucauucugauccagaguc

SEQ ID NO: 275047 - RNA, 22 nt, Homo sapiens
gagaugaaaucuugcucuguca

SEQ ID NO: 275048 - RNA, 22 nt, Homo sapiens
gagauggagacuuggccuuaaa

SEQ ID NO: 275049 - RNA, 22 nt, Homo sapiens
gagauggaguuucacuucgcuc

SEQ ID NO: 275050 - RNA, 22 nt, Homo sapiens
gagauguaagaauuuauuuguu

SEQ ID NO: 275051 - RNA, 22 nt, Homo sapiens
gagaugugugugauuauauaau

SEQ ID NO: 275052 - RNA, 22 nt, Homo sapiens
gagauguuuguuucacugucac

SEQ ID NO: 275053 - RNA, 22 nt, Homo sapiens
gagauuauuagauguucugcuu

SEQ ID NO: 275054 - RNA, 22 nt, Homo sapiens
gagauuuucagcuugacuggga

SEQ ID NO: 275055 - RNA, 22 nt, Homo sapiens
gagcacauaugacauuuucuuc

SEQ ID NO: 275056 - RNA, 22 nt, Homo sapiens
gagcugccuugccuaugcaaga

SEQ ID NO: 275057 - RNA, 22 nt, Homo sapiens
gagcuguugguuugaaagaauu

SEQ ID NO: 275058 - RNA, 22 nt, Homo sapiens
gaggaaguuuacaaagcaucug

SEQ ID NO: 275059 - RNA, 22 nt, Homo sapiens
gagguagguacaauugccacca

SEQ ID NO: 275060 - RNA, 22 nt, Homo sapiens
gaggucauguggcaggcagcca

SEQ ID NO: 275061 - RNA, 22 nt, Homo sapiens
gagguggauacauuaaauaaug

SEQ ID NO: 275062 - RNA, 22 nt, Homo sapiens
gugagauaucuagacuagggaa

SEQ ID NO: 275063 - RNA, 22 nt, Homo sapiens
gugagauggagucuugcuuugu

SEQ ID NO: 275064 - RNA, 22 nt, Homo sapiens
gugagcaauugauacuugaagu

SEQ ID NO: 275065 - RNA, 22 nt, Homo sapiens
gugagcagagaucgcgugauug

SEQ ID NO: 275066 - RNA, 22 nt, Homo sapiens
gugagcuagaccacuuggcucc

SEQ ID NO: 275067 - RNA, 22 nt, Homo sapiens
gugagcuauguccugguuuggg

SEQ ID NO: 275068 - RNA, 21 nt, Homo sapiens
gugaggaguuacuggcuuuga

SEQ ID NO: 275069 - RNA, 22 nt, Homo sapiens
gugaucucauuuggaauuagag

SEQ ID NO: 275070 - RNA, 22 nt, Homo sapiens
gugauguguuuguucuaucucu

SEQ ID NO: 275071 - RNA, 22 nt, Homo sapiens
gugcaagagugauugcaguuuu

SEQ ID NO: 275072 - RNA, 21 nt, Homo sapiens
gugcacaguaguguuuaauag

SEQ ID NO: 275073 - RNA, 22 nt, Homo sapiens
uauuugguuauaugaguaaguu

SEQ ID NO: 275074 - RNA, 20 nt, Homo sapiens
uauuugguuauuuccauggu

SEQ ID NO: 275075 - RNA, 22 nt, Homo sapiens
ucaaaaucucuuagcugugucu

SEQ ID NO: 275076 - RNA, 22 nt, Homo sapiens
ucaaagugcuauggcucagguu

SEQ ID NO: 275077 - RNA, 22 nt, Homo sapiens
ucaaaugcacguagagaaaaua

SEQ ID NO: 275078 - RNA, 22 nt, Homo sapiens
ucaaaugcuguauuguaguaau

SEQ ID NO: 275079 - RNA, 22 nt, Homo sapiens
ucaacagugggcacuguaaaug

SEQ ID NO: 275080 - RNA, 22 nt, Homo sapiens
agccaagacucuguuccccuug

SEQ ID NO: 275081 - RNA, 22 nt, Homo sapiens
agccaguuuggcuaauuuuggc

SEQ ID NO: 275082 - RNA, 22 nt, Homo sapiens
agcccugugauuacuuuuauaa

SEQ ID NO: 275083 - RNA, 22 nt, Homo sapiens
agcggcuguuccccuggucuau

SEQ ID NO: 275084 - RNA, 18 nt, Homo sapiens
agcucaguguuugcuuac

SEQ ID NO: 275085 - RNA, 22 nt, Homo sapiens
agcuccaucuucagggguucag

SEQ ID NO: 275086 - RNA, 22 nt, Homo sapiens
agcugcacaaauggaugugagg

SEQ ID NO: 275087 - RNA, 22 nt, Homo sapiens
agcuggauuguuuaccuggggc

SEQ ID NO: 275088 - RNA, 22 nt, Homo sapiens
agcugguauuuugucaaggaua

SEQ ID NO: 275089 - RNA, 22 nt, Homo sapiens
agcuugugcuguaugaagggcc

SEQ ID NO: 275090 - RNA, 21 nt, Homo sapiens
agcuuguguguaucacagugu

SEQ ID NO: 275091 - RNA, 22 nt, Homo sapiens
aggaagcuagcauuuguucagu

SEQ ID NO: 275092 - RNA, 22 nt, Homo sapiens
aggaaucuaagguaucagguua

SEQ ID NO: 275093 - RNA, 22 nt, Homo sapiens
aggaauggaaacuuuugauggu

SEQ ID NO: 275094 - RNA, 22 nt, Homo sapiens
aggaaugucaaugguaguuuaa

SEQ ID NO: 275095 - RNA, 21 nt, Homo sapiens
aggagauguuuguccuuuuag

SEQ ID NO: 275096 - RNA, 22 nt, Homo sapiens
aggagcacaauggucaugugga

SEQ ID NO: 275097 - RNA, 22 nt, Homo sapiens
aggcaugaaauacaugcauuga

SEQ ID NO: 275098 - RNA, 22 nt, Homo sapiens
aggcuuuuggagguggcuuucu

SEQ ID NO: 275099 - RNA, 22 nt, Homo sapiens
agggcacuguagguccugccuc

SEQ ID NO: 275100 - RNA, 22 nt, Homo sapiens
agggcuuguuuaacuaucauua

SEQ ID NO: 275101 - RNA, 22 nt, Homo sapiens
agguaaacauggggacugcuac

SEQ ID NO: 275102 - RNA, 22 nt, Homo sapiens
agguauauuggacagauguaaa

SEQ ID NO: 275103 - RNA, 22 nt, Homo sapiens
agguauuuucaacuuagaaugg

SEQ ID NO: 275104 - RNA, 22 nt, Homo sapiens
aggugcugagcagagaauccug

SEQ ID NO: 275105 - RNA, 22 nt, Homo sapiens
aggugcuugaaucuaugagcuc

SEQ ID NO: 275106 - RNA, 22 nt, Homo sapiens
aguaaagccagaccuguuaauu

SEQ ID NO: 275107 - RNA, 22 nt, Homo sapiens
aguaacauuucuaguagagagu

SEQ ID NO: 275108 - RNA, 22 nt, Homo sapiens
aguacaucuggcuggauagaua

SEQ ID NO: 275109 - RNA, 22 nt, Homo sapiens
aguauguuuugaaaccaagaag

SEQ ID NO: 275110 - RNA, 22 nt, Homo sapiens
aguauuuguuggaauaccuguu

SEQ ID NO: 275111 - RNA, 22 nt, Homo sapiens
agucaagaaucucagcaucuuu

SEQ ID NO: 275112 - RNA, 22 nt, Homo sapiens
agucacaugccagcacacccag

SEQ ID NO: 275113 - RNA, 22 nt, Homo sapiens
agucauggaucacaguagccuc

SEQ ID NO: 275114 - RNA, 22 nt, Homo sapiens
agugaaaucugaagaaggucau

SEQ ID NO: 275115 - RNA, 22 nt, Homo sapiens
agugaacacagcuucuuugguu

SEQ ID NO: 275116 - RNA, 19 nt, Homo sapiens
agugagccaagauccuacc

SEQ ID NO: 275117 - RNA, 22 nt, Homo sapiens
aguggcacuauucucagaguca

SEQ ID NO: 275118 - RNA, 22 nt, Homo sapiens
aguggguguuccauuggauaaa

SEQ ID NO: 275119 - RNA, 22 nt, Homo sapiens
aguggugucugaguggccaggg

SEQ ID NO: 275120 - RNA, 22 nt, Homo sapiens
agugguuuuggaauggaauuca

SEQ ID NO: 275121 - RNA, 22 nt, Homo sapiens
aguguuuuuacaagcacucugg

SEQ ID NO: 275122 - RNA, 22 nt, Homo sapiens
auaaaguguuuaguauaggcaa

SEQ ID NO: 275123 - RNA, 22 nt, Homo sapiens
auaaaugcaaugguauuuuuga

SEQ ID NO: 275124 - RNA, 22 nt, Homo sapiens
auaaaugcuuccagucauuaaa

SEQ ID NO: 275125 - RNA, 22 nt, Homo sapiens
auaaggcagcugcuaaaaggca

SEQ ID NO: 275126 - RNA, 22 nt, Homo sapiens
cucaaaugguccagcuaguggu

SEQ ID NO: 275127 - RNA, 22 nt, Homo sapiens
cucacugucaacauguauuugg

SEQ ID NO: 275128 - RNA, 22 nt, Homo sapiens
cucagagcacaguuuaugacag

SEQ ID NO: 275129 - RNA, 22 nt, Homo sapiens
cucagcuacuugggaagcugag

SEQ ID NO: 275130 - RNA, 20 nt, Homo sapiens
cucagugcacccccauaaaa

SEQ ID NO: 275131 - RNA, 19 nt, Homo sapiens
cucauggagaaggagaaua

SEQ ID NO: 275132 - RNA, 22 nt, Homo sapiens
cucauugcaaucuccaccuccc

SEQ ID NO: 275133 - RNA, 22 nt, Homo sapiens
cucauugcaaucucugccuccc

SEQ ID NO: 275134 - RNA, 22 nt, Homo sapiens
cuccaguuucagaaucccaugu

SEQ ID NO: 275135 - RNA, 22 nt, Homo sapiens
cucccauugcaaacaacagaag

SEQ ID NO: 275136 - RNA, 22 nt, Homo sapiens
cucgagagaaaaugcuucacug

SEQ ID NO: 275137 - RNA, 22 nt, Homo sapiens
cucuuggguagauuuugcagag

SEQ ID NO: 275138 - RNA, 22 nt, Homo sapiens
cucuuuggaugccuuaggguua

SEQ ID NO: 275139 - RNA, 22 nt, Homo sapiens
cugaaggcagguagaauagaga

SEQ ID NO: 275140 - RNA, 22 nt, Homo sapiens
cugagaacaucauucagauauu

SEQ ID NO: 275141 - RNA, 22 nt, Homo sapiens
cugagagaggagcuaaaacugc

SEQ ID NO: 275142 - RNA, 22 nt, Homo sapiens
cugagagaugagaccucucacu

SEQ ID NO: 275143 - RNA, 22 nt, Homo sapiens
cugagauggagucucgcauugu

SEQ ID NO: 275144 - RNA, 22 nt, Homo sapiens
cugaggauauucagccucugug

SEQ ID NO: 275145 - RNA, 22 nt, Homo sapiens
cugagguaggcccugagaauau

SEQ ID NO: 275146 - RNA, 22 nt, Homo sapiens
cugagguaggugaucagugcuu

SEQ ID NO: 275147 - RNA, 22 nt, Homo sapiens
cugauauuuuaaaauuggcugg

SEQ ID NO: 275148 - RNA, 22 nt, Homo sapiens
cugauauuuuucuggcuugugu

SEQ ID NO: 275149 - RNA, 22 nt, Homo sapiens
cugcccuuucuauaugauguaa

SEQ ID NO: 275150 - RNA, 22 nt, Homo sapiens
cugccuaaagaaaaagacguug

SEQ ID NO: 275151 - RNA, 22 nt, Homo sapiens
cugccuagauguuguagggggu

SEQ ID NO: 275152 - RNA, 20 nt, Homo sapiens
cugcuccccuacaaaucuca

SEQ ID NO: 275153 - RNA, 22 nt, Homo sapiens
cuggaagaaaaucacgccaucu

SEQ ID NO: 275154 - RNA, 18 nt, Homo sapiens
cuggaaggcuacuacagu

SEQ ID NO: 275155 - RNA, 22 nt, Homo sapiens
cuggauauuaacauugaugaaa

SEQ ID NO: 275156 - RNA, 22 nt, Homo sapiens
cuggcacagugucagaaacaca

SEQ ID NO: 275157 - RNA, 22 nt, Homo sapiens
cuggcaccauacacuguuguug

SEQ ID NO: 275158 - RNA, 22 nt, Homo sapiens
cuggcacccuugcuuaggaaga

SEQ ID NO: 275159 - RNA, 22 nt, Homo sapiens
cugucacaguuuuggaggccag

SEQ ID NO: 275160 - RNA, 17 nt, Homo sapiens
cugugaugaucuugucu

SEQ ID NO: 275161 - RNA, 22 nt, Homo sapiens
cugugcuugauuauaugagugu

SEQ ID NO: 275162 - RNA, 22 nt, Homo sapiens
cuguuagguuaaggaauggcaa

SEQ ID NO: 275163 - RNA, 22 nt, Homo sapiens
cuguuugguuaucuuuuccugu

SEQ ID NO: 275164 - RNA, 22 nt, Homo sapiens
cuuaaggccagauaauuucuau

SEQ ID NO: 275165 - RNA, 22 nt, Homo sapiens
cuuagguaggugccagguuuuu

SEQ ID NO: 275166 - RNA, 22 nt, Homo sapiens
cuuagguuaaucaugaaccuuu

SEQ ID NO: 275167 - RNA, 22 nt, Homo sapiens
cuuagguuaugauaaauuuagu

SEQ ID NO: 275168 - RNA, 22 nt, Homo sapiens
cuuccaaguggggcacgugcca

SEQ ID NO: 275169 - RNA, 22 nt, Homo sapiens
cuucugauugaaaauggaguag

SEQ ID NO: 275170 - RNA, 22 nt, Homo sapiens
cuugcagagucauucuaauuuc

SEQ ID NO: 275171 - RNA, 19 nt, Homo sapiens
cuugccccauucauccucu

SEQ ID NO: 275172 - RNA, 22 nt, Homo sapiens
cuugccuuugucuucaaaggcu

SEQ ID NO: 275173 - RNA, 22 nt, Homo sapiens
cuuggcacugcucacccuccuu

SEQ ID NO: 275174 - RNA, 22 nt, Homo sapiens
cuuggcuucuuuauguggcuau

SEQ ID NO: 275175 - RNA, 22 nt, Homo sapiens
cuuggguugauugauaaugcca

SEQ ID NO: 275176 - RNA, 21 nt, Homo sapiens
cuugucuugcuuagaauagac

SEQ ID NO: 275177 - RNA, 22 nt, Homo sapiens
cuuuagcaaggauauggggaug

SEQ ID NO: 275178 - RNA, 22 nt, Homo sapiens
cuuuagcaauugauuaugccau

SEQ ID NO: 275179 - RNA, 22 nt, Homo sapiens
cuuuaguuaaaauugggguugu

SEQ ID NO: 275180 - RNA, 20 nt, Homo sapiens
cuuuggcaaugagaacaggg

SEQ ID NO: 275181 - RNA, 22 nt, Homo sapiens
cuuuggugagggauaaauuuca

SEQ ID NO: 275182 - RNA, 20 nt, Homo sapiens
cuuuggugagucaacuccuu

SEQ ID NO: 275183 - RNA, 22 nt, Homo sapiens
cuuugguuaauaggauauggca

SEQ ID NO: 275184 - RNA, 22 nt, Homo sapiens
cuuuuggcuuagaauugucuug

SEQ ID NO: 275185 - RNA, 22 nt, Homo sapiens
ugagauaucauuucacacccag

SEQ ID NO: 275186 - RNA, 22 nt, Homo sapiens
ugagaucacuaagagguaaugg

SEQ ID NO: 275187 - RNA, 18 nt, Homo sapiens
ugagaucagcaucaaggg

SEQ ID NO: 275188 - RNA, 22 nt, Homo sapiens
ugagaucaugccacugcacuuc

SEQ ID NO: 275189 - RNA, 22 nt, Homo sapiens
ugagaucaugucauuugcacuc

SEQ ID NO: 275190 - RNA, 22 nt, Homo sapiens
ugagaugaagcuagaagaaugg

SEQ ID NO: 275191 - RNA, 22 nt, Homo sapiens
ugagaugaagucucacucuguc

SEQ ID NO: 275192 - RNA, 22 nt, Homo sapiens
ugagaugaagugauguaaaaca

SEQ ID NO: 275193 - RNA, 22 nt, Homo sapiens
ugagaugacgacacaccucagu

SEQ ID NO: 275194 - RNA, 22 nt, Homo sapiens
ugagaugauagauauguuaauu

SEQ ID NO: 275195 - RNA, 22 nt, Homo sapiens
ugagauggaguuucacuuuugu

SEQ ID NO: 275196 - RNA, 22 nt, Homo sapiens
ugagauggcuuuauugcugaau

SEQ ID NO: 275197 - RNA, 22 nt, Homo sapiens
ugagauggguaauuaaauggug

SEQ ID NO: 275198 - RNA, 22 nt, Homo sapiens
ugagaugugaagaucacaugaa

SEQ ID NO: 275199 - RNA, 23 nt, Homo sapiens
ugagauuacccagaaagaguaua

SEQ ID NO: 275200 - RNA, 22 nt, Homo sapiens
ugagauuacguucggcccacuu

SEQ ID NO: 275201 - RNA, 22 nt, Homo sapiens
ugagcagaaguuuugauuggcg

SEQ ID NO: 275202 - RNA, 20 nt, Homo sapiens
ugagccccuggacucaagcg

SEQ ID NO: 275203 - RNA, 18 nt, Homo sapiens
ugaggaaaggguuugcua

SEQ ID NO: 275204 - RNA, 22 nt, Homo sapiens
ugaggagugagaaauugguuuc

SEQ ID NO: 275205 - RNA, 17 nt, Homo sapiens
ugaggcacuaguaucac

SEQ ID NO: 275206 - RNA, 22 nt, Homo sapiens
ugagggcguauccuucauuaag

SEQ ID NO: 275207 - RNA, 22 nt, Homo sapiens
ugagguaacagaagcgagcauu

SEQ ID NO: 275208 - RNA, 22 nt, Homo sapiens
ugaggugaaguaauauucuaag

SEQ ID NO: 275209 - RNA, 22 nt, Homo sapiens
ugaggugagggguuaggugcua

SEQ ID NO: 275210 - RNA, 22 nt, Homo sapiens
aggcuguguggauaauauuggg

SEQ ID NO: 275211 - RNA, 22 nt, Homo sapiens
agggcauuguacaaaucaucau

SEQ ID NO: 275212 - RNA, 22 nt, Homo sapiens
agggccuuuguagauguacuca

SEQ ID NO: 275213 - RNA, 22 nt, Homo sapiens
agguacuugagauucugaacug

SEQ ID NO: 275214 - RNA, 22 nt, Homo sapiens
agguagugugaugcuccuguuu

SEQ ID NO: 275215 - RNA, 22 nt, Homo sapiens
agguaguguuauuugcagcuga

SEQ ID NO: 275216 - RNA, 22 nt, Homo sapiens
agguccauugguauuauagcau

SEQ ID NO: 275217 - RNA, 22 nt, Homo sapiens
aggugacugguuuaucuggcag

SEQ ID NO: 275218 - RNA, 22 nt, Homo sapiens
aggugcuauauuucgaggauag

SEQ ID NO: 275219 - RNA, 22 nt, Homo sapiens
agguuaacaucuauuuuggaug

SEQ ID NO: 275220 - RNA, 22 nt, Homo sapiens
agguuguguuugugauuagaua

SEQ ID NO: 275221 - RNA, 22 nt, Homo sapiens
aguagcacaugccacccugucu

SEQ ID NO: 275222 - RNA, 20 nt, Homo sapiens
aguauucacuuuuuucaugg

SEQ ID NO: 275223 - RNA, 22 nt, Homo sapiens
agucauaggagagauaucacug

SEQ ID NO: 275224 - RNA, 22 nt, Homo sapiens
agugaauguuggaaaguuauuu

SEQ ID NO: 275225 - RNA, 22 nt, Homo sapiens
agugacuagaauaugaauuuua

SEQ ID NO: 275226 - RNA, 22 nt, Homo sapiens
agugagcugcagucuggggucc

SEQ ID NO: 275227 - RNA, 22 nt, Homo sapiens
aguggcaaugugauguccugaa

SEQ ID NO: 275228 - RNA, 23 nt, Homo sapiens
aguggucuccugggcccagcugu

SEQ ID NO: 275229 - RNA, 22 nt, Homo sapiens
aguguuuuucaugggauacuuu

SEQ ID NO: 275230 - RNA, 22 nt, Homo sapiens
aguucaaaucgagccuggccau

SEQ ID NO: 275231 - RNA, 22 nt, Homo sapiens
aguuccuacuggcuguaaagaa

SEQ ID NO: 275232 - RNA, 22 nt, Homo sapiens
aguuggccccuacugggaggug

SEQ ID NO: 275233 - RNA, 22 nt, Homo sapiens
aguuggugauugauugggucug

SEQ ID NO: 275234 - RNA, 22 nt, Homo sapiens
auaaaagcaggucuaggucagg

SEQ ID NO: 275235 - RNA, 22 nt, Homo sapiens
auaaagcaagucucuggccuca

SEQ ID NO: 275236 - RNA, 22 nt, Homo sapiens
auaaagcuauuccucucuuuuu

SEQ ID NO: 275237 - RNA, 22 nt, Homo sapiens
auaaaugccuguuguuuuaagc

SEQ ID NO: 275238 - RNA, 22 nt, Homo sapiens
auaacauccuuucuuaucguug

SEQ ID NO: 275239 - RNA, 22 nt, Homo sapiens
auaaguaguaaagcagugacua

SEQ ID NO: 275240 - RNA, 22 nt, Homo sapiens
auacagguauacaaugcauaau

SEQ ID NO: 275241 - RNA, 22 nt, Homo sapiens
auacagugaauacuuacagugu

SEQ ID NO: 275242 - RNA, 22 nt, Homo sapiens
auacauguucaagggcauauau

SEQ ID NO: 275243 - RNA, 22 nt, Homo sapiens
auagcacacuauagcuucaaac

SEQ ID NO: 275244 - RNA, 22 nt, Homo sapiens
auagcacaguguguguacacca

SEQ ID NO: 275245 - RNA, 22 nt, Homo sapiens
auagccuguaggccuuaaggug

SEQ ID NO: 275246 - RNA, 22 nt, Homo sapiens
auaggagcacgaacucuagugu

SEQ ID NO: 275247 - RNA, 22 nt, Homo sapiens
auaggcacauuaggaacuuuug

SEQ ID NO: 275248 - RNA, 22 nt, Homo sapiens
auagugcagugaugaaccuagg

SEQ ID NO: 275249 - RNA, 22 nt, Homo sapiens
auaucacagguguuuaccugau

SEQ ID NO: 275250 - RNA, 22 nt, Homo sapiens
auaucugcauugccauuuaugu

SEQ ID NO: 275251 - RNA, 22 nt, Homo sapiens
auaugcauguacccacacaggc

SEQ ID NO: 275252 - RNA, 20 nt, Homo sapiens
auaugcauguguuuucacuu

SEQ ID NO: 275253 - RNA, 22 nt, Homo sapiens
auauuacagagaggaccuggga

SEQ ID NO: 275254 - RNA, 18 nt, Homo sapiens
auauugccuucagacuag

SEQ ID NO: 275255 - RNA, 22 nt, Homo sapiens
auauuggacugugcuaguuaga

SEQ ID NO: 275256 - RNA, 22 nt, Homo sapiens
auauuguacugcuacugguucu

SEQ ID NO: 275257 - RNA, 22 nt, Homo sapiens
aucacagauauggguuuaaauc

SEQ ID NO: 275258 - RNA, 22 nt, Homo sapiens
aucaccagaugcuucaagcaga

SEQ ID NO: 275259 - RNA, 19 nt, Homo sapiens
aucaccauuauuuggaaca

SEQ ID NO: 275260 - RNA, 22 nt, Homo sapiens
aucaccuggaggugaucacuug

SEQ ID NO: 275261 - RNA, 22 nt, Homo sapiens
aucacugugauuucuacugugc

SEQ ID NO: 275262 - RNA, 21 nt, Homo sapiens
aucagagacccaggcuuccuc

SEQ ID NO: 275263 - RNA, 20 nt, Homo sapiens
aucagagacuaggauugcca

SEQ ID NO: 275264 - RNA, 22 nt, Homo sapiens
aucagcaguguaaaaacggacu

SEQ ID NO: 275265 - RNA, 23 nt, Homo sapiens
aucagguuguagaauguguuugc

SEQ ID NO: 275266 - RNA, 22 nt, Homo sapiens
aucauccagccccagaagggag

SEQ ID NO: 275267 - RNA, 22 nt, Homo sapiens
aucauuaguuguggaauucuug

SEQ ID NO: 275268 - RNA, 23 nt, Homo sapiens
auccacauucuaguccuuuaugc

SEQ ID NO: 275269 - RNA, 22 nt, Homo sapiens
aucccuagaaaaaucagcacau

SEQ ID NO: 275270 - RNA, 22 nt, Homo sapiens
aucccugagccugacucucaga

SEQ ID NO: 275271 - RNA, 22 nt, Homo sapiens
auccucaguggcuuaaguauag

SEQ ID NO: 275272 - RNA, 22 nt, Homo sapiens
auccuguaggcuaguagacagu

SEQ ID NO: 275273 - RNA, 22 nt, Homo sapiens
aucgcgccauuguacuccagcc

SEQ ID NO: 275274 - RNA, 22 nt, Homo sapiens
aucugcauuagggugaagaccu

SEQ ID NO: 275275 - RNA, 22 nt, Homo sapiens
aucugcauucccauguuuauug

SEQ ID NO: 275276 - RNA, 22 nt, Homo sapiens
aucugcuccuggugaggguuuc

SEQ ID NO: 275277 - RNA, 22 nt, Homo sapiens
aucuggcuucuuuuaguccaca

SEQ ID NO: 275278 - RNA, 22 nt, Homo sapiens
aucugguguuuuucucccucgu

SEQ ID NO: 275279 - RNA, 21 nt, Homo sapiens
aucuugguauagucuuauugg

SEQ ID NO: 275280 - RNA, 22 nt, Homo sapiens
aucuuuggugcaugauacuuug

SEQ ID NO: 275281 - RNA, 23 nt, Homo sapiens
augaaagcccuugcaaaugcugg

SEQ ID NO: 275282 - RNA, 22 nt, Homo sapiens
augaaagguugucuuaagccau

SEQ ID NO: 275283 - RNA, 22 nt, Homo sapiens
augaaguauuaggacacauuua

SEQ ID NO: 275284 - RNA, 17 nt, Homo sapiens
augaagucaucauuuuu

SEQ ID NO: 275285 - RNA, 22 nt, Homo sapiens
augagaaugaagccuggcgugu

SEQ ID NO: 275286 - RNA, 22 nt, Homo sapiens
augagagcaacaccuucacuug

SEQ ID NO: 275287 - RNA, 22 nt, Homo sapiens
augagagcuaacuguggguaca

SEQ ID NO: 275288 - RNA, 22 nt, Homo sapiens
augagagcugacuuuaaggcaa

SEQ ID NO: 275289 - RNA, 22 nt, Homo sapiens
augagaugaggaauggcccucc

SEQ ID NO: 275290 - RNA, 22 nt, Homo sapiens
augagaugcaagauuagauggg

SEQ ID NO: 275291 - RNA, 21 nt, Homo sapiens
augagauguuagacuuuagac

SEQ ID NO: 275292 - RNA, 22 nt, Homo sapiens
augagauuguuugugugaaaua

SEQ ID NO: 275293 - RNA, 22 nt, Homo sapiens
cuggugugugacuuuucauuau

SEQ ID NO: 275294 - RNA, 22 nt, Homo sapiens
cuguaaagaucacagagcuggu

SEQ ID NO: 275295 - RNA, 23 nt, Homo sapiens
cuguacacauauacaucuaagua

SEQ ID NO: 275296 - RNA, 22 nt, Homo sapiens
cugugcauggauuuuaagauug

SEQ ID NO: 275297 - RNA, 22 nt, Homo sapiens
cuucaccaguuuggcagucuca

SEQ ID NO: 275298 - RNA, 22 nt, Homo sapiens
cuucagcaauauauccccuggg

SEQ ID NO: 275299 - RNA, 18 nt, Homo sapiens
cuucauugcuguuuugcu

SEQ ID NO: 275300 - RNA, 20 nt, Homo sapiens
cuugccuagcccuuugccuc

SEQ ID NO: 275301 - RNA, 22 nt, Homo sapiens
cuuggcacgugauagguguuga

SEQ ID NO: 275302 - RNA, 22 nt, Homo sapiens
cuuggcuugguaucaaauaacc

SEQ ID NO: 275303 - RNA, 22 nt, Homo sapiens
cuuggcuuguuguccccugcuc

SEQ ID NO: 275304 - RNA, 22 nt, Homo sapiens
cuugucuugcacacgguugcca

SEQ ID NO: 275305 - RNA, 22 nt, Homo sapiens
cuuguucuccuaagaugaaugc

SEQ ID NO: 275306 - RNA, 22 nt, Homo sapiens
cuuuacacauccuaaccagugu

SEQ ID NO: 275307 - RNA, 22 nt, Homo sapiens
cuuucacacuguuggugggaau

SEQ ID NO: 275308 - RNA, 22 nt, Homo sapiens
cuuuggcauuagccuguauaga

SEQ ID NO: 275309 - RNA, 23 nt, Homo sapiens
cuuugguaggaaauuugaauuau

SEQ ID NO: 275310 - RNA, 22 nt, Homo sapiens
cuuuggugauagauaccccaua

SEQ ID NO: 275311 - RNA, 22 nt, Homo sapiens
cuuugguggagucuuuagguuc

SEQ ID NO: 275312 - RNA, 22 nt, Homo sapiens
cuuugguguauuuucagagacc

SEQ ID NO: 275313 - RNA, 22 nt, Homo sapiens
cuuuugugauucuucaguuacu

SEQ ID NO: 275314 - RNA, 22 nt, Homo sapiens
cuuuugugauucuucaguugcu

SEQ ID NO: 275315 - RNA, 21 nt, Homo sapiens
gaaauacugccuuaggagcug

SEQ ID NO: 275316 - RNA, 22 nt, Homo sapiens
gaaauguauuaaugaguugaaa

SEQ ID NO: 275317 - RNA, 22 nt, Homo sapiens
gaacccuggaggcggagguugc

SEQ ID NO: 275318 - RNA, 22 nt, Homo sapiens
gaagaucacacuguagaucuau

SEQ ID NO: 275319 - RNA, 17 nt, Homo sapiens
gaaguguuucuucauga

SEQ ID NO: 275320 - RNA, 22 nt, Homo sapiens
gaaucaauugaucuaugugucu

SEQ ID NO: 275321 - RNA, 18 nt, Homo sapiens
gacaguguggcaauuccu

SEQ ID NO: 275322 - RNA, 22 nt, Homo sapiens
gacauuaucagguuuguuuucu

SEQ ID NO: 275323 - RNA, 22 nt, Homo sapiens
gacccucuagauggaagcacug

SEQ ID NO: 275324 - RNA, 22 nt, Homo sapiens
gacuaggagagcagcugcccau

SEQ ID NO: 275325 - RNA, 22 nt, Homo sapiens
gacugaguaagcagaagcaauu

SEQ ID NO: 275326 - RNA, 22 nt, Homo sapiens
gacuuugguagaggaaaaaucu

SEQ ID NO: 275327 - RNA, 22 nt, Homo sapiens
gagaacuaaugauguacuaggc

SEQ ID NO: 275328 - RNA, 22 nt, Homo sapiens
gagaacugagauaagugauauu

SEQ ID NO: 275329 - RNA, 22 nt, Homo sapiens
gagaacugagugugcuggcgga

SEQ ID NO: 275330 - RNA, 22 nt, Homo sapiens
gagaacuggcugauucaaggac

SEQ ID NO: 275331 - RNA, 22 nt, Homo sapiens
gagagcuaggccacuggggcuu

SEQ ID NO: 275332 - RNA, 22 nt, Homo sapiens
gagagugcuuggcaucugcuga

SEQ ID NO: 275333 - RNA, 22 nt, Homo sapiens
gagauaacuacuggauuaaguu

SEQ ID NO: 275334 - RNA, 22 nt, Homo sapiens
gagaucacuucuguauucuaca

SEQ ID NO: 275335 - RNA, 20 nt, Homo sapiens
gagauguugaucagggcuau

SEQ ID NO: 275336 - RNA, 22 nt, Homo sapiens
gagauguuuuguuaucaaagga

SEQ ID NO: 275337 - RNA, 22 nt, Homo sapiens
gagcacccuuuguugauugcaa

SEQ ID NO: 275338 - RNA, 22 nt, Homo sapiens
gagcacugaauacugugguggu

SEQ ID NO: 275339 - RNA, 22 nt, Homo sapiens
gagcaguugagagugcuggcca

SEQ ID NO: 275340 - RNA, 22 nt, Homo sapiens
gagcuagguuuugaauccagac

SEQ ID NO: 275341 - RNA, 22 nt, Homo sapiens
gagcuaguagagugcacccggc

SEQ ID NO: 275342 - RNA, 22 nt, Homo sapiens
gagcugaaguuuccauuuguac

SEQ ID NO: 275343 - RNA, 22 nt, Homo sapiens
uauuaguuguaugauucccaag

SEQ ID NO: 275344 - RNA, 22 nt, Homo sapiens
uauugcagaaugugaguuggca

SEQ ID NO: 275345 - RNA, 22 nt, Homo sapiens
uauugcuccuaauaucacggug

SEQ ID NO: 275346 - RNA, 22 nt, Homo sapiens
uauuuggugaaugaaugcaugu

SEQ ID NO: 275347 - RNA, 22 nt, Homo sapiens
ucaaagugacaaaguugcagca

SEQ ID NO: 275348 - RNA, 22 nt, Homo sapiens
ucaaaucaucuuuuccaaagcu

SEQ ID NO: 275349 - RNA, 22 nt, Homo sapiens
ucaaauguuuguuuaaggcuua

SEQ ID NO: 275350 - RNA, 22 nt, Homo sapiens
ucaacagugauggaaaguuaua

SEQ ID NO: 275351 - RNA, 22 nt, Homo sapiens
ucaagcaauucuccugccucag

SEQ ID NO: 275352 - RNA, 22 nt, Homo sapiens
ucaaguaguaacuaacugugac

SEQ ID NO: 275353 - RNA, 22 nt, Homo sapiens
ucaagugauucuugugccuuag

SEQ ID NO: 275354 - RNA, 22 nt, Homo sapiens
ucaaugcaaccuccaccucugg

SEQ ID NO: 275355 - RNA, 22 nt, Homo sapiens
ucacaaagcuuggccugcuucu

SEQ ID NO: 275356 - RNA, 22 nt, Homo sapiens
ucacagaugaggcgagaggcag

SEQ ID NO: 275357 - RNA, 22 nt, Homo sapiens
ucacagugcaggaucaguuaau

SEQ ID NO: 275358 - RNA, 18 nt, Homo sapiens
ucacauggccgagagaga

SEQ ID NO: 275359 - RNA, 20 nt, Homo sapiens
ucacccugacaucugcccag

SEQ ID NO: 275360 - RNA, 22 nt, Homo sapiens
ucaccuguagcuaagaccuaau

SEQ ID NO: 275361 - RNA, 21 nt, Homo sapiens
ucaccuguagcugcauguucu

SEQ ID NO: 275362 - RNA, 18 nt, Homo sapiens
ucacggggagcagcagcc

SEQ ID NO: 275363 - RNA, 22 nt, Homo sapiens
ucacugagcacaggagaugugc

SEQ ID NO: 275364 - RNA, 22 nt, Homo sapiens
ucacugcgaccuccaccucccg

SEQ ID NO: 275365 - RNA, 22 nt, Homo sapiens
ucacugcgaccuccaccuccug

SEQ ID NO: 275366 - RNA, 22 nt, Homo sapiens
ucacugugcacauaugauaggu

SEQ ID NO: 275367 - RNA, 18 nt, Homo sapiens
ucacugugugucuugggu

SEQ ID NO: 275368 - RNA, 22 nt, Homo sapiens
ucagaaccucugauuuauacuu

SEQ ID NO: 275369 - RNA, 22 nt, Homo sapiens
ucagaacugaacaaaccagucu

SEQ ID NO: 275370 - RNA, 22 nt, Homo sapiens
ucagaguggccucucuugaaga

SEQ ID NO: 275371 - RNA, 22 nt, Homo sapiens
ucagagugguuguaccauuuga

SEQ ID NO: 275372 - RNA, 22 nt, Homo sapiens
ucagaucaugcuuaugauggga

SEQ ID NO: 275373 - RNA, 22 nt, Homo sapiens
auaaggcuaaggacuugaguua

SEQ ID NO: 275374 - RNA, 22 nt, Homo sapiens
auaaucaugucugaaaccuuug

SEQ ID NO: 275375 - RNA, 22 nt, Homo sapiens
auaauguuugauugagcagaua

SEQ ID NO: 275376 - RNA, 22 nt, Homo sapiens
auagcaauuugggaaucagacu

SEQ ID NO: 275377 - RNA, 22 nt, Homo sapiens
auagcagcuugucagggcagac

SEQ ID NO: 275378 - RNA, 22 nt, Homo sapiens
auagcagugugaaaauguacua

SEQ ID NO: 275379 - RNA, 22 nt, Homo sapiens
auagugaacuuugugagaacaa

SEQ ID NO: 275380 - RNA, 22 nt, Homo sapiens
auaguggcaugaucauagcuca

SEQ ID NO: 275381 - RNA, 22 nt, Homo sapiens
auaugcacgugcauacacacuu

SEQ ID NO: 275382 - RNA, 22 nt, Homo sapiens
auauggcuuuuauuauguugag

SEQ ID NO: 275383 - RNA, 22 nt, Homo sapiens
auauguucucauucauaugugg

SEQ ID NO: 275384 - RNA, 22 nt, Homo sapiens
auauugacuuucucuuagauca

SEQ ID NO: 275385 - RNA, 22 nt, Homo sapiens
aucaaagcagcauggcccaguc

SEQ ID NO: 275386 - RNA, 22 nt, Homo sapiens
aucaaaugcuggcagagugccu

SEQ ID NO: 275387 - RNA, 22 nt, Homo sapiens
aucaagcuacacccuuuggaaa

SEQ ID NO: 275388 - RNA, 22 nt, Homo sapiens
aucaagcuggcauauguaguuc

SEQ ID NO: 275389 - RNA, 22 nt, Homo sapiens
aucaaguaaucugaguaagagu

SEQ ID NO: 275390 - RNA, 22 nt, Homo sapiens
aucaaguacuguacugaaagug

SEQ ID NO: 275391 - RNA, 22 nt, Homo sapiens
aucacagugagcauaugucuau

SEQ ID NO: 275392 - RNA, 19 nt, Homo sapiens
aucaccagucuuuccacug

SEQ ID NO: 275393 - RNA, 22 nt, Homo sapiens
aucauccugucaggagcuguga

SEQ ID NO: 275394 - RNA, 22 nt, Homo sapiens
aucauguuuauguguaggauau

SEQ ID NO: 275395 - RNA, 22 nt, Homo sapiens
aucauugugcaucuucauucca

SEQ ID NO: 275396 - RNA, 22 nt, Homo sapiens
auccaagagacugaugacuucc

SEQ ID NO: 275397 - RNA, 22 nt, Homo sapiens
auccuguacuaagguuuuccca

SEQ ID NO: 275398 - RNA, 22 nt, Homo sapiens
aucugcaaagcugggcugagac

SEQ ID NO: 275399 - RNA, 22 nt, Homo sapiens
aucuuuggauacuugauauagu

SEQ ID NO: 275400 - RNA, 22 nt, Homo sapiens
aucuuuggucaucacagcuaga

SEQ ID NO: 275401 - RNA, 22 nt, Homo sapiens
augaaaucuuuggcagaucuua

SEQ ID NO: 275402 - RNA, 22 nt, Homo sapiens
augaaauguaugagucuggguu

SEQ ID NO: 275403 - RNA, 22 nt, Homo sapiens
augaacacuccaauuguacucc

SEQ ID NO: 275404 - RNA, 18 nt, Homo sapiens
augaacucaucaguucuu

SEQ ID NO: 275405 - RNA, 22 nt, Homo sapiens
augaagcuagcugauugcugau

SEQ ID NO: 275406 - RNA, 22 nt, Homo sapiens
augaagucguuacuaccaauug

SEQ ID NO: 275407 - RNA, 22 nt, Homo sapiens
augacacugcagagauguccca

SEQ ID NO: 275408 - RNA, 18 nt, Homo sapiens
augagagccgauuccugg

SEQ ID NO: 275409 - RNA, 22 nt, Homo sapiens
augagaucugugaacaccuguc

SEQ ID NO: 275410 - RNA, 22 nt, Homo sapiens
augagcagaugcuccugccucu

SEQ ID NO: 275411 - RNA, 22 nt, Homo sapiens
augaggcaggaaaggcguaucu

SEQ ID NO: 275412 - RNA, 22 nt, Homo sapiens
augaggugaguaaauaaaugaa

SEQ ID NO: 275413 - RNA, 22 nt, Homo sapiens
augauacugaguugaguucuca

SEQ ID NO: 275414 - RNA, 22 nt, Homo sapiens
augauagguuuagguuuagaca

SEQ ID NO: 275415 - RNA, 22 nt, Homo sapiens
augauggaggccgugauggacg

SEQ ID NO: 275416 - RNA, 22 nt, Homo sapiens
augcaaaucuuaaguaugugug

SEQ ID NO: 275417 - RNA, 22 nt, Homo sapiens
augcagacacaaguuauaguaa

SEQ ID NO: 275418 - RNA, 22 nt, Homo sapiens
augcagaucacauuuuucuguc

SEQ ID NO: 275419 - RNA, 22 nt, Homo sapiens
augcaugucaaauuuguagguu

SEQ ID NO: 275420 - RNA, 22 nt, Homo sapiens
augccacugcacuucagcuugg

SEQ ID NO: 275421 - RNA, 22 nt, Homo sapiens
augccacugcauaagguuuuca

SEQ ID NO: 275422 - RNA, 22 nt, Homo sapiens
augccacugcgcucuagccugg

SEQ ID NO: 275423 - RNA, 22 nt, Homo sapiens
augccacuguccuccugccuag

SEQ ID NO: 275424 - RNA, 21 nt, Homo sapiens
auggaaagacugccucuucaa

SEQ ID NO: 275425 - RNA, 22 nt, Homo sapiens
auggaaucauccuccugggagc

SEQ ID NO: 275426 - RNA, 22 nt, Homo sapiens
auggcacuuuggacugcuagau

SEQ ID NO: 275427 - RNA, 22 nt, Homo sapiens
auggcagcaccccacucuacug

SEQ ID NO: 275428 - RNA, 22 nt, Homo sapiens
auggcaguuucacucugggauu

SEQ ID NO: 275429 - RNA, 22 nt, Homo sapiens
uuggccccucccaaauuucaug

SEQ ID NO: 275430 - RNA, 22 nt, Homo sapiens
uuggccgugucauuugcuuuga

SEQ ID NO: 275431 - RNA, 22 nt, Homo sapiens
uuggccuccuggucauauccag

SEQ ID NO: 275432 - RNA, 23 nt, Homo sapiens
uugggcaaaucacugagggcaga

SEQ ID NO: 275433 - RNA, 22 nt, Homo sapiens
uugguacuacacuucuaaucuu

SEQ ID NO: 275434 - RNA, 20 nt, Homo sapiens
uuggugaccuacagaugugg

SEQ ID NO: 275435 - RNA, 22 nt, Homo sapiens
uuguaauguuaccaaauggugu

SEQ ID NO: 275436 - RNA, 22 nt, Homo sapiens
uuguacuauuuuuaucagugau

SEQ ID NO: 275437 - RNA, 22 nt, Homo sapiens
uugucacauggggcggcugccc

SEQ ID NO: 275438 - RNA, 22 nt, Homo sapiens
uugucaugguuaauuuuaugua

SEQ ID NO: 275439 - RNA, 22 nt, Homo sapiens
uugugaagaaaccagaaaaguu

SEQ ID NO: 275440 - RNA, 22 nt, Homo sapiens
uuguuugguuagaugggcaagu

SEQ ID NO: 275441 - RNA, 22 nt, Homo sapiens
uuguuugguugaguauggaagu

SEQ ID NO: 275442 - RNA, 22 nt, Homo sapiens
uuuaaagcuccaagcaugucug

SEQ ID NO: 275443 - RNA, 22 nt, Homo sapiens
uuuaaggcacuucaugguuuca

SEQ ID NO: 275444 - RNA, 17 nt, Homo sapiens
uuuaaugcuaggacucu

SEQ ID NO: 275445 - RNA, 22 nt, Homo sapiens
uuuagcaauggagggugacuuu

SEQ ID NO: 275446 - RNA, 23 nt, Homo sapiens
uuucacagaaggauuguagggcc

SEQ ID NO: 275447 - RNA, 22 nt, Homo sapiens
uuucacuagccagcccuuuauu

SEQ ID NO: 275448 - RNA, 22 nt, Homo sapiens
uuuccauguuggugaaaugagg

SEQ ID NO: 275449 - RNA, 22 nt, Homo sapiens
uuucuacagugaacgauuucua

SEQ ID NO: 275450 - RNA, 22 nt, Homo sapiens
uuucugagaccaaaacuuguaa

SEQ ID NO: 275451 - RNA, 22 nt, Homo sapiens
uuucugcuugagagaauugcug

SEQ ID NO: 275452 - RNA, 22 nt, Homo sapiens
uuugaaugcaacaaaugcggga

SEQ ID NO: 275453 - RNA, 20 nt, Homo sapiens
uuugaauguaaagcauguca

SEQ ID NO: 275454 - RNA, 22 nt, Homo sapiens
uuugagcauggaaauggcauga

SEQ ID NO: 275455 - RNA, 21 nt, Homo sapiens
uuugaucauuaaaagugaauc

SEQ ID NO: 275456 - RNA, 22 nt, Homo sapiens
uuugauguccaccucagcccac

SEQ ID NO: 275457 - RNA, 22 nt, Homo sapiens
uuugauguugauacuaccuuca

SEQ ID NO: 275458 - RNA, 22 nt, Homo sapiens
uuugauuguacuaaaauuguac

SEQ ID NO: 275459 - RNA, 22 nt, Homo sapiens
uuugccaaugggaauuuuccua

SEQ ID NO: 275460 - RNA, 22 nt, Homo sapiens
uuugcuuaaaucuuaaucagau

SEQ ID NO: 275461 - RNA, 20 nt, Homo sapiens
uuuggcacugagugguauaa

SEQ ID NO: 275462 - RNA, 22 nt, Homo sapiens
uuuggcagaaaacuaaaaggua

SEQ ID NO: 275463 - RNA, 22 nt, Homo sapiens
uuuggcagaugacccucaaguu

SEQ ID NO: 275464 - RNA, 22 nt, Homo sapiens
uuuggcauuaagaugcuguauc

SEQ ID NO: 275465 - RNA, 22 nt, Homo sapiens
uuugggaaugguuugucuccca

SEQ ID NO: 275466 - RNA, 22 nt, Homo sapiens
uuuggguuaguuuuccaaucuu

SEQ ID NO: 275467 - RNA, 22 nt, Homo sapiens
uuugguguauauguaaacuaug

SEQ ID NO: 275468 - RNA, 22 nt, Homo sapiens
uuuguaauaccugaggcugggu

SEQ ID NO: 275469 - RNA, 22 nt, Homo sapiens
uuuguacacgugggugaauugu

SEQ ID NO: 275470 - RNA, 22 nt, Homo sapiens
uuugucaauaacuaccaacagg

SEQ ID NO: 275471 - RNA, 22 nt, Homo sapiens
uuugucacccugaauguaagau

SEQ ID NO: 275472 - RNA, 22 nt, Homo sapiens
uuugucacucuuggagguuguu

SEQ ID NO: 275473 - RNA, 22 nt, Homo sapiens
uuugugaaugucauaagcucca

SEQ ID NO: 275474 - RNA, 22 nt, Homo sapiens
uuugugcuccucucaguaugug

SEQ ID NO: 275475 - RNA, 22 nt, Homo sapiens
uuuuacacuguugguuggaaug

SEQ ID NO: 275476 - RNA, 22 nt, Homo sapiens
uuuuacagaggagguugcugau

SEQ ID NO: 275477 - RNA, 20 nt, Homo sapiens
uuuuagcacuuguuauggug

SEQ ID NO: 275478 - RNA, 23 nt, Homo sapiens
uuuugcaauaagucacuggaaua

SEQ ID NO: 275479 - RNA, 19 nt, Homo sapiens
uuuuggaaaugugaacagc

SEQ ID NO: 275480 - RNA, 22 nt, Homo sapiens
uuuuggcuuaaagagaauguau

SEQ ID NO: 275481 - RNA, 22 nt, Homo sapiens
uuuuggcuuuuccucagcaagc

SEQ ID NO: 275482 - RNA, 22 nt, Homo sapiens
uuuuguacgccuguguccauca

SEQ ID NO: 275483 - RNA, 22 nt, Homo sapiens
uuuugugacuauuguaaauggg

SEQ ID NO: 275484 - RNA, 21 nt, Homo sapiens
uuuugugcaugugcagccugc

SEQ ID NO: 275485 - RNA, 22 nt, Homo sapiens
uuuuuugguaauugaacaauga

SEQ ID NO: 275486 - RNA, 22 nt, Homo sapiens
auggcaguuucagcuauaguuu

SEQ ID NO: 275487 - RNA, 22 nt, Homo sapiens
auggccgggugcgguggcucac

SEQ ID NO: 275488 - RNA, 22 nt, Homo sapiens
auggcuucuuacucuucugcau

SEQ ID NO: 275489 - RNA, 21 nt, Homo sapiens
auggugagaaaguagugucaa

SEQ ID NO: 275490 - RNA, 22 nt, Homo sapiens
augucacagguccuagccaagu

SEQ ID NO: 275491 - RNA, 22 nt, Homo sapiens
augucacugcacuccugccugg

SEQ ID NO: 275492 - RNA, 20 nt, Homo sapiens
augucagaguguggguacgg

SEQ ID NO: 275493 - RNA, 22 nt, Homo sapiens
augucugguagccaccuggagg

SEQ ID NO: 275494 - RNA, 22 nt, Homo sapiens
augugacagcaacccccagccc

SEQ ID NO: 275495 - RNA, 22 nt, Homo sapiens
augugacuggaucauggggacg

SEQ ID NO: 275496 - RNA, 22 nt, Homo sapiens
augugcacaugcuuacauguga

SEQ ID NO: 275497 - RNA, 22 nt, Homo sapiens
auguggcacuugacuuucucgc

SEQ ID NO: 275498 - RNA, 22 nt, Homo sapiens
auguggcuuuccuagaucuuag

SEQ ID NO: 275499 - RNA, 18 nt, Homo sapiens
auguggcuuuugaaggcu

SEQ ID NO: 275500 - RNA, 22 nt, Homo sapiens
auuaaucaggcaaugcuugcua

SEQ ID NO: 275501 - RNA, 22 nt, Homo sapiens
auuagguuagugcaaaaguaau

SEQ ID NO: 275502 - RNA, 22 nt, Homo sapiens
auuaucacaguuuugcauaugg

SEQ ID NO: 275503 - RNA, 20 nt, Homo sapiens
auucauggugguacguuguc

SEQ ID NO: 275504 - RNA, 22 nt, Homo sapiens
auuccacaguuaacacagaccg

SEQ ID NO: 275505 - RNA, 23 nt, Homo sapiens
auugaacacuuucauaugugagg

SEQ ID NO: 275506 - RNA, 22 nt, Homo sapiens
auugaaugaaauggcagacacu

SEQ ID NO: 275507 - RNA, 22 nt, Homo sapiens
auugcaacuuccgccuccuggg

SEQ ID NO: 275508 - RNA, 21 nt, Homo sapiens
auugcacaauauacccaugua

SEQ ID NO: 275509 - RNA, 22 nt, Homo sapiens
auugcacuccacccugggcaac

SEQ ID NO: 275510 - RNA, 22 nt, Homo sapiens
auugcacuccagucugggcaac

SEQ ID NO: 275511 - RNA, 22 nt, Homo sapiens
auugcacuccauccugggcaau

SEQ ID NO: 275512 - RNA, 22 nt, Homo sapiens
auugcucagucagggagcucgg

SEQ ID NO: 275513 - RNA, 22 nt, Homo sapiens
auuggcaagauagcauaugagg

SEQ ID NO: 275514 - RNA, 22 nt, Homo sapiens
auuggcaauguacauaucuugc

SEQ ID NO: 275515 - RNA, 22 nt, Homo sapiens
auuggcagaaaucuuuauagua

SEQ ID NO: 275516 - RNA, 22 nt, Homo sapiens
auuggggaaugguggcuuuagu

SEQ ID NO: 275517 - RNA, 22 nt, Homo sapiens
auuguacuccagccugggcgac

SEQ ID NO: 275518 - RNA, 22 nt, Homo sapiens
auuuggcaauuuugaagaugcc

SEQ ID NO: 275519 - RNA, 22 nt, Homo sapiens
auuuggcaguauaaugcuuugg

SEQ ID NO: 275520 - RNA, 22 nt, Homo sapiens
auuuggcagugaagggaucaca

SEQ ID NO: 275521 - RNA, 22 nt, Homo sapiens
auuuuuggauauagggaaggau

SEQ ID NO: 275522 - RNA, 22 nt, Homo sapiens
auuuuugguugucagcacuagg

SEQ ID NO: 275523 - RNA, 22 nt, Homo sapiens
caaaguaauugcuguuuugcca

SEQ ID NO: 275524 - RNA, 22 nt, Homo sapiens
caaauacuuucauguugucuug

SEQ ID NO: 275525 - RNA, 22 nt, Homo sapiens
caaaugcuucuauggacugucu

SEQ ID NO: 275526 - RNA, 22 nt, Homo sapiens
cacacugucuuucagaaugguu

SEQ ID NO: 275527 - RNA, 22 nt, Homo sapiens
cacagcacaggcaugaguguca

SEQ ID NO: 275528 - RNA, 22 nt, Homo sapiens
cacagugaacaauauccucugu

SEQ ID NO: 275529 - RNA, 22 nt, Homo sapiens
cacaguguuccagcuauuugaa

SEQ ID NO: 275530 - RNA, 19 nt, Homo sapiens
caccagugcaugcuacuau

SEQ ID NO: 275531 - RNA, 22 nt, Homo sapiens
cacugcaauuacuuuugcacca

SEQ ID NO: 275532 - RNA, 22 nt, Homo sapiens
cacugcacuccagccuaagagg

SEQ ID NO: 275533 - RNA, 22 nt, Homo sapiens
cacugcacuccagucccgucuc

SEQ ID NO: 275534 - RNA, 21 nt, Homo sapiens
cacugguguugcuauaucaaa

SEQ ID NO: 275535 - RNA, 22 nt, Homo sapiens
cagagaacauucagagcuguag

SEQ ID NO: 275536 - RNA, 22 nt, Homo sapiens
cagauacucauggaacuggguu

SEQ ID NO: 275537 - RNA, 22 nt, Homo sapiens
cagaugcaugaccugggcuugg

SEQ ID NO: 275538 - RNA, 22 nt, Homo sapiens
cagcacauuacaaguacuuggu

SEQ ID NO: 275539 - RNA, 22 nt, Homo sapiens
ugaggugcagcaauccucaugu

SEQ ID NO: 275540 - RNA, 22 nt, Homo sapiens
ugagguuggggucagggcuagc

SEQ ID NO: 275541 - RNA, 22 nt, Homo sapiens
ugaguagaacaucaagucauac

SEQ ID NO: 275542 - RNA, 22 nt, Homo sapiens
ugagugaggcugggcagucccu

SEQ ID NO: 275543 - RNA, 18 nt, Homo sapiens
ugauaucaucacaauuga

SEQ ID NO: 275544 - RNA, 22 nt, Homo sapiens
ugauaucucuugccuccaaaug

SEQ ID NO: 275545 - RNA, 22 nt, Homo sapiens
ugauccccucacauuauuauau

SEQ ID NO: 275546 - RNA, 22 nt, Homo sapiens
ugaucuguccaccucagcuucc

SEQ ID NO: 275547 - RNA, 22 nt, Homo sapiens
ugcaaagaaauuuuggugacca

SEQ ID NO: 275548 - RNA, 22 nt, Homo sapiens
ugcaaguaauuccagcuacuga

SEQ ID NO: 275549 - RNA, 22 nt, Homo sapiens
ugcaauuuaaugugucccaauu

SEQ ID NO: 275550 - RNA, 16 nt, Homo sapiens
ugcagaguaggugaau

SEQ ID NO: 275551 - RNA, 21 nt, Homo sapiens
ugcagccauucagcccuaugc

SEQ ID NO: 275552 - RNA, 22 nt, Homo sapiens
ugcauaauuccuugcaccagaa

SEQ ID NO: 275553 - RNA, 22 nt, Homo sapiens
ugcauauguugaaccaggcuug

SEQ ID NO: 275554 - RNA, 22 nt, Homo sapiens
ugcauugcacuugcaugagaua

SEQ ID NO: 275555 - RNA, 22 nt, Homo sapiens
ugcauuguuuagaaacacuggg

SEQ ID NO: 275556 - RNA, 22 nt, Homo sapiens
ugccaguguugccuuucacuag

SEQ ID NO: 275557 - RNA, 22 nt, Homo sapiens
ugccuacuuugcaucugucagg

SEQ ID NO: 275558 - RNA, 22 nt, Homo sapiens
ugccugagcccagcccuguagu

SEQ ID NO: 275559 - RNA, 22 nt, Homo sapiens
ugccuggagagcuccuacauau

SEQ ID NO: 275560 - RNA, 23 nt, Homo sapiens
ugcuccccucauggaugaauaaa

SEQ ID NO: 275561 - RNA, 22 nt, Homo sapiens
ugcugguguggucuagccgcuu

SEQ ID NO: 275562 - RNA, 22 nt, Homo sapiens
uggaaacuuauguucuucugug

SEQ ID NO: 275563 - RNA, 20 nt, Homo sapiens
uggaaaguaagucaugauau

SEQ ID NO: 275564 - RNA, 22 nt, Homo sapiens
uggaagacucuagucucuugag

SEQ ID NO: 275565 - RNA, 22 nt, Homo sapiens
uggaaggcuucauauguaaaga

SEQ ID NO: 275566 - RNA, 22 nt, Homo sapiens
uggaaguaaccaugaauggaau

SEQ ID NO: 275567 - RNA, 23 nt, Homo sapiens
uggaaguauggaggaggcagaau

SEQ ID NO: 275568 - RNA, 22 nt, Homo sapiens
uggaauaugagacgggguuguc

SEQ ID NO: 275569 - RNA, 22 nt, Homo sapiens
uggaaucuuaggugaaggcuuu

SEQ ID NO: 275570 - RNA, 22 nt, Homo sapiens
uggacagacaagguuauagauc

SEQ ID NO: 275571 - RNA, 23 nt, Homo sapiens
uggaggacaagcauggauaguga

SEQ ID NO: 275572 - RNA, 22 nt, Homo sapiens
uggaggucauuggaucaugggg

SEQ ID NO: 275573 - RNA, 20 nt, Homo sapiens
uggaguuguggcaguuugga

SEQ ID NO: 275574 - RNA, 22 nt, Homo sapiens
uggcaaaugaagucagcuguac

SEQ ID NO: 275575 - RNA, 22 nt, Homo sapiens
uggcaaaugugagaugagaacu

SEQ ID NO: 275576 - RNA, 22 nt, Homo sapiens
uggcaacaucuggggacauguu

SEQ ID NO: 275577 - RNA, 22 nt, Homo sapiens
uggcaagaagagcaugagacca

SEQ ID NO: 275578 - RNA, 22 nt, Homo sapiens
uggcaagaaggauuuauuccuu

SEQ ID NO: 275579 - RNA, 22 nt, Homo sapiens
uggcaagagauaugugucuaua

SEQ ID NO: 275580 - RNA, 22 nt, Homo sapiens
uggcaagagcaaaauguacagu

SEQ ID NO: 275581 - RNA, 22 nt, Homo sapiens
uggcaauaaggacuccuuaggu

SEQ ID NO: 275582 - RNA, 19 nt, Homo sapiens
uggcacauguauacauaug

SEQ ID NO: 275583 - RNA, 22 nt, Homo sapiens
uggcagaugggugagcuggaga

SEQ ID NO: 275584 - RNA, 22 nt, Homo sapiens
uggcaguuuacaaaugccauga

SEQ ID NO: 275585 - RNA, 22 nt, Homo sapiens
uggcaguuuuaugugguucaac

SEQ ID NO: 275586 - RNA, 20 nt, Homo sapiens
uggcaugaaauuuuccaagc

SEQ ID NO: 275587 - RNA, 23 nt, Homo sapiens
uggcauuuuaguuagcuucagug

SEQ ID NO: 275588 - RNA, 22 nt, Homo sapiens
uggcauuuugugugaauuagaa

SEQ ID NO: 275589 - RNA, 22 nt, Homo sapiens
uggccaagagcacagauauugg

SEQ ID NO: 275590 - RNA, 22 nt, Homo sapiens
uggcccccucccaaaucucaua

SEQ ID NO: 275591 - RNA, 22 nt, Homo sapiens
uggcgagaugcucgugugcaga

SEQ ID NO: 275592 - RNA, 22 nt, Homo sapiens
uggcuacugacugaugauuaua

SEQ ID NO: 275593 - RNA, 22 nt, Homo sapiens
uggcuagauauccagaguucug

SEQ ID NO: 275594 - RNA, 22 nt, Homo sapiens
uggcuuuucauccugggacauu

SEQ ID NO: 275595 - RNA, 22 nt, Homo sapiens
ugggaacaugaagguuaaagag

SEQ ID NO: 275596 - RNA, 18 nt, Homo sapiens
ugggaagaaauucuucuc

SEQ ID NO: 275597 - RNA, 22 nt, Homo sapiens
ugggagugugcacaauuucagc

SEQ ID NO: 275598 - RNA, 22 nt, Homo sapiens
ugggaucagcugggcucucugu

SEQ ID NO: 275599 - RNA, 22 nt, Homo sapiens
ugggaucauuaugcauagugua

SEQ ID NO: 275600 - RNA, 22 nt, Homo sapiens
ugggcaaaugcuuuuuagucaa

SEQ ID NO: 275601 - RNA, 22 nt, Homo sapiens
uggggugugagggagaaagaaa

SEQ ID NO: 275602 - RNA, 22 nt, Homo sapiens
uggguagagcacugggggcgag

SEQ ID NO: 275603 - RNA, 22 nt, Homo sapiens
uggguaggcccucauuggacag

SEQ ID NO: 275604 - RNA, 19 nt, Homo sapiens
uggucccccgcaaucucau

SEQ ID NO: 275605 - RNA, 22 nt, Homo sapiens
uggugcaaugaagugaucucaa

SEQ ID NO: 275606 - RNA, 19 nt, Homo sapiens
uggugccuuguucuuggau

SEQ ID NO: 275607 - RNA, 22 nt, Homo sapiens
uguaacacacacuguuuacucc

SEQ ID NO: 275608 - RNA, 20 nt, Homo sapiens
uguaaucuaaguuuuaagcc

SEQ ID NO: 275609 - RNA, 22 nt, Homo sapiens
uguaauguuucaucauuauuaa

SEQ ID NO: 275610 - RNA, 22 nt, Homo sapiens
uguaauuuaaaugauccuugga

SEQ ID NO: 275611 - RNA, 22 nt, Homo sapiens
uguauacauauguauguuuugu

SEQ ID NO: 275612 - RNA, 22 nt, Homo sapiens
uguauugcuugaagagugaauu

SEQ ID NO: 275613 - RNA, 22 nt, Homo sapiens
ugucacagagauuuugguaugu

SEQ ID NO: 275614 - RNA, 22 nt, Homo sapiens
ugucaccuugcucauccucgga

SEQ ID NO: 275615 - RNA, 22 nt, Homo sapiens
ugucagggaggcucggccgcac

SEQ ID NO: 275616 - RNA, 22 nt, Homo sapiens
ugucauacaguaacaugguugg

SEQ ID NO: 275617 - RNA, 22 nt, Homo sapiens
ugucauauagaauguucuauga

SEQ ID NO: 275618 - RNA, 22 nt, Homo sapiens
ugucauguugguguacugcacc

SEQ ID NO: 275619 - RNA, 18 nt, Homo sapiens
aaacagugucucuuucug

SEQ ID NO: 275620 - RNA, 22 nt, Homo sapiens
aaacucuguagcagagacagau

SEQ ID NO: 275621 - RNA, 22 nt, Homo sapiens
aaagaagucagccuguccuuug

SEQ ID NO: 275622 - RNA, 22 nt, Homo sapiens
aaagaguucagguagauuucaa

SEQ ID NO: 275623 - RNA, 22 nt, Homo sapiens
aaagcuacaggaccugcucauu

SEQ ID NO: 275624 - RNA, 22 nt, Homo sapiens
aaagcuaccagauucuguugga

SEQ ID NO: 275625 - RNA, 22 nt, Homo sapiens
aaagugacuuagugccccauuu

SEQ ID NO: 275626 - RNA, 22 nt, Homo sapiens
aaagugauguccaggcuuucag

SEQ ID NO: 275627 - RNA, 22 nt, Homo sapiens
aaagugauugcgguuuuugcca

SEQ ID NO: 275628 - RNA, 22 nt, Homo sapiens
aaagugcaguacuucguauauu

SEQ ID NO: 275629 - RNA, 22 nt, Homo sapiens
aaaguguguuuccaaccugugg

SEQ ID NO: 275630 - RNA, 22 nt, Homo sapiens
aaaucccuugcucucucagacc

SEQ ID NO: 275631 - RNA, 22 nt, Homo sapiens
aaaugcaguugguggggauaug

SEQ ID NO: 275632 - RNA, 22 nt, Homo sapiens
aaaugcaucauuaggugauuuu

SEQ ID NO: 275633 - RNA, 22 nt, Homo sapiens
aaaugcaugaggugggaagaaa

SEQ ID NO: 275634 - RNA, 22 nt, Homo sapiens
aaaugcucucuacacguuucug

SEQ ID NO: 275635 - RNA, 20 nt, Homo sapiens
aagagcucaccagaauaucu

SEQ ID NO: 275636 - RNA, 19 nt, Homo sapiens
aagaugauguuugggcuaa

SEQ ID NO: 275637 - RNA, 22 nt, Homo sapiens
aagcacaauuucaccuucuugu

SEQ ID NO: 275638 - RNA, 21 nt, Homo sapiens
aagcacauugaguguguguga

SEQ ID NO: 275639 - RNA, 22 nt, Homo sapiens
aagcacccuuugucuggacaug

SEQ ID NO: 275640 - RNA, 22 nt, Homo sapiens
aagcaucacuggaggcagccau

SEQ ID NO: 275641 - RNA, 22 nt, Homo sapiens
aagcuacauuuuauuuauguca

SEQ ID NO: 275642 - RNA, 22 nt, Homo sapiens
aagcuggauuuaguguggagca

SEQ ID NO: 275643 - RNA, 22 nt, Homo sapiens
aagcuguuguucauccugaauu

SEQ ID NO: 275644 - RNA, 22 nt, Homo sapiens
aaggagcagagagcccuguuuc

SEQ ID NO: 275645 - RNA, 22 nt, Homo sapiens
aaggaguagacaacauggcgcc

SEQ ID NO: 275646 - RNA, 22 nt, Homo sapiens
aaggcacugaacuuaaauucug

SEQ ID NO: 275647 - RNA, 22 nt, Homo sapiens
aaggcaugcaaagaacauuuua

SEQ ID NO: 275648 - RNA, 22 nt, Homo sapiens
aaggcaugcaguacguuucuau

SEQ ID NO: 275649 - RNA, 22 nt, Homo sapiens
uccacagugguugaacuaguuu

SEQ ID NO: 275650 - RNA, 22 nt, Homo sapiens
uccagguuucaugcucuuuauu

SEQ ID NO: 275651 - RNA, 22 nt, Homo sapiens
uccagguuuggcuuuauaacuu

SEQ ID NO: 275652 - RNA, 22 nt, Homo sapiens
uccaguguuauaauaugcgucu

SEQ ID NO: 275653 - RNA, 22 nt, Homo sapiens
uccaguguuucuuccacuauuu

SEQ ID NO: 275654 - RNA, 22 nt, Homo sapiens
uccaguuuuguuaacauauggu

SEQ ID NO: 275655 - RNA, 22 nt, Homo sapiens
ucccagugcuaugcaaaagccu

SEQ ID NO: 275656 - RNA, 22 nt, Homo sapiens
ucccaguuuuucugaauaguca

SEQ ID NO: 275657 - RNA, 19 nt, Homo sapiens
uccccgggucuagugcagc

SEQ ID NO: 275658 - RNA, 22 nt, Homo sapiens
uccccgucacacgcaggcuuac

SEQ ID NO: 275659 - RNA, 22 nt, Homo sapiens
uccccugauaccaaccaccaug

SEQ ID NO: 275660 - RNA, 22 nt, Homo sapiens
ucccuguagugccuagaucaga

SEQ ID NO: 275661 - RNA, 22 nt, Homo sapiens
uccucauggagaaccucugcua

SEQ ID NO: 275662 - RNA, 22 nt, Homo sapiens
uccugcauucugaaauacaagu

SEQ ID NO: 275663 - RNA, 22 nt, Homo sapiens
uccuggcuccacuguuuauucc

SEQ ID NO: 275664 - RNA, 22 nt, Homo sapiens
uccuucacucuacaucuuuguu

SEQ ID NO: 275665 - RNA, 22 nt, Homo sapiens
uccuugguugauccugugcaga

SEQ ID NO: 275666 - RNA, 19 nt, Homo sapiens
ucuaaaucucuugauagac

SEQ ID NO: 275667 - RNA, 22 nt, Homo sapiens
ucuaguaaugagaggcaggaga

SEQ ID NO: 275668 - RNA, 22 nt, Homo sapiens
ucucaaccucccaaguagcugg

SEQ ID NO: 275669 - RNA, 22 nt, Homo sapiens
ucucaagaugguagaugggaau

SEQ ID NO: 275670 - RNA, 22 nt, Homo sapiens
ucucaaguaacugggacaauaa

SEQ ID NO: 275671 - RNA, 18 nt, Homo sapiens
ucucacagcaaucuguca

SEQ ID NO: 275672 - RNA, 22 nt, Homo sapiens
ucugagcaauaaacaacauauu

SEQ ID NO: 275673 - RNA, 22 nt, Homo sapiens
ucugccacugucauugugugau

SEQ ID NO: 275674 - RNA, 22 nt, Homo sapiens
ucugccuacugguuggaggaac

SEQ ID NO: 275675 - RNA, 22 nt, Homo sapiens
ucuggauuuuugaggcaauaua

SEQ ID NO: 275676 - RNA, 22 nt, Homo sapiens
ucugguguuauucauguaguuu

SEQ ID NO: 275677 - RNA, 22 nt, Homo sapiens
ucuugcauuuuuaaauagugcu

SEQ ID NO: 275678 - RNA, 22 nt, Homo sapiens
ucuuggacuuuugugagaaauc

SEQ ID NO: 275679 - RNA, 22 nt, Homo sapiens
ucuuugguaauggaugucugau

SEQ ID NO: 275680 - RNA, 22 nt, Homo sapiens
ucuuugguaggaguaggaggcc

SEQ ID NO: 275681 - RNA, 22 nt, Homo sapiens
ucuuugguaugugcaugugcuu

SEQ ID NO: 275682 - RNA, 22 nt, Homo sapiens
ucuuugguauuuguggggaauu

SEQ ID NO: 275683 - RNA, 21 nt, Homo sapiens
ucuuuggucaccaguuuucau

SEQ ID NO: 275684 - RNA, 22 nt, Homo sapiens
ucuuugguuguuuagggugcau

SEQ ID NO: 275685 - RNA, 22 nt, Homo sapiens
ucuuuugugagucagccucucc

SEQ ID NO: 275686 - RNA, 22 nt, Homo sapiens
ucuuuuguucuauucaggccuu

SEQ ID NO: 275687 - RNA, 22 nt, Homo sapiens
ugaaacacaccuccucuccauc

SEQ ID NO: 275688 - RNA, 22 nt, Homo sapiens
ugaaaucauguaguuauugcaa

SEQ ID NO: 275689 - RNA, 22 nt, Homo sapiens
ugaaaugaucaguuugguuacu

SEQ ID NO: 275690 - RNA, 22 nt, Homo sapiens
ugaaaugauuauaugguguuug

SEQ ID NO: 275691 - RNA, 22 nt, Homo sapiens
ugaaauguuaaacaaguggcuc

SEQ ID NO: 275692 - RNA, 22 nt, Homo sapiens
ugaacagagaaacacuggccau

SEQ ID NO: 275693 - RNA, 20 nt, Homo sapiens
ugaaggaggucauuuauacc

SEQ ID NO: 275694 - RNA, 22 nt, Homo sapiens
ugaaggcaggagggagaaaagu

SEQ ID NO: 275695 - RNA, 22 nt, Homo sapiens
ugaauagacacuaaagacugua

SEQ ID NO: 275696 - RNA, 22 nt, Homo sapiens
ugaauauguuaaauaauguucu

SEQ ID NO: 275697 - RNA, 22 nt, Homo sapiens
ugacaagaguagagagggugcc

SEQ ID NO: 275698 - RNA, 20 nt, Homo sapiens
ugacaagugagaauuauggg

SEQ ID NO: 275699 - RNA, 22 nt, Homo sapiens
ugacagcaucaggauuggagag

SEQ ID NO: 275700 - RNA, 22 nt, Homo sapiens
ugacagguugauaggugcagca

SEQ ID NO: 275701 - RNA, 22 nt, Homo sapiens
ugacauguauaucuuacgcuau

SEQ ID NO: 275702 - RNA, 22 nt, Homo sapiens
ugacuacauaaguaaucucaaa

SEQ ID NO: 275703 - RNA, 22 nt, Homo sapiens
ugacucaguuucucagguagua

SEQ ID NO: 275704 - RNA, 22 nt, Homo sapiens
ugacuugaucauuacacauucu

SEQ ID NO: 275705 - RNA, 22 nt, Homo sapiens
ugagaacagcagcuugggacac

SEQ ID NO: 275706 - RNA, 19 nt, Homo sapiens
ugagaaccucuacagaguc

SEQ ID NO: 275707 - RNA, 22 nt, Homo sapiens
ugagaacuaaugaagaauuuau

SEQ ID NO: 275708 - RNA, 22 nt, Homo sapiens
ugagaagcauaccagugucugu

SEQ ID NO: 275709 - RNA, 22 nt, Homo sapiens
ugagaauauuuuccaugucuca

SEQ ID NO: 275710 - RNA, 22 nt, Homo sapiens
ugagaaugacugggcaugcugc

SEQ ID NO: 275711 - RNA, 22 nt, Homo sapiens
ugagacacugaauccggccuga

SEQ ID NO: 275712 - RNA, 22 nt, Homo sapiens
ugagacggagucucgcucuguc

SEQ ID NO: 275713 - RNA, 22 nt, Homo sapiens
ugagacggagucucgcucuguu

SEQ ID NO: 275714 - RNA, 22 nt, Homo sapiens
ugagacggagucuugcucuguc

SEQ ID NO: 275715 - RNA, 22 nt, Homo sapiens
ugagacugagucuugcucuauu

SEQ ID NO: 275716 - RNA, 22 nt, Homo sapiens
ugagaucaacugagucagagca

SEQ ID NO: 275717 - RNA, 22 nt, Homo sapiens
ugagaucaaggugggcccuggg

SEQ ID NO: 275718 - RNA, 20 nt, Homo sapiens
ugagaucaggauuaaggcua

SEQ ID NO: 275719 - RNA, 22 nt, Homo sapiens
ugagaucaguuguuauaauucu

SEQ ID NO: 275720 - RNA, 22 nt, Homo sapiens
ugagaugaaagcagaaagacuu

SEQ ID NO: 275721 - RNA, 22 nt, Homo sapiens
ugagaugagggcugcacucaaa

SEQ ID NO: 275722 - RNA, 22 nt, Homo sapiens
ugagaugaugggauaagagggc

SEQ ID NO: 275723 - RNA, 22 nt, Homo sapiens
ugagaugcuccucuugcaaagc

SEQ ID NO: 275724 - RNA, 22 nt, Homo sapiens
ugagauggguucugguccccug

SEQ ID NO: 275725 - RNA, 22 nt, Homo sapiens
ugagaugguaaauuuuuguugu

SEQ ID NO: 275726 - RNA, 21 nt, Homo sapiens
ugagaugugaccagggcauca

SEQ ID NO: 275727 - RNA, 22 nt, Homo sapiens
ugagauguuccaaugacuauua

SEQ ID NO: 275728 - RNA, 21 nt, Homo sapiens
ugagauuaaguuguuuagaag

SEQ ID NO: 275729 - RNA, 21 nt, Homo sapiens
ugagauuauauuaacauggua

SEQ ID NO: 275730 - RNA, 22 nt, Homo sapiens
ugagauuaucguaauguaucuc

SEQ ID NO: 275731 - RNA, 22 nt, Homo sapiens
ugagcacagcgugugggagagc

SEQ ID NO: 275732 - RNA, 22 nt, Homo sapiens
ugagcaucauucacaccuuggu

SEQ ID NO: 275733 - RNA, 22 nt, Homo sapiens
ugagccaaguucacaccauugc

SEQ ID NO: 275734 - RNA, 20 nt, Homo sapiens
ugagcuuguaaacacuguuu

SEQ ID NO: 275735 - RNA, 22 nt, Homo sapiens
ugaggaguguauuucauucgcu

SEQ ID NO: 275736 - RNA, 22 nt, Homo sapiens
ugaggcacucuagacuuauuca

SEQ ID NO: 275737 - RNA, 20 nt, Homo sapiens
ugaggucaggaguuacagac

SEQ ID NO: 275738 - RNA, 22 nt, Homo sapiens
ugagguuauuuguucaagaagu

SEQ ID NO: 275739 - RNA, 23 nt, Homo sapiens
ugaguagguccacguaugugagu

SEQ ID NO: 275740 - RNA, 22 nt, Homo sapiens
ugaguauagaucaguucaagug

SEQ ID NO: 275741 - RNA, 22 nt, Homo sapiens
ugaguauguuuaaugugacaau

SEQ ID NO: 275742 - RNA, 22 nt, Homo sapiens
ugauaacauuucuucugguaca

SEQ ID NO: 275743 - RNA, 20 nt, Homo sapiens
ugauauuucuggaaguggag

SEQ ID NO: 275744 - RNA, 22 nt, Homo sapiens
ugauauuuuugauccuuaaguu

SEQ ID NO: 275745 - RNA, 22 nt, Homo sapiens
ugaucucagcucacugguugaa

SEQ ID NO: 275746 - RNA, 23 nt, Homo sapiens
ugauguccacuuagggucuaggu

SEQ ID NO: 275747 - RNA, 22 nt, Homo sapiens
ugauguugacuguaggcagaga

SEQ ID NO: 275748 - RNA, 22 nt, Homo sapiens
ugcaaacuuccuugggcagcau

SEQ ID NO: 275749 - RNA, 22 nt, Homo sapiens
ugcaaagucgaaacugcaguuu

SEQ ID NO: 275750 - RNA, 22 nt, Homo sapiens
ugcaaauguuaggugucauuau

SEQ ID NO: 275751 - RNA, 22 nt, Homo sapiens
uggguagagaaucaggaucuua

SEQ ID NO: 275752 - RNA, 19 nt, Homo sapiens
uggguagugaugagacaua

SEQ ID NO: 275753 - RNA, 22 nt, Homo sapiens
uggguccccuacucuuuccaca

SEQ ID NO: 275754 - RNA, 22 nt, Homo sapiens
ugggugugaccgcucaaggggg

SEQ ID NO: 275755 - RNA, 20 nt, Homo sapiens
ugguaauguaagagaggaga

SEQ ID NO: 275756 - RNA, 22 nt, Homo sapiens
ugguacuucaugcucacagaua

SEQ ID NO: 275757 - RNA, 22 nt, Homo sapiens
uggucuccuuuguacccugggc

SEQ ID NO: 275758 - RNA, 22 nt, Homo sapiens
uggugcccuguccuucuguggc

SEQ ID NO: 275759 - RNA, 22 nt, Homo sapiens
ugguggcuuuucguagguucac

SEQ ID NO: 275760 - RNA, 23 nt, Homo sapiens
uguaaagcuaugaauuauucuuu

SEQ ID NO: 275761 - RNA, 22 nt, Homo sapiens
uguaugucugcucuuuggaacu

SEQ ID NO: 275762 - RNA, 21 nt, Homo sapiens
ugucaagugggaaaacaugua

SEQ ID NO: 275763 - RNA, 22 nt, Homo sapiens
ugucagcacaacucagguuccu

SEQ ID NO: 275764 - RNA, 22 nt, Homo sapiens
ugucaugagucuccuccaucuu

SEQ ID NO: 275765 - RNA, 22 nt, Homo sapiens
ugucauggcauuuguaaacugc

SEQ ID NO: 275766 - RNA, 22 nt, Homo sapiens
ugucauggugcucugggcccug

SEQ ID NO: 275767 - RNA, 22 nt, Homo sapiens
uguccugcagagguguuugccu

SEQ ID NO: 275768 - RNA, 22 nt, Homo sapiens
ugucuagaucugaauguaauug

SEQ ID NO: 275769 - RNA, 22 nt, Homo sapiens
ugucuuggagaauccuggguuu

SEQ ID NO: 275770 - RNA, 22 nt, Homo sapiens
ugugaaugaagaaugcuaaccu

SEQ ID NO: 275771 - RNA, 17 nt, Homo sapiens
ugugacccugggcuacc

SEQ ID NO: 275772 - RNA, 22 nt, Homo sapiens
ugugacucuggcacauggugag

SEQ ID NO: 275773 - RNA, 22 nt, Homo sapiens
ugugagaucucagaauugaacu

SEQ ID NO: 275774 - RNA, 22 nt, Homo sapiens
ugugagcuauggaguuguagag

SEQ ID NO: 275775 - RNA, 22 nt, Homo sapiens
ugugcaaucuuccauuuuuagg

SEQ ID NO: 275776 - RNA, 22 nt, Homo sapiens
ugugcacaaccugcagguuugu

SEQ ID NO: 275777 - RNA, 22 nt, Homo sapiens
ugugccacugcacuccugccug

SEQ ID NO: 275778 - RNA, 22 nt, Homo sapiens
ugugccacugcacuccugggug

SEQ ID NO: 275779 - RNA, 22 nt, Homo sapiens
ugugccacugcacucuggccug

SEQ ID NO: 275780 - RNA, 22 nt, Homo sapiens
ugugccacuguucuguaaagug

SEQ ID NO: 275781 - RNA, 22 nt, Homo sapiens
uguggcaaagucuugugaauau

SEQ ID NO: 275782 - RNA, 22 nt, Homo sapiens
uguggcaaauggucaggaagaa

SEQ ID NO: 275783 - RNA, 22 nt, Homo sapiens
uguggcauugaauaaccuugga

SEQ ID NO: 275784 - RNA, 22 nt, Homo sapiens
uguggccuuuguuucaguuggg

SEQ ID NO: 275785 - RNA, 22 nt, Homo sapiens
uguguaaauauauacacacgug

SEQ ID NO: 275786 - RNA, 22 nt, Homo sapiens
uguguacaucucuacacacaug

SEQ ID NO: 275787 - RNA, 22 nt, Homo sapiens
uguuacacugugcacuaaauuu

SEQ ID NO: 275788 - RNA, 22 nt, Homo sapiens
uuaaagugcuguuuuugccggg

SEQ ID NO: 275789 - RNA, 20 nt, Homo sapiens
uuaaaucuagugcagacuca

SEQ ID NO: 275790 - RNA, 22 nt, Homo sapiens
uucuccugguggacccuaaacg

SEQ ID NO: 275791 - RNA, 22 nt, Homo sapiens
uucugagguuauauucucucaa

SEQ ID NO: 275792 - RNA, 22 nt, Homo sapiens
uucugccaaucaacccacaucc

SEQ ID NO: 275793 - RNA, 22 nt, Homo sapiens
uucugcuugaucuaguguguug

SEQ ID NO: 275794 - RNA, 22 nt, Homo sapiens
uucuggccuccauuuuucuccu

SEQ ID NO: 275795 - RNA, 22 nt, Homo sapiens
uucugugcugaaucaaagacug

SEQ ID NO: 275796 - RNA, 22 nt, Homo sapiens
uucugugcuuguggaugaagug

SEQ ID NO: 275797 - RNA, 22 nt, Homo sapiens
uucuugcacuuaacugacauuc

SEQ ID NO: 275798 - RNA, 22 nt, Homo sapiens
uugaaagaaaggagacugaguu

SEQ ID NO: 275799 - RNA, 22 nt, Homo sapiens
uugagaguggcagagguggaac

SEQ ID NO: 275800 - RNA, 22 nt, Homo sapiens
uugagauagaauaggaauggga

SEQ ID NO: 275801 - RNA, 22 nt, Homo sapiens
uugagauauccauaaaugggaa

SEQ ID NO: 275802 - RNA, 22 nt, Homo sapiens
uugagaugaagucuugcucucu

SEQ ID NO: 275803 - RNA, 22 nt, Homo sapiens
uugagaugaaguuuugcucuuu

SEQ ID NO: 275804 - RNA, 22 nt, Homo sapiens
uugagauggagucucacgcauu

SEQ ID NO: 275805 - RNA, 22 nt, Homo sapiens
uugagauggagucucacuccuu

SEQ ID NO: 275806 - RNA, 22 nt, Homo sapiens
uugagauggagucucgcucugu

SEQ ID NO: 275807 - RNA, 22 nt, Homo sapiens
uugagauggagucuugcucugu

SEQ ID NO: 275808 - RNA, 22 nt, Homo sapiens
uugagauggaguucauuuuugu

SEQ ID NO: 275809 - RNA, 22 nt, Homo sapiens
uugagauggauagacauagcau

SEQ ID NO: 275810 - RNA, 22 nt, Homo sapiens
uugagauggugccacuguacuc

SEQ ID NO: 275811 - RNA, 22 nt, Homo sapiens
uugagauguaagauguuaauau

SEQ ID NO: 275812 - RNA, 22 nt, Homo sapiens
uugagauguauguauauaaugu

SEQ ID NO: 275813 - RNA, 22 nt, Homo sapiens
uugagauguggguuggugacuu

SEQ ID NO: 275814 - RNA, 22 nt, Homo sapiens
uugagcaacauagugagacugu

SEQ ID NO: 275815 - RNA, 22 nt, Homo sapiens
uugagcaaugucacugaggcuu

SEQ ID NO: 275816 - RNA, 22 nt, Homo sapiens
uugagccaaggauugucuuucc

SEQ ID NO: 275817 - RNA, 22 nt, Homo sapiens
uugagcuauguacagaugcugu

SEQ ID NO: 275818 - RNA, 23 nt, Homo sapiens
uugaggcauguaccaucaauauc

SEQ ID NO: 275819 - RNA, 16 nt, Homo sapiens
uugaggcaugucucag

SEQ ID NO: 275820 - RNA, 22 nt, Homo sapiens
uugagggagcauuuguuuugag

SEQ ID NO: 275821 - RNA, 22 nt, Homo sapiens
uugagggagccuguuagucccg

SEQ ID NO: 275822 - RNA, 22 nt, Homo sapiens
uugaggugggaggaucacuuga

SEQ ID NO: 275823 - RNA, 20 nt, Homo sapiens
uugaggugugaggggcagag

SEQ ID NO: 275824 - RNA, 23 nt, Homo sapiens
uugcaaagccugaaacucuucag

SEQ ID NO: 275825 - RNA, 22 nt, Homo sapiens
uugcaaaguuugccuccuguag

SEQ ID NO: 275826 - RNA, 22 nt, Homo sapiens
aaaacgcauccucacaggucug

SEQ ID NO: 275827 - RNA, 22 nt, Homo sapiens
aaagagaucuaugggcacuaug

SEQ ID NO: 275828 - RNA, 22 nt, Homo sapiens
aaagggcuuuguaaacuucaag

SEQ ID NO: 275829 - RNA, 18 nt, Homo sapiens
aaagugaugucauucuuu

SEQ ID NO: 275830 - RNA, 22 nt, Homo sapiens
aaagugcugggaucacacugaa

SEQ ID NO: 275831 - RNA, 22 nt, Homo sapiens
aaagugucuguuccuagcauga

SEQ ID NO: 275832 - RNA, 20 nt, Homo sapiens
aaaugcuguaauguuuggga

SEQ ID NO: 275833 - RNA, 22 nt, Homo sapiens
aaauucaugucaccucuaggua

SEQ ID NO: 275834 - RNA, 23 nt, Homo sapiens
aaauuugccuauuauuccuaugg

SEQ ID NO: 275835 - RNA, 22 nt, Homo sapiens
uugcaacauguauucuggugau

SEQ ID NO: 275836 - RNA, 22 nt, Homo sapiens
uugcacuccagcucuaggugac

SEQ ID NO: 275837 - RNA, 22 nt, Homo sapiens
uugcauagacaauauuaaucuu

SEQ ID NO: 275838 - RNA, 23 nt, Homo sapiens
uugcauagacauccucauagauu

SEQ ID NO: 275839 - RNA, 19 nt, Homo sapiens
uugcauauguugaaccagg

SEQ ID NO: 275840 - RNA, 23 nt, Homo sapiens
uugcauugcccuccauaguacuc

SEQ ID NO: 275841 - RNA, 22 nt, Homo sapiens
uugccaauauuuuacugagaag

SEQ ID NO: 275842 - RNA, 22 nt, Homo sapiens
uugccuuuguuggaaacaagug

SEQ ID NO: 275843 - RNA, 22 nt, Homo sapiens
uugcuacauugauugccucuuu

SEQ ID NO: 275844 - RNA, 22 nt, Homo sapiens
uugcucaccugagaagaauaga

SEQ ID NO: 275845 - RNA, 22 nt, Homo sapiens
uuggaagcacauuguuuaauua

SEQ ID NO: 275846 - RNA, 22 nt, Homo sapiens
uuggaaggcuccuaaugaaugg

SEQ ID NO: 275847 - RNA, 22 nt, Homo sapiens
uuggcaaguccccaccucucuc

SEQ ID NO: 275848 - RNA, 22 nt, Homo sapiens
uuggcaaucaauucugacgucu

SEQ ID NO: 275849 - RNA, 22 nt, Homo sapiens
uuggcacugagcaagaacaggg

SEQ ID NO: 275850 - RNA, 20 nt, Homo sapiens
uuggcagagucuuuagggua

SEQ ID NO: 275851 - RNA, 22 nt, Homo sapiens
uuggcagcacgcaguccagagg

SEQ ID NO: 275852 - RNA, 22 nt, Homo sapiens
uuggcagucugaggcacagacu

SEQ ID NO: 275853 - RNA, 22 nt, Homo sapiens
uuggcauuuauucuaaggucaa

SEQ ID NO: 275854 - RNA, 22 nt, Homo sapiens
uuggccaauggugauucccggc

SEQ ID NO: 275855 - RNA, 22 nt, Homo sapiens
uuggccccuuucauccacagcu

SEQ ID NO: 275856 - RNA, 22 nt, Homo sapiens
uuggccuuuucaaugccucuuu

SEQ ID NO: 275857 - RNA, 22 nt, Homo sapiens
uuggcuaagaucacgugagaau

SEQ ID NO: 275858 - RNA, 22 nt, Homo sapiens
uuggcuucuggacuauugugca

SEQ ID NO: 275859 - RNA, 22 nt, Homo sapiens
uugggucaguuccuugacuccu

SEQ ID NO: 275860 - RNA, 22 nt, Homo sapiens
uuggucagcucaauggagaggg

SEQ ID NO: 275861 - RNA, 22 nt, Homo sapiens
uuguaauguuaggguguccaug

SEQ ID NO: 275862 - RNA, 22 nt, Homo sapiens
uugucacugcacuccagucugg

SEQ ID NO: 275863 - RNA, 21 nt, Homo sapiens
uuguccccacccaaaucucau

SEQ ID NO: 275864 - RNA, 22 nt, Homo sapiens
uugugaucauugucaaauagug

SEQ ID NO: 275865 - RNA, 22 nt, Homo sapiens
uugugcaaaguugugguuucug

SEQ ID NO: 275866 - RNA, 22 nt, Homo sapiens
uugugguaggaguugccauguu

SEQ ID NO: 275867 - RNA, 22 nt, Homo sapiens
uuguugcacugcuuuccuggcc

SEQ ID NO: 275868 - RNA, 22 nt, Homo sapiens
uuuaaacugucuuggguuugga

SEQ ID NO: 275869 - RNA, 22 nt, Homo sapiens
uuuaaagcacggaguuuguggc

SEQ ID NO: 275870 - RNA, 22 nt, Homo sapiens
uuuaaagcaugacgagaagaag

SEQ ID NO: 275871 - RNA, 22 nt, Homo sapiens
uuuaacauuggaugagaucguc

SEQ ID NO: 275872 - RNA, 22 nt, Homo sapiens
uuuaaggcaugccuguacaugc

SEQ ID NO: 275873 - RNA, 22 nt, Homo sapiens
uuuaauacugcaucuuuacucu

SEQ ID NO: 275874 - RNA, 22 nt, Homo sapiens
uuuaugucuguacaucgggcgg

SEQ ID NO: 275875 - RNA, 22 nt, Homo sapiens
uuucacagagggcuucuuucua

SEQ ID NO: 275876 - RNA, 22 nt, Homo sapiens
uuucacagcaauugccuauugu

SEQ ID NO: 275877 - RNA, 17 nt, Homo sapiens
uuucagaguggaagugu

SEQ ID NO: 275878 - RNA, 22 nt, Homo sapiens
uuucagguauuuaagggccguu

SEQ ID NO: 275879 - RNA, 22 nt, Homo sapiens
uuucaucaagcacagaguagau

SEQ ID NO: 275880 - RNA, 22 nt, Homo sapiens
uuuccacauggacuuaccuucg

SEQ ID NO: 275881 - RNA, 22 nt, Homo sapiens
uuuccagguggccaacauuuua

SEQ ID NO: 275882 - RNA, 22 nt, Homo sapiens
uuuccaguuggaaagccuguuu

SEQ ID NO: 275883 - RNA, 22 nt, Homo sapiens
uuucccagugguacaguuuaua

SEQ ID NO: 275884 - RNA, 22 nt, Homo sapiens
uuucucaguguuucaggguagg

SEQ ID NO: 275885 - RNA, 22 nt, Homo sapiens
uuucuuggagcucuuagggucg

SEQ ID NO: 275886 - RNA, 22 nt, Homo sapiens
uuugagaaugcuaccagagaag

SEQ ID NO: 275887 - RNA, 22 nt, Homo sapiens
uuugagauaucuuccaucagua

SEQ ID NO: 275888 - RNA, 22 nt, Homo sapiens
uuugagaucuuuagaaucaggc

SEQ ID NO: 275889 - RNA, 22 nt, Homo sapiens
uuugagcauuagggcaaaggca

SEQ ID NO: 275890 - RNA, 22 nt, Homo sapiens
uuugauguugagacuauaaagc

SEQ ID NO: 275891 - RNA, 22 nt, Homo sapiens
uuugcaagaugaaaaaguucua

SEQ ID NO: 275892 - RNA, 22 nt, Homo sapiens
uuugcaucuuagaaaguucucc

SEQ ID NO: 275893 - RNA, 22 nt, Homo sapiens
uuugcaucuuuugcuuccugga

SEQ ID NO: 275894 - RNA, 22 nt, Homo sapiens
uuugcugagucugacuucaugg

SEQ ID NO: 275895 - RNA, 22 nt, Homo sapiens
uuuggcaaagaucaacauguua

SEQ ID NO: 275896 - RNA, 22 nt, Homo sapiens
uuuggcaacguuggaucccuca

SEQ ID NO: 275897 - RNA, 22 nt, Homo sapiens
uuuggcaauaaacuccccuaac

SEQ ID NO: 275898 - RNA, 22 nt, Homo sapiens
uuuggcacuauagguaaauuug

SEQ ID NO: 275899 - RNA, 22 nt, Homo sapiens
uuuggcaguuauuuacucagug

SEQ ID NO: 275900 - RNA, 22 nt, Homo sapiens
uuuggcauuagagagacuugca

SEQ ID NO: 275901 - RNA, 22 nt, Homo sapiens
uuugggccaugguuuguguaua

SEQ ID NO: 275902 - RNA, 22 nt, Homo sapiens
uuuguacacuguugguaggauu

SEQ ID NO: 275903 - RNA, 22 nt, Homo sapiens
uuuguauguuggagauuggaga

SEQ ID NO: 275904 - RNA, 22 nt, Homo sapiens
ggaguguguuuuccaacuuggu

SEQ ID NO: 275905 - RNA, 23 nt, Homo sapiens
ggauggaaaguuuugagggccac

SEQ ID NO: 275906 - RNA, 22 nt, Homo sapiens
ggauuagagauguuauuaagag

SEQ ID NO: 275907 - RNA, 19 nt, Homo sapiens
ggcaagaguuguucugugu

SEQ ID NO: 275908 - RNA, 22 nt, Homo sapiens
ggcaagugggagggaguguuuc

SEQ ID NO: 275909 - RNA, 19 nt, Homo sapiens
ggcacugugugagugagga

SEQ ID NO: 275910 - RNA, 22 nt, Homo sapiens
ggcagaauugcugaggaugcua

SEQ ID NO: 275911 - RNA, 22 nt, Homo sapiens
ggcagcucaggccccgcgcuga

SEQ ID NO: 275912 - RNA, 17 nt, Homo sapiens
ggcaggaauuaauguca

SEQ ID NO: 275913 - RNA, 22 nt, Homo sapiens
ggcagguaaggagugggagccu

SEQ ID NO: 275914 - RNA, 22 nt, Homo sapiens
ggcaugguggugugugccuaua

SEQ ID NO: 275915 - RNA, 22 nt, Homo sapiens
ggcauugugauccaccagccuu

SEQ ID NO: 275916 - RNA, 22 nt, Homo sapiens
ggcuagaauagggauagaccuu

SEQ ID NO: 275917 - RNA, 22 nt, Homo sapiens
ggcuagagagcucagggauaug

SEQ ID NO: 275918 - RNA, 22 nt, Homo sapiens
ggcucaguugcaaaucaguuca

SEQ ID NO: 275919 - RNA, 22 nt, Homo sapiens
gggaagauauaggcugggcacc

SEQ ID NO: 275920 - RNA, 22 nt, Homo sapiens
gggaggucauuguaaggucuua

SEQ ID NO: 275921 - RNA, 22 nt, Homo sapiens
gggagugucuaaccuguuaaca

SEQ ID NO: 275922 - RNA, 20 nt, Homo sapiens
gggcaaguaugugggaaguc

SEQ ID NO: 275923 - RNA, 16 nt, Homo sapiens
gggcaugugaagccua

SEQ ID NO: 275924 - RNA, 22 nt, Homo sapiens
ggucaguuuucuccaggaucca

SEQ ID NO: 275925 - RNA, 22 nt, Homo sapiens
ggucauggagcuuuacuuuaug

SEQ ID NO: 275926 - RNA, 22 nt, Homo sapiens
ggugagauguucagacgaacug

SEQ ID NO: 275927 - RNA, 22 nt, Homo sapiens
ggugagguaguaagguacaaua

SEQ ID NO: 275928 - RNA, 22 nt, Homo sapiens
gguggcuuuuugugauggcuga

SEQ ID NO: 275929 - RNA, 22 nt, Homo sapiens
gguguguaaauuacuuaucucu

SEQ ID NO: 275930 - RNA, 22 nt, Homo sapiens
guaaucucagcuucuugggagg

SEQ ID NO: 275931 - RNA, 19 nt, Homo sapiens
guaaucucaguacuuuggu

SEQ ID NO: 275932 - RNA, 22 nt, Homo sapiens
guaaugaacuugaaagccuguu

SEQ ID NO: 275933 - RNA, 22 nt, Homo sapiens
guaccucaguuggaaaugcaga

SEQ ID NO: 275934 - RNA, 22 nt, Homo sapiens
guagcagcuacuaaguugcugu

SEQ ID NO: 275935 - RNA, 22 nt, Homo sapiens
guaguggcaugaucuuggcuca

SEQ ID NO: 275936 - RNA, 22 nt, Homo sapiens
guauagcaaugccccacaccug

SEQ ID NO: 275937 - RNA, 22 nt, Homo sapiens
guauaggcuuucaccacgccau

SEQ ID NO: 275938 - RNA, 22 nt, Homo sapiens
guaugucuugucuauggcugcu

SEQ ID NO: 275939 - RNA, 19 nt, Homo sapiens
guauuugguaaacucucca

SEQ ID NO: 275940 - RNA, 22 nt, Homo sapiens
gucacuguggagaagaaagugg

SEQ ID NO: 275941 - RNA, 22 nt, Homo sapiens
gucaguuugguuaaucauucca

SEQ ID NO: 275942 - RNA, 22 nt, Homo sapiens
gucauugucaauugacaauugu

SEQ ID NO: 275943 - RNA, 22 nt, Homo sapiens
guccagagaagucauuacuuca

SEQ ID NO: 275944 - RNA, 22 nt, Homo sapiens
gucgguguuuccugagaacgaa

SEQ ID NO: 275945 - RNA, 18 nt, Homo sapiens
gucucacaugguggaagc

SEQ ID NO: 275946 - RNA, 22 nt, Homo sapiens
gucucccagccuacaucuuucu

SEQ ID NO: 275947 - RNA, 22 nt, Homo sapiens
gucuggcaauggcagacuggca

SEQ ID NO: 275948 - RNA, 22 nt, Homo sapiens
gucuuggagacauugccauuga

SEQ ID NO: 275949 - RNA, 22 nt, Homo sapiens
gugaaauguguagaggaucugg

SEQ ID NO: 275950 - RNA, 22 nt, Homo sapiens
gugacugcauccauccaggcuu

SEQ ID NO: 275951 - RNA, 22 nt, Homo sapiens
gugagauacuagagauauagug

SEQ ID NO: 275952 - RNA, 22 nt, Homo sapiens
gugagaugauggguauguuaau

SEQ ID NO: 275953 - RNA, 22 nt, Homo sapiens
gugagauggaguuggugucuuu

SEQ ID NO: 275954 - RNA, 22 nt, Homo sapiens
gugagcauucaaggaaggagcu

SEQ ID NO: 275955 - RNA, 22 nt, Homo sapiens
gugagcuaagcaaauaugagcc

SEQ ID NO: 275956 - RNA, 22 nt, Homo sapiens
gugagguaagaguugcuuugcu

SEQ ID NO: 275957 - RNA, 20 nt, Homo sapiens
gugagguagaggguuaccug

SEQ ID NO: 275958 - RNA, 22 nt, Homo sapiens
uucauaguucuuuuagucauua

SEQ ID NO: 275959 - RNA, 22 nt, Homo sapiens
uucaucaguugagcugguugcu

SEQ ID NO: 275960 - RNA, 22 nt, Homo sapiens
uucauguaauuccauaagguaa

SEQ ID NO: 275961 - RNA, 22 nt, Homo sapiens
uuccagagucaccuuucugucg

SEQ ID NO: 275962 - RNA, 22 nt, Homo sapiens
uuccaguguguucauccucaga

SEQ ID NO: 275963 - RNA, 22 nt, Homo sapiens
uucccagagagggacuucuaau

SEQ ID NO: 275964 - RNA, 22 nt, Homo sapiens
uucccaguggaacauguaguca

SEQ ID NO: 275965 - RNA, 20 nt, Homo sapiens
uucccucagccuugagggua

SEQ ID NO: 275966 - RNA, 22 nt, Homo sapiens
uuccuacugcccauuaaaaugg

SEQ ID NO: 275967 - RNA, 22 nt, Homo sapiens
uuccugagaucagaauucaaau

SEQ ID NO: 275968 - RNA, 22 nt, Homo sapiens
uucgagagaaaaggcauauaug

SEQ ID NO: 275969 - RNA, 20 nt, Homo sapiens
uucuacagucacaggaagau

SEQ ID NO: 275970 - RNA, 22 nt, Homo sapiens
uucuagcacuuugggagacuga

SEQ ID NO: 275971 - RNA, 20 nt, Homo sapiens
uucuauggugaugaguccug

SEQ ID NO: 275972 - RNA, 22 nt, Homo sapiens
uucucagugaacuccagcuugu

SEQ ID NO: 275973 - RNA, 22 nt, Homo sapiens
uucugcacaucgaucacaagau

SEQ ID NO: 275974 - RNA, 22 nt, Homo sapiens
uucuggcucgauucucugaccg

SEQ ID NO: 275975 - RNA, 22 nt, Homo sapiens
uucuugguuuaucgcuuuaaaa

SEQ ID NO: 275976 - RNA, 22 nt, Homo sapiens
uucuuuggauaaaguuuuaugc

SEQ ID NO: 275977 - RNA, 23 nt, Homo sapiens
uugaaaagucaguagccucugau

SEQ ID NO: 275978 - RNA, 22 nt, Homo sapiens
uugaaagcuaucucaaaucgcu

SEQ ID NO: 275979 - RNA, 22 nt, Homo sapiens
uugaaagucuaggcuuacagua

SEQ ID NO: 275980 - RNA, 22 nt, Homo sapiens
uugaaauguguaagcuccgaaa

SEQ ID NO: 275981 - RNA, 22 nt, Homo sapiens
uugaaugucuauuaaguuguuu

SEQ ID NO: 275982 - RNA, 22 nt, Homo sapiens
uugagaagugucuguucauguc

SEQ ID NO: 275983 - RNA, 22 nt, Homo sapiens
uugagauacauaauuaugaaug

SEQ ID NO: 275984 - RNA, 22 nt, Homo sapiens
uugagauaggaacucacuaugc

SEQ ID NO: 275985 - RNA, 22 nt, Homo sapiens
uugagauaggagcuguuguucu

SEQ ID NO: 275986 - RNA, 22 nt, Homo sapiens
uugagauagggucuaccucugu

SEQ ID NO: 275987 - RNA, 22 nt, Homo sapiens
uugagauaucuuggccuuugca

SEQ ID NO: 275988 - RNA, 22 nt, Homo sapiens
uugagauggagcuucacucuug

SEQ ID NO: 275989 - RNA, 22 nt, Homo sapiens
uugagauggagucucacucugu

SEQ ID NO: 275990 - RNA, 22 nt, Homo sapiens
uugagauggagucucacucuug

SEQ ID NO: 275991 - RNA, 22 nt, Homo sapiens
uugagauggagucucgcucuuu

SEQ ID NO: 275992 - RNA, 22 nt, Homo sapiens
uugagauggagucuuguucucu

SEQ ID NO: 275993 - RNA, 22 nt, Homo sapiens
uugagauggagucuuguucuuu

SEQ ID NO: 275994 - RNA, 22 nt, Homo sapiens
uugagauggaguuucaauauug

SEQ ID NO: 275995 - RNA, 22 nt, Homo sapiens
uugagauggaguuucacucucg

SEQ ID NO: 275996 - RNA, 22 nt, Homo sapiens
uugagauggaguuucacucugu

SEQ ID NO: 275997 - RNA, 22 nt, Homo sapiens
uugagauggaguuucacucuug

SEQ ID NO: 275998 - RNA, 22 nt, Homo sapiens
uugagauggaguuucgcucuuu

SEQ ID NO: 275999 - RNA, 22 nt, Homo sapiens
uugagauguggcaguuuaugag

SEQ ID NO: 276000 - RNA, 22 nt, Homo sapiens
uugagcaaaacauuaauauuag

SEQ ID NO: 276001 - RNA, 22 nt, Homo sapiens
uugagcccuggaggcagaggcu

SEQ ID NO: 276002 - RNA, 22 nt, Homo sapiens
uugagcucaucaagauagagaa

SEQ ID NO: 276003 - RNA, 22 nt, Homo sapiens
uugagcuuuuuacuuguccaau

SEQ ID NO: 276004 - RNA, 22 nt, Homo sapiens
uugaggacugcuaagcauuuga

SEQ ID NO: 276005 - RNA, 22 nt, Homo sapiens
uugaggacugguugaaagcuuu

SEQ ID NO: 276006 - RNA, 22 nt, Homo sapiens
uugagggaggccucaguuuaca

SEQ ID NO: 276007 - RNA, 22 nt, Homo sapiens
uugaguagauaccuaggaauag

SEQ ID NO: 276008 - RNA, 22 nt, Homo sapiens
uugaguaguaagugguucaccg

SEQ ID NO: 276009 - RNA, 22 nt, Homo sapiens
uugaguuuaucuaaagaccugg

SEQ ID NO: 276010 - RNA, 22 nt, Homo sapiens
uugaguuugaguauucuaaagc

SEQ ID NO: 276011 - RNA, 22 nt, Homo sapiens
uugcaaacaucuuguuucacau

SEQ ID NO: 276012 - RNA, 22 nt, Homo sapiens
uugcaaagaccucuucacuucc

SEQ ID NO: 276013 - RNA, 22 nt, Homo sapiens
uugcaacauuguaaguuuauau

SEQ ID NO: 276014 - RNA, 22 nt, Homo sapiens
uugcaagaaaucagagccuucc

SEQ ID NO: 276015 - RNA, 22 nt, Homo sapiens
uugcacagugcuuucuuugccc

SEQ ID NO: 276016 - RNA, 22 nt, Homo sapiens
uugcacucugaagaccuacugu

SEQ ID NO: 276017 - RNA, 22 nt, Homo sapiens
uugcaggugguuuaugcaagac

SEQ ID NO: 276018 - RNA, 22 nt, Homo sapiens
uugccacuucucuugccccauu

SEQ ID NO: 276019 - RNA, 22 nt, Homo sapiens
uugccuaggcuggaguguggug

SEQ ID NO: 276020 - RNA, 22 nt, Homo sapiens
uugccugagaagccaagaauaa

SEQ ID NO: 276021 - RNA, 22 nt, Homo sapiens
uugcuauguugcccagucugga

SEQ ID NO: 276022 - RNA, 22 nt, Homo sapiens
uugcuccccaggaaaggaagca

SEQ ID NO: 276023 - RNA, 22 nt, Homo sapiens
uugcuccucugccaggaccugu

SEQ ID NO: 276024 - RNA, 22 nt, Homo sapiens
uuggaaagagguguuuaugacu

SEQ ID NO: 276025 - RNA, 22 nt, Homo sapiens
uuggaaaugguaaaggguuaau

SEQ ID NO: 276026 - RNA, 22 nt, Homo sapiens
uuggaauguacucuagccuaug

SEQ ID NO: 276027 - RNA, 22 nt, Homo sapiens
uuggcaagaauguaugccgauc

SEQ ID NO: 276028 - RNA, 22 nt, Homo sapiens
uuggcauaguugcacuuacuag

SEQ ID NO: 276029 - RNA, 20 nt, Homo sapiens
uuggcauuuagacaagaguu

SEQ ID NO: 276030 - RNA, 22 nt, Homo sapiens
uuggccagugucuuuuuuuccu

SEQ ID NO: 276031 - RNA, 22 nt, Homo sapiens
uugggagugucucuggacugca

SEQ ID NO: 276032 - RNA, 22 nt, Homo sapiens
uugggcaauaggaagcaggugg

SEQ ID NO: 276033 - RNA, 22 nt, Homo sapiens
uuggggcacggccucuguugcc

SEQ ID NO: 276034 - RNA, 22 nt, Homo sapiens
uugguauguguuucauacucaa

SEQ ID NO: 276035 - RNA, 22 nt, Homo sapiens
uuguaaagucugucucagucag

SEQ ID NO: 276036 - RNA, 22 nt, Homo sapiens
uuguaacaguucugcgagcagc

SEQ ID NO: 276037 - RNA, 23 nt, Homo sapiens
uuguaacuggagaguaacauucc

SEQ ID NO: 276038 - RNA, 22 nt, Homo sapiens
uuguauacucuauuuuagcagu

SEQ ID NO: 276039 - RNA, 22 nt, Homo sapiens
uuguauugucuugaugaguuga

SEQ ID NO: 276040 - RNA, 22 nt, Homo sapiens
uugucaaugggugagugcagag

SEQ ID NO: 276041 - RNA, 22 nt, Homo sapiens
uugugaucuucagaaaguggcu

SEQ ID NO: 276042 - RNA, 22 nt, Homo sapiens
uugugcaaaaguaauugcgguu

SEQ ID NO: 276043 - RNA, 18 nt, Homo sapiens
uugugccugagaaggugg

SEQ ID NO: 276044 - RNA, 22 nt, Homo sapiens
uugugccugguacauggagaaa

SEQ ID NO: 276045 - RNA, 22 nt, Homo sapiens
uugugcuucaucaccuagcaga

SEQ ID NO: 276046 - RNA, 16 nt, Homo sapiens
uuguggcuuuugcaca

SEQ ID NO: 276047 - RNA, 22 nt, Homo sapiens
uugugguaggcauguaagauga

SEQ ID NO: 276048 - RNA, 20 nt, Homo sapiens
uuuaagacaugcugaauuga

SEQ ID NO: 276049 - RNA, 22 nt, Homo sapiens
uuuaaugcgucucugaguuuug

SEQ ID NO: 276050 - RNA, 22 nt, Homo sapiens
uuuaaugcugcccagucauggg

SEQ ID NO: 276051 - RNA, 22 nt, Homo sapiens
uuuagcaauucauuuugugucu

SEQ ID NO: 276052 - RNA, 22 nt, Homo sapiens
uuuaggcaauauauucaugucu

SEQ ID NO: 276053 - RNA, 22 nt, Homo sapiens
uuuaggcaugcaguucuauuua

SEQ ID NO: 276054 - RNA, 22 nt, Homo sapiens
uuuaucuguuuaaaacuguuca

SEQ ID NO: 276055 - RNA, 22 nt, Homo sapiens
uuuauggagagauauuuauggu

SEQ ID NO: 276056 - RNA, 22 nt, Homo sapiens
uuuauugcucuaaaguugccau

SEQ ID NO: 276057 - RNA, 19 nt, Homo sapiens
uuucaauguaaggauggag

SEQ ID NO: 276058 - RNA, 22 nt, Homo sapiens
uuucaguguggcaggcauagcu

SEQ ID NO: 276059 - RNA, 22 nt, Homo sapiens
uuucauggaauauagucauuuu

SEQ ID NO: 276060 - RNA, 22 nt, Homo sapiens
auggcacuacugggaaugucuu

SEQ ID NO: 276061 - RNA, 22 nt, Homo sapiens
auggcagcugacacuuccgucu

SEQ ID NO: 276062 - RNA, 22 nt, Homo sapiens
auggcaguguaugauuauauua

SEQ ID NO: 276063 - RNA, 22 nt, Homo sapiens
auggcauggugaagucuuugga

SEQ ID NO: 276064 - RNA, 22 nt, Homo sapiens
auggcccugggaaaggaggcau

SEQ ID NO: 276065 - RNA, 22 nt, Homo sapiens
auggccuaugacagguauguug

SEQ ID NO: 276066 - RNA, 22 nt, Homo sapiens
auggccugaugcaccuguccca

SEQ ID NO: 276067 - RNA, 22 nt, Homo sapiens
auggcucaauucuuucccugaa

SEQ ID NO: 276068 - RNA, 22 nt, Homo sapiens
auggcuucuucuaaaagugggg

SEQ ID NO: 276069 - RNA, 22 nt, Homo sapiens
augggcuaguaaagacaaacuu

SEQ ID NO: 276070 - RNA, 22 nt, Homo sapiens
augggguagguagcucggggaa

SEQ ID NO: 276071 - RNA, 21 nt, Homo sapiens
augguacugucucuggagaua

SEQ ID NO: 276072 - RNA, 22 nt, Homo sapiens
auggucccuguuccaugcuccu

SEQ ID NO: 276073 - RNA, 22 nt, Homo sapiens
auguccaugagcacauguauca

SEQ ID NO: 276074 - RNA, 22 nt, Homo sapiens
augugacagugguuuuaagcgu

SEQ ID NO: 276075 - RNA, 22 nt, Homo sapiens
augugccauucucauggcgcuu

SEQ ID NO: 276076 - RNA, 22 nt, Homo sapiens
augugcuaguaucaaacgagac

SEQ ID NO: 276077 - RNA, 22 nt, Homo sapiens
auguggcuuuucaacuguguga

SEQ ID NO: 276078 - RNA, 22 nt, Homo sapiens
auguugcuugaaggcauuuugu

SEQ ID NO: 276079 - RNA, 22 nt, Homo sapiens
auguuugguaagaauauuguua

SEQ ID NO: 276080 - RNA, 23 nt, Homo sapiens
auuaagguuacuacaguaugagg

SEQ ID NO: 276081 - RNA, 22 nt, Homo sapiens
auuaagugcuugcagaagucca

SEQ ID NO: 276082 - RNA, 22 nt, Homo sapiens
auuaaguuaggauuuugagaua

SEQ ID NO: 276083 - RNA, 22 nt, Homo sapiens
auuacauagucaaggugucuca

SEQ ID NO: 276084 - RNA, 22 nt, Homo sapiens
auuagguuggugcaaaaguaau

SEQ ID NO: 276085 - RNA, 22 nt, Homo sapiens
auucacagggggagaaggguau

SEQ ID NO: 276086 - RNA, 22 nt, Homo sapiens
auugaacuuaaaagacuugcca

SEQ ID NO: 276087 - RNA, 22 nt, Homo sapiens
auugacaguuggccaguaagug

SEQ ID NO: 276088 - RNA, 22 nt, Homo sapiens
auugagcaauuccuaugugcuu

SEQ ID NO: 276089 - RNA, 18 nt, Homo sapiens
auugagcaugacagaccu

SEQ ID NO: 276090 - RNA, 22 nt, Homo sapiens
auugaguaacaauuuuguucaa

SEQ ID NO: 276091 - RNA, 22 nt, Homo sapiens
auugcacuccagccugggcagc

SEQ ID NO: 276092 - RNA, 22 nt, Homo sapiens
auugcacugcagccugggcaac

SEQ ID NO: 276093 - RNA, 18 nt, Homo sapiens
auugcccucauggggcuu

SEQ ID NO: 276094 - RNA, 22 nt, Homo sapiens
auugcuuuuacugggagcuuug

SEQ ID NO: 276095 - RNA, 22 nt, Homo sapiens
auuggcaauccauauauuuucu

SEQ ID NO: 276096 - RNA, 22 nt, Homo sapiens
auuggcaaucgucuccauuuuu

SEQ ID NO: 276097 - RNA, 22 nt, Homo sapiens
auuggcuuuugaaagucugcga

SEQ ID NO: 276098 - RNA, 22 nt, Homo sapiens
auuggguuaaaggauaugaaca

SEQ ID NO: 276099 - RNA, 22 nt, Homo sapiens
auuguacuagguccuagggcuu

SEQ ID NO: 276100 - RNA, 22 nt, Homo sapiens
auuguacuccagccugggcagc

SEQ ID NO: 276101 - RNA, 22 nt, Homo sapiens
auuguacuccagccugggcuaa

SEQ ID NO: 276102 - RNA, 22 nt, Homo sapiens
auuguacuccagccugggcugc

SEQ ID NO: 276103 - RNA, 22 nt, Homo sapiens
auuguacucuagccucugggca

SEQ ID NO: 276104 - RNA, 22 nt, Homo sapiens
auuguucuuguguccuuuuccu

SEQ ID NO: 276105 - RNA, 19 nt, Homo sapiens
auuugaucaucaggcacag

SEQ ID NO: 276106 - RNA, 22 nt, Homo sapiens
auuuggcaacguagggaggcau

SEQ ID NO: 276107 - RNA, 22 nt, Homo sapiens
auuugguuauucaguuguucag

SEQ ID NO: 276108 - RNA, 22 nt, Homo sapiens
auuuuugguugguaggcuauua

SEQ ID NO: 276109 - RNA, 22 nt, Homo sapiens
caaagugcuggaauuggccggg

SEQ ID NO: 276110 - RNA, 22 nt, Homo sapiens
caagagagcugaugguuuuaaa

SEQ ID NO: 276111 - RNA, 22 nt, Homo sapiens
caaguguuggcuuguauacaaa

SEQ ID NO: 276112 - RNA, 22 nt, Homo sapiens
cacaaaguagauuagucuucca

SEQ ID NO: 276113 - RNA, 22 nt, Homo sapiens
cacauagcuagucaguagugaa

SEQ ID NO: 276114 - RNA, 22 nt, Homo sapiens
caccagcuggcauugaauaccu

SEQ ID NO: 276115 - RNA, 22 nt, Homo sapiens
caccuguacauggcaguguccu

SEQ ID NO: 276116 - RNA, 18 nt, Homo sapiens
cacugagcccuucacucu

SEQ ID NO: 276117 - RNA, 22 nt, Homo sapiens
cacugcauccuugaccuucugg

SEQ ID NO: 276118 - RNA, 22 nt, Homo sapiens
cacugcauuacucaugagcaug

SEQ ID NO: 276119 - RNA, 22 nt, Homo sapiens
cagacagugucccgagucccug

SEQ ID NO: 276120 - RNA, 22 nt, Homo sapiens
cagacaugucuuguggccgugg

SEQ ID NO: 276121 - RNA, 22 nt, Homo sapiens
cagagagcuugcccuuguauau

SEQ ID NO: 276122 - RNA, 22 nt, Homo sapiens
caggaccucuugccuggaagcc

SEQ ID NO: 276123 - RNA, 19 nt, Homo sapiens
caguaucauugcacauagu

SEQ ID NO: 276124 - RNA, 22 nt, Homo sapiens
caguggaugauguuuucugugg

SEQ ID NO: 276125 - RNA, 22 nt, Homo sapiens
cauaaaucuuguugaauagcac

SEQ ID NO: 276126 - RNA, 18 nt, Homo sapiens
cauagcacuucagcacau

SEQ ID NO: 276127 - RNA, 22 nt, Homo sapiens
caucacacuuggauguaagaca

SEQ ID NO: 276128 - RNA, 22 nt, Homo sapiens
caucacagcaaguagggagugg

SEQ ID NO: 276129 - RNA, 22 nt, Homo sapiens
caugacacauguuuaccuaugu

SEQ ID NO: 276130 - RNA, 22 nt, Homo sapiens
caugccacugcacgccauccug

SEQ ID NO: 276131 - RNA, 22 nt, Homo sapiens
caugggacugucuuggcuauac

SEQ ID NO: 276132 - RNA, 21 nt, Homo sapiens
caugucacugcacucuagccu

SEQ ID NO: 276133 - RNA, 22 nt, Homo sapiens
cauuaguugaagugcagggaga

SEQ ID NO: 276134 - RNA, 20 nt, Homo sapiens
cauugcccuccagccugggc

SEQ ID NO: 276135 - RNA, 22 nt, Homo sapiens
cauugucccucaaugacuauga

SEQ ID NO: 276136 - RNA, 22 nt, Homo sapiens
ccacagucuaugcaacaagguc

SEQ ID NO: 276137 - RNA, 22 nt, Homo sapiens
ccacauuaccuugcuugcucca

SEQ ID NO: 276138 - RNA, 22 nt, Homo sapiens
ccacccuuccauucuuccucuu

SEQ ID NO: 276139 - RNA, 22 nt, Homo sapiens
ccacuguuuaaauggcugagga

SEQ ID NO: 276140 - RNA, 22 nt, Homo sapiens
ccagauguuuucauucagcaag

SEQ ID NO: 276141 - RNA, 22 nt, Homo sapiens
ccagccgggugcaguggcucac

SEQ ID NO: 276142 - RNA, 22 nt, Homo sapiens
ccaggguugagacccacugacu

SEQ ID NO: 276143 - RNA, 22 nt, Homo sapiens
ccagugucugacagacacggcg

SEQ ID NO: 276144 - RNA, 22 nt, Homo sapiens
ccaguuuucucacuguugcagu

SEQ ID NO: 276145 - RNA, 20 nt, Homo sapiens
ccaucaguccucucuuguuc

SEQ ID NO: 276146 - RNA, 23 nt, Homo sapiens
uacagcacacugaugggucuuga

SEQ ID NO: 276147 - RNA, 22 nt, Homo sapiens
uacaggaaugucagguugcugu

SEQ ID NO: 276148 - RNA, 22 nt, Homo sapiens
uacaggacuauagaacuuuccc

SEQ ID NO: 276149 - RNA, 22 nt, Homo sapiens
uacaguguuuugguauuccaca

SEQ ID NO: 276150 - RNA, 22 nt, Homo sapiens
uacauccauccugcugggcagu

SEQ ID NO: 276151 - RNA, 19 nt, Homo sapiens
uacaugcagcaggcacgca

SEQ ID NO: 276152 - RNA, 22 nt, Homo sapiens
uacauguauccauuguuuuugg

SEQ ID NO: 276153 - RNA, 22 nt, Homo sapiens
uaccacugccgagaaaacagau

SEQ ID NO: 276154 - RNA, 23 nt, Homo sapiens
uaccugagacuggguaauuaaua

SEQ ID NO: 276155 - RNA, 22 nt, Homo sapiens
uaccuuugucaguuacucaccu

SEQ ID NO: 276156 - RNA, 22 nt, Homo sapiens
uacucugcagagaugcauaaca

SEQ ID NO: 276157 - RNA, 22 nt, Homo sapiens
uagaagcacuaucccuccuagu

SEQ ID NO: 276158 - RNA, 18 nt, Homo sapiens
uagaauauaggucauucu

SEQ ID NO: 276159 - RNA, 22 nt, Homo sapiens
uagaauggaaggcauguuugcc

SEQ ID NO: 276160 - RNA, 22 nt, Homo sapiens
uagaauggaagguugagaagaa

SEQ ID NO: 276161 - RNA, 22 nt, Homo sapiens
uagacccauuguucagagagug

SEQ ID NO: 276162 - RNA, 21 nt, Homo sapiens
uagagagcaauaccuccagag

SEQ ID NO: 276163 - RNA, 21 nt, Homo sapiens
uagagcaacacacgcccucuc

SEQ ID NO: 276164 - RNA, 22 nt, Homo sapiens
uagagccauugcagauguuuga

SEQ ID NO: 276165 - RNA, 22 nt, Homo sapiens
uagaggaaggauuggaaacgca

SEQ ID NO: 276166 - RNA, 22 nt, Homo sapiens
uagaucaauuaauuguuacuug

SEQ ID NO: 276167 - RNA, 20 nt, Homo sapiens
uagcacacauguagaauagu

SEQ ID NO: 276168 - RNA, 22 nt, Homo sapiens
uagcaccuuagcauuucuagug

SEQ ID NO: 276169 - RNA, 22 nt, Homo sapiens
uagcagcauuuuuguagaguau

SEQ ID NO: 276170 - RNA, 22 nt, Homo sapiens
uagcagccaggaagggcuggcu

SEQ ID NO: 276171 - RNA, 22 nt, Homo sapiens
uagcaguaaagaaugugauguu

SEQ ID NO: 276172 - RNA, 22 nt, Homo sapiens
uagcaguaccccaguauccugg

SEQ ID NO: 276173 - RNA, 22 nt, Homo sapiens
uagcuucuccauagcuccaugu

SEQ ID NO: 276174 - RNA, 18 nt, Homo sapiens
uaggaacauugauuggag

SEQ ID NO: 276175 - RNA, 22 nt, Homo sapiens
uaggaaugaacgauuuauuggu

SEQ ID NO: 276176 - RNA, 22 nt, Homo sapiens
uaggcaaaugcaagaguagaac

SEQ ID NO: 276177 - RNA, 22 nt, Homo sapiens
uaggggcacacuucgguuagca

SEQ ID NO: 276178 - RNA, 22 nt, Homo sapiens
uaggucacugcucugugucuaa

SEQ ID NO: 276179 - RNA, 22 nt, Homo sapiens
uaguaucacaagguguacaccc

SEQ ID NO: 276180 - RNA, 22 nt, Homo sapiens
uauacaguaggcacucaguggc

SEQ ID NO: 276181 - RNA, 22 nt, Homo sapiens
uauagcaaugugccacucucug

SEQ ID NO: 276182 - RNA, 20 nt, Homo sapiens
uauagcaauuuuuuucuccu

SEQ ID NO: 276183 - RNA, 22 nt, Homo sapiens
uauaugauugguagacccugca

SEQ ID NO: 276184 - RNA, 22 nt, Homo sapiens
uaucaccuugcaggagcuauga

SEQ ID NO: 276185 - RNA, 22 nt, Homo sapiens
uaucaccuugcaguggaugcua

SEQ ID NO: 276186 - RNA, 22 nt, Homo sapiens
uauccacgugaaaaagauugaa

SEQ ID NO: 276187 - RNA, 21 nt, Homo sapiens
uaucccagucacaucuaccca

SEQ ID NO: 276188 - RNA, 22 nt, Homo sapiens
uaucuacauguagguauguaug

SEQ ID NO: 276189 - RNA, 20 nt, Homo sapiens
uaugacacugucauaaaaau

SEQ ID NO: 276190 - RNA, 22 nt, Homo sapiens
uauggccccuacaugugcaaaa

SEQ ID NO: 276191 - RNA, 22 nt, Homo sapiens
uauggcuuuguuaacauuuucu

SEQ ID NO: 276192 - RNA, 22 nt, Homo sapiens
uaugucacuugguuuggugcua

SEQ ID NO: 276193 - RNA, 22 nt, Homo sapiens
uauuacacuuuagugucuucca

SEQ ID NO: 276194 - RNA, 22 nt, Homo sapiens
uauuacagaccauaucgccggg

SEQ ID NO: 276195 - RNA, 20 nt, Homo sapiens
uauuacagaguaauggugga

SEQ ID NO: 276196 - RNA, 22 nt, Homo sapiens
uauuagguuggugcaaaaguua

SEQ ID NO: 276197 - RNA, 22 nt, Homo sapiens
uauuaguuuucuguggauuaca

SEQ ID NO: 276198 - RNA, 22 nt, Homo sapiens
uauugacauuacagugggucuu

SEQ ID NO: 276199 - RNA, 22 nt, Homo sapiens
uauugauuaauugugauuaggc

SEQ ID NO: 276200 - RNA, 22 nt, Homo sapiens
uauuucaguugugcagguaguu

SEQ ID NO: 276201 - RNA, 22 nt, Homo sapiens
uauuugguuggugcaaaaguaa

SEQ ID NO: 276202 - RNA, 22 nt, Homo sapiens
ucaaacauccccaccagggacu

SEQ ID NO: 276203 - RNA, 22 nt, Homo sapiens
ucagaucuucagcaggggcccc

SEQ ID NO: 276204 - RNA, 22 nt, Homo sapiens
ucagaugaugucccuguucuaa

SEQ ID NO: 276205 - RNA, 21 nt, Homo sapiens
ucagcucaucacugccuggag

SEQ ID NO: 276206 - RNA, 21 nt, Homo sapiens
ucaggcuuuuugagugccaau

SEQ ID NO: 276207 - RNA, 22 nt, Homo sapiens
ucaggugcaguggcucaugcuu

SEQ ID NO: 276208 - RNA, 22 nt, Homo sapiens
ucagguugcuaaguauaauauu

SEQ ID NO: 276209 - RNA, 22 nt, Homo sapiens
ucagucauucaauuguugaaug

SEQ ID NO: 276210 - RNA, 22 nt, Homo sapiens
ucagucauucacucacucggac

SEQ ID NO: 276211 - RNA, 22 nt, Homo sapiens
ucagugguuaaaagauucuaga

SEQ ID NO: 276212 - RNA, 22 nt, Homo sapiens
ucauacuguugugaaacaaaac

SEQ ID NO: 276213 - RNA, 22 nt, Homo sapiens
ucaucagguaugucagcggagu

SEQ ID NO: 276214 - RNA, 22 nt, Homo sapiens
ucaucaguuuuuuauaugugau

SEQ ID NO: 276215 - RNA, 22 nt, Homo sapiens
ucaugguuuuauaacccucuug

SEQ ID NO: 276216 - RNA, 22 nt, Homo sapiens
ucaugucuuguuguauuuauuu

SEQ ID NO: 276217 - RNA, 22 nt, Homo sapiens
ucauuagagaucuuggggaaaa

SEQ ID NO: 276218 - RNA, 22 nt, Homo sapiens
ucauucauucuucaguggguac

SEQ ID NO: 276219 - RNA, 22 nt, Homo sapiens
uccagugugcaggcaaguuuga

SEQ ID NO: 276220 - RNA, 22 nt, Homo sapiens
uccaguuuggaggcuugaugug

SEQ ID NO: 276221 - RNA, 22 nt, Homo sapiens
uccauaguacuagaaacugacc

SEQ ID NO: 276222 - RNA, 22 nt, Homo sapiens
uccccugagucaccugcuucuc

SEQ ID NO: 276223 - RNA, 22 nt, Homo sapiens
uccccuuuguaagauggaaacg

SEQ ID NO: 276224 - RNA, 22 nt, Homo sapiens
ucccuacuggggcacugccuag

SEQ ID NO: 276225 - RNA, 22 nt, Homo sapiens
ucccuuagccaaauccccagcc

SEQ ID NO: 276226 - RNA, 22 nt, Homo sapiens
uccugcauucauccugguguug

SEQ ID NO: 276227 - RNA, 22 nt, Homo sapiens
uccuuugguggagucuuuaggg

SEQ ID NO: 276228 - RNA, 22 nt, Homo sapiens
uccuuuguuacaguuggcucug

SEQ ID NO: 276229 - RNA, 22 nt, Homo sapiens
ucuaaaacuagauugugaugau

SEQ ID NO: 276230 - RNA, 22 nt, Homo sapiens
ucuaaggcaccuagagucauca

SEQ ID NO: 276231 - RNA, 22 nt, Homo sapiens
ucucacacugaauguguguggg

SEQ ID NO: 276232 - RNA, 22 nt, Homo sapiens
ucucugauuaaacaagauagug

SEQ ID NO: 276233 - RNA, 22 nt, Homo sapiens
ucucuggauaucuacuuauguu

SEQ ID NO: 276234 - RNA, 22 nt, Homo sapiens
ucugacagugagagaaaucuga

SEQ ID NO: 276235 - RNA, 22 nt, Homo sapiens
ucugcauaucaugcagaacuau

SEQ ID NO: 276236 - RNA, 22 nt, Homo sapiens
ucuggcuccaaagucuauuuuu

SEQ ID NO: 276237 - RNA, 21 nt, Homo sapiens
ucuggcuuucauuccccuucu

SEQ ID NO: 276238 - RNA, 22 nt, Homo sapiens
ucuggcuuucuuuacuuaaugu

SEQ ID NO: 276239 - RNA, 23 nt, Homo sapiens
ucuggcuuugggaugcucaaggg

SEQ ID NO: 276240 - RNA, 22 nt, Homo sapiens
ucuggcuuugugaguugccaga

SEQ ID NO: 276241 - RNA, 22 nt, Homo sapiens
ucuggcuuuuaacaucuauaaa

SEQ ID NO: 276242 - RNA, 22 nt, Homo sapiens
ucugguggugaugagagacagu

SEQ ID NO: 276243 - RNA, 22 nt, Homo sapiens
ucuggugugcucuggacuugca

SEQ ID NO: 276244 - RNA, 22 nt, Homo sapiens
ucuuauggagaaaggugguugg

SEQ ID NO: 276245 - RNA, 22 nt, Homo sapiens
ucuucagucauauuggccugga

SEQ ID NO: 276246 - RNA, 22 nt, Homo sapiens
ucuugcaguucccaaauucaca

SEQ ID NO: 276247 - RNA, 22 nt, Homo sapiens
ucuugcuuuugcagagcuucuc

SEQ ID NO: 276248 - RNA, 22 nt, Homo sapiens
ucuuugagugcccugagucccu

SEQ ID NO: 276249 - RNA, 22 nt, Homo sapiens
ucuuugguagaagcuauuuuau

SEQ ID NO: 276250 - RNA, 22 nt, Homo sapiens
ucuuuggucaucaugggaagca

SEQ ID NO: 276251 - RNA, 22 nt, Homo sapiens
ucuuuggugaauggucauccag

SEQ ID NO: 276252 - RNA, 22 nt, Homo sapiens
ucuuugguugcacugcaggugu

SEQ ID NO: 276253 - RNA, 22 nt, Homo sapiens
ucuuuguguucaggagccacgu

SEQ ID NO: 276254 - RNA, 22 nt, Homo sapiens
ugaaauacuuuggcucuuuguu

SEQ ID NO: 276255 - RNA, 22 nt, Homo sapiens
ugaaaugcugucuaggggaaau

SEQ ID NO: 276256 - RNA, 22 nt, Homo sapiens
ugaacucauccuuucuuauggc

SEQ ID NO: 276257 - RNA, 22 nt, Homo sapiens
ugaagaucuuaggagcugaggg

SEQ ID NO: 276258 - RNA, 22 nt, Homo sapiens
ugaauauguuucuaaaagugca

SEQ ID NO: 276259 - RNA, 22 nt, Homo sapiens
ugaaugguuuuuagagaacaau

SEQ ID NO: 276260 - RNA, 22 nt, Homo sapiens
ugacaagacuacauaucccauu

SEQ ID NO: 276261 - RNA, 22 nt, Homo sapiens
ugacacuugcccuuagaaacau

SEQ ID NO: 276262 - RNA, 22 nt, Homo sapiens
ugacaugaagaaaaacagauuu

SEQ ID NO: 276263 - RNA, 22 nt, Homo sapiens
ugacauggagguggaggaagau

SEQ ID NO: 276264 - RNA, 22 nt, Homo sapiens
ugacauguagagaacuucucau

SEQ ID NO: 276265 - RNA, 22 nt, Homo sapiens
ugacauguccaggugguccugu

SEQ ID NO: 276266 - RNA, 22 nt, Homo sapiens
ugacuagagacagaaacuaaaa

SEQ ID NO: 276267 - RNA, 22 nt, Homo sapiens
ugacuaguuugaggacauuaua

SEQ ID NO: 276268 - RNA, 22 nt, Homo sapiens
ugagaaccucugugugcccacu

SEQ ID NO: 276269 - RNA, 22 nt, Homo sapiens
ugagaacuagagaacaagguga

SEQ ID NO: 276270 - RNA, 22 nt, Homo sapiens
ugagaacuuauggugauuuuuu

SEQ ID NO: 276271 - RNA, 22 nt, Homo sapiens
ugagaaugaugauugguaaacc

SEQ ID NO: 276272 - RNA, 22 nt, Homo sapiens
ugagaaugcagaaucucgugca

SEQ ID NO: 276273 - RNA, 22 nt, Homo sapiens
ugagacggagucucgcuguguc

SEQ ID NO: 276274 - RNA, 22 nt, Homo sapiens
ugagagaugaacuauucuugaa

SEQ ID NO: 276275 - RNA, 22 nt, Homo sapiens
ugagaggugauaaagcaagggu

SEQ ID NO: 276276 - RNA, 22 nt, Homo sapiens
ugagaguauaaauugaugcagc

SEQ ID NO: 276277 - RNA, 22 nt, Homo sapiens
ugagauagggucucacucuguc

SEQ ID NO: 276278 - RNA, 22 nt, Homo sapiens
ugagauaguacuuuuuuaaagg

SEQ ID NO: 276279 - RNA, 22 nt, Homo sapiens
gcaucacagggagacaggccuc

SEQ ID NO: 276280 - RNA, 20 nt, Homo sapiens
gcaugagucuuuauaguaga

SEQ ID NO: 276281 - RNA, 22 nt, Homo sapiens
gccagugugaugugaucauggc

SEQ ID NO: 276282 - RNA, 22 nt, Homo sapiens
gccauugcacuccagccuagcg

SEQ ID NO: 276283 - RNA, 22 nt, Homo sapiens
gccauugcacuccagccuaggc

SEQ ID NO: 276284 - RNA, 22 nt, Homo sapiens
gccauugcacuccagccuaggu

SEQ ID NO: 276285 - RNA, 22 nt, Homo sapiens
gccauugcacuccagccugagc

SEQ ID NO: 276286 - RNA, 22 nt, Homo sapiens
gccauugcacucuagccuaggu

SEQ ID NO: 276287 - RNA, 22 nt, Homo sapiens
gccccgggugaugcagccguca

SEQ ID NO: 276288 - RNA, 22 nt, Homo sapiens
gccccugagacuugccucgggc

SEQ ID NO: 276289 - RNA, 22 nt, Homo sapiens
gcccuguaguauaguuugaagu

SEQ ID NO: 276290 - RNA, 22 nt, Homo sapiens
gccuuuggugacaggcaugugu

SEQ ID NO: 276291 - RNA, 22 nt, Homo sapiens
gcuaggagauccacugcucucu

SEQ ID NO: 276292 - RNA, 22 nt, Homo sapiens
gcuccauuuuccauuucucuaa

SEQ ID NO: 276293 - RNA, 22 nt, Homo sapiens
gcugcuguggcagauuggauuc

SEQ ID NO: 276294 - RNA, 22 nt, Homo sapiens
gcuggaauuaacauagaugugc

SEQ ID NO: 276295 - RNA, 22 nt, Homo sapiens
gcuggcuuucuccugaucucag

SEQ ID NO: 276296 - RNA, 22 nt, Homo sapiens
gcuguguguuaucagaaauugc

SEQ ID NO: 276297 - RNA, 22 nt, Homo sapiens
gcuuuguuaaaacacagccaca

SEQ ID NO: 276298 - RNA, 18 nt, Homo sapiens
ggaaaacuuuucuaagua

SEQ ID NO: 276299 - RNA, 22 nt, Homo sapiens
ggaaauguuggugucaugaguu

SEQ ID NO: 276300 - RNA, 22 nt, Homo sapiens
ggaaggucaaagggaaagcaga

SEQ ID NO: 276301 - RNA, 21 nt, Homo sapiens
ggaauuuagggaaugauuuag

SEQ ID NO: 276302 - RNA, 22 nt, Homo sapiens
ggacuguacuccuggccagugu

SEQ ID NO: 276303 - RNA, 22 nt, Homo sapiens
ggacuguaguuucccgggcugg

SEQ ID NO: 276304 - RNA, 22 nt, Homo sapiens
ggagagugacauauuucuaggc

SEQ ID NO: 276305 - RNA, 22 nt, Homo sapiens
ggagaugauuaugaaucacuua

SEQ ID NO: 276306 - RNA, 22 nt, Homo sapiens
ggagauguuuaaccuuuuaucu

SEQ ID NO: 276307 - RNA, 22 nt, Homo sapiens
ggagguagguuugugauuugua

SEQ ID NO: 276308 - RNA, 20 nt, Homo sapiens
ggagguguugauuuuucuuu

SEQ ID NO: 276309 - RNA, 22 nt, Homo sapiens
ggagucugauguucuaaggcag

SEQ ID NO: 276310 - RNA, 22 nt, Homo sapiens
ggaguguaguggcuccaucucg

SEQ ID NO: 276311 - RNA, 22 nt, Homo sapiens
ggagugugauuguucucuguua

SEQ ID NO: 276312 - RNA, 22 nt, Homo sapiens
ggaguucaucaggugaggggua

SEQ ID NO: 276313 - RNA, 22 nt, Homo sapiens
ggauauguagggcauaucuaca

SEQ ID NO: 276314 - RNA, 22 nt, Homo sapiens
ggauggcauuucuuuagcuuuu

SEQ ID NO: 276315 - RNA, 22 nt, Homo sapiens
ggcaaagagacaugcaucgggg

SEQ ID NO: 276316 - RNA, 22 nt, Homo sapiens
ggcaaagaugaccauuacuuuu

SEQ ID NO: 276317 - RNA, 21 nt, Homo sapiens
ggcaagaaacacaaucaagua

SEQ ID NO: 276318 - RNA, 22 nt, Homo sapiens
ggcaagaaccucaauuaccuuu

SEQ ID NO: 276319 - RNA, 22 nt, Homo sapiens
ggcaagaggagauucugcuccc

SEQ ID NO: 276320 - RNA, 22 nt, Homo sapiens
ggcaaggugcuacagacaguga

SEQ ID NO: 276321 - RNA, 22 nt, Homo sapiens
ggcaaugaggcggaccagcagg

SEQ ID NO: 276322 - RNA, 22 nt, Homo sapiens
ggcacgguggcucacaccugua

SEQ ID NO: 276323 - RNA, 22 nt, Homo sapiens
ggcacugugaugugagggggua

SEQ ID NO: 276324 - RNA, 22 nt, Homo sapiens
ggcagcauugccuuugcaguga

SEQ ID NO: 276325 - RNA, 22 nt, Homo sapiens
ggcuagagacaaguugcugaga

SEQ ID NO: 276326 - RNA, 19 nt, Homo sapiens
ggcucagucaacugacugu

SEQ ID NO: 276327 - RNA, 22 nt, Homo sapiens
ggcuuuggucacacaggggcaa

SEQ ID NO: 276328 - RNA, 19 nt, Homo sapiens
gggaggaugcgucuucagg

SEQ ID NO: 276329 - RNA, 22 nt, Homo sapiens
gggaguagagaguuucucugac

SEQ ID NO: 276330 - RNA, 22 nt, Homo sapiens
gggcaagaagucuuguaguuuu

SEQ ID NO: 276331 - RNA, 22 nt, Homo sapiens
ggggcauugugucuggguuccu

SEQ ID NO: 276332 - RNA, 22 nt, Homo sapiens
gggggagugugguacccagcau

SEQ ID NO: 276333 - RNA, 22 nt, Homo sapiens
ggucacauugcuagcauggguu

SEQ ID NO: 276334 - RNA, 22 nt, Homo sapiens
ggucuagagagagggguggacu

SEQ ID NO: 276335 - RNA, 21 nt, Homo sapiens
ggugagaaaggagacauagac

SEQ ID NO: 276336 - RNA, 22 nt, Homo sapiens
ggugaggaaaguugaguuucua

SEQ ID NO: 276337 - RNA, 23 nt, Homo sapiens
ggugaggaguacagagucuucau

SEQ ID NO: 276338 - RNA, 22 nt, Homo sapiens
ggugcuugaggaacggaggcug

SEQ ID NO: 276339 - RNA, 22 nt, Homo sapiens
gguggcaaaucugaguggcgcu

SEQ ID NO: 276340 - RNA, 22 nt, Homo sapiens
guaaucucaccuacuugggagg

SEQ ID NO: 276341 - RNA, 22 nt, Homo sapiens
guaaucucagcuacuugggagc

SEQ ID NO: 276342 - RNA, 22 nt, Homo sapiens
guacacaacaugcagguuuguu

SEQ ID NO: 276343 - RNA, 22 nt, Homo sapiens
uggcuuuuauuauguugaggua

SEQ ID NO: 276344 - RNA, 22 nt, Homo sapiens
uggcuuuuccuugaaucugccu

SEQ ID NO: 276345 - RNA, 22 nt, Homo sapiens
uggcuuuuguuauuuggaagcu

SEQ ID NO: 276346 - RNA, 22 nt, Homo sapiens
ugggaaugaaauuacauagcuu

SEQ ID NO: 276347 - RNA, 22 nt, Homo sapiens
ugggaccccuacucuuuccaca

SEQ ID NO: 276348 - RNA, 22 nt, Homo sapiens
ugggaucaugagcaccgcuucc

SEQ ID NO: 276349 - RNA, 22 nt, Homo sapiens
ugggaugaauacaaugggauca

SEQ ID NO: 276350 - RNA, 22 nt, Homo sapiens
ugggaugaugaaaaggcuuucu

SEQ ID NO: 276351 - RNA, 22 nt, Homo sapiens
ugggcaaauugugagggaggua

SEQ ID NO: 276352 - RNA, 22 nt, Homo sapiens
ugggcaagugacuuggcuucuc

SEQ ID NO: 276353 - RNA, 22 nt, Homo sapiens
ugggcagugggacagcuuugug

SEQ ID NO: 276354 - RNA, 22 nt, Homo sapiens
ugggcuagaugcuuugggguca

SEQ ID NO: 276355 - RNA, 22 nt, Homo sapiens
uggggcuuuuucuuguauucuc

SEQ ID NO: 276356 - RNA, 22 nt, Homo sapiens
ugggguaggccugguuaugugc

SEQ ID NO: 276357 - RNA, 22 nt, Homo sapiens
uggguagaugaauccauuccaa

SEQ ID NO: 276358 - RNA, 22 nt, Homo sapiens
ugggugaguaucuauuauucag

SEQ ID NO: 276359 - RNA, 23 nt, Homo sapiens
ugguaacauguuguggcagggga

SEQ ID NO: 276360 - RNA, 22 nt, Homo sapiens
uggugagaaaugagaugcuuuu

SEQ ID NO: 276361 - RNA, 22 nt, Homo sapiens
uguaaacauguauguguuuaug

SEQ ID NO: 276362 - RNA, 22 nt, Homo sapiens
uguaagcagcagagacuauccu

SEQ ID NO: 276363 - RNA, 22 nt, Homo sapiens
uguacaugggacaggaggagag

SEQ ID NO: 276364 - RNA, 22 nt, Homo sapiens
uguagacagcacguaguugagu

SEQ ID NO: 276365 - RNA, 22 nt, Homo sapiens
uguaugagagacauggcugcuu

SEQ ID NO: 276366 - RNA, 22 nt, Homo sapiens
uguauuuguuguuaaauggaga

SEQ ID NO: 276367 - RNA, 22 nt, Homo sapiens
ugucaaauucuggguuaaaaca

SEQ ID NO: 276368 - RNA, 21 nt, Homo sapiens
ugucaagaugacugcugcggc

SEQ ID NO: 276369 - RNA, 22 nt, Homo sapiens
ugucaagaugguuugauguugu

SEQ ID NO: 276370 - RNA, 22 nt, Homo sapiens
ugucacauccaagaaggugcag

SEQ ID NO: 276371 - RNA, 22 nt, Homo sapiens
ugucaguggucuggaugcagcc

SEQ ID NO: 276372 - RNA, 21 nt, Homo sapiens
ugucaugcagagacccuggag

SEQ ID NO: 276373 - RNA, 22 nt, Homo sapiens
ugucauggauucugagucuggg

SEQ ID NO: 276374 - RNA, 22 nt, Homo sapiens
ugucauggucacaggcauuuca

SEQ ID NO: 276375 - RNA, 22 nt, Homo sapiens
ugugaagaugagaugacgcccu

SEQ ID NO: 276376 - RNA, 22 nt, Homo sapiens
ugugaauggugcuuccuagaug

SEQ ID NO: 276377 - RNA, 22 nt, Homo sapiens
ugugaauguaaccuuauuugga

SEQ ID NO: 276378 - RNA, 22 nt, Homo sapiens
ugugacuaguggugaaugacgc

SEQ ID NO: 276379 - RNA, 22 nt, Homo sapiens
ugugagacugguucugaaccca

SEQ ID NO: 276380 - RNA, 22 nt, Homo sapiens
ugugaucauugcuguuaaagug

SEQ ID NO: 276381 - RNA, 22 nt, Homo sapiens
ugugauggaguuucauggacug

SEQ ID NO: 276382 - RNA, 20 nt, Homo sapiens
ugugauuauuuaguugcaug

SEQ ID NO: 276383 - RNA, 22 nt, Homo sapiens
ugugauugauauauuuacagaa

SEQ ID NO: 276384 - RNA, 22 nt, Homo sapiens
ugugcacaacaugcagguuugu

SEQ ID NO: 276385 - RNA, 22 nt, Homo sapiens
ugugcacaaugugcagguuuga

SEQ ID NO: 276386 - RNA, 23 nt, Homo sapiens
ugugcacauuuacauauauacac

SEQ ID NO: 276387 - RNA, 22 nt, Homo sapiens
ugugccacuccaaccuggguga

SEQ ID NO: 276388 - RNA, 22 nt, Homo sapiens
ugugccacuccagcucuagcuu

SEQ ID NO: 276389 - RNA, 22 nt, Homo sapiens
ugugccugagguuaacauuguu

SEQ ID NO: 276390 - RNA, 22 nt, Homo sapiens
ugugcucaucucagucaacugu

SEQ ID NO: 276391 - RNA, 22 nt, Homo sapiens
ugugguuuuucacauuuagaga

SEQ ID NO: 276392 - RNA, 22 nt, Homo sapiens
uguuacagcagcacaaaaugga

SEQ ID NO: 276393 - RNA, 22 nt, Homo sapiens
uguucuggagaguuuagucugg

SEQ ID NO: 276394 - RNA, 22 nt, Homo sapiens
uguuggcauugcugcugacccu

SEQ ID NO: 276395 - RNA, 19 nt, Homo sapiens
uguuuggcuauaggucuaa

SEQ ID NO: 276396 - RNA, 22 nt, Homo sapiens
uuaaaggcaugguuagacaugg

SEQ ID NO: 276397 - RNA, 22 nt, Homo sapiens
uuaaagugaucauaaggauagu

SEQ ID NO: 276398 - RNA, 22 nt, Homo sapiens
uuaaaguguuugcagacaggug

SEQ ID NO: 276399 - RNA, 22 nt, Homo sapiens
uuaaaugcauagaauguguagu

SEQ ID NO: 276400 - RNA, 22 nt, Homo sapiens
uuaaaugcuagaauuuucuuug

SEQ ID NO: 276401 - RNA, 22 nt, Homo sapiens
uuaagaagugauuuuccucauu

SEQ ID NO: 276402 - RNA, 22 nt, Homo sapiens
uuaagcuaguuuauucaggaaa

SEQ ID NO: 276403 - RNA, 22 nt, Homo sapiens
uuaagguuuuuguagcaaggau

SEQ ID NO: 276404 - RNA, 22 nt, Homo sapiens
uuaaguagaugaaugugaaugu

SEQ ID NO: 276405 - RNA, 22 nt, Homo sapiens
uuaaguagcugggcaugguggu

SEQ ID NO: 276406 - RNA, 19 nt, Homo sapiens
uuaagugugauaucucagu

SEQ ID NO: 276407 - RNA, 22 nt, Homo sapiens
uuaaguuguagcuacaaauaca

SEQ ID NO: 276408 - RNA, 22 nt, Homo sapiens
uuaaucuguucucuguauucua

SEQ ID NO: 276409 - RNA, 22 nt, Homo sapiens
uuaauggagaguuucauuggug

SEQ ID NO: 276410 - RNA, 22 nt, Homo sapiens
uuaauguaucuaucacaucaca

SEQ ID NO: 276411 - RNA, 22 nt, Homo sapiens
uuaauuguaucuauagauguca

SEQ ID NO: 276412 - RNA, 22 nt, Homo sapiens
uuacacaguaggucccuaguaa

SEQ ID NO: 276413 - RNA, 22 nt, Homo sapiens
uuacacaguugguaggggcaga

SEQ ID NO: 276414 - RNA, 22 nt, Homo sapiens
uuacaguagaugaggguauaau

SEQ ID NO: 276415 - RNA, 22 nt, Homo sapiens
uuacauugcuucaaauucagug

SEQ ID NO: 276416 - RNA, 22 nt, Homo sapiens
uuacccauuagagaauuuaaga

SEQ ID NO: 276417 - RNA, 22 nt, Homo sapiens
uuacuacucucuaugaccaguu

SEQ ID NO: 276418 - RNA, 22 nt, Homo sapiens
uuagaacuagaggaguuugagu

SEQ ID NO: 276419 - RNA, 22 nt, Homo sapiens
uuagcacaucuuucuauguaag

SEQ ID NO: 276420 - RNA, 22 nt, Homo sapiens
uuaguagcacagaguaucagca

SEQ ID NO: 276421 - RNA, 22 nt, Homo sapiens
uuagugaaugcaccacuucuga

SEQ ID NO: 276422 - RNA, 22 nt, Homo sapiens
uuauagcagugcccaacuccug

SEQ ID NO: 276423 - RNA, 22 nt, Homo sapiens
uuauagcuaacaucugugaaaa

SEQ ID NO: 276424 - RNA, 22 nt, Homo sapiens
uuauguaaaucaaucuggaauc

SEQ ID NO: 276425 - RNA, 22 nt, Homo sapiens
uuaugucuuuuguguucagcua

SEQ ID NO: 276426 - RNA, 22 nt, Homo sapiens
uuauucugucuuuggucucaau

SEQ ID NO: 276427 - RNA, 22 nt, Homo sapiens
uuauugcuuuugugcaggugag

SEQ ID NO: 276428 - RNA, 23 nt, Homo sapiens
uucaaauguucucugguugucag

SEQ ID NO: 276429 - RNA, 22 nt, Homo sapiens
uucaagcuacaguggcaggguu

SEQ ID NO: 276430 - RNA, 22 nt, Homo sapiens
uucaagcugggcaaauaagggg

SEQ ID NO: 276431 - RNA, 20 nt, Homo sapiens
uucaagugauucucaugccu

SEQ ID NO: 276432 - RNA, 22 nt, Homo sapiens
uucaaguguucaggagcuacag

SEQ ID NO: 276433 - RNA, 22 nt, Homo sapiens
uucaauacuguugauccuuaug

SEQ ID NO: 276434 - RNA, 22 nt, Homo sapiens
uucacaugguugccuuuugauc

SEQ ID NO: 276435 - RNA, 22 nt, Homo sapiens
uucaccuggaguucaggauaag

SEQ ID NO: 276436 - RNA, 22 nt, Homo sapiens
uucaccuugggucccacuugcu

SEQ ID NO: 276437 - RNA, 22 nt, Homo sapiens
uucacugggugugguggcucac

SEQ ID NO: 276438 - RNA, 21 nt, Homo sapiens
uucacuggucuauuucccuuu

SEQ ID NO: 276439 - RNA, 22 nt, Homo sapiens
uucagagagggagggauaccua

SEQ ID NO: 276440 - RNA, 22 nt, Homo sapiens
uucaggcaccauggucauugau

SEQ ID NO: 276441 - RNA, 22 nt, Homo sapiens
uucaggcaccauugucauugau

SEQ ID NO: 276442 - RNA, 22 nt, Homo sapiens
uucagggcauuggaguuucuga

SEQ ID NO: 276443 - RNA, 22 nt, Homo sapiens
uucauagucacauucgaugucu

SEQ ID NO: 276444 - RNA, 17 nt, Homo sapiens
uguggcucuuaugcuga

SEQ ID NO: 276445 - RNA, 22 nt, Homo sapiens
uguggcugguggcaccuuuucc

SEQ ID NO: 276446 - RNA, 22 nt, Homo sapiens
uguggcuuuguaaccauggguc

SEQ ID NO: 276447 - RNA, 19 nt, Homo sapiens
uguggucauccugggacga

SEQ ID NO: 276448 - RNA, 22 nt, Homo sapiens
uguuacagcagaauugaaagag

SEQ ID NO: 276449 - RNA, 22 nt, Homo sapiens
uguuaguuguucauguuaagag

SEQ ID NO: 276450 - RNA, 22 nt, Homo sapiens
uguucacaguguuucuuugaga

SEQ ID NO: 276451 - RNA, 22 nt, Homo sapiens
uguucauggauccaguggcuuc

SEQ ID NO: 276452 - RNA, 22 nt, Homo sapiens
uguucuggagccgguucaaaug

SEQ ID NO: 276453 - RNA, 19 nt, Homo sapiens
uguugcacauaucaauaug

SEQ ID NO: 276454 - RNA, 22 nt, Homo sapiens
uguuuuggagguccucacuaga

SEQ ID NO: 276455 - RNA, 22 nt, Homo sapiens
uuaaaugucuguagaugugcug

SEQ ID NO: 276456 - RNA, 21 nt, Homo sapiens
uuaacagacaagugucuuccc

SEQ ID NO: 276457 - RNA, 22 nt, Homo sapiens
uuaacagugucaaucuguagua

SEQ ID NO: 276458 - RNA, 22 nt, Homo sapiens
uuaaggaaagcauuuaauucag

SEQ ID NO: 276459 - RNA, 22 nt, Homo sapiens
uuaaggcauucuuugucuucau

SEQ ID NO: 276460 - RNA, 23 nt, Homo sapiens
uuaaggugaugucuuugugccuc

SEQ ID NO: 276461 - RNA, 22 nt, Homo sapiens
uuaaugacaucauaggugaagu

SEQ ID NO: 276462 - RNA, 22 nt, Homo sapiens
uuaaugugaaucaggaugcauu

SEQ ID NO: 276463 - RNA, 19 nt, Homo sapiens
uuacacaaccuaguggggc

SEQ ID NO: 276464 - RNA, 22 nt, Homo sapiens
uuacaccuguaauccagcacuu

SEQ ID NO: 276465 - RNA, 22 nt, Homo sapiens
uuacacguaauaucacggugug

SEQ ID NO: 276466 - RNA, 19 nt, Homo sapiens
uuacauccauugcauuuca

SEQ ID NO: 276467 - RNA, 22 nt, Homo sapiens
uuacauguggugugaagaagag

SEQ ID NO: 276468 - RNA, 17 nt, Homo sapiens
uuagagguagacucauu

SEQ ID NO: 276469 - RNA, 22 nt, Homo sapiens
uuagagguaggauuucaccaug

SEQ ID NO: 276470 - RNA, 22 nt, Homo sapiens
uuagcagcacaaaagcagacua

SEQ ID NO: 276471 - RNA, 22 nt, Homo sapiens
uuagcagcaucccuggccugua

SEQ ID NO: 276472 - RNA, 22 nt, Homo sapiens
uuagcaugucuacuaauuugcu

SEQ ID NO: 276473 - RNA, 22 nt, Homo sapiens
uuauacacugugggaguguaaa

SEQ ID NO: 276474 - RNA, 20 nt, Homo sapiens
uuauagcuacaucuugacug

SEQ ID NO: 276475 - RNA, 22 nt, Homo sapiens
uuaugcaucuuccacacucauu

SEQ ID NO: 276476 - RNA, 22 nt, Homo sapiens
uuauggcuauugaugacaauug

SEQ ID NO: 276477 - RNA, 22 nt, Homo sapiens
uuauucauuaacagggaccaaa

SEQ ID NO: 276478 - RNA, 22 nt, Homo sapiens
uuauuugguugcugacuuggaa

SEQ ID NO: 276479 - RNA, 22 nt, Homo sapiens
uucaaaguuggaggacaaacug

SEQ ID NO: 276480 - RNA, 22 nt, Homo sapiens
uucacagagagaacucaaacca

SEQ ID NO: 276481 - RNA, 21 nt, Homo sapiens
uucaccauggcuccacacucu

SEQ ID NO: 276482 - RNA, 22 nt, Homo sapiens
uucaccuugcccacagcagucu

SEQ ID NO: 276483 - RNA, 22 nt, Homo sapiens
uucacuguagcuuggauguuua

SEQ ID NO: 276484 - RNA, 20 nt, Homo sapiens
uucagcaaaggaaugggagu

SEQ ID NO: 276485 - RNA, 22 nt, Homo sapiens
uucagcaguggccaguggaaau

SEQ ID NO: 276486 - RNA, 22 nt, Homo sapiens
uucauaguguuuccuuccagug

SEQ ID NO: 276487 - RNA, 22 nt, Homo sapiens
uuccagaugggaguucuauucu

SEQ ID NO: 276488 - RNA, 22 nt, Homo sapiens
uucccugagcaucuguugagcc

SEQ ID NO: 276489 - RNA, 19 nt, Homo sapiens
uuccugagaacaagggcuu

SEQ ID NO: 276490 - RNA, 21 nt, Homo sapiens
uucuauggucagaauucaaua

SEQ ID NO: 276491 - RNA, 22 nt, Homo sapiens
uucuaugguuuaauaguuuggg

SEQ ID NO: 276492 - RNA, 22 nt, Homo sapiens
uucuaugguuuuuaugguguua

SEQ ID NO: 276493 - RNA, 22 nt, Homo sapiens
uucucagugaaguuuagaacau

SEQ ID NO: 276494 - RNA, 22 nt, Homo sapiens
uucucagugcuaucuuuuaugc

SEQ ID NO: 276495 - RNA, 22 nt, Homo sapiens
uucugcuagucugucagaucuu

SEQ ID NO: 276496 - RNA, 22 nt, Homo sapiens
uucuggcucaggucaacacuuc

SEQ ID NO: 276497 - RNA, 22 nt, Homo sapiens
uucugugguugaaaggagagau

SEQ ID NO: 276498 - RNA, 22 nt, Homo sapiens
uucuuaguggcaccacuuuuuu

SEQ ID NO: 276499 - RNA, 22 nt, Homo sapiens
uucuuccagccuugaggggccc

SEQ ID NO: 276500 - RNA, 22 nt, Homo sapiens
uucuugaggcaugccgcuggga

SEQ ID NO: 276501 - RNA, 20 nt, Homo sapiens
uucuugaguuaacaaguuac

SEQ ID NO: 276502 - RNA, 22 nt, Homo sapiens
uucuugcuguauccucacaugg

SEQ ID NO: 276503 - RNA, 22 nt, Homo sapiens
uugaaauguuuagaaguuugga

SEQ ID NO: 276504 - RNA, 22 nt, Homo sapiens
uugaagguaggaugugcuauca

SEQ ID NO: 276505 - RNA, 22 nt, Homo sapiens
uugaaugaaauuggugugggga

SEQ ID NO: 276506 - RNA, 22 nt, Homo sapiens
uugacauaguuucugaaauaga

SEQ ID NO: 276507 - RNA, 22 nt, Homo sapiens
uugagaaucuuugcuaaaggaa

SEQ ID NO: 276508 - RNA, 22 nt, Homo sapiens
uugagaugauggauaugcuaau

SEQ ID NO: 276509 - RNA, 22 nt, Homo sapiens
uugagauggagucucacucuuc

SEQ ID NO: 276510 - RNA, 22 nt, Homo sapiens
uugagauggagucucacucuuu

SEQ ID NO: 276511 - RNA, 22 nt, Homo sapiens
uugagauggagucucgcacugu

SEQ ID NO: 276512 - RNA, 22 nt, Homo sapiens
uugagauggagucucgcugugu

SEQ ID NO: 276513 - RNA, 22 nt, Homo sapiens
uugagauggagucucguucugu

SEQ ID NO: 276514 - RNA, 22 nt, Homo sapiens
uugagauggagucuugcacugu

SEQ ID NO: 276515 - RNA, 22 nt, Homo sapiens
uugagauggagucuugcgcugu

SEQ ID NO: 276516 - RNA, 22 nt, Homo sapiens
uugagauggagucuugcucuug

SEQ ID NO: 276517 - RNA, 22 nt, Homo sapiens
uugagauggaguuucgcucuug

SEQ ID NO: 276518 - RNA, 22 nt, Homo sapiens
uugagauggaguuuugcucuug

SEQ ID NO: 276519 - RNA, 22 nt, Homo sapiens
uugagauguaguuucacuccug

SEQ ID NO: 276520 - RNA, 19 nt, Homo sapiens
uugagaugugaacucacac

SEQ ID NO: 276521 - RNA, 22 nt, Homo sapiens
uugagcuauauacuucagacuu

SEQ ID NO: 276522 - RNA, 22 nt, Homo sapiens
uugaggaaugucauuuguguuu

SEQ ID NO: 276523 - RNA, 22 nt, Homo sapiens
uugaggaaugugauuucaaaua

SEQ ID NO: 276524 - RNA, 22 nt, Homo sapiens
uugaggacuggaacacaggucu

SEQ ID NO: 276525 - RNA, 22 nt, Homo sapiens
uugagggaagccagaggucugc

SEQ ID NO: 276526 - RNA, 22 nt, Homo sapiens
uugagggaggcagggcuugucu

SEQ ID NO: 276527 - RNA, 22 nt, Homo sapiens
uugagguagcuuugauggaggu

SEQ ID NO: 276528 - RNA, 22 nt, Homo sapiens
uugaggugaagggcagagcagc

SEQ ID NO: 276529 - RNA, 22 nt, Homo sapiens
uugaguagugugaugcaugucu

SEQ ID NO: 276530 - RNA, 22 nt, Homo sapiens
uugauaauguuaacuuugguca

SEQ ID NO: 276531 - RNA, 22 nt, Homo sapiens
uugauagguuuuauguauaguu

SEQ ID NO: 276532 - RNA, 22 nt, Homo sapiens
uugcaaaguugccaaggaagga

SEQ ID NO: 276533 - RNA, 22 nt, Homo sapiens
uugcagagccccacacugggcu

SEQ ID NO: 276534 - RNA, 22 nt, Homo sapiens
uugcauaagugcauucugugau

SEQ ID NO: 276535 - RNA, 22 nt, Homo sapiens
uugcaugguuuuuaucugaaau

SEQ ID NO: 276536 - RNA, 22 nt, Homo sapiens
uuggaaacgucaccuuuuccuu

SEQ ID NO: 276537 - RNA, 20 nt, Homo sapiens
uuggaaaugugaauugggag

SEQ ID NO: 276538 - RNA, 22 nt, Homo sapiens
uuggaagacauucugucugcua

SEQ ID NO: 276539 - RNA, 22 nt, Homo sapiens
uuggcaacauagugagaccccc

SEQ ID NO: 276540 - RNA, 22 nt, Homo sapiens
uuggcaagaaccuucuuccaag

SEQ ID NO: 276541 - RNA, 22 nt, Homo sapiens
uuggcacgugguggggcucgga

SEQ ID NO: 276542 - RNA, 22 nt, Homo sapiens
uuggcagcuguggaaucugggc

SEQ ID NO: 276543 - RNA, 22 nt, Homo sapiens
uuggcaguaucuacuacagcua

SEQ ID NO: 276544 - RNA, 22 nt, Homo sapiens
uuggcagugcccgaugcugggg

SEQ ID NO: 276545 - RNA, 22 nt, Homo sapiens
uuggccccuccaaaucucaugu

SEQ ID NO: 276546 - RNA, 22 nt, Homo sapiens
cagccgggugagguggcuuguu

SEQ ID NO: 276547 - RNA, 20 nt, Homo sapiens
cagcuaccugggaaauuugg

SEQ ID NO: 276548 - RNA, 23 nt, Homo sapiens
cagcucauuuggguccccuuguc

SEQ ID NO: 276549 - RNA, 22 nt, Homo sapiens
cagcucuuguuaaaacuaacua

SEQ ID NO: 276550 - RNA, 22 nt, Homo sapiens
cagcuguuguuaugucugcagg

SEQ ID NO: 276551 - RNA, 23 nt, Homo sapiens
cagcuucauugaacauaacuccu

SEQ ID NO: 276552 - RNA, 22 nt, Homo sapiens
caggaaugugaggguucccugc

SEQ ID NO: 276553 - RNA, 22 nt, Homo sapiens
caggcaaggugaaguguacugg

SEQ ID NO: 276554 - RNA, 22 nt, Homo sapiens
caggcauuguccaugcugaagg

SEQ ID NO: 276555 - RNA, 22 nt, Homo sapiens
cagugucugcauuuggaacuca

SEQ ID NO: 276556 - RNA, 22 nt, Homo sapiens
caucacuuuuccuuuuacagau

SEQ ID NO: 276557 - RNA, 22 nt, Homo sapiens
caucccugucgucaagucucug

SEQ ID NO: 276558 - RNA, 22 nt, Homo sapiens
cauggcacugagcagguaugca

SEQ ID NO: 276559 - RNA, 22 nt, Homo sapiens
cauggcaucuguguggccucca

SEQ ID NO: 276560 - RNA, 22 nt, Homo sapiens
cauggcauuugcagaguugaaa

SEQ ID NO: 276561 - RNA, 22 nt, Homo sapiens
cauggcccugggcugggcgaac

SEQ ID NO: 276562 - RNA, 22 nt, Homo sapiens
caugguguuaggcacugggaau

SEQ ID NO: 276563 - RNA, 22 nt, Homo sapiens
caugucacuuccucucugaugg

SEQ ID NO: 276564 - RNA, 22 nt, Homo sapiens
ccaaggaauacccucccuuuuu

SEQ ID NO: 276565 - RNA, 22 nt, Homo sapiens
ccacccuggagaauuugagguc

SEQ ID NO: 276566 - RNA, 22 nt, Homo sapiens
ccaccuguacuuaagucacuuu

SEQ ID NO: 276567 - RNA, 22 nt, Homo sapiens
ccaguguuuuugaauuccagga

SEQ ID NO: 276568 - RNA, 17 nt, Homo sapiens
ccaguuuucccucagug

SEQ ID NO: 276569 - RNA, 22 nt, Homo sapiens
ccaguuuuucauuuauacuagu

SEQ ID NO: 276570 - RNA, 22 nt, Homo sapiens
ccaguuuuuggcaaugaugaau

SEQ ID NO: 276571 - RNA, 22 nt, Homo sapiens
ccaucacacugugauuauuauc

SEQ ID NO: 276572 - RNA, 22 nt, Homo sapiens
ccaucccuuucugagcaguucc

SEQ ID NO: 276573 - RNA, 18 nt, Homo sapiens
cccagugacuuauggccu

SEQ ID NO: 276574 - RNA, 22 nt, Homo sapiens
cccaguuuugccacuuacuagc

SEQ ID NO: 276575 - RNA, 22 nt, Homo sapiens
ccccuguaaacuggcuucccug

SEQ ID NO: 276576 - RNA, 20 nt, Homo sapiens
cccuaagccagaugcugggg

SEQ ID NO: 276577 - RNA, 22 nt, Homo sapiens
cccugaagauacagaguuuggg

SEQ ID NO: 276578 - RNA, 22 nt, Homo sapiens
cccuguguuuagcugaagguuu

SEQ ID NO: 276579 - RNA, 20 nt, Homo sapiens
ccuaguguucuuaggcugca

SEQ ID NO: 276580 - RNA, 22 nt, Homo sapiens
ccugcauugucaaggccaagcc

SEQ ID NO: 276581 - RNA, 22 nt, Homo sapiens
ccuggcacugggccccguggcu

SEQ ID NO: 276582 - RNA, 22 nt, Homo sapiens
ccugucuugaagagauccuccu

SEQ ID NO: 276583 - RNA, 22 nt, Homo sapiens
ccugugguuaaccagcuagaug

SEQ ID NO: 276584 - RNA, 22 nt, Homo sapiens
ccuucauucauuaauuuagccc

SEQ ID NO: 276585 - RNA, 22 nt, Homo sapiens
ccuucauugcaucuuuaagaga

SEQ ID NO: 276586 - RNA, 22 nt, Homo sapiens
ccuugguggccacaagacauug

SEQ ID NO: 276587 - RNA, 22 nt, Homo sapiens
cgccgggggaugggcaccagcg

SEQ ID NO: 276588 - RNA, 22 nt, Homo sapiens
cgugaggaaaacagaggguguu

SEQ ID NO: 276589 - RNA, 22 nt, Homo sapiens
cuaaugcagucaggagaaggaa

SEQ ID NO: 276590 - RNA, 22 nt, Homo sapiens
cuagauuauccaacuuauuagc

SEQ ID NO: 276591 - RNA, 22 nt, Homo sapiens
cuagcacauaguuauucacuca

SEQ ID NO: 276592 - RNA, 22 nt, Homo sapiens
cuagucacaggaguugaaggau

SEQ ID NO: 276593 - RNA, 22 nt, Homo sapiens
cuauggcuguaugacgugcaug

SEQ ID NO: 276594 - RNA, 22 nt, Homo sapiens
cucaaagugcuaagauuaggcu

SEQ ID NO: 276595 - RNA, 22 nt, Homo sapiens
ccaugaacuagaauagaacaug

SEQ ID NO: 276596 - RNA, 19 nt, Homo sapiens
ccauggcaaugaucugaug

SEQ ID NO: 276597 - RNA, 22 nt, Homo sapiens
cccagaguucuuaaauacugag

SEQ ID NO: 276598 - RNA, 22 nt, Homo sapiens
cccagugaagagaaccuuacga

SEQ ID NO: 276599 - RNA, 19 nt, Homo sapiens
cccagugucagagaagggu

SEQ ID NO: 276600 - RNA, 22 nt, Homo sapiens
cccagugugaacuuggcauuuu

SEQ ID NO: 276601 - RNA, 22 nt, Homo sapiens
cccaguguguuguggauauuua

SEQ ID NO: 276602 - RNA, 22 nt, Homo sapiens
cccaguguuacgugacagccug

SEQ ID NO: 276603 - RNA, 22 nt, Homo sapiens
cccuguguuguucaaggaucug

SEQ ID NO: 276604 - RNA, 22 nt, Homo sapiens
cccuugcacuucagagcugcau

SEQ ID NO: 276605 - RNA, 19 nt, Homo sapiens
ccucaaguacuaauauguu

SEQ ID NO: 276606 - RNA, 22 nt, Homo sapiens
ccucauggagaaccucugcuag

SEQ ID NO: 276607 - RNA, 22 nt, Homo sapiens
ccucuuuguugagacuucacca

SEQ ID NO: 276608 - RNA, 22 nt, Homo sapiens
ccuuggcacuacugacauugua

SEQ ID NO: 276609 - RNA, 22 nt, Homo sapiens
ccuuuguuaguuugcugagaau

SEQ ID NO: 276610 - RNA, 22 nt, Homo sapiens
cgaggaguaucuuugugguguu

SEQ ID NO: 276611 - RNA, 22 nt, Homo sapiens
cuaaagauagugacaugauuug

SEQ ID NO: 276612 - RNA, 18 nt, Homo sapiens
cuaauacuauucaacaag

SEQ ID NO: 276613 - RNA, 22 nt, Homo sapiens
cuaaucugugcauagaagaggc

SEQ ID NO: 276614 - RNA, 22 nt, Homo sapiens
cuacagaguaucuaaagaggua

SEQ ID NO: 276615 - RNA, 22 nt, Homo sapiens
cuaccuggguggcucaugacuu

SEQ ID NO: 276616 - RNA, 22 nt, Homo sapiens
cuagcagaacaauacaauucgg

SEQ ID NO: 276617 - RNA, 22 nt, Homo sapiens
cuagccuggagugcaguggugc

SEQ ID NO: 276618 - RNA, 22 nt, Homo sapiens
cuagcuuuugauguaaagugag

SEQ ID NO: 276619 - RNA, 22 nt, Homo sapiens
cuauggcagccacggccuggag

SEQ ID NO: 276620 - RNA, 22 nt, Homo sapiens
cuauggcuguagucccugugua

SEQ ID NO: 276621 - RNA, 21 nt, Homo sapiens
cucaaaguacugauauuacag

SEQ ID NO: 276622 - RNA, 18 nt, Homo sapiens
cucaaccucaugcagggc

SEQ ID NO: 276623 - RNA, 22 nt, Homo sapiens
cucacugugguguccuuaggua

SEQ ID NO: 276624 - RNA, 20 nt, Homo sapiens
cucagauuauucugaagcaa

SEQ ID NO: 276625 - RNA, 22 nt, Homo sapiens
cucaguuuugccuuguuuaagg

SEQ ID NO: 276626 - RNA, 22 nt, Homo sapiens
cucauggaauacuucacagcca

SEQ ID NO: 276627 - RNA, 22 nt, Homo sapiens
cucauggagauagagaauagaa

SEQ ID NO: 276628 - RNA, 20 nt, Homo sapiens
cucccugacaaauguggaaa

SEQ ID NO: 276629 - RNA, 22 nt, Homo sapiens
cuccuggugauuggagugugaa

SEQ ID NO: 276630 - RNA, 22 nt, Homo sapiens
cucugacagugguuagcacugu

SEQ ID NO: 276631 - RNA, 22 nt, Homo sapiens
cucugagccugagguuccuacu

SEQ ID NO: 276632 - RNA, 22 nt, Homo sapiens
cucugagguuauucguaauauu

SEQ ID NO: 276633 - RNA, 22 nt, Homo sapiens
cucugguggaagcagggggcaa

SEQ ID NO: 276634 - RNA, 19 nt, Homo sapiens
cucuuuggugucucuucuu

SEQ ID NO: 276635 - RNA, 22 nt, Homo sapiens
cugaaaagcaucugcauagcug

SEQ ID NO: 276636 - RNA, 22 nt, Homo sapiens
cugaaagguauacgcuuguuau

SEQ ID NO: 276637 - RNA, 22 nt, Homo sapiens
cugaaauggaaugugugcacag

SEQ ID NO: 276638 - RNA, 22 nt, Homo sapiens
cugaauguucuggauggaagag

SEQ ID NO: 276639 - RNA, 22 nt, Homo sapiens
cugagacacucuuaucugcaua

SEQ ID NO: 276640 - RNA, 22 nt, Homo sapiens
cugagauacacuaauagucucu

SEQ ID NO: 276641 - RNA, 22 nt, Homo sapiens
cugagaucaagucuugcucugu

SEQ ID NO: 276642 - RNA, 22 nt, Homo sapiens
cugagaucguggggcugcuguc

SEQ ID NO: 276643 - RNA, 22 nt, Homo sapiens
cugagaucugaaccaggagugu

SEQ ID NO: 276644 - RNA, 22 nt, Homo sapiens
cugagcaugacaucaugugacu

SEQ ID NO: 276645 - RNA, 22 nt, Homo sapiens
cugaggacaucagggaagcauc

SEQ ID NO: 276646 - RNA, 22 nt, Homo sapiens
cugaggcacggcgaccuuaagu

SEQ ID NO: 276647 - RNA, 22 nt, Homo sapiens
cugagguacugggggccaggau

SEQ ID NO: 276648 - RNA, 22 nt, Homo sapiens
cugagguauuuaggugaaagaa

SEQ ID NO: 276649 - RNA, 20 nt, Homo sapiens
cugagguugggguccuuccc

SEQ ID NO: 276650 - RNA, 19 nt, Homo sapiens
cugcaagguaauaggucag

SEQ ID NO: 276651 - RNA, 22 nt, Homo sapiens
cugcauuagucuguuuaguguu

SEQ ID NO: 276652 - RNA, 22 nt, Homo sapiens
cugccacugacaccucaaggac

SEQ ID NO: 276653 - RNA, 22 nt, Homo sapiens
cugccugagaaaauggagggca

SEQ ID NO: 276654 - RNA, 18 nt, Homo sapiens
cuggaugucgaguguguu

SEQ ID NO: 276655 - RNA, 22 nt, Homo sapiens
cuggcaaauaguagagccagga

SEQ ID NO: 276656 - RNA, 22 nt, Homo sapiens
cuggccagagacauucauuaaa

SEQ ID NO: 276657 - RNA, 22 nt, Homo sapiens
cuggcgagacagcuccaucacu

SEQ ID NO: 276658 - RNA, 22 nt, Homo sapiens
cugggaucaguucuagucagaa

SEQ ID NO: 276659 - RNA, 22 nt, Homo sapiens
cugggaugugacuguugccccc

SEQ ID NO: 276660 - RNA, 22 nt, Homo sapiens
cugugcauaucuuggacugugu

SEQ ID NO: 276661 - RNA, 22 nt, Homo sapiens
cugugccaagcuugcgaugugc

SEQ ID NO: 276662 - RNA, 22 nt, Homo sapiens
cuguguaguacuagauugagca

SEQ ID NO: 276663 - RNA, 22 nt, Homo sapiens
cuguugguguuuaaucacugca

SEQ ID NO: 276664 - RNA, 22 nt, Homo sapiens
cuuagcaugucagcaccggguu

SEQ ID NO: 276665 - RNA, 22 nt, Homo sapiens
cuucaaguguggccaccugacc

SEQ ID NO: 276666 - RNA, 22 nt, Homo sapiens
cuucacuuuguuaaacuccaau

SEQ ID NO: 276667 - RNA, 22 nt, Homo sapiens
cuuccauaguauuuuuacaaaa

SEQ ID NO: 276668 - RNA, 22 nt, Homo sapiens
cuugcacuagugcagaggcgcu

SEQ ID NO: 276669 - RNA, 22 nt, Homo sapiens
cuugcacuguuguaagggacuu

SEQ ID NO: 276670 - RNA, 22 nt, Homo sapiens
cuugcagagcccauggauguca

SEQ ID NO: 276671 - RNA, 22 nt, Homo sapiens
cuuggcuccgacuccccuccaa

SEQ ID NO: 276672 - RNA, 22 nt, Homo sapiens
cuuugcaaaacauugagaccuc

SEQ ID NO: 276673 - RNA, 22 nt, Homo sapiens
cuuuggagaaaaguucuugggc

SEQ ID NO: 276674 - RNA, 22 nt, Homo sapiens
cuuuggcacuuccuaagugcca

SEQ ID NO: 276675 - RNA, 22 nt, Homo sapiens
cuuuuacacuguuggcaggauu

SEQ ID NO: 276676 - RNA, 22 nt, Homo sapiens
cuuuuggcuuaagauugucuug

SEQ ID NO: 276677 - RNA, 22 nt, Homo sapiens
cuuuuugguagagcaggugugc

SEQ ID NO: 276678 - RNA, 22 nt, Homo sapiens
gaaagauuuuaacugggagacu

SEQ ID NO: 276679 - RNA, 22 nt, Homo sapiens
gaaauguugauagugggcauug

SEQ ID NO: 276680 - RNA, 22 nt, Homo sapiens
gaagcauugauccacaggcgug

SEQ ID NO: 276681 - RNA, 22 nt, Homo sapiens
gaaggagcuuaucugccauuuc

SEQ ID NO: 276682 - RNA, 22 nt, Homo sapiens
gaauggaacugacuauagcuga

SEQ ID NO: 276683 - RNA, 22 nt, Homo sapiens
gacacagugaagucucuacuug

SEQ ID NO: 276684 - RNA, 22 nt, Homo sapiens
gacagacacaauugauccauga

SEQ ID NO: 276685 - RNA, 22 nt, Homo sapiens
gacaucauuaugagauuuaaac

SEQ ID NO: 276686 - RNA, 22 nt, Homo sapiens
gacccucuagagggaagcgcuu

SEQ ID NO: 276687 - RNA, 22 nt, Homo sapiens
gaccugagagguacauguauuu

SEQ ID NO: 276688 - RNA, 22 nt, Homo sapiens
gacuggauagauaaaguuaguu

SEQ ID NO: 276689 - RNA, 20 nt, Homo sapiens
gacuugagagugggagagua

SEQ ID NO: 276690 - RNA, 22 nt, Homo sapiens
gagaacuggcgugaacugcacg

SEQ ID NO: 276691 - RNA, 22 nt, Homo sapiens
gagacauguuugccaauaauuu

SEQ ID NO: 276692 - RNA, 22 nt, Homo sapiens
gagagugaaguuugcuaccugu

SEQ ID NO: 276693 - RNA, 22 nt, Homo sapiens
gagagugugucagaggcugcga

SEQ ID NO: 276694 - RNA, 22 nt, Homo sapiens
gagauaaauaggucacaguucu

SEQ ID NO: 276695 - RNA, 22 nt, Homo sapiens
gagaucacuguuuauauucucu

SEQ ID NO: 276696 - RNA, 22 nt, Homo sapiens
gagaucaucuaaucuggccucu

SEQ ID NO: 276697 - RNA, 22 nt, Homo sapiens
gagguggugguggaggcauagc

SEQ ID NO: 276698 - RNA, 23 nt, Homo sapiens
gaguacauuaaaagcccagacug

SEQ ID NO: 276699 - RNA, 22 nt, Homo sapiens
gaguagaacugguuaucuaaua

SEQ ID NO: 276700 - RNA, 22 nt, Homo sapiens
gaguauguauaugagugugucu

SEQ ID NO: 276701 - RNA, 22 nt, Homo sapiens
gaguauuuuacaucguguaauu

SEQ ID NO: 276702 - RNA, 21 nt, Homo sapiens
gagugcaaauaaagagagggc

SEQ ID NO: 276703 - RNA, 18 nt, Homo sapiens
gaguggugcuucccuugu

SEQ ID NO: 276704 - RNA, 22 nt, Homo sapiens
gaguucaaaucucagcucuguu

SEQ ID NO: 276705 - RNA, 22 nt, Homo sapiens
gaguucaauuuccagcuguucu

SEQ ID NO: 276706 - RNA, 22 nt, Homo sapiens
gauaaauccagauucugaugua

SEQ ID NO: 276707 - RNA, 22 nt, Homo sapiens
gaucagagugaaccuuguuaug

SEQ ID NO: 276708 - RNA, 22 nt, Homo sapiens
gaucaguuucuggagauacgua

SEQ ID NO: 276709 - RNA, 19 nt, Homo sapiens
gaucuguugaucaaugugu

SEQ ID NO: 276710 - RNA, 22 nt, Homo sapiens
gaugagauguucucauggauug

SEQ ID NO: 276711 - RNA, 22 nt, Homo sapiens
gaugaggcuagagacaugugua

SEQ ID NO: 276712 - RNA, 22 nt, Homo sapiens
gaugauguuggaaacuuggugc

SEQ ID NO: 276713 - RNA, 22 nt, Homo sapiens
gauggaauuaaaaucagaauca

SEQ ID NO: 276714 - RNA, 22 nt, Homo sapiens
gauuuguauuaaaagugugacg

SEQ ID NO: 276715 - RNA, 22 nt, Homo sapiens
gcaaaugcuaugccauuuuaua

SEQ ID NO: 276716 - RNA, 22 nt, Homo sapiens
gcaagaguauuucaaggaagau

SEQ ID NO: 276717 - RNA, 22 nt, Homo sapiens
gcaagaugagagcccgggcagu

SEQ ID NO: 276718 - RNA, 21 nt, Homo sapiens
gcaaguacuaucaucauuauc

SEQ ID NO: 276719 - RNA, 22 nt, Homo sapiens
gcacaggguuacauucuaaggu

SEQ ID NO: 276720 - RNA, 22 nt, Homo sapiens
gcaccacugcacucucagcuug

SEQ ID NO: 276721 - RNA, 22 nt, Homo sapiens
gcaccguggaguauggggagga

SEQ ID NO: 276722 - RNA, 22 nt, Homo sapiens
gcacgcauuguccuucuaguca

SEQ ID NO: 276723 - RNA, 22 nt, Homo sapiens
gcagagaaacaggucuaaggag

SEQ ID NO: 276724 - RNA, 23 nt, Homo sapiens
gcagucauuuggaaaagguugaa

SEQ ID NO: 276725 - RNA, 22 nt, Homo sapiens
gccaaaaugcugggauuacagg

SEQ ID NO: 276726 - RNA, 22 nt, Homo sapiens
gccaguguguguuguucuccgc

SEQ ID NO: 276727 - RNA, 22 nt, Homo sapiens
gccaguguuuuauugagaauuu

SEQ ID NO: 276728 - RNA, 22 nt, Homo sapiens
gccauugcacuccagccucggg

SEQ ID NO: 276729 - RNA, 22 nt, Homo sapiens
gccauugcacucuagccugagc

SEQ ID NO: 276730 - RNA, 17 nt, Homo sapiens
gcccuuugugccucuuc

SEQ ID NO: 276731 - RNA, 22 nt, Homo sapiens
gcuauggccugaauguuugugu

SEQ ID NO: 276732 - RNA, 22 nt, Homo sapiens
gcucaguuuccucagcugcaaa

SEQ ID NO: 276733 - RNA, 22 nt, Homo sapiens
gcucugguuacaaaggcaaauu

SEQ ID NO: 276734 - RNA, 22 nt, Homo sapiens
gcugagguucaagaagguuaaa

SEQ ID NO: 276735 - RNA, 22 nt, Homo sapiens
gcugaguaguauuucauuguau

SEQ ID NO: 276736 - RNA, 22 nt, Homo sapiens
gcugcuuuugaugacaaaaaca

SEQ ID NO: 276737 - RNA, 22 nt, Homo sapiens
gcugguauuacaggcaugagcc

SEQ ID NO: 276738 - RNA, 22 nt, Homo sapiens
gcugguguucaggcccucaguc

SEQ ID NO: 276739 - RNA, 22 nt, Homo sapiens
gcuguugcuauuauuccgagaa

SEQ ID NO: 276740 - RNA, 22 nt, Homo sapiens
gcuuugcaauggcauugaccau

SEQ ID NO: 276741 - RNA, 22 nt, Homo sapiens
ggaaagaucagcuaaauguaag

SEQ ID NO: 276742 - RNA, 22 nt, Homo sapiens
ggaacaccauuuuuccugccuu

SEQ ID NO: 276743 - RNA, 18 nt, Homo sapiens
ggaagccuauuuaguaac

SEQ ID NO: 276744 - RNA, 22 nt, Homo sapiens
ggaagccuggaaaaaauuguga

SEQ ID NO: 276745 - RNA, 22 nt, Homo sapiens
ggacaaaguauuuucaaaugua

SEQ ID NO: 276746 - RNA, 23 nt, Homo sapiens
ggacuguaagggauauaaagguu

SEQ ID NO: 276747 - RNA, 22 nt, Homo sapiens
ggagauuauugaaucaugaggg

SEQ ID NO: 276748 - RNA, 22 nt, Homo sapiens
ggagcugugauuugaguccaga

SEQ ID NO: 276749 - RNA, 16 nt, Homo sapiens
ggaggucaucugggaa

SEQ ID NO: 276750 - RNA, 22 nt, Homo sapiens
ggaucacuugagaccaggaguu

SEQ ID NO: 276751 - RNA, 22 nt, Homo sapiens
ggcaacauggugaaacucuguc

SEQ ID NO: 276752 - RNA, 21 nt, Homo sapiens
ggcaagagaauacaacauaaa

SEQ ID NO: 276753 - RNA, 22 nt, Homo sapiens
ggcaagaucuuggcucacugaa

SEQ ID NO: 276754 - RNA, 22 nt, Homo sapiens
ggcaaggauuagauucuccccu

SEQ ID NO: 276755 - RNA, 22 nt, Homo sapiens
ggcucaguuuccuccgucugcu

SEQ ID NO: 276756 - RNA, 22 nt, Homo sapiens
gggaaauguaaagucauaagau

SEQ ID NO: 276757 - RNA, 22 nt, Homo sapiens
gggaagguaaucauuacuugau

SEQ ID NO: 276758 - RNA, 22 nt, Homo sapiens
gggaagugugguuucuuuacag

SEQ ID NO: 276759 - RNA, 22 nt, Homo sapiens
gggaauggaagacauuaugaug

SEQ ID NO: 276760 - RNA, 22 nt, Homo sapiens
gggucauggaugugaagcuaga

SEQ ID NO: 276761 - RNA, 19 nt, Homo sapiens
ggucauggagguuguguga

SEQ ID NO: 276762 - RNA, 22 nt, Homo sapiens
ggucauggauaagauccagaag

SEQ ID NO: 276763 - RNA, 22 nt, Homo sapiens
ggucauggauguuuauaguaca

SEQ ID NO: 276764 - RNA, 22 nt, Homo sapiens
ggugacugguuuaucuggcagu

SEQ ID NO: 276765 - RNA, 19 nt, Homo sapiens
ggugagaaauuaugggucu

SEQ ID NO: 276766 - RNA, 22 nt, Homo sapiens
ggugaguggugcuuaaguucag

SEQ ID NO: 276767 - RNA, 22 nt, Homo sapiens
ggugccuacugugugucaggca

SEQ ID NO: 276768 - RNA, 22 nt, Homo sapiens
gguggucuuccccuggaguucg

SEQ ID NO: 276769 - RNA, 22 nt, Homo sapiens
gguggugguauuucagaaaaug

SEQ ID NO: 276770 - RNA, 22 nt, Homo sapiens
guaaaugcagaugcaugaccuu

SEQ ID NO: 276771 - RNA, 22 nt, Homo sapiens
guaaauguccugcuacagagug

SEQ ID NO: 276772 - RNA, 22 nt, Homo sapiens
guaauacuuuugggauauuaga

SEQ ID NO: 276773 - RNA, 22 nt, Homo sapiens
guaaucucagcuacuugggagu

SEQ ID NO: 276774 - RNA, 22 nt, Homo sapiens
guagaauguauacaguauacag

SEQ ID NO: 276775 - RNA, 22 nt, Homo sapiens
guauacuucugaaaauagcuau

SEQ ID NO: 276776 - RNA, 22 nt, Homo sapiens
guaugucuuuauagcagugugg

SEQ ID NO: 276777 - RNA, 22 nt, Homo sapiens
guauugccacuuuugaacaguu

SEQ ID NO: 276778 - RNA, 22 nt, Homo sapiens
gucacagaaaaagauaugccaa

SEQ ID NO: 276779 - RNA, 22 nt, Homo sapiens
gucaccauugagucauuuccuc

SEQ ID NO: 276780 - RNA, 22 nt, Homo sapiens
gucacugucuacuguaauagcc

SEQ ID NO: 276781 - RNA, 22 nt, Homo sapiens
gucuuuggaaagacaaaguuca

SEQ ID NO: 276782 - RNA, 17 nt, Homo sapiens
gucuuugguugaguuua

SEQ ID NO: 276783 - RNA, 22 nt, Homo sapiens
gucuuuguuauuaugaaucaac

SEQ ID NO: 276784 - RNA, 22 nt, Homo sapiens
gugaccagaugggcaggggugu

SEQ ID NO: 276785 - RNA, 22 nt, Homo sapiens
gugagaagaaaaauauggcugu

SEQ ID NO: 276786 - RNA, 22 nt, Homo sapiens
gugagaauauuuuaaauacuaa

SEQ ID NO: 276787 - RNA, 22 nt, Homo sapiens
gugagaaucaaacuacauaaau

SEQ ID NO: 276788 - RNA, 22 nt, Homo sapiens
ugagaacugguagcacuuguga

SEQ ID NO: 276789 - RNA, 22 nt, Homo sapiens
ugagaaugaugauuuccaguuu

SEQ ID NO: 276790 - RNA, 22 nt, Homo sapiens
gugcauaugcaugugcaugcac

SEQ ID NO: 276791 - RNA, 22 nt, Homo sapiens
gugccuuuucugagcaaugagc

SEQ ID NO: 276792 - RNA, 22 nt, Homo sapiens
guggaaaucucugugugacuua

SEQ ID NO: 276793 - RNA, 22 nt, Homo sapiens
guggaagauaguguguuaaugu

SEQ ID NO: 276794 - RNA, 22 nt, Homo sapiens
guggcacaauuaaguagcuauu

SEQ ID NO: 276795 - RNA, 22 nt, Homo sapiens
guggcuuguaggggucaaggga

SEQ ID NO: 276796 - RNA, 22 nt, Homo sapiens
gugggcaaagcuaguguguaga

SEQ ID NO: 276797 - RNA, 22 nt, Homo sapiens
gugggguaggugacuugaugag

SEQ ID NO: 276798 - RNA, 22 nt, Homo sapiens
gugguuuuaauauucagucuag

SEQ ID NO: 276799 - RNA, 22 nt, Homo sapiens
gugucaguggggagugaucuuc

SEQ ID NO: 276800 - RNA, 22 nt, Homo sapiens
gugucuccugccuucaugcagc

SEQ ID NO: 276801 - RNA, 22 nt, Homo sapiens
guguggcaggugggggcucaga

SEQ ID NO: 276802 - RNA, 22 nt, Homo sapiens
guguuugguugauagagccacu

SEQ ID NO: 276803 - RNA, 22 nt, Homo sapiens
guuaugcagcaauugauaaucu

SEQ ID NO: 276804 - RNA, 22 nt, Homo sapiens
guucccaguugaaaugauuagu

SEQ ID NO: 276805 - RNA, 22 nt, Homo sapiens
guugauguugcagucuugagga

SEQ ID NO: 276806 - RNA, 22 nt, Homo sapiens
guugcacagucuuuccuggacu

SEQ ID NO: 276807 - RNA, 22 nt, Homo sapiens
guuggcaagaggugcuguacac

SEQ ID NO: 276808 - RNA, 22 nt, Homo sapiens
guuuggauuuucuaauuucugu

SEQ ID NO: 276809 - RNA, 22 nt, Homo sapiens
uaaacacucacuucauagccau

SEQ ID NO: 276810 - RNA, 22 nt, Homo sapiens
uaaacugcuugaaaugguguca

SEQ ID NO: 276811 - RNA, 22 nt, Homo sapiens
uaaacugcuugaggguaaguac

SEQ ID NO: 276812 - RNA, 22 nt, Homo sapiens
uaaagcauguaauuagguuaga

SEQ ID NO: 276813 - RNA, 22 nt, Homo sapiens
uaaagcuaugagaacaccguag

SEQ ID NO: 276814 - RNA, 22 nt, Homo sapiens
uaaagcuauuauaguuauguuu

SEQ ID NO: 276815 - RNA, 22 nt, Homo sapiens
uaaaugcucuuuaaaagugcuu

SEQ ID NO: 276816 - RNA, 22 nt, Homo sapiens
uaaaugcuugagaugauggaua

SEQ ID NO: 276817 - RNA, 22 nt, Homo sapiens
uaacauugucuugcuuaguuuu

SEQ ID NO: 276818 - RNA, 22 nt, Homo sapiens
uaacuaguggaauuugauuuca

SEQ ID NO: 276819 - RNA, 22 nt, Homo sapiens
uaagagagcuccaucuuuuccu

SEQ ID NO: 276820 - RNA, 22 nt, Homo sapiens
uaaggcacauaggccuggaaac

SEQ ID NO: 276821 - RNA, 22 nt, Homo sapiens
uaaggcuaggaauucucugaag

SEQ ID NO: 276822 - RNA, 22 nt, Homo sapiens
uaagugacuuugagauuccuca

SEQ ID NO: 276823 - RNA, 21 nt, Homo sapiens
uaauaaugucucagacaccua

SEQ ID NO: 276824 - RNA, 22 nt, Homo sapiens
uaauacuagugaauagcaggau

SEQ ID NO: 276825 - RNA, 22 nt, Homo sapiens
uaauccugucuugaccaucagg

SEQ ID NO: 276826 - RNA, 22 nt, Homo sapiens
uaaugcaucagugguaguucuu

SEQ ID NO: 276827 - RNA, 22 nt, Homo sapiens
uaaugcauguaaugggcugaua

SEQ ID NO: 276828 - RNA, 22 nt, Homo sapiens
uacaaaguaacaguuccuguau

SEQ ID NO: 276829 - RNA, 21 nt, Homo sapiens
uacaaugcacaggagagccuc

SEQ ID NO: 276830 - RNA, 22 nt, Homo sapiens
uacagaauugcagguguggcag

SEQ ID NO: 276831 - RNA, 22 nt, Homo sapiens
uacagcacaggugcagguguug

SEQ ID NO: 276832 - RNA, 22 nt, Homo sapiens
uacagcacugugcauagugguu

SEQ ID NO: 276833 - RNA, 22 nt, Homo sapiens
uacagguauagauguguguucu

SEQ ID NO: 276834 - RNA, 22 nt, Homo sapiens
uacaggugcucuacagacagga

SEQ ID NO: 276835 - RNA, 22 nt, Homo sapiens
uacauugcacuuuauuagauac

SEQ ID NO: 276836 - RNA, 16 nt, Homo sapiens
uacauuuguuacaugg

SEQ ID NO: 276837 - RNA, 22 nt, Homo sapiens
uacccucuggauacccuuguuc

SEQ ID NO: 276838 - RNA, 22 nt, Homo sapiens
uaccugagacaacuuugaggaa

SEQ ID NO: 276839 - RNA, 22 nt, Homo sapiens
uacucuuuagcuccuuaaggaa

SEQ ID NO: 276840 - RNA, 22 nt, Homo sapiens
uagaagcugagaauguccucag

SEQ ID NO: 276841 - RNA, 22 nt, Homo sapiens
uagacaacugaaacacugugca

SEQ ID NO: 276842 - RNA, 22 nt, Homo sapiens
uagaggaaugaauuuggccaga

SEQ ID NO: 276843 - RNA, 22 nt, Homo sapiens
uagauuauuggcugauuugauc

SEQ ID NO: 276844 - RNA, 22 nt, Homo sapiens
uagcacagggaauugguucucu

SEQ ID NO: 276845 - RNA, 19 nt, Homo sapiens
uagcacagggucccagacu

SEQ ID NO: 276846 - RNA, 22 nt, Homo sapiens
uagcacaugucagguaauuugc

SEQ ID NO: 276847 - RNA, 22 nt, Homo sapiens
uagcagcaccccacucuacugg

SEQ ID NO: 276848 - RNA, 20 nt, Homo sapiens
uagcagcagacagagggagg

SEQ ID NO: 276849 - RNA, 22 nt, Homo sapiens
uagcaggaaaggggucagaucu

SEQ ID NO: 276850 - RNA, 20 nt, Homo sapiens
uagcaggugucaggugauau

SEQ ID NO: 276851 - RNA, 22 nt, Homo sapiens
uagcuaguauuuugcugaggau

SEQ ID NO: 276852 - RNA, 21 nt, Homo sapiens
uagcucagugguguugccaua

SEQ ID NO: 276853 - RNA, 17 nt, Homo sapiens
uagcuucacauuaggaa

SEQ ID NO: 276854 - RNA, 22 nt, Homo sapiens
uaggcacuguguuuguaggagu

SEQ ID NO: 276855 - RNA, 21 nt, Homo sapiens
uaggccgggugcaggaugcuu

SEQ ID NO: 276856 - RNA, 22 nt, Homo sapiens
uagggcuugugaucagguguag

SEQ ID NO: 276857 - RNA, 22 nt, Homo sapiens
uagggcuuuaguuugcuugugu

SEQ ID NO: 276858 - RNA, 22 nt, Homo sapiens
uagggcuuuuccaagcugccac

SEQ ID NO: 276859 - RNA, 22 nt, Homo sapiens
uaggugaaugcuggaagaaaug

SEQ ID NO: 276860 - RNA, 22 nt, Homo sapiens
uaggugcacaguaaauauaugu

SEQ ID NO: 276861 - RNA, 22 nt, Homo sapiens
uauacaugugccauguuggugu

SEQ ID NO: 276862 - RNA, 22 nt, Homo sapiens
uauaugcucugggauccugaaa

SEQ ID NO: 276863 - RNA, 22 nt, Homo sapiens
uauauguucugugucccuuucg

SEQ ID NO: 276864 - RNA, 23 nt, Homo sapiens
uaucucaaugcacagagaggaaa

SEQ ID NO: 276865 - RNA, 22 nt, Homo sapiens
uaucucacauauucaguagguu

SEQ ID NO: 276866 - RNA, 22 nt, Homo sapiens
uaucucuuuucauguguaaaug

SEQ ID NO: 276867 - RNA, 22 nt, Homo sapiens
uaucugcaucccauuuuuauca

SEQ ID NO: 276868 - RNA, 22 nt, Homo sapiens
uaugaauuuuauccaggauaua

SEQ ID NO: 276869 - RNA, 22 nt, Homo sapiens
uaugacauaguccuuaacccuc

SEQ ID NO: 276870 - RNA, 22 nt, Homo sapiens
uaugacuuguuuucuggucugc

SEQ ID NO: 276871 - RNA, 19 nt, Homo sapiens
uaugcaacuuauagugcug

SEQ ID NO: 276872 - RNA, 22 nt, Homo sapiens
uaugcuuauaaacauuugucag

SEQ ID NO: 276873 - RNA, 22 nt, Homo sapiens
uauggcugcuuucacacuacaa

SEQ ID NO: 276874 - RNA, 22 nt, Homo sapiens
uauggcuucuauaaggaagcuu

SEQ ID NO: 276875 - RNA, 22 nt, Homo sapiens
uauggguuucagagggugauag

SEQ ID NO: 276876 - RNA, 22 nt, Homo sapiens
uaugugcacaugcccuggugac

SEQ ID NO: 276877 - RNA, 22 nt, Homo sapiens
uauuagguuggggcaaaaguaa

SEQ ID NO: 276878 - RNA, 22 nt, Homo sapiens
uauuccagcccuggugagccag

SEQ ID NO: 276879 - RNA, 22 nt, Homo sapiens
uauuccauuugggucaggauga

SEQ ID NO: 276880 - RNA, 22 nt, Homo sapiens
uauuccucuuuguugagguuau

SEQ ID NO: 276881 - RNA, 22 nt, Homo sapiens
uauuggcucuguuucucugaag

SEQ ID NO: 276882 - RNA, 22 nt, Homo sapiens
uauuguuaaagauguuaaugau

SEQ ID NO: 276883 - RNA, 22 nt, Homo sapiens
uauuugauugacuuuagcagga

SEQ ID NO: 276884 - RNA, 22 nt, Homo sapiens
uauuugguagcuauuuugcagu

SEQ ID NO: 276885 - RNA, 20 nt, Homo sapiens
ugagaacauguggcauuugg

SEQ ID NO: 276886 - RNA, 22 nt, Homo sapiens
ugagaacugcagggagcugcau

SEQ ID NO: 276887 - RNA, 22 nt, Homo sapiens
ugcaagaggagacuguacucag

SEQ ID NO: 276888 - RNA, 23 nt, Homo sapiens
ugcaccacuacacacucuugggu

SEQ ID NO: 276889 - RNA, 22 nt, Homo sapiens
ugcagagaaacauuuuguauuu

SEQ ID NO: 276890 - RNA, 17 nt, Homo sapiens
ugcagcacacugauggg

SEQ ID NO: 276891 - RNA, 22 nt, Homo sapiens
ugcagcauugcacuccagccug

SEQ ID NO: 276892 - RNA, 22 nt, Homo sapiens
ugcauacacaagcauacaugua

SEQ ID NO: 276893 - RNA, 22 nt, Homo sapiens
ugcauauguugaaccagccuug

SEQ ID NO: 276894 - RNA, 21 nt, Homo sapiens
ugcauauuggaacuuucucuc

SEQ ID NO: 276895 - RNA, 20 nt, Homo sapiens
ugccaagaaaugaggguauu

SEQ ID NO: 276896 - RNA, 22 nt, Homo sapiens
ugccauugcacuccagccuggg

SEQ ID NO: 276897 - RNA, 22 nt, Homo sapiens
ugcccguaauuccagcacuuug

SEQ ID NO: 276898 - RNA, 22 nt, Homo sapiens
ugcucaccugcugcucaccucc

SEQ ID NO: 276899 - RNA, 22 nt, Homo sapiens
ugcugcuguuguuguuacuagc

SEQ ID NO: 276900 - RNA, 22 nt, Homo sapiens
ugcugguauuauguuauccaga

SEQ ID NO: 276901 - RNA, 22 nt, Homo sapiens
ugcuuugguagaaaucuuuggu

SEQ ID NO: 276902 - RNA, 22 nt, Homo sapiens
uggaagacauugggugaagggu

SEQ ID NO: 276903 - RNA, 22 nt, Homo sapiens
uggaagacucaagguggugaau

SEQ ID NO: 276904 - RNA, 23 nt, Homo sapiens
uggaagacuccucucuuggcugc

SEQ ID NO: 276905 - RNA, 20 nt, Homo sapiens
uggaagccuggugcuaucuu

SEQ ID NO: 276906 - RNA, 22 nt, Homo sapiens
uggaagguaaguuuugagcauu

SEQ ID NO: 276907 - RNA, 22 nt, Homo sapiens
uggaagugucugugcccagcuc

SEQ ID NO: 276908 - RNA, 22 nt, Homo sapiens
uggaauaucaugagaguuuguu

SEQ ID NO: 276909 - RNA, 22 nt, Homo sapiens
uggaaucaucaacgaaugaaau

SEQ ID NO: 276910 - RNA, 20 nt, Homo sapiens
uggaaucugaagaucucagu

SEQ ID NO: 276911 - RNA, 20 nt, Homo sapiens
uggaaugcagccuccuucug

SEQ ID NO: 276912 - RNA, 19 nt, Homo sapiens
uggaauggauuuaaaugug

SEQ ID NO: 276913 - RNA, 22 nt, Homo sapiens
uggacacugguggauauggaau

SEQ ID NO: 276914 - RNA, 20 nt, Homo sapiens
uggaccagagagguggggac

SEQ ID NO: 276915 - RNA, 22 nt, Homo sapiens
uggacuguaaauuggggacucu

SEQ ID NO: 276916 - RNA, 22 nt, Homo sapiens
uggacuguaagugccuugagua

SEQ ID NO: 276917 - RNA, 22 nt, Homo sapiens
uggagggcuagucauuucuuuu

SEQ ID NO: 276918 - RNA, 22 nt, Homo sapiens
uggagucuugcucuguugccca

SEQ ID NO: 276919 - RNA, 21 nt, Homo sapiens
uggagugcaacacuagguaua

SEQ ID NO: 276920 - RNA, 22 nt, Homo sapiens
uggaugccuaauaaaugcagac

SEQ ID NO: 276921 - RNA, 20 nt, Homo sapiens
uggauugugaugggauuugc

SEQ ID NO: 276922 - RNA, 22 nt, Homo sapiens
uggcaaagugugacgugggggu

SEQ ID NO: 276923 - RNA, 22 nt, Homo sapiens
uggcaaauagcaauaggagggu

SEQ ID NO: 276924 - RNA, 22 nt, Homo sapiens
uggcaaaucagaggcauggaca

SEQ ID NO: 276925 - RNA, 22 nt, Homo sapiens
uggcaaaugaaagaaagccagu

SEQ ID NO: 276926 - RNA, 22 nt, Homo sapiens
uggcaaauuccaaaguuaauuc

SEQ ID NO: 276927 - RNA, 22 nt, Homo sapiens
uggcaagaaccacaguuacuuu

SEQ ID NO: 276928 - RNA, 22 nt, Homo sapiens
uggcaagaccccaucucuacaa

SEQ ID NO: 276929 - RNA, 22 nt, Homo sapiens
uggcaagagggaugcaagguuu

SEQ ID NO: 276930 - RNA, 23 nt, Homo sapiens
uggcaagauuuguauugccugga

SEQ ID NO: 276931 - RNA, 20 nt, Homo sapiens
uggcaagugggaauuguggg

SEQ ID NO: 276932 - RNA, 22 nt, Homo sapiens
uggcaauaauucagugugggcu

SEQ ID NO: 276933 - RNA, 22 nt, Homo sapiens
uggcacuggagauacauuaaua

SEQ ID NO: 276934 - RNA, 19 nt, Homo sapiens
uggcacuugacguccggau

SEQ ID NO: 276935 - RNA, 22 nt, Homo sapiens
uggcaguuuacagcuuuaggag

SEQ ID NO: 276936 - RNA, 22 nt, Homo sapiens
uggcaguuucacauggcucaac

SEQ ID NO: 276937 - RNA, 22 nt, Homo sapiens
uggcaguuuuugccuucaauac

SEQ ID NO: 276938 - RNA, 19 nt, Homo sapiens
uggcaugaaugugaacuaa

SEQ ID NO: 276939 - RNA, 22 nt, Homo sapiens
uggcauguaaugcagaaguugc

SEQ ID NO: 276940 - RNA, 22 nt, Homo sapiens
uggcaugucguuuuucauagga

SEQ ID NO: 276941 - RNA, 22 nt, Homo sapiens
uggcauuuucucuguucuuaga

SEQ ID NO: 276942 - RNA, 23 nt, Homo sapiens
uggcauuuuuggcaaugccuucu

SEQ ID NO: 276943 - RNA, 22 nt, Homo sapiens
uggccaguguuuuuccugggcu

SEQ ID NO: 276944 - RNA, 22 nt, Homo sapiens
uggcggagacauggacuucaga

SEQ ID NO: 276945 - RNA, 22 nt, Homo sapiens
uggcuacagaaaguacuaguga

SEQ ID NO: 276946 - RNA, 23 nt, Homo sapiens
uggcuagacguccuuuccugaug

SEQ ID NO: 276947 - RNA, 20 nt, Homo sapiens
ugggaacaugugguauaugg

SEQ ID NO: 276948 - RNA, 22 nt, Homo sapiens
ugggaagaagguuuacuugcca

SEQ ID NO: 276949 - RNA, 22 nt, Homo sapiens
ugggcaagagagcaugacccug

SEQ ID NO: 276950 - RNA, 22 nt, Homo sapiens
ucaaacugucagguugaccaga

SEQ ID NO: 276951 - RNA, 17 nt, Homo sapiens
ucaaaugcucccaguga

SEQ ID NO: 276952 - RNA, 22 nt, Homo sapiens
ucaaaugcucuuugcagagagg

SEQ ID NO: 276953 - RNA, 22 nt, Homo sapiens
ucaaggacuacauggggugaaa

SEQ ID NO: 276954 - RNA, 22 nt, Homo sapiens
ucaaguacuuauuugauaauua

SEQ ID NO: 276955 - RNA, 22 nt, Homo sapiens
ucaaguagugacucgaguuauu

SEQ ID NO: 276956 - RNA, 22 nt, Homo sapiens
ucacaauucucaauuugugaaa

SEQ ID NO: 276957 - RNA, 23 nt, Homo sapiens
ucacacuuaagagaaaugcagcu

SEQ ID NO: 276958 - RNA, 22 nt, Homo sapiens
ucacagacauugaggggaccuu

SEQ ID NO: 276959 - RNA, 22 nt, Homo sapiens
ucacagacugagccaaauagag

SEQ ID NO: 276960 - RNA, 22 nt, Homo sapiens
ucacaggguguuauuagaauua

SEQ ID NO: 276961 - RNA, 18 nt, Homo sapiens
ucacagguaaaguugaca

SEQ ID NO: 276962 - RNA, 22 nt, Homo sapiens
ucacaguauucaugaacaugga

SEQ ID NO: 276963 - RNA, 22 nt, Homo sapiens
ucacaguguuaaaccuuucuuu

SEQ ID NO: 276964 - RNA, 22 nt, Homo sapiens
ucacauuguuauguaaauguuu

SEQ ID NO: 276965 - RNA, 16 nt, Homo sapiens
ucaccccuagagaucc

SEQ ID NO: 276966 - RNA, 22 nt, Homo sapiens
ucacccuguguuuugcguuugc

SEQ ID NO: 276967 - RNA, 19 nt, Homo sapiens
ucaccuugcccugcacaca

SEQ ID NO: 276968 - RNA, 22 nt, Homo sapiens
ucacgguggaaucccagauccc

SEQ ID NO: 276969 - RNA, 21 nt, Homo sapiens
ucacuaguaaaaggugaacug

SEQ ID NO: 276970 - RNA, 20 nt, Homo sapiens
ucacuggguucuugaagucu

SEQ ID NO: 276971 - RNA, 22 nt, Homo sapiens
ucacuuggccgcagccuucucu

SEQ ID NO: 276972 - RNA, 22 nt, Homo sapiens
ucacuuggugaacacauuaugu

SEQ ID NO: 276973 - RNA, 22 nt, Homo sapiens
ucagacacugcccuccaccugu

SEQ ID NO: 276974 - RNA, 22 nt, Homo sapiens
ucagagcaaagacacuuuauca

SEQ ID NO: 276975 - RNA, 22 nt, Homo sapiens
ucagaguagagcgacuucuccu

SEQ ID NO: 276976 - RNA, 22 nt, Homo sapiens
ucagaguggagucugcagccuu

SEQ ID NO: 276977 - RNA, 22 nt, Homo sapiens
ucagauacuggugacaugaaug

SEQ ID NO: 276978 - RNA, 22 nt, Homo sapiens
ucagauguuugagaaguauacu

SEQ ID NO: 276979 - RNA, 20 nt, Homo sapiens
ucagcagucuggagcagagg

SEQ ID NO: 276980 - RNA, 22 nt, Homo sapiens
ucagcagugugaaaacaaacua

SEQ ID NO: 276981 - RNA, 22 nt, Homo sapiens
ucaggcuuuucccagagugaug

SEQ ID NO: 276982 - RNA, 22 nt, Homo sapiens
ucaggugcagagaagaaauggg

SEQ ID NO: 276983 - RNA, 22 nt, Homo sapiens
ucaggugcaguggcucugaccu

SEQ ID NO: 276984 - RNA, 22 nt, Homo sapiens
ucaguaguaaauggauuuggaa

SEQ ID NO: 276985 - RNA, 22 nt, Homo sapiens
ucaguauaugaaucuggggcag

SEQ ID NO: 276986 - RNA, 22 nt, Homo sapiens
ucagucauugauggaguagguc

SEQ ID NO: 276987 - RNA, 23 nt, Homo sapiens
ucagugaaggaacaacuaaauag

SEQ ID NO: 276988 - RNA, 22 nt, Homo sapiens
ucagugcuuggcacagagagcu

SEQ ID NO: 276989 - RNA, 21 nt, Homo sapiens
ucauauguaucuuugugccuc

SEQ ID NO: 276990 - RNA, 22 nt, Homo sapiens
ucaucagugcuugcaaauuauu

SEQ ID NO: 276991 - RNA, 22 nt, Homo sapiens
ucauucacucccuugaaguuag

SEQ ID NO: 276992 - RNA, 22 nt, Homo sapiens
ucauugcaaucucugccucccg

SEQ ID NO: 276993 - RNA, 22 nt, Homo sapiens
ucauuguccaacuucuuucagu

SEQ ID NO: 276994 - RNA, 22 nt, Homo sapiens
uccacagugguggaauuguuca

SEQ ID NO: 276995 - RNA, 22 nt, Homo sapiens
caugauauugcagaauguuggu

SEQ ID NO: 276996 - RNA, 22 nt, Homo sapiens
caugcagcacacaugucugugc

SEQ ID NO: 276997 - RNA, 22 nt, Homo sapiens
cauggcccuggguccauaggaa

SEQ ID NO: 276998 - RNA, 22 nt, Homo sapiens
cauugggugagaacaugcuccu

SEQ ID NO: 276999 - RNA, 23 nt, Homo sapiens
ccacacuguuuagaauggcauca

SEQ ID NO: 277000 - RNA, 22 nt, Homo sapiens
ccagaguggagccuuugcgagg

SEQ ID NO: 277001 - RNA, 22 nt, Homo sapiens
ccagaguugccucagguuucug

SEQ ID NO: 277002 - RNA, 22 nt, Homo sapiens
ccagaguuucugauucagcagg

SEQ ID NO: 277003 - RNA, 20 nt, Homo sapiens
ccagcaucauuagauucugg

SEQ ID NO: 277004 - RNA, 23 nt, Homo sapiens
ccaguauuuauguaaggaagugu

SEQ ID NO: 277005 - RNA, 18 nt, Homo sapiens
ccagugcaaggaaagccc

SEQ ID NO: 277006 - RNA, 20 nt, Homo sapiens
ccaguguuauuuauguucua

SEQ ID NO: 277007 - RNA, 22 nt, Homo sapiens
ccaguuuucaagauaaugguuu

SEQ ID NO: 277008 - RNA, 21 nt, Homo sapiens
ccauggcaaugguaaacugac

SEQ ID NO: 277009 - RNA, 22 nt, Homo sapiens
cccagugugcugggugacagcu

SEQ ID NO: 277010 - RNA, 19 nt, Homo sapiens
ccccuguggauaccgaggg

SEQ ID NO: 277011 - RNA, 22 nt, Homo sapiens
ccuccauuugugucaggaaguc

SEQ ID NO: 277012 - RNA, 21 nt, Homo sapiens
ccugaugaccucugagaguua

SEQ ID NO: 277013 - RNA, 21 nt, Homo sapiens
ccugauguucacuuggccuuc

SEQ ID NO: 277014 - RNA, 22 nt, Homo sapiens
ccuggaagaaaggugcuaaaua

SEQ ID NO: 277015 - RNA, 22 nt, Homo sapiens
ccuuggcaauggcuggggcuga

SEQ ID NO: 277016 - RNA, 22 nt, Homo sapiens
ccuuuuugaguugccagaguuc

SEQ ID NO: 277017 - RNA, 22 nt, Homo sapiens
cgcccuguagcuagcuagaggu

SEQ ID NO: 277018 - RNA, 22 nt, Homo sapiens
cuaaaacuuucugagugcagca

SEQ ID NO: 277019 - RNA, 22 nt, Homo sapiens
cuaaaguagccaggacugcagg

SEQ ID NO: 277020 - RNA, 22 nt, Homo sapiens
cuacagguaugaaagggaguau

SEQ ID NO: 277021 - RNA, 22 nt, Homo sapiens
cuacuauguagagauauugaau

SEQ ID NO: 277022 - RNA, 22 nt, Homo sapiens
cuagcccagugcuccuggauca

SEQ ID NO: 277023 - RNA, 22 nt, Homo sapiens
cuagcuccauauaaagcaggau

SEQ ID NO: 277024 - RNA, 22 nt, Homo sapiens
cuagguucucaaaccagcguca

SEQ ID NO: 277025 - RNA, 22 nt, Homo sapiens
cuagucacauuuucaucaaaua

SEQ ID NO: 277026 - RNA, 22 nt, Homo sapiens
cuaugcuucuuaaauuaguuau

SEQ ID NO: 277027 - RNA, 22 nt, Homo sapiens
cuaugcuuucugggcccugggu

SEQ ID NO: 277028 - RNA, 22 nt, Homo sapiens
cuauggcucugucuuuuaaguu

SEQ ID NO: 277029 - RNA, 22 nt, Homo sapiens
cuaugguuucucaaacuccuga

SEQ ID NO: 277030 - RNA, 20 nt, Homo sapiens
cucacagacagcuucuuucu

SEQ ID NO: 277031 - RNA, 22 nt, Homo sapiens
cucaccuugugauccacccacc

SEQ ID NO: 277032 - RNA, 21 nt, Homo sapiens
cucucugcuuaugaauaguga

SEQ ID NO: 277033 - RNA, 22 nt, Homo sapiens
cucugcuuaaugucccacuuga

SEQ ID NO: 277034 - RNA, 22 nt, Homo sapiens
cugaauguccaggcagagguuu

SEQ ID NO: 277035 - RNA, 22 nt, Homo sapiens
cugaauguuucacucugaaaug

SEQ ID NO: 277036 - RNA, 22 nt, Homo sapiens
cugaauguuuucuucuauucug

SEQ ID NO: 277037 - RNA, 22 nt, Homo sapiens
cugacauggggauccaccuuag

SEQ ID NO: 277038 - RNA, 22 nt, Homo sapiens
cugagaaugaugauuuccaguu

SEQ ID NO: 277039 - RNA, 22 nt, Homo sapiens
cugagcccauucuggggagaag

SEQ ID NO: 277040 - RNA, 22 nt, Homo sapiens
cugaggaaguucuuuaacaguu

SEQ ID NO: 277041 - RNA, 22 nt, Homo sapiens
cugaggguagaaggaucacuug

SEQ ID NO: 277042 - RNA, 22 nt, Homo sapiens
cugaugaaguauuuguucugga

SEQ ID NO: 277043 - RNA, 22 nt, Homo sapiens
cuggaaucuagaaaagguaagg

SEQ ID NO: 277044 - RNA, 22 nt, Homo sapiens
cuggaauucaaaaucugaauuu

SEQ ID NO: 277045 - RNA, 22 nt, Homo sapiens
cuggcaagaggauaaaguccua

SEQ ID NO: 277046 - RNA, 22 nt, Homo sapiens
cuggcaagagugaaccagcugu

SEQ ID NO: 277047 - RNA, 22 nt, Homo sapiens
cuggcagugcuuguuauccugg

SEQ ID NO: 277048 - RNA, 22 nt, Homo sapiens
cuggcaucuaaauacuugaugu

SEQ ID NO: 277049 - RNA, 22 nt, Homo sapiens
cuggcucugggcuaaagaaaua

SEQ ID NO: 277050 - RNA, 18 nt, Homo sapiens
aucauugcacugucuugc

SEQ ID NO: 277051 - RNA, 22 nt, Homo sapiens
auccaguguuuucuuuugucac

SEQ ID NO: 277052 - RNA, 22 nt, Homo sapiens
aucuagagaggcagucuggccg

SEQ ID NO: 277053 - RNA, 22 nt, Homo sapiens
aucuccaggugccagcugcgcc

SEQ ID NO: 277054 - RNA, 22 nt, Homo sapiens
aucucuugccagucagaauggu

SEQ ID NO: 277055 - RNA, 22 nt, Homo sapiens
aucugcaaauaaugaagauugg

SEQ ID NO: 277056 - RNA, 22 nt, Homo sapiens
aucugcacaucuguguuuuugu

SEQ ID NO: 277057 - RNA, 19 nt, Homo sapiens
aucuggaguuccuggggcu

SEQ ID NO: 277058 - RNA, 22 nt, Homo sapiens
aucugggguuggcaaaguuugg

SEQ ID NO: 277059 - RNA, 22 nt, Homo sapiens
aucuuuggugaguucuuugguc

SEQ ID NO: 277060 - RNA, 22 nt, Homo sapiens
augaaaagcauaaacgcugaag

SEQ ID NO: 277061 - RNA, 22 nt, Homo sapiens
augaaacuggcuaauuuuugua

SEQ ID NO: 277062 - RNA, 22 nt, Homo sapiens
augaaaugcauguuaaguccgu

SEQ ID NO: 277063 - RNA, 18 nt, Homo sapiens
augaagucaucacuuuua

SEQ ID NO: 277064 - RNA, 22 nt, Homo sapiens
augacauugaugcucuggcugg

SEQ ID NO: 277065 - RNA, 22 nt, Homo sapiens
augaccaaugggcagagcuaga

SEQ ID NO: 277066 - RNA, 22 nt, Homo sapiens
augaccagagagugcgcagggu

SEQ ID NO: 277067 - RNA, 22 nt, Homo sapiens
augacuauugcacuuuccuggu

SEQ ID NO: 277068 - RNA, 22 nt, Homo sapiens
augacuggauaauggacacaca

SEQ ID NO: 277069 - RNA, 22 nt, Homo sapiens
augagaacugucaaugagagcu

SEQ ID NO: 277070 - RNA, 22 nt, Homo sapiens
augagauaaaccaucucuuaag

SEQ ID NO: 277071 - RNA, 22 nt, Homo sapiens
augagauacuacaaaugaguuu

SEQ ID NO: 277072 - RNA, 22 nt, Homo sapiens
augagaucaaauuuaagcuguu

SEQ ID NO: 277073 - RNA, 22 nt, Homo sapiens
augagcuaauauggguaaguug

SEQ ID NO: 277074 - RNA, 22 nt, Homo sapiens
augagcuguuuggaagacacuu

SEQ ID NO: 277075 - RNA, 22 nt, Homo sapiens
augaggaaggagccuuugucug

SEQ ID NO: 277076 - RNA, 22 nt, Homo sapiens
augaggcacugcgcccuacuga

SEQ ID NO: 277077 - RNA, 22 nt, Homo sapiens
augauauuauucuagcccagag

SEQ ID NO: 277078 - RNA, 20 nt, Homo sapiens
augcaaacccugcuuugugg

SEQ ID NO: 277079 - RNA, 22 nt, Homo sapiens
augcaacuugaaauuuuccgga

SEQ ID NO: 277080 - RNA, 22 nt, Homo sapiens
augcaagacaccacgugagaau

SEQ ID NO: 277081 - RNA, 22 nt, Homo sapiens
augcagauauuuuugugguugc

SEQ ID NO: 277082 - RNA, 22 nt, Homo sapiens
augccacugcacuccaaccugg

SEQ ID NO: 277083 - RNA, 22 nt, Homo sapiens
auggaaaugaagggcuggcccu

SEQ ID NO: 277084 - RNA, 22 nt, Homo sapiens
auggaacuggagaucauuaugu

SEQ ID NO: 277085 - RNA, 22 nt, Homo sapiens
auggaagaaaguuggguucuug

SEQ ID NO: 277086 - RNA, 22 nt, Homo sapiens
auggaagaauugucggggaugu

SEQ ID NO: 277087 - RNA, 22 nt, Homo sapiens
auggaagacuccucuuugggua

SEQ ID NO: 277088 - RNA, 22 nt, Homo sapiens
auggaaggagaauggucuuuga

SEQ ID NO: 277089 - RNA, 22 nt, Homo sapiens
auggaaggagaggaaugaauga

SEQ ID NO: 277090 - RNA, 22 nt, Homo sapiens
auggaguguggaacugggaauc

SEQ ID NO: 277091 - RNA, 22 nt, Homo sapiens
auggcacagaguagaugcucaa

SEQ ID NO: 277092 - RNA, 22 nt, Homo sapiens
auggcacugauggaaguaccuu

SEQ ID NO: 277093 - RNA, 22 nt, Homo sapiens
auggcagagucagaaagucagg

SEQ ID NO: 277094 - RNA, 22 nt, Homo sapiens
auggcagcugguuuuacccuag

SEQ ID NO: 277095 - RNA, 22 nt, Homo sapiens
auggccauuacuaagaauguuu

SEQ ID NO: 277096 - RNA, 22 nt, Homo sapiens
auggcccccuguuugugaacau

SEQ ID NO: 277097 - RNA, 23 nt, Homo sapiens
auggcccuggugggagugucuuu

SEQ ID NO: 277098 - RNA, 22 nt, Homo sapiens
auggcggugugggcggugcagc

SEQ ID NO: 277099 - RNA, 22 nt, Homo sapiens
auggucuuuguuucuaauucug

SEQ ID NO: 277100 - RNA, 22 nt, Homo sapiens
auguaacaguauuuggagaugu

SEQ ID NO: 277101 - RNA, 22 nt, Homo sapiens
augugccaauuaggauuccaag

SEQ ID NO: 277102 - RNA, 22 nt, Homo sapiens
augugugaaucccagaaccugu

SEQ ID NO: 277103 - RNA, 22 nt, Homo sapiens
auuaagugaaugaaguuguucc

SEQ ID NO: 277104 - RNA, 21 nt, Homo sapiens
auuaaugcucugguuagaggc

SEQ ID NO: 277105 - RNA, 22 nt, Homo sapiens
auuauaugucaucacagacacc

SEQ ID NO: 277106 - RNA, 22 nt, Homo sapiens
auucacugugcuuggccaaauu

SEQ ID NO: 277107 - RNA, 22 nt, Homo sapiens
uuacagcagugccccacuccca

SEQ ID NO: 277108 - RNA, 17 nt, Homo sapiens
uuacaggugcugagagu

SEQ ID NO: 277109 - RNA, 21 nt, Homo sapiens
uuacaguugguugugaggugg

SEQ ID NO: 277110 - RNA, 22 nt, Homo sapiens
uuacauguuguggguuguggcc

SEQ ID NO: 277111 - RNA, 22 nt, Homo sapiens
uuacuguacugcucuuaaccug

SEQ ID NO: 277112 - RNA, 18 nt, Homo sapiens
uuagagugcauuacuuug

SEQ ID NO: 277113 - RNA, 22 nt, Homo sapiens
uuagcaauugauucucauaagc

SEQ ID NO: 277114 - RNA, 22 nt, Homo sapiens
uuagcagccuucaagcuccaag

SEQ ID NO: 277115 - RNA, 22 nt, Homo sapiens
uuaggugcauggaaguguuuuc

SEQ ID NO: 277116 - RNA, 22 nt, Homo sapiens
uuaguucauugugacuggacuc

SEQ ID NO: 277117 - RNA, 22 nt, Homo sapiens
uuauaacagagacuccugugcu

SEQ ID NO: 277118 - RNA, 22 nt, Homo sapiens
uuauaacucugcagccugguau

SEQ ID NO: 277119 - RNA, 22 nt, Homo sapiens
uuauagguuucuacaggacuau

SEQ ID NO: 277120 - RNA, 22 nt, Homo sapiens
uuaugcuuauugguguacggua

SEQ ID NO: 277121 - RNA, 22 nt, Homo sapiens
uuauuagcacccuaccaugugg

SEQ ID NO: 277122 - RNA, 22 nt, Homo sapiens
uucaagcuauggugaucuuuuc

SEQ ID NO: 277123 - RNA, 22 nt, Homo sapiens
uucaaggacuaaggauuuuugg

SEQ ID NO: 277124 - RNA, 22 nt, Homo sapiens
uucaaguaguucucaugccuca

SEQ ID NO: 277125 - RNA, 22 nt, Homo sapiens
uucaauuaauauuauacucuca

SEQ ID NO: 277126 - RNA, 22 nt, Homo sapiens
uucacagccgcaccccaucacu

SEQ ID NO: 277127 - RNA, 22 nt, Homo sapiens
uucacaguacucccuggaauua

SEQ ID NO: 277128 - RNA, 22 nt, Homo sapiens
uucaccuguagcaugcccuugg

SEQ ID NO: 277129 - RNA, 22 nt, Homo sapiens
uucagaugcacacuguagucua

SEQ ID NO: 277130 - RNA, 22 nt, Homo sapiens
uucagcacaguguggaucauuc

SEQ ID NO: 277131 - RNA, 22 nt, Homo sapiens
uucagcuacuugggaggcugaa

SEQ ID NO: 277132 - RNA, 18 nt, Homo sapiens
uucaguuuguaucugggg

SEQ ID NO: 277133 - RNA, 22 nt, Homo sapiens
uucauagucuaugcaaguaaga

SEQ ID NO: 277134 - RNA, 21 nt, Homo sapiens
uucauaugcacugagugccca

SEQ ID NO: 277135 - RNA, 22 nt, Homo sapiens
uucaucacagucuccgaugccc

SEQ ID NO: 277136 - RNA, 23 nt, Homo sapiens
uucaucagggauauuggccugaa

SEQ ID NO: 277137 - RNA, 22 nt, Homo sapiens
uucaucagggguauuggccaau

SEQ ID NO: 277138 - RNA, 18 nt, Homo sapiens
uucaucaguccucagcug

SEQ ID NO: 277139 - RNA, 22 nt, Homo sapiens
uuccacagggauuugcauugau

SEQ ID NO: 277140 - RNA, 22 nt, Homo sapiens
uuccacaggguugaacuaguuu

SEQ ID NO: 277141 - RNA, 22 nt, Homo sapiens
uuccagugggacgagaugugga

SEQ ID NO: 277142 - RNA, 22 nt, Homo sapiens
uuccauagucauagugcugaug

SEQ ID NO: 277143 - RNA, 22 nt, Homo sapiens
uuccauuuguucggugucgcca

SEQ ID NO: 277144 - RNA, 22 nt, Homo sapiens
uucccagagccugggagugagg

SEQ ID NO: 277145 - RNA, 22 nt, Homo sapiens
uucccuagaacacauggaggga

SEQ ID NO: 277146 - RNA, 22 nt, Homo sapiens
uucccuuucugaaaaucucauu

SEQ ID NO: 277147 - RNA, 22 nt, Homo sapiens
uucccuuuguuaaauuggaaga

SEQ ID NO: 277148 - RNA, 22 nt, Homo sapiens
uuccugugacccccaagcccac

SEQ ID NO: 277149 - RNA, 22 nt, Homo sapiens
uuccuuaguuauuugguccccu

SEQ ID NO: 277150 - RNA, 22 nt, Homo sapiens
uuccuucaugcuugaaggguau

SEQ ID NO: 277151 - RNA, 23 nt, Homo sapiens
uucggcaaaugcccuuuaggcag

SEQ ID NO: 277152 - RNA, 22 nt, Homo sapiens
uucuauggucacagaugcuuga

SEQ ID NO: 277153 - RNA, 22 nt, Homo sapiens
uucuaugguuaccaggcuaguc

SEQ ID NO: 277154 - RNA, 22 nt, Homo sapiens
uucuggcuaugggauacuaaau

SEQ ID NO: 277155 - RNA, 22 nt, Homo sapiens
uucugugguagaaaucucaaau

SEQ ID NO: 277156 - RNA, 22 nt, Homo sapiens
uucuucaggcauucccagaagc

SEQ ID NO: 277157 - RNA, 22 nt, Homo sapiens
uucuucaggccacaaaaauggu

SEQ ID NO: 277158 - RNA, 22 nt, Homo sapiens
uucuucaguuacaacaaggggg

SEQ ID NO: 277159 - RNA, 22 nt, Homo sapiens
uucuucugguuaugaaauuuga

SEQ ID NO: 277160 - RNA, 22 nt, Homo sapiens
uucuuuggaaacaguacuaauu

SEQ ID NO: 277161 - RNA, 22 nt, Homo sapiens
uucuuugguacaagggccgacc

SEQ ID NO: 277162 - RNA, 22 nt, Homo sapiens
uugaaguagaaagacgaaauuu

SEQ ID NO: 277163 - RNA, 22 nt, Homo sapiens
uugaauagaagguuuuuuguuc

SEQ ID NO: 277164 - RNA, 22 nt, Homo sapiens
uugacacuaauuauuauaggug

SEQ ID NO: 277165 - RNA, 22 nt, Homo sapiens
uugacauguaaguacucuauag

SEQ ID NO: 277166 - RNA, 22 nt, Homo sapiens
uugaccccuucuaauagccuca

SEQ ID NO: 277167 - RNA, 22 nt, Homo sapiens
uugagauggaaucucgcuuugu

SEQ ID NO: 277168 - RNA, 22 nt, Homo sapiens
uugagauggagccucacucugc

SEQ ID NO: 277169 - RNA, 22 nt, Homo sapiens
uugagauggagucucacucugc

SEQ ID NO: 277170 - RNA, 22 nt, Homo sapiens
uugagauggagucucacugugu

SEQ ID NO: 277171 - RNA, 22 nt, Homo sapiens
uugagauggagucuugcucucu

SEQ ID NO: 277172 - RNA, 22 nt, Homo sapiens
uugagauggaguguugcucugu

SEQ ID NO: 277173 - RNA, 22 nt, Homo sapiens
uugagcaaugaacgauucaggg

SEQ ID NO: 277174 - RNA, 22 nt, Homo sapiens
uugagcccuggagguggaggcu

SEQ ID NO: 277175 - RNA, 22 nt, Homo sapiens
uugaggaagugguuccccagag

SEQ ID NO: 277176 - RNA, 22 nt, Homo sapiens
uugaggacugagacagaccaag

SEQ ID NO: 277177 - RNA, 22 nt, Homo sapiens
uugaggcaaugaggagaagcug

SEQ ID NO: 277178 - RNA, 22 nt, Homo sapiens
uugaggugaauuugcaggaugc

SEQ ID NO: 277179 - RNA, 22 nt, Homo sapiens
uugagguggugucuugcucugu

SEQ ID NO: 277180 - RNA, 22 nt, Homo sapiens
uugagguguauuguacagcaca

SEQ ID NO: 277181 - RNA, 22 nt, Homo sapiens
uugauguccaucucuagguaaa

SEQ ID NO: 277182 - RNA, 22 nt, Homo sapiens
uugauuagauccaguugauuga

SEQ ID NO: 277183 - RNA, 22 nt, Homo sapiens
uugcaagaaaugcagauucuca

SEQ ID NO: 277184 - RNA, 22 nt, Homo sapiens
uugcacauguugaaccagcaaa

SEQ ID NO: 277185 - RNA, 22 nt, Homo sapiens
uugcacuugcugaggagugauu

SEQ ID NO: 277186 - RNA, 22 nt, Homo sapiens
uugcagcaaagagggaggggca

SEQ ID NO: 277187 - RNA, 22 nt, Homo sapiens
uugcauaauaagagggauacgu

SEQ ID NO: 277188 - RNA, 19 nt, Homo sapiens
uugcauagguugaaccagc

SEQ ID NO: 277189 - RNA, 22 nt, Homo sapiens
uugcauauguugaaccaagcgu

SEQ ID NO: 277190 - RNA, 19 nt, Homo sapiens
uugcauauguugaaccagc

SEQ ID NO: 277191 - RNA, 22 nt, Homo sapiens
uugcauuguacuugguacggcu

SEQ ID NO: 277192 - RNA, 18 nt, Homo sapiens
uugccuauucacucugau

SEQ ID NO: 277193 - RNA, 22 nt, Homo sapiens
uuggaaaaauccaccuugaucu

SEQ ID NO: 277194 - RNA, 22 nt, Homo sapiens
uuggaaauauguuaagugucau

SEQ ID NO: 277195 - RNA, 22 nt, Homo sapiens
uuggaaauguguuugcauucag

SEQ ID NO: 277196 - RNA, 22 nt, Homo sapiens
uuggcaagcuguuaauuauaaa

SEQ ID NO: 277197 - RNA, 22 nt, Homo sapiens
uuggcaaguuucugucagcaaa

SEQ ID NO: 277198 - RNA, 22 nt, Homo sapiens
uuggcaauauuuacugaaguug

SEQ ID NO: 277199 - RNA, 22 nt, Homo sapiens
uuggcacuugauaauauucugg

SEQ ID NO: 277200 - RNA, 22 nt, Homo sapiens
uuggcagcauuccagccaagca

SEQ ID NO: 277201 - RNA, 22 nt, Homo sapiens
uuggcagugguucugacggacc

SEQ ID NO: 277202 - RNA, 23 nt, Homo sapiens
uuggcaucugggacacaagcuga

SEQ ID NO: 277203 - RNA, 22 nt, Homo sapiens
uuggcauugccaaacugucaac

SEQ ID NO: 277204 - RNA, 22 nt, Homo sapiens
uuggccauggagcacuuuucua

SEQ ID NO: 277205 - RNA, 17 nt, Homo sapiens
uugggcaagguagguga

SEQ ID NO: 277206 - RNA, 22 nt, Homo sapiens
uugggguagaauugcaacauau

SEQ ID NO: 277207 - RNA, 22 nt, Homo sapiens
uuggucaaaucugaugggagaa

SEQ ID NO: 277208 - RNA, 22 nt, Homo sapiens
uuguaaagaucauaugcuguuc

SEQ ID NO: 277209 - RNA, 22 nt, Homo sapiens
agacaguguguguauauauggu

SEQ ID NO: 277210 - RNA, 22 nt, Homo sapiens
agacaucauuugauggugggag

SEQ ID NO: 277211 - RNA, 22 nt, Homo sapiens
agagacauugcuccaacucacc

SEQ ID NO: 277212 - RNA, 22 nt, Homo sapiens
agagaccuguaaaguucaggca

SEQ ID NO: 277213 - RNA, 19 nt, Homo sapiens
agagacucauuguagcauu

SEQ ID NO: 277214 - RNA, 22 nt, Homo sapiens
agagagguggguggagccccca

SEQ ID NO: 277215 - RNA, 22 nt, Homo sapiens
agagauaguuuccaacucauac

SEQ ID NO: 277216 - RNA, 22 nt, Homo sapiens
agagcuguguuuuaacuuuuua

SEQ ID NO: 277217 - RNA, 23 nt, Homo sapiens
agagguuuaaucaggcaguugcu

SEQ ID NO: 277218 - RNA, 18 nt, Homo sapiens
agaguaucauuuccccca

SEQ ID NO: 277219 - RNA, 20 nt, Homo sapiens
agagugcuggacugaggagc

SEQ ID NO: 277220 - RNA, 22 nt, Homo sapiens
agauauguuauugauguuaaug

SEQ ID NO: 277221 - RNA, 22 nt, Homo sapiens
agauauguuuaguuucaaaaug

SEQ ID NO: 277222 - RNA, 22 nt, Homo sapiens
agaucacaguaccguaaggcug

SEQ ID NO: 277223 - RNA, 22 nt, Homo sapiens
agaucacagucuuugguuuuag

SEQ ID NO: 277224 - RNA, 22 nt, Homo sapiens
agaugccucauguucuagguuc

SEQ ID NO: 277225 - RNA, 22 nt, Homo sapiens
agaugguauuauagguuucugu

SEQ ID NO: 277226 - RNA, 22 nt, Homo sapiens
agauggugauaaaugugguacc

SEQ ID NO: 277227 - RNA, 22 nt, Homo sapiens
agauggugugcuaggaaaugua

SEQ ID NO: 277228 - RNA, 18 nt, Homo sapiens
agaugguguugcuucugu

SEQ ID NO: 277229 - RNA, 22 nt, Homo sapiens
agauguuguucaucugauuguu

SEQ ID NO: 277230 - RNA, 22 nt, Homo sapiens
agcaacauuuuugaccuuucuu

SEQ ID NO: 277231 - RNA, 22 nt, Homo sapiens
agcaagaaugaacucucccaga

SEQ ID NO: 277232 - RNA, 22 nt, Homo sapiens
agcaagauuguucccauuuucu

SEQ ID NO: 277233 - RNA, 22 nt, Homo sapiens
agcacaguuaaaugaggcuucu

SEQ ID NO: 277234 - RNA, 22 nt, Homo sapiens
agcacauauauuucccaaaaca

SEQ ID NO: 277235 - RNA, 17 nt, Homo sapiens
agcaccacacucucuug

SEQ ID NO: 277236 - RNA, 22 nt, Homo sapiens
agcaccaugggcugaguaagug

SEQ ID NO: 277237 - RNA, 22 nt, Homo sapiens
agcaccguucaaacccagguua

SEQ ID NO: 277238 - RNA, 22 nt, Homo sapiens
agcagcaccaaacagacuaaga

SEQ ID NO: 277239 - RNA, 22 nt, Homo sapiens
agcagcucaagacuuaaauuug

SEQ ID NO: 277240 - RNA, 22 nt, Homo sapiens
agcagcucaugccuuugggagg

SEQ ID NO: 277241 - RNA, 22 nt, Homo sapiens
agcagcuuugaucugaaugauu

SEQ ID NO: 277242 - RNA, 22 nt, Homo sapiens
agcagcuuugcauggccugugg

SEQ ID NO: 277243 - RNA, 22 nt, Homo sapiens
agcagguauucgggucaugggg

SEQ ID NO: 277244 - RNA, 22 nt, Homo sapiens
agcagguguggcuuauccugaa

SEQ ID NO: 277245 - RNA, 22 nt, Homo sapiens
agcaguacauaaaaagcauccu

SEQ ID NO: 277246 - RNA, 22 nt, Homo sapiens
agcaguagugaaaguagacuua

SEQ ID NO: 277247 - RNA, 19 nt, Homo sapiens
agcaucauuauuguuuugg

SEQ ID NO: 277248 - RNA, 19 nt, Homo sapiens
agccaguuuucccagcacc

SEQ ID NO: 277249 - RNA, 23 nt, Homo sapiens
agccugguuucccugcuucuccc

SEQ ID NO: 277250 - RNA, 22 nt, Homo sapiens
agcuaaaucucauguugaauug

SEQ ID NO: 277251 - RNA, 22 nt, Homo sapiens
agcuauauugaggaugccauuc

SEQ ID NO: 277252 - RNA, 18 nt, Homo sapiens
agcucaguguuugcuuac

SEQ ID NO: 277253 - RNA, 22 nt, Homo sapiens
agcuccaucuucagggguucag

SEQ ID NO: 277254 - RNA, 22 nt, Homo sapiens
agcugaguguuccaagagcgag

SEQ ID NO: 277255 - RNA, 20 nt, Homo sapiens
agcugcagauauaaauccgc

SEQ ID NO: 277256 - RNA, 20 nt, Homo sapiens
agcuggguguguuggugcau

SEQ ID NO: 277257 - RNA, 22 nt, Homo sapiens
agcugguauuuugucaaggaua

SEQ ID NO: 277258 - RNA, 22 nt, Homo sapiens
agcuggucucaggugcccugcu

SEQ ID NO: 277259 - RNA, 22 nt, Homo sapiens
agcuggucugauacuuaccucc

SEQ ID NO: 277260 - RNA, 21 nt, Homo sapiens
agcugguuuccacagugugcu

SEQ ID NO: 277261 - RNA, 22 nt, Homo sapiens
agcuguaguuugguggauguaa

SEQ ID NO: 277262 - RNA, 22 nt, Homo sapiens
agcuguguugucugaagucaga

SEQ ID NO: 277263 - RNA, 22 nt, Homo sapiens
agcuguuguucucagaggcuuu

SEQ ID NO: 277264 - RNA, 22 nt, Homo sapiens
agcuucauuccaacuuccuucu

SEQ ID NO: 277265 - RNA, 22 nt, Homo sapiens
agcuuguagugauuugugguaa

SEQ ID NO: 277266 - RNA, 22 nt, Homo sapiens
agcuugugauuuagagugagag

SEQ ID NO: 277267 - RNA, 22 nt, Homo sapiens
agcuugugcuguaugaagggcc

SEQ ID NO: 277268 - RNA, 22 nt, Homo sapiens
agcuuguggugaauacugcuag

SEQ ID NO: 277269 - RNA, 22 nt, Homo sapiens
aggaagacauauagaacuaaaa

SEQ ID NO: 277270 - RNA, 22 nt, Homo sapiens
aggaagacugaaauugcuguuc

SEQ ID NO: 277271 - RNA, 16 nt, Homo sapiens
aggaagacuuagagau

SEQ ID NO: 277272 - RNA, 22 nt, Homo sapiens
aggaaguaauaaguuugguucu

SEQ ID NO: 277273 - RNA, 22 nt, Homo sapiens
aggaaucuaagguaucagguua

SEQ ID NO: 277274 - RNA, 18 nt, Homo sapiens
aggaaugguaauacuuca

SEQ ID NO: 277275 - RNA, 22 nt, Homo sapiens
aggaccccucaucagcaccagu

SEQ ID NO: 277276 - RNA, 22 nt, Homo sapiens
aggagcuuuggggaaaacagau

SEQ ID NO: 277277 - RNA, 22 nt, Homo sapiens
aggagguaggaauugugcuagg

SEQ ID NO: 277278 - RNA, 22 nt, Homo sapiens
aggaguguguauuaaugaaauu

SEQ ID NO: 277279 - RNA, 22 nt, Homo sapiens
aggcaagugauagcugcguaau

SEQ ID NO: 277280 - RNA, 22 nt, Homo sapiens
aggcaagugggagacagcauuu

SEQ ID NO: 277281 - RNA, 22 nt, Homo sapiens
aggcaaguugcucaaaugcaaa

SEQ ID NO: 277282 - RNA, 22 nt, Homo sapiens
auagaggacugaggugaucuuu

SEQ ID NO: 277283 - RNA, 22 nt, Homo sapiens
auagaucauugucauuuuagau

SEQ ID NO: 277284 - RNA, 22 nt, Homo sapiens
auagcaaugccccauucccagu

SEQ ID NO: 277285 - RNA, 22 nt, Homo sapiens
auagcacugguuuuucuugguu

SEQ ID NO: 277286 - RNA, 22 nt, Homo sapiens
auagcacuuaccacaggcugca

SEQ ID NO: 277287 - RNA, 22 nt, Homo sapiens
auagcagacauuucaaggcagg

SEQ ID NO: 277288 - RNA, 22 nt, Homo sapiens
auagcagaccaccucucccacu

SEQ ID NO: 277289 - RNA, 22 nt, Homo sapiens
auagcagcaccccacuaccuca

SEQ ID NO: 277290 - RNA, 22 nt, Homo sapiens
auagcagcuugucagggcagac

SEQ ID NO: 277291 - RNA, 22 nt, Homo sapiens
auagcauaucccacaugucaga

SEQ ID NO: 277292 - RNA, 22 nt, Homo sapiens
auaggagcacaaacuauuguga

SEQ ID NO: 277293 - RNA, 19 nt, Homo sapiens
auagggcuagcauauacug

SEQ ID NO: 277294 - RNA, 22 nt, Homo sapiens
auagugaacuuugugagaacaa

SEQ ID NO: 277295 - RNA, 22 nt, Homo sapiens
auagugcugcaaugaacauaca

SEQ ID NO: 277296 - RNA, 22 nt, Homo sapiens
auagugcuuuugaaucuuguug

SEQ ID NO: 277297 - RNA, 23 nt, Homo sapiens
auauaguagaugugcaguaacau

SEQ ID NO: 277298 - RNA, 22 nt, Homo sapiens
auauaugcacacgugugcauau

SEQ ID NO: 277299 - RNA, 22 nt, Homo sapiens
auauaugcuaagugcuaauaaa

SEQ ID NO: 277300 - RNA, 22 nt, Homo sapiens
auauauguuuucugggaagaaa

SEQ ID NO: 277301 - RNA, 22 nt, Homo sapiens
auaucaaggccauuuucuaaau

SEQ ID NO: 277302 - RNA, 22 nt, Homo sapiens
auaugcaaauccauagagacag

SEQ ID NO: 277303 - RNA, 22 nt, Homo sapiens
auaugcacgugcauacacacuu

SEQ ID NO: 277304 - RNA, 22 nt, Homo sapiens
auaugcacuauacacacguaua

SEQ ID NO: 277305 - RNA, 20 nt, Homo sapiens
auaugcauguguuuucacuu

SEQ ID NO: 277306 - RNA, 22 nt, Homo sapiens
auaugguacuuaugcucaaacu

SEQ ID NO: 277307 - RNA, 22 nt, Homo sapiens
auauguaguuucagaaguggaa

SEQ ID NO: 277308 - RNA, 22 nt, Homo sapiens
auauucaagugaggauggcuaa

SEQ ID NO: 277309 - RNA, 22 nt, Homo sapiens
auauugcuccuaauaccacggu

SEQ ID NO: 277310 - RNA, 22 nt, Homo sapiens
auauuggacucugugcuaggaa

SEQ ID NO: 277311 - RNA, 22 nt, Homo sapiens
aucaaagugaaauauuaguuau

SEQ ID NO: 277312 - RNA, 22 nt, Homo sapiens
aucaaaguuucccagaaguugu

SEQ ID NO: 277313 - RNA, 22 nt, Homo sapiens
aucaaaugcuggcagagugccu

SEQ ID NO: 277314 - RNA, 22 nt, Homo sapiens
aucacacucaccuucuguccuu

SEQ ID NO: 277315 - RNA, 22 nt, Homo sapiens
aucacagagucacgggcaacuu

SEQ ID NO: 277316 - RNA, 22 nt, Homo sapiens
aucacagcuacuccucugucuu

SEQ ID NO: 277317 - RNA, 22 nt, Homo sapiens
aucacagguacuauggcugaca

SEQ ID NO: 277318 - RNA, 22 nt, Homo sapiens
aucacagugaaaacagucaauu

SEQ ID NO: 277319 - RNA, 22 nt, Homo sapiens
aucacuggccuuuuuaaaugcu

SEQ ID NO: 277320 - RNA, 22 nt, Homo sapiens
aucacuguccacucaucuuucu

SEQ ID NO: 277321 - RNA, 22 nt, Homo sapiens
aucacugugauuucuacugugc

SEQ ID NO: 277322 - RNA, 22 nt, Homo sapiens
aucagaaucucuugagaguguu

SEQ ID NO: 277323 - RNA, 22 nt, Homo sapiens
aucagauggcuaaaacagaaga

SEQ ID NO: 277324 - RNA, 22 nt, Homo sapiens
aucagauguuuguauaggagua

SEQ ID NO: 277325 - RNA, 19 nt, Homo sapiens
aucagcacaagugugcuuu

SEQ ID NO: 277326 - RNA, 22 nt, Homo sapiens
aucaggaaccuuuuuggugugu

SEQ ID NO: 277327 - RNA, 22 nt, Homo sapiens
aucagucuguuggaauaucgcu

SEQ ID NO: 277328 - RNA, 22 nt, Homo sapiens
aucagugaaagugaaaucuccg

SEQ ID NO: 277329 - RNA, 22 nt, Homo sapiens
aucagugauugauuuaaagacg

SEQ ID NO: 277330 - RNA, 22 nt, Homo sapiens
aucagugcauguuuguugagcu

SEQ ID NO: 277331 - RNA, 22 nt, Homo sapiens
aucauagcucacugcagccucg

SEQ ID NO: 277332 - RNA, 22 nt, Homo sapiens
aucauaucaucugcaaacaaag

SEQ ID NO: 277333 - RNA, 22 nt, Homo sapiens
aucaucaugcacuacagccugg

SEQ ID NO: 277334 - RNA, 22 nt, Homo sapiens
aucauguaguaagacacauuua

SEQ ID NO: 277335 - RNA, 18 nt, Homo sapiens
aucauugcacugucuugc

SEQ ID NO: 277336 - RNA, 22 nt, Homo sapiens
aucauugugugaguugauggga

SEQ ID NO: 277337 - RNA, 22 nt, Homo sapiens
auccaguuuuaggagauuucua

SEQ ID NO: 277338 - RNA, 22 nt, Homo sapiens
auccauugcucaagagaaguca

SEQ ID NO: 277339 - RNA, 22 nt, Homo sapiens
aucccaguucagccucugacac

SEQ ID NO: 277340 - RNA, 22 nt, Homo sapiens
aucccgagacuuugcugaaguu

SEQ ID NO: 277341 - RNA, 22 nt, Homo sapiens
auccucugagagaguuucauaa

SEQ ID NO: 277342 - RNA, 22 nt, Homo sapiens
auccugagacuuugcugaaguu

SEQ ID NO: 277343 - RNA, 22 nt, Homo sapiens
aucgcugagaaagggacuuuca

SEQ ID NO: 277344 - RNA, 22 nt, Homo sapiens
aucuacagccagucugguuugu

SEQ ID NO: 277345 - RNA, 22 nt, Homo sapiens
aucuacuugcugggucucugga

SEQ ID NO: 277346 - RNA, 22 nt, Homo sapiens
aucucaaugcuuuuguaggcca

SEQ ID NO: 277347 - RNA, 21 nt, Homo sapiens
aucucacuugaauguaaaagc

SEQ ID NO: 277348 - RNA, 22 nt, Homo sapiens
aucucaguuaauuccaucuuuc

SEQ ID NO: 277349 - RNA, 22 nt, Homo sapiens
aucucugagauguucugauuuu

SEQ ID NO: 277350 - RNA, 22 nt, Homo sapiens
aucucuugccagucagaauggu

SEQ ID NO: 277351 - RNA, 22 nt, Homo sapiens
aucuggcuucuuuuaguccaca

SEQ ID NO: 277352 - RNA, 22 nt, Homo sapiens
aucugguguauuggugcugggu

SEQ ID NO: 277353 - RNA, 22 nt, Homo sapiens
aucuguguuuaaggucccagaa

SEQ ID NO: 277354 - RNA, 22 nt, Homo sapiens
aucuuguguugaauggugcaga

SEQ ID NO: 277355 - RNA, 22 nt, Homo sapiens
guccuguuuuuaagguucauag

SEQ ID NO: 277356 - RNA, 22 nt, Homo sapiens
gucguggagcucacagugugcc

SEQ ID NO: 277357 - RNA, 22 nt, Homo sapiens
gucucccaaccccugugcccag

SEQ ID NO: 277358 - RNA, 22 nt, Homo sapiens
gucucccagccuacaucuuucu

SEQ ID NO: 277359 - RNA, 22 nt, Homo sapiens
gucucugagaugucaacaccua

SEQ ID NO: 277360 - RNA, 22 nt, Homo sapiens
gucucugguugcuuuuguacca

SEQ ID NO: 277361 - RNA, 22 nt, Homo sapiens
gucucuuguuaucauuucugag

SEQ ID NO: 277362 - RNA, 22 nt, Homo sapiens
gucugguuuuuuauauccucac

SEQ ID NO: 277363 - RNA, 22 nt, Homo sapiens
gucugucuuuugucuuugaaau

SEQ ID NO: 277364 - RNA, 20 nt, Homo sapiens
gucuugcuccguugcccagg

SEQ ID NO: 277365 - RNA, 22 nt, Homo sapiens
gucuuugagauaggguuauuuu

SEQ ID NO: 277366 - RNA, 22 nt, Homo sapiens
gucuuugaugucuaugugcuuc

SEQ ID NO: 277367 - RNA, 22 nt, Homo sapiens
gucuuuggaaaaaaugucuguu

SEQ ID NO: 277368 - RNA, 22 nt, Homo sapiens
gucuuuggaaagacaaaguuca

SEQ ID NO: 277369 - RNA, 17 nt, Homo sapiens
gucuuugguugaguuua

SEQ ID NO: 277370 - RNA, 22 nt, Homo sapiens
gugaaagauuaaaccagugugu

SEQ ID NO: 277371 - RNA, 22 nt, Homo sapiens
gugaaaugaaucuggaaauauu

SEQ ID NO: 277372 - RNA, 22 nt, Homo sapiens
gugaacaagcaaaggcaggagg

SEQ ID NO: 277373 - RNA, 22 nt, Homo sapiens
gugaaugaaugggugaauacau

SEQ ID NO: 277374 - RNA, 22 nt, Homo sapiens
gugacagaguaagacccuguau

SEQ ID NO: 277375 - RNA, 22 nt, Homo sapiens
gugacauuauuucagcuacaug

SEQ ID NO: 277376 - RNA, 22 nt, Homo sapiens
gugaccagaugggcaggggugu

SEQ ID NO: 277377 - RNA, 22 nt, Homo sapiens
gugacuggacucugaagaaaau

SEQ ID NO: 277378 - RNA, 22 nt, Homo sapiens
gugagaagaaaaauauggcugu

SEQ ID NO: 277379 - RNA, 22 nt, Homo sapiens
gugagcacugaaagaaggcaag

SEQ ID NO: 277380 - RNA, 22 nt, Homo sapiens
gugagcuaagcaaauaugagcc

SEQ ID NO: 277381 - RNA, 22 nt, Homo sapiens
gugagcuccucuucugcugcag

SEQ ID NO: 277382 - RNA, 17 nt, Homo sapiens
gugagguggguaguauc

SEQ ID NO: 277383 - RNA, 22 nt, Homo sapiens
gugaggugguacaauauuaacu

SEQ ID NO: 277384 - RNA, 22 nt, Homo sapiens
gugagguguuaaccaaccugug

SEQ ID NO: 277385 - RNA, 20 nt, Homo sapiens
gugagucauuaguaaccaaa

SEQ ID NO: 277386 - RNA, 22 nt, Homo sapiens
gugauaucacuguaucacucca

SEQ ID NO: 277387 - RNA, 22 nt, Homo sapiens
gugaucaugauccugaagcauu

SEQ ID NO: 277388 - RNA, 22 nt, Homo sapiens
gugauuguuaaacugccucucu

SEQ ID NO: 277389 - RNA, 22 nt, Homo sapiens
gugcacaaaucuuaaauguaca

SEQ ID NO: 277390 - RNA, 22 nt, Homo sapiens
gugcacauuguuuaugucuguu

SEQ ID NO: 277391 - RNA, 22 nt, Homo sapiens
gugcauaugcaugugcaugcac

SEQ ID NO: 277392 - RNA, 22 nt, Homo sapiens
gugcaugucuaugcgagucuaa

SEQ ID NO: 277393 - RNA, 22 nt, Homo sapiens
gugccacugcaccuggccuaag

SEQ ID NO: 277394 - RNA, 23 nt, Homo sapiens
gugccuucugagccuagucucca

SEQ ID NO: 277395 - RNA, 22 nt, Homo sapiens
gugcucauuuagagagaagcac

SEQ ID NO: 277396 - RNA, 22 nt, Homo sapiens
gugcuuguguuaauauguagcu

SEQ ID NO: 277397 - RNA, 22 nt, Homo sapiens
gugcuuuguuguggcaguggca

SEQ ID NO: 277398 - RNA, 21 nt, Homo sapiens
guggaaauggaauuuacuaau

SEQ ID NO: 277399 - RNA, 22 nt, Homo sapiens
guggaagaccagacuuuccaac

SEQ ID NO: 277400 - RNA, 22 nt, Homo sapiens
guggaaugauaucucauugugg

SEQ ID NO: 277401 - RNA, 22 nt, Homo sapiens
guggacagagacuaaauguugu

SEQ ID NO: 277402 - RNA, 22 nt, Homo sapiens
guggacaugaauuuuggaggca

SEQ ID NO: 277403 - RNA, 22 nt, Homo sapiens
guggaguacugagggucacuua

SEQ ID NO: 277404 - RNA, 22 nt, Homo sapiens
guggagucaucacucagagugg

SEQ ID NO: 277405 - RNA, 18 nt, Homo sapiens
guggagugucuuccugga

SEQ ID NO: 277406 - RNA, 22 nt, Homo sapiens
guggaucacuugaggucaagag

SEQ ID NO: 277407 - RNA, 22 nt, Homo sapiens
guggcaugaaagcagauaccac

SEQ ID NO: 277408 - RNA, 22 nt, Homo sapiens
guggcgagaucauagcucauug

SEQ ID NO: 277409 - RNA, 22 nt, Homo sapiens
gugggaugaucacaguucacug

SEQ ID NO: 277410 - RNA, 22 nt, Homo sapiens
gugggaugaucgcuugagccca

SEQ ID NO: 277411 - RNA, 22 nt, Homo sapiens
gugggaugcaaguaaaauuguc

SEQ ID NO: 277412 - RNA, 22 nt, Homo sapiens
gugggguaggguaggacucaac

SEQ ID NO: 277413 - RNA, 22 nt, Homo sapiens
gugguaucauuuaaccauuaga

SEQ ID NO: 277414 - RNA, 22 nt, Homo sapiens
gugguuguuggaguggcaauuu

SEQ ID NO: 277415 - RNA, 22 nt, Homo sapiens
gugguuuuaauauucagucuag

SEQ ID NO: 277416 - RNA, 22 nt, Homo sapiens
guguaaaucaaucuguugucuu

SEQ ID NO: 277417 - RNA, 22 nt, Homo sapiens
guguaaguccugaguuuggaua

SEQ ID NO: 277418 - RNA, 22 nt, Homo sapiens
guguagagaaauagccugaagg

SEQ ID NO: 277419 - RNA, 22 nt, Homo sapiens
guguauauccuauuaguucugu

SEQ ID NO: 277420 - RNA, 22 nt, Homo sapiens
guguaugugagaaugcucaugu

SEQ ID NO: 277421 - RNA, 22 nt, Homo sapiens
guguauguuucucccugucccu

SEQ ID NO: 277422 - RNA, 22 nt, Homo sapiens
gugucacuguugagaaguccac

SEQ ID NO: 277423 - RNA, 22 nt, Homo sapiens
gugucaguggggagugaucuuc

SEQ ID NO: 277424 - RNA, 22 nt, Homo sapiens
gugucccagugugcauacaggu

SEQ ID NO: 277425 - RNA, 22 nt, Homo sapiens
gugucuccuguggagcuaugua

SEQ ID NO: 277426 - RNA, 18 nt, Homo sapiens
gugucugguuaugggagu

SEQ ID NO: 277427 - RNA, 22 nt, Homo sapiens
gugugcaugucuuuuuaguagg

SEQ ID NO: 277428 - RNA, 22 nt, Homo sapiens
uaauagcaguguuacuaggacu

SEQ ID NO: 277429 - RNA, 22 nt, Homo sapiens
uaauaguuucagaaguuguuuu

SEQ ID NO: 277430 - RNA, 22 nt, Homo sapiens
uaauauguauacagacagauac

SEQ ID NO: 277431 - RNA, 22 nt, Homo sapiens
uaaucacagagguuuggccuca

SEQ ID NO: 277432 - RNA, 22 nt, Homo sapiens
uaauccugucuugaccaucagg

SEQ ID NO: 277433 - RNA, 22 nt, Homo sapiens
uaaugcauacagaagguguuuu

SEQ ID NO: 277434 - RNA, 22 nt, Homo sapiens
uaaugcaucagugguaguucuu

SEQ ID NO: 277435 - RNA, 22 nt, Homo sapiens
uaaugcuugguuguuuggaaaa

SEQ ID NO: 277436 - RNA, 22 nt, Homo sapiens
uacaaaguaacaguuccuguau

SEQ ID NO: 277437 - RNA, 22 nt, Homo sapiens
uacacagucaaaaauuuccagg

SEQ ID NO: 277438 - RNA, 22 nt, Homo sapiens
uacaccaauuuaaucaaaagca

SEQ ID NO: 277439 - RNA, 22 nt, Homo sapiens
uacagaguagaagauuugcaga

SEQ ID NO: 277440 - RNA, 22 nt, Homo sapiens
uacagaguauccauuugaguuc

SEQ ID NO: 277441 - RNA, 22 nt, Homo sapiens
uacagaucaguuauuuuguaga

SEQ ID NO: 277442 - RNA, 23 nt, Homo sapiens
uacagcacacugaugggucuuga

SEQ ID NO: 277443 - RNA, 22 nt, Homo sapiens
uacaggaaugucagguugcugu

SEQ ID NO: 277444 - RNA, 20 nt, Homo sapiens
uacaggacugagaaucugug

SEQ ID NO: 277445 - RNA, 22 nt, Homo sapiens
uacaggauagacaauuuauuaa

SEQ ID NO: 277446 - RNA, 22 nt, Homo sapiens
uacaggcagguguucccugguu

SEQ ID NO: 277447 - RNA, 22 nt, Homo sapiens
uacaggugcucuacagacagga

SEQ ID NO: 277448 - RNA, 22 nt, Homo sapiens
uacaguacagugacaccauuau

SEQ ID NO: 277449 - RNA, 22 nt, Homo sapiens
uacaguaguaucuucauuuguu

SEQ ID NO: 277450 - RNA, 22 nt, Homo sapiens
uacaguccaugcauuauccucc

SEQ ID NO: 277451 - RNA, 22 nt, Homo sapiens
uacagugcuugguaucuaguaa

SEQ ID NO: 277452 - RNA, 22 nt, Homo sapiens
uacaguggcaugucaggugcuu

SEQ ID NO: 277453 - RNA, 22 nt, Homo sapiens
uacagugggcacuggcgcccug

SEQ ID NO: 277454 - RNA, 22 nt, Homo sapiens
uacauacuguaugguucuguuu

SEQ ID NO: 277455 - RNA, 22 nt, Homo sapiens
uacauacuucacagacuuuaaa

SEQ ID NO: 277456 - RNA, 20 nt, Homo sapiens
uacauaguaaacugagagca

SEQ ID NO: 277457 - RNA, 22 nt, Homo sapiens
uacauaguaagcacuaugccaa

SEQ ID NO: 277458 - RNA, 22 nt, Homo sapiens
uacauaguaagcaucuccugug

SEQ ID NO: 277459 - RNA, 19 nt, Homo sapiens
uacauaguauuuaguggca

SEQ ID NO: 277460 - RNA, 22 nt, Homo sapiens
uacaugcaugggcaugugugca

SEQ ID NO: 277461 - RNA, 22 nt, Homo sapiens
uacauguauguguuuauggcug

SEQ ID NO: 277462 - RNA, 22 nt, Homo sapiens
uacauugcacuuuauuagauac

SEQ ID NO: 277463 - RNA, 22 nt, Homo sapiens
uaccacugccgagaaaacagau

SEQ ID NO: 277464 - RNA, 22 nt, Homo sapiens
uaccagugaauuccaggggcua

SEQ ID NO: 277465 - RNA, 19 nt, Homo sapiens
uacccagaagcagcauugu

SEQ ID NO: 277466 - RNA, 22 nt, Homo sapiens
uaccugagucuagagucuagaa

SEQ ID NO: 277467 - RNA, 22 nt, Homo sapiens
uacuacuuucugacaucuuuaa

SEQ ID NO: 277468 - RNA, 23 nt, Homo sapiens
uacuaguaagcguguucuuugca

SEQ ID NO: 277469 - RNA, 22 nt, Homo sapiens
uacucaguagucuguugcuguc

SEQ ID NO: 277470 - RNA, 22 nt, Homo sapiens
uacugcacuccaaccugagaga

SEQ ID NO: 277471 - RNA, 22 nt, Homo sapiens
uacugcacuccacccuggguga

SEQ ID NO: 277472 - RNA, 22 nt, Homo sapiens
uacugcauuucacuguuaaaga

SEQ ID NO: 277473 - RNA, 21 nt, Homo sapiens
uacuggagauacagucugcaa

SEQ ID NO: 277474 - RNA, 22 nt, Homo sapiens
uagaaagcaugaccuucagaua

SEQ ID NO: 277475 - RNA, 22 nt, Homo sapiens
uagaaguaggcuacgugucugg

SEQ ID NO: 277476 - RNA, 18 nt, Homo sapiens
uagaauauaggucauucu

SEQ ID NO: 277477 - RNA, 22 nt, Homo sapiens
uagaaugucagcuucuugaggg

SEQ ID NO: 277478 - RNA, 22 nt, Homo sapiens
uagacuguaagauccaggagag

SEQ ID NO: 277479 - RNA, 20 nt, Homo sapiens
uagagagauauggggguucc

SEQ ID NO: 277480 - RNA, 21 nt, Homo sapiens
uagagcaacacacgcccucuc

SEQ ID NO: 277481 - RNA, 22 nt, Homo sapiens
uagagcaaugacucuggaaacc

SEQ ID NO: 277482 - RNA, 22 nt, Homo sapiens
uagagcacagugauuagaccua

SEQ ID NO: 277483 - RNA, 22 nt, Homo sapiens
uagagcuagggacucgcaaugu

SEQ ID NO: 277484 - RNA, 22 nt, Homo sapiens
uagaggaaggauuggaaacgca

SEQ ID NO: 277485 - RNA, 22 nt, Homo sapiens
uagagguagguguaugaacuag

SEQ ID NO: 277486 - RNA, 22 nt, Homo sapiens
uagagguucuaagauucucaga

SEQ ID NO: 277487 - RNA, 21 nt, Homo sapiens
uagauacuguauuaaaccuag

SEQ ID NO: 277488 - RNA, 22 nt, Homo sapiens
uagaucauauucagugcuuacu

SEQ ID NO: 277489 - RNA, 19 nt, Homo sapiens
uagaugucuuugcauagau

SEQ ID NO: 277490 - RNA, 21 nt, Homo sapiens
uagcaaauugcuauuaaggca

SEQ ID NO: 277491 - RNA, 22 nt, Homo sapiens
uagcaagaugaauuugugcaaa

SEQ ID NO: 277492 - RNA, 20 nt, Homo sapiens
uagcacacauguagaauagu

SEQ ID NO: 277493 - RNA, 17 nt, Homo sapiens
uagcacagugccuggua

SEQ ID NO: 277494 - RNA, 22 nt, Homo sapiens
uagcacaucccuaaaaugcugu

SEQ ID NO: 277495 - RNA, 22 nt, Homo sapiens
uagcaccacaaucaagauacag

SEQ ID NO: 277496 - RNA, 23 nt, Homo sapiens
uagcacuuuuuacauauggacau

SEQ ID NO: 277497 - RNA, 22 nt, Homo sapiens
uagcagaauaacuugccagccu

SEQ ID NO: 277498 - RNA, 18 nt, Homo sapiens
uagcagacaucauugggg

SEQ ID NO: 277499 - RNA, 22 nt, Homo sapiens
uagcagacuauuuugugauaau

SEQ ID NO: 277500 - RNA, 20 nt, Homo sapiens
uagcagcagacagagggagg

SEQ ID NO: 277501 - RNA, 20 nt, Homo sapiens
uauugcacuccagucugggc

SEQ ID NO: 277502 - RNA, 22 nt, Homo sapiens
uauugcauguugagcaguaccu

SEQ ID NO: 277503 - RNA, 22 nt, Homo sapiens
uauugcuggcucugucuucauu

SEQ ID NO: 277504 - RNA, 22 nt, Homo sapiens
uauugcuuaugaugcugaauua

SEQ ID NO: 277505 - RNA, 22 nt, Homo sapiens
uauugcuuuacucucuuauccu

SEQ ID NO: 277506 - RNA, 22 nt, Homo sapiens
uauugucacuaaaggaagcugg

SEQ ID NO: 277507 - RNA, 22 nt, Homo sapiens
uauuugauugacuuuagcagga

SEQ ID NO: 277508 - RNA, 22 nt, Homo sapiens
uauuuguccccuccaaaaguca

SEQ ID NO: 277509 - RNA, 22 nt, Homo sapiens
ucaaaaucucuuagcugugucu

SEQ ID NO: 277510 - RNA, 22 nt, Homo sapiens
ucaaaguaaagccucaggaugg

SEQ ID NO: 277511 - RNA, 22 nt, Homo sapiens
ucaaagugagcuccuucucacu

SEQ ID NO: 277512 - RNA, 22 nt, Homo sapiens
ucaaauguucccuguacuggcc

SEQ ID NO: 277513 - RNA, 21 nt, Homo sapiens
ucaacccuugcgucaccaagc

SEQ ID NO: 277514 - RNA, 18 nt, Homo sapiens
ucaagcaauugucaugcc

SEQ ID NO: 277515 - RNA, 22 nt, Homo sapiens
ucaaggacucagagagggauua

SEQ ID NO: 277516 - RNA, 21 nt, Homo sapiens
ucaaggaguauacguaugcca

SEQ ID NO: 277517 - RNA, 22 nt, Homo sapiens
ucaagguacguugccucagauu

SEQ ID NO: 277518 - RNA, 22 nt, Homo sapiens
ucaaguaagaagugggcauaaa

SEQ ID NO: 277519 - RNA, 22 nt, Homo sapiens
ucaaguaguaacuaacugugac

SEQ ID NO: 277520 - RNA, 22 nt, Homo sapiens
ucacaaagcuuggccugcuucu

SEQ ID NO: 277521 - RNA, 20 nt, Homo sapiens
ucacaagccaagaucacguc

SEQ ID NO: 277522 - RNA, 22 nt, Homo sapiens
ucacacgugaacucaucacaga

SEQ ID NO: 277523 - RNA, 22 nt, Homo sapiens
ucacagacugagccaaauagag

SEQ ID NO: 277524 - RNA, 22 nt, Homo sapiens
ucacagaggagaagaccuuuaa

SEQ ID NO: 277525 - RNA, 22 nt, Homo sapiens
ucacagauaaauaaagaugauu

SEQ ID NO: 277526 - RNA, 22 nt, Homo sapiens
ucacaggguguuauuagaauua

SEQ ID NO: 277527 - RNA, 22 nt, Homo sapiens
ucacagucaaaguaaucauaga

SEQ ID NO: 277528 - RNA, 22 nt, Homo sapiens
ucacagugaguggaguggggug

SEQ ID NO: 277529 - RNA, 22 nt, Homo sapiens
ucacaguguuaaaccuuucuuu

SEQ ID NO: 277530 - RNA, 17 nt, Homo sapiens
ucacaguguuaggauga

SEQ ID NO: 277531 - RNA, 20 nt, Homo sapiens
ucacauccucucccaacaug

SEQ ID NO: 277532 - RNA, 22 nt, Homo sapiens
ucacaucucagguuucuugaca

SEQ ID NO: 277533 - RNA, 22 nt, Homo sapiens
ucacaugaagauuuuaguauac

SEQ ID NO: 277534 - RNA, 22 nt, Homo sapiens
ucacaugugacauauauauuug

SEQ ID NO: 277535 - RNA, 22 nt, Homo sapiens
ucaccuuacuugcuucugaacu

SEQ ID NO: 277536 - RNA, 18 nt, Homo sapiens
ucaccuugaugcuggguc

SEQ ID NO: 277537 - RNA, 19 nt, Homo sapiens
ucacgugcagcagccacac

SEQ ID NO: 277538 - RNA, 22 nt, Homo sapiens
ucacugaaacuguccuggguua

SEQ ID NO: 277539 - RNA, 21 nt, Homo sapiens
ucacugagguuaaauaggguu

SEQ ID NO: 277540 - RNA, 22 nt, Homo sapiens
ucacugcacuucaggcuuucuc

SEQ ID NO: 277541 - RNA, 22 nt, Homo sapiens
ucacuggcaaauauauccguug

SEQ ID NO: 277542 - RNA, 22 nt, Homo sapiens
ucacuggccaaauucuggguga

SEQ ID NO: 277543 - RNA, 22 nt, Homo sapiens
ucacugugguuuugaugugcau

SEQ ID NO: 277544 - RNA, 22 nt, Homo sapiens
ucagaacugaacaaaccagucu

SEQ ID NO: 277545 - RNA, 22 nt, Homo sapiens
ucagaacugauacuagaacuuu

SEQ ID NO: 277546 - RNA, 21 nt, Homo sapiens
ucagaagcucccagggaggac

SEQ ID NO: 277547 - RNA, 22 nt, Homo sapiens
ucagaauguaacuuuaguugga

SEQ ID NO: 277548 - RNA, 22 nt, Homo sapiens
ucagaccauuucauuacagacu

SEQ ID NO: 277549 - RNA, 22 nt, Homo sapiens
ucagagcaaagacacuuuauca

SEQ ID NO: 277550 - RNA, 22 nt, Homo sapiens
ucagaguaguuccuggcagaaa

SEQ ID NO: 277551 - RNA, 22 nt, Homo sapiens
ucagauacuggugacaugaaug

SEQ ID NO: 277552 - RNA, 22 nt, Homo sapiens
ucagaucaugcuuaugauggga

SEQ ID NO: 277553 - RNA, 22 nt, Homo sapiens
ucagaucuucagcaggggcccc

SEQ ID NO: 277554 - RNA, 22 nt, Homo sapiens
ucagaugcauccauaccccacu

SEQ ID NO: 277555 - RNA, 19 nt, Homo sapiens
ucagcaguaaucaacuuca

SEQ ID NO: 277556 - RNA, 22 nt, Homo sapiens
ucagcaucacgugggcucccgu

SEQ ID NO: 277557 - RNA, 20 nt, Homo sapiens
ucagguagggcuucaacauu

SEQ ID NO: 277558 - RNA, 22 nt, Homo sapiens
ucaggugccuuggcuaauuguu

SEQ ID NO: 277559 - RNA, 22 nt, Homo sapiens
ucaguaaauguuaggacauuuc

SEQ ID NO: 277560 - RNA, 22 nt, Homo sapiens
ucaguacuuuggagcucacaua

SEQ ID NO: 277561 - RNA, 22 nt, Homo sapiens
ucagucuuuuuuuggcaagcau

SEQ ID NO: 277562 - RNA, 23 nt, Homo sapiens
ucagugaaggaacaacuaaauag

SEQ ID NO: 277563 - RNA, 22 nt, Homo sapiens
ucagugaauauauaacagcgau

SEQ ID NO: 277564 - RNA, 22 nt, Homo sapiens
ucagugauugcuuucauggaaa

SEQ ID NO: 277565 - RNA, 22 nt, Homo sapiens
ucagugcaggaaucucuagcca

SEQ ID NO: 277566 - RNA, 22 nt, Homo sapiens
ucagugcuuggcacagagagcu

SEQ ID NO: 277567 - RNA, 22 nt, Homo sapiens
ucaguggacuuagucuuucccc

SEQ ID NO: 277568 - RNA, 22 nt, Homo sapiens
ucaguggauuuaaccugaauca

SEQ ID NO: 277569 - RNA, 22 nt, Homo sapiens
ucagugggcuauguaauuaacu

SEQ ID NO: 277570 - RNA, 22 nt, Homo sapiens
ucagugucaucuggguuguuug

SEQ ID NO: 277571 - RNA, 22 nt, Homo sapiens
ucagugucugugauggagaggu

SEQ ID NO: 277572 - RNA, 22 nt, Homo sapiens
ucagugucugugcaccgcugga

SEQ ID NO: 277573 - RNA, 22 nt, Homo sapiens
ucauacaggccaccagggaagu

SEQ ID NO: 277574 - RNA, 22 nt, Homo sapiens
ucuggguuuuguaccgugcucg

SEQ ID NO: 277575 - RNA, 22 nt, Homo sapiens
ucuggguuuuuacaauguuuac

SEQ ID NO: 277576 - RNA, 22 nt, Homo sapiens
ucuggguuuuuccauugccggu

SEQ ID NO: 277577 - RNA, 22 nt, Homo sapiens
ucugguuccuuggcuucggguc

SEQ ID NO: 277578 - RNA, 22 nt, Homo sapiens
ucuguacuccuugaguagugcu

SEQ ID NO: 277579 - RNA, 22 nt, Homo sapiens
ucuguacugccaaguuucuuua

SEQ ID NO: 277580 - RNA, 22 nt, Homo sapiens
ucugucuugugguuugagugcc

SEQ ID NO: 277581 - RNA, 22 nt, Homo sapiens
ucugucuuugccuaaguuuguc

SEQ ID NO: 277582 - RNA, 22 nt, Homo sapiens
ucugugaaugaacacuugaaaa

SEQ ID NO: 277583 - RNA, 22 nt, Homo sapiens
ucugugaaugugaccuuauuug

SEQ ID NO: 277584 - RNA, 22 nt, Homo sapiens
ucugugcauggcagaggaauga

SEQ ID NO: 277585 - RNA, 22 nt, Homo sapiens
ucugugcuugucauaugcuuug

SEQ ID NO: 277586 - RNA, 19 nt, Homo sapiens
ucugugcuugucccccugu

SEQ ID NO: 277587 - RNA, 22 nt, Homo sapiens
ucuguggucagaguccuuggcc

SEQ ID NO: 277588 - RNA, 21 nt, Homo sapiens
ucuguguugaucucacuggga

SEQ ID NO: 277589 - RNA, 22 nt, Homo sapiens
ucuguguugaugcucauuaauu

SEQ ID NO: 277590 - RNA, 22 nt, Homo sapiens
ucuguguuugaucaagauugua

SEQ ID NO: 277591 - RNA, 22 nt, Homo sapiens
ucuguugguucuuugaggagga

SEQ ID NO: 277592 - RNA, 22 nt, Homo sapiens
ucuucuagcggaacccucuugu

SEQ ID NO: 277593 - RNA, 22 nt, Homo sapiens
ucuugaacuucauaggucuaga

SEQ ID NO: 277594 - RNA, 22 nt, Homo sapiens
ucuugcuuguuguucccuucau

SEQ ID NO: 277595 - RNA, 22 nt, Homo sapiens
ucuuggguggauucauucuuuc

SEQ ID NO: 277596 - RNA, 22 nt, Homo sapiens
ucuugguaaugucacauuuccu

SEQ ID NO: 277597 - RNA, 21 nt, Homo sapiens
ucuugguauguauuuaggagg

SEQ ID NO: 277598 - RNA, 23 nt, Homo sapiens
ucuuguacuuugagugagcaugg

SEQ ID NO: 277599 - RNA, 22 nt, Homo sapiens
ucuuuaguaauuucuguaaggc

SEQ ID NO: 277600 - RNA, 22 nt, Homo sapiens
ucuuugguaggaguaggaggcc

SEQ ID NO: 277601 - RNA, 22 nt, Homo sapiens
ucuuugguaugugcaugugcuu

SEQ ID NO: 277602 - RNA, 22 nt, Homo sapiens
ucuuugguauugugaauagugu

SEQ ID NO: 277603 - RNA, 22 nt, Homo sapiens
ucuuuugugagucagccucucc

SEQ ID NO: 277604 - RNA, 22 nt, Homo sapiens
ugaaacacacagagaagggaga

SEQ ID NO: 277605 - RNA, 22 nt, Homo sapiens
ugaaacacacauugcccuuuau

SEQ ID NO: 277606 - RNA, 22 nt, Homo sapiens
ugaaaguuauauugugaaauuc

SEQ ID NO: 277607 - RNA, 22 nt, Homo sapiens
ugaaauacuuaauuucuccaug

SEQ ID NO: 277608 - RNA, 22 nt, Homo sapiens
ugaaaucauguaguuauugcaa

SEQ ID NO: 277609 - RNA, 21 nt, Homo sapiens
ugaaaugcaugugcacauuaa

SEQ ID NO: 277610 - RNA, 22 nt, Homo sapiens
ugaaaugcuaauucguagcuaa

SEQ ID NO: 277611 - RNA, 22 nt, Homo sapiens
ugaaaugguuaugugaggagau

SEQ ID NO: 277612 - RNA, 22 nt, Homo sapiens
ugaaauguaaguugucuagucu

SEQ ID NO: 277613 - RNA, 22 nt, Homo sapiens
ugaaauuauucuuaccaaggug

SEQ ID NO: 277614 - RNA, 22 nt, Homo sapiens
ugaaauuuuuuauucguuggcu

SEQ ID NO: 277615 - RNA, 22 nt, Homo sapiens
ugaacacaucuccugguaccug

SEQ ID NO: 277616 - RNA, 21 nt, Homo sapiens
ugaacacuggacugagugucc

SEQ ID NO: 277617 - RNA, 22 nt, Homo sapiens
ugaacagcaccuccuagaguug

SEQ ID NO: 277618 - RNA, 22 nt, Homo sapiens
ugaagacucaauuauuaugaac

SEQ ID NO: 277619 - RNA, 22 nt, Homo sapiens
ugaagacucaguuugagggaca

SEQ ID NO: 277620 - RNA, 22 nt, Homo sapiens
ugaagagucuaaaucugucuuc

SEQ ID NO: 277621 - RNA, 22 nt, Homo sapiens
ugaaggacauaaggcagaguga

SEQ ID NO: 277622 - RNA, 22 nt, Homo sapiens
ugaaggcaggagggagaaaagu

SEQ ID NO: 277623 - RNA, 22 nt, Homo sapiens
ugaagggcauuguuuugccaaa

SEQ ID NO: 277624 - RNA, 22 nt, Homo sapiens
ugaaguaauguuuuauucuauu

SEQ ID NO: 277625 - RNA, 22 nt, Homo sapiens
ugaagugaagacucacagaagg

SEQ ID NO: 277626 - RNA, 22 nt, Homo sapiens
ugaauagacagucacugccucc

SEQ ID NO: 277627 - RNA, 22 nt, Homo sapiens
ugaauagagcugcaguggacau

SEQ ID NO: 277628 - RNA, 22 nt, Homo sapiens
ugaauaguaauguguuuggucu

SEQ ID NO: 277629 - RNA, 22 nt, Homo sapiens
ugaauagugucacaauaaacau

SEQ ID NO: 277630 - RNA, 22 nt, Homo sapiens
ugaauaguuugacagaacucuu

SEQ ID NO: 277631 - RNA, 22 nt, Homo sapiens
ugaauauguuaaauaauguucu

SEQ ID NO: 277632 - RNA, 22 nt, Homo sapiens
ugaaucauuucuugucuucagu

SEQ ID NO: 277633 - RNA, 22 nt, Homo sapiens
ugaaugcaucauguagggcuca

SEQ ID NO: 277634 - RNA, 22 nt, Homo sapiens
ugaaugcuaaaggaaaacagua

SEQ ID NO: 277635 - RNA, 22 nt, Homo sapiens
ugaauggauccaauucuuagua

SEQ ID NO: 277636 - RNA, 22 nt, Homo sapiens
ugaauguaacuaaaccugugaa

SEQ ID NO: 277637 - RNA, 22 nt, Homo sapiens
ugaauguccauugauguuuuga

SEQ ID NO: 277638 - RNA, 22 nt, Homo sapiens
ugaaugugauggguuucaugug

SEQ ID NO: 277639 - RNA, 22 nt, Homo sapiens
ugaauguuugcagcuuauacca

SEQ ID NO: 277640 - RNA, 22 nt, Homo sapiens
ugacaagaacuuuccauaguaa

SEQ ID NO: 277641 - RNA, 19 nt, Homo sapiens
ugacacuguuggugggagg

SEQ ID NO: 277642 - RNA, 22 nt, Homo sapiens
ugacacuugcccuuagaaacau

SEQ ID NO: 277643 - RNA, 22 nt, Homo sapiens
ugacaguaucuacagcuucuua

SEQ ID NO: 277644 - RNA, 23 nt, Homo sapiens
ugacagucucccgauggcuaggc

SEQ ID NO: 277645 - RNA, 22 nt, Homo sapiens
ugacaguguccucauucccaac

SEQ ID NO: 277646 - RNA, 22 nt, Homo sapiens
ugagguugucagugucauucuu

SEQ ID NO: 277647 - RNA, 22 nt, Homo sapiens
ugaguagaaauaaacgcaaacu

SEQ ID NO: 277648 - RNA, 22 nt, Homo sapiens
ugaguagaacuagucuagagcu

SEQ ID NO: 277649 - RNA, 21 nt, Homo sapiens
ugaguagcuagaacuaggggc

SEQ ID NO: 277650 - RNA, 19 nt, Homo sapiens
ugaguauauuguauucauu

SEQ ID NO: 277651 - RNA, 22 nt, Homo sapiens
ugagucauuuccuuaugcuacu

SEQ ID NO: 277652 - RNA, 22 nt, Homo sapiens
ugagugaaagaagcacuaagga

SEQ ID NO: 277653 - RNA, 22 nt, Homo sapiens
ugagugaacgcugagaccaaau

SEQ ID NO: 277654 - RNA, 22 nt, Homo sapiens
ugagugccuggagggcagggac

SEQ ID NO: 277655 - RNA, 22 nt, Homo sapiens
ugaguggagacuguguguagag

SEQ ID NO: 277656 - RNA, 22 nt, Homo sapiens
ugaguggagaucgcaccauugc

SEQ ID NO: 277657 - RNA, 22 nt, Homo sapiens
ugauaagaaauuguucauguag

SEQ ID NO: 277658 - RNA, 22 nt, Homo sapiens
ugauacuggcuucauagaauga

SEQ ID NO: 277659 - RNA, 22 nt, Homo sapiens
ugauagaucugggcaaaguaaa

SEQ ID NO: 277660 - RNA, 22 nt, Homo sapiens
ugauaggucacucaacagugag

SEQ ID NO: 277661 - RNA, 22 nt, Homo sapiens
ugauauggcuuggcuaugucac

SEQ ID NO: 277662 - RNA, 22 nt, Homo sapiens
ugauauguaacuacuccuuaua

SEQ ID NO: 277663 - RNA, 22 nt, Homo sapiens
ugauauguagguggcaagcaua

SEQ ID NO: 277664 - RNA, 22 nt, Homo sapiens
ugauauguaugugaccuagaaa

SEQ ID NO: 277665 - RNA, 22 nt, Homo sapiens
ugauaugucacuugaucauggu

SEQ ID NO: 277666 - RNA, 22 nt, Homo sapiens
ugauaugucccucgacaucagg

SEQ ID NO: 277667 - RNA, 22 nt, Homo sapiens
ugauauuuuugauccuuaaguu

SEQ ID NO: 277668 - RNA, 22 nt, Homo sapiens
ugauccuguccuuaugauguua

SEQ ID NO: 277669 - RNA, 20 nt, Homo sapiens
ugaugcaaaucuuuaaaagu

SEQ ID NO: 277670 - RNA, 21 nt, Homo sapiens
ugaugcaauccgcuaggucgc

SEQ ID NO: 277671 - RNA, 22 nt, Homo sapiens
ugauggcaauggcauucauuuu

SEQ ID NO: 277672 - RNA, 22 nt, Homo sapiens
ugauggcauuuggaguugggac

SEQ ID NO: 277673 - RNA, 22 nt, Homo sapiens
ugaugguccauaguucauggua

SEQ ID NO: 277674 - RNA, 22 nt, Homo sapiens
ugauguguuuuguaguucaacu

SEQ ID NO: 277675 - RNA, 22 nt, Homo sapiens
ugauuagagcccaagcuuugaa

SEQ ID NO: 277676 - RNA, 22 nt, Homo sapiens
ugauuugucugcaggaauagug

SEQ ID NO: 277677 - RNA, 22 nt, Homo sapiens
ugcaagaaucagccuaucauua

SEQ ID NO: 277678 - RNA, 22 nt, Homo sapiens
ugcaagacacuguccugggcau

SEQ ID NO: 277679 - RNA, 22 nt, Homo sapiens
ugcaaguaauuccagcuacuga

SEQ ID NO: 277680 - RNA, 22 nt, Homo sapiens
ugcaauauccucuacuauaggu

SEQ ID NO: 277681 - RNA, 18 nt, Homo sapiens
ugcaauggagaugcagcc

SEQ ID NO: 277682 - RNA, 22 nt, Homo sapiens
ugcaccacugcacuucagccug

SEQ ID NO: 277683 - RNA, 22 nt, Homo sapiens
ugcacugucuugucgcauagca

SEQ ID NO: 277684 - RNA, 19 nt, Homo sapiens
ugcagcaauguaaaagaca

SEQ ID NO: 277685 - RNA, 21 nt, Homo sapiens
ugcagccauucagcccuaugc

SEQ ID NO: 277686 - RNA, 22 nt, Homo sapiens
ugcagugugcuggggucuccau

SEQ ID NO: 277687 - RNA, 22 nt, Homo sapiens
ugcaguguucuuuagaggaaau

SEQ ID NO: 277688 - RNA, 22 nt, Homo sapiens
ugcaguuuaggaacugguaaca

SEQ ID NO: 277689 - RNA, 22 nt, Homo sapiens
ugcauaauuccuugcaccagaa

SEQ ID NO: 277690 - RNA, 22 nt, Homo sapiens
ugcauacacaagcauacaugua

SEQ ID NO: 277691 - RNA, 21 nt, Homo sapiens
ugcauacuucucagaugauua

SEQ ID NO: 277692 - RNA, 22 nt, Homo sapiens
ugcauagaauguucuguaaaua

SEQ ID NO: 277693 - RNA, 22 nt, Homo sapiens
ugcauaugcagcauuuaugauu

SEQ ID NO: 277694 - RNA, 22 nt, Homo sapiens
ugcauauguugaaccagccuug

SEQ ID NO: 277695 - RNA, 22 nt, Homo sapiens
ugcauauguugagaugcauauu

SEQ ID NO: 277696 - RNA, 22 nt, Homo sapiens
ugcauauucgaguuauuuuggg

SEQ ID NO: 277697 - RNA, 22 nt, Homo sapiens
ugcauccauucuagacucaucu

SEQ ID NO: 277698 - RNA, 22 nt, Homo sapiens
ugcaugcaucuuuuauaguagc

SEQ ID NO: 277699 - RNA, 21 nt, Homo sapiens
ugcauggagaacacugagggu

SEQ ID NO: 277700 - RNA, 22 nt, Homo sapiens
ugcauggagauauacaguuuuu

SEQ ID NO: 277701 - RNA, 22 nt, Homo sapiens
ugcauggagcucucuuuggacu

SEQ ID NO: 277702 - RNA, 22 nt, Homo sapiens
ugcauggaggagcuccccgcag

SEQ ID NO: 277703 - RNA, 22 nt, Homo sapiens
ugccaacaugccuggcuguuuu

SEQ ID NO: 277704 - RNA, 22 nt, Homo sapiens
ugccagaugugcccucuccacc

SEQ ID NO: 277705 - RNA, 22 nt, Homo sapiens
ugccaguauuuuacugaggauu

SEQ ID NO: 277706 - RNA, 22 nt, Homo sapiens
ugccaguauuuuauugagcauu

SEQ ID NO: 277707 - RNA, 22 nt, Homo sapiens
ugccauagcaaugguaagcuga

SEQ ID NO: 277708 - RNA, 22 nt, Homo sapiens
ugccuaguagaaggugaacaug

SEQ ID NO: 277709 - RNA, 22 nt, Homo sapiens
ugccugagcccagcccuguagu

SEQ ID NO: 277710 - RNA, 22 nt, Homo sapiens
ugccugcugucuaauauauucu

SEQ ID NO: 277711 - RNA, 22 nt, Homo sapiens
ugccuggagagcuccuacauau

SEQ ID NO: 277712 - RNA, 22 nt, Homo sapiens
ugccuucuguuaaacgaggaug

SEQ ID NO: 277713 - RNA, 21 nt, Homo sapiens
ugccuuuguaguaggugucuu

SEQ ID NO: 277714 - RNA, 22 nt, Homo sapiens
ugcguucauuuggccaguggcg

SEQ ID NO: 277715 - RNA, 22 nt, Homo sapiens
ugcuagaagaucacacacauca

SEQ ID NO: 277716 - RNA, 22 nt, Homo sapiens
ugcucaccugcugcucaccucc

SEQ ID NO: 277717 - RNA, 22 nt, Homo sapiens
ugcugcaaacaggcaucugugg

SEQ ID NO: 277718 - RNA, 22 nt, Homo sapiens
ugcugcacaguucuuaagauua

SEQ ID NO: 277719 - RNA, 22 nt, Homo sapiens
ugggcaguauggucauuuucgu

SEQ ID NO: 277720 - RNA, 22 nt, Homo sapiens
ugggccgcugcaggaugguccc

SEQ ID NO: 277721 - RNA, 22 nt, Homo sapiens
ugggcuagaugcuuugggguca

SEQ ID NO: 277722 - RNA, 22 nt, Homo sapiens
uggguaggcccucauuggacag

SEQ ID NO: 277723 - RNA, 22 nt, Homo sapiens
uggguccccuacucuuuccaca

SEQ ID NO: 277724 - RNA, 22 nt, Homo sapiens
ugggugugaccgcucaaggggg

SEQ ID NO: 277725 - RNA, 23 nt, Homo sapiens
uggguucauucuugaagucagug

SEQ ID NO: 277726 - RNA, 23 nt, Homo sapiens
uggguucccuaagcgcaugcugc

SEQ ID NO: 277727 - RNA, 22 nt, Homo sapiens
ugguaaaaugucauuuaccaga

SEQ ID NO: 277728 - RNA, 22 nt, Homo sapiens
ugguaagaaaaccauuauuagc

SEQ ID NO: 277729 - RNA, 22 nt, Homo sapiens
ugguaugucuuucuuccuguag

SEQ ID NO: 277730 - RNA, 22 nt, Homo sapiens
ugguauguguucuaaaauuaug

SEQ ID NO: 277731 - RNA, 22 nt, Homo sapiens
ugguauguugucucuuuguucu

SEQ ID NO: 277732 - RNA, 22 nt, Homo sapiens
uggucaaaugccaaucuguagu

SEQ ID NO: 277733 - RNA, 22 nt, Homo sapiens
uggucaccuucuugcucugucu

SEQ ID NO: 277734 - RNA, 22 nt, Homo sapiens
uggucaguugaguccuugccaa

SEQ ID NO: 277735 - RNA, 22 nt, Homo sapiens
uggucaguugugccucaauucc

SEQ ID NO: 277736 - RNA, 22 nt, Homo sapiens
ugguccaguucugugauauugc

SEQ ID NO: 277737 - RNA, 22 nt, Homo sapiens
uggucuucuggccuccagaacc

SEQ ID NO: 277738 - RNA, 22 nt, Homo sapiens
uggugagaaaagaugucuuugu

SEQ ID NO: 277739 - RNA, 22 nt, Homo sapiens
uggugcaaugaagugaucucaa

SEQ ID NO: 277740 - RNA, 22 nt, Homo sapiens
uggugcuuaaauaaggcuuuca

SEQ ID NO: 277741 - RNA, 17 nt, Homo sapiens
uggugcuugaaaguugc

SEQ ID NO: 277742 - RNA, 20 nt, Homo sapiens
uggugguuuuaugugguuua

SEQ ID NO: 277743 - RNA, 22 nt, Homo sapiens
ugguuccauauuaauuuuagga

SEQ ID NO: 277744 - RNA, 22 nt, Homo sapiens
ugguuguuuuaaaugucgucug

SEQ ID NO: 277745 - RNA, 23 nt, Homo sapiens
ugguuuguaagagauggacugga

SEQ ID NO: 277746 - RNA, 22 nt, Homo sapiens
uguaaaaagcccagccgcugag

SEQ ID NO: 277747 - RNA, 22 nt, Homo sapiens
uguaaaucugguuaauuggaua

SEQ ID NO: 277748 - RNA, 22 nt, Homo sapiens
uguacaaauuucugugguggug

SEQ ID NO: 277749 - RNA, 21 nt, Homo sapiens
uguagcagcaugauucauagu

SEQ ID NO: 277750 - RNA, 22 nt, Homo sapiens
uguagguguacauacaugguua

SEQ ID NO: 277751 - RNA, 22 nt, Homo sapiens
uguauacauauguauguuuugu

SEQ ID NO: 277752 - RNA, 21 nt, Homo sapiens
uguauauguuuauacacacac

SEQ ID NO: 277753 - RNA, 22 nt, Homo sapiens
uguauauguuuguacauauguc

SEQ ID NO: 277754 - RNA, 22 nt, Homo sapiens
ugucaaaugcagugauauuuga

SEQ ID NO: 277755 - RNA, 22 nt, Homo sapiens
ugucaagaaaucaaggugugag

SEQ ID NO: 277756 - RNA, 22 nt, Homo sapiens
ugucaauauguaauaacugaau

SEQ ID NO: 277757 - RNA, 22 nt, Homo sapiens
ugucaccauuuguaggugagga

SEQ ID NO: 277758 - RNA, 22 nt, Homo sapiens
ugucagcacaacucagguuccu

SEQ ID NO: 277759 - RNA, 22 nt, Homo sapiens
ugucaggagcaaugauaaauuu

SEQ ID NO: 277760 - RNA, 22 nt, Homo sapiens
ugucaggaguuuuagaaucuua

SEQ ID NO: 277761 - RNA, 22 nt, Homo sapiens
ugucaggaugcuccuuuuggcu

SEQ ID NO: 277762 - RNA, 22 nt, Homo sapiens
ugucaguuucuugagauggaac

SEQ ID NO: 277763 - RNA, 19 nt, Homo sapiens
ugucaucaucuuuucuugc

SEQ ID NO: 277764 - RNA, 22 nt, Homo sapiens
ugucauguagaaauuguccauu

SEQ ID NO: 277765 - RNA, 22 nt, Homo sapiens
ugucaugucuuuguguaucaau

SEQ ID NO: 277766 - RNA, 22 nt, Homo sapiens
ugucauguuucuacugaccaaa

SEQ ID NO: 277767 - RNA, 22 nt, Homo sapiens
ugucauucaggaaauucuaagu

SEQ ID NO: 277768 - RNA, 22 nt, Homo sapiens
ugucauuguggugcagauauaa

SEQ ID NO: 277769 - RNA, 22 nt, Homo sapiens
ugucucagugauuggcuuucug

SEQ ID NO: 277770 - RNA, 22 nt, Homo sapiens
ugucuuguagacugaaggcuuc

SEQ ID NO: 277771 - RNA, 22 nt, Homo sapiens
ugugaaaucagauagccuuuuu

SEQ ID NO: 277772 - RNA, 22 nt, Homo sapiens
ugugaauguaagaaaauccaac

SEQ ID NO: 277773 - RNA, 22 nt, Homo sapiens
ugugacagguagguaauuuuug

SEQ ID NO: 277774 - RNA, 22 nt, Homo sapiens
ugugaugauuugauaaacguau

SEQ ID NO: 277775 - RNA, 22 nt, Homo sapiens
ugugaugguuuggaagcuucuu

SEQ ID NO: 277776 - RNA, 22 nt, Homo sapiens
ugugauguggagggcagaucca

SEQ ID NO: 277777 - RNA, 22 nt, Homo sapiens
ugugcaaauguuaaacuaacuu

SEQ ID NO: 277778 - RNA, 22 nt, Homo sapiens
ugugcaaucagcuucauuacau

SEQ ID NO: 277779 - RNA, 22 nt, Homo sapiens
ugugcaguuuugagugaauuuc

SEQ ID NO: 277780 - RNA, 22 nt, Homo sapiens
ugugcauagugugugcggggcg

SEQ ID NO: 277781 - RNA, 22 nt, Homo sapiens
ugugccacugcacuccugggug

SEQ ID NO: 277782 - RNA, 22 nt, Homo sapiens
ugugcgcaucggggccugcuuc

SEQ ID NO: 277783 - RNA, 22 nt, Homo sapiens
ugugcguguaagagaucuaggu

SEQ ID NO: 277784 - RNA, 22 nt, Homo sapiens
ugugcgugugccuguaagaauu

SEQ ID NO: 277785 - RNA, 22 nt, Homo sapiens
uguggaaauaaaagaaagguua

SEQ ID NO: 277786 - RNA, 22 nt, Homo sapiens
uguggaaauggugcuacgaaca

SEQ ID NO: 277787 - RNA, 22 nt, Homo sapiens
uguggcaaauggucaggaagaa

SEQ ID NO: 277788 - RNA, 20 nt, Homo sapiens
uguggcacuguaucucucag

SEQ ID NO: 277789 - RNA, 22 nt, Homo sapiens
uguggcauuuucagaaaggaug

SEQ ID NO: 277790 - RNA, 18 nt, Homo sapiens
uguggcuguuuuccaaua

SEQ ID NO: 277791 - RNA, 23 nt, Homo sapiens
ugugguauuauuccauuuauagg

SEQ ID NO: 277792 - RNA, 22 nt, Homo sapiens
uuauuugguugcugacuuggaa

SEQ ID NO: 277793 - RNA, 22 nt, Homo sapiens
uucaaaaccucugcuuaagccc

SEQ ID NO: 277794 - RNA, 22 nt, Homo sapiens
uucaaauguucuuucaccaccc

SEQ ID NO: 277795 - RNA, 22 nt, Homo sapiens
uucacagaaaaaggcgaugagg

SEQ ID NO: 277796 - RNA, 22 nt, Homo sapiens
uucacagccgcaccccaucacu

SEQ ID NO: 277797 - RNA, 22 nt, Homo sapiens
uucacagcuuaauaaggcucag

SEQ ID NO: 277798 - RNA, 22 nt, Homo sapiens
uucacaguguuucucacgguua

SEQ ID NO: 277799 - RNA, 22 nt, Homo sapiens
uucacugcacuccagccugagc

SEQ ID NO: 277800 - RNA, 22 nt, Homo sapiens
uucacugcaugaaaaggacagc

SEQ ID NO: 277801 - RNA, 22 nt, Homo sapiens
uucacuguaaaaugaagagggu

SEQ ID NO: 277802 - RNA, 22 nt, Homo sapiens
uucacugugugacccugggcca

SEQ ID NO: 277803 - RNA, 22 nt, Homo sapiens
uucagcaggccaggcccugacu

SEQ ID NO: 277804 - RNA, 22 nt, Homo sapiens
uucagcuacuugggaggcugaa

SEQ ID NO: 277805 - RNA, 22 nt, Homo sapiens
uucagggcauuggaguuucuga

SEQ ID NO: 277806 - RNA, 22 nt, Homo sapiens
uucagguaguuuaacuguucca

SEQ ID NO: 277807 - RNA, 22 nt, Homo sapiens
uucagguaucccuugucuauag

SEQ ID NO: 277808 - RNA, 22 nt, Homo sapiens
uucaguacuucaaaaucuuuaa

SEQ ID NO: 277809 - RNA, 20 nt, Homo sapiens
uucagugcagguaacaaucc

SEQ ID NO: 277810 - RNA, 22 nt, Homo sapiens
uucagugguuauuugugagauu

SEQ ID NO: 277811 - RNA, 18 nt, Homo sapiens
uucauaguagcaugauuu

SEQ ID NO: 277812 - RNA, 22 nt, Homo sapiens
uucauaguauuuuucuccaaau

SEQ ID NO: 277813 - RNA, 22 nt, Homo sapiens
uucauagucuaugcaaguaaga

SEQ ID NO: 277814 - RNA, 23 nt, Homo sapiens
uucaucagggauauuggccugaa

SEQ ID NO: 277815 - RNA, 22 nt, Homo sapiens
uucaucaguugagcugguugcu

SEQ ID NO: 277816 - RNA, 21 nt, Homo sapiens
uucaucuggccguauuccagg

SEQ ID NO: 277817 - RNA, 22 nt, Homo sapiens
uucauggaauauugaccauuuu

SEQ ID NO: 277818 - RNA, 22 nt, Homo sapiens
uucauggauggaaaugauuuug

SEQ ID NO: 277819 - RNA, 22 nt, Homo sapiens
uucauguaauauuucacagcuu

SEQ ID NO: 277820 - RNA, 22 nt, Homo sapiens
uucauugaaugauuuuuagaag

SEQ ID NO: 277821 - RNA, 22 nt, Homo sapiens
uuccaagugggaaacaaaaaug

SEQ ID NO: 277822 - RNA, 22 nt, Homo sapiens
uuccacaaugguugaacuaguu

SEQ ID NO: 277823 - RNA, 22 nt, Homo sapiens
uuccacaggguugaacuaguuu

SEQ ID NO: 277824 - RNA, 23 nt, Homo sapiens
uuccaccauugacuaguuacaua

SEQ ID NO: 277825 - RNA, 22 nt, Homo sapiens
uuccagugggacgagaugugga

SEQ ID NO: 277826 - RNA, 22 nt, Homo sapiens
uuccaguguuugacucaccuuu

SEQ ID NO: 277827 - RNA, 22 nt, Homo sapiens
uuccaguuauuauaccucuuaa

SEQ ID NO: 277828 - RNA, 22 nt, Homo sapiens
uuccaguuuuauggguauagag

SEQ ID NO: 277829 - RNA, 22 nt, Homo sapiens
uuccauagucauagugcugaug

SEQ ID NO: 277830 - RNA, 22 nt, Homo sapiens
uuccauguaguugagcaguuuu

SEQ ID NO: 277831 - RNA, 22 nt, Homo sapiens
uuccaugugggcuugucaagua

SEQ ID NO: 277832 - RNA, 22 nt, Homo sapiens
uuccauguugauacgugaaguu

SEQ ID NO: 277833 - RNA, 22 nt, Homo sapiens
uuccauugugucaucuuggugg

SEQ ID NO: 277834 - RNA, 22 nt, Homo sapiens
uucccagagagggacuucuaau

SEQ ID NO: 277835 - RNA, 22 nt, Homo sapiens
uucccagagccugggagugagg

SEQ ID NO: 277836 - RNA, 22 nt, Homo sapiens
uucccagucaaacgaaggacuu

SEQ ID NO: 277837 - RNA, 20 nt, Homo sapiens
uucccucagccuugagggua

SEQ ID NO: 277838 - RNA, 22 nt, Homo sapiens
uucccugaguaucuuaccaugg

SEQ ID NO: 277839 - RNA, 22 nt, Homo sapiens
uucccuuugaaacuaaacuugc

SEQ ID NO: 277840 - RNA, 22 nt, Homo sapiens
uuccuaguccugagucucugcg

SEQ ID NO: 277841 - RNA, 22 nt, Homo sapiens
uuccugagagggcugggugcag

SEQ ID NO: 277842 - RNA, 22 nt, Homo sapiens
uuccugaggccuccccagaagc

SEQ ID NO: 277843 - RNA, 22 nt, Homo sapiens
uuccuugagucuuuuuccugag

SEQ ID NO: 277844 - RNA, 22 nt, Homo sapiens
uuccuugugacuaguagugacc

SEQ ID NO: 277845 - RNA, 22 nt, Homo sapiens
uucuacaugggucgucggugag

SEQ ID NO: 277846 - RNA, 22 nt, Homo sapiens
uucuagagagaagacuuaagcu

SEQ ID NO: 277847 - RNA, 22 nt, Homo sapiens
uucuagcacuuugggagacuga

SEQ ID NO: 277848 - RNA, 22 nt, Homo sapiens
uucuaugguuuuuaugguguua

SEQ ID NO: 277849 - RNA, 22 nt, Homo sapiens
uucuauguuugaaaaugccaaa

SEQ ID NO: 277850 - RNA, 22 nt, Homo sapiens
uucucacaguacagggagcucu

SEQ ID NO: 277851 - RNA, 22 nt, Homo sapiens
uucucaguuccuacuuugguga

SEQ ID NO: 277852 - RNA, 17 nt, Homo sapiens
uucucaguucugaucuc

SEQ ID NO: 277853 - RNA, 22 nt, Homo sapiens
uucucauggaacaucuguacug

SEQ ID NO: 277854 - RNA, 22 nt, Homo sapiens
uucuccugguggacccuaaacg

SEQ ID NO: 277855 - RNA, 22 nt, Homo sapiens
uucucgcuuuuuccaccuguau

SEQ ID NO: 277856 - RNA, 22 nt, Homo sapiens
uucucuggucagaggggagguu

SEQ ID NO: 277857 - RNA, 19 nt, Homo sapiens
uucucugguuguacuaccc

SEQ ID NO: 277858 - RNA, 22 nt, Homo sapiens
uucugauggaguaguccacaga

SEQ ID NO: 277859 - RNA, 22 nt, Homo sapiens
uucugcuagucugucagaucuu

SEQ ID NO: 277860 - RNA, 22 nt, Homo sapiens
uucuggccccucccaaucucau

SEQ ID NO: 277861 - RNA, 22 nt, Homo sapiens
uucuggcuuuuaaagaaauguu

SEQ ID NO: 277862 - RNA, 22 nt, Homo sapiens
uucugugcuuguggaugaagug

SEQ ID NO: 277863 - RNA, 22 nt, Homo sapiens
uucuucaguuacaacaaggggg

SEQ ID NO: 277864 - RNA, 22 nt, Homo sapiens
uucuugcacugaucccauaagc

SEQ ID NO: 277865 - RNA, 22 nt, Homo sapiens
uugcauugacacaugaagcuca

SEQ ID NO: 277866 - RNA, 23 nt, Homo sapiens
uugcauugcccuccauaguacuc

SEQ ID NO: 277867 - RNA, 22 nt, Homo sapiens
uugccaauauuuuacugagaag

SEQ ID NO: 277868 - RNA, 22 nt, Homo sapiens
uugccauggaguagaauugaag

SEQ ID NO: 277869 - RNA, 22 nt, Homo sapiens
uugccuaguuuaggucugugcu

SEQ ID NO: 277870 - RNA, 22 nt, Homo sapiens
uugcucaggcuagaguucagcu

SEQ ID NO: 277871 - RNA, 20 nt, Homo sapiens
uugcugguguuagaggaggc

SEQ ID NO: 277872 - RNA, 22 nt, Homo sapiens
uugcuucauucaacauugaggg

SEQ ID NO: 277873 - RNA, 22 nt, Homo sapiens
uugcuucuuucgucuggcccca

SEQ ID NO: 277874 - RNA, 22 nt, Homo sapiens
uuggaaauguguuugcauucag

SEQ ID NO: 277875 - RNA, 22 nt, Homo sapiens
uuggaaggcuccuaaugaaugg

SEQ ID NO: 277876 - RNA, 22 nt, Homo sapiens
uuggaaggcugaauggccucuc

SEQ ID NO: 277877 - RNA, 22 nt, Homo sapiens
uuggaagguaaucaaaaguucu

SEQ ID NO: 277878 - RNA, 22 nt, Homo sapiens
uuggaauauaaccuguuucuaa

SEQ ID NO: 277879 - RNA, 22 nt, Homo sapiens
uuggaaugcacacugagccugc

SEQ ID NO: 277880 - RNA, 22 nt, Homo sapiens
uuggaauguauggcaucuugcg

SEQ ID NO: 277881 - RNA, 22 nt, Homo sapiens
uuggaaugugacugauaauauu

SEQ ID NO: 277882 - RNA, 22 nt, Homo sapiens
uuggacuuuaagauagagaugu

SEQ ID NO: 277883 - RNA, 22 nt, Homo sapiens
uuggacuuuuauucugcaggca

SEQ ID NO: 277884 - RNA, 22 nt, Homo sapiens
uuggagugugagagcagccugg

SEQ ID NO: 277885 - RNA, 22 nt, Homo sapiens
uuggaguguucugguccgggcu

SEQ ID NO: 277886 - RNA, 22 nt, Homo sapiens
uuggauuuuaacaaacuaggug

SEQ ID NO: 277887 - RNA, 22 nt, Homo sapiens
uuggcaaaugucacaaaucagg

SEQ ID NO: 277888 - RNA, 22 nt, Homo sapiens
uuggcaaguccccaccucucuc

SEQ ID NO: 277889 - RNA, 22 nt, Homo sapiens
uuggcaauauuuacugaaguug

SEQ ID NO: 277890 - RNA, 22 nt, Homo sapiens
uuggcacgugguggggcucgga

SEQ ID NO: 277891 - RNA, 22 nt, Homo sapiens
uuggcagugguucugacggacc

SEQ ID NO: 277892 - RNA, 22 nt, Homo sapiens
uuggcauugaguuucaaaucau

SEQ ID NO: 277893 - RNA, 22 nt, Homo sapiens
uuggcauuuauucuaaggucaa

SEQ ID NO: 277894 - RNA, 22 nt, Homo sapiens
uuggcccugcugaccauucccu

SEQ ID NO: 277895 - RNA, 22 nt, Homo sapiens
uuggcuauagauacauggauua

SEQ ID NO: 277896 - RNA, 22 nt, Homo sapiens
uuggcuuguaaaaugaaaagcu

SEQ ID NO: 277897 - RNA, 22 nt, Homo sapiens
uugggaaugcuaaaccucuauu

SEQ ID NO: 277898 - RNA, 23 nt, Homo sapiens
uugggcaaaucacugagggcaga

SEQ ID NO: 277899 - RNA, 22 nt, Homo sapiens
uugggcuugagggugcccaguc

SEQ ID NO: 277900 - RNA, 22 nt, Homo sapiens
uugguaagguggaugaugaaua

SEQ ID NO: 277901 - RNA, 22 nt, Homo sapiens
uugguaaucccuagugucuaga

SEQ ID NO: 277902 - RNA, 22 nt, Homo sapiens
uugguacuaaaaaguagggugu

SEQ ID NO: 277903 - RNA, 22 nt, Homo sapiens
uugguacuagcugaucgcagag

SEQ ID NO: 277904 - RNA, 22 nt, Homo sapiens
uuggucaaaucugaugggagaa

SEQ ID NO: 277905 - RNA, 22 nt, Homo sapiens
uugguccccacuccccugccaa

SEQ ID NO: 277906 - RNA, 22 nt, Homo sapiens
uugguccccuucaaccagcugu

SEQ ID NO: 277907 - RNA, 22 nt, Homo sapiens
uugguccucccaugcucaagag

SEQ ID NO: 277908 - RNA, 22 nt, Homo sapiens
uuggucucuuaaucacacuuuu

SEQ ID NO: 277909 - RNA, 20 nt, Homo sapiens
uuggugaccuacagaugugg

SEQ ID NO: 277910 - RNA, 22 nt, Homo sapiens
uugguuccuuagccuaggacua

SEQ ID NO: 277911 - RNA, 22 nt, Homo sapiens
uuguaaaguucuuaggaagcuc

SEQ ID NO: 277912 - RNA, 22 nt, Homo sapiens
uuguaacaguuuauugacucga

SEQ ID NO: 277913 - RNA, 22 nt, Homo sapiens
uuguaagaaucuagcucuuuau

SEQ ID NO: 277914 - RNA, 23 nt, Homo sapiens
uuguacacuaagaaucgcagaug

SEQ ID NO: 277915 - RNA, 22 nt, Homo sapiens
uuguacaggaguguaagcuuca

SEQ ID NO: 277916 - RNA, 22 nt, Homo sapiens
uuguaccacagggcaugaagug

SEQ ID NO: 277917 - RNA, 22 nt, Homo sapiens
uuguacuauuuuuaucagugau

SEQ ID NO: 277918 - RNA, 22 nt, Homo sapiens
uuguauaggcucaguaagaauc

SEQ ID NO: 277919 - RNA, 21 nt, Homo sapiens
uuguaugguugaacuugauac

SEQ ID NO: 277920 - RNA, 22 nt, Homo sapiens
uuguauguuguuugucagagaa

SEQ ID NO: 277921 - RNA, 22 nt, Homo sapiens
uuguauguuuguucuuucagau

SEQ ID NO: 277922 - RNA, 22 nt, Homo sapiens
uugucaaacucauucuccaucc

SEQ ID NO: 277923 - RNA, 22 nt, Homo sapiens
uugucacccuacauaacaggga

SEQ ID NO: 277924 - RNA, 22 nt, Homo sapiens
uugucacuauaaauaagcauuu

SEQ ID NO: 277925 - RNA, 22 nt, Homo sapiens
uugucaguguucacucaaagcu

SEQ ID NO: 277926 - RNA, 22 nt, Homo sapiens
uuguccacugcuagccucugca

SEQ ID NO: 277927 - RNA, 22 nt, Homo sapiens
uuguccauggacagcaccacag

SEQ ID NO: 277928 - RNA, 22 nt, Homo sapiens
uuguccuccacauuugaucagu

SEQ ID NO: 277929 - RNA, 19 nt, Homo sapiens
uugucuuagaguugucauu

SEQ ID NO: 277930 - RNA, 22 nt, Homo sapiens
uugugaauggugccacaauaaa

SEQ ID NO: 277931 - RNA, 22 nt, Homo sapiens
uugugaauggugcugcaguaaa

SEQ ID NO: 277932 - RNA, 22 nt, Homo sapiens
uugugcacauguacccuagaac

SEQ ID NO: 277933 - RNA, 22 nt, Homo sapiens
uugugcauguauauuaguucac

SEQ ID NO: 277934 - RNA, 22 nt, Homo sapiens
uugugguuuuagcacuguggau

SEQ ID NO: 277935 - RNA, 22 nt, Homo sapiens
uugugguuuuuaaaacuaggug

SEQ ID NO: 277936 - RNA, 22 nt, Homo sapiens
uugugucaaauggcaauuagca

SEQ ID NO: 277937 - RNA, 22 nt, Homo sapiens
auggagagaauuauucucucag

SEQ ID NO: 277938 - RNA, 22 nt, Homo sapiens
auggagugagaauggagguucc

SEQ ID NO: 277939 - RNA, 22 nt, Homo sapiens
auggauagucucacucacauac

SEQ ID NO: 277940 - RNA, 22 nt, Homo sapiens
auggauguucuagggaugugau

SEQ ID NO: 277941 - RNA, 22 nt, Homo sapiens
auggauuuuaggauacaguuga

SEQ ID NO: 277942 - RNA, 22 nt, Homo sapiens
auggcaaaaaaugcaauuacuu

SEQ ID NO: 277943 - RNA, 22 nt, Homo sapiens
auggcacuaaguucaacacuua

SEQ ID NO: 277944 - RNA, 22 nt, Homo sapiens
auggcacuaaugggaguuuacu

SEQ ID NO: 277945 - RNA, 22 nt, Homo sapiens
auggcacucaaucaaguugaga

SEQ ID NO: 277946 - RNA, 22 nt, Homo sapiens
auggcacugaagcguauugaca

SEQ ID NO: 277947 - RNA, 22 nt, Homo sapiens
auggcacuguguauuuuucugu

SEQ ID NO: 277948 - RNA, 22 nt, Homo sapiens
auggcagcaccccacucuacug

SEQ ID NO: 277949 - RNA, 22 nt, Homo sapiens
auggcagugagucucuaguauu

SEQ ID NO: 277950 - RNA, 22 nt, Homo sapiens
auggcaguuucacucugggauu

SEQ ID NO: 277951 - RNA, 22 nt, Homo sapiens
auggcauggugcaggguuuaag

SEQ ID NO: 277952 - RNA, 22 nt, Homo sapiens
auggcauugaagaguugucccu

SEQ ID NO: 277953 - RNA, 22 nt, Homo sapiens
auggccgggugcgguggcucac

SEQ ID NO: 277954 - RNA, 22 nt, Homo sapiens
auggccuuuuuaucucaccaag

SEQ ID NO: 277955 - RNA, 22 nt, Homo sapiens
auggcuagauuguaugguaguu

SEQ ID NO: 277956 - RNA, 22 nt, Homo sapiens
auggcucaauucuuucccugaa

SEQ ID NO: 277957 - RNA, 22 nt, Homo sapiens
auggcucaguguguaucuauca

SEQ ID NO: 277958 - RNA, 22 nt, Homo sapiens
auggcuguuuaagaguuucauu

SEQ ID NO: 277959 - RNA, 22 nt, Homo sapiens
auggcuugugacccaugcuuca

SEQ ID NO: 277960 - RNA, 22 nt, Homo sapiens
auggcuugugggaacuuuuaaa

SEQ ID NO: 277961 - RNA, 22 nt, Homo sapiens
auggcuuugggcugcucugccc

SEQ ID NO: 277962 - RNA, 22 nt, Homo sapiens
auggcuuuugaccugguaggau

SEQ ID NO: 277963 - RNA, 22 nt, Homo sapiens
augggagugugguuagagaccu

SEQ ID NO: 277964 - RNA, 22 nt, Homo sapiens
augggauaguaucaguggaaua

SEQ ID NO: 277965 - RNA, 22 nt, Homo sapiens
augggguaggcuugcuguagua

SEQ ID NO: 277966 - RNA, 22 nt, Homo sapiens
augguaguagaugugugguuuu

SEQ ID NO: 277967 - RNA, 22 nt, Homo sapiens
auggucccauucauucacguau

SEQ ID NO: 277968 - RNA, 22 nt, Homo sapiens
auggucuuuauuguguugagug

SEQ ID NO: 277969 - RNA, 22 nt, Homo sapiens
auguaaacagaugugcagcuug

SEQ ID NO: 277970 - RNA, 17 nt, Homo sapiens
auguaauccucaucucu

SEQ ID NO: 277971 - RNA, 22 nt, Homo sapiens
auguaauugagguuuuugccau

SEQ ID NO: 277972 - RNA, 22 nt, Homo sapiens
auguaguauuaaugagagauaa

SEQ ID NO: 277973 - RNA, 22 nt, Homo sapiens
augucaacauagacaguagagu

SEQ ID NO: 277974 - RNA, 21 nt, Homo sapiens
augucauggaugacuaauuca

SEQ ID NO: 277975 - RNA, 22 nt, Homo sapiens
augucuagagugauacugaagc

SEQ ID NO: 277976 - RNA, 22 nt, Homo sapiens
augucuggcagaagacuucuca

SEQ ID NO: 277977 - RNA, 22 nt, Homo sapiens
augucugguagccaccuggagg

SEQ ID NO: 277978 - RNA, 22 nt, Homo sapiens
augugacuuuuuccugugccuu

SEQ ID NO: 277979 - RNA, 22 nt, Homo sapiens
augugaugguuaauuuuaugug

SEQ ID NO: 277980 - RNA, 22 nt, Homo sapiens
augugcaauguguacguagccc

SEQ ID NO: 277981 - RNA, 22 nt, Homo sapiens
augugcacauucugguaaauau

SEQ ID NO: 277982 - RNA, 20 nt, Homo sapiens
augugcuaauauuaauaugu

SEQ ID NO: 277983 - RNA, 22 nt, Homo sapiens
augugcuugagggaaaucaguu

SEQ ID NO: 277984 - RNA, 22 nt, Homo sapiens
augugcuuuuuaaacagaugcu

SEQ ID NO: 277985 - RNA, 22 nt, Homo sapiens
augugguaggcccaugagucau

SEQ ID NO: 277986 - RNA, 22 nt, Homo sapiens
augugguaguuauagugauaag

SEQ ID NO: 277987 - RNA, 19 nt, Homo sapiens
augugguuagcaugacugc

SEQ ID NO: 277988 - RNA, 22 nt, Homo sapiens
auguguaaagcuuuucuuuguu

SEQ ID NO: 277989 - RNA, 22 nt, Homo sapiens
augugugcuugauguaaaaagu

SEQ ID NO: 277990 - RNA, 22 nt, Homo sapiens
auguuagcaucuggcacuaugg

SEQ ID NO: 277991 - RNA, 22 nt, Homo sapiens
auguuugguagugaauauggua

SEQ ID NO: 277992 - RNA, 22 nt, Homo sapiens
auuaaguuaggauuuugagaua

SEQ ID NO: 277993 - RNA, 22 nt, Homo sapiens
auuacaugucuauccaugaaca

SEQ ID NO: 277994 - RNA, 22 nt, Homo sapiens
auuacuuugcaccaaccuaaua

SEQ ID NO: 277995 - RNA, 22 nt, Homo sapiens
auuagguuggugcaaaacuuuc

SEQ ID NO: 277996 - RNA, 22 nt, Homo sapiens
auucaaagugcauguucccacu

SEQ ID NO: 277997 - RNA, 22 nt, Homo sapiens
auucaaggagucuucgucccaa

SEQ ID NO: 277998 - RNA, 22 nt, Homo sapiens
auucacuuuuauagacaggucu

SEQ ID NO: 277999 - RNA, 22 nt, Homo sapiens
auucagaggggcagcugucuug

SEQ ID NO: 278000 - RNA, 22 nt, Homo sapiens
auucaucagggauauuggucug

SEQ ID NO: 278001 - RNA, 22 nt, Homo sapiens
auuccacaguuaacacagaccg

SEQ ID NO: 278002 - RNA, 22 nt, Homo sapiens
auuccauaguacagugaugagu

SEQ ID NO: 278003 - RNA, 22 nt, Homo sapiens
auucccuguagaauaaggaugg

SEQ ID NO: 278004 - RNA, 18 nt, Homo sapiens
auucuacaggccuuuuga

SEQ ID NO: 278005 - RNA, 22 nt, Homo sapiens
auugaacacagaguagcuuucc

SEQ ID NO: 278006 - RNA, 22 nt, Homo sapiens
auugaacuguuggagagguuuu

SEQ ID NO: 278007 - RNA, 22 nt, Homo sapiens
auugaguaaaaaauagugaugu

SEQ ID NO: 278008 - RNA, 19 nt, Homo sapiens
auugauuaaguuugcuguc

SEQ ID NO: 278009 - RNA, 22 nt, Homo sapiens
auugcacaaagagggaaacuga

SEQ ID NO: 278010 - RNA, 22 nt, Homo sapiens
auugcacacagaaucaggguaa

SEQ ID NO: 278011 - RNA, 18 nt, Homo sapiens
auugcacaccagccuggg

SEQ ID NO: 278012 - RNA, 22 nt, Homo sapiens
auugcacuccagccuggccaac

SEQ ID NO: 278013 - RNA, 22 nt, Homo sapiens
auugcacuccagccuugugaca

SEQ ID NO: 278014 - RNA, 22 nt, Homo sapiens
auugcauaaacacauuucuuau

SEQ ID NO: 278015 - RNA, 22 nt, Homo sapiens
auuggcuuuauacauaagaaua

SEQ ID NO: 278016 - RNA, 22 nt, Homo sapiens
auuggucuugaaaccagagaga

SEQ ID NO: 278017 - RNA, 22 nt, Homo sapiens
auuguacauacaccggugugua

SEQ ID NO: 278018 - RNA, 22 nt, Homo sapiens
auuguacuccagccugggcaag

SEQ ID NO: 278019 - RNA, 22 nt, Homo sapiens
auuguacucuagccucugggca

SEQ ID NO: 278020 - RNA, 22 nt, Homo sapiens
auuguuccccggucauuuuugu

SEQ ID NO: 278021 - RNA, 19 nt, Homo sapiens
auuuccuggagcuggucuc

SEQ ID NO: 278022 - RNA, 22 nt, Homo sapiens
auuuccuguaggggcuugcgaa

SEQ ID NO: 278023 - RNA, 22 nt, Homo sapiens
auuuggcauagaguaucauucu

SEQ ID NO: 278024 - RNA, 20 nt, Homo sapiens
auuuggcauaguuuaagcaa

SEQ ID NO: 278025 - RNA, 22 nt, Homo sapiens
auuugguugggugcgguggcuu

SEQ ID NO: 278026 - RNA, 22 nt, Homo sapiens
auuuugguuacauaguugagcu

SEQ ID NO: 278027 - RNA, 22 nt, Homo sapiens
auuuuugguugguaggcuauua

SEQ ID NO: 278028 - RNA, 22 nt, Homo sapiens
caaaggcuuccacugcauccuu

SEQ ID NO: 278029 - RNA, 22 nt, Homo sapiens
caaaggcuucugaaacugcaga

SEQ ID NO: 278030 - RNA, 22 nt, Homo sapiens
caaagugcugggaugggccagg

SEQ ID NO: 278031 - RNA, 22 nt, Homo sapiens
caaagugguuuauacaugauug

SEQ ID NO: 278032 - RNA, 19 nt, Homo sapiens
caaaguguucuucuuugcc

SEQ ID NO: 278033 - RNA, 22 nt, Homo sapiens
caaaugacaucauuucauucaa

SEQ ID NO: 278034 - RNA, 22 nt, Homo sapiens
caacacagugaaacccgucucu

SEQ ID NO: 278035 - RNA, 22 nt, Homo sapiens
caacacuguuuauuggauagcc

SEQ ID NO: 278036 - RNA, 22 nt, Homo sapiens
caacucuguaggauccaggugg

SEQ ID NO: 278037 - RNA, 22 nt, Homo sapiens
caaggaauucucaauagaguua

SEQ ID NO: 278038 - RNA, 22 nt, Homo sapiens
caagggguggaaaugguagugu

SEQ ID NO: 278039 - RNA, 21 nt, Homo sapiens
caagugaugcuucugcuuuaa

SEQ ID NO: 278040 - RNA, 22 nt, Homo sapiens
caaguguuggcuuguauacaaa

SEQ ID NO: 278041 - RNA, 22 nt, Homo sapiens
caaguguuuccuuaaauacuug

SEQ ID NO: 278042 - RNA, 21 nt, Homo sapiens
caauggcacgaucuuggcuca

SEQ ID NO: 278043 - RNA, 22 nt, Homo sapiens
cacaaugucuaagauguuucua

SEQ ID NO: 278044 - RNA, 22 nt, Homo sapiens
cacagaauucauuggauuaccu

SEQ ID NO: 278045 - RNA, 22 nt, Homo sapiens
cacaggccugucucuuucuaac

SEQ ID NO: 278046 - RNA, 22 nt, Homo sapiens
cacagucuugcaauauugagau

SEQ ID NO: 278047 - RNA, 22 nt, Homo sapiens
cacagugaacaauauccucugu

SEQ ID NO: 278048 - RNA, 22 nt, Homo sapiens
cacagugaacugguggguuuuu

SEQ ID NO: 278049 - RNA, 22 nt, Homo sapiens
cacagugaaugucaucauugcc

SEQ ID NO: 278050 - RNA, 22 nt, Homo sapiens
cacaguguucauagccaucagg

SEQ ID NO: 278051 - RNA, 22 nt, Homo sapiens
cacauguucaggagcacuuaga

SEQ ID NO: 278052 - RNA, 22 nt, Homo sapiens
cacugcaauuacuuuugcacca

SEQ ID NO: 278053 - RNA, 22 nt, Homo sapiens
cacugcacuccagucccgucuc

SEQ ID NO: 278054 - RNA, 22 nt, Homo sapiens
cacugcacuccagucugacgac

SEQ ID NO: 278055 - RNA, 22 nt, Homo sapiens
cacugcacuccaguuuggauga

SEQ ID NO: 278056 - RNA, 22 nt, Homo sapiens
cacugggccaucacuuaauauu

SEQ ID NO: 278057 - RNA, 22 nt, Homo sapiens
cacuguggauggaacuauguga

SEQ ID NO: 278058 - RNA, 22 nt, Homo sapiens
cagagaacauucagagcuguag

SEQ ID NO: 278059 - RNA, 22 nt, Homo sapiens
cagagugcauguuuagaugagu

SEQ ID NO: 278060 - RNA, 22 nt, Homo sapiens
cagaugguggucccacagccca

SEQ ID NO: 278061 - RNA, 22 nt, Homo sapiens
cagcacauuacaaguacuuggu

SEQ ID NO: 278062 - RNA, 22 nt, Homo sapiens
cagcagguuuuuaucaguuaag

SEQ ID NO: 278063 - RNA, 22 nt, Homo sapiens
cagcaguuguuucggauuggga

SEQ ID NO: 278064 - RNA, 22 nt, Homo sapiens
cagcaucauucaucugggguaa

SEQ ID NO: 278065 - RNA, 22 nt, Homo sapiens
cagcccguaaucccagcacuuu

SEQ ID NO: 278066 - RNA, 22 nt, Homo sapiens
cagcgaggucugcgucacauug

SEQ ID NO: 278067 - RNA, 22 nt, Homo sapiens
cagcuaguuuuugguuuacagu

SEQ ID NO: 278068 - RNA, 22 nt, Homo sapiens
cagcugaugucgaaugcacucu

SEQ ID NO: 278069 - RNA, 22 nt, Homo sapiens
cagcugcuuuggaaaauauuuu

SEQ ID NO: 278070 - RNA, 22 nt, Homo sapiens
cagcugguguuacaaaccagag

SEQ ID NO: 278071 - RNA, 23 nt, Homo sapiens
cagcuucauugaacauaacuccu

SEQ ID NO: 278072 - RNA, 22 nt, Homo sapiens
cagcuugugguauugcugguug

SEQ ID NO: 278073 - RNA, 22 nt, Homo sapiens
caggaaugugaggguucccugc

SEQ ID NO: 278074 - RNA, 22 nt, Homo sapiens
gccauggaggauuuauagaggc

SEQ ID NO: 278075 - RNA, 22 nt, Homo sapiens
gccauugcacuccagccuaggc

SEQ ID NO: 278076 - RNA, 22 nt, Homo sapiens
gccauugcacuccagccugagc

SEQ ID NO: 278077 - RNA, 22 nt, Homo sapiens
gcccuguaguauaguuugaagu

SEQ ID NO: 278078 - RNA, 22 nt, Homo sapiens
gcccuuugugucuggcuggggu

SEQ ID NO: 278079 - RNA, 22 nt, Homo sapiens
gccuguagaagaguagaugacc

SEQ ID NO: 278080 - RNA, 22 nt, Homo sapiens
gcgagcauuguaggaaguucag

SEQ ID NO: 278081 - RNA, 19 nt, Homo sapiens
gcggcacuggagacacagc

SEQ ID NO: 278082 - RNA, 22 nt, Homo sapiens
gcgguuuuaagugaguuucuua

SEQ ID NO: 278083 - RNA, 22 nt, Homo sapiens
gcguugcacuccagccugggua

SEQ ID NO: 278084 - RNA, 22 nt, Homo sapiens
gcuaugguuuuuagcuccauca

SEQ ID NO: 278085 - RNA, 22 nt, Homo sapiens
gcuaugucuguugcucuugggc

SEQ ID NO: 278086 - RNA, 22 nt, Homo sapiens
gcucaaguaauggcaguuuugc

SEQ ID NO: 278087 - RNA, 22 nt, Homo sapiens
gcugagcuaugccauauaugcc

SEQ ID NO: 278088 - RNA, 22 nt, Homo sapiens
gcugauggugcaguucuagccu

SEQ ID NO: 278089 - RNA, 17 nt, Homo sapiens
gcugauguuugcauuuu

SEQ ID NO: 278090 - RNA, 17 nt, Homo sapiens
gcugcauucauguagaa

SEQ ID NO: 278091 - RNA, 22 nt, Homo sapiens
gcugcguguagaguucucacug

SEQ ID NO: 278092 - RNA, 22 nt, Homo sapiens
gcugcuguuucucuuucagcau

SEQ ID NO: 278093 - RNA, 22 nt, Homo sapiens
gcugcuuuugaugacaaaaaca

SEQ ID NO: 278094 - RNA, 22 nt, Homo sapiens
gcuggguugccagguuacuuaa

SEQ ID NO: 278095 - RNA, 22 nt, Homo sapiens
gcuggugacuuuaaguugaagc

SEQ ID NO: 278096 - RNA, 22 nt, Homo sapiens
gcugguguugugaaucaggccg

SEQ ID NO: 278097 - RNA, 22 nt, Homo sapiens
gcuguauuguugaaggaaaugu

SEQ ID NO: 278098 - RNA, 22 nt, Homo sapiens
gcugucuggagucuguucaaug

SEQ ID NO: 278099 - RNA, 22 nt, Homo sapiens
gcugugguuuaguagaaagaag

SEQ ID NO: 278100 - RNA, 22 nt, Homo sapiens
gcuguguguuaucagaaauugc

SEQ ID NO: 278101 - RNA, 22 nt, Homo sapiens
gcuguguugugcccagcaucau

SEQ ID NO: 278102 - RNA, 22 nt, Homo sapiens
gcuguuugccgccaucgcagac

SEQ ID NO: 278103 - RNA, 22 nt, Homo sapiens
gcuugguccccacccaaaucgc

SEQ ID NO: 278104 - RNA, 18 nt, Homo sapiens
ggaaaacuuuucuaagua

SEQ ID NO: 278105 - RNA, 22 nt, Homo sapiens
ggaaagcuagguguggguguac

SEQ ID NO: 278106 - RNA, 22 nt, Homo sapiens
ggaaaguaacccauucucuuac

SEQ ID NO: 278107 - RNA, 22 nt, Homo sapiens
ggaagacaguguggugauuccu

SEQ ID NO: 278108 - RNA, 22 nt, Homo sapiens
ggaagacuggcuuguuuaccca

SEQ ID NO: 278109 - RNA, 22 nt, Homo sapiens
ggaagguaauuggguaaugaga

SEQ ID NO: 278110 - RNA, 19 nt, Homo sapiens
ggaaugcaccaguccuugc

SEQ ID NO: 278111 - RNA, 22 nt, Homo sapiens
ggaauguaguaauuugguuagu

SEQ ID NO: 278112 - RNA, 22 nt, Homo sapiens
uaguaacacauugaacgaucgc

SEQ ID NO: 278113 - RNA, 22 nt, Homo sapiens
uaguaccauucccaaaccaacu

SEQ ID NO: 278114 - RNA, 18 nt, Homo sapiens
uaguacuguucucaugau

SEQ ID NO: 278115 - RNA, 22 nt, Homo sapiens
uagugaaugucacuggcuguug

SEQ ID NO: 278116 - RNA, 22 nt, Homo sapiens
uagugaauguuggcuauuaaua

SEQ ID NO: 278117 - RNA, 22 nt, Homo sapiens
uagugcugagauugagaagccc

SEQ ID NO: 278118 - RNA, 21 nt, Homo sapiens
uagugcugaggcaguauggga

SEQ ID NO: 278119 - RNA, 20 nt, Homo sapiens
uaguggcaugcaccuguagc

SEQ ID NO: 278120 - RNA, 22 nt, Homo sapiens
uagugguaguuauggauuugcu

SEQ ID NO: 278121 - RNA, 22 nt, Homo sapiens
uaguuguugcagguaggaugua

SEQ ID NO: 278122 - RNA, 23 nt, Homo sapiens
uauaacuuuuaauuuacuggccu

SEQ ID NO: 278123 - RNA, 22 nt, Homo sapiens
uauagcacugaccuuccaggac

SEQ ID NO: 278124 - RNA, 22 nt, Homo sapiens
uauagcagugugagaacagacu

SEQ ID NO: 278125 - RNA, 22 nt, Homo sapiens
uauagcuugaaggaauggucau

SEQ ID NO: 278126 - RNA, 23 nt, Homo sapiens
uugcaaagccugaaacucuucag

SEQ ID NO: 278127 - RNA, 22 nt, Homo sapiens
uugcaacauuguaaguuuauau

SEQ ID NO: 278128 - RNA, 22 nt, Homo sapiens
uugcaagauguucaugggcugu

SEQ ID NO: 278129 - RNA, 22 nt, Homo sapiens
uugcaaggugcagcuuaugcaa

SEQ ID NO: 278130 - RNA, 22 nt, Homo sapiens
uugcacagugcuuucuuugccc

SEQ ID NO: 278131 - RNA, 22 nt, Homo sapiens
uugcacauugcaccuuuuguau

SEQ ID NO: 278132 - RNA, 22 nt, Homo sapiens
uugcacuauuaguauagauguc

SEQ ID NO: 278133 - RNA, 22 nt, Homo sapiens
uugcacuccagcucuaggugac

SEQ ID NO: 278134 - RNA, 22 nt, Homo sapiens
uugcacuugcugaggagugauu

SEQ ID NO: 278135 - RNA, 22 nt, Homo sapiens
uugcagagccccugcaaggguc

SEQ ID NO: 278136 - RNA, 22 nt, Homo sapiens
uugcagcaaagagggaggggca

SEQ ID NO: 278137 - RNA, 22 nt, Homo sapiens
uugcagcaaauaggaaugagga

SEQ ID NO: 278138 - RNA, 23 nt, Homo sapiens
uugcauagacauccucauagauu

SEQ ID NO: 278139 - RNA, 22 nt, Homo sapiens
uugcauagaccgaugucuugga

SEQ ID NO: 278140 - RNA, 22 nt, Homo sapiens
uugcauauguugaaccaagcgu

SEQ ID NO: 278141 - RNA, 22 nt, Homo sapiens
uugcaugggagcugggugaagc

SEQ ID NO: 278142 - RNA, 22 nt, Homo sapiens
uugcaugguuuuuaucugaaau

SEQ ID NO: 278143 - RNA, 22 nt, Homo sapiens
uugcauuuucuaggagggcaaa

SEQ ID NO: 278144 - RNA, 22 nt, Homo sapiens
uugccacuucucuugccccauu

SEQ ID NO: 278145 - RNA, 21 nt, Homo sapiens
uugccugacacuggaagaaau

SEQ ID NO: 278146 - RNA, 22 nt, Homo sapiens
uugcgaugaagacaaaacaugc

SEQ ID NO: 278147 - RNA, 22 nt, Homo sapiens
uugcgcuuuuccuauguugccc

SEQ ID NO: 278148 - RNA, 22 nt, Homo sapiens
uugcuccucugccaggaccugu

SEQ ID NO: 278149 - RNA, 22 nt, Homo sapiens
uuggaaaccucugcagguguuu

SEQ ID NO: 278150 - RNA, 22 nt, Homo sapiens
uuggaaaguuguuguaguuauu

SEQ ID NO: 278151 - RNA, 20 nt, Homo sapiens
uuggaaaugugaauugggag

SEQ ID NO: 278152 - RNA, 22 nt, Homo sapiens
uuggaagacaaugcugauucuc

SEQ ID NO: 278153 - RNA, 22 nt, Homo sapiens
uuggaagacauucugucugcua

SEQ ID NO: 278154 - RNA, 22 nt, Homo sapiens
uuggaagauuacuuaguuuucu

SEQ ID NO: 278155 - RNA, 19 nt, Homo sapiens
uuggaauuuuagaguuuga

SEQ ID NO: 278156 - RNA, 22 nt, Homo sapiens
uuggacuucuaacugacaugga

SEQ ID NO: 278157 - RNA, 22 nt, Homo sapiens
uuggagagaaaggcaguuccug

SEQ ID NO: 278158 - RNA, 22 nt, Homo sapiens
uuggagcccuaacucucaguac

SEQ ID NO: 278159 - RNA, 22 nt, Homo sapiens
uuggagugugcucauaacugcu

SEQ ID NO: 278160 - RNA, 22 nt, Homo sapiens
uuggauaguuuaugaaaaaugg

SEQ ID NO: 278161 - RNA, 22 nt, Homo sapiens
uuggauggugauaugguuugga

SEQ ID NO: 278162 - RNA, 22 nt, Homo sapiens
uuggauuuugguggcaacucau

SEQ ID NO: 278163 - RNA, 22 nt, Homo sapiens
uuggcaaagaggaaugccacuu

SEQ ID NO: 278164 - RNA, 22 nt, Homo sapiens
uuggcaaagugucuggcauuua

SEQ ID NO: 278165 - RNA, 22 nt, Homo sapiens
uuggcaagaaccuucuuccaag

SEQ ID NO: 278166 - RNA, 22 nt, Homo sapiens
uuggcaagaauguaugccgauc

SEQ ID NO: 278167 - RNA, 22 nt, Homo sapiens
uuggcagugcccgaugcugggg

SEQ ID NO: 278168 - RNA, 22 nt, Homo sapiens
uuggcauugccaaacugucaac

SEQ ID NO: 278169 - RNA, 22 nt, Homo sapiens
gugauugucuaaucaagauaca

SEQ ID NO: 278170 - RNA, 21 nt, Homo sapiens
gugcaaacaucauagaaugua

SEQ ID NO: 278171 - RNA, 22 nt, Homo sapiens
gugcaaugucaggagaugcagc

SEQ ID NO: 278172 - RNA, 22 nt, Homo sapiens
gugcacaucgugcagguuuguu

SEQ ID NO: 278173 - RNA, 22 nt, Homo sapiens
gugcacaucuguguuccagcua

SEQ ID NO: 278174 - RNA, 22 nt, Homo sapiens
gugcaguuuugagugaguuucu

SEQ ID NO: 278175 - RNA, 19 nt, Homo sapiens
gugcauaguuauuaaagag

SEQ ID NO: 278176 - RNA, 22 nt, Homo sapiens
gugccacaguguuaagggauuc

SEQ ID NO: 278177 - RNA, 22 nt, Homo sapiens
gugccuucuagcuaugguuggc

SEQ ID NO: 278178 - RNA, 16 nt, Homo sapiens
gugcuguguuguuagg

SEQ ID NO: 278179 - RNA, 22 nt, Homo sapiens
guggaaaauuauugcuguuuuu

SEQ ID NO: 278180 - RNA, 22 nt, Homo sapiens
guggaaaucucugugugacuua

SEQ ID NO: 278181 - RNA, 22 nt, Homo sapiens
guggaagguaaugcagcuuacu

SEQ ID NO: 278182 - RNA, 22 nt, Homo sapiens
guggaaucuagagaggcaguag

SEQ ID NO: 278183 - RNA, 22 nt, Homo sapiens
guggaaugcaguguugauucaa

SEQ ID NO: 278184 - RNA, 22 nt, Homo sapiens
guggacggagguugcagugagc

SEQ ID NO: 278185 - RNA, 22 nt, Homo sapiens
guggagcuguguggccuugggc

SEQ ID NO: 278186 - RNA, 22 nt, Homo sapiens
guggcaagaugacuacucacug

SEQ ID NO: 278187 - RNA, 22 nt, Homo sapiens
guggcagaacagguaggguucu

SEQ ID NO: 278188 - RNA, 22 nt, Homo sapiens
guggcaguuuuaaauaugaaaa

SEQ ID NO: 278189 - RNA, 21 nt, Homo sapiens
guggccuuuggagcaugucag

SEQ ID NO: 278190 - RNA, 22 nt, Homo sapiens
guggcuagaaugaagguagcug

SEQ ID NO: 278191 - RNA, 22 nt, Homo sapiens
gugggagugucccguuuuucca

SEQ ID NO: 278192 - RNA, 22 nt, Homo sapiens
gugggcucguucguguuagaca

SEQ ID NO: 278193 - RNA, 22 nt, Homo sapiens
gugggguaggcaauuccuagug

SEQ ID NO: 278194 - RNA, 22 nt, Homo sapiens
guggucagaaaucucaguggca

SEQ ID NO: 278195 - RNA, 22 nt, Homo sapiens
gugguuuuacaaagagaaagau

SEQ ID NO: 278196 - RNA, 22 nt, Homo sapiens
gugguuuucaacuccaccugca

SEQ ID NO: 278197 - RNA, 22 nt, Homo sapiens
gugguuuuuagauuucuacagu

SEQ ID NO: 278198 - RNA, 20 nt, Homo sapiens
guguaagagcaagcuuccua

SEQ ID NO: 278199 - RNA, 21 nt, Homo sapiens
gugucacagacaugacagaug

SEQ ID NO: 278200 - RNA, 22 nt, Homo sapiens
guguucaaacccaggucugucu

SEQ ID NO: 278201 - RNA, 22 nt, Homo sapiens
guguucauggaauuugcaauug

SEQ ID NO: 278202 - RNA, 22 nt, Homo sapiens
guuaagaaguguaacuuaaguu

SEQ ID NO: 278203 - RNA, 22 nt, Homo sapiens
guuacugucuuccugauugcuu

SEQ ID NO: 278204 - RNA, 22 nt, Homo sapiens
guuauggaguauaugugaacug

SEQ ID NO: 278205 - RNA, 22 nt, Homo sapiens
guuauguguuuccuuaauugcu

SEQ ID NO: 278206 - RNA, 22 nt, Homo sapiens
guuauguuaaauuguuguaugc

SEQ ID NO: 278207 - RNA, 22 nt, Homo sapiens
guucaaggaauguuggcuucuc

SEQ ID NO: 278208 - RNA, 22 nt, Homo sapiens
guucaagugauucuacugccuc

SEQ ID NO: 278209 - RNA, 22 nt, Homo sapiens
guucaaguuuucucuugugggu

SEQ ID NO: 278210 - RNA, 20 nt, Homo sapiens
guucacagagguuaugauua

SEQ ID NO: 278211 - RNA, 22 nt, Homo sapiens
guucaucaggaauauuggccua

SEQ ID NO: 278212 - RNA, 22 nt, Homo sapiens
guucaucagggauacuggccug

SEQ ID NO: 278213 - RNA, 22 nt, Homo sapiens
guucaucagggauauuggccug

SEQ ID NO: 278214 - RNA, 22 nt, Homo sapiens
guugaaaucaucacuuggcaug

SEQ ID NO: 278215 - RNA, 22 nt, Homo sapiens
guugaaauccuaacccccuagu

SEQ ID NO: 278216 - RNA, 22 nt, Homo sapiens
guugaacaauagauucauauca

SEQ ID NO: 278217 - RNA, 19 nt, Homo sapiens
guugacacuggcucuucag

SEQ ID NO: 278218 - RNA, 22 nt, Homo sapiens
guugcaaaguaauugugguuuu

SEQ ID NO: 278219 - RNA, 22 nt, Homo sapiens
guugcacagucuuuccuggacu

SEQ ID NO: 278220 - RNA, 22 nt, Homo sapiens
guugccuaggcuggagugcagu

SEQ ID NO: 278221 - RNA, 22 nt, Homo sapiens
guugcucaggcuggagugcagu

SEQ ID NO: 278222 - RNA, 22 nt, Homo sapiens
guuguggcuugugauuaagcac

SEQ ID NO: 278223 - RNA, 22 nt, Homo sapiens
uaaaagucaucacaacuggagu

SEQ ID NO: 278224 - RNA, 22 nt, Homo sapiens
uaaacacucacuucauagccau

SEQ ID NO: 278225 - RNA, 22 nt, Homo sapiens
uaaagagcuuuugaggugucau

SEQ ID NO: 278226 - RNA, 22 nt, Homo sapiens
uaaagauaaggcucgcuuggau

SEQ ID NO: 278227 - RNA, 17 nt, Homo sapiens
uaaagccagucaaguca

SEQ ID NO: 278228 - RNA, 22 nt, Homo sapiens
uaaagccagugauuaugucucu

SEQ ID NO: 278229 - RNA, 22 nt, Homo sapiens
uaaagcuauuauaguuauguuu

SEQ ID NO: 278230 - RNA, 22 nt, Homo sapiens
uaaaugcuugagaugauggaua

SEQ ID NO: 278231 - RNA, 22 nt, Homo sapiens
uaacaccuuugauagcacuuuu

SEQ ID NO: 278232 - RNA, 18 nt, Homo sapiens
uaacagucucucaggauc

SEQ ID NO: 278233 - RNA, 22 nt, Homo sapiens
uaacaguggucugugguaucug

SEQ ID NO: 278234 - RNA, 22 nt, Homo sapiens
uaacauucacaugcugcaaaaa

SEQ ID NO: 278235 - RNA, 22 nt, Homo sapiens
uaacauuguugauuauacuaag

SEQ ID NO: 278236 - RNA, 22 nt, Homo sapiens
uaacugcaaccuccgccucccg

SEQ ID NO: 278237 - RNA, 22 nt, Homo sapiens
uaacuucaucauaagucaagaa

SEQ ID NO: 278238 - RNA, 22 nt, Homo sapiens
uaagacucuggacucuaauguu

SEQ ID NO: 278239 - RNA, 18 nt, Homo sapiens
uaagaugcagccuauucc

SEQ ID NO: 278240 - RNA, 22 nt, Homo sapiens
uucauguaaucaaggcagcuaa

SEQ ID NO: 278241 - RNA, 22 nt, Homo sapiens
uuccaauguuccguguugcagu

SEQ ID NO: 278242 - RNA, 22 nt, Homo sapiens
uuccacaauggcugaacuaguu

SEQ ID NO: 278243 - RNA, 22 nt, Homo sapiens
uuccaguaauagcacagcauug

SEQ ID NO: 278244 - RNA, 21 nt, Homo sapiens
uuccagugagccuagaugccu

SEQ ID NO: 278245 - RNA, 22 nt, Homo sapiens
uuccaguguguucauccucaga

SEQ ID NO: 278246 - RNA, 22 nt, Homo sapiens
uuccaugagaugcaucaaagcu

SEQ ID NO: 278247 - RNA, 22 nt, Homo sapiens
uuccauuuguucggugucgcca

SEQ ID NO: 278248 - RNA, 22 nt, Homo sapiens
uucccagagaaaaggguuucuu

SEQ ID NO: 278249 - RNA, 22 nt, Homo sapiens
uucccagugccaggcacuggga

SEQ ID NO: 278250 - RNA, 22 nt, Homo sapiens
uucccaguggaacauguaguca

SEQ ID NO: 278251 - RNA, 22 nt, Homo sapiens
uucccagugguuagcucugguc

SEQ ID NO: 278252 - RNA, 22 nt, Homo sapiens
uucccaguuggggaaagcgacc

SEQ ID NO: 278253 - RNA, 22 nt, Homo sapiens
uuccccgugaaacuuucucauu

SEQ ID NO: 278254 - RNA, 22 nt, Homo sapiens
uucccucagaaacacacagccc

SEQ ID NO: 278255 - RNA, 22 nt, Homo sapiens
uucccugaaauauucacuuuca

SEQ ID NO: 278256 - RNA, 22 nt, Homo sapiens
uucccugaaguguuacucuaga

SEQ ID NO: 278257 - RNA, 22 nt, Homo sapiens
uucccugugggaguaggaaagu

SEQ ID NO: 278258 - RNA, 22 nt, Homo sapiens
uucccugugggcuggugcucca

SEQ ID NO: 278259 - RNA, 22 nt, Homo sapiens
uuccuacugcccauuaaaaugg

SEQ ID NO: 278260 - RNA, 19 nt, Homo sapiens
uuccugagaacaagggcuu

SEQ ID NO: 278261 - RNA, 22 nt, Homo sapiens
uuccugagaucagaauucaaau

SEQ ID NO: 278262 - RNA, 22 nt, Homo sapiens
uuccugcacuugcuugccuaug

SEQ ID NO: 278263 - RNA, 22 nt, Homo sapiens
uuccuugguucagggaaggucc

SEQ ID NO: 278264 - RNA, 21 nt, Homo sapiens
uucuaaguaaauguuggacau

SEQ ID NO: 278265 - RNA, 20 nt, Homo sapiens
uucuacagucacaggaagau

SEQ ID NO: 278266 - RNA, 21 nt, Homo sapiens
uucuauggucagaauucaaua

SEQ ID NO: 278267 - RNA, 20 nt, Homo sapiens
uucuauggugaugaguccug

SEQ ID NO: 278268 - RNA, 22 nt, Homo sapiens
uucuaugguuaccaggcuaguc

SEQ ID NO: 278269 - RNA, 22 nt, Homo sapiens
uucucaguucgguggcagugcu

SEQ ID NO: 278270 - RNA, 22 nt, Homo sapiens
uucucugggacauaggucgggu

SEQ ID NO: 278271 - RNA, 22 nt, Homo sapiens
uucugagguuauauucucucaa

SEQ ID NO: 278272 - RNA, 22 nt, Homo sapiens
uucugcacaucgaucacaagau

SEQ ID NO: 278273 - RNA, 23 nt, Homo sapiens
uucugccacugaaaaugccucag

SEQ ID NO: 278274 - RNA, 22 nt, Homo sapiens
uucuggaaaucagcagagggug

SEQ ID NO: 278275 - RNA, 22 nt, Homo sapiens
uucuggccuccauuuuucuccu

SEQ ID NO: 278276 - RNA, 22 nt, Homo sapiens
uucuggcucgauucucugaccg

SEQ ID NO: 278277 - RNA, 22 nt, Homo sapiens
uucuggcuuauaaacgugacuu

SEQ ID NO: 278278 - RNA, 22 nt, Homo sapiens
uucugugguugaaaggagagau

SEQ ID NO: 278279 - RNA, 22 nt, Homo sapiens
uucugugguuucauuuaccugu

SEQ ID NO: 278280 - RNA, 22 nt, Homo sapiens
uucuguguuuaggucacggcua

SEQ ID NO: 278281 - RNA, 22 nt, Homo sapiens
uucuuagguuaaggcugagaga

SEQ ID NO: 278282 - RNA, 22 nt, Homo sapiens
uucuuagucauguaauagucca

SEQ ID NO: 278283 - RNA, 21 nt, Homo sapiens
uucuucaggcagaaggauuau

SEQ ID NO: 278284 - RNA, 22 nt, Homo sapiens
uucuugcuguauccucacaugg

SEQ ID NO: 278285 - RNA, 22 nt, Homo sapiens
uucuugguguaguaguugaaaa

SEQ ID NO: 278286 - RNA, 22 nt, Homo sapiens
uucuugguuuaucgcuuuaaaa

SEQ ID NO: 278287 - RNA, 18 nt, Homo sapiens
uucuuguguugauauuuu

SEQ ID NO: 278288 - RNA, 22 nt, Homo sapiens
uucuuugcaugaucucaaaguc

SEQ ID NO: 278289 - RNA, 19 nt, Homo sapiens
uucuuuguugugggggcug

SEQ ID NO: 278290 - RNA, 22 nt, Homo sapiens
uugaaagacaucaccuacugcu

SEQ ID NO: 278291 - RNA, 22 nt, Homo sapiens
uugaaagaugaacuggauugga

SEQ ID NO: 278292 - RNA, 22 nt, Homo sapiens
uugaaagucauggcacaggcaa

SEQ ID NO: 278293 - RNA, 22 nt, Homo sapiens
uugaaaucuuccacagcccaag

SEQ ID NO: 278294 - RNA, 22 nt, Homo sapiens
uugaacuagaaccugcaaauuu

SEQ ID NO: 278295 - RNA, 19 nt, Homo sapiens
uugaaggccgccuugcaga

SEQ ID NO: 278296 - RNA, 22 nt, Homo sapiens
uugaaguaggaaaggaggaggu

SEQ ID NO: 278297 - RNA, 22 nt, Homo sapiens
uugaaguauagaguuuaagaac

SEQ ID NO: 278298 - RNA, 22 nt, Homo sapiens
uugaauagaagguuuuuuguuc

SEQ ID NO: 278299 - RNA, 18 nt, Homo sapiens
uugaauagagccaagcac

SEQ ID NO: 278300 - RNA, 22 nt, Homo sapiens
uugaauaggcucaugcuuauca

SEQ ID NO: 278301 - RNA, 22 nt, Homo sapiens
uugaauaguggugaaaguuuga

SEQ ID NO: 278302 - RNA, 18 nt, Homo sapiens
uugaaugcgucccagaga

SEQ ID NO: 278303 - RNA, 22 nt, Homo sapiens
uugacagagaaaagugugacuu

SEQ ID NO: 278304 - RNA, 22 nt, Homo sapiens
uugacauauguguguccacaua

SEQ ID NO: 278305 - RNA, 22 nt, Homo sapiens
uugacauguaggcagggaaugg

SEQ ID NO: 278306 - RNA, 22 nt, Homo sapiens
uugacuuagacauucaguugga

SEQ ID NO: 278307 - RNA, 22 nt, Homo sapiens
uugacuuuuaggaggaaaauga

SEQ ID NO: 278308 - RNA, 22 nt, Homo sapiens
uugagagagaacauuuguuaca

SEQ ID NO: 278309 - RNA, 22 nt, Homo sapiens
uugagauggagccucacucugc

SEQ ID NO: 278310 - RNA, 22 nt, Homo sapiens
uugagauggagcuucacucuug

SEQ ID NO: 278311 - RNA, 22 nt, Homo sapiens
caggcagucuggggguguaucc

SEQ ID NO: 278312 - RNA, 22 nt, Homo sapiens
caggcagugggagacaaaacug

SEQ ID NO: 278313 - RNA, 22 nt, Homo sapiens
cagggaauguuauuuaauagca

SEQ ID NO: 278314 - RNA, 22 nt, Homo sapiens
cagguacuucugggcugagcag

SEQ ID NO: 278315 - RNA, 21 nt, Homo sapiens
cagguagugucugaagccaga

SEQ ID NO: 278316 - RNA, 19 nt, Homo sapiens
cagguagugugcugacaug

SEQ ID NO: 278317 - RNA, 22 nt, Homo sapiens
caguaaauaucugagcgagguc

SEQ ID NO: 278318 - RNA, 22 nt, Homo sapiens
cagugcaaagccucugcccaga

SEQ ID NO: 278319 - RNA, 22 nt, Homo sapiens
cagugcauccauguucagcagu

SEQ ID NO: 278320 - RNA, 22 nt, Homo sapiens
caguuacuuuugcaccaaccua

SEQ ID NO: 278321 - RNA, 22 nt, Homo sapiens
caguuguuuuaugacauaagau

SEQ ID NO: 278322 - RNA, 22 nt, Homo sapiens
cauaaaucuuguugaauagcac

SEQ ID NO: 278323 - RNA, 18 nt, Homo sapiens
cauagcacuucagcacau

SEQ ID NO: 278324 - RNA, 22 nt, Homo sapiens
caucaaaguggagggaaggacc

SEQ ID NO: 278325 - RNA, 21 nt, Homo sapiens
caucaaauugucauggugggu

SEQ ID NO: 278326 - RNA, 22 nt, Homo sapiens
caucacauucugagauacugag

SEQ ID NO: 278327 - RNA, 19 nt, Homo sapiens
caucccugagcugaagugg

SEQ ID NO: 278328 - RNA, 22 nt, Homo sapiens
caucccugucgucaagucucug

SEQ ID NO: 278329 - RNA, 22 nt, Homo sapiens
caugaaagacugaggaauugga

SEQ ID NO: 278330 - RNA, 23 nt, Homo sapiens
caugaacuaguuugcagccauga

SEQ ID NO: 278331 - RNA, 22 nt, Homo sapiens
uccuucacucuacaucuuuguu

SEQ ID NO: 278332 - RNA, 22 nt, Homo sapiens
uccuugaaacaggaagaauuca

SEQ ID NO: 278333 - RNA, 22 nt, Homo sapiens
uccuugagaggacagagccaua

SEQ ID NO: 278334 - RNA, 22 nt, Homo sapiens
uccuugagucuuugcucagaug

SEQ ID NO: 278335 - RNA, 22 nt, Homo sapiens
uccuuggucaaaaagaaagugu

SEQ ID NO: 278336 - RNA, 23 nt, Homo sapiens
uccuugguuggcgcccuaugugu

SEQ ID NO: 278337 - RNA, 20 nt, Homo sapiens
ucgcaccacuauacuccagc

SEQ ID NO: 278338 - RNA, 22 nt, Homo sapiens
ucgcagcucacuggagccucga

SEQ ID NO: 278339 - RNA, 22 nt, Homo sapiens
ucgugccacugcacuccagccu

SEQ ID NO: 278340 - RNA, 22 nt, Homo sapiens
ucuaaaguacuacuacuguugg

SEQ ID NO: 278341 - RNA, 22 nt, Homo sapiens
ucuaaggcaccuagagucauca

SEQ ID NO: 278342 - RNA, 17 nt, Homo sapiens
ucuaauaauaugcauuu

SEQ ID NO: 278343 - RNA, 18 nt, Homo sapiens
ucuagacacugugucuau

SEQ ID NO: 278344 - RNA, 22 nt, Homo sapiens
ucuagaugaaguauaaaguagu

SEQ ID NO: 278345 - RNA, 22 nt, Homo sapiens
ucuaucacagugauguuccaga

SEQ ID NO: 278346 - RNA, 22 nt, Homo sapiens
ucucaagaugguagaugggaau

SEQ ID NO: 278347 - RNA, 22 nt, Homo sapiens
ucucaaguggucgcaguuagau

SEQ ID NO: 278348 - RNA, 22 nt, Homo sapiens
ucucacagaguugaacuuucuu

SEQ ID NO: 278349 - RNA, 22 nt, Homo sapiens
ucucagcacagucagggcgccu

SEQ ID NO: 278350 - RNA, 22 nt, Homo sapiens
ucucaguggcuuccucacuuuu

SEQ ID NO: 278351 - RNA, 22 nt, Homo sapiens
ucucaguggugcuggcagggga

SEQ ID NO: 278352 - RNA, 19 nt, Homo sapiens
ucucaguguuggucaggug

SEQ ID NO: 278353 - RNA, 22 nt, Homo sapiens
ucucaguuuucuggggaagaaa

SEQ ID NO: 278354 - RNA, 20 nt, Homo sapiens
ucucauggagggaaagagca

SEQ ID NO: 278355 - RNA, 22 nt, Homo sapiens
ucuccauuguccagaugaggaa

SEQ ID NO: 278356 - RNA, 22 nt, Homo sapiens
ucucccauccaugaacuucugu

SEQ ID NO: 278357 - RNA, 22 nt, Homo sapiens
ucucccauccguacacggauug

SEQ ID NO: 278358 - RNA, 22 nt, Homo sapiens
ucucugaaacucuugacauccu

SEQ ID NO: 278359 - RNA, 22 nt, Homo sapiens
ucucugagaaaaguuucuccca

SEQ ID NO: 278360 - RNA, 22 nt, Homo sapiens
ucucugagaccacuccaaacuc

SEQ ID NO: 278361 - RNA, 22 nt, Homo sapiens
ucucugauuauugcauuucauu

SEQ ID NO: 278362 - RNA, 19 nt, Homo sapiens
ucucugguguuggagggga

SEQ ID NO: 278363 - RNA, 22 nt, Homo sapiens
ucucugguuaugucauuaagca

SEQ ID NO: 278364 - RNA, 22 nt, Homo sapiens
ucucugguuuucaaagcaguau

SEQ ID NO: 278365 - RNA, 22 nt, Homo sapiens
ucucuguuuagagccagcaauu

SEQ ID NO: 278366 - RNA, 22 nt, Homo sapiens
ucugacacuucugcagaauuga

SEQ ID NO: 278367 - RNA, 22 nt, Homo sapiens
ucugacucuggagucucagguu

SEQ ID NO: 278368 - RNA, 22 nt, Homo sapiens
ucuggagugugaaguggauaug

SEQ ID NO: 278369 - RNA, 23 nt, Homo sapiens
ucuggaucauucguagugccagc

SEQ ID NO: 278370 - RNA, 22 nt, Homo sapiens
ucuggccuacaucauuuuuccg

SEQ ID NO: 278371 - RNA, 22 nt, Homo sapiens
ucuggcuuauuucacuuagcau

SEQ ID NO: 278372 - RNA, 22 nt, Homo sapiens
ucuggcuucugacuuaggggac

SEQ ID NO: 278373 - RNA, 22 nt, Homo sapiens
ucuggcuugugaacugucuucu

SEQ ID NO: 278374 - RNA, 21 nt, Homo sapiens
ucuggcuuucauuccccuucu

SEQ ID NO: 278375 - RNA, 22 nt, Homo sapiens
ucugggguuuccacuuuuacuu

SEQ ID NO: 278376 - RNA, 22 nt, Homo sapiens
ucugguggugaugagagacagu

SEQ ID NO: 278377 - RNA, 22 nt, Homo sapiens
ucuggugugcucuggacuugca

SEQ ID NO: 278378 - RNA, 23 nt, Homo sapiens
ucugguguugucaaaugcugguu

SEQ ID NO: 278379 - RNA, 22 nt, Homo sapiens
ucugucacugaaucccugucac

SEQ ID NO: 278380 - RNA, 22 nt, Homo sapiens
ucugucacugguggacgaucac

SEQ ID NO: 278381 - RNA, 22 nt, Homo sapiens
ucugugaaaucauuuccuguaa

SEQ ID NO: 278382 - RNA, 22 nt, Homo sapiens
ucugugcauuguaggauguuua

SEQ ID NO: 278383 - RNA, 22 nt, Homo sapiens
ucugugcauuuucuuuuagacu

SEQ ID NO: 278384 - RNA, 22 nt, Homo sapiens
cuggaaagaaucaggcuaaacu

SEQ ID NO: 278385 - RNA, 22 nt, Homo sapiens
cuggaaaguagacaaucuaaaa

SEQ ID NO: 278386 - RNA, 22 nt, Homo sapiens
cuggaagcacaacgcauuuauu

SEQ ID NO: 278387 - RNA, 22 nt, Homo sapiens
cuggaaggaaaaacaaccacag

SEQ ID NO: 278388 - RNA, 22 nt, Homo sapiens
cuggagaucuugacauugaagu

SEQ ID NO: 278389 - RNA, 22 nt, Homo sapiens
cuggagauuaaccaauugccau

SEQ ID NO: 278390 - RNA, 22 nt, Homo sapiens
cuggagcaaaggugacucuugu

SEQ ID NO: 278391 - RNA, 22 nt, Homo sapiens
ugagcaaaauuuuggacauaga

SEQ ID NO: 278392 - RNA, 22 nt, Homo sapiens
ugagcaagaaauagaaacagau

SEQ ID NO: 278393 - RNA, 22 nt, Homo sapiens
ugagcagaaagcugcaaggucg

SEQ ID NO: 278394 - RNA, 22 nt, Homo sapiens
ugagcagugaguguggugcagg

SEQ ID NO: 278395 - RNA, 22 nt, Homo sapiens
ugagccauggcaccuugucuaa

SEQ ID NO: 278396 - RNA, 22 nt, Homo sapiens
ugagcuccuucauaaaaaggca

SEQ ID NO: 278397 - RNA, 18 nt, Homo sapiens
ugaggaaaggguuugcua

SEQ ID NO: 278398 - RNA, 22 nt, Homo sapiens
ugaggagugaacuauuucugau

SEQ ID NO: 278399 - RNA, 22 nt, Homo sapiens
ugaggaguguauuucauucgcu

SEQ ID NO: 278400 - RNA, 22 nt, Homo sapiens
ugaggcaagauacugauuucau

SEQ ID NO: 278401 - RNA, 22 nt, Homo sapiens
ugagggaugccugguuuguuuu

SEQ ID NO: 278402 - RNA, 22 nt, Homo sapiens
ugaggugagauggcuaccccaa

SEQ ID NO: 278403 - RNA, 22 nt, Homo sapiens
ugagguguuaacuuuacuuuua

SEQ ID NO: 278404 - RNA, 22 nt, Homo sapiens
ugagguguuugugcaccaucug

SEQ ID NO: 278405 - RNA, 22 nt, Homo sapiens
ugaguagaacuccuggagaugu

SEQ ID NO: 278406 - RNA, 22 nt, Homo sapiens
ugaguagcuaauguuuacugag

SEQ ID NO: 278407 - RNA, 22 nt, Homo sapiens
ugaguauagaucaguucaagug

SEQ ID NO: 278408 - RNA, 22 nt, Homo sapiens
ugaguauguaggaugugucuua

SEQ ID NO: 278409 - RNA, 22 nt, Homo sapiens
ugagucauguaauaaugcugcu

SEQ ID NO: 278410 - RNA, 22 nt, Homo sapiens
ugagucuguucucacauugcua

SEQ ID NO: 278411 - RNA, 22 nt, Homo sapiens
ugaguguccaccccuuucacag

SEQ ID NO: 278412 - RNA, 22 nt, Homo sapiens
ugaguuaggagaguguggcucu

SEQ ID NO: 278413 - RNA, 22 nt, Homo sapiens
ugaguucaauuguauuuuauua

SEQ ID NO: 278414 - RNA, 22 nt, Homo sapiens
ugaguucuuuuacauuuugaau

SEQ ID NO: 278415 - RNA, 22 nt, Homo sapiens
ugaguuuaucuaaagaccuggg

SEQ ID NO: 278416 - RNA, 22 nt, Homo sapiens
ugauaggagauuuucaucugua

SEQ ID NO: 278417 - RNA, 18 nt, Homo sapiens
ugauaucaucacaauuga

SEQ ID NO: 278418 - RNA, 20 nt, Homo sapiens
ugauaugguuuggcuguguu

SEQ ID NO: 278419 - RNA, 22 nt, Homo sapiens
ugauaugugaguauaugguuau

SEQ ID NO: 278420 - RNA, 22 nt, Homo sapiens
ugaucaaagugcuggaauuaca

SEQ ID NO: 278421 - RNA, 21 nt, Homo sapiens
ugaucacaugaaaaccaugca

SEQ ID NO: 278422 - RNA, 22 nt, Homo sapiens
ugaucucauuagcaccuuuagc

SEQ ID NO: 278423 - RNA, 22 nt, Homo sapiens
ugaugacacugauuucuucaau

SEQ ID NO: 278424 - RNA, 22 nt, Homo sapiens
ugaugacauugucacagucuga

SEQ ID NO: 278425 - RNA, 22 nt, Homo sapiens
ugaugcugaugccugccagaag

SEQ ID NO: 278426 - RNA, 22 nt, Homo sapiens
ugaugguaguucagucaaugua

SEQ ID NO: 278427 - RNA, 23 nt, Homo sapiens
ugauguccacuuagggucuaggu

SEQ ID NO: 278428 - RNA, 22 nt, Homo sapiens
ugaugugucaucugagagagug

SEQ ID NO: 278429 - RNA, 20 nt, Homo sapiens
ugauuaguccacuuggcucu

SEQ ID NO: 278430 - RNA, 22 nt, Homo sapiens
ugauucccucaagugccuuaug

SEQ ID NO: 278431 - RNA, 22 nt, Homo sapiens
ugauuguucuguccccaggggc

SEQ ID NO: 278432 - RNA, 22 nt, Homo sapiens
ugcaaacuuccuugggcagcau

SEQ ID NO: 278433 - RNA, 22 nt, Homo sapiens
ugcaaauguuauuuugguuucu

SEQ ID NO: 278434 - RNA, 22 nt, Homo sapiens
ugcaagcacacccagggauugu

SEQ ID NO: 278435 - RNA, 22 nt, Homo sapiens
ugcaaugucuucugaggggagc

SEQ ID NO: 278436 - RNA, 22 nt, Homo sapiens
ugcaccacuacacuccaggcug

SEQ ID NO: 278437 - RNA, 22 nt, Homo sapiens
ugcaccacugcacuccaggcug

SEQ ID NO: 278438 - RNA, 22 nt, Homo sapiens
ugcaccacugcacugccugggu

SEQ ID NO: 278439 - RNA, 18 nt, Homo sapiens
ugcagcaucaguacccag

SEQ ID NO: 278440 - RNA, 18 nt, Homo sapiens
ugcagcuuugugauuggc

SEQ ID NO: 278441 - RNA, 22 nt, Homo sapiens
ugcagguacuugacaacuuggg

SEQ ID NO: 278442 - RNA, 22 nt, Homo sapiens
ugcaguacauucagcauccucu

SEQ ID NO: 278443 - RNA, 22 nt, Homo sapiens
ugcagugcaugacuguguuaug

SEQ ID NO: 278444 - RNA, 22 nt, Homo sapiens
ugcagugucaauaauaauuagu

SEQ ID NO: 278445 - RNA, 22 nt, Homo sapiens
ugcagugugaaagagccugaca

SEQ ID NO: 278446 - RNA, 22 nt, Homo sapiens
ugcagugugauuuucuggcuga

SEQ ID NO: 278447 - RNA, 22 nt, Homo sapiens
ugcauacugggagguugggugu

SEQ ID NO: 278448 - RNA, 22 nt, Homo sapiens
ugcauauguauacaugugccau

SEQ ID NO: 278449 - RNA, 22 nt, Homo sapiens
ugcauauguugaaccaggcuug

SEQ ID NO: 278450 - RNA, 22 nt, Homo sapiens
ugcauauucuaggauuuuguau

SEQ ID NO: 278451 - RNA, 22 nt, Homo sapiens
ugcauggauguuugaacacacu

SEQ ID NO: 278452 - RNA, 22 nt, Homo sapiens
ugcauuaguaaguaauuuuaau

SEQ ID NO: 278453 - RNA, 22 nt, Homo sapiens
ugcauuguggaucuaaaugcau

SEQ ID NO: 278454 - RNA, 21 nt, Homo sapiens
ugcauuguugcugagagcagg

SEQ ID NO: 278455 - RNA, 20 nt, Homo sapiens
ugccaagaaaugaggguauu

SEQ ID NO: 278456 - RNA, 20 nt, Homo sapiens
ugccaagaugacuauagcuc

SEQ ID NO: 278457 - RNA, 22 nt, Homo sapiens
ggcacaguuaagugcuaccuaa

SEQ ID NO: 278458 - RNA, 22 nt, Homo sapiens
ggcacugugaugugagggggua

SEQ ID NO: 278459 - RNA, 19 nt, Homo sapiens
ggcacugugugagugagga

SEQ ID NO: 278460 - RNA, 22 nt, Homo sapiens
ggcagaucauuggccucaguuu

SEQ ID NO: 278461 - RNA, 22 nt, Homo sapiens
ggcagcaugggugccuuuguga

SEQ ID NO: 278462 - RNA, 17 nt, Homo sapiens
ggcaggauccaggaucc

SEQ ID NO: 278463 - RNA, 22 nt, Homo sapiens
ggcagguaaggagugggagccu

SEQ ID NO: 278464 - RNA, 22 nt, Homo sapiens
ggcaguuuguucuugcuccuuu

SEQ ID NO: 278465 - RNA, 22 nt, Homo sapiens
ggcccaguugcgggugguaccg

SEQ ID NO: 278466 - RNA, 22 nt, Homo sapiens
ggcuagaugcuagagauaucau

SEQ ID NO: 278467 - RNA, 22 nt, Homo sapiens
ggcucaguugcaaaucaguuca

SEQ ID NO: 278468 - RNA, 22 nt, Homo sapiens
ggcucaguuuccuccgucugcu

SEQ ID NO: 278469 - RNA, 22 nt, Homo sapiens
ggcucguguuuucuguccaguu

SEQ ID NO: 278470 - RNA, 22 nt, Homo sapiens
ggcuuggaggaaugugagggcu

SEQ ID NO: 278471 - RNA, 22 nt, Homo sapiens
ggcuuuggucacacaggggcaa

SEQ ID NO: 278472 - RNA, 22 nt, Homo sapiens
gggaagauauaggcugggcacc

SEQ ID NO: 278473 - RNA, 22 nt, Homo sapiens
gggaagugugcagaguucucuu

SEQ ID NO: 278474 - RNA, 22 nt, Homo sapiens
gggaaugaagagaaccuuccca

SEQ ID NO: 278475 - RNA, 22 nt, Homo sapiens
gggagguagguauuagcuuuuc

SEQ ID NO: 278476 - RNA, 22 nt, Homo sapiens
gggaggucauuguaaggucuua

SEQ ID NO: 278477 - RNA, 22 nt, Homo sapiens
gggaggucauuguucaaugcug

SEQ ID NO: 278478 - RNA, 22 nt, Homo sapiens
gggagugucuaaccuguuaaca

SEQ ID NO: 278479 - RNA, 22 nt, Homo sapiens
gggaguguguaggacccagugu

SEQ ID NO: 278480 - RNA, 22 nt, Homo sapiens
gggaugaaguugauguagaaag

SEQ ID NO: 278481 - RNA, 22 nt, Homo sapiens
gggaugaauuagguauguuuau

SEQ ID NO: 278482 - RNA, 19 nt, Homo sapiens
gggcaaaucuggaaauuua

SEQ ID NO: 278483 - RNA, 20 nt, Homo sapiens
gggcaaguaugugggaaguc

SEQ ID NO: 278484 - RNA, 22 nt, Homo sapiens
gggcauguggacuuguauguuu

SEQ ID NO: 278485 - RNA, 22 nt, Homo sapiens
gggguauguaagugagugagug

SEQ ID NO: 278486 - RNA, 22 nt, Homo sapiens
gggucaguuuugagaaagcgug

SEQ ID NO: 278487 - RNA, 22 nt, Homo sapiens
ggguucccugaugagaguuagu

SEQ ID NO: 278488 - RNA, 22 nt, Homo sapiens
gguaacaguggggcuaugcuua

SEQ ID NO: 278489 - RNA, 22 nt, Homo sapiens
gguauuuaaaguaccugucugc

SEQ ID NO: 278490 - RNA, 19 nt, Homo sapiens
ggucauggagguuguguga

SEQ ID NO: 278491 - RNA, 22 nt, Homo sapiens
ggucccccuccacucucgcaaa

SEQ ID NO: 278492 - RNA, 22 nt, Homo sapiens
ggugacagugguuaaaauuugu

SEQ ID NO: 278493 - RNA, 22 nt, Homo sapiens
ggugagaaagggauuccuguuc

SEQ ID NO: 278494 - RNA, 22 nt, Homo sapiens
ggugagauguucagacgaacug

SEQ ID NO: 278495 - RNA, 22 nt, Homo sapiens
ggugagcacagaaugcccugag

SEQ ID NO: 278496 - RNA, 23 nt, Homo sapiens
ggugaggaguacagagucuucau

SEQ ID NO: 278497 - RNA, 19 nt, Homo sapiens
ggugcuugaauauuccucc

SEQ ID NO: 278498 - RNA, 22 nt, Homo sapiens
ggugcuugaggaacggaggcug

SEQ ID NO: 278499 - RNA, 22 nt, Homo sapiens
gguggucuuccccuggaguucg

SEQ ID NO: 278500 - RNA, 22 nt, Homo sapiens
ggugucaguuggccccuacugg

SEQ ID NO: 278501 - RNA, 22 nt, Homo sapiens
gguuagaaacagguccucagga

SEQ ID NO: 278502 - RNA, 18 nt, Homo sapiens
guaaauguaucuauugcc

SEQ ID NO: 278503 - RNA, 22 nt, Homo sapiens
guaaauguccugcuacagagug

SEQ ID NO: 278504 - RNA, 22 nt, Homo sapiens
guaacacaugcugcucucuggu

SEQ ID NO: 278505 - RNA, 22 nt, Homo sapiens
guaagucucaugagaucugaug

SEQ ID NO: 278506 - RNA, 22 nt, Homo sapiens
guaaucucagcuacucaggagg

SEQ ID NO: 278507 - RNA, 22 nt, Homo sapiens
guaaucucagcuacucgggagg

SEQ ID NO: 278508 - RNA, 22 nt, Homo sapiens
guaaucucagcuacuugggagg

SEQ ID NO: 278509 - RNA, 22 nt, Homo sapiens
guaaucucagcuucuugggagg

SEQ ID NO: 278510 - RNA, 22 nt, Homo sapiens
guaaucuguaguaaagcaccau

SEQ ID NO: 278511 - RNA, 22 nt, Homo sapiens
guacaggugcaggaugggcagg

SEQ ID NO: 278512 - RNA, 22 nt, Homo sapiens
guacaguaguaaaagugaauga

SEQ ID NO: 278513 - RNA, 22 nt, Homo sapiens
guacaugcauacaugcacaucu

SEQ ID NO: 278514 - RNA, 22 nt, Homo sapiens
guagaucucaacacuggaagua

SEQ ID NO: 278515 - RNA, 22 nt, Homo sapiens
gucaaguaaauguuaugguuau

SEQ ID NO: 278516 - RNA, 22 nt, Homo sapiens
gucacagcuggcauugucugca

SEQ ID NO: 278517 - RNA, 22 nt, Homo sapiens
gucacauugaugcccauggugg

SEQ ID NO: 278518 - RNA, 22 nt, Homo sapiens
gucacuggcugucuuguaugau

SEQ ID NO: 278519 - RNA, 21 nt, Homo sapiens
gucacuggggcuggauaauuc

SEQ ID NO: 278520 - RNA, 22 nt, Homo sapiens
gucacuguggagaagaaagugg

SEQ ID NO: 278521 - RNA, 22 nt, Homo sapiens
gucagaaucucagaugacaacg

SEQ ID NO: 278522 - RNA, 22 nt, Homo sapiens
gucagagcacugaguugugggc

SEQ ID NO: 278523 - RNA, 22 nt, Homo sapiens
gucagaugcagauuccaguucu

SEQ ID NO: 278524 - RNA, 22 nt, Homo sapiens
gucagcaaagaggaauaguuug

SEQ ID NO: 278525 - RNA, 22 nt, Homo sapiens
gucaggcaccgauacaguuuuu

SEQ ID NO: 278526 - RNA, 22 nt, Homo sapiens
gucagguaccugaaagcagcca

SEQ ID NO: 278527 - RNA, 22 nt, Homo sapiens
gucagugcauguaaacauaaaa

SEQ ID NO: 278528 - RNA, 22 nt, Homo sapiens
gucagugccugucccaggcuuu

SEQ ID NO: 278529 - RNA, 22 nt, Homo sapiens
gucaguucuugugguugcauuc

SEQ ID NO: 278530 - RNA, 22 nt, Homo sapiens
gucaguuucacucagcuggaac

SEQ ID NO: 278531 - RNA, 22 nt, Homo sapiens
gucaucaucaguccucugugca

SEQ ID NO: 278532 - RNA, 22 nt, Homo sapiens
gucaugggguacuacacauggg

SEQ ID NO: 278533 - RNA, 22 nt, Homo sapiens
guccaagacuaggaguuggcag

SEQ ID NO: 278534 - RNA, 22 nt, Homo sapiens
guccauuuguuuccagagcacu

SEQ ID NO: 278535 - RNA, 22 nt, Homo sapiens
gucccugcgauugugggauccu

SEQ ID NO: 278536 - RNA, 22 nt, Homo sapiens
guccuugaggcuuugacugugg

SEQ ID NO: 278537 - RNA, 22 nt, Homo sapiens
gucguggagucucuggcuugua

SEQ ID NO: 278538 - RNA, 22 nt, Homo sapiens
gucuaugagucccugaauuuaa

SEQ ID NO: 278539 - RNA, 22 nt, Homo sapiens
gucucacagcuagcugcuuuau

SEQ ID NO: 278540 - RNA, 22 nt, Homo sapiens
gucucauugcaguuagaccugu

SEQ ID NO: 278541 - RNA, 22 nt, Homo sapiens
gucucccagccuacauauuucu

SEQ ID NO: 278542 - RNA, 22 nt, Homo sapiens
gucucuugguuuagagcauuua

SEQ ID NO: 278543 - RNA, 22 nt, Homo sapiens
gucugcaugucauaugauagua

SEQ ID NO: 278544 - RNA, 22 nt, Homo sapiens
gucuggcacagggaaaguacaa

SEQ ID NO: 278545 - RNA, 22 nt, Homo sapiens
gucuggcuccuucuacuacaug

SEQ ID NO: 278546 - RNA, 20 nt, Homo sapiens
gucugucuccgaguagaauu

SEQ ID NO: 278547 - RNA, 22 nt, Homo sapiens
gucuugcacuuaccuaagaacu

SEQ ID NO: 278548 - RNA, 22 nt, Homo sapiens
gucuuuugcuagccagagagcu

SEQ ID NO: 278549 - RNA, 17 nt, Homo sapiens
gugaaaucaucauuuuu

SEQ ID NO: 278550 - RNA, 22 nt, Homo sapiens
gugaacagaaccugggaucgaa

SEQ ID NO: 278551 - RNA, 22 nt, Homo sapiens
gugaagaucccuguccuguucc

SEQ ID NO: 278552 - RNA, 22 nt, Homo sapiens
gugaaucauaugccagucaugc

SEQ ID NO: 278553 - RNA, 22 nt, Homo sapiens
gugacacuggagcuggcacaau

SEQ ID NO: 278554 - RNA, 22 nt, Homo sapiens
gugacaucagcuccagguauaa

SEQ ID NO: 278555 - RNA, 22 nt, Homo sapiens
gugacugggaguggugaagaua

SEQ ID NO: 278556 - RNA, 22 nt, Homo sapiens
gugagagaaugacuauguguuu

SEQ ID NO: 278557 - RNA, 16 nt, Homo sapiens
gugagagaugacaaac

SEQ ID NO: 278558 - RNA, 22 nt, Homo sapiens
gugagaggaggcagcuuuuaca

SEQ ID NO: 278559 - RNA, 22 nt, Homo sapiens
gugagaugaggucucacucugu

SEQ ID NO: 278560 - RNA, 22 nt, Homo sapiens
gugagauuaccauuuaaaucag

SEQ ID NO: 278561 - RNA, 22 nt, Homo sapiens
gugagcaguguccuugggggca

SEQ ID NO: 278562 - RNA, 22 nt, Homo sapiens
gugagcauauuaguauugcacu

SEQ ID NO: 278563 - RNA, 22 nt, Homo sapiens
gugaggcugguccugccuccca

SEQ ID NO: 278564 - RNA, 22 nt, Homo sapiens
gugagggaugugaaaaagguca

SEQ ID NO: 278565 - RNA, 22 nt, Homo sapiens
gugauacugcuuauuaauuuaa

SEQ ID NO: 278566 - RNA, 22 nt, Homo sapiens
gugauaucugagccugccccag

SEQ ID NO: 278567 - RNA, 22 nt, Homo sapiens
gugauauguuaggaucuaaguc

SEQ ID NO: 278568 - RNA, 22 nt, Homo sapiens
gugauguguuuguucuaucucu

SEQ ID NO: 278569 - RNA, 22 nt, Homo sapiens
uuagacaguggugcacugcacu

SEQ ID NO: 278570 - RNA, 19 nt, Homo sapiens
uuagagaucaucugcuuca

SEQ ID NO: 278571 - RNA, 22 nt, Homo sapiens
uuagagcacugaucugcucuuu

SEQ ID NO: 278572 - RNA, 20 nt, Homo sapiens
uuagaguaguaugauuuaua

SEQ ID NO: 278573 - RNA, 22 nt, Homo sapiens
uuagauuauugagcauccacug

SEQ ID NO: 278574 - RNA, 22 nt, Homo sapiens
uuagcaauugauucucauaagc

SEQ ID NO: 278575 - RNA, 22 nt, Homo sapiens
uuagcagcucuaauaacugcua

SEQ ID NO: 278576 - RNA, 22 nt, Homo sapiens
uuaggcaguuuauugauuuuca

SEQ ID NO: 278577 - RNA, 22 nt, Homo sapiens
uuaggcuuuauugaaaacaaua

SEQ ID NO: 278578 - RNA, 19 nt, Homo sapiens
uuagguacuggauaugccc

SEQ ID NO: 278579 - RNA, 22 nt, Homo sapiens
uuagguacuuuggagagauuca

SEQ ID NO: 278580 - RNA, 22 nt, Homo sapiens
uuagugaaugggugugauuugu

SEQ ID NO: 278581 - RNA, 22 nt, Homo sapiens
uuagugcugaguggaauguucu

SEQ ID NO: 278582 - RNA, 22 nt, Homo sapiens
uuaguuuaucagugguuucuga

SEQ ID NO: 278583 - RNA, 19 nt, Homo sapiens
uuauacuguauuguuuagg

SEQ ID NO: 278584 - RNA, 22 nt, Homo sapiens
uuauagacacguuguaacaaac

SEQ ID NO: 278585 - RNA, 22 nt, Homo sapiens
uuauaggcaggugguguagaug

SEQ ID NO: 278586 - RNA, 22 nt, Homo sapiens
uuaucaaacccuaggagguggu

SEQ ID NO: 278587 - RNA, 22 nt, Homo sapiens
uuaucagcagcaugaaaauaga

SEQ ID NO: 278588 - RNA, 22 nt, Homo sapiens
uuauccagcgcuguuuuggaga

SEQ ID NO: 278589 - RNA, 22 nt, Homo sapiens
uuaugacauugacaguuuuuag

SEQ ID NO: 278590 - RNA, 22 nt, Homo sapiens
uuaugccagugauuauaagggc

SEQ ID NO: 278591 - RNA, 22 nt, Homo sapiens
uuaugcuguuuucuggagauuu

SEQ ID NO: 278592 - RNA, 22 nt, Homo sapiens
uuaugguuguuaucuugguucg

SEQ ID NO: 278593 - RNA, 22 nt, Homo sapiens
uuauguccuuuaacuucaucac

SEQ ID NO: 278594 - RNA, 22 nt, Homo sapiens
uuauguguuuaauguuucugaa

SEQ ID NO: 278595 - RNA, 22 nt, Homo sapiens
uuauuagagauauuugguuagg

SEQ ID NO: 278596 - RNA, 22 nt, Homo sapiens
uuauuagcacccuaccaugugg

SEQ ID NO: 278597 - RNA, 22 nt, Homo sapiens
uuauuagguuaaccuauagcua

SEQ ID NO: 278598 - RNA, 22 nt, Homo sapiens
uuauuagguugguggaaaagua

SEQ ID NO: 278599 - RNA, 22 nt, Homo sapiens
uuauuauguuggugcaaaggua

SEQ ID NO: 278600 - RNA, 22 nt, Homo sapiens
uuauucagcaccugcuguguuc

SEQ ID NO: 278601 - RNA, 22 nt, Homo sapiens
uuauugcuccagaggcugauuu

SEQ ID NO: 278602 - RNA, 22 nt, Homo sapiens
uucaaaguaaagggauggagac

SEQ ID NO: 278603 - RNA, 22 nt, Homo sapiens
uucaaaucuucguuuugccaua

SEQ ID NO: 278604 - RNA, 22 nt, Homo sapiens
uucaagucaacaagcacuugag

SEQ ID NO: 278605 - RNA, 22 nt, Homo sapiens
uucaagucaaggaaagaggucu

SEQ ID NO: 278606 - RNA, 22 nt, Homo sapiens
uucaagucaauuuuugaaugac

SEQ ID NO: 278607 - RNA, 22 nt, Homo sapiens
uucaauuaauauuauacucuca

SEQ ID NO: 278608 - RNA, 22 nt, Homo sapiens
uucacaguacucccuggaauua

SEQ ID NO: 278609 - RNA, 22 nt, Homo sapiens
uucacagucacccuucuccaug

SEQ ID NO: 278610 - RNA, 22 nt, Homo sapiens
uucacaguguguacaccagggg

SEQ ID NO: 278611 - RNA, 22 nt, Homo sapiens
uucaccaguuuugucacgaaug

SEQ ID NO: 278612 - RNA, 22 nt, Homo sapiens
uucacccugguuguagauggac

SEQ ID NO: 278613 - RNA, 22 nt, Homo sapiens
uucaccuggguuggccaucauu

SEQ ID NO: 278614 - RNA, 22 nt, Homo sapiens
uucacugcacuccagccugggu

SEQ ID NO: 278615 - RNA, 22 nt, Homo sapiens
uucacuggagcccaggaguugg

SEQ ID NO: 278616 - RNA, 22 nt, Homo sapiens
uucacuguagcuuggauguuua

SEQ ID NO: 278617 - RNA, 22 nt, Homo sapiens
uucagacugggugaagagggua

SEQ ID NO: 278618 - RNA, 22 nt, Homo sapiens
uucagagcauugguuuuuugaa

SEQ ID NO: 278619 - RNA, 22 nt, Homo sapiens
uucagagugaggcucucggaac

SEQ ID NO: 278620 - RNA, 22 nt, Homo sapiens
uucagaguggacagaaauuaag

SEQ ID NO: 278621 - RNA, 22 nt, Homo sapiens
uucagagugguaugaagugaug

SEQ ID NO: 278622 - RNA, 22 nt, Homo sapiens
uucaggcaccauggucauugau

SEQ ID NO: 278623 - RNA, 22 nt, Homo sapiens
uucaggcaccauugucauugau

SEQ ID NO: 278624 - RNA, 22 nt, Homo sapiens
uucaggcuccugugagaaucua

SEQ ID NO: 278625 - RNA, 22 nt, Homo sapiens
uucagggacuuuagacaagaga

SEQ ID NO: 278626 - RNA, 22 nt, Homo sapiens
uucagggagaaggcaaacguug

SEQ ID NO: 278627 - RNA, 22 nt, Homo sapiens
uucagguaauuaugguuugucu

SEQ ID NO: 278628 - RNA, 22 nt, Homo sapiens
uucaguaaauguucuuacuaua

SEQ ID NO: 278629 - RNA, 22 nt, Homo sapiens
uucaguccauuuccuuggucac

SEQ ID NO: 278630 - RNA, 18 nt, Homo sapiens
uucagugaauucuuuuga

SEQ ID NO: 278631 - RNA, 22 nt, Homo sapiens
uucagugccuggaagucgugcu

SEQ ID NO: 278632 - RNA, 22 nt, Homo sapiens
uucaguggagaggcugaguggu

SEQ ID NO: 278633 - RNA, 22 nt, Homo sapiens
uucauacaguggcugcacucca

SEQ ID NO: 278634 - RNA, 22 nt, Homo sapiens
uucauaguaacaguaacuaugg

SEQ ID NO: 278635 - RNA, 22 nt, Homo sapiens
uucauaguucuuuuagucauua

SEQ ID NO: 278636 - RNA, 22 nt, Homo sapiens
uucaucagcuguagaugucaug

SEQ ID NO: 278637 - RNA, 22 nt, Homo sapiens
uucaugcaucuguagugguuaa

SEQ ID NO: 278638 - RNA, 22 nt, Homo sapiens
uucauggaguugagaaggcuaa

SEQ ID NO: 278639 - RNA, 22 nt, Homo sapiens
cuggacguugaggcugcaguga

SEQ ID NO: 278640 - RNA, 22 nt, Homo sapiens
cuggagcauugguggauuuguu

SEQ ID NO: 278641 - RNA, 22 nt, Homo sapiens
cuggaggccugaacauaaaugg

SEQ ID NO: 278642 - RNA, 22 nt, Homo sapiens
cuggauagucaggagauauaua

SEQ ID NO: 278643 - RNA, 18 nt, Homo sapiens
cuggaugucgaguguguu

SEQ ID NO: 278644 - RNA, 22 nt, Homo sapiens
cuggcaaaaagagggcaauaau

SEQ ID NO: 278645 - RNA, 22 nt, Homo sapiens
cuggcacagugucagaaacaca

SEQ ID NO: 278646 - RNA, 22 nt, Homo sapiens
cuggcagucugccucuucacug

SEQ ID NO: 278647 - RNA, 22 nt, Homo sapiens
cuggcagugcuuguuauccugg

SEQ ID NO: 278648 - RNA, 22 nt, Homo sapiens
cuggccagagacauucauuaaa

SEQ ID NO: 278649 - RNA, 22 nt, Homo sapiens
cuggcccaguucugcguuuugc

SEQ ID NO: 278650 - RNA, 22 nt, Homo sapiens
cuggcucugagguguuuagggc

SEQ ID NO: 278651 - RNA, 22 nt, Homo sapiens
cugggaugugacuguugccccc

SEQ ID NO: 278652 - RNA, 22 nt, Homo sapiens
cuggugagaugucuuuccucuu

SEQ ID NO: 278653 - RNA, 21 nt, Homo sapiens
cugguguuagcacuucuuccc

SEQ ID NO: 278654 - RNA, 22 nt, Homo sapiens
cuguaacagaauaaauuuguuu

SEQ ID NO: 278655 - RNA, 22 nt, Homo sapiens
cuguaguuagcagaugaugaau

SEQ ID NO: 278656 - RNA, 22 nt, Homo sapiens
cugucuagagggcacaugaugc

SEQ ID NO: 278657 - RNA, 22 nt, Homo sapiens
cugucuggaggccugcaaauaa

SEQ ID NO: 278658 - RNA, 22 nt, Homo sapiens
cugucuggaguccuucgugugc

SEQ ID NO: 278659 - RNA, 22 nt, Homo sapiens
cugugaucuuuuuucauguggu

SEQ ID NO: 278660 - RNA, 22 nt, Homo sapiens
cugugcaugcgcggagcugaaa

SEQ ID NO: 278661 - RNA, 22 nt, Homo sapiens
cugugcauucuuaaaucaggaa

SEQ ID NO: 278662 - RNA, 23 nt, Homo sapiens
cuguggugaggcccuagaaucug

SEQ ID NO: 278663 - RNA, 22 nt, Homo sapiens
cugugguuacguucuuugugcu

SEQ ID NO: 278664 - RNA, 22 nt, Homo sapiens
cugugguuuaaggaauuuugac

SEQ ID NO: 278665 - RNA, 22 nt, Homo sapiens
cuguugguuaaauuccaugcag

SEQ ID NO: 278666 - RNA, 22 nt, Homo sapiens
cuuaaggccagauaauuucuau

SEQ ID NO: 278667 - RNA, 22 nt, Homo sapiens
cuuagguuaugauaaauuuagu

SEQ ID NO: 278668 - RNA, 20 nt, Homo sapiens
cuuaucaguggcaaguauaa

SEQ ID NO: 278669 - RNA, 22 nt, Homo sapiens
cuucaaaguuggcuaggagaca

SEQ ID NO: 278670 - RNA, 22 nt, Homo sapiens
cuucagcaauauauccccuggg

SEQ ID NO: 278671 - RNA, 22 nt, Homo sapiens
cuucaugucuucaauggggggg

SEQ ID NO: 278672 - RNA, 20 nt, Homo sapiens
cuuccaguggccccaucuuu

SEQ ID NO: 278673 - RNA, 22 nt, Homo sapiens
cuugcacucagaagauucaguu

SEQ ID NO: 278674 - RNA, 22 nt, Homo sapiens
cuugccuuugucuucaaaggcu

SEQ ID NO: 278675 - RNA, 22 nt, Homo sapiens
cuuggcuccgacuccccuccaa

SEQ ID NO: 278676 - RNA, 22 nt, Homo sapiens
cuugguuacauuuuccuagaaa

SEQ ID NO: 278677 - RNA, 22 nt, Homo sapiens
cuugucuugcacacgguugcca

SEQ ID NO: 278678 - RNA, 21 nt, Homo sapiens
cuugucuugcuuagaauagac

SEQ ID NO: 278679 - RNA, 22 nt, Homo sapiens
cuugugcaugaccccagguggg

SEQ ID NO: 278680 - RNA, 22 nt, Homo sapiens
cuuuaguuaaaauugggguugu

SEQ ID NO: 278681 - RNA, 22 nt, Homo sapiens
cuuugcaaaacauugagaccuc

SEQ ID NO: 278682 - RNA, 22 nt, Homo sapiens
cuuuggcaaugucauuuucaau

SEQ ID NO: 278683 - RNA, 22 nt, Homo sapiens
cuuuggcacuuccuaagugcca

SEQ ID NO: 278684 - RNA, 22 nt, Homo sapiens
cuuugggaccgcgguuuauacu

SEQ ID NO: 278685 - RNA, 22 nt, Homo sapiens
cuuuuacacugcuggugggaau

SEQ ID NO: 278686 - RNA, 22 nt, Homo sapiens
cuuuuggucuaucagagaagca

SEQ ID NO: 278687 - RNA, 20 nt, Homo sapiens
gaaacaucuauccucuccuu

SEQ ID NO: 278688 - RNA, 22 nt, Homo sapiens
gaaagugcugcuugacugggau

SEQ ID NO: 278689 - RNA, 18 nt, Homo sapiens
gaaaugccucuugcuuac

SEQ ID NO: 278690 - RNA, 22 nt, Homo sapiens
gaaaugcucagggguuuuccag

SEQ ID NO: 278691 - RNA, 22 nt, Homo sapiens
gaacuguuucuggugaaagagu

SEQ ID NO: 278692 - RNA, 18 nt, Homo sapiens
gaagaaguaggcauggca

SEQ ID NO: 278693 - RNA, 22 nt, Homo sapiens
gaagguacgcuuaggaaaugau

SEQ ID NO: 278694 - RNA, 17 nt, Homo sapiens
gaaguguuucuucauga

SEQ ID NO: 278695 - RNA, 22 nt, Homo sapiens
gaauaaacuagagaggacugag

SEQ ID NO: 278696 - RNA, 22 nt, Homo sapiens
gaauagugcugcaaugaacaua

SEQ ID NO: 278697 - RNA, 22 nt, Homo sapiens
gaaugcagcagugacagggcug

SEQ ID NO: 278698 - RNA, 22 nt, Homo sapiens
aaaugcuguuccaggaccuauc

SEQ ID NO: 278699 - RNA, 22 nt, Homo sapiens
aaaugcuucuauguggcauguu

SEQ ID NO: 278700 - RNA, 22 nt, Homo sapiens
aaaugucauggaguguuucccc

SEQ ID NO: 278701 - RNA, 22 nt, Homo sapiens
aacaccuugcgugggcgucaau

SEQ ID NO: 278702 - RNA, 22 nt, Homo sapiens
aacacuggcugcucgaguucuc

SEQ ID NO: 278703 - RNA, 22 nt, Homo sapiens
aacacuguuuccagucaugauc

SEQ ID NO: 278704 - RNA, 20 nt, Homo sapiens
aacagcacugucugaagcuu

SEQ ID NO: 278705 - RNA, 22 nt, Homo sapiens
aacaggguggugccugguccau

SEQ ID NO: 278706 - RNA, 22 nt, Homo sapiens
aacagugcauuccuguccauau

SEQ ID NO: 278707 - RNA, 18 nt, Homo sapiens
gacucaguuucuaaggca

SEQ ID NO: 278708 - RNA, 22 nt, Homo sapiens
gacuggagcuguaugugguuac

SEQ ID NO: 278709 - RNA, 22 nt, Homo sapiens
gagaacagaagcauuccuaauu

SEQ ID NO: 278710 - RNA, 22 nt, Homo sapiens
gagaacauacggcauuugguuu

SEQ ID NO: 278711 - RNA, 22 nt, Homo sapiens
gagaaccuccagcaagguagua

SEQ ID NO: 278712 - RNA, 22 nt, Homo sapiens
gagaacuaaugguuugauaagg

SEQ ID NO: 278713 - RNA, 20 nt, Homo sapiens
gagaacugagaugcguuuga

SEQ ID NO: 278714 - RNA, 22 nt, Homo sapiens
gagaacugagugugcuggcgga

SEQ ID NO: 278715 - RNA, 22 nt, Homo sapiens
gagaaguaaauuuauuugcaaa

SEQ ID NO: 278716 - RNA, 22 nt, Homo sapiens
gagaagugcgucguuugaugau

SEQ ID NO: 278717 - RNA, 22 nt, Homo sapiens
gagaaugaacagacugccucuu

SEQ ID NO: 278718 - RNA, 22 nt, Homo sapiens
gagaaugagauuaugguuacau

SEQ ID NO: 278719 - RNA, 22 nt, Homo sapiens
gagacauugacuuuguuccaga

SEQ ID NO: 278720 - RNA, 22 nt, Homo sapiens
gagacugagucuugcccuguca

SEQ ID NO: 278721 - RNA, 22 nt, Homo sapiens
gagagugugucagaggcugcga

SEQ ID NO: 278722 - RNA, 22 nt, Homo sapiens
gagauaaauaggucacaguucu

SEQ ID NO: 278723 - RNA, 22 nt, Homo sapiens
gagauaacuacuggauuaaguu

SEQ ID NO: 278724 - RNA, 22 nt, Homo sapiens
gagauaguguggguacagcuau

SEQ ID NO: 278725 - RNA, 22 nt, Homo sapiens
gagaucaucuaaucuggccucu

SEQ ID NO: 278726 - RNA, 22 nt, Homo sapiens
gagaucaugcugguucucucau

SEQ ID NO: 278727 - RNA, 23 nt, Homo sapiens
gagaucauucuggaauuagagug

SEQ ID NO: 278728 - RNA, 22 nt, Homo sapiens
gagaucauugugggccaagcug

SEQ ID NO: 278729 - RNA, 22 nt, Homo sapiens
gagauggugugcuguuggaagu

SEQ ID NO: 278730 - RNA, 22 nt, Homo sapiens
gagcacugaauacugugguggu

SEQ ID NO: 278731 - RNA, 22 nt, Homo sapiens
gagcacugauuuauuuuugucu

SEQ ID NO: 278732 - RNA, 22 nt, Homo sapiens
gagcuacauggauagucugcau

SEQ ID NO: 278733 - RNA, 22 nt, Homo sapiens
gagcucauuaaaaauguagaau

SEQ ID NO: 278734 - RNA, 22 nt, Homo sapiens
gagcuccuccccuuggcuuuca

SEQ ID NO: 278735 - RNA, 22 nt, Homo sapiens
gagcugaaguuuccauuuguac

SEQ ID NO: 278736 - RNA, 22 nt, Homo sapiens
gagcugccuugccuaugcaaga

SEQ ID NO: 278737 - RNA, 22 nt, Homo sapiens
gagcuuguggucuucguguuau

SEQ ID NO: 278738 - RNA, 22 nt, Homo sapiens
gaggaaguaauuuuaggccugu

SEQ ID NO: 278739 - RNA, 22 nt, Homo sapiens
gaggaaguuuacaaagcaucug

SEQ ID NO: 278740 - RNA, 22 nt, Homo sapiens
gaggagauauucugcuggaugg

SEQ ID NO: 278741 - RNA, 22 nt, Homo sapiens
gaggaucucuugagcccagaag

SEQ ID NO: 278742 - RNA, 22 nt, Homo sapiens
gaggcagucugucccuuagcag

SEQ ID NO: 278743 - RNA, 22 nt, Homo sapiens
gagguauggauaucuggagagg

SEQ ID NO: 278744 - RNA, 22 nt, Homo sapiens
gagguaugugggcagacauuua

SEQ ID NO: 278745 - RNA, 22 nt, Homo sapiens
gaggucaggacauuuuugcuuu

SEQ ID NO: 278746 - RNA, 22 nt, Homo sapiens
gaggugaaggucucaauaaaua

SEQ ID NO: 278747 - RNA, 22 nt, Homo sapiens
gagguggauacauuaaauaaug

SEQ ID NO: 278748 - RNA, 22 nt, Homo sapiens
gaguaaauguccuagcuucuug

SEQ ID NO: 278749 - RNA, 22 nt, Homo sapiens
gaguagaacugguuaucuaaua

SEQ ID NO: 278750 - RNA, 23 nt, Homo sapiens
gagugcaaugacaugaucucgga

SEQ ID NO: 278751 - RNA, 22 nt, Homo sapiens
gagugcaauggcaagaucuugg

SEQ ID NO: 278752 - RNA, 22 nt, Homo sapiens
gagugcaauggcaugaucuugg

SEQ ID NO: 278753 - RNA, 22 nt, Homo sapiens
gagugcaauggcgcgaucucgg

SEQ ID NO: 278754 - RNA, 22 nt, Homo sapiens
gagugcauaugggccuguguca

SEQ ID NO: 278755 - RNA, 21 nt, Homo sapiens
gaguggcuuuuguuucaccag

SEQ ID NO: 278756 - RNA, 22 nt, Homo sapiens
gaguggugguucugaaacuuuu

SEQ ID NO: 278757 - RNA, 22 nt, Homo sapiens
gaguuacauuguaauugccgag

SEQ ID NO: 278758 - RNA, 22 nt, Homo sapiens
gaguucaauuuccagcuguucu

SEQ ID NO: 278759 - RNA, 22 nt, Homo sapiens
gaguuguuuuaaggcacugacu

SEQ ID NO: 278760 - RNA, 22 nt, Homo sapiens
gaguuuguaaacuauucacuaa

SEQ ID NO: 278761 - RNA, 22 nt, Homo sapiens
gauaaaguauuggguacuaugc

SEQ ID NO: 278762 - RNA, 19 nt, Homo sapiens
gauagacaucacagugcca

SEQ ID NO: 278763 - RNA, 22 nt, Homo sapiens
gauaguugugagaacucuuacu

SEQ ID NO: 278764 - RNA, 22 nt, Homo sapiens
gauauguaaaaauuauaucuga

SEQ ID NO: 278765 - RNA, 22 nt, Homo sapiens
gauauuacuuccaauauugcaa

SEQ ID NO: 278766 - RNA, 22 nt, Homo sapiens
gaucaauuggcugaagacacgu

SEQ ID NO: 278767 - RNA, 17 nt, Homo sapiens
gaucacagucgucuccu

SEQ ID NO: 278768 - RNA, 22 nt, Homo sapiens
gaucacaugggagaaugagagu

SEQ ID NO: 278769 - RNA, 20 nt, Homo sapiens
gaucaguuuggaguaagugc

SEQ ID NO: 278770 - RNA, 22 nt, Homo sapiens
gaucucaguggauacugugaug

SEQ ID NO: 278771 - RNA, 22 nt, Homo sapiens
aauaaagcuuugagcuuugcug

SEQ ID NO: 278772 - RNA, 20 nt, Homo sapiens
aauaacagccccagggaggu

SEQ ID NO: 278773 - RNA, 22 nt, Homo sapiens
aauaagaaguggaagggaccgg

SEQ ID NO: 278774 - RNA, 22 nt, Homo sapiens
aauaagcauaguaccugauagg

SEQ ID NO: 278775 - RNA, 22 nt, Homo sapiens
ucacaguaacuuuguugcuuuu

SEQ ID NO: 278776 - RNA, 22 nt, Homo sapiens
ucacagucacugucacguugaa

SEQ ID NO: 278777 - RNA, 22 nt, Homo sapiens
ucacaguccuguuuaggagagg

SEQ ID NO: 278778 - RNA, 23 nt, Homo sapiens
ucacaguggcugcuuaauuguga

SEQ ID NO: 278779 - RNA, 22 nt, Homo sapiens
ucacauagcugaguaaaaugga

SEQ ID NO: 278780 - RNA, 22 nt, Homo sapiens
ucacauggggaagggacuagcu

SEQ ID NO: 278781 - RNA, 22 nt, Homo sapiens
ucaccaguacuccaaauugagg

SEQ ID NO: 278782 - RNA, 20 nt, Homo sapiens
ucacccugacaucugcccag

SEQ ID NO: 278783 - RNA, 22 nt, Homo sapiens
ucacccugacaugcggccgaac

SEQ ID NO: 278784 - RNA, 22 nt, Homo sapiens
ucaccgugaauuaacaacacuu

SEQ ID NO: 278785 - RNA, 22 nt, Homo sapiens
ucaccuguagcuaagaccuaau

SEQ ID NO: 278786 - RNA, 22 nt, Homo sapiens
ucaccuugcacaguuguguggg

SEQ ID NO: 278787 - RNA, 22 nt, Homo sapiens
ucacgugcucuuguguguucug

SEQ ID NO: 278788 - RNA, 22 nt, Homo sapiens
ucacuaaagaaaauggcaugga

SEQ ID NO: 278789 - RNA, 23 nt, Homo sapiens
ucacuagaguccuggaguuugag

SEQ ID NO: 278790 - RNA, 22 nt, Homo sapiens
ucacuagaucaagggagagaaa

SEQ ID NO: 278791 - RNA, 22 nt, Homo sapiens
ucacucagaccuggugauaugc

SEQ ID NO: 278792 - RNA, 22 nt, Homo sapiens
ucacugagaaugauguuucuga

SEQ ID NO: 278793 - RNA, 22 nt, Homo sapiens
ucacugcacuagguaaugccac

SEQ ID NO: 278794 - RNA, 22 nt, Homo sapiens
ucacuggacucuagccugggug

SEQ ID NO: 278795 - RNA, 20 nt, Homo sapiens
ucacuggagcucauuugauu

SEQ ID NO: 278796 - RNA, 22 nt, Homo sapiens
ucacuggaggagaggaagugga

SEQ ID NO: 278797 - RNA, 22 nt, Homo sapiens
ucacuggagguuccugaaguuc

SEQ ID NO: 278798 - RNA, 22 nt, Homo sapiens
ucacugugcaugaaggaugcug

SEQ ID NO: 278799 - RNA, 22 nt, Homo sapiens
ucacugugguuggaaggcuuaa

SEQ ID NO: 278800 - RNA, 22 nt, Homo sapiens
ucacuguguauguauaugcagg

SEQ ID NO: 278801 - RNA, 22 nt, Homo sapiens
ucacuuugacggccaacuucua

SEQ ID NO: 278802 - RNA, 22 nt, Homo sapiens
ucagagucuagaucacucacug

SEQ ID NO: 278803 - RNA, 22 nt, Homo sapiens
ucagagugcagggaguagcagc

SEQ ID NO: 278804 - RNA, 22 nt, Homo sapiens
ucagaguggagucugcagccuu

SEQ ID NO: 278805 - RNA, 22 nt, Homo sapiens
ucagaguguuuuccaacuuggu

SEQ ID NO: 278806 - RNA, 22 nt, Homo sapiens
ucagaucauuaagguagguuua

SEQ ID NO: 278807 - RNA, 19 nt, Homo sapiens
ucagaugcauuagggguua

SEQ ID NO: 278808 - RNA, 22 nt, Homo sapiens
ucagauguuuuguuuaucugcu

SEQ ID NO: 278809 - RNA, 22 nt, Homo sapiens
ucagcacauucaaggccugccu

SEQ ID NO: 278810 - RNA, 22 nt, Homo sapiens
ucagcgcauggucgugcggcau

SEQ ID NO: 278811 - RNA, 21 nt, Homo sapiens
ucagcucaucacugccuggag

SEQ ID NO: 278812 - RNA, 21 nt, Homo sapiens
ucaggaccucuaguuagccag

SEQ ID NO: 278813 - RNA, 22 nt, Homo sapiens
ucaggcaccuuccucuuaucug

SEQ ID NO: 278814 - RNA, 22 nt, Homo sapiens
ucaggcacucagcuuagagucu

SEQ ID NO: 278815 - RNA, 20 nt, Homo sapiens
ucaggcuccgcauuaacuua

SEQ ID NO: 278816 - RNA, 22 nt, Homo sapiens
ucagguaaucuauuugucuuuu

SEQ ID NO: 278817 - RNA, 22 nt, Homo sapiens
ucagguagcauuuuggaaacag

SEQ ID NO: 278818 - RNA, 23 nt, Homo sapiens
ucagguaguuucagaggaccuug

SEQ ID NO: 278819 - RNA, 22 nt, Homo sapiens
ucaggucauuccaggagggcca

SEQ ID NO: 278820 - RNA, 22 nt, Homo sapiens
ucaguaccugagagugggcaga

SEQ ID NO: 278821 - RNA, 23 nt, Homo sapiens
ucaguacuccacuuucaauagug

SEQ ID NO: 278822 - RNA, 22 nt, Homo sapiens
ucaguagcaugaaaacagacua

SEQ ID NO: 278823 - RNA, 22 nt, Homo sapiens
ucagugaauguuggccacuacu

SEQ ID NO: 278824 - RNA, 20 nt, Homo sapiens
ucagugauugguuuaguuau

SEQ ID NO: 278825 - RNA, 22 nt, Homo sapiens
ucagugcuguaccaucuaagga

SEQ ID NO: 278826 - RNA, 22 nt, Homo sapiens
ucaguguuuggaaucucaauuu

SEQ ID NO: 278827 - RNA, 22 nt, Homo sapiens
ucaguuuguauuucagguugca

SEQ ID NO: 278828 - RNA, 22 nt, Homo sapiens
ucauacaguaguccucacuugu

SEQ ID NO: 278829 - RNA, 22 nt, Homo sapiens
ucauacuguugugaaacaaaac

SEQ ID NO: 278830 - RNA, 22 nt, Homo sapiens
ucauaucauuagaucuacugua

SEQ ID NO: 278831 - RNA, 21 nt, Homo sapiens
ucauauguaucuuugugccuc

SEQ ID NO: 278832 - RNA, 22 nt, Homo sapiens
ucaucagaaucccuuagggaug

SEQ ID NO: 278833 - RNA, 22 nt, Homo sapiens
ucaucaggaaacuuaugcagug

SEQ ID NO: 278834 - RNA, 22 nt, Homo sapiens
ucaucagguaugucagcggagu

SEQ ID NO: 278835 - RNA, 22 nt, Homo sapiens
ucaugcaaugagucaggaggca

SEQ ID NO: 278836 - RNA, 22 nt, Homo sapiens
ucauguaauuuugugucuauga

SEQ ID NO: 278837 - RNA, 22 nt, Homo sapiens
ucauugcuuauuuguuggugga

SEQ ID NO: 278838 - RNA, 22 nt, Homo sapiens
ucauugguagcucauggaaccg

SEQ ID NO: 278839 - RNA, 18 nt, Homo sapiens
ucauuggugagcaccucc

SEQ ID NO: 278840 - RNA, 22 nt, Homo sapiens
ucauugguucuggguguuguug

SEQ ID NO: 278841 - RNA, 22 nt, Homo sapiens
uccaauguaaucaucauugaau

SEQ ID NO: 278842 - RNA, 22 nt, Homo sapiens
uccagcuuuuucuaauucugug

SEQ ID NO: 278843 - RNA, 22 nt, Homo sapiens
uccaguggacagacauaccaug

SEQ ID NO: 278844 - RNA, 22 nt, Homo sapiens
ggaguaggaaggaaauguuaaa

SEQ ID NO: 278845 - RNA, 22 nt, Homo sapiens
ggagugcuguuguuacacaagg

SEQ ID NO: 278846 - RNA, 22 nt, Homo sapiens
ggagugucagaaacaguguccu

SEQ ID NO: 278847 - RNA, 22 nt, Homo sapiens
ggagugucccaaucucagcuca

SEQ ID NO: 278848 - RNA, 22 nt, Homo sapiens
ggaguguguaggagaaagguaa

SEQ ID NO: 278849 - RNA, 22 nt, Homo sapiens
ggaguuuaagucuugugcaucu

SEQ ID NO: 278850 - RNA, 22 nt, Homo sapiens
ggauacaucuggacagccgaau

SEQ ID NO: 278851 - RNA, 22 nt, Homo sapiens
ggaucacagagcuugggaaagg

SEQ ID NO: 278852 - RNA, 22 nt, Homo sapiens
ggaucacagccagcucccagaa

SEQ ID NO: 278853 - RNA, 22 nt, Homo sapiens
ggaugcauuuuugguugucaca

SEQ ID NO: 278854 - RNA, 21 nt, Homo sapiens
ggauucaucccucaugaauuu

SEQ ID NO: 278855 - RNA, 22 nt, Homo sapiens
ggcaaaaucgcaauuacuuuug

SEQ ID NO: 278856 - RNA, 22 nt, Homo sapiens
ggcaaaugaagauggagaggcu

SEQ ID NO: 278857 - RNA, 22 nt, Homo sapiens
ggcaacaauuccuacuucuuuu

SEQ ID NO: 278858 - RNA, 22 nt, Homo sapiens
ggcaagaggagauucugcuccc

SEQ ID NO: 278859 - RNA, 20 nt, Homo sapiens
ggcaagguagcauuucuucu

SEQ ID NO: 278860 - RNA, 22 nt, Homo sapiens
ggcaaggugcuacagacaguga

SEQ ID NO: 278861 - RNA, 22 nt, Homo sapiens
ggcaaguauguuuuaggaugcu

SEQ ID NO: 278862 - RNA, 22 nt, Homo sapiens
ggcaagugucagcagcaacacc

SEQ ID NO: 278863 - RNA, 22 nt, Homo sapiens
ggcaauauuauuaacccucugu

SEQ ID NO: 278864 - RNA, 22 nt, Homo sapiens
ggcaaugaggcggaccagcagg

SEQ ID NO: 278865 - RNA, 22 nt, Homo sapiens
ggcaccacagacgccaggcgug

SEQ ID NO: 278866 - RNA, 22 nt, Homo sapiens
ggcagagucuugcaucuuuaga

SEQ ID NO: 278867 - RNA, 17 nt, Homo sapiens
ggcaggaauuaauguca

SEQ ID NO: 278868 - RNA, 22 nt, Homo sapiens
ggcaguguaauaauuuauuaau

SEQ ID NO: 278869 - RNA, 22 nt, Homo sapiens
ggcaugaaguagcccacaggca

SEQ ID NO: 278870 - RNA, 22 nt, Homo sapiens
ggcauugaguggguaggaguca

SEQ ID NO: 278871 - RNA, 22 nt, Homo sapiens
ggcauugugauccaccagccuu

SEQ ID NO: 278872 - RNA, 22 nt, Homo sapiens
ggccuguaggguauugguaggg

SEQ ID NO: 278873 - RNA, 22 nt, Homo sapiens
ggcuagagaauagugccacuaa

SEQ ID NO: 278874 - RNA, 22 nt, Homo sapiens
ggcucagugaucuguuucugua

SEQ ID NO: 278875 - RNA, 18 nt, Homo sapiens
ggcugguguuuuaguaua

SEQ ID NO: 278876 - RNA, 22 nt, Homo sapiens
ggcuguguguuaaaauaggcuu

SEQ ID NO: 278877 - RNA, 22 nt, Homo sapiens
gggaacauggaaauucugcucu

SEQ ID NO: 278878 - RNA, 22 nt, Homo sapiens
gggaagugugguuucuuuacag

SEQ ID NO: 278879 - RNA, 22 nt, Homo sapiens
gggagcacaagaaauguuucau

SEQ ID NO: 278880 - RNA, 22 nt, Homo sapiens
gggaugaagaagaauaguucgu

SEQ ID NO: 278881 - RNA, 22 nt, Homo sapiens
gggaugauuaugguucacuaca

SEQ ID NO: 278882 - RNA, 22 nt, Homo sapiens
gggauguuuuauacugagccug

SEQ ID NO: 278883 - RNA, 22 nt, Homo sapiens
gggcaaaacuguacugccaagg

SEQ ID NO: 278884 - RNA, 22 nt, Homo sapiens
gggcaacauugaguacccugaa

SEQ ID NO: 278885 - RNA, 22 nt, Homo sapiens
gggcaagaagucuuguaguuuu

SEQ ID NO: 278886 - RNA, 18 nt, Homo sapiens
gggcaaguugccuggcuu

SEQ ID NO: 278887 - RNA, 22 nt, Homo sapiens
gggcacgugugugcugugcuca

SEQ ID NO: 278888 - RNA, 22 nt, Homo sapiens
gggcagaugucuggacaccuca

SEQ ID NO: 278889 - RNA, 22 nt, Homo sapiens
gggccagaugcauuuguuauuu

SEQ ID NO: 278890 - RNA, 22 nt, Homo sapiens
gggguaggcuacacugaguucc

SEQ ID NO: 278891 - RNA, 19 nt, Homo sapiens
gggucaguuugaaugauua

SEQ ID NO: 278892 - RNA, 17 nt, Homo sapiens
gguacguuuuguucugu

SEQ ID NO: 278893 - RNA, 22 nt, Homo sapiens
gguaucuuggagagagaaguga

SEQ ID NO: 278894 - RNA, 22 nt, Homo sapiens
gguauguuuagaccauuuacau

SEQ ID NO: 278895 - RNA, 22 nt, Homo sapiens
ggucacauuggacuaucaaguu

SEQ ID NO: 278896 - RNA, 19 nt, Homo sapiens
ggucagcaaagucuagcug

SEQ ID NO: 278897 - RNA, 22 nt, Homo sapiens
ggucaguguuaucaccgaagga

SEQ ID NO: 278898 - RNA, 22 nt, Homo sapiens
ggucauguguccaggagguagc

SEQ ID NO: 278899 - RNA, 22 nt, Homo sapiens
ggucugguguugaaauucuuca

SEQ ID NO: 278900 - RNA, 22 nt, Homo sapiens
ggugacugguuuaucuggcagu

SEQ ID NO: 278901 - RNA, 22 nt, Homo sapiens
ggugaggaaaguugaguuucua

SEQ ID NO: 278902 - RNA, 22 nt, Homo sapiens
ggugaguggugcuuaaguucag

SEQ ID NO: 278903 - RNA, 22 nt, Homo sapiens
gguggcaaaucugaguggcgcu

SEQ ID NO: 278904 - RNA, 22 nt, Homo sapiens
gguggugguauuucagaaaaug

SEQ ID NO: 278905 - RNA, 22 nt, Homo sapiens
guaaaguaaagcacaucaaggu

SEQ ID NO: 278906 - RNA, 22 nt, Homo sapiens
guaauaacuguggaaaaagguu

SEQ ID NO: 278907 - RNA, 22 nt, Homo sapiens
guaaucucagcuacucgggaga

SEQ ID NO: 278908 - RNA, 22 nt, Homo sapiens
guaaucucagcuacuugggagc

SEQ ID NO: 278909 - RNA, 22 nt, Homo sapiens
guaaugaacuugaaagccuguu

SEQ ID NO: 278910 - RNA, 22 nt, Homo sapiens
acuagagaugcauuuguaguuu

SEQ ID NO: 278911 - RNA, 22 nt, Homo sapiens
acuagaugauuauguuccauug

SEQ ID NO: 278912 - RNA, 22 nt, Homo sapiens
acuauacuguaacuguauucag

SEQ ID NO: 278913 - RNA, 22 nt, Homo sapiens
acucagagugggccccuagaua

SEQ ID NO: 278914 - RNA, 22 nt, Homo sapiens
acuccauuucauuuuagcucuu

SEQ ID NO: 278915 - RNA, 22 nt, Homo sapiens
acucuguugucuggccuuccug

SEQ ID NO: 278916 - RNA, 22 nt, Homo sapiens
acugacaugaucaggcauguuc

SEQ ID NO: 278917 - RNA, 22 nt, Homo sapiens
uaguauguuuauagcauugagu

SEQ ID NO: 278918 - RNA, 22 nt, Homo sapiens
uaguccauuuucaugcugcuau

SEQ ID NO: 278919 - RNA, 22 nt, Homo sapiens
uagugcaguggcuccaucucag

SEQ ID NO: 278920 - RNA, 22 nt, Homo sapiens
uagugcauguugaguucccgac

SEQ ID NO: 278921 - RNA, 18 nt, Homo sapiens
uagugcuguucucaugau

SEQ ID NO: 278922 - RNA, 22 nt, Homo sapiens
uagugguaguagcaguaauauu

SEQ ID NO: 278923 - RNA, 22 nt, Homo sapiens
uaguuuaucuucuggauggaca

SEQ ID NO: 278924 - RNA, 22 nt, Homo sapiens
uauaacacccacauauagucuu

SEQ ID NO: 278925 - RNA, 22 nt, Homo sapiens
uauacacgugugcauauauaca

SEQ ID NO: 278926 - RNA, 22 nt, Homo sapiens
uauacaugugggcaucaggaga

SEQ ID NO: 278927 - RNA, 22 nt, Homo sapiens
uauacugucuuuguaugccuag

SEQ ID NO: 278928 - RNA, 22 nt, Homo sapiens
uauagcacugagaauguaauuc

SEQ ID NO: 278929 - RNA, 17 nt, Homo sapiens
uauagcacuucucacau

SEQ ID NO: 278930 - RNA, 22 nt, Homo sapiens
uauagcccuugguguggaaaug

SEQ ID NO: 278931 - RNA, 22 nt, Homo sapiens
uauagcuuaaaguuuagauccu

SEQ ID NO: 278932 - RNA, 21 nt, Homo sapiens
uauaguaguaugauuuacaau

SEQ ID NO: 278933 - RNA, 22 nt, Homo sapiens
uauaucuagagcggaccaggcu

SEQ ID NO: 278934 - RNA, 22 nt, Homo sapiens
uauaugcacucagguguaugug

SEQ ID NO: 278935 - RNA, 22 nt, Homo sapiens
uauaugcuaaacaagggguggg

SEQ ID NO: 278936 - RNA, 22 nt, Homo sapiens
uauaugucuuuguuauguugag

SEQ ID NO: 278937 - RNA, 19 nt, Homo sapiens
uaucaaguaugcacuguac

SEQ ID NO: 278938 - RNA, 22 nt, Homo sapiens
uaucacaaacuuagcaguuuaa

SEQ ID NO: 278939 - RNA, 22 nt, Homo sapiens
uaucacagaggguauccuagag

SEQ ID NO: 278940 - RNA, 22 nt, Homo sapiens
uaucacagcauugucuauaaua

SEQ ID NO: 278941 - RNA, 20 nt, Homo sapiens
uaucacaguucaggaacucu

SEQ ID NO: 278942 - RNA, 22 nt, Homo sapiens
uaucacaguugcauauuuaagg

SEQ ID NO: 278943 - RNA, 22 nt, Homo sapiens
uaucacugucaggcccucauau

SEQ ID NO: 278944 - RNA, 22 nt, Homo sapiens
uaucuacauguagguauguaug

SEQ ID NO: 278945 - RNA, 22 nt, Homo sapiens
uaucucaguguacaggaugaua

SEQ ID NO: 278946 - RNA, 22 nt, Homo sapiens
uaucuuggaguuugacaaccaa

SEQ ID NO: 278947 - RNA, 22 nt, Homo sapiens
uaugaaucuggcuacuccaggg

SEQ ID NO: 278948 - RNA, 22 nt, Homo sapiens
uaugacauaguccuuaacccuc

SEQ ID NO: 278949 - RNA, 22 nt, Homo sapiens
uaugacuuuugaauacagaugg

SEQ ID NO: 278950 - RNA, 22 nt, Homo sapiens
uaugagagcugguagguagaga

SEQ ID NO: 278951 - RNA, 22 nt, Homo sapiens
uaugcacacucucccaggaggg

SEQ ID NO: 278952 - RNA, 22 nt, Homo sapiens
uaugcacuaggcacuguguuug

SEQ ID NO: 278953 - RNA, 22 nt, Homo sapiens
uaugcacuauggaaguagcuca

SEQ ID NO: 278954 - RNA, 22 nt, Homo sapiens
uaugcuuauaaacauuugucag

SEQ ID NO: 278955 - RNA, 22 nt, Homo sapiens
uauggacuuuaggauagcuuuu

SEQ ID NO: 278956 - RNA, 22 nt, Homo sapiens
uggaaguuaaaugacucuuucu

SEQ ID NO: 278957 - RNA, 22 nt, Homo sapiens
uggaauaucaugagaguuuguu

SEQ ID NO: 278958 - RNA, 22 nt, Homo sapiens
uggaaucuuaggugaaggcuuu

SEQ ID NO: 278959 - RNA, 19 nt, Homo sapiens
uggaaugaaauguuagggg

SEQ ID NO: 278960 - RNA, 20 nt, Homo sapiens
uggaaugcagccuccuucug

SEQ ID NO: 278961 - RNA, 22 nt, Homo sapiens
uggaauguaacuugaaacuuuu

SEQ ID NO: 278962 - RNA, 22 nt, Homo sapiens
uggaauguagcguugacacgag

SEQ ID NO: 278963 - RNA, 22 nt, Homo sapiens
uggaauguuuaucaaaacagua

SEQ ID NO: 278964 - RNA, 22 nt, Homo sapiens
uggacaagauagguucuauauu

SEQ ID NO: 278965 - RNA, 22 nt, Homo sapiens
uggacagaaacauguuuucagu

SEQ ID NO: 278966 - RNA, 22 nt, Homo sapiens
uggacagagagaccggcauuuu

SEQ ID NO: 278967 - RNA, 21 nt, Homo sapiens
uggaccccuuccuuacaucau

SEQ ID NO: 278968 - RNA, 22 nt, Homo sapiens
uggagacugaucccucuuuccu

SEQ ID NO: 278969 - RNA, 22 nt, Homo sapiens
uggagcaaaguugaggccaagc

SEQ ID NO: 278970 - RNA, 22 nt, Homo sapiens
uggagcccuaaacuucuaauau

SEQ ID NO: 278971 - RNA, 23 nt, Homo sapiens
uggaggacaagcauggauaguga

SEQ ID NO: 278972 - RNA, 22 nt, Homo sapiens
uggagguagacauugggaagag

SEQ ID NO: 278973 - RNA, 19 nt, Homo sapiens
uggagucaucaugcugcua

SEQ ID NO: 278974 - RNA, 21 nt, Homo sapiens
uggagugcaacacuagguaua

SEQ ID NO: 278975 - RNA, 22 nt, Homo sapiens
uggagugcgugucugaguuuuu

SEQ ID NO: 278976 - RNA, 22 nt, Homo sapiens
uggaguguguugcagaugaagg

SEQ ID NO: 278977 - RNA, 22 nt, Homo sapiens
uggaguuugacaugccuuuggg

SEQ ID NO: 278978 - RNA, 22 nt, Homo sapiens
uggauagauacuauccaggacu

SEQ ID NO: 278979 - RNA, 22 nt, Homo sapiens
uggauaguaaagucagauuccc

SEQ ID NO: 278980 - RNA, 22 nt, Homo sapiens
uggauagugauaagguagauga

SEQ ID NO: 278981 - RNA, 22 nt, Homo sapiens
uggaugccuaauaaaugcagac

SEQ ID NO: 278982 - RNA, 22 nt, Homo sapiens
uggauguacagucaguauuugu

SEQ ID NO: 278983 - RNA, 22 nt, Homo sapiens
uggauugaaagcuuuaauauug

SEQ ID NO: 278984 - RNA, 22 nt, Homo sapiens
uggauuuuaauuauucugucau

SEQ ID NO: 278985 - RNA, 22 nt, Homo sapiens
uggcaaaauggaauauguuggg

SEQ ID NO: 278986 - RNA, 22 nt, Homo sapiens
uggcaaauguaguacccaauag

SEQ ID NO: 278987 - RNA, 22 nt, Homo sapiens
uggcaagaacaacaauuacuuu

SEQ ID NO: 278988 - RNA, 22 nt, Homo sapiens
uggcaauaaaaugcaguuacuu

SEQ ID NO: 278989 - RNA, 18 nt, Homo sapiens
uggcaauaugguucuacc

SEQ ID NO: 278990 - RNA, 19 nt, Homo sapiens
auggauacauuuucugcua

SEQ ID NO: 278991 - RNA, 22 nt, Homo sapiens
auggauauuuuuugaacauaga

SEQ ID NO: 278992 - RNA, 22 nt, Homo sapiens
auggauuuguaguacaugguug

SEQ ID NO: 278993 - RNA, 22 nt, Homo sapiens
auggauuuugaacuugagaguu

SEQ ID NO: 278994 - RNA, 22 nt, Homo sapiens
auggauuuuggggccagaggca

SEQ ID NO: 278995 - RNA, 22 nt, Homo sapiens
auggcaagaagagcaauuauuu

SEQ ID NO: 278996 - RNA, 22 nt, Homo sapiens
auggcaauaauagcuaccauuu

SEQ ID NO: 278997 - RNA, 22 nt, Homo sapiens
auggcacugauggaaguaccuu

SEQ ID NO: 278998 - RNA, 22 nt, Homo sapiens
auggcacugccuggcuucaugg

SEQ ID NO: 278999 - RNA, 22 nt, Homo sapiens
auggcagaaucaagccgacagc

SEQ ID NO: 279000 - RNA, 22 nt, Homo sapiens
auggcaguuuggucucugugcu

SEQ ID NO: 279001 - RNA, 22 nt, Homo sapiens
auggccauuacuaagaauguuu

SEQ ID NO: 279002 - RNA, 22 nt, Homo sapiens
auggcccaguuugcuaucccua

SEQ ID NO: 279003 - RNA, 20 nt, Homo sapiens
auggcccugcugggaguguc

SEQ ID NO: 279004 - RNA, 22 nt, Homo sapiens
auggcccugggaaaggaggcau

SEQ ID NO: 279005 - RNA, 23 nt, Homo sapiens
auggcccuggugggagugucuuu

SEQ ID NO: 279006 - RNA, 22 nt, Homo sapiens
auggcucuguuuuuuaugcucu

SEQ ID NO: 279007 - RNA, 22 nt, Homo sapiens
auggcucuuauuauuugaggua

SEQ ID NO: 279008 - RNA, 22 nt, Homo sapiens
auggcugugaaaugguaggugg

SEQ ID NO: 279009 - RNA, 22 nt, Homo sapiens
auggcuuuuauuguguugaggu

SEQ ID NO: 279010 - RNA, 22 nt, Homo sapiens
auggcuuuuccugucuugcaug

SEQ ID NO: 279011 - RNA, 22 nt, Homo sapiens
augggaaaaucagaaggccugg

SEQ ID NO: 279012 - RNA, 22 nt, Homo sapiens
augggcacugauguauucugug

SEQ ID NO: 279013 - RNA, 22 nt, Homo sapiens
augggcuaguaaagacaaacuu

SEQ ID NO: 279014 - RNA, 21 nt, Homo sapiens
augggguagaagagaaggcuu

SEQ ID NO: 279015 - RNA, 22 nt, Homo sapiens
augggguagguagcucggggaa

SEQ ID NO: 279016 - RNA, 22 nt, Homo sapiens
augggugaguaugaguugacuu

SEQ ID NO: 279017 - RNA, 18 nt, Homo sapiens
auggguguuggaaaauga

SEQ ID NO: 279018 - RNA, 22 nt, Homo sapiens
augguaagcugaaaauaucgaa

SEQ ID NO: 279019 - RNA, 22 nt, Homo sapiens
augguacuccagagaagcagaa

SEQ ID NO: 279020 - RNA, 22 nt, Homo sapiens
augguacuggguaaaagugggg

SEQ ID NO: 279021 - RNA, 22 nt, Homo sapiens
auggucuuuguuucuaauucug

SEQ ID NO: 279022 - RNA, 22 nt, Homo sapiens
auggucuuuucccuggauuaua

SEQ ID NO: 279023 - RNA, 21 nt, Homo sapiens
auggugagaaaguagugucaa

SEQ ID NO: 279024 - RNA, 22 nt, Homo sapiens
uauggcuuucuacuugaguucu

SEQ ID NO: 279025 - RNA, 22 nt, Homo sapiens
uaugguuuuaagguuaaggacu

SEQ ID NO: 279026 - RNA, 22 nt, Homo sapiens
uaugugcaaauuaauugcuaga

SEQ ID NO: 279027 - RNA, 22 nt, Homo sapiens
uauguuaucaaaaagcuaagga

SEQ ID NO: 279028 - RNA, 22 nt, Homo sapiens
uauuacagaccauaucgccggg

SEQ ID NO: 279029 - RNA, 22 nt, Homo sapiens
uauuacugucaauaucacagaa

SEQ ID NO: 279030 - RNA, 22 nt, Homo sapiens
uauuagguuggugcaaaaguua

SEQ ID NO: 279031 - RNA, 22 nt, Homo sapiens
uauuccauuugugaaaggaagu

SEQ ID NO: 279032 - RNA, 18 nt, Homo sapiens
uauuccucuuccucuauc

SEQ ID NO: 279033 - RNA, 22 nt, Homo sapiens
uauugauuaauugugauuaggc

SEQ ID NO: 279034 - RNA, 22 nt, Homo sapiens
uauugcagauacccaggaaguu

SEQ ID NO: 279035 - RNA, 22 nt, Homo sapiens
uauugcuaaauucuuuuccuag

SEQ ID NO: 279036 - RNA, 22 nt, Homo sapiens
uauugcuccccauaucgcagug

SEQ ID NO: 279037 - RNA, 22 nt, Homo sapiens
uauugcucugacugauuggaug

SEQ ID NO: 279038 - RNA, 22 nt, Homo sapiens
uauuggcucuguuucucugaag

SEQ ID NO: 279039 - RNA, 22 nt, Homo sapiens
uauuugauuaacaagagccuaa

SEQ ID NO: 279040 - RNA, 22 nt, Homo sapiens
uauuuggugaaugaaugcaugu

SEQ ID NO: 279041 - RNA, 22 nt, Homo sapiens
uauuugguuggugcaaaaguaa

SEQ ID NO: 279042 - RNA, 22 nt, Homo sapiens
ucaaacacuccauaucgcgauu

SEQ ID NO: 279043 - RNA, 22 nt, Homo sapiens
ucaaaguagaaaaggggcaauu

SEQ ID NO: 279044 - RNA, 22 nt, Homo sapiens
ucaaaguauucuucugagaacc

SEQ ID NO: 279045 - RNA, 22 nt, Homo sapiens
ucaaaucaucuuuuccaaagcu

SEQ ID NO: 279046 - RNA, 22 nt, Homo sapiens
ucaaaugcucuuugcagagagg

SEQ ID NO: 279047 - RNA, 21 nt, Homo sapiens
ucaaauugaaauuaggucauu

SEQ ID NO: 279048 - RNA, 22 nt, Homo sapiens
ucaagcaauucugcugccucag

SEQ ID NO: 279049 - RNA, 22 nt, Homo sapiens
ucaaugaaugaugguugguaug

SEQ ID NO: 279050 - RNA, 22 nt, Homo sapiens
ucacaaggcaggaaugaaaggg

SEQ ID NO: 279051 - RNA, 22 nt, Homo sapiens
ucacacugaauuugaagcaaug

SEQ ID NO: 279052 - RNA, 22 nt, Homo sapiens
ucacacugcaucuguuggaauu

SEQ ID NO: 279053 - RNA, 22 nt, Homo sapiens
ucacacuguuuugauuauuaua

SEQ ID NO: 279054 - RNA, 23 nt, Homo sapiens
ucacacuuaagagaaaugcagcu

SEQ ID NO: 279055 - RNA, 21 nt, Homo sapiens
ucacagccuaggaccugaaga

SEQ ID NO: 279056 - RNA, 22 nt, Homo sapiens
ucacaguagggaacugacaaag

SEQ ID NO: 279057 - RNA, 22 nt, Homo sapiens
ucacaguauucaugaacaugga

SEQ ID NO: 279058 - RNA, 22 nt, Homo sapiens
ucacagucuccucuagggaggg

SEQ ID NO: 279059 - RNA, 22 nt, Homo sapiens
ucacagucugcgugaugagaca

SEQ ID NO: 279060 - RNA, 22 nt, Homo sapiens
ucacagugcaggaucaguuaau

SEQ ID NO: 279061 - RNA, 22 nt, Homo sapiens
ucacaguugauugaaacacagc

SEQ ID NO: 279062 - RNA, 22 nt, Homo sapiens
ucacauaguuuucgggaccuug

SEQ ID NO: 279063 - RNA, 22 nt, Homo sapiens
auugauaguuuaauaggaauug

SEQ ID NO: 279064 - RNA, 22 nt, Homo sapiens
auugcaauuaguccauagaguu

SEQ ID NO: 279065 - RNA, 22 nt, Homo sapiens
auugcacaucugcacuacagcc

SEQ ID NO: 279066 - RNA, 22 nt, Homo sapiens
auugcacuccagccuggcagca

SEQ ID NO: 279067 - RNA, 22 nt, Homo sapiens
auugcacuccagccuggccgag

SEQ ID NO: 279068 - RNA, 22 nt, Homo sapiens
auugcacuccagccugggcaac

SEQ ID NO: 279069 - RNA, 22 nt, Homo sapiens
auugcacuccagccugggcagc

SEQ ID NO: 279070 - RNA, 22 nt, Homo sapiens
auugcacuccauccugggcaau

SEQ ID NO: 279071 - RNA, 22 nt, Homo sapiens
auugcauugugaucuucccaga

SEQ ID NO: 279072 - RNA, 22 nt, Homo sapiens
auugcauuuucagguuggucug

SEQ ID NO: 279073 - RNA, 22 nt, Homo sapiens
auugccuaacauagauguucag

SEQ ID NO: 279074 - RNA, 22 nt, Homo sapiens
auugccucaauuccaagacugc

SEQ ID NO: 279075 - RNA, 22 nt, Homo sapiens
auugcuauuauuugaccauugu

SEQ ID NO: 279076 - RNA, 22 nt, Homo sapiens
auugcugagacauugcuaaucu

SEQ ID NO: 279077 - RNA, 22 nt, Homo sapiens
auuggcaauccauauauuuucu

SEQ ID NO: 279078 - RNA, 22 nt, Homo sapiens
auuguaccccaauguacaauau

SEQ ID NO: 279079 - RNA, 22 nt, Homo sapiens
auuguacuccagccugggcagc

SEQ ID NO: 279080 - RNA, 22 nt, Homo sapiens
auuguaguuugcuauggcaaua

SEQ ID NO: 279081 - RNA, 22 nt, Homo sapiens
auugucauuuucugagaaguaa

SEQ ID NO: 279082 - RNA, 22 nt, Homo sapiens
auuugacacugagagccucagu

SEQ ID NO: 279083 - RNA, 22 nt, Homo sapiens
auuuggcagugaagggaucaca

SEQ ID NO: 279084 - RNA, 22 nt, Homo sapiens
auuuggguuuuacaucaggcua

SEQ ID NO: 279085 - RNA, 21 nt, Homo sapiens
auuugguggcugugugacacu

SEQ ID NO: 279086 - RNA, 22 nt, Homo sapiens
auuugguuauucaguuguucag

SEQ ID NO: 279087 - RNA, 22 nt, Homo sapiens
auuugucacuauguggcuaaua

SEQ ID NO: 279088 - RNA, 22 nt, Homo sapiens
auuuuuggauauagggaaggau

SEQ ID NO: 279089 - RNA, 22 nt, Homo sapiens
ucagguaugucuuuaacagcag

SEQ ID NO: 279090 - RNA, 22 nt, Homo sapiens
ucaggugcagagaagaaauggg

SEQ ID NO: 279091 - RNA, 22 nt, Homo sapiens
ucagguugcuaaguauaauauu

SEQ ID NO: 279092 - RNA, 23 nt, Homo sapiens
ucaguacucuauaagugccagcu

SEQ ID NO: 279093 - RNA, 22 nt, Homo sapiens
ucaguagcauugcuuauacagu

SEQ ID NO: 279094 - RNA, 18 nt, Homo sapiens
ucagucacugccuggcuu

SEQ ID NO: 279095 - RNA, 22 nt, Homo sapiens
ucagucuuuuaccauuaaguau

SEQ ID NO: 279096 - RNA, 22 nt, Homo sapiens
ucagugacugcugcuuguauac

SEQ ID NO: 279097 - RNA, 22 nt, Homo sapiens
ucagugauugguuauuuuaggc

SEQ ID NO: 279098 - RNA, 22 nt, Homo sapiens
ucagugcaggaauuuccuuaga

SEQ ID NO: 279099 - RNA, 22 nt, Homo sapiens
ucagugccauugccauaugagu

SEQ ID NO: 279100 - RNA, 21 nt, Homo sapiens
ucagugcugugggcaaggugc

SEQ ID NO: 279101 - RNA, 22 nt, Homo sapiens
ucagugcuguuugcccucguuu

SEQ ID NO: 279102 - RNA, 22 nt, Homo sapiens
ucagugcuuuuuguugucauca

SEQ ID NO: 279103 - RNA, 22 nt, Homo sapiens
ucaguggagagcuuccaggauu

SEQ ID NO: 279104 - RNA, 22 nt, Homo sapiens
ucaguggagccucacucugugg

SEQ ID NO: 279105 - RNA, 22 nt, Homo sapiens
ucagugguuaaaagauucuaga

SEQ ID NO: 279106 - RNA, 22 nt, Homo sapiens
ucagugucugcauucuuauugu

SEQ ID NO: 279107 - RNA, 22 nt, Homo sapiens
ucaguguugauggcugcugacu

SEQ ID NO: 279108 - RNA, 22 nt, Homo sapiens
ucaguuuagguguaacggccac

SEQ ID NO: 279109 - RNA, 22 nt, Homo sapiens
ucauaaaguuguuuuaauggga

SEQ ID NO: 279110 - RNA, 22 nt, Homo sapiens
ucauauguaugugcaauuuugu

SEQ ID NO: 279111 - RNA, 22 nt, Homo sapiens
ucauauugguuaaaauaguggg

SEQ ID NO: 279112 - RNA, 21 nt, Homo sapiens
ucaucaagcuguagacaugau

SEQ ID NO: 279113 - RNA, 16 nt, Homo sapiens
ucaucacagucucugg

SEQ ID NO: 279114 - RNA, 22 nt, Homo sapiens
ucaucagaguuuacaagcucag

SEQ ID NO: 279115 - RNA, 21 nt, Homo sapiens
ucaucagucaaagacaauggu

SEQ ID NO: 279116 - RNA, 20 nt, Homo sapiens
ucaucaguuggugcucgcug

SEQ ID NO: 279117 - RNA, 22 nt, Homo sapiens
ucauccauacaguuagcaaagg

SEQ ID NO: 279118 - RNA, 22 nt, Homo sapiens
ucaucucaguuucuugccguac

SEQ ID NO: 279119 - RNA, 22 nt, Homo sapiens
ucaucuggcgaaugugaagagu

SEQ ID NO: 279120 - RNA, 22 nt, Homo sapiens
ucaugacacuggcaggagcuaa

SEQ ID NO: 279121 - RNA, 22 nt, Homo sapiens
ucaugagacacacuggaaagga

SEQ ID NO: 279122 - RNA, 22 nt, Homo sapiens
ucaugcaucuuguggaauuuga

SEQ ID NO: 279123 - RNA, 22 nt, Homo sapiens
ucaugggagcccccaucaugag

SEQ ID NO: 279124 - RNA, 22 nt, Homo sapiens
ucaugguuuuauaacccucuug

SEQ ID NO: 279125 - RNA, 23 nt, Homo sapiens
ucauguauucccuguaaugggua

SEQ ID NO: 279126 - RNA, 22 nt, Homo sapiens
ucaugugagcacagagcaagau

SEQ ID NO: 279127 - RNA, 22 nt, Homo sapiens
ucauucauucauccagcuugag

SEQ ID NO: 279128 - RNA, 22 nt, Homo sapiens
ucauucauucuucaguggguac

SEQ ID NO: 279129 - RNA, 22 nt, Homo sapiens
ucauugguagcuugaaggggau

SEQ ID NO: 279130 - RNA, 22 nt, Homo sapiens
ucauuguccaacuucuuucagu

SEQ ID NO: 279131 - RNA, 22 nt, Homo sapiens
uccacaguaaggacccugccuu

SEQ ID NO: 279132 - RNA, 22 nt, Homo sapiens
uccacugagcuagaccacuugg

SEQ ID NO: 279133 - RNA, 22 nt, Homo sapiens
uccacuuuugugcugaauugga

SEQ ID NO: 279134 - RNA, 17 nt, Homo sapiens
uccagauuucaauugaa

SEQ ID NO: 279135 - RNA, 22 nt, Homo sapiens
uccagguacucagggggcugag

SEQ ID NO: 279136 - RNA, 22 nt, Homo sapiens
uuugggcuuuuaaucuagagca

SEQ ID NO: 279137 - RNA, 18 nt, Homo sapiens
uuugguccuuuauaaaca

SEQ ID NO: 279138 - RNA, 22 nt, Homo sapiens
uuuggucuuuuguaaguuaucu

SEQ ID NO: 279139 - RNA, 22 nt, Homo sapiens
uuugguguauauguaaacuaug

SEQ ID NO: 279140 - RNA, 22 nt, Homo sapiens
uuugguuuuuguuaucacucau

SEQ ID NO: 279141 - RNA, 22 nt, Homo sapiens
uuuguacacuguuggugguuau

SEQ ID NO: 279142 - RNA, 23 nt, Homo sapiens
uuuguacuaugucaguuuagaua

SEQ ID NO: 279143 - RNA, 23 nt, Homo sapiens
uuuguaguagcaugauuuauaau

SEQ ID NO: 279144 - RNA, 22 nt, Homo sapiens
uuugucccccguaguucauaua

SEQ ID NO: 279145 - RNA, 19 nt, Homo sapiens
uuuguccugcccuuucuca

SEQ ID NO: 279146 - RNA, 22 nt, Homo sapiens
uuugugaggugauggauauguc

SEQ ID NO: 279147 - RNA, 22 nt, Homo sapiens
uuugugucccucuaaaauuuau

SEQ ID NO: 279148 - RNA, 22 nt, Homo sapiens
uuuguuugaagucgagacaacu

SEQ ID NO: 279149 - RNA, 22 nt, Homo sapiens
uuuuacacuguugguuggaaug

SEQ ID NO: 279150 - RNA, 22 nt, Homo sapiens
uuuuacacuucgguugugugca

SEQ ID NO: 279151 - RNA, 22 nt, Homo sapiens
uuuuacagaggagguugcugau

SEQ ID NO: 279152 - RNA, 19 nt, Homo sapiens
uuuuccccuuucuuaagac

SEQ ID NO: 279153 - RNA, 20 nt, Homo sapiens
uuuugcacuccuacuaaggu

SEQ ID NO: 279154 - RNA, 22 nt, Homo sapiens
uuuugcuccuggcaaacucaua

SEQ ID NO: 279155 - RNA, 22 nt, Homo sapiens
uuuuggcucuugguaggucaga

SEQ ID NO: 279156 - RNA, 22 nt, Homo sapiens
uacauccauccugcugggcagu

SEQ ID NO: 279157 - RNA, 19 nt, Homo sapiens
uacaugcagcaggcacgca

SEQ ID NO: 279158 - RNA, 22 nt, Homo sapiens
uacaugugcacaacgugcaggu

SEQ ID NO: 279159 - RNA, 22 nt, Homo sapiens
uaccaaaguuucggccucuguu

SEQ ID NO: 279160 - RNA, 22 nt, Homo sapiens
uaccaaguauuuucacaugaac

SEQ ID NO: 279161 - RNA, 22 nt, Homo sapiens
uaccacaggcuggguaaucuau

SEQ ID NO: 279162 - RNA, 22 nt, Homo sapiens
uaccaguaaugguucuagagga

SEQ ID NO: 279163 - RNA, 22 nt, Homo sapiens
uaccauguaucugggaugcuuu

SEQ ID NO: 279164 - RNA, 22 nt, Homo sapiens
uacccaguaacaaguauuuugg

SEQ ID NO: 279165 - RNA, 22 nt, Homo sapiens
uacccucuggauacccuuguuc

SEQ ID NO: 279166 - RNA, 22 nt, Homo sapiens
uacccuuagcuuacauucuagg

SEQ ID NO: 279167 - RNA, 22 nt, Homo sapiens
uaccugagcccucugcugaguu

SEQ ID NO: 279168 - RNA, 22 nt, Homo sapiens
uacuagaaccuuauucagagug

SEQ ID NO: 279169 - RNA, 22 nt, Homo sapiens
uacucaauugcagucaccuggc

SEQ ID NO: 279170 - RNA, 22 nt, Homo sapiens
uacucaguagacacucauaugu

SEQ ID NO: 279171 - RNA, 22 nt, Homo sapiens
uacucugcagccauaaaacaga

SEQ ID NO: 279172 - RNA, 22 nt, Homo sapiens
uacugagagaggaauauugaaa

SEQ ID NO: 279173 - RNA, 19 nt, Homo sapiens
uacugcaccucaaccuggg

SEQ ID NO: 279174 - RNA, 22 nt, Homo sapiens
uacugcacuccagccugccaac

SEQ ID NO: 279175 - RNA, 22 nt, Homo sapiens
uacugcacuccagccugggaga

SEQ ID NO: 279176 - RNA, 22 nt, Homo sapiens
uacugcacuccagccuggguga

SEQ ID NO: 279177 - RNA, 22 nt, Homo sapiens
uacugcacuccagccuugccaa

SEQ ID NO: 279178 - RNA, 22 nt, Homo sapiens
uacugcacucuagccuggguga

SEQ ID NO: 279179 - RNA, 20 nt, Homo sapiens
uacugcacuuuccucauggu

SEQ ID NO: 279180 - RNA, 22 nt, Homo sapiens
uacugcuaccuccagcuucugg

SEQ ID NO: 279181 - RNA, 22 nt, Homo sapiens
uacugcugucagugccaaguag

SEQ ID NO: 279182 - RNA, 22 nt, Homo sapiens
uacuuuguagauuguuuccuuu

SEQ ID NO: 279183 - RNA, 22 nt, Homo sapiens
uagaauggaaggcauguuugcc

SEQ ID NO: 279184 - RNA, 22 nt, Homo sapiens
uagaccauucuauuuccuaugc

SEQ ID NO: 279185 - RNA, 22 nt, Homo sapiens
uagacugguuuagcacugaaua

SEQ ID NO: 279186 - RNA, 22 nt, Homo sapiens
uagagauaucaauuucauggug

SEQ ID NO: 279187 - RNA, 22 nt, Homo sapiens
uagagcacaagguagauuucua

SEQ ID NO: 279188 - RNA, 22 nt, Homo sapiens
uagagccauugcagauguuuga

SEQ ID NO: 279189 - RNA, 22 nt, Homo sapiens
uagagcuugacacuuuccaugg

SEQ ID NO: 279190 - RNA, 22 nt, Homo sapiens
uagagguaggucuucgagucuc

SEQ ID NO: 279191 - RNA, 22 nt, Homo sapiens
uagaucaacuuugguaagagaa

SEQ ID NO: 279192 - RNA, 23 nt, Homo sapiens
uagaucaucaaguuuacugugcu

SEQ ID NO: 279193 - RNA, 22 nt, Homo sapiens
uagaucuuuaaaaggugcuaga

SEQ ID NO: 279194 - RNA, 23 nt, Homo sapiens
uagcaacaguuggaggugaggua

SEQ ID NO: 279195 - RNA, 20 nt, Homo sapiens
uuggcauuuagacaagaguu

SEQ ID NO: 279196 - RNA, 22 nt, Homo sapiens
uuggccccuccaaaucucaugu

SEQ ID NO: 279197 - RNA, 19 nt, Homo sapiens
uuggcccugguucucuucu

SEQ ID NO: 279198 - RNA, 22 nt, Homo sapiens
uuggccuccuggucauauccag

SEQ ID NO: 279199 - RNA, 23 nt, Homo sapiens
uuggccuccuugugucuagggcu

SEQ ID NO: 279200 - RNA, 22 nt, Homo sapiens
uuggcuguguuucccuacaaau

SEQ ID NO: 279201 - RNA, 22 nt, Homo sapiens
uuggcuucuggacuauugugca

SEQ ID NO: 279202 - RNA, 22 nt, Homo sapiens
uugggacuggaaggaguaaggg

SEQ ID NO: 279203 - RNA, 22 nt, Homo sapiens
uugggauggaaauuuguacccc

SEQ ID NO: 279204 - RNA, 22 nt, Homo sapiens
uugggcaaguggcaugaccaug

SEQ ID NO: 279205 - RNA, 21 nt, Homo sapiens
uuggggaauggagagguuuuc

SEQ ID NO: 279206 - RNA, 22 nt, Homo sapiens
uuggggcacggccucuguugcc

SEQ ID NO: 279207 - RNA, 22 nt, Homo sapiens
uugggguaggaauauggaauga

SEQ ID NO: 279208 - RNA, 22 nt, Homo sapiens
uuggguccucugguccuugguu

SEQ ID NO: 279209 - RNA, 22 nt, Homo sapiens
uugguacuacacuucuaaucuu

SEQ ID NO: 279210 - RNA, 22 nt, Homo sapiens
uuggucagcucaauggagaggg

SEQ ID NO: 279211 - RNA, 22 nt, Homo sapiens
uuggucaggcuaaucucgaacg

SEQ ID NO: 279212 - RNA, 22 nt, Homo sapiens
uuggucaggcuagaguguggug

SEQ ID NO: 279213 - RNA, 19 nt, Homo sapiens
uuggucccuuuggguucuu

SEQ ID NO: 279214 - RNA, 23 nt, Homo sapiens
uuggucucccaaaguguugagau

SEQ ID NO: 279215 - RNA, 21 nt, Homo sapiens
uuggucuucucugugauucuu

SEQ ID NO: 279216 - RNA, 22 nt, Homo sapiens
uugguuaccuucagaaaugagu

SEQ ID NO: 279217 - RNA, 22 nt, Homo sapiens
uugguucaguuuaacgaguaau

SEQ ID NO: 279218 - RNA, 22 nt, Homo sapiens
uuguaaagucugucucagucag

SEQ ID NO: 279219 - RNA, 22 nt, Homo sapiens
uuguacccuuucuaugaggcca

SEQ ID NO: 279220 - RNA, 22 nt, Homo sapiens
uuguacuagucauauuuugaaa

SEQ ID NO: 279221 - RNA, 22 nt, Homo sapiens
uuguagcaaauauauuuuggaa

SEQ ID NO: 279222 - RNA, 22 nt, Homo sapiens
uuguaguguuuauucugucaac

SEQ ID NO: 279223 - RNA, 22 nt, Homo sapiens
uuguauguuucugugcacauga

SEQ ID NO: 279224 - RNA, 22 nt, Homo sapiens
uuguauugucuugaugaguuga

SEQ ID NO: 279225 - RNA, 22 nt, Homo sapiens
uugucacauggggcggcugccc

SEQ ID NO: 279226 - RNA, 22 nt, Homo sapiens
uugucacucuuccuaggguagg

SEQ ID NO: 279227 - RNA, 22 nt, Homo sapiens
uuguccaagucccauuuguuga

SEQ ID NO: 279228 - RNA, 22 nt, Homo sapiens
uuguccuggagguucuugcaag

SEQ ID NO: 279229 - RNA, 22 nt, Homo sapiens
uuggccagugucuuuuuuuccu

SEQ ID NO: 279230 - RNA, 22 nt, Homo sapiens
uuggccuuuucaaugccucuuu

SEQ ID NO: 279231 - RNA, 22 nt, Homo sapiens
uuggcuuuuaugcagcuuaggu

SEQ ID NO: 279232 - RNA, 22 nt, Homo sapiens
uuggucagcuagauuauucccu

SEQ ID NO: 279233 - RNA, 22 nt, Homo sapiens
uuggucaggagccucccucuuu

SEQ ID NO: 279234 - RNA, 21 nt, Homo sapiens
uugguccacaugucauaguua

SEQ ID NO: 279235 - RNA, 22 nt, Homo sapiens
uugguccauuacauugaugaca

SEQ ID NO: 279236 - RNA, 22 nt, Homo sapiens
uugguucucuuagccaucuuaa

SEQ ID NO: 279237 - RNA, 22 nt, Homo sapiens
uuguaaacaucuguacauugcu

SEQ ID NO: 279238 - RNA, 22 nt, Homo sapiens
uuguaaucaacacaucauuggg

SEQ ID NO: 279239 - RNA, 22 nt, Homo sapiens
uuguacuuuuaguagagacggg

SEQ ID NO: 279240 - RNA, 22 nt, Homo sapiens
uuguagcaaauguguaaacaaa

SEQ ID NO: 279241 - RNA, 22 nt, Homo sapiens
uuguaguagucucguucuuuua

SEQ ID NO: 279242 - RNA, 22 nt, Homo sapiens
uuguaugucuucauuugaaaaa

SEQ ID NO: 279243 - RNA, 22 nt, Homo sapiens
uugucauuuucagaguguuacg

SEQ ID NO: 279244 - RNA, 22 nt, Homo sapiens
uuguccuugagauaguuugcag

SEQ ID NO: 279245 - RNA, 22 nt, Homo sapiens
uugucucacuggaguuuaguaa

SEQ ID NO: 279246 - RNA, 20 nt, Homo sapiens
cauuccacuuuccugucagu

SEQ ID NO: 279247 - RNA, 22 nt, Homo sapiens
cauugcaauccagccugggcaa

SEQ ID NO: 279248 - RNA, 22 nt, Homo sapiens
cauugcacacauuuaccuaugu

SEQ ID NO: 279249 - RNA, 22 nt, Homo sapiens
cauugcacuccacuccugaaca

SEQ ID NO: 279250 - RNA, 22 nt, Homo sapiens
cauugcacuccagccugcugac

SEQ ID NO: 279251 - RNA, 20 nt, Homo sapiens
cauugcacuccagcuugggc

SEQ ID NO: 279252 - RNA, 22 nt, Homo sapiens
cauugcccuccagccugggcaa

SEQ ID NO: 279253 - RNA, 22 nt, Homo sapiens
cauugguuggacaguucucucu

SEQ ID NO: 279254 - RNA, 22 nt, Homo sapiens
cauugguuuauagauggggaaa

SEQ ID NO: 279255 - RNA, 22 nt, Homo sapiens
cauugguuuuucaggaguauau

SEQ ID NO: 279256 - RNA, 22 nt, Homo sapiens
cauuuugguuaaauagguagcu

SEQ ID NO: 279257 - RNA, 22 nt, Homo sapiens
ccaagccucaguuucccucugu

SEQ ID NO: 279258 - RNA, 22 nt, Homo sapiens
ccaaggcacugauucuguacuc

SEQ ID NO: 279259 - RNA, 22 nt, Homo sapiens
ccacaaccuccauauccugggu

SEQ ID NO: 279260 - RNA, 22 nt, Homo sapiens
ccacagucuaugcaacaagguc

SEQ ID NO: 279261 - RNA, 22 nt, Homo sapiens
ccacugcacuccagcccggcaa

SEQ ID NO: 279262 - RNA, 22 nt, Homo sapiens
ccacugggcuagguguuuugga

SEQ ID NO: 279263 - RNA, 22 nt, Homo sapiens
ccagaguugccucagguuucug

SEQ ID NO: 279264 - RNA, 22 nt, Homo sapiens
ccagcaccauuuauuaaauagg

SEQ ID NO: 279265 - RNA, 22 nt, Homo sapiens
ccagccgggugcaguggcucac

SEQ ID NO: 279266 - RNA, 22 nt, Homo sapiens
ccagguuucuagaauaauuccu

SEQ ID NO: 279267 - RNA, 22 nt, Homo sapiens
ccaguauugaacacaaugaaag

SEQ ID NO: 279268 - RNA, 18 nt, Homo sapiens
ccagugcaaggaaagccc

SEQ ID NO: 279269 - RNA, 22 nt, Homo sapiens
ccagugcugugcaguguaugag

SEQ ID NO: 279270 - RNA, 21 nt, Homo sapiens
ccagugguuggaaacuauggg

SEQ ID NO: 279271 - RNA, 22 nt, Homo sapiens
ccaguuuuucauuuauacuagu

SEQ ID NO: 279272 - RNA, 22 nt, Homo sapiens
ccaucacaggccucagugggaa

SEQ ID NO: 279273 - RNA, 22 nt, Homo sapiens
ccaucccuuucugagcaguucc

SEQ ID NO: 279274 - RNA, 22 nt, Homo sapiens
ccaugaacuagaauagaacaug

SEQ ID NO: 279275 - RNA, 22 nt, Homo sapiens
ccauggcuauucuguaaggguu

SEQ ID NO: 279276 - RNA, 22 nt, Homo sapiens
ccauuucacucuuccugaagga

SEQ ID NO: 279277 - RNA, 22 nt, Homo sapiens
cccacaguggccucauauccuu

SEQ ID NO: 279278 - RNA, 22 nt, Homo sapiens
cccagcguucggcauggcugag

SEQ ID NO: 279279 - RNA, 21 nt, Homo sapiens
cccagguucucugaggguaga

SEQ ID NO: 279280 - RNA, 22 nt, Homo sapiens
ccccaguguguaaaggccuugc

SEQ ID NO: 279281 - RNA, 22 nt, Homo sapiens
ccccggguucugucugcccuug

SEQ ID NO: 279282 - RNA, 22 nt, Homo sapiens
ccccuguaaacuggcuucccug

SEQ ID NO: 279283 - RNA, 22 nt, Homo sapiens
cccgggcugaaaucagauuugu

SEQ ID NO: 279284 - RNA, 22 nt, Homo sapiens
cccugaagaaagccuaggacau

SEQ ID NO: 279285 - RNA, 22 nt, Homo sapiens
cccugagagcagggucuuucuc

SEQ ID NO: 279286 - RNA, 22 nt, Homo sapiens
cccugagcagccugaguuuccc

SEQ ID NO: 279287 - RNA, 22 nt, Homo sapiens
cccuggacauucaucauuaugu

SEQ ID NO: 279288 - RNA, 22 nt, Homo sapiens
ccggcuguguggagaggccccu

SEQ ID NO: 279289 - RNA, 22 nt, Homo sapiens
ccuaggcacugggguccagccc

SEQ ID NO: 279290 - RNA, 21 nt, Homo sapiens
ccuccauuuguauucuugccc

SEQ ID NO: 279291 - RNA, 21 nt, Homo sapiens
ccugaagaagugaccucugag

SEQ ID NO: 279292 - RNA, 22 nt, Homo sapiens
ccugagguagaguuuauauuga

SEQ ID NO: 279293 - RNA, 22 nt, Homo sapiens
ccugcauugucaaggccaagcc

SEQ ID NO: 279294 - RNA, 22 nt, Homo sapiens
ccuggaucauugucauucccaa

SEQ ID NO: 279295 - RNA, 22 nt, Homo sapiens
ccuggcacugggccccguggcu

SEQ ID NO: 279296 - RNA, 22 nt, Homo sapiens
ccugguguuuugauggucgggu

SEQ ID NO: 279297 - RNA, 22 nt, Homo sapiens
ccuuggcaauggcuggggcuga

SEQ ID NO: 279298 - RNA, 19 nt, Homo sapiens
ccuuugguuuccaugacau

SEQ ID NO: 279299 - RNA, 22 nt, Homo sapiens
cgcaguguuugugucccugggu

SEQ ID NO: 279300 - RNA, 22 nt, Homo sapiens
cgccugagcugaggaagcugca

SEQ ID NO: 279301 - RNA, 22 nt, Homo sapiens
cuaaaacuuucugagugcagca

SEQ ID NO: 279302 - RNA, 22 nt, Homo sapiens
cuaaagauagugacaugauuug

SEQ ID NO: 279303 - RNA, 22 nt, Homo sapiens
cuaaaguagccaggacugcagg

SEQ ID NO: 279304 - RNA, 22 nt, Homo sapiens
cuaaagugcuuaaaaucucauu

SEQ ID NO: 279305 - RNA, 17 nt, Homo sapiens
cuaaggcaagagucugc

SEQ ID NO: 279306 - RNA, 22 nt, Homo sapiens
cuaaggcaguagccugaauaau

SEQ ID NO: 279307 - RNA, 22 nt, Homo sapiens
cuaagguacuguuaacauugua

SEQ ID NO: 279308 - RNA, 20 nt, Homo sapiens
cuaaucaucccagaagaaau

SEQ ID NO: 279309 - RNA, 22 nt, Homo sapiens
cuaauccugugguagcacucaa

SEQ ID NO: 279310 - RNA, 22 nt, Homo sapiens
cuaaugcagucaggagaaggaa

SEQ ID NO: 279311 - RNA, 22 nt, Homo sapiens
cuacagaguaucuaaagaggua

SEQ ID NO: 279312 - RNA, 22 nt, Homo sapiens
cuacagcagcccaguccccgaa

SEQ ID NO: 279313 - RNA, 22 nt, Homo sapiens
cuacaguucuuaauuaaguagu

SEQ ID NO: 279314 - RNA, 22 nt, Homo sapiens
cuacccuuaaguuucugugggg

SEQ ID NO: 279315 - RNA, 22 nt, Homo sapiens
cuaccuggguggcucaugacuu

SEQ ID NO: 279316 - RNA, 22 nt, Homo sapiens
cuacucuggagagugacaauca

SEQ ID NO: 279317 - RNA, 22 nt, Homo sapiens
cuagaggcacagccuaggcacu

SEQ ID NO: 279318 - RNA, 22 nt, Homo sapiens
cuagcaacauuucagugaguuu

SEQ ID NO: 279319 - RNA, 22 nt, Homo sapiens
cugggaucaguucuagucagaa

SEQ ID NO: 279320 - RNA, 22 nt, Homo sapiens
cugggucaguuucugauuauug

SEQ ID NO: 279321 - RNA, 22 nt, Homo sapiens
cugguaagaaggucuaagucaa

SEQ ID NO: 279322 - RNA, 22 nt, Homo sapiens
cuggucaagagcaaaggccagg

SEQ ID NO: 279323 - RNA, 22 nt, Homo sapiens
cuggucaugggggcacccucug

SEQ ID NO: 279324 - RNA, 23 nt, Homo sapiens
cuguacacauauacaucuaagua

SEQ ID NO: 279325 - RNA, 22 nt, Homo sapiens
cugucacaguuuuggaggccag

SEQ ID NO: 279326 - RNA, 22 nt, Homo sapiens
cuguccugcagagucagaauga

SEQ ID NO: 279327 - RNA, 22 nt, Homo sapiens
cugucucagugaauugguuuua

SEQ ID NO: 279328 - RNA, 22 nt, Homo sapiens
cugugaagaaagucauugguag

SEQ ID NO: 279329 - RNA, 22 nt, Homo sapiens
cugugcaaacaagugaaccccu

SEQ ID NO: 279330 - RNA, 22 nt, Homo sapiens
cugugcaaagcgcucucggggu

SEQ ID NO: 279331 - RNA, 22 nt, Homo sapiens
cugugcauguaugcgugaguuc

SEQ ID NO: 279332 - RNA, 22 nt, Homo sapiens
cugugcauguuguccaauucuu

SEQ ID NO: 279333 - RNA, 19 nt, Homo sapiens
cugugcauuucuguggaag

SEQ ID NO: 279334 - RNA, 22 nt, Homo sapiens
cugugccaagcuugcgaugugc

SEQ ID NO: 279335 - RNA, 22 nt, Homo sapiens
cuguucaaauuguuugugaagu

SEQ ID NO: 279336 - RNA, 22 nt, Homo sapiens
cuguugguguuuaaucacugca

SEQ ID NO: 279337 - RNA, 18 nt, Homo sapiens
cuuaacauugggaugaua

SEQ ID NO: 279338 - RNA, 22 nt, Homo sapiens
cuuaggguacuuuggugcauca

SEQ ID NO: 279339 - RNA, 17 nt, Homo sapiens
cuucaaauaauuucccc

SEQ ID NO: 279340 - RNA, 22 nt, Homo sapiens
cuucaucugguuugugaacuuu

SEQ ID NO: 279341 - RNA, 22 nt, Homo sapiens
cuucaugggagaaccacaggua

SEQ ID NO: 279342 - RNA, 18 nt, Homo sapiens
cuucauugcuguuuugcu

SEQ ID NO: 279343 - RNA, 22 nt, Homo sapiens
cuuccaguggcagccgggcaug

SEQ ID NO: 279344 - RNA, 22 nt, Homo sapiens
cuugacacugguuuucugaaua

SEQ ID NO: 279345 - RNA, 22 nt, Homo sapiens
cuugagacauuguuuuccaagu

SEQ ID NO: 279346 - RNA, 22 nt, Homo sapiens
cuugaucaaugugguacuugau

SEQ ID NO: 279347 - RNA, 22 nt, Homo sapiens
cuugcagagucauucuaauuuc

SEQ ID NO: 279348 - RNA, 22 nt, Homo sapiens
cuuggcauugccccuggaauuu

SEQ ID NO: 279349 - RNA, 22 nt, Homo sapiens
cuuggcuuguuguccccugcuc

SEQ ID NO: 279350 - RNA, 22 nt, Homo sapiens
cuuguguuacauauuuaagaga

SEQ ID NO: 279351 - RNA, 22 nt, Homo sapiens
cuuucacacuguuggugggaau

SEQ ID NO: 279352 - RNA, 22 nt, Homo sapiens
cuuuccauuguuggagcauaaa

SEQ ID NO: 279353 - RNA, 22 nt, Homo sapiens
cuuucucagugagacccgagau

SEQ ID NO: 279354 - RNA, 22 nt, Homo sapiens
cuuugauuauaaaaggguguuu

SEQ ID NO: 279355 - RNA, 22 nt, Homo sapiens
cuuuggguauucucccuugggg

SEQ ID NO: 279356 - RNA, 22 nt, Homo sapiens
cuuuggucaaaauaaguaaguu

SEQ ID NO: 279357 - RNA, 22 nt, Homo sapiens
cuuuggucaauugcugugggga

SEQ ID NO: 279358 - RNA, 18 nt, Homo sapiens
cuuugguccccgcacccu

SEQ ID NO: 279359 - RNA, 23 nt, Homo sapiens
cuuuggucucugguugacuucag

SEQ ID NO: 279360 - RNA, 22 nt, Homo sapiens
cuuuggugagggauaaauuuca

SEQ ID NO: 279361 - RNA, 22 nt, Homo sapiens
cuuugguuuacuuggugcuagu

SEQ ID NO: 279362 - RNA, 21 nt, Homo sapiens
cuuugguuucugacuugcaua

SEQ ID NO: 279363 - RNA, 22 nt, Homo sapiens
cuuuguguaggugccucuggcu

SEQ ID NO: 279364 - RNA, 22 nt, Homo sapiens
cuuugugugggccaagggcugg

SEQ ID NO: 279365 - RNA, 22 nt, Homo sapiens
cuuuuacacuguuggcaggauu

SEQ ID NO: 279366 - RNA, 22 nt, Homo sapiens
cuuuuggugguucugaugcagg

SEQ ID NO: 279367 - RNA, 22 nt, Homo sapiens
cuuuugugauuccucaguuacu

SEQ ID NO: 279368 - RNA, 22 nt, Homo sapiens
cuuuugugauucuucaguugcu

SEQ ID NO: 279369 - RNA, 22 nt, Homo sapiens
cuuuuguggaucuucuguugcu

SEQ ID NO: 279370 - RNA, 22 nt, Homo sapiens
cuuuuugguagagcaggugugc

SEQ ID NO: 279371 - RNA, 22 nt, Homo sapiens
gaaagacuuucugcuguggaua

SEQ ID NO: 279372 - RNA, 22 nt, Homo sapiens
gaaagugcugcaaggccaugca

SEQ ID NO: 279373 - RNA, 22 nt, Homo sapiens
gaaauggaucagagcaagcuuu

SEQ ID NO: 279374 - RNA, 23 nt, Homo sapiens
gaaauguaagugaugccccacag

SEQ ID NO: 279375 - RNA, 22 nt, Homo sapiens
gaaaugucugagauguggcuca

SEQ ID NO: 279376 - RNA, 22 nt, Homo sapiens
gaaauguugauagugggcauug

SEQ ID NO: 279377 - RNA, 22 nt, Homo sapiens
gaagaacuaggugagaucuaga

SEQ ID NO: 279378 - RNA, 22 nt, Homo sapiens
gaagaaguacaagacaaauuuu

SEQ ID NO: 279379 - RNA, 22 nt, Homo sapiens
gaaggcaugcugcauggccaga

SEQ ID NO: 279380 - RNA, 22 nt, Homo sapiens
gaaggugcuuggugaaugcauu

SEQ ID NO: 279381 - RNA, 22 nt, Homo sapiens
gaagugcaguggcacagucaug

SEQ ID NO: 279382 - RNA, 22 nt, Homo sapiens
gaaucacaguuauuagagcagc

SEQ ID NO: 279383 - RNA, 22 nt, Homo sapiens
gaaugaauguuuauccuuagau

SEQ ID NO: 279384 - RNA, 22 nt, Homo sapiens
gaaugauacuguuaacgaaaga

SEQ ID NO: 279385 - RNA, 20 nt, Homo sapiens
gacauagagacucucaaaaa

SEQ ID NO: 279386 - RNA, 22 nt, Homo sapiens
gacauguuuucaagauuuauaa

SEQ ID NO: 279387 - RNA, 22 nt, Homo sapiens
gacauguuuucauguauuugga

SEQ ID NO: 279388 - RNA, 22 nt, Homo sapiens
gaccaaagaggcaggcauuaga

SEQ ID NO: 279389 - RNA, 22 nt, Homo sapiens
gacccauagaagcgagcuugug

SEQ ID NO: 279390 - RNA, 22 nt, Homo sapiens
gaccccuagagauaggaggaac

SEQ ID NO: 279391 - RNA, 22 nt, Homo sapiens
gacccuguugggguuuagggcu

SEQ ID NO: 279392 - RNA, 17 nt, Homo sapiens
uuuuggauuagaaaucc

SEQ ID NO: 279393 - RNA, 22 nt, Homo sapiens
uuuuggcucugucuguaucuuu

SEQ ID NO: 279394 - RNA, 22 nt, Homo sapiens
uuuuggcuuaaagagaauguau

SEQ ID NO: 279395 - RNA, 22 nt, Homo sapiens
uuuuggucuccaguuucugcug

SEQ ID NO: 279396 - RNA, 22 nt, Homo sapiens
uuuuggugguuaugugucaaug

SEQ ID NO: 279397 - RNA, 22 nt, Homo sapiens
uuuugguguacaauucuaugga

SEQ ID NO: 279398 - RNA, 22 nt, Homo sapiens
uuuugguuguuggguaagagua

SEQ ID NO: 279399 - RNA, 22 nt, Homo sapiens
uuuugugcauggcccaguggua

SEQ ID NO: 279400 - RNA, 21 nt, Homo sapiens
uuuugugcaugugcagccugc

SEQ ID NO: 279401 - RNA, 22 nt, Homo sapiens
uuuuugagaauuggugaaacac

SEQ ID NO: 279402 - RNA, 22 nt, Homo sapiens
uuuuugaguaaauauaaauugu

SEQ ID NO: 279403 - RNA, 22 nt, Homo sapiens
uuuuugauuaauggguagacca

SEQ ID NO: 279404 - RNA, 22 nt, Homo sapiens
uuuuuggguaaugauuaucaau

SEQ ID NO: 279405 - RNA, 21 nt, Homo sapiens
uuuuugguggucauggauaga

SEQ ID NO: 279406 - RNA, 22 nt, Homo sapiens
uuuuugugguauauugcaacaa

SEQ ID NO: 279407 - RNA, 23 nt, Homo sapiens
uuuuuguguuucauggaaauagg

SEQ ID NO: 279408 - RNA, 22 nt, Homo sapiens
uaagugaauauggacaguuagc

SEQ ID NO: 279409 - RNA, 22 nt, Homo sapiens
uaagugaauguuggcuacugaa

SEQ ID NO: 279410 - RNA, 22 nt, Homo sapiens
uaagugcaacauaaguguuaaa

SEQ ID NO: 279411 - RNA, 18 nt, Homo sapiens
uaagugcuuuaaacacau

SEQ ID NO: 279412 - RNA, 22 nt, Homo sapiens
uaauaguuggcacuggagaaag

SEQ ID NO: 279413 - RNA, 22 nt, Homo sapiens
uaauauguuuugaaaucaggaa

SEQ ID NO: 279414 - RNA, 22 nt, Homo sapiens
uaauccuggcacuuugggaggc

SEQ ID NO: 279415 - RNA, 22 nt, Homo sapiens
uaauucuguauguaucagaguu

SEQ ID NO: 279416 - RNA, 22 nt, Homo sapiens
uacaagcaggaaaugguauaug

SEQ ID NO: 279417 - RNA, 22 nt, Homo sapiens
uacaagcuaaaauggaagauca

SEQ ID NO: 279418 - RNA, 21 nt, Homo sapiens
uacaagcuguagcacaugcca

SEQ ID NO: 279419 - RNA, 22 nt, Homo sapiens
uacaaguggguuugugcaggag

SEQ ID NO: 279420 - RNA, 22 nt, Homo sapiens
uacaauagugacaaaucagcau

SEQ ID NO: 279421 - RNA, 22 nt, Homo sapiens
uacagaauauuucugcccugag

SEQ ID NO: 279422 - RNA, 22 nt, Homo sapiens
uacagaauucugucccuugagu

SEQ ID NO: 279423 - RNA, 22 nt, Homo sapiens
uacagcacugugcauagugguu

SEQ ID NO: 279424 - RNA, 22 nt, Homo sapiens
uacaggacuucucagaguuauu

SEQ ID NO: 279425 - RNA, 22 nt, Homo sapiens
uacagguauagauguguguucu

SEQ ID NO: 279426 - RNA, 22 nt, Homo sapiens
ugucaguggucuggaugcagcc

SEQ ID NO: 279427 - RNA, 22 nt, Homo sapiens
ugucaguguacuguaagaauua

SEQ ID NO: 279428 - RNA, 22 nt, Homo sapiens
ugucaguuucaguguuagccuu

SEQ ID NO: 279429 - RNA, 22 nt, Homo sapiens
ugucauauagaauguucuauga

SEQ ID NO: 279430 - RNA, 23 nt, Homo sapiens
ugucaucaagaugaggucacacu

SEQ ID NO: 279431 - RNA, 22 nt, Homo sapiens
ugucaugaaauauguuuuucua

SEQ ID NO: 279432 - RNA, 22 nt, Homo sapiens
ugucaugagucuccuccaucuu

SEQ ID NO: 279433 - RNA, 22 nt, Homo sapiens
ugucauguaaagaguaaauggu

SEQ ID NO: 279434 - RNA, 22 nt, Homo sapiens
ugucauguauauaccacuucca

SEQ ID NO: 279435 - RNA, 22 nt, Homo sapiens
ugucauguugguguacugcacc

SEQ ID NO: 279436 - RNA, 19 nt, Homo sapiens
ugucccagccauagaggca

SEQ ID NO: 279437 - RNA, 19 nt, Homo sapiens
ucacaggguugacuugagg

SEQ ID NO: 279438 - RNA, 22 nt, Homo sapiens
ucacaguaaauccagaagaaau

SEQ ID NO: 279439 - RNA, 22 nt, Homo sapiens
ucacaguagagcuucuuucaga

SEQ ID NO: 279440 - RNA, 20 nt, Homo sapiens
ucacagucacacauaauccu

SEQ ID NO: 279441 - RNA, 22 nt, Homo sapiens
ucacagucggugacuucuugcu

SEQ ID NO: 279442 - RNA, 22 nt, Homo sapiens
ucacaguucagcauggcugagg

SEQ ID NO: 279443 - RNA, 21 nt, Homo sapiens
ucacaucguuuagcugugccu

SEQ ID NO: 279444 - RNA, 22 nt, Homo sapiens
ucacaugcacaucucuggaacc

SEQ ID NO: 279445 - RNA, 22 nt, Homo sapiens
ucacauggaaaaguccaguaaa

SEQ ID NO: 279446 - RNA, 22 nt, Homo sapiens
ucacauguguaugagcuuugau

SEQ ID NO: 279447 - RNA, 22 nt, Homo sapiens
ucacauuaagcuguuauuucuu

SEQ ID NO: 279448 - RNA, 22 nt, Homo sapiens
ucaccaccuuccaggaccacug

SEQ ID NO: 279449 - RNA, 22 nt, Homo sapiens
ucacccacacaggagacaggga

SEQ ID NO: 279450 - RNA, 22 nt, Homo sapiens
ucaccuggggcacagcugaaga

SEQ ID NO: 279451 - RNA, 21 nt, Homo sapiens
ucaccuguagcugcauguucu

SEQ ID NO: 279452 - RNA, 19 nt, Homo sapiens
ucaccuugcccugcacaca

SEQ ID NO: 279453 - RNA, 22 nt, Homo sapiens
ucacgcugcugcaaccagccug

SEQ ID NO: 279454 - RNA, 22 nt, Homo sapiens
ucacuagggagaaacugaggcu

SEQ ID NO: 279455 - RNA, 22 nt, Homo sapiens
ucacugaaaccacugccuccug

SEQ ID NO: 279456 - RNA, 22 nt, Homo sapiens
ucacugagcacaggagaugugc

SEQ ID NO: 279457 - RNA, 22 nt, Homo sapiens
ucacugcacuccagccuuuaug

SEQ ID NO: 279458 - RNA, 22 nt, Homo sapiens
ucacugcgaccuccgccucccg

SEQ ID NO: 279459 - RNA, 22 nt, Homo sapiens
ucacuggacagaaauaaaggug

SEQ ID NO: 279460 - RNA, 22 nt, Homo sapiens
ucacuggagauagcaaucuggu

SEQ ID NO: 279461 - RNA, 22 nt, Homo sapiens
ucacugggagcauuugagccuu

SEQ ID NO: 279462 - RNA, 20 nt, Homo sapiens
ucacugugaacuucuugagg

SEQ ID NO: 279463 - RNA, 22 nt, Homo sapiens
ucacugugcacauaugauaggu

SEQ ID NO: 279464 - RNA, 22 nt, Homo sapiens
ucacuguggaacucaaaaagcu

SEQ ID NO: 279465 - RNA, 22 nt, Homo sapiens
ucacugugguuugggaaagugc

SEQ ID NO: 279466 - RNA, 22 nt, Homo sapiens
ucuuugguugcacugcaggugu

SEQ ID NO: 279467 - RNA, 22 nt, Homo sapiens
ucuuuguguucaggagccacgu

SEQ ID NO: 279468 - RNA, 22 nt, Homo sapiens
ucuuuuggguauggagccauca

SEQ ID NO: 279469 - RNA, 22 nt, Homo sapiens
ugaaacacaccuccucuccauc

SEQ ID NO: 279470 - RNA, 18 nt, Homo sapiens
ugaaacacauuuuuuccu

SEQ ID NO: 279471 - RNA, 22 nt, Homo sapiens
ugaaaugcugucuaggggaaau

SEQ ID NO: 279472 - RNA, 22 nt, Homo sapiens
ugaaauggugcggucugcagca

SEQ ID NO: 279473 - RNA, 22 nt, Homo sapiens
ugaacucagcauccagggccaa

SEQ ID NO: 279474 - RNA, 22 nt, Homo sapiens
ugaacugagacuagacuuguuc

SEQ ID NO: 279475 - RNA, 22 nt, Homo sapiens
ugaagacauuuuugggugugua

SEQ ID NO: 279476 - RNA, 22 nt, Homo sapiens
ugaagaucauacugguggaggg

SEQ ID NO: 279477 - RNA, 22 nt, Homo sapiens
ugaagcuuguuucuguaccuuu

SEQ ID NO: 279478 - RNA, 19 nt, Homo sapiens
ugaaguauagggcuucuga

SEQ ID NO: 279479 - RNA, 22 nt, Homo sapiens
ugaagugaaugguaaguaugcc

SEQ ID NO: 279480 - RNA, 22 nt, Homo sapiens
ugaagugcugugggccaggcgu

SEQ ID NO: 279481 - RNA, 22 nt, Homo sapiens
ugaagugggaaaugaguauuaa

SEQ ID NO: 279482 - RNA, 22 nt, Homo sapiens
ugaauacuucaaaaaaauagcu

SEQ ID NO: 279483 - RNA, 22 nt, Homo sapiens
ugaauacuucguucaaagauaa

SEQ ID NO: 279484 - RNA, 22 nt, Homo sapiens
ugaauauguuucuaaaagugca

SEQ ID NO: 279485 - RNA, 22 nt, Homo sapiens
ugaauauuugcuacucacucuu

SEQ ID NO: 279486 - RNA, 21 nt, Homo sapiens
ugaauauuuggguugugucca

SEQ ID NO: 279487 - RNA, 22 nt, Homo sapiens
ugaaugauuuuaaaagccucuc

SEQ ID NO: 279488 - RNA, 22 nt, Homo sapiens
ugaaugcaucuagaaauuuauu

SEQ ID NO: 279489 - RNA, 22 nt, Homo sapiens
ugaaugcauggggccaagaagg

SEQ ID NO: 279490 - RNA, 22 nt, Homo sapiens
ugaaugguaaagaaaagcacug

SEQ ID NO: 279491 - RNA, 20 nt, Homo sapiens
ugaauguaauuacagaugua

SEQ ID NO: 279492 - RNA, 23 nt, Homo sapiens
ugaauguaucgaaugugggaaag

SEQ ID NO: 279493 - RNA, 21 nt, Homo sapiens
ugaaugucuaggcagaaguuu

SEQ ID NO: 279494 - RNA, 22 nt, Homo sapiens
ugaauguuguugguugagauau

SEQ ID NO: 279495 - RNA, 22 nt, Homo sapiens
ugacaagaaagcgucuucuuuu

SEQ ID NO: 279496 - RNA, 22 nt, Homo sapiens
ugacaagacuacauaucccauu

SEQ ID NO: 279497 - RNA, 22 nt, Homo sapiens
ugacaagaguagagagggugcc

SEQ ID NO: 279498 - RNA, 17 nt, Homo sapiens
ugacagaaacuuguugu

SEQ ID NO: 279499 - RNA, 22 nt, Homo sapiens
ugacagcaucaggauuggagag

SEQ ID NO: 279500 - RNA, 22 nt, Homo sapiens
ugacagcugaggcccagaguac

SEQ ID NO: 279501 - RNA, 22 nt, Homo sapiens
ugacaggagauuaugugauguu

SEQ ID NO: 279502 - RNA, 22 nt, Homo sapiens
ugacagugaacagguuaccacu

SEQ ID NO: 279503 - RNA, 22 nt, Homo sapiens
ugacaguguccuccuccugaga

SEQ ID NO: 279504 - RNA, 22 nt, Homo sapiens
ugacauagcuauuaagugaugc

SEQ ID NO: 279505 - RNA, 22 nt, Homo sapiens
ugacaugaagaaaaacagauuu

SEQ ID NO: 279506 - RNA, 22 nt, Homo sapiens
ugacaugaaggcaccucugucc

SEQ ID NO: 279507 - RNA, 22 nt, Homo sapiens
ugacauggagggugcggcugca

SEQ ID NO: 279508 - RNA, 22 nt, Homo sapiens
ugacauguccaggugguccugu

SEQ ID NO: 279509 - RNA, 22 nt, Homo sapiens
ugacauugggagugaagugaag

SEQ ID NO: 279510 - RNA, 22 nt, Homo sapiens
ugaccacugucuaagauaggug

SEQ ID NO: 279511 - RNA, 22 nt, Homo sapiens
ugaccagaaaacaaauuaguuu

SEQ ID NO: 279512 - RNA, 22 nt, Homo sapiens
ugacuagagcaauuggaaacaa

SEQ ID NO: 279513 - RNA, 22 nt, Homo sapiens
ugacuaggaaauuagaacuuuu

SEQ ID NO: 279514 - RNA, 23 nt, Homo sapiens
ugacugaguauauguuuggugcu

SEQ ID NO: 279515 - RNA, 20 nt, Homo sapiens
ugacuggauacccuuuggcu

SEQ ID NO: 279516 - RNA, 22 nt, Homo sapiens
ugagaagugacgcagcaggguu

SEQ ID NO: 279517 - RNA, 19 nt, Homo sapiens
ugagaauguuaccaggucc

SEQ ID NO: 279518 - RNA, 21 nt, Homo sapiens
ugagacaauccuggucaauau

SEQ ID NO: 279519 - RNA, 22 nt, Homo sapiens
ugagacaaucucaucucaguga

SEQ ID NO: 279520 - RNA, 22 nt, Homo sapiens
ugagacaucacaaaauccucaa

SEQ ID NO: 279521 - RNA, 22 nt, Homo sapiens
ugagacaucucuccugagacag

SEQ ID NO: 279522 - RNA, 22 nt, Homo sapiens
ugagacaucugagauuuuaagc

SEQ ID NO: 279523 - RNA, 22 nt, Homo sapiens
ugagacaugugaacuguaguuc

SEQ ID NO: 279524 - RNA, 22 nt, Homo sapiens
ugagacaugugaauauuuguac

SEQ ID NO: 279525 - RNA, 22 nt, Homo sapiens
agccucauucuacauguuaaug

SEQ ID NO: 279526 - RNA, 22 nt, Homo sapiens
agccuguguugaauuauagaaa

SEQ ID NO: 279527 - RNA, 23 nt, Homo sapiens
agccuguugccuaggcagcucau

SEQ ID NO: 279528 - RNA, 22 nt, Homo sapiens
agcuaacauuuuuccucuucca

SEQ ID NO: 279529 - RNA, 22 nt, Homo sapiens
agcucauugcuguccuggagga

SEQ ID NO: 279530 - RNA, 22 nt, Homo sapiens
agcugcaaagggagagaugauu

SEQ ID NO: 279531 - RNA, 22 nt, Homo sapiens
agcugcaauguuuaguauaaua

SEQ ID NO: 279532 - RNA, 22 nt, Homo sapiens
agcugcauucguaucauauugu

SEQ ID NO: 279533 - RNA, 22 nt, Homo sapiens
agcugguauuuugucgaggacu

SEQ ID NO: 279534 - RNA, 22 nt, Homo sapiens
agcugguccugugacuugcuuc

SEQ ID NO: 279535 - RNA, 22 nt, Homo sapiens
agcuggucuacguguguaugag

SEQ ID NO: 279536 - RNA, 22 nt, Homo sapiens
agcuucauucugaauagguuga

SEQ ID NO: 279537 - RNA, 22 nt, Homo sapiens
agcuuguauuuguagccuguug

SEQ ID NO: 279538 - RNA, 22 nt, Homo sapiens
aggaaaucuuagcugaggggau

SEQ ID NO: 279539 - RNA, 22 nt, Homo sapiens
guggaggagaaagaagcauuuc

SEQ ID NO: 279540 - RNA, 22 nt, Homo sapiens
guggaguaugaaaacugacuuu

SEQ ID NO: 279541 - RNA, 22 nt, Homo sapiens
guggcaaacucagcaugcccca

SEQ ID NO: 279542 - RNA, 22 nt, Homo sapiens
guggcaaagaugccuucuccaa

SEQ ID NO: 279543 - RNA, 22 nt, Homo sapiens
guggcacgaugaucugggcuca

SEQ ID NO: 279544 - RNA, 22 nt, Homo sapiens
gugggauaauuuuuggugcugu

SEQ ID NO: 279545 - RNA, 22 nt, Homo sapiens
gugggauggaaaugggcuucag

SEQ ID NO: 279546 - RNA, 22 nt, Homo sapiens
gugggauggagagaagguauga

SEQ ID NO: 279547 - RNA, 22 nt, Homo sapiens
gugggguaggugacuugaugag

SEQ ID NO: 279548 - RNA, 22 nt, Homo sapiens
gugguguccugcaccuauaguc

SEQ ID NO: 279549 - RNA, 22 nt, Homo sapiens
guggugucuuguuuaauauaua

SEQ ID NO: 279550 - RNA, 22 nt, Homo sapiens
gugguucuagagggacagaaug

SEQ ID NO: 279551 - RNA, 22 nt, Homo sapiens
gugguuuuaucccagaaauuaa

SEQ ID NO: 279552 - RNA, 22 nt, Homo sapiens
guguaaaacaauuagaggauuu

SEQ ID NO: 279553 - RNA, 22 nt, Homo sapiens
guguaaaugagugcugaaggag

SEQ ID NO: 279554 - RNA, 22 nt, Homo sapiens
guguauguuguccauggaugcg

SEQ ID NO: 279555 - RNA, 22 nt, Homo sapiens
gugucaaggaugccugucaggc

SEQ ID NO: 279556 - RNA, 22 nt, Homo sapiens
gugucaugaagguuuuaugcag

SEQ ID NO: 279557 - RNA, 22 nt, Homo sapiens
guguccucgaguacacaucagg

SEQ ID NO: 279558 - RNA, 22 nt, Homo sapiens
gugugacugcucuauuagggcg

SEQ ID NO: 279559 - RNA, 22 nt, Homo sapiens
gugugcacaaucuggcaugugc

SEQ ID NO: 279560 - RNA, 19 nt, Homo sapiens
gugugcauaucacagagca

SEQ ID NO: 279561 - RNA, 22 nt, Homo sapiens
gugugcauaugucuuuauagua

SEQ ID NO: 279562 - RNA, 22 nt, Homo sapiens
gugugcauggagggggcaguga

SEQ ID NO: 279563 - RNA, 21 nt, Homo sapiens
gugugcuugaauucagcuguc

SEQ ID NO: 279564 - RNA, 22 nt, Homo sapiens
guuaaagacauccacauaggag

SEQ ID NO: 279565 - RNA, 22 nt, Homo sapiens
guuagaugaagaccaagggcaa

SEQ ID NO: 279566 - RNA, 22 nt, Homo sapiens
guuagguagaaguuuacuuuga

SEQ ID NO: 279567 - RNA, 22 nt, Homo sapiens
guuauguuauguuauguuaugu

SEQ ID NO: 279568 - RNA, 22 nt, Homo sapiens
guucacaguuucuaaucccagc

SEQ ID NO: 279569 - RNA, 22 nt, Homo sapiens
guucaucagggacacugguuug

SEQ ID NO: 279570 - RNA, 22 nt, Homo sapiens
guucaucagggauauuggcuua

SEQ ID NO: 279571 - RNA, 17 nt, Homo sapiens
guucccaguggcauuug

SEQ ID NO: 279572 - RNA, 22 nt, Homo sapiens
guugacuaggagcuacuacuac

SEQ ID NO: 279573 - RNA, 22 nt, Homo sapiens
guuggcuuuuuaaggaaauugc

SEQ ID NO: 279574 - RNA, 22 nt, Homo sapiens
guugguauuacagaaauuaguu

SEQ ID NO: 279575 - RNA, 22 nt, Homo sapiens
guuggucaaugugauuaggcca

SEQ ID NO: 279576 - RNA, 22 nt, Homo sapiens
guuguauaggcauggggagaau

SEQ ID NO: 279577 - RNA, 22 nt, Homo sapiens
guuuaacugguacuucaagucu

SEQ ID NO: 279578 - RNA, 22 nt, Homo sapiens
guuuacagucgacuugggaaua

SEQ ID NO: 279579 - RNA, 22 nt, Homo sapiens
guuugcacuccuaugagaaucu

SEQ ID NO: 279580 - RNA, 22 nt, Homo sapiens
guuuuuggggucacuauuaccg

SEQ ID NO: 279581 - RNA, 22 nt, Homo sapiens
uaaacugcuugaaaugguguca

SEQ ID NO: 279582 - RNA, 22 nt, Homo sapiens
uaaacugucuugcaguuacaug

SEQ ID NO: 279583 - RNA, 22 nt, Homo sapiens
uaaagcuagaauuguuccagca

SEQ ID NO: 279584 - RNA, 22 nt, Homo sapiens
uaaagcuaucacauuggugauu

SEQ ID NO: 279585 - RNA, 22 nt, Homo sapiens
uaaagcuuggauuuaggcuaau

SEQ ID NO: 279586 - RNA, 20 nt, Homo sapiens
uaaaugccucaugcuuuauu

SEQ ID NO: 279587 - RNA, 22 nt, Homo sapiens
uaaaugcucuuuaaaagugcuu

SEQ ID NO: 279588 - RNA, 22 nt, Homo sapiens
uaaaugcuuaauugaaugugga

SEQ ID NO: 279589 - RNA, 22 nt, Homo sapiens
uaaauggauauugccaucuccu

SEQ ID NO: 279590 - RNA, 22 nt, Homo sapiens
uaaauugcauaaguacaaauga

SEQ ID NO: 279591 - RNA, 18 nt, Homo sapiens
uaaauugcuucaccugag

SEQ ID NO: 279592 - RNA, 22 nt, Homo sapiens
uaacaacauucuaacugacggc

SEQ ID NO: 279593 - RNA, 22 nt, Homo sapiens
ugagaccugaucuugguacugc

SEQ ID NO: 279594 - RNA, 22 nt, Homo sapiens
ugagaccuuucauuucucagug

SEQ ID NO: 279595 - RNA, 22 nt, Homo sapiens
ugagacgaagucucguucugua

SEQ ID NO: 279596 - RNA, 22 nt, Homo sapiens
ugagacggagucucgcuguguc

SEQ ID NO: 279597 - RNA, 22 nt, Homo sapiens
ugagacugagucucgcucuauu

SEQ ID NO: 279598 - RNA, 22 nt, Homo sapiens
ugagacugagucuugcucuugu

SEQ ID NO: 279599 - RNA, 22 nt, Homo sapiens
ugagacugaguuucacuuuugu

SEQ ID NO: 279600 - RNA, 22 nt, Homo sapiens
ugagacugaguuucgcucuugu

SEQ ID NO: 279601 - RNA, 22 nt, Homo sapiens
ugagacugguaauguguagggc

SEQ ID NO: 279602 - RNA, 22 nt, Homo sapiens
ugagagaugaacuauucuugaa

SEQ ID NO: 279603 - RNA, 22 nt, Homo sapiens
ugagagaugaacucugauaugu

SEQ ID NO: 279604 - RNA, 22 nt, Homo sapiens
ugagagaugauaaaauguuugu

SEQ ID NO: 279605 - RNA, 22 nt, Homo sapiens
ugagagcuuuuuugccugguga

SEQ ID NO: 279606 - RNA, 22 nt, Homo sapiens
ugagagucauacaaauaaaaau

SEQ ID NO: 279607 - RNA, 22 nt, Homo sapiens
ugagauaacuaaaaacauuuug

SEQ ID NO: 279608 - RNA, 22 nt, Homo sapiens
ugagauaggaucuugcucuguu

SEQ ID NO: 279609 - RNA, 22 nt, Homo sapiens
ugagaucaagguuaauauaauc

SEQ ID NO: 279610 - RNA, 22 nt, Homo sapiens
ugagaugaaagcagaaagacuu

SEQ ID NO: 279611 - RNA, 22 nt, Homo sapiens
ugagaugaagugauguaaaaca

SEQ ID NO: 279612 - RNA, 22 nt, Homo sapiens
auacacuggagcaaaccuggag

SEQ ID NO: 279613 - RNA, 22 nt, Homo sapiens
auacagcuaaaauauuaaguua

SEQ ID NO: 279614 - RNA, 22 nt, Homo sapiens
auacagugaauacuuacagugu

SEQ ID NO: 279615 - RNA, 22 nt, Homo sapiens
auacagugaauaucuggggcag

SEQ ID NO: 279616 - RNA, 22 nt, Homo sapiens
auacaguguauguauaguacau

SEQ ID NO: 279617 - RNA, 22 nt, Homo sapiens
auacaguguucugggaagaagu

SEQ ID NO: 279618 - RNA, 22 nt, Homo sapiens
auacaguugccauuucuugugc

SEQ ID NO: 279619 - RNA, 22 nt, Homo sapiens
auacaugcauuugcacgagagu

SEQ ID NO: 279620 - RNA, 19 nt, Homo sapiens
auacccacuagguuacuua

SEQ ID NO: 279621 - RNA, 22 nt, Homo sapiens
auacuagucaagaauguaugag

SEQ ID NO: 279622 - RNA, 22 nt, Homo sapiens
auacuccugucucagcugagau

SEQ ID NO: 279623 - RNA, 22 nt, Homo sapiens
auagaagcuauguauaggggcc

SEQ ID NO: 279624 - RNA, 22 nt, Homo sapiens
auagacacugaaaucccugcca

SEQ ID NO: 279625 - RNA, 22 nt, Homo sapiens
auagaguuagaaagaaauguuu

SEQ ID NO: 279626 - RNA, 22 nt, Homo sapiens
auagcaaugcaagaauggcuua

SEQ ID NO: 279627 - RNA, 22 nt, Homo sapiens
auagcaaugccccacuccuugg

SEQ ID NO: 279628 - RNA, 22 nt, Homo sapiens
auagcacuuauagauuuggucu

SEQ ID NO: 279629 - RNA, 22 nt, Homo sapiens
auagcagaacagugucucacug

SEQ ID NO: 279630 - RNA, 22 nt, Homo sapiens
auagcagcagcuaguagugaua

SEQ ID NO: 279631 - RNA, 22 nt, Homo sapiens
auagcagcauauguaauguuga

SEQ ID NO: 279632 - RNA, 22 nt, Homo sapiens
auagcagugugagaaugaacua

SEQ ID NO: 279633 - RNA, 20 nt, Homo sapiens
auagcauugauggacucaaa

SEQ ID NO: 279634 - RNA, 22 nt, Homo sapiens
auagcccuuuucuaacuaugug

SEQ ID NO: 279635 - RNA, 22 nt, Homo sapiens
auagccucauucuucagaugag

SEQ ID NO: 279636 - RNA, 22 nt, Homo sapiens
auaggagcacgaacucuagugu

SEQ ID NO: 279637 - RNA, 22 nt, Homo sapiens
auaggagugugcacagaguagg

SEQ ID NO: 279638 - RNA, 22 nt, Homo sapiens
auaguagagagggcaaaaugcu

SEQ ID NO: 279639 - RNA, 22 nt, Homo sapiens
auaguagcaugcacuggugcug

SEQ ID NO: 279640 - RNA, 22 nt, Homo sapiens
auagugcugcagucaauguacg

SEQ ID NO: 279641 - RNA, 22 nt, Homo sapiens
auagugcugugaugaacauaca

SEQ ID NO: 279642 - RNA, 22 nt, Homo sapiens
auauagcaaugaaagagaugaa

SEQ ID NO: 279643 - RNA, 22 nt, Homo sapiens
auaucacaaacaagucuguacu

SEQ ID NO: 279644 - RNA, 22 nt, Homo sapiens
auaucacucccaauaucgcagg

SEQ ID NO: 279645 - RNA, 22 nt, Homo sapiens
auaucugcauugccauuuaugu

SEQ ID NO: 279646 - RNA, 22 nt, Homo sapiens
auauggcauucagaacuguaua

SEQ ID NO: 279647 - RNA, 21 nt, Homo sapiens
auaugugcuguggaagucagc

SEQ ID NO: 279648 - RNA, 22 nt, Homo sapiens
auauuacagagaggaccuggga

SEQ ID NO: 279649 - RNA, 22 nt, Homo sapiens
auauugcuuagugaugaagucu

SEQ ID NO: 279650 - RNA, 22 nt, Homo sapiens
auauugcuugaggccaggaggu

SEQ ID NO: 279651 - RNA, 22 nt, Homo sapiens
auauuggccuaaaauucucuuu

SEQ ID NO: 279652 - RNA, 22 nt, Homo sapiens
auauuugguuaccugugggucu

SEQ ID NO: 279653 - RNA, 20 nt, Homo sapiens
aucaaagacuuagaggggga

SEQ ID NO: 279654 - RNA, 22 nt, Homo sapiens
aucaaagccaugcucaguuuuc

SEQ ID NO: 279655 - RNA, 22 nt, Homo sapiens
aucaaaguaucucaauauggua

SEQ ID NO: 279656 - RNA, 22 nt, Homo sapiens
aucaaaucuccagaaccugucu

SEQ ID NO: 279657 - RNA, 22 nt, Homo sapiens
aucaagccaaagaaaguccuug

SEQ ID NO: 279658 - RNA, 22 nt, Homo sapiens
aucacagcccuccucuuggaug

SEQ ID NO: 279659 - RNA, 22 nt, Homo sapiens
aucacaggucaaaucauuauuu

SEQ ID NO: 279660 - RNA, 22 nt, Homo sapiens
uaacaagagagucagucagucc

SEQ ID NO: 279661 - RNA, 21 nt, Homo sapiens
uaacagcuccacuccauucuc

SEQ ID NO: 279662 - RNA, 22 nt, Homo sapiens
uaacagcucuacagcugcucuu

SEQ ID NO: 279663 - RNA, 22 nt, Homo sapiens
uaacaguguauuccuuuggaca

SEQ ID NO: 279664 - RNA, 22 nt, Homo sapiens
uaacaguguauuuacuacuucc

SEQ ID NO: 279665 - RNA, 22 nt, Homo sapiens
uaacauugcuggacuaccugcu

SEQ ID NO: 279666 - RNA, 22 nt, Homo sapiens
uaacauugucuugcuuaguuuu

SEQ ID NO: 279667 - RNA, 22 nt, Homo sapiens
uaacccagugucugugaugggu

SEQ ID NO: 279668 - RNA, 22 nt, Homo sapiens
uaacuaaagagaagucaauguc

SEQ ID NO: 279669 - RNA, 22 nt, Homo sapiens
uaacuacuucugcuucagagua

SEQ ID NO: 279670 - RNA, 22 nt, Homo sapiens
uaacucugccuagugacauggu

SEQ ID NO: 279671 - RNA, 22 nt, Homo sapiens
uaacuguggaaaugacuuuaaa

SEQ ID NO: 279672 - RNA, 22 nt, Homo sapiens
uaagaauucuguccgguauacu

SEQ ID NO: 279673 - RNA, 22 nt, Homo sapiens
uaagacuguguaauuuaugaag

SEQ ID NO: 279674 - RNA, 22 nt, Homo sapiens
uaagacuguuggcaauuuuugc

SEQ ID NO: 279675 - RNA, 22 nt, Homo sapiens
uaagccaccgugccuggccuaa

SEQ ID NO: 279676 - RNA, 22 nt, Homo sapiens
uaaggcaaucagucaugguguu

SEQ ID NO: 279677 - RNA, 22 nt, Homo sapiens
uaaggcccggccuuuccaagca

SEQ ID NO: 279678 - RNA, 22 nt, Homo sapiens
uaaggcuuugcuggacucaguc

SEQ ID NO: 279679 - RNA, 22 nt, Homo sapiens
uaagguuuuugauaugcugcug

SEQ ID NO: 279680 - RNA, 22 nt, Homo sapiens
uaaguaauugugguuuuugcca

SEQ ID NO: 279681 - RNA, 22 nt, Homo sapiens
uaagucacuccagguuaaagug

SEQ ID NO: 279682 - RNA, 22 nt, Homo sapiens
uaagucguggaugauucuucgg

SEQ ID NO: 279683 - RNA, 22 nt, Homo sapiens
uaagucuuuuuggaguuuauaa

SEQ ID NO: 279684 - RNA, 22 nt, Homo sapiens
ugcaguacuuugaaauauacug

SEQ ID NO: 279685 - RNA, 22 nt, Homo sapiens
ugcaguaggcccagcgggaggc

SEQ ID NO: 279686 - RNA, 22 nt, Homo sapiens
ugcauaucuucagccgggcacg

SEQ ID NO: 279687 - RNA, 22 nt, Homo sapiens
ugcauaucuuguggaauaucuc

SEQ ID NO: 279688 - RNA, 22 nt, Homo sapiens
ugcauaugucuuuauagcagca

SEQ ID NO: 279689 - RNA, 22 nt, Homo sapiens
ugcauauguucaaaguauucug

SEQ ID NO: 279690 - RNA, 22 nt, Homo sapiens
ugcauauuuuauaaagauggaa

SEQ ID NO: 279691 - RNA, 22 nt, Homo sapiens
ugcauuguuccgaauguguccu

SEQ ID NO: 279692 - RNA, 22 nt, Homo sapiens
ugccaaggagucagucccuaga

SEQ ID NO: 279693 - RNA, 22 nt, Homo sapiens
ugccaggaugaggucaauguuu

SEQ ID NO: 279694 - RNA, 20 nt, Homo sapiens
ugccagugugucaauuuaua

SEQ ID NO: 279695 - RNA, 22 nt, Homo sapiens
ugccaguguugccuuucacuag

SEQ ID NO: 279696 - RNA, 22 nt, Homo sapiens
ugccaugaagagaggaagcagu

SEQ ID NO: 279697 - RNA, 22 nt, Homo sapiens
ugccaugaaguaauggcaaaaa

SEQ ID NO: 279698 - RNA, 19 nt, Homo sapiens
ugccauguagcacaugguc

SEQ ID NO: 279699 - RNA, 22 nt, Homo sapiens
ugcccguaauuccagcacuuug

SEQ ID NO: 279700 - RNA, 22 nt, Homo sapiens
ugccuagagagaaccauaacug

SEQ ID NO: 279701 - RNA, 22 nt, Homo sapiens
ugccuuauuccaacugagcucu

SEQ ID NO: 279702 - RNA, 22 nt, Homo sapiens
ugcuagagaaauauauuugggg

SEQ ID NO: 279703 - RNA, 22 nt, Homo sapiens
ugcuaugucuucucucacagag

SEQ ID NO: 279704 - RNA, 22 nt, Homo sapiens
ugcuauguuuucccuccuuauc

SEQ ID NO: 279705 - RNA, 22 nt, Homo sapiens
ugcucaguuuaaaacuuuugag

SEQ ID NO: 279706 - RNA, 21 nt, Homo sapiens
ugcuccauuuucuagccugaa

SEQ ID NO: 279707 - RNA, 18 nt, Homo sapiens
ugcuccccugggugagca

SEQ ID NO: 279708 - RNA, 22 nt, Homo sapiens
ugcugguguuuaggaauaagaa

SEQ ID NO: 279709 - RNA, 22 nt, Homo sapiens
ugcugguuuucaucaucagugg

SEQ ID NO: 279710 - RNA, 22 nt, Homo sapiens
ugcuuaguuguauguuccacau

SEQ ID NO: 279711 - RNA, 22 nt, Homo sapiens
ugcuuguguucagguaaccuuu

SEQ ID NO: 279712 - RNA, 22 nt, Homo sapiens
uggaaacuuauguucuucugug

SEQ ID NO: 279713 - RNA, 20 nt, Homo sapiens
uggaaaguaagucaugauau

SEQ ID NO: 279714 - RNA, 22 nt, Homo sapiens
uggaaaguacuugaguuuguau

SEQ ID NO: 279715 - RNA, 22 nt, Homo sapiens
uggaaaguaguucuaaucuaag

SEQ ID NO: 279716 - RNA, 22 nt, Homo sapiens
uggaaauaaaugugccaagauc

SEQ ID NO: 279717 - RNA, 22 nt, Homo sapiens
uggaagacacauaccugauaac

SEQ ID NO: 279718 - RNA, 22 nt, Homo sapiens
uggaagacauugggugaagggu

SEQ ID NO: 279719 - RNA, 22 nt, Homo sapiens
uggaagacauuuuggaccuugg

SEQ ID NO: 279720 - RNA, 22 nt, Homo sapiens
uggaagacucuagucucuugag

SEQ ID NO: 279721 - RNA, 22 nt, Homo sapiens
uggaagacuuuagaggcuuaua

SEQ ID NO: 279722 - RNA, 22 nt, Homo sapiens
uggaaggcuucauauguaaaga

SEQ ID NO: 279723 - RNA, 22 nt, Homo sapiens
uggaaguagauagauuguguca

SEQ ID NO: 279724 - RNA, 22 nt, Homo sapiens
uggaaguauagauaauugaaag

SEQ ID NO: 279725 - RNA, 22 nt, Homo sapiens
uggaagucauugagguguguua

SEQ ID NO: 279726 - RNA, 22 nt, Homo sapiens
uggaagucuucauuauguauag

SEQ ID NO: 279727 - RNA, 21 nt, Homo sapiens
uggaaguguacaauuauaccc

SEQ ID NO: 279728 - RNA, 22 nt, Homo sapiens
aucacauggccagguaguaauc

SEQ ID NO: 279729 - RNA, 19 nt, Homo sapiens
aucaccagucuuuccacug

SEQ ID NO: 279730 - RNA, 22 nt, Homo sapiens
aucaccugagcaguauacacug

SEQ ID NO: 279731 - RNA, 22 nt, Homo sapiens
aucaccuggaggugaucacuug

SEQ ID NO: 279732 - RNA, 22 nt, Homo sapiens
aucacugggcaagauaucauga

SEQ ID NO: 279733 - RNA, 22 nt, Homo sapiens
aucacuguaaguuuacacuuug

SEQ ID NO: 279734 - RNA, 23 nt, Homo sapiens
aucacuguuaacaauuucuuccu

SEQ ID NO: 279735 - RNA, 22 nt, Homo sapiens
aucacuguuuugaugcucggac

SEQ ID NO: 279736 - RNA, 22 nt, Homo sapiens
aucacuuugcucuccagugugg

SEQ ID NO: 279737 - RNA, 22 nt, Homo sapiens
aucagaaucucuagugggacca

SEQ ID NO: 279738 - RNA, 22 nt, Homo sapiens
aucagagugaauaaugacaaaa

SEQ ID NO: 279739 - RNA, 22 nt, Homo sapiens
aucagcagcaugaaaacggacu

SEQ ID NO: 279740 - RNA, 22 nt, Homo sapiens
aucagcagcaugaaaagcaacu

SEQ ID NO: 279741 - RNA, 22 nt, Homo sapiens
aucagcaguguaaaaacggacu

SEQ ID NO: 279742 - RNA, 22 nt, Homo sapiens
aucaggcacacauuggaguuug

SEQ ID NO: 279743 - RNA, 22 nt, Homo sapiens
aucagugagugguuagugaaug

SEQ ID NO: 279744 - RNA, 22 nt, Homo sapiens
aucauauccuagauauaacuuc

SEQ ID NO: 279745 - RNA, 22 nt, Homo sapiens
aucauggaguauuugcaagucu

SEQ ID NO: 279746 - RNA, 22 nt, Homo sapiens
aucauugugcaucuucauucca

SEQ ID NO: 279747 - RNA, 22 nt, Homo sapiens
auccaagagacugaugacuucc

SEQ ID NO: 279748 - RNA, 22 nt, Homo sapiens
auccaucagacggcaggcguug

SEQ ID NO: 279749 - RNA, 22 nt, Homo sapiens
auccauguggauaaauguguau

SEQ ID NO: 279750 - RNA, 22 nt, Homo sapiens
aucccuguaguaauauucuagc

SEQ ID NO: 279751 - RNA, 22 nt, Homo sapiens
aucccugugauccaaucacuuc

SEQ ID NO: 279752 - RNA, 22 nt, Homo sapiens
auccucugagaucuaggcagag

SEQ ID NO: 279753 - RNA, 22 nt, Homo sapiens
auccuguagucucacagcccca

SEQ ID NO: 279754 - RNA, 21 nt, Homo sapiens
auccuucuuuuucaaccugug

SEQ ID NO: 279755 - RNA, 21 nt, Homo sapiens
aucgcacaauauaccccugua

SEQ ID NO: 279756 - RNA, 22 nt, Homo sapiens
aucgcaccauugcacuccagca

SEQ ID NO: 279757 - RNA, 22 nt, Homo sapiens
ugccagagacguagggaauauu

SEQ ID NO: 279758 - RNA, 22 nt, Homo sapiens
ugccaguguuuuguugaagauu

SEQ ID NO: 279759 - RNA, 22 nt, Homo sapiens
ugccaugaagaucccugaaaug

SEQ ID NO: 279760 - RNA, 22 nt, Homo sapiens
ugccuaggcuggaaugcaaugg

SEQ ID NO: 279761 - RNA, 22 nt, Homo sapiens
ugccuaggcuggagugcagugg

SEQ ID NO: 279762 - RNA, 22 nt, Homo sapiens
uuggcagaaaaggucggggguu

SEQ ID NO: 279763 - RNA, 20 nt, Homo sapiens
uuggcagagucuuuagggua

SEQ ID NO: 279764 - RNA, 22 nt, Homo sapiens
uuggcagcauuccagccaagca

SEQ ID NO: 279765 - RNA, 22 nt, Homo sapiens
uuggcagcuguggaaucugggc

SEQ ID NO: 279766 - RNA, 22 nt, Homo sapiens
uuggcauuguggauggaaucau

SEQ ID NO: 279767 - RNA, 22 nt, Homo sapiens
uuggcauuuuggacacccagga

SEQ ID NO: 279768 - RNA, 22 nt, Homo sapiens
uuggccccucccaaauuucaug

SEQ ID NO: 279769 - RNA, 22 nt, Homo sapiens
uuggccccuuucauccacagcu

SEQ ID NO: 279770 - RNA, 22 nt, Homo sapiens
uuggcuaugaguccuaugugca

SEQ ID NO: 279771 - RNA, 22 nt, Homo sapiens
uuggcuguguuccucaaggagu

SEQ ID NO: 279772 - RNA, 22 nt, Homo sapiens
uuggcuguguuuauaugcugga

SEQ ID NO: 279773 - RNA, 22 nt, Homo sapiens
uuggcuuggagaguugaaaugu

SEQ ID NO: 279774 - RNA, 22 nt, Homo sapiens
uugggaauguccuaauaucucg

SEQ ID NO: 279775 - RNA, 22 nt, Homo sapiens
uugggagugucucuggacugca

SEQ ID NO: 279776 - RNA, 22 nt, Homo sapiens
uugggauaaucacaaaguaaaa

SEQ ID NO: 279777 - RNA, 23 nt, Homo sapiens
uugggcaaaucacuaacgucucc

SEQ ID NO: 279778 - RNA, 22 nt, Homo sapiens
uugggcuuuuagguccuuaaca

SEQ ID NO: 279779 - RNA, 22 nt, Homo sapiens
uugggguagaauugcaacauau

SEQ ID NO: 279780 - RNA, 22 nt, Homo sapiens
uugggucaguuccuugacuccu

SEQ ID NO: 279781 - RNA, 22 nt, Homo sapiens
uugguccacugugaaauuggga

SEQ ID NO: 279782 - RNA, 22 nt, Homo sapiens
uuggucucaucaagagcagcuu

SEQ ID NO: 279783 - RNA, 22 nt, Homo sapiens
uuggucugcucugauguuuucu

SEQ ID NO: 279784 - RNA, 22 nt, Homo sapiens
uuggucuucuaauguaccuguu

SEQ ID NO: 279785 - RNA, 22 nt, Homo sapiens
uugguuccauuuuaccagcucu

SEQ ID NO: 279786 - RNA, 21 nt, Homo sapiens
uugguucccucugacaggucu

SEQ ID NO: 279787 - RNA, 19 nt, Homo sapiens
uugguugguuauuucuuac

SEQ ID NO: 279788 - RNA, 22 nt, Homo sapiens
uugguuuccuuccugcuuaacu

SEQ ID NO: 279789 - RNA, 21 nt, Homo sapiens
uuguagcagcauaaucccaga

SEQ ID NO: 279790 - RNA, 22 nt, Homo sapiens
uuguagcuuuuuaaugugcugc

SEQ ID NO: 279791 - RNA, 22 nt, Homo sapiens
uuguaguagcauuauuuauaau

SEQ ID NO: 279792 - RNA, 22 nt, Homo sapiens
uuguauguaaccauuuggcaaa

SEQ ID NO: 279793 - RNA, 22 nt, Homo sapiens
uuguauguugaaugaugguaua

SEQ ID NO: 279794 - RNA, 22 nt, Homo sapiens
uugucacccucucuuggugucu

SEQ ID NO: 279795 - RNA, 22 nt, Homo sapiens
uugucaccucuaaaucucauau

SEQ ID NO: 279796 - RNA, 22 nt, Homo sapiens
uugucacugcacuccagucugg

SEQ ID NO: 279797 - RNA, 22 nt, Homo sapiens
uuguccccaucugcugccagaa

SEQ ID NO: 279798 - RNA, 16 nt, Homo sapiens
uugucccuucccaaau

SEQ ID NO: 279799 - RNA, 22 nt, Homo sapiens
uuguccucuccaaaucucaugu

SEQ ID NO: 279800 - RNA, 22 nt, Homo sapiens
uugugagggagcuaagaugagu

SEQ ID NO: 279801 - RNA, 22 nt, Homo sapiens
uugugauggugcauacugagcu

SEQ ID NO: 279802 - RNA, 22 nt, Homo sapiens
uugugcauaucagagguuugcu

SEQ ID NO: 279803 - RNA, 22 nt, Homo sapiens
uugugcuucaucaccuagcaga

SEQ ID NO: 279804 - RNA, 22 nt, Homo sapiens
uugugcuuuugagcugagauga

SEQ ID NO: 279805 - RNA, 22 nt, Homo sapiens
uuguguuugaugcugacacgca

SEQ ID NO: 279806 - RNA, 22 nt, Homo sapiens
uuguuaugggguggcuugaaag

SEQ ID NO: 279807 - RNA, 22 nt, Homo sapiens
uuguuauguaucucaagauaaa

SEQ ID NO: 279808 - RNA, 22 nt, Homo sapiens
uuguuauguuaaacuacugaaa

SEQ ID NO: 279809 - RNA, 22 nt, Homo sapiens
uuguuauguuggucaguaaugu

SEQ ID NO: 279810 - RNA, 22 nt, Homo sapiens
uuuaaacugucuuggguuugga

SEQ ID NO: 279811 - RNA, 22 nt, Homo sapiens
uuuaaagcuaaaauauguuuau

SEQ ID NO: 279812 - RNA, 20 nt, Homo sapiens
uuuaagacaugcugaauuga

SEQ ID NO: 279813 - RNA, 22 nt, Homo sapiens
uuuaaggcacuucaugguuuca

SEQ ID NO: 279814 - RNA, 22 nt, Homo sapiens
uuuaaggcaggucuggugguga

SEQ ID NO: 279815 - RNA, 22 nt, Homo sapiens
uuuaaggcaugccuguacaugc

SEQ ID NO: 279816 - RNA, 22 nt, Homo sapiens
uuuaaugcgucucugaguuuug

SEQ ID NO: 279817 - RNA, 17 nt, Homo sapiens
uuuaaugcuaggacucu

SEQ ID NO: 279818 - RNA, 22 nt, Homo sapiens
uuuacugugggguuucuuagag

SEQ ID NO: 279819 - RNA, 22 nt, Homo sapiens
uuuagguagucaaagguuaguc

SEQ ID NO: 279820 - RNA, 22 nt, Homo sapiens
uuuaguucauuaaggaaucucc

SEQ ID NO: 279821 - RNA, 22 nt, Homo sapiens
uuuaucaggccuuuggaaaaau

SEQ ID NO: 279822 - RNA, 22 nt, Homo sapiens
uuuaucuguuuaaaacuguuca

SEQ ID NO: 279823 - RNA, 22 nt, Homo sapiens
uuuaugucuguacaucgggcgg

SEQ ID NO: 279824 - RNA, 23 nt, Homo sapiens
uuucacaguagcuggaucagccu

SEQ ID NO: 279825 - RNA, 20 nt, Homo sapiens
uuucaguacuuucuacuggc

SEQ ID NO: 279826 - RNA, 22 nt, Homo sapiens
uuucaguagagacacgguuuug

SEQ ID NO: 279827 - RNA, 22 nt, Homo sapiens
uuucauagccuucuaaugaguu

SEQ ID NO: 279828 - RNA, 22 nt, Homo sapiens
uuucaucagccagggucagucu

SEQ ID NO: 279829 - RNA, 22 nt, Homo sapiens
uuucauggacgcaaugccuuuu

SEQ ID NO: 279830 - RNA, 22 nt, Homo sapiens
gaagugcuuuuggacuaacagu

SEQ ID NO: 279831 - RNA, 22 nt, Homo sapiens
ugccuuuguucuggaaugggaa

SEQ ID NO: 279832 - RNA, 22 nt, Homo sapiens
ugcgauaguuugcugguaaauu

SEQ ID NO: 279833 - RNA, 22 nt, Homo sapiens
ugcuacccuucgucucucuggu

SEQ ID NO: 279834 - RNA, 22 nt, Homo sapiens
ugcuaugucagccaggcugguc

SEQ ID NO: 279835 - RNA, 23 nt, Homo sapiens
ugcuccccucauggaugaauaaa

SEQ ID NO: 279836 - RNA, 23 nt, Homo sapiens
ugcugagaccuagauccuaaaga

SEQ ID NO: 279837 - RNA, 22 nt, Homo sapiens
ugcugcaaacaugagaggaagu

SEQ ID NO: 279838 - RNA, 22 nt, Homo sapiens
ugcugcaaucucggcacuuugg

SEQ ID NO: 279839 - RNA, 22 nt, Homo sapiens
ugcuggugauuaaauccugaag

SEQ ID NO: 279840 - RNA, 22 nt, Homo sapiens
ugcuggugauucagauucaaau

SEQ ID NO: 279841 - RNA, 22 nt, Homo sapiens
ugcuggugucaucaaggcuuug

SEQ ID NO: 279842 - RNA, 22 nt, Homo sapiens
ugcugguuuaaaaugcaaauuc

SEQ ID NO: 279843 - RNA, 22 nt, Homo sapiens
ugcuguguugcuggcuuaaaga

SEQ ID NO: 279844 - RNA, 17 nt, Homo sapiens
ugcuuagagagccucag

SEQ ID NO: 279845 - RNA, 22 nt, Homo sapiens
ugcuuagucuugcuuuagcuau

SEQ ID NO: 279846 - RNA, 19 nt, Homo sapiens
uggaacugauucaguucug

SEQ ID NO: 279847 - RNA, 23 nt, Homo sapiens
uggaagacuccucucuuggcugc

SEQ ID NO: 279848 - RNA, 20 nt, Homo sapiens
uggaaggcaucugcauuauu

SEQ ID NO: 279849 - RNA, 22 nt, Homo sapiens
uggaagguaaguuuugagcauu

SEQ ID NO: 279850 - RNA, 22 nt, Homo sapiens
uggaauaugagacgggguuguc

SEQ ID NO: 279851 - RNA, 22 nt, Homo sapiens
uggaaucaucaacgaaugaaau

SEQ ID NO: 279852 - RNA, 21 nt, Homo sapiens
uggaaucuauagaggcaguag

SEQ ID NO: 279853 - RNA, 21 nt, Homo sapiens
uggaaucuauuauuccaguuu

SEQ ID NO: 279854 - RNA, 20 nt, Homo sapiens
uggaaucugaagaucucagu

SEQ ID NO: 279855 - RNA, 22 nt, Homo sapiens
uggaaugguaucuuguuggggu

SEQ ID NO: 279856 - RNA, 22 nt, Homo sapiens
uggaauguauaucguuuuuugu

SEQ ID NO: 279857 - RNA, 22 nt, Homo sapiens
uggaaugugaauaacuuccuuc

SEQ ID NO: 279858 - RNA, 22 nt, Homo sapiens
uggaauguggacucuuaugggg

SEQ ID NO: 279859 - RNA, 22 nt, Homo sapiens
uggaauguuauggcuuuaaucu

SEQ ID NO: 279860 - RNA, 21 nt, Homo sapiens
uggaauguucugacuucaggg

SEQ ID NO: 279861 - RNA, 22 nt, Homo sapiens
uggaauuuagguugauaguaua

SEQ ID NO: 279862 - RNA, 22 nt, Homo sapiens
uggacacuggagauucgucagu

SEQ ID NO: 279863 - RNA, 22 nt, Homo sapiens
uggacagacaagguuauagauc

SEQ ID NO: 279864 - RNA, 21 nt, Homo sapiens
uggaccccuuccagucaucau

SEQ ID NO: 279865 - RNA, 22 nt, Homo sapiens
uggagaacugaugucuccaaga

SEQ ID NO: 279866 - RNA, 22 nt, Homo sapiens
uggagacaaagauagaaaagca

SEQ ID NO: 279867 - RNA, 22 nt, Homo sapiens
uggagcccuaguuccucauaac

SEQ ID NO: 279868 - RNA, 22 nt, Homo sapiens
uggaggacugcagaacugaggc

SEQ ID NO: 279869 - RNA, 22 nt, Homo sapiens
uggagggcuagucauuucuuuu

SEQ ID NO: 279870 - RNA, 22 nt, Homo sapiens
uggagguagagaugggaucucc

SEQ ID NO: 279871 - RNA, 22 nt, Homo sapiens
uggagguaggugauauguagca

SEQ ID NO: 279872 - RNA, 20 nt, Homo sapiens
uggaggucaucugucacuac

SEQ ID NO: 279873 - RNA, 22 nt, Homo sapiens
uggagugauaugguuauauggg

SEQ ID NO: 279874 - RNA, 20 nt, Homo sapiens
uggagugcuguguugagaag

SEQ ID NO: 279875 - RNA, 22 nt, Homo sapiens
uggaguguuggggcaggaucuc

SEQ ID NO: 279876 - RNA, 22 nt, Homo sapiens
uggaugacuguuauaugcauau

SEQ ID NO: 279877 - RNA, 22 nt, Homo sapiens
uggcaaaaaaacgcaauuacgu

SEQ ID NO: 279878 - RNA, 22 nt, Homo sapiens
uggcaaaugaaagaaagccagu

SEQ ID NO: 279879 - RNA, 22 nt, Homo sapiens
uggcaaaugugagaugagaacu

SEQ ID NO: 279880 - RNA, 21 nt, Homo sapiens
uggcaacauggauggauucug

SEQ ID NO: 279881 - RNA, 22 nt, Homo sapiens
uggcaagaaccacaguuacuuu

SEQ ID NO: 279882 - RNA, 22 nt, Homo sapiens
uggcaagaacugcaauugcuuu

SEQ ID NO: 279883 - RNA, 22 nt, Homo sapiens
uggcaagagaacaacaucucuc

SEQ ID NO: 279884 - RNA, 22 nt, Homo sapiens
uggcaagagcugcauucaucug

SEQ ID NO: 279885 - RNA, 19 nt, Homo sapiens
uggcacauguauacuuaug

SEQ ID NO: 279886 - RNA, 22 nt, Homo sapiens
uggcaccauccaggugucucua

SEQ ID NO: 279887 - RNA, 20 nt, Homo sapiens
uggcaccugacagauagcca

SEQ ID NO: 279888 - RNA, 22 nt, Homo sapiens
uggcagaugagccgcgcuccaa

SEQ ID NO: 279889 - RNA, 22 nt, Homo sapiens
uggcagaugcucuuggugccca

SEQ ID NO: 279890 - RNA, 22 nt, Homo sapiens
uggcagcgcaguugaaaaagaa

SEQ ID NO: 279891 - RNA, 22 nt, Homo sapiens
uggcaguuuacagcuuuaggag

SEQ ID NO: 279892 - RNA, 22 nt, Homo sapiens
uggcauauaaagauguguucaa

SEQ ID NO: 279893 - RNA, 22 nt, Homo sapiens
uggcauaugguauuugauaucu

SEQ ID NO: 279894 - RNA, 20 nt, Homo sapiens
uggcaugaaauuuuccaagc

SEQ ID NO: 279895 - RNA, 17 nt, Homo sapiens
uggcaugaggguguggg

SEQ ID NO: 279896 - RNA, 22 nt, Homo sapiens
uggcaugcauuguggguaauua

SEQ ID NO: 279897 - RNA, 22 nt, Homo sapiens
uggcauggaaagcuuuucauac

SEQ ID NO: 279898 - RNA, 22 nt, Homo sapiens
uggcauggaguggauggcccca

SEQ ID NO: 279899 - RNA, 22 nt, Homo sapiens
uggcauggggcagaacauuaca

SEQ ID NO: 279900 - RNA, 22 nt, Homo sapiens
uggcaugucguuuuucauagga

SEQ ID NO: 279901 - RNA, 22 nt, Homo sapiens
uggcauuguccaauaaaauuuu

SEQ ID NO: 279902 - RNA, 22 nt, Homo sapiens
uuuccuguaggaaggaaauaga

SEQ ID NO: 279903 - RNA, 22 nt, Homo sapiens
gaauagugcugcaagaaacaua

SEQ ID NO: 279904 - RNA, 22 nt, Homo sapiens
gaauagugcugcaauaaacaua

SEQ ID NO: 279905 - RNA, 22 nt, Homo sapiens
gaauagugcugcgauaaacaua

SEQ ID NO: 279906 - RNA, 22 nt, Homo sapiens
gaaucacugugguaucccaugc

SEQ ID NO: 279907 - RNA, 22 nt, Homo sapiens
gaaucauuguuucuaaguuugu

SEQ ID NO: 279908 - RNA, 22 nt, Homo sapiens
gaaugguuuacaaguguaaucu

SEQ ID NO: 279909 - RNA, 22 nt, Homo sapiens
gaauucugucgcuuacuagaug

SEQ ID NO: 279910 - RNA, 22 nt, Homo sapiens
gacaccugguguggaacuggag

SEQ ID NO: 279911 - RNA, 22 nt, Homo sapiens
gacagacacaauugauccauga

SEQ ID NO: 279912 - RNA, 22 nt, Homo sapiens
gacagugagaugucaugugaaa

SEQ ID NO: 279913 - RNA, 22 nt, Homo sapiens
gacauguuucucucuguuuacu

SEQ ID NO: 279914 - RNA, 22 nt, Homo sapiens
gaccacagacuggaaagagggc

SEQ ID NO: 279915 - RNA, 22 nt, Homo sapiens
gaccacauuccacacaggcuuu

SEQ ID NO: 279916 - RNA, 22 nt, Homo sapiens
gacccucuagauggaagcacug

SEQ ID NO: 279917 - RNA, 22 nt, Homo sapiens
gaccuguaguuuaguugccugu

SEQ ID NO: 279918 - RNA, 22 nt, Homo sapiens
gacuaaugaaagagugugauau

SEQ ID NO: 279919 - RNA, 18 nt, Homo sapiens
gacuccauuucagccaga

SEQ ID NO: 279920 - RNA, 22 nt, Homo sapiens
gacugaggaagcgcucucuccu

SEQ ID NO: 279921 - RNA, 22 nt, Homo sapiens
gacugaguaagcagaagcaauu

SEQ ID NO: 279922 - RNA, 22 nt, Homo sapiens
gacuggccauugauacagaggu

SEQ ID NO: 279923 - RNA, 16 nt, Homo sapiens
gacugggcugaggaau

SEQ ID NO: 279924 - RNA, 22 nt, Homo sapiens
gacuucaucauacuaugugugg

SEQ ID NO: 279925 - RNA, 22 nt, Homo sapiens
gacuuugguaaacucgguggca

SEQ ID NO: 279926 - RNA, 22 nt, Homo sapiens
gacuuugguagaggaaaaaucu

SEQ ID NO: 279927 - RNA, 22 nt, Homo sapiens
gagacagugucagccauugaaa

SEQ ID NO: 279928 - RNA, 22 nt, Homo sapiens
gagacggagucucgcucuguca

SEQ ID NO: 279929 - RNA, 22 nt, Homo sapiens
gagacugagucucgcucugccg

SEQ ID NO: 279930 - RNA, 22 nt, Homo sapiens
gagacugagucuugcucuguca

SEQ ID NO: 279931 - RNA, 22 nt, Homo sapiens
gagacugaguuuugcucuuguu

SEQ ID NO: 279932 - RNA, 22 nt, Homo sapiens
gagagugaaguuugcuaccugu

SEQ ID NO: 279933 - RNA, 22 nt, Homo sapiens
gagagugcuuggcaucugcuga

SEQ ID NO: 279934 - RNA, 22 nt, Homo sapiens
gagauagguauuucauuuaccc

SEQ ID NO: 279935 - RNA, 22 nt, Homo sapiens
gagaucaaguauucuccacuaa

SEQ ID NO: 279936 - RNA, 22 nt, Homo sapiens
gagaucaguuaaugaagugagc

SEQ ID NO: 279937 - RNA, 22 nt, Homo sapiens
gagaucauguacuagaacaccu

SEQ ID NO: 279938 - RNA, 22 nt, Homo sapiens
gagaucuauuccucacccuucu

SEQ ID NO: 279939 - RNA, 22 nt, Homo sapiens
gagaucuuggccaaguuucuua

SEQ ID NO: 279940 - RNA, 22 nt, Homo sapiens
gagauuaauacacaucaaaugc

SEQ ID NO: 279941 - RNA, 22 nt, Homo sapiens
gagauuauuuaaaaggugauuu

SEQ ID NO: 279942 - RNA, 22 nt, Homo sapiens
gagauuuucagcuugacuggga

SEQ ID NO: 279943 - RNA, 22 nt, Homo sapiens
gagcaacaguggcagugguggg

SEQ ID NO: 279944 - RNA, 22 nt, Homo sapiens
gagcaccagucccugucagugc

SEQ ID NO: 279945 - RNA, 22 nt, Homo sapiens
gagcacccuuuguugauugcaa

SEQ ID NO: 279946 - RNA, 20 nt, Homo sapiens
gagcaucacaggccucugcu

SEQ ID NO: 279947 - RNA, 22 nt, Homo sapiens
gagcaucaguggccucaucuca

SEQ ID NO: 279948 - RNA, 22 nt, Homo sapiens
gagcuagcauuuagacaucugg

SEQ ID NO: 279949 - RNA, 22 nt, Homo sapiens
gagcucauuaaaguaggaccua

SEQ ID NO: 279950 - RNA, 22 nt, Homo sapiens
gagcugguccuuuaaggaugca

SEQ ID NO: 279951 - RNA, 22 nt, Homo sapiens
gagcuguugguuugaaagaauu

SEQ ID NO: 279952 - RNA, 22 nt, Homo sapiens
gagcuuggguuaaaguugccuu

SEQ ID NO: 279953 - RNA, 22 nt, Homo sapiens
gagcuuguagugugaaugguau

SEQ ID NO: 279954 - RNA, 22 nt, Homo sapiens
gaggaaguagcuacugucuuuc

SEQ ID NO: 279955 - RNA, 22 nt, Homo sapiens
gaggaguagggcacaaagccuu

SEQ ID NO: 279956 - RNA, 22 nt, Homo sapiens
gaggcaauaugagggaggcuuc

SEQ ID NO: 279957 - RNA, 22 nt, Homo sapiens
gaggcaguguguccguucucgg

SEQ ID NO: 279958 - RNA, 22 nt, Homo sapiens
gaggcauuauucccaucuuaca

SEQ ID NO: 279959 - RNA, 22 nt, Homo sapiens
gaggcauugaagauauggaagu

SEQ ID NO: 279960 - RNA, 22 nt, Homo sapiens
gaggcuagauggggaugugucc

SEQ ID NO: 279961 - RNA, 22 nt, Homo sapiens
gagguaagaaagucaguccuuc

SEQ ID NO: 279962 - RNA, 22 nt, Homo sapiens
gagguaggggccuuaaagaugc

SEQ ID NO: 279963 - RNA, 22 nt, Homo sapiens
gagguaugauugacauauaaaa

SEQ ID NO: 279964 - RNA, 22 nt, Homo sapiens
gaggugauaucucauugugguu

SEQ ID NO: 279965 - RNA, 22 nt, Homo sapiens
gagguguagucaugccaagauc

SEQ ID NO: 279966 - RNA, 22 nt, Homo sapiens
gaguaaaugucacuguugcugu

SEQ ID NO: 279967 - RNA, 23 nt, Homo sapiens
gaguacauuaaaagcccagacug

SEQ ID NO: 279968 - RNA, 22 nt, Homo sapiens
gagugcaauggugccaucucgg

SEQ ID NO: 279969 - RNA, 22 nt, Homo sapiens
gaguuaggaucucacuguguca

SEQ ID NO: 279970 - RNA, 23 nt, Homo sapiens
uggcauuuuaguuagcuucagug

SEQ ID NO: 279971 - RNA, 22 nt, Homo sapiens
uggcauuuugugugaauuagaa

SEQ ID NO: 279972 - RNA, 22 nt, Homo sapiens
uggcauuuuguuuuagaauuag

SEQ ID NO: 279973 - RNA, 22 nt, Homo sapiens
uggccaagagcacagauauugg

SEQ ID NO: 279974 - RNA, 23 nt, Homo sapiens
uggccagaaacuucuuuucaucc

SEQ ID NO: 279975 - RNA, 22 nt, Homo sapiens
gaucuggagguuuuccucauga

SEQ ID NO: 279976 - RNA, 22 nt, Homo sapiens
gaugagguagaagacucagcaa

SEQ ID NO: 279977 - RNA, 22 nt, Homo sapiens
gaugagguaguguaccuagucu

SEQ ID NO: 279978 - RNA, 22 nt, Homo sapiens
gaugauauuugagucauuagaa

SEQ ID NO: 279979 - RNA, 22 nt, Homo sapiens
gaugaucaugaccuacagaugg

SEQ ID NO: 279980 - RNA, 22 nt, Homo sapiens
gauggaauuaaaaucagaauca

SEQ ID NO: 279981 - RNA, 22 nt, Homo sapiens
gauggaguugucgccugggcug

SEQ ID NO: 279982 - RNA, 22 nt, Homo sapiens
gauggcauuucuggaucugccc

SEQ ID NO: 279983 - RNA, 22 nt, Homo sapiens
gaugguggucuacccuuucccu

SEQ ID NO: 279984 - RNA, 22 nt, Homo sapiens
gauggugucccaggcucaggcu

SEQ ID NO: 279985 - RNA, 22 nt, Homo sapiens
gaugguuuuucuccgauuuaua

SEQ ID NO: 279986 - RNA, 22 nt, Homo sapiens
gauguguuuuaggaucucagca

SEQ ID NO: 279987 - RNA, 22 nt, Homo sapiens
gauuguguucauaggcauguua

SEQ ID NO: 279988 - RNA, 22 nt, Homo sapiens
gcaacugguuucaguuuuucag

SEQ ID NO: 279989 - RNA, 22 nt, Homo sapiens
gcaaugcugucugugcacagau

SEQ ID NO: 279990 - RNA, 22 nt, Homo sapiens
gcacacguagaagcaugcauca

SEQ ID NO: 279991 - RNA, 22 nt, Homo sapiens
gcacagucaacacuuauucacc

SEQ ID NO: 279992 - RNA, 22 nt, Homo sapiens
gcacaguggcucccgucuauaa

SEQ ID NO: 279993 - RNA, 22 nt, Homo sapiens
gcacaguguuacuugauauauu

SEQ ID NO: 279994 - RNA, 22 nt, Homo sapiens
gcacauggccccaucgugccga

SEQ ID NO: 279995 - RNA, 22 nt, Homo sapiens
gcaccguggaguauggggagga

SEQ ID NO: 279996 - RNA, 22 nt, Homo sapiens
gcagaauugguuucuucuaagg

SEQ ID NO: 279997 - RNA, 22 nt, Homo sapiens
gcagaguauagagggcugggcc

SEQ ID NO: 279998 - RNA, 22 nt, Homo sapiens
gcagcacauggcagaacauauu

SEQ ID NO: 279999 - RNA, 17 nt, Homo sapiens
gcaguacuuaguaagga

SEQ ID NO: 280000 - RNA, 20 nt, Homo sapiens
gcaguacuuuuaguucuaag

SEQ ID NO: 280001 - RNA, 22 nt, Homo sapiens
gcaguagugugaucuuggcuca

SEQ ID NO: 280002 - RNA, 22 nt, Homo sapiens
gcagucacagggagauggugac

SEQ ID NO: 280003 - RNA, 22 nt, Homo sapiens
gcagugaugugaucauagcuca

SEQ ID NO: 280004 - RNA, 20 nt, Homo sapiens
gcaguguucugaccugaauc

SEQ ID NO: 280005 - RNA, 22 nt, Homo sapiens
gcauauguuuggguguguauau

SEQ ID NO: 280006 - RNA, 22 nt, Homo sapiens
gcauauuuuaaaguguaaccug

SEQ ID NO: 280007 - RNA, 20 nt, Homo sapiens
gcaugagucuuuauaguaga

SEQ ID NO: 280008 - RNA, 22 nt, Homo sapiens
gcaugaugaauaauaucacaag

SEQ ID NO: 280009 - RNA, 22 nt, Homo sapiens
gccauugcacuccagcuugggc

SEQ ID NO: 280010 - RNA, 22 nt, Homo sapiens
gccauugcacuccgcccugggc

SEQ ID NO: 280011 - RNA, 22 nt, Homo sapiens
gccauugcacucuagccugagc

SEQ ID NO: 280012 - RNA, 22 nt, Homo sapiens
gcccauuguuccuaggcuacaa

SEQ ID NO: 280013 - RNA, 22 nt, Homo sapiens
gcccugagauucuuggauucug

SEQ ID NO: 280014 - RNA, 22 nt, Homo sapiens
gcccuguugcccaggcuggagu

SEQ ID NO: 280015 - RNA, 22 nt, Homo sapiens
gccuuuggugacaggcaugugu

SEQ ID NO: 280016 - RNA, 22 nt, Homo sapiens
gcgugguguuagaaugagaagu

SEQ ID NO: 280017 - RNA, 23 nt, Homo sapiens
gcuaggagagaugaaacacaggu

SEQ ID NO: 280018 - RNA, 16 nt, Homo sapiens
gcucuuguucucuguu

SEQ ID NO: 280019 - RNA, 22 nt, Homo sapiens
gcucuuuugggguaauucugag

SEQ ID NO: 280020 - RNA, 22 nt, Homo sapiens
gcugagacauugguuuucuccu

SEQ ID NO: 280021 - RNA, 22 nt, Homo sapiens
gcugcacuuuaaggcauccccu

SEQ ID NO: 280022 - RNA, 22 nt, Homo sapiens
gcuggucugccguaguaggugc

SEQ ID NO: 280023 - RNA, 20 nt, Homo sapiens
gcugugcuuaauacacuuuc

SEQ ID NO: 280024 - RNA, 19 nt, Homo sapiens
gcuucuugaggacgaugac

SEQ ID NO: 280025 - RNA, 22 nt, Homo sapiens
ggaaagacaccuuacuauguua

SEQ ID NO: 280026 - RNA, 21 nt, Homo sapiens
ggaaaguuaaggaaauacccc

SEQ ID NO: 280027 - RNA, 22 nt, Homo sapiens
ggaaaucaucauucucgguaua

SEQ ID NO: 280028 - RNA, 22 nt, Homo sapiens
ggaagaauaaugggccuuagag

SEQ ID NO: 280029 - RNA, 20 nt, Homo sapiens
ggaagagugacacaagguau

SEQ ID NO: 280030 - RNA, 17 nt, Homo sapiens
ggaagccuuugguuuaa

SEQ ID NO: 280031 - RNA, 22 nt, Homo sapiens
ggaaugagaaauauuacacaau

SEQ ID NO: 280032 - RNA, 22 nt, Homo sapiens
ggaauguuaaagacuacacuga

SEQ ID NO: 280033 - RNA, 21 nt, Homo sapiens
ggaauuuagggaaugauuuag

SEQ ID NO: 280034 - RNA, 22 nt, Homo sapiens
ggacagugaaugccacuccucc

SEQ ID NO: 280035 - RNA, 22 nt, Homo sapiens
ggacuaggagcuaggaagaucu

SEQ ID NO: 280036 - RNA, 22 nt, Homo sapiens
ggacuggaagcauauuuauuuu

SEQ ID NO: 280037 - RNA, 22 nt, Homo sapiens
ggacugucagggcuauuaguca

SEQ ID NO: 280038 - RNA, 22 nt, Homo sapiens
auguuugguaagaauauuguua

SEQ ID NO: 280039 - RNA, 22 nt, Homo sapiens
auuaaauguuggacguauacau

SEQ ID NO: 280040 - RNA, 22 nt, Homo sapiens
auuaagugaaugaaguuguucc

SEQ ID NO: 280041 - RNA, 22 nt, Homo sapiens
auuaaguugugccugaaaacuu

SEQ ID NO: 280042 - RNA, 22 nt, Homo sapiens
auuacauagucaaggugucuca

SEQ ID NO: 280043 - RNA, 22 nt, Homo sapiens
auuagaugguuauaggugugag

SEQ ID NO: 280044 - RNA, 22 nt, Homo sapiens
auuagugaaugugaugucuuga

SEQ ID NO: 280045 - RNA, 22 nt, Homo sapiens
auuauguuguauuuccuugcag

SEQ ID NO: 280046 - RNA, 22 nt, Homo sapiens
auucaagugaugugauucuucu

SEQ ID NO: 280047 - RNA, 22 nt, Homo sapiens
auucacugugcuuggccaaauu

SEQ ID NO: 280048 - RNA, 22 nt, Homo sapiens
auucacuguggcuuucucugau

SEQ ID NO: 280049 - RNA, 22 nt, Homo sapiens
auuccacuuagugacucauuug

SEQ ID NO: 280050 - RNA, 23 nt, Homo sapiens
auuccaguggcaauuggagaaac

SEQ ID NO: 280051 - RNA, 22 nt, Homo sapiens
auuccauagugucuguggcaga

SEQ ID NO: 280052 - RNA, 22 nt, Homo sapiens
auugaacuuacuaucuaaacua

SEQ ID NO: 280053 - RNA, 22 nt, Homo sapiens
auugacuugauauauagcugau

SEQ ID NO: 280054 - RNA, 21 nt, Homo sapiens
auugagcacaugaaacauggc

SEQ ID NO: 280055 - RNA, 22 nt, Homo sapiens
auugcaacuuccgccuccuggg

SEQ ID NO: 280056 - RNA, 21 nt, Homo sapiens
auugcacaauauacccaugua

SEQ ID NO: 280057 - RNA, 22 nt, Homo sapiens
auugcacaccagucugggcaaa

SEQ ID NO: 280058 - RNA, 22 nt, Homo sapiens
auugcacuccagccuaggcaac

SEQ ID NO: 280059 - RNA, 22 nt, Homo sapiens
auugcacuccagccuggcaaua

SEQ ID NO: 280060 - RNA, 21 nt, Homo sapiens
auugcacuccagccugggcga

SEQ ID NO: 280061 - RNA, 22 nt, Homo sapiens
auugcacuccagccuggugaca

SEQ ID NO: 280062 - RNA, 22 nt, Homo sapiens
auugcacuccagucucaccagg

SEQ ID NO: 280063 - RNA, 22 nt, Homo sapiens
auugcagcccacccugggugau

SEQ ID NO: 280064 - RNA, 22 nt, Homo sapiens
auugcaugucauguuuagugua

SEQ ID NO: 280065 - RNA, 22 nt, Homo sapiens
caggcaaggugaaguguacugg

SEQ ID NO: 280066 - RNA, 22 nt, Homo sapiens
caggcagucuggcucccaagug

SEQ ID NO: 280067 - RNA, 22 nt, Homo sapiens
caggcauagucuugaguuuuau

SEQ ID NO: 280068 - RNA, 20 nt, Homo sapiens
cagggcaaugaggagguaaa

SEQ ID NO: 280069 - RNA, 22 nt, Homo sapiens
cagguacaugcaugugugugca

SEQ ID NO: 280070 - RNA, 22 nt, Homo sapiens
cagguaggccaauguuuuccaa

SEQ ID NO: 280071 - RNA, 22 nt, Homo sapiens
cagguaguauuugguuacauaa

SEQ ID NO: 280072 - RNA, 23 nt, Homo sapiens
cagguaguucuuuauaguagugu

SEQ ID NO: 280073 - RNA, 22 nt, Homo sapiens
caggugaaugccucuccuucug

SEQ ID NO: 280074 - RNA, 22 nt, Homo sapiens
caguagcaugccucagaaugag

SEQ ID NO: 280075 - RNA, 19 nt, Homo sapiens
caguaucauugcacauagu

SEQ ID NO: 280076 - RNA, 22 nt, Homo sapiens
cagucacagugacaggaugugg

SEQ ID NO: 280077 - RNA, 22 nt, Homo sapiens
cagugauaggugguuguuggca

SEQ ID NO: 280078 - RNA, 22 nt, Homo sapiens
cagugcauaggaucuaaaauuu

SEQ ID NO: 280079 - RNA, 20 nt, Homo sapiens
cagugcauugcuucugauuu

SEQ ID NO: 280080 - RNA, 22 nt, Homo sapiens
cagugguuuucaacccugguug

SEQ ID NO: 280081 - RNA, 22 nt, Homo sapiens
cagugguuuuuagcuugcuggg

SEQ ID NO: 280082 - RNA, 22 nt, Homo sapiens
cagugucugcauuuggaacuca

SEQ ID NO: 280083 - RNA, 22 nt, Homo sapiens
caguguuuuuaacaggugcccg

SEQ ID NO: 280084 - RNA, 21 nt, Homo sapiens
cauaaugcuacuuauuuuaug

SEQ ID NO: 280085 - RNA, 22 nt, Homo sapiens
cauacaugugcuugucuuaugc

SEQ ID NO: 280086 - RNA, 22 nt, Homo sapiens
cauauucacuuuacagagcugu

SEQ ID NO: 280087 - RNA, 22 nt, Homo sapiens
caucacacuuggauguaagaca

SEQ ID NO: 280088 - RNA, 23 nt, Homo sapiens
caucacagagccuuccuugacuc

SEQ ID NO: 280089 - RNA, 22 nt, Homo sapiens
caucacagcaaguagggagugg

SEQ ID NO: 280090 - RNA, 22 nt, Homo sapiens
caucacaguacuaaucgucaua

SEQ ID NO: 280091 - RNA, 22 nt, Homo sapiens
caucacaucugcaugguaagua

SEQ ID NO: 280092 - RNA, 22 nt, Homo sapiens
caucagauugagaucaucuaag

SEQ ID NO: 280093 - RNA, 22 nt, Homo sapiens
caucagcaauguaugaggguuc

SEQ ID NO: 280094 - RNA, 22 nt, Homo sapiens
caucauugcacccuauagagaa

SEQ ID NO: 280095 - RNA, 22 nt, Homo sapiens
caugaaagugagaaacuccugg

SEQ ID NO: 280096 - RNA, 22 nt, Homo sapiens
caugacacauguuuaccuaugu

SEQ ID NO: 280097 - RNA, 22 nt, Homo sapiens
caugacacuggcauguuucuuu

SEQ ID NO: 280098 - RNA, 22 nt, Homo sapiens
caugauauugcagaauguuggu

SEQ ID NO: 280099 - RNA, 22 nt, Homo sapiens
caugcauagccauucauucguu

SEQ ID NO: 280100 - RNA, 22 nt, Homo sapiens
cauggcacugagcagguaugca

SEQ ID NO: 280101 - RNA, 22 nt, Homo sapiens
cauggcuuuuauaacaagaaau

SEQ ID NO: 280102 - RNA, 22 nt, Homo sapiens
cauggucaccuuccaaguuauu

SEQ ID NO: 280103 - RNA, 22 nt, Homo sapiens
caugucuuuuauucugugugau

SEQ ID NO: 280104 - RNA, 22 nt, Homo sapiens
cauuacacuccagccuggguga

SEQ ID NO: 280105 - RNA, 22 nt, Homo sapiens
cauugcacuccagccugaggga

SEQ ID NO: 280106 - RNA, 20 nt, Homo sapiens
cauugcacuccagccugcug

SEQ ID NO: 280107 - RNA, 22 nt, Homo sapiens
cauugcacuccagccuuggcaa

SEQ ID NO: 280108 - RNA, 22 nt, Homo sapiens
cauugcaguggaguggggaaga

SEQ ID NO: 280109 - RNA, 20 nt, Homo sapiens
cauugcccuccagccugggc

SEQ ID NO: 280110 - RNA, 22 nt, Homo sapiens
cauugguuccaguuuguccuua

SEQ ID NO: 280111 - RNA, 22 nt, Homo sapiens
cauugucccucaaugucuauga

SEQ ID NO: 280112 - RNA, 22 nt, Homo sapiens
cauuugcacugagacucagcuu

SEQ ID NO: 280113 - RNA, 22 nt, Homo sapiens
cauuuuacuuuccagacgugga

SEQ ID NO: 280114 - RNA, 22 nt, Homo sapiens
ccaaaguauuuucacugauauc

SEQ ID NO: 280115 - RNA, 22 nt, Homo sapiens
ccaaaucucauguugaaaugug

SEQ ID NO: 280116 - RNA, 19 nt, Homo sapiens
ccacaaugguugaacuaga

SEQ ID NO: 280117 - RNA, 22 nt, Homo sapiens
ccacaguggauuaaaguuacug

SEQ ID NO: 280118 - RNA, 22 nt, Homo sapiens
ccacauuaccuugcuugcucca

SEQ ID NO: 280119 - RNA, 22 nt, Homo sapiens
ccaccuguacuuaagucacuuu

SEQ ID NO: 280120 - RNA, 22 nt, Homo sapiens
ccacugggcaguuuauuaucag

SEQ ID NO: 280121 - RNA, 22 nt, Homo sapiens
ccacugugguaucugauacugg

SEQ ID NO: 280122 - RNA, 22 nt, Homo sapiens
ccagaguggagccuuugcgagg

SEQ ID NO: 280123 - RNA, 22 nt, Homo sapiens
ccagaguucuaggcauuggaaa

SEQ ID NO: 280124 - RNA, 22 nt, Homo sapiens
ccaggguuccacgccuggcugu

SEQ ID NO: 280125 - RNA, 23 nt, Homo sapiens
ccaguauuuauguaaggaagugu

SEQ ID NO: 280126 - RNA, 22 nt, Homo sapiens
ccagucuuggugucuguagcac

SEQ ID NO: 280127 - RNA, 22 nt, Homo sapiens
ccagugcauggaucccaggggg

SEQ ID NO: 280128 - RNA, 22 nt, Homo sapiens
ccaguuuucucacuguugcagu

SEQ ID NO: 280129 - RNA, 20 nt, Homo sapiens
ccaucaguccucucuuguuc

SEQ ID NO: 280130 - RNA, 22 nt, Homo sapiens
ccauggcuucugcauucuguca

SEQ ID NO: 280131 - RNA, 22 nt, Homo sapiens
ccauugcacuccagccuaggca

SEQ ID NO: 280132 - RNA, 22 nt, Homo sapiens
ccauugcacuucagccuaggug

SEQ ID NO: 280133 - RNA, 22 nt, Homo sapiens
cccaguaaucuugccaguuuuc

SEQ ID NO: 280134 - RNA, 18 nt, Homo sapiens
cccagugacuuauggccu

SEQ ID NO: 280135 - RNA, 22 nt, Homo sapiens
cccagugguuacauaaggagua

SEQ ID NO: 280136 - RNA, 22 nt, Homo sapiens
cccaguguuacgugacagccug

SEQ ID NO: 280137 - RNA, 22 nt, Homo sapiens
cccaguuuugcuucucaugagg

SEQ ID NO: 280138 - RNA, 22 nt, Homo sapiens
cccgugucuuggucuagggccu

SEQ ID NO: 280139 - RNA, 22 nt, Homo sapiens
cccugaagauacagaguuuggg

SEQ ID NO: 280140 - RNA, 22 nt, Homo sapiens
cccuggacacacacuuuuauuc

SEQ ID NO: 280141 - RNA, 21 nt, Homo sapiens
cccugguguuuggaguuugag

SEQ ID NO: 280142 - RNA, 22 nt, Homo sapiens
cccuguguuuagcugaagguuu

SEQ ID NO: 280143 - RNA, 22 nt, Homo sapiens
cccuugcacuucagagcugcau

SEQ ID NO: 280144 - RNA, 22 nt, Homo sapiens
ccggguguuuuguucucucaga

SEQ ID NO: 280145 - RNA, 21 nt, Homo sapiens
ccucuuugagggaagaaaggg

SEQ ID NO: 280146 - RNA, 22 nt, Homo sapiens
ccuggaaugaagcuuauauugc

SEQ ID NO: 280147 - RNA, 22 nt, Homo sapiens
ccuggguuacaggugugagcca

SEQ ID NO: 280148 - RNA, 22 nt, Homo sapiens
ccugucuugaagagauccuccu

SEQ ID NO: 280149 - RNA, 22 nt, Homo sapiens
aaagugcuuacuaaguugccaa

SEQ ID NO: 280150 - RNA, 22 nt, Homo sapiens
aaaguggugggauuccaggcau

SEQ ID NO: 280151 - RNA, 22 nt, Homo sapiens
aaaguucuugcugaaggauuau

SEQ ID NO: 280152 - RNA, 22 nt, Homo sapiens
aaauaguagcugaaugagggaa

SEQ ID NO: 280153 - RNA, 15 nt, Homo sapiens
aaauaugucaguucu

SEQ ID NO: 280154 - RNA, 22 nt, Homo sapiens
aaaugcaguugguggggauaug

SEQ ID NO: 280155 - RNA, 22 nt, Homo sapiens
aaaugcaucauuaggugauuuu

SEQ ID NO: 280156 - RNA, 22 nt, Homo sapiens
aaaugcaugaggugggaagaaa

SEQ ID NO: 280157 - RNA, 22 nt, Homo sapiens
aaaugcccuaaaauggagcauc

SEQ ID NO: 280158 - RNA, 22 nt, Homo sapiens
aaaugcucucuacacguuucug

SEQ ID NO: 280159 - RNA, 20 nt, Homo sapiens
aaaugcuguaauguuuggga

SEQ ID NO: 280160 - RNA, 22 nt, Homo sapiens
aaaugcugucaaauuguguucu

SEQ ID NO: 280161 - RNA, 22 nt, Homo sapiens
aaauggcuuugaggguaggaca

SEQ ID NO: 280162 - RNA, 22 nt, Homo sapiens
aaauggcuuuuugggcaaggug

SEQ ID NO: 280163 - RNA, 22 nt, Homo sapiens
aaauugcaguuaggaugauggu

SEQ ID NO: 280164 - RNA, 22 nt, Homo sapiens
aaauugcauugagcugcuuauu

SEQ ID NO: 280165 - RNA, 22 nt, Homo sapiens
aacagagcuggugacuccaggu

SEQ ID NO: 280166 - RNA, 22 nt, Homo sapiens
aacagauugcugagccccaccc

SEQ ID NO: 280167 - RNA, 22 nt, Homo sapiens
aacagcauaguacccgugauaa

SEQ ID NO: 280168 - RNA, 22 nt, Homo sapiens
aacaggcuccuaggggugcacc

SEQ ID NO: 280169 - RNA, 22 nt, Homo sapiens
aacagugcauucagggauauau

SEQ ID NO: 280170 - RNA, 22 nt, Homo sapiens
aacauagucaugggguaauguu

SEQ ID NO: 280171 - RNA, 15 nt, Homo sapiens
aaccuggaggagcuu

SEQ ID NO: 280172 - RNA, 22 nt, Homo sapiens
aaccuguggauuuugguaucug

SEQ ID NO: 280173 - RNA, 22 nt, Homo sapiens
aaccuucauuccuuucccugcc

SEQ ID NO: 280174 - RNA, 22 nt, Homo sapiens
aacuaggccuagaaguugagua

SEQ ID NO: 280175 - RNA, 22 nt, Homo sapiens
aacugcacauauuuguaugggu

SEQ ID NO: 280176 - RNA, 22 nt, Homo sapiens
aacuggcauagccagacuucuc

SEQ ID NO: 280177 - RNA, 22 nt, Homo sapiens
aacuggucuuuggaggaggagg

SEQ ID NO: 280178 - RNA, 22 nt, Homo sapiens
aagagaugaagguccugacugu

SEQ ID NO: 280179 - RNA, 22 nt, Homo sapiens
aagaggcuguaggauaaugccu

SEQ ID NO: 280180 - RNA, 23 nt, Homo sapiens
aagagguaugacuaugaagugga

SEQ ID NO: 280181 - RNA, 22 nt, Homo sapiens
aagagugucuuugugcuggccc

SEQ ID NO: 280182 - RNA, 22 nt, Homo sapiens
aagauagcuaagcuucuucuaa

SEQ ID NO: 280183 - RNA, 22 nt, Homo sapiens
aagaugauguuguguuuucacu

SEQ ID NO: 280184 - RNA, 19 nt, Homo sapiens
aagaugauguuugggcuaa

SEQ ID NO: 280185 - RNA, 22 nt, Homo sapiens
aagaugcagucauacuggagua

SEQ ID NO: 280186 - RNA, 22 nt, Homo sapiens
aagaugguauuucauuaguuuu

SEQ ID NO: 280187 - RNA, 22 nt, Homo sapiens
aagcacaauuucaccuucuugu

SEQ ID NO: 280188 - RNA, 22 nt, Homo sapiens
aagcagacauguucauuuugaa

SEQ ID NO: 280189 - RNA, 22 nt, Homo sapiens
aagcaucacuggaggcagccau

SEQ ID NO: 280190 - RNA, 22 nt, Homo sapiens
aagcugcauuuucuagaugcuu

SEQ ID NO: 280191 - RNA, 22 nt, Homo sapiens
aagcugccuugcugaggagaaa

SEQ ID NO: 280192 - RNA, 22 nt, Homo sapiens
aagcuggauuuaguguggagca

SEQ ID NO: 280193 - RNA, 22 nt, Homo sapiens
aagcuggcauucaugagauuac

SEQ ID NO: 280194 - RNA, 22 nt, Homo sapiens
aagcugguguugcugcucuguu

SEQ ID NO: 280195 - RNA, 22 nt, Homo sapiens
aaggaauacuggugguugcuau

SEQ ID NO: 280196 - RNA, 22 nt, Homo sapiens
aaggaauucaaauuuucucugg

SEQ ID NO: 280197 - RNA, 22 nt, Homo sapiens
aaggagcuuaagugacuuguac

SEQ ID NO: 280198 - RNA, 22 nt, Homo sapiens
aaggaguauugaaugaccaagu

SEQ ID NO: 280199 - RNA, 22 nt, Homo sapiens
aaggcuguuguguaauaggauu

SEQ ID NO: 280200 - RNA, 22 nt, Homo sapiens
aagggaaugcuuccaguuugug

SEQ ID NO: 280201 - RNA, 22 nt, Homo sapiens
aagggaauguuguggcugguuu

SEQ ID NO: 280202 - RNA, 22 nt, Homo sapiens
agucacaugccagcacacccag

SEQ ID NO: 280203 - RNA, 22 nt, Homo sapiens
agucagauuggcauuuguuggg

SEQ ID NO: 280204 - RNA, 22 nt, Homo sapiens
agucagucuguccugugcugag

SEQ ID NO: 280205 - RNA, 22 nt, Homo sapiens
agucagugcauaagaaugaagu

SEQ ID NO: 280206 - RNA, 22 nt, Homo sapiens
agucaguggaguaaauguaauu

SEQ ID NO: 280207 - RNA, 22 nt, Homo sapiens
agucagugucuguaaggagaac

SEQ ID NO: 280208 - RNA, 20 nt, Homo sapiens
agucaguuuauuuucucucu

SEQ ID NO: 280209 - RNA, 22 nt, Homo sapiens
agucauagaguuugcccuucuc

SEQ ID NO: 280210 - RNA, 21 nt, Homo sapiens
agucauaggaguacauaaugc

SEQ ID NO: 280211 - RNA, 22 nt, Homo sapiens
auggaaaugaagggcuggcccu

SEQ ID NO: 280212 - RNA, 22 nt, Homo sapiens
auggaauggcacuuugaagauu

SEQ ID NO: 280213 - RNA, 22 nt, Homo sapiens
auggaauguaaguuauguuugc

SEQ ID NO: 280214 - RNA, 22 nt, Homo sapiens
aucacuggucaugagagaagua

SEQ ID NO: 280215 - RNA, 21 nt, Homo sapiens
aucagagacccaggcuuccuc

SEQ ID NO: 280216 - RNA, 23 nt, Homo sapiens
aucagauaguuguagguaugugg

SEQ ID NO: 280217 - RNA, 22 nt, Homo sapiens
aucagauuccacauuuuaucag

SEQ ID NO: 280218 - RNA, 22 nt, Homo sapiens
aucaucacaguuguguguaaug

SEQ ID NO: 280219 - RNA, 22 nt, Homo sapiens
aucauccugucaggagcuguga

SEQ ID NO: 280220 - RNA, 22 nt, Homo sapiens
auugaauuugguuugcuaagaa

SEQ ID NO: 280221 - RNA, 22 nt, Homo sapiens
auugagcacugacucugugcca

SEQ ID NO: 280222 - RNA, 22 nt, Homo sapiens
auugaggcauguaccaaugguc

SEQ ID NO: 280223 - RNA, 19 nt, Homo sapiens
acaguauugugcacagguu

SEQ ID NO: 280224 - RNA, 22 nt, Homo sapiens
acagucacaauuuguaccuuuu

SEQ ID NO: 280225 - RNA, 23 nt, Homo sapiens
acagucuaguuugaagucaggua

SEQ ID NO: 280226 - RNA, 22 nt, Homo sapiens
acagugcuucugauaugaugcc

SEQ ID NO: 280227 - RNA, 22 nt, Homo sapiens
acaguggugcgaucucggcuca

SEQ ID NO: 280228 - RNA, 23 nt, Homo sapiens
acaguggugugaucuuggcucag

SEQ ID NO: 280229 - RNA, 18 nt, Homo sapiens
acagugucauggcucaau

SEQ ID NO: 280230 - RNA, 19 nt, Homo sapiens
acagugucucuauaaugau

SEQ ID NO: 280231 - RNA, 22 nt, Homo sapiens
acaucacuguuugauugauuga

SEQ ID NO: 280232 - RNA, 22 nt, Homo sapiens
acaucccuugcucggggccccu

SEQ ID NO: 280233 - RNA, 22 nt, Homo sapiens
acaugacauugggguggggaua

SEQ ID NO: 280234 - RNA, 22 nt, Homo sapiens
acaugcauauguuggaagaaag

SEQ ID NO: 280235 - RNA, 22 nt, Homo sapiens
acauggcuuaugaauuuggaga

SEQ ID NO: 280236 - RNA, 21 nt, Homo sapiens
acauguacacauguaugcaca

SEQ ID NO: 280237 - RNA, 18 nt, Homo sapiens
acauucagcuugaagaua

SEQ ID NO: 280238 - RNA, 22 nt, Homo sapiens
accauugcacuccagccugggc

SEQ ID NO: 280239 - RNA, 22 nt, Homo sapiens
acccagaagucauucaggaaca

SEQ ID NO: 280240 - RNA, 22 nt, Homo sapiens
acccuacauaguagauccuaca

SEQ ID NO: 280241 - RNA, 22 nt, Homo sapiens
acccugacacgauucuucacuu

SEQ ID NO: 280242 - RNA, 22 nt, Homo sapiens
acccuguaggugcuggcagaga

SEQ ID NO: 280243 - RNA, 22 nt, Homo sapiens
acccugucaaaauggaccaauc

SEQ ID NO: 280244 - RNA, 22 nt, Homo sapiens
acccugucacucccaucaauuu

SEQ ID NO: 280245 - RNA, 22 nt, Homo sapiens
acccugucagcuggccugggca

SEQ ID NO: 280246 - RNA, 22 nt, Homo sapiens
acccuuaagcacuaguucagcu

SEQ ID NO: 280247 - RNA, 18 nt, Homo sapiens
acccuucagcacugggcc

SEQ ID NO: 280248 - RNA, 22 nt, Homo sapiens
accugcacagccgaacauagac

SEQ ID NO: 280249 - RNA, 23 nt, Homo sapiens
accugugguuauuuuacucuucc

SEQ ID NO: 280250 - RNA, 22 nt, Homo sapiens
accuuguagcaaaccuaacaua

SEQ ID NO: 280251 - RNA, 19 nt, Homo sapiens
acuaggccuacaaagcuau

SEQ ID NO: 280252 - RNA, 22 nt, Homo sapiens
acucagagaacauucccagucu

SEQ ID NO: 280253 - RNA, 21 nt, Homo sapiens
acugagagaucuggggcacau

SEQ ID NO: 280254 - RNA, 23 nt, Homo sapiens
acugagcaauguuuacauacuug

SEQ ID NO: 280255 - RNA, 22 nt, Homo sapiens
acugagucauugaggcccucuc

SEQ ID NO: 280256 - RNA, 22 nt, Homo sapiens
acugcacuccagcccaggugac

SEQ ID NO: 280257 - RNA, 22 nt, Homo sapiens
acugcacuccagccucgcaaca

SEQ ID NO: 280258 - RNA, 22 nt, Homo sapiens
acugcacuccagccucggggac

SEQ ID NO: 280259 - RNA, 22 nt, Homo sapiens
acugcacuccagccucgugaca

SEQ ID NO: 280260 - RNA, 22 nt, Homo sapiens
acugcacuccagccugugagac

SEQ ID NO: 280261 - RNA, 22 nt, Homo sapiens
acugcacuccagccuugagagc

SEQ ID NO: 280262 - RNA, 22 nt, Homo sapiens
acugcacuccagccuuggcaac

SEQ ID NO: 280263 - RNA, 22 nt, Homo sapiens
acugcacuccagcuccagggug

SEQ ID NO: 280264 - RNA, 22 nt, Homo sapiens
acugcacuccagcuuuggguga

SEQ ID NO: 280265 - RNA, 22 nt, Homo sapiens
acugcacuccagcuuuggugac

SEQ ID NO: 280266 - RNA, 22 nt, Homo sapiens
acugcacuccggccuggcaaca

SEQ ID NO: 280267 - RNA, 22 nt, Homo sapiens
acugcacucuagcauggguaau

SEQ ID NO: 280268 - RNA, 22 nt, Homo sapiens
acugcacucuagccuuggcaac

SEQ ID NO: 280269 - RNA, 22 nt, Homo sapiens
acugcacuguccuagaguccuc

SEQ ID NO: 280270 - RNA, 22 nt, Homo sapiens
acugcacuucagccuugggaaa

SEQ ID NO: 280271 - RNA, 22 nt, Homo sapiens
acugcacuucagccuugugaca

SEQ ID NO: 280272 - RNA, 22 nt, Homo sapiens
acuggaguuuguucaagaaaua

SEQ ID NO: 280273 - RNA, 22 nt, Homo sapiens
acuggcaauggcagaaauaguu

SEQ ID NO: 280274 - RNA, 22 nt, Homo sapiens
cugagaucugaaccaggagugu

SEQ ID NO: 280275 - RNA, 22 nt, Homo sapiens
cugagauggagucucgcauugu

SEQ ID NO: 280276 - RNA, 22 nt, Homo sapiens
cugagcaaagaagugauaauga

SEQ ID NO: 280277 - RNA, 22 nt, Homo sapiens
cugaggcacggcgaccuuaagu

SEQ ID NO: 280278 - RNA, 22 nt, Homo sapiens
cugagguaggugaucagugcuu

SEQ ID NO: 280279 - RNA, 22 nt, Homo sapiens
cugagguauaucccauuagaag

SEQ ID NO: 280280 - RNA, 22 nt, Homo sapiens
cugaggugggagaaucacauaa

SEQ ID NO: 280281 - RNA, 22 nt, Homo sapiens
cugaguauaacugaccuuauga

SEQ ID NO: 280282 - RNA, 22 nt, Homo sapiens
cugauauuuuucuggcuugugu

SEQ ID NO: 280283 - RNA, 22 nt, Homo sapiens
cugaucuggaggugucugggga

SEQ ID NO: 280284 - RNA, 21 nt, Homo sapiens
cugcauccauuucugagugau

SEQ ID NO: 280285 - RNA, 19 nt, Homo sapiens
cugcaugagacaguugguu

SEQ ID NO: 280286 - RNA, 22 nt, Homo sapiens
cugccacugacaccucaaggac

SEQ ID NO: 280287 - RNA, 18 nt, Homo sapiens
cugccagugugcucuccg

SEQ ID NO: 280288 - RNA, 22 nt, Homo sapiens
cuggaaacaucuuaggaaugca

SEQ ID NO: 280289 - RNA, 22 nt, Homo sapiens
cuggaaagcaaagggugcauug

SEQ ID NO: 280290 - RNA, 22 nt, Homo sapiens
cuggaaagcaaguccauugcuc

SEQ ID NO: 280291 - RNA, 22 nt, Homo sapiens
cuggaagaaaaucacgccaucu

SEQ ID NO: 280292 - RNA, 22 nt, Homo sapiens
cuggaauauuagcuggucuuaa

SEQ ID NO: 280293 - RNA, 22 nt, Homo sapiens
cuggacaaaucuggaaagaacc

SEQ ID NO: 280294 - RNA, 22 nt, Homo sapiens
cuggauagagauugaugaugcu

SEQ ID NO: 280295 - RNA, 22 nt, Homo sapiens
cuggcaaauguuuucuguaaag

SEQ ID NO: 280296 - RNA, 22 nt, Homo sapiens
cuggcaagagugaaccagcugu

SEQ ID NO: 280297 - RNA, 22 nt, Homo sapiens
cuguaauguaaugagacuacau

SEQ ID NO: 280298 - RNA, 22 nt, Homo sapiens
cuguaugugagaaauaauaagu

SEQ ID NO: 280299 - RNA, 22 nt, Homo sapiens
cuguauguuucuaugaauguga

SEQ ID NO: 280300 - RNA, 22 nt, Homo sapiens
cugucucagccucuccaguagc

SEQ ID NO: 280301 - RNA, 17 nt, Homo sapiens
cugugaugaucuugucu

SEQ ID NO: 280302 - RNA, 22 nt, Homo sapiens
cugugcaaguuauaggccaggu

SEQ ID NO: 280303 - RNA, 22 nt, Homo sapiens
cugugcauaugacuuuauugga

SEQ ID NO: 280304 - RNA, 22 nt, Homo sapiens
cugugcauggauuuuaagauug

SEQ ID NO: 280305 - RNA, 22 nt, Homo sapiens
cugugcauuggaugucucccug

SEQ ID NO: 280306 - RNA, 22 nt, Homo sapiens
cugugcuugauuauaugagugu

SEQ ID NO: 280307 - RNA, 22 nt, Homo sapiens
cugugguauuauuagaaauauc

SEQ ID NO: 280308 - RNA, 22 nt, Homo sapiens
cugugguguaacucuuggggcg

SEQ ID NO: 280309 - RNA, 22 nt, Homo sapiens
cuguuagguuaaggaauggcaa

SEQ ID NO: 280310 - RNA, 22 nt, Homo sapiens
cuguugcaguuauggcugcagg

SEQ ID NO: 280311 - RNA, 22 nt, Homo sapiens
cuguuugaggguuugcuuucag

SEQ ID NO: 280312 - RNA, 22 nt, Homo sapiens
cuguuugguaaggaugccucag

SEQ ID NO: 280313 - RNA, 22 nt, Homo sapiens
cuguuugguuaucuuuuccugu

SEQ ID NO: 280314 - RNA, 22 nt, Homo sapiens
cuuacagucuaucagccacaac

SEQ ID NO: 280315 - RNA, 22 nt, Homo sapiens
cuucacggugccuacuuguguc

SEQ ID NO: 280316 - RNA, 22 nt, Homo sapiens
cuucacuggagucccuggauuc

SEQ ID NO: 280317 - RNA, 22 nt, Homo sapiens
cuucaugagacuuuuggaaggc

SEQ ID NO: 280318 - RNA, 22 nt, Homo sapiens
cuuccauaguauuuuuacaaaa

SEQ ID NO: 280319 - RNA, 22 nt, Homo sapiens
cuucucagugcucaucuuauuu

SEQ ID NO: 280320 - RNA, 22 nt, Homo sapiens
cuucugauugaaaauggaguag

SEQ ID NO: 280321 - RNA, 22 nt, Homo sapiens
cuugacacugcaguuuuccugg

SEQ ID NO: 280322 - RNA, 22 nt, Homo sapiens
cuugacacugucacucaggcca

SEQ ID NO: 280323 - RNA, 22 nt, Homo sapiens
cuugagcaaacaaaggugguag

SEQ ID NO: 280324 - RNA, 22 nt, Homo sapiens
cuugcauuuuggagaaugcuga

SEQ ID NO: 280325 - RNA, 19 nt, Homo sapiens
cuugccccauucauccucu

SEQ ID NO: 280326 - RNA, 22 nt, Homo sapiens
cuugccuaaucugcaugauuuu

SEQ ID NO: 280327 - RNA, 22 nt, Homo sapiens
cuuggacaccucaugcccaccu

SEQ ID NO: 280328 - RNA, 22 nt, Homo sapiens
cuuggauuauaauggaauauuu

SEQ ID NO: 280329 - RNA, 22 nt, Homo sapiens
cuuggcaugaagaauaauuuuu

SEQ ID NO: 280330 - RNA, 22 nt, Homo sapiens
cuugugauugcacggcugccug

SEQ ID NO: 280331 - RNA, 22 nt, Homo sapiens
cuuguucuccuaagaugaaugc

SEQ ID NO: 280332 - RNA, 22 nt, Homo sapiens
cuuuacacauccuaaccagugu

SEQ ID NO: 280333 - RNA, 22 nt, Homo sapiens
cuuuagcaauugauuaugccau

SEQ ID NO: 280334 - RNA, 22 nt, Homo sapiens
cuuuaguugucuccucaagggu

SEQ ID NO: 280335 - RNA, 22 nt, Homo sapiens
cuuugcaaauggccuuuccaag

SEQ ID NO: 280336 - RNA, 18 nt, Homo sapiens
cuuugcagcuuccagagg

SEQ ID NO: 280337 - RNA, 20 nt, Homo sapiens
cuuuggcaaugagaacaggg

SEQ ID NO: 280338 - RNA, 22 nt, Homo sapiens
cuuuggcauuagccuguauaga

SEQ ID NO: 280339 - RNA, 21 nt, Homo sapiens
cuuugguagaguuuuuagggu

SEQ ID NO: 280340 - RNA, 22 nt, Homo sapiens
cuuuggucaauugcugcgggga

SEQ ID NO: 280341 - RNA, 22 nt, Homo sapiens
cuuugguguauuuucagagacc

SEQ ID NO: 280342 - RNA, 22 nt, Homo sapiens
cuuugguuaauaggauauggca

SEQ ID NO: 280343 - RNA, 22 nt, Homo sapiens
cuuuguaugucaugacaacugu

SEQ ID NO: 280344 - RNA, 23 nt, Homo sapiens
cuuuguccccacccaaaucucau

SEQ ID NO: 280345 - RNA, 22 nt, Homo sapiens
ucaaugcaaccuccaccucugg

SEQ ID NO: 280346 - RNA, 18 nt, Homo sapiens
ucaauguggauguucuuu

SEQ ID NO: 280347 - RNA, 19 nt, Homo sapiens
ucaauucugucaauggcuu

SEQ ID NO: 280348 - RNA, 22 nt, Homo sapiens
ucaauugcaucaacaguguaca

SEQ ID NO: 280349 - RNA, 22 nt, Homo sapiens
ucacaauggagacucgggcgga

SEQ ID NO: 280350 - RNA, 22 nt, Homo sapiens
ucacacucucaccaacauuugg

SEQ ID NO: 280351 - RNA, 22 nt, Homo sapiens
ucacagacauugaggggaccuu

SEQ ID NO: 280352 - RNA, 22 nt, Homo sapiens
ucacagaugaggcgagaggcag

SEQ ID NO: 280353 - RNA, 18 nt, Homo sapiens
ucacagguaaaguugaca

SEQ ID NO: 280354 - RNA, 18 nt, Homo sapiens
ucacagguaauuaggauu

SEQ ID NO: 280355 - RNA, 22 nt, Homo sapiens
cugaggugggaggauuacuuga

SEQ ID NO: 280356 - RNA, 22 nt, Homo sapiens
cugagguuaggaguuugagacc

SEQ ID NO: 280357 - RNA, 22 nt, Homo sapiens
cugagguuguucuucucagugg

SEQ ID NO: 280358 - RNA, 22 nt, Homo sapiens
cugaguauuugaggccgaagga

SEQ ID NO: 280359 - RNA, 18 nt, Homo sapiens
cugagucauuccuggguc

SEQ ID NO: 280360 - RNA, 22 nt, Homo sapiens
cugauaugaugggugauuuuca

SEQ ID NO: 280361 - RNA, 21 nt, Homo sapiens
cugaucacaggugagcugccu

SEQ ID NO: 280362 - RNA, 22 nt, Homo sapiens
cugaucuguagcagccaccaca

SEQ ID NO: 280363 - RNA, 20 nt, Homo sapiens
cugcacauccacucuacuuc

SEQ ID NO: 280364 - RNA, 22 nt, Homo sapiens
cugcacugagacccucuuugcu

SEQ ID NO: 280365 - RNA, 22 nt, Homo sapiens
cugcauuugaugacguauggug

SEQ ID NO: 280366 - RNA, 22 nt, Homo sapiens
cugcccuuucuauaugauguaa

SEQ ID NO: 280367 - RNA, 22 nt, Homo sapiens
cugccuaaagaaaaagacguug

SEQ ID NO: 280368 - RNA, 22 nt, Homo sapiens
cugcuauauugguucaggcuug

SEQ ID NO: 280369 - RNA, 20 nt, Homo sapiens
cugcuccccuacaaaucuca

SEQ ID NO: 280370 - RNA, 22 nt, Homo sapiens
cuggaaugugagccccaaaaag

SEQ ID NO: 280371 - RNA, 18 nt, Homo sapiens
aaacagugucucuuucug

SEQ ID NO: 280372 - RNA, 22 nt, Homo sapiens
aaaccacagugugcugcugggg

SEQ ID NO: 280373 - RNA, 18 nt, Homo sapiens
aaacugcuuccuuggccu

SEQ ID NO: 280374 - RNA, 22 nt, Homo sapiens
aaagcuaagguagcauuggaga

SEQ ID NO: 280375 - RNA, 22 nt, Homo sapiens
aaaggcacugugacuuuauagg

SEQ ID NO: 280376 - RNA, 22 nt, Homo sapiens
aaagggcuuuguaaacuucaag

SEQ ID NO: 280377 - RNA, 19 nt, Homo sapiens
aaagguaguaaccucugau

SEQ ID NO: 280378 - RNA, 22 nt, Homo sapiens
aaaguaauugcaguuuuugcaa

SEQ ID NO: 280379 - RNA, 20 nt, Homo sapiens
aaaguaggcuaauaccaaaa

SEQ ID NO: 280380 - RNA, 17 nt, Homo sapiens
aaaguccuuugcuaucu

SEQ ID NO: 280381 - RNA, 22 nt, Homo sapiens
aaagucuagaggaucaugugug

SEQ ID NO: 280382 - RNA, 22 nt, Homo sapiens
aaagugauguccaggcuuucag

SEQ ID NO: 280383 - RNA, 22 nt, Homo sapiens
aaagugauuguaguuuuugcca

SEQ ID NO: 280384 - RNA, 22 nt, Homo sapiens
aaagugcaguacuucguauauu

SEQ ID NO: 280385 - RNA, 22 nt, Homo sapiens
aaagugcugagucuaggcgggg

SEQ ID NO: 280386 - RNA, 22 nt, Homo sapiens
aaagugcuuccuuuuugagggu

SEQ ID NO: 280387 - RNA, 22 nt, Homo sapiens
aaagugcuucucuuuggugggu

SEQ ID NO: 280388 - RNA, 22 nt, Homo sapiens
aaagugguuuuucagacuuuga

SEQ ID NO: 280389 - RNA, 22 nt, Homo sapiens
aaaucccuugcucucucagacc

SEQ ID NO: 280390 - RNA, 22 nt, Homo sapiens
aaaugcacagaaaggaugugga

SEQ ID NO: 280391 - RNA, 22 nt, Homo sapiens
aaaugcauugagggaaaaggca

SEQ ID NO: 280392 - RNA, 22 nt, Homo sapiens
aaaugcugcuuuggccucuucu

SEQ ID NO: 280393 - RNA, 22 nt, Homo sapiens
uccaguguuccucagucacccc

SEQ ID NO: 280394 - RNA, 22 nt, Homo sapiens
gauggcuacugauuaaauauag

SEQ ID NO: 280395 - RNA, 22 nt, Homo sapiens
gauuggcauugcugcaccugag

SEQ ID NO: 280396 - RNA, 22 nt, Homo sapiens
gauuugagagaggguguuuaua

SEQ ID NO: 280397 - RNA, 22 nt, Homo sapiens
gauuuguuggccugugagcuag

SEQ ID NO: 280398 - RNA, 22 nt, Homo sapiens
gauuuugguuagggaaggauac

SEQ ID NO: 280399 - RNA, 22 nt, Homo sapiens
gcaaaauugagaagggaauaua

SEQ ID NO: 280400 - RNA, 22 nt, Homo sapiens
gcaaaucuuauguccucacauu

SEQ ID NO: 280401 - RNA, 22 nt, Homo sapiens
gcaagaaucugggaguaaaauu

SEQ ID NO: 280402 - RNA, 22 nt, Homo sapiens
gcaagaauggaacaggagagcc

SEQ ID NO: 280403 - RNA, 22 nt, Homo sapiens
gcacauauguaaauagcugccu

SEQ ID NO: 280404 - RNA, 22 nt, Homo sapiens
gcacauuacaaguauuagcuca

SEQ ID NO: 280405 - RNA, 22 nt, Homo sapiens
gcaccacugcacucucagcuug

SEQ ID NO: 280406 - RNA, 22 nt, Homo sapiens
gcaccaugguagaauaauggua

SEQ ID NO: 280407 - RNA, 22 nt, Homo sapiens
gcaccccuuaccgggcuggguu

SEQ ID NO: 280408 - RNA, 22 nt, Homo sapiens
gcacccugucaaaauggaccaa

SEQ ID NO: 280409 - RNA, 22 nt, Homo sapiens
gcacugagagaagccccaagua

SEQ ID NO: 280410 - RNA, 19 nt, Homo sapiens
gcagagaugugguagcuug

SEQ ID NO: 280411 - RNA, 22 nt, Homo sapiens
gcagaucucuucauuucucuua

SEQ ID NO: 280412 - RNA, 22 nt, Homo sapiens
gcagaucuucgcgguaaguguu

SEQ ID NO: 280413 - RNA, 22 nt, Homo sapiens
gcaggaauuucucugcagaccc

SEQ ID NO: 280414 - RNA, 22 nt, Homo sapiens
gcaguacuuuauguccuaauua

SEQ ID NO: 280415 - RNA, 19 nt, Homo sapiens
gcaguauugaaggccaguc

SEQ ID NO: 280416 - RNA, 22 nt, Homo sapiens
gcagugcuggagcccccgugug

SEQ ID NO: 280417 - RNA, 22 nt, Homo sapiens
gcaguguugugauccaggucuu

SEQ ID NO: 280418 - RNA, 22 nt, Homo sapiens
gcaucacagggagacaggccuc

SEQ ID NO: 280419 - RNA, 22 nt, Homo sapiens
gcauggaaggcgcuuugugacu

SEQ ID NO: 280420 - RNA, 22 nt, Homo sapiens
gcauggagcauacauuucuguu

SEQ ID NO: 280421 - RNA, 22 nt, Homo sapiens
gccaagaagugucuaagcagga

SEQ ID NO: 280422 - RNA, 22 nt, Homo sapiens
gccaagaucugaauaauuaaga

SEQ ID NO: 280423 - RNA, 20 nt, Homo sapiens
gccacaguuaagcuucugcc

SEQ ID NO: 280424 - RNA, 22 nt, Homo sapiens
gccagugugaugugaucauggc

SEQ ID NO: 280425 - RNA, 22 nt, Homo sapiens
gccauugcacuccagccuagcg

SEQ ID NO: 280426 - RNA, 22 nt, Homo sapiens
gcccaguagcaguacaucccuu

SEQ ID NO: 280427 - RNA, 22 nt, Homo sapiens
gccccgggugaugcagccguca

SEQ ID NO: 280428 - RNA, 22 nt, Homo sapiens
gcccugauacauucuucugccu

SEQ ID NO: 280429 - RNA, 22 nt, Homo sapiens
gcccuguguuuggguaugguca

SEQ ID NO: 280430 - RNA, 22 nt, Homo sapiens
gcggguguuuuacccuugcaga

SEQ ID NO: 280431 - RNA, 22 nt, Homo sapiens
gcuacugucuaucugugcuucu

SEQ ID NO: 280432 - RNA, 22 nt, Homo sapiens
gcuagcacauugucaccucuca

SEQ ID NO: 280433 - RNA, 22 nt, Homo sapiens
gcuaggagauccacugcucucu

SEQ ID NO: 280434 - RNA, 22 nt, Homo sapiens
gcuaggagaucugcugcucucu

SEQ ID NO: 280435 - RNA, 22 nt, Homo sapiens
gcuccuuugaguagcuucugug

SEQ ID NO: 280436 - RNA, 22 nt, Homo sapiens
gcucugguuacaaaggcaaauu

SEQ ID NO: 280437 - RNA, 22 nt, Homo sapiens
gcugacagugguuauacuuaga

SEQ ID NO: 280438 - RNA, 22 nt, Homo sapiens
gcugauguugaccuugaucacc

SEQ ID NO: 280439 - RNA, 22 nt, Homo sapiens
gcugcuguaccagaugugguua

SEQ ID NO: 280440 - RNA, 22 nt, Homo sapiens
gcugcuguuuaguuucuccugg

SEQ ID NO: 280441 - RNA, 22 nt, Homo sapiens
gcuggauguuucaauacaaaua

SEQ ID NO: 280442 - RNA, 22 nt, Homo sapiens
gcuggguucagagugggcugcg

SEQ ID NO: 280443 - RNA, 22 nt, Homo sapiens
gcugucaugagcaacacaugaa

SEQ ID NO: 280444 - RNA, 22 nt, Homo sapiens
gcuuguguuugcuccccagaau

SEQ ID NO: 280445 - RNA, 22 nt, Homo sapiens
gcuuugcaauggcauugaccau

SEQ ID NO: 280446 - RNA, 22 nt, Homo sapiens
gcuuugguucaaccaggcaauu

SEQ ID NO: 280447 - RNA, 22 nt, Homo sapiens
ggaaagaucagcuaaauguaag

SEQ ID NO: 280448 - RNA, 22 nt, Homo sapiens
ggaaagauguaauauuaucuaa

SEQ ID NO: 280449 - RNA, 22 nt, Homo sapiens
ggaaaguccuucuguaggcucc

SEQ ID NO: 280450 - RNA, 22 nt, Homo sapiens
ggaaauguuggugucaugaguu

SEQ ID NO: 280451 - RNA, 22 nt, Homo sapiens
ggaacaccauuuuuccugccuu

SEQ ID NO: 280452 - RNA, 22 nt, Homo sapiens
ggaagacuuagaguagcaucag

SEQ ID NO: 280453 - RNA, 22 nt, Homo sapiens
ggaagguaauugucagcucaua

SEQ ID NO: 280454 - RNA, 22 nt, Homo sapiens
ggaagugcuguguggaagucug

SEQ ID NO: 280455 - RNA, 22 nt, Homo sapiens
ggaauaguauaaauaccacaaa

SEQ ID NO: 280456 - RNA, 22 nt, Homo sapiens
ggaauauaaaacuuuugacagg

SEQ ID NO: 280457 - RNA, 22 nt, Homo sapiens
ggaaugcagugagcauuagaua

SEQ ID NO: 280458 - RNA, 22 nt, Homo sapiens
ggaaugcuaaaauaggaugcug

SEQ ID NO: 280459 - RNA, 22 nt, Homo sapiens
ggaaugggauuugaagucuggc

SEQ ID NO: 280460 - RNA, 22 nt, Homo sapiens
ggaauguauuaaggcauugggc

SEQ ID NO: 280461 - RNA, 20 nt, Homo sapiens
ggaauguuaaucuccaugau

SEQ ID NO: 280462 - RNA, 22 nt, Homo sapiens
ggaauuaaggcaauugaaagcu

SEQ ID NO: 280463 - RNA, 22 nt, Homo sapiens
ggacaaaguauuuucaaaugua

SEQ ID NO: 280464 - RNA, 22 nt, Homo sapiens
aauacugaaaguauuuucaaau

SEQ ID NO: 280465 - RNA, 22 nt, Homo sapiens
guaguuuaucagaaagaauagg

SEQ ID NO: 280466 - RNA, 23 nt, Homo sapiens
guaguuugaugcaauccacuugu

SEQ ID NO: 280467 - RNA, 21 nt, Homo sapiens
guauggcauugauuaguuacu

SEQ ID NO: 280468 - RNA, 22 nt, Homo sapiens
guaugugacuggaacaguagga

SEQ ID NO: 280469 - RNA, 18 nt, Homo sapiens
guauuccagccugaguga

SEQ ID NO: 280470 - RNA, 22 nt, Homo sapiens
guauuguacuacaagcucuuua

SEQ ID NO: 280471 - RNA, 22 nt, Homo sapiens
gucaagugaagcagugggagua

SEQ ID NO: 280472 - RNA, 22 nt, Homo sapiens
gucaccagcuguguuagccccu

SEQ ID NO: 280473 - RNA, 22 nt, Homo sapiens
gucacugccugaggcugaugca

SEQ ID NO: 280474 - RNA, 22 nt, Homo sapiens
gucacugugacggcaguuacau

SEQ ID NO: 280475 - RNA, 22 nt, Homo sapiens
gucacugugaggaggggccagg

SEQ ID NO: 280476 - RNA, 22 nt, Homo sapiens
gucagcuuuuccuuacuuuagg

SEQ ID NO: 280477 - RNA, 22 nt, Homo sapiens
gucaggaugauuuggggaggug

SEQ ID NO: 280478 - RNA, 22 nt, Homo sapiens
gucagggagucucuaucagugg

SEQ ID NO: 280479 - RNA, 22 nt, Homo sapiens
gucagucugucccugccuggcg

SEQ ID NO: 280480 - RNA, 22 nt, Homo sapiens
gucaguuugguuaaucauucca

SEQ ID NO: 280481 - RNA, 22 nt, Homo sapiens
gucauaugcucggaaaauguua

SEQ ID NO: 280482 - RNA, 22 nt, Homo sapiens
gucaucaggacgggucaucugc

SEQ ID NO: 280483 - RNA, 22 nt, Homo sapiens
gucauggaaaucuacauuguua

SEQ ID NO: 280484 - RNA, 22 nt, Homo sapiens
gucauguuuaacuucuugagga

SEQ ID NO: 280485 - RNA, 22 nt, Homo sapiens
guccaaagugggagaggugggg

SEQ ID NO: 280486 - RNA, 22 nt, Homo sapiens
guccaguacucuuuccugaaaa

SEQ ID NO: 280487 - RNA, 22 nt, Homo sapiens
guccaguguuggagguuuuacc

SEQ ID NO: 280488 - RNA, 22 nt, Homo sapiens
gucccagagauauugugucuuu

SEQ ID NO: 280489 - RNA, 22 nt, Homo sapiens
gucgguguuuccugagaacgaa

SEQ ID NO: 280490 - RNA, 22 nt, Homo sapiens
gucucagugcgaaucucaaaga

SEQ ID NO: 280491 - RNA, 22 nt, Homo sapiens
gucuggagacuugggucaucaa

SEQ ID NO: 280492 - RNA, 22 nt, Homo sapiens
gucuggcuccugucuaaucacu

SEQ ID NO: 280493 - RNA, 22 nt, Homo sapiens
gucuggcuuaucucacuuacca

SEQ ID NO: 280494 - RNA, 22 nt, Homo sapiens
gucugguuccugggagauuucu

SEQ ID NO: 280495 - RNA, 22 nt, Homo sapiens
gucugguugacagcauguggcc

SEQ ID NO: 280496 - RNA, 22 nt, Homo sapiens
gucuugaaggcugaguaccugu

SEQ ID NO: 280497 - RNA, 22 nt, Homo sapiens
gucuuugcuuuuaaccagaggu

SEQ ID NO: 280498 - RNA, 22 nt, Homo sapiens
gucuuuguuuugauuuaccaga

SEQ ID NO: 280499 - RNA, 22 nt, Homo sapiens
gugaaagcaucugacugugcca

SEQ ID NO: 280500 - RNA, 22 nt, Homo sapiens
gugaaauauuuaacguccaggu

SEQ ID NO: 280501 - RNA, 22 nt, Homo sapiens
gugaacagcagaugagugagug

SEQ ID NO: 280502 - RNA, 22 nt, Homo sapiens
gugaauguuuucuuacauggua

SEQ ID NO: 280503 - RNA, 22 nt, Homo sapiens
gugaauugagagaacuguguua

SEQ ID NO: 280504 - RNA, 22 nt, Homo sapiens
gugacagucaaagacaugacuu

SEQ ID NO: 280505 - RNA, 22 nt, Homo sapiens
gugacaguggagacuuacuuca

SEQ ID NO: 280506 - RNA, 22 nt, Homo sapiens
gugacauuuuuacugaugagag

SEQ ID NO: 280507 - RNA, 22 nt, Homo sapiens
gugaccaaagauagcucaaguu

SEQ ID NO: 280508 - RNA, 22 nt, Homo sapiens
gugaccucuguugcugucacua

SEQ ID NO: 280509 - RNA, 18 nt, Homo sapiens
gugagaaugacuguucug

SEQ ID NO: 280510 - RNA, 22 nt, Homo sapiens
gugagacugaguuucgcucuug

SEQ ID NO: 280511 - RNA, 22 nt, Homo sapiens
gugagaugauggguauguuaau

SEQ ID NO: 280512 - RNA, 22 nt, Homo sapiens
gugagaugguaucucauugugg

SEQ ID NO: 280513 - RNA, 22 nt, Homo sapiens
gugagcagagaucgcgugauug

SEQ ID NO: 280514 - RNA, 22 nt, Homo sapiens
gugagcauaggaggcuucuguu

SEQ ID NO: 280515 - RNA, 22 nt, Homo sapiens
gugagguauacugggaucacua

SEQ ID NO: 280516 - RNA, 22 nt, Homo sapiens
gugaguaaagguucauugaauu

SEQ ID NO: 280517 - RNA, 22 nt, Homo sapiens
gugagucaaucugagggguuca

SEQ ID NO: 280518 - RNA, 22 nt, Homo sapiens
gugauagaucugggauucagaa

SEQ ID NO: 280519 - RNA, 22 nt, Homo sapiens
gugaucucagcucacuggaacc

SEQ ID NO: 280520 - RNA, 22 nt, Homo sapiens
gugaucucauuuggaauuagag

SEQ ID NO: 280521 - RNA, 22 nt, Homo sapiens
gugaugacauucagagaugaag

SEQ ID NO: 280522 - RNA, 22 nt, Homo sapiens
gugauuuaguagaugcuaguua

SEQ ID NO: 280523 - RNA, 22 nt, Homo sapiens
gugcaaauuccagcucaacucc

SEQ ID NO: 280524 - RNA, 22 nt, Homo sapiens
gugcaaccaucaccacugacuc

SEQ ID NO: 280525 - RNA, 22 nt, Homo sapiens
gugcaagcaucauggaguguac

SEQ ID NO: 280526 - RNA, 20 nt, Homo sapiens
ucuugaacuuagucaacagg

SEQ ID NO: 280527 - RNA, 22 nt, Homo sapiens
ucuugcaccuacaugcuuuguc

SEQ ID NO: 280528 - RNA, 22 nt, Homo sapiens
ucuuggcauggcugaagauucc

SEQ ID NO: 280529 - RNA, 22 nt, Homo sapiens
ucuuggguuugccuugcugcug

SEQ ID NO: 280530 - RNA, 22 nt, Homo sapiens
ucuugguugaaaauucauaaua

SEQ ID NO: 280531 - RNA, 19 nt, Homo sapiens
ucuuuagucacauuuuuau

SEQ ID NO: 280532 - RNA, 20 nt, Homo sapiens
ucuuucgguuaccaggcagu

SEQ ID NO: 280533 - RNA, 22 nt, Homo sapiens
ucuuugaguggagcgaggcaga

SEQ ID NO: 280534 - RNA, 22 nt, Homo sapiens
ucuuugguaauggaugucugau

SEQ ID NO: 280535 - RNA, 19 nt, Homo sapiens
ucuuugguacgugcuuuga

SEQ ID NO: 280536 - RNA, 22 nt, Homo sapiens
ucuuugguagaagcuauuuuau

SEQ ID NO: 280537 - RNA, 22 nt, Homo sapiens
ucuuugguucuguuuauguaau

SEQ ID NO: 280538 - RNA, 22 nt, Homo sapiens
ugugacagcacagcaucucuuu

SEQ ID NO: 280539 - RNA, 18 nt, Homo sapiens
ugugacauugagcauguc

SEQ ID NO: 280540 - RNA, 22 nt, Homo sapiens
ugugagacugacagggcagggu

SEQ ID NO: 280541 - RNA, 22 nt, Homo sapiens
ugugaguguguacuaguuauca

SEQ ID NO: 280542 - RNA, 22 nt, Homo sapiens
ugugaugaagaguccaagaaca

SEQ ID NO: 280543 - RNA, 18 nt, Homo sapiens
ugugauggauauguuaau

SEQ ID NO: 280544 - RNA, 22 nt, Homo sapiens
ugugaugguuuagcauuuucuu

SEQ ID NO: 280545 - RNA, 20 nt, Homo sapiens
ugugauuauuuaguugcaug

SEQ ID NO: 280546 - RNA, 22 nt, Homo sapiens
ugugauuauuuauagacaguca

SEQ ID NO: 280547 - RNA, 22 nt, Homo sapiens
ugugcaaaaguaauugcgguuu

SEQ ID NO: 280548 - RNA, 22 nt, Homo sapiens
ugugcaaauuagcacaacccga

SEQ ID NO: 280549 - RNA, 18 nt, Homo sapiens
ugugcaauauuaaccacc

SEQ ID NO: 280550 - RNA, 22 nt, Homo sapiens
ugugcaauucgauggagcucau

SEQ ID NO: 280551 - RNA, 22 nt, Homo sapiens
ugugcacauaacauuuuuuuag

SEQ ID NO: 280552 - RNA, 22 nt, Homo sapiens
ugugcacauugugcagguugau

SEQ ID NO: 280553 - RNA, 23 nt, Homo sapiens
ugugcacauuuacauauauacac

SEQ ID NO: 280554 - RNA, 22 nt, Homo sapiens
ugugcaguuuuagcguauuuua

SEQ ID NO: 280555 - RNA, 22 nt, Homo sapiens
ugugcaugacagcauacaaacg

SEQ ID NO: 280556 - RNA, 22 nt, Homo sapiens
ugugccacugcacucuggccug

SEQ ID NO: 280557 - RNA, 22 nt, Homo sapiens
ugugccacugcacucugggcaa

SEQ ID NO: 280558 - RNA, 22 nt, Homo sapiens
ugugccuaguaauguguccaga

SEQ ID NO: 280559 - RNA, 22 nt, Homo sapiens
ugugcuugcuucuucuccuagu

SEQ ID NO: 280560 - RNA, 21 nt, Homo sapiens
uguggcaauggccucacagau

SEQ ID NO: 280561 - RNA, 22 nt, Homo sapiens
uguggcagugcuuuaugaaacc

SEQ ID NO: 280562 - RNA, 22 nt, Homo sapiens
uguggcauugaauaaccuugga

SEQ ID NO: 280563 - RNA, 22 nt, Homo sapiens
uguggcucuucuguucuccacu

SEQ ID NO: 280564 - RNA, 22 nt, Homo sapiens
ugugggaggugcuaauguaaau

SEQ ID NO: 280565 - RNA, 22 nt, Homo sapiens
ugugguagugcuuaccugcagu

SEQ ID NO: 280566 - RNA, 22 nt, Homo sapiens
uguggucaucacuugaagguaa

SEQ ID NO: 280567 - RNA, 22 nt, Homo sapiens
auggugugugaauuaaauguua

SEQ ID NO: 280568 - RNA, 22 nt, Homo sapiens
auguaacaguauuuggagaugu

SEQ ID NO: 280569 - RNA, 21 nt, Homo sapiens
auguaacugggaaugugagag

SEQ ID NO: 280570 - RNA, 20 nt, Homo sapiens
auguaauguaugauauguac

SEQ ID NO: 280571 - RNA, 22 nt, Homo sapiens
auguaguagauauuuauggaaa

SEQ ID NO: 280572 - RNA, 22 nt, Homo sapiens
auguaguaugaagaagaugcuu

SEQ ID NO: 280573 - RNA, 22 nt, Homo sapiens
augucaaggugggugauaguuu

SEQ ID NO: 280574 - RNA, 22 nt, Homo sapiens
augucacagguccuagccaagu

SEQ ID NO: 280575 - RNA, 22 nt, Homo sapiens
augucacugcacuccugccugg

SEQ ID NO: 280576 - RNA, 20 nt, Homo sapiens
augucaggaagggagucagg

SEQ ID NO: 280577 - RNA, 22 nt, Homo sapiens
auguccaugagcacauguauca

SEQ ID NO: 280578 - RNA, 22 nt, Homo sapiens
auguccauggaaucuguagcaa

SEQ ID NO: 280579 - RNA, 22 nt, Homo sapiens
auguccuggacccagacaaagc

SEQ ID NO: 280580 - RNA, 22 nt, Homo sapiens
augugaacugaauuaauucaca

SEQ ID NO: 280581 - RNA, 22 nt, Homo sapiens
augugaaugugaucggauaguc

SEQ ID NO: 280582 - RNA, 22 nt, Homo sapiens
augugcaaauuuccaaacucuu

SEQ ID NO: 280583 - RNA, 22 nt, Homo sapiens
augugcaacugcuggaacaguc

SEQ ID NO: 280584 - RNA, 22 nt, Homo sapiens
augugcaauggugucaccacau

SEQ ID NO: 280585 - RNA, 18 nt, Homo sapiens
augugcaauuuuguauuu

SEQ ID NO: 280586 - RNA, 22 nt, Homo sapiens
augugcaugcuguucugccaga

SEQ ID NO: 280587 - RNA, 22 nt, Homo sapiens
auguggaaauguauaugugucu

SEQ ID NO: 280588 - RNA, 22 nt, Homo sapiens
auguggcacuugacuuucucgc

SEQ ID NO: 280589 - RNA, 22 nt, Homo sapiens
auguggcauuucucauucauuu

SEQ ID NO: 280590 - RNA, 22 nt, Homo sapiens
augugggaggacuuggcuguug

SEQ ID NO: 280591 - RNA, 22 nt, Homo sapiens
auguguauuaccucgauuguga

SEQ ID NO: 280592 - RNA, 23 nt, Homo sapiens
augugugcuuggagagcaggaug

SEQ ID NO: 280593 - RNA, 22 nt, Homo sapiens
augugugcuugugacacagccu

SEQ ID NO: 280594 - RNA, 22 nt, Homo sapiens
auguuauguucuucucuguaua

SEQ ID NO: 280595 - RNA, 18 nt, Homo sapiens
auguuauguuuguagaag

SEQ ID NO: 280596 - RNA, 22 nt, Homo sapiens
auuaacaucuagaguuuuggug

SEQ ID NO: 280597 - RNA, 23 nt, Homo sapiens
auuaagguuacuacaguaugagg

SEQ ID NO: 280598 - RNA, 22 nt, Homo sapiens
auuaaguaaugguuccaauaau

SEQ ID NO: 280599 - RNA, 22 nt, Homo sapiens
auuaucacaguuuugcauaugg

SEQ ID NO: 280600 - RNA, 22 nt, Homo sapiens
auuauugacucauagaaaggau

SEQ ID NO: 280601 - RNA, 22 nt, Homo sapiens
auucaaggacuggauugcggga

SEQ ID NO: 280602 - RNA, 22 nt, Homo sapiens
auucaagucaucucuccgcauu

SEQ ID NO: 280603 - RNA, 22 nt, Homo sapiens
auucaagugaugcagcuguuuu

SEQ ID NO: 280604 - RNA, 22 nt, Homo sapiens
auuccacuuccacuaguuucuc

SEQ ID NO: 280605 - RNA, 22 nt, Homo sapiens
auuccagauggaguugaggguu

SEQ ID NO: 280606 - RNA, 22 nt, Homo sapiens
auuccauuuguuaucacacccg

SEQ ID NO: 280607 - RNA, 22 nt, Homo sapiens
auugaacuuaaaagacuugcca

SEQ ID NO: 280608 - RNA, 22 nt, Homo sapiens
auugacaguuggccaguaagug

SEQ ID NO: 280609 - RNA, 22 nt, Homo sapiens
auugagcaaggucuccuaguau

SEQ ID NO: 280610 - RNA, 22 nt, Homo sapiens
auugauagaucauaugguaggu

SEQ ID NO: 280611 - RNA, 22 nt, Homo sapiens
gagguaagaguuuuccauuucu

SEQ ID NO: 280612 - RNA, 22 nt, Homo sapiens
gagguaaguggauuaugagguc

SEQ ID NO: 280613 - RNA, 21 nt, Homo sapiens
gagguagggauuaaagaccuc

SEQ ID NO: 280614 - RNA, 22 nt, Homo sapiens
gaggucaugucgggccccagga

SEQ ID NO: 280615 - RNA, 22 nt, Homo sapiens
gaggugguagguucacagcagc

SEQ ID NO: 280616 - RNA, 22 nt, Homo sapiens
gaguaacagcauaaauuuguga

SEQ ID NO: 280617 - RNA, 22 nt, Homo sapiens
gaguauauuugcacuguuaugu

SEQ ID NO: 280618 - RNA, 22 nt, Homo sapiens
gaguauuuuacaucguguaauu

SEQ ID NO: 280619 - RNA, 22 nt, Homo sapiens
gagugcaagguuuuucugagug

SEQ ID NO: 280620 - RNA, 22 nt, Homo sapiens
gagugcaauggcaccgucucgg

SEQ ID NO: 280621 - RNA, 22 nt, Homo sapiens
gagugcaauggcagaucuccgc

SEQ ID NO: 280622 - RNA, 22 nt, Homo sapiens
gagugcaauggcgcgaucuggg

SEQ ID NO: 280623 - RNA, 22 nt, Homo sapiens
gagugcuguuagcccuggguuu

SEQ ID NO: 280624 - RNA, 23 nt, Homo sapiens
gaguggagacucauugauuuccu

SEQ ID NO: 280625 - RNA, 22 nt, Homo sapiens
gagugguaguuucuagaggugu

SEQ ID NO: 280626 - RNA, 18 nt, Homo sapiens
gaguggugcuucccuugu

SEQ ID NO: 280627 - RNA, 22 nt, Homo sapiens
gaguucauuuugaaaccuugau

SEQ ID NO: 280628 - RNA, 22 nt, Homo sapiens
gauaaauccagauucugaugua

SEQ ID NO: 280629 - RNA, 22 nt, Homo sapiens
gauaagagaugauuuugccaug

SEQ ID NO: 280630 - RNA, 22 nt, Homo sapiens
gauagcauucaauuaucuguug

SEQ ID NO: 280631 - RNA, 22 nt, Homo sapiens
gauauguaguaguugaaaaaga

SEQ ID NO: 280632 - RNA, 22 nt, Homo sapiens
gauaugucuauuagcuugauug

SEQ ID NO: 280633 - RNA, 22 nt, Homo sapiens
gauaugugauaagaguuaucuu

SEQ ID NO: 280634 - RNA, 22 nt, Homo sapiens
gaucacauguguacucaaugug

SEQ ID NO: 280635 - RNA, 22 nt, Homo sapiens
gaucuguguuuguaugcauaag

SEQ ID NO: 280636 - RNA, 19 nt, Homo sapiens
gaucuguugaucaaugugu

SEQ ID NO: 280637 - RNA, 22 nt, Homo sapiens
gaugagaucauaaguguggagc

SEQ ID NO: 280638 - RNA, 22 nt, Homo sapiens
gaugagaugagcauuugaauug

SEQ ID NO: 280639 - RNA, 22 nt, Homo sapiens
gaugagcuaaguucucacagca

SEQ ID NO: 280640 - RNA, 22 nt, Homo sapiens
gaugccuauugcuaguccuaaa

SEQ ID NO: 280641 - RNA, 22 nt, Homo sapiens
gauggcacuaagccauguagga

SEQ ID NO: 280642 - RNA, 22 nt, Homo sapiens
gauggcaugugcugccaccaag

SEQ ID NO: 280643 - RNA, 22 nt, Homo sapiens
gaugguuuucaccugcaugcuu

SEQ ID NO: 280644 - RNA, 19 nt, Homo sapiens
auauaacauccaggagcag

SEQ ID NO: 280645 - RNA, 22 nt, Homo sapiens
auaucccaguguguaaacacug

SEQ ID NO: 280646 - RNA, 22 nt, Homo sapiens
auauccuggagcauuuuugcaa

SEQ ID NO: 280647 - RNA, 20 nt, Homo sapiens
auaugcagacacauacauac

SEQ ID NO: 280648 - RNA, 22 nt, Homo sapiens
auauggguuuuauauuaggcuc

SEQ ID NO: 280649 - RNA, 22 nt, Homo sapiens
auauggucccuguucucaagga

SEQ ID NO: 280650 - RNA, 22 nt, Homo sapiens
auauguauuuuaacguguaagg

SEQ ID NO: 280651 - RNA, 22 nt, Homo sapiens
auaugucuguuuagucuguaau

SEQ ID NO: 280652 - RNA, 22 nt, Homo sapiens
auauucacagguaucagagauu

SEQ ID NO: 280653 - RNA, 22 nt, Homo sapiens
auauuggacugugcuaguuaga

SEQ ID NO: 280654 - RNA, 22 nt, Homo sapiens
auauuguacugcuacugguucu

SEQ ID NO: 280655 - RNA, 22 nt, Homo sapiens
aucaaaguaggcauauguuuuu

SEQ ID NO: 280656 - RNA, 22 nt, Homo sapiens
aucaaagugaauuaaugagaau

SEQ ID NO: 280657 - RNA, 22 nt, Homo sapiens
aucaaauugucauuuuaaggau

SEQ ID NO: 280658 - RNA, 22 nt, Homo sapiens
aucaaguaaucugaguaagagu

SEQ ID NO: 280659 - RNA, 22 nt, Homo sapiens
aucacacuguuauuuuaguuaa

SEQ ID NO: 280660 - RNA, 22 nt, Homo sapiens
aucacagaguuaaaacuuucuu

SEQ ID NO: 280661 - RNA, 22 nt, Homo sapiens
aucacagauauggguuuaaauc

SEQ ID NO: 280662 - RNA, 22 nt, Homo sapiens
aucacaguggcucacaagagcc

SEQ ID NO: 280663 - RNA, 22 nt, Homo sapiens
aucaccagaugcuucaagcaga

SEQ ID NO: 280664 - RNA, 22 nt, Homo sapiens
aucaccauguguacauuagacc

SEQ ID NO: 280665 - RNA, 19 nt, Homo sapiens
aucaccauuauuuggaaca

SEQ ID NO: 280666 - RNA, 20 nt, Homo sapiens
aucacuggagaaggaaaccu

SEQ ID NO: 280667 - RNA, 22 nt, Homo sapiens
aucacugggagcagccauuaau

SEQ ID NO: 280668 - RNA, 22 nt, Homo sapiens
aucagaaucucuagaggacugu

SEQ ID NO: 280669 - RNA, 20 nt, Homo sapiens
aucagagacuaggauugcca

SEQ ID NO: 280670 - RNA, 22 nt, Homo sapiens
aucagagccugugugcccugaa

SEQ ID NO: 280671 - RNA, 22 nt, Homo sapiens
aucagauuccagaggcagcacc

SEQ ID NO: 280672 - RNA, 22 nt, Homo sapiens
aucagcacugaucauacagcuu

SEQ ID NO: 280673 - RNA, 22 nt, Homo sapiens
aucagcagcaugaaaacaggcu

SEQ ID NO: 280674 - RNA, 22 nt, Homo sapiens
aucagcaugcagaagucggggg

SEQ ID NO: 280675 - RNA, 22 nt, Homo sapiens
aucagcauucccaaaugaugug

SEQ ID NO: 280676 - RNA, 22 nt, Homo sapiens
aucagugcagugggaacuagaa

SEQ ID NO: 280677 - RNA, 22 nt, Homo sapiens
aucagugcauaguauuuaauga

SEQ ID NO: 280678 - RNA, 22 nt, Homo sapiens
aucauacuguuuugauuacugu

SEQ ID NO: 280679 - RNA, 21 nt, Homo sapiens
agagucaucucuaucuguacc

SEQ ID NO: 280680 - RNA, 22 nt, Homo sapiens
agauacaucuaugugucugugu

SEQ ID NO: 280681 - RNA, 22 nt, Homo sapiens
agaugauguuucuggcacauga

SEQ ID NO: 280682 - RNA, 23 nt, Homo sapiens
agaugcaucuggcugcgaggcaa

SEQ ID NO: 280683 - RNA, 22 nt, Homo sapiens
agaugcauuuuuauuggaauac

SEQ ID NO: 280684 - RNA, 22 nt, Homo sapiens
agaugguguuuucucaccagau

SEQ ID NO: 280685 - RNA, 22 nt, Homo sapiens
agcaacaucagcagcaggaaaa

SEQ ID NO: 280686 - RNA, 22 nt, Homo sapiens
agcaacauuguucauaauagcu

SEQ ID NO: 280687 - RNA, 22 nt, Homo sapiens
agcaaccuugaauagcccuuuc

SEQ ID NO: 280688 - RNA, 22 nt, Homo sapiens
agcaccacaauuuccugccuaa

SEQ ID NO: 280689 - RNA, 22 nt, Homo sapiens
agcaccacauacuacagagaua

SEQ ID NO: 280690 - RNA, 22 nt, Homo sapiens
agcaccaccguugcucuauccc

SEQ ID NO: 280691 - RNA, 22 nt, Homo sapiens
agcaccagaaucugaguuauuc

SEQ ID NO: 280692 - RNA, 22 nt, Homo sapiens
agcaccauuguacuccagccug

SEQ ID NO: 280693 - RNA, 22 nt, Homo sapiens
agcaccauuuauugaaaagaca

SEQ ID NO: 280694 - RNA, 22 nt, Homo sapiens
agcaccauuucucuaaagcacu

SEQ ID NO: 280695 - RNA, 22 nt, Homo sapiens
agcagagcaguggauuuuguga

SEQ ID NO: 280696 - RNA, 22 nt, Homo sapiens
agcagagcauauucauucgggg

SEQ ID NO: 280697 - RNA, 22 nt, Homo sapiens
agcagauguuuagugagcgccu

SEQ ID NO: 280698 - RNA, 22 nt, Homo sapiens
agcagcaugaggggacuucugc

SEQ ID NO: 280699 - RNA, 22 nt, Homo sapiens
agcagcauuaguggaaucuugu

SEQ ID NO: 280700 - RNA, 20 nt, Homo sapiens
agcagccacagauuccucag

SEQ ID NO: 280701 - RNA, 22 nt, Homo sapiens
agcagcgacacccuguggugag

SEQ ID NO: 280702 - RNA, 22 nt, Homo sapiens
agcagcuuugcauggccuguga

SEQ ID NO: 280703 - RNA, 22 nt, Homo sapiens
agcaggauuguuacaauaguaa

SEQ ID NO: 280704 - RNA, 22 nt, Homo sapiens
agcagguauuuaagaaacucag

SEQ ID NO: 280705 - RNA, 22 nt, Homo sapiens
agcagugucauuuucuggugag

SEQ ID NO: 280706 - RNA, 22 nt, Homo sapiens
agcauagugccuugaaaacaau

SEQ ID NO: 280707 - RNA, 22 nt, Homo sapiens
agcauggucacuuugggcccca

SEQ ID NO: 280708 - RNA, 20 nt, Homo sapiens
agcauugguuagaacaguag

SEQ ID NO: 280709 - RNA, 21 nt, Homo sapiens
agccugugggucauaguugcc

SEQ ID NO: 280710 - RNA, 22 nt, Homo sapiens
agcgccauugcacuccagccuu

SEQ ID NO: 280711 - RNA, 22 nt, Homo sapiens
agcggcuguuccccuggucuau

SEQ ID NO: 280712 - RNA, 22 nt, Homo sapiens
agcuacuguuagucuaguuagg

SEQ ID NO: 280713 - RNA, 22 nt, Homo sapiens
agcuagugugauucuuuggggu

SEQ ID NO: 280714 - RNA, 22 nt, Homo sapiens
agcucacagccuagcacuguga

SEQ ID NO: 280715 - RNA, 21 nt, Homo sapiens
agcuccacucguucccaaagc

SEQ ID NO: 280716 - RNA, 22 nt, Homo sapiens
agcuccaugauaguaugucugu

SEQ ID NO: 280717 - RNA, 22 nt, Homo sapiens
agcuccauuguaaucaccuggu

SEQ ID NO: 280718 - RNA, 22 nt, Homo sapiens
agcuccuuugcuuuuuccagga

SEQ ID NO: 280719 - RNA, 22 nt, Homo sapiens
agcugauggucuuguaugaugu

SEQ ID NO: 280720 - RNA, 22 nt, Homo sapiens
agcugcauuuacuuuugcacaa

SEQ ID NO: 280721 - RNA, 22 nt, Homo sapiens
agcuggaauuuaagguagauag

SEQ ID NO: 280722 - RNA, 22 nt, Homo sapiens
agcuggauguggaugacccugu

SEQ ID NO: 280723 - RNA, 22 nt, Homo sapiens
agcuggcuguggagaaaccccu

SEQ ID NO: 280724 - RNA, 22 nt, Homo sapiens
agcugugucuucuuaaagauuu

SEQ ID NO: 280725 - RNA, 22 nt, Homo sapiens
uugucuugcagcuuaggcauca

SEQ ID NO: 280726 - RNA, 22 nt, Homo sapiens
uugugaaaaaccucucguggaa

SEQ ID NO: 280727 - RNA, 22 nt, Homo sapiens
uugugaaaucuaggcagagguu

SEQ ID NO: 280728 - RNA, 22 nt, Homo sapiens
uugugaauggaguagcaggauc

SEQ ID NO: 280729 - RNA, 22 nt, Homo sapiens
uugugcaaaaguaauugcgguu

SEQ ID NO: 280730 - RNA, 20 nt, Homo sapiens
uugugcauugggccauuggg

SEQ ID NO: 280731 - RNA, 21 nt, Homo sapiens
uugugccaaacccuggaggga

SEQ ID NO: 280732 - RNA, 19 nt, Homo sapiens
uugugggaggacagagggg

SEQ ID NO: 280733 - RNA, 22 nt, Homo sapiens
uugugguugaugaagacugucu

SEQ ID NO: 280734 - RNA, 22 nt, Homo sapiens
uugugguuuucagcuuauauau

SEQ ID NO: 280735 - RNA, 22 nt, Homo sapiens
uuguguccccacucaaauuaca

SEQ ID NO: 280736 - RNA, 22 nt, Homo sapiens
uuguuuuggagaugagcuaaaa

SEQ ID NO: 280737 - RNA, 22 nt, Homo sapiens
uuuaaagcacggaguuuguggc

SEQ ID NO: 280738 - RNA, 22 nt, Homo sapiens
uuuaacauuggaugagaucguc

SEQ ID NO: 280739 - RNA, 22 nt, Homo sapiens
uuuaauacugcaucuuuacucu

SEQ ID NO: 280740 - RNA, 22 nt, Homo sapiens
uuuaaugcacuaggugguguuc

SEQ ID NO: 280741 - RNA, 22 nt, Homo sapiens
uuuaaugcaucccaaaauguag

SEQ ID NO: 280742 - RNA, 22 nt, Homo sapiens
uuuaauguuacaguauugguau

SEQ ID NO: 280743 - RNA, 18 nt, Homo sapiens
uuuacaguagaaggacuu

SEQ ID NO: 280744 - RNA, 22 nt, Homo sapiens
uuuacagucuuuugugugaguc

SEQ ID NO: 280745 - RNA, 22 nt, Homo sapiens
uuuagcagcaaagagcuguguu

SEQ ID NO: 280746 - RNA, 22 nt, Homo sapiens
uuuaggcaauauauucaugucu

SEQ ID NO: 280747 - RNA, 22 nt, Homo sapiens
uuuauagucaggaacuugagga

SEQ ID NO: 280748 - RNA, 22 nt, Homo sapiens
uuuauccagccucuagcaaggu

SEQ ID NO: 280749 - RNA, 19 nt, Homo sapiens
uuucacacucgccuacuuc

SEQ ID NO: 280750 - RNA, 23 nt, Homo sapiens
uuucacagaaggauuguagggcc

SEQ ID NO: 280751 - RNA, 22 nt, Homo sapiens
uuucaggcaagggugacccuga

SEQ ID NO: 280752 - RNA, 22 nt, Homo sapiens
uuucauagccuuugucgucuga

SEQ ID NO: 280753 - RNA, 22 nt, Homo sapiens
uuucauggaauauagucauuuu

SEQ ID NO: 280754 - RNA, 23 nt, Homo sapiens
uuucauggggauuuacucauucc

SEQ ID NO: 280755 - RNA, 22 nt, Homo sapiens
uuuccacauggacuuaccuucg

SEQ ID NO: 280756 - RNA, 22 nt, Homo sapiens
uuucccugaaggcucugaaguc

SEQ ID NO: 280757 - RNA, 22 nt, Homo sapiens
uuucuacagggcuugccaggua

SEQ ID NO: 280758 - RNA, 22 nt, Homo sapiens
uuucuacagugaacgauuucua

SEQ ID NO: 280759 - RNA, 22 nt, Homo sapiens
uuugaagugugaugccuugaug

SEQ ID NO: 280760 - RNA, 22 nt, Homo sapiens
uuugaaguguggcacugaguuu

SEQ ID NO: 280761 - RNA, 19 nt, Homo sapiens
uuugaauauaaugcagcua

SEQ ID NO: 280762 - RNA, 22 nt, Homo sapiens
uuugacaaugugugcuuguauu

SEQ ID NO: 280763 - RNA, 22 nt, Homo sapiens
uuugacuacugaugguguacgc

SEQ ID NO: 280764 - RNA, 22 nt, Homo sapiens
uuugacucacagccuggcugcc

SEQ ID NO: 280765 - RNA, 22 nt, Homo sapiens
uuugaguaggcuuauauuuugg

SEQ ID NO: 280766 - RNA, 22 nt, Homo sapiens
uuugauguccaccucagcccac

SEQ ID NO: 280767 - RNA, 22 nt, Homo sapiens
uuugcaauagguuguggggagg

SEQ ID NO: 280768 - RNA, 22 nt, Homo sapiens
uuugcacucaguaagugggagc

SEQ ID NO: 280769 - RNA, 22 nt, Homo sapiens
uuugcacuugaaaacacucuca

SEQ ID NO: 280770 - RNA, 22 nt, Homo sapiens
uuugcacuuuuguaauaugguu

SEQ ID NO: 280771 - RNA, 22 nt, Homo sapiens
uuugcauaauaagauuagggug

SEQ ID NO: 280772 - RNA, 19 nt, Homo sapiens
uuugcauagugagaauaua

SEQ ID NO: 280773 - RNA, 22 nt, Homo sapiens
uuugcaucuuuugcuuccugga

SEQ ID NO: 280774 - RNA, 22 nt, Homo sapiens
uuugccaauauuuuacugagga

SEQ ID NO: 280775 - RNA, 22 nt, Homo sapiens
uuugcuuaguaaauguagaaaa

SEQ ID NO: 280776 - RNA, 21 nt, Homo sapiens
uuuggcauuaugucaccagag

SEQ ID NO: 280777 - RNA, 22 nt, Homo sapiens
uuuggcauuuuacuacucaaau

SEQ ID NO: 280778 - RNA, 22 nt, Homo sapiens
uuuggcuuugagaagcagugga

SEQ ID NO: 280779 - RNA, 22 nt, Homo sapiens
ugguacugucucuauuuuguag

SEQ ID NO: 280780 - RNA, 22 nt, Homo sapiens
ugguagguuuauaaagaauuua

SEQ ID NO: 280781 - RNA, 22 nt, Homo sapiens
ugguauggaguaauuaguaagc

SEQ ID NO: 280782 - RNA, 19 nt, Homo sapiens
uguggucauccugggacga

SEQ ID NO: 280783 - RNA, 22 nt, Homo sapiens
ugugguuuuaguaaaacuaugu

SEQ ID NO: 280784 - RNA, 22 nt, Homo sapiens
ugugguuuuuuucuccaauagg

SEQ ID NO: 280785 - RNA, 22 nt, Homo sapiens
uguguacugcagaguauucugu

SEQ ID NO: 280786 - RNA, 22 nt, Homo sapiens
ugugucacugaggguuagugua

SEQ ID NO: 280787 - RNA, 22 nt, Homo sapiens
ugugucacugcacuccagcgug

SEQ ID NO: 280788 - RNA, 22 nt, Homo sapiens
ugugucuugcuggugccugcau

SEQ ID NO: 280789 - RNA, 22 nt, Homo sapiens
uguuacagcagaauugauugca

SEQ ID NO: 280790 - RNA, 22 nt, Homo sapiens
uguuacagugacuaauguuuua

SEQ ID NO: 280791 - RNA, 22 nt, Homo sapiens
uguuacaguguaggccuugggu

SEQ ID NO: 280792 - RNA, 22 nt, Homo sapiens
uguuauuuuguguuagggcaca

SEQ ID NO: 280793 - RNA, 22 nt, Homo sapiens
uguucauggauccaguggcuuc

SEQ ID NO: 280794 - RNA, 22 nt, Homo sapiens
uguucuggagaggcaggccaca

SEQ ID NO: 280795 - RNA, 22 nt, Homo sapiens
uguucuugagccuuuagaccua

SEQ ID NO: 280796 - RNA, 20 nt, Homo sapiens
uguugcacucuagccugggu

SEQ ID NO: 280797 - RNA, 22 nt, Homo sapiens
uguuuguuugauaugggauaaa

SEQ ID NO: 280798 - RNA, 22 nt, Homo sapiens
uguuuguuugugauacgguaca

SEQ ID NO: 280799 - RNA, 22 nt, Homo sapiens
uuaaagccauaccugagagagu

SEQ ID NO: 280800 - RNA, 22 nt, Homo sapiens
uuaaaggcaugguuagacaugg

SEQ ID NO: 280801 - RNA, 22 nt, Homo sapiens
uuaacagugucaaucuguagua

SEQ ID NO: 280802 - RNA, 22 nt, Homo sapiens
uuaaguacuucccuguuggaca

SEQ ID NO: 280803 - RNA, 22 nt, Homo sapiens
uuaaguuaggcuucagcagucu

SEQ ID NO: 280804 - RNA, 22 nt, Homo sapiens
uuaaguuguagcuacaaauaca

SEQ ID NO: 280805 - RNA, 22 nt, Homo sapiens
uuaaugaacuuuauuuuguaga

SEQ ID NO: 280806 - RNA, 22 nt, Homo sapiens
uuaauguaucuaucacaucaca

SEQ ID NO: 280807 - RNA, 22 nt, Homo sapiens
uuaauuguccaaguucaucucu

SEQ ID NO: 280808 - RNA, 22 nt, Homo sapiens
uuacaaccucagcagugcaaag

SEQ ID NO: 280809 - RNA, 19 nt, Homo sapiens
uuacacaaccuaguggggc

SEQ ID NO: 280810 - RNA, 22 nt, Homo sapiens
uuacacaguaggucccuaguaa

SEQ ID NO: 280811 - RNA, 22 nt, Homo sapiens
uuacaggacuaagcagcuuugc

SEQ ID NO: 280812 - RNA, 17 nt, Homo sapiens
uuacaggugcugagagu

SEQ ID NO: 280813 - RNA, 22 nt, Homo sapiens
uuacaguaugaguaagaguucu

SEQ ID NO: 280814 - RNA, 22 nt, Homo sapiens
uuacaguauugcaaggacuagg

SEQ ID NO: 280815 - RNA, 23 nt, Homo sapiens
uuacaguggcaugaucucugcuc

SEQ ID NO: 280816 - RNA, 22 nt, Homo sapiens
uuacaguguuuguucuguuacu

SEQ ID NO: 280817 - RNA, 22 nt, Homo sapiens
uuacaguucugguggagaggua

SEQ ID NO: 280818 - RNA, 22 nt, Homo sapiens
uuacauguuguggguuguggcc

SEQ ID NO: 280819 - RNA, 22 nt, Homo sapiens
uuacauguuuauggggguacau

SEQ ID NO: 280820 - RNA, 22 nt, Homo sapiens
uuaccaguggugcuguaaacuu

SEQ ID NO: 280821 - RNA, 22 nt, Homo sapiens
uuaccucuguggcucucggacu

SEQ ID NO: 280822 - RNA, 22 nt, Homo sapiens
uuagacacacauacauuuaucu

SEQ ID NO: 280823 - RNA, 17 nt, Homo sapiens
uuagacagacauccugc

SEQ ID NO: 280824 - RNA, 18 nt, Homo sapiens
uuagagugcauuacuuug

SEQ ID NO: 280825 - RNA, 23 nt, Homo sapiens
uuagaucuuuaaggaaucuccac

SEQ ID NO: 280826 - RNA, 22 nt, Homo sapiens
uuagaugaagucacagaaccca

SEQ ID NO: 280827 - RNA, 22 nt, Homo sapiens
uuagauguuugacugggccuua

SEQ ID NO: 280828 - RNA, 22 nt, Homo sapiens
uuagcaauagccugcaucugca

SEQ ID NO: 280829 - RNA, 22 nt, Homo sapiens
uuagcacuugggaguauuuauu

SEQ ID NO: 280830 - RNA, 22 nt, Homo sapiens
uuagcagcacaaaagcagacua

SEQ ID NO: 280831 - RNA, 22 nt, Homo sapiens
uuagcagcaucccuggccugua

SEQ ID NO: 280832 - RNA, 22 nt, Homo sapiens
uuagcagcaugaaaauggacug

SEQ ID NO: 280833 - RNA, 22 nt, Homo sapiens
uuagcagugugagcacagacua

SEQ ID NO: 280834 - RNA, 22 nt, Homo sapiens
uuaggcucuuuaucaguuaacu

SEQ ID NO: 280835 - RNA, 22 nt, Homo sapiens
uuagguuauuacugacaauaau

SEQ ID NO: 280836 - RNA, 22 nt, Homo sapiens
uuaguaguagcugcaugucagu

SEQ ID NO: 280837 - RNA, 22 nt, Homo sapiens
uuaguaguugugauagguaccu

SEQ ID NO: 280838 - RNA, 22 nt, Homo sapiens
uuauagcacuaagaagguaaua

SEQ ID NO: 280839 - RNA, 22 nt, Homo sapiens
uuauagcagugcccaacuccug

SEQ ID NO: 280840 - RNA, 22 nt, Homo sapiens
uuauauguuacucccucuagca

SEQ ID NO: 280841 - RNA, 22 nt, Homo sapiens
uuauauguuucuguuuggaggc

SEQ ID NO: 280842 - RNA, 22 nt, Homo sapiens
uuauauguuucuuagggacaga

SEQ ID NO: 280843 - RNA, 22 nt, Homo sapiens
uuaucacauugacugauuugca

SEQ ID NO: 280844 - RNA, 22 nt, Homo sapiens
uuaucccacuuucuguuccugu

SEQ ID NO: 280845 - RNA, 21 nt, Homo sapiens
uuaucccagugucucugcagg

SEQ ID NO: 280846 - RNA, 22 nt, Homo sapiens
uuaugaaguagguuaagagcag

SEQ ID NO: 280847 - RNA, 22 nt, Homo sapiens
uuaugacaggcucaggagcccc

SEQ ID NO: 280848 - RNA, 22 nt, Homo sapiens
uuaugcagcaaagugcuugaaa

SEQ ID NO: 280849 - RNA, 22 nt, Homo sapiens
uuauggcaaugccccacuccua

SEQ ID NO: 280850 - RNA, 22 nt, Homo sapiens
ugagauagaaaacauaggagaa

SEQ ID NO: 280851 - RNA, 18 nt, Homo sapiens
ugagaucagcaucaaggg

SEQ ID NO: 280852 - RNA, 22 nt, Homo sapiens
ugagaucaugccacugcacuuc

SEQ ID NO: 280853 - RNA, 22 nt, Homo sapiens
ugagaucaugucauuugcacuc

SEQ ID NO: 280854 - RNA, 22 nt, Homo sapiens
ugagaucauguguggaccccag

SEQ ID NO: 280855 - RNA, 20 nt, Homo sapiens
ugagauccacgugaaguaug

SEQ ID NO: 280856 - RNA, 19 nt, Homo sapiens
ugagauccacugaagauuc

SEQ ID NO: 280857 - RNA, 23 nt, Homo sapiens
ugagaucuacagaucucagaucu

SEQ ID NO: 280858 - RNA, 22 nt, Homo sapiens
ugagaucuguaaagucugacau

SEQ ID NO: 280859 - RNA, 22 nt, Homo sapiens
ugagaucuuggaggcuuuguga

SEQ ID NO: 280860 - RNA, 22 nt, Homo sapiens
ugagaucuuugcuguccucacc

SEQ ID NO: 280861 - RNA, 22 nt, Homo sapiens
ugagaugaagcuagaagaaugg

SEQ ID NO: 280862 - RNA, 22 nt, Homo sapiens
ugagaugagaaucaguucuaau

SEQ ID NO: 280863 - RNA, 22 nt, Homo sapiens
ugagaugagggaagccuaggca

SEQ ID NO: 280864 - RNA, 22 nt, Homo sapiens
ugagaugagggcugcacucaaa

SEQ ID NO: 280865 - RNA, 21 nt, Homo sapiens
ugagaugauccugcaugcaug

SEQ ID NO: 280866 - RNA, 22 nt, Homo sapiens
ugagaugaugggauaagagggc

SEQ ID NO: 280867 - RNA, 22 nt, Homo sapiens
ugagaugcaaaaugagaauugu

SEQ ID NO: 280868 - RNA, 22 nt, Homo sapiens
ugagaugcuccucuugcaaagc

SEQ ID NO: 280869 - RNA, 22 nt, Homo sapiens
ugagauggaguuucacuuuugu

SEQ ID NO: 280870 - RNA, 22 nt, Homo sapiens
ugagauggaguuucgcccuugu

SEQ ID NO: 280871 - RNA, 22 nt, Homo sapiens
ugagauggaguuucgcucuugu

SEQ ID NO: 280872 - RNA, 22 nt, Homo sapiens
ugagauggaguuucgcuuuugu

SEQ ID NO: 280873 - RNA, 22 nt, Homo sapiens
ugagauggaucuuggauuugaa

SEQ ID NO: 280874 - RNA, 22 nt, Homo sapiens
ugagauggcugaauucagaaua

SEQ ID NO: 280875 - RNA, 23 nt, Homo sapiens
ugagaugucugauugcgaggguc

SEQ ID NO: 280876 - RNA, 21 nt, Homo sapiens
ugagaugugaccagggcauca

SEQ ID NO: 280877 - RNA, 22 nt, Homo sapiens
ugagaugugugcauucaacuca

SEQ ID NO: 280878 - RNA, 21 nt, Homo sapiens
ugagauuauauuaacauggua

SEQ ID NO: 280879 - RNA, 22 nt, Homo sapiens
ugagauuaucguaauguaucuc

SEQ ID NO: 280880 - RNA, 22 nt, Homo sapiens
ugagauuaucuguacauaggag

SEQ ID NO: 280881 - RNA, 22 nt, Homo sapiens
ugagcacagcgugugggagagc

SEQ ID NO: 280882 - RNA, 22 nt, Homo sapiens
ugagcagaaguuuugauuggcg

SEQ ID NO: 280883 - RNA, 22 nt, Homo sapiens
ugagcagagaagugcccugcgc

SEQ ID NO: 280884 - RNA, 22 nt, Homo sapiens
ugagcaucauucacaccuuggu

SEQ ID NO: 280885 - RNA, 22 nt, Homo sapiens
ugagcauuguguuugacuguga

SEQ ID NO: 280886 - RNA, 22 nt, Homo sapiens
ugagcuaagugccaauauuaau

SEQ ID NO: 280887 - RNA, 22 nt, Homo sapiens
ugagcuagagaguuuaguguca

SEQ ID NO: 280888 - RNA, 22 nt, Homo sapiens
ugagcuaggaucacaccugcau

SEQ ID NO: 280889 - RNA, 22 nt, Homo sapiens
ugagcuagggccuggaauaggg

SEQ ID NO: 280890 - RNA, 22 nt, Homo sapiens
ugagcucagcuaguugaggugu

SEQ ID NO: 280891 - RNA, 22 nt, Homo sapiens
ugaggcaaggcugaaugaaggc

SEQ ID NO: 280892 - RNA, 22 nt, Homo sapiens
ugagguaacaaacuaugaguua

SEQ ID NO: 280893 - RNA, 22 nt, Homo sapiens
ugagguaagauguucauuuuuc

SEQ ID NO: 280894 - RNA, 22 nt, Homo sapiens
ugaggugagggguuaggugcua

SEQ ID NO: 280895 - RNA, 22 nt, Homo sapiens
ugaggugaggguaucaaaugcu

SEQ ID NO: 280896 - RNA, 22 nt, Homo sapiens
ugagguguauugggggaaauuc

SEQ ID NO: 280897 - RNA, 23 nt, Homo sapiens
ugagguguuaagcagacuugucu

SEQ ID NO: 280898 - RNA, 22 nt, Homo sapiens
ugagguugaaggacauuuuuau

SEQ ID NO: 280899 - RNA, 22 nt, Homo sapiens
ugagguugguauuacugucucu

SEQ ID NO: 280900 - RNA, 22 nt, Homo sapiens
ugaguagauccaagacuguccu

SEQ ID NO: 280901 - RNA, 22 nt, Homo sapiens
ugaguagcuaagacgauaggca

SEQ ID NO: 280902 - RNA, 23 nt, Homo sapiens
ugaguaggcaguuuuccccucac

SEQ ID NO: 280903 - RNA, 23 nt, Homo sapiens
ugaguaggugguuuuccccucac

SEQ ID NO: 280904 - RNA, 22 nt, Homo sapiens
ugagucaauucuaacaauggca

SEQ ID NO: 280905 - RNA, 22 nt, Homo sapiens
ugagucuguuccaaagaaauaa

SEQ ID NO: 280906 - RNA, 22 nt, Homo sapiens
ugagugaaugugaaggcuaggg

SEQ ID NO: 280907 - RNA, 22 nt, Homo sapiens
ugaguuaauuuuuguaucaugu

SEQ ID NO: 280908 - RNA, 22 nt, Homo sapiens
ugaguuaguguggugcuuggaa

SEQ ID NO: 280909 - RNA, 22 nt, Homo sapiens
ugauauguguaaacaauguaua

SEQ ID NO: 280910 - RNA, 22 nt, Homo sapiens
ugaucugucacuuaucacauuu

SEQ ID NO: 280911 - RNA, 22 nt, Homo sapiens
ugaugcugaguggcuauuugaa

SEQ ID NO: 280912 - RNA, 22 nt, Homo sapiens
ugauggcauuucauguuuguaa

SEQ ID NO: 280913 - RNA, 22 nt, Homo sapiens
ugauggccuguucuccauaugu

SEQ ID NO: 280914 - RNA, 22 nt, Homo sapiens
ugaugguguuaccaucuuuacu

SEQ ID NO: 280915 - RNA, 22 nt, Homo sapiens
ugaugguuuuauuaauaggacc

SEQ ID NO: 280916 - RNA, 22 nt, Homo sapiens
ugauugcacaccugcacucaag

SEQ ID NO: 280917 - RNA, 18 nt, Homo sapiens
ugcaaacauguguguguu

SEQ ID NO: 280918 - RNA, 22 nt, Homo sapiens
ugcaaaguccucauucuuaccc

SEQ ID NO: 280919 - RNA, 22 nt, Homo sapiens
ugcaaagucgaaacugcaguuu

SEQ ID NO: 280920 - RNA, 19 nt, Homo sapiens
ugcaaagucuuuuccuauu

SEQ ID NO: 280921 - RNA, 22 nt, Homo sapiens
ugcaaaucuuguguaguuguga

SEQ ID NO: 280922 - RNA, 22 nt, Homo sapiens
ugcaaauguuaguaacaccacu

SEQ ID NO: 280923 - RNA, 22 nt, Homo sapiens
ugcaacacauugccccugcucu

SEQ ID NO: 280924 - RNA, 21 nt, Homo sapiens
ugcaagaaucaggaagcugcc

SEQ ID NO: 280925 - RNA, 22 nt, Homo sapiens
ugcaagaaucuuucaggcuagc

SEQ ID NO: 280926 - RNA, 17 nt, Homo sapiens
ugcaauuuaagcuagau

SEQ ID NO: 280927 - RNA, 23 nt, Homo sapiens
ugcaccacuacacacucuugggu

SEQ ID NO: 280928 - RNA, 22 nt, Homo sapiens
ugcagagaaacauuuuguauuu

SEQ ID NO: 280929 - RNA, 22 nt, Homo sapiens
ugcagagucuguccugccugcc

SEQ ID NO: 280930 - RNA, 22 nt, Homo sapiens
ugcagcucaaauuccuaacaag

SEQ ID NO: 280931 - RNA, 23 nt, Homo sapiens
ugcaguagugagaucuaggcuca

SEQ ID NO: 280932 - RNA, 22 nt, Homo sapiens
ugcaguagugugaucuuggcuc

SEQ ID NO: 280933 - RNA, 21 nt, Homo sapiens
ugcagugugguugcccugcug

SEQ ID NO: 280934 - RNA, 18 nt, Homo sapiens
ugcauacuaucugauuuu

SEQ ID NO: 280935 - RNA, 22 nt, Homo sapiens
ugcauacuguaugcgugcauac

SEQ ID NO: 280936 - RNA, 22 nt, Homo sapiens
ugcauagcaaaauaggauuaga

SEQ ID NO: 280937 - RNA, 22 nt, Homo sapiens
ugcauaggagcagggucuaugu

SEQ ID NO: 280938 - RNA, 19 nt, Homo sapiens
ugcauaggguuacauacuc

SEQ ID NO: 280939 - RNA, 21 nt, Homo sapiens
ugcauaucucuaaugaccagu

SEQ ID NO: 280940 - RNA, 22 nt, Homo sapiens
ugcauaucuucuuuugagaaau

SEQ ID NO: 280941 - RNA, 22 nt, Homo sapiens
ugcauaugucuuuauaguagca

SEQ ID NO: 280942 - RNA, 18 nt, Homo sapiens
ugcauauguugaaccagc

SEQ ID NO: 280943 - RNA, 22 nt, Homo sapiens
ugcaugaugcugagauuuggga

SEQ ID NO: 280944 - RNA, 21 nt, Homo sapiens
ugcaugguagucacaugauuc

SEQ ID NO: 280945 - RNA, 22 nt, Homo sapiens
ugcauguucuuacucauacaug

SEQ ID NO: 280946 - RNA, 22 nt, Homo sapiens
ugcauuagucuguucucacacu

SEQ ID NO: 280947 - RNA, 21 nt, Homo sapiens
ugcauuggagaauguuucuca

SEQ ID NO: 280948 - RNA, 22 nt, Homo sapiens
ugcauuguuuagaaacacuggg

SEQ ID NO: 280949 - RNA, 22 nt, Homo sapiens
ugcauuguuuuugguucccagg

SEQ ID NO: 280950 - RNA, 19 nt, Homo sapiens
ugccaagaaagucagcuua

SEQ ID NO: 280951 - RNA, 22 nt, Homo sapiens
ugccaagaacauuuucuguuuu

SEQ ID NO: 280952 - RNA, 22 nt, Homo sapiens
ugccaagauuucaggaauuaag

SEQ ID NO: 280953 - RNA, 22 nt, Homo sapiens
ugccaguauuuuauuaagaauu

SEQ ID NO: 280954 - RNA, 22 nt, Homo sapiens
ugcccuguaucccacuguuuca

SEQ ID NO: 280955 - RNA, 18 nt, Homo sapiens
ugccuacugggcucaagc

SEQ ID NO: 280956 - RNA, 22 nt, Homo sapiens
ugccuacugguuguucugggca

SEQ ID NO: 280957 - RNA, 22 nt, Homo sapiens
ugccuacuuugcaucugucagg

SEQ ID NO: 280958 - RNA, 22 nt, Homo sapiens
ugccuaggcccaguccucagaa

SEQ ID NO: 280959 - RNA, 22 nt, Homo sapiens
ugccuaggcuggaaugcagugg

SEQ ID NO: 280960 - RNA, 22 nt, Homo sapiens
ugccuaggcuggaguguagugg

SEQ ID NO: 280961 - RNA, 22 nt, Homo sapiens
ugccugagccagguuuuaggag

SEQ ID NO: 280962 - RNA, 16 nt, Homo sapiens
ugccuucuucuguauu

SEQ ID NO: 280963 - RNA, 21 nt, Homo sapiens
ugcuacugucacuuccuuugu

SEQ ID NO: 280964 - RNA, 21 nt, Homo sapiens
ugcuauguuguccaggcuggc

SEQ ID NO: 280965 - RNA, 21 nt, Homo sapiens
ugcucaugaguaaugcaguga

SEQ ID NO: 280966 - RNA, 22 nt, Homo sapiens
ugcugcuguuaucauuuuacca

SEQ ID NO: 280967 - RNA, 22 nt, Homo sapiens
ugcugcuguuguuguuacuagc

SEQ ID NO: 280968 - RNA, 22 nt, Homo sapiens
ugcugguaguuuaugacuaauu

SEQ ID NO: 280969 - RNA, 18 nt, Homo sapiens
ugcuuagucauuuucaau

SEQ ID NO: 280970 - RNA, 22 nt, Homo sapiens
ugcuuugguagaaaucuuuggu

SEQ ID NO: 280971 - RNA, 21 nt, Homo sapiens
uggaaacuucuagcuuacgua

SEQ ID NO: 280972 - RNA, 22 nt, Homo sapiens
uggaacacaucuaaggaagcag

SEQ ID NO: 280973 - RNA, 22 nt, Homo sapiens
auuugucaauacacuucuucca

SEQ ID NO: 280974 - RNA, 22 nt, Homo sapiens
auuuugcauugcuguaaaggaa

SEQ ID NO: 280975 - RNA, 22 nt, Homo sapiens
caaagcuauagcaccagaggga

SEQ ID NO: 280976 - RNA, 22 nt, Homo sapiens
caaaggcuguuauaggccagga

SEQ ID NO: 280977 - RNA, 22 nt, Homo sapiens
caaaguaauugugguuuugcca

SEQ ID NO: 280978 - RNA, 22 nt, Homo sapiens
caaagucuucaguugauucuga

SEQ ID NO: 280979 - RNA, 22 nt, Homo sapiens
caaagugcugaaagaggccagg

SEQ ID NO: 280980 - RNA, 22 nt, Homo sapiens
caaaugcuucuauggacugucu

SEQ ID NO: 280981 - RNA, 22 nt, Homo sapiens
caaauugcuugucuguagugga

SEQ ID NO: 280982 - RNA, 22 nt, Homo sapiens
caaauugcuuguggaggauaau

SEQ ID NO: 280983 - RNA, 22 nt, Homo sapiens
caacaguaaagcauuuuuaagu

SEQ ID NO: 280984 - RNA, 22 nt, Homo sapiens
caaccaguagcugaguucaaaa

SEQ ID NO: 280985 - RNA, 19 nt, Homo sapiens
caacccugcagagaaagga

SEQ ID NO: 280986 - RNA, 22 nt, Homo sapiens
caacugcucacuccuggguuca

SEQ ID NO: 280987 - RNA, 22 nt, Homo sapiens
caagagagcugaugguuuuaaa

SEQ ID NO: 280988 - RNA, 22 nt, Homo sapiens
caagaggcuguguauaaagcca

SEQ ID NO: 280989 - RNA, 22 nt, Homo sapiens
caagugcuuucuuggggauuua

SEQ ID NO: 280990 - RNA, 22 nt, Homo sapiens
cacaaugucugguaggccacuu

SEQ ID NO: 280991 - RNA, 22 nt, Homo sapiens
cacagcuaacaacuguuucuuc

SEQ ID NO: 280992 - RNA, 22 nt, Homo sapiens
cacagggcuaacauuuuugccc

SEQ ID NO: 280993 - RNA, 22 nt, Homo sapiens
cacaggucauccuggaucaagg

SEQ ID NO: 280994 - RNA, 22 nt, Homo sapiens
cacaguagaauagagcacuagg

SEQ ID NO: 280995 - RNA, 22 nt, Homo sapiens
cacauguuugcuacauuuuucu

SEQ ID NO: 280996 - RNA, 22 nt, Homo sapiens
cacauguuuuagcauggcuguu

SEQ ID NO: 280997 - RNA, 22 nt, Homo sapiens
caccacauuccauugaucaggc

SEQ ID NO: 280998 - RNA, 22 nt, Homo sapiens
caccagcuggcauugaauaccu

SEQ ID NO: 280999 - RNA, 22 nt, Homo sapiens
caccagguuggagugcaguggu

SEQ ID NO: 281000 - RNA, 22 nt, Homo sapiens
cacccaguaagcaugaggcccu

SEQ ID NO: 281001 - RNA, 22 nt, Homo sapiens
cacugcacuccagccuaagagg

SEQ ID NO: 281002 - RNA, 22 nt, Homo sapiens
cacugcacucuucuucugggca

SEQ ID NO: 281003 - RNA, 21 nt, Homo sapiens
cacugcacuugccuucugggu

SEQ ID NO: 281004 - RNA, 23 nt, Homo sapiens
cacugggcagcagguguucccag

SEQ ID NO: 281005 - RNA, 22 nt, Homo sapiens
cacuuugguucaccugaguuuc

SEQ ID NO: 281006 - RNA, 22 nt, Homo sapiens
cagaaguauugguaugcucugu

SEQ ID NO: 281007 - RNA, 22 nt, Homo sapiens
cagagaacugaguuauuuucuu

SEQ ID NO: 281008 - RNA, 22 nt, Homo sapiens
cagagaaugucuuuuuuaacca

SEQ ID NO: 281009 - RNA, 22 nt, Homo sapiens
cagaucaucuugagcuuaggaa

SEQ ID NO: 281010 - RNA, 22 nt, Homo sapiens
cagauggucuuaaggcagccuu

SEQ ID NO: 281011 - RNA, 22 nt, Homo sapiens
cagcaaaucauccuauuugagc

SEQ ID NO: 281012 - RNA, 20 nt, Homo sapiens
cagcacgcacaugagacugu

SEQ ID NO: 281013 - RNA, 20 nt, Homo sapiens
cagcuagugguaggagucgg

SEQ ID NO: 281014 - RNA, 22 nt, Homo sapiens
cagcucuuguuaaaacuaacua

SEQ ID NO: 281015 - RNA, 22 nt, Homo sapiens
cagcuggugcugcaccaguggg

SEQ ID NO: 281016 - RNA, 22 nt, Homo sapiens
cagcuggugggagcuggguucc

SEQ ID NO: 281017 - RNA, 22 nt, Homo sapiens
caggcauuguccaugcugaagg

SEQ ID NO: 281018 - RNA, 22 nt, Homo sapiens
caggguccccuaccuuuugaug

SEQ ID NO: 281019 - RNA, 22 nt, Homo sapiens
cagguacauuuuaaagggcuca

SEQ ID NO: 281020 - RNA, 22 nt, Homo sapiens
cagguaguguguagcacagcag

SEQ ID NO: 281021 - RNA, 22 nt, Homo sapiens
cagguauagucacuugcccaag

SEQ ID NO: 281022 - RNA, 22 nt, Homo sapiens
caggugcauuggcugacaccug

SEQ ID NO: 281023 - RNA, 22 nt, Homo sapiens
caggugguauuugguuuucugu

SEQ ID NO: 281024 - RNA, 22 nt, Homo sapiens
caguaguagccccuuagaugga

SEQ ID NO: 281025 - RNA, 22 nt, Homo sapiens
cagugcaaccuccaucucucgg

SEQ ID NO: 281026 - RNA, 23 nt, Homo sapiens
cagugcaugacuguauaugcaaa

SEQ ID NO: 281027 - RNA, 22 nt, Homo sapiens
cagugcaugacuguauauuauc

SEQ ID NO: 281028 - RNA, 23 nt, Homo sapiens
cagugcauuguggcauucagcau

SEQ ID NO: 281029 - RNA, 22 nt, Homo sapiens
cagugcuuguuauuguucuauu

SEQ ID NO: 281030 - RNA, 22 nt, Homo sapiens
caguggaugaacaagaagugau

SEQ ID NO: 281031 - RNA, 22 nt, Homo sapiens
cagugguuuucucaguucagca

SEQ ID NO: 281032 - RNA, 22 nt, Homo sapiens
caguuacuugacacaaccaauu

SEQ ID NO: 281033 - RNA, 22 nt, Homo sapiens
cauaaagauggaggaggccagg

SEQ ID NO: 281034 - RNA, 19 nt, Homo sapiens
caucacagagucuuccauu

SEQ ID NO: 281035 - RNA, 21 nt, Homo sapiens
caucacauuacucaaaguccu

SEQ ID NO: 281036 - RNA, 20 nt, Homo sapiens
caucaccuggcaggauuugu

SEQ ID NO: 281037 - RNA, 22 nt, Homo sapiens
caugcauuggucuauuauguga

SEQ ID NO: 281038 - RNA, 22 nt, Homo sapiens
caugccacugcacgccauccug

SEQ ID NO: 281039 - RNA, 22 nt, Homo sapiens
cauggagcuaggcuugaucccu

SEQ ID NO: 281040 - RNA, 22 nt, Homo sapiens
cauggcccuggguccauaggaa

SEQ ID NO: 281041 - RNA, 19 nt, Homo sapiens
cauggcuuauaauuuuaau

SEQ ID NO: 281042 - RNA, 22 nt, Homo sapiens
cauggguuuucucaaguaguca

SEQ ID NO: 281043 - RNA, 21 nt, Homo sapiens
caugucacugcacucuagccu

SEQ ID NO: 281044 - RNA, 22 nt, Homo sapiens
caugucacuuccucucugaugg

SEQ ID NO: 281045 - RNA, 22 nt, Homo sapiens
cauuaguugaagugcagggaga

SEQ ID NO: 281046 - RNA, 22 nt, Homo sapiens
gcaaaaaguagugcugguuagg

SEQ ID NO: 281047 - RNA, 21 nt, Homo sapiens
gcaaacauccuuugaugccag

SEQ ID NO: 281048 - RNA, 22 nt, Homo sapiens
gcaaaguguuuuccaacuuggu

SEQ ID NO: 281049 - RNA, 20 nt, Homo sapiens
gcaaauggaucccacaagcc

SEQ ID NO: 281050 - RNA, 22 nt, Homo sapiens
gcaagaugagagcccgggcagu

SEQ ID NO: 281051 - RNA, 22 nt, Homo sapiens
gcaauacugacagcauuaguuu

SEQ ID NO: 281052 - RNA, 22 nt, Homo sapiens
gcacaggguuacauucuaaggu

SEQ ID NO: 281053 - RNA, 22 nt, Homo sapiens
gcacaguaggugguaggacuuu

SEQ ID NO: 281054 - RNA, 22 nt, Homo sapiens
gcacuacugcacuccagucuag

SEQ ID NO: 281055 - RNA, 22 nt, Homo sapiens
gcagcacaugacuguauguaua

SEQ ID NO: 281056 - RNA, 22 nt, Homo sapiens
gcagcagugcccuggauggaaa

SEQ ID NO: 281057 - RNA, 22 nt, Homo sapiens
gcagcauuaccaagacauggca

SEQ ID NO: 281058 - RNA, 22 nt, Homo sapiens
gcaggauuggagccucucugaa

SEQ ID NO: 281059 - RNA, 22 nt, Homo sapiens
gcagguauuagagagccugaaa

SEQ ID NO: 281060 - RNA, 22 nt, Homo sapiens
gcagugcaugacgguauauaua

SEQ ID NO: 281061 - RNA, 22 nt, Homo sapiens
gcagugugaucacagcuuacug

SEQ ID NO: 281062 - RNA, 22 nt, Homo sapiens
gcaguguggguagagggcaaga

SEQ ID NO: 281063 - RNA, 22 nt, Homo sapiens
gcagugugugaggaauuugggu

SEQ ID NO: 281064 - RNA, 16 nt, Homo sapiens
gcaguguguuuaauag

SEQ ID NO: 281065 - RNA, 20 nt, Homo sapiens
gcauaugucuuuauggcagc

SEQ ID NO: 281066 - RNA, 22 nt, Homo sapiens
gcaugcacuguauuuaaguauc

SEQ ID NO: 281067 - RNA, 22 nt, Homo sapiens
gcauggagaaggggacugauuc

SEQ ID NO: 281068 - RNA, 19 nt, Homo sapiens
gccaccuggugcguguucu

SEQ ID NO: 281069 - RNA, 22 nt, Homo sapiens
gccauugcacuacagccuaggc

SEQ ID NO: 281070 - RNA, 22 nt, Homo sapiens
gccauugcacuccagccuaggu

SEQ ID NO: 281071 - RNA, 22 nt, Homo sapiens
gccauugcacucuagccuaggu

SEQ ID NO: 281072 - RNA, 22 nt, Homo sapiens
gcccacuguuaaauuuguuuua

SEQ ID NO: 281073 - RNA, 22 nt, Homo sapiens
gcccagauguuuggggucaugg

SEQ ID NO: 281074 - RNA, 22 nt, Homo sapiens
gccuagagaguuaucaggcugu

SEQ ID NO: 281075 - RNA, 22 nt, Homo sapiens
gccuaguguuaauguguguuca

SEQ ID NO: 281076 - RNA, 22 nt, Homo sapiens
gccucaguuguggccagggauu

SEQ ID NO: 281077 - RNA, 22 nt, Homo sapiens
gcgguagcauagacugcaggac

SEQ ID NO: 281078 - RNA, 19 nt, Homo sapiens
gcucaccuugcugcuccag

SEQ ID NO: 281079 - RNA, 22 nt, Homo sapiens
gcuccauuuuccauuucucuaa

SEQ ID NO: 281080 - RNA, 22 nt, Homo sapiens
gcugaaauguuuaauuugggag

SEQ ID NO: 281081 - RNA, 22 nt, Homo sapiens
gcugcuguggcagauuggauuc

SEQ ID NO: 281082 - RNA, 22 nt, Homo sapiens
gcugcuguuauucaucagaacu

SEQ ID NO: 281083 - RNA, 22 nt, Homo sapiens
gcuggcuuucuccugaucucag

SEQ ID NO: 281084 - RNA, 22 nt, Homo sapiens
gcuggugaaggcugaaaagugg

SEQ ID NO: 281085 - RNA, 22 nt, Homo sapiens
gcugugauucuguguagauagu

SEQ ID NO: 281086 - RNA, 22 nt, Homo sapiens
gcuguguucucgaggcggggga

SEQ ID NO: 281087 - RNA, 22 nt, Homo sapiens
gcuguugguaaaaaggacauga

SEQ ID NO: 281088 - RNA, 19 nt, Homo sapiens
gcuuguccacgugagauaa

SEQ ID NO: 281089 - RNA, 22 nt, Homo sapiens
gcuuuguugauggugagucugu

SEQ ID NO: 281090 - RNA, 22 nt, Homo sapiens
ggaaagacuauuguaaaggaug

SEQ ID NO: 281091 - RNA, 22 nt, Homo sapiens
ggaagaauauuaggggauuucg

SEQ ID NO: 281092 - RNA, 22 nt, Homo sapiens
ggaagagugaauuaucuugacu

SEQ ID NO: 281093 - RNA, 20 nt, Homo sapiens
ggaauagucuacacucugac

SEQ ID NO: 281094 - RNA, 22 nt, Homo sapiens
ggaauauaaaaagccccagaau

SEQ ID NO: 281095 - RNA, 23 nt, Homo sapiens
ggaaugaaaccugguuaugauau

SEQ ID NO: 281096 - RNA, 22 nt, Homo sapiens
ggaauggaacaaagucuugaaa

SEQ ID NO: 281097 - RNA, 22 nt, Homo sapiens
ggaauugcaucaaaugcaggua

SEQ ID NO: 281098 - RNA, 22 nt, Homo sapiens
ggacaagagacugggacacuga

SEQ ID NO: 281099 - RNA, 22 nt, Homo sapiens
ggacaagaucuuccaccauuca

SEQ ID NO: 281100 - RNA, 22 nt, Homo sapiens
ggacauguauauauaugugugu

SEQ ID NO: 281101 - RNA, 22 nt, Homo sapiens
ggacuagggacauggggagcug

SEQ ID NO: 281102 - RNA, 22 nt, Homo sapiens
ggagagcuaggcagagguuugu

SEQ ID NO: 281103 - RNA, 22 nt, Homo sapiens
ggagauccucugcgggcaaaga

SEQ ID NO: 281104 - RNA, 22 nt, Homo sapiens
ggaggcuaguaaaaagguagaa

SEQ ID NO: 281105 - RNA, 16 nt, Homo sapiens
ggaggucaucugggaa

SEQ ID NO: 281106 - RNA, 20 nt, Homo sapiens
ggagguguugauuuuucuuu

SEQ ID NO: 281107 - RNA, 20 nt, Homo sapiens
ggagguuguauaaguacauc

SEQ ID NO: 281108 - RNA, 21 nt, Homo sapiens
ggaguauaaggcaaaggagug

SEQ ID NO: 281109 - RNA, 22 nt, Homo sapiens
ggaguguuccauuugucacauu

SEQ ID NO: 281110 - RNA, 22 nt, Homo sapiens
ggauacauuuuuccuccucuuc

SEQ ID NO: 281111 - RNA, 22 nt, Homo sapiens
ggaugcauucaacuuccaguuc

SEQ ID NO: 281112 - RNA, 22 nt, Homo sapiens
ggauggcauuucuuuagcuuuu

SEQ ID NO: 281113 - RNA, 23 nt, Homo sapiens
ggauucaucuguuuguucgcugu

SEQ ID NO: 281114 - RNA, 22 nt, Homo sapiens
ggcaaaauggccagugggucac

SEQ ID NO: 281115 - RNA, 22 nt, Homo sapiens
ggcaacaaagacauuucaacau

SEQ ID NO: 281116 - RNA, 21 nt, Homo sapiens
ggcaagaaacacaaucaagua

SEQ ID NO: 281117 - RNA, 22 nt, Homo sapiens
ggcaagaaccagggauuugcgu

SEQ ID NO: 281118 - RNA, 21 nt, Homo sapiens
ggcaagagaauacaacauaaa

SEQ ID NO: 281119 - RNA, 22 nt, Homo sapiens
caguacaauguugauuagaagu

SEQ ID NO: 281120 - RNA, 22 nt, Homo sapiens
cagucacugggauuauggucau

SEQ ID NO: 281121 - RNA, 20 nt, Homo sapiens
cagucauagacaucagaguc

SEQ ID NO: 281122 - RNA, 22 nt, Homo sapiens
cagugaauuucaggucaagagu

SEQ ID NO: 281123 - RNA, 18 nt, Homo sapiens
cagugcaauacaggagag

SEQ ID NO: 281124 - RNA, 22 nt, Homo sapiens
cagugcuuuaucaaguccucca

SEQ ID NO: 281125 - RNA, 22 nt, Homo sapiens
caguggaugauguuuucugugg

SEQ ID NO: 281126 - RNA, 23 nt, Homo sapiens
cagugguguuagagaaaucuuuu

SEQ ID NO: 281127 - RNA, 22 nt, Homo sapiens
cauacaagcuacaaucacaaag

SEQ ID NO: 281128 - RNA, 22 nt, Homo sapiens
cauagcacugagcucuacccuc

SEQ ID NO: 281129 - RNA, 22 nt, Homo sapiens
cauaugguuuuauguucuucau

SEQ ID NO: 281130 - RNA, 23 nt, Homo sapiens
caucacauagaggaaagaggaca

SEQ ID NO: 281131 - RNA, 22 nt, Homo sapiens
caucacaugcuuauuuuccuca

SEQ ID NO: 281132 - RNA, 22 nt, Homo sapiens
caucucauugaauugcugagca

SEQ ID NO: 281133 - RNA, 22 nt, Homo sapiens
caugcacugaguccaccucugg

SEQ ID NO: 281134 - RNA, 19 nt, Homo sapiens
caugccacugcacuugagu

SEQ ID NO: 281135 - RNA, 22 nt, Homo sapiens
cauggcacauauauaucuaggu

SEQ ID NO: 281136 - RNA, 22 nt, Homo sapiens
cauggcacaucuuuucugacua

SEQ ID NO: 281137 - RNA, 22 nt, Homo sapiens
cauggcacuggugggagugucu

SEQ ID NO: 281138 - RNA, 22 nt, Homo sapiens
cauggcauuugcagaguugaaa

SEQ ID NO: 281139 - RNA, 22 nt, Homo sapiens
cauggcccugggcugggcgaac

SEQ ID NO: 281140 - RNA, 22 nt, Homo sapiens
cauggcuuucacaguaaagccu

SEQ ID NO: 281141 - RNA, 22 nt, Homo sapiens
caugggcacugacuugcauucg

SEQ ID NO: 281142 - RNA, 22 nt, Homo sapiens
caugguacugccacagaagagu

SEQ ID NO: 281143 - RNA, 22 nt, Homo sapiens
cauguauagauuccauaguggu

SEQ ID NO: 281144 - RNA, 22 nt, Homo sapiens
cauuacacuuguaagguuuuuc

SEQ ID NO: 281145 - RNA, 22 nt, Homo sapiens
cauuccacuggauaaacaaggu

SEQ ID NO: 281146 - RNA, 22 nt, Homo sapiens
cauugcaacuucugccucccag

SEQ ID NO: 281147 - RNA, 22 nt, Homo sapiens
cauugcaaugaggucuugcagu

SEQ ID NO: 281148 - RNA, 19 nt, Homo sapiens
cauugcacuccacccuggg

SEQ ID NO: 281149 - RNA, 22 nt, Homo sapiens
cauugcacuccagccuaggcaa

SEQ ID NO: 281150 - RNA, 22 nt, Homo sapiens
cauugcacuccagccugaguga

SEQ ID NO: 281151 - RNA, 22 nt, Homo sapiens
cauugcacuccagccuggccaa

SEQ ID NO: 281152 - RNA, 22 nt, Homo sapiens
cauugcacuccagccuugguga

SEQ ID NO: 281153 - RNA, 22 nt, Homo sapiens
cauugcacuccauccuuggcaa

SEQ ID NO: 281154 - RNA, 22 nt, Homo sapiens
cauugcacucuagccucggcaa

SEQ ID NO: 281155 - RNA, 22 nt, Homo sapiens
cauugguuaguuaacuuuaaga

SEQ ID NO: 281156 - RNA, 22 nt, Homo sapiens
cauugguugaacagauuguguu

SEQ ID NO: 281157 - RNA, 22 nt, Homo sapiens
cauugucccucaaugacuauga

SEQ ID NO: 281158 - RNA, 22 nt, Homo sapiens
ccaaguguucucauuguucaau

SEQ ID NO: 281159 - RNA, 22 nt, Homo sapiens
ccagaauucucauuggaaggaa

SEQ ID NO: 281160 - RNA, 22 nt, Homo sapiens
ccagcaccauuuguugaauagg

SEQ ID NO: 281161 - RNA, 22 nt, Homo sapiens
ccaggguugagacccacugacu

SEQ ID NO: 281162 - RNA, 22 nt, Homo sapiens
ccagugucugacagacacggcg

SEQ ID NO: 281163 - RNA, 20 nt, Homo sapiens
ccaguguuauuuauguucua

SEQ ID NO: 281164 - RNA, 19 nt, Homo sapiens
ccaguguugccagagcuga

SEQ ID NO: 281165 - RNA, 22 nt, Homo sapiens
ccaucacacugugauuauuauc

SEQ ID NO: 281166 - RNA, 22 nt, Homo sapiens
cccagagacagaaugauaaacu

SEQ ID NO: 281167 - RNA, 22 nt, Homo sapiens
cccagugaagagaaccuuacga

SEQ ID NO: 281168 - RNA, 22 nt, Homo sapiens
cccauuguuaaguugaguaucu

SEQ ID NO: 281169 - RNA, 22 nt, Homo sapiens
ccccagguuucaauaaagccca

SEQ ID NO: 281170 - RNA, 22 nt, Homo sapiens
aggaagugucuucuuuuaggca

SEQ ID NO: 281171 - RNA, 22 nt, Homo sapiens
aggaagugugcaauuaauuucu

SEQ ID NO: 281172 - RNA, 23 nt, Homo sapiens
aggaauggaaaaccaaguaucau

SEQ ID NO: 281173 - RNA, 22 nt, Homo sapiens
aggacacugagcaugggagguu

SEQ ID NO: 281174 - RNA, 22 nt, Homo sapiens
aggaccaugguauugcuuuggg

SEQ ID NO: 281175 - RNA, 22 nt, Homo sapiens
aggaccauuguguagcagacau

SEQ ID NO: 281176 - RNA, 22 nt, Homo sapiens
aggagaucagccucccugcaac

SEQ ID NO: 281177 - RNA, 22 nt, Homo sapiens
aggagaugaagcuuuaucuaaa

SEQ ID NO: 281178 - RNA, 22 nt, Homo sapiens
aggagcacaauggucaugugga

SEQ ID NO: 281179 - RNA, 21 nt, Homo sapiens
aggagcauucaugacgagguu

SEQ ID NO: 281180 - RNA, 21 nt, Homo sapiens
aggagcauucucuugcuuugu

SEQ ID NO: 281181 - RNA, 20 nt, Homo sapiens
aggagcauuuacauuggcuc

SEQ ID NO: 281182 - RNA, 22 nt, Homo sapiens
aggaggauugcuuucaucuuuu

SEQ ID NO: 281183 - RNA, 22 nt, Homo sapiens
aggagguagaacauugccauuu

SEQ ID NO: 281184 - RNA, 22 nt, Homo sapiens
aggagguagucugucccuuagc

SEQ ID NO: 281185 - RNA, 22 nt, Homo sapiens
aggauuagagacuucucuaccu

SEQ ID NO: 281186 - RNA, 22 nt, Homo sapiens
aggcaagaaugcuuguuucacc

SEQ ID NO: 281187 - RNA, 22 nt, Homo sapiens
aggcagaugagguccucagcug

SEQ ID NO: 281188 - RNA, 22 nt, Homo sapiens
aggcagucugaguuuugaaagg

SEQ ID NO: 281189 - RNA, 22 nt, Homo sapiens
aggcaugguggcacauacaugu

SEQ ID NO: 281190 - RNA, 22 nt, Homo sapiens
aggcaugugugcagacugucug

SEQ ID NO: 281191 - RNA, 22 nt, Homo sapiens
aggcuagacuuugagaauuuuu

SEQ ID NO: 281192 - RNA, 22 nt, Homo sapiens
aggcuguguggauaauauuggg

SEQ ID NO: 281193 - RNA, 22 nt, Homo sapiens
agggcaagacuuguuaagaaca

SEQ ID NO: 281194 - RNA, 22 nt, Homo sapiens
aggguaguaggcuugggauugg

SEQ ID NO: 281195 - RNA, 22 nt, Homo sapiens
agguaauagcacaugauaccuu

SEQ ID NO: 281196 - RNA, 22 nt, Homo sapiens
agguaguguuauuugcagcuga

SEQ ID NO: 281197 - RNA, 20 nt, Homo sapiens
agguaguuauacaaaugugu

SEQ ID NO: 281198 - RNA, 22 nt, Homo sapiens
agguauguauguaugggagaaa

SEQ ID NO: 281199 - RNA, 22 nt, Homo sapiens
aggugaauggauaaacuguggg

SEQ ID NO: 281200 - RNA, 22 nt, Homo sapiens
aggugcaugcuucacuggauau

SEQ ID NO: 281201 - RNA, 22 nt, Homo sapiens
aggugcucuuccuguaggucac

SEQ ID NO: 281202 - RNA, 22 nt, Homo sapiens
aggugguauuucaaaguggcag

SEQ ID NO: 281203 - RNA, 22 nt, Homo sapiens
aggugguuuuaggcagagacau

SEQ ID NO: 281204 - RNA, 20 nt, Homo sapiens
agguucaaaucccaaucaug

SEQ ID NO: 281205 - RNA, 22 nt, Homo sapiens
aguaaagcaucagcuagaugug

SEQ ID NO: 281206 - RNA, 22 nt, Homo sapiens
aguaacaggauccaaagaaugu

SEQ ID NO: 281207 - RNA, 22 nt, Homo sapiens
aguaccauuacucacuuauuuu

SEQ ID NO: 281208 - RNA, 22 nt, Homo sapiens
aguaccauuagauuaggaugac

SEQ ID NO: 281209 - RNA, 22 nt, Homo sapiens
aguauguagugcaaucagucag

SEQ ID NO: 281210 - RNA, 22 nt, Homo sapiens
agucaagugggguuagauaguu

SEQ ID NO: 281211 - RNA, 22 nt, Homo sapiens
agucaguguguauugauggcac

SEQ ID NO: 281212 - RNA, 22 nt, Homo sapiens
agucaugggagagaugugaucg

SEQ ID NO: 281213 - RNA, 22 nt, Homo sapiens
agucgguguuacugacagaaug

SEQ ID NO: 281214 - RNA, 22 nt, Homo sapiens
agucugguguucucacacuagu

SEQ ID NO: 281215 - RNA, 22 nt, Homo sapiens
agugacaugggaucaaaucuga

SEQ ID NO: 281216 - RNA, 22 nt, Homo sapiens
agugcaaagccgagguuucuug

SEQ ID NO: 281217 - RNA, 22 nt, Homo sapiens
agugcaauaaggauguagaacu

SEQ ID NO: 281218 - RNA, 22 nt, Homo sapiens
agugcaguggcauggucauaac

SEQ ID NO: 281219 - RNA, 22 nt, Homo sapiens
agugcaguugucacgugccuuc

SEQ ID NO: 281220 - RNA, 22 nt, Homo sapiens
agugcauugagacuugugaguu

SEQ ID NO: 281221 - RNA, 23 nt, Homo sapiens
agugccuaguauauaggaggcgc

SEQ ID NO: 281222 - RNA, 22 nt, Homo sapiens
agugccuauugauggaaagaua

SEQ ID NO: 281223 - RNA, 22 nt, Homo sapiens
aguggaguguaaagcgucuuuu

SEQ ID NO: 281224 - RNA, 22 nt, Homo sapiens
aguggauguuguggccugggag

SEQ ID NO: 281225 - RNA, 22 nt, Homo sapiens
aguggauuuuagacugagauuu

SEQ ID NO: 281226 - RNA, 22 nt, Homo sapiens
gugcaauguuaauuacuugacu

SEQ ID NO: 281227 - RNA, 22 nt, Homo sapiens
gugcaauucacuguuaugucug

SEQ ID NO: 281228 - RNA, 22 nt, Homo sapiens
gugcacauauggugcauaagug

SEQ ID NO: 281229 - RNA, 22 nt, Homo sapiens
gugcacaugcgugcgcacauau

SEQ ID NO: 281230 - RNA, 22 nt, Homo sapiens
gugcacaugguagguauugagu

SEQ ID NO: 281231 - RNA, 21 nt, Homo sapiens
gugcagaugccacagucacuc

SEQ ID NO: 281232 - RNA, 22 nt, Homo sapiens
gugcaguuugaaaguagaaaca

SEQ ID NO: 281233 - RNA, 22 nt, Homo sapiens
gugccacugcacuccggccugg

SEQ ID NO: 281234 - RNA, 22 nt, Homo sapiens
gugccuagugcuauugugcccu

SEQ ID NO: 281235 - RNA, 22 nt, Homo sapiens
gugcgggaggcgcgccuaggug

SEQ ID NO: 281236 - RNA, 22 nt, Homo sapiens
gugcuauguuauccagcaagau

SEQ ID NO: 281237 - RNA, 22 nt, Homo sapiens
guggaaaaguaguugcgguuuu

SEQ ID NO: 281238 - RNA, 22 nt, Homo sapiens
guggaaagaacacaaaauuagg

SEQ ID NO: 281239 - RNA, 22 nt, Homo sapiens
guggaaggucaugaauguucuu

SEQ ID NO: 281240 - RNA, 22 nt, Homo sapiens
guggaauauaaagcaucgugua

SEQ ID NO: 281241 - RNA, 17 nt, Homo sapiens
guggaaugucaugucaa

SEQ ID NO: 281242 - RNA, 22 nt, Homo sapiens
guggaauuauagagacaucuug

SEQ ID NO: 281243 - RNA, 22 nt, Homo sapiens
ugagaugauagauauguuaauu

SEQ ID NO: 281244 - RNA, 21 nt, Homo sapiens
ugagaugcaaucaccagggag

SEQ ID NO: 281245 - RNA, 22 nt, Homo sapiens
ugagaugcauauucuggcuccu

SEQ ID NO: 281246 - RNA, 20 nt, Homo sapiens
ugagaugcauugggauguuu

SEQ ID NO: 281247 - RNA, 22 nt, Homo sapiens
ugagauggguaauuaaauggug

SEQ ID NO: 281248 - RNA, 22 nt, Homo sapiens
ugagauggguucugguccccug

SEQ ID NO: 281249 - RNA, 21 nt, Homo sapiens
ugagauuaaguuguuuagaag

SEQ ID NO: 281250 - RNA, 22 nt, Homo sapiens
ugagauuaaucuuuaaguaaga

SEQ ID NO: 281251 - RNA, 22 nt, Homo sapiens
ugagauuacguucggcccacuu

SEQ ID NO: 281252 - RNA, 19 nt, Homo sapiens
ugagauuguaugaggagau

SEQ ID NO: 281253 - RNA, 22 nt, Homo sapiens
ugagcaagaucuuuauaauuag

SEQ ID NO: 281254 - RNA, 22 nt, Homo sapiens
ugagcaauaaaguuacacaguu

SEQ ID NO: 281255 - RNA, 22 nt, Homo sapiens
ugagcagaguuguuucuccuga

SEQ ID NO: 281256 - RNA, 21 nt, Homo sapiens
ugagcauuaguacaguaggga

SEQ ID NO: 281257 - RNA, 22 nt, Homo sapiens
ugagccaaguucacaccauugc

SEQ ID NO: 281258 - RNA, 22 nt, Homo sapiens
ugagccaugguuagcuucucau

SEQ ID NO: 281259 - RNA, 22 nt, Homo sapiens
ugagcuaggauccugucacugu

SEQ ID NO: 281260 - RNA, 22 nt, Homo sapiens
ugagcucaguauuucauaaaca

SEQ ID NO: 281261 - RNA, 20 nt, Homo sapiens
ugagcucaugacauuuuucu

SEQ ID NO: 281262 - RNA, 22 nt, Homo sapiens
ugagcugagaucaugcuauugu

SEQ ID NO: 281263 - RNA, 22 nt, Homo sapiens
ugagcugagaucgugccauugu

SEQ ID NO: 281264 - RNA, 22 nt, Homo sapiens
ugagcugagauuaagcugcugc

SEQ ID NO: 281265 - RNA, 22 nt, Homo sapiens
ugaggaauguguguuaaagaua

SEQ ID NO: 281266 - RNA, 22 nt, Homo sapiens
ugaggagugagaaauugguuuc

SEQ ID NO: 281267 - RNA, 22 nt, Homo sapiens
ugaggcacucccuagcggggug

SEQ ID NO: 281268 - RNA, 22 nt, Homo sapiens
ugagguacaacauggacugaag

SEQ ID NO: 281269 - RNA, 22 nt, Homo sapiens
ugagguagaggugaacuugacc

SEQ ID NO: 281270 - RNA, 22 nt, Homo sapiens
ugagguagguaccauuaucacu

SEQ ID NO: 281271 - RNA, 22 nt, Homo sapiens
ugagguaggugaagaaugcacg

SEQ ID NO: 281272 - RNA, 19 nt, Homo sapiens
ugagguauuuguugggaga

SEQ ID NO: 281273 - RNA, 22 nt, Homo sapiens
ugaggugaaguaauauucuaag

SEQ ID NO: 281274 - RNA, 22 nt, Homo sapiens
ugagguuggggucagggcuagc

SEQ ID NO: 281275 - RNA, 22 nt, Homo sapiens
ugagguuguccacuauaaucca

SEQ ID NO: 281276 - RNA, 22 nt, Homo sapiens
ugaguagaagugaagauagugg

SEQ ID NO: 281277 - RNA, 22 nt, Homo sapiens
ugaguagagaauucagcuaagg

SEQ ID NO: 281278 - RNA, 22 nt, Homo sapiens
ugaguaggauugguauuucuuc

SEQ ID NO: 281279 - RNA, 22 nt, Homo sapiens
ugaguagucagugggcaggaag

SEQ ID NO: 281280 - RNA, 22 nt, Homo sapiens
ugaguaugaguucaggaaaggc

SEQ ID NO: 281281 - RNA, 22 nt, Homo sapiens
ugaguauguuuaaugugacaau

SEQ ID NO: 281282 - RNA, 22 nt, Homo sapiens
ugagucaauggaggcucagagc

SEQ ID NO: 281283 - RNA, 22 nt, Homo sapiens
ugagucaugcuggagucauggc

SEQ ID NO: 281284 - RNA, 22 nt, Homo sapiens
ugagugaaggggcucuguugug

SEQ ID NO: 281285 - RNA, 22 nt, Homo sapiens
ugagugaggcugggcagucccu

SEQ ID NO: 281286 - RNA, 22 nt, Homo sapiens
ugagugagguucuacucuguga

SEQ ID NO: 281287 - RNA, 22 nt, Homo sapiens
ugaguuagguguuuuaaauaua

SEQ ID NO: 281288 - RNA, 22 nt, Homo sapiens
ugaguucaugcuuguaguucua

SEQ ID NO: 281289 - RNA, 20 nt, Homo sapiens
ugaguuccuuguucagaagc

SEQ ID NO: 281290 - RNA, 22 nt, Homo sapiens
ugauaagugagauagcaaguga

SEQ ID NO: 281291 - RNA, 22 nt, Homo sapiens
ugauagucauucaauuuagcca

SEQ ID NO: 281292 - RNA, 22 nt, Homo sapiens
ugauaucucuugccuccaaaug

SEQ ID NO: 281293 - RNA, 22 nt, Homo sapiens
ugauaucugaauagauacacaa

SEQ ID NO: 281294 - RNA, 22 nt, Homo sapiens
agugggccccuagaggugaggu

SEQ ID NO: 281295 - RNA, 22 nt, Homo sapiens
aguggguguuccauuggauaaa

SEQ ID NO: 281296 - RNA, 22 nt, Homo sapiens
agugguauaauauuauuuugaa

SEQ ID NO: 281297 - RNA, 22 nt, Homo sapiens
agugguuuuaaguagagcauac

SEQ ID NO: 281298 - RNA, 20 nt, Homo sapiens
agugguuuucaaauaugucu

SEQ ID NO: 281299 - RNA, 22 nt, Homo sapiens
agugguuuuggaauggaauuca

SEQ ID NO: 281300 - RNA, 22 nt, Homo sapiens
agugucaggagacagguagcug

SEQ ID NO: 281301 - RNA, 22 nt, Homo sapiens
aguuccauuuauucucgucucu

SEQ ID NO: 281302 - RNA, 18 nt, Homo sapiens
aguuguuuuauccugccc

SEQ ID NO: 281303 - RNA, 22 nt, Homo sapiens
auaaagacacuuggcaugauuu

SEQ ID NO: 281304 - RNA, 22 nt, Homo sapiens
auaaagccaugagcuugagaug

SEQ ID NO: 281305 - RNA, 22 nt, Homo sapiens
auaaaguguuuaguauaggcaa

SEQ ID NO: 281306 - RNA, 22 nt, Homo sapiens
auaaaugccuguuguuuuaagc

SEQ ID NO: 281307 - RNA, 22 nt, Homo sapiens
auaaaugcuuccagucauuaaa

SEQ ID NO: 281308 - RNA, 22 nt, Homo sapiens
auaacauccuuucuuaucguug

SEQ ID NO: 281309 - RNA, 22 nt, Homo sapiens
auaacucuguuuuuuucaugca

SEQ ID NO: 281310 - RNA, 22 nt, Homo sapiens
auaagagcaggcuucuggccag

SEQ ID NO: 281311 - RNA, 22 nt, Homo sapiens
auaaguauuuggacuuuacugu

SEQ ID NO: 281312 - RNA, 22 nt, Homo sapiens
auaauacuuuuauuuugaggaa

SEQ ID NO: 281313 - RNA, 22 nt, Homo sapiens
auaaugcuuuucuagguugcau

SEQ ID NO: 281314 - RNA, 22 nt, Homo sapiens
auacacgugcagaacaugcagg

SEQ ID NO: 281315 - RNA, 19 nt, Homo sapiens
auacacguguauacauaca

SEQ ID NO: 281316 - RNA, 22 nt, Homo sapiens
uaagugaauuugacagguaaug

SEQ ID NO: 281317 - RNA, 22 nt, Homo sapiens
uaagugcuugacuuugauguuu

SEQ ID NO: 281318 - RNA, 22 nt, Homo sapiens
uaauacauucaaggugguaguu

SEQ ID NO: 281319 - RNA, 22 nt, Homo sapiens
uaauacuagugaauagcaggau

SEQ ID NO: 281320 - RNA, 22 nt, Homo sapiens
uaauagcucggauaaacaugau

SEQ ID NO: 281321 - RNA, 22 nt, Homo sapiens
uaauccuagcacuuuggaagac

SEQ ID NO: 281322 - RNA, 22 nt, Homo sapiens
uaaucucagcugagcugagauu

SEQ ID NO: 281323 - RNA, 22 nt, Homo sapiens
uaaugcacucgaaucauggaau

SEQ ID NO: 281324 - RNA, 19 nt, Homo sapiens
uaaugccacugccuggcau

SEQ ID NO: 281325 - RNA, 22 nt, Homo sapiens
uaaugcuguggucuaaugggga

SEQ ID NO: 281326 - RNA, 22 nt, Homo sapiens
uaaugcuguggucugguuuaaa

SEQ ID NO: 281327 - RNA, 22 nt, Homo sapiens
uacaaagcuacucgagggcagg

SEQ ID NO: 281328 - RNA, 22 nt, Homo sapiens
uacaaagugggaaacgaagguu

SEQ ID NO: 281329 - RNA, 22 nt, Homo sapiens
uacaacacugguucgacaugug

SEQ ID NO: 281330 - RNA, 16 nt, Homo sapiens
uacaacagugaguaug

SEQ ID NO: 281331 - RNA, 22 nt, Homo sapiens
uacacacguguguauauauaca

SEQ ID NO: 281332 - RNA, 22 nt, Homo sapiens
uacacaugugaguucuuuucua

SEQ ID NO: 281333 - RNA, 22 nt, Homo sapiens
uacaccugaguuugugguuuuc

SEQ ID NO: 281334 - RNA, 22 nt, Homo sapiens
uacaccugcacucuagccuggg

SEQ ID NO: 281335 - RNA, 20 nt, Homo sapiens
uacacguguagcauucucua

SEQ ID NO: 281336 - RNA, 23 nt, Homo sapiens
uacagcugcagaaucaggcuaag

SEQ ID NO: 281337 - RNA, 22 nt, Homo sapiens
uacaguagagaucagcaaacua

SEQ ID NO: 281338 - RNA, 22 nt, Homo sapiens
uacagucuggaggccuguguug

SEQ ID NO: 281339 - RNA, 22 nt, Homo sapiens
uacaguggugugaucucagcuc

SEQ ID NO: 281340 - RNA, 22 nt, Homo sapiens
uacauaguuacuuccauuucca

SEQ ID NO: 281341 - RNA, 22 nt, Homo sapiens
uacauguauccauuguuuuugg

SEQ ID NO: 281342 - RNA, 22 nt, Homo sapiens
uacaugugccauguugguuugc

SEQ ID NO: 281343 - RNA, 22 nt, Homo sapiens
uacauugucauauucucucucu

SEQ ID NO: 281344 - RNA, 22 nt, Homo sapiens
uaccagugucagcuuccugugu

SEQ ID NO: 281345 - RNA, 22 nt, Homo sapiens
uaccauguauguuucuccauug

SEQ ID NO: 281346 - RNA, 22 nt, Homo sapiens
uacccuuuaguauaaaaucaga

SEQ ID NO: 281347 - RNA, 22 nt, Homo sapiens
uacuaguaagggugguuuggcu

SEQ ID NO: 281348 - RNA, 22 nt, Homo sapiens
uacucaguaagugcuggcugcu

SEQ ID NO: 281349 - RNA, 22 nt, Homo sapiens
uacugcacuccagcuuaggaga

SEQ ID NO: 281350 - RNA, 19 nt, Homo sapiens
uacugcacuccagucuggg

SEQ ID NO: 281351 - RNA, 22 nt, Homo sapiens
uacugcagucagacuccugggc

SEQ ID NO: 281352 - RNA, 22 nt, Homo sapiens
uacugcaucgaaaugcuuuuau

SEQ ID NO: 281353 - RNA, 22 nt, Homo sapiens
uacugcauuccaaucugggcga

SEQ ID NO: 281354 - RNA, 22 nt, Homo sapiens
uacuguacugcaguucugcaaa

SEQ ID NO: 281355 - RNA, 22 nt, Homo sapiens
uacuuuguagagugugagaauu

SEQ ID NO: 281356 - RNA, 22 nt, Homo sapiens
uagaauguaacaguuaaaagca

SEQ ID NO: 281357 - RNA, 22 nt, Homo sapiens
uagacacugcauauuuuuuuaa

SEQ ID NO: 281358 - RNA, 21 nt, Homo sapiens
uagagagcaauaccuccagag

SEQ ID NO: 281359 - RNA, 22 nt, Homo sapiens
uagagguagagugacuucccca

SEQ ID NO: 281360 - RNA, 22 nt, Homo sapiens
uagaguacucugguaaguucuu

SEQ ID NO: 281361 - RNA, 22 nt, Homo sapiens
uagaguguuuuguuaggcagca

SEQ ID NO: 281362 - RNA, 22 nt, Homo sapiens
ugauaucugaucauccuugaua

SEQ ID NO: 281363 - RNA, 21 nt, Homo sapiens
ugauaugguagaagagagaca

SEQ ID NO: 281364 - RNA, 21 nt, Homo sapiens
ugauaugguuuggauaugugu

SEQ ID NO: 281365 - RNA, 18 nt, Homo sapiens
ugauaugguuuggcucug

SEQ ID NO: 281366 - RNA, 22 nt, Homo sapiens
ugauauguggauucagcucaaa

SEQ ID NO: 281367 - RNA, 22 nt, Homo sapiens
ugauauguuagaaucuugcaag

SEQ ID NO: 281368 - RNA, 20 nt, Homo sapiens
ugauauuucuggaaguggag

SEQ ID NO: 281369 - RNA, 22 nt, Homo sapiens
ugaucacagcuugacuaaagga

SEQ ID NO: 281370 - RNA, 22 nt, Homo sapiens
ugauccagugcucaguuggagu

SEQ ID NO: 281371 - RNA, 22 nt, Homo sapiens
ugaucuuuuuaauguccauggg

SEQ ID NO: 281372 - RNA, 22 nt, Homo sapiens
ugaugaaguauaggaagggcuu

SEQ ID NO: 281373 - RNA, 22 nt, Homo sapiens
ugaugguuuuaaaaagaggagu

SEQ ID NO: 281374 - RNA, 22 nt, Homo sapiens
ugauguaggcauuuaagguuau

SEQ ID NO: 281375 - RNA, 22 nt, Homo sapiens
ugauuagaggaaugguagauua

SEQ ID NO: 281376 - RNA, 22 nt, Homo sapiens
ugauuggagaacaaacugcaua

SEQ ID NO: 281377 - RNA, 22 nt, Homo sapiens
ugauuuguccauguggcacgug

SEQ ID NO: 281378 - RNA, 22 nt, Homo sapiens
ugauuuguuucaggaguuuucu

SEQ ID NO: 281379 - RNA, 22 nt, Homo sapiens
ugcaaauguuaggugucauuau

SEQ ID NO: 281380 - RNA, 22 nt, Homo sapiens
ugcaagaaacauauuccacaag

SEQ ID NO: 281381 - RNA, 22 nt, Homo sapiens
ugcaagucaucuguccuucaga

SEQ ID NO: 281382 - RNA, 20 nt, Homo sapiens
ugcaaguugccuuuggaggc

SEQ ID NO: 281383 - RNA, 22 nt, Homo sapiens
ugcaaugugaaauaagcacauc

SEQ ID NO: 281384 - RNA, 22 nt, Homo sapiens
ugcaccacugcacuccagcuug

SEQ ID NO: 281385 - RNA, 22 nt, Homo sapiens
ugcaccaucuugcuucuguggu

SEQ ID NO: 281386 - RNA, 22 nt, Homo sapiens
ugcaccauugucaccuggguga

SEQ ID NO: 281387 - RNA, 22 nt, Homo sapiens
ugcagauucguuuugaggggua

SEQ ID NO: 281388 - RNA, 22 nt, Homo sapiens
ugcagguaggcaguaucauuua

SEQ ID NO: 281389 - RNA, 22 nt, Homo sapiens
aucgcacuccauccugggcaac

SEQ ID NO: 281390 - RNA, 22 nt, Homo sapiens
aucgcgccauuguacuccagcc

SEQ ID NO: 281391 - RNA, 16 nt, Homo sapiens
aucucagaccugcuga

SEQ ID NO: 281392 - RNA, 22 nt, Homo sapiens
aucucauuccuucugggcugau

SEQ ID NO: 281393 - RNA, 22 nt, Homo sapiens
aucuccaggugccagcugcgcc

SEQ ID NO: 281394 - RNA, 20 nt, Homo sapiens
aucucugggcaaaggaaaau

SEQ ID NO: 281395 - RNA, 22 nt, Homo sapiens
aucugauggagagcguguggcu

SEQ ID NO: 281396 - RNA, 22 nt, Homo sapiens
aucugcuccuggugaggguuuc

SEQ ID NO: 281397 - RNA, 22 nt, Homo sapiens
aucugggguuggcaaaguuugg

SEQ ID NO: 281398 - RNA, 22 nt, Homo sapiens
aucugugguuguaugcauauua

SEQ ID NO: 281399 - RNA, 22 nt, Homo sapiens
aucuucucuugaagggugggga

SEQ ID NO: 281400 - RNA, 22 nt, Homo sapiens
aucuugggugggaacugagaau

SEQ ID NO: 281401 - RNA, 22 nt, Homo sapiens
aucuuuaguggcuguuuucaga

SEQ ID NO: 281402 - RNA, 22 nt, Homo sapiens
aucuuugauuguagguacaaug

SEQ ID NO: 281403 - RNA, 22 nt, Homo sapiens
aucuuuggcgggaauaucacag

SEQ ID NO: 281404 - RNA, 22 nt, Homo sapiens
aucuuuggucaucacagcuaga

SEQ ID NO: 281405 - RNA, 22 nt, Homo sapiens
augaaaacaugauuugccuguu

SEQ ID NO: 281406 - RNA, 22 nt, Homo sapiens
augaaaucuuuggcagaucuua

SEQ ID NO: 281407 - RNA, 22 nt, Homo sapiens
augaaauugcuaucgcaguacu

SEQ ID NO: 281408 - RNA, 22 nt, Homo sapiens
augaagagaaaguggaucuugg

SEQ ID NO: 281409 - RNA, 22 nt, Homo sapiens
augaagaucucugccuuguguc

SEQ ID NO: 281410 - RNA, 22 nt, Homo sapiens
augaaugcaucuaucaaagcau

SEQ ID NO: 281411 - RNA, 23 nt, Homo sapiens
augaauguaaggaguguaagaaa

SEQ ID NO: 281412 - RNA, 22 nt, Homo sapiens
augacagcaucugugaaguugu

SEQ ID NO: 281413 - RNA, 22 nt, Homo sapiens
augacagugagugagcucucac

SEQ ID NO: 281414 - RNA, 22 nt, Homo sapiens
augaccaaugggcagagcuaga

SEQ ID NO: 281415 - RNA, 22 nt, Homo sapiens
augacuaaaggguuuauguuga

SEQ ID NO: 281416 - RNA, 22 nt, Homo sapiens
augacuggaacggcacuuuaca

SEQ ID NO: 281417 - RNA, 22 nt, Homo sapiens
augacuggauaauggacacaca

SEQ ID NO: 281418 - RNA, 22 nt, Homo sapiens
augagacaguucccuuuaucuu

SEQ ID NO: 281419 - RNA, 22 nt, Homo sapiens
augagauacuacaaaugaguuu

SEQ ID NO: 281420 - RNA, 22 nt, Homo sapiens
augagauauguuaaaaguuaaa

SEQ ID NO: 281421 - RNA, 22 nt, Homo sapiens
augagauauuuuauaagaucau

SEQ ID NO: 281422 - RNA, 22 nt, Homo sapiens
augagaugaggaauggcccucc

SEQ ID NO: 281423 - RNA, 22 nt, Homo sapiens
augagcagaagagauacacugu

SEQ ID NO: 281424 - RNA, 22 nt, Homo sapiens
augagcuguuuggaagacacuu

SEQ ID NO: 281425 - RNA, 22 nt, Homo sapiens
augaggaaggagccuuugucug

SEQ ID NO: 281426 - RNA, 22 nt, Homo sapiens
augaggugaguaaauaaaugaa

SEQ ID NO: 281427 - RNA, 22 nt, Homo sapiens
augaggugggagaaucacuuga

SEQ ID NO: 281428 - RNA, 22 nt, Homo sapiens
augaguaugagaauacauuaag

SEQ ID NO: 281429 - RNA, 19 nt, Homo sapiens
augaguuaggggaaauuuc

SEQ ID NO: 281430 - RNA, 22 nt, Homo sapiens
uagaucacucaggcaauaaaag

SEQ ID NO: 281431 - RNA, 22 nt, Homo sapiens
uagaucauauacuugccaugac

SEQ ID NO: 281432 - RNA, 20 nt, Homo sapiens
uagaugcauuuagauucauu

SEQ ID NO: 281433 - RNA, 22 nt, Homo sapiens
uagauuaucuguaugugcucuu

SEQ ID NO: 281434 - RNA, 22 nt, Homo sapiens
uagauuauuggcugauuugauc

SEQ ID NO: 281435 - RNA, 22 nt, Homo sapiens
uagcacaucuucuuggccugca

SEQ ID NO: 281436 - RNA, 22 nt, Homo sapiens
uagcaccuuagcauuucuagug

SEQ ID NO: 281437 - RNA, 22 nt, Homo sapiens
uagcagcaccccacucuacugg

SEQ ID NO: 281438 - RNA, 22 nt, Homo sapiens
uagcagcauaaauggacuaaga

SEQ ID NO: 281439 - RNA, 22 nt, Homo sapiens
uagcagcauuuuuguagaguau

SEQ ID NO: 281440 - RNA, 22 nt, Homo sapiens
uagcagucucagaaugcauggu

SEQ ID NO: 281441 - RNA, 22 nt, Homo sapiens
uagcauaauuuguagaaaauca

SEQ ID NO: 281442 - RNA, 22 nt, Homo sapiens
uagcaucagauuccauauucua

SEQ ID NO: 281443 - RNA, 22 nt, Homo sapiens
uagcaugacacuuguugaaugc

SEQ ID NO: 281444 - RNA, 18 nt, Homo sapiens
uagcaugaugcugagugc

SEQ ID NO: 281445 - RNA, 22 nt, Homo sapiens
uagcauggagucaugcacggcu

SEQ ID NO: 281446 - RNA, 22 nt, Homo sapiens
uagcucagcccagcuaagcuca

SEQ ID NO: 281447 - RNA, 22 nt, Homo sapiens
uagcuccacagcuauauauaau

SEQ ID NO: 281448 - RNA, 22 nt, Homo sapiens
uaggaaguacaucucagaaucu

SEQ ID NO: 281449 - RNA, 20 nt, Homo sapiens
uaggagcaaugagaguagaa

SEQ ID NO: 281450 - RNA, 22 nt, Homo sapiens
uaggauaguccuccugagaccu

SEQ ID NO: 281451 - RNA, 22 nt, Homo sapiens
uaggcacugagaauaugaggau

SEQ ID NO: 281452 - RNA, 22 nt, Homo sapiens
uaggccuuuuuaugucaauauc

SEQ ID NO: 281453 - RNA, 22 nt, Homo sapiens
uagggcaaggaacaguuaaaaa

SEQ ID NO: 281454 - RNA, 22 nt, Homo sapiens
uagggcuugugaucagguguag

SEQ ID NO: 281455 - RNA, 22 nt, Homo sapiens
uagggcuuuaguuugcuugugu

SEQ ID NO: 281456 - RNA, 22 nt, Homo sapiens
uagguaaguaugugugaugggg

SEQ ID NO: 281457 - RNA, 22 nt, Homo sapiens
uaggucaguuuuggcuuggcuu

SEQ ID NO: 281458 - RNA, 22 nt, Homo sapiens
uaggucuuuuaugaaauauauu

SEQ ID NO: 281459 - RNA, 23 nt, Homo sapiens
uagguuauuugguaaauauaugu

SEQ ID NO: 281460 - RNA, 22 nt, Homo sapiens
uagguucuccacagguucucca

SEQ ID NO: 281461 - RNA, 22 nt, Homo sapiens
uaguaguuuuguguauaauaau

SEQ ID NO: 281462 - RNA, 22 nt, Homo sapiens
uuuccaagaugcuuacuuucuc

SEQ ID NO: 281463 - RNA, 22 nt, Homo sapiens
uuuccauguuggugaaaugagg

SEQ ID NO: 281464 - RNA, 19 nt, Homo sapiens
uuucccugcagaccuacua

SEQ ID NO: 281465 - RNA, 22 nt, Homo sapiens
cuggaguuugaggcugcaguga

SEQ ID NO: 281466 - RNA, 22 nt, Homo sapiens
cuggcaccauacacuguuguug

SEQ ID NO: 281467 - RNA, 22 nt, Homo sapiens
cuggcaguguuucuugugggcu

SEQ ID NO: 281468 - RNA, 22 nt, Homo sapiens
cuggcgagacagcuccaucacu

SEQ ID NO: 281469 - RNA, 22 nt, Homo sapiens
cuggcugagugguaaguagagg

SEQ ID NO: 281470 - RNA, 22 nt, Homo sapiens
cugggaugauguaaauaggcua

SEQ ID NO: 281471 - RNA, 22 nt, Homo sapiens
cugggauggaggagaauuagag

SEQ ID NO: 281472 - RNA, 22 nt, Homo sapiens
cugggguaggacuggcuuuuga

SEQ ID NO: 281473 - RNA, 22 nt, Homo sapiens
cugguuguuacaaagagccugg

SEQ ID NO: 281474 - RNA, 22 nt, Homo sapiens
cugguuguuacaugcuugccag

SEQ ID NO: 281475 - RNA, 22 nt, Homo sapiens
cugguuguucuggaugggcagg

SEQ ID NO: 281476 - RNA, 22 nt, Homo sapiens
cuguaaggcacuaagcauaugu

SEQ ID NO: 281477 - RNA, 22 nt, Homo sapiens
cuguacucaucccauaugcacu

SEQ ID NO: 281478 - RNA, 22 nt, Homo sapiens
cugucacuggggcacauguccc

SEQ ID NO: 281479 - RNA, 22 nt, Homo sapiens
cugugauagguuagucaugaau

SEQ ID NO: 281480 - RNA, 22 nt, Homo sapiens
cugugcacaucuggcggcccga

SEQ ID NO: 281481 - RNA, 22 nt, Homo sapiens
cugugcauaucuuggacugugu

SEQ ID NO: 281482 - RNA, 22 nt, Homo sapiens
cugugcuugagagaugacacag

SEQ ID NO: 281483 - RNA, 23 nt, Homo sapiens
cuguggauaugaguuguaaaugg

SEQ ID NO: 281484 - RNA, 22 nt, Homo sapiens
cuguggauguauugcacagucu

SEQ ID NO: 281485 - RNA, 22 nt, Homo sapiens
cugugguugagcuuugccauga

SEQ ID NO: 281486 - RNA, 22 nt, Homo sapiens
cuuaacagugguauugaugacc

SEQ ID NO: 281487 - RNA, 22 nt, Homo sapiens
cuuaaguaguuguggaaugaau

SEQ ID NO: 281488 - RNA, 19 nt, Homo sapiens
cuuaggugaccaguuccca

SEQ ID NO: 281489 - RNA, 22 nt, Homo sapiens
cuucaccaguuuggcagucuca

SEQ ID NO: 281490 - RNA, 22 nt, Homo sapiens
cuucacuuuguuaaacuccaau

SEQ ID NO: 281491 - RNA, 22 nt, Homo sapiens
cuucaguucuguaaggacagca

SEQ ID NO: 281492 - RNA, 22 nt, Homo sapiens
cuuccaaguggggcacgugcca

SEQ ID NO: 281493 - RNA, 22 nt, Homo sapiens
cuuccagcuggguucagucagu

SEQ ID NO: 281494 - RNA, 22 nt, Homo sapiens
cuucccguuauugcccuugggu

SEQ ID NO: 281495 - RNA, 18 nt, Homo sapiens
cuuccuuagucugguuaa

SEQ ID NO: 281496 - RNA, 22 nt, Homo sapiens
cuucuguuaguucugauaacuu

SEQ ID NO: 281497 - RNA, 22 nt, Homo sapiens
cuucuugagacuuaggcuuugg

SEQ ID NO: 281498 - RNA, 22 nt, Homo sapiens
cuucuugagggccugcugggaa

SEQ ID NO: 281499 - RNA, 20 nt, Homo sapiens
cuugaagacuaugcugcuga

SEQ ID NO: 281500 - RNA, 23 nt, Homo sapiens
cuugagacaaaugcgugugugca

SEQ ID NO: 281501 - RNA, 22 nt, Homo sapiens
cuugagcauauucuauauuaaa

SEQ ID NO: 281502 - RNA, 22 nt, Homo sapiens
cuugcacauuacagaucugcau

SEQ ID NO: 281503 - RNA, 22 nt, Homo sapiens
cuugcagagcccauggauguca

SEQ ID NO: 281504 - RNA, 22 nt, Homo sapiens
cuugcagaggcccuggggagag

SEQ ID NO: 281505 - RNA, 22 nt, Homo sapiens
cuuggcacugcucacccuccuu

SEQ ID NO: 281506 - RNA, 22 nt, Homo sapiens
cuuggcuucuuuauguggcuau

SEQ ID NO: 281507 - RNA, 22 nt, Homo sapiens
cuugggcagugugcauguguau

SEQ ID NO: 281508 - RNA, 22 nt, Homo sapiens
cuuguacacuguuggugggaau

SEQ ID NO: 281509 - RNA, 22 nt, Homo sapiens
cuugucacuguuggcuuuagaa

SEQ ID NO: 281510 - RNA, 19 nt, Homo sapiens
cuugugccugaagcuuggg

SEQ ID NO: 281511 - RNA, 22 nt, Homo sapiens
cuugugccugaucuuagggggc

SEQ ID NO: 281512 - RNA, 22 nt, Homo sapiens
cuuguuguggaggggagugcag

SEQ ID NO: 281513 - RNA, 17 nt, Homo sapiens
cuuguugugguaguuug

SEQ ID NO: 281514 - RNA, 22 nt, Homo sapiens
cuuuacaguuggacucacgagg

SEQ ID NO: 281515 - RNA, 22 nt, Homo sapiens
cuuuagcaaggauauggggaug

SEQ ID NO: 281516 - RNA, 22 nt, Homo sapiens
cuuucugaggagaauagagaac

SEQ ID NO: 281517 - RNA, 22 nt, Homo sapiens
cuuugcacaucucugcuuuccc

SEQ ID NO: 281518 - RNA, 21 nt, Homo sapiens
cuuugcacugcuccucagcuc

SEQ ID NO: 281519 - RNA, 22 nt, Homo sapiens
cuuuggagaaaaguucuugggc

SEQ ID NO: 281520 - RNA, 22 nt, Homo sapiens
cuuugguucuguuuauaugcug

SEQ ID NO: 281521 - RNA, 19 nt, Homo sapiens
cuuugguugagcguguugg

SEQ ID NO: 281522 - RNA, 22 nt, Homo sapiens
cuuugguugugcucuccacuuu

SEQ ID NO: 281523 - RNA, 22 nt, Homo sapiens
cuuuguggggucuuuccucaaa

SEQ ID NO: 281524 - RNA, 22 nt, Homo sapiens
cuuuuacacugguggugggaau

SEQ ID NO: 281525 - RNA, 22 nt, Homo sapiens
cuuuuacacuguuggugggaau

SEQ ID NO: 281526 - RNA, 20 nt, Homo sapiens
cuuuuagcagcagcaagaga

SEQ ID NO: 281527 - RNA, 22 nt, Homo sapiens
cuuuugugauucuucaguuacu

SEQ ID NO: 281528 - RNA, 21 nt, Homo sapiens
cuuuuuacucguucauaugca

SEQ ID NO: 281529 - RNA, 22 nt, Homo sapiens
cuuuuugcugcagcaauacugg

SEQ ID NO: 281530 - RNA, 22 nt, Homo sapiens
gaaaauccauccccagggagua

SEQ ID NO: 281531 - RNA, 22 nt, Homo sapiens
gaaagauuuuaacugggagacu

SEQ ID NO: 281532 - RNA, 22 nt, Homo sapiens
gaaagguaggaacagggugcag

SEQ ID NO: 281533 - RNA, 21 nt, Homo sapiens
gaaauacugccuuaggagcug

SEQ ID NO: 281534 - RNA, 22 nt, Homo sapiens
gaaauguauuaaugaguugaaa

SEQ ID NO: 281535 - RNA, 22 nt, Homo sapiens
uuucuauguugaccagucuaga

SEQ ID NO: 281536 - RNA, 16 nt, Homo sapiens
uuucuauguuuuacua

SEQ ID NO: 281537 - RNA, 22 nt, Homo sapiens
uuucucaguguuucaggguagg

SEQ ID NO: 281538 - RNA, 20 nt, Homo sapiens
uuucuccccuauaaaucuca

SEQ ID NO: 281539 - RNA, 22 nt, Homo sapiens
uuugacuuuuagaauaugaguu

SEQ ID NO: 281540 - RNA, 22 nt, Homo sapiens
uuugagaaugcuaccagagaag

SEQ ID NO: 281541 - RNA, 22 nt, Homo sapiens
uuugagauaucuuccaucagua

SEQ ID NO: 281542 - RNA, 22 nt, Homo sapiens
uuugagaucuuuagaaucaggc

SEQ ID NO: 281543 - RNA, 22 nt, Homo sapiens
uuugagcauguaguuuaacccu

SEQ ID NO: 281544 - RNA, 22 nt, Homo sapiens
uuugagcauuagggcaaaggca

SEQ ID NO: 281545 - RNA, 22 nt, Homo sapiens
uuugcacuucugagugugacau

SEQ ID NO: 281546 - RNA, 20 nt, Homo sapiens
uuugcagaaucuaagaagag

SEQ ID NO: 281547 - RNA, 23 nt, Homo sapiens
uuugccacuuauuagcugggagg

SEQ ID NO: 281548 - RNA, 22 nt, Homo sapiens
uuugccuuugugauauggucua

SEQ ID NO: 281549 - RNA, 22 nt, Homo sapiens
uuugcugagucugacuucaugg

SEQ ID NO: 281550 - RNA, 22 nt, Homo sapiens
uuugcuuaaaguccuuguggga

SEQ ID NO: 281551 - RNA, 22 nt, Homo sapiens
uuuggaagaugccacuguauca

SEQ ID NO: 281552 - RNA, 22 nt, Homo sapiens
uuuggcagaaaacaagaaucug

SEQ ID NO: 281553 - RNA, 23 nt, Homo sapiens
uuuggcauuccagaaauuuucau

SEQ ID NO: 281554 - RNA, 22 nt, Homo sapiens
uuuggccauguuggucaggcug

SEQ ID NO: 281555 - RNA, 22 nt, Homo sapiens
uuuggcucugugucccacccaa

SEQ ID NO: 281556 - RNA, 22 nt, Homo sapiens
uuuggcuguuucuggacuaaga

SEQ ID NO: 281557 - RNA, 22 nt, Homo sapiens
uuuggcuuuugugauacguaau

SEQ ID NO: 281558 - RNA, 22 nt, Homo sapiens
uuugggaaaugaaguugguaga

SEQ ID NO: 281559 - RNA, 22 nt, Homo sapiens
uuugggaaugaguuuaucauuu

SEQ ID NO: 281560 - RNA, 22 nt, Homo sapiens
uuuguacacgugggugaauugu

SEQ ID NO: 281561 - RNA, 22 nt, Homo sapiens
uuuguacacuguugguaggauu

SEQ ID NO: 281562 - RNA, 22 nt, Homo sapiens
uuuguacuucauacaauaacuc

SEQ ID NO: 281563 - RNA, 22 nt, Homo sapiens
uuuguacuugguguucuggaaa

SEQ ID NO: 281564 - RNA, 18 nt, Homo sapiens
uuuguacuuuuucuaaug

SEQ ID NO: 281565 - RNA, 22 nt, Homo sapiens
uuuguagcuacaaagugagaug

SEQ ID NO: 281566 - RNA, 22 nt, Homo sapiens
uuugucauagcagcaggaaugg

SEQ ID NO: 281567 - RNA, 21 nt, Homo sapiens
uuuguccaccuguguucacca

SEQ ID NO: 281568 - RNA, 22 nt, Homo sapiens
uuugucuccuaagacucugugg

SEQ ID NO: 281569 - RNA, 22 nt, Homo sapiens
uuugugaaugucauaagcucca

SEQ ID NO: 281570 - RNA, 22 nt, Homo sapiens
uuugugagguggauagauugca

SEQ ID NO: 281571 - RNA, 22 nt, Homo sapiens
uuugugcaaacuaggauugcga

SEQ ID NO: 281572 - RNA, 23 nt, Homo sapiens
uuuguguccccacccaaaucuca

SEQ ID NO: 281573 - RNA, 22 nt, Homo sapiens
uuuguucuucguuccugagcca

SEQ ID NO: 281574 - RNA, 20 nt, Homo sapiens
uuuuagcacuuguuauggug

SEQ ID NO: 281575 - RNA, 22 nt, Homo sapiens
uuuuagcuuuucccaggacucc

SEQ ID NO: 281576 - RNA, 22 nt, Homo sapiens
uuuuaguggaauauuuacaguu

SEQ ID NO: 281577 - RNA, 22 nt, Homo sapiens
uuuucaguuuuccagguagccg

SEQ ID NO: 281578 - RNA, 22 nt, Homo sapiens
uuuugcacuguuuuaucugaca

SEQ ID NO: 281579 - RNA, 22 nt, Homo sapiens
uuuugcaggucaggggcagaga

SEQ ID NO: 281580 - RNA, 22 nt, Homo sapiens
uuuugcucuucggaagagcuug

SEQ ID NO: 281581 - RNA, 22 nt, Homo sapiens
uuuuggcacuuugucugauucu

SEQ ID NO: 281582 - RNA, 22 nt, Homo sapiens
uuuuggcuagaaauauaccucc

SEQ ID NO: 281583 - RNA, 22 nt, Homo sapiens
uuuugggggugauucacacagu

SEQ ID NO: 281584 - RNA, 21 nt, Homo sapiens
uuuuggucauucaggaagaaa

SEQ ID NO: 281585 - RNA, 22 nt, Homo sapiens
uuuuguacgccuguguccauca

SEQ ID NO: 281586 - RNA, 22 nt, Homo sapiens
uuuuucacuuaaguuaggcuca

SEQ ID NO: 281587 - RNA, 22 nt, Homo sapiens
uuuuugagguauaguguggcua

SEQ ID NO: 281588 - RNA, 22 nt, Homo sapiens
uuuuuggaggagguuagaucau

SEQ ID NO: 281589 - RNA, 22 nt, Homo sapiens
uuuuuuaguuagcugggcauga

SEQ ID NO: 281590 - RNA, 22 nt, Homo sapiens
guaaguauuaggugugagauuc

SEQ ID NO: 281591 - RNA, 22 nt, Homo sapiens
guaagugguagagcugggcuau

SEQ ID NO: 281592 - RNA, 22 nt, Homo sapiens
guaauacuggacaggguaucag

SEQ ID NO: 281593 - RNA, 22 nt, Homo sapiens
guaaucucaccuacuugggagg

SEQ ID NO: 281594 - RNA, 22 nt, Homo sapiens
guacacauacauauaugugugu

SEQ ID NO: 281595 - RNA, 22 nt, Homo sapiens
guacaguuuagugcuuugagaa

SEQ ID NO: 281596 - RNA, 22 nt, Homo sapiens
guacauagucacacauauacau

SEQ ID NO: 281597 - RNA, 22 nt, Homo sapiens
guacaugcaugcaugggugugc

SEQ ID NO: 281598 - RNA, 22 nt, Homo sapiens
guacccaguagauaguuuuuca

SEQ ID NO: 281599 - RNA, 22 nt, Homo sapiens
guagaaagcauuucagauuugc

SEQ ID NO: 281600 - RNA, 22 nt, Homo sapiens
guagagguagauucuguuuuga

SEQ ID NO: 281601 - RNA, 22 nt, Homo sapiens
guagcagcuacuaaguugcugu

SEQ ID NO: 281602 - RNA, 22 nt, Homo sapiens
guauacaguugacccuugaacc

SEQ ID NO: 281603 - RNA, 22 nt, Homo sapiens
guaucauugccuaaugcucuca

SEQ ID NO: 281604 - RNA, 22 nt, Homo sapiens
guaugacacaggaagcuuaacc

SEQ ID NO: 281605 - RNA, 22 nt, Homo sapiens
guaugcaagugauaugacauau

SEQ ID NO: 281606 - RNA, 22 nt, Homo sapiens
guauggcaugcaugagaauuuc

SEQ ID NO: 281607 - RNA, 22 nt, Homo sapiens
guauggcauuuguggauuggcc

SEQ ID NO: 281608 - RNA, 21 nt, Homo sapiens
guaugguugaagugacaagcc

SEQ ID NO: 281609 - RNA, 22 nt, Homo sapiens
guauuagaugguauuugaagau

SEQ ID NO: 281610 - RNA, 22 nt, Homo sapiens
guauuaguuaucuacugcugug

SEQ ID NO: 281611 - RNA, 19 nt, Homo sapiens
guauuugacuuucuuguuu

SEQ ID NO: 281612 - RNA, 22 nt, Homo sapiens
gucaaagugauuguaauuaggu

SEQ ID NO: 281613 - RNA, 22 nt, Homo sapiens
gucaacauauuaauuauguucu

SEQ ID NO: 281614 - RNA, 22 nt, Homo sapiens
gucacagaaaaagauaugccaa

SEQ ID NO: 281615 - RNA, 22 nt, Homo sapiens
gucacagcacuuuuaguaagug

SEQ ID NO: 281616 - RNA, 22 nt, Homo sapiens
gucacaggaaacuaauaugcgc

SEQ ID NO: 281617 - RNA, 22 nt, Homo sapiens
gucacaguggccagugauguuc

SEQ ID NO: 281618 - RNA, 22 nt, Homo sapiens
gucacaguguuuguucauccca

SEQ ID NO: 281619 - RNA, 22 nt, Homo sapiens
auggcacuguguccugggguca

SEQ ID NO: 281620 - RNA, 22 nt, Homo sapiens
auggcaguguaugauuauauua

SEQ ID NO: 281621 - RNA, 22 nt, Homo sapiens
auggcaucgucaccuuuucagu

SEQ ID NO: 281622 - RNA, 22 nt, Homo sapiens
auggcauuuuuagggcugggug

SEQ ID NO: 281623 - RNA, 22 nt, Homo sapiens
auggcccccuguuugugaacau

SEQ ID NO: 281624 - RNA, 22 nt, Homo sapiens
auggcccugaguucaauauauu

SEQ ID NO: 281625 - RNA, 22 nt, Homo sapiens
auggcccuguguggagcugcug

SEQ ID NO: 281626 - RNA, 22 nt, Homo sapiens
auggcugagugauuucaaacag

SEQ ID NO: 281627 - RNA, 22 nt, Homo sapiens
auggcugugagaucgacuuauu

SEQ ID NO: 281628 - RNA, 22 nt, Homo sapiens
auggcuguuccugggaguucua

SEQ ID NO: 281629 - RNA, 22 nt, Homo sapiens
auggcuuaagacaaccuuucau

SEQ ID NO: 281630 - RNA, 22 nt, Homo sapiens
auggcuucuuacucuucugcau

SEQ ID NO: 281631 - RNA, 22 nt, Homo sapiens
auggcuucuucuaaaagugggg

SEQ ID NO: 281632 - RNA, 22 nt, Homo sapiens
auggcuuuguguucagagcuga

SEQ ID NO: 281633 - RNA, 22 nt, Homo sapiens
auggcuuuuuaaaucauguugu

SEQ ID NO: 281634 - RNA, 17 nt, Homo sapiens
augggguuguagcccca

SEQ ID NO: 281635 - RNA, 22 nt, Homo sapiens
augggucuccugaauacagcac

SEQ ID NO: 281636 - RNA, 21 nt, Homo sapiens
augguacugucucuggagaua

SEQ ID NO: 281637 - RNA, 22 nt, Homo sapiens
augguauggaaggucuggagga

SEQ ID NO: 281638 - RNA, 22 nt, Homo sapiens
augguauuuaacagucuuucua

SEQ ID NO: 281639 - RNA, 22 nt, Homo sapiens
auggucuuuuuguuaugagaga

SEQ ID NO: 281640 - RNA, 22 nt, Homo sapiens
augguuuauuuguaagcagagu

SEQ ID NO: 281641 - RNA, 22 nt, Homo sapiens
auguaacuaucugagccauggg

SEQ ID NO: 281642 - RNA, 22 nt, Homo sapiens
auguaagugugcucaaauguua

SEQ ID NO: 281643 - RNA, 22 nt, Homo sapiens
auguagugugauuuucacuaga

SEQ ID NO: 281644 - RNA, 22 nt, Homo sapiens
augucauagauaaggaagugga

SEQ ID NO: 281645 - RNA, 22 nt, Homo sapiens
augucuguuugcugagcccggc

SEQ ID NO: 281646 - RNA, 22 nt, Homo sapiens
augugaacaucauagaaugcac

SEQ ID NO: 281647 - RNA, 22 nt, Homo sapiens
augugacagugguuuuaagcgu

SEQ ID NO: 281648 - RNA, 22 nt, Homo sapiens
augugacugauguaaucagaca

SEQ ID NO: 281649 - RNA, 22 nt, Homo sapiens
augugcaagaucauuaaagcuc

SEQ ID NO: 281650 - RNA, 21 nt, Homo sapiens
augugcacuaugucauuuaau

SEQ ID NO: 281651 - RNA, 22 nt, Homo sapiens
augugcauaugaagcacagaca

SEQ ID NO: 281652 - RNA, 22 nt, Homo sapiens
augugcuagguacuguuuagca

SEQ ID NO: 281653 - RNA, 22 nt, Homo sapiens
augugcuuaaaaaugcagagaa

SEQ ID NO: 281654 - RNA, 22 nt, Homo sapiens
auguggcuuuccuagaucuuag

SEQ ID NO: 281655 - RNA, 22 nt, Homo sapiens
augugggaggaauguguuucca

SEQ ID NO: 281656 - RNA, 23 nt, Homo sapiens
augugguuuuagguguugaacug

SEQ ID NO: 281657 - RNA, 22 nt, Homo sapiens
augugucaaaucuaggccaaag

SEQ ID NO: 281658 - RNA, 22 nt, Homo sapiens
auguguucaucacagcacaauu

SEQ ID NO: 281659 - RNA, 22 nt, Homo sapiens
auguuagcaucaauauucauca

SEQ ID NO: 281660 - RNA, 22 nt, Homo sapiens
auguuauguuaaugauaaugga

SEQ ID NO: 281661 - RNA, 22 nt, Homo sapiens
auguugcuugaaggcauuuugu

SEQ ID NO: 281662 - RNA, 22 nt, Homo sapiens
caccaguuuuucagugauucaa

SEQ ID NO: 281663 - RNA, 22 nt, Homo sapiens
cacccagucaucuuggguuuuu

SEQ ID NO: 281664 - RNA, 22 nt, Homo sapiens
caccccuaccugagucaggagu

SEQ ID NO: 281665 - RNA, 22 nt, Homo sapiens
cacccuugcagggacagcuuug

SEQ ID NO: 281666 - RNA, 22 nt, Homo sapiens
caccgagguuggagugcagugg

SEQ ID NO: 281667 - RNA, 22 nt, Homo sapiens
cacugcacuccagcuugugggc

SEQ ID NO: 281668 - RNA, 22 nt, Homo sapiens
cacugcaguaaauugcgucggu

SEQ ID NO: 281669 - RNA, 22 nt, Homo sapiens
cacugcaguguaauuaagguug

SEQ ID NO: 281670 - RNA, 17 nt, Homo sapiens
cacugggugcaagagga

SEQ ID NO: 281671 - RNA, 21 nt, Homo sapiens
cacugguguugcuauaucaaa

SEQ ID NO: 281672 - RNA, 22 nt, Homo sapiens
cagacagugucccgagucccug

SEQ ID NO: 281673 - RNA, 22 nt, Homo sapiens
cagagguaagcaagucagcauu

SEQ ID NO: 281674 - RNA, 22 nt, Homo sapiens
cagagguauugcaaaagccuag

SEQ ID NO: 281675 - RNA, 22 nt, Homo sapiens
cagauacuccuggucucaggag

SEQ ID NO: 281676 - RNA, 22 nt, Homo sapiens
cagauacuggaguccugaaguu

SEQ ID NO: 281677 - RNA, 22 nt, Homo sapiens
cagauacuggccuggagcugug

SEQ ID NO: 281678 - RNA, 22 nt, Homo sapiens
cagcacauagcaguugcucagu

SEQ ID NO: 281679 - RNA, 22 nt, Homo sapiens
cagcucauugcagucucgaccu

SEQ ID NO: 281680 - RNA, 22 nt, Homo sapiens
cagcugguggcaagaagacaga

SEQ ID NO: 281681 - RNA, 22 nt, Homo sapiens
cagcuguguuauaaacuaccau

SEQ ID NO: 281682 - RNA, 22 nt, Homo sapiens
caggaccucuugccuggaagcc

SEQ ID NO: 281683 - RNA, 22 nt, Homo sapiens
cagggcauuggcugguaccugg

SEQ ID NO: 281684 - RNA, 22 nt, Homo sapiens
cagggcauugucuucuuaguac

SEQ ID NO: 281685 - RNA, 22 nt, Homo sapiens
cagguaagaugcuuucucuuau

SEQ ID NO: 281686 - RNA, 22 nt, Homo sapiens
gucaccauugagucauuuccuc

SEQ ID NO: 281687 - RNA, 22 nt, Homo sapiens
gucacugucuacuguaauagcc

SEQ ID NO: 281688 - RNA, 22 nt, Homo sapiens
gucagcaaaguucuccugcaga

SEQ ID NO: 281689 - RNA, 22 nt, Homo sapiens
gucagggagggauagaugauua

SEQ ID NO: 281690 - RNA, 22 nt, Homo sapiens
gucagugucuuugcagcucaga

SEQ ID NO: 281691 - RNA, 22 nt, Homo sapiens
gucauggagggacauaacuaac

SEQ ID NO: 281692 - RNA, 22 nt, Homo sapiens
gucauuguguggacauggagaa

SEQ ID NO: 281693 - RNA, 22 nt, Homo sapiens
guccaaauccaugggauguaca

SEQ ID NO: 281694 - RNA, 22 nt, Homo sapiens
guccaguuguuuucugagguug

SEQ ID NO: 281695 - RNA, 22 nt, Homo sapiens
gucccugaggaacauccagggc

SEQ ID NO: 281696 - RNA, 22 nt, Homo sapiens
guccuggagaagcguggaccgg

SEQ ID NO: 281697 - RNA, 22 nt, Homo sapiens
gucuagaacuucugaccuuagg

SEQ ID NO: 281698 - RNA, 22 nt, Homo sapiens
gucuccgagccguguggagccg

SEQ ID NO: 281699 - RNA, 22 nt, Homo sapiens
gucugugcauuaauacgugcug

SEQ ID NO: 281700 - RNA, 22 nt, Homo sapiens
gucuguuugauccagaucaaaa

SEQ ID NO: 281701 - RNA, 22 nt, Homo sapiens
gucuguuuggggaccuguggcc

SEQ ID NO: 281702 - RNA, 22 nt, Homo sapiens
gucuuccagccuccaucuuucu

SEQ ID NO: 281703 - RNA, 22 nt, Homo sapiens
gucuuuaguugaaacauguggu

SEQ ID NO: 281704 - RNA, 22 nt, Homo sapiens
gucuuugcauguauguucauga

SEQ ID NO: 281705 - RNA, 22 nt, Homo sapiens
gucuuuguuuggucuguaucag

SEQ ID NO: 281706 - RNA, 22 nt, Homo sapiens
gugaaauacauaaucccaagug

SEQ ID NO: 281707 - RNA, 22 nt, Homo sapiens
gugaaucuguuuucuucuguuc

SEQ ID NO: 281708 - RNA, 22 nt, Homo sapiens
gugaauguaaagucaugugacu

SEQ ID NO: 281709 - RNA, 22 nt, Homo sapiens
gugacugcauccauccaggcuu

SEQ ID NO: 281710 - RNA, 22 nt, Homo sapiens
gugagaaucaaacuacauaaau

SEQ ID NO: 281711 - RNA, 22 nt, Homo sapiens
gugagauggagucuugcuuugu

SEQ ID NO: 281712 - RNA, 22 nt, Homo sapiens
gugagauggaguuggugucuuu

SEQ ID NO: 281713 - RNA, 22 nt, Homo sapiens
gugagaugugacuucugccucu

SEQ ID NO: 281714 - RNA, 19 nt, Homo sapiens
gugagcaaugcauugcacu

SEQ ID NO: 281715 - RNA, 22 nt, Homo sapiens
gugagcaauugauacuugaagu

SEQ ID NO: 281716 - RNA, 22 nt, Homo sapiens
gugagccaugauuuuaccacug

SEQ ID NO: 281717 - RNA, 22 nt, Homo sapiens
gugaggaaggaaaccugcuagc

SEQ ID NO: 281718 - RNA, 21 nt, Homo sapiens
gugaggaguuacuggcuuuga

SEQ ID NO: 281719 - RNA, 22 nt, Homo sapiens
gugaggcacugcugcuuuccag

SEQ ID NO: 281720 - RNA, 22 nt, Homo sapiens
gugagguagagcaugugaaaga

SEQ ID NO: 281721 - RNA, 22 nt, Homo sapiens
gugaggucagggcuguggacag

SEQ ID NO: 281722 - RNA, 22 nt, Homo sapiens
gugagucagucuguguagggcu

SEQ ID NO: 281723 - RNA, 22 nt, Homo sapiens
gugagucaugucccaucugauu

SEQ ID NO: 281724 - RNA, 22 nt, Homo sapiens
gugaucauuguauugggguuau

SEQ ID NO: 281725 - RNA, 22 nt, Homo sapiens
gugaugcaguacguagaggaga

SEQ ID NO: 281726 - RNA, 22 nt, Homo sapiens
gugauguguuucaacagcuccu

SEQ ID NO: 281727 - RNA, 22 nt, Homo sapiens
gugcaaauguuauugagguuuu

SEQ ID NO: 281728 - RNA, 22 nt, Homo sapiens
gugcaacaucccuccauaauuu

SEQ ID NO: 281729 - RNA, 22 nt, Homo sapiens
gugcaacaugccuggcuaauuu

SEQ ID NO: 281730 - RNA, 18 nt, Homo sapiens
gugcaaugaauagcagag

SEQ ID NO: 281731 - RNA, 22 nt, Homo sapiens
gugcaaugagaaggggcucugg

SEQ ID NO: 281732 - RNA, 21 nt, Homo sapiens
gugcacaguaguguuuaauag

SEQ ID NO: 281733 - RNA, 22 nt, Homo sapiens
gugcacuguagaacccuuuguu

SEQ ID NO: 281734 - RNA, 23 nt, Homo sapiens
gugcaguggcgagauuucggcuc

SEQ ID NO: 281735 - RNA, 22 nt, Homo sapiens
uucaagcuauggugaucuuuuc

SEQ ID NO: 281736 - RNA, 22 nt, Homo sapiens
uucaagucuuggcuuugccacc

SEQ ID NO: 281737 - RNA, 21 nt, Homo sapiens
uucacaagggaaguagggggc

SEQ ID NO: 281738 - RNA, 22 nt, Homo sapiens
uucacagagagaacucaaacca

SEQ ID NO: 281739 - RNA, 22 nt, Homo sapiens
uucacagaguuauuuuuaugcu

SEQ ID NO: 281740 - RNA, 20 nt, Homo sapiens
uucacaggcagcuucuuucu

SEQ ID NO: 281741 - RNA, 21 nt, Homo sapiens
uucaccauggcuccacacucu

SEQ ID NO: 281742 - RNA, 23 nt, Homo sapiens
uucaccguguuggccaggcuggu

SEQ ID NO: 281743 - RNA, 22 nt, Homo sapiens
uucaccuugcccacagcagucu

SEQ ID NO: 281744 - RNA, 22 nt, Homo sapiens
uucaccuugggucccacuugcu

SEQ ID NO: 281745 - RNA, 22 nt, Homo sapiens
uucacugcauuucagccugggc

SEQ ID NO: 281746 - RNA, 22 nt, Homo sapiens
uucagcacaguguggaucauuc

SEQ ID NO: 281747 - RNA, 22 nt, Homo sapiens
uucaguacacguguucucauuu

SEQ ID NO: 281748 - RNA, 22 nt, Homo sapiens
uucaguugcaucaguugaccag

SEQ ID NO: 281749 - RNA, 18 nt, Homo sapiens
uucaguuuguaucugggg

SEQ ID NO: 281750 - RNA, 22 nt, Homo sapiens
uucaucagggguauuggccaau

SEQ ID NO: 281751 - RNA, 22 nt, Homo sapiens
uucauggaacaaguggguucaa

SEQ ID NO: 281752 - RNA, 22 nt, Homo sapiens
uucauggacucaauaguuucgc

SEQ ID NO: 281753 - RNA, 22 nt, Homo sapiens
uucauggagccauccuuugauc

SEQ ID NO: 281754 - RNA, 22 nt, Homo sapiens
uucauggguuaauuuguucgau

SEQ ID NO: 281755 - RNA, 22 nt, Homo sapiens
uucauggugguacaaaagcaau

SEQ ID NO: 281756 - RNA, 22 nt, Homo sapiens
uucauguaauauauuucaggcc

SEQ ID NO: 281757 - RNA, 22 nt, Homo sapiens
uuccacaaugguugaacuaauu

SEQ ID NO: 281758 - RNA, 22 nt, Homo sapiens
uuccacaaugguugaacuagcu

SEQ ID NO: 281759 - RNA, 22 nt, Homo sapiens
uuccacgugaaguauucuaaag

SEQ ID NO: 281760 - RNA, 22 nt, Homo sapiens
uuccagaugggaguucuauucu

SEQ ID NO: 281761 - RNA, 20 nt, Homo sapiens
uuccagcacauuagggaagc

SEQ ID NO: 281762 - RNA, 22 nt, Homo sapiens
uuccagcugggggcaacucugc

SEQ ID NO: 281763 - RNA, 22 nt, Homo sapiens
uuccaguggacuacuucauccu

SEQ ID NO: 281764 - RNA, 22 nt, Homo sapiens
uucccguacugguguugccuau

SEQ ID NO: 281765 - RNA, 22 nt, Homo sapiens
uucccugugugcagaugggugu

SEQ ID NO: 281766 - RNA, 23 nt, Homo sapiens
uucccuuagaagaaggggagaaa

SEQ ID NO: 281767 - RNA, 22 nt, Homo sapiens
uucccuuucugccuugaaucuu

SEQ ID NO: 281768 - RNA, 22 nt, Homo sapiens
uuccuacugugcaaaguugcaa

SEQ ID NO: 281769 - RNA, 22 nt, Homo sapiens
uuccugagccuuguaucuagua

SEQ ID NO: 281770 - RNA, 22 nt, Homo sapiens
uuccuggaggggaaguguccaa

SEQ ID NO: 281771 - RNA, 22 nt, Homo sapiens
uuccuguagcgauuuuaguaau

SEQ ID NO: 281772 - RNA, 22 nt, Homo sapiens
uuccugugacccccaagcccac

SEQ ID NO: 281773 - RNA, 22 nt, Homo sapiens
uuccugugacuguguggcaccc

SEQ ID NO: 281774 - RNA, 22 nt, Homo sapiens
uuccuugagaaaguacaaggcu

SEQ ID NO: 281775 - RNA, 22 nt, Homo sapiens
uucuaaacaucuuacaaugcau

SEQ ID NO: 281776 - RNA, 22 nt, Homo sapiens
uucuacagugacugcagccaua

SEQ ID NO: 281777 - RNA, 22 nt, Homo sapiens
uucuauggucacagaugcuuga

SEQ ID NO: 281778 - RNA, 22 nt, Homo sapiens
uucucaaggagccuucguaacu

SEQ ID NO: 281779 - RNA, 22 nt, Homo sapiens
uucucagcccccugacagucag

SEQ ID NO: 281780 - RNA, 21 nt, Homo sapiens
uucucaggguguguccuaccc

SEQ ID NO: 281781 - RNA, 22 nt, Homo sapiens
uucucaguaauuccagauuuuu

SEQ ID NO: 281782 - RNA, 22 nt, Homo sapiens
uucucagugcuaucuuuuaugc

SEQ ID NO: 281783 - RNA, 22 nt, Homo sapiens
uucucuaguuacuuuaauggag

SEQ ID NO: 281784 - RNA, 22 nt, Homo sapiens
uucucuguggauugggugagag

SEQ ID NO: 281785 - RNA, 22 nt, Homo sapiens
uucuggcucaggucaacacuuc

SEQ ID NO: 281786 - RNA, 22 nt, Homo sapiens
uucugugcugaaucaaagacug

SEQ ID NO: 281787 - RNA, 22 nt, Homo sapiens
uucuucaggccacaaaaauggu

SEQ ID NO: 281788 - RNA, 22 nt, Homo sapiens
uucuuccagccuugaggggccc

SEQ ID NO: 281789 - RNA, 20 nt, Homo sapiens
uucuugaguuaacaaguuac

SEQ ID NO: 281790 - RNA, 22 nt, Homo sapiens
uucuugcacuuggcccucauua

SEQ ID NO: 281791 - RNA, 22 nt, Homo sapiens
uucuuuaguucacuugcuccag

SEQ ID NO: 281792 - RNA, 23 nt, Homo sapiens
uugaaaagucaguagccucugau

SEQ ID NO: 281793 - RNA, 22 nt, Homo sapiens
uugaaagacagaggggcaaguu

SEQ ID NO: 281794 - RNA, 22 nt, Homo sapiens
uugaaagcuaucucaaaucgcu

SEQ ID NO: 281795 - RNA, 22 nt, Homo sapiens
uugaaaguaaacaucacaaaga

SEQ ID NO: 281796 - RNA, 22 nt, Homo sapiens
uugaaagucuaggcuuacagua

SEQ ID NO: 281797 - RNA, 22 nt, Homo sapiens
uugaaguagguaccguucaauu

SEQ ID NO: 281798 - RNA, 22 nt, Homo sapiens
ucuuuagguguuauaguucaag

SEQ ID NO: 281799 - RNA, 22 nt, Homo sapiens
ucuuucacuuagcaugauguuu

SEQ ID NO: 281800 - RNA, 22 nt, Homo sapiens
ucuuugauaagauccagaagaa

SEQ ID NO: 281801 - RNA, 22 nt, Homo sapiens
ucuuuggaggcgaucuguuuga

SEQ ID NO: 281802 - RNA, 22 nt, Homo sapiens
ucuuuggauggaaauuggaguc

SEQ ID NO: 281803 - RNA, 22 nt, Homo sapiens
ucuuuggguguauuucacagcc

SEQ ID NO: 281804 - RNA, 22 nt, Homo sapiens
ucuuugguauuuguggggaauu

SEQ ID NO: 281805 - RNA, 22 nt, Homo sapiens
ucuuuggucagaaagauuacac

SEQ ID NO: 281806 - RNA, 22 nt, Homo sapiens
ucuuuggucuacuuucauaugu

SEQ ID NO: 281807 - RNA, 22 nt, Homo sapiens
ucuuugguuagguuuaguugau

SEQ ID NO: 281808 - RNA, 22 nt, Homo sapiens
ucuuugguuguuuagggugcau

SEQ ID NO: 281809 - RNA, 22 nt, Homo sapiens
ucuuugguuucugucucuguaa

SEQ ID NO: 281810 - RNA, 22 nt, Homo sapiens
ucuuuguguaggucaaucuggc

SEQ ID NO: 281811 - RNA, 22 nt, Homo sapiens
ugaaaaguuguugaaggcuuca

SEQ ID NO: 281812 - RNA, 20 nt, Homo sapiens
ugaaacacauggacuggggu

SEQ ID NO: 281813 - RNA, 22 nt, Homo sapiens
ugaaagacugaaagcuuuucuu

SEQ ID NO: 281814 - RNA, 22 nt, Homo sapiens
ugaaagcuacaggaaaguauuu

SEQ ID NO: 281815 - RNA, 22 nt, Homo sapiens
ugaaagguauagguucuggagg

SEQ ID NO: 281816 - RNA, 22 nt, Homo sapiens
ugaaaguaauugcaguuuuuac

SEQ ID NO: 281817 - RNA, 22 nt, Homo sapiens
ugaaaucuuugaugguggcauu

SEQ ID NO: 281818 - RNA, 22 nt, Homo sapiens
ugaaaugccuuuaaugaauuua

SEQ ID NO: 281819 - RNA, 22 nt, Homo sapiens
ugaaauggaaagaguguagacu

SEQ ID NO: 281820 - RNA, 22 nt, Homo sapiens
ugaaauguugggugauggaauc

SEQ ID NO: 281821 - RNA, 22 nt, Homo sapiens
ugaacacuggauaaggagucag

SEQ ID NO: 281822 - RNA, 22 nt, Homo sapiens
ugaacagucaucucucuuguau

SEQ ID NO: 281823 - RNA, 20 nt, Homo sapiens
ugaaggaggucauuuauacc

SEQ ID NO: 281824 - RNA, 22 nt, Homo sapiens
ugaaggaguauggauaagucgu

SEQ ID NO: 281825 - RNA, 22 nt, Homo sapiens
ugaagugaagcaguaguguggg

SEQ ID NO: 281826 - RNA, 22 nt, Homo sapiens
ugaaguguuuuuucaggcaugu

SEQ ID NO: 281827 - RNA, 22 nt, Homo sapiens
ugaauacugugcaaaggauuug

SEQ ID NO: 281828 - RNA, 22 nt, Homo sapiens
ugaauagaaguggcaggaguag

SEQ ID NO: 281829 - RNA, 22 nt, Homo sapiens
ugaauagacacuaaagacugua

SEQ ID NO: 281830 - RNA, 22 nt, Homo sapiens
ugaauauguuaauuagcaucau

SEQ ID NO: 281831 - RNA, 22 nt, Homo sapiens
ugaaugguuuuuagagaacaau

SEQ ID NO: 281832 - RNA, 22 nt, Homo sapiens
ugaauguauuuauuaccauuca

SEQ ID NO: 281833 - RNA, 22 nt, Homo sapiens
ugaauguuugcuuacuuccaua

SEQ ID NO: 281834 - RNA, 22 nt, Homo sapiens
ugacaagauauggucuuaucaa

SEQ ID NO: 281835 - RNA, 22 nt, Homo sapiens
ugacaagugauuaaggcauauu

SEQ ID NO: 281836 - RNA, 22 nt, Homo sapiens
ugacacagcaagauggaaccau

SEQ ID NO: 281837 - RNA, 22 nt, Homo sapiens
ugacacauguagacaucuggug

SEQ ID NO: 281838 - RNA, 23 nt, Homo sapiens
ugacagaccuucuggaagaaguc

SEQ ID NO: 281839 - RNA, 22 nt, Homo sapiens
ugacagagcaggacuucaucuc

SEQ ID NO: 281840 - RNA, 18 nt, Homo sapiens
ugacagcacaugugggga

SEQ ID NO: 281841 - RNA, 22 nt, Homo sapiens
ugacagcugaagauguugaacc

SEQ ID NO: 281842 - RNA, 22 nt, Homo sapiens
ugacaggauggagaucgguauu

SEQ ID NO: 281843 - RNA, 22 nt, Homo sapiens
ugacaggucuaauuuacugaca

SEQ ID NO: 281844 - RNA, 22 nt, Homo sapiens
ugacagguuggaauuaugggag

SEQ ID NO: 281845 - RNA, 22 nt, Homo sapiens
ugacagugugagacuuugucuc

SEQ ID NO: 281846 - RNA, 22 nt, Homo sapiens
ugacaugagauuugggaggggc

SEQ ID NO: 281847 - RNA, 22 nt, Homo sapiens
ugacauggagguggaggaagau

SEQ ID NO: 281848 - RNA, 22 nt, Homo sapiens
ugacauguugcauuauauuucc

SEQ ID NO: 281849 - RNA, 22 nt, Homo sapiens
ugacauuacagucacuugcugu

SEQ ID NO: 281850 - RNA, 21 nt, Homo sapiens
ugacauuauuucaugucagua

SEQ ID NO: 281851 - RNA, 19 nt, Homo sapiens
ugaccagggacagaaacca

SEQ ID NO: 281852 - RNA, 22 nt, Homo sapiens
ugacggaggacaccugcggaau

SEQ ID NO: 281853 - RNA, 22 nt, Homo sapiens
ugacuacaggucaggaagcugu

SEQ ID NO: 281854 - RNA, 22 nt, Homo sapiens
ugacuacauaaguaaucucaaa

SEQ ID NO: 281855 - RNA, 22 nt, Homo sapiens
ugacuauaggauaacaugcauu

SEQ ID NO: 281856 - RNA, 22 nt, Homo sapiens
ugacuauaucucuguauaaacu

SEQ ID NO: 281857 - RNA, 22 nt, Homo sapiens
ugacuggaacuuuagugagucu

SEQ ID NO: 281858 - RNA, 22 nt, Homo sapiens
ugacuggagaccucaguagggu

SEQ ID NO: 281859 - RNA, 23 nt, Homo sapiens
ugacuggagacuguugauccuuu

SEQ ID NO: 281860 - RNA, 22 nt, Homo sapiens
ugacuugaggcucgcacaaguu

SEQ ID NO: 281861 - RNA, 22 nt, Homo sapiens
ugacuugauccauggggcucca

SEQ ID NO: 281862 - RNA, 22 nt, Homo sapiens
ugagaacaugcacuugagguug

SEQ ID NO: 281863 - RNA, 20 nt, Homo sapiens
ugagaacauguggcauuugg

SEQ ID NO: 281864 - RNA, 22 nt, Homo sapiens
ugagaacugcagggagcugcau

SEQ ID NO: 281865 - RNA, 22 nt, Homo sapiens
ugagaacugccuguauuuaucu

SEQ ID NO: 281866 - RNA, 22 nt, Homo sapiens
ugagaagacaucagcuuucgga

SEQ ID NO: 281867 - RNA, 22 nt, Homo sapiens
ugagaagugauauagaaguuaa

SEQ ID NO: 281868 - RNA, 22 nt, Homo sapiens
ugagaauauuugaagauguuag

SEQ ID NO: 281869 - RNA, 22 nt, Homo sapiens
ugagaauauuuuccaugucuca

SEQ ID NO: 281870 - RNA, 22 nt, Homo sapiens
ugagaaugacugggcaugcugc

SEQ ID NO: 281871 - RNA, 22 nt, Homo sapiens
ugagaaugaugauuuccaguuu

SEQ ID NO: 281872 - RNA, 22 nt, Homo sapiens
ugagaauguagggcucucccag

SEQ ID NO: 281873 - RNA, 22 nt, Homo sapiens
gaagugguaggauugcuuuuga

SEQ ID NO: 281874 - RNA, 19 nt, Homo sapiens
gaaguguuguccuccagua

SEQ ID NO: 281875 - RNA, 19 nt, Homo sapiens
gaaguguuuguucuccaug

SEQ ID NO: 281876 - RNA, 22 nt, Homo sapiens
uggccaguuuuuaauugggucu

SEQ ID NO: 281877 - RNA, 22 nt, Homo sapiens
uggcccccucccaaaucucaua

SEQ ID NO: 281878 - RNA, 22 nt, Homo sapiens
uggcuacugacugaugauuaua

SEQ ID NO: 281879 - RNA, 22 nt, Homo sapiens
uggcuacuguacuugagcuauu

SEQ ID NO: 281880 - RNA, 22 nt, Homo sapiens
uggcucauuucuaaacccagcu

SEQ ID NO: 281881 - RNA, 22 nt, Homo sapiens
uggcucuguuuguuaacuagac

SEQ ID NO: 281882 - RNA, 22 nt, Homo sapiens
uggcucuuucuagacuuaauua

SEQ ID NO: 281883 - RNA, 22 nt, Homo sapiens
uggcuguuuauuucaccuggau

SEQ ID NO: 281884 - RNA, 22 nt, Homo sapiens
uggcuguuuauuucacgugggu

SEQ ID NO: 281885 - RNA, 22 nt, Homo sapiens
uggcuugauggcacaagguuuc

SEQ ID NO: 281886 - RNA, 22 nt, Homo sapiens
uggcuuuuccaggcauuacgau

SEQ ID NO: 281887 - RNA, 22 nt, Homo sapiens
uggcuuuuccuugaaucugccu

SEQ ID NO: 281888 - RNA, 22 nt, Homo sapiens
ugggaaauguagccuagcugug

SEQ ID NO: 281889 - RNA, 22 nt, Homo sapiens
ugggaacaugaagguuaaagag

SEQ ID NO: 281890 - RNA, 22 nt, Homo sapiens
ugggaagaagguuuacuugcca

SEQ ID NO: 281891 - RNA, 22 nt, Homo sapiens
ugggaagaugcugcuucuuccu

SEQ ID NO: 281892 - RNA, 22 nt, Homo sapiens
ugggaucagcugggcucucugu

SEQ ID NO: 281893 - RNA, 22 nt, Homo sapiens
ugggauccaugugguuuaagca

SEQ ID NO: 281894 - RNA, 22 nt, Homo sapiens
ugggaugaauacaaugggauca

SEQ ID NO: 281895 - RNA, 22 nt, Homo sapiens
ugggaugaugaaaaggcuuucu

SEQ ID NO: 281896 - RNA, 22 nt, Homo sapiens
ugggaugauguuaaacguacuc

SEQ ID NO: 281897 - RNA, 22 nt, Homo sapiens
ugggauguagccuucuauuuuc

SEQ ID NO: 281898 - RNA, 22 nt, Homo sapiens
ugggaugugagucuucgcuuuc

SEQ ID NO: 281899 - RNA, 23 nt, Homo sapiens
ugggauguuuuuggaaacuucug

SEQ ID NO: 281900 - RNA, 22 nt, Homo sapiens
uggggugugagggagaaagaaa

SEQ ID NO: 281901 - RNA, 19 nt, Homo sapiens
uggguagugaugagacaua

SEQ ID NO: 281902 - RNA, 22 nt, Homo sapiens
ugggugaguaucuauuauucag

SEQ ID NO: 281903 - RNA, 22 nt, Homo sapiens
ugguaagaggcccugaguuugu

SEQ ID NO: 281904 - RNA, 22 nt, Homo sapiens
ugguaauguaauuuggagaagg

SEQ ID NO: 281905 - RNA, 22 nt, Homo sapiens
ugguagugugagucuaaauugg

SEQ ID NO: 281906 - RNA, 22 nt, Homo sapiens
ugguauguaugauuaacaugga

SEQ ID NO: 281907 - RNA, 19 nt, Homo sapiens
uggucaguucugggagcug

SEQ ID NO: 281908 - RNA, 22 nt, Homo sapiens
ugguccacuaacccucaguauc

SEQ ID NO: 281909 - RNA, 21 nt, Homo sapiens
uggucccauaagauuacaaug

SEQ ID NO: 281910 - RNA, 22 nt, Homo sapiens
ugguccucugcuuccagaauuc

SEQ ID NO: 281911 - RNA, 22 nt, Homo sapiens
uggucuggagagucccgcccag

SEQ ID NO: 281912 - RNA, 22 nt, Homo sapiens
uggucuuuucaacaaaugguau

SEQ ID NO: 281913 - RNA, 22 nt, Homo sapiens
uggugagaaacuagauauuuuu

SEQ ID NO: 281914 - RNA, 22 nt, Homo sapiens
uggugcaaauguaauugugguu

SEQ ID NO: 281915 - RNA, 22 nt, Homo sapiens
uggugcuugaugaggguggagc

SEQ ID NO: 281916 - RNA, 22 nt, Homo sapiens
ugguggcuuuucguagguucac

SEQ ID NO: 281917 - RNA, 22 nt, Homo sapiens
ugguguuugagaagcugauguc

SEQ ID NO: 281918 - RNA, 22 nt, Homo sapiens
ugguuaucauagcuaugcuacu

SEQ ID NO: 281919 - RNA, 22 nt, Homo sapiens
ugguucaguugcacaggcuguu

SEQ ID NO: 281920 - RNA, 22 nt, Homo sapiens
ugguugaucccaucacccaggu

SEQ ID NO: 281921 - RNA, 22 nt, Homo sapiens
uguaaacauguauguguuuaug

SEQ ID NO: 281922 - RNA, 18 nt, Homo sapiens
uguaaacuaccucaaccu

SEQ ID NO: 281923 - RNA, 22 nt, Homo sapiens
uguaacugcuuagaagguuuua

SEQ ID NO: 281924 - RNA, 22 nt, Homo sapiens
uguaagcauuauauaauuguug

SEQ ID NO: 281925 - RNA, 22 nt, Homo sapiens
uguaauguuucaucauuauuaa

SEQ ID NO: 281926 - RNA, 22 nt, Homo sapiens
uguaauuuaaaugauccuugga

SEQ ID NO: 281927 - RNA, 19 nt, Homo sapiens
uguacacuguaaaccugug

SEQ ID NO: 281928 - RNA, 22 nt, Homo sapiens
uguagcaaauaaaagucuggau

SEQ ID NO: 281929 - RNA, 22 nt, Homo sapiens
uguagucauuuggaguccagcu

SEQ ID NO: 281930 - RNA, 23 nt, Homo sapiens
uguauacacccugugcaucuggg

SEQ ID NO: 281931 - RNA, 22 nt, Homo sapiens
uguauacugucuaauauguugu

SEQ ID NO: 281932 - RNA, 22 nt, Homo sapiens
uguaugguuauuuguggauggu

SEQ ID NO: 281933 - RNA, 22 nt, Homo sapiens
ugucaaagagacaucugcacuc

SEQ ID NO: 281934 - RNA, 21 nt, Homo sapiens
ugucaagaugacugcugcggc

SEQ ID NO: 281935 - RNA, 22 nt, Homo sapiens
ugucaagaugguuugauguugu

SEQ ID NO: 281936 - RNA, 22 nt, Homo sapiens
ugucacagagauuuugguaugu

SEQ ID NO: 281937 - RNA, 22 nt, Homo sapiens
ugucacaguuuguacuuuauag

SEQ ID NO: 281938 - RNA, 22 nt, Homo sapiens
ugucacugugaguuugacugcu

SEQ ID NO: 281939 - RNA, 22 nt, Homo sapiens
ugucacuuugccuucuggacuu

SEQ ID NO: 281940 - RNA, 22 nt, Homo sapiens
ugucaguggacugugaaaggca

SEQ ID NO: 281941 - RNA, 19 nt, Homo sapiens
gaguugggguuuacuguaa

SEQ ID NO: 281942 - RNA, 22 nt, Homo sapiens
gauaaaucuuggcuagucuaag

SEQ ID NO: 281943 - RNA, 22 nt, Homo sapiens
gauaauucuagcagauacaggc

SEQ ID NO: 281944 - RNA, 22 nt, Homo sapiens
gauauguacagcucucuaggau

SEQ ID NO: 281945 - RNA, 22 nt, Homo sapiens
gauauguguaucuauguacaug

SEQ ID NO: 281946 - RNA, 19 nt, Homo sapiens
gauauguugagcacccuuu

SEQ ID NO: 281947 - RNA, 22 nt, Homo sapiens
gauauguuucuucaauaccuag

SEQ ID NO: 281948 - RNA, 22 nt, Homo sapiens
gaucacauuguuucauacauau

SEQ ID NO: 281949 - RNA, 22 nt, Homo sapiens
ucacuuggccgcagccuucucu

SEQ ID NO: 281950 - RNA, 22 nt, Homo sapiens
ucacuuuggguacuauggaaau

SEQ ID NO: 281951 - RNA, 22 nt, Homo sapiens
ucacuuuguauagcgacuggcu

SEQ ID NO: 281952 - RNA, 22 nt, Homo sapiens
ucacuuuguuuuuggauaaguu

SEQ ID NO: 281953 - RNA, 22 nt, Homo sapiens
ucagacacugagcaaacgacua

SEQ ID NO: 281954 - RNA, 22 nt, Homo sapiens
ucagacacugcccuccaccugu

SEQ ID NO: 281955 - RNA, 22 nt, Homo sapiens
ucagaguggccucucuugaaga

SEQ ID NO: 281956 - RNA, 22 nt, Homo sapiens
ucagaucaguuccacaagaacu

SEQ ID NO: 281957 - RNA, 22 nt, Homo sapiens
ucagcaccauguaacaauugau

SEQ ID NO: 281958 - RNA, 20 nt, Homo sapiens
ucagcagucuggagcagagg

SEQ ID NO: 281959 - RNA, 22 nt, Homo sapiens
ucaggcacuaguaagaaaaagg

SEQ ID NO: 281960 - RNA, 22 nt, Homo sapiens
ucaggcaugcagcaaugcagug

SEQ ID NO: 281961 - RNA, 22 nt, Homo sapiens
ucagguagcuagauuaugugag

SEQ ID NO: 281962 - RNA, 23 nt, Homo sapiens
ucagguaggccuagaguauucuu

SEQ ID NO: 281963 - RNA, 22 nt, Homo sapiens
ucagguagugccaugauugauu

SEQ ID NO: 281964 - RNA, 22 nt, Homo sapiens
ucagguaguuugugggagauga

SEQ ID NO: 281965 - RNA, 22 nt, Homo sapiens
ucaguaaaugcuguucucuuuu

SEQ ID NO: 281966 - RNA, 22 nt, Homo sapiens
ucagucauguuuaccagacgua

SEQ ID NO: 281967 - RNA, 22 nt, Homo sapiens
ucagucauucaauuguugaaug

SEQ ID NO: 281968 - RNA, 22 nt, Homo sapiens
ucagucauugauggaguagguc

SEQ ID NO: 281969 - RNA, 22 nt, Homo sapiens
ucaguccccucgcugagucuac

SEQ ID NO: 281970 - RNA, 22 nt, Homo sapiens
ucagugaacgaggaggagggug

SEQ ID NO: 281971 - RNA, 21 nt, Homo sapiens
ucagugcaauucuauggggaa

SEQ ID NO: 281972 - RNA, 20 nt, Homo sapiens
ucagugcagauuguccaagu

SEQ ID NO: 281973 - RNA, 17 nt, Homo sapiens
ucagugcauuuaagaga

SEQ ID NO: 281974 - RNA, 19 nt, Homo sapiens
ucagugcuauguaauguag

SEQ ID NO: 281975 - RNA, 22 nt, Homo sapiens
ucaguggagcuacaauucuggg

SEQ ID NO: 281976 - RNA, 22 nt, Homo sapiens
ucaguggauuauuaaagucacc

SEQ ID NO: 281977 - RNA, 23 nt, Homo sapiens
ucagugucuggauccugcucagu

SEQ ID NO: 281978 - RNA, 22 nt, Homo sapiens
ucaguguuuuauccuccagagc

SEQ ID NO: 281979 - RNA, 22 nt, Homo sapiens
ucaguuaaugcugccugcugga

SEQ ID NO: 281980 - RNA, 21 nt, Homo sapiens
ucaguuacugagagagaagug

SEQ ID NO: 281981 - RNA, 21 nt, Homo sapiens
ucauaagcucaacaucuguag

SEQ ID NO: 281982 - RNA, 18 nt, Homo sapiens
ucauagaucaugacagug

SEQ ID NO: 281983 - RNA, 20 nt, Homo sapiens
ucauagggugguggcagugg

SEQ ID NO: 281984 - RNA, 22 nt, Homo sapiens
ucauaggucugagaagaaaaua

SEQ ID NO: 281985 - RNA, 19 nt, Homo sapiens
ucauagucuaagaugagaa

SEQ ID NO: 281986 - RNA, 23 nt, Homo sapiens
ucaucacagcauuuccugguauu

SEQ ID NO: 281987 - RNA, 22 nt, Homo sapiens
ucauggcuuuuauuauguugag

SEQ ID NO: 281988 - RNA, 22 nt, Homo sapiens
ucauggggugcuuugcuagauu

SEQ ID NO: 281989 - RNA, 22 nt, Homo sapiens
ucauguauuaucauuagugggu

SEQ ID NO: 281990 - RNA, 22 nt, Homo sapiens
ucaugugaggauaacaauagug

SEQ ID NO: 281991 - RNA, 22 nt, Homo sapiens
ucauguguugcacugaggaccu

SEQ ID NO: 281992 - RNA, 22 nt, Homo sapiens
ucauuagagaucuuggggaaaa

SEQ ID NO: 281993 - RNA, 22 nt, Homo sapiens
ucauuagucaccuagccagcuu

SEQ ID NO: 281994 - RNA, 22 nt, Homo sapiens
ucauucacucccuugaaguuag

SEQ ID NO: 281995 - RNA, 22 nt, Homo sapiens
uccaccgugggcugcggggcuc

SEQ ID NO: 281996 - RNA, 18 nt, Homo sapiens
uccacgugcuuuccagau

SEQ ID NO: 281997 - RNA, 20 nt, Homo sapiens
uccacugagcgucacggcag

SEQ ID NO: 281998 - RNA, 22 nt, Homo sapiens
uccagaguggugaugcuggggc

SEQ ID NO: 281999 - RNA, 22 nt, Homo sapiens
uccagguuucaugcucuuuauu

SEQ ID NO: 282000 - RNA, 18 nt, Homo sapiens
uccaguuuucccagcauc

SEQ ID NO: 282001 - RNA, 22 nt, Homo sapiens
uccaugugaaaaggucgugaua

SEQ ID NO: 282002 - RNA, 22 nt, Homo sapiens
uccauuugucuauguuucuguu

SEQ ID NO: 282003 - RNA, 22 nt, Homo sapiens
ucccaguguguagcuugucucu

SEQ ID NO: 282004 - RNA, 22 nt, Homo sapiens
ucccaguuuuucugaauaguca

SEQ ID NO: 282005 - RNA, 22 nt, Homo sapiens
uccccggaugacggccgcuuca

SEQ ID NO: 282006 - RNA, 22 nt, Homo sapiens
uccccugauaccaaccaccaug

SEQ ID NO: 282007 - RNA, 22 nt, Homo sapiens
ucccuagacuccugccuuucag

SEQ ID NO: 282008 - RNA, 22 nt, Homo sapiens
ucccugaaagcugagauuggaa

SEQ ID NO: 282009 - RNA, 22 nt, Homo sapiens
ucccugaaucucagguucugua

SEQ ID NO: 282010 - RNA, 22 nt, Homo sapiens
ucccugagcaaaguuuucugua

SEQ ID NO: 282011 - RNA, 22 nt, Homo sapiens
ucccuggagcaagagaagaagg

SEQ ID NO: 282012 - RNA, 18 nt, Homo sapiens
ucccuuuguagaugaccc

SEQ ID NO: 282013 - RNA, 22 nt, Homo sapiens
uccugagaauagaguugcaugu

SEQ ID NO: 282014 - RNA, 22 nt, Homo sapiens
uccuuuggcuaacuuucuaagu

SEQ ID NO: 282015 - RNA, 22 nt, Homo sapiens
uccuuuggguagcuguucagau

SEQ ID NO: 282016 - RNA, 22 nt, Homo sapiens
uccuuugguggagucuuuaggg

SEQ ID NO: 282017 - RNA, 22 nt, Homo sapiens
ucgcaccauugcacuccagcca

SEQ ID NO: 282018 - RNA, 22 nt, Homo sapiens
ucuaauguaaccugcaaauauu

SEQ ID NO: 282019 - RNA, 22 nt, Homo sapiens
ucuaucacagccccacacucuc

SEQ ID NO: 282020 - RNA, 22 nt, Homo sapiens
agcacagccuuguguuuucuug

SEQ ID NO: 282021 - RNA, 22 nt, Homo sapiens
agcacagugaaugguuuacuca

SEQ ID NO: 282022 - RNA, 22 nt, Homo sapiens
agcacauuaguaucuaagaaca

SEQ ID NO: 282023 - RNA, 22 nt, Homo sapiens
agcaccauugcacuccagccug

SEQ ID NO: 282024 - RNA, 22 nt, Homo sapiens
agcacgaaaccaaauucuguga

SEQ ID NO: 282025 - RNA, 19 nt, Homo sapiens
agcagaacaaauguguggg

SEQ ID NO: 282026 - RNA, 21 nt, Homo sapiens
agcagaguggcagcucuuuug

SEQ ID NO: 282027 - RNA, 21 nt, Homo sapiens
agcagcuuugguugaagcaga

SEQ ID NO: 282028 - RNA, 22 nt, Homo sapiens
agcaggacaauaugggaucagg

SEQ ID NO: 282029 - RNA, 22 nt, Homo sapiens
agcagguguccacaauguuugc

SEQ ID NO: 282030 - RNA, 16 nt, Homo sapiens
agcagguguuagguga

SEQ ID NO: 282031 - RNA, 22 nt, Homo sapiens
agcaguagaauuccugcaucac

SEQ ID NO: 282032 - RNA, 22 nt, Homo sapiens
uugaaguaguacuuuauuauag

SEQ ID NO: 282033 - RNA, 22 nt, Homo sapiens
uugaauagacagccagcuuuaa

SEQ ID NO: 282034 - RNA, 22 nt, Homo sapiens
uugaauguacuuguucucacua

SEQ ID NO: 282035 - RNA, 22 nt, Homo sapiens
uugacagaccuuggucauaucc

SEQ ID NO: 282036 - RNA, 22 nt, Homo sapiens
uugacaguugggcagggaaguu

SEQ ID NO: 282037 - RNA, 22 nt, Homo sapiens
uugacauaaucauuucacagug

SEQ ID NO: 282038 - RNA, 22 nt, Homo sapiens
uugacauaguuucugaaauaga

SEQ ID NO: 282039 - RNA, 22 nt, Homo sapiens
uugacauguaaguacucuauag

SEQ ID NO: 282040 - RNA, 22 nt, Homo sapiens
uugaccaaagaagagucauugc

SEQ ID NO: 282041 - RNA, 22 nt, Homo sapiens
uugacuccagagugaguaaaug

SEQ ID NO: 282042 - RNA, 22 nt, Homo sapiens
uugacuguaagauggcuauuac

SEQ ID NO: 282043 - RNA, 22 nt, Homo sapiens
uugagaagugucuguucauguc

SEQ ID NO: 282044 - RNA, 22 nt, Homo sapiens
aagagaacugacaguaccuggg

SEQ ID NO: 282045 - RNA, 22 nt, Homo sapiens
aagagagcuaugugcauaauua

SEQ ID NO: 282046 - RNA, 22 nt, Homo sapiens
aagagguagaagcuugccuucu

SEQ ID NO: 282047 - RNA, 22 nt, Homo sapiens
aagagguagcagucacaaaaga

SEQ ID NO: 282048 - RNA, 22 nt, Homo sapiens
aagagguaggaaauggucauuu

SEQ ID NO: 282049 - RNA, 22 nt, Homo sapiens
aagaguuaguaaaauuuccucu
